United States Patent 11,578,365 (CHICKEN WHOLE-GENOME SNP CHIP AND USE THEREOF) - sequence listing, part 2

SEQ ID NO: 19377 - DNA, 71 bp, chicken (Gallus Gallus)
  misc_feature (36): n=c or t
ttgctttttaatgttattttaaataaaaagcatccnaagatatgctgtctgtaaagatcttgattgtgtcc

SEQ ID NO: 19378 - DNA, 71 bp, chicken (Gallus Gallus)
  misc_feature (36): n=a or g
tgaggcttaaaactgtgcgtagagtagaagtgaggnaagtagattttttgaagtagtatactagtgcagtg

SEQ ID NO: 19379 - DNA, 71 bp, chicken (Gallus Gallus)
  misc_feature (36): n=a or g
tttttacaatatgaagataactgcagctaatggganatggcagggaaaattataaatttattcttctttct

SEQ ID NO: 19380 - DNA, 71 bp, chicken (Gallus Gallus)
  misc_feature (36): n=a or g
agggtgtctgtgcacagtgagggagtggggagggcntagagaaaggacagcagggattccttcttaacttc

SEQ ID NO: 19381 - DNA, 71 bp, chicken (Gallus Gallus)
  misc_feature (36): n=a or g
tgctgctattcaggccagctttatttttctctttgnatcttgcgttaattcaaaaaccaccaacaatcaaa

SEQ ID NO: 19382 - DNA, 71 bp, chicken (Gallus Gallus)
  misc_feature (36): n=c or t
tttggtcttctgacaagattgtgactttgttgcagngtttgtcagaatcaagtgatcatagctgcattctt

SEQ ID NO: 19383 - DNA, 71 bp, chicken (Gallus Gallus)
  misc_feature (36): n=a or g
cagtacagcttctctacaccactctgaggtggcatnaattcagactgatcattcagccatctctcattatg

SEQ ID NO: 19384 - DNA, 71 bp, chicken (Gallus Gallus)
  misc_feature (36): n=c or g
tactgctcacatacagaccttttgcttttctttttnccaagtatgggaagcatggtgacctctcacagaga

SEQ ID NO: 19385 - DNA, 71 bp, chicken (Gallus Gallus)
  misc_feature (36): n=g or t
gccatgacttctgacacttggaagacaaattaacgnaagttagatttgtataaacctgtcaccaaaaatcc

SEQ ID NO: 19386 - DNA, 71 bp, chicken (Gallus Gallus)
  misc_feature (36): n=a or g
gcctgtattggactagaaatttttcacaaattgctntcagagatgcaggaggataaacaaaagttaatttg

SEQ ID NO: 19387 - DNA, 71 bp, chicken (Gallus Gallus)
  misc_feature (36): n=c or t
aaaataaaacccaacatttattatgacaaaagttangtacatgctaacaatgttgaggagagagtccacag

SEQ ID NO: 19388 - DNA, 71 bp, chicken (Gallus Gallus)
  misc_feature (36): n=a or g
gtatggtgaaagagccatttactagaaccgatcagnaaactcaaataatttttactttgaccaggtaatcc

SEQ ID NO: 19389 - DNA, 71 bp, chicken (Gallus Gallus)
  misc_feature (36): n=a or g
tcttgagatatctgaggggtagagtctttacagagncatttttgggcaaccgtatttgaagatgtttatct

SEQ ID NO: 19390 - DNA, 71 bp, chicken (Gallus Gallus)
  misc_feature (36): n=a or g
aagcaaataataacttctagaaacaaggtatttgtngttttttttattgttgttgttttgtttaactgata

SEQ ID NO: 19391 - DNA, 71 bp, chicken (Gallus Gallus)
  misc_feature (36): n=a or g
tggcaactttggcagaaaggctttccgtaagcaggnggtgcctcgttcagaaaagatcttgaattctgggg

SEQ ID NO: 19392 - DNA, 71 bp, chicken (Gallus Gallus)
  misc_feature (36): n=a or g
accacagcagcgctgggcagcataggcctcgttctntccatgtatatgcatgtgttggtgtggtgctccca

SEQ ID NO: 19393 - DNA, 71 bp, chicken (Gallus Gallus)
  misc_feature (36): n=a or c
agaaagaggttgtttctttaaacagtacacagtaangtttggaactacttgctccaaagtaccaatgtgga

SEQ ID NO: 19394 - DNA, 71 bp, chicken (Gallus Gallus)
  misc_feature (36): n=a or g
tgaagctcggcctacagcagaacaatgtgggctgcntctgacagcagaaccaatgctgctggacatgtcat

SEQ ID NO: 19395 - DNA, 71 bp, chicken (Gallus Gallus)
  misc_feature (36): n=a or g
acctgctatgtttatatagttatattataggcagtnctgctagataggtcttataattacacgaccaaata

SEQ ID NO: 19396 - DNA, 71 bp, chicken (Gallus Gallus)
  misc_feature (36): n=a or g
atgccagaaaacaggaatttaactgactatcgttcnccggtaggaaagtgtacttacataatgttaacaaa

SEQ ID NO: 19397 - DNA, 71 bp, chicken (Gallus Gallus)
  misc_feature (36): n=a or g
taaataatagcatttaaactgcattattttagagtntacatacaaaaaaaaaaagaatgtattgttggttc

SEQ ID NO: 19398 - DNA, 71 bp, chicken (Gallus Gallus)
  misc_feature (36): n=a or g
agggaaaatgggaggcagggatgagacaacttgcanagctccccatagtcatatagaaggagaatacttta

SEQ ID NO: 19399 - DNA, 71 bp, chicken (Gallus Gallus)
  misc_feature (36): n=c or g
acaagatggggcattcattgggcactgttactaaanatagggaagaagcagagttcagaatgtgcttaaaa

SEQ ID NO: 19400 - DNA, 71 bp, chicken (Gallus Gallus)
  misc_feature (36): n=c or t
tgtgtgtgtactttcgtggtccaacaccccagatgntctgaggactgtagcagcaggatctttgcaatacc

SEQ ID NO: 19401 - DNA, 71 bp, chicken (Gallus Gallus)
  misc_feature (36): n=a or c
aattccaaggtagagatgcctcactaataaggtttnttcagttttgtagtaacttaaatcactgttttatt

SEQ ID NO: 19402 - DNA, 71 bp, chicken (Gallus Gallus)
  misc_feature (36): n=a or t
agaggtttttaggatagtggtagttgaagtcagttnaattttaactcagggacttaaccattggagcaaat

SEQ ID NO: 19403 - DNA, 71 bp, chicken (Gallus Gallus)
  misc_feature (36): n=c or t
ttgctgcagggactcccacggctctcagcggattgngcttttcaaatcctaccagactcttctaacagctt

SEQ ID NO: 19404 - DNA, 71 bp, chicken (Gallus Gallus)
  misc_feature (36): n=a or c
gtgaaaaacaaggttgatctagagaacaaagacttntgcagtgtaatacattttatgtacaaaagcataag

SEQ ID NO: 19405 - DNA, 71 bp, chicken (Gallus Gallus)
  misc_feature (36): n=a or g
acttcttggagtagaattcaaagaacgttacagctntgaatgtttgttgctaatacggaaagctaacatgt

SEQ ID NO: 19406 - DNA, 71 bp, chicken (Gallus Gallus)
  misc_feature (36): n=a or g
ctatattcccggagctgcgtgaattttcttccacantgctcacagactcgttccaagttttgttttgctct

SEQ ID NO: 19407 - DNA, 71 bp, chicken (Gallus Gallus)
  misc_feature (36): n=c or t
gtagttctgttataacaagtgtgctattatgcaganagggagataagcatactttgtaactcagcatcttt

SEQ ID NO: 19408 - DNA, 71 bp, chicken (Gallus Gallus)
  misc_feature (36): n=a or t
ttagcatcttttccatctatctgtattgcatctgtnttcatcattcatacattttcatatttttaaaaata

SEQ ID NO: 19409 - DNA, 71 bp, chicken (Gallus Gallus)
  misc_feature (36): n=c or t
tatgtttgaaaaaaattgatcctttgcctttttttnctgttgactttttaccttcttcccattgcagaacc

SEQ ID NO: 19410 - DNA, 71 bp, chicken (Gallus Gallus)
  misc_feature (36): n=c or t
aataaagcaaccaagtgtgaaaacattctttcttangtgttctttcaaatctgaagtgtttgaaggtatac

SEQ ID NO: 19411 - DNA, 71 bp, chicken (Gallus Gallus)
  misc_feature (36): n=c or t
aatttctgtcatggcctgtgatgaacagcatgcaangttggttcaagataagagccaaaagcgtgtcaaag

SEQ ID NO: 19412 - DNA, 71 bp, chicken (Gallus Gallus)
  misc_feature (36): n=a or g
agatgcattaccactgcacaccacgatgagatcatncttccaggtagaccatgtagcaggcagtgtgcgga

SEQ ID NO: 19413 - DNA, 71 bp, chicken (Gallus Gallus)
  misc_feature (36): n=a or g
caggtcatattgaacatggacagtgaggaaattccnaccttctcaagtccaaaggaggaaactgcttattg

SEQ ID NO: 19414 - DNA, 71 bp, chicken (Gallus Gallus)
  misc_feature (36): n=c or t
aatggctcccaggaattttttctcatcctgaaatgncccttgtcaggggaacgcgttcacagagcagaagg

SEQ ID NO: 19415 - DNA, 71 bp, chicken (Gallus Gallus)
  misc_feature (36): n=a or g
acttcagaaaaaaatctgtgctaccttgagggcacnaggatagatggcaaactgataaggcacataaatga

SEQ ID NO: 19416 - DNA, 71 bp, chicken (Gallus Gallus)
  misc_feature (36): n=c or t
ctctgcagcaggcagttggggcttggctttgttttntccctttgatcaagtcacctacgctgcacactgct

SEQ ID NO: 19417 - DNA, 71 bp, chicken (Gallus Gallus)
  misc_feature (36): n=a or g
aaagaagcttcatcagaaactgaccagttctcatgncatgcatgaattttcagtgaaaatacttcctgttg

SEQ ID NO: 19418 - DNA, 71 bp, chicken (Gallus Gallus)
  misc_feature (36): n=c or t
actcaactgtaacttccaaaccatggacttctcatncagaaagagcatggaacgtttttgccaggttttaa

SEQ ID NO: 19419 - DNA, 71 bp, chicken (Gallus Gallus)
  misc_feature (36): n=a or c
tatcgacggggctgcctacaccgcggtaaatatatntcttttaactttaacaactacatgaggaagtcacg

SEQ ID NO: 19420 - DNA, 71 bp, chicken (Gallus Gallus)
  misc_feature (36): n=a or g
caggcattttaaaaccatgttagtgtgactaagagnagtttttatgttatgcacatggaacaatatgatcc

SEQ ID NO: 19421 - DNA, 71 bp, chicken (Gallus Gallus)
  misc_feature (36): n=c or g
taaaatccaaaagtgaagttgctcagtaaatacttngatgcacatactgaatcttttttccctgccttttc

SEQ ID NO: 19422 - DNA, 71 bp, chicken (Gallus Gallus)
  misc_feature (36): n=c or t
cagccctgaatgccgtccaccttcctacaggaaacngatttgtatttctgcaccagcctccatgctgcaca

SEQ ID NO: 19423 - DNA, 71 bp, chicken (Gallus Gallus)
  misc_feature (36): n=a or g
agtctacaaacctgactcatgttgtttccatttcanagcaaaatagcagataaggttgtgttttctaactt

SEQ ID NO: 19424 - DNA, 71 bp, chicken (Gallus Gallus)
  misc_feature (36): n=c or t
catgttccagcccatgtgcctgatgcctgccagccncatgcatttttgctactgtctggcagtcgtggtcc

SEQ ID NO: 19425 - DNA, 71 bp, chicken (Gallus Gallus)
  misc_feature (36): n=c or t
gatctttggagatttaagaatttgaagaaagacttnggttgtttatttttttttggtaatctttgccataa

SEQ ID NO: 19426 - DNA, 71 bp, chicken (Gallus Gallus)
  misc_feature (36): n=a or t
taataaatgattttttacgggtcatgctattgcttnagaaagtcaagatgtgttttctagcacccgtgtca

SEQ ID NO: 19427 - DNA, 71 bp, chicken (Gallus Gallus)
  misc_feature (36): n=c or t
tacaatctttgatttatttaaataggttaatcatancatactgtttactctctctttctaaatagaacacg

SEQ ID NO: 19428 - DNA, 71 bp, chicken (Gallus Gallus)
  misc_feature (36): n=g or t
cttagtttttatccctgggttatgtcatagaaatanttttagaactaacccaagaagaaaaatacaaaatc

SEQ ID NO: 19429 - DNA, 71 bp, chicken (Gallus Gallus)
  misc_feature (36): n=c or t
ggcatgcatggacagacgaggtgttgctaagtttgngtccgaaaccgatgttttcacgcctctgtatgtgt

SEQ ID NO: 19430 - DNA, 71 bp, chicken (Gallus Gallus)
  misc_feature (36): n=g or t
tgtaccaggattgaattgagtggtaacacatttccntgacaacttgataaattgtatcctgtccaggtgga

SEQ ID NO: 19431 - DNA, 71 bp, chicken (Gallus Gallus)
  misc_feature (36): n=a or c
ttccagagcttcctttaatgctaaccactagaattnagacttaggacttcagcatattagatctcacttgt

SEQ ID NO: 19432 - DNA, 71 bp, chicken (Gallus Gallus)
  misc_feature (36): n=a or g
ctgtaaaactagattcaaaatgagatttgtcagcancacttttcatgtagtattttcccattaatcaaagt

SEQ ID NO: 19433 - DNA, 71 bp, chicken (Gallus Gallus)
  misc_feature (36): n=c or t
cattgaaatgttctcttgtgaagttattgcaactgntctgattgagatgaatcactttactgtagagagaa

SEQ ID NO: 19434 - DNA, 71 bp, chicken (Gallus Gallus)
  misc_feature (36): n=c or t
tgaaataggtcatgagactcatgccctaaagtgccnctttgtctaccccagctgtaaaggaagtcagattg

SEQ ID NO: 19435 - DNA, 71 bp, chicken (Gallus Gallus)
  misc_feature (36): n=a or g
aatatgaaaatgtgaataattataaatccatgtacnttttccagacgttttaattgcctggatagttcagc

SEQ ID NO: 19436 - DNA, 71 bp, chicken (Gallus Gallus)
  misc_feature (36): n=c or t
gaatatctacttgagctacaataatcatagaattgntaaggttggaatagaccactaagaccatccagtcc

SEQ ID NO: 19437 - DNA, 71 bp, chicken (Gallus Gallus)
  misc_feature (36): n=c or t
aaaagagaatgcaggactcctagcaagagtttgtangatgaagctaatggggactggagataagagactga

SEQ ID NO: 19438 - DNA, 71 bp, chicken (Gallus Gallus)
  misc_feature (36): n=a or t
aaaaaaaattctgatctcttctgtatgcagactctnaacctaatcttggcttgaaaaaaatgttggaaacc

SEQ ID NO: 19439 - DNA, 71 bp, chicken (Gallus Gallus)
  misc_feature (36): n=a or g
aatctcagagtttaatagcatgtattagtacaagcntattcctccatccctctgatctctatcggtctcat

SEQ ID NO: 19440 - DNA, 71 bp, chicken (Gallus Gallus)
  misc_feature (36): n=a or g
aataaacattaatgcaacctgtcacctctcagatanaacagaaaaggaagttcagtagtatattccataac

SEQ ID NO: 19441 - DNA, 71 bp, chicken (Gallus Gallus)
  misc_feature (36): n=c or t
gtttggattgggtggatcttctaaaatcagctagtnccaacccctctgctttgggcagggataactttcag

SEQ ID NO: 19442 - DNA, 71 bp, chicken (Gallus Gallus)
  misc_feature (36): n=a or g
taaggttccaagtactgttgaggtctgaaagcagtnaaaaaaaaaaaaacaacagatcaacattaaagcag

SEQ ID NO: 19443 - DNA, 71 bp, chicken (Gallus Gallus)
  misc_feature (36): n=a or g
caatactgcaaagtactcacttctcctttagtaacntatttgtctggtactaaatgaagaactgtgtattc

SEQ ID NO: 19444 - DNA, 71 bp, chicken (Gallus Gallus)
  misc_feature (36): n=a or g
cctttcctccatatcacagaggatgcagctttctcnctctggcatataaaaactgcagttccactttcttc

SEQ ID NO: 19445 - DNA, 71 bp, chicken (Gallus Gallus)
  misc_feature (36): n=c or t
gtcaccatgcacacaacacagctaacaaaccccagnctccacaataaatgtctttgaagagatgcagcact

SEQ ID NO: 19446 - DNA, 71 bp, chicken (Gallus Gallus)
  misc_feature (36): n=a or c
tcaaaatgagggcatattactcaacatgagcaatangacttaggtaagtacctagagactagataggcatg

SEQ ID NO: 19447 - DNA, 71 bp, chicken (Gallus Gallus)
  misc_feature (36): n=a or c
gggttatgtggagtcaacatctgctgctcaacaccncagaacaggacttgcccactctcttctctgaaccc

SEQ ID NO: 19448 - DNA, 71 bp, chicken (Gallus Gallus)
  misc_feature (36): n=c or t
atgtctgaagtctcttcccaaggtacgattaccatnctgtttttgtcctcaggcatgccgctcattgttct

SEQ ID NO: 19449 - DNA, 71 bp, chicken (Gallus Gallus)
  misc_feature (36): n=g or t
cattttctccagctccctacagaattacatgcactnctgtcccaccaagtcctccagatggcagctcttct

SEQ ID NO: 19450 - DNA, 71 bp, chicken (Gallus Gallus)
  misc_feature (36): n=c or t
agcacctcagagttcatttgagagcagccagggtgngttaatcaaggattcccctccacaccaccataaat

SEQ ID NO: 19451 - DNA, 71 bp, chicken (Gallus Gallus)
  misc_feature (36): n=a or c
tctgttggagctgtggagaacaaagacacacagtgnatgaatatctgctgtgatcagtgcttaattgcagc

SEQ ID NO: 19452 - DNA, 71 bp, chicken (Gallus Gallus)
  misc_feature (36): n=a or c
tgaaacatgattgaagctgatacactttaacttgtntttacagacagatatagtgctgtccccaatactga

SEQ ID NO: 19453 - DNA, 71 bp, chicken (Gallus Gallus)
  misc_feature (36): n=g or t
atctattttccacactttcgttaatgtaaataaacntaggaagaaaaagcagactgctacaactgcaaaat

SEQ ID NO: 19454 - DNA, 71 bp, chicken (Gallus Gallus)
  misc_feature (36): n=a or g
atatttttaggttacgcacccgtaattaagttgtgnttgatctgccctcctaaagagccaagaaggcgagc

SEQ ID NO: 19455 - DNA, 71 bp, chicken (Gallus Gallus)
  misc_feature (36): n=c or t
tctctccctgattattcttccatacatcctgtatgnattttaaatgtcatgcttctcatctcacagaacag

SEQ ID NO: 19456 - DNA, 71 bp, chicken (Gallus Gallus)
  misc_feature (36): n=c or t
tctttataacgaagcaacaaaacccgttcctagcanggccacttacagaagtcctcaaagtgatgctaaca

SEQ ID NO: 19457 - DNA, 71 bp, chicken (Gallus Gallus)
  misc_feature (36): n=a or g
ttaagtttgggttggtgaatgagggttaagacctgnttctccttctgcaggctctatacctgttcacagtg

SEQ ID NO: 19458 - DNA, 71 bp, chicken (Gallus Gallus)
  misc_feature (36): n=a or g
acttctggttctgcattgcttgctcgatttacaacntcatcgttcttgttaccttcagttttcccttcctc

SEQ ID NO: 19459 - DNA, 71 bp, chicken (Gallus Gallus)
  misc_feature (36): n=c or t
gctcacagtgacaaatcagtgaaagaacaggctggngttccacattttgtgctcagtttgtaagctttcct

SEQ ID NO: 19460 - DNA, 71 bp, chicken (Gallus Gallus)
  misc_feature (36): n=a or g
gaaaatgtatggagtggttggggagtggggaaggcnttgaagataagactacactagggagaaggtgctgg

SEQ ID NO: 19461 - DNA, 71 bp, chicken (Gallus Gallus)
  misc_feature (36): n=a or g
acacgctgcagctggaaggcaccgggaggaagccancatctgggatgtggagcctttgctttagttcgcat

SEQ ID NO: 19462 - DNA, 71 bp, chicken (Gallus Gallus)
  misc_feature (36): n=a or g
tagcagctttttaaatcatagaagttttttaaaccntaagtgaactcaaagcagactaatggaccatatct

SEQ ID NO: 19463 - DNA, 71 bp, chicken (Gallus Gallus)
  misc_feature (36): n=a or t
gaattttccacagctcctgttccatagttagacatngctgagaaccctcccattcctgcttttgtctttct

SEQ ID NO: 19464 - DNA, 71 bp, chicken (Gallus Gallus)
  misc_feature (36): n=a or g
gcagttctgctttgttttctacatgaatctttaccnctcatctctgtttttctcatgaacaaagtggttct

SEQ ID NO: 19465 - DNA, 71 bp, chicken (Gallus Gallus)
  misc_feature (36): n=a or t
aacacgcctgcgcccggcaaccctcacagaacttantaaacttctgccttgctgataaccgcgagcggtag

SEQ ID NO: 19466 - DNA, 71 bp, chicken (Gallus Gallus)
  misc_feature (36): n=a or g
acttaagggcatttgtgcccatgctagctttgatgngattcagccaggctgtagggaggtgcagaggggtc

SEQ ID NO: 19467 - DNA, 71 bp, chicken (Gallus Gallus)
  misc_feature (36): n=c or t
aaactcctgacaactacaacagctacaaacagctcntcagccgtacgattcattaaagcaacctttcagga

SEQ ID NO: 19468 - DNA, 71 bp, chicken (Gallus Gallus)
  misc_feature (36): n=c or t
ggtaacattctggtctaaaacaactgattctgtganaagttcttaattttagataatcttaaatagctgaa

SEQ ID NO: 19469 - DNA, 71 bp, chicken (Gallus Gallus)
  misc_feature (36): n=a or g
tttattcttatttagattgtgagaagtgacctgaangaactcagagatctcgatctgaagggagctcctta

SEQ ID NO: 19470 - DNA, 71 bp, chicken (Gallus Gallus)
  misc_feature (36): n=c or t
ttttgtggagcagcattacctggatagatgagcagncctacagctcttctcccatgttaatgacatttctt

SEQ ID NO: 19471 - DNA, 71 bp, chicken (Gallus Gallus)
  misc_feature (36): n=g or t
ctttactctgctagttgctgcattttgcacaacttnttgttaatctgctgcagaataaaccacgtcctcct

SEQ ID NO: 19472 - DNA, 71 bp, chicken (Gallus Gallus)
  misc_feature (36): n=c or t
ctatattagtattttcactagaccaattgaaatganggaaaaataaacaaaacaaaaaagcagagaagact

SEQ ID NO: 19473 - DNA, 71 bp, chicken (Gallus Gallus)
  misc_feature (36): n=c or t
gctctgagctgagtacagttttatttgtcctttctngtgttttgagtctcaaaaggctgttatttctaaat

SEQ ID NO: 19474 - DNA, 71 bp, chicken (Gallus Gallus)
  misc_feature (36): n=a or g
ggagagaggcataacttgcataccacttctattatnattgttcacaatttttgaaaatattgagaacatga

SEQ ID NO: 19475 - DNA, 71 bp, chicken (Gallus Gallus)
  misc_feature (36): n=a or g
gttcacagcccagctcaacatggtggtactggaggntggctttgcagaagggacagtaagcaaacagggag

SEQ ID NO: 19476 - DNA, 71 bp, chicken (Gallus Gallus)
  misc_feature (36): n=a or g
tgaatgcagaaaccagttggagaatggtcttgaatngaatcaaatgtctgagtttccgtagtgacaaggga

SEQ ID NO: 19477 - DNA, 71 bp, chicken (Gallus Gallus)
  misc_feature (36): n=c or t
ttgtgttgtgtcgtgttgtgctgtgtcgtgttgtgntgtatcgtctttgtgctgctagagcttgatacagt

SEQ ID NO: 19478 - DNA, 71 bp, chicken (Gallus Gallus)
  misc_feature (36): n=a or t
tacttaaaatattcatccagtgtgttcctaccagtnaacaaccaggctagtgaatctgatgccattgcact

SEQ ID NO: 19479 - DNA, 71 bp, chicken (Gallus Gallus)
  misc_feature (36): n=a or c
agtgtttttttaaggcactaaggcatgaaaaactancattagatcaaatcccctttaagctgtatgattca

SEQ ID NO: 19480 - DNA, 71 bp, chicken (Gallus Gallus)
  misc_feature (36): n=a or g
aacctacatagtggcagaaagaaaaggctagttttncaaacaaagaaaaattgaagaaaatattacaaatt

SEQ ID NO: 19481 - DNA, 71 bp, chicken (Gallus Gallus)
  misc_feature (36): n=c or t
ccttttatgtggagtggagcagagctatagcagatngagatctgctccctttataggggaaaagcacgaga

SEQ ID NO: 19482 - DNA, 71 bp, chicken (Gallus Gallus)
  misc_feature (36): n=g or t
accaaattacttttgtcttctcagcgtctgtccagncaaactttagaaagtaattttctcagtttaattga

SEQ ID NO: 19483 - DNA, 71 bp, chicken (Gallus Gallus)
  misc_feature (36): n=c or t
ctgcagaagcaatgttttggtaacccggtcttaaangttgcctatcgtattaaaacattttaccaacatag

SEQ ID NO: 19484 - DNA, 71 bp, chicken (Gallus Gallus)
  misc_feature (36): n=a or g
ccatataaccaaattaaggcagaaattccatttacntgttcttgaaattattttaaaatcatcattaggat

SEQ ID NO: 19485 - DNA, 71 bp, chicken (Gallus Gallus)
  misc_feature (36): n=a or g
ttgttttgaagttgttactgttcttttgctgtttgnagacttgtttaagcaaagcagtatgacctttgtta

SEQ ID NO: 19486 - DNA, 71 bp, chicken (Gallus Gallus)
  misc_feature (36): n=c or t
actgctgacaggtactaagtccctatttcatttttnaggttgagacatttttctaagcatggttctttaat

SEQ ID NO: 19487 - DNA, 71 bp, chicken (Gallus Gallus)
  misc_feature (36): n=c or t
aaaaaaacaaaaaaacaaaaaaaccctcatctgtgntgttcatggttttaactatcagttcctgagttttt

SEQ ID NO: 19488 - DNA, 71 bp, chicken (Gallus Gallus)
  misc_feature (36): n=c or t
ccataatttataggagacagactgacgtttctgcangtacccaaatgaacagtgagtgtctgagagtgaga

SEQ ID NO: 19489 - DNA, 71 bp, chicken (Gallus Gallus)
  misc_feature (36): n=c or t
gctgggagcgcttgagcataaagggccaggatcctncaagagcaaaagttccactaactgtgacaatgcct

SEQ ID NO: 19490 - DNA, 71 bp, chicken (Gallus Gallus)
  misc_feature (36): n=c or t
tgaaaacctactccagtacaaaatgcacttgcctangtccactaaaagactgaaaataaatattttaaatc

SEQ ID NO: 19491 - DNA, 71 bp, chicken (Gallus Gallus)
  misc_feature (36): n=a or g
atactggaagttgtatggtagttgtctgcatgtctntttcccccccccccacacacacacacactttccat

SEQ ID NO: 19492 - DNA, 71 bp, chicken (Gallus Gallus)
  misc_feature (36): n=a or c
gtcagctatcttctgctcaacattcacaccaagtanaaggaaggaggtggcaaaagctattctctatatca

SEQ ID NO: 19493 - DNA, 71 bp, chicken (Gallus Gallus)
  misc_feature (36): n=g or t
tgtatccattccttgtaaaaaaatctttgcttaaanaagtctctgcctttctctctcaaaggaaaaacacc

SEQ ID NO: 19494 - DNA, 71 bp, chicken (Gallus Gallus)
  misc_feature (36): n=c or t
ctgcctgcaaaactgtattaaatacttaaatatgcnatgagggaattagtggaagatactcttcttattcc

SEQ ID NO: 19495 - DNA, 71 bp, chicken (Gallus Gallus)
  misc_feature (36): n=c or t
accagaacgcaaaggaaaacagagccatttttgagnagtccaaacacgggacttctattaatgtgaaaaca

SEQ ID NO: 19496 - DNA, 71 bp, chicken (Gallus Gallus)
  misc_feature (36): n=a or g
tatctatccccagtaacaacactggaagcaataccntgggacataggcacccttttctgtttaaccagtgg

SEQ ID NO: 19497 - DNA, 71 bp, chicken (Gallus Gallus)
  misc_feature (36): n=c or t
atggtgcatccttcttctattccttttatcaaacancgagcatttcagcagagaacaactacattacaacc

SEQ ID NO: 19498 - DNA, 71 bp, chicken (Gallus Gallus)
  misc_feature (36): n=c or t
tacacaggactaccaggatatgaaggtgatgcgagntactacatgagagactacatctgtttaagtctata

SEQ ID NO: 19499 - DNA, 71 bp, chicken (Gallus Gallus)
  misc_feature (36): n=a or g
gagctccggcgctctcctgtgtcgttgcctgtcctnttccatagccgtgccgttctgcaggagattgttgt

SEQ ID NO: 19500 - DNA, 71 bp, chicken (Gallus Gallus)
  misc_feature (36): n=c or t
ggtgaacttgggctaaggatgcacttcaacgtctanggaagaaagcaaatgctcttctgacaaacttgggg

SEQ ID NO: 19501 - DNA, 71 bp, chicken (Gallus Gallus)
  misc_feature (36): n=c or t
taggagtccccagtgctgcttctcaccagaacagcntttaggtatgttccatccaggaccagttctcccca

SEQ ID NO: 19502 - DNA, 71 bp, chicken (Gallus Gallus)
  misc_feature (36): n=a or c
atgtgtgtaaattagcatttacatgatataattccncatctgcacacacattaaagagatacgtatttcaa

SEQ ID NO: 19503 - DNA, 71 bp, chicken (Gallus Gallus)
  misc_feature (36): n=c or t
cataccaaggattattccctattatgcaggtttatnattatagagtatgattccctgttttactccctgtg

SEQ ID NO: 19504 - DNA, 71 bp, chicken (Gallus Gallus)
  misc_feature (36): n=a or g
gagccagagcacttagggagataaacaagagcaagncttttgctgttctcaagatgggggagaggttatgg

SEQ ID NO: 19505 - DNA, 71 bp, chicken (Gallus Gallus)
  misc_feature (36): n=c or t
gggctgacaagcaagcaaaaaggaaacaaaagcaangctaacagtttaaaagaatatctgacttctagctg

SEQ ID NO: 19506 - DNA, 71 bp, chicken (Gallus Gallus)
  misc_feature (36): n=c or g
gaaaaagaaatcaaactcagcagggaatatctaganaatattgtttgcaaagtaaactgtctgtaatctat

SEQ ID NO: 19507 - DNA, 71 bp, chicken (Gallus Gallus)
  misc_feature (36): n=a or g
tctctggtcatgaggcagttattaagtactactcantattatttttagatcttgttttggatgcacaccag

SEQ ID NO: 19508 - DNA, 71 bp, chicken (Gallus Gallus)
  misc_feature (36): n=a or g
tgccactgagtttgttcactgttaagctgttcctcnttctcaggtcagccggctggcttgagccttcagtc

SEQ ID NO: 19509 - DNA, 71 bp, chicken (Gallus Gallus)
  misc_feature (36): n=a or g
ttgtgcaagagtgcattaagcctctggcattatttntatgtggcaaagacaagacctctcatatttcaagg

SEQ ID NO: 19510 - DNA, 71 bp, chicken (Gallus Gallus)
  misc_feature (36): n=a or g
ttgtattttattttcataatgatgtaatattaactntgtgtgtcaaaatatatgaatttatgaatttaaat

SEQ ID NO: 19511 - DNA, 71 bp, chicken (Gallus Gallus)
  misc_feature (36): n=g or t
tcagagaggaattcagacctgaatttctctttacanaaactagattttatcaatgattgtaaagtcttatc

SEQ ID NO: 19512 - DNA, 71 bp, chicken (Gallus Gallus)
  misc_feature (36): n=g or t
caatggatttctacagatgatcttaagaatgcctgngatttccccccctatatttcataacaacgtaattc

SEQ ID NO: 19513 - DNA, 71 bp, chicken (Gallus Gallus)
  misc_feature (36): n=a or c
aggggagatgtgctctgggaaagccacttctctgantgtcctttcctccatctgctttgatcttttgttgc

SEQ ID NO: 19514 - DNA, 71 bp, chicken (Gallus Gallus)
  misc_feature (36): n=c or t
gaaaaaaaaagcgatctgatctaaatatagcacttnctttatgcacaagctgataaaaagaacaaattagc

SEQ ID NO: 19515 - DNA, 71 bp, chicken (Gallus Gallus)
  misc_feature (36): n=a or g
gtattggtaacggatgttatgtctttgtgtatcatntttctaatgcaccgctagaattaggaataaggttt

SEQ ID NO: 19516 - DNA, 71 bp, chicken (Gallus Gallus)
  misc_feature (36): n=c or t
atcaatactaagattcaggagtttaacatctttgtnaacctggatagtgggaccgagtgcacagtcagtag

SEQ ID NO: 19517 - DNA, 71 bp, chicken (Gallus Gallus)
  misc_feature (36): n=a or g
tcagctctggtgtactgaagcttaaggagagaagcntattggaaaacaagacacaaaaataattaaaaaaa

SEQ ID NO: 19518 - DNA, 71 bp, chicken (Gallus Gallus)
  misc_feature (36): n=a or c
caaaacacaaatattcttttgaaaactctctgactnatgtctgttcagcatccgaaaacagaaacatacgt

SEQ ID NO: 19519 - DNA, 71 bp, chicken (Gallus Gallus)
  misc_feature (36): n=c or g
ttgctgcccttatgtcttcaggaactctaccagcantctattgattgccccatgtgaatggcagaactttc

SEQ ID NO: 19520 - DNA, 71 bp, chicken (Gallus Gallus)
  misc_feature (36): n=c or g
acacctaagcattaagacctgcaaagctgcaaatgncagcctctcgacggccatagcaatggtctgcggat

SEQ ID NO: 19521 - DNA, 71 bp, chicken (Gallus Gallus)
  misc_feature (36): n=a or g
aatttcatggggtcttatttttccccatttgtatantattgaagaagtaatttaaagtttacagatatagt

SEQ ID NO: 19522 - DNA, 71 bp, chicken (Gallus Gallus)
  misc_feature (36): n=a or g
gtaaagcatcctttactgcattatcctgagtttgtncattttaccagttcttgtatcttgttgagttaatg

SEQ ID NO: 19523 - DNA, 71 bp, chicken (Gallus Gallus)
  misc_feature (36): n=a or t
tttcctgtttgcccagtacctgcagttggtagaacngcagcagaatttagaattgctgatgtggagaattt

SEQ ID NO: 19524 - DNA, 71 bp, chicken (Gallus Gallus)
  misc_feature (36): n=c or t
gaaaaatgaagataagctttttgcagggcatatagngataagacaaggggtaattgttttaaatggaaaga

SEQ ID NO: 19525 - DNA, 71 bp, chicken (Gallus Gallus)
  misc_feature (36): n=c or t
gggtgtatttaccataacaacattattatttgatgngtagactccaagcactgactgctttcattcacaat

SEQ ID NO: 19526 - DNA, 71 bp, chicken (Gallus Gallus)
  misc_feature (36): n=a or g
ttaatcatagggaaaagaattggcaaacttgtatancattactgtttctaaaatgatgttatctcatatta

SEQ ID NO: 19527 - DNA, 71 bp, chicken (Gallus Gallus)
  misc_feature (36): n=a or g
gcaatataagctagccaaggtttaggcagtctcacnctacagttccaacagacagaagatttgtcatcatt

SEQ ID NO: 19528 - DNA, 71 bp, chicken (Gallus Gallus)
  misc_feature (36): n=a or g
ctgacatacatgagttctgcgaatgacagatgccangaatcaactaattttgcgtgaatgctacaaataca

SEQ ID NO: 19529 - DNA, 71 bp, chicken (Gallus Gallus)
  misc_feature (36): n=c or t
ctcccaatgctgtcaagatggacaatctgagatacnttaaaaaaaatatacccaaacttttgtactaaatg

SEQ ID NO: 19530 - DNA, 71 bp, chicken (Gallus Gallus)
  misc_feature (36): n=c or g
gtgcccacaactcccagacagtgtagaattagtacntgcatcacacagaaaacgacacttctgctaacctt

SEQ ID NO: 19531 - DNA, 71 bp, chicken (Gallus Gallus)
  misc_feature (36): n=g or t
cttaggcttaagtctctttcttgctctagaaaatcnttttgcttgcaggtttcttccttccctccctgcag

SEQ ID NO: 19532 - DNA, 71 bp, chicken (Gallus Gallus)
  misc_feature (36): n=a or c
ggcaagtatttctaagaagcattactaaactgaaanaactccaaccaaactcaggcagtgcattaaacaga

SEQ ID NO: 19533 - DNA, 71 bp, chicken (Gallus Gallus)
  misc_feature (36): n=a or c
taagaagtaacgttgccttcttctgaagaactttgnaacttacttaataacagccatttaatttgtaatca

SEQ ID NO: 19534 - DNA, 71 bp, chicken (Gallus Gallus)
  misc_feature (36): n=c or g
ctatgatatctatgatattcataacatccagaatangtctcatataaagagaactctcaaccatcccacac

SEQ ID NO: 19535 - DNA, 71 bp, chicken (Gallus Gallus)
  misc_feature (36): n=c or t
tatgagattgcagattgctaatgctataaatgactnggagcaaagggacactcgaagagtactcagcatac

SEQ ID NO: 19536 - DNA, 71 bp, chicken (Gallus Gallus)
  misc_feature (36): n=c or t
tgtgtggtggccactagtaagtaagagggctgtggnggtgtggagacatcgggactttgtgaatcctggaa

SEQ ID NO: 19537 - DNA, 71 bp, chicken (Gallus Gallus)
  misc_feature (36): n=a or t
taggagtctggttaggagctccagagcattttaacnttctagtccatttcctttcatcactgtgatagtca

SEQ ID NO: 19538 - DNA, 71 bp, chicken (Gallus Gallus)
  misc_feature (36): n=c or t
aaggtttccaggggacccaactgctgagatacaatngggtcccacatctcagccccgggtgcaagcggggc

SEQ ID NO: 19539 - DNA, 71 bp, chicken (Gallus Gallus)
  misc_feature (36): n=a or g
ccagcagtttccatcctcaaagaataaattaagtcntacttctttacaaaaaaaacccaaaccataacaac

SEQ ID NO: 19540 - DNA, 71 bp, chicken (Gallus Gallus)
  misc_feature (36): n=a or t
cttttttttttttttttttaatgggaagtttaaaancagtattttaaatcaacatttcaaaatataattta

SEQ ID NO: 19541 - DNA, 71 bp, chicken (Gallus Gallus)
  misc_feature (36): n=c or g
gatgtggatggctttagtgggggttcctgctccctntcagagggatattcagaagtgcattgtgaccattg

SEQ ID NO: 19542 - DNA, 71 bp, chicken (Gallus Gallus)
  misc_feature (36): n=a or g
ttgtagcccttgaaagcagcctggatcttcaccgcngcgttgttcatggaaggatcatctaaatctgctat

SEQ ID NO: 19543 - DNA, 71 bp, chicken (Gallus Gallus)
  misc_feature (36): n=a or c
agagagcagtagtattaaacatcaacaccaccattnttttggtgccacagtctagaagaaaatgtatatat

SEQ ID NO: 19544 - DNA, 71 bp, chicken (Gallus Gallus)
  misc_feature (36): n=a or g
ctttccctctatcctcacagcccaaaaggactgcanatttccaagataagtgtgaaggagctgtgatgccc

SEQ ID NO: 19545 - DNA, 71 bp, chicken (Gallus Gallus)
  misc_feature (36): n=c or t
cctcaccagtgctgactaggggagaaggatcacctnccttaacctgctgacagtgttttgcctaatacagc

SEQ ID NO: 19546 - DNA, 71 bp, chicken (Gallus Gallus)
  misc_feature (36): n=a or g
gctaaacctcagctatggaaatgttatctctttacntggctcaagatcttgcacggaaaatgtctgaaaat

SEQ ID NO: 19547 - DNA, 71 bp, chicken (Gallus Gallus)
  misc_feature (36): n=a or g
tattttcttcctgactgttaccagattcacataganatgccagagtaaaatacaaaagactcttctccata

SEQ ID NO: 19548 - DNA, 71 bp, chicken (Gallus Gallus)
  misc_feature (36): n=a or c
ataacaaccactgcgcaagttgtctagtttcaaatnatcttctagtagccgagaacctactcaagcctcta

SEQ ID NO: 19549 - DNA, 71 bp, chicken (Gallus Gallus)
  misc_feature (36): n=c or t
ctgatgaaccatgtttgtcaacctgaaatacatctnagggcagtcagagatctcctacctgcatgcgttcg

SEQ ID NO: 19550 - DNA, 71 bp, chicken (Gallus Gallus)
  misc_feature (36): n=a or g
tgagaaggtctgttaataaccacacactactagagncattaaataggccacccgtgcttctaacacacaca

SEQ ID NO: 19551 - DNA, 71 bp, chicken (Gallus Gallus)
  misc_feature (36): n=a or g
ttggagtagctttcagtgtttggctcttaagaaatntgagaaatgaaaagctgcttacatgggaattatgt

SEQ ID NO: 19552 - DNA, 71 bp, chicken (Gallus Gallus)
  misc_feature (36): n=a or c
gaactgcatattgtagcaatggacttgggtggaaantgggagggaaaacaaagtccttctgaagtttgaga

SEQ ID NO: 19553 - DNA, 71 bp, chicken (Gallus Gallus)
  misc_feature (36): n=c or t
tgcacgcatgcacagaaaaaagctcatcacagaaangaatgcaaggaggtaggcttctaaaacgaattctc

SEQ ID NO: 19554 - DNA, 71 bp, chicken (Gallus Gallus)
  misc_feature (36): n=a or g
cctgcgcctcagtcctttcctcaggtgattggtccntggttcagacggtcactcaagagttcccatacact

SEQ ID NO: 19555 - DNA, 71 bp, chicken (Gallus Gallus)
  misc_feature (36): n=c or g
gaaccactcctatcattccacagaagatggcctctngtatctttagtgactgtgaataatccatttgagct

SEQ ID NO: 19556 - DNA, 71 bp, chicken (Gallus Gallus)
  misc_feature (36): n=a or t
agtgaatcctaagatggtaaggatgtaaagtttganatcatcttacaaagtcaaatcccttcagtgttctc

SEQ ID NO: 19557 - DNA, 71 bp, chicken (Gallus Gallus)
  misc_feature (36): n=a or g
cacaggccagagagtggaatgtctaaatagacaacnaattcataaaaaggagatctttttctcagtgaatt

SEQ ID NO: 19558 - DNA, 71 bp, chicken (Gallus Gallus)
  misc_feature (36): n=a or g
agcacaatgatggataatgtgaaacagaatgagacntgtgatacttataatgtgatacaatcttcctctgt

SEQ ID NO: 19559 - DNA, 71 bp, chicken (Gallus Gallus)
  misc_feature (36): n=a or g
taaaactcttgtgtgatgctaaagatcacctctgcnactctgaaagcacgttggccttaaatcagctatgt

SEQ ID NO: 19560 - DNA, 71 bp, chicken (Gallus Gallus)
  misc_feature (36): n=a or c
ctgcacctgggcagttggaggccatcgatcagcagntcctcagttgatggagtgaaagaacagcgaggtct

SEQ ID NO: 19561 - DNA, 71 bp, chicken (Gallus Gallus)
  misc_feature (36): n=a or g
tggtgaccccatcatgcaaatggaaatgctggaacnttggtgttaagtgggcataagcaaagagcttcgaa

SEQ ID NO: 19562 - DNA, 71 bp, chicken (Gallus Gallus)
  misc_feature (36): n=c or t
gaaggcacaagcataagatgctcttgctgttcccanggagagtcatcaaaagagtgccaaaatttgaattt

SEQ ID NO: 19563 - DNA, 71 bp, chicken (Gallus Gallus)
  misc_feature (36): n=a or g
gagcatttgaaaataaatgttacaatgattatgtantgagaagcaaccctgggttatttagaatgagatgc

SEQ ID NO: 19564 - DNA, 71 bp, chicken (Gallus Gallus)
  misc_feature (36): n=c or t
ccttgaccaaaaaaaaaaaaattgcactgtgaagtntattatagactcgaaaaaaataccatgaaatgctc

SEQ ID NO: 19565 - DNA, 71 bp, chicken (Gallus Gallus)
  misc_feature (36): n=a or g
tcatgtttatttaagtatttagaccttccaattccngctgttttgaataagcatgtgtgacatttttcagt

SEQ ID NO: 19566 - DNA, 71 bp, chicken (Gallus Gallus)
  misc_feature (36): n=a or g
tcaagaacaaatataagatcctaccacctagagaanaataatcaaatgcatcagtacaggttaggaactga

SEQ ID NO: 19567 - DNA, 71 bp, chicken (Gallus Gallus)
  misc_feature (36): n=a or g
attatgtatttaggggtgaatttgaaataaaatgcnactatttcccttactctgacacattttagtaatct

SEQ ID NO: 19568 - DNA, 71 bp, chicken (Gallus Gallus)
  misc_feature (36): n=a or g
tacaaggttggcgcaaataaaaattttatatctctngggttttcatgatcaagagattttgtatcaagtat

SEQ ID NO: 19569 - DNA, 71 bp, chicken (Gallus Gallus)
  misc_feature (36): n=a or g
aatgtaatagccaaaatgctgatcctaacttcacantaagcatttcatcactgatgacagctctgaaagtt

SEQ ID NO: 19570 - DNA, 71 bp, chicken (Gallus Gallus)
  misc_feature (36): n=a or t
ccatgtcccaccagtccttcctgacactccctgaanatccaaagtttttgcttgacaacagccaactcagt

SEQ ID NO: 19571 - DNA, 71 bp, chicken (Gallus Gallus)
  misc_feature (36): n=c or t
tgagaagtttttcagccaggtcagatatctacaaangcataaaaatcgcataatcttccaactctgaaggc

SEQ ID NO: 19572 - DNA, 71 bp, chicken (Gallus Gallus)
  misc_feature (36): n=a or g
atttgttttggtttttttttttgagaccctgcactntgatactgtaaacctctcaaatccaaacttgcagc

SEQ ID NO: 19573 - DNA, 71 bp, chicken (Gallus Gallus)
  misc_feature (36): n=a or g
ctcgatgagcctgaattctgtttagttcaatttgcntgatgcaaaggcatctcgctcagttcagaataaag

SEQ ID NO: 19574 - DNA, 71 bp, chicken (Gallus Gallus)
  misc_feature (36): n=a or g
taaagtccaatctttctgcttcatttattccatgcnctgagatctctacaaaggcccggtttaactattct

SEQ ID NO: 19575 - DNA, 71 bp, chicken (Gallus Gallus)
  misc_feature (36): n=c or t
aaatcagaaaatatccttatgtgagcgtatacagcngtggtagtgctgtgtatctctcaaaggttagagga

SEQ ID NO: 19576 - DNA, 71 bp, chicken (Gallus Gallus)
  misc_feature (36): n=c or t
actatgtattctgtatcttatgtttttaggtactcntttgttgtagctatgggatacctcaccttgtgcca

SEQ ID NO: 19577 - DNA, 71 bp, chicken (Gallus Gallus)
  misc_feature (36): n=c or t
gaacatctatcgagaattttatatcttacattacangggtaatgctaaaaagaataggtgttatacccctg

SEQ ID NO: 19578 - DNA, 71 bp, chicken (Gallus Gallus)
  misc_feature (36): n=g or t
gagcataagatacccagttctttccaaatcttcatntggtcagttcagatctatggcagatctcttgcaac

SEQ ID NO: 19579 - DNA, 71 bp, chicken (Gallus Gallus)
  misc_feature (36): n=a or g
ttcttggcatgccgcaaattccagcccttttaaggnaagccctttccagccactacaaagcgataccttgg

SEQ ID NO: 19580 - DNA, 71 bp, chicken (Gallus Gallus)
  misc_feature (36): n=c or g
aaaactgaaaggaaatgtatgctagagatcagatanaccaaaaatacacactaaaagttagaaaggaaatt

SEQ ID NO: 19581 - DNA, 71 bp, chicken (Gallus Gallus)
  misc_feature (36): n=a or g
aagcttttagtaatgactttaaaagctttctaggancttgttgataacttgatttcacttcctattatgtg

SEQ ID NO: 19582 - DNA, 71 bp, chicken (Gallus Gallus)
  misc_feature (36): n=a or c
aattatcacctgggaaatgcacaacaccaccatcanacctaaaatcaattttgttcttttcaaattatcag

SEQ ID NO: 19583 - DNA, 71 bp, chicken (Gallus Gallus)
  misc_feature (36): n=a or g
agttagttttattgtcccttggacacaagtggtagncactgagggacacagacaattttctgtaaggccca

SEQ ID NO: 19584 - DNA, 71 bp, chicken (Gallus Gallus)
  misc_feature (36): n=c or g
tttaatacatcttgttctgctgatttaggctaatgnattaacaagggcaatcttcaacatcttttctttta

SEQ ID NO: 19585 - DNA, 71 bp, chicken (Gallus Gallus)
  misc_feature (36): n=g or t
ctttacgcttcctgaatctcaacaagtcttttttcnttgtttgtttttgtttttgtttttctcctgaggaa

SEQ ID NO: 19586 - DNA, 71 bp, chicken (Gallus Gallus)
  misc_feature (36): n=g or t
gaggaaaaattgtcaaaacactaacttgtttttggntttttttttgctctcgctctacatgtttttggagt

SEQ ID NO: 19587 - DNA, 71 bp, chicken (Gallus Gallus)
  misc_feature (36): n=a or g
agaggaagagttgttacttgtactgtaggctctatnttagtctgctgatacaaattcaccagtatggtagc

SEQ ID NO: 19588 - DNA, 71 bp, chicken (Gallus Gallus)
  misc_feature (36): n=a or g
tttttgtcgtttagggttaagaatatttaaattccntgtcttctcatgggtagtgaaggaaaggtgatcag

SEQ ID NO: 19589 - DNA, 71 bp, chicken (Gallus Gallus)
  misc_feature (36): n=c or t
ttcgtaagtatcacttaaaccctgagtttcaccctngaaaagatgtttactgctattcactcctggtatca

SEQ ID NO: 19590 - DNA, 71 bp, chicken (Gallus Gallus)
  misc_feature (36): n=c or t
cagccagataacggggcctgcaggaacactaccagncctttccacacacaccaacaacatgttagtcttta

SEQ ID NO: 19591 - DNA, 71 bp, chicken (Gallus Gallus)
  misc_feature (36): n=a or g
acccaggccattctatgattatatcctgatacaaantgaagaaaaatgaataatcaatacttaaattttct

SEQ ID NO: 19592 - DNA, 71 bp, chicken (Gallus Gallus)
  misc_feature (36): n=g or t
cataagctcactgcattagcacagaagtacggctangtggtaaagcagtaggagaataagttcttcttgac

SEQ ID NO: 19593 - DNA, 71 bp, chicken (Gallus Gallus)
  misc_feature (36): n=c or g
tatatagaggaccagctgttgcagattttctgaaancttctgtaatgtcttctggctaaaatttttcatct

SEQ ID NO: 19594 - DNA, 71 bp, chicken (Gallus Gallus)
  misc_feature (36): n=g or t
agtgcatttccactatcttgaagcctacaatagatnatcccttccctctacccatccaggctccatgtcca

SEQ ID NO: 19595 - DNA, 71 bp, chicken (Gallus Gallus)
  misc_feature (36): n=a or c
ggaaaccacaatgcttaggcatcctgtaattcagtngccttattagggtagtgtaacaattgaaagattga

SEQ ID NO: 19596 - DNA, 71 bp, chicken (Gallus Gallus)
  misc_feature (36): n=c or g
aatagatgacatatttcagtcaaattctactactantagtagagcagtattcatgagaatatgacaaacag

SEQ ID NO: 19597 - DNA, 71 bp, chicken (Gallus Gallus)
  misc_feature (36): n=c or t
ttaagacggctacttcaagaggtccttgagaaccanatagccttcaaagtgtaaccttctatcaggaatgg

SEQ ID NO: 19598 - DNA, 71 bp, chicken (Gallus Gallus)
  misc_feature (36): n=a or g
aaggccaaggaatattatcctcctattacctacagnaaatgagaacaagcgatggttcaaggtcaccacag

SEQ ID NO: 19599 - DNA, 71 bp, chicken (Gallus Gallus)
  misc_feature (36): n=c or t
gaggacatccatttcagcttttctcctttctcgttnaggtagacatcaaccctcaggttctcatcggtgtc

SEQ ID NO: 19600 - DNA, 71 bp, chicken (Gallus Gallus)
  misc_feature (36): n=c or t
ttaaacatctattttaggatgagatgaagcatgccngcaaagtttctgttctctgttgactttaaagggaa

SEQ ID NO: 19601 - DNA, 71 bp, chicken (Gallus Gallus)
  misc_feature (36): n=c or g
gataatgaagttgagttgtttcataaagttgatgcnaagatcaaaaaacctgactttttcagggatggtca

SEQ ID NO: 19602 - DNA, 71 bp, chicken (Gallus Gallus)
  misc_feature (36): n=a or g
gtgggtctcaaattgcaaatctgtcaagctgaaaancaaatcactaccaaaactttttagattgtatctgt

SEQ ID NO: 19603 - DNA, 71 bp, chicken (Gallus Gallus)
  misc_feature (36): n=a or g
aaagaaaaagcttaagaagcaattagtggatgatcnaaatgaaaaggactattgtgaggacagttgtcttt

SEQ ID NO: 19604 - DNA, 71 bp, chicken (Gallus Gallus)
  misc_feature (36): n=a or g
aggtatataaaataagcatttaatcggcattcacanctcagtaagaaatctcacttttggaactgattagt

SEQ ID NO: 19605 - DNA, 71 bp, chicken (Gallus Gallus)
  misc_feature (36): n=a or g
ggatgaagaaaactcttgggactaactcttaaaaanagaaaagaaaagaaaacacaaaaaaaaccccaaca

SEQ ID NO: 19606 - DNA, 71 bp, chicken (Gallus Gallus)
  misc_feature (36): n=a or g
tcccgatgatccgtgggggtgaccatctcgttggcntagccattttcagagcacagggacagctcgtctgt

SEQ ID NO: 19607 - DNA, 71 bp, chicken (Gallus Gallus)
  misc_feature (36): n=c or t
cttgggctccctctccttgggagtcagattctaacnatcagtcagaggaaaggacatcaagctatgtgctc

SEQ ID NO: 19608 - DNA, 71 bp, chicken (Gallus Gallus)
  misc_feature (36): n=a or g
ttctgccccctatagagtttttcctaatggaaaggncattttagaatgttttgtgtggcagaggtcttctc

SEQ ID NO: 19609 - DNA, 71 bp, chicken (Gallus Gallus)
  misc_feature (36): n=a or g
atatgtgcttatgcacgtgcactcacacatctgcantgttccagtgggccaccttctttttggtagatgaa

SEQ ID NO: 19610 - DNA, 71 bp, chicken (Gallus Gallus)
  misc_feature (36): n=a or g
actgtagattttttgtaatgaatattttgcagcaanccacttgttactaatgatactaattttacttgtac

SEQ ID NO: 19611 - DNA, 71 bp, chicken (Gallus Gallus)
  misc_feature (36): n=a or g
tctgagaagtcaaagaagtaatcgttcactagcccntacacaaagcaataaggctgagagttctttgcaca

SEQ ID NO: 19612 - DNA, 71 bp, chicken (Gallus Gallus)
  misc_feature (36): n=a or g
cgagctgtgtgactgtgatgtggcattttggggaanaaagaagtgtgcaaactgtggggtaagaaaacaga

SEQ ID NO: 19613 - DNA, 71 bp, chicken (Gallus Gallus)
  misc_feature (36): n=c or t
cttgggtcaaaacagtcctatgcagcagtgtcagcntggtgaagattggctggaaaactgaccagtaggaa

SEQ ID NO: 19614 - DNA, 71 bp, chicken (Gallus Gallus)
  misc_feature (36): n=a or c
gctgacacacattgtttattttctgagtataactgncgaactttttctgacctaagacatatggaaatcaa

SEQ ID NO: 19615 - DNA, 71 bp, chicken (Gallus Gallus)
  misc_feature (36): n=c or g
aacaaagtagactaggttttacaatacattaattangagtactgtataatctcttcatagaagaactaaca

SEQ ID NO: 19616 - DNA, 71 bp, chicken (Gallus Gallus)
  misc_feature (36): n=a or g
atccttcactctcaaagcagagtataagtctatgcngttgaatgaactccattactgctttgaatatcacc

SEQ ID NO: 19617 - DNA, 71 bp, chicken (Gallus Gallus)
  misc_feature (36): n=a or g
ccatatgtatttttaaaacaatgtgtgtggaaagtntcttctttcctgccaagaacccagtttaggatggt

SEQ ID NO: 19618 - DNA, 71 bp, chicken (Gallus Gallus)
  misc_feature (36): n=a or g
gattagctttcagaaagacatgaaaatgcctaagangaaactgagtaaaaagagaatctgcacagaaagaa

SEQ ID NO: 19619 - DNA, 71 bp, chicken (Gallus Gallus)
  misc_feature (36): n=c or g
aaatgagattttttttacatttgggatgtgtagacnctggtgtaggtgggtgctgatccctgtatgtctgt

SEQ ID NO: 19620 - DNA, 71 bp, chicken (Gallus Gallus)
  misc_feature (36): n=a or c
ctgatagtaaactttgttttctcagtagcagtaatnactgtggcaggaaaaacttgctttatatatcatgc

SEQ ID NO: 19621 - DNA, 71 bp, chicken (Gallus Gallus)
  misc_feature (36): n=a or g
tggacataagagagcgagagtggcagaagtgtcacngtggtgtaaattgacgatatcttaaggagagacca

SEQ ID NO: 19622 - DNA, 71 bp, chicken (Gallus Gallus)
  misc_feature (36): n=g or t
aaaaaaattaagtgctttgagtaaatcatgtaacantttctactagcaaaccttagagcattaaaataaat

SEQ ID NO: 19623 - DNA, 71 bp, chicken (Gallus Gallus)
  misc_feature (36): n=c or g
agaaatggcttttgcaaccttgcttactaccatggnttcagaggtcagaagtgcatcaatttgtcattatt

SEQ ID NO: 19624 - DNA, 71 bp, chicken (Gallus Gallus)
  misc_feature (36): n=a or t
tcctatttaacaaaacaactctagaaacaaccaaancgctatgacaagaaatgtgtgaaaacttcgaaaca

SEQ ID NO: 19625 - DNA, 71 bp, chicken (Gallus Gallus)
  misc_feature (36): n=c or t
tattgcaactttctcaatgttgactagtaaaatttntctttttaatagtgactacatgaaagttgaagatt

SEQ ID NO: 19626 - DNA, 71 bp, chicken (Gallus Gallus)
  misc_feature (36): n=a or c
tggatctttttcgcacatgtgattcacatgttcccntgtaagaggaaaaaaccctaaagaaagattaattc

SEQ ID NO: 19627 - DNA, 71 bp, chicken (Gallus Gallus)
  misc_feature (36): n=a or c
gttgatgcctgctgcgaatagaaaagcatatgggantattctctaatcattgctctaatgaaagacatata

SEQ ID NO: 19628 - DNA, 71 bp, chicken (Gallus Gallus)
  misc_feature (36): n=a or g
gtatttcccattctgccatgagctatgcatgcagcngtttgagaataaaatattaatttcctagtttgcag

SEQ ID NO: 19629 - DNA, 71 bp, chicken (Gallus Gallus)
  misc_feature (36): n=a or g
ttactgagagctgtgtatacctctgagaaccaaacntgactcagtatttgctccctaatgggatgacttgg

SEQ ID NO: 19630 - DNA, 71 bp, chicken (Gallus Gallus)
  misc_feature (36): n=c or t
tcttcatttattatatgcgaagtccacagaaactanactcaatggggcagcatcagctattgtgaatgtca

SEQ ID NO: 19631 - DNA, 71 bp, chicken (Gallus Gallus)
  misc_feature (36): n=g or t
tggcacttatgcaaatgccatttaatgttgtatcanaaatgttgtcagcgtccttccagtaagaaagtaaa

SEQ ID NO: 19632 - DNA, 71 bp, chicken (Gallus Gallus)
  misc_feature (36): n=a or g
aaaaatgcaacaattaaatgtatttctataaacaancacttcaggatcagaaccctgaaaagtaaaatatg

SEQ ID NO: 19633 - DNA, 71 bp, chicken (Gallus Gallus)
  misc_feature (36): n=a or g
tagattaagggcttccagtatttatgaatttttctntatgtttctaatatacattagaacatcacataggt

SEQ ID NO: 19634 - DNA, 71 bp, chicken (Gallus Gallus)
  misc_feature (36): n=c or t
aaaaaagctagatttgattaacataaaaatatgaangttacctttcaaagtagaagattctcaatagtaat

SEQ ID NO: 19635 - DNA, 71 bp, chicken (Gallus Gallus)
  misc_feature (36): n=c or t
aaagaaaagatgtcagtaagattaggaatcagcctngaagccagagtaaatacatttgccactttgatcag

SEQ ID NO: 19636 - DNA, 71 bp, chicken (Gallus Gallus)
  misc_feature (36): n=c or t
ggaaaccaaagtacagaattcatttgtatacacatntctttttctttccttctccccaggagaaatgcaac

SEQ ID NO: 19637 - DNA, 71 bp, chicken (Gallus Gallus)
  misc_feature (36): n=c or t
gcctactcaggcaattttatcagaagggaatgtggntgccctaacatttatttagtctgttgtaaaactga

SEQ ID NO: 19638 - DNA, 71 bp, chicken (Gallus Gallus)
  misc_feature (36): n=c or g
ttctcttctcttccacaactgattactggtgtactngataaggacgtgccagctgaagtgttactgtctgt

SEQ ID NO: 19639 - DNA, 71 bp, chicken (Gallus Gallus)
  misc_feature (36): n=a or g
aaatagatgcgctggttgggttgatacctgggtganaagagagctccctatggatacctgctccactgcct

SEQ ID NO: 19640 - DNA, 71 bp, chicken (Gallus Gallus)
  misc_feature (36): n=a or g
tggatgtggattgcacacagagaaacttaagcacancacctccaaattgcactgtgctcaaaggagcccaa

SEQ ID NO: 19641 - DNA, 71 bp, chicken (Gallus Gallus)
  misc_feature (36): n=a or g
gaaaaagctgagggggatcttatcattgcttataantatctaaagggtgagaatcaagaggatgaggtctg

SEQ ID NO: 19642 - DNA, 71 bp, chicken (Gallus Gallus)
  misc_feature (36): n=c or t
cccagggcagggaacaaacagcaccttaccttgacngtagaggaagaggttgcaatctgaatcacttgggc

SEQ ID NO: 19643 - DNA, 71 bp, chicken (Gallus Gallus)
  misc_feature (36): n=c or t
ggcctccagctacacgtacccaccattactgttgtntggcccttgcattcatcacaccagtagtgagttgg

SEQ ID NO: 19644 - DNA, 71 bp, chicken (Gallus Gallus)
  misc_feature (36): n=a or g
aagctgtgaataaatgggttgcaatgtctttgacantatgtgagtaattaatatttgctgtggtgaaatat

SEQ ID NO: 19645 - DNA, 71 bp, chicken (Gallus Gallus)
  misc_feature (36): n=c or g
gcggctgtggcagagcacaaagtgattacacacatncagggccgcactgccagcctcagctgctggcggct

SEQ ID NO: 19646 - DNA, 71 bp, chicken (Gallus Gallus)
  misc_feature (36): n=c or t
cctaagaactggaagctcgtggtgtctgccccatcnccaggaacagacccccaaatctttgatgagattcg

SEQ ID NO: 19647 - DNA, 71 bp, chicken (Gallus Gallus)
  misc_feature (36): n=g or t
cagggggtgagacgacaactgagccatcaagatgcntgtgaaacctccatcacgctgcttagccttctttg

SEQ ID NO: 19648 - DNA, 71 bp, chicken (Gallus Gallus)
  misc_feature (36): n=a or g
agaacttggtgcttgccttgaattttggagctcttnaatcactaggcagatataacctgcacatcactcac

SEQ ID NO: 19649 - DNA, 71 bp, chicken (Gallus Gallus)
  misc_feature (36): n=a or g
ttgctatctcctctgcctgttctaaatgtatgcagncacagccccagcttgcagttcgatttcttgctttc

SEQ ID NO: 19650 - DNA, 71 bp, chicken (Gallus Gallus)
  misc_feature (36): n=c or t
cacagcaagtgattcctcatacctaaataagcaccnaccccaggcagaggagggcaggaggtgaccctcct

SEQ ID NO: 19651 - DNA, 71 bp, chicken (Gallus Gallus)
  misc_feature (36): n=a or g
tggatcattgtctgatcctgctctccttaatgcccntgtcagggctctctcgtgcctctggcacttctcct

SEQ ID NO: 19652 - DNA, 71 bp, chicken (Gallus Gallus)
  misc_feature (36): n=c or g
agcttggtggtaattgccattactaaacgccagaanaggagatactgaatggatcttttttctcctttgct

SEQ ID NO: 19653 - DNA, 71 bp, chicken (Gallus Gallus)
  misc_feature (36): n=a or g
agattttcctgtctccaatggtttcaggaggccccntgcttctcctgtcctgaccagcttaaaggcagggc

SEQ ID NO: 19654 - DNA, 71 bp, chicken (Gallus Gallus)
  misc_feature (36): n=c or t
gggacgtttaaatagtgattctccttaaaatcttcnggtttttctctctctttaaaaaaaaaaaaagacac

SEQ ID NO: 19655 - DNA, 71 bp, chicken (Gallus Gallus)
  misc_feature (36): n=g or t
tttatttgcaaatatgaataggtagttacttcaaanagctaaatggctttctttccatagtcttgcattca

SEQ ID NO: 19656 - DNA, 71 bp, chicken (Gallus Gallus)
  misc_feature (36): n=c or t
gccccaggtttttgacccaaccaatagctactggtnacacttcacagggaaaagcgttagcaccacaccca

SEQ ID NO: 19657 - DNA, 71 bp, chicken (Gallus Gallus)
  misc_feature (36): n=g or t
gaagaaagagaagaaatactcatctttgtttaaatnactgtatttttgtacataagtataaactagagaat

SEQ ID NO: 19658 - DNA, 71 bp, chicken (Gallus Gallus)
  misc_feature (36): n=c or g
atataggtaacgtgtcatgttttctaaatttttcantagggtgagattcctgtgctcaggaatgccactgc

SEQ ID NO: 19659 - DNA, 71 bp, chicken (Gallus Gallus)
  misc_feature (36): n=c or t
tgctgcttctgctttctccagttttgtttattatcnatgcttctcgtttatgcagcctaatggacggtctt

SEQ ID NO: 19660 - DNA, 71 bp, chicken (Gallus Gallus)
  misc_feature (36): n=c or t
tatctgttttaggccactaatgggaggtggatttcnggattagtcacaccacactgtcatcgcaggtggtg

SEQ ID NO: 19661 - DNA, 71 bp, chicken (Gallus Gallus)
  misc_feature (36): n=a or g
gtttcggagaatataatacatggatactttgcagtncaggaattacagatatatgggcaggtggaacagag

SEQ ID NO: 19662 - DNA, 71 bp, chicken (Gallus Gallus)
  misc_feature (36): n=c or t
gggtagagcaataagagtctttttgatttgttagtnggctttgacagtgatacagaatttccttcagtaga

SEQ ID NO: 19663 - DNA, 71 bp, chicken (Gallus Gallus)
  misc_feature (36): n=a or g
agaacagatttcatactgtttaatttacatttatcnttaatggcaggaagaaaactgttttctacacaaga

SEQ ID NO: 19664 - DNA, 71 bp, chicken (Gallus Gallus)
  misc_feature (36): n=a or g
accgctgtcccataaaccaggaactgtgcagctctntggcttcactctgtgctggaggtagcaatgagctg

SEQ ID NO: 19665 - DNA, 71 bp, chicken (Gallus Gallus)
  misc_feature (36): n=c or t
acagactctagattgatcttattacacagggatcanagagaactacctggctctttgacaaaatgtaagag

SEQ ID NO: 19666 - DNA, 71 bp, chicken (Gallus Gallus)
  misc_feature (36): n=a or c
ctctgggatgggtgcagggctgccgaaagccatttncattactctttttttaactgttcaggctgacagca

SEQ ID NO: 19667 - DNA, 71 bp, chicken (Gallus Gallus)
  misc_feature (36): n=a or g
tcctgaacagcatactcctctctcctgcctaggaanggttctgtgctgctactgtatttctcactgtacca

SEQ ID NO: 19668 - DNA, 71 bp, chicken (Gallus Gallus)
  misc_feature (36): n=a or g
tgtcaagggcagaagttttatgaagtactgtatgcncatgctactaaaaatttgcagcagggcaagtcatt

SEQ ID NO: 19669 - DNA, 71 bp, chicken (Gallus Gallus)
  misc_feature (36): n=a or g
tgctcttaacttggtttaggtaaagctgaagctcantaagttcacttagagtagctgatcctctgtaacct

SEQ ID NO: 19670 - DNA, 71 bp, chicken (Gallus Gallus)
  misc_feature (36): n=c or t
ttccaaattcccacttgaaacctgcatatgagggtnagtggtcccatcttatttttaagtgatacatttag

SEQ ID NO: 19671 - DNA, 71 bp, chicken (Gallus Gallus)
  misc_feature (36): n=g or t
tgaggcattgagagtaactacagtataaaaaagaancagcaggtatacaaaacaagatatctagaagtgac

SEQ ID NO: 19672 - DNA, 71 bp, chicken (Gallus Gallus)
  misc_feature (36): n=c or t
gtcagagaaaattattgctcccatgcagcaaatctnaagcatttttattttccctttaattaacattcaaa

SEQ ID NO: 19673 - DNA, 71 bp, chicken (Gallus Gallus)
  misc_feature (36): n=c or g
ctttcaatgttaagaatcaacacctattgacttganatgctagatgaaaagaatgagttacctttcctgac

SEQ ID NO: 19674 - DNA, 71 bp, chicken (Gallus Gallus)
  misc_feature (36): n=a or g
atatcacacataaaattgtggttaatccttatgatntaatcagctcacttgaatataactacagtttgaat

SEQ ID NO: 19675 - DNA, 71 bp, chicken (Gallus Gallus)
  misc_feature (36): n=c or g
tccatgtttacttatgtaatcaatgctaagataaanttgctcctctctcattttcaattcaaggcagtcca

SEQ ID NO: 19676 - DNA, 71 bp, chicken (Gallus Gallus)
  misc_feature (36): n=c or g
gggcacccaacagctcaaggaattgcttctgccctnttgtaccttctacagttaccacattaaagattcac

SEQ ID NO: 19677 - DNA, 71 bp, chicken (Gallus Gallus)
  misc_feature (36): n=c or t
tgcagtcccacacttcattctcacccagagatcctngggagggactatagctttcccctaaacaaactttt

SEQ ID NO: 19678 - DNA, 71 bp, chicken (Gallus Gallus)
  misc_feature (36): n=a or g
gaatcaaagatggctttggtggagtgaatcttgacntctggcctagtttagcctacttctggtcttgtaga

SEQ ID NO: 19679 - DNA, 71 bp, chicken (Gallus Gallus)
  misc_feature (36): n=c or t
tgaaagactgggtttgtgtctctgtgaagcaccagngattttctgacactctgtgaagtgttcaggtccac

SEQ ID NO: 19680 - DNA, 71 bp, chicken (Gallus Gallus)
  misc_feature (36): n=c or t
ataatgactgtttaatttccagtgcacagcctaaangtttttaacaactctaatagtaatttgaagtttca

SEQ ID NO: 19681 - DNA, 71 bp, chicken (Gallus Gallus)
  misc_feature (36): n=c or t
cagatttggaatactggtgggtaataagtgattttnggtagtgcgtttttttttcttgcttttgtgaataa

SEQ ID NO: 19682 - DNA, 71 bp, chicken (Gallus Gallus)
  misc_feature (36): n=c or g
ggaactacttgatgtttgtgtgcctggtatttgganagagtggaatattcttttcaggacacaacaattag

SEQ ID NO: 19683 - DNA, 71 bp, chicken (Gallus Gallus)
  misc_feature (36): n=a or g
tctggattgcagctgtggtcttgagcttcttacccncctcacccaatttggtaccacctacgaacttacca

SEQ ID NO: 19684 - DNA, 71 bp, chicken (Gallus Gallus)
  misc_feature (36): n=a or g
tcctagtcgactgttttcttaacttggagaaggacnctgaaagaatgatgaaaacctttcaatccacctct

SEQ ID NO: 19685 - DNA, 71 bp, chicken (Gallus Gallus)
  misc_feature (36): n=c or t
gagcaaaactgcaaacagcttggttctgggagatgntggtgtgccaagtcataaggtgcacataaaagatg

SEQ ID NO: 19686 - DNA, 71 bp, chicken (Gallus Gallus)
  misc_feature (36): n=a or g
ttgccctgttagcagccaggtgttgttatctatctngtatattcacccaggtaggctagtggagcgcatga

SEQ ID NO: 19687 - DNA, 71 bp, chicken (Gallus Gallus)
  misc_feature (36): n=a or g
tcacaatatttaacaggcctctattcactatcccanaagtttctacagtgggattttaaacagcagcataa

SEQ ID NO: 19688 - DNA, 71 bp, chicken (Gallus Gallus)
  misc_feature (36): n=c or t
atcctccatcctccttcattgcctgcttcacctcantcaagcagcaacttttaatttattacacctggagg

SEQ ID NO: 19689 - DNA, 71 bp, chicken (Gallus Gallus)
  misc_feature (36): n=c or t
ctaaaatcacagaggtgtctgagaaatctgtacttnacatgttcgcaacttgctgaaattgagataagtta

SEQ ID NO: 19690 - DNA, 71 bp, chicken (Gallus Gallus)
  misc_feature (36): n=a or c
ggctaccagtcctgggaaactcagtgtttttgaagntttccagtttgactgcagctgagctaagctcataa

SEQ ID NO: 19691 - DNA, 71 bp, chicken (Gallus Gallus)
  misc_feature (36): n=a or g
gctgatctgtaaggtcccattcagaaaatgtgggtncagtattcatttaaaatgactatagtagcactctg

SEQ ID NO: 19692 - DNA, 71 bp, chicken (Gallus Gallus)
  misc_feature (36): n=c or t
ttcaacttgcagatccgtttttaaaatagatctgancttttggcaaatttctgtaaacttacctggtatta

SEQ ID NO: 19693 - DNA, 71 bp, chicken (Gallus Gallus)
  misc_feature (36): n=a or t
caactgacttcctatctctggagttacaagagggancatgagctatggtctcccaccatgaggatgagcaa

SEQ ID NO: 19694 - DNA, 71 bp, chicken (Gallus Gallus)
  misc_feature (36): n=a or g
cagcttttgcatagagaaaagaaacattctgcactntcaatagttcaagtattttgccacagtactgaagt

SEQ ID NO: 19695 - DNA, 71 bp, chicken (Gallus Gallus)
  misc_feature (36): n=c or g
gtttactaagctgtgtttttatgtactggtgctagntcttactttgtatatcaagttccagggttgagtgg

SEQ ID NO: 19696 - DNA, 71 bp, chicken (Gallus Gallus)
  misc_feature (36): n=a or g
tccccaaaaaattgcacctgcatctgcatgaaaagngtaaggtcattttactctgatctacagtttggttc

SEQ ID NO: 19697 - DNA, 71 bp, chicken (Gallus Gallus)
  misc_feature (36): n=c or t
aatgaacacaatttagagggctttgtagtcttaccngtactttggtatttgaacattcgtaggagataatt

SEQ ID NO: 19698 - DNA, 71 bp, chicken (Gallus Gallus)
  misc_feature (36): n=c or t
actaacccaattttctttgtgtttcagggaaaactnggcgtgccagggctgcccggctacccgggcaggca

SEQ ID NO: 19699 - DNA, 71 bp, chicken (Gallus Gallus)
  misc_feature (36): n=a or g
atcctttgaggctaaaatagtactattggaaagagncagtttttgttagctatgagtgaggctcagtgatt

SEQ ID NO: 19700 - DNA, 71 bp, chicken (Gallus Gallus)
  misc_feature (36): n=a or g
ctctcctcagttgctggaaataaataaatcaacacntgtcatactacatacggggttgccagaagccagag

SEQ ID NO: 19701 - DNA, 71 bp, chicken (Gallus Gallus)
  misc_feature (36): n=a or g
aaaaaagaagttaattgataccattttcactagtanaagttctattcatcaataaaaggaaagggaacatt

SEQ ID NO: 19702 - DNA, 71 bp, chicken (Gallus Gallus)
  misc_feature (36): n=c or t
gttgcttaaaccaattaattttattttcactttcantttatcttttactgaatgctaccacatatcttcag

SEQ ID NO: 19703 - DNA, 71 bp, chicken (Gallus Gallus)
  misc_feature (36): n=g or t
ttaatacaatttatcactttgttaattactagtttncagcctgatccaggaattctttgtgcagttctgtt

SEQ ID NO: 19704 - DNA, 71 bp, chicken (Gallus Gallus)
  misc_feature (36): n=c or t
ggctctggtttggcaccgtttctagttttgaagacngtctcatgcaagctccaaataagaataatttcagt

SEQ ID NO: 19705 - DNA, 71 bp, chicken (Gallus Gallus)
  misc_feature (36): n=a or g
acatgtggcaaagttcagttactccaggggtgaacnttggcctttataccaaatacagggaagcacaggca

SEQ ID NO: 19706 - DNA, 71 bp, chicken (Gallus Gallus)
  misc_feature (36): n=a or t
agtaacatttgcgagttacgtattggagataggtcngaacttcagtctctgtatagcacagtgagcgcacc

SEQ ID NO: 19707 - DNA, 71 bp, chicken (Gallus Gallus)
  misc_feature (36): n=c or g
cctctgaagcacctgatgctgagcgttgtgaacaanaaggtttttatatccacagctgagaattttttttc

SEQ ID NO: 19708 - DNA, 71 bp, chicken (Gallus Gallus)
  misc_feature (36): n=a or g
ttaaagaacttgggcttcagggtcaaaagccagtcnactagaaatatacaaaaccacacacgcacagaaat

SEQ ID NO: 19709 - DNA, 71 bp, chicken (Gallus Gallus)
  misc_feature (36): n=g or t
agacaaagacaatggaattaatcacactttaccttntacacataatctttgcactgggggtgaaacgctca

SEQ ID NO: 19710 - DNA, 71 bp, chicken (Gallus Gallus)
  misc_feature (36): n=a or g
tgtctgtggccagacaacacggcagaccagagtcanttaaaagtcttgccacatttgccggtttgtatcat

SEQ ID NO: 19711 - DNA, 71 bp, chicken (Gallus Gallus)
  misc_feature (36): n=a or g
ctgccctatggaacatctgatactctctctgagcantgatctaccaatggattatttaaatatgaatcctt

SEQ ID NO: 19712 - DNA, 71 bp, chicken (Gallus Gallus)
  misc_feature (36): n=a or g
tagacagtagagttgaaaagatcccatctctgttgngcaatcatactgcattttaagaatgttttatttat

SEQ ID NO: 19713 - DNA, 71 bp, chicken (Gallus Gallus)
  misc_feature (36): n=a or g
ctatgattctctgagcagtctgtactcacaaccttncaatgctgtttattttaaagccttcgtacagtctg

SEQ ID NO: 19714 - DNA, 71 bp, chicken (Gallus Gallus)
  misc_feature (36): n=a or g
caaaatccagcacttgttccagttaaccttcattcngatggtgattgcccagacctctgatttatcaagat

SEQ ID NO: 19715 - DNA, 71 bp, chicken (Gallus Gallus)
  misc_feature (36): n=a or c
atattatagcactggagaaattcattttcaagatanagtccatctcctccatggtcatacattgtcccatt

SEQ ID NO: 19716 - DNA, 71 bp, chicken (Gallus Gallus)
  misc_feature (36): n=a or g
aagtttttaagccgttcatagaagttaaagaagctnttatgaggctgtaggatagcatgtgatagctttag

SEQ ID NO: 19717 - DNA, 71 bp, chicken (Gallus Gallus)
  misc_feature (36): n=c or g
gtaacttccagctgcagagccactacagagacgtanaacaggagaggttccttttctaatccaaatccata

SEQ ID NO: 19718 - DNA, 71 bp, chicken (Gallus Gallus)
  misc_feature (36): n=a or g
gggatggagagagaaaaattataatggaaggtcggncctcaaatcacagtgagtaaagcatgggctgctgg

SEQ ID NO: 19719 - DNA, 71 bp, chicken (Gallus Gallus)
  misc_feature (36): n=c or t
gtccagaacttatcttctgccaaactgaatttcttngatggttaaacttgggtcttgccaaagttgcatat

SEQ ID NO: 19720 - DNA, 71 bp, chicken (Gallus Gallus)
  misc_feature (36): n=a or g
tagaaaaagctaccatgctttcctgtgcttttaacnttagcaatagaaatacaatccaccaacccccaagt

SEQ ID NO: 19721 - DNA, 71 bp, chicken (Gallus Gallus)
  misc_feature (36): n=c or t
gagtatattactcaaactgtatttcgagatcctttnagctcatgccatttaacttttttcttttccttgtg

SEQ ID NO: 19722 - DNA, 71 bp, chicken (Gallus Gallus)
  misc_feature (36): n=a or g
agcctcaagttccgatcgttccagtttctgaagccnctcatgtgattctcataggagctctcataactgga

SEQ ID NO: 19723 - DNA, 71 bp, chicken (Gallus Gallus)
  misc_feature (36): n=a or g
atttgcttgcaaagcttccttgcaaattccagtgcnagaataactttgttcttctccagagggctgtagct

SEQ ID NO: 19724 - DNA, 71 bp, chicken (Gallus Gallus)
  misc_feature (36): n=g or t
tgctgtggtttgcaaagtacagtactcatgtgtttnggaaaaaactgtctttcacacaaaaactgctaaga

SEQ ID NO: 19725 - DNA, 71 bp, chicken (Gallus Gallus)
  misc_feature (36): n=c or t
atattttcctaatcgccagctaaacactttcagganaaatccctataaaaagctggtatttttctttctaa

SEQ ID NO: 19726 - DNA, 71 bp, chicken (Gallus Gallus)
  misc_feature (36): n=a or t
gcccttggctgaggggttgcggctaatgttatgtgngccagggacttattcagtgtcttttaccaggtaac

SEQ ID NO: 19727 - DNA, 71 bp, chicken (Gallus Gallus)
  misc_feature (36): n=a or g
acatagaggaaatatgacaaatgcatatttaagggntatttgtgtataccagtttgctaaggtgaagcgtg

SEQ ID NO: 19728 - DNA, 71 bp, chicken (Gallus Gallus)
  misc_feature (36): n=a or g
aagccttgtcaggattacctgacagagcctgattcnttcagcaggtaggcgacttgttgtatatgcttctc

SEQ ID NO: 19729 - DNA, 71 bp, chicken (Gallus Gallus)
  misc_feature (36): n=a or g
tttgctgctgagagagcaccgagcagcagcatcccntaccgcctggcagctaaactagagctttcccacag

SEQ ID NO: 19730 - DNA, 71 bp, chicken (Gallus Gallus)
  misc_feature (36): n=c or g
ttcaccccatggtgaaaccacttccgtatcttctgntccataagcctgtttgtgtatccttccactaaaaa

SEQ ID NO: 19731 - DNA, 71 bp, chicken (Gallus Gallus)
  misc_feature (36): n=a or g
tatggcatgcctcatccctaacgtacttcaacttcngcacatgtaaaacagcattagcacctcgctgtgcc

SEQ ID NO: 19732 - DNA, 71 bp, chicken (Gallus Gallus)
  misc_feature (36): n=a or t
ggccacatgatttccaatgcaagttggtataactgntattactgtgttatatatgtaattaaaatacatta

SEQ ID NO: 19733 - DNA, 71 bp, chicken (Gallus Gallus)
  misc_feature (36): n=c or g
ggtttacactctctgggagtaagcataaagctgaantatctggagacagctccgtatagcatgctgccact

SEQ ID NO: 19734 - DNA, 71 bp, chicken (Gallus Gallus)
  misc_feature (36): n=a or g
caaaaataatagtaaaggtagggtttgctaaagtancatccaaaggatataaaatccgtttgaggcagcaa

SEQ ID NO: 19735 - DNA, 71 bp, chicken (Gallus Gallus)
  misc_feature (36): n=c or t
tctagtctactttcccttcccaagtcaggatctgtnctccttttggtatcccaaaggaatgtttatctgat

SEQ ID NO: 19736 - DNA, 71 bp, chicken (Gallus Gallus)
  misc_feature (36): n=a or g
ggacaaagtgacggcccacaggggaaacttaccaancagcaacacagaaattaagtattaaagtggtgctt

SEQ ID NO: 19737 - DNA, 71 bp, chicken (Gallus Gallus)
  misc_feature (36): n=a or c
acagaggctcaaagcattccctatcccaaaggtatncaaagttttaagggcttttaaccaccgattttaca

SEQ ID NO: 19738 - DNA, 71 bp, chicken (Gallus Gallus)
  misc_feature (36): n=a or g
ttcctccatactgtaatttgacagcaagctcacagnacagaataccaataataattcataactatttcctt

SEQ ID NO: 19739 - DNA, 71 bp, chicken (Gallus Gallus)
  misc_feature (36): n=a or g
aagcttagttgtaaaataccaaaaaagtcatgttgntgtttagtaatgagcactcatactactctcatact

SEQ ID NO: 19740 - DNA, 71 bp, chicken (Gallus Gallus)
  misc_feature (36): n=a or c
ttgaaaacaaaacagcatgaaaggatgagcatgtangatcagatatcgtgtttaatatctgatattttctt

SEQ ID NO: 19741 - DNA, 71 bp, chicken (Gallus Gallus)
  misc_feature (36): n=g or t
ttgagcctgtctcccactttactgcaagacttgaanatattttcacctctgtataaaaatcaatgaacacc

SEQ ID NO: 19742 - DNA, 71 bp, chicken (Gallus Gallus)
  misc_feature (36): n=a or g
aatcaatctatgtttttctgtcctactctgagcacngtcaggagacatagctcactctcttaccaaagtta

SEQ ID NO: 19743 - DNA, 71 bp, chicken (Gallus Gallus)
  misc_feature (36): n=a or g
cgtgcacttggtgtgcgttgtaaccatatgtacacntctccagtttatttttaaaaggtcaccatcctgct

SEQ ID NO: 19744 - DNA, 71 bp, chicken (Gallus Gallus)
  misc_feature (36): n=a or c
tgcttctcatagaaaagtgctgctgctgtgtgttanaaatgtgtgtacagaacataacaggtgccattact

SEQ ID NO: 19745 - DNA, 71 bp, chicken (Gallus Gallus)
  misc_feature (36): n=a or g
caaagatgcaaggcattcctgaagcagagaaggctngagaagctgccaggtacacaggtactcaagcgcag

SEQ ID NO: 19746 - DNA, 71 bp, chicken (Gallus Gallus)
  misc_feature (36): n=c or t
gggaagcatgcgggaaattttgcagtcttttatatnatggtcccacagacaaaaaatcagggatcccatgg

SEQ ID NO: 19747 - DNA, 71 bp, chicken (Gallus Gallus)
  misc_feature (36): n=g or t
ttaagattgtgagatttaccattgtgtttataatanaaacaattggcactgagtggatgaattttttatcc

SEQ ID NO: 19748 - DNA, 71 bp, chicken (Gallus Gallus)
  misc_feature (36): n=g or t
ttcttatcagctggcaaagtttctaaggaacacaancctatggaaaagccatccctaattgaaccaagtct

SEQ ID NO: 19749 - DNA, 71 bp, chicken (Gallus Gallus)
  misc_feature (36): n=a or g
agacgacatgaataaggcgtgactgagaagtgaggnatgctttcctctgcaaagatagggctgataaaagt

SEQ ID NO: 19750 - DNA, 71 bp, chicken (Gallus Gallus)
  misc_feature (36): n=c or t
ggtgttcctgttcactgcaagagagttggattgganggcctttaaagtcccatgcaattcaaacaattcta

SEQ ID NO: 19751 - DNA, 71 bp, chicken (Gallus Gallus)
  misc_feature (36): n=c or g
ttagaactttcctgaagctttggagtaagagaaaanaaatcttctgtcaaacacttaaaaatactttgtgc

SEQ ID NO: 19752 - DNA, 71 bp, chicken (Gallus Gallus)
  misc_feature (36): n=c or t
agtggtgggatgagtgtctgtgaaggatcttcattngttaaaatttcatctgtgtatctctgaaaaaaaac

SEQ ID NO: 19753 - DNA, 71 bp, chicken (Gallus Gallus)
  misc_feature (36): n=a or c
gataagtgttcttcatatgggtttcatctgagcagnttttgatgtctatgttgggttgaattacattatcc

SEQ ID NO: 19754 - DNA, 71 bp, chicken (Gallus Gallus)
  misc_feature (36): n=c or t
tgttgaacactttcagcgcatctttaaagctgctantgcacactgaccatagcagtcttcacgaggagggg

SEQ ID NO: 19755 - DNA, 71 bp, chicken (Gallus Gallus)
  misc_feature (36): n=a or g
acccatttattttgaaaaaaccacatttgtagcacnttacagattatggtttcttacttaacactgctgtg

SEQ ID NO: 19756 - DNA, 71 bp, chicken (Gallus Gallus)
  misc_feature (36): n=a or c
atatatatgaggattctctctttatttaatttctcncatttttcatttagagtggctaggcccatttgtct

SEQ ID NO: 19757 - DNA, 71 bp, chicken (Gallus Gallus)
  misc_feature (36): n=c or t
acacctgggtttcccggccttaaagggctgggagcnatagcttcagcttcccttagcaataaaaaaggcag

SEQ ID NO: 19758 - DNA, 71 bp, chicken (Gallus Gallus)
  misc_feature (36): n=a or g
caggatctattgcagctccccacaaattaagccacngtagaagcagcatttccgaaagaagatcagcaagg

SEQ ID NO: 19759 - DNA, 71 bp, chicken (Gallus Gallus)
  misc_feature (36): n=a or g
ttatcatgtttgtatctgttgcttttagagaagagnttgtttttttttttttctctttcagaaatttggca

SEQ ID NO: 19760 - DNA, 71 bp, chicken (Gallus Gallus)
  misc_feature (36): n=c or t
ttgtatgtcttcttgctttttctgtttaaaggtttnaatggagaatgtgatgaatgttgttagaggaaact

SEQ ID NO: 19761 - DNA, 71 bp, chicken (Gallus Gallus)
  misc_feature (36): n=c or t
cctctgcagaactaggtggtcagcctaattatcatntgccatgataaaatagctttaatctccatgcaaag

SEQ ID NO: 19762 - DNA, 71 bp, chicken (Gallus Gallus)
  misc_feature (36): n=a or g
taactacttgggatcagaagagttttgggctttggncttcaggaacctgttgagcattatattaccatcca

SEQ ID NO: 19763 - DNA, 71 bp, chicken (Gallus Gallus)
  misc_feature (36): n=a or g
ttttgatttcctaatctagtcagctaactgggactngatttgaggaggggaaaagacatatggtaaggggt

SEQ ID NO: 19764 - DNA, 71 bp, chicken (Gallus Gallus)
  misc_feature (36): n=c or g
ctctgcaaacagtacgtagtgaaggatttctctgtnttggtacatttactctgacaatctcattcagcagg

SEQ ID NO: 19765 - DNA, 71 bp, chicken (Gallus Gallus)
  misc_feature (36): n=a or g
aatgtctgataataaggaaaacgtttgctctaaacntttgataataaggaaaacgtttgctctaaacgtta

SEQ ID NO: 19766 - DNA, 71 bp, chicken (Gallus Gallus)
  misc_feature (36): n=a or g
ccaaccacacaaaatgaacagctcaagtaataaatnagcaggtcttcagattaattattctcagtatgagc

SEQ ID NO: 19767 - DNA, 71 bp, chicken (Gallus Gallus)
  misc_feature (36): n=g or t
cagttcataacatattttccttggaaatcaagagcnttcctcactggaggtttttgatcaaaatcttggca

SEQ ID NO: 19768 - DNA, 71 bp, chicken (Gallus Gallus)
  misc_feature (36): n=a or g
agaagggagaaagataaaatgtgtaaggtgaagggnaaaggcagaggcagataggagactgatttgaaagg

SEQ ID NO: 19769 - DNA, 71 bp, chicken (Gallus Gallus)
  misc_feature (36): n=c or t
attaataagcagaagatattttcttgccttctgttntactattcatagattttcagtcacattacaacact

SEQ ID NO: 19770 - DNA, 71 bp, chicken (Gallus Gallus)
  misc_feature (36): n=a or t
ttacggcaaggaacatggtctccttctcagagccanctgaagttttatttatcaaattctttgcaaatctg

SEQ ID NO: 19771 - DNA, 71 bp, chicken (Gallus Gallus)
  misc_feature (36): n=a or g
gcacaccttcacctcttaattataattagagttcantaaaaacattcctatttatttgatttattttacca

SEQ ID NO: 19772 - DNA, 71 bp, chicken (Gallus Gallus)
  misc_feature (36): n=a or g
accccatcacatccaggcaaaattcaaacaaaatancacccacctaactgaggacgctggtcttctgtttt

SEQ ID NO: 19773 - DNA, 71 bp, chicken (Gallus Gallus)
  misc_feature (36): n=c or t
attggaactgattgccagtcaagaagttccctggtnaaaatgggaagtgttctgtactacctgtggaagtg

SEQ ID NO: 19774 - DNA, 71 bp, chicken (Gallus Gallus)
  misc_feature (36): n=c or t
taaggcaaaccactctggacctcaccccaaaacctnttcttccaatcagccaagcgaccatgaatgtgtgc

SEQ ID NO: 19775 - DNA, 71 bp, chicken (Gallus Gallus)
  misc_feature (36): n=c or t
caaaatcatttgcacttaaaatatctagccctgganctttaaaggtaccttaataacccattgaaatcagc

SEQ ID NO: 19776 - DNA, 71 bp, chicken (Gallus Gallus)
  misc_feature (36): n=a or g
atcctggcactgtgatcactgacattcaaatctccnttctacagaccagtgactgctgggaaggatgcctt

SEQ ID NO: 19777 - DNA, 71 bp, chicken (Gallus Gallus)
  misc_feature (36): n=a or t
atttgttcggtcctctaatttccttgctcagacttntaaccaaagaaaattacaggaaataagaacaaaaa

SEQ ID NO: 19778 - DNA, 71 bp, chicken (Gallus Gallus)
  misc_feature (36): n=c or t
gctgggtagaaaaagtccctgtgagtattgttgacnagatagagaccttgtcttcttaatagctgttgcag

SEQ ID NO: 19779 - DNA, 71 bp, chicken (Gallus Gallus)
  misc_feature (36): n=c or t
tgctttcttcatcaggatgaaaggctttcctgtgangcttctgtttctcctcctattcacataaatgccat

SEQ ID NO: 19780 - DNA, 71 bp, chicken (Gallus Gallus)
  misc_feature (36): n=c or t
cccttctttgaaccctcttgaaaatatttaggccangtttatcagaaagtagaggtaagttttgaggcgtg

SEQ ID NO: 19781 - DNA, 71 bp, chicken (Gallus Gallus)
  misc_feature (36): n=c or g
atgctacttaaacagtgaaaaattcactcaaaaaanttaggagagacacatagtaacactcaaaccatcat

SEQ ID NO: 19782 - DNA, 71 bp, chicken (Gallus Gallus)
  misc_feature (36): n=c or t
tggcagacggcacatgcgacggagtgctgactctgngtatctccaaaaatggtcataattgtacagcaaag

SEQ ID NO: 19783 - DNA, 71 bp, chicken (Gallus Gallus)
  misc_feature (36): n=c or t
caatggccaaatgtgtcctggatagatacatttacnacctcacaaaactgtagcatcaagctgtatctggg

SEQ ID NO: 19784 - DNA, 71 bp, chicken (Gallus Gallus)
  misc_feature (36): n=c or t
tcatcttatccctgttgcaaagctgaacagaattgngttcctgaaaagctctctgccaattatactgaagc

SEQ ID NO: 19785 - DNA, 71 bp, chicken (Gallus Gallus)
  misc_feature (36): n=a or t
caagaaagaaaaatcccactgaactgaaatcacttngtgatcttcagtcaaagtttagtaagagtagaagg

SEQ ID NO: 19786 - DNA, 71 bp, chicken (Gallus Gallus)
  misc_feature (36): n=a or g
gtgctgtcacaactgaccctgataaagagtctgtcnccttccttcttatagccttcagctaccttcaggac

SEQ ID NO: 19787 - DNA, 71 bp, chicken (Gallus Gallus)
  misc_feature (36): n=a or g
cctgagaaaagcaggatgtgttaaatccagtgctcntgtcaccatgtggattacagtttttccccacgtga

SEQ ID NO: 19788 - DNA, 71 bp, chicken (Gallus Gallus)
  misc_feature (36): n=a or g
tctattgtctgtgttttgagacatatgatctagcanaagtcatgagaccaacaacgatatatcctttggta

SEQ ID NO: 19789 - DNA, 71 bp, chicken (Gallus Gallus)
  misc_feature (36): n=a or g
gttaattatcaaatgtgtctttttcaaacctgtaantactgtgcacactaaaatgccacatgatggcatga

SEQ ID NO: 19790 - DNA, 71 bp, chicken (Gallus Gallus)
  misc_feature (36): n=a or g
catgattaaaaactcgttggttgaagatttaaatgngtttaggattggcatggtgtcaccattgtgcaaat

SEQ ID NO: 19791 - DNA, 71 bp, chicken (Gallus Gallus)
  misc_feature (36): n=a or g
gcaaaatctgagtgcctttgaatacaatacagagcnttgctgtgctgcagacccttagtaaggttccataa

SEQ ID NO: 19792 - DNA, 71 bp, chicken (Gallus Gallus)
  misc_feature (36): n=c or t
tggcttttattagcaaagatcttttctcagaaactngaaaaccctcccgacttcgcttcttgctcagctcc

SEQ ID NO: 19793 - DNA, 71 bp, chicken (Gallus Gallus)
  misc_feature (36): n=a or g
atccatcactttgggagactctgccatctgtgtgantcctcatatgttgaactcaaaccacttgttttaca

SEQ ID NO: 19794 - DNA, 71 bp, chicken (Gallus Gallus)
  misc_feature (36): n=c or t
acttataagcactgcatatagcaaatcaactggagngtcagtgacagctattagccgaagactttaattgc

SEQ ID NO: 19795 - DNA, 71 bp, chicken (Gallus Gallus)
  misc_feature (36): n=c or t
ttttaaacagaacatagaactaaaagaaaaacaaanagaggaaaaaaaatccttcaaactcaaaagaaata

SEQ ID NO: 19796 - DNA, 71 bp, chicken (Gallus Gallus)
  misc_feature (36): n=c or t
ttcatctcatcccactgtcctgcttcgtatctagtnctcacataaaatcattctgccagatccagaaagtc

SEQ ID NO: 19797 - DNA, 71 bp, chicken (Gallus Gallus)
  misc_feature (36): n=c or g
acgtaaggacagcaattttgttcatttccttcactntactcttggcttctgtgaaagctgagactaaaatt

SEQ ID NO: 19798 - DNA, 71 bp, chicken (Gallus Gallus)
  misc_feature (36): n=c or g
tacagagtcttttgggagtaacgtcttttgcaaaanttacagtgatagaacttgtatacaaagtttaagtc

SEQ ID NO: 19799 - DNA, 71 bp, chicken (Gallus Gallus)
  misc_feature (36): n=a or g
tgaggactgagagaaggcaaagctgcaccagcttcntctatgtggtgcagtagcactgtgagacatatatt

SEQ ID NO: 19800 - DNA, 71 bp, chicken (Gallus Gallus)
  misc_feature (36): n=a or t
ttctcactgcaaggagctctgaccactacacagctncatgtccacgtggggtccaataaatacaaataaca

SEQ ID NO: 19801 - DNA, 71 bp, chicken (Gallus Gallus)
  misc_feature (36): n=c or t
ctgttccttctcctttcagttattagagatgctaangtggtgcagctggatgtagactcagaagtcaacca

SEQ ID NO: 19802 - DNA, 71 bp, chicken (Gallus Gallus)
  misc_feature (36): n=c or t
gtcagatcaaaagtccttttaagttagcgtgcttcnattggcttaagtgatatttcacctgtttatatcac

SEQ ID NO: 19803 - DNA, 71 bp, chicken (Gallus Gallus)
  misc_feature (36): n=c or t
ttggtatgatgacagtggatgattaaaaaacaaagnggttaatgggaatttatccctgttgcaatatattc

SEQ ID NO: 19804 - DNA, 71 bp, chicken (Gallus Gallus)
  misc_feature (36): n=a or g
aaagtatgcctagttagcatagtagagagagggatnctagtctggagtaacaaaagttgatttatgttgtt

SEQ ID NO: 19805 - DNA, 71 bp, chicken (Gallus Gallus)
  misc_feature (36): n=c or t
gacctgcaaggaagcttctgcacaggttgtggtagngccctataattactcatcctgttcattctcagtgt

SEQ ID NO: 19806 - DNA, 71 bp, chicken (Gallus Gallus)
  misc_feature (36): n=a or g
atgtgagatctatgcatcccctcccatccagatcangagagtatccatgttgggtggagctcttcctatac

SEQ ID NO: 19807 - DNA, 71 bp, chicken (Gallus Gallus)
  misc_feature (36): n=a or g
ttctgtaatgataaatcaaagcaaagtgagcagcantaacaccatatataccagcgttcacagtacctgaa

SEQ ID NO: 19808 - DNA, 71 bp, chicken (Gallus Gallus)
  misc_feature (36): n=c or t
ctaatgtgatatcaaagtacctgtctgcacagaaantgtgtatcaaacatgaattcatcttccaacttaat

SEQ ID NO: 19809 - DNA, 71 bp, chicken (Gallus Gallus)
  misc_feature (36): n=c or t
cttctctcagcgtttgtgcagcaatacaacaaaatnagttatctattgtttttaaaaaagatttaaaaagt

SEQ ID NO: 19810 - DNA, 71 bp, chicken (Gallus Gallus)
  misc_feature (36): n=g or t
tgctttgttgggtcactcagttctcaattgatgccnactaatagccatgggatgctaaaaggcataattgg

SEQ ID NO: 19811 - DNA, 71 bp, chicken (Gallus Gallus)
  misc_feature (36): n=c or t
acttataagcatgctgttagctttattcctcataangaaagcttcacctaaaaatgcctcctaaaaaaaaa

SEQ ID NO: 19812 - DNA, 71 bp, chicken (Gallus Gallus)
  misc_feature (36): n=a or t
cacagtgtgggtgatttcacagaattaatactcatncagaactgctgtgaaacttggccagaaacgtgttt

SEQ ID NO: 19813 - DNA, 71 bp, chicken (Gallus Gallus)
  misc_feature (36): n=a or g
atataggcgacactaattccatacagagactaaaangactaaaaactcccatgtacttaacaatacagcac

SEQ ID NO: 19814 - DNA, 71 bp, chicken (Gallus Gallus)
  misc_feature (36): n=c or g
gctggaggttattgcagtgcctcttctggagtgatncagtcctcactagagggacttctaattccaatttc

SEQ ID NO: 19815 - DNA, 71 bp, chicken (Gallus Gallus)
  misc_feature (36): n=c or g
tcacttgatagtattgggtatcatacagttaggatntcgggggaatacaattggctgcttatacacatttg

SEQ ID NO: 19816 - DNA, 71 bp, chicken (Gallus Gallus)
  misc_feature (36): n=c or g
ctctttcgatgttctgattttgagttatcgcagtanctcctcaaaagaaagcaaatgctgtaccgtacctt

SEQ ID NO: 19817 - DNA, 71 bp, chicken (Gallus Gallus)
  misc_feature (36): n=a or g
ccagttccagtaacagctgggtcaaggtgctgtgcnttttaatcttgtatgttttatgtattagctctatc

SEQ ID NO: 19818 - DNA, 71 bp, chicken (Gallus Gallus)
  misc_feature (36): n=c or t
caggactaggtgggcctttgttctgataccatatanccatttctgcacttctgctattccctgttgtctgt

SEQ ID NO: 19819 - DNA, 71 bp, chicken (Gallus Gallus)
  misc_feature (36): n=c or t
aatttttaggtatggatgattcattctgagcagcgntgaaggagtcttgaaaacttctgtctctttttttt

SEQ ID NO: 19820 - DNA, 71 bp, chicken (Gallus Gallus)
  misc_feature (36): n=c or t
agatgaatacatattcattgtttccaattgcatcantcatgttgtcacgatttgttttctgatatactata

SEQ ID NO: 19821 - DNA, 71 bp, chicken (Gallus Gallus)
  misc_feature (36): n=g or t
ccctaagtatgacatctaacctttccttaaacaccnccaaggacagtgactccaccacttcctttggtagc

SEQ ID NO: 19822 - DNA, 71 bp, chicken (Gallus Gallus)
  misc_feature (36): n=a or c
atccttttctatgaatatatgagagaaatctctctntatatattcatttatctctccagttgagttacttt

SEQ ID NO: 19823 - DNA, 71 bp, chicken (Gallus Gallus)
  misc_feature (36): n=a or t
ttcattcactaaaaaaagagacatcactagcatgcngatttaacttgttaggtttatgttcagtatttcca

SEQ ID NO: 19824 - DNA, 71 bp, chicken (Gallus Gallus)
  misc_feature (36): n=c or t
agaagaacaatgtgctcctgactgacctcacacttntcacaaatagctgggatgatgttgtgaaggggcac

SEQ ID NO: 19825 - DNA, 71 bp, chicken (Gallus Gallus)
  misc_feature (36): n=a or t
attgtaacatagattagttatttaaatgaaggaagnggatgtctttcatcaaataaggcaagagaaaatag

SEQ ID NO: 19826 - DNA, 71 bp, chicken (Gallus Gallus)
  misc_feature (36): n=a or g
tgagcatccctggccacctgctgggccagatggagntgctcaatgggtcgagtggaagaagacccactgag

SEQ ID NO: 19827 - DNA, 71 bp, chicken (Gallus Gallus)
  misc_feature (36): n=g or t
aggcaggagggtgacagcttgaagaagattccaaangagagccgatactgagttttgacttcaaaaattcg

SEQ ID NO: 19828 - DNA, 71 bp, chicken (Gallus Gallus)
  misc_feature (36): n=c or t
cagactgcccttttccagaagactgaagtgaaacangtgagcttcagcttctcagattcttgcaagatata

SEQ ID NO: 19829 - DNA, 71 bp, chicken (Gallus Gallus)
  misc_feature (36): n=a or g
ttaattgataatgtatgaattaaagcttctctgatnttgcagaaacttgcacatcctcaatttttcaaaca

SEQ ID NO: 19830 - DNA, 71 bp, chicken (Gallus Gallus)
  misc_feature (36): n=a or c
ctcaccctcagaattatagtcagaatactgatttantctgttcatgccatatcagcagaaccagacccaat

SEQ ID NO: 19831 - DNA, 71 bp, chicken (Gallus Gallus)
  misc_feature (36): n=c or t
gtaagaattaagatacggtacgatgtaaagtgcatnggggacagtgttaaatacagtctcagtgtgcatag

SEQ ID NO: 19832 - DNA, 71 bp, chicken (Gallus Gallus)
  misc_feature (36): n=c or t
tttggaatcaaagacgttttcaaatctttgcatatnagcgccaactcctgccaaatacaccacagctcagg

SEQ ID NO: 19833 - DNA, 71 bp, chicken (Gallus Gallus)
  misc_feature (36): n=a or g
ccaaccttgtttgcactgcaggatagggttaagcancttggtcatggtctctatttgaaaactaagctcca

SEQ ID NO: 19834 - DNA, 71 bp, chicken (Gallus Gallus)
  misc_feature (36): n=a or g
actgtaaaatattgtaatcactgccgtgtactacantctcctacagtatatggggagagaacaatttatgt

SEQ ID NO: 19835 - DNA, 71 bp, chicken (Gallus Gallus)
  misc_feature (36): n=a or g
atcaagtcattgatcagtaatgaatgaatagatccncaataattcacaaaatatacactacaggagtagct

SEQ ID NO: 19836 - DNA, 71 bp, chicken (Gallus Gallus)
  misc_feature (36): n=c or t
caaaccattctgtgattctacgatcagggaagatangaagggacagtgatcctaaggaagataattcataa

SEQ ID NO: 19837 - DNA, 71 bp, chicken (Gallus Gallus)
  misc_feature (36): n=a or g
caggtgagtttttaataggattcattaagtactctntaagatgagctctgctgaaacaaaaccaggaggga

SEQ ID NO: 19838 - DNA, 71 bp, chicken (Gallus Gallus)
  misc_feature (36): n=a or c
agtaatgaagttttcagatgttacggaactgcacangagtgatattgcctactgtttttcaggaaggtata

SEQ ID NO: 19839 - DNA, 71 bp, chicken (Gallus Gallus)
  misc_feature (36): n=c or t
cattttatttgatttattagttccagttcaaattanattgtattatattgtattatagtgtgttgtcttgc

SEQ ID NO: 19840 - DNA, 71 bp, chicken (Gallus Gallus)
  misc_feature (36): n=c or t
atgcacaggctagcattctcaccccaaaacaccacnttccaacatgaaggaaatttggtttgtactccaga

SEQ ID NO: 19841 - DNA, 71 bp, chicken (Gallus Gallus)
  misc_feature (36): n=c or t
aaatctgctaatataaagagtctggttacaaattcnttgaatccaacctacattcacccagcataaattgt

SEQ ID NO: 19842 - DNA, 71 bp, chicken (Gallus Gallus)
  misc_feature (36): n=a or g
cctccttcccctgcactcttctcagcttcagcatanaagtacattttgtcctatgttaacttctcaggata

SEQ ID NO: 19843 - DNA, 71 bp, chicken (Gallus Gallus)
  misc_feature (36): n=a or c
catacctttgcttagatattcaaattctctgaaacnacaattacagctgtaaaaagttttgtttgtatttt

SEQ ID NO: 19844 - DNA, 71 bp, chicken (Gallus Gallus)
  misc_feature (36): n=c or t
ccttggctgtaatttttttctttttttttttttttncccaattcattaatattgcacaaatgttgtttaaa

SEQ ID NO: 19845 - DNA, 71 bp, chicken (Gallus Gallus)
  misc_feature (36): n=a or g
taacaagggcactgagaggcaacggtcatctcaagnggccgtgaagaacccagatagaagaactcttccaa

SEQ ID NO: 19846 - DNA, 71 bp, chicken (Gallus Gallus)
  misc_feature (36): n=a or c
tctaaatccagcacaagctatctgcactctcttctntatcaaatcactttgtggagtttttcccccacatc

SEQ ID NO: 19847 - DNA, 71 bp, chicken (Gallus Gallus)
  misc_feature (36): n=a or g
ctacatatatgttaatattcgtaaatatgtaacctntctacctgtttatctatctgtggatttttgttgta

SEQ ID NO: 19848 - DNA, 71 bp, chicken (Gallus Gallus)
  misc_feature (36): n=a or c
atgaaataactcactcttttattggagatcatttanatgagctttgaggtagatttatctcatccaaacag

SEQ ID NO: 19849 - DNA, 71 bp, chicken (Gallus Gallus)
  misc_feature (36): n=c or t
tagtagtgggtaggactgagaatatcaaacttcctnatggaaagaaccctgtggctgctaacagcagagtg

SEQ ID NO: 19850 - DNA, 71 bp, chicken (Gallus Gallus)
  misc_feature (36): n=a or g
atgcatgaacagagatcatcagtaagaagccaacanatgctgtgacacgggacatgtcacacatgtttgaa

SEQ ID NO: 19851 - DNA, 71 bp, chicken (Gallus Gallus)
  misc_feature (36): n=c or t
ggaactggtccacctccagcctatgaccacttccangctgatcttaggtcgggcttcatttgtgcataccc

SEQ ID NO: 19852 - DNA, 71 bp, chicken (Gallus Gallus)
  misc_feature (36): n=c or t
ctgaacaccggaggtagacagatgaaactcatgtanctcaccttgacacctcctaagaaaggtctctttcc

SEQ ID NO: 19853 - DNA, 71 bp, chicken (Gallus Gallus)
  misc_feature (36): n=a or g
atgagccttcacacgttatattgaaagtagagaacnatgggaaaacaaattcttagttctgtgaaagatta

SEQ ID NO: 19854 - DNA, 71 bp, chicken (Gallus Gallus)
  misc_feature (36): n=a or g
taatagtaccagtgacctgtatttccaggtgtctantagtttttctttttttctttaccaaaatgcttata

SEQ ID NO: 19855 - DNA, 71 bp, chicken (Gallus Gallus)
  misc_feature (36): n=a or t
tgtgtgtacatgatgcctggcaaactctacaattcnaatacttccaactcacaacattgctttgtcttttt

SEQ ID NO: 19856 - DNA, 71 bp, chicken (Gallus Gallus)
  misc_feature (36): n=c or g
tgttgcattcagaaaactgttttgaattcagagtantaaaaatgatacgctgctttgtgttattccataga

SEQ ID NO: 19857 - DNA, 71 bp, chicken (Gallus Gallus)
  misc_feature (36): n=c or g
ttaacacaaaagccatatacttactgcttactatantaactacccttttgtaaggcccttctcttggactg

SEQ ID NO: 19858 - DNA, 71 bp, chicken (Gallus Gallus)
  misc_feature (36): n=c or t
cggtgtccttgcctactcgggattctgaatgtagcngggtttaccttgtcctcacccgaacacaagggact

SEQ ID NO: 19859 - DNA, 71 bp, chicken (Gallus Gallus)
  misc_feature (36): n=a or g
aaaacacaaagtctgataagcccccagtacagactnctcatcagcagaagattctgcatgccaggacagca

SEQ ID NO: 19860 - DNA, 71 bp, chicken (Gallus Gallus)
  misc_feature (36): n=g or t
ttggtgtgataggcaagaggataaggacgtgtatgnacatacagaagcaactcctgtgctgacactcatcc

SEQ ID NO: 19861 - DNA, 71 bp, chicken (Gallus Gallus)
  misc_feature (36): n=c or t
gctactgtgatgctggctttgctataaatcactctnagtgtctgaattttaacttaatctcctaagttatt

SEQ ID NO: 19862 - DNA, 71 bp, chicken (Gallus Gallus)
  misc_feature (36): n=c or t
tgtttcaaacatactctttcccttcacttagcaacngtgactgatgagctgtaatttggctctgcttcact

SEQ ID NO: 19863 - DNA, 71 bp, chicken (Gallus Gallus)
  misc_feature (36): n=c or g
ggggcatccacagcctccttgggcaacctgttccantgcatcaccactacttctaacccatgaaccttaag

SEQ ID NO: 19864 - DNA, 71 bp, chicken (Gallus Gallus)
  misc_feature (36): n=c or t
tagaaaaggaccctagaaaagacacgcaagggctanggtgtgtagcttctggcccagaggtcctacagctt

SEQ ID NO: 19865 - DNA, 71 bp, chicken (Gallus Gallus)
  misc_feature (36): n=c or t
aaactgaagactacctgaatgtatcttattgatggnatcccctgtcaagaagttgatttaatagtgttatg

SEQ ID NO: 19866 - DNA, 71 bp, chicken (Gallus Gallus)
  misc_feature (36): n=c or t
taatggggtaaaacttcggtggagaggaaccaaagnggtgcacactatcagcagcaggacaacagcagcca

SEQ ID NO: 19867 - DNA, 71 bp, chicken (Gallus Gallus)
  misc_feature (36): n=a or g
agtgagatgagaagcccgataacaaaccgttggtgngggtcaggatgaggtgataccactttgcagtcctg

SEQ ID NO: 19868 - DNA, 71 bp, chicken (Gallus Gallus)
  misc_feature (36): n=c or t
tcccctggctgaagggggactgtcaaactgaaccanacagaaatacggggaaaatagtgttctcgaacaaa

SEQ ID NO: 19869 - DNA, 71 bp, chicken (Gallus Gallus)
  misc_feature (36): n=c or t
ctttggagatattctttgggctgacctaggaagatntaagccattgagcaacaagtcctttcctgcaaaat

SEQ ID NO: 19870 - DNA, 71 bp, chicken (Gallus Gallus)
  misc_feature (36): n=a or t
aacagtatgtatatccctcagcagacaaggaagtgngatcgtatgtaacagcatttcttatgctatgagaa

SEQ ID NO: 19871 - DNA, 71 bp, chicken (Gallus Gallus)
  misc_feature (36): n=a or c
tggacattagggctatttggatgatccacaccatcngtcatcaaaaaagccacttttatacttctctcgcg

SEQ ID NO: 19872 - DNA, 71 bp, chicken (Gallus Gallus)
  misc_feature (36): n=c or t
attttctcatgtttctatcaagaagttctgaatacntggtattgttatggatacgctgttgcatttcattt

SEQ ID NO: 19873 - DNA, 71 bp, chicken (Gallus Gallus)
  misc_feature (36): n=a or g
aaaattttagccagagcatagactgctgagctcagnttcacctagtacttgacaccactgctttgtagaaa

SEQ ID NO: 19874 - DNA, 71 bp, chicken (Gallus Gallus)
  misc_feature (36): n=c or t
cacgatcctatcactttggttcagttgaatacaaanccctttgacagtagggaaacagcaaaacaacattc

SEQ ID NO: 19875 - DNA, 71 bp, chicken (Gallus Gallus)
  misc_feature (36): n=a or t
ggattatcttaagaagtacaggaaagagaagagagntgagtgtttcataaacaatctagctagcctgatgg

SEQ ID NO: 19876 - DNA, 71 bp, chicken (Gallus Gallus)
  misc_feature (36): n=c or g
ggtattagatacatttgttattcaaccagatgcatngattgcaataggagtctcttggtacttcaagatgt

SEQ ID NO: 19877 - DNA, 71 bp, chicken (Gallus Gallus)
  misc_feature (36): n=c or t
acggtgctttctactgaaaacgcatcaaacaagtanacagtagtagtagtatgtgtttgcctgcacttctg

SEQ ID NO: 19878 - DNA, 71 bp, chicken (Gallus Gallus)
  misc_feature (36): n=a or g
aagggtgccacaggttgtacaaaaagtcacatttcncagaggatctgatgaatgattcagataacctagaa

SEQ ID NO: 19879 - DNA, 71 bp, chicken (Gallus Gallus)
  misc_feature (36): n=a or g
ctggagtgctttcacacttgctttcagtaaggcatnctacattccattactggaaatatttcttatttaga

SEQ ID NO: 19880 - DNA, 71 bp, chicken (Gallus Gallus)
  misc_feature (36): n=c or t
cacattctgtgggtggaatatatgggtaacttgtgngtcttgttggttgtttttagtacatcccgtgtcct

SEQ ID NO: 19881 - DNA, 71 bp, chicken (Gallus Gallus)
  misc_feature (36): n=a or g
aagatgctgcggtactgtgttctttaatggtctccncacactggagcttaaagctgtgtattgcatcagac

SEQ ID NO: 19882 - DNA, 71 bp, chicken (Gallus Gallus)
  misc_feature (36): n=c or t
aagcaattatctccttctagatgaggtcttctctcngttgttttccagacttgtgtctgatcagctgaaag

SEQ ID NO: 19883 - DNA, 71 bp, chicken (Gallus Gallus)
  misc_feature (36): n=a or g
aagtgcactaagtaccgttcacattcagagcagagntctgatcacattcttttatgttctccctgttatta

SEQ ID NO: 19884 - DNA, 71 bp, chicken (Gallus Gallus)
  misc_feature (36): n=c or t
ggttgtttctggaagcaaggcaaaagatgatcaaantgcaacaagaaaaagcaatcttttgggagcagaat

SEQ ID NO: 19885 - DNA, 71 bp, chicken (Gallus Gallus)
  misc_feature (36): n=a or g
aataagtggcaaaatacacatcaaaattaaaagtancagtatcttttcaactgtaatggaagcaagaatga

SEQ ID NO: 19886 - DNA, 71 bp, chicken (Gallus Gallus)
  misc_feature (36): n=a or g
catgctgtattagatgaatacaaagtactggataangagaaaaaggataaaaaatgagaacaatgaagtat

SEQ ID NO: 19887 - DNA, 71 bp, chicken (Gallus Gallus)
  misc_feature (36): n=c or t
tagaaatctgtgtattcctaaggtaaccacaaaagngtatcagttcattgctattttcagtgatgctttta

SEQ ID NO: 19888 - DNA, 71 bp, chicken (Gallus Gallus)
  misc_feature (36): n=g or t
tagttttcctactacaaagattatggtttctgtatncctgtaccttgttgcttttgcacaaacacatacgc

SEQ ID NO: 19889 - DNA, 71 bp, chicken (Gallus Gallus)
  misc_feature (36): n=g or t
aaactacagcacttgaaacttactcagtgctcagtnttcccatgtccgatcctatcagtgtcacagtggta

SEQ ID NO: 19890 - DNA, 71 bp, chicken (Gallus Gallus)
  misc_feature (36): n=a or t
gaatcttgtaatcatcatctcagtggctcatctatntggattcaaactctagtttgaatataatgctgctg

SEQ ID NO: 19891 - DNA, 71 bp, chicken (Gallus Gallus)
  misc_feature (36): n=a or g
tcagcatggtcatgatgatccctaacctaccaccanctttgccctgagcactgtccagcattcattagaag

SEQ ID NO: 19892 - DNA, 71 bp, chicken (Gallus Gallus)
  misc_feature (36): n=c or t
gctatccactttttaatcagaagtttatatgacaantattgaactgttgcaaattatggcctagcatatga

SEQ ID NO: 19893 - DNA, 71 bp, chicken (Gallus Gallus)
  misc_feature (36): n=g or t
gtgatgtggcaaatactttcagttgaagtgaatatntctgaagcatccaggttgttttgtctgcgtatgtg

SEQ ID NO: 19894 - DNA, 71 bp, chicken (Gallus Gallus)
  misc_feature (36): n=a or g
cccaggccattctgtgattctgtaatcttgcctttntacaggtttaattcctctttgcaacccatggacca

SEQ ID NO: 19895 - DNA, 71 bp, chicken (Gallus Gallus)
  misc_feature (36): n=c or t
tgggagccaacatgatttaccagcatatgcagcaanggaaaatcaataggtttattttggtttcagacacc

SEQ ID NO: 19896 - DNA, 71 bp, chicken (Gallus Gallus)
  misc_feature (36): n=a or c
gtacaatttttgtcagtttgttttggacacactgtnaagtagtatgtgcttattgtcatgttcatctaaga

SEQ ID NO: 19897 - DNA, 71 bp, chicken (Gallus Gallus)
  misc_feature (36): n=c or t
atacactaaagaaggagccttgaaataggaacgagngagagaaatttttctaaaaagctccttctttaatc

SEQ ID NO: 19898 - DNA, 71 bp, chicken (Gallus Gallus)
  misc_feature (36): n=a or c
atagaggaggggtgggaaaatgctcaacagccaggnaactttgtccctagcatctctttgacctgactcag

SEQ ID NO: 19899 - DNA, 71 bp, chicken (Gallus Gallus)
  misc_feature (36): n=a or g
ttccctcagggaggtgttgcagcccaactaaaaccnttgcacagggacagttctataggcactgatgcaca

SEQ ID NO: 19900 - DNA, 71 bp, chicken (Gallus Gallus)
  misc_feature (36): n=a or g
gcctccttgccttcgtaggggctgtcttccctcccntgaaacttgttctgggaatggtgggcatgctctgt

SEQ ID NO: 19901 - DNA, 71 bp, chicken (Gallus Gallus)
  misc_feature (36): n=c or g
tcccagaccagtgccttaaccacaagcccatctttntgctcagcttggtctttctgtctgcttcctgggca

SEQ ID NO: 19902 - DNA, 71 bp, chicken (Gallus Gallus)
  misc_feature (36): n=c or t
tgagtctggtttcaagctcatctgactgccactgangttacaggatggtccatgcactaagactgtgtacg

SEQ ID NO: 19903 - DNA, 71 bp, chicken (Gallus Gallus)
  misc_feature (36): n=a or g
aaagtgtaccttgcaggaaacagttttaccttagcngatattttgatgtactacggattgcatcatgtcat

SEQ ID NO: 19904 - DNA, 71 bp, chicken (Gallus Gallus)
  misc_feature (36): n=c or t
tgtcccttcaggatgctattcctatgatcagtaaantgagatacaatccaagatttgacaaggctttcaaa

SEQ ID NO: 19905 - DNA, 71 bp, chicken (Gallus Gallus)
  misc_feature (36): n=a or g
ttcccaggcaatactgtgtgataaggatgagagaangcgcaagatgtacaaactttttagctacaatcttg

SEQ ID NO: 19906 - DNA, 71 bp, chicken (Gallus Gallus)
  misc_feature (36): n=a or g
tataaaactcactttgataatgacctcagtgcacantgcaatattaatgcatttataagcagtgaggcaca

SEQ ID NO: 19907 - DNA, 71 bp, chicken (Gallus Gallus)
  misc_feature (36): n=g or t
ttccccagactgtatctccacacgactagagtaccncagggttttcttttggtcagcttcactgacaacac

SEQ ID NO: 19908 - DNA, 71 bp, chicken (Gallus Gallus)
  misc_feature (36): n=a or g
aaaggcattcaccaatgcactgctcagtctacactnccagcagtttaacatccttccttcagcattcaaca

SEQ ID NO: 19909 - DNA, 71 bp, chicken (Gallus Gallus)
  misc_feature (36): n=a or c
caaatgcgtggcactcagcagtgccatgagttcacngtgttgtgatctgaagcaggcagctattaaggtgg

SEQ ID NO: 19910 - DNA, 71 bp, chicken (Gallus Gallus)
  misc_feature (36): n=a or t
actgaagcagatcacggatctgatatttaattattncatgtgagtttttttccttccaaacagtgggattt

SEQ ID NO: 19911 - DNA, 71 bp, chicken (Gallus Gallus)
  misc_feature (36): n=c or t
acactctatcccactgtttgtcattaatcaagatgntgaatagtaccagtcccaagatggacccctggaga

SEQ ID NO: 19912 - DNA, 71 bp, chicken (Gallus Gallus)
  misc_feature (36): n=c or g
tgtttatagtgaacatcttcatacatcttaaagganagtctcatcttccgaatgcagaatgcactgttgag

SEQ ID NO: 19913 - DNA, 71 bp, chicken (Gallus Gallus)
  misc_feature (36): n=c or t
gaagaaaacatcaaaaaaatcagatcagattctcantgtcacgtaggaaatactgtttcttaatcagtccc

SEQ ID NO: 19914 - DNA, 71 bp, chicken (Gallus Gallus)
  misc_feature (36): n=a or c
cttacaggtcagcttcgaatcataaagaagaaaatncgagggaagcagagtttgcttttaggaagaaatgg

SEQ ID NO: 19915 - DNA, 71 bp, chicken (Gallus Gallus)
  misc_feature (36): n=a or g
agcagccactgatacaacttgaagatttagtgtgcntggaagttttacaaagagccacaacctcatcagtg

SEQ ID NO: 19916 - DNA, 71 bp, chicken (Gallus Gallus)
  misc_feature (36): n=c or t
atccacgtgaaaggtctgaacgagatactgtcattncactaaacttgaaattgtttatcagcttctagttc

SEQ ID NO: 19917 - DNA, 71 bp, chicken (Gallus Gallus)
  misc_feature (36): n=a or g
tcatactaaagaccagcagatttggttcctgaactntaaaatggaactttcagataaaattatagaccagc

SEQ ID NO: 19918 - DNA, 71 bp, chicken (Gallus Gallus)
  misc_feature (36): n=a or g
gcctgtaccgctgcatgggattcttcctttccaggnacagggcattgcatttgtctttgtcgacctttata

SEQ ID NO: 19919 - DNA, 71 bp, chicken (Gallus Gallus)
  misc_feature (36): n=a or g
tatttatatttctatttggcagcagaataacaattnctttgtccataaaagtgatgcaatatttacacaaa

SEQ ID NO: 19920 - DNA, 71 bp, chicken (Gallus Gallus)
  misc_feature (36): n=a or g
aattgattcataaatgagaaggtggcattcatctcngtgctcttattggaaacctaaatctcagtaaattt

SEQ ID NO: 19921 - DNA, 71 bp, chicken (Gallus Gallus)
  misc_feature (36): n=a or c
ttcacaattgatcctgcatcatccagttttgttctnagcttcttgataaaagaatgaattcttcttccagg

SEQ ID NO: 19922 - DNA, 71 bp, chicken (Gallus Gallus)
  misc_feature (36): n=a or t
ctgaataggactggagctgccttcaggttagggatnttcatcagagttgcttgaggtaagaaaaagaaaac

SEQ ID NO: 19923 - DNA, 71 bp, chicken (Gallus Gallus)
  misc_feature (36): n=g or t
tttctgaagtcattccctctgtctttgtggtgcagnggggccccagtttctatgtgagacatcacttcagc

SEQ ID NO: 19924 - DNA, 71 bp, chicken (Gallus Gallus)
  misc_feature (36): n=a or g
acaatggtttggagctctcctaaacctggggtggangaataacacaacaaacttgtaactgcaccatgaag

SEQ ID NO: 19925 - DNA, 71 bp, chicken (Gallus Gallus)
  misc_feature (36): n=a or c
tgtatgtactcccacagttcgtttcagcaccagcanttgaacttacataccatttaccaactccactctcc

SEQ ID NO: 19926 - DNA, 71 bp, chicken (Gallus Gallus)
  misc_feature (36): n=a or g
cccggcgggggcctgaaaggcaatgcccgggctgantggtaaggaacacaccgaagcgaacgtagtcagtt

SEQ ID NO: 19927 - DNA, 71 bp, chicken (Gallus Gallus)
  misc_feature (36): n=c or g
ggtctgctttggttatcattcctgctcttcagatanctctcgtgcaggtaacaaaatgatctaacttttta

SEQ ID NO: 19928 - DNA, 71 bp, chicken (Gallus Gallus)
  misc_feature (36): n=a or g
cactattttgggaggaggaggaataagtaaagatgntctgtccccaccctggggcttggacctcagggtaa

SEQ ID NO: 19929 - DNA, 71 bp, chicken (Gallus Gallus)
  misc_feature (36): n=c or g
gggggttgcagtattctatagacttctcttccaaanacttcctaaatctttgggcttcataactgcagttc

SEQ ID NO: 19930 - DNA, 71 bp, chicken (Gallus Gallus)
  misc_feature (36): n=c or t
tactaggattttcctttaatatattacaaatatctngtatgttgaaaaaggaatatgctatttttatatca

SEQ ID NO: 19931 - DNA, 71 bp, chicken (Gallus Gallus)
  misc_feature (36): n=c or g
cagagtagctatggaacgctgggggaaggcatgaantgccggccgcagctgaccagtgccctgaagagctc

SEQ ID NO: 19932 - DNA, 71 bp, chicken (Gallus Gallus)
  misc_feature (36): n=a or c
cagcttcaagtttatttccatagccatagcatttanaattcttgttctaggaaggaaagatagtggtgtta

SEQ ID NO: 19933 - DNA, 71 bp, chicken (Gallus Gallus)
  misc_feature (36): n=a or g
ctctcagctgtcagagtgcagatgaaaatctctccntaactcaaagcgccaaaccttttgtgcatccatac

SEQ ID NO: 19934 - DNA, 71 bp, chicken (Gallus Gallus)
  misc_feature (36): n=a or c
gcacagactcataacactgtgaatcaacataatcantagaaatgaaattctcagtgctcaccttgatgaga

SEQ ID NO: 19935 - DNA, 71 bp, chicken (Gallus Gallus)
  misc_feature (36): n=c or t
aggattggcagggaagaatggaagaactgcccttanggaaggggtgctgaaagtcacattgatttcctctg

SEQ ID NO: 19936 - DNA, 71 bp, chicken (Gallus Gallus)
  misc_feature (36): n=c or t
tagcgtagcctggattagagtggtttggagatgcanagggaaacaggaggaagagcagaaagcagagccta

SEQ ID NO: 19937 - DNA, 71 bp, chicken (Gallus Gallus)
  misc_feature (36): n=c or t
aaaagtagaggctgctttggcttttggagaatgagnctgttgtgccactgttttagatgacagctgaaaag

SEQ ID NO: 19938 - DNA, 71 bp, chicken (Gallus Gallus)
  misc_feature (36): n=a or c
catctgctctggtaacagaccttttcaccctagtgnttggggggtcagaagcatgtgatggagatctaagt

SEQ ID NO: 19939 - DNA, 71 bp, chicken (Gallus Gallus)
  misc_feature (36): n=c or g
ggcaagctcaccattaatactgaagatagaagatgngttctagcccacagaatctgttgtcagctgcataa

SEQ ID NO: 19940 - DNA, 71 bp, chicken (Gallus Gallus)
  misc_feature (36): n=a or t
aatattaatggtattgtttatgcagaactaaattcnctgcaaattcagaatcatagaatcaaagtatatcc

SEQ ID NO: 19941 - DNA, 71 bp, chicken (Gallus Gallus)
  misc_feature (36): n=c or t
tactttgacatcttaaggttaaacaaacaaaaccanactcttgtccatgctgagaaggtgaacctcaattt

SEQ ID NO: 19942 - DNA, 71 bp, chicken (Gallus Gallus)
  misc_feature (36): n=c or t
tgctgaagagagagaggtagaggtacaagtatcacnatgctaatgttggaataagactgcagaaagtcata

SEQ ID NO: 19943 - DNA, 71 bp, chicken (Gallus Gallus)
  misc_feature (36): n=a or t
tgcattcttccacatgagacacagtttagggcattnctaccattggagaggatacctcatctccattcatg

SEQ ID NO: 19944 - DNA, 71 bp, chicken (Gallus Gallus)
  misc_feature (36): n=c or t
tggtgtgtttctgatagaaggatttgggctgtttcnaacatcaaaacatagaactgaaaacttttcttttt

SEQ ID NO: 19945 - DNA, 71 bp, chicken (Gallus Gallus)
  misc_feature (36): n=c or g
ggtattacctttgaaaataataactctagtactacntatgatgaatgctaagtattaatgttgaccatggt

SEQ ID NO: 19946 - DNA, 71 bp, chicken (Gallus Gallus)
  misc_feature (36): n=a or g
tcgggagagaaagaaggtgccctcatctccagctcngcctttatgtctggtcatttgggcttccacaatga

SEQ ID NO: 19947 - DNA, 71 bp, chicken (Gallus Gallus)
  misc_feature (36): n=c or t
agacaagaagagattcacgttaattgggccaaacgnaactcagaaaaaatccttgaattcatttttttcta

SEQ ID NO: 19948 - DNA, 71 bp, chicken (Gallus Gallus)
  misc_feature (36): n=a or c
cagaaagcaaagcacctgacaagccacttagcaggnactttccctcaccacaaagactaatgtgtatctag

SEQ ID NO: 19949 - DNA, 71 bp, chicken (Gallus Gallus)
  misc_feature (36): n=c or t
aatcgaaacgtgtgacatgttggcacacagaattangacattcagtgactttgttctcaaacttattaaag

SEQ ID NO: 19950 - DNA, 71 bp, chicken (Gallus Gallus)
  misc_feature (36): n=g or t
aacaaggacaagatgtctgttgccttcagaagcagncaggtaaatgaagaaaactcgtccagtgaggatag

SEQ ID NO: 19951 - DNA, 71 bp, chicken (Gallus Gallus)
  misc_feature (36): n=c or t
tgttaagctgtactctttgactcccgctggtcaganggcgctctcatttgcgtagttcaagcattaaggaa

SEQ ID NO: 19952 - DNA, 71 bp, chicken (Gallus Gallus)
  misc_feature (36): n=a or t
aaaacttttcttcaaggtatgggtgcccttacaatncgtgtagtaattgtacagcagggtaagtcctcagc

SEQ ID NO: 19953 - DNA, 71 bp, chicken (Gallus Gallus)
  misc_feature (36): n=c or t
acgttgcttattccaatcagagctttacagaaatgngttccaaacaaacaaaaaagaaaaaaacctttttt

SEQ ID NO: 19954 - DNA, 71 bp, chicken (Gallus Gallus)
  misc_feature (36): n=c or t
acatttgctagcgtaagaaacttttttgttgtattncttgagcttccacgtattattcttactgtgttttg

SEQ ID NO: 19955 - DNA, 71 bp, chicken (Gallus Gallus)
  misc_feature (36): n=a or g
tttggagctaagtgttatcctctggatgagagccanttctgactgaaatgctgatcagtttctttagttcc

SEQ ID NO: 19956 - DNA, 71 bp, chicken (Gallus Gallus)
  misc_feature (36): n=g or t
ctacaggagtagcaatgcatctttttagcaaaaatnaatgcttggccaagagcatcagtgactctgttcac

SEQ ID NO: 19957 - DNA, 71 bp, chicken (Gallus Gallus)
  misc_feature (36): n=c or t
ttcctggtttgatgagctttgccattacacaacganctaggcattttcttcctaggctggcttacagaagg

SEQ ID NO: 19958 - DNA, 71 bp, chicken (Gallus Gallus)
  misc_feature (36): n=c or t
cacgaaaaaaaaagcatttttatgtgtggagtgctntcctttttaaccagtcctgtcgctggactgcatgc

SEQ ID NO: 19959 - DNA, 71 bp, chicken (Gallus Gallus)
  misc_feature (36): n=a or g
taggatgggctggtggaaaagcacagccttcttggnaagaagagaggtgatagcgtgaggttcatttctga

SEQ ID NO: 19960 - DNA, 71 bp, chicken (Gallus Gallus)
  misc_feature (36): n=c or t
acagcctcttgcaccagtgtgaaatttctgatctancttatgcattcaccttggtttatctactagagaca

SEQ ID NO: 19961 - DNA, 71 bp, chicken (Gallus Gallus)
  misc_feature (36): n=a or g
gtcaatactcctagtaaaagatgccagctacagganggaaggtgaggctttttggaacatcatcaaataac

SEQ ID NO: 19962 - DNA, 71 bp, chicken (Gallus Gallus)
  misc_feature (36): n=g or t
tcagttgagcatcaatgagtactcccaagtctgttncctctacacagtcttccagtcactctgccccaagc

SEQ ID NO: 19963 - DNA, 71 bp, chicken (Gallus Gallus)
  misc_feature (36): n=c or g
ttgatgggggaagactgtttgaatgaaagaaacatngaacagctaactccagctggtttagcaataaaggt

SEQ ID NO: 19964 - DNA, 71 bp, chicken (Gallus Gallus)
  misc_feature (36): n=a or g
acaggggatcgtaaagatggctttgcagctcctctntctttgacgtgtgtttttttctggactgcctgtta

SEQ ID NO: 19965 - DNA, 71 bp, chicken (Gallus Gallus)
  misc_feature (36): n=c or t
aaaatgtaacaggatattattgggaaggttcattcnctactgtcataccaccaatatctgcctctgatggt

SEQ ID NO: 19966 - DNA, 71 bp, chicken (Gallus Gallus)
  misc_feature (36): n=a or g
cagttatcagaaattgtgagagaatttaagaccacnaatcggctgctgctaactggaactccacttcagaa

SEQ ID NO: 19967 - DNA, 71 bp, chicken (Gallus Gallus)
  misc_feature (36): n=c or t
tcagtttataactgaattattaccgttatctgtgangcattgaagtggttttggaatagtttcagcagtgt

SEQ ID NO: 19968 - DNA, 71 bp, chicken (Gallus Gallus)
  misc_feature (36): n=a or g
gagtggtattactaaacaataagattggagggaaanaatgcttatatggactgtagttacagctcctgctg

SEQ ID NO: 19969 - DNA, 71 bp, chicken (Gallus Gallus)
  misc_feature (36): n=a or g
ttaatattgggggttaatgtggaggctatttgaaanattttgtttaaataaggaaaaaacaaaaaggtcag

SEQ ID NO: 19970 - DNA, 71 bp, chicken (Gallus Gallus)
  misc_feature (36): n=a or t
catagaacggatttggttggaagggacattaaagancatctacttccaacagcactgagataaccattctg

SEQ ID NO: 19971 - DNA, 71 bp, chicken (Gallus Gallus)
  misc_feature (36): n=a or g
atattctatgattccatgatttaccaaacaggtccnaatgcatactgtttacttgcagtccatcatactta

SEQ ID NO: 19972 - DNA, 71 bp, chicken (Gallus Gallus)
  misc_feature (36): n=c or t
gacttattaggtacacagcacctcttgtccacacanaccccacagaaagttaacttgtagctttgtgtagt

SEQ ID NO: 19973 - DNA, 71 bp, chicken (Gallus Gallus)
  misc_feature (36): n=a or c
taaaagaactaggttaattcatccctaggtaacatncagtgccaatagaagtggtttctttgtagtagtcc

SEQ ID NO: 19974 - DNA, 71 bp, chicken (Gallus Gallus)
  misc_feature (36): n=a or g
tgcctgctagagctctcttcccttactgtgagagtngaagagatgtggtaaagtgtataatgaatctgtga

SEQ ID NO: 19975 - DNA, 71 bp, chicken (Gallus Gallus)
  misc_feature (36): n=a or g
cacaattcatcctctaggaacactcagctctttatntggttgttttggacgaagtcccttctccaattttt

SEQ ID NO: 19976 - DNA, 71 bp, chicken (Gallus Gallus)
  misc_feature (36): n=c or t
agcagagaaaataatgagtatagtagatgaatacangctcttctcagattcagtaaactgacatctctctg

SEQ ID NO: 19977 - DNA, 71 bp, chicken (Gallus Gallus)
  misc_feature (36): n=a or g
cttctgagctgagaaaaatccaggcctgctgatggngaacagggaataagagattattttgcagatttctc

SEQ ID NO: 19978 - DNA, 71 bp, chicken (Gallus Gallus)
  misc_feature (36): n=g or t
caagcaatacacagcacatctggagccaaatgcaangatgcattttgagaacatggggtacatgttatcct

SEQ ID NO: 19979 - DNA, 71 bp, chicken (Gallus Gallus)
  misc_feature (36): n=c or t
gtttgacattttccttctctgtaaaatcaagttttncctgccatgtaatcctgaaagtgcatgagtttttc

SEQ ID NO: 19980 - DNA, 71 bp, chicken (Gallus Gallus)
  misc_feature (36): n=c or t
atcttaatgcctttactttcattgctaccagttcanttattcccccctctcctgtctctttgttcctgttt

SEQ ID NO: 19981 - DNA, 71 bp, chicken (Gallus Gallus)
  misc_feature (36): n=a or t
tttcctatcactatttgtaaagcctttcaaattctnttccatcttccatcctgcgatttcttttggtcttc

SEQ ID NO: 19982 - DNA, 71 bp, chicken (Gallus Gallus)
  misc_feature (36): n=a or c
gactgaactatgatttctttctcctcaagtcccacntcccattattgaagggattctcagggcagattgct

SEQ ID NO: 19983 - DNA, 71 bp, chicken (Gallus Gallus)
  misc_feature (36): n=a or g
tttgctgtgtttttaataacacttgagttttcagcntctgaaagcacgtctacgtgcaaaaattcaattat

SEQ ID NO: 19984 - DNA, 71 bp, chicken (Gallus Gallus)
  misc_feature (36): n=c or t
ttagtttacccatttttcctgtgatttaaccagtanccacattatgtataggtaaacttgtctgtagatta

SEQ ID NO: 19985 - DNA, 71 bp, chicken (Gallus Gallus)
  misc_feature (36): n=c or t
tgacgtgtgtgatctgtgttctcagctgaactacantcatattttccacattttcagtacatgaaagatac

SEQ ID NO: 19986 - DNA, 71 bp, chicken (Gallus Gallus)
  misc_feature (36): n=c or t
ggatggccacaaacattgcataagggatggaacacntcccatgtgaggacaggctgagagagttggagcta

SEQ ID NO: 19987 - DNA, 71 bp, chicken (Gallus Gallus)
  misc_feature (36): n=a or t
ctatgtactttcaaaaaatgtacaagcagaaaaaantataccattcatttatgcatatagagacatgctat

SEQ ID NO: 19988 - DNA, 71 bp, chicken (Gallus Gallus)
  misc_feature (36): n=a or t
agtgtgtacagagtatctgatgtttcattttcaagntgttctcacttaatgccttcatctataagtcttca

SEQ ID NO: 19989 - DNA, 71 bp, chicken (Gallus Gallus)
  misc_feature (36): n=a or c
gcaagcctccaagcttgggaatacaacagcagcagntgagggatgtgcagaagtggggatgaaggcaaaca

SEQ ID NO: 19990 - DNA, 71 bp, chicken (Gallus Gallus)
  misc_feature (36): n=a or g
agcccttcttagctgatgttatagtgcagacctaanttgagtgttacatgctggctgcacacagtaagcta

SEQ ID NO: 19991 - DNA, 71 bp, chicken (Gallus Gallus)
  misc_feature (36): n=c or t
tcatcttcttcatgaaaagtgtcatccataagcacnagtgtgcaaggcttctcagtctcacctgcaatcat

SEQ ID NO: 19992 - DNA, 71 bp, chicken (Gallus Gallus)
  misc_feature (36): n=c or t
ttaagaatgaaaacatgctagtaatacagacatagngtaacccccatttgtttcaaatttctttcaccaaa

SEQ ID NO: 19993 - DNA, 71 bp, chicken (Gallus Gallus)
  misc_feature (36): n=c or t
atatgatcctatgaaaatatctagtctgtcttcctntccctctttcctttaagtcaaactgctgcagctgt

SEQ ID NO: 19994 - DNA, 71 bp, chicken (Gallus Gallus)
  misc_feature (36): n=g or t
catgtggggcaaggttattttgtaaagacagattcnggtcttcagaattctttctgatctcctattttagt

SEQ ID NO: 19995 - DNA, 71 bp, chicken (Gallus Gallus)
  misc_feature (36): n=g or t
tgcatgtgattttctatgtatgttgtcctggtacantttctaggaatgctttgttaagtgtgtggaaagct

SEQ ID NO: 19996 - DNA, 71 bp, chicken (Gallus Gallus)
  misc_feature (36): n=c or t
ctgacaaagtttttcattaggacttggagttcctgnactgtaggattgctttcctttcatggaatatctga

SEQ ID NO: 19997 - DNA, 71 bp, chicken (Gallus Gallus)
  misc_feature (36): n=g or t
aggatgtagactaaaccacttggggaaaagagtgtnctcaatatatctgctggccaggaaatatgtccatt

SEQ ID NO: 19998 - DNA, 71 bp, chicken (Gallus Gallus)
  misc_feature (36): n=a or g
atcattttccagttttcatctttttgtttctcttcntacttaaagataaactgacaatcagaaacttgatg

SEQ ID NO: 19999 - DNA, 71 bp, chicken (Gallus Gallus)
  misc_feature (36): n=a or c
gttagtttcttttgataaacagcttcagatgaattnaaaagagaaactgtaaagcttcaaagctagaaaga

SEQ ID NO: 20000 - DNA, 71 bp, chicken (Gallus Gallus)
  misc_feature (36): n=c or t
acattaccagatgtagaagtatattagagtggcttncagagtcaggtatgttccagactcaaatatgaggt

SEQ ID NO: 20001 - DNA, 71 bp, chicken (Gallus Gallus)
  misc_feature (36): n=a or g
tggatcacttcggatcatgaatgtcccagttaatcngggctgtttgcatactgtgagaaactcaagcatct

SEQ ID NO: 20002 - DNA, 71 bp, chicken (Gallus Gallus)
  misc_feature (36): n=g or t
gatgccctctgctgctgcactgctgtctgtaggagngctttctgttgtttctgcaaggagatagattaagc

SEQ ID NO: 20003 - DNA, 71 bp, chicken (Gallus Gallus)
  misc_feature (36): n=g or t
tttcagagctatttatgtactttgggctttctggcntggtataagttcctttttgtagcttactcaaataa

SEQ ID NO: 20004 - DNA, 71 bp, chicken (Gallus Gallus)
  misc_feature (36): n=c or t
aaaaacactccataaacaaacagcatgttatttccncagttgtcagtggaacttaaaggagtctatttagc

SEQ ID NO: 20005 - DNA, 71 bp, chicken (Gallus Gallus)
  misc_feature (36): n=c or t
acaatatataacagcacttactggttcccaaactcnagtcatcttcaagaggttcttgctcattgccaagt

SEQ ID NO: 20006 - DNA, 71 bp, chicken (Gallus Gallus)
  misc_feature (36): n=c or t
gaagtaacaatatttactgattcaaggtatgcatanggagtggtacatacctttggaaaaaatttggatga

SEQ ID NO: 20007 - DNA, 71 bp, chicken (Gallus Gallus)
  misc_feature (36): n=g or t
caacctcgatgccactagtcgttcactctaatatanagtcaaagaatcataacatggctgaagttggcagt

SEQ ID NO: 20008 - DNA, 71 bp, chicken (Gallus Gallus)
  misc_feature (36): n=a or c
ctgagtgaggagaacgaatttcccacccccgacatntgaatgtggtgtgtgatatctcagacagaaccatg

SEQ ID NO: 20009 - DNA, 71 bp, chicken (Gallus Gallus)
  misc_feature (36): n=c or g
taaagagcccaaaatactgtggggaatattttttgnattctttctttatgttatcaaggaattatttcctt

SEQ ID NO: 20010 - DNA, 71 bp, chicken (Gallus Gallus)
  misc_feature (36): n=a or t
tcaaaacattcaaggcaacttcattcaactttctcnttatagttggtagaactcttaagatcatgtgagct

SEQ ID NO: 20011 - DNA, 71 bp, chicken (Gallus Gallus)
  misc_feature (36): n=a or g
aggagtacagaggcatccatttgccaccctgacccnctatctagagaggcctactgcttgccaagggccca

SEQ ID NO: 20012 - DNA, 71 bp, chicken (Gallus Gallus)
  misc_feature (36): n=g or t
tgctgagaatccttctcacgggactcatccatccangaatgcttgtgtgaggtatttttttgttccccaga

SEQ ID NO: 20013 - DNA, 71 bp, chicken (Gallus Gallus)
  misc_feature (36): n=a or g
attaaatatatcctgtagatttttatatgaaatatnaagtgaaagaagcagcttacttttggtccagctag

SEQ ID NO: 20014 - DNA, 71 bp, chicken (Gallus Gallus)
  misc_feature (36): n=g or t
cacaacatatgactgctaaaatccttctccttgcgnaccactatcttttctttgcaatttcttctgctgcc

SEQ ID NO: 20015 - DNA, 71 bp, chicken (Gallus Gallus)
  misc_feature (36): n=c or g
aattgagattatgatctgatacttaatagtaaatcntggagaagtggtagtctttccaagttgctcttagt

SEQ ID NO: 20016 - DNA, 71 bp, chicken (Gallus Gallus)
  misc_feature (36): n=c or t
aatcagaggctcaggccatgattcaacagttcccanacagactttcatcataacatcaacaaatttttaac

SEQ ID NO: 20017 - DNA, 71 bp, chicken (Gallus Gallus)
  misc_feature (36): n=a or c
accaccactctacagtgtgtcaggatgaagagggantatattgacgctctgaaaagagaacttcatatgag

SEQ ID NO: 20018 - DNA, 71 bp, chicken (Gallus Gallus)
  misc_feature (36): n=a or g
ctgctttattaaaaataattaagaagcactttttgnttattttgactttacagtagtaattgttctgttgt

SEQ ID NO: 20019 - DNA, 71 bp, chicken (Gallus Gallus)
  misc_feature (36): n=c or g
tgcctggtcctctttgacatagtatggatacctcancattttctttcagcttatgaagtttatggcagatt

SEQ ID NO: 20020 - DNA, 71 bp, chicken (Gallus Gallus)
  misc_feature (36): n=c or t
gtccctttataatttgtctatatttaaaagtttacntcactcgaggcatcttaaacctcagtatataaaat

SEQ ID NO: 20021 - DNA, 71 bp, chicken (Gallus Gallus)
  misc_feature (36): n=a or t
aaggtttatttctgctggtttaaagtattctagtgnttttggaaggtctccattaatgatagaccaagaag

SEQ ID NO: 20022 - DNA, 71 bp, chicken (Gallus Gallus)
  misc_feature (36): n=c or t
aattttgacattgtttattgaagctaggaataaaantgagaagttgcagactgaaggatgcttgggaaagc

SEQ ID NO: 20023 - DNA, 71 bp, chicken (Gallus Gallus)
  misc_feature (36): n=a or g
aagcacctactcagatctgggtatctctgaggtgantcagctgcgctacgggaatggcctaatgattcttt

SEQ ID NO: 20024 - DNA, 71 bp, chicken (Gallus Gallus)
  misc_feature (36): n=c or t
aggaattgctaaaatcagcaacagctcaagtggaanagatcagaagtcttgagagaatgtaaaactcttag

SEQ ID NO: 20025 - DNA, 71 bp, chicken (Gallus Gallus)
  misc_feature (36): n=c or t
acttggagtcaggagttgctaaagcagtaaagactngtgaaagctttatatagcatgtcacaagcaggaga

SEQ ID NO: 20026 - DNA, 71 bp, chicken (Gallus Gallus)
  misc_feature (36): n=a or g
acctgagatcagctttagctcctctgtttcctgagnaccagatcaagcaaaatgagtcaagggcacaagat

SEQ ID NO: 20027 - DNA, 71 bp, chicken (Gallus Gallus)
  misc_feature (36): n=a or c
aaaggaccattaaagtgattgctcttgcagaaaagnacttctcttcctccagctcagcccaggatctgctc

SEQ ID NO: 20028 - DNA, 71 bp, chicken (Gallus Gallus)
  misc_feature (36): n=a or g
tctgaagccttacagctctgattgccatttctgccnttttcccttcactgtgtgaaaccaacccaaggtac

SEQ ID NO: 20029 - DNA, 71 bp, chicken (Gallus Gallus)
  misc_feature (36): n=g or t
ccacagtgctcactgatagctggtaaaataagaagngaagattatgaaattcagaagctcaaaaggtccag

SEQ ID NO: 20030 - DNA, 71 bp, chicken (Gallus Gallus)
  misc_feature (36): n=a or g
acctcagctggaaaaagagtatcgagaggcttgggnacaggtatcccagataagctggaaatctgaaaagc

SEQ ID NO: 20031 - DNA, 71 bp, chicken (Gallus Gallus)
  misc_feature (36): n=c or t
ttgttggcttctgtctgacccttcacttgaggacanggagttcttatgtttcagacactgcagcccaaata

SEQ ID NO: 20032 - DNA, 71 bp, chicken (Gallus Gallus)
  misc_feature (36): n=g or t
ttgcccgtatcaatcagaaaggaaagataaatgccnggcgagccaaggtaacaagtgaaaaagagggacaa

SEQ ID NO: 20033 - DNA, 71 bp, chicken (Gallus Gallus)
  misc_feature (36): n=c or t
tcaggtagtcatctcgcagtattcaaacagaaagtnatcttaaaactaattctatacttacaagaaatatt

SEQ ID NO: 20034 - DNA, 71 bp, chicken (Gallus Gallus)
  misc_feature (36): n=g or t
gttttgaataaacccatgcttacactcattgcaacngagtctttctattgtaagtgcctgcaaggaaaagg

SEQ ID NO: 20035 - DNA, 71 bp, chicken (Gallus Gallus)
  misc_feature (36): n=a or c
tagccagcatgcttcctgtacacaggggaactgacncagccacaatcagttcacggagcttctcttgcctg

SEQ ID NO: 20036 - DNA, 71 bp, chicken (Gallus Gallus)
  misc_feature (36): n=c or t
ttctcattgtggttgttctccaggatgtttggcttntccatcattatcttctttcccaggacaacttctcc

SEQ ID NO: 20037 - DNA, 71 bp, chicken (Gallus Gallus)
  misc_feature (36): n=g or t
tggaagtattggaggctgggatcaaatctgggaggnacatacaggtaatcaggattacatacaggaggcta

SEQ ID NO: 20038 - DNA, 71 bp, chicken (Gallus Gallus)
  misc_feature (36): n=a or c
aattgctgtggccttgtccactcaaacattcgaacnctaccatcttgtgctcctgtaagatctagattaag

SEQ ID NO: 20039 - DNA, 71 bp, chicken (Gallus Gallus)
  misc_feature (36): n=a or g
gtgctttaattacctgatggggggcagctgcgtgcntgtgctgttatttctctgtgtgttcccccccccta

SEQ ID NO: 20040 - DNA, 71 bp, chicken (Gallus Gallus)
  misc_feature (36): n=g or t
gagtggcatcctcgcttaagaatccgtcagaggagnttactggcttaaaccaaagtgaatgtgcaatagtt

SEQ ID NO: 20041 - DNA, 71 bp, chicken (Gallus Gallus)
  misc_feature (36): n=a or c
tttcagtaacctgcaactcccgtagccgtcgaagcnccaaagctacctgtttcacaaaagcagcatgcata

SEQ ID NO: 20042 - DNA, 71 bp, chicken (Gallus Gallus)
  misc_feature (36): n=a or c
gaaaagcagacacaggcctcctgactgaggagcatncatccacttccaggccacaggtgagctgccaaagt

SEQ ID NO: 20043 - DNA, 71 bp, chicken (Gallus Gallus)
  misc_feature (36): n=a or g
ggacgacagcaatgcctacgcagcactaccggaganggagaggagctgtgataccattgactgcccttacc

SEQ ID NO: 20044 - DNA, 71 bp, chicken (Gallus Gallus)
  misc_feature (36): n=g or t
gtcttgtgtgcagtcacagctcccgggtggcagganggaaagaattccccactttggagcctgctacaatt

SEQ ID NO: 20045 - DNA, 71 bp, chicken (Gallus Gallus)
  misc_feature (36): n=g or t
gtttaaatgttttaaagtatacagctgagtggaagntaatcaaaagcaaatcttacatcaagccatgatgc

SEQ ID NO: 20046 - DNA, 71 bp, chicken (Gallus Gallus)
  misc_feature (36): n=g or t
tcggcaggtgatagctgtggccaggacagcagacgntgtcattatgatgctggatgccacaaagggtgaag

SEQ ID NO: 20047 - DNA, 71 bp, chicken (Gallus Gallus)
  misc_feature (36): n=a or c
gaaggaaaacaaaagagagaacctcaggagatgtcntgatttatagctctacttgctggagaaaaatctct

SEQ ID NO: 20048 - DNA, 71 bp, chicken (Gallus Gallus)
  misc_feature (36): n=g or t
agatagctgcaggatagctgtctggggttcagaagnggaaattcccttgttccagctgctttacctgctgg

SEQ ID NO: 20049 - DNA, 71 bp, chicken (Gallus Gallus)
  misc_feature (36): n=g or t
gagctatgcagagaccatgagctctacagaagggcnggaggaccatcttcccttcagaaaggatggaaatc

SEQ ID NO: 20050 - DNA, 71 bp, chicken (Gallus Gallus)
  misc_feature (36): n=g or t
agaggattcctacctcttcgaccttgacaacaaggnactgtatctagggaggtgaacccaaggtcttgttt

SEQ ID NO: 20051 - DNA, 71 bp, chicken (Gallus Gallus)
  misc_feature (36): n=g or t
aaacacttcctttctctcatgaaactcagcaggaangctttaattcatactactgccaggatgtgaaggag

SEQ ID NO: 20052 - DNA, 71 bp, chicken (Gallus Gallus)
  misc_feature (36): n=g or t
tgccagagctctactgagttcaccttctgtggaagnggagaactgtagcagtaacactatatatgtactgt

SEQ ID NO: 20053 - DNA, 71 bp, chicken (Gallus Gallus)
  misc_feature (36): n=c or t
gacagaaaagtccttctacaccaactctctgatgtngtacaatgacacatcagagttgtgaaaatctcacc

SEQ ID NO: 20054 - DNA, 71 bp, chicken (Gallus Gallus)
  misc_feature (36): n=a or c
tgtaagtcatcttagcttgctggctaacgcaagganaagcctctgaagcatgctctgtcttttacatgtca

SEQ ID NO: 20055 - DNA, 71 bp, chicken (Gallus Gallus)
  misc_feature (36): n=a or g
acgtatctgaaccattaaaaccagactattttgggntgaggctgctttcactagtagagaacttatgagtg

SEQ ID NO: 20056 - DNA, 71 bp, chicken (Gallus Gallus)
  misc_feature (36): n=g or t
attcataacttcaggaaaccaaatttacaggctggnacattgacacaagttacttgggatgctgaaatggt

SEQ ID NO: 20057 - DNA, 71 bp, chicken (Gallus Gallus)
  misc_feature (36): n=g or t
gctggcacccagctggctggtggctttatctttctntgggaggaaagtcaggaatccactctgatttctgt

SEQ ID NO: 20058 - DNA, 71 bp, chicken (Gallus Gallus)
  misc_feature (36): n=a or c
tccagaacaacccctccaggtcctccagaacaaacnccagagatacaacccatcttttaatgatatctact

SEQ ID NO: 20059 - DNA, 71 bp, chicken (Gallus Gallus)
  misc_feature (36): n=c or t
cactctcaagttatttggcacaagattaacaatttncctgctgctactaaatttttagaatttattttaca

SEQ ID NO: 20060 - DNA, 71 bp, chicken (Gallus Gallus)
  misc_feature (36): n=g or t
ctatggtcacaatgaatattacattggctacttttnctgcacgctatacctagttacattatgttggattc

SEQ ID NO: 20061 - DNA, 71 bp, chicken (Gallus Gallus)
  misc_feature (36): n=g or t
attttaagtggacattgagagatgcgtgtagaagangtttcttactgaagatttcaacttagttagagatg

SEQ ID NO: 20062 - DNA, 71 bp, chicken (Gallus Gallus)
  misc_feature (36): n=a or g
actaggttattttctaatgaacctaaagtccctgtnatgctgtttgttgcccttatctggttgaactggaa

SEQ ID NO: 20063 - DNA, 71 bp, chicken (Gallus Gallus)
  misc_feature (36): n=g or t
ctgttatttgtacttctttttgatctctatggctgntatgcctactacagatagacttgcacacaagtaca

SEQ ID NO: 20064 - DNA, 71 bp, chicken (Gallus Gallus)
  misc_feature (36): n=a or c
actttacggtgggaggtgttgaatatattcccatcntcagacagcaagtacatcaggaaaccatctttggt

SEQ ID NO: 20065 - DNA, 71 bp, chicken (Gallus Gallus)
  misc_feature (36): n=g or t
atagcaccttatgtctcaggtccccatgagtcaggnaggcagagccgagggactctgaaagtagaggaaaa

SEQ ID NO: 20066 - DNA, 71 bp, chicken (Gallus Gallus)
  misc_feature (36): n=a or c
tccaacagaaaacccacagacaacttcattcaaggnagactatctggtatcagtgattttattttccagaa

SEQ ID NO: 20067 - DNA, 71 bp, chicken (Gallus Gallus)
  misc_feature (36): n=g or t
ggttttggcccactgggatttttgcctgtgtagacngggagacagtctacacgtctacagtttaaaggatc

SEQ ID NO: 20068 - DNA, 71 bp, chicken (Gallus Gallus)
  misc_feature (36): n=a or g
ttctgcaggaatgatttttaatgaagaagatcaggnggtacgagacttgggctatcagaagcatgctttca

SEQ ID NO: 20069 - DNA, 71 bp, chicken (Gallus Gallus)
  misc_feature (36): n=g or t
gcttggtgggaggatttgtggtggaacatgaagcgngggaatctgttcatattcagcatggatatgagcag

SEQ ID NO: 20070 - DNA, 71 bp, chicken (Gallus Gallus)
  misc_feature (36): n=g or t
tgaaaggtctggcttcctcaactgaaagcaattagngaagtagtaaagatggaattttacttaaaaataaa

SEQ ID NO: 20071 - DNA, 71 bp, chicken (Gallus Gallus)
  misc_feature (36): n=a or g
cagcatggtgagcgctcactgtactgacttttatangtggagacattttccttatcataggattgaggttt

SEQ ID NO: 20072 - DNA, 71 bp, chicken (Gallus Gallus)
  misc_feature (36): n=a or c
gattttgagctttcaggtatgagcagcacaggagcnccagcctcaatatcaagaagaacccgggaagctcg

SEQ ID NO: 20073 - DNA, 71 bp, chicken (Gallus Gallus)
  misc_feature (36): n=g or t
caataagggaggcaaaagtagacaatgcaatgctgnggatttggaagggatacatccggactgtcttctgc

SEQ ID NO: 20074 - DNA, 71 bp, chicken (Gallus Gallus)
  misc_feature (36): n=g or t
gccttcccttgattagtcaaagtcctctgtggctgnatagtgtgcaaggcttcctttaacattggattaat

SEQ ID NO: 20075 - DNA, 71 bp, chicken (Gallus Gallus)
  misc_feature (36): n=a or c
gacatcctggcatctcagatgggttgtgagtatccntgcagtatttctccacaaaatgtcaagggatggtg

SEQ ID NO: 20076 - DNA, 71 bp, chicken (Gallus Gallus)
  misc_feature (36): n=a or c
ggagctttagttaaggactgcagcagacttccacancattacattacattgctatgcaatgttataataac

SEQ ID NO: 20077 - DNA, 71 bp, chicken (Gallus Gallus)
  misc_feature (36): n=g or t
gctggtcagcccctcgatgctgctttcgccaatgcnggggttcttcagagctcgccaggcgtcagccactg

SEQ ID NO: 20078 - DNA, 71 bp, chicken (Gallus Gallus)
  misc_feature (36): n=g or t
cttcctccacacacaaccttttgttgctaagtttcnggtacaatggctttcaccagcttgattagcagcag

SEQ ID NO: 20079 - DNA, 71 bp, chicken (Gallus Gallus)
  misc_feature (36): n=a or g
gcagtgggtctgtgttggctcctgacggacaggaangggcaagggacaagccttgctgatgcttagctgca

SEQ ID NO: 20080 - DNA, 71 bp, chicken (Gallus Gallus)
  misc_feature (36): n=g or t
acccctgtgtcagtaaagaggaagtccactggaagnatgtgcatcactaaattcatgaaaaggcctaggga

SEQ ID NO: 20081 - DNA, 71 bp, chicken (Gallus Gallus)
  misc_feature (36): n=a or c
agttgggatggggaggagggggatgacggatggggntgctgatgggtgcgagatgaggatgctgagggatg

SEQ ID NO: 20082 - DNA, 71 bp, chicken (Gallus Gallus)
  misc_feature (36): n=a or g
tctgtaggctctggacctctgtgtacagcttatggngatgggagaaacggctttgattatgtcagatgcca

SEQ ID NO: 20083 - DNA, 71 bp, chicken (Gallus Gallus)
  misc_feature (36): n=g or t
cagcagaaactcattttgattgccagagccctgagnacactcatcaaccttaacgaccctaaacagcttca

SEQ ID NO: 20084 - DNA, 71 bp, chicken (Gallus Gallus)
  misc_feature (36): n=a or c
agagctccttggcagatatctgtccgggttgcaccnccaacgatgaactgagggtcatccactaattcctg

SEQ ID NO: 20085 - DNA, 71 bp, chicken (Gallus Gallus)
  misc_feature (36): n=g or t
ctctgtacagtatcgtaggtcatcacaatggaaggntcagcattgacaaacacaatcctcaaggtgtaatc

SEQ ID NO: 20086 - DNA, 71 bp, chicken (Gallus Gallus)
  misc_feature (36): n=a or c
caccaaaaagcagcaaagaggacttgcatgcccgcncctgggacaatctctacactatacattaccaagct

SEQ ID NO: 20087 - DNA, 71 bp, chicken (Gallus Gallus)
  misc_feature (36): n=g or t
aagcctttgtaaatcctaagctccccaaaagcccantgggtgctctgacatccattctcccaacacaatcc

SEQ ID NO: 20088 - DNA, 71 bp, chicken (Gallus Gallus)
  misc_feature (36): n=g or t
ttccaacttttgtgcctcagctctattggttagtgnagtaagatgctctacttgatcagtgtgtttatgca

SEQ ID NO: 20089 - DNA, 71 bp, chicken (Gallus Gallus)
  misc_feature (36): n=c or t
ctagttctgtataggttcagagaagacaggcagatngtcactctgagtgttcttccctactgtttatagat

SEQ ID NO: 20090 - DNA, 71 bp, chicken (Gallus Gallus)
  misc_feature (36): n=a or c
aggaggtcccttccctcacaggaacagcaggaaganagacttccagggagtgatccaattcagagtgaccc

SEQ ID NO: 20091 - DNA, 71 bp, chicken (Gallus Gallus)
  misc_feature (36): n=c or t
ggtggaaatgctcctagtggcaaagctgctttgtgnctgagttcaggtaaccaagatctttccaaatcagt

SEQ ID NO: 20092 - DNA, 71 bp, chicken (Gallus Gallus)
  misc_feature (36): n=g or t
tatggcatgaagctgggttcaaatcaactgacgtgngttgaagatccatctaatgagccaccgactttgca

SEQ ID NO: 20093 - DNA, 71 bp, chicken (Gallus Gallus)
  misc_feature (36): n=g or t
gatgggggaatggctgtgattgaccagtggatctgngcacatgctaggtagtgaatctgattttctttggg

SEQ ID NO: 20094 - DNA, 71 bp, chicken (Gallus Gallus)
  misc_feature (36): n=a or g
ttttaagactgctttgattaaccggggatatacttngtggagactagacagctaaagcttctaatccacgt

SEQ ID NO: 20095 - DNA, 71 bp, chicken (Gallus Gallus)
  misc_feature (36): n=g or t
gcggccgtctctggtgccatctagtggccaaaaggnggaaatgcagacccgtcagtttggcgcaggagaaa

SEQ ID NO: 20096 - DNA, 71 bp, chicken (Gallus Gallus)
  misc_feature (36): n=a or g
agcaaagcaagtggtgaccttcacttgtctacagcntcatgatcagggcatttcaagacctagttctggcc

SEQ ID NO: 20097 - DNA, 71 bp, chicken (Gallus Gallus)
  misc_feature (36): n=c or t
agtagtgacacgccatctatttttgacattgcgcgnccactgcatgtttctctgaaagtgagggttaccga

SEQ ID NO: 20098 - DNA, 71 bp, chicken (Gallus Gallus)
  misc_feature (36): n=a or g
ttgtgtatgctggatgacatgtatcttagggtcctnaaggagtgatctgatgtatttgccacatcactctc

SEQ ID NO: 20099 - DNA, 71 bp, chicken (Gallus Gallus)
  misc_feature (36): n=c or t
tgcagggacactagctgaaaattgtctcaggacacnttaatgcttcctaatgccacggctgcagaattagt

SEQ ID NO: 20100 - DNA, 71 bp, chicken (Gallus Gallus)
  misc_feature (36): n=g or t
gagtggagaaaggattgagggcagcccaaaggattngggaatggtagttaatgacaagatcagcatgaggt

SEQ ID NO: 20101 - DNA, 71 bp, chicken (Gallus Gallus)
  misc_feature (36): n=c or t
atgatgaacattacctgactgacacgcttttcttgnaaaaactatcatccagttcactaaccacaaactat

SEQ ID NO: 20102 - DNA, 71 bp, chicken (Gallus Gallus)
  misc_feature (36): n=a or g
ttcaagaggcattttgataattccctcagtagtatnctttaacattggttagtccagaagtgtttaggagg

SEQ ID NO: 20103 - DNA, 71 bp, chicken (Gallus Gallus)
  misc_feature (36): n=a or t
tatggcggggctgtagggtcgttgtcggctgctttnagtccctgtaataacgagagagagagaaaaagatt

SEQ ID NO: 20104 - DNA, 71 bp, chicken (Gallus Gallus)
  misc_feature (36): n=c or g
gaaattttactggttgctatactgaaagtggcaggnaattgataaagtgctctgtggatctgtccttccat

SEQ ID NO: 20105 - DNA, 71 bp, chicken (Gallus Gallus)
  misc_feature (36): n=c or g
ttttaatcccttgttgtaccttcatattgtggcagnttgttatatgaatcattaatggtgattaatcttgt

SEQ ID NO: 20106 - DNA, 71 bp, chicken (Gallus Gallus)
  misc_feature (36): n=c or g
aatattttgaagaaattacttacgttctaagcccancattctctaataccagttcttccaatcgattggac

SEQ ID NO: 20107 - DNA, 71 bp, chicken (Gallus Gallus)
  misc_feature (36): n=c or g
ggccacagggtccatgctggtttgtctggctgtggntgtggctttaggcttaaaactggtactaacctccg

SEQ ID NO: 20108 - DNA, 71 bp, chicken (Gallus Gallus)
  misc_feature (36): n=c or g
tagacaatgacaagtagagggtaaaggggataaatncagccattacatatagaaaccgttctttcaactcc

SEQ ID NO: 20109 - DNA, 71 bp, chicken (Gallus Gallus)
  misc_feature (36): n=c or g
catggaaggcactcagtatcttttccgagttgcagntgagaatctgtttggtagaggaccatatgtggaaa

SEQ ID NO: 20110 - DNA, 71 bp, chicken (Gallus Gallus)
  misc_feature (36): n=a or t
ggttaaaatggagtttctatagccaggaagatcagntaaaggaagcagagatagttttaggaaaggaatct

SEQ ID NO: 20111 - DNA, 71 bp, chicken (Gallus Gallus)
  misc_feature (36): n=c or g
ctggtgccagcggctccctcttctatgtcaccagcnacgatgaattcatcataaaaactgtgatgcacaaa

SEQ ID NO: 20112 - DNA, 71 bp, chicken (Gallus Gallus)
  misc_feature (36): n=c or g
acggtaaggtgagttctgtacctatggtatggctgntttcatgcactttgtttggatgttaatccagacaa

SEQ ID NO: 20113 - DNA, 71 bp, chicken (Gallus Gallus)
  misc_feature (36): n=c or g
accaggcacaggcccagagcttggtcacgtgctggnagcactcagaacactgtctgtcttccatgaagaga

SEQ ID NO: 20114 - DNA, 71 bp, chicken (Gallus Gallus)
  misc_feature (36): n=c or g
tgtatgcctacagatactactgtaaaacttctaaantgttaaaaggtacttcctgagcagttttatatagt

SEQ ID NO: 20115 - DNA, 71 bp, chicken (Gallus Gallus)
  misc_feature (36): n=a or c
gtttcaggtgattaatagttgtgatagaaataggtncttctggttaaagcatatattggcaagattatgtt

SEQ ID NO: 20116 - DNA, 71 bp, chicken (Gallus Gallus)
  misc_feature (36): n=g or t
gtaatgcatttaataacagtgttaagagtggagggngcacttgccgacagcggttcaaaacagagattagt

SEQ ID NO: 20117 - DNA, 71 bp, chicken (Gallus Gallus)
  misc_feature (36): n=c or t
cagagacccttggtagaccaagcagtttgatttttnttgttggcttggtggtaagtctgcatgagacaagg

SEQ ID NO: 20118 - DNA, 71 bp, chicken (Gallus Gallus)
  misc_feature (36): n=g or t
cttctaactggcagctgccatgaaatacagaaaggngattaaatagtgacttgctccattgaatctgctgc

SEQ ID NO: 20119 - DNA, 71 bp, chicken (Gallus Gallus)
  misc_feature (36): n=a or g
ggggttgacttcatactttgttgtgactgaccttgnaaatgaaatctagaaggaggttcattttgctctgg

SEQ ID NO: 20120 - DNA, 71 bp, chicken (Gallus Gallus)
  misc_feature (36): n=g or t
cggacggattataatgaaccaggaaccattcccagngctgctcggggattggatgatacagtttccatagc

SEQ ID NO: 20121 - DNA, 71 bp, chicken (Gallus Gallus)
  misc_feature (36): n=a or g
gtagaagaaactggaaactgaacttctgcaattggngatggagacagcagacatagttcatccattttatt

SEQ ID NO: 20122 - DNA, 71 bp, chicken (Gallus Gallus)
  misc_feature (36): n=g or t
ttcctttgatgctgatttgcttttcatggtggcagntaagatattctaatattacacttttccagtaggcc

SEQ ID NO: 20123 - DNA, 71 bp, chicken (Gallus Gallus)
  misc_feature (36): n=g or t
tcccgctgcagaagagtcaccgtgtgagaccaaggngtgccagaacggcgggacgtgccaggtggcaaacg

SEQ ID NO: 20124 - DNA, 71 bp, chicken (Gallus Gallus)
  misc_feature (36): n=a or g
ctaaaaagaccgtcaaaaaagccgcactggcccacnaagcagtgtttgggagcaaatggcctagaacttgc

SEQ ID NO: 20125 - DNA, 71 bp, chicken (Gallus Gallus)
  misc_feature (36): n=c or g
tcatatagttatcttgttatctagtaattttatcancccagccacaggaattattaggaagaccagtgtta

SEQ ID NO: 20126 - DNA, 71 bp, chicken (Gallus Gallus)
  misc_feature (36): n=a or c
cttcaaaaatgaattatctgagctcctggacccccncactaggatgagccacagccaggacccatatcgtt

SEQ ID NO: 20127 - DNA, 71 bp, chicken (Gallus Gallus)
  misc_feature (36): n=a or g
gctcagagatgaagaggactccgtgaatttccctgngtcttgtgtgttttagagcatgttggagcagagac

SEQ ID NO: 20128 - DNA, 71 bp, chicken (Gallus Gallus)
  misc_feature (36): n=g or t
ctcgttcagctgctctagtgtgaaattggttctgcntctcctttgtttcagcttggtctggccgtcctcgt

SEQ ID NO: 20129 - DNA, 71 bp, chicken (Gallus Gallus)
  misc_feature (36): n=g or t
ttactgtgacataagcatcaagagtttcatggcttnaactgctacttcatggtccttgtccagaggcatgg

SEQ ID NO: 20130 - DNA, 71 bp, chicken (Gallus Gallus)
  misc_feature (36): n=g or t
atctacgtaagcttgtgtggcactgcacataatacngtgctgaaagtgaaagctgtaaaagttaacaaacc

SEQ ID NO: 20131 - DNA, 71 bp, chicken (Gallus Gallus)
  misc_feature (36): n=g or t
ttacagaattatgaaatggaattgctagtagcaggngtacaagaaaaaatgcgtgggagaggacaaacaat

SEQ ID NO: 20132 - DNA, 71 bp, chicken (Gallus Gallus)
  misc_feature (36): n=a or g
aaaaagaaattttatgctcacaaactttccttgagngagagtacaacataggtgtcacacaatatatgtat

SEQ ID NO: 20133 - DNA, 71 bp, chicken (Gallus Gallus)
  misc_feature (36): n=c or t
tggtgcccaacgtgaagaggcagaaggcgatctccncacaggcgctgacctccccgcactcaaacaagcac

SEQ ID NO: 20134 - DNA, 71 bp, chicken (Gallus Gallus)
  misc_feature (36): n=a or c
aaaacaaaaagcagtactcacaacagagacaccacnaactatcagtctgaacagttcatacaagccttctc

SEQ ID NO: 20135 - DNA, 71 bp, chicken (Gallus Gallus)
  misc_feature (36): n=g or t
gggagctcagtagttcctaaaataatacatcaaggnagacaagaactcactagtttaccagttgctgttgt

SEQ ID NO: 20136 - DNA, 71 bp, chicken (Gallus Gallus)
  misc_feature (36): n=g or t
gaatcaagagggaccactgatgtacaaagcctacanttgctcccctgtcccccaaaaggcttatgtgtaga

SEQ ID NO: 20137 - DNA, 71 bp, chicken (Gallus Gallus)
  misc_feature (36): n=a or g
aaggaatgagaaatgtaatgaaacgaaatggctggnagatttaatctaatatctccatgcaaagccagctt

SEQ ID NO: 20138 - DNA, 71 bp, chicken (Gallus Gallus)
  misc_feature (36): n=a or g
ggaaagaaacacaaggtgaagtgctgcacatagacngccttcgtggggttttgtctcaagtcatgtcaatc

SEQ ID NO: 20139 - DNA, 71 bp, chicken (Gallus Gallus)
  misc_feature (36): n=a or g
tggctggctgtaccccagaggaacagaaaacatatnaaagcctcacagaaatgtttaggtttgccactaaa

SEQ ID NO: 20140 - DNA, 71 bp, chicken (Gallus Gallus)
  misc_feature (36): n=g or t
ttgtttgtttttctaacttctagtggtgatagcggnaaatgcatatgctgggaacttcagaaagaacagct

SEQ ID NO: 20141 - DNA, 71 bp, chicken (Gallus Gallus)
  misc_feature (36): n=a or c
cttaatattgagggagttgatacagtttcagcaaantctttagtttcctggtcttactgtgttcctggtct

SEQ ID NO: 20142 - DNA, 71 bp, chicken (Gallus Gallus)
  misc_feature (36): n=a or c
tactgactgtggtggtgagaagccagactgtactcngcacctggttatatgcttaatattacatactgatg

SEQ ID NO: 20143 - DNA, 71 bp, chicken (Gallus Gallus)
  misc_feature (36): n=a or c
atctcataggtctgcatagccagctgaaccttgtcntccccaaattctttgcatttcccgtacgcctcctg

SEQ ID NO: 20144 - DNA, 71 bp, chicken (Gallus Gallus)
  misc_feature (36): n=g or t
acaatatctactccaaataaacaagctactctcagngtaagagcattaccacttcctgaggaggtaactcg

SEQ ID NO: 20145 - DNA, 71 bp, chicken (Gallus Gallus)
  misc_feature (36): n=a or g
caggaatttgtaaactgaagtccttaacatgaccanaaagaaaccgccaggcttctcaagatgccagctgg

SEQ ID NO: 20146 - DNA, 71 bp, chicken (Gallus Gallus)
  misc_feature (36): n=g or t
cgcagagccaatggagaacatcctctgcgtgggctncattgctgccccagggtcccggacagcacttcttg

SEQ ID NO: 20147 - DNA, 71 bp, chicken (Gallus Gallus)
  misc_feature (36): n=c or t
actgtggctcgttcgggtaagaaatggaaatgtttnagttgtattaccttgtcaaggccactgtataatct

SEQ ID NO: 20148 - DNA, 71 bp, chicken (Gallus Gallus)
  misc_feature (36): n=a or c
cactcaagggagatcttgccacgtgtttgacctccnctgaggtggagaagaaatcctttgaatcacagaaa

SEQ ID NO: 20149 - DNA, 71 bp, chicken (Gallus Gallus)
  misc_feature (36): n=a or c
gagggctgtaaatccgtggtggcaaacaagaaaagnctgaagctgtaagcaaacaggaaacaaatgatctc

SEQ ID NO: 20150 - DNA, 71 bp, chicken (Gallus Gallus)
  misc_feature (36): n=g or t
tgtaattgctttggtcctctaagagtctatggtttnttagagagtatgcacagccaaagagcagggagctg

SEQ ID NO: 20151 - DNA, 71 bp, chicken (Gallus Gallus)
  misc_feature (36): n=a or c
gcgccctggtctcctttggctggcagatcagatccnccctgtctgggcaccggctcccattcttcaggctc

SEQ ID NO: 20152 - DNA, 71 bp, chicken (Gallus Gallus)
  misc_feature (36): n=a or c
atcttcttttttacctatgttctatgtgcatctgcncagccgtagctgaagtttgacatttggctctctgt

SEQ ID NO: 20153 - DNA, 71 bp, chicken (Gallus Gallus)
  misc_feature (36): n=g or t
ggtggagacagtggatatcccagtgagaagagaagngagctagaagatctggatcatagagagaaggtaag

SEQ ID NO: 20154 - DNA, 71 bp, chicken (Gallus Gallus)
  misc_feature (36): n=g or t
tgtcatcagtagggtcgtttctctccatcctttttncctcctgtgcttttagggccctcagctttctgccc

SEQ ID NO: 20155 - DNA, 71 bp, chicken (Gallus Gallus)
  misc_feature (36): n=a or g
tagtcatagtcgtagtcatagacacatctaatgggngagatgaaggaacttgggtgatattttattctcag

SEQ ID NO: 20156 - DNA, 71 bp, chicken (Gallus Gallus)
  misc_feature (36): n=c or t
ggcctccctgtttagacgtcagctcttgctcgatcncttccagccctgcgctcttctggaaacggctcatg

SEQ ID NO: 20157 - DNA, 71 bp, chicken (Gallus Gallus)
  misc_feature (36): n=a or g
aatacaaaagtgaccactgttacagtaaatctgcanagtgcatttagatcctgggctgaggcagcagctgg

SEQ ID NO: 20158 - DNA, 71 bp, chicken (Gallus Gallus)
  misc_feature (36): n=g or t
gtttgtcagacagggctgtgcactccttgagctcgngctgcatggttctttcagcccccggtctcggcagc

SEQ ID NO: 20159 - DNA, 71 bp, chicken (Gallus Gallus)
  misc_feature (36): n=a or c
tggcagggtctaagcaccgattaaatactaattcancagccatatcttttgtaaataaatttctgaccata

SEQ ID NO: 20160 - DNA, 71 bp, chicken (Gallus Gallus)
  misc_feature (36): n=g or t
atgttggcaaaaagattaattcatggtttatctatntcaatggactctgaagaagccatgattaataaact

SEQ ID NO: 20161 - DNA, 71 bp, chicken (Gallus Gallus)
  misc_feature (36): n=a or c
aattaagctataatattcagagaggaatccaagccncaaaattcatattccaccctccaaggttcaaaaga

SEQ ID NO: 20162 - DNA, 71 bp, chicken (Gallus Gallus)
  misc_feature (36): n=c or t
tcctctgtatataacgtaatgtttgaaaatggaacngtgttaagagagggttagctccataagcctcctgt

SEQ ID NO: 20163 - DNA, 71 bp, chicken (Gallus Gallus)
  misc_feature (36): n=a or c
ttgaccactcagaacactaaatcagagagcactatnccagacagtacctgacatttcataaacacgttttc

SEQ ID NO: 20164 - DNA, 71 bp, chicken (Gallus Gallus)
  misc_feature (36): n=g or t
aagaattttatggagtatagactgcagagaggcttntgtcacagctgctgttagaactaaaagcaaacatt

SEQ ID NO: 20165 - DNA, 71 bp, chicken (Gallus Gallus)
  misc_feature (36): n=a or c
tattcatgtggtaattggataaaactgccagggcanaagagttgtcataaagcacattccctcggataatc

SEQ ID NO: 20166 - DNA, 71 bp, chicken (Gallus Gallus)
  misc_feature (36): n=a or c
tggtcatagattttctttatcatggttttattctanaagccatacagctcaccaggcatccatatacctat

SEQ ID NO: 20167 - DNA, 71 bp, chicken (Gallus Gallus)
  misc_feature (36): n=a or c
attgctgccctttaaaatcagcttaagcattcagcnctctgccacccagtctgaaaggccagtgaccacaa

SEQ ID NO: 20168 - DNA, 71 bp, chicken (Gallus Gallus)
  misc_feature (36): n=a or g
tataatttaaactaaagcaaacatgacacttggcanaaaacgggcaaggctcagaagtctctctattggct

SEQ ID NO: 20169 - DNA, 71 bp, chicken (Gallus Gallus)
  misc_feature (36): n=a or c
cctccagatcagctaccaaagcattgagtcctctgncccagcagtcaacgttcccggcccgcgacgcaccg

SEQ ID NO: 20170 - DNA, 71 bp, chicken (Gallus Gallus)
  misc_feature (36): n=c or t
ctgatgtttcatctaattctaagtgcatgcactgancatatcctaagttgtacttcatattataaccattt

SEQ ID NO: 20171 - DNA, 71 bp, chicken (Gallus Gallus)
  misc_feature (36): n=c or g
atgggcggctgtactgcaagaaggactactgggcgngttttggggagctgtgccacggctgcgccgagcag

SEQ ID NO: 20172 - DNA, 71 bp, chicken (Gallus Gallus)
  misc_feature (36): n=a or t
aatatacttttgttatgtatactcaaatctaatgcnaaagcctatctgcaaagttatctgcagcattcagg

SEQ ID NO: 20173 - DNA, 71 bp, chicken (Gallus Gallus)
  misc_feature (36): n=a or c
acttacaagattatttatattattggagatacatgnaaatggttccagaagaacatggaaaggttactcct

SEQ ID NO: 20174 - DNA, 71 bp, chicken (Gallus Gallus)
  misc_feature (36): n=c or t
tccctccccttggagattttaaagccaagagctggntgatagtctggtttgttatactgagaattcctgag

SEQ ID NO: 20175 - DNA, 71 bp, chicken (Gallus Gallus)
  misc_feature (36): n=a or c
agtaggaatagattttctgtctatcaaatgtgatcnaagccagtcctttcaacaattattaaatctcacag

SEQ ID NO: 20176 - DNA, 71 bp, chicken (Gallus Gallus)
  misc_feature (36): n=a or g
ccctatgatgtttatgatacagattatgtggtaatntgttagaaagataaatgtaagtttatagggagaga

SEQ ID NO: 20177 - DNA, 71 bp, chicken (Gallus Gallus)
  misc_feature (36): n=a or c
ccgttccgtgactctatgagatgcacaacgaggccntccgggatttctgctttccagagcaaaagttggag

SEQ ID NO: 20178 - DNA, 71 bp, chicken (Gallus Gallus)
  misc_feature (36): n=g or t
ctgctttttttctgagcacctcatggaggctggaanggaagcctatatgtcttgttaagcccgtttcatac

SEQ ID NO: 20179 - DNA, 71 bp, chicken (Gallus Gallus)
  misc_feature (36): n=c or t
gaagagcatgctcagcatttcttggagtatggcttncttactggcaattggagcaccattcacatagttgt

SEQ ID NO: 20180 - DNA, 71 bp, chicken (Gallus Gallus)
  misc_feature (36): n=c or t
aggtgaaagtgaaagggatctagccataatcaaagncgattatccaaggattctgtctatctggttctttt

SEQ ID NO: 20181 - DNA, 71 bp, chicken (Gallus Gallus)
  misc_feature (36): n=g or t
cagaatatcttggcacactcagtggcagagtgaggnagaaagaatgcaccattagatgaattctcttccgg

SEQ ID NO: 20182 - DNA, 71 bp, chicken (Gallus Gallus)
  misc_feature (36): n=g or t
gagtcccaaaggggaagtgaccctacgtgggcatcnggatccccaaaggaaggtgaccctctatggactcc

SEQ ID NO: 20183 - DNA, 71 bp, chicken (Gallus Gallus)
  misc_feature (36): n=c or t
caaagttgtaaacccagttcaactggctaccaggcnctgactgtgcttggtacaaaacaattggtatgtac

SEQ ID NO: 20184 - DNA, 71 bp, chicken (Gallus Gallus)
  misc_feature (36): n=c or t
gtctaacagcataccacctcttccatgtctcttacntccagtatctgtctccagagaaaatatatgtcttc

SEQ ID NO: 20185 - DNA, 71 bp, chicken (Gallus Gallus)
  misc_feature (36): n=a or c
attatgaattttcaggctggcagtccattcaggganccactgataaagtttttgacgcgtcatccatccca

SEQ ID NO: 20186 - DNA, 71 bp, chicken (Gallus Gallus)
  misc_feature (36): n=g or t
tggagcccttaatatcacactgttaaatgaggatcnggcatgttgaatttttcaattagttgtgattttta

SEQ ID NO: 20187 - DNA, 71 bp, chicken (Gallus Gallus)
  misc_feature (36): n=g or t
atgaattcagtgtttaagactattctagacttgacntatccaataacctcaatgttttctggagcagcttt

SEQ ID NO: 20188 - DNA, 71 bp, chicken (Gallus Gallus)
  misc_feature (36): n=g or t
cattaattcctccacagcagaattcagcagttttangggtgtatcttgcctcttcttacaataactgaggc

SEQ ID NO: 20189 - DNA, 71 bp, chicken (Gallus Gallus)
  misc_feature (36): n=c or t
ttgcattggaccctctctggacatgacagtagcttntgaaagttctggttaaacagaattgaaatgcaaac

SEQ ID NO: 20190 - DNA, 71 bp, chicken (Gallus Gallus)
  misc_feature (36): n=g or t
gccttgcttgcaggatgctgactcttccgagcgggngctcatggacatgcgctggggcctggtgccctcct

SEQ ID NO: 20191 - DNA, 71 bp, chicken (Gallus Gallus)
  misc_feature (36): n=a or c
acatttagcacttctgcctgatgtaaccccaactcncacactcgggctcagggctaaaacagcaaggctgc

SEQ ID NO: 20192 - DNA, 71 bp, chicken (Gallus Gallus)
  misc_feature (36): n=a or c
tacagcttcaaatctctgccatgtggacagtccaanatctgtgcatagctgccattggttcaaagcagtgc

SEQ ID NO: 20193 - DNA, 71 bp, chicken (Gallus Gallus)
  misc_feature (36): n=g or t
caaccaatgaaaccagaaatggcccatcagaccttnggcctaatcttggagatgatgcttttacctgctcg

SEQ ID NO: 20194 - DNA, 71 bp, chicken (Gallus Gallus)
  misc_feature (36): n=a or g
aaaaggtaaggagaaggaaacttttacagacgtcanatcacacctgtccttcttcagcttcctcccattct

SEQ ID NO: 20195 - DNA, 71 bp, chicken (Gallus Gallus)
  misc_feature (36): n=c or t
tttgctgtgatctgctgtacggaaagaaacgactgnagctgaaaagatcctgagcgaacaaatggatttct

SEQ ID NO: 20196 - DNA, 71 bp, chicken (Gallus Gallus)
  misc_feature (36): n=g or t
gtccagttgcagcaagtctctaagaataaaactggngaatgctgctcattgctttgaaacgttttgtgagc

SEQ ID NO: 20197 - DNA, 71 bp, chicken (Gallus Gallus)
  misc_feature (36): n=a or c
tcatcagcagtgttgattaccagcctcttcttcccnctgctactagcacttcaggatcatcctgtccatcc

SEQ ID NO: 20198 - DNA, 71 bp, chicken (Gallus Gallus)
  misc_feature (36): n=g or t
tgcacgaggccaagagcttcctgcagaagcggcagnttgggaacatcccccccgtgcgccgcctgggccac

SEQ ID NO: 20199 - DNA, 71 bp, chicken (Gallus Gallus)
  misc_feature (36): n=g or t
gcatgagatgaaaaatggaatcccacccaaccgtancatcctgggaggcttctcacaggtgagctgagctg

SEQ ID NO: 20200 - DNA, 71 bp, chicken (Gallus Gallus)
  misc_feature (36): n=a or c
tgcagttggatcacacccagtagtagggctgctccnggcacccgtctggacagcaagaactgcagggctgc

SEQ ID NO: 20201 - DNA, 71 bp, chicken (Gallus Gallus)
  misc_feature (36): n=a or c
cttacccatctactttcccttttgtgccatccaacncttccactttgcttccatcagcaagacaccagttc

SEQ ID NO: 20202 - DNA, 71 bp, chicken (Gallus Gallus)
  misc_feature (36): n=a or c
tctcaatattaatatgaaatagcacttctctttacncccaagcttccccatgtattcatagcattcttgcc

SEQ ID NO: 20203 - DNA, 71 bp, chicken (Gallus Gallus)
  misc_feature (36): n=c or t
ggctttggccaagggttccttcttgctctctatccnctctggtttcctctcgagtttctctgagccacggc

SEQ ID NO: 20204 - DNA, 71 bp, chicken (Gallus Gallus)
  misc_feature (36): n=a or c
atgtggaatgcatcattcaggaaaccgagcacaganccgcctttctcttcaaatgctccacatagctcctt

SEQ ID NO: 20205 - DNA, 71 bp, chicken (Gallus Gallus)
  misc_feature (36): n=a or c
gcttttcttaagctcccataaagagcagtattcccnatttgtttgcgctgtggtgggacagactggtattg

SEQ ID NO: 20206 - DNA, 71 bp, chicken (Gallus Gallus)
  misc_feature (36): n=g or t
accataagcagctcacgctctgctgttcgttttagngcacggtagcgtttctcatcagcagatgacagttc

SEQ ID NO: 20207 - DNA, 71 bp, chicken (Gallus Gallus)
  misc_feature (36): n=c or t
aacccccaacataaacaaacatgtaccttcttgacngcgtattttgggtcatctggaagaatcaatacgat

SEQ ID NO: 20208 - DNA, 71 bp, chicken (Gallus Gallus)
  misc_feature (36): n=g or t
ttttgtttaggttcatcctcagccactagtggcagnaccattattggagagaacactggagtttttgttgg

SEQ ID NO: 20209 - DNA, 71 bp, chicken (Gallus Gallus)
  misc_feature (36): n=g or t
ttattttttttgtgagatttcacatggaggcagagngatgcacagacttatatttggtttctgatgcaagc

SEQ ID NO: 20210 - DNA, 71 bp, chicken (Gallus Gallus)
  misc_feature (36): n=a or c
ttgctaaatgctgttcccatgaatgcaagcctttcnctgccattagcgcctgcccacaggtataaacattc

SEQ ID NO: 20211 - DNA, 71 bp, chicken (Gallus Gallus)
  misc_feature (36): n=a or c
taagcagatgacctgcattcataagtagattcgttnaagccattatgaacagcagttacattaataaatat

SEQ ID NO: 20212 - DNA, 71 bp, chicken (Gallus Gallus)
  misc_feature (36): n=a or c
cattacagactctaatcactatttttcccgtgaacncttccagcggctttgaacccaaaatccagcagcca

SEQ ID NO: 20213 - DNA, 71 bp, chicken (Gallus Gallus)
  misc_feature (36): n=a or c
tcattagcattttaatgaattgctttaaaatgaaanaccattcttttctgatatagtggttgtgatagaag

SEQ ID NO: 20214 - DNA, 71 bp, chicken (Gallus Gallus)
  misc_feature (36): n=a or c
acatgagtttaagggcatggtgtgaagaggagcagnaatgaaagacacagacttcagcgagtctgtgggca

SEQ ID NO: 20215 - DNA, 71 bp, chicken (Gallus Gallus)
  misc_feature (36): n=g or t
ttaagtaataagttgatacattacagtagctcatgnccacatttattcctcctcagacaggcaagtacctg

SEQ ID NO: 20216 - DNA, 71 bp, chicken (Gallus Gallus)
  misc_feature (36): n=g or t
cccaaaaaggcggccaacttaccaggttgaatatcntatccacgatgtctctgttcgacacctcaccaacc

SEQ ID NO: 20217 - DNA, 71 bp, chicken (Gallus Gallus)
  misc_feature (36): n=g or t
gtctccttagcattgttcagaacgctcattggcttncattgtgaagatgtgatgttgcagctagttttaag

SEQ ID NO: 20218 - DNA, 71 bp, chicken (Gallus Gallus)
  misc_feature (36): n=a or c
actaggtgtcaaacaatgcagcatgccagcttaccncaggactatcctggttgtcattaagctctgagagt

SEQ ID NO: 20219 - DNA, 71 bp, chicken (Gallus Gallus)
  misc_feature (36): n=c or t
ttttgcatactcttcacatcaggccccctcatctgngttactgctctgggggtgttggagtctccccgccc

SEQ ID NO: 20220 - DNA, 71 bp, chicken (Gallus Gallus)
  misc_feature (36): n=a or c
gtaccttagcaacctcatttgaaataaaattctccncctttctatttgagccccagttcaaaggcaaatat

SEQ ID NO: 20221 - DNA, 71 bp, chicken (Gallus Gallus)
  misc_feature (36): n=a or g
aacaaatgtttcataggttttctttgtgatcgtttnggcttgaaatgcgctctggaggtccagcctttctc

SEQ ID NO: 20222 - DNA, 71 bp, chicken (Gallus Gallus)
  misc_feature (36): n=c or t
ataccaggaagtttgcctgaaattcagtcagttttncctttcaactgcatcttctttttattatgtttaag

SEQ ID NO: 20223 - DNA, 71 bp, chicken (Gallus Gallus)
  misc_feature (36): n=c or t
atgtcacaggtagtaaaagacagtttttcttagaantgagtttaaatctgtttttgctacactgcagggag

SEQ ID NO: 20224 - DNA, 71 bp, chicken (Gallus Gallus)
  misc_feature (36): n=a or g
gaagggatgggtgaggtatctccttaggcagcaaangcaaaatctccttttttggaaacatcagcttgcag

SEQ ID NO: 20225 - DNA, 71 bp, chicken (Gallus Gallus)
  misc_feature (36): n=c or t
ctgccctccccgctggcccggggtccctttggttcngcttagcctcaccatcatgggaacctgcccctaag

SEQ ID NO: 20226 - DNA, 71 bp, chicken (Gallus Gallus)
  misc_feature (36): n=a or g
cttttccaagtctaagtcctcaactactcctttaanttgcattattgatttgtcacctaatgatacgttct

SEQ ID NO: 20227 - DNA, 71 bp, chicken (Gallus Gallus)
  misc_feature (36): n=a or g
gcccccaggctgacaagagtgtagatccactgaatnacaaacattatgacgagggacacaattgcctattg

SEQ ID NO: 20228 - DNA, 71 bp, chicken (Gallus Gallus)
  misc_feature (36): n=c or t
gaatgtcttagtggcagtcttctattccgtctcgantgaagtcatttgaaaatggagttgtcagacactat

SEQ ID NO: 20229 - DNA, 71 bp, chicken (Gallus Gallus)
  misc_feature (36): n=c or t
taggcagcattctgtaacgctcctggcaaagtctgnctcagaaggaaaatgtggagaaaagaaggaaaacc

SEQ ID NO: 20230 - DNA, 71 bp, chicken (Gallus Gallus)
  misc_feature (36): n=g or t
atcaaactgcgagaaagaggtttgttcagaaatgtnttcttccattaaatgaagacagtccattgatgtat

SEQ ID NO: 20231 - DNA, 71 bp, chicken (Gallus Gallus)
  misc_feature (36): n=a or c
aaacaaaataatcattcaccttatgtcagtccctcntaaaacgtgtccacataaatagcagtagtattcat

SEQ ID NO: 20232 - DNA, 71 bp, chicken (Gallus Gallus)
  misc_feature (36): n=a or c
ttatatggatgaagatgatgacagatccagttttcncagccatatggatattgcagcagaagaggaagtat

SEQ ID NO: 20233 - DNA, 71 bp, chicken (Gallus Gallus)
  misc_feature (36): n=a or c
gtgggggggtgctccagagaatcctgagtagagatncccctgattcctattggatgagccatgccacatag

SEQ ID NO: 20234 - DNA, 71 bp, chicken (Gallus Gallus)
  misc_feature (36): n=c or t
ggtgatgcactgtactctagataaaatgcttgcttntaaggagaagggtcaagatatattaaactgcacta

SEQ ID NO: 20235 - DNA, 71 bp, chicken (Gallus Gallus)
  misc_feature (36): n=g or t
atatatagttactgatattctccatctcaatcaagnatgaagtatgagaacctgtaaaaagataagtaaaa

SEQ ID NO: 20236 - DNA, 71 bp, chicken (Gallus Gallus)
  misc_feature (36): n=g or t
tcctgagctgccggaggtctcagctgggctcgcagngactcacggccattccatccgcttcctcccctctc

SEQ ID NO: 20237 - DNA, 71 bp, chicken (Gallus Gallus)
  misc_feature (36): n=g or t
atgtgtaacatgttttgtcagtggcctgcttctgtntctgtatctgtatgtatatctttgggaaatgttct

SEQ ID NO: 20238 - DNA, 71 bp, chicken (Gallus Gallus)
  misc_feature (36): n=g or t
actcgtgttctctgtatcaacctcgcagctggaganggaggacgaagacactatcgatgtgttccagcagc

SEQ ID NO: 20239 - DNA, 71 bp, chicken (Gallus Gallus)
  misc_feature (36): n=a or c
catctgtatgcattcaaaccttcttgaaccacaccnaagccttatgaatttgatgaatcatatttatgaaa

SEQ ID NO: 20240 - DNA, 71 bp, chicken (Gallus Gallus)
  misc_feature (36): n=a or t
caaaacagcaatagaagtgtagttattgcttcatgntttctagccattacgagcggcatcctcgtcattgt

SEQ ID NO: 20241 - DNA, 71 bp, chicken (Gallus Gallus)
  misc_feature (36): n=c or t
atgtttatgattttcctgtgctataccccttggccntctttttctccatttgtgcttcacctccccaaatc

SEQ ID NO: 20242 - DNA, 71 bp, chicken (Gallus Gallus)
  misc_feature (36): n=g or t
gtattcacaaatacctggcagcaagagctgagcttnttgtggatagccaagaagcttcctgcattgagcat

SEQ ID NO: 20243 - DNA, 71 bp, chicken (Gallus Gallus)
  misc_feature (36): n=a or g
aaacttcagacttagccttcattacttcttatggcngtcagacacaaagaggaaaattaacagatgtactg

SEQ ID NO: 20244 - DNA, 71 bp, chicken (Gallus Gallus)
  misc_feature (36): n=a or t
tttaaaagctaacattaaagaatgaaacctgtaaanctcaggaaataagcaaactttagtaagcttgttta

SEQ ID NO: 20245 - DNA, 71 bp, chicken (Gallus Gallus)
  misc_feature (36): n=a or c
ttaccacaagctctttgagcaacttcagggaaaagnaattgtaagttttgttacattagttccacatctgt

SEQ ID NO: 20246 - DNA, 71 bp, chicken (Gallus Gallus)
  misc_feature (36): n=a or t
ccaggaacctgggccatagagatgcagtggatatgnttccttttcccagtgagatctgtatcagagatcta

SEQ ID NO: 20247 - DNA, 71 bp, chicken (Gallus Gallus)
  misc_feature (36): n=a or g
tctggatgtggtttaaaagaaaggatcattctcaanttttcttgctagaaatagcacatctcacatgccac

SEQ ID NO: 20248 - DNA, 71 bp, chicken (Gallus Gallus)
  misc_feature (36): n=a or g
ccttcttgtggagacaccataatccttgattgtgancctggtatgtaagtaagtaccctctcattgagtct

SEQ ID NO: 20249 - DNA, 71 bp, chicken (Gallus Gallus)
  misc_feature (36): n=c or g
agaaaaagtattgggtggtactagataacagatagntgtacatgagccagcagtgtgccaggtgaccaaga

SEQ ID NO: 20250 - DNA, 71 bp, chicken (Gallus Gallus)
  misc_feature (36): n=c or t
ccctagaagagattacacagagagagaaagaattgnctgaaagttcatattttgattgaaggaattagagg

SEQ ID NO: 20251 - DNA, 71 bp, chicken (Gallus Gallus)
  misc_feature (36): n=a or c
gaaaaaaagagtaccaccgccttttggctccacatnaagaaataaagagctgtctaactattccttataca

SEQ ID NO: 20252 - DNA, 71 bp, chicken (Gallus Gallus)
  misc_feature (36): n=a or g
tgcctaaatctatggctttaaacatgggcaaccagngctcttacaggtctgcaggagatgtgagaatacaa

SEQ ID NO: 20253 - DNA, 71 bp, chicken (Gallus Gallus)
  misc_feature (36): n=a or g
tgcagatagtttcacattcttatatggtgttgttcngttcctcagtggatttacttttttttttcagcaga

SEQ ID NO: 20254 - DNA, 71 bp, chicken (Gallus Gallus)
  misc_feature (36): n=a or g
gtctctggagcaacctgcacagacccctcgcctgtngccactctcttatggttcttattttgggtaatatt

SEQ ID NO: 20255 - DNA, 71 bp, chicken (Gallus Gallus)
  misc_feature (36): n=c or t
ttccacctctgtgactattcaactttactcacttcncctggtttatcatgatgctccccttggtggttctg

SEQ ID NO: 20256 - DNA, 71 bp, chicken (Gallus Gallus)
  misc_feature (36): n=c or t
ttacaaagggattggtgcaacaccagtattcccganaccttattgctttctgatttgccactgaaaatagt

SEQ ID NO: 20257 - DNA, 71 bp, chicken (Gallus Gallus)
  misc_feature (36): n=c or t
actgtgggttaaaatggcagtcagctttggggtgangtaaaagggagcccatggtatccacataccaaatt

SEQ ID NO: 20258 - DNA, 71 bp, chicken (Gallus Gallus)
  misc_feature (36): n=a or g
gtttccttgacaatttcatctgtgctgtcctctacncagtaagtaactaagtgtaccaaatgtacaagtga

SEQ ID NO: 20259 - DNA, 71 bp, chicken (Gallus Gallus)
  misc_feature (36): n=a or c
tttgtcatttggttttctgctgatcgttgtccaganccaatagttctggaggtaggtagagcacagaatac

SEQ ID NO: 20260 - DNA, 71 bp, chicken (Gallus Gallus)
  misc_feature (36): n=a or t
ctcacctggtttgcagctggtagcattcaaaatatntatttaacactcttctactgctactttgcatctca

SEQ ID NO: 20261 - DNA, 71 bp, chicken (Gallus Gallus)
  misc_feature (36): n=a or t
gatactgtttcagaaatctgctttgtgtatgcaaantatagctaattagctttagagtcatgttttgttaa

SEQ ID NO: 20262 - DNA, 71 bp, chicken (Gallus Gallus)
  misc_feature (36): n=a or t
tccagatctgaagaaacaaaacaagggtagatcctnaagggatccaaccgatccctcccactctatcctgc

SEQ ID NO: 20263 - DNA, 71 bp, chicken (Gallus Gallus)
  misc_feature (36): n=a or c
tggtcttctatcatctctgtgtaaggtcacataatntactgtatagaaaaaagaacatatccgcggaacat

SEQ ID NO: 20264 - DNA, 71 bp, chicken (Gallus Gallus)
  misc_feature (36): n=c or t
aggagggaaagttcttactctccttttctgctatcnatcatcatcttctgccagacagattctcccatcca

SEQ ID NO: 20265 - DNA, 71 bp, chicken (Gallus Gallus)
  misc_feature (36): n=a or g
aatgttttatgacagcagtggtgagaaagttaaccntattaaaaaaaacattgcatgcatcacaagtactg

SEQ ID NO: 20266 - DNA, 71 bp, chicken (Gallus Gallus)
  misc_feature (36): n=c or t
gttcagcaacccaaagtctcttgccttcacagagantgtgacatccagggattctttatctgatcaactgg

SEQ ID NO: 20267 - DNA, 71 bp, chicken (Gallus Gallus)
  misc_feature (36): n=a or g
ttaaggtgaaatgcgtaagataagtgaaaaaagtangaagtaccataagtttcaggaaaggctgaagaatg

SEQ ID NO: 20268 - DNA, 71 bp, chicken (Gallus Gallus)
  misc_feature (36): n=a or g
aattcagtcacaattcagcaatttaatgattttaancaaggactgcaaggagacagactgcatttttcact

SEQ ID NO: 20269 - DNA, 71 bp, chicken (Gallus Gallus)
  misc_feature (36): n=a or g
tttgcttttgtattgagataactgtacttttgttanatgataaaatacacaaaatgaaggtcatgaatata

SEQ ID NO: 20270 - DNA, 71 bp, chicken (Gallus Gallus)
  misc_feature (36): n=c or t
caatgctcatcaatccaccaagcccacaaaaaatgngcagattttgaagacattttccagggttttaccct

SEQ ID NO: 20271 - DNA, 71 bp, chicken (Gallus Gallus)
  misc_feature (36): n=c or t
ctgaagaacccagttgttacgacagattaacccttntccttctctctaaatacctttcacatccaaccatt

SEQ ID NO: 20272 - DNA, 71 bp, chicken (Gallus Gallus)
  misc_feature (36): n=c or t
tttaatgagctagtaaaactttcttcaagaatctgntgtaatttcaggaaggtatctttaatacggagttt

SEQ ID NO: 20273 - DNA, 71 bp, chicken (Gallus Gallus)
  misc_feature (36): n=g or t
acattgaaaaaatggttaaaatgcccttcttaagcnctacagagccttaatatagggatacattaattcct

SEQ ID NO: 20274 - DNA, 71 bp, chicken (Gallus Gallus)
  misc_feature (36): n=a or g
attttttcatcagttgaaatggtggctggaaactcnagagggaaatagtaaaattaacaggttgaaaaatg

SEQ ID NO: 20275 - DNA, 71 bp, chicken (Gallus Gallus)
  misc_feature (36): n=a or g
ttttgttttttagatttttggggagacaactacatnttgttagtggaagaaaacagagtgaagactgctct

SEQ ID NO: 20276 - DNA, 71 bp, chicken (Gallus Gallus)
  misc_feature (36): n=c or t
ccagtctaaacacaatggcacactcatccaatatgngctgtttagggcagagcagctgtctaaactttcat

SEQ ID NO: 20277 - DNA, 71 bp, chicken (Gallus Gallus)
  misc_feature (36): n=a or t
acattgtttttgacagcttgaagtacaagtggagtnagattgcttcttaatccaaggtaaattatgccagt

SEQ ID NO: 20278 - DNA, 71 bp, chicken (Gallus Gallus)
  misc_feature (36): n=c or t
tattcctgactgcaccaatactcaaaacatttgtgnattttaatgtatatccaagaagaaagaagatgaga

SEQ ID NO: 20279 - DNA, 71 bp, chicken (Gallus Gallus)
  misc_feature (36): n=a or g
gaaataagccatagcttcatcagttatcattgcacnttttgaggtgttacgtgtaaagtagcactgttggg

SEQ ID NO: 20280 - DNA, 71 bp, chicken (Gallus Gallus)
  misc_feature (36): n=a or g
gcctttgtcaacagtgccttgctccattttaaaagncccatgttttttgcagtcttttctctgtcactgat

SEQ ID NO: 20281 - DNA, 71 bp, chicken (Gallus Gallus)
  misc_feature (36): n=a or g
ctatttcaacattatttacttctgagaagtcctttncaggcaaactatgatgccctgtgaaaggtagattt

SEQ ID NO: 20282 - DNA, 71 bp, chicken (Gallus Gallus)
  misc_feature (36): n=c or t
tttatgcacaggccccgaacttctgcttctgtcatntgaacaatcttcccaggacgacatcctcgtactga

SEQ ID NO: 20283 - DNA, 71 bp, chicken (Gallus Gallus)
  misc_feature (36): n=a or g
ttattttattatatgagccattaacaaaagcttgancataacactcatgttaaagctagaacgtgatggaa

SEQ ID NO: 20284 - DNA, 71 bp, chicken (Gallus Gallus)
  misc_feature (36): n=c or t
gtgcttctctttcaagtctatcttgctttggtgtcnttcactgaacatatttctcttctgttctctttctt

SEQ ID NO: 20285 - DNA, 71 bp, chicken (Gallus Gallus)
  misc_feature (36): n=c or t
ggtgtggtgtgtgtaagcagttcagagatgaatganagctgacaagtaaggaacctattaaatgactcaga

SEQ ID NO: 20286 - DNA, 71 bp, chicken (Gallus Gallus)
  misc_feature (36): n=a or g
acttgtatatatttttgattttgcaactcaagtgcngcactcttttgcacttacacctatggcattactcc

SEQ ID NO: 20287 - DNA, 71 bp, chicken (Gallus Gallus)
  misc_feature (36): n=c or t
tctttctttttttttcctcctgtggtactaatgctnctgaaagcaagtgcctaagagcacttacaaaaacc

SEQ ID NO: 20288 - DNA, 71 bp, chicken (Gallus Gallus)
  misc_feature (36): n=c or t
aaaatgaaaatggattgagtggatcaactggtagtntaaacaatattgcccaataatgtctattgaacact

SEQ ID NO: 20289 - DNA, 71 bp, chicken (Gallus Gallus)
  misc_feature (36): n=g or t
gcagcaacagatccccatggcagatgccctccaccnccaaggcaatagttctgtagctctctgttctgctg

SEQ ID NO: 20290 - DNA, 71 bp, chicken (Gallus Gallus)
  misc_feature (36): n=a or g
ccagcatgtcctcttagtaagtatctggaaaaactntacctttatgtatggattgttggggccagctacaa

SEQ ID NO: 20291 - DNA, 71 bp, chicken (Gallus Gallus)
  misc_feature (36): n=g or t
gatcaactggtaatgatgagaaatgaagggaagtanctccccaggtgttaaagcaggcatttctgttttgc

SEQ ID NO: 20292 - DNA, 71 bp, chicken (Gallus Gallus)
  misc_feature (36): n=a or g
acacttaaggattcagtatttgcagcttcaaagagngacttttgagagacaaaaggacttgagagctgaac

SEQ ID NO: 20293 - DNA, 71 bp, chicken (Gallus Gallus)
  misc_feature (36): n=c or t
agattactgcgcaaatccttatcagaccctaaatcnatggcagtccactgacattctacactgcacaatcc

SEQ ID NO: 20294 - DNA, 71 bp, chicken (Gallus Gallus)
  misc_feature (36): n=a or g
gatttctaacagattctttaaattcctgaagactcnggccaagtttttgtttcatctacttcatttcaatg

SEQ ID NO: 20295 - DNA, 71 bp, chicken (Gallus Gallus)
  misc_feature (36): n=a or t
gaagtgcaatttgagcatctcccattcccaaaagtnatgggtgctcaagacattcaggacttaatgaaaac

SEQ ID NO: 20296 - DNA, 71 bp, chicken (Gallus Gallus)
  misc_feature (36): n=c or t
gttagcaacaacttgtaacttcgcctgggctcaaangaggtttaatggctctccgtgtgcccggcggagga

SEQ ID NO: 20297 - DNA, 71 bp, chicken (Gallus Gallus)
  misc_feature (36): n=a or g
gtgtgatatgcacaaactccagaaaattgcaatggncaatctcaggggaggtcaagaatagaaattatact

SEQ ID NO: 20298 - DNA, 71 bp, chicken (Gallus Gallus)
  misc_feature (36): n=a or t
catcatcagaaaagtgacttcccactaacaagtccngtgcccttgatctcattatgatttgtccatcctca

SEQ ID NO: 20299 - DNA, 71 bp, chicken (Gallus Gallus)
  misc_feature (36): n=c or g
ggaaataacatcttaagtgtggtatgtggcttaggnatccacatcagttcttctagtgagatcgccttttt

SEQ ID NO: 20300 - DNA, 71 bp, chicken (Gallus Gallus)
  misc_feature (36): n=c or t
ttccccaaatccttacacagataagctcagctcccntcatctctgccctttatcacttgcagaggggctgc

SEQ ID NO: 20301 - DNA, 71 bp, chicken (Gallus Gallus)
  misc_feature (36): n=c or t
tagtctatacctgttgattgtccatcaccaccaatntctactttgagaatgtgtaaagaagcaccaaaatt

SEQ ID NO: 20302 - DNA, 71 bp, chicken (Gallus Gallus)
  misc_feature (36): n=g or t
ttaacgtgaccttagaaatgacatagcagaaggtantctagtaaatgttatgcagcattaatacaacttgg

SEQ ID NO: 20303 - DNA, 71 bp, chicken (Gallus Gallus)
  misc_feature (36): n=g or t
ttacatcacctcttcttgccttgtgtttgcactaangtaaaacattaattgtgctgcttgcagtagctctc

SEQ ID NO: 20304 - DNA, 71 bp, chicken (Gallus Gallus)
  misc_feature (36): n=c or g
cacatgtagtgtgcttccaagtcccctctctggtgnctggattggatgttgcatattttcatacattcaaa

SEQ ID NO: 20305 - DNA, 71 bp, chicken (Gallus Gallus)
  misc_feature (36): n=g or t
atgatatattttcctaattatctgatgcagattctnttatcaggaatatttaaatatatttggagaaattt

SEQ ID NO: 20306 - DNA, 71 bp, chicken (Gallus Gallus)
  misc_feature (36): n=c or t
taaaataagccaaagtttaagggttaccatttctgnctgtaaagcttgattttttttctctagcattagac

SEQ ID NO: 20307 - DNA, 71 bp, chicken (Gallus Gallus)
  misc_feature (36): n=a or g
cctgggcagaagcggaagcaatacaacgacagcccngaaaatgacatcagccgacgggacaacactgcagg

SEQ ID NO: 20308 - DNA, 71 bp, chicken (Gallus Gallus)
  misc_feature (36): n=a or g
ttgagactaccattataatttacaagaataagacanctttataaatcaagggacagtttgaaatgagagag

SEQ ID NO: 20309 - DNA, 71 bp, chicken (Gallus Gallus)
  misc_feature (36): n=c or g
ggaaagaatttcaaaggcactctaagaataaaaatnataagtattaaaaaaaaggggggggggaggagggc

SEQ ID NO: 20310 - DNA, 71 bp, chicken (Gallus Gallus)
  misc_feature (36): n=c or t
tgaattggcacatgtgcaaaatgtttcgggttttcnttctgctacagaaggtttcactgtgttctgattat

SEQ ID NO: 20311 - DNA, 71 bp, chicken (Gallus Gallus)
  misc_feature (36): n=c or t
aaattgttggtttttttaataaatattccttacaanggtatgatgtaatcttgcaagggaggtgctgcacc

SEQ ID NO: 20312 - DNA, 71 bp, chicken (Gallus Gallus)
  misc_feature (36): n=a or t
gacttatttgcagtctgtagaaacgagtaatattcntggattttaagtgaatgaatctgaaaataaaaatc

SEQ ID NO: 20313 - DNA, 71 bp, chicken (Gallus Gallus)
  misc_feature (36): n=a or g
aatcctcatgtagcatatagggatgtctcaagactngtactattcccagttaagtgcttatagctgcccca

SEQ ID NO: 20314 - DNA, 71 bp, chicken (Gallus Gallus)
  misc_feature (36): n=g or t
gctgttcaagaagctgaggtaggaattgtccatgcnttgcttggttaacagttctggagaagagagctaca

SEQ ID NO: 20315 - DNA, 71 bp, chicken (Gallus Gallus)
  misc_feature (36): n=c or t
agatcgctttgtttttaacagtcaagactgtgatgncaacagccatctaatgctttcatctcccttgtttc

SEQ ID NO: 20316 - DNA, 71 bp, chicken (Gallus Gallus)
  misc_feature (36): n=c or t
ctcactttattattgaatgtagtcacgtgataattngctcaaaagtatcactgcatgtctgtgaagcttgt

SEQ ID NO: 20317 - DNA, 71 bp, chicken (Gallus Gallus)
  misc_feature (36): n=c or g
atgcattctttatgaagagtagagaaaaggaatctnttctgcttttagttgggtcaaattcttttcattaa

SEQ ID NO: 20318 - DNA, 71 bp, chicken (Gallus Gallus)
  misc_feature (36): n=c or t
gttgctgtaaaactctcaagtaattcttcaactttnctctctccacagattttaaaatcaagctgcatggt

SEQ ID NO: 20319 - DNA, 71 bp, chicken (Gallus Gallus)
  misc_feature (36): n=c or t
gggtggcatcagcactgccagccgtgtgaggtaagnggttgtcccactcagctctatgctgtctgacctca

SEQ ID NO: 20320 - DNA, 71 bp, chicken (Gallus Gallus)
  misc_feature (36): n=a or g
ccttatttctcctgtcttcatcactgcttacttctnttgcttagatagcttcagccaacatggctgtcctc

SEQ ID NO: 20321 - DNA, 71 bp, chicken (Gallus Gallus)
  misc_feature (36): n=c or t
cataattttgaattttttttttttttttttgagttntgacttagaattgtgaattctggatatttatgcag

SEQ ID NO: 20322 - DNA, 71 bp, chicken (Gallus Gallus)
  misc_feature (36): n=c or t
gggacccctttgggtcttctgctcctatgaacccanagacttacgctgactatactatgcagagcttcttt

SEQ ID NO: 20323 - DNA, 71 bp, chicken (Gallus Gallus)
  misc_feature (36): n=a or t
tatatgctctatgtacacatccctttcaagcacaanttcagacctatgccaaggagaagaccttcctataa

SEQ ID NO: 20324 - DNA, 71 bp, chicken (Gallus Gallus)
  misc_feature (36): n=a or t
ataaaatatgaacaattactgtctaaattcactcanatacttgcacagtgtgaacttctatcattcaaatg

SEQ ID NO: 20325 - DNA, 71 bp, chicken (Gallus Gallus)
  misc_feature (36): n=c or t
atagggaaaaaaactaacaatatagctaatcagaangtagaaactacaatacgagtagtatcatgcatggc

SEQ ID NO: 20326 - DNA, 71 bp, chicken (Gallus Gallus)
  misc_feature (36): n=c or t
accactctcataatgaataatttcttccttatgtcnaacttaaacctacccttttgtaaattgaaaactgt

SEQ ID NO: 20327 - DNA, 71 bp, chicken (Gallus Gallus)
  misc_feature (36): n=a or g
gtggtctggtatttcccactgctttggtgctggacnttaaacaggagaccaaagagcatttctgtggcata

SEQ ID NO: 20328 - DNA, 71 bp, chicken (Gallus Gallus)
  misc_feature (36): n=c or t
tttttctaatgaacagcctaaatcatgagattacantgtacatggtgaaatcctgcgtcctttcttttctt

SEQ ID NO: 20329 - DNA, 71 bp, chicken (Gallus Gallus)
  misc_feature (36): n=c or g
agtatgacctctataactccagatgttgattttccncatctacatgtgtttgctattagaagtagttaata

SEQ ID NO: 20330 - DNA, 71 bp, chicken (Gallus Gallus)
  misc_feature (36): n=a or t
atatttttactctatgccttctccaattgcagctcngattttgaaggagattaaatgaaattttgattcat

SEQ ID NO: 20331 - DNA, 71 bp, chicken (Gallus Gallus)
  misc_feature (36): n=a or g
ctctctgcaatataatctacactgcagttaaaaacnagttcaaattggaataaaggaaagcctgatgcctt

SEQ ID NO: 20332 - DNA, 71 bp, chicken (Gallus Gallus)
  misc_feature (36): n=c or t
gggagaacttccgtcttccgtatacatctctgggantgcaacaggtaccaatgcggacatgggggtctttt

SEQ ID NO: 20333 - DNA, 71 bp, chicken (Gallus Gallus)
  misc_feature (36): n=a or g
tcagaatttccagggaagagttggaaaaagcagacntgcccctttatagaaacagtgaagctgtcaactta

SEQ ID NO: 20334 - DNA, 71 bp, chicken (Gallus Gallus)
  misc_feature (36): n=g or t
ataacgggtacatttctccaaatacccaagttactnagcaacccaagtcccccttccaataacaattcaaa

SEQ ID NO: 20335 - DNA, 71 bp, chicken (Gallus Gallus)
  misc_feature (36): n=c or t
gaaaaagaataaaattattctcaaaggagctgcacngtgcccggaggcagagccctatggttgctccaact

SEQ ID NO: 20336 - DNA, 71 bp, chicken (Gallus Gallus)
  misc_feature (36): n=a or g
gaaaaggagacctaagaagtatatgggagaaagaanaaaccacacaacacttacagatgatctcatactga

SEQ ID NO: 20337 - DNA, 71 bp, chicken (Gallus Gallus)
  misc_feature (36): n=a or g
ttgttttacatgcgatttcaaagatggatgaatccnccttggaaagactactacatcccaaaggagttagc

SEQ ID NO: 20338 - DNA, 71 bp, chicken (Gallus Gallus)
  misc_feature (36): n=c or t
tgtactttaattcagtaagggaatgggtatgatacnaggctgtttattctgcaatctcaacacagccacag

SEQ ID NO: 20339 - DNA, 71 bp, chicken (Gallus Gallus)
  misc_feature (36): n=c or t
aaaaagggggcttttgcagtgaagggggctgaaganagggaagaacagaaacttatagttctgcaggctct

SEQ ID NO: 20340 - DNA, 71 bp, chicken (Gallus Gallus)
  misc_feature (36): n=a or c
tggcttctccaaggcctagggggaagagacagagancaaggactctacaatgctctgtcagcaataagtta

SEQ ID NO: 20341 - DNA, 71 bp, chicken (Gallus Gallus)
  misc_feature (36): n=c or g
gccatcatcactcaaaagatttgcctatgtctgatntgagggctgtatcaatttttcctctctcagtgctt

SEQ ID NO: 20342 - DNA, 71 bp, chicken (Gallus Gallus)
  misc_feature (36): n=c or g
acaccatgagttgtaaagttagtgataagcaagatntgccatggtgtcaagctttacatttctgcaattaa

SEQ ID NO: 20343 - DNA, 71 bp, chicken (Gallus Gallus)
  misc_feature (36): n=g or t
caatccaattctctgagtccattatcaacttcagtnttattctgtgtgtaaaatgttgtctaaatgagaac

SEQ ID NO: 20344 - DNA, 71 bp, chicken (Gallus Gallus)
  misc_feature (36): n=a or g
tttgtagaaacgtccagcagttccttacttcgtgcntgccactgcagctagtagaacaagccaatgtgact

SEQ ID NO: 20345 - DNA, 71 bp, chicken (Gallus Gallus)
  misc_feature (36): n=a or g
gggatggtacacgtgaaggatatcagactgattcanaaccgatcacgttttttaaaaggtagttgtcattt

SEQ ID NO: 20346 - DNA, 71 bp, chicken (Gallus Gallus)
  misc_feature (36): n=c or t
tcccaccaacaaacagccacatgtcattacaggtangttacctctgtgagtccctttcccgtcagctggaa

SEQ ID NO: 20347 - DNA, 71 bp, chicken (Gallus Gallus)
  misc_feature (36): n=c or t
atcttgctaaagaattaattgcaaactgagctcttntatggtaattttaatcataataagggaaacctcaa

SEQ ID NO: 20348 - DNA, 71 bp, chicken (Gallus Gallus)
  misc_feature (36): n=a or g
gttacattagtttcctatttaaaggggaagaaaacnaaacaacccataactgcatgctttctttgaaaaac

SEQ ID NO: 20349 - DNA, 71 bp, chicken (Gallus Gallus)
  misc_feature (36): n=a or c
taaaaagggaaaggcagactcttcacacccccacantccaggtgattttgcctgcaggagcaaatgctgac

SEQ ID NO: 20350 - DNA, 71 bp, chicken (Gallus Gallus)
  misc_feature (36): n=c or t
gtgaataacatctttagaaatgtgatgagtatgagnctaaaaaatggtgaatatacaacgagcaattgaat

SEQ ID NO: 20351 - DNA, 71 bp, chicken (Gallus Gallus)
  misc_feature (36): n=a or g
gttcagagatctcaaaatgacaaatgtgaaatcctntggcttctactggatatcactaaataaatgtaaaa

SEQ ID NO: 20352 - DNA, 71 bp, chicken (Gallus Gallus)
  misc_feature (36): n=a or t
ttttagtctttaaacagtcggtagaatagaaagctnactgcatgaggctggtcacacagtacgcattacag

SEQ ID NO: 20353 - DNA, 71 bp, chicken (Gallus Gallus)
  misc_feature (36): n=c or t
taacatttctaaccttctaatctttgcaggtttctnctctgtagccctcttccttcactaaaataattaca

SEQ ID NO: 20354 - DNA, 71 bp, chicken (Gallus Gallus)
  misc_feature (36): n=c or t
gctgcaataatgagcaatgagggctatagggtgttntttcatgcgttgcagtgcattcattcctgggggct

SEQ ID NO: 20355 - DNA, 71 bp, chicken (Gallus Gallus)
  misc_feature (36): n=a or g
cttcattttgtcctcttcaggctgtgtctagcttcngctctctgaaagagtcagttttcagacagctttgg

SEQ ID NO: 20356 - DNA, 71 bp, chicken (Gallus Gallus)
  misc_feature (36): n=c or g
tgtcactggacaaaagagaagagcttttgtctgaancccacaggacactagtaaatttttgaaggggactg

SEQ ID NO: 20357 - DNA, 71 bp, chicken (Gallus Gallus)
  misc_feature (36): n=c or t
ctgaaagaggcatttcagaactattccaaggccaanacacctttgatcagcagtagtttcatcttgtgaaa

SEQ ID NO: 20358 - DNA, 71 bp, chicken (Gallus Gallus)
  misc_feature (36): n=a or g
gttcttctgaagattaagtagtaaagaaggaaagancggcataaaatgatgaaggaaaaataggagtggat

SEQ ID NO: 20359 - DNA, 71 bp, chicken (Gallus Gallus)
  misc_feature (36): n=a or g
ttctgtacaacatgaaaaacaaatggtgaaagtcangttcactgttggggggcggctcattgcgcccacca

SEQ ID NO: 20360 - DNA, 71 bp, chicken (Gallus Gallus)
  misc_feature (36): n=a or g
tcctgtccttggactacctcttatcttttgtcagcntaagcgttgctgcagctgctgtgagccacatcaga

SEQ ID NO: 20361 - DNA, 71 bp, chicken (Gallus Gallus)
  misc_feature (36): n=a or g
aaacacctaatgtttgttttgaggtggtgcaaaggntgctgctcatttgtgttactctttgaggaaagatt

SEQ ID NO: 20362 - DNA, 71 bp, chicken (Gallus Gallus)
  misc_feature (36): n=a or g
gaattatatgccattgtagtactagtagactccaanattagttaaattcaaacttacaaatgtacaagggc

SEQ ID NO: 20363 - DNA, 71 bp, chicken (Gallus Gallus)
  misc_feature (36): n=g or t
gcgagcccaaaacagaagttggcaggctgtgtttanaaggcagaggggagaaggttacctctcactcgagg

SEQ ID NO: 20364 - DNA, 71 bp, chicken (Gallus Gallus)
  misc_feature (36): n=a or g
cctgcatttttgttgtagacttatcaaaggaaaagnaacaaggaacacacagggagagtgtggagtgttgg

SEQ ID NO: 20365 - DNA, 71 bp, chicken (Gallus Gallus)
  misc_feature (36): n=c or t
acaaaatgcactgatttgcacatctcaccttataangtatgtaagaaaaacattggcttttggatggcttt

SEQ ID NO: 20366 - DNA, 71 bp, chicken (Gallus Gallus)
  misc_feature (36): n=a or g
caagtgccacactatttctccttactattcagcctngaatactctgtgggcctgcctcagagcaataagca

SEQ ID NO: 20367 - DNA, 71 bp, chicken (Gallus Gallus)
  misc_feature (36): n=a or g
aataaactatagattggttatgcaaacttctgccanaacattcaggaccaagaagatattatacaagtgat

SEQ ID NO: 20368 - DNA, 71 bp, chicken (Gallus Gallus)
  misc_feature (36): n=c or t
tgattctgaattctgcccaaattcacttttttgtgngtgtgtgtgtatgtatttgtgtgtgtgtcccatgg

SEQ ID NO: 20369 - DNA, 71 bp, chicken (Gallus Gallus)
  misc_feature (36): n=a or g
tataactaagtgtcactttagaacatgtgactatcncacgtggctctgttgatttagttcagctgtatcta

SEQ ID NO: 20370 - DNA, 71 bp, chicken (Gallus Gallus)
  misc_feature (36): n=c or t
gaaaaaggagaccatcttctcagtcatcatagcacnggagaaccagaatttctcttcctcttctccagaaa

SEQ ID NO: 20371 - DNA, 71 bp, chicken (Gallus Gallus)
  misc_feature (36): n=c or t
gtatggtactgttaaaaaaaacaaacaacaacaaangccagctttaccatcaattcaccatattcatttac

SEQ ID NO: 20372 - DNA, 71 bp, chicken (Gallus Gallus)
  misc_feature (36): n=a or g
gtgatcagcaatgagcaaaccctatattgtccagantactgggaaatcatagaaccatagaatagattgga

SEQ ID NO: 20373 - DNA, 71 bp, chicken (Gallus Gallus)
  misc_feature (36): n=c or t
atgccctgagcagcagggaaggcatttctcccagtngcagaccagtgcactgtgtcaatcacactcctgca

SEQ ID NO: 20374 - DNA, 71 bp, chicken (Gallus Gallus)
  misc_feature (36): n=c or t
cccacacagcaactaaaggagcaagtgaaatcacangaggcttaactcacctcaattttgtctgaagcagg

SEQ ID NO: 20375 - DNA, 71 bp, chicken (Gallus Gallus)
  misc_feature (36): n=c or t
taactattccatttataattcaagggctagctgcantgcacttactccacttccctttcccgcttggcctt

SEQ ID NO: 20376 - DNA, 71 bp, chicken (Gallus Gallus)
  misc_feature (36): n=a or g
aaactaaaataatctagaataattaaactggacccntgaacaggatttttggaaaatgagaaattgaggag

SEQ ID NO: 20377 - DNA, 71 bp, chicken (Gallus Gallus)
  misc_feature (36): n=a or t
aaaaagaattaatttacatatacttgatcaaaaganattttggtatgcatatttattctttcaggagggca

SEQ ID NO: 20378 - DNA, 71 bp, chicken (Gallus Gallus)
  misc_feature (36): n=c or t
gatatctccgtgcagcattcactacttgaaagcaanggtttggtgataggttgtgaagagagggatattgg

SEQ ID NO: 20379 - DNA, 71 bp, chicken (Gallus Gallus)
  misc_feature (36): n=c or g
ctaaagggcaacgcggactgcatcttgtgaccagtntatgaggtccttcagcaccacagctggctcgtgct

SEQ ID NO: 20380 - DNA, 71 bp, chicken (Gallus Gallus)
  misc_feature (36): n=c or t
ccggatgtttggtgtatgcgtgtgctacaccttaanatattttccatatactgaatagcaaatgtccatat

SEQ ID NO: 20381 - DNA, 71 bp, chicken (Gallus Gallus)
  misc_feature (36): n=a or t
catctgcactgtgatgtaggatgtggtatggaaganattacctggaagtccttgctaatgggagggacaga

SEQ ID NO: 20382 - DNA, 71 bp, chicken (Gallus Gallus)
  misc_feature (36): n=a or g
ttattcagtaatgacagtttgtggaaaaactctccngagggatataaaatcttggcatctgtattcctttt

SEQ ID NO: 20383 - DNA, 71 bp, chicken (Gallus Gallus)
  misc_feature (36): n=c or t
cgtgtaggacagcttgcgtactataatttcctcaangtgtataggaaaatcatctccgtgacttcattttt

SEQ ID NO: 20384 - DNA, 71 bp, chicken (Gallus Gallus)
  misc_feature (36): n=a or c
tgcataaaatttttcatatcccttaccgagacatanagatcagttgcttactatcactcttgagttttcat

SEQ ID NO: 20385 - DNA, 71 bp, chicken (Gallus Gallus)
  misc_feature (36): n=a or g
aagatcaaaagagccattacaaggccagcattcaanctgcagaaagggaaaaatggtattcgtaattctcc

SEQ ID NO: 20386 - DNA, 71 bp, chicken (Gallus Gallus)
  misc_feature (36): n=g or t
gcaatacactcccactagttaactttcctgaagatntaactttgcttcctgatatattctacagtccaaga

SEQ ID NO: 20387 - DNA, 71 bp, chicken (Gallus Gallus)
  misc_feature (36): n=a or c
ggaagtactgctggagctggtcacatgaaagataanatcttaaggtcaagataggggcctatactctactc

SEQ ID NO: 20388 - DNA, 71 bp, chicken (Gallus Gallus)
  misc_feature (36): n=a or t
tacttttaaaaatgatttacaataactacagttatnattgcaacgagtcattaggcatcaccaaccactcc

SEQ ID NO: 20389 - DNA, 71 bp, chicken (Gallus Gallus)
  misc_feature (36): n=a or t
tttaatgtagcctcatgaatagagaagatatctcanaaagctggccatttttgtttgtaagtttatatgta

SEQ ID NO: 20390 - DNA, 71 bp, chicken (Gallus Gallus)
  misc_feature (36): n=c or t
gaattttgccagaaattaaaacagcaaagaaaattnggggttatctttcatcctgccaatattcagtacaa

SEQ ID NO: 20391 - DNA, 71 bp, chicken (Gallus Gallus)
  misc_feature (36): n=a or c
ttattaataataagcacatcaggcttacttttctgnggtgtttgtgctgctccctccagaggccctcccca

SEQ ID NO: 20392 - DNA, 71 bp, chicken (Gallus Gallus)
  misc_feature (36): n=g or t
gtgtaacggagagatgaaatggtgccaaatgaaacnggcacaaaatgaacaaggtgccgtccagtgaaacc

SEQ ID NO: 20393 - DNA, 71 bp, chicken (Gallus Gallus)
  misc_feature (36): n=c or g
ggagtgttgatgtaaaataaggaaaggagtcacaanggttgcattctttcttatctgcttctttgagaaag

SEQ ID NO: 20394 - DNA, 71 bp, chicken (Gallus Gallus)
  misc_feature (36): n=c or t
tagaggataattatatatttcaaatgagagataggnttgttgaaatttttatttgccttctaaaggaaata

SEQ ID NO: 20395 - DNA, 71 bp, chicken (Gallus Gallus)
  misc_feature (36): n=c or t
gatgagatccagccttggggatcaaagtaactgctnaggcagaatgtaacctgacggagcagtgctgggct

SEQ ID NO: 20396 - DNA, 71 bp, chicken (Gallus Gallus)
  misc_feature (36): n=a or c
gctgccaaattcatgaatactcaaagttttagcacntttttacaagctttggcagaaggacatcattaatg

SEQ ID NO: 20397 - DNA, 71 bp, chicken (Gallus Gallus)
  misc_feature (36): n=a or g
cctttgagctacactgagtttacttaaaatacttanactgcttttacagtactgctataactaatatataa

SEQ ID NO: 20398 - DNA, 71 bp, chicken (Gallus Gallus)
  misc_feature (36): n=a or g
tttgttctttaactaattagggaatagctgccttantcgtaaggttgagtctcttcttgttgcttgaaaaa

SEQ ID NO: 20399 - DNA, 71 bp, chicken (Gallus Gallus)
  misc_feature (36): n=a or g
aatgcatactggttgggaaataaaagctccataatnaattccatatttacacagtttttcaacaatacttt

SEQ ID NO: 20400 - DNA, 71 bp, chicken (Gallus Gallus)
  misc_feature (36): n=c or t
atgtgtctatatatacattcagagtttgtgtgactnctatgtacatacattgtatacactaccgcgtatta

SEQ ID NO: 20401 - DNA, 71 bp, chicken (Gallus Gallus)
  misc_feature (36): n=a or c
ctgattagcaaatggaatgtgtaatgtgctcccaanaggccattttcccatgagaaacaactcattttgag

SEQ ID NO: 20402 - DNA, 71 bp, chicken (Gallus Gallus)
  misc_feature (36): n=a or g
acttcaggctttgcatctgtaccagaagtctaagcntaaggaacttcttttttttaacgtgttacaaacag

SEQ ID NO: 20403 - DNA, 71 bp, chicken (Gallus Gallus)
  misc_feature (36): n=a or g
ccagccagacaggtactcacaactgcagcgtgggcngttcgctgcttgcaaacaccaccgtaactactgag

SEQ ID NO: 20404 - DNA, 71 bp, chicken (Gallus Gallus)
  misc_feature (36): n=c or t
aagtgcttcttggtgttcaaagggaaacttctatantccaggttgtacctattgttccttgtcctgtcagt

SEQ ID NO: 20405 - DNA, 71 bp, chicken (Gallus Gallus)
  misc_feature (36): n=a or g
gaatttcatgcatgtgaagctggctttcctgagcangcttgtgcagctgttgggtgctgccttggtcaagg

SEQ ID NO: 20406 - DNA, 71 bp, chicken (Gallus Gallus)
  misc_feature (36): n=a or g
ttttgttctgcatgtgcctacaccacctccccactngtttctttgataatgtcaccagttcccagagtcaa

SEQ ID NO: 20407 - DNA, 71 bp, chicken (Gallus Gallus)
  misc_feature (36): n=g or t
ggtgagggagttgagtaccctgaggataactgatcngaccattacttctgacagacgttctttgacgtcag

SEQ ID NO: 20408 - DNA, 71 bp, chicken (Gallus Gallus)
  misc_feature (36): n=c or t
acaactattaaaaaatagaaggagccaatgcaattngtcctctgtgaactctgtcttgtctatactgaact

SEQ ID NO: 20409 - DNA, 71 bp, chicken (Gallus Gallus)
  misc_feature (36): n=a or g
ctgctcccctcatgagctattttttatttattttcngctttttattatgagctgctatttgttccccatta

SEQ ID NO: 20410 - DNA, 71 bp, chicken (Gallus Gallus)
  misc_feature (36): n=a or g
taatgaaaacagtagtgagaagtaactcaggagacngtagcagattgtattttaagcacatctttgtatgt

SEQ ID NO: 20411 - DNA, 71 bp, chicken (Gallus Gallus)
  misc_feature (36): n=c or t
gcatactcctatgttcttcccttagttgttggccantcctggagacaaacttccccatttgcagtttatgg

SEQ ID NO: 20412 - DNA, 71 bp, chicken (Gallus Gallus)
  misc_feature (36): n=a or t
acctcctgtcttgtttcccatatgtcctcaatgccncttctaatagaacctagtatcaattcttttgtctt

SEQ ID NO: 20413 - DNA, 71 bp, chicken (Gallus Gallus)
  misc_feature (36): n=a or t
ttttgaggtcttttccaaccttaattattctgcgantctgtgatagcaaagaatctttaccagaaagtatc

SEQ ID NO: 20414 - DNA, 71 bp, chicken (Gallus Gallus)
  misc_feature (36): n=c or g
aagccacatctctcagcttaatataggcatgaacantaccttgtgttagtgcagctgtataagccttattt

SEQ ID NO: 20415 - DNA, 71 bp, chicken (Gallus Gallus)
  misc_feature (36): n=g or t
ttattgtcatagatggtgaggtcatatgaggctaanggatctgtttcacagaaagttgttgatgaggctgc

SEQ ID NO: 20416 - DNA, 71 bp, chicken (Gallus Gallus)
  misc_feature (36): n=c or t
cctctaaaccacctagaagactttcagaatcagtanattcagctgaggaaaacaaaactgattctaaagtg

SEQ ID NO: 20417 - DNA, 71 bp, chicken (Gallus Gallus)
  misc_feature (36): n=c or g
aaaagaaagaaagaagttacataataatttattcantactaatcattcaagctctagctgaaaataaaagc

SEQ ID NO: 20418 - DNA, 71 bp, chicken (Gallus Gallus)
  misc_feature (36): n=a or g
tgaatggctgaaattagcccaattcttccaaaggangttattcaaacagtatgaagctgttgaatgttgta

SEQ ID NO: 20419 - DNA, 71 bp, chicken (Gallus Gallus)
  misc_feature (36): n=a or g
agtcactgttgagcattaaaaaacaaatgtaaccanattaaaaaggtgcttcttccatataataaacacac

SEQ ID NO: 20420 - DNA, 71 bp, chicken (Gallus Gallus)
  misc_feature (36): n=c or g
tcccagtgctgaaagacaagaagtcttgatagtttngagaagaagtttggagaaaaagctccaagaagttt

SEQ ID NO: 20421 - DNA, 71 bp, chicken (Gallus Gallus)
  misc_feature (36): n=g or t
ttgctgttaatgtttctaatgtatttcattaaacanccattatttgactaatgaagttagttaagtatgtt

SEQ ID NO: 20422 - DNA, 71 bp, chicken (Gallus Gallus)
  misc_feature (36): n=a or g
ttctacacaaaataatccttataacagtttgttacngagctctgaggaaaaagactccagtttgagcccca

SEQ ID NO: 20423 - DNA, 71 bp, chicken (Gallus Gallus)
  misc_feature (36): n=c or t
aaagaatctcacttgattctgcctcaaaaaccactnagcatcacagaccatgttgtgtgaagctccccaac

SEQ ID NO: 20424 - DNA, 71 bp, chicken (Gallus Gallus)
  misc_feature (36): n=a or g
taactaaaagacaagaacagctacagagcagaacanaagtaggactcttaagtggctcagatcctatagat

SEQ ID NO: 20425 - DNA, 71 bp, chicken (Gallus Gallus)
  misc_feature (36): n=g or t
ttcctgtattaatcatgttgataatgagaatcattnagggaaaataatatttcaagtctttgtatttaagg

SEQ ID NO: 20426 - DNA, 71 bp, chicken (Gallus Gallus)
  misc_feature (36): n=c or t
tatattgttacttattgttgtatattatcaacttgnatatttatgttttgacatgcagaaatgcacacaca

SEQ ID NO: 20427 - DNA, 71 bp, chicken (Gallus Gallus)
  misc_feature (36): n=a or g
tgttcatacagtaatagtagaggtgtttgtgttgancccaaacttggaaaacattttccgtaatttatgtt

SEQ ID NO: 20428 - DNA, 71 bp, chicken (Gallus Gallus)
  misc_feature (36): n=c or t
ttcatactgaatgatgttatgggatttttctttganaaacgtattgattaacaaaggagtattaagcagga

SEQ ID NO: 20429 - DNA, 71 bp, chicken (Gallus Gallus)
  misc_feature (36): n=a or g
ccttctagtgacatccctggaaatactatgcattcnctactgtcgtgaagcatcacatccatcagccatga

SEQ ID NO: 20430 - DNA, 71 bp, chicken (Gallus Gallus)
  misc_feature (36): n=c or g
cagtcatagaaacagatggtgcttctggaagggccntaaacattttcaccattagttcaatgtaaacctcc

SEQ ID NO: 20431 - DNA, 71 bp, chicken (Gallus Gallus)
  misc_feature (36): n=a or g
ctaccatcatggtttagttttcctgtcacttaacantgacgtcttagtctagaatgtatgttgagctctgt

SEQ ID NO: 20432 - DNA, 71 bp, chicken (Gallus Gallus)
  misc_feature (36): n=c or t
tgcatacgagtagaaaatcaatacaagtatcttgcngaagtgacacattcattacttaacaaaggtcagaa

SEQ ID NO: 20433 - DNA, 71 bp, chicken (Gallus Gallus)
  misc_feature (36): n=a or g
gagaaaatatgtatttatacagtagattatgagtanatcttagactggatgttgtggagaagagacagtgt

SEQ ID NO: 20434 - DNA, 71 bp, chicken (Gallus Gallus)
  misc_feature (36): n=a or t
gtaagaaactggccaaaagaagttgttttgtgatgngttctatggaaaacttgcaaataggataaagatgg

SEQ ID NO: 20435 - DNA, 71 bp, chicken (Gallus Gallus)
  misc_feature (36): n=c or t
ctagacatggtaaatgtgaccattctgtagggattnctgtctccgtgcggaataaccccttttttgaaagc

SEQ ID NO: 20436 - DNA, 71 bp, chicken (Gallus Gallus)
  misc_feature (36): n=a or t
aggctgagattttgaaaacaggtaggttgtgtctangtcaaatcctgctgaagtcaatagaagtcttacct

SEQ ID NO: 20437 - DNA, 71 bp, chicken (Gallus Gallus)
  misc_feature (36): n=c or t
aatgatctgcaaggtccctaaaactaaacacagaangttacccgagccctaatcaatccgaagcactgtta

SEQ ID NO: 20438 - DNA, 71 bp, chicken (Gallus Gallus)
  misc_feature (36): n=c or t
cataaaagttatttttgaagtcatgttctgtgttgntacctgaaaatatttgtgtgatgataatcacagaa

SEQ ID NO: 20439 - DNA, 71 bp, chicken (Gallus Gallus)
  misc_feature (36): n=c or g
gatgctcttatcaagcacaggaagaagtgctggctncaccagtttttcaacaagaagattaccagggccag

SEQ ID NO: 20440 - DNA, 71 bp, chicken (Gallus Gallus)
  misc_feature (36): n=g or t
gagagatcatctgtatacgtgtataaattgcgcacntagtctctgtttcatgacattgccaattcacaaat

SEQ ID NO: 20441 - DNA, 71 bp, chicken (Gallus Gallus)
  misc_feature (36): n=g or t
tttacattttctggtattggaggaaagagagctgangctgacacatggatgctgtacaaaatctcggcttc

SEQ ID NO: 20442 - DNA, 71 bp, chicken (Gallus Gallus)
  misc_feature (36): n=g or t
tttaatgagctgctgttgaatgaaatgacagtgaanctgagaattttccagtctgctgccttagatgtgta

SEQ ID NO: 20443 - DNA, 71 bp, chicken (Gallus Gallus)
  misc_feature (36): n=a or g
catagccttaatgacattgagctcagtgggacaacncagagggatacatcaaagcaccactggcgctctgt

SEQ ID NO: 20444 - DNA, 71 bp, chicken (Gallus Gallus)
  misc_feature (36): n=c or t
acagcataactcatagccaactaaatgctactcagncttgagactacattaacttagagcttttcttcatc

SEQ ID NO: 20445 - DNA, 71 bp, chicken (Gallus Gallus)
  misc_feature (36): n=c or t
gggcagagctgcagttctgaagaaaaacaggtaagnttgtagggctggcagcaaatgccaaagtgtggtgt

SEQ ID NO: 20446 - DNA, 71 bp, chicken (Gallus Gallus)
  misc_feature (36): n=a or g
agattactttttgccttttatctgataggaaagtcnacaaataggaaagccaacaaacaagcctgattatt

SEQ ID NO: 20447 - DNA, 71 bp, chicken (Gallus Gallus)
  misc_feature (36): n=c or t
tatccagaaattagtttttaaacacaaaatcaggcntagaattaatcacttgagtagagatacaatattca

SEQ ID NO: 20448 - DNA, 71 bp, chicken (Gallus Gallus)
  misc_feature (36): n=a or t
attttgttggctatgatcacagctggggactgatanacctttttctgtctagcactggtgttaaacaccag

SEQ ID NO: 20449 - DNA, 71 bp, chicken (Gallus Gallus)
  misc_feature (36): n=c or g
cctgtcacagccttctcttatctgcatgtcctttanctataaggatctgcaggatgcttgtgtacagtagg

SEQ ID NO: 20450 - DNA, 71 bp, chicken (Gallus Gallus)
  misc_feature (36): n=a or g
tagacaaaaatatcaagttgtaagtttaagagtatngcctctcagagtatccagtaggatgttctccttat

SEQ ID NO: 20451 - DNA, 71 bp, chicken (Gallus Gallus)
  misc_feature (36): n=a or g
agccaaagtagtcctgtacgtctgtgtatgtgtgtntatgtgtgtttgcatgtgagagtctgctctgtgta

SEQ ID NO: 20452 - DNA, 71 bp, chicken (Gallus Gallus)
  misc_feature (36): n=c or t
gtcactgccactgactgtactacttctatatagganggtctgaggacatgtatgctgaatattacgagaca

SEQ ID NO: 20453 - DNA, 71 bp, chicken (Gallus Gallus)
  misc_feature (36): n=c or t
ccagaaagcagatggctcaattctcttttacatgancttgttttggtatatagaagggaaactgtttcaga

SEQ ID NO: 20454 - DNA, 71 bp, chicken (Gallus Gallus)
  misc_feature (36): n=a or c
catgcatggatgccgtacattaggatctcctttagntgcagtattcctttcttcttacctacaccaaggat

SEQ ID NO: 20455 - DNA, 71 bp, chicken (Gallus Gallus)
  misc_feature (36): n=a or g
agtgtttgtacaacaggaatagtgacttgaactgantgtcttcagaggagaatgaaacagaggttcaacac

SEQ ID NO: 20456 - DNA, 71 bp, chicken (Gallus Gallus)
  misc_feature (36): n=g or t
tagatatagttttaaggggttttcaggtagaccatnatctcaccctttgccttttcgcagtattattttta

SEQ ID NO: 20457 - DNA, 71 bp, chicken (Gallus Gallus)
  misc_feature (36): n=c or t
caagaaaaaggagtgagagcaagtaccagaactgcngtaagacaaattcctattataaaacacggataatg

SEQ ID NO: 20458 - DNA, 71 bp, chicken (Gallus Gallus)
  misc_feature (36): n=a or c
aataagttacccttctagaacaactgataatcttcnattttgcattaattcttcctgagaaaaaactcagg

SEQ ID NO: 20459 - DNA, 71 bp, chicken (Gallus Gallus)
  misc_feature (36): n=a or g
cccttcaatggccaaacatctaaattttcaggtgcncttgtaggagctgtgaaacagacaaacaatggaaa

SEQ ID NO: 20460 - DNA, 71 bp, chicken (Gallus Gallus)
  misc_feature (36): n=a or g
ttgatgtcagcttgaaatggtctctatcagagcagnaagattcacttatattcacttgcatgggtggtaag

SEQ ID NO: 20461 - DNA, 71 bp, chicken (Gallus Gallus)
  misc_feature (36): n=a or g
cccagctacgctgtggcccacaaagaaggaatccanaagacctcacttgggcttgtaattcagagaaggga

SEQ ID NO: 20462 - DNA, 71 bp, chicken (Gallus Gallus)
  misc_feature (36): n=a or c
tcctttcaagcaatgaaatcatgttgatacaaaccncatagctacactactaccatgtcaccataaagaat

SEQ ID NO: 20463 - DNA, 71 bp, chicken (Gallus Gallus)
  misc_feature (36): n=c or t
aatcagataaagatcttctaaacctctgtgcaacanctccacattgtgtgactggagcagctgctctcggt

SEQ ID NO: 20464 - DNA, 71 bp, chicken (Gallus Gallus)
  misc_feature (36): n=a or g
tatacgttgagataataatatcagtagaaggaaagntttcaataactttgtgtcttggttctcttttaagc

SEQ ID NO: 20465 - DNA, 71 bp, chicken (Gallus Gallus)
  misc_feature (36): n=a or t
aatcaagtctgtagcaaacatggcccaaggaaaagnggtacttcaaatatatcatcagtattgatgcctat

SEQ ID NO: 20466 - DNA, 71 bp, chicken (Gallus Gallus)
  misc_feature (36): n=a or t
gaactagggatcaatcaagttatttcattggcaagnatattggtagtgaatactcatatgagcaatttgca

SEQ ID NO: 20467 - DNA, 71 bp, chicken (Gallus Gallus)
  misc_feature (36): n=c or t
gctgtgccttatatacaattctagcctatcattggnggatatcctttatttaaaaggaaaaccacagcctg

SEQ ID NO: 20468 - DNA, 71 bp, chicken (Gallus Gallus)
  misc_feature (36): n=a or g
acccaaattctggcagcattctgaacaaactcacantttccaaggacacagttccagctccctcctacatg

SEQ ID NO: 20469 - DNA, 71 bp, chicken (Gallus Gallus)
  misc_feature (36): n=c or t
gttcttggtagtcatcaccttgatcctgagcgaaantgaggcagaggaccaacagctttatgagctgcatg

SEQ ID NO: 20470 - DNA, 71 bp, chicken (Gallus Gallus)
  misc_feature (36): n=c or t
tttttgaatgcgtgttgtagatttaaatggtgttgngttgcagtgctttaactgacctggttgcagagcat

SEQ ID NO: 20471 - DNA, 71 bp, chicken (Gallus Gallus)
  misc_feature (36): n=c or t
tctgtaaatggaagttaaagaaccaaaaggtgatgnatccttttaaaataccacatgctgtaattatagat

SEQ ID NO: 20472 - DNA, 71 bp, chicken (Gallus Gallus)
  misc_feature (36): n=c or g
cattctcaccaattccaacaggtgttggagaacacnagcattttgttgcacaagacagcataggttgagca

SEQ ID NO: 20473 - DNA, 71 bp, chicken (Gallus Gallus)
  misc_feature (36): n=a or g
cagctacaaaacactttttttcaacacatttctccntcattagctatgcagtttcattagcaatggacaac

SEQ ID NO: 20474 - DNA, 71 bp, chicken (Gallus Gallus)
  misc_feature (36): n=c or t
caggagaggctggctgaaactgcaagtgtgaaatgnacagtgttatttttgagaagaacattccagtataa

SEQ ID NO: 20475 - DNA, 71 bp, chicken (Gallus Gallus)
  misc_feature (36): n=a or c
ccttactgttttgatgacagagcttttacagatttnagtgccaatgcggagaaagacataaatgttgttct

SEQ ID NO: 20476 - DNA, 71 bp, chicken (Gallus Gallus)
  misc_feature (36): n=a or g
tttgggtcttatttaggaagaggagacacaaatgtngatatttaggtgggaattttggatcttacgaggag

SEQ ID NO: 20477 - DNA, 71 bp, chicken (Gallus Gallus)
  misc_feature (36): n=a or t
tcgtaagtcagtttcctaaacacaagtatatgcatntccagtaatgagtaacttttcagtggctgtgtcaa

SEQ ID NO: 20478 - DNA, 71 bp, chicken (Gallus Gallus)
  misc_feature (36): n=c or g
caactgtaaggatgaccttaccgcccaactgtgttngtctcttgtcattgcagccaatgaagattcgcaca

SEQ ID NO: 20479 - DNA, 71 bp, chicken (Gallus Gallus)
  misc_feature (36): n=a or c
catcagctcttgtctgtgcacagaagtgtaagactnaatttcaggtcttaggagagtggctagaactcagt

SEQ ID NO: 20480 - DNA, 71 bp, chicken (Gallus Gallus)
  misc_feature (36): n=a or g
ccccctccacaatcattaagaagtgaaaaaaatctncaacgaaaagccatcagtaactttatttccatcct

SEQ ID NO: 20481 - DNA, 71 bp, chicken (Gallus Gallus)
  misc_feature (36): n=c or t
tataaatggtatttaacagaagtagcaattgctatngttcaataaccacatgagcctattgtgatatttac

SEQ ID NO: 20482 - DNA, 71 bp, chicken (Gallus Gallus)
  misc_feature (36): n=a or g
ggttgagccagtctcaaggaagtagcattggggttngggttacctcgtagacagcgaagccgatggtatgc

SEQ ID NO: 20483 - DNA, 71 bp, chicken (Gallus Gallus)
  misc_feature (36): n=a or g
tgtagcagacctttccatctgagaacatatttcctnctctgctgtctctgatgtcgactgtgcttcagaga

SEQ ID NO: 20484 - DNA, 71 bp, chicken (Gallus Gallus)
  misc_feature (36): n=g or t
caaaagaggagctacagtgtagtagagctctaatanaaagtcttgacaaatgttcaactgcagtttctatc

SEQ ID NO: 20485 - DNA, 71 bp, chicken (Gallus Gallus)
  misc_feature (36): n=a or g
gcctgttatacggatttaaagtaatttctaggcttntaagtccagagattcaccttatgaaattcagcaaa

SEQ ID NO: 20486 - DNA, 71 bp, chicken (Gallus Gallus)
  misc_feature (36): n=c or g
ccaagtgaaaatcctaaaacatattaaagcccactnttagtgtggcccaaccgctgcccctgagctgcaaa

SEQ ID NO: 20487 - DNA, 71 bp, chicken (Gallus Gallus)
  misc_feature (36): n=a or c
acatccctcagtgccacattgacacaacttttgaanacctccaggggatggtgactccaccacctccctgg

SEQ ID NO: 20488 - DNA, 71 bp, chicken (Gallus Gallus)
  misc_feature (36): n=c or t
ctttatttgtatgcaccagtccatttgagcattcanagttttccttaccaccgcagggtggttaattaata

SEQ ID NO: 20489 - DNA, 71 bp, chicken (Gallus Gallus)
  misc_feature (36): n=a or g
aaatcttcatgtagataagggaacagtagtctcccntgctccagtgtgctttttagtcctgattttccatg

SEQ ID NO: 20490 - DNA, 71 bp, chicken (Gallus Gallus)
  misc_feature (36): n=a or g
ttcctacttttatatttgactgagtacttcattccntcttgatgcaaaatgaattcttgtaaatctgccag

SEQ ID NO: 20491 - DNA, 71 bp, chicken (Gallus Gallus)
  misc_feature (36): n=c or t
gaacaatgacttaaaaattctaacctcatatttttnacctcctttataagcgttagaaatgttaaaataat

SEQ ID NO: 20492 - DNA, 71 bp, chicken (Gallus Gallus)
  misc_feature (36): n=c or g
gtactattgctacctggattcaatggtgctgttctnatttgcagtcaaaagacacagaaaggctgtagcaa

SEQ ID NO: 20493 - DNA, 71 bp, chicken (Gallus Gallus)
  misc_feature (36): n=c or t
agctactccctcttgaatagctgataaagccaggancacatcctgatgggcaagttggggtattgggaagt

SEQ ID NO: 20494 - DNA, 71 bp, chicken (Gallus Gallus)
  misc_feature (36): n=c or g
ctacagctatgataactttgtaacactgaccttagnatgtgctagtatgaagtaggctaatggcattcaaa

SEQ ID NO: 20495 - DNA, 71 bp, chicken (Gallus Gallus)
  misc_feature (36): n=a or c
tcagctggagaggagatccaggacctcccatccaancaatatcatttttgctgtgacaggcagcaaacagt

SEQ ID NO: 20496 - DNA, 71 bp, chicken (Gallus Gallus)
  misc_feature (36): n=a or g
tttgactccagatgatagtggtgataccatgtctcntcattggtatagatgcaatccagaaaattgtcagc

SEQ ID NO: 20497 - DNA, 71 bp, chicken (Gallus Gallus)
  misc_feature (36): n=c or t
tgcattattaacgggcacagtgaaagagaaaagtgngtgccctactttcagcaaaatgaaaagcaggcact

SEQ ID NO: 20498 - DNA, 71 bp, chicken (Gallus Gallus)
  misc_feature (36): n=g or t
ttactcaagctcattttctccaggtcttggtgcaanccacaacatcctccccacagaagtcagtctcaagc

SEQ ID NO: 20499 - DNA, 71 bp, chicken (Gallus Gallus)
  misc_feature (36): n=a or g
ctggtggagagaaggttccctaacagtccatcgtcngttactggtggagaaggatgcacatcttgtgttca

SEQ ID NO: 20500 - DNA, 71 bp, chicken (Gallus Gallus)
  misc_feature (36): n=a or g
gcaagaaacaaaagcgggaaccaggtcctgtgtgangggggaatctgctctgccttctggagccccttcca

SEQ ID NO: 20501 - DNA, 71 bp, chicken (Gallus Gallus)
  misc_feature (36): n=c or t
gtacagacctaaggtttatgaaaaccctttcacctncttacaataaacacagaagacctgcttatgccatg

SEQ ID NO: 20502 - DNA, 71 bp, chicken (Gallus Gallus)
  misc_feature (36): n=a or g
tgcttccattatggataacagcacagagagaagacntgcagactggaaaggttcaactccatggagctctc

SEQ ID NO: 20503 - DNA, 71 bp, chicken (Gallus Gallus)
  misc_feature (36): n=c or t
cggtcaaaaggcagctcagtcgatccatgtcctcangagcctactccctcagagctctagtgaaaattgat

SEQ ID NO: 20504 - DNA, 71 bp, chicken (Gallus Gallus)
  misc_feature (36): n=g or t
gggggagatgggcttgctgagcttggagaagagcanccctgcccacagcaagaagttgaaactagatgatc

SEQ ID NO: 20505 - DNA, 71 bp, chicken (Gallus Gallus)
  misc_feature (36): n=a or g
tgcaccacgcgtacagaagcagaaagctacaccagngctacaacttggctcttctggcaatgcatagccag

SEQ ID NO: 20506 - DNA, 71 bp, chicken (Gallus Gallus)
  misc_feature (36): n=a or g
atactgatgaaatttcattctataatgggatttctncagcagtgattatgcttttaaaaaatactttaaat

SEQ ID NO: 20507 - DNA, 71 bp, chicken (Gallus Gallus)
  misc_feature (36): n=c or t
ctttcaacatttagaattctgtgttttggggaaaanagttgtgcaacttgtgattctacaaaataaatgaa

SEQ ID NO: 20508 - DNA, 71 bp, chicken (Gallus Gallus)
  misc_feature (36): n=c or g
tgctgcctccagtatgtcagagatgtatttggaganaaagtcctacttaccacttcaaggatctagactgg

SEQ ID NO: 20509 - DNA, 71 bp, chicken (Gallus Gallus)
  misc_feature (36): n=a or g
cagttgtttttgcacagctcataatggttcctggcnatgttcagcaattaatgttctttagaacaccctga

SEQ ID NO: 20510 - DNA, 71 bp, chicken (Gallus Gallus)
  misc_feature (36): n=a or g
aaaaaaaccctgtgtttgtgaattggattcaccacntcatggaatcagaaagagtactgtattgacgtact

SEQ ID NO: 20511 - DNA, 71 bp, chicken (Gallus Gallus)
  misc_feature (36): n=a or g
gtttccccccatatatcaacaagatgatttagcctnaacaaaacttcaacatgagaaacttaatgcatgaa

SEQ ID NO: 20512 - DNA, 71 bp, chicken (Gallus Gallus)
  misc_feature (36): n=c or t
catgcctgcactcagtgtgatgtttccccatttccnctactccactataaaacttagagtggagtagatga

SEQ ID NO: 20513 - DNA, 71 bp, chicken (Gallus Gallus)
  misc_feature (36): n=c or t
ggccactccttcctctacaacgtggagctgtggaanggtgagctggtggtgccccagacaggcttctatta

SEQ ID NO: 20514 - DNA, 71 bp, chicken (Gallus Gallus)
  misc_feature (36): n=a or g
tgctcttgcattatcagtagcaattatgcacttcantttccaatatacttacatcatttcaactaacgcta

SEQ ID NO: 20515 - DNA, 71 bp, chicken (Gallus Gallus)
  misc_feature (36): n=a or g
catccaaaactttgttaaggcactgctgatttcacnccaggacttcgaactggactgttattaagaatagg

SEQ ID NO: 20516 - DNA, 71 bp, chicken (Gallus Gallus)
  misc_feature (36): n=a or g
cagtaatgcgtatacgggtatagtatatttcaaaancataacctactatagagatgatgaagtgtctcagt

SEQ ID NO: 20517 - DNA, 71 bp, chicken (Gallus Gallus)
  misc_feature (36): n=c or t
gattatggtatatctggatgagcagtatcatgcttntcccaagggaattatcaagacagagctgaagtttc

SEQ ID NO: 20518 - DNA, 71 bp, chicken (Gallus Gallus)
  misc_feature (36): n=c or t
taatcactaaacaggaattcaagtggctagagctcngagtatcaaatcatttttgaaatagctctaagcca

SEQ ID NO: 20519 - DNA, 71 bp, chicken (Gallus Gallus)
  misc_feature (36): n=a or g
ccagagagcagaggtgagcatttaggaaagcagcantgcaagacccaaggagtgggcacactgcagctgca

SEQ ID NO: 20520 - DNA, 71 bp, chicken (Gallus Gallus)
  misc_feature (36): n=c or t
agaaagcttgttttgcacatattttcaagagtacanggggagatcgtggccccactgaaacatgcagctgc

SEQ ID NO: 20521 - DNA, 71 bp, chicken (Gallus Gallus)
  misc_feature (36): n=a or t
atttgagagtttggttgggtttccagaacctagaantatctccttggctatgaagccatctggcactagcc

SEQ ID NO: 20522 - DNA, 71 bp, chicken (Gallus Gallus)
  misc_feature (36): n=a or g
gagattgggggtggagagaaaacttttatctccctntttacttctcctttctcacctcactgtttctgttt

SEQ ID NO: 20523 - DNA, 71 bp, chicken (Gallus Gallus)
  misc_feature (36): n=c or t
cctcaccactctcataggaaagaacttccccctgangtccaacctcaatctttcctccttcaacttcaaac

SEQ ID NO: 20524 - DNA, 71 bp, chicken (Gallus Gallus)
  misc_feature (36): n=a or c
tatcctccattctgggattccagaaaggaatgcganataatctctctgacagataaactggtgatcatttc

SEQ ID NO: 20525 - DNA, 71 bp, chicken (Gallus Gallus)
  misc_feature (36): n=c or t
aagagcattggcatatatatccaatcactcttcttngtgcaaactgataaaattgtttgtggctctcctaa

SEQ ID NO: 20526 - DNA, 71 bp, chicken (Gallus Gallus)
  misc_feature (36): n=c or g
aatggtctatgactggatatgttagctatcaaatgntcagtgatgaagaaagtgatgcaaaatctagcaga

SEQ ID NO: 20527 - DNA, 71 bp, chicken (Gallus Gallus)
  misc_feature (36): n=c or t
aaaactggtcaaatttagccatgcaactgagcatanttgaattctcataccatgatcacaaagataattgg

SEQ ID NO: 20528 - DNA, 71 bp, chicken (Gallus Gallus)
  misc_feature (36): n=a or t
ggctggtttcttagcagtcatagaagtgcattatgnttcttaattaagaggcatagaaccatagaatggcc

SEQ ID NO: 20529 - DNA, 71 bp, chicken (Gallus Gallus)
  misc_feature (36): n=a or g
ggttgcttccatctctctttctggatagatttgcanagtggttgccagtgccatttatcagtgagtaggtc

SEQ ID NO: 20530 - DNA, 71 bp, chicken (Gallus Gallus)
  misc_feature (36): n=c or t
ttggaaagagactggtcagaagaagcaggacagggnatttcaatattaaatttatcgtagcatacatctgg

SEQ ID NO: 20531 - DNA, 71 bp, chicken (Gallus Gallus)
  misc_feature (36): n=g or t
ttgactacctaggcaaactcataacatccctgtganccatctttgtggtgattgttctgttggccagaagc

SEQ ID NO: 20532 - DNA, 71 bp, chicken (Gallus Gallus)
  misc_feature (36): n=c or t
agtcagcagctgcccacaggaactgtctgtggcctnagtcctctttgttcagcttaccactgagaagtctt

SEQ ID NO: 20533 - DNA, 71 bp, chicken (Gallus Gallus)
  misc_feature (36): n=a or c
cttcttttttctgttttgtcttttactttcagaccngagttcttcagctgggataaagttataacgatgtc

SEQ ID NO: 20534 - DNA, 71 bp, chicken (Gallus Gallus)
  misc_feature (36): n=g or t
aggagtttgaggtctggaggtggaactgtgtccttntattgaccaacttgttacatggatgaacagtgctc

SEQ ID NO: 20535 - DNA, 71 bp, chicken (Gallus Gallus)
  misc_feature (36): n=a or t
gggctgagcaccgcgtctccgtgcatcacgttcccnagcatgttgtcttagttctcttttgctcttcatta

SEQ ID NO: 20536 - DNA, 71 bp, chicken (Gallus Gallus)
  misc_feature (36): n=a or g
taactgccccggacagaggctgaaagttttctttcnaagggtaaagaacagcattaaaaatcaagtcttcc

SEQ ID NO: 20537 - DNA, 71 bp, chicken (Gallus Gallus)
  misc_feature (36): n=a or g
acagaggagtgaggagctcacctagatcagtctctntgaggacactggtcagaaatctctgatttgagggt

SEQ ID NO: 20538 - DNA, 71 bp, chicken (Gallus Gallus)
  misc_feature (36): n=g or t
cagaatgaatggaatggaatgcaaaaaaaagtatangacatgaggagtcacaatgctttaagaaactataa

SEQ ID NO: 20539 - DNA, 71 bp, chicken (Gallus Gallus)
  misc_feature (36): n=c or t
taaatttcgtaacattcagaataatttcaaacaaanattcaagatggtatcatgacttgataatcttgcaa

SEQ ID NO: 20540 - DNA, 71 bp, chicken (Gallus Gallus)
  misc_feature (36): n=c or t
gatatattcattaatattcaaagtaataagaagttntgcatagaaaaaaaacaattctgtaaatgagcatt

SEQ ID NO: 20541 - DNA, 71 bp, chicken (Gallus Gallus)
  misc_feature (36): n=a or t
gaaggccttcgtcaccagtgaatcactgagctgtangcactcagcctacggtggctccccgtagctgcagg

SEQ ID NO: 20542 - DNA, 71 bp, chicken (Gallus Gallus)
  misc_feature (36): n=a or g
aaaacaggaaaggaaaggattgacacactttattcnaaagcatcattagctgtaccaaaattcctgtcact

SEQ ID NO: 20543 - DNA, 71 bp, chicken (Gallus Gallus)
  misc_feature (36): n=a or g
cccattacttattttatttgtcagaaacaaacacanaacttgctcatggcatggaaggaaaagcagctagg

SEQ ID NO: 20544 - DNA, 71 bp, chicken (Gallus Gallus)
  misc_feature (36): n=a or t
ttggttctaccatggctaatagtgctgtcattagcnctaactgtgagccagtcacatcaatgacttcaggt

SEQ ID NO: 20545 - DNA, 71 bp, chicken (Gallus Gallus)
  misc_feature (36): n=c or g
aacctggccaaccccctttcctgtgctaaattgttntttttatttaaaaagatacctagaacttctttgac

SEQ ID NO: 20546 - DNA, 71 bp, chicken (Gallus Gallus)
  misc_feature (36): n=c or g
tctaacatgcattaacatatatgtaaggccagagtntagaccttctttgtccccagaacaagatttctgta

SEQ ID NO: 20547 - DNA, 71 bp, chicken (Gallus Gallus)
  misc_feature (36): n=g or t
gtgctttgggcctctccaaaccgcattaacaccagngtgtgcgagtggagaggccataccggtgccactac

SEQ ID NO: 20548 - DNA, 71 bp, chicken (Gallus Gallus)
  misc_feature (36): n=c or g
tacccagatcacctcctgtgctgaagtaaaactcanaaaggagcctcaccagggtagcctggacttgggtg

SEQ ID NO: 20549 - DNA, 71 bp, chicken (Gallus Gallus)
  misc_feature (36): n=c or t
ttcttgtcctgacgccctatttttgctgtacctgancctgattaaatatttgatcacatctccaacagata

SEQ ID NO: 20550 - DNA, 71 bp, chicken (Gallus Gallus)
  misc_feature (36): n=g or t
aaaactcatcgttttaactaaaagacagattttagntcaggtttgggagagaatacgttccttctcaccac

SEQ ID NO: 20551 - DNA, 71 bp, chicken (Gallus Gallus)
  misc_feature (36): n=c or t
atttttttataatttccattttttggggaaccatanagctcctttctgaacaagtgagtctaagtaatgtt

SEQ ID NO: 20552 - DNA, 71 bp, chicken (Gallus Gallus)
  misc_feature (36): n=g or t
gtccctcagcttcctgacctcttcaggttgcccaanctcccaggtttacaaggattacgtgttgggcttca

SEQ ID NO: 20553 - DNA, 71 bp, chicken (Gallus Gallus)
  misc_feature (36): n=a or c
agaaataaaattattggcatgagcaagttaacgacnaattaagtacaaaaacaaaactaaattacttgcac

SEQ ID NO: 20554 - DNA, 71 bp, chicken (Gallus Gallus)
  misc_feature (36): n=c or t
tggattacattctttgcagtgtaattccatcagtgncagtggacttcagccagactgtcttttctctactt

SEQ ID NO: 20555 - DNA, 71 bp, chicken (Gallus Gallus)
  misc_feature (36): n=c or t
ctgggggcaaatagctggatctttgctctccacganatcacaggtgccatctggacaagtcttgatacttg

SEQ ID NO: 20556 - DNA, 71 bp, chicken (Gallus Gallus)
  misc_feature (36): n=c or t
aactagttatttactttgggcagtgaaaaattgagnttcagaaaataatgaaagtagacatgtggaagaga

SEQ ID NO: 20557 - DNA, 71 bp, chicken (Gallus Gallus)
  misc_feature (36): n=a or g
ggttcctgacaagcagattatgatccaaaaatcacngtttagggaattcagaccagttctgatcttctctg

SEQ ID NO: 20558 - DNA, 71 bp, chicken (Gallus Gallus)
  misc_feature (36): n=a or c
taagagtagaccctttacagtaaggtcagtgtttcnctatgaattatttcttaataaacttattacatgaa

SEQ ID NO: 20559 - DNA, 71 bp, chicken (Gallus Gallus)
  misc_feature (36): n=c or t
ggaatttgtttctgaaaatagactgggcctgaatangtatttttatttttacttcattgtattgagatctt

SEQ ID NO: 20560 - DNA, 71 bp, chicken (Gallus Gallus)
  misc_feature (36): n=a or g
ggccctaaatctcttctagctcttaagagttaatangcacagttacacttcagttttctaaccagcatttt

SEQ ID NO: 20561 - DNA, 71 bp, chicken (Gallus Gallus)
  misc_feature (36): n=a or g
tagtccagaggtccctgatgccacgctctcagcgtnattctgctggctcacaaatcagcagatgttaacat

SEQ ID NO: 20562 - DNA, 71 bp, chicken (Gallus Gallus)
  misc_feature (36): n=c or t
tattagagcatgatattcagaaagttcacagtgctncacctgtgcacagctgttttcctccttgcttgtct

SEQ ID NO: 20563 - DNA, 71 bp, chicken (Gallus Gallus)
  misc_feature (36): n=a or g
agcacttacatgcttccagctggtgaagaaaaccangtttttgcatgtggagctgctctttccccactgac

SEQ ID NO: 20564 - DNA, 71 bp, chicken (Gallus Gallus)
  misc_feature (36): n=c or t
ccacttcaagaagaactattatagtctggacatagnacttgatcaaaaaaacatctgccattcagattcat

SEQ ID NO: 20565 - DNA, 71 bp, chicken (Gallus Gallus)
  misc_feature (36): n=c or g
cactgtacttggaggaattttgaaatattcacacanaaactgcttctgaggaaaaagaagtcatctggcag

SEQ ID NO: 20566 - DNA, 71 bp, chicken (Gallus Gallus)
  misc_feature (36): n=c or t
atgaattaaaccatgggttagagagaatgacagatnatgacacatatgtatgaagcgtgacaagctactga

SEQ ID NO: 20567 - DNA, 71 bp, chicken (Gallus Gallus)
  misc_feature (36): n=c or t
tgcacataatttcacttctgtgaagaatgtcttctnggattaagtattttctataattctgtgatttaatc

SEQ ID NO: 20568 - DNA, 71 bp, chicken (Gallus Gallus)
  misc_feature (36): n=c or g
tttaacaattcgctggagaagcatgttgataacgcncaggtgagagctctcatatttcaacagctagcgat

SEQ ID NO: 20569 - DNA, 71 bp, chicken (Gallus Gallus)
  misc_feature (36): n=c or t
aagagaatggggaaacaaacaaacaaacaaaaaaanagatcatcccaaaactaagactgaaaaaatctaac

SEQ ID NO: 20570 - DNA, 71 bp, chicken (Gallus Gallus)
  misc_feature (36): n=c or t
ctttttctttccctttcacagagtggactttaccangatcaaagaaattatagcagccttagatatagtaa

SEQ ID NO: 20571 - DNA, 71 bp, chicken (Gallus Gallus)
  misc_feature (36): n=c or t
tcaattgcttatttcctgcaaaagtggtattaaagngtggctcatagtaaatgaatgatggcatttatttc

SEQ ID NO: 20572 - DNA, 71 bp, chicken (Gallus Gallus)
  misc_feature (36): n=a or g
cattagaaattaaccctttcagtgctttatgtcaangtaagtatcatctttcagttttgtatttgccacaa

SEQ ID NO: 20573 - DNA, 71 bp, chicken (Gallus Gallus)
  misc_feature (36): n=a or g
gctccttcaggagagaagtgagttcatgtggactcnctgctgtgtattttcagagagctacttggaaaaca

SEQ ID NO: 20574 - DNA, 71 bp, chicken (Gallus Gallus)
  misc_feature (36): n=c or t
atactgcttaacttcttcatcactgacacagatgcngtgacagagtatttatcacctgcaaacttgcagag

SEQ ID NO: 20575 - DNA, 71 bp, chicken (Gallus Gallus)
  misc_feature (36): n=a or g
taaataaacagcgagggcacttagtgcagtaaatancgatttacagcagcaggaacaacaatggtggaacc

SEQ ID NO: 20576 - DNA, 71 bp, chicken (Gallus Gallus)
  misc_feature (36): n=c or t
tctgccactcagagcattcagatcacagtcttctangttgttgtgagcactctcttgaggtagatagtaat

SEQ ID NO: 20577 - DNA, 71 bp, chicken (Gallus Gallus)
  misc_feature (36): n=c or g
cagattttgttgttgttatttattttttatatgganagttattactagctgactccaaagatctggcacaa

SEQ ID NO: 20578 - DNA, 71 bp, chicken (Gallus Gallus)
  misc_feature (36): n=c or t
atttgttcaagtgagatttcagtaatgtaaaactangtatgtgtaatcattcaggtcaagttagattcaga

SEQ ID NO: 20579 - DNA, 71 bp, chicken (Gallus Gallus)
  misc_feature (36): n=a or t
ttttgcatctctccttgctaaacattcaagcaaagngtttgtttcagtgcacagagaagggaataaaatat

SEQ ID NO: 20580 - DNA, 71 bp, chicken (Gallus Gallus)
  misc_feature (36): n=a or t
gcttaaaaaataatatctgctggtcaaaagatttcnacatttttctctacattttctactcagcatttcat

SEQ ID NO: 20581 - DNA, 71 bp, chicken (Gallus Gallus)
  misc_feature (36): n=a or g
cattgttctattgcttcttttagaaaccactgaggngcagcaggttttcacatggaaaatatgactgtctt

SEQ ID NO: 20582 - DNA, 71 bp, chicken (Gallus Gallus)
  misc_feature (36): n=c or t
cacaggcatacttcaatctataacttttcgttcccnacacatatccatcagtgcttagaagtctgacctgg

SEQ ID NO: 20583 - DNA, 71 bp, chicken (Gallus Gallus)
  misc_feature (36): n=a or g
atgtattctgtccatctcaataatttttccagttgnaagttccactttccaaatggtaaaaaacaactgat

SEQ ID NO: 20584 - DNA, 71 bp, chicken (Gallus Gallus)
  misc_feature (36): n=a or t
tctgaaaattagcctgtcttctttcaaaaatatcanatcatatatgtaactatattaatatttggcattta

SEQ ID NO: 20585 - DNA, 71 bp, chicken (Gallus Gallus)
  misc_feature (36): n=c or t
catgagcctgcagtgtgcccttgtagccaagaaggncaatggtatctaaaaagagcatggtcagcaagttg

SEQ ID NO: 20586 - DNA, 71 bp, chicken (Gallus Gallus)
  misc_feature (36): n=a or g
agttttaaattataagaatatatttatatatttatnttctatatatgcacagatatttcattcagaaataa

SEQ ID NO: 20587 - DNA, 71 bp, chicken (Gallus Gallus)
  misc_feature (36): n=g or t
agagatgttttctcagcatcacccttcaggctgtgnctatactgttgcttccatgcccttcagctccccgg

SEQ ID NO: 20588 - DNA, 71 bp, chicken (Gallus Gallus)
  misc_feature (36): n=a or c
gcaaaagtggaagaagtgtacttttcttcactacanactggaaggttaatgttattgccaatgggaagtag

SEQ ID NO: 20589 - DNA, 71 bp, chicken (Gallus Gallus)
  misc_feature (36): n=g or t
aatgaatgtagataaacttgtatcgctgtgtgcatntaaatgcaatttcatgttgctgttactgcagatta

SEQ ID NO: 20590 - DNA, 71 bp, chicken (Gallus Gallus)
  misc_feature (36): n=a or g
ctactgatgattatataggattcctcttaaagctgnaaccagttctttctaactaaaattagttactagat

SEQ ID NO: 20591 - DNA, 71 bp, chicken (Gallus Gallus)
  misc_feature (36): n=c or t
tcgtccatatgttaataccaactgcaccattaattntctctgctttcaagtgatgctctatgccctacaac

SEQ ID NO: 20592 - DNA, 71 bp, chicken (Gallus Gallus)
  misc_feature (36): n=c or g
cttacagcaaagaagcatagattatgatcaccaganagccaccactgaacagcttctgagctgctgaaatc

SEQ ID NO: 20593 - DNA, 71 bp, chicken (Gallus Gallus)
  misc_feature (36): n=a or g
gatgtaaggaatattttatttagaagtttggaaacngagcagttcttagccaccttatctcaaagggagtg

SEQ ID NO: 20594 - DNA, 71 bp, chicken (Gallus Gallus)
  misc_feature (36): n=a or c
ttatcataaccaatttaatggcctagggttgtctcnttcatcatttatgcaggtaagttgtatatcccaag

SEQ ID NO: 20595 - DNA, 71 bp, chicken (Gallus Gallus)
  misc_feature (36): n=c or t
atcacagctgtaggatcagaagggataagaaactgntccgaacaacagatccagaagtcctatcactggag

SEQ ID NO: 20596 - DNA, 71 bp, chicken (Gallus Gallus)
  misc_feature (36): n=a or g
cagtgctaggttgaagctctaggatttgaccttagngtagttactagatagaagtttgttttaaaaaagca

SEQ ID NO: 20597 - DNA, 71 bp, chicken (Gallus Gallus)
  misc_feature (36): n=c or t
agcagaatatctaataacatcaaacaagaatgatanggttaacagctgtttatgcagaaattaagtttgaa

SEQ ID NO: 20598 - DNA, 71 bp, chicken (Gallus Gallus)
  misc_feature (36): n=a or g
agtgcctttctccttttgcaggctgctgggagaggncttcagtacagccagtttgtaagtacaggttgggt

SEQ ID NO: 20599 - DNA, 71 bp, chicken (Gallus Gallus)
  misc_feature (36): n=a or g
acaattcttccactagtgagatttaagtatgcaagntgtagaattagtcgctttaaaacatcatttgaatg

SEQ ID NO: 20600 - DNA, 71 bp, chicken (Gallus Gallus)
  misc_feature (36): n=a or g
tccagccaaaatatccttctgtccacaaatactcancgttgcacagttgcccagctgctaacattctcaac

SEQ ID NO: 20601 - DNA, 71 bp, chicken (Gallus Gallus)
  misc_feature (36): n=c or t
tggtaaatggcaccttaaaaacaacaggagacgccngtgcctgtttttttttaccatgggaatcaccaggt

SEQ ID NO: 20602 - DNA, 71 bp, chicken (Gallus Gallus)
  misc_feature (36): n=c or g
cgtagggttagtttaccagtgtggaggaacaaaagngaagacaaaaatctattttttttgactaataaata

SEQ ID NO: 20603 - DNA, 71 bp, chicken (Gallus Gallus)
  misc_feature (36): n=a or g
tgaccctctttgcatggcacagcaaagacagtggtnggaattcaggtaagtaggagctacgtgaatccata

SEQ ID NO: 20604 - DNA, 71 bp, chicken (Gallus Gallus)
  misc_feature (36): n=c or g
tctcattgtccttcttctcttattctaaagaatcangtttattatatttgggaagaacaataatcccttca

SEQ ID NO: 20605 - DNA, 71 bp, chicken (Gallus Gallus)
  misc_feature (36): n=c or t
accccaaggcagacctgacacaggtggagtccccangctgcttttccaactaaatcataatgaaaccgctc

SEQ ID NO: 20606 - DNA, 71 bp, chicken (Gallus Gallus)
  misc_feature (36): n=c or t
ttttagaaaagaaaaaccattgtagaagaatgaaanttttgggtgctagaggtaagggattggacaaagca

SEQ ID NO: 20607 - DNA, 71 bp, chicken (Gallus Gallus)
  misc_feature (36): n=a or g
tctgtttaaatttacaaactttaaacattctttttnattcttggttggtggagtacaacttaccattgcat

SEQ ID NO: 20608 - DNA, 71 bp, chicken (Gallus Gallus)
  misc_feature (36): n=a or g
acaccccatgtctggaagcaggcagaggaaaacgancctcctggatgaacagaagtattcctactgcagcg

SEQ ID NO: 20609 - DNA, 71 bp, chicken (Gallus Gallus)
  misc_feature (36): n=c or t
tgattccacacagtattaaccctttcacaaatctancacatacgcctcgttattatgacatactgaagaaa

SEQ ID NO: 20610 - DNA, 71 bp, chicken (Gallus Gallus)
  misc_feature (36): n=a or g
agatctcagccattcttagatatgacaccttcaaancaaaagccccctgttgcccaaaatactgatgctga

SEQ ID NO: 20611 - DNA, 71 bp, chicken (Gallus Gallus)
  misc_feature (36): n=c or t
ttcatgtaattacagaatatccaacgttggacaggngccaagaagatggtataatcaaatcaagatgtgat

SEQ ID NO: 20612 - DNA, 71 bp, chicken (Gallus Gallus)
  misc_feature (36): n=a or g
atggtgttccctcttccttcctttctgtcagcacanccattccatatctcagtttcctgactctaaatgga

SEQ ID NO: 20613 - DNA, 71 bp, chicken (Gallus Gallus)
  misc_feature (36): n=c or t
agttctctgtgcagttctgagctgtctgtgtggaantgtgctgtgttcccactgaacggctccatagctga

SEQ ID NO: 20614 - DNA, 71 bp, chicken (Gallus Gallus)
  misc_feature (36): n=a or g
aaaaacaagaaaaagtaggctccaaatctctttctngctaccaaagtacgaattcaactctataacaaggg

SEQ ID NO: 20615 - DNA, 71 bp, chicken (Gallus Gallus)
  misc_feature (36): n=a or g
ctggaaacaacttattttaaggtatggctttcattncttttatcaacataagaatgagaatctacagttct

SEQ ID NO: 20616 - DNA, 71 bp, chicken (Gallus Gallus)
  misc_feature (36): n=c or t
gctatgtaagttccttaaataaggtttaagcaatgntgttgtggaaaaatctcctgaacataagagtgtgg

SEQ ID NO: 20617 - DNA, 71 bp, chicken (Gallus Gallus)
  misc_feature (36): n=c or t
tatttccgaacagaatctactaccttctcttatttnttccacctttaaaaatgtgctgcaaaagagtcata

SEQ ID NO: 20618 - DNA, 71 bp, chicken (Gallus Gallus)
  misc_feature (36): n=c or t
tcagatgaccctgcagcagggaaaggactgctctgngcacaccatttctgacgctctctttctatgcatcc

SEQ ID NO: 20619 - DNA, 71 bp, chicken (Gallus Gallus)
  misc_feature (36): n=c or t
acagttaaatttaccagagatcctccatcagagccncagatctcatattcaggagcaaagtaaacaattaa

SEQ ID NO: 20620 - DNA, 71 bp, chicken (Gallus Gallus)
  misc_feature (36): n=c or t
atacagcaacttttcaccattgaaattctgttggangtagaaggaggcagtctagtgtggttatcgtcgtc

SEQ ID NO: 20621 - DNA, 71 bp, chicken (Gallus Gallus)
  misc_feature (36): n=a or g
gccagttatctgggggaagaagaccaaaaacatgcnaatagaacaaccaagcatatgaaatccctattttg

SEQ ID NO: 20622 - DNA, 71 bp, chicken (Gallus Gallus)
  misc_feature (36): n=a or g
tttgagttggataggggagcaaacgcttgctcaacncttaattattttgagaagagagaggctggtggaca

SEQ ID NO: 20623 - DNA, 71 bp, chicken (Gallus Gallus)
  misc_feature (36): n=a or g
acgattcccatgaaggctgaagttctgtaaaatacncaggtgccatgtgctgccttctgtatacttctcct

SEQ ID NO: 20624 - DNA, 71 bp, chicken (Gallus Gallus)
  misc_feature (36): n=a or g
tcacacattggcaaaactctggcaaaatttaatacnttagtccagacaatttgtttgctgtcactgtggct

SEQ ID NO: 20625 - DNA, 71 bp, chicken (Gallus Gallus)
  misc_feature (36): n=a or g
atgtgtatatatatttttaaataaatttgttctctngtacagtggtatttatgcttatttgttgaacttaa

SEQ ID NO: 20626 - DNA, 71 bp, chicken (Gallus Gallus)
  misc_feature (36): n=g or t
gctctctttgctgcttaactgggttagagacttcantctgattccctgtattaatacatggaggaatctgt

SEQ ID NO: 20627 - DNA, 71 bp, chicken (Gallus Gallus)
  misc_feature (36): n=c or g
acacagtgtttgcagcctgcgcgggcagtttcacangggacacacccttggagtcaatgttcatttccttc

SEQ ID NO: 20628 - DNA, 71 bp, chicken (Gallus Gallus)
  misc_feature (36): n=g or t
aaacatgagtggccagtagggctaagaaggtgattntccccctctattctgtccttgtgaggcctggtcta

SEQ ID NO: 20629 - DNA, 71 bp, chicken (Gallus Gallus)
  misc_feature (36): n=c or t
tatgaattgtttgttaatacctcagagtatgcctgnatcatataatgagttatgggtaaaacagtgttacc

SEQ ID NO: 20630 - DNA, 71 bp, chicken (Gallus Gallus)
  misc_feature (36): n=c or g
ccttgtgtttttcctgcctggagaaataactccttnagcagtgaatgagagctacttgtaatgtcactgtg

SEQ ID NO: 20631 - DNA, 71 bp, chicken (Gallus Gallus)
  misc_feature (36): n=c or t
tgttcagaaggtacaaaccagtaaattcatctttanaatataggatatttttcctttacaaactgtaagag

SEQ ID NO: 20632 - DNA, 71 bp, chicken (Gallus Gallus)
  misc_feature (36): n=c or t
ttaagatattgcttagaacatggcaagttttaacangaagcaaaaatccttgtgaaaatcttttgttcatt

SEQ ID NO: 20633 - DNA, 71 bp, chicken (Gallus Gallus)
  misc_feature (36): n=a or g
aggctgtgggaacagccttgatatcccatacagatngttgttctgggacaaaaccctcctaggtgccggag

SEQ ID NO: 20634 - DNA, 71 bp, chicken (Gallus Gallus)
  misc_feature (36): n=a or c
ttatatagtgcaaaactttgattttgatttttcatnagaaagtaatatattgaggaaaagaagaaaaaagt

SEQ ID NO: 20635 - DNA, 71 bp, chicken (Gallus Gallus)
  misc_feature (36): n=a or g
gcctttgaatgtgtaccagattgtgtcagatctgcngcaggtgagctgtggaggcagatcctagcattttg

SEQ ID NO: 20636 - DNA, 71 bp, chicken (Gallus Gallus)
  misc_feature (36): n=c or g
acaagcagctgcaagtacttccactctttctgtcanaggatggcttcagaatgacagtgtgcagtttgcct

SEQ ID NO: 20637 - DNA, 71 bp, chicken (Gallus Gallus)
  misc_feature (36): n=c or t
gaggggcaggtgatatcattttatgtcttttccccntccatctagcttctacatattgtaagtaaatttgt

SEQ ID NO: 20638 - DNA, 71 bp, chicken (Gallus Gallus)
  misc_feature (36): n=c or t
gtaattgaagaaacctatcgtcatctcgtttctgcnatggaggatctcagcctgccaggagaccattagat

SEQ ID NO: 20639 - DNA, 71 bp, chicken (Gallus Gallus)
  misc_feature (36): n=a or g
cagtacacctgtcttgtttattcaggcgatgctatnagaatactgtacactggaacacttctacttagtga

SEQ ID NO: 20640 - DNA, 71 bp, chicken (Gallus Gallus)
  misc_feature (36): n=c or g
cactgtgtcaggtgaaaagcattcatgatcttttgnccgcatgagctaattacagagaatagttcataatt

SEQ ID NO: 20641 - DNA, 71 bp, chicken (Gallus Gallus)
  misc_feature (36): n=c or t
tcaattcccacactgctaagtggattgctactgccngaaggtacagttctaacaaggtcagacacttcaac

SEQ ID NO: 20642 - DNA, 71 bp, chicken (Gallus Gallus)
  misc_feature (36): n=a or g
ctatgacattagaaatcccacaccaaaggaccacanctattctggtatgaaaagtgtgctgccatatgcac

SEQ ID NO: 20643 - DNA, 71 bp, chicken (Gallus Gallus)
  misc_feature (36): n=a or g
acaacacaactcatgaattaattccaactcagtcantagggaggaaacttggatctttgcaactctagtaa

SEQ ID NO: 20644 - DNA, 71 bp, chicken (Gallus Gallus)
  misc_feature (36): n=a or g
agacagtcattctcctgcccaccccagccctgcacnaggatcttggctgggagtgatgtattgcactgcag

SEQ ID NO: 20645 - DNA, 71 bp, chicken (Gallus Gallus)
  misc_feature (36): n=a or g
ataataaagtaaaagcctcttacgatttgcagagtncaggctgagcttccatgctctgtaaattattctgt

SEQ ID NO: 20646 - DNA, 71 bp, chicken (Gallus Gallus)
  misc_feature (36): n=a or g
gcattcaatctttcagttcagagctatcctgtgctnttacaacacataaattgtcagtctgacctgcaagc

SEQ ID NO: 20647 - DNA, 71 bp, chicken (Gallus Gallus)
  misc_feature (36): n=a or g
aaaatatactttgcagactgaactaagtagataccncacagaaattttctcgtaactgtctatgcaccaga

SEQ ID NO: 20648 - DNA, 71 bp, chicken (Gallus Gallus)
  misc_feature (36): n=c or t
agattgatactacatcttgatgttgtctgcagtcangccgagtttgtgctcaattccctcgtccaagtcat

SEQ ID NO: 20649 - DNA, 71 bp, chicken (Gallus Gallus)
  misc_feature (36): n=c or t
ctgtgtgtactcaatcctctcatccagatgatcaanaaagatgcgtgttcctatggcacatggagatgctc

SEQ ID NO: 20650 - DNA, 71 bp, chicken (Gallus Gallus)
  misc_feature (36): n=g or t
tacttaactaagtattttctggccatctatcgctgnctgccttggtatcacatcatcatgcagtgcaagat

SEQ ID NO: 20651 - DNA, 71 bp, chicken (Gallus Gallus)
  misc_feature (36): n=g or t
tctaaagaaagagcgggggagcaaactgtcagtttncccatgcagtaccacctgaaggacacagtgggaga

SEQ ID NO: 20652 - DNA, 71 bp, chicken (Gallus Gallus)
  misc_feature (36): n=a or g
aaggaaaaggaaaatagttatggctgtatagatagntagatgtatataacagctgatgcacaagcagttgc

SEQ ID NO: 20653 - DNA, 71 bp, chicken (Gallus Gallus)
  misc_feature (36): n=a or g
ccatgaggccgcagtaacaatttaaggccctgcacnttgcagagttacaaggggcaagcccccctggctct

SEQ ID NO: 20654 - DNA, 71 bp, chicken (Gallus Gallus)
  misc_feature (36): n=c or t
aagtgttttaattttctttcaggggatggcatgaangcttacatggcatacagagtaacaacaaaggtaag

SEQ ID NO: 20655 - DNA, 71 bp, chicken (Gallus Gallus)
  misc_feature (36): n=c or t
ctccagcagttaacctgggattgcattaaatgttcngtattcgaattgactttaaatccctcttggtctat

SEQ ID NO: 20656 - DNA, 71 bp, chicken (Gallus Gallus)
  misc_feature (36): n=g or t
atttcaatgtactctggtgctgaacacgtcagcacnaaatcactgctaggatttggcatatacagcctatt

SEQ ID NO: 20657 - DNA, 71 bp, chicken (Gallus Gallus)
  misc_feature (36): n=c or t
gtgaagcatattaagaaaactctttgtgtgtataangtatgtatattttagagcctttaggaatgtagttt

SEQ ID NO: 20658 - DNA, 71 bp, chicken (Gallus Gallus)
  misc_feature (36): n=a or g
tgttttacccagcttgatctttaaaaacaccatgcnttttaaggagcctgcgcagcacttgagaaacccgc

SEQ ID NO: 20659 - DNA, 71 bp, chicken (Gallus Gallus)
  misc_feature (36): n=a or g
ttgtgacatattaggtaaaatggaacacaacttatnaatgccaagaaaatcactgaccttcccttgacaag

SEQ ID NO: 20660 - DNA, 71 bp, chicken (Gallus Gallus)
  misc_feature (36): n=g or t
aatagtccctcagaaacattcgtttttcctgaaacnaggataagctgatgttgcctgcaataaaaacacag

SEQ ID NO: 20661 - DNA, 71 bp, chicken (Gallus Gallus)
  misc_feature (36): n=c or t
tgagaagaacctggcctcatccatttgtctctcacntccctttagatagttataaatatttattaggttcc

SEQ ID NO: 20662 - DNA, 71 bp, chicken (Gallus Gallus)
  misc_feature (36): n=a or g
aaaaaatctaaattgtgcaagtgtaataaacaaagntattgattctttatttttaattgttaaagtgctta

SEQ ID NO: 20663 - DNA, 71 bp, chicken (Gallus Gallus)
  misc_feature (36): n=a or g
gattaatagtgtgtactattgtgtgtactacacagnattgtgcatactcaggaattaggtacatccttcct

SEQ ID NO: 20664 - DNA, 71 bp, chicken (Gallus Gallus)
  misc_feature (36): n=c or g
aatgttcaggtgaaaaatatttaaattaaaaaattnctggaagttcctccctttccttcacttcctccgtc

SEQ ID NO: 20665 - DNA, 71 bp, chicken (Gallus Gallus)
  misc_feature (36): n=a or g
ggaggagatacatgtttagctatacacaatgctacncacacattttagatggcactgattacattcactgt

SEQ ID NO: 20666 - DNA, 71 bp, chicken (Gallus Gallus)
  misc_feature (36): n=a or g
cactaccaatatatgtgtcactgacacactgagacntaccagctacagagcttatttcctccaacctcctc

SEQ ID NO: 20667 - DNA, 71 bp, chicken (Gallus Gallus)
  misc_feature (36): n=a or g
ttgtcacttgggaccttcagttcaccaaaggtatcntattctatcctaaaagactcttgagtggactgtgg

SEQ ID NO: 20668 - DNA, 71 bp, chicken (Gallus Gallus)
  misc_feature (36): n=a or g
atgggacacatcctgttctgtatatatgaggacaantgactcattacaacttgcattcacacagttaaact

SEQ ID NO: 20669 - DNA, 71 bp, chicken (Gallus Gallus)
  misc_feature (36): n=c or g
catatagtttttctagataaagtcagtcaaactttnaagctgattgcttaaatgccatagactattctcct

SEQ ID NO: 20670 - DNA, 71 bp, chicken (Gallus Gallus)
  misc_feature (36): n=a or c
agcagaatagaagatgcagcaaactttaaaaaaaanctgttaaatatttcccttacagaaccatagatttc

SEQ ID NO: 20671 - DNA, 71 bp, chicken (Gallus Gallus)
  misc_feature (36): n=a or g
tccagcctgtgtggtcagtgggtagtatactagagntgcttgccagtcctgtgcaggaaggctcttgccta

SEQ ID NO: 20672 - DNA, 71 bp, chicken (Gallus Gallus)
  misc_feature (36): n=c or t
tttgtggtagttgtactgagctcaaggttatttgtntggggcaggtgcctcagtgcaaggaattctatcat

SEQ ID NO: 20673 - DNA, 71 bp, chicken (Gallus Gallus)
  misc_feature (36): n=a or c
tgaaatcagagcagggttcgttctagggaaaagctnactctgcttcagttggtctgaaatgtagtttggca

SEQ ID NO: 20674 - DNA, 71 bp, chicken (Gallus Gallus)
  misc_feature (36): n=a or g
tgaagaagcagctcaagatggatgcgtacagaaggngcttccagctacaccagtcagcctcgctcacttca

SEQ ID NO: 20675 - DNA, 71 bp, chicken (Gallus Gallus)
  misc_feature (36): n=a or g
gtttaattctagatgctccaaatctttaatatcagnaattccaggtattaattctgaaatcgagttgccgc

SEQ ID NO: 20676 - DNA, 71 bp, chicken (Gallus Gallus)
  misc_feature (36): n=c or t
tctcccacaaattatctccagacagtgaaatctcangtggagtgctgccacgtacataatgtaacagcttc

SEQ ID NO: 20677 - DNA, 71 bp, chicken (Gallus Gallus)
  misc_feature (36): n=a or t
gctcttttttattgtgtaggtaattgaacactgggntgtgttgcccagtgagttttaaggtttccatcagt

SEQ ID NO: 20678 - DNA, 71 bp, chicken (Gallus Gallus)
  misc_feature (36): n=a or g
gttttcacatgctattgtttcatatagctaagagangacaataaacagagaactgaaatctcaccacatac

SEQ ID NO: 20679 - DNA, 71 bp, chicken (Gallus Gallus)
  misc_feature (36): n=g or t
gaagaggaatggtcttgggttgaatttatgtaggcngctttaaaagtaattcctcctacttacttccatgg

SEQ ID NO: 20680 - DNA, 71 bp, chicken (Gallus Gallus)
  misc_feature (36): n=c or t
actggacctttcttcacatgcatggctttatgtaancaaatgggtttttgctagtttctgcacccaggata

SEQ ID NO: 20681 - DNA, 71 bp, chicken (Gallus Gallus)
  misc_feature (36): n=a or g
agatttctacaagtttcccactgtgataatttaagnactcctctgattcttctcatctaacttgctgtaat

SEQ ID NO: 20682 - DNA, 71 bp, chicken (Gallus Gallus)
  misc_feature (36): n=c or t
atgcagggctggctgtgcagccgggcatgcccagantcaccctgaatcagagattgaatacttttcatgta

SEQ ID NO: 20683 - DNA, 71 bp, chicken (Gallus Gallus)
  misc_feature (36): n=c or t
tctccaacctattaaaccagtcagggacaaaacaangtgaatagctttttgccatcttagtaagttgaaat

SEQ ID NO: 20684 - DNA, 71 bp, chicken (Gallus Gallus)
  misc_feature (36): n=a or c
tggtgggacgcttagtagttgctctgaagttgctcncgcagctgttggccattgacctcagctgttccttg

SEQ ID NO: 20685 - DNA, 71 bp, chicken (Gallus Gallus)
  misc_feature (36): n=a or g
agaaatggtagatgcttaccagcaactctccagacntgttttgaaatcgttcctgttctgctcagtttggt

SEQ ID NO: 20686 - DNA, 71 bp, chicken (Gallus Gallus)
  misc_feature (36): n=a or g
tcagcaccagagatgatcttagaagcccctcctgcngtgatgacaccaaagaagaacttccatcctcagca

SEQ ID NO: 20687 - DNA, 71 bp, chicken (Gallus Gallus)
  misc_feature (36): n=c or t
gcccagataacttgcattcgtactgcggctttaccnatagtggctggggttctttgttgctaatgtggctc

SEQ ID NO: 20688 - DNA, 71 bp, chicken (Gallus Gallus)
  misc_feature (36): n=a or g
atgtttatttcagaaagctttggcaatgtaaatcgnataagctccgagcttgatgaagttgcattaaataa

SEQ ID NO: 20689 - DNA, 71 bp, chicken (Gallus Gallus)
  misc_feature (36): n=a or g
gtatctgtgaaatgaatggcaaatctagctgctctntctttaaaatgcttctgtttaaaagatgagacaac

SEQ ID NO: 20690 - DNA, 71 bp, chicken (Gallus Gallus)
  misc_feature (36): n=a or g
agaatcacagaattccaaaatcacaaggattggaangcatctctggaaatcacctagtctagcctagcgaa

SEQ ID NO: 20691 - DNA, 71 bp, chicken (Gallus Gallus)
  misc_feature (36): n=c or t
gggtgcctgctctcagactgaacctgtgctacatgnataccaggagcatgacaaagtgccaagctgaaggg

SEQ ID NO: 20692 - DNA, 71 bp, chicken (Gallus Gallus)
  misc_feature (36): n=c or t
ccagagggaagacaggcaggtttccacatgagtgcngatgtgagatggagcagcaattagctcaaaatgtg

SEQ ID NO: 20693 - DNA, 71 bp, chicken (Gallus Gallus)
  misc_feature (36): n=c or g
aattaattaactaacaggagtattctaagcctactncactacagcaaaccgaagctgatgagagctatatt

SEQ ID NO: 20694 - DNA, 71 bp, chicken (Gallus Gallus)
  misc_feature (36): n=c or t
actttaaaaattcagcatatccaagaggccaggatnatgggtgtattctccctatcctgagctgtatattc

SEQ ID NO: 20695 - DNA, 71 bp, chicken (Gallus Gallus)
  misc_feature (36): n=a or t
ttctcactcactattcagtagctgtttgggcatagnttattcttgagatgaaaaaaaaatgcagtttacag

SEQ ID NO: 20696 - DNA, 71 bp, chicken (Gallus Gallus)
  misc_feature (36): n=c or t
gtatcagctatagaggacactggcttgctgtcaggnttttccagcagttctcacaaaaaaattcctgtgtg

SEQ ID NO: 20697 - DNA, 71 bp, chicken (Gallus Gallus)
  misc_feature (36): n=c or t
tctaggctttattgtagaagtgcatatgttactatnggtattaaactattctttatatttattgttgtact

SEQ ID NO: 20698 - DNA, 71 bp, chicken (Gallus Gallus)
  misc_feature (36): n=a or g
tgactaccatgccacagaggttatgtgcgctcactnaagtttctgatgtgcacacaagagggttcctccct

SEQ ID NO: 20699 - DNA, 71 bp, chicken (Gallus Gallus)
  misc_feature (36): n=c or t
tacaaaagagtgaaagaacctcaggttttgttttanagtcctactctctaaattgtaaaattttaaatcat

SEQ ID NO: 20700 - DNA, 71 bp, chicken (Gallus Gallus)
  misc_feature (36): n=a or g
tcttccagttaaaagcaatttcctcttgtcctttcnctatgtgcccttatgaaatgcaattctccaatata

SEQ ID NO: 20701 - DNA, 71 bp, chicken (Gallus Gallus)
  misc_feature (36): n=a or g
tttatgcaaaacaatgagctgagaaaggctccttcntggatgcaataggtaacagctgctatgccagctca

SEQ ID NO: 20702 - DNA, 71 bp, chicken (Gallus Gallus)
  misc_feature (36): n=a or c
ctccacctaatacctaatacaacaagcagaaagcangacagaagtagtggctcaagacagagttccttcca

SEQ ID NO: 20703 - DNA, 71 bp, chicken (Gallus Gallus)
  misc_feature (36): n=c or t
gctggagccatgtcacaatactgtcatttgaggcangtggcttcctgagcttgccttcaatgtctctgcag

SEQ ID NO: 20704 - DNA, 71 bp, chicken (Gallus Gallus)
  misc_feature (36): n=a or g
cttagctcttcttgatgtgccctttacagttttggnctaccaagcaggaaagctctgtcactcattaactt

SEQ ID NO: 20705 - DNA, 71 bp, chicken (Gallus Gallus)
  misc_feature (36): n=c or t
taataaacgtgactaaggtcacatggagagtccatnggaaacattaattgctcataaatctccctactcct

SEQ ID NO: 20706 - DNA, 71 bp, chicken (Gallus Gallus)
  misc_feature (36): n=a or g
atctttaaagcttaatgtatttactgttgcagctcnagtctggtactgtcaagagtctcagcacagaaaga

SEQ ID NO: 20707 - DNA, 71 bp, chicken (Gallus Gallus)
  misc_feature (36): n=a or g
taaagtatggaatgaaactgctttgcttgtgagccngcacaacttgaaaatgagttaactttaagcacaca

SEQ ID NO: 20708 - DNA, 71 bp, chicken (Gallus Gallus)
  misc_feature (36): n=c or t
aacttagacaagacagggcaatgcctaatccaagtngtgcaactatcaaacccagccttggctgtgggagt

SEQ ID NO: 20709 - DNA, 71 bp, chicken (Gallus Gallus)
  misc_feature (36): n=a or g
atgcagacactgaagagaatggcaagaaacccaggnaactcaaggctactgttaaagaagtgttaatttga

SEQ ID NO: 20710 - DNA, 71 bp, chicken (Gallus Gallus)
  misc_feature (36): n=c or t
ttgtacaatgaaatcatgttctcactgtgaagaaantcaagatctgctcttattttcttgcacatgacagc

SEQ ID NO: 20711 - DNA, 71 bp, chicken (Gallus Gallus)
  misc_feature (36): n=c or t
aagttggtatctgcttacagcatgtttaacagacgnactcatagttcaggtttaaggttagacaactaacc

SEQ ID NO: 20712 - DNA, 71 bp, chicken (Gallus Gallus)
  misc_feature (36): n=a or g
ttaaatgtgaaaataacatatacttcgagacgtcantgactgaaaaataaatggatatggacgaacattac

SEQ ID NO: 20713 - DNA, 71 bp, chicken (Gallus Gallus)
  misc_feature (36): n=c or t
agaaggccctttgaaagctaaaagcttcaaatgcantgctgatcttcaaaactttgcagataaaagaaaaa

SEQ ID NO: 20714 - DNA, 71 bp, chicken (Gallus Gallus)
  misc_feature (36): n=g or t
acttcagctcttagtaagtgcaccttggcacatttngtctgctatattatgtagtccagttctaccaagat

SEQ ID NO: 20715 - DNA, 71 bp, chicken (Gallus Gallus)
  misc_feature (36): n=a or g
ttggcatccaaattggagcctaaaacaagatgacantagcctactcaccaagaccaaagtgtgcaaaaggc

SEQ ID NO: 20716 - DNA, 71 bp, chicken (Gallus Gallus)
  misc_feature (36): n=c or t
atcatgaaaaggaaaatgatgttcatcaagacctgngcctgccactacaactgccctggagacaatgacat

SEQ ID NO: 20717 - DNA, 71 bp, chicken (Gallus Gallus)
  misc_feature (36): n=c or g
acttccattagaaagcacttgattttactcatgtgnacatgttctgctcaactttactagctcacaatttt

SEQ ID NO: 20718 - DNA, 71 bp, chicken (Gallus Gallus)
  misc_feature (36): n=c or t
tgacctcagtataattgagagcaaggtctagaaggnataaaaaatttctcctatatttcacaccaggataa

SEQ ID NO: 20719 - DNA, 71 bp, chicken (Gallus Gallus)
  misc_feature (36): n=a or g
gcactaaatcagtaaataaatcatctagaggtacanagtgtttgtgtcaatgaagtgaaaataacccttta

SEQ ID NO: 20720 - DNA, 71 bp, chicken (Gallus Gallus)
  misc_feature (36): n=a or g
cattcagaagcattcattccacaagtgatgacaccncaatttcgttactgcttcataaatacaaccaaaca

SEQ ID NO: 20721 - DNA, 71 bp, chicken (Gallus Gallus)
  misc_feature (36): n=a or g
gctctgtgttgctggtggactccactgtgcaattcntttgtgcatctggaagactctttgatagccaaacg

SEQ ID NO: 20722 - DNA, 71 bp, chicken (Gallus Gallus)
  misc_feature (36): n=g or t
ccactatccatcctgatctttgctcagagattctgncatggatgtctgcactggcacttgagggatgtgtt

SEQ ID NO: 20723 - DNA, 71 bp, chicken (Gallus Gallus)
  misc_feature (36): n=a or g
gtgaggtgtgagcaggcctgcccttgcacctttgantgatttctctgcacttcccagtaacaaagaactgg

SEQ ID NO: 20724 - DNA, 71 bp, chicken (Gallus Gallus)
  misc_feature (36): n=c or t
taaatgcaaaagtttcccaagacctcaagaatttanacaagagaacctttgcctatcaagctaacagaaca

SEQ ID NO: 20725 - DNA, 71 bp, chicken (Gallus Gallus)
  misc_feature (36): n=c or t
acctatgcttttaatattagcactaaatagtttttntagctctaaacaatggttatccccacccacctcct

SEQ ID NO: 20726 - DNA, 71 bp, chicken (Gallus Gallus)
  misc_feature (36): n=a or g
ttacacaagaagatttaaggctatgctttctctgcnaagagaaattgtttctcttggaactacttccagtg

SEQ ID NO: 20727 - DNA, 71 bp, chicken (Gallus Gallus)
  misc_feature (36): n=c or t
atcactaaggccatgttttaaccagcatcagctcancattacacgggacatcgcttgtatcctgctttttg

SEQ ID NO: 20728 - DNA, 71 bp, chicken (Gallus Gallus)
  misc_feature (36): n=g or t
tttttgttttggctttaaaaacattcaattactggnttagtaatgtaccatctacacaagaggaaactaca

SEQ ID NO: 20729 - DNA, 71 bp, chicken (Gallus Gallus)
  misc_feature (36): n=c or t
cttccttagttccttcaggcagctagtcaaagcccngagtcagaagaagtcaggcctgaagtagaatttca

SEQ ID NO: 20730 - DNA, 71 bp, chicken (Gallus Gallus)
  misc_feature (36): n=a or c
acaagtgattctagaatgcagtttgtcatctgatanaatgtacactgttaaaataaggcatattttgaaac

SEQ ID NO: 20731 - DNA, 71 bp, chicken (Gallus Gallus)
  misc_feature (36): n=a or g
agagtgaaaaaaggtcagagcactgcacaaacaganaaacctcacatgattgcttcacacacacacagagt

SEQ ID NO: 20732 - DNA, 71 bp, chicken (Gallus Gallus)
  misc_feature (36): n=c or t
ctactcttgttcctcagttcctcaacagaactttcnatataaatttataagaaatgcagatcctatgcatt

SEQ ID NO: 20733 - DNA, 71 bp, chicken (Gallus Gallus)
  misc_feature (36): n=c or t
aagtctaagaggtctgaacgctccattatcacttanttatgaaagtcataatgattaattcttggacgacg

SEQ ID NO: 20734 - DNA, 71 bp, chicken (Gallus Gallus)
  misc_feature (36): n=c or t
caactcttctgccttccatttctttcatttagtccngtggacatcacatttaaagtgaaagagctttagca

SEQ ID NO: 20735 - DNA, 71 bp, chicken (Gallus Gallus)
  misc_feature (36): n=c or t
tctttgcagaagtacaacacatggaagtgtagatgngacacttaaggacatggtttagtgggcatatggag

SEQ ID NO: 20736 - DNA, 71 bp, chicken (Gallus Gallus)
  misc_feature (36): n=a or g
tctttacctcaatatgactaaatgaagaaagttatnttccagaagtttgtatctattttctccagagataa

SEQ ID NO: 20737 - DNA, 71 bp, chicken (Gallus Gallus)
  misc_feature (36): n=a or c
agagcaaagggacaaagttaactaaggcagtttcanagggaaaggtaaagtaggacctcagaaaataaacc

SEQ ID NO: 20738 - DNA, 71 bp, chicken (Gallus Gallus)
  misc_feature (36): n=c or t
atgcagaacagaatgtgagatcacttggagagttantgaggctgcccaaggccatggcagctccaaacttt

SEQ ID NO: 20739 - DNA, 71 bp, chicken (Gallus Gallus)
  misc_feature (36): n=g or t
ctgggctgcctggtctgtctgatgagcagtgtgtgntttagtggtgctaggagagaaagaaaatttaaaat

SEQ ID NO: 20740 - DNA, 71 bp, chicken (Gallus Gallus)
  misc_feature (36): n=a or g
catggggcttttacacagtgcttgtgctcacagagngacagctgctgtttagagaaggtcattagcacagg

SEQ ID NO: 20741 - DNA, 71 bp, chicken (Gallus Gallus)
  misc_feature (36): n=a or c
tgaaaagaagtacaataaagcacaaccactctccanaaatggcagcagtataagctggcaaattcatgctc

SEQ ID NO: 20742 - DNA, 71 bp, chicken (Gallus Gallus)
  misc_feature (36): n=a or g
attattaaatcatttcagaataagcctctcacagcntaccaacctttgaatctctgtgcttaatgagctct

SEQ ID NO: 20743 - DNA, 71 bp, chicken (Gallus Gallus)
  misc_feature (36): n=c or t
atagctaagagccagatcctcaatttttccctgctntgcagtattttgcagtaaaacaactgggaaatttc

SEQ ID NO: 20744 - DNA, 71 bp, chicken (Gallus Gallus)
  misc_feature (36): n=g or t
gaaacaaagtaaaccaattccaggaatcattttccncagtagaaggcttcatgcagggactgcaccacaaa

SEQ ID NO: 20745 - DNA, 71 bp, chicken (Gallus Gallus)
  misc_feature (36): n=a or c
gatctagagctgagaaagtctcttcttagcttcctncacgtgagtacggaccctacaccaaccgcttcgca

SEQ ID NO: 20746 - DNA, 71 bp, chicken (Gallus Gallus)
  misc_feature (36): n=c or t
cgctgttccagtgcctcaacacccaacaccttcttnctaacatctaacttcagtttcccctcttttagttt

SEQ ID NO: 20747 - DNA, 71 bp, chicken (Gallus Gallus)
  misc_feature (36): n=c or g
ctgctatgcaactgttcacttattccacctgtaatntggatacgtatttaacaagtaatgatagagggtca

SEQ ID NO: 20748 - DNA, 71 bp, chicken (Gallus Gallus)
  misc_feature (36): n=a or c
accagcctacctctgtcccgtattcccaccaccacncatgcagccctatggtaacagaatgatgcaagaca

SEQ ID NO: 20749 - DNA, 71 bp, chicken (Gallus Gallus)
  misc_feature (36): n=c or g
ctgaatttagggatgtgtgaggtttattttcaagantgtatctgaatagattaatgttcaccacaaacaac

SEQ ID NO: 20750 - DNA, 71 bp, chicken (Gallus Gallus)
  misc_feature (36): n=g or t
ccatattaactataaaattcaatgcattgtttgttnatggagaatataaacaggaaggggaacagctgttt

SEQ ID NO: 20751 - DNA, 71 bp, chicken (Gallus Gallus)
  misc_feature (36): n=a or g
ctgtgatgggtcaggagaagactctaaaccttggantattttagctggtaaagcagtaactgcagaacatt

SEQ ID NO: 20752 - DNA, 71 bp, chicken (Gallus Gallus)
  misc_feature (36): n=c or g
ttacatgaaaaaaacatccatactccagaaaagcanacagtagttgcatggttgtctgtatcactgatacc

SEQ ID NO: 20753 - DNA, 71 bp, chicken (Gallus Gallus)
  misc_feature (36): n=a or g
tgcgtggaggattgtaattggaagctacttgtgctnaaaaatcagaatatccaaatcccatccttgataca

SEQ ID NO: 20754 - DNA, 71 bp, chicken (Gallus Gallus)
  misc_feature (36): n=c or t
agttcatgcatttgagtcacttttattggcatgganccggtggctcagaccaaagtgtttcctcattgcat

SEQ ID NO: 20755 - DNA, 71 bp, chicken (Gallus Gallus)
  misc_feature (36): n=c or t
tatcagttatttccagatatgtgcatggactagtanacaagcaatttcttccccatagttagaaattctca

SEQ ID NO: 20756 - DNA, 71 bp, chicken (Gallus Gallus)
  misc_feature (36): n=a or g
tcgggtgaacgtcagtgggtcttattattgtggctnatctcagcttattgatgttgcctacccatacccct

SEQ ID NO: 20757 - DNA, 71 bp, chicken (Gallus Gallus)
  misc_feature (36): n=c or t
acggccctaaggacacaggtgataaatagagtgatncactgcccagcacatgcagacactgggtaggagag

SEQ ID NO: 20758 - DNA, 71 bp, chicken (Gallus Gallus)
  misc_feature (36): n=a or g
aggccggtcaggtggccctactgcagcacgagcacngtttttgtgctcgttttggctgtgttagacccaac

SEQ ID NO: 20759 - DNA, 71 bp, chicken (Gallus Gallus)
  misc_feature (36): n=a or g
ggtggcttataaacaaatatctaatgcatataaacnaatgggtacagaaatagatagaggcaggtaaatat

SEQ ID NO: 20760 - DNA, 71 bp, chicken (Gallus Gallus)
  misc_feature (36): n=g or t
tcgttagattttcaaaagaacacatattttgaaggnaattataaatcacacacaacattaaattctttgtt

SEQ ID NO: 20761 - DNA, 71 bp, chicken (Gallus Gallus)
  misc_feature (36): n=a or g
acaaaagctcaacgagaagccagagccagggcagangctactcttaaactactccaagctcagggtaagtc

SEQ ID NO: 20762 - DNA, 71 bp, chicken (Gallus Gallus)
  misc_feature (36): n=g or t
aaaaaggtaggcaaaaacaggtaatgatttgatcancaggatagtacaaatagtcactgacatgtacgctg

SEQ ID NO: 20763 - DNA, 71 bp, chicken (Gallus Gallus)
  misc_feature (36): n=a or g
tacgattcatttttttttccttctttttacaagatncacaatacagccgtgtttttcaaaggtagggttct

SEQ ID NO: 20764 - DNA, 71 bp, chicken (Gallus Gallus)
  misc_feature (36): n=a or c
gggacagtgtttcctatttctacagctttccagcanaggaataaggaaccgatgttgctgtacatgcagta

SEQ ID NO: 20765 - DNA, 71 bp, chicken (Gallus Gallus)
  misc_feature (36): n=c or t
ctctattttctagggacatgaagtaagctcccattntgatctacatgcatttccttgggtaagcagtgcag

SEQ ID NO: 20766 - DNA, 71 bp, chicken (Gallus Gallus)
  misc_feature (36): n=c or t
atggccagactgaaagccgaaatgaagctttggctntcctctgtctttaccctctatcatgcttaaaactt

SEQ ID NO: 20767 - DNA, 71 bp, chicken (Gallus Gallus)
  misc_feature (36): n=a or c
catagtacttttggaaatcaccaaagggctcactcngtactgtcaccttcatggcaagtcagcatgctggg

SEQ ID NO: 20768 - DNA, 71 bp, chicken (Gallus Gallus)
  misc_feature (36): n=c or t
agatgaaaatgttctatcctgttttgtgttacatanagtttttgtgttactgacagcttttctgtaagagt

SEQ ID NO: 20769 - DNA, 71 bp, chicken (Gallus Gallus)
  misc_feature (36): n=a or g
gaggcctcaaaccacatgtgtgtgtgcctctgcatncaggagtaaatggatgacaaattgaggtatttcct

SEQ ID NO: 20770 - DNA, 71 bp, chicken (Gallus Gallus)
  misc_feature (36): n=g or t
tgcaatgtgaagaatctgatataatttgagaaaaangtattcatttaatgagtgacactcctaccagaata

SEQ ID NO: 20771 - DNA, 71 bp, chicken (Gallus Gallus)
  misc_feature (36): n=c or t
attgagcaaaggatggtggggcaaattttagactcnttgaaaaaaacatatggaatccttgctgtttgctg

SEQ ID NO: 20772 - DNA, 71 bp, chicken (Gallus Gallus)
  misc_feature (36): n=a or t
gagactttagtaatggtatgcatcgtaacagatcanaaattacttctggaataagaaaactgtgtttttat

SEQ ID NO: 20773 - DNA, 71 bp, chicken (Gallus Gallus)
  misc_feature (36): n=a or g
acaactgagtccttaattgcaaagaacagacaaggnggtggggaacaaaaatcttcaaaactaattttaaa

SEQ ID NO: 20774 - DNA, 71 bp, chicken (Gallus Gallus)
  misc_feature (36): n=g or t
acactgcatgattggaagtgctttccagcagacctnttctggattgtagaggatcagaactgcagaacacg

SEQ ID NO: 20775 - DNA, 71 bp, chicken (Gallus Gallus)
  misc_feature (36): n=a or g
aattatcagctgacagtgtgcacaacgctgatggangtggataagggtcacacagagacctacctgcggga

SEQ ID NO: 20776 - DNA, 71 bp, chicken (Gallus Gallus)
  misc_feature (36): n=g or t
agaatgtcaagcactgaataattctttcttgacacnttctgaattcactcaacaaaatcatttggaagcaa

SEQ ID NO: 20777 - DNA, 71 bp, chicken (Gallus Gallus)
  misc_feature (36): n=c or t
cataaagcattgagcactgattctcagtagtcaccncccaaaaaaaatttcctgcattctccttttctcca

SEQ ID NO: 20778 - DNA, 71 bp, chicken (Gallus Gallus)
  misc_feature (36): n=c or t
tattgtcataacactgacacaaaatctaagttacanagtccagttcctcttagaaaactagagacactgga

SEQ ID NO: 20779 - DNA, 71 bp, chicken (Gallus Gallus)
  misc_feature (36): n=g or t
tttcttacatatttttcagctatgaaaccaacttangttgatcaagataattaaatgtagtcatatagtcc

SEQ ID NO: 20780 - DNA, 71 bp, chicken (Gallus Gallus)
  misc_feature (36): n=c or t
tggaataagataagcttgtgtgttagtacatttcangtaattcccggcatccgtggtcagatgcctaactg

SEQ ID NO: 20781 - DNA, 71 bp, chicken (Gallus Gallus)
  misc_feature (36): n=c or t
tcaagtgttcttgcatgcaggtacatttttaaccangcagcagtgacaggtttctttctattctattttat

SEQ ID NO: 20782 - DNA, 71 bp, chicken (Gallus Gallus)
  misc_feature (36): n=a or g
ctgactcaagcaagtgcctttgcaaatagagctggngagtggaaatcattgtataggtgctgcagagctta

SEQ ID NO: 20783 - DNA, 71 bp, chicken (Gallus Gallus)
  misc_feature (36): n=a or g
cagcaggggcacggccaggctttttaggactgagancaaaaattcaatcctggagggtttacggagctaaa

SEQ ID NO: 20784 - DNA, 71 bp, chicken (Gallus Gallus)
  misc_feature (36): n=c or g
gaaagtttcttatgagagagataacaatcttagatnttggtagagttggtgatattcctctaattttattt

SEQ ID NO: 20785 - DNA, 71 bp, chicken (Gallus Gallus)
  misc_feature (36): n=c or t
ttgtgtgtgcagtagctacagaaaggtaaacacccntgagatgctttccaccagtatttggtacagcttgc

SEQ ID NO: 20786 - DNA, 71 bp, chicken (Gallus Gallus)
  misc_feature (36): n=a or g
aatcttctttgaaattcattttgtaacctaaagccnatcaacttatatttaaaaacatacattgaaatcac

SEQ ID NO: 20787 - DNA, 71 bp, chicken (Gallus Gallus)
  misc_feature (36): n=a or g
tgctgtgtactgttttgctttcaaacttatggccantagttgtaactcaaagtattttttccagcattcct

SEQ ID NO: 20788 - DNA, 71 bp, chicken (Gallus Gallus)
  misc_feature (36): n=c or g
tatgagtgtcaccaaaggagatttaaaattagactnttcattacacataaatatgctgttttgacagacca

SEQ ID NO: 20789 - DNA, 71 bp, chicken (Gallus Gallus)
  misc_feature (36): n=c or t
aaggcactgaatggaaaggatggtggctttagtccnacagccagaaagcagattctgcagcaatgagatgt

SEQ ID NO: 20790 - DNA, 71 bp, chicken (Gallus Gallus)
  misc_feature (36): n=c or t
ggaactcccgaaactcctggaaggtagacatcttcnagcacaggtgtgacagggaagtgtgttggcagtgt

SEQ ID NO: 20791 - DNA, 71 bp, chicken (Gallus Gallus)
  misc_feature (36): n=c or t
ccaaagttcttcatttcattcattacttgtaaatanttgcggctctggtttcactcttctgcactgtcaga

SEQ ID NO: 20792 - DNA, 71 bp, chicken (Gallus Gallus)
  misc_feature (36): n=c or t
gctctgtgatggcgctgacatgattgtacctcttgnagggtgtagacgtagactttgcccctctccctgcc

SEQ ID NO: 20793 - DNA, 71 bp, chicken (Gallus Gallus)
  misc_feature (36): n=a or c
tcataagctgtaaacacattctagtagaaactattnattgcacgtctttttgaagccatcatttcttcagt

SEQ ID NO: 20794 - DNA, 71 bp, chicken (Gallus Gallus)
  misc_feature (36): n=g or t
aacttctataatctcacttatgatgtgactagatgnctagaatgtgtctctatgatggctagaaaatgtct

SEQ ID NO: 20795 - DNA, 71 bp, chicken (Gallus Gallus)
  misc_feature (36): n=c or t
gtctttatccatttcactccactgatttacagggcngttctgaattagaagcttgccctctgaagaatttc

SEQ ID NO: 20796 - DNA, 71 bp, chicken (Gallus Gallus)
  misc_feature (36): n=a or g
tcatattagtatgaaagcaaacaacttctttcactnaagtttcactgctaaaatggatgatatcgcttttg

SEQ ID NO: 20797 - DNA, 71 bp, chicken (Gallus Gallus)
  misc_feature (36): n=c or t
ggggagttggaccggatggcctttaagggtcccttnctacccaaaagattcaatgattctaggagtatttc

SEQ ID NO: 20798 - DNA, 71 bp, chicken (Gallus Gallus)
  misc_feature (36): n=a or g
aagggctcctttttatttagatccgtttaggtcgtntctgtcagaagggaatggtgttatgatcagttgtt

SEQ ID NO: 20799 - DNA, 71 bp, chicken (Gallus Gallus)
  misc_feature (36): n=c or t
tcgattggtattttaatatagtatagaatacagtangagggctgctccaaaatgaatgcctcctattttat

SEQ ID NO: 20800 - DNA, 71 bp, chicken (Gallus Gallus)
  misc_feature (36): n=g or t
cttggggccacagtgggatttttcacatggtttccnaaggtcggaattcatatagggaatctcagtaggtc

SEQ ID NO: 20801 - DNA, 71 bp, chicken (Gallus Gallus)
  misc_feature (36): n=a or g
acccactacatgtagctgcacatcacaattctatgntatttcttttagctaatgacttacccaacacttct

SEQ ID NO: 20802 - DNA, 71 bp, chicken (Gallus Gallus)
  misc_feature (36): n=a or g
gttgtttcttcaccaaggatatttatatttacagancaagctatgagcacatctatataagagtattatta

SEQ ID NO: 20803 - DNA, 71 bp, chicken (Gallus Gallus)
  misc_feature (36): n=c or t
agtggaggggtgttcacgttcggtgcaggttcctgngggcaactgggacatgattccatgaatgatgaagt

SEQ ID NO: 20804 - DNA, 71 bp, chicken (Gallus Gallus)
  misc_feature (36): n=a or c
tatttatcattttcaatagttctccctcatactaanagtttatagccaaaggacaaccccattctgttttc

SEQ ID NO: 20805 - DNA, 71 bp, chicken (Gallus Gallus)
  misc_feature (36): n=c or g
agacatgtacatgtatgcgcgtagttgcatatctanctttgtttatccattcctgcctgtctggtttccat

SEQ ID NO: 20806 - DNA, 71 bp, chicken (Gallus Gallus)
  misc_feature (36): n=c or t
tgtggttgttctatactgtatccacagaaatgaacntagttttaagtaggagactgcagatatttattaca

SEQ ID NO: 20807 - DNA, 71 bp, chicken (Gallus Gallus)
  misc_feature (36): n=c or t
ctgtgtaatcaggaggttgcagcgtgctgtactttnctccatgaggtggactgggtgcccgtgtggtggct

SEQ ID NO: 20808 - DNA, 71 bp, chicken (Gallus Gallus)
  misc_feature (36): n=c or g
accataaacattcataattattattttattttagantatggtaaaacaaacacaaaagcaaacacacaaac

SEQ ID NO: 20809 - DNA, 71 bp, chicken (Gallus Gallus)
  misc_feature (36): n=a or c
aagaagtttaaatcaaagtattaactgtggagtttntctgcataaagaattatggaattaaaatagtaatc

SEQ ID NO: 20810 - DNA, 71 bp, chicken (Gallus Gallus)
  misc_feature (36): n=a or g
taggcactggatgtagagcaggattctgattcctanataaattgttgctggtgtcctgacagcttcacagc

SEQ ID NO: 20811 - DNA, 71 bp, chicken (Gallus Gallus)
  misc_feature (36): n=c or t
ttgtcagcagataagtactattggtatgcgtgtaantgataagattttaacatagtaataaagccagtttg

SEQ ID NO: 20812 - DNA, 71 bp, chicken (Gallus Gallus)
  misc_feature (36): n=a or g
aatgcataagatttcaatgtaaagacagaaaaaacnttgcatttcaacactttgacaattgctcttctaat

SEQ ID NO: 20813 - DNA, 71 bp, chicken (Gallus Gallus)
  misc_feature (36): n=c or t
aatgttatacaacctacacctgcagtcagggtttgnttaaacacataaggcaatctccataaagtcacttg

SEQ ID NO: 20814 - DNA, 71 bp, chicken (Gallus Gallus)
  misc_feature (36): n=a or g
cacagatcctatcctatataaaggacaagaaatagntgtgagacaggaggcaggaaatgtgtcatttcact

SEQ ID NO: 20815 - DNA, 71 bp, chicken (Gallus Gallus)
  misc_feature (36): n=a or g
ctgcacagaatccaaaagtgccattatttgtgaggnatgcgcacacacagattcctgctgatgtttaggaa

SEQ ID NO: 20816 - DNA, 71 bp, chicken (Gallus Gallus)
  misc_feature (36): n=a or g
ttcatattttttgctgttcacaggaccatgtttagncaatgtatcccaatgcacacaagtatcagccatca

SEQ ID NO: 20817 - DNA, 71 bp, chicken (Gallus Gallus)
  misc_feature (36): n=a or c
cagcactactgctctactggcatttctgagcagttnctacataacctctcattcccgttcagcttctctcc

SEQ ID NO: 20818 - DNA, 71 bp, chicken (Gallus Gallus)
  misc_feature (36): n=c or t
attctgcatcacaatggatgttcagtctagctacanaaaactatgctgaaacgtgctaccaacatacgctc

SEQ ID NO: 20819 - DNA, 71 bp, chicken (Gallus Gallus)
  misc_feature (36): n=g or t
gctttcactgagtaatcatatgttctgtcttttagnctgaatggttgtagaataatagaaaagacaggaac

SEQ ID NO: 20820 - DNA, 71 bp, chicken (Gallus Gallus)
  misc_feature (36): n=c or t
aaaagcaaagcaaagcctttctcatatggaacagangaataggcaacatcaggatctatttcattcagatt

SEQ ID NO: 20821 - DNA, 71 bp, chicken (Gallus Gallus)
  misc_feature (36): n=c or t
tgtaatgggaagcccactagatagcaccctatacangtgtttctcccctcttaatctgttccactataatc

SEQ ID NO: 20822 - DNA, 71 bp, chicken (Gallus Gallus)
  misc_feature (36): n=c or t
ccacatttacatgcagtagggttttacgtgtgttantatctttaagtttacacaatatcatgatcttcacc

SEQ ID NO: 20823 - DNA, 71 bp, chicken (Gallus Gallus)
  misc_feature (36): n=a or g
aaaatcatatcctactgaacacaattataggttgtnaactggtagagaacaaaaatctgctgcaaaacgtt

SEQ ID NO: 20824 - DNA, 71 bp, chicken (Gallus Gallus)
  misc_feature (36): n=a or c
cattctgagcataccttttttccccactgttttcanattgaagttaagatcagaatgctttcttcttgata

SEQ ID NO: 20825 - DNA, 71 bp, chicken (Gallus Gallus)
  misc_feature (36): n=c or t
atgtgcttaatcctgatggtattgtgcctgattttncgtggggcttggcgatctggacagtaagatgcaca

SEQ ID NO: 20826 - DNA, 71 bp, chicken (Gallus Gallus)
  misc_feature (36): n=c or t
tatgtcccagtttctgcattatgaatgtagtgtatncaaggctcgaattttgcaaaagccagtgaaagcat

SEQ ID NO: 20827 - DNA, 71 bp, chicken (Gallus Gallus)
  misc_feature (36): n=a or g
tgctcagaccaactgatgacaggatattacactaancaatccaaatgatagcttttagttggctaaattgg

SEQ ID NO: 20828 - DNA, 71 bp, chicken (Gallus Gallus)
  misc_feature (36): n=a or g
ttcaccagaggtttattagaatcttttctgtgatcnagtcttacattcccaatttgattcataagatagac

SEQ ID NO: 20829 - DNA, 71 bp, chicken (Gallus Gallus)
  misc_feature (36): n=a or g
atggctcattaccagtgaagaatacagactgaagcncatactgctgtgacaaaggatggcagtattaacaa

SEQ ID NO: 20830 - DNA, 71 bp, chicken (Gallus Gallus)
  misc_feature (36): n=a or g
gtatgaatggaaagatggtctgtcttgcagcatacngagaccagaggaaaatttacaggggataaaaattg

SEQ ID NO: 20831 - DNA, 71 bp, chicken (Gallus Gallus)
  misc_feature (36): n=a or g
tctatgttgcttttcagatgtttagcagactgctgntgagtttgctctgaagaacctacacacatggtatg

SEQ ID NO: 20832 - DNA, 71 bp, chicken (Gallus Gallus)
  misc_feature (36): n=c or t
tcatatgagtaccttctcaagatacttagaagcatngctgatcaggagttgcttcccaaagaattcatggt

SEQ ID NO: 20833 - DNA, 71 bp, chicken (Gallus Gallus)
  misc_feature (36): n=a or g
gcagtcaacctcagccttcccttctccattttgagngcacattccagctgtgtgtttctagttgcacatac

SEQ ID NO: 20834 - DNA, 71 bp, chicken (Gallus Gallus)
  misc_feature (36): n=c or t
tgagtttctcatgaaaacatacctctttctgtgaanggtagtctttatgtcaagcttggaacgtggaaatg

SEQ ID NO: 20835 - DNA, 71 bp, chicken (Gallus Gallus)
  misc_feature (36): n=a or c
attaatagaccgtaaaatatgtatctttattctccnctatctttgcttgcagtgagttctgtaatacaagt

SEQ ID NO: 20836 - DNA, 71 bp, chicken (Gallus Gallus)
  misc_feature (36): n=a or g
cccattacaattgcaactttgcagtttgggttcccngcaccttaaaaaagtcacaaacacaaaaacagttt

SEQ ID NO: 20837 - DNA, 71 bp, chicken (Gallus Gallus)
  misc_feature (36): n=a or c
atgtgatggaccaatgaaatgcaagtatctggaaanaaattaagtctagaaagccaaaagaagcaaaagac

SEQ ID NO: 20838 - DNA, 71 bp, chicken (Gallus Gallus)
  misc_feature (36): n=c or t
cagtgcaaaacacagacgtcaagattaggtatgtgnatgggatacggctccaagtcttcccactgcataga

SEQ ID NO: 20839 - DNA, 71 bp, chicken (Gallus Gallus)
  misc_feature (36): n=c or t
caccatcctccacagccactgcccatgccgttcagnccatttcactccatatagccactgttgaggccaca

SEQ ID NO: 20840 - DNA, 71 bp, chicken (Gallus Gallus)
  misc_feature (36): n=a or g
tcacgttagagttcggaatgcagtacagataatgcnagtggtgtaaaaggaagaagtaccaacacaaatta

SEQ ID NO: 20841 - DNA, 71 bp, chicken (Gallus Gallus)
  misc_feature (36): n=c or t
tacgctaattgtaatgagtgaacattaatagggtangtgtgactacacatattgtaaatggaatcagagta

SEQ ID NO: 20842 - DNA, 71 bp, chicken (Gallus Gallus)
  misc_feature (36): n=c or t
tatcagatataacccaaagatattactgatactatnaggtcagagacaagccaacgtcaaagtaacagttt

SEQ ID NO: 20843 - DNA, 71 bp, chicken (Gallus Gallus)
  misc_feature (36): n=g or t
tcttacacttctgtaagatctgtctccttctatcanctaggagaactactctcctgaattagatatcatta

SEQ ID NO: 20844 - DNA, 71 bp, chicken (Gallus Gallus)
  misc_feature (36): n=c or t
tccacatttcacaaaaatgtttaagaaccatctacnctttgatatattgtttgtatctgaatgttgaaaaa

SEQ ID NO: 20845 - DNA, 71 bp, chicken (Gallus Gallus)
  misc_feature (36): n=a or g
acagtttgggaatctacctcacagtatttacaattnagtttacaaaaccttatgtgacactgttagcatca

SEQ ID NO: 20846 - DNA, 71 bp, chicken (Gallus Gallus)
  misc_feature (36): n=g or t
tgaggtgttaaacagcctgaaaaaaaaaaaataatnctgtgcagagaataacagtgcaaacaccagagagc

SEQ ID NO: 20847 - DNA, 71 bp, chicken (Gallus Gallus)
  misc_feature (36): n=a or g
caaaaccaacagcttttgttcatgaagagccttcanttattttattttattttgtaaaaggcaaattctaa

SEQ ID NO: 20848 - DNA, 71 bp, chicken (Gallus Gallus)
  misc_feature (36): n=c or t
tctttgctagtgtgagacaaaattgacttactgcanctcctgtagttaaaaatccttcaaagaccttgagt

SEQ ID NO: 20849 - DNA, 71 bp, chicken (Gallus Gallus)
  misc_feature (36): n=c or t
ctgggtcccttggtgcatgccctggtgctacggcgnggcatcccctgacattgtggtcccgctctcagccc

SEQ ID NO: 20850 - DNA, 71 bp, chicken (Gallus Gallus)
  misc_feature (36): n=g or t
ctatcactacagtatttggtcagatcaaggaaaagncctcaaagttacttttagtcagtgtgtacaatgaa

SEQ ID NO: 20851 - DNA, 71 bp, chicken (Gallus Gallus)
  misc_feature (36): n=c or t
gcctaaatcttcttctactgtcaactaattgatttngctctaacttcaaagcttgtttactctttgtctgt

SEQ ID NO: 20852 - DNA, 71 bp, chicken (Gallus Gallus)
  misc_feature (36): n=c or g
aacatttgccattacctcccattactttcagtcaanaatgctttgtgaaagactataagacctggccactt

SEQ ID NO: 20853 - DNA, 71 bp, chicken (Gallus Gallus)
  misc_feature (36): n=a or g
gaacatcttctgtgtgtacagacaacaactacagcntaccaactcctaacctgaccaacaccttcccttga

SEQ ID NO: 20854 - DNA, 71 bp, chicken (Gallus Gallus)
  misc_feature (36): n=c or g
acagcatatgctccacaccaccatcaggcattctgnatttatcccctcaccacaaactccaagtaacacgt

SEQ ID NO: 20855 - DNA, 71 bp, chicken (Gallus Gallus)
  misc_feature (36): n=a or g
acataaaagtccatggtgtttttctcaagtgaacantctgctctggtcacagcactgtgaactaaatctca

SEQ ID NO: 20856 - DNA, 71 bp, chicken (Gallus Gallus)
  misc_feature (36): n=c or t
agaaaatgggctacagtgttcttctgcacatgtgcnctaattggtattaacagaaactacaacaatgaggc

SEQ ID NO: 20857 - DNA, 71 bp, chicken (Gallus Gallus)
  misc_feature (36): n=c or t
ttccatctggctgcttaactgggcatacaccctcantgttcgtgctccatcacctagcacactactcaaaa

SEQ ID NO: 20858 - DNA, 71 bp, chicken (Gallus Gallus)
  misc_feature (36): n=c or t
atgatcagtcttatctagcagcagaccaaactgacngaaacaggaaatgttgcagagagggatgtatctcc

SEQ ID NO: 20859 - DNA, 71 bp, chicken (Gallus Gallus)
  misc_feature (36): n=c or t
cttcactaatactcaaagctaaatctagaatgaatncattttttaaaactcttaactcttccatactaaat

SEQ ID NO: 20860 - DNA, 71 bp, chicken (Gallus Gallus)
  misc_feature (36): n=c or g
atatgtccaaatctgtgtcaaagtgaacctgaaggntttcttgaaactgtttttgagctcactttggttag

SEQ ID NO: 20861 - DNA, 71 bp, chicken (Gallus Gallus)
  misc_feature (36): n=c or t
gaagagcttagtaaacttgtgcctccagaatgccantggtatggaatcattgtgtcctctctctcaaattg

SEQ ID NO: 20862 - DNA, 71 bp, chicken (Gallus Gallus)
  misc_feature (36): n=c or t
aaggctaacgcagaaggtctaggtttgctaaataangttttaagaggagatttgatagtctagaactccag

SEQ ID NO: 20863 - DNA, 71 bp, chicken (Gallus Gallus)
  misc_feature (36): n=a or g
tatggatgttaaatgaaatactggaataaacctacngaaacatgaataactattttcactgtgggttctct

SEQ ID NO: 20864 - DNA, 71 bp, chicken (Gallus Gallus)
  misc_feature (36): n=a or g
gtacatttttttccacgggagaaataaaaagctgcnattacgcattaacgctgaccggttatactcctgag

SEQ ID NO: 20865 - DNA, 71 bp, chicken (Gallus Gallus)
  misc_feature (36): n=c or t
caaaggaaaagcattccttgttattgagttctgctngccatagaacaagtatgaatgttagggttggggac

SEQ ID NO: 20866 - DNA, 71 bp, chicken (Gallus Gallus)
  misc_feature (36): n=a or g
tctcagattctccaaaaacttaagcagatggcttcntttggtttcatgctgtttatggtttcaaagttttc

SEQ ID NO: 20867 - DNA, 71 bp, chicken (Gallus Gallus)
  misc_feature (36): n=c or g
acagtattaccataattttgctgtcagagaagtaantgtgaaaaggtgacgtcttgctcagcaggtctgct

SEQ ID NO: 20868 - DNA, 71 bp, chicken (Gallus Gallus)
  misc_feature (36): n=c or t
aatatccttgttgggataaacagaatgccatcgatntgttgatccagatctcatttgtgtattctatgggg

SEQ ID NO: 20869 - DNA, 71 bp, chicken (Gallus Gallus)
  misc_feature (36): n=c or t
tgctgatgaacctaagcctgaatttatggtatacgngttggtggttttgtttcaagctgggtcatctctca

SEQ ID NO: 20870 - DNA, 71 bp, chicken (Gallus Gallus)
  misc_feature (36): n=c or t
aaggaaacctgttctgagaagaggcataaaattagnagaaatgccgacatcttgagccccagggaagaaag

SEQ ID NO: 20871 - DNA, 71 bp, chicken (Gallus Gallus)
  misc_feature (36): n=a or g
agaacagagaagactctgatagcaacatactaacantactttttgcatagaagggaaaaatgaatgaaaac

SEQ ID NO: 20872 - DNA, 71 bp, chicken (Gallus Gallus)
  misc_feature (36): n=c or t
ttgtggtatcacacacagtgcagtctaaattctgtnggtgctgagcattggaaatacgctgcaatctaaag

SEQ ID NO: 20873 - DNA, 71 bp, chicken (Gallus Gallus)
  misc_feature (36): n=a or g
tcacagatttgtagtttcccttcaacagaacatgcnaggtttatattcatactataaggttacacagagta

SEQ ID NO: 20874 - DNA, 71 bp, chicken (Gallus Gallus)
  misc_feature (36): n=c or t
cggcattattacgtacaataccttatgattaatgtngctgttttcctagtcgtcaagtctccaatgacttc

SEQ ID NO: 20875 - DNA, 71 bp, chicken (Gallus Gallus)
  misc_feature (36): n=a or g
tcagaatagaaacatgttgtactttttgacttcagnctgcctggttctgtatgagtttgtaagatggaaga

SEQ ID NO: 20876 - DNA, 71 bp, chicken (Gallus Gallus)
  misc_feature (36): n=c or t
tatgcccagaagcattatggaaaccaaggctggcanctattaacaagtgtatgctgttcacagatggtatt

SEQ ID NO: 20877 - DNA, 71 bp, chicken (Gallus Gallus)
  misc_feature (36): n=c or t
acctttatataaaagtcataaatcttacaaattaangtgtcaagcagttaccagagctcttcagtctgttt

SEQ ID NO: 20878 - DNA, 71 bp, chicken (Gallus Gallus)
  misc_feature (36): n=a or c
aaggcatccaacagaagtccaaggcctttgtgtccnaaactgttaacctagctagctgggtagctggttaa

SEQ ID NO: 20879 - DNA, 71 bp, chicken (Gallus Gallus)
  misc_feature (36): n=c or t
ggtgaagattcgggcatgtgcctctctacacacctngggtagacacctgaagtcaggcagcatgaataggg

SEQ ID NO: 20880 - DNA, 71 bp, chicken (Gallus Gallus)
  misc_feature (36): n=a or g
aggaattaatacagcagtagcaatgtaatttcgtcntttcttgatgaaatttgagaattaggcatacatgg

SEQ ID NO: 20881 - DNA, 71 bp, chicken (Gallus Gallus)
  misc_feature (36): n=g or t
gtgttaccttttagtctacacttagccaattaacgnagactgacattctgaagattacaattagtgagcag

SEQ ID NO: 20882 - DNA, 71 bp, chicken (Gallus Gallus)
  misc_feature (36): n=c or t
agttagggagccattccagaaagtctgccaacaacngacagaggatatgagacaaaacaaagaaattgtgt

SEQ ID NO: 20883 - DNA, 71 bp, chicken (Gallus Gallus)
  misc_feature (36): n=a or g
aaacacggaataactagtacacctcatagctccacntggtatcacagttcccatcatgtgcccaggaagat

SEQ ID NO: 20884 - DNA, 71 bp, chicken (Gallus Gallus)
  misc_feature (36): n=c or t
ttccaaaaacatgcatagtattataatttagctttngtaacatcaagccccaagtgccctccttgcccact

SEQ ID NO: 20885 - DNA, 71 bp, chicken (Gallus Gallus)
  misc_feature (36): n=c or t
ttcttcagagctcaagggtgagctggcattgctggncagaaataggcatttttgtagaagtataaagtagg

SEQ ID NO: 20886 - DNA, 71 bp, chicken (Gallus Gallus)
  misc_feature (36): n=a or g
tccattattcacttgccacaggaatttggaaaactngtggtagcagtgaaaagagccctatgcctaacagc

SEQ ID NO: 20887 - DNA, 71 bp, chicken (Gallus Gallus)
  misc_feature (36): n=a or g
tttaggctctttcaacatccccttcccttgctgcantggtttgaatctgtgagggcagtatttctgagcag

SEQ ID NO: 20888 - DNA, 71 bp, chicken (Gallus Gallus)
  misc_feature (36): n=a or g
cgtaggttggaggtgctccctaacccaattctgtcncagtaatctgggtcagcctcaacacttcacgcagt

SEQ ID NO: 20889 - DNA, 71 bp, chicken (Gallus Gallus)
  misc_feature (36): n=a or g
gaggccaggtagagtgtaacagtaagaagtaggcanagctcctggaattctttccagttgtatgaaaagaa

SEQ ID NO: 20890 - DNA, 71 bp, chicken (Gallus Gallus)
  misc_feature (36): n=c or t
gtttattttaagttagacagcaagcggttaaattgngtgggatgcaatcagcaaatttaccttggagttgc

SEQ ID NO: 20891 - DNA, 71 bp, chicken (Gallus Gallus)
  misc_feature (36): n=a or g
tcaggcataaaacaagttagggttctgtagcagagnaatgttctccctttcccaaaggcacctcctgttta

SEQ ID NO: 20892 - DNA, 71 bp, chicken (Gallus Gallus)
  misc_feature (36): n=a or t
ttctatctagttcacgtgtcagcacacctcagaagncattaaagagaagaagaagcaaccagggttataga

SEQ ID NO: 20893 - DNA, 71 bp, chicken (Gallus Gallus)
  misc_feature (36): n=c or g
tctttaacttttgtagctccttttgctgaaccagtncagaaagcagaagtctatactttgctgtgtaaggt

SEQ ID NO: 20894 - DNA, 71 bp, chicken (Gallus Gallus)
  misc_feature (36): n=c or g
attaatgtcattctggtatgtgcatcatatattctnatagagaaaccagggccaatagtttagtcatattt

SEQ ID NO: 20895 - DNA, 71 bp, chicken (Gallus Gallus)
  misc_feature (36): n=c or t
tgtttggatgagattagttcccctttaattaaccangtgttcacagtttgaggtatttcattacctgcaca

SEQ ID NO: 20896 - DNA, 71 bp, chicken (Gallus Gallus)
  misc_feature (36): n=a or g
atgaaagaccaaggttgggggtggtttcagtactantattttctttcttcttgcttgccactggagctctg

SEQ ID NO: 20897 - DNA, 71 bp, chicken (Gallus Gallus)
  misc_feature (36): n=c or t
ctggccagagaatagctagcttccttaagcttcaanggtaccacttctttcagatttacttttaaactaca

SEQ ID NO: 20898 - DNA, 71 bp, chicken (Gallus Gallus)
  misc_feature (36): n=a or t
ctgtaatgccatatttcttggttagctttctttgtnaaaggtttttgtgaacacacaggtaatttgtttcc

SEQ ID NO: 20899 - DNA, 71 bp, chicken (Gallus Gallus)
  misc_feature (36): n=c or t
caccagagatgaatcactgccatgaagggactcacnctgcgcagctatggacgtcaaaggacagaaggaga

SEQ ID NO: 20900 - DNA, 71 bp, chicken (Gallus Gallus)
  misc_feature (36): n=c or t
cttgttggctaatttcctttgcttctgtttcccagnctctaaaaccaatgtttgaaagtgacagccacagg

SEQ ID NO: 20901 - DNA, 71 bp, chicken (Gallus Gallus)
  misc_feature (36): n=c or t
atttccaattcctcctttccgatactacatcagtgnagtgggtttggacatcctgcatgtcacagtgcacg

SEQ ID NO: 20902 - DNA, 71 bp, chicken (Gallus Gallus)
  misc_feature (36): n=c or t
aaacagcatgttccacacccagctttccagttgcancatctcttatccaaaggttaacaaggaagaattcc

SEQ ID NO: 20903 - DNA, 71 bp, chicken (Gallus Gallus)
  misc_feature (36): n=c or t
ctacatatttttgttgttacctttatgtaagagagngcatcaaacatttcttcaatttgctctgatgactg

SEQ ID NO: 20904 - DNA, 71 bp, chicken (Gallus Gallus)
  misc_feature (36): n=g or t
tattgtgcataattcccattttggagctagtccctnagaaggagctatgtgtaacctggctcggcagagaa

SEQ ID NO: 20905 - DNA, 71 bp, chicken (Gallus Gallus)
  misc_feature (36): n=c or t
ttgttttttccgattgtagtttttgttgcagtctgnagattatagaaaggcagggaacatttggacttctt

SEQ ID NO: 20906 - DNA, 71 bp, chicken (Gallus Gallus)
  misc_feature (36): n=g or t
gcgtgttcgggtgcttcttgcacaagccactgctancttctccaagtgctttcttcagctctgatggggaa

SEQ ID NO: 20907 - DNA, 71 bp, chicken (Gallus Gallus)
  misc_feature (36): n=a or t
taaacttgtattcacacgttatccctgcttttgaanagagcaatgccaaatactgctatttgtttaccttt

SEQ ID NO: 20908 - DNA, 71 bp, chicken (Gallus Gallus)
  misc_feature (36): n=a or c
cctaaatatcccttttgttagcaacatcatgattanacagaattacagacagaatcactgtatctttccta

SEQ ID NO: 20909 - DNA, 71 bp, chicken (Gallus Gallus)
  misc_feature (36): n=a or g
ctgatcaacttccacctgaacaaataaggttgcacnagcaacaaatcttgaaaaaggcagcgtttggtgat

SEQ ID NO: 20910 - DNA, 71 bp, chicken (Gallus Gallus)
  misc_feature (36): n=g or t
cattaatgaaatgatgccagttgatcatctcaccanggatgagcctgaggttgagaggtgagtggtagact

SEQ ID NO: 20911 - DNA, 71 bp, chicken (Gallus Gallus)
  misc_feature (36): n=c or t
accagtgacttctccagacgattcttcagtcctctntcctcgcatcgttcagacacacacaaaagcaaaaa

SEQ ID NO: 20912 - DNA, 71 bp, chicken (Gallus Gallus)
  misc_feature (36): n=a or g
ctctgagtgactgtccaatgaaaagctaatgaactntgtgcatttcacttagtcgcacaaatacatcagct

SEQ ID NO: 20913 - DNA, 71 bp, chicken (Gallus Gallus)
  misc_feature (36): n=c or t
aggcagttatggcaatatgcgttcttcctgtccttnctctctttattttagaaaaaaaaaaaaaaaaagaa

SEQ ID NO: 20914 - DNA, 71 bp, chicken (Gallus Gallus)
  misc_feature (36): n=c or t
ctagctcagaaaacatactggttttgacttcgtttngcaaatacgtcacttgttatattgctgaacataca

SEQ ID NO: 20915 - DNA, 71 bp, chicken (Gallus Gallus)
  misc_feature (36): n=a or g
tgttggtaaagtgatgttcaaaagtcagttaatgcnttaaaaggaaagtaaccgaagatgagaacccagct

SEQ ID NO: 20916 - DNA, 71 bp, chicken (Gallus Gallus)
  misc_feature (36): n=c or t
atgtggcttcatggaggtcggtggcagactccaacncgatgaaagcttggtcacttgtgcagtggggaaag

SEQ ID NO: 20917 - DNA, 71 bp, chicken (Gallus Gallus)
  misc_feature (36): n=a or c
attggagattttcgtctgtcaggactgtttctgagntgcagcccatggcgggatgtagcttcagacagctt

SEQ ID NO: 20918 - DNA, 71 bp, chicken (Gallus Gallus)
  misc_feature (36): n=c or t
taaggtcagaaataaaaatgaattgcaggggaattncaagttctacagtgcacctcaggaagctggaaatt

SEQ ID NO: 20919 - DNA, 71 bp, chicken (Gallus Gallus)
  misc_feature (36): n=c or t
cttgttcattttcactcatctctgtttgaaatcttngttgttagagtttatgctatggcctggcaagtgtt

SEQ ID NO: 20920 - DNA, 71 bp, chicken (Gallus Gallus)
  misc_feature (36): n=c or t
ataaagagaatggtctcattcatattggattgcatnccaaattccaaaccacaatttacagtttctggcca

SEQ ID NO: 20921 - DNA, 71 bp, chicken (Gallus Gallus)
  misc_feature (36): n=a or g
acacaactgtcattaggtatgtgccatttctaaatnaaataggacaatcaaagcataaaataaaatttaac

SEQ ID NO: 20922 - DNA, 71 bp, chicken (Gallus Gallus)
  misc_feature (36): n=a or g
ttgtttggggttcggaattttgtttggaatgaacanccagatgtaggaaaaagtggggatctcttaagtta

SEQ ID NO: 20923 - DNA, 71 bp, chicken (Gallus Gallus)
  misc_feature (36): n=a or g
tttatgttgcatttctaagtttaaaagacatgtcanccagcaaatctttggttttggaaaactgagcattt

SEQ ID NO: 20924 - DNA, 71 bp, chicken (Gallus Gallus)
  misc_feature (36): n=a or g
caccaacctggatgctgtatggcaaagatgctggcnggtcacagccttagggcatccctcagcaccttcac

SEQ ID NO: 20925 - DNA, 71 bp, chicken (Gallus Gallus)
  misc_feature (36): n=a or g
cttccctttgctactgtcttccccatcctagagcantactgcataaaattcaccctagggaccacctctct

SEQ ID NO: 20926 - DNA, 71 bp, chicken (Gallus Gallus)
  misc_feature (36): n=c or g
tattgatatgtgtaaagtcatttggctgataaagtnatttaagcaaagtgttcagttttttgtcatgctgc

SEQ ID NO: 20927 - DNA, 71 bp, chicken (Gallus Gallus)
  misc_feature (36): n=a or g
aaaagagaacaaattgttttaatataatttcagaangagacaagttagaattaatgcagaattggctcaaa

SEQ ID NO: 20928 - DNA, 71 bp, chicken (Gallus Gallus)
  misc_feature (36): n=a or c
gcaacaattagaacagctgggaagacaaatcagaanaaagaaagtggaggaaaagagctgtgtttactttg

SEQ ID NO: 20929 - DNA, 71 bp, chicken (Gallus Gallus)
  misc_feature (36): n=a or g
ttaggaattactgaagcatagcgaaaggagagtacnactgacattgatagctgtctccactaaaaagttag

SEQ ID NO: 20930 - DNA, 71 bp, chicken (Gallus Gallus)
  misc_feature (36): n=c or t
aaagtgctgagtggttgtgcctgagtgatatgccanctcctgggcagcacgtgtagggctatcccttattt

SEQ ID NO: 20931 - DNA, 71 bp, chicken (Gallus Gallus)
  misc_feature (36): n=c or t
ttgtctgctggtgactgctcaaaagcaaagaatganagcgctccttacacaagatggttgctgcagctatg

SEQ ID NO: 20932 - DNA, 71 bp, chicken (Gallus Gallus)
  misc_feature (36): n=a or g
aactactataaagacagtgtagatgtcccatttagnaaacatataattctttaataattaatttcaaattt

SEQ ID NO: 20933 - DNA, 71 bp, chicken (Gallus Gallus)
  misc_feature (36): n=c or t
aaacctctctgttttcttccagctcatgcaatcagntagtcaagaggaaagataagggaatccctatgtct

SEQ ID NO: 20934 - DNA, 71 bp, chicken (Gallus Gallus)
  misc_feature (36): n=c or t
atactgtgaaaagaagccacattcacattaccctgnctagtaatcaattgtctccttgccagagaatttga

SEQ ID NO: 20935 - DNA, 71 bp, chicken (Gallus Gallus)
  misc_feature (36): n=a or g
ttccactcattaagattacttcaggcatctgcatcngagagatggtcaaagaaaatgtattcagagataaa

SEQ ID NO: 20936 - DNA, 71 bp, chicken (Gallus Gallus)
  misc_feature (36): n=g or t
ggcatggctctgtatcctcagaagcttggcagtctntaacaggttctggttgtcctgcatctgacagacag

SEQ ID NO: 20937 - DNA, 71 bp, chicken (Gallus Gallus)
  misc_feature (36): n=a or g
tccttactttagtagacagcctgtagatctgctccntgcacctgcagaatgcgggtctcttggccgaactg

SEQ ID NO: 20938 - DNA, 71 bp, chicken (Gallus Gallus)
  misc_feature (36): n=c or t
gctatgaaacaaattcaaggccagtgcagggcatgnttctgtatgtaattactgactttaaggcactgggt

SEQ ID NO: 20939 - DNA, 71 bp, chicken (Gallus Gallus)
  misc_feature (36): n=c or g
ggatggagagcatagccacaacccattgttattatnattctgatagagaccacctcacagaggcttgtgat

SEQ ID NO: 20940 - DNA, 71 bp, chicken (Gallus Gallus)
  misc_feature (36): n=a or g
aaaatgtaatgttatcattcactgttctgctatggncatatttacaatagctgaagtgtaagtccttcaca

SEQ ID NO: 20941 - DNA, 71 bp, chicken (Gallus Gallus)
  misc_feature (36): n=a or g
atcagcattttaccttcacagatgagtagcttgtcnttgtagaagaagcccaccggacactcgcatcggaa

SEQ ID NO: 20942 - DNA, 71 bp, chicken (Gallus Gallus)
  misc_feature (36): n=a or g
tcatgaaacaggttaagatattttgacacctgtgcntttgcccgaggcagggaaagatgcactgttaagga

SEQ ID NO: 20943 - DNA, 71 bp, chicken (Gallus Gallus)
  misc_feature (36): n=c or t
aaaacatattgttcctagaagttcgtgaaatttggngcttagaagttaaatgactaaggatgaccaggcag

SEQ ID NO: 20944 - DNA, 71 bp, chicken (Gallus Gallus)
  misc_feature (36): n=c or t
taagctaaaaatatggttcctttggaaactgaatgnctgtcagctggttattcccatcctatttgcaagca

SEQ ID NO: 20945 - DNA, 71 bp, chicken (Gallus Gallus)
  misc_feature (36): n=a or g
taaacaacaaatcaaggtggtttagggcttttcagntcaaagaaatcaggtagcaacagaaaaaatcatag

SEQ ID NO: 20946 - DNA, 71 bp, chicken (Gallus Gallus)
  misc_feature (36): n=a or g
acttttttaatggttagagctctaaatggggaacancgagtacagaaagtctgtattacaactctgcattt

SEQ ID NO: 20947 - DNA, 71 bp, chicken (Gallus Gallus)
  misc_feature (36): n=a or g
catgaatacctttggtccttaaaacaagcacagagnggaagaagcaagtgatagttttggaaggcacacag

SEQ ID NO: 20948 - DNA, 71 bp, chicken (Gallus Gallus)
  misc_feature (36): n=c or g
ctcagggataatacctcaggtctcaacagatctttntaggcacgcatgctctgaaaagggctttttctaaa

SEQ ID NO: 20949 - DNA, 71 bp, chicken (Gallus Gallus)
  misc_feature (36): n=a or c
cataggttagcatgagtcagatgcagaggaagaacngagtttgtcactgggatgttctgctcttctgaaac

SEQ ID NO: 20950 - DNA, 71 bp, chicken (Gallus Gallus)
  misc_feature (36): n=c or t
tgtagacagctctatcatttgttatctgcttggcangtcactgaagacgaaataaataagtgaataattga

SEQ ID NO: 20951 - DNA, 71 bp, chicken (Gallus Gallus)
  misc_feature (36): n=c or t
gatgattcatatgctgaccttaattcatattacagngccccttgacagtgtgccagctgtgaacatgcaca

SEQ ID NO: 20952 - DNA, 71 bp, chicken (Gallus Gallus)
  misc_feature (36): n=c or t
agataccaaccatggccaagacacacctgtatctantagccttgtcaaagatagacttctaatctctcttc

SEQ ID NO: 20953 - DNA, 71 bp, chicken (Gallus Gallus)
  misc_feature (36): n=a or c
agccaggggaacattagtatcagtaaaacactcacnagcttcaagtaaggattgatgctaaatgcctctat

SEQ ID NO: 20954 - DNA, 71 bp, chicken (Gallus Gallus)
  misc_feature (36): n=a or t
tggaagatctattgtttgcatttatagccagctgcncctctcaggtcagcacttcagggtatctccgaatg

SEQ ID NO: 20955 - DNA, 71 bp, chicken (Gallus Gallus)
  misc_feature (36): n=c or t
agtgagatgctatagcattagtttgaaatatcaacnaaatcggagacaatttgcctatgactttacaagaa

SEQ ID NO: 20956 - DNA, 71 bp, chicken (Gallus Gallus)
  misc_feature (36): n=a or t
atctttaaatgacagggttagcattgtaaaccttgnggtgttcagattttctgcagttttcagaattgttg

SEQ ID NO: 20957 - DNA, 71 bp, chicken (Gallus Gallus)
  misc_feature (36): n=c or t
tagctctgggggacaatttctgtggacctgaccccncaaaagctccaacaggtttataacctaactatgct

SEQ ID NO: 20958 - DNA, 71 bp, chicken (Gallus Gallus)
  misc_feature (36): n=c or g
tcaccctccctcatggaagggcttttagaagacagnggaactccttctggtgccagctacacagcagtgta

SEQ ID NO: 20959 - DNA, 71 bp, chicken (Gallus Gallus)
  misc_feature (36): n=a or g
agggcctgaaaaagcacgtgctgaattacaatgccngcttctactctctcatgactgccctccccggtctt

SEQ ID NO: 20960 - DNA, 71 bp, chicken (Gallus Gallus)
  misc_feature (36): n=a or g
gaagtgtagtcccacacacgtgaaactaccttagcncttgattttttttccctggaaatattagaaatgaa

SEQ ID NO: 20961 - DNA, 71 bp, chicken (Gallus Gallus)
  misc_feature (36): n=c or t
aaaaccttctgcatgttgaagtaatacttttgactnttccacatctgcctggaatcaattccttcaagcta

SEQ ID NO: 20962 - DNA, 71 bp, chicken (Gallus Gallus)
  misc_feature (36): n=a or g
ctgaccacttcttcagcatcaggattcatgacttcnatgaaagggtttccacctctgcttgcaaagaggct

SEQ ID NO: 20963 - DNA, 71 bp, chicken (Gallus Gallus)
  misc_feature (36): n=a or g
gacctcactgggatttcttactgcttcacgggaaanttgccttgcaaaaggcaatcgcagcacatagaaaa

SEQ ID NO: 20964 - DNA, 71 bp, chicken (Gallus Gallus)
  misc_feature (36): n=a or g
aatgaaaagctataaaaagattttaaagaagttagnaatcactttgagtatgtcaaggccattgccaaatt

SEQ ID NO: 20965 - DNA, 71 bp, chicken (Gallus Gallus)
  misc_feature (36): n=c or g
agatcgtgaactacgcttagccaaaaagtcttctantcaagcaaaggtgttctcctcccctaacatgattt

SEQ ID NO: 20966 - DNA, 71 bp, chicken (Gallus Gallus)
  misc_feature (36): n=a or g
tttcccttgaaaagacagcagtaggaacaacaacancaaaaaaaaaaaaaacaaacaatcatagtgatgtt

SEQ ID NO: 20967 - DNA, 71 bp, chicken (Gallus Gallus)
  misc_feature (36): n=a or g
aacatacagtccaattgtgaaactagggaggtaganatataaatttgaaggcttaaagttagagcagctac

SEQ ID NO: 20968 - DNA, 71 bp, chicken (Gallus Gallus)
  misc_feature (36): n=a or g
acaataacagtgtgaaagtattataaaatggtattnctgctttggtaaaccaagggtttctcttctcgctt

SEQ ID NO: 20969 - DNA, 71 bp, chicken (Gallus Gallus)
  misc_feature (36): n=c or t
gctgcataataaggcattaacagcacactttttgcnggttgacatctctttttagggatcaaaattaaaat

SEQ ID NO: 20970 - DNA, 71 bp, chicken (Gallus Gallus)
  misc_feature (36): n=c or t
gataaattggataaatcaagcaaactaatactaaanggacactggtaactttctggactttggactagtag

SEQ ID NO: 20971 - DNA, 71 bp, chicken (Gallus Gallus)
  misc_feature (36): n=g or t
tttgtagtgcttcttaaactgcagctcttaggtttntcccctttccacatcttactgggctctcaccaacc

SEQ ID NO: 20972 - DNA, 71 bp, chicken (Gallus Gallus)
  misc_feature (36): n=a or c
agttaataggtatacactctttctgaaatcacaagnagcagcaaatataataaataataacaaaatatttt

SEQ ID NO: 20973 - DNA, 71 bp, chicken (Gallus Gallus)
  misc_feature (36): n=c or t
tgtctccatcaggaagctatggggctcctatggggntttggtacctttgggatgtggtcacactgtccccc

SEQ ID NO: 20974 - DNA, 71 bp, chicken (Gallus Gallus)
  misc_feature (36): n=a or g
taaggaacaaatcattgtttaacaccgcagtagcantgggtgtgaggactatcagtcacttgaactaccca

SEQ ID NO: 20975 - DNA, 71 bp, chicken (Gallus Gallus)
  misc_feature (36): n=a or c
tagctcttgtcatctactggctcagttctacaatgncttttttctgctgagactcacactttcaaaagcag

SEQ ID NO: 20976 - DNA, 71 bp, chicken (Gallus Gallus)
  misc_feature (36): n=a or g
acaaaatgagtaataaccagattggcctcgtgattntgaatatggttgcatatattgattgtgatatgagc

SEQ ID NO: 20977 - DNA, 71 bp, chicken (Gallus Gallus)
  misc_feature (36): n=a or t
cttggcatcaacttgcaagttgaagggattctgacngttaagagcagttaggagaaagcttttgatgcgaa

SEQ ID NO: 20978 - DNA, 71 bp, chicken (Gallus Gallus)
  misc_feature (36): n=c or g
ctttatatctgggctgatgccacagtggaacaagantgcaaagcccatttctctgtctggctgtgggggtt

SEQ ID NO: 20979 - DNA, 71 bp, chicken (Gallus Gallus)
  misc_feature (36): n=c or g
gccacctaaacaagcaactgtgcgtgattgctttanagcttcaaactgtgatttgtagaggaaatagaatt

SEQ ID NO: 20980 - DNA, 71 bp, chicken (Gallus Gallus)
  misc_feature (36): n=a or g
caaagaacagttgggctgagtaagagacctgaactncgagatggatttactgttaccctccgggtagggag

SEQ ID NO: 20981 - DNA, 71 bp, chicken (Gallus Gallus)
  misc_feature (36): n=g or t
ttcaaatgagaggaaaaaatatatgcaaggaagttntcattctatgaagtgcttccagacctaataaaatc

SEQ ID NO: 20982 - DNA, 71 bp, chicken (Gallus Gallus)
  misc_feature (36): n=c or t
agggaaatggatttattttggctgtgagttaatcanactttcatcttacatttttaattgtgatttttaat

SEQ ID NO: 20983 - DNA, 71 bp, chicken (Gallus Gallus)
  misc_feature (36): n=a or g
taaaacaggcaaaatatgtcatctggtttcctcaangtaggaattagtagtccaagtcttctccatgcaag

SEQ ID NO: 20984 - DNA, 71 bp, chicken (Gallus Gallus)
  misc_feature (36): n=a or g
atcagatgccttcggaatgttatccactggaatttnatcaccacgttcatcctgagaaatgtgatgtggtt

SEQ ID NO: 20985 - DNA, 71 bp, chicken (Gallus Gallus)
  misc_feature (36): n=c or g
cttgctcagatcaccggcactgatcatagtgagtancttcataaggaaataaaagtaaaggctgtgggaag

SEQ ID NO: 20986 - DNA, 71 bp, chicken (Gallus Gallus)
  misc_feature (36): n=c or t
gttctcatgtagtaaagaagtttataaaggaacttnagtaaaaacattcttccctgttctagaaattaaag

SEQ ID NO: 20987 - DNA, 71 bp, chicken (Gallus Gallus)
  misc_feature (36): n=a or c
taaagtctaacactgaaaagcagaaaatcatgtagnttaattataagttagacactttcacgaggtatgga

SEQ ID NO: 20988 - DNA, 71 bp, chicken (Gallus Gallus)
  misc_feature (36): n=a or g
ttaacatgcaaatgtgaaagcccacaaaatgcaccntttctttagcagaaccagaagcatgcacagtccac

SEQ ID NO: 20989 - DNA, 71 bp, chicken (Gallus Gallus)
  misc_feature (36): n=c or g
taatttctattaattattacatttaatttctcattntgttgtgtttgaaagcttcagttgtggagccagga

SEQ ID NO: 20990 - DNA, 71 bp, chicken (Gallus Gallus)
  misc_feature (36): n=a or g
cgtagaaagacactctcagaaagttaccagcacccnatatccatactcctcaagatatgaggaacttgtca

SEQ ID NO: 20991 - DNA, 71 bp, chicken (Gallus Gallus)
  misc_feature (36): n=a or g
atgtggggtgcagagataggggaggggggcagtcantgccctctttgtattcagaatcttgaactgacatt

SEQ ID NO: 20992 - DNA, 71 bp, chicken (Gallus Gallus)
  misc_feature (36): n=c or t
aaaagttttacatgactgtaaaatgtagctcttttncaaaaaaaatggctttaatttctaagtctgaattt

SEQ ID NO: 20993 - DNA, 71 bp, chicken (Gallus Gallus)
  misc_feature (36): n=a or g
gtcctccaagagtacctagaaaccaactcagaaacntacgtaaaagtcaaactgatatttgggatggtgtg

SEQ ID NO: 20994 - DNA, 71 bp, chicken (Gallus Gallus)
  misc_feature (36): n=a or g
ttcagcattagcatgtttttaaaaagtttaagatcntggtacctttcaaatccaaagataacttgtctgga

SEQ ID NO: 20995 - DNA, 71 bp, chicken (Gallus Gallus)
  misc_feature (36): n=c or t
tttaaaaaaaaactaaaaccgctcactgttgcattngacaaacttaaccattcaatttttctccccaaaca

SEQ ID NO: 20996 - DNA, 71 bp, chicken (Gallus Gallus)
  misc_feature (36): n=c or t
ccataacagaatatctgagcctgcagtcccaaaggnctgggcacagtgcacttacactcacatgtacactc

SEQ ID NO: 20997 - DNA, 71 bp, chicken (Gallus Gallus)
  misc_feature (36): n=a or g
tcttggtttcttaaagcttgggattttgacctcaanttgactttactccaagtggttggagagaatcaact

SEQ ID NO: 20998 - DNA, 71 bp, chicken (Gallus Gallus)
  misc_feature (36): n=a or g
agggaaatgcaatcaaagcgattcagtgagaactcncactctcagccctcagagcagtcaatgagcggctg

SEQ ID NO: 20999 - DNA, 71 bp, chicken (Gallus Gallus)
  misc_feature (36): n=g or t
tactgctattcattcactcctaactgttgtttcatnatataattgttataaaccactatcaatcataaaat

SEQ ID NO: 21000 - DNA, 71 bp, chicken (Gallus Gallus)
  misc_feature (36): n=c or t
aggatggtgccctcttttctgcaagcaggggagttngcaaccagactgaaaatggttgaaatgcaaccagt

SEQ ID NO: 21001 - DNA, 71 bp, chicken (Gallus Gallus)
  misc_feature (36): n=a or g
atgggaatcccatcattcatatcaattgtgctgtcngtggtgagagcatttatggcagccacaatggcaga

SEQ ID NO: 21002 - DNA, 71 bp, chicken (Gallus Gallus)
  misc_feature (36): n=a or t
cagtaaagtcctccttctgctttccagtagcttacnggaagagtctggttctaagtccctgtaaaactcta

SEQ ID NO: 21003 - DNA, 71 bp, chicken (Gallus Gallus)
  misc_feature (36): n=a or t
aggcaagggataggcataatgtgaagtagttcaacnctactaaaagccaaataaattggcgatggccacaa

SEQ ID NO: 21004 - DNA, 71 bp, chicken (Gallus Gallus)
  misc_feature (36): n=g or t
ctattatgagtctaatgcatttctgttgcattggtnttacagtgcagagctgcagaagtcggtgcctggcc

SEQ ID NO: 21005 - DNA, 71 bp, chicken (Gallus Gallus)
  misc_feature (36): n=a or g
gcccatcatgctaccctgctagtgtccatcatacanacttacggttacaaggaatgctaatgtcctccctg

SEQ ID NO: 21006 - DNA, 71 bp, chicken (Gallus Gallus)
  misc_feature (36): n=a or g
cctggagctttagagctcacctgtccttccatggancgcaccttttaacctgaaagctggtaaagttcaag

SEQ ID NO: 21007 - DNA, 71 bp, chicken (Gallus Gallus)
  misc_feature (36): n=c or t
tatattgaaaatgtgtttctatctaaatattactgnatatttgtattattgtctgtaatacacaacatgta

SEQ ID NO: 21008 - DNA, 71 bp, chicken (Gallus Gallus)
  misc_feature (36): n=a or g
aggaacacattgcatatgcttgtcttgctcttattntctttcctagacatccacttctggccagtatcagt

SEQ ID NO: 21009 - DNA, 71 bp, chicken (Gallus Gallus)
  misc_feature (36): n=c or t
ttaagaacaaaaccaatgacatttatataactttantcgtattatgacagtattagcagctttagcaaaaa

SEQ ID NO: 21010 - DNA, 71 bp, chicken (Gallus Gallus)
  misc_feature (36): n=c or t
tggatgccaagataactgaaaataacacaatgtganttctattgttttcttagttgattaagcgtatcttg

SEQ ID NO: 21011 - DNA, 71 bp, chicken (Gallus Gallus)
  misc_feature (36): n=c or t
tctgcagaatccaccactctgcagcttaggatttgngcctgcttagtacctatgtctgaagtgtgaagatt

SEQ ID NO: 21012 - DNA, 71 bp, chicken (Gallus Gallus)
  misc_feature (36): n=a or g
aagtccacacaacaacaatttatcttctgtccaatncagaatataaagaatatatttctgtatttggggta

SEQ ID NO: 21013 - DNA, 71 bp, chicken (Gallus Gallus)
  misc_feature (36): n=a or g
tatccatttcttgagattatcttattctttacgtcnctgcattacaatcagactgtgaattgggctcttcg

SEQ ID NO: 21014 - DNA, 71 bp, chicken (Gallus Gallus)
  misc_feature (36): n=g or t
cactttcaacactgactacacattaccattattctncattttcctaaagtcagcacctgaaagtattacca

SEQ ID NO: 21015 - DNA, 71 bp, chicken (Gallus Gallus)
  misc_feature (36): n=c or t
gccctttgcattctgaaatgatattatgaacagcanaaagccattatggattttgaaattctttagtataa

SEQ ID NO: 21016 - DNA, 71 bp, chicken (Gallus Gallus)
  misc_feature (36): n=c or t
ataaatgccagattcacagaagctgaggtggaacangcatcgggactggagaactagttcagtttccatct

SEQ ID NO: 21017 - DNA, 71 bp, chicken (Gallus Gallus)
  misc_feature (36): n=g or t
aggggcatgagcgcagaggagaaagtaacagtagantcgatgacagttgtgcgtataactatagtgcagac

SEQ ID NO: 21018 - DNA, 71 bp, chicken (Gallus Gallus)
  misc_feature (36): n=c or t
tttattccatgtactcatgcaggttggagccccganacccggtattcagagcattttcttcaagaagctaa

SEQ ID NO: 21019 - DNA, 71 bp, chicken (Gallus Gallus)
  misc_feature (36): n=c or t
agaagaaaagatcttctcatgtcaagagttaattcnacagaacttgttttagggttttactcttaaaaggc

SEQ ID NO: 21020 - DNA, 71 bp, chicken (Gallus Gallus)
  misc_feature (36): n=c or t
aatcctgagccattcaggagtagtagtcattattanttagaaatgtgggagcaaacagccagtcgagaatt

SEQ ID NO: 21021 - DNA, 71 bp, chicken (Gallus Gallus)
  misc_feature (36): n=a or c
aatctttagaattatcaaagaacacaataaaagtcntcaaggttgaagatacctcagtgacctgaaggcaa

SEQ ID NO: 21022 - DNA, 71 bp, chicken (Gallus Gallus)
  misc_feature (36): n=a or g
ttagatagacttctagatagaactgtaacttgcatntgaaagagatgatagattaccattctgtattttta

SEQ ID NO: 21023 - DNA, 71 bp, chicken (Gallus Gallus)
  misc_feature (36): n=a or c
catcacaaagagatgttgagtcaccagaagcaaccngttaaatccagttaagaaacgcacgtaggagtttt

SEQ ID NO: 21024 - DNA, 71 bp, chicken (Gallus Gallus)
  misc_feature (36): n=a or g
ccatcagaggtgggctccagacccctcacagcttcnttgtttttacctggacacaccgcagggcctcagta

SEQ ID NO: 21025 - DNA, 71 bp, chicken (Gallus Gallus)
  misc_feature (36): n=c or t
caggacactgcctttatatattgcagctggaaaacntgtaagacattcaaggttactctgcagtaaggcaa

SEQ ID NO: 21026 - DNA, 71 bp, chicken (Gallus Gallus)
  misc_feature (36): n=c or t
atagcactggccacaatgtagcccataaaaccaganattcctgctgagtatttttcagctgatgagctctt

SEQ ID NO: 21027 - DNA, 71 bp, chicken (Gallus Gallus)
  misc_feature (36): n=a or t
gaatatgaataatatggctgactacactcacattanattgtggaataactctaaagagaattctatgtttc

SEQ ID NO: 21028 - DNA, 71 bp, chicken (Gallus Gallus)
  misc_feature (36): n=a or g
gttgctgttatcagaattcaaatggaatacagtgcnctactacataccacacaacatggccttcctaactc

SEQ ID NO: 21029 - DNA, 71 bp, chicken (Gallus Gallus)
  misc_feature (36): n=a or g
attgacactgacactgcattcctcaccatgccccanatacattcctgcagaaaaatcatgagagaggtcaa

SEQ ID NO: 21030 - DNA, 71 bp, chicken (Gallus Gallus)
  misc_feature (36): n=c or t
atccctaaagctataactttatgaatctacgtgcantgtatggaaaatatagcttgttttttttttttttt

SEQ ID NO: 21031 - DNA, 71 bp, chicken (Gallus Gallus)
  misc_feature (36): n=c or t
cgagtgggccaatgtataccggcagggttcaacttncagtgcccacatgggcaggtgatcgtggccatcag

SEQ ID NO: 21032 - DNA, 71 bp, chicken (Gallus Gallus)
  misc_feature (36): n=c or t
ttggtcctacaggaccctggaagctccccaaagacnccttgctgcaaatccaagactttgccctggtctgc

SEQ ID NO: 21033 - DNA, 71 bp, chicken (Gallus Gallus)
  misc_feature (36): n=a or t
tgtttttttcataagaatcagtaactatacagtgcnaggatcaggtcctgtgatgatagtatgtttggtga

SEQ ID NO: 21034 - DNA, 71 bp, chicken (Gallus Gallus)
  misc_feature (36): n=g or t
catcttcactttggcaggggcttctggcaatttctntctcctcggggtcaagggatgctaaccctcaccac

SEQ ID NO: 21035 - DNA, 71 bp, chicken (Gallus Gallus)
  misc_feature (36): n=c or t
aagctagagcgagtgaagaagctaaaagactacgcnttcattcattttgatgaacgggatggtgcagtaaa

SEQ ID NO: 21036 - DNA, 71 bp, chicken (Gallus Gallus)
  misc_feature (36): n=c or t
aacttgaaactacttttcagggattcagaaattccncaaatttcttctgttttgtcttctctattccctat

SEQ ID NO: 21037 - DNA, 71 bp, chicken (Gallus Gallus)
  misc_feature (36): n=a or c
tcccatcctacccaaaagtcctacacccgttacccnaaacaccatttcctaacccatttccaatctcctgt

SEQ ID NO: 21038 - DNA, 71 bp, chicken (Gallus Gallus)
  misc_feature (36): n=a or c
caatgtttagaaaagtacacgtttgcactgggttcncatccccggtgacacacaaggtcaggctggaatgg

SEQ ID NO: 21039 - DNA, 71 bp, chicken (Gallus Gallus)
  misc_feature (36): n=c or t
tgggaagcttgaagtcaaccgtaagcacagtgtggngatgagtgagaaccatcttaagctgacatcttggc

SEQ ID NO: 21040 - DNA, 71 bp, chicken (Gallus Gallus)
  misc_feature (36): n=c or t
aagccaaggcagaaggcaaacctgcctgtggcacangcttaatgaatatacagaagcaaaagcagaaggga

SEQ ID NO: 21041 - DNA, 71 bp, chicken (Gallus Gallus)
  misc_feature (36): n=g or t
ttcataggtaaatattgataaatacagactgtgcantattcagtaagttctttttgctgacttttctttca

SEQ ID NO: 21042 - DNA, 71 bp, chicken (Gallus Gallus)
  misc_feature (36): n=g or t
ctatatttctgtataaatctgttggtttagttcaanagcacacaggaaaaataagcaagacacgtgactga

SEQ ID NO: 21043 - DNA, 71 bp, chicken (Gallus Gallus)
  misc_feature (36): n=g or t
aggtcacttctatatactcctggggtttttgtgctnaactcacctgaggactgagtaagctgcatttttgg

SEQ ID NO: 21044 - DNA, 71 bp, chicken (Gallus Gallus)
  misc_feature (36): n=c or t
atcacagaatcaaaatactctgaactgcaagggacncaaaaggatcatcagcttcgactcctgcctccaca

SEQ ID NO: 21045 - DNA, 71 bp, chicken (Gallus Gallus)
  misc_feature (36): n=a or t
catgcttgaacttctggataagaaggaaattttacncttttggaagttgtaacatttaactatgatgagaa

SEQ ID NO: 21046 - DNA, 71 bp, chicken (Gallus Gallus)
  misc_feature (36): n=a or g
ttactttaacctttgctgcaactattgtttttactngaagaggagtgtcattagattgtgtctgggataca

SEQ ID NO: 21047 - DNA, 71 bp, chicken (Gallus Gallus)
  misc_feature (36): n=a or g
agctggatttagagcacgcagatgtgactgtgggcnaagctaaacagcagttgcattctggagcacatcca

SEQ ID NO: 21048 - DNA, 71 bp, chicken (Gallus Gallus)
  misc_feature (36): n=c or t
aatttctgatttctatgaaacaaatgggatgctttntttgagctaaacattgttaatagataggtaaagtc

SEQ ID NO: 21049 - DNA, 71 bp, chicken (Gallus Gallus)
  misc_feature (36): n=c or t
cagcagcttgtctgcatgttaccggctaagagtagngatgaatgaggagccctaagctgagcacatgtcct

SEQ ID NO: 21050 - DNA, 71 bp, chicken (Gallus Gallus)
  misc_feature (36): n=a or g
tgtctcatattagcacttaatcacatatcttaaatnggtccaaaatgtactttttttgaattctttaatgc

SEQ ID NO: 21051 - DNA, 71 bp, chicken (Gallus Gallus)
  misc_feature (36): n=a or g
tgggtaaaactaaatggcaccctttaaggatgttgnttcctctgaaacacaagaatttttgctgctttttt

SEQ ID NO: 21052 - DNA, 71 bp, chicken (Gallus Gallus)
  misc_feature (36): n=a or c
gtacatgagctagcttggttactgctgctttgggtntggctctgcttggcactattgcaggttggatgata

SEQ ID NO: 21053 - DNA, 71 bp, chicken (Gallus Gallus)
  misc_feature (36): n=a or g
aatgttattaaatctaacagctcgctctaccgccancacctaaataatgctgtaaaatgcatgctctggct

SEQ ID NO: 21054 - DNA, 71 bp, chicken (Gallus Gallus)
  misc_feature (36): n=a or g
gagagtgaagtacagggggtatggctccgaatgctnccaatcacagaagatcttagagtatggagatgaat

SEQ ID NO: 21055 - DNA, 71 bp, chicken (Gallus Gallus)
  misc_feature (36): n=a or t
gtggtctatagtttttgagctattctttatactttncgatgacagagaaaccaaaggaaataacagttcta

SEQ ID NO: 21056 - DNA, 71 bp, chicken (Gallus Gallus)
  misc_feature (36): n=c or t
ttctctcttatggtgcagctggaagacatgaagacnacagtggtgaaggtgataaaatgttagtacttagc

SEQ ID NO: 21057 - DNA, 71 bp, chicken (Gallus Gallus)
  misc_feature (36): n=a or g
tcagcggcaatttaggaagaatgcacacatttaccntagaagcactgaagttatgcaccaagttattttca

SEQ ID NO: 21058 - DNA, 71 bp, chicken (Gallus Gallus)
  misc_feature (36): n=c or t
aatccgttttggcactcttttatacctttagcctcnacagcatcctgtggcaatgagttccccaattgaat

SEQ ID NO: 21059 - DNA, 71 bp, chicken (Gallus Gallus)
  misc_feature (36): n=a or g
attttgctttgtgctgggccgatcagaagcagcccntccaatgaagtcttgccatgaacatccatagtgaa

SEQ ID NO: 21060 - DNA, 71 bp, chicken (Gallus Gallus)
  misc_feature (36): n=a or g
aaaaaacatttgttaatcataaagaaattatgactntttggggaaaacttctgcaaagcaactataaccag

SEQ ID NO: 21061 - DNA, 71 bp, chicken (Gallus Gallus)
  misc_feature (36): n=a or g
tgaacagcctacactgcaatgcattttcagggtcantgtttgatagtttctgtctactctactacttttta

SEQ ID NO: 21062 - DNA, 71 bp, chicken (Gallus Gallus)
  misc_feature (36): n=a or t
gaatttccttgtatcagtatgggaaaaaaaaaaaanattgttaactactctctttaaacaacattttgtta

SEQ ID NO: 21063 - DNA, 71 bp, chicken (Gallus Gallus)
  misc_feature (36): n=c or t
tcttcacgagacagcaaacacagaggaagacacttntaattcttcctatttagtaacagacgtaaacagaa

SEQ ID NO: 21064 - DNA, 71 bp, chicken (Gallus Gallus)
  misc_feature (36): n=a or g
tggaaatagatgaaaaatgctcacccacaccataancacacagaaaaaaactccaagaggagcaatctcca

SEQ ID NO: 21065 - DNA, 71 bp, chicken (Gallus Gallus)
  misc_feature (36): n=a or g
aatgctatcacagaaccctggagttttacagcctcngccaacagcagaggtgctcctggtttccccttcct

SEQ ID NO: 21066 - DNA, 71 bp, chicken (Gallus Gallus)
  misc_feature (36): n=g or t
gagataaagcaagtgttaaaaagcttgcttgtacgnaatggctttgtgagcagaaatgagtggtgttggtg

SEQ ID NO: 21067 - DNA, 71 bp, chicken (Gallus Gallus)
  misc_feature (36): n=a or g
tgtttttagggttttatttcctaccaaaaagctacnctagtcttattttttaatatttcatttcccacaga

SEQ ID NO: 21068 - DNA, 71 bp, chicken (Gallus Gallus)
  misc_feature (36): n=a or g
aacggagagcacaattagattgtatgctgagcactnctgatgatcttgctgtggaccctgaaatctgcatc

SEQ ID NO: 21069 - DNA, 71 bp, chicken (Gallus Gallus)
  misc_feature (36): n=g or t
aatcttcttgcttgacactgtacttatgagctgtgntcacatgctcttctctttgtaacattttttttttt

SEQ ID NO: 21070 - DNA, 71 bp, chicken (Gallus Gallus)
  misc_feature (36): n=a or g
taatgggaaaggtgttacaacagaggcgtgatgacngaaggaccagcacaatagaaagctgctataaagga

SEQ ID NO: 21071 - DNA, 71 bp, chicken (Gallus Gallus)
  misc_feature (36): n=a or g
ttttaatgttggtagtggtagacatttgtttttctntattgtagtgtcccataagacatgttatattaatt

SEQ ID NO: 21072 - DNA, 71 bp, chicken (Gallus Gallus)
  misc_feature (36): n=c or t
aaattaaaagatatgtcttcagaagcagcaacacanagtaacagtctactacgaaaatgcccatgagtcag

SEQ ID NO: 21073 - DNA, 71 bp, chicken (Gallus Gallus)
  misc_feature (36): n=c or t
cccgtaactcttttgctccagaagctccctaggatngttaaggttgaaaaagacttctcagatcaccacat

SEQ ID NO: 21074 - DNA, 71 bp, chicken (Gallus Gallus)
  misc_feature (36): n=a or t
tcggctgcttactttcttcaacttgtatctctattnaccaggaaaaacaggacaaagcagttctccaagca

SEQ ID NO: 21075 - DNA, 71 bp, chicken (Gallus Gallus)
  misc_feature (36): n=c or t
gaaccaacctaggattctcagtcagtcctcatacancttgccctccagacccttttttatcttcatagccc

SEQ ID NO: 21076 - DNA, 71 bp, chicken (Gallus Gallus)
  misc_feature (36): n=c or g
ctctcctgactcagctgcacaggatgcctaaatgcnagaatgccaagtcagcgcattcgcttccaaggctg

SEQ ID NO: 21077 - DNA, 71 bp, chicken (Gallus Gallus)
  misc_feature (36): n=c or t
atacacatccactgaggaagaagtgtgagattcacngggaaccttgagtcctttttgacagaatattggac

SEQ ID NO: 21078 - DNA, 71 bp, chicken (Gallus Gallus)
  misc_feature (36): n=a or t
tttaccggggaaaagaaacgacacgggttgtatccngaaatcactgtgcatccttataccctcctgggctg

SEQ ID NO: 21079 - DNA, 71 bp, chicken (Gallus Gallus)
  misc_feature (36): n=c or t
gttaagcagaccttcagtacaaacagtgtggaaagncttaagcttttgagtgggtggtagaggtgtaagaa

SEQ ID NO: 21080 - DNA, 71 bp, chicken (Gallus Gallus)
  misc_feature (36): n=c or t
agacatctcattgcccccaggcaggccagatggacnctgtgtctctgtatgcatcttcaaaacaggctata

SEQ ID NO: 21081 - DNA, 71 bp, chicken (Gallus Gallus)
  misc_feature (36): n=c or t
ttaagctattcaagaaacctgcataatttgtgtcanagcaaagaggacagcagtgtatacatgaggaactg

SEQ ID NO: 21082 - DNA, 71 bp, chicken (Gallus Gallus)
  misc_feature (36): n=a or t
gagaacaatagtttaatttgatttcctgcagagaanttaacagagcctagctgtatatgtaaatagctata

SEQ ID NO: 21083 - DNA, 71 bp, chicken (Gallus Gallus)
  misc_feature (36): n=a or c
tagatttcagcttgtttttggcactgagaccaaagntccagatcctaacatcctgtgcctctgcaacatct

SEQ ID NO: 21084 - DNA, 71 bp, chicken (Gallus Gallus)
  misc_feature (36): n=c or t
ttaagaggaaaatcaagctctgtgagttttcagtgnccctcatacagtaaaactgtaggtgttaaaacatt

SEQ ID NO: 21085 - DNA, 71 bp, chicken (Gallus Gallus)
  misc_feature (36): n=a or g
ggattagcctgaagagttatctttgttgatgaactnaatgaacagtttcaagaggtttagaagaatactgt

SEQ ID NO: 21086 - DNA, 71 bp, chicken (Gallus Gallus)
  misc_feature (36): n=a or t
ggggagtggctcagagacatgttgtttgtaagcagntccttcagaaacactccggtgtgataacacagctt

SEQ ID NO: 21087 - DNA, 71 bp, chicken (Gallus Gallus)
  misc_feature (36): n=a or c
gtccttcaagaagcagtgactttccagcaagacaangcctgacacttacgttactgaatggtgttaagagt

SEQ ID NO: 21088 - DNA, 71 bp, chicken (Gallus Gallus)
  misc_feature (36): n=a or g
attgaagtatgctgatttgggtctggaaacaccccnttgcctacatgtcttagacaaaacactccataaga

SEQ ID NO: 21089 - DNA, 71 bp, chicken (Gallus Gallus)
  misc_feature (36): n=c or g
cttgagatattctcagtctttggatagattttagtngatgtgaaaaggctgtaatggtctcactgtagcta

SEQ ID NO: 21090 - DNA, 71 bp, chicken (Gallus Gallus)
  misc_feature (36): n=c or t
cacatcactatttttcctaaggcaaacaaacagttntgctcatcgcattatgtgctattgatagcaaaatt

SEQ ID NO: 21091 - DNA, 71 bp, chicken (Gallus Gallus)
  misc_feature (36): n=a or t
tgctctaacagagaatactagttggtacagcttcanaaccttgttgtgtggacacccattaccatgttaca

SEQ ID NO: 21092 - DNA, 71 bp, chicken (Gallus Gallus)
  misc_feature (36): n=c or t
taactctctgtgtcacagagctgaatggaaaactgntatgtatcttacgtaaagaaatttattcgtactca

SEQ ID NO: 21093 - DNA, 71 bp, chicken (Gallus Gallus)
  misc_feature (36): n=c or t
gttcttgcttcttaattagtgtttcactcccaccanagcagggacattttctaacaaaaggtcattttgaa

SEQ ID NO: 21094 - DNA, 71 bp, chicken (Gallus Gallus)
  misc_feature (36): n=a or g
accctagctcctctgatgtggacaagcctgcaccangctgttgcacccgggttggacatgctgttactatt

SEQ ID NO: 21095 - DNA, 71 bp, chicken (Gallus Gallus)
  misc_feature (36): n=c or g
tgacttatggttctgatttagcgagggttgcctgtnacgtatgactctgtgacttctttcatatgttttct

SEQ ID NO: 21096 - DNA, 71 bp, chicken (Gallus Gallus)
  misc_feature (36): n=a or t
attttgtgtaaatgctttcaaaatcaaatgtgggtntgtatttttttttttttaacttttaaagttttggt

SEQ ID NO: 21097 - DNA, 71 bp, chicken (Gallus Gallus)
  misc_feature (36): n=c or t
tatgttccactttcagttggtacttcagaagctatncaagctgagtactgaaatgttaactttgctgtttt

SEQ ID NO: 21098 - DNA, 71 bp, chicken (Gallus Gallus)
  misc_feature (36): n=a or g
ctgtgtaccacaacagctgttgatacaaacgttgtncactctgattagaaaaagataaaacaaaccgcttt

SEQ ID NO: 21099 - DNA, 71 bp, chicken (Gallus Gallus)
  misc_feature (36): n=c or t
ttgattatctcctggaaaatgaaacatagatcctcngtgtctttcctggtttgtgcccatcattgttggga

SEQ ID NO: 21100 - DNA, 71 bp, chicken (Gallus Gallus)
  misc_feature (36): n=a or t
ttgactgaaatgcactttctgttcgtgccaatggancagagaactgctgatgcacaatgaggacagggcat

SEQ ID NO: 21101 - DNA, 71 bp, chicken (Gallus Gallus)
  misc_feature (36): n=a or g
ttgcctgattatatggcaacagagatgttttcttcntccaatctacagccaggaaaatacacacctctgag

SEQ ID NO: 21102 - DNA, 71 bp, chicken (Gallus Gallus)
  misc_feature (36): n=a or c
aattctgcttgcttagctacaacctgttgacaaagntagatggaagtcttttttctctgctatggtagacc

SEQ ID NO: 21103 - DNA, 71 bp, chicken (Gallus Gallus)
  misc_feature (36): n=a or g
aggcagaaaagttagataagctttgagcagtgggantgcaggaaaaataacctcttctgatagaagtatgt

SEQ ID NO: 21104 - DNA, 71 bp, chicken (Gallus Gallus)
  misc_feature (36): n=g or t
gacatcatctttggagttatgtctgttggagtgggnccagaggatcagagggctggagcacctttcctgtg

SEQ ID NO: 21105 - DNA, 71 bp, chicken (Gallus Gallus)
  misc_feature (36): n=a or g
ttgcagcagaagctgtagcatcatttgcttagatcngcacaagcccttctgatcctgcctcgggtgctcag

SEQ ID NO: 21106 - DNA, 71 bp, chicken (Gallus Gallus)
  misc_feature (36): n=a or g
taggcagtactactctaagacataaataaaatgtgnggaatggtcagaggagatgtaaatagaatgtgagg

SEQ ID NO: 21107 - DNA, 71 bp, chicken (Gallus Gallus)
  misc_feature (36): n=a or g
tggaaaaaatacaatgcttcctttaattttaagccntaaagctctgtccagttctatgtgccgtggccttc

SEQ ID NO: 21108 - DNA, 71 bp, chicken (Gallus Gallus)
  misc_feature (36): n=c or t
accctcagacccttccccatcaccgtagccctttgnggatgttgaatgtccttatgttgtggtgcagtgct

SEQ ID NO: 21109 - DNA, 71 bp, chicken (Gallus Gallus)
  misc_feature (36): n=c or t
gttcattttaggcatgtgccaagagagagtgcgacngcagactgctgtaacccacattgctctggtctcag

SEQ ID NO: 21110 - DNA, 71 bp, chicken (Gallus Gallus)
  misc_feature (36): n=a or t
cagggcaacattccaacaccacctgcatctaccaantaaggacgatttaacctatattcacactatcttaa

SEQ ID NO: 21111 - DNA, 71 bp, chicken (Gallus Gallus)
  misc_feature (36): n=a or g
ggtatccattaaaagatctggtttaggagatggaanggagagatcttcaactagaaggaggaaaaagttgt

SEQ ID NO: 21112 - DNA, 71 bp, chicken (Gallus Gallus)
  misc_feature (36): n=a or g
atcccatctccctaagatgttttctccacaacttcntatgtttgtatgcatgtaccttggtgtgctgggct

SEQ ID NO: 21113 - DNA, 71 bp, chicken (Gallus Gallus)
  misc_feature (36): n=a or g
taatgtggttatacgttcaactcctactcaactcanacttctttcaaaactatcattaaaagaaacatcac

SEQ ID NO: 21114 - DNA, 71 bp, chicken (Gallus Gallus)
  misc_feature (36): n=a or g
tgaggtcttctggggctaattatttatttaatgagnagtggtcacagtggcactatgagaagggcagcccc

SEQ ID NO: 21115 - DNA, 71 bp, chicken (Gallus Gallus)
  misc_feature (36): n=a or c
tttgcttccctgcagcagattccttttcagtacagntcttattaactgccacatctttataacagtttttt

SEQ ID NO: 21116 - DNA, 71 bp, chicken (Gallus Gallus)
  misc_feature (36): n=c or g
aagaatgaaggctgagtgtactgacttgcctgcaanactactaatgagtcctcatcagagctagcactaga

SEQ ID NO: 21117 - DNA, 71 bp, chicken (Gallus Gallus)
  misc_feature (36): n=c or t
attagtttcaccatcctcactccttcaccagcatgntagtcttattgcgttagtttctttctttctttgtg

SEQ ID NO: 21118 - DNA, 71 bp, chicken (Gallus Gallus)
  misc_feature (36): n=c or t
ctcttttctcttcgacacagccccccacgaaagcanattgtggatacctatacggagttctaccacacccc

SEQ ID NO: 21119 - DNA, 71 bp, chicken (Gallus Gallus)
  misc_feature (36): n=a or c
tgagaggtggtaaagaacatcaggttagaagaaagntggtaggaactcaggctcctcgagtcgtcggcttt

SEQ ID NO: 21120 - DNA, 71 bp, chicken (Gallus Gallus)
  misc_feature (36): n=a or g
gatgcccaaactttgccttcccgtggccacgcttcnatccaccccttctctgatagcacctcttcataaca

SEQ ID NO: 21121 - DNA, 71 bp, chicken (Gallus Gallus)
  misc_feature (36): n=a or g
aaatattactagttgctgtttcttcatccttttgtncacacatgttggttttgctgcatttgctctgtata

SEQ ID NO: 21122 - DNA, 71 bp, chicken (Gallus Gallus)
  misc_feature (36): n=a or g
tctctgtgattccaacccaaacctaggagaaaaaangagagcaaactaatcttttggactcttaatggatc

SEQ ID NO: 21123 - DNA, 71 bp, chicken (Gallus Gallus)
  misc_feature (36): n=c or g
aactgacatgtttgagcacatccaggtctctttatntatgtgcatgacatgggatcttggaccaattttaa

SEQ ID NO: 21124 - DNA, 71 bp, chicken (Gallus Gallus)
  misc_feature (36): n=c or g
tagagtactgaatctgagctttccacctacaaaaantgtagctaccttctgctttacaagattgaatttgt

SEQ ID NO: 21125 - DNA, 71 bp, chicken (Gallus Gallus)
  misc_feature (36): n=c or t
taaatctatgcaatttcttctggaagcatgaaaganactttccaatatgacatcatatgtacaaatacggc

SEQ ID NO: 21126 - DNA, 71 bp, chicken (Gallus Gallus)
  misc_feature (36): n=a or g
ttggccaggagaatgatgtgttgatgggtaatgctngtcctaaaacagcatcactccctgttctgccacgt

SEQ ID NO: 21127 - DNA, 71 bp, chicken (Gallus Gallus)
  misc_feature (36): n=a or g
gactactgatcatgtcagttcttcagtacaacctcngagcctgttttcctctgcaacatgaaaaagtttcc

SEQ ID NO: 21128 - DNA, 71 bp, chicken (Gallus Gallus)
  misc_feature (36): n=c or t
aatttgttcggcacaggtgacacagccaaatgccantctcaccaattttacagaggtgccagacctgagat

SEQ ID NO: 21129 - DNA, 71 bp, chicken (Gallus Gallus)
  misc_feature (36): n=a or g
gcaggaaatgatagaatcgttgcatgttccgagtcngaagggacccataaggatacccataagggacccat

SEQ ID NO: 21130 - DNA, 71 bp, chicken (Gallus Gallus)
  misc_feature (36): n=c or t
gttaataataaaaacttttctgtgtttaagcattanggaatatttgataacacattgataacatttgttgc

SEQ ID NO: 21131 - DNA, 71 bp, chicken (Gallus Gallus)
  misc_feature (36): n=c or t
tctcttcaaaattcccccatttaacccgaaaatcangccttttctctttgaaaacccccatttagcccgaa

SEQ ID NO: 21132 - DNA, 71 bp, chicken (Gallus Gallus)
  misc_feature (36): n=a or g
aggatgtgggccgtgctgttccgatcgatatcaccnaataccagattctactctggcttttacacgcactc

SEQ ID NO: 21133 - DNA, 71 bp, chicken (Gallus Gallus)
  misc_feature (36): n=g or t
tatactctgtcaagagtggtggtggggagaagtaangcaaggtatattagtaaatatatattagtaaattt

SEQ ID NO: 21134 - DNA, 71 bp, chicken (Gallus Gallus)
  misc_feature (36): n=a or g
aatcaatagatcaatcgatccattccgtcatcaagnaagttcttaaagccttgagcctggacacagctgcc

SEQ ID NO: 21135 - DNA, 71 bp, chicken (Gallus Gallus)
  misc_feature (36): n=a or g
atttttgtggcaagcacaatgcagagtgattctgcntggttaatgagtgtgtgatgtgcaagcgctcagtt

SEQ ID NO: 21136 - DNA, 71 bp, chicken (Gallus Gallus)
  misc_feature (36): n=a or g
aatttaaaaaaaaaaaaacaccaaaccaaatgaaantaaggttacttttaagctgaacttgatttgccatg

SEQ ID NO: 21137 - DNA, 71 bp, chicken (Gallus Gallus)
  misc_feature (36): n=c or t
cattttccattattattgcacttgccaccgagcatntgaatgttgtgcatgaattctctcatctgatcagt

SEQ ID NO: 21138 - DNA, 71 bp, chicken (Gallus Gallus)
  misc_feature (36): n=g or t
tatgtgaggctgctctgaaattaatgcctcctattntatgatattggcccatatcagagatggatgtggtt

SEQ ID NO: 21139 - DNA, 71 bp, chicken (Gallus Gallus)
  misc_feature (36): n=a or t
aattaaactttctacctgttgagtgttccctgttancacaaatacaataagtgccatcatcatatagttac

SEQ ID NO: 21140 - DNA, 71 bp, chicken (Gallus Gallus)
  misc_feature (36): n=a or g
cagtgttgggaagatgatagataatttagaaaatcngttatgcactgaacctgttgaaggtgatctccaca

SEQ ID NO: 21141 - DNA, 71 bp, chicken (Gallus Gallus)
  misc_feature (36): n=a or g
cggggtgaagaaggttgttgccagtctttgtatctntgtcttggatttggccagtccgctgtgatagaatt

SEQ ID NO: 21142 - DNA, 71 bp, chicken (Gallus Gallus)
  misc_feature (36): n=g or t
tataaagatgttacataccttcctagttctattttncaaagggataagcaagataaaaagggggttttttg

SEQ ID NO: 21143 - DNA, 71 bp, chicken (Gallus Gallus)
  misc_feature (36): n=c or g
gccataaatcactgcttgtattaaaaagctgaaagntctggatgtcttatgaatttcagtttgaaatgaaa

SEQ ID NO: 21144 - DNA, 71 bp, chicken (Gallus Gallus)
  misc_feature (36): n=c or t
actgtttgaatatctcccttttggtacactgtaatntgtttctcttccatttgtttgtgcacattctcaca

SEQ ID NO: 21145 - DNA, 71 bp, chicken (Gallus Gallus)
  misc_feature (36): n=a or c
agtgtatgtataagaaacattttgatggctgttgtntgacagaagcatttgttgctgctatgaaaacatat

SEQ ID NO: 21146 - DNA, 71 bp, chicken (Gallus Gallus)
  misc_feature (36): n=c or t
gttcaatgcagtgataaccatatcacttccatccantgggacaggtgttcttcctgacagaggaacatttc

SEQ ID NO: 21147 - DNA, 71 bp, chicken (Gallus Gallus)
  misc_feature (36): n=c or t
tccctctgagcagctccttctggaacctcccagctnttccaatctgatgattttagaattgcttcctgcac

SEQ ID NO: 21148 - DNA, 71 bp, chicken (Gallus Gallus)
  misc_feature (36): n=a or t
tttccatatattctttttctcgtggctgttaaagcnattgtaaaataaaaatcatcactgcaactaaagaa

SEQ ID NO: 21149 - DNA, 71 bp, chicken (Gallus Gallus)
  misc_feature (36): n=a or t
tgtaatatcttctgtgagaaaataggaaaagaaatnagtgtgaaaattaaactaaagatagatcagatttc

SEQ ID NO: 21150 - DNA, 71 bp, chicken (Gallus Gallus)
  misc_feature (36): n=c or t
ttagggtgctttttccagggagcactcattctccanttaaaaaaaacctttgttcttcacctgtgagagaa

SEQ ID NO: 21151 - DNA, 71 bp, chicken (Gallus Gallus)
  misc_feature (36): n=a or c
gcaataagacaagaggcagcaggctcaaactgcaanacaggaagcacattagaaaaagcttcttcactatg

SEQ ID NO: 21152 - DNA, 71 bp, chicken (Gallus Gallus)
  misc_feature (36): n=a or g
gtactccttgcaaataatgcagtttcaaataatatnttttgttctacactataattgcagaatggaactgc

SEQ ID NO: 21153 - DNA, 71 bp, chicken (Gallus Gallus)
  misc_feature (36): n=c or g
aaagatgaaagtttaaaaatatattaaaagaccttnttttatgctccaggctggtttctgaatgctattca

SEQ ID NO: 21154 - DNA, 71 bp, chicken (Gallus Gallus)
  misc_feature (36): n=a or g
gtagatatggcactggtctagagctgtcaggcatgngttgatggttggactaaatgatcttagtgatcttt

SEQ ID NO: 21155 - DNA, 71 bp, chicken (Gallus Gallus)
  misc_feature (36): n=a or g
aagaattaaagacagttcatgaagatgtcccttcanccatatgcaaacaacatatcaagggcaaaacccac

SEQ ID NO: 21156 - DNA, 71 bp, chicken (Gallus Gallus)
  misc_feature (36): n=a or g
tcaatttccatcagagagagctgaggcaaactgtcntcctgaaggaagtgcctcaaacagatgactgcgat

SEQ ID NO: 21157 - DNA, 71 bp, chicken (Gallus Gallus)
  misc_feature (36): n=c or t
caagtcaattaattctagtgctcactgcgactcacngttctcttggtgctatatataacttctttagctat

SEQ ID NO: 21158 - DNA, 71 bp, chicken (Gallus Gallus)
  misc_feature (36): n=c or t
taaactcgtccaaacctcccaaaaagtgtctttccnatccttggtgtgtctcctgtttcatcttctttgtg

SEQ ID NO: 21159 - DNA, 71 bp, chicken (Gallus Gallus)
  misc_feature (36): n=a or g
aacgcttgtagtattccctgttaaatcacaatctcngtgacttctcttattacagtactactaaaagaagc

SEQ ID NO: 21160 - DNA, 71 bp, chicken (Gallus Gallus)
  misc_feature (36): n=a or g
tcaggcagaacagaactctacttccaaactgtgacntcttagaagggaactgatctgaagctgcagttagt

SEQ ID NO: 21161 - DNA, 71 bp, chicken (Gallus Gallus)
  misc_feature (36): n=a or g
atgaagtgctgtgtgactgtcgcctaatttcacccncatgagccttagcaaaggatgcaatagggaagcac

SEQ ID NO: 21162 - DNA, 71 bp, chicken (Gallus Gallus)
  misc_feature (36): n=a or g
atcaaagtatgttataatctcctcaaagctgttgtntcccaaattcctgctttatctgtacttctaatgtt

SEQ ID NO: 21163 - DNA, 71 bp, chicken (Gallus Gallus)
  misc_feature (36): n=c or t
cccttcagaactgtctcacaagggactcctcccagncaatgccctaaactgcccaaaggaataaaaggaaa

SEQ ID NO: 21164 - DNA, 71 bp, chicken (Gallus Gallus)
  misc_feature (36): n=c or t
gtgttcacaatgttcagaaagtgcacattttgaagncttgtttcagtactataaatgtccacgacctattc

SEQ ID NO: 21165 - DNA, 71 bp, chicken (Gallus Gallus)
  misc_feature (36): n=g or t
acttacagtaagttttgactgagcaacagaataagntagccacgaataacccaatcagggctctgtaggaa

SEQ ID NO: 21166 - DNA, 71 bp, chicken (Gallus Gallus)
  misc_feature (36): n=c or t
tgatcctcggtattacagtaacatttggaattctantggccgccagtgctattcggcacagaacacaacac

SEQ ID NO: 21167 - DNA, 71 bp, chicken (Gallus Gallus)
  misc_feature (36): n=a or g
ctcttcctgcacatatggtgcataggagacagcatngtgctctcgagcacacctacctgagccttctggag

SEQ ID NO: 21168 - DNA, 71 bp, chicken (Gallus Gallus)
  misc_feature (36): n=g or t
cttcaggacacctatgaactgctactcttggatatnaaattactgctagaaatgtggattatgaacatttt

SEQ ID NO: 21169 - DNA, 71 bp, chicken (Gallus Gallus)
  misc_feature (36): n=c or g
gaatttgcaccctgacttagggtctgtgcagtctanggacatttaactgacaattctcacctatatcatgt

SEQ ID NO: 21170 - DNA, 71 bp, chicken (Gallus Gallus)
  misc_feature (36): n=c or t
gggactgtaaacaagggcgaaaggtgcctgataaanatctcagttttgagtagtacatcaagcaaagtgaa

SEQ ID NO: 21171 - DNA, 71 bp, chicken (Gallus Gallus)
  misc_feature (36): n=c or t
tttctgacccgtaacctccagtctgtgctagtaaangtgacagagaggctgtgggacagtggacattcatt

SEQ ID NO: 21172 - DNA, 71 bp, chicken (Gallus Gallus)
  misc_feature (36): n=a or g
aaaaaaagaaaggaactgatcagaaagacagtgacngtatgtgtggggaaacaggctctcctgatgactga

SEQ ID NO: 21173 - DNA, 71 bp, chicken (Gallus Gallus)
  misc_feature (36): n=a or c
ctatgagggaaccctaattttatggttaacaattanctccagctctaaaaaaaacaaacaacagaaaaagg

SEQ ID NO: 21174 - DNA, 71 bp, chicken (Gallus Gallus)
  misc_feature (36): n=a or g
ggctcaaaaagcctgaaatgccctcattttatgcantgctttctaaaaaggagatggagcttgattgaacg

SEQ ID NO: 21175 - DNA, 71 bp, chicken (Gallus Gallus)
  misc_feature (36): n=c or g
tttgtttttccttttagtaacactacaatataacantattctgtaagctaaaacatatataaatacaaaca

SEQ ID NO: 21176 - DNA, 71 bp, chicken (Gallus Gallus)
  misc_feature (36): n=a or g
cctgtttcttgcttttttcttcagactatgaagaantgttaggcctatctaggccatggtctattaacagc

SEQ ID NO: 21177 - DNA, 71 bp, chicken (Gallus Gallus)
  misc_feature (36): n=c or t
tttgtgtttacatcttgaagtcttagggttccctgnagagctacagggactgttgatactttcatatgtac

SEQ ID NO: 21178 - DNA, 71 bp, chicken (Gallus Gallus)
  misc_feature (36): n=c or t
ctcaccactttgtccatgagcttccaggtcttctcnacagtcctccggtccgcagccgcctgcttcggggg

SEQ ID NO: 21179 - DNA, 71 bp, chicken (Gallus Gallus)
  misc_feature (36): n=c or t
aaaggaagatttcttcttctgttcttctcttgaagnagatcactcagcaatctgcaacttaagaattatgc

SEQ ID NO: 21180 - DNA, 71 bp, chicken (Gallus Gallus)
  misc_feature (36): n=a or g
tggacaatactggagaaacacttctctacagtgcantcaaaaggtacaatttacaatagtaattgtgcaca

SEQ ID NO: 21181 - DNA, 71 bp, chicken (Gallus Gallus)
  misc_feature (36): n=c or t
atatgtagtaaaaacatgccatcaacctatttctantccttggagatgtggtagcattttaagaattctgt

SEQ ID NO: 21182 - DNA, 71 bp, chicken (Gallus Gallus)
  misc_feature (36): n=a or g
tcagtgccaaagaagcgccctgttttggtagatgcnactcagacatgggctcagaataggaattatgagcc

SEQ ID NO: 21183 - DNA, 71 bp, chicken (Gallus Gallus)
  misc_feature (36): n=c or t
ccaagtcaagtaatctatacccagagctacctgtangcttctttttatatcctatcattgccatctttacc

SEQ ID NO: 21184 - DNA, 71 bp, chicken (Gallus Gallus)
  misc_feature (36): n=c or t
tgaaagctgtctgcattggtgcatcaacgcttcagncaatatgcagtatccacagcttacatgtttatttc

SEQ ID NO: 21185 - DNA, 71 bp, chicken (Gallus Gallus)
  misc_feature (36): n=g or t
atccaatttgtggatatttcatttaaagtgtgccangagtgaattgtcccacattgatgaattgataggcc

SEQ ID NO: 21186 - DNA, 71 bp, chicken (Gallus Gallus)
  misc_feature (36): n=c or t
gtattaccactgtgcactgaaagaaaactattaagngggggaaaaaaaatatctaatgaaataacacttca

SEQ ID NO: 21187 - DNA, 71 bp, chicken (Gallus Gallus)
  misc_feature (36): n=a or g
gacacgggccaagtacatcacactgcctatcccaantggataggcagtgcccaactgcatgtgacaccact

SEQ ID NO: 21188 - DNA, 71 bp, chicken (Gallus Gallus)
  misc_feature (36): n=a or g
aggaactacagagaaaccaggaactgtaatgtctanagagttttaaattgtgctaagtacttttaaatgaa

SEQ ID NO: 21189 - DNA, 71 bp, chicken (Gallus Gallus)
  misc_feature (36): n=c or t
attgaagaaacagatgcagaacactaatgagcattnaggtcttgcatgtctaacttgctagttttatgttt

SEQ ID NO: 21190 - DNA, 71 bp, chicken (Gallus Gallus)
  misc_feature (36): n=c or t
gataacgcatgaattgaaataggatgcaagtaatgngtaacagctgaagtgcacagaagtactgcatttcg

SEQ ID NO: 21191 - DNA, 71 bp, chicken (Gallus Gallus)
  misc_feature (36): n=c or t
tggagactctgtacagcacttaggctttttgttggncccaaatgggttggatgtcatcagtgtgtttgagc

SEQ ID NO: 21192 - DNA, 71 bp, chicken (Gallus Gallus)
  misc_feature (36): n=a or g
actggaattaaaagatggtgcctgcatagcatctgnaataaattcctgaaaatccataaaatcacatggct

SEQ ID NO: 21193 - DNA, 71 bp, chicken (Gallus Gallus)
  misc_feature (36): n=a or t
actcactccatgtggttttagttataggcatcttcntctcctcttacagtgacagcagtttgtgaatggtc

SEQ ID NO: 21194 - DNA, 71 bp, chicken (Gallus Gallus)
  misc_feature (36): n=c or t
gattgccccactgaaagaaggcactctctggctgtnccaacaacaccactgtctttcacctctcaatgaga

SEQ ID NO: 21195 - DNA, 71 bp, chicken (Gallus Gallus)
  misc_feature (36): n=a or c
attcacactttcatgtcagacaccattttgtcagantgaccaactgctatcggttgcacagcaacaaaatg

SEQ ID NO: 21196 - DNA, 71 bp, chicken (Gallus Gallus)
  misc_feature (36): n=c or t
cccgaggtccctggcatgctcacaaaaagtaacaangacaataaaaaaggcaacttgcccaaataaaccac

SEQ ID NO: 21197 - DNA, 71 bp, chicken (Gallus Gallus)
  misc_feature (36): n=c or t
ggtggtctacttgtgtgttttgctctttacctgtgnttttccaattagtgtgaaagagtggtcaagctacg

SEQ ID NO: 21198 - DNA, 71 bp, chicken (Gallus Gallus)
  misc_feature (36): n=g or t
gaccctgagcttttctctttgatgatagcaataggncctgagggaatggcatggagctgtgtcaggggaga

SEQ ID NO: 21199 - DNA, 71 bp, chicken (Gallus Gallus)
  misc_feature (36): n=a or g
tcttcccattgcttttatgtatcatctcaatatcangatgttctggaccagccttccaagatgactggtga

SEQ ID NO: 21200 - DNA, 71 bp, chicken (Gallus Gallus)
  misc_feature (36): n=g or t
cgaaagtgacataattgccagtatcctctcggtgtncaaactgcgcatgcacgtggctgaacaggggaagc

SEQ ID NO: 21201 - DNA, 71 bp, chicken (Gallus Gallus)
  misc_feature (36): n=g or t
acttgcacacgtgaacaatctcaagcaccataatcngtcgaactacatctttcatattttcatgagttgaa

SEQ ID NO: 21202 - DNA, 71 bp, chicken (Gallus Gallus)
  misc_feature (36): n=a or t
agacaacaggtgattcagtaagccaagcagagtganagcatggattcttagtaaagacagcagcagatatt

SEQ ID NO: 21203 - DNA, 71 bp, chicken (Gallus Gallus)
  misc_feature (36): n=c or g
tcctgagcttgttctcatctacagtaatcgatacanatttttgtccctgttttttttaggttgtttctgtt

SEQ ID NO: 21204 - DNA, 71 bp, chicken (Gallus Gallus)
  misc_feature (36): n=a or c
atcatcataataagtgaagtagcacttctgttaatnaagttagaggtcagccacttggacgaaaaactttg

SEQ ID NO: 21205 - DNA, 71 bp, chicken (Gallus Gallus)
  misc_feature (36): n=a or g
attaacaatgaactagactgaaaattctcttattanatgtctctgtgttacaccacgatctcctgtctgct

SEQ ID NO: 21206 - DNA, 71 bp, chicken (Gallus Gallus)
  misc_feature (36): n=a or g
ttctatcagattgtctggtgttgttagagtacagcnttgtaatgcattttggttattggattgcagaagca

SEQ ID NO: 21207 - DNA, 71 bp, chicken (Gallus Gallus)
  misc_feature (36): n=c or t
gcaccagcacagactatgaaacaagtgtgtggatcngaaaatcaggtgccactttcaacagtagccttgaa

SEQ ID NO: 21208 - DNA, 71 bp, chicken (Gallus Gallus)
  misc_feature (36): n=a or g
tgaagaattcaaaaacacctctttgcttcatccacncttccatgtcagacaccagtttgtcagactgcccc

SEQ ID NO: 21209 - DNA, 71 bp, chicken (Gallus Gallus)
  misc_feature (36): n=c or t
aacccttttttactttttaattactcagggatcaanggtctttcaaaaacactgtgctcccacctctttgt

SEQ ID NO: 21210 - DNA, 71 bp, chicken (Gallus Gallus)
  misc_feature (36): n=g or t
atgtgtgcgtgaatgaacagtttcttctttctgccngctttagttggaaggtttgcagtgtttatgaaaca

SEQ ID NO: 21211 - DNA, 71 bp, chicken (Gallus Gallus)
  misc_feature (36): n=c or t
attattttcaaatggctgcttgacactgtgcatccnggagatgaagttctataaaagtgttggttgttttc

SEQ ID NO: 21212 - DNA, 71 bp, chicken (Gallus Gallus)
  misc_feature (36): n=c or t
agaagcaacattatgtgaacggatcatgtatcttantctgctaatactgaattttacatatagagtgaatg

SEQ ID NO: 21213 - DNA, 71 bp, chicken (Gallus Gallus)
  misc_feature (36): n=a or g
agacaagatggtatcaaaataccgtctgttagcacnttatagttcttacaacaaaagatgtatttatagtg

SEQ ID NO: 21214 - DNA, 71 bp, chicken (Gallus Gallus)
  misc_feature (36): n=a or c
tattattatttaatggccctatggaattcaggtttnattcctgcaggaatacctgcataaatctccactat

SEQ ID NO: 21215 - DNA, 71 bp, chicken (Gallus Gallus)
  misc_feature (36): n=c or g
cattaaagatgcttgttacagatgcagcaagtcctnctgtccttcctaatgtattactgcccacgacctac

SEQ ID NO: 21216 - DNA, 71 bp, chicken (Gallus Gallus)
  misc_feature (36): n=a or c
cttgccactacctggattgtccatgtatatcaatcnaggtttcctctatggaacttgtcaagtttttattt

SEQ ID NO: 21217 - DNA, 71 bp, chicken (Gallus Gallus)
  misc_feature (36): n=a or t
tgacctgaaaaatatatggaggctttggggtcagangaacattgcaattatagttcacccgttgtcctaga

SEQ ID NO: 21218 - DNA, 71 bp, chicken (Gallus Gallus)
  misc_feature (36): n=a or c
tttatttccacggaaaatacaacaaagagcacgatnacactatatgatagagcatattttcggccacaaaa

SEQ ID NO: 21219 - DNA, 71 bp, chicken (Gallus Gallus)
  misc_feature (36): n=a or g
gtggaggtataaaccttgctagtgttggagcccacntgagcagcttgttattgcaatactctatggcgaca

SEQ ID NO: 21220 - DNA, 71 bp, chicken (Gallus Gallus)
  misc_feature (36): n=c or t
cagtcagatatctgtgcacatgttgtccatggggantgtgcatttccagcactgctggaactccagttgtc

SEQ ID NO: 21221 - DNA, 71 bp, chicken (Gallus Gallus)
  misc_feature (36): n=a or g
gttctctatcatttcctatgacttttcatgttttcnggactctattagaaaaaagaaggaaggactcacac

SEQ ID NO: 21222 - DNA, 71 bp, chicken (Gallus Gallus)
  misc_feature (36): n=c or t
cagcagtcttcagtttatttctgtcttggcaagtangaacagatccatgataatcaattcaaaagatatta

SEQ ID NO: 21223 - DNA, 71 bp, chicken (Gallus Gallus)
  misc_feature (36): n=a or g
ccactacaccagcatttcacgagaggcagaaactcngaagtacaagcaatctagttttaaacaaaaacaga

SEQ ID NO: 21224 - DNA, 71 bp, chicken (Gallus Gallus)
  misc_feature (36): n=g or t
gccctctgcagaccgagtatgggagatacaaggaanaaagcttgcctacaggcggttgacaaataaaccaa

SEQ ID NO: 21225 - DNA, 71 bp, chicken (Gallus Gallus)
  misc_feature (36): n=c or t
atccactatccgataaagaggagtggggagaacttntagtaccctatgaattggccaggtggagttagcag

SEQ ID NO: 21226 - DNA, 71 bp, chicken (Gallus Gallus)
  misc_feature (36): n=a or g
ggaaaaaatagcaatgaattgctaacagaagatacntggaagaaaatatattacagggatttatatatata

SEQ ID NO: 21227 - DNA, 71 bp, chicken (Gallus Gallus)
  misc_feature (36): n=a or c
attatagaaattaatgaataaagggtttaacatcanaaattgctaaatctgcaaatggcctaaactgccaa

SEQ ID NO: 21228 - DNA, 71 bp, chicken (Gallus Gallus)
  misc_feature (36): n=g or t
ccccaacacactaacaccagtactcttaatggaggngacacaataaagaaatgaaggcccattttttttcc

SEQ ID NO: 21229 - DNA, 71 bp, chicken (Gallus Gallus)
  misc_feature (36): n=c or t
caaatattccacatgccacacaaagaatctgttacnttcatagttgttttcaaaggctgacttttccatct

SEQ ID NO: 21230 - DNA, 71 bp, chicken (Gallus Gallus)
  misc_feature (36): n=c or g
ctagagtgtatgcctaactcagctggtaagagagtntacgaggggaggtaccccgctagacctgctgttta

SEQ ID NO: 21231 - DNA, 71 bp, chicken (Gallus Gallus)
  misc_feature (36): n=a or g
gcacatgccagaaagtgtgctgcctcaaagaacatnttgctagagaggacaagacaaagattagaagcagg

SEQ ID NO: 21232 - DNA, 71 bp, chicken (Gallus Gallus)
  misc_feature (36): n=c or t
ggggttttgtttaaaacaattaaggatgtaaaaaanttaggaacactcagattcacatcggctgctttttt

SEQ ID NO: 21233 - DNA, 71 bp, chicken (Gallus Gallus)
  misc_feature (36): n=a or g
tctaaaatgacacatagtggttgaacccgaaacccnaaagtctatcctcacacatgcacccatctagcaca

SEQ ID NO: 21234 - DNA, 71 bp, chicken (Gallus Gallus)
  misc_feature (36): n=c or t
gaacacatgtgctaaatgcctagaagaaatggcagnctatccttaagtatttgctttcaaccaaaaatgca

SEQ ID NO: 21235 - DNA, 71 bp, chicken (Gallus Gallus)
  misc_feature (36): n=a or g
gagaactgcagcagtaaggaactggatttgttaccnggaagtaatggttttaatatttagaattgtaaaat

SEQ ID NO: 21236 - DNA, 71 bp, chicken (Gallus Gallus)
  misc_feature (36): n=a or t
tctactggctattcagaagatggccctgagagaggngttgactctacttctcttctgaagttgggttattg

SEQ ID NO: 21237 - DNA, 71 bp, chicken (Gallus Gallus)
  misc_feature (36): n=c or t
cagtattcttcttagtattttgcaaacgatttccanaataatgcactctcattttgcctaggaaaatctga

SEQ ID NO: 21238 - DNA, 71 bp, chicken (Gallus Gallus)
  misc_feature (36): n=a or g
gtgggacttttggagatgcgcacaaatgcctatagngagcctatcttttgggctccttgtgtggtggcttc

SEQ ID NO: 21239 - DNA, 71 bp, chicken (Gallus Gallus)
  misc_feature (36): n=g or t
tataagtattcttctgctctattttggactattctntcattgtaagttctgattcaggaagaaaaaaggta

SEQ ID NO: 21240 - DNA, 71 bp, chicken (Gallus Gallus)
  misc_feature (36): n=c or t
tcattctgaagggtttgtgcaccattatcttgaganagttaagtcagatgaggtattttgagactcaaaaa

SEQ ID NO: 21241 - DNA, 71 bp, chicken (Gallus Gallus)
  misc_feature (36): n=a or g
agcactgaggattcctgctgtttcacaggagtgagnatcaaatggagcacacagatatcaactgcctgcta

SEQ ID NO: 21242 - DNA, 71 bp, chicken (Gallus Gallus)
  misc_feature (36): n=c or t
ttcagttcattcagagatgcacagaatttggtacanggctggtaccttttgtttttgcaggatgcatttac

SEQ ID NO: 21243 - DNA, 71 bp, chicken (Gallus Gallus)
  misc_feature (36): n=a or c
aatctattgacagcagtttgactgaaaacttaaacnaactacttttgtagtagtagaaactgacatcttac

SEQ ID NO: 21244 - DNA, 71 bp, chicken (Gallus Gallus)
  misc_feature (36): n=a or g
ctccagataggatacttagggcttgttggggcacgnggctgggcttagctccgtccatgcaacctaattac

SEQ ID NO: 21245 - DNA, 71 bp, chicken (Gallus Gallus)
  misc_feature (36): n=a or g
tttcgtgggctgcaatggggactgatggaagccagntgctgaattaataagtgaatgcctgtgtgctctaa

SEQ ID NO: 21246 - DNA, 71 bp, chicken (Gallus Gallus)
  misc_feature (36): n=c or t
gcgtgtcactgcgtagcttccccctgactttgctcngctctttctttgcgtgtccttaaagcaaccacaca

SEQ ID NO: 21247 - DNA, 71 bp, chicken (Gallus Gallus)
  misc_feature (36): n=c or t
ttctctccccccacacctgtgagtcaggacaactcnattaaaggaagcttttattggaagctgtcgataga

SEQ ID NO: 21248 - DNA, 71 bp, chicken (Gallus Gallus)
  misc_feature (36): n=a or g
taaaaaaaacaaacaaacaggtgtgggttttttttntatcagtggtgtttttttctgatgtacaatatcat

SEQ ID NO: 21249 - DNA, 71 bp, chicken (Gallus Gallus)
  misc_feature (36): n=c or g
aggcactccaaagagattcttctcatgcaaaggtgngatgactcagaccaggtgatgacttatctctctct

SEQ ID NO: 21250 - DNA, 71 bp, chicken (Gallus Gallus)
  misc_feature (36): n=c or t
caaacttttggcagcacagggaacaccaaggcatcnccatttccttgctggctgcattttgtgagcactag

SEQ ID NO: 21251 - DNA, 71 bp, chicken (Gallus Gallus)
  misc_feature (36): n=c or t
aacatgtcaaccggtcattcttcaagcatttgccanccaaaaatgttaagctcaagctatgtaagtttatt

SEQ ID NO: 21252 - DNA, 71 bp, chicken (Gallus Gallus)
  misc_feature (36): n=a or c
tgccaacctcagcccttctgtaattctgtgaagtcntagtttagtgccagatgttatgaaggagaaacaag

SEQ ID NO: 21253 - DNA, 71 bp, chicken (Gallus Gallus)
  misc_feature (36): n=a or g
tgatacattccactggctggaaggcaaaagccacanctcaaacaagaaagaaggtgttaaaggagaaacaa

SEQ ID NO: 21254 - DNA, 71 bp, chicken (Gallus Gallus)
  misc_feature (36): n=a or g
caaagcatttcatttcaaaacagctcgaagctaaanaacaatgatatataaggaagaattacgaaacacga

SEQ ID NO: 21255 - DNA, 71 bp, chicken (Gallus Gallus)
  misc_feature (36): n=c or t
gcagtttgcggtaacaccgctgtatcagatgctgtnacgctggcaggaaacacaaatacgcatttttctgt

SEQ ID NO: 21256 - DNA, 71 bp, chicken (Gallus Gallus)
  misc_feature (36): n=c or t
tcttcttctcaaccttcattgagtgttttgaagtangagtaggtacatttttggtgtctttaacagaaatg

SEQ ID NO: 21257 - DNA, 71 bp, chicken (Gallus Gallus)
  misc_feature (36): n=a or g
atttccatccacgatgctattaaaaacatcgcgccnatgttggtgtgtgtaccacaatggaaaggtatatt

SEQ ID NO: 21258 - DNA, 71 bp, chicken (Gallus Gallus)
  misc_feature (36): n=a or g
tggatcctgccatggtgaacgtggtaaaacacttgnctgtacatcctaatggacaacaagatttagctgat

SEQ ID NO: 21259 - DNA, 71 bp, chicken (Gallus Gallus)
  misc_feature (36): n=c or g
agtgttcatgttcacaaataagaaacaacaacaaanaaaaaccaaccacctccaccacaaagcatcatcag

SEQ ID NO: 21260 - DNA, 71 bp, chicken (Gallus Gallus)
  misc_feature (36): n=c or t
catatgagcatatgctaatgtacattttttcatttncattttgctagttttgaacacagctgatatcttca

SEQ ID NO: 21261 - DNA, 71 bp, chicken (Gallus Gallus)
  misc_feature (36): n=a or g
gccactgaagccactaaaatctaggatgacctatgnatgctttatggcaatgtgatccaaggtggtcactg

SEQ ID NO: 21262 - DNA, 71 bp, chicken (Gallus Gallus)
  misc_feature (36): n=c or t
taccaccgtcagagtttgcacagacagcacacgtgntgattagctcaccttgagcaccgtgtcacttcctg

SEQ ID NO: 21263 - DNA, 71 bp, chicken (Gallus Gallus)
  misc_feature (36): n=c or g
aaatcttgctgacacttagtaaagtgacttgcacantgttgaacacggtttaaggttctgctgagttgtaa

SEQ ID NO: 21264 - DNA, 71 bp, chicken (Gallus Gallus)
  misc_feature (36): n=a or g
tccagcctacagaaaggaggaaatgcactcatagcngaggctcagtgtttatctgcagccatcaccactca

SEQ ID NO: 21265 - DNA, 71 bp, chicken (Gallus Gallus)
  misc_feature (36): n=a or g
ttcagatagtagtaaatgggtagctaacgtaaacanagtatgagtattttatttatccatttagtcacatg

SEQ ID NO: 21266 - DNA, 71 bp, chicken (Gallus Gallus)
  misc_feature (36): n=c or g
gcagcatgctgtctggtgctgcctgggcaaggattntgaccctatgccagcatttcttcctacagaggaaa

SEQ ID NO: 21267 - DNA, 71 bp, chicken (Gallus Gallus)
  misc_feature (36): n=c or g
tcagtagtggaagcaaacacaatgccgctctggtanaccttgctattttgctgtcatagtgaacaaaattc

SEQ ID NO: 21268 - DNA, 71 bp, chicken (Gallus Gallus)
  misc_feature (36): n=c or t
ccgattctgcacatttcagctgtgaaggggtcttantttaagaatcagaacatggatatttccctttagca

SEQ ID NO: 21269 - DNA, 71 bp, chicken (Gallus Gallus)
  misc_feature (36): n=c or t
tttttgtatcctttccttttttatgattatgaattnggtgtaactcgtgacaattctacctgtactgcaga

SEQ ID NO: 21270 - DNA, 71 bp, chicken (Gallus Gallus)
  misc_feature (36): n=a or g
tttcgacccaagccattctatgattctatgattcanttgtccagtaggcacattaaagagatcatttttcc

SEQ ID NO: 21271 - DNA, 71 bp, chicken (Gallus Gallus)
  misc_feature (36): n=a or g
gacaggtattgacatgttaaagcaccctgaataacnaaaatggttgaaaaagatttttacatgtgaaacag

SEQ ID NO: 21272 - DNA, 71 bp, chicken (Gallus Gallus)
  misc_feature (36): n=c or t
aagtctatcctgaggaggctgcactttttttttttnttcagttttattggtgatctttttttagtccagat

SEQ ID NO: 21273 - DNA, 71 bp, chicken (Gallus Gallus)
  misc_feature (36): n=c or g
acatgtactttattgttcattttaaggtatctgttnctttgtagcattgtactggaatatacattaattaa

SEQ ID NO: 21274 - DNA, 71 bp, chicken (Gallus Gallus)
  misc_feature (36): n=c or t
gtcagtccaaaaaacatatagctttaacatttctanccctgtttttcttctgacaagttttccaactagtg

SEQ ID NO: 21275 - DNA, 71 bp, chicken (Gallus Gallus)
  misc_feature (36): n=a or g
acaaaacattttatcagtgcatttcagaaacacgtngcatgaaatgagtgttcaattctctgcagtacatt

SEQ ID NO: 21276 - DNA, 71 bp, chicken (Gallus Gallus)
  misc_feature (36): n=c or t
catgagtcaccgtgcttcccatttagatctctgtanggacatgttgcaactgctgtatttgcttgcattaa

SEQ ID NO: 21277 - DNA, 71 bp, chicken (Gallus Gallus)
  misc_feature (36): n=a or g
gccttatacatagaaatgaaataggatgatttgcantgaatgcatcagctttttatgacgaaatggaaagc

SEQ ID NO: 21278 - DNA, 71 bp, chicken (Gallus Gallus)
  misc_feature (36): n=c or t
tttttttttttttttttttgaaggaggaggggaacntcttttccaaaagatttttccattgcagcttgttg

SEQ ID NO: 21279 - DNA, 71 bp, chicken (Gallus Gallus)
  misc_feature (36): n=c or t
caaatccttctcctcagggctgctcttaatccatcntctgcccagactgtatgtgtgcttgggattgccca

SEQ ID NO: 21280 - DNA, 71 bp, chicken (Gallus Gallus)
  misc_feature (36): n=c or t
tgttttgaaactgatgcccaataatttgtagaggangcagaatgtaaactcttcgcttcttgatgctgata

SEQ ID NO: 21281 - DNA, 71 bp, chicken (Gallus Gallus)
  misc_feature (36): n=c or t
cagtgcccagcagagaaacaccctggctgctaccgnatggcagaagggaaaagtgatttcagtgagagagc

SEQ ID NO: 21282 - DNA, 71 bp, chicken (Gallus Gallus)
  misc_feature (36): n=g or t
tgtgtagttttccctagcccaccccaaagaaccctnttctttaaagtaagttgtggatgccctcaaggaaa

SEQ ID NO: 21283 - DNA, 71 bp, chicken (Gallus Gallus)
  misc_feature (36): n=c or t
caggctaacccacttctatcagattatacctgtaanaatgcaaaatttaaacattttcttggagtgtggtt

SEQ ID NO: 21284 - DNA, 71 bp, chicken (Gallus Gallus)
  misc_feature (36): n=a or g
gaaagtaactcttaaatatgagtccttgtcagaatnaaacatcttgtataaaccacatacatttaaactga

SEQ ID NO: 21285 - DNA, 71 bp, chicken (Gallus Gallus)
  misc_feature (36): n=a or g
ataaattggcagataagctgcaaatatctttcgtgnctttgtattcccttgaagcatctgggaagcaaaat

SEQ ID NO: 21286 - DNA, 71 bp, chicken (Gallus Gallus)
  misc_feature (36): n=a or g
aaccaacgtgtaggtaatgtacagtgcagaacatcngaaaagtccaggagtggtagaacagcactgggaga

SEQ ID NO: 21287 - DNA, 71 bp, chicken (Gallus Gallus)
  misc_feature (36): n=c or t
agacaggtaagaaatatctgtttctgtatgttttanttgtcaactcatggtctggcaacaacagaaaaggt

SEQ ID NO: 21288 - DNA, 71 bp, chicken (Gallus Gallus)
  misc_feature (36): n=c or t
aacttcagtcctactccctgtgaaagataccagttnctccatgccacaggcagtccagacgacctcaggga

SEQ ID NO: 21289 - DNA, 71 bp, chicken (Gallus Gallus)
  misc_feature (36): n=a or g
ttttatctatctagatatatgttttgattgctgccngtacagtccctatctcaaagaacttgcaccataag

SEQ ID NO: 21290 - DNA, 71 bp, chicken (Gallus Gallus)
  misc_feature (36): n=a or g
agaaagcttgacaatagtgtgtgcagataagacttncatgtataaaaccttttcaagctcaaaagctgtgg

SEQ ID NO: 21291 - DNA, 71 bp, chicken (Gallus Gallus)
  misc_feature (36): n=c or t
acaattgaagggactgcacagaggtatgtttctgtntcatactatttgcatgacagtttgttcctgtaatg

SEQ ID NO: 21292 - DNA, 71 bp, chicken (Gallus Gallus)
  misc_feature (36): n=c or t
tcttatcgtgttagttttatggtgattcagacaagntgataaatgtgttcttactttctttcctcatagtt

SEQ ID NO: 21293 - DNA, 71 bp, chicken (Gallus Gallus)
  misc_feature (36): n=a or g
gagagagtgaactaccagctgtttaaagaattatcngatgagatgtctggtgaactgtccttagggacata

SEQ ID NO: 21294 - DNA, 71 bp, chicken (Gallus Gallus)
  misc_feature (36): n=c or t
gagaaaatgttcatacaaaaagaagtacgaaacaangttttgtaattttaaagcagccagagagtttccct

SEQ ID NO: 21295 - DNA, 71 bp, chicken (Gallus Gallus)
  misc_feature (36): n=g or t
tgagtgaccggattgtgctcatcagaacagccaganagaaaatgaaaagtgaacccttaagttgcacattt

SEQ ID NO: 21296 - DNA, 71 bp, chicken (Gallus Gallus)
  misc_feature (36): n=c or t
gtttgtgacgttgctcccttttgtactgcagacttntgaatgtcctgaaggcttgaactgtgcaagcattg

SEQ ID NO: 21297 - DNA, 71 bp, chicken (Gallus Gallus)
  misc_feature (36): n=a or g
catgtcgcatgtaggacgagtcagcttagctctgcngtttcaagtaaggcagcagcaaccaccttgagccg

SEQ ID NO: 21298 - DNA, 71 bp, chicken (Gallus Gallus)
  misc_feature (36): n=c or t
cgtcaggagataaaaaccaacagatacatgctaaangaactgtagctatacacatgaacactagccaaaaa

SEQ ID NO: 21299 - DNA, 71 bp, chicken (Gallus Gallus)
  misc_feature (36): n=a or g
cccaccagtcattcctgcaactgaaactggtccctntacaatacccagagcttctctccttccctaatagt

SEQ ID NO: 21300 - DNA, 71 bp, chicken (Gallus Gallus)
  misc_feature (36): n=a or c
caaagaaactcaactgattgtatgaattctcatatnattgataacttcactgtgctgggaagctgtgaaaa

SEQ ID NO: 21301 - DNA, 71 bp, chicken (Gallus Gallus)
  misc_feature (36): n=a or t
attctctctcacattccctctaacttttcttctggntgatgtattagttttgttttacagatacgacatac

SEQ ID NO: 21302 - DNA, 71 bp, chicken (Gallus Gallus)
  misc_feature (36): n=g or t
cacaacgtcttggaaaaccctaaactgctcatgaanttcagaccactgggacatagtctctgtgggaagta

SEQ ID NO: 21303 - DNA, 71 bp, chicken (Gallus Gallus)
  misc_feature (36): n=a or t
aaaggctgaaatactcaacaccttttgttgccttcntcattcaaaagcagaacccactcttctgtgtatac

SEQ ID NO: 21304 - DNA, 71 bp, chicken (Gallus Gallus)
  misc_feature (36): n=a or g
agcccattcactgactgaggcaaatcagtcataccntttctcagggggagcaggaaatactctctctgccc

SEQ ID NO: 21305 - DNA, 71 bp, chicken (Gallus Gallus)
  misc_feature (36): n=c or t
actaggatcatctatggaggtaaatgagtgtatagnctctttgaggctgcacttactttctttgcttgctg

SEQ ID NO: 21306 - DNA, 71 bp, chicken (Gallus Gallus)
  misc_feature (36): n=c or t
cagtcaaagaacaattatcttataagagttgtttcnagatttacagtaatggaaagcaaatcatagaatca

SEQ ID NO: 21307 - DNA, 71 bp, chicken (Gallus Gallus)
  misc_feature (36): n=a or c
tcttaaaaaaattatttcctgagaagctcaaatagntacaaaaatcataaatagctatgacattttcatat

SEQ ID NO: 21308 - DNA, 71 bp, chicken (Gallus Gallus)
  misc_feature (36): n=g or t
agataaaatactggagctgacacggggttttagagnagaaaattgatagtttttcagcttgtttctgccag

SEQ ID NO: 21309 - DNA, 71 bp, chicken (Gallus Gallus)
  misc_feature (36): n=a or g
atttgagtaagcaccaaaacacatataatcataatngttctttgaatttgtttcctgatttctcttgatta

SEQ ID NO: 21310 - DNA, 71 bp, chicken (Gallus Gallus)
  misc_feature (36): n=c or t
agtagggtactaacccatgatttcagctgctcggtnggctgctcaccagctcctgacacaaggttcggtgg

SEQ ID NO: 21311 - DNA, 71 bp, chicken (Gallus Gallus)
  misc_feature (36): n=a or g
cctttatttaaataaaaatggtgattatttctagcnattaattttaagaacacacatgcataggcttcatc

SEQ ID NO: 21312 - DNA, 71 bp, chicken (Gallus Gallus)
  misc_feature (36): n=a or g
acaatgaatctaataaatataaatatgaccttgacngttcctccaccagcggagaggctggaaataaaagc

SEQ ID NO: 21313 - DNA, 71 bp, chicken (Gallus Gallus)
  misc_feature (36): n=c or g
cttctcaatgtaactgttactaacacaaatggaaantgaatgggaaaatataaacggaatcttaaacatta

SEQ ID NO: 21314 - DNA, 71 bp, chicken (Gallus Gallus)
  misc_feature (36): n=a or c
gtcatgggattttgtgtttctttttttatcataccnccaagcaaatctgcagaatagttagttatttttgc

SEQ ID NO: 21315 - DNA, 71 bp, chicken (Gallus Gallus)
  misc_feature (36): n=a or g
aaaagaaatgtgcaaaaccttttacttgcaagcctntcatgctaggatgcctgctgactctcaccgctcag

SEQ ID NO: 21316 - DNA, 71 bp, chicken (Gallus Gallus)
  misc_feature (36): n=c or g
ttaacaacctgttgtgtctaatatctggtgtccttnaagtgggtcatgcatgacaattcatgccaaatggg

SEQ ID NO: 21317 - DNA, 71 bp, chicken (Gallus Gallus)
  misc_feature (36): n=c or g
gttaagcttgtttatcctgacaaaatggatggatgntaaaggagacatgactccttttaataaaagcatca

SEQ ID NO: 21318 - DNA, 71 bp, chicken (Gallus Gallus)
  misc_feature (36): n=a or c
attccttttgtctgggagagttgtcctgctgcctcngtttacagattcttgtttctgggtgttcagagcct

SEQ ID NO: 21319 - DNA, 71 bp, chicken (Gallus Gallus)
  misc_feature (36): n=a or g
ttgcaagatctgttggaaaacaactcctcagtatgntagtgctagatttgtttaaaaataatgagactcca

SEQ ID NO: 21320 - DNA, 71 bp, chicken (Gallus Gallus)
  misc_feature (36): n=a or g
ctgcacatcagagtcatctgcagttctttacatggncaaactaatttacaaacaccattgttcatacaaac

SEQ ID NO: 21321 - DNA, 71 bp, chicken (Gallus Gallus)
  misc_feature (36): n=a or g
gctgcagctggctcctcttgcttgggtgcctgttcnttgttcttctgtggctctacttttgcatcgacaac

SEQ ID NO: 21322 - DNA, 71 bp, chicken (Gallus Gallus)
  misc_feature (36): n=c or t
caacaattccagctgcttaataaatttcttcattcncacagggtgtgtttgatcaccgaatgaaatgctgg

SEQ ID NO: 21323 - DNA, 71 bp, chicken (Gallus Gallus)
  misc_feature (36): n=c or t
aggccctgggcacttcagtcccagacatctaaagtngcatccatgctggacttcaggttaaattagtaatt

SEQ ID NO: 21324 - DNA, 71 bp, chicken (Gallus Gallus)
  misc_feature (36): n=a or g
gatcacaagaaaatacatagatttctatgtgacgcnggtcatacaccttttccaattcccagtgaaattaa

SEQ ID NO: 21325 - DNA, 71 bp, chicken (Gallus Gallus)
  misc_feature (36): n=c or t
gatcggtgttgtccctcttcacagacatgatccacncatgcctttctctaaaaatgccatgccatctcaca

SEQ ID NO: 21326 - DNA, 71 bp, chicken (Gallus Gallus)
  misc_feature (36): n=a or g
aaagtcaatcacctcttgtattttctactgtcttanagactttctctcttcctgttgtagctgatggtact

SEQ ID NO: 21327 - DNA, 71 bp, chicken (Gallus Gallus)
  misc_feature (36): n=a or g
caatgagacagttctgatataaaaaacacaagatanctctagactgccatatgcttcatacgtaggttctc

SEQ ID NO: 21328 - DNA, 71 bp, chicken (Gallus Gallus)
  misc_feature (36): n=c or t
caggctgagtaccagcacccctaagaagcacagagnggagctaagagaggctcaatatttttggatcccag

SEQ ID NO: 21329 - DNA, 71 bp, chicken (Gallus Gallus)
  misc_feature (36): n=a or g
agtccataatataatgtgacacttgcattaagagtnggatccagttgcctgaaaatggcatttaaatgcca

SEQ ID NO: 21330 - DNA, 71 bp, chicken (Gallus Gallus)
  misc_feature (36): n=c or t
caagccaatgtaacatttttccatgcttctgcacanatacattgtgtgggaactcaaatgcacaggctttg

SEQ ID NO: 21331 - DNA, 71 bp, chicken (Gallus Gallus)
  misc_feature (36): n=c or t
gtaaacagaccagtgtgagttctttaattgttctcnaaaccccttcctcctcattctcttttgaatatcaa

SEQ ID NO: 21332 - DNA, 71 bp, chicken (Gallus Gallus)
  misc_feature (36): n=a or g
agtaattttacaaactcagcaacagggacaaattangtaatactgtcacatactaattaataagctgtttc

SEQ ID NO: 21333 - DNA, 71 bp, chicken (Gallus Gallus)
  misc_feature (36): n=c or t
agtgggaggaaaagtttgacgaactatgttctctgnggtgccctacaaaatgtctccttcacaagtcagcc

SEQ ID NO: 21334 - DNA, 71 bp, chicken (Gallus Gallus)
  misc_feature (36): n=g or t
gcttcttgcttatctgaccctcctgtcagtacaaanctcacagaaaaccaccagactttgaggtcagaccc

SEQ ID NO: 21335 - DNA, 71 bp, chicken (Gallus Gallus)
  misc_feature (36): n=c or t
tatcctatcgtcctgtatttttaatcagtggctctnattcattatttttaatcaattgtacctttagtatc

SEQ ID NO: 21336 - DNA, 71 bp, chicken (Gallus Gallus)
  misc_feature (36): n=c or t
atatccgtatcatttgaaaagacagaagtactacanttctcccattgcagtctatcttatgctgtaatcct

SEQ ID NO: 21337 - DNA, 71 bp, chicken (Gallus Gallus)
  misc_feature (36): n=c or t
gttatcaatccttggaaatattgatcattactttgnagccagatggggaaagtgtttggattaaactatac

SEQ ID NO: 21338 - DNA, 71 bp, chicken (Gallus Gallus)
  misc_feature (36): n=a or g
ttttctagaatgacattaggcagtcacaaagcagcnctggctccaaggtttcaggggcagccagctgtcac

SEQ ID NO: 21339 - DNA, 71 bp, chicken (Gallus Gallus)
  misc_feature (36): n=c or t
gtctctgctgtcctatatttctcaggatggaaccangaagcactcactctcctgatccagttgtctgaagc

SEQ ID NO: 21340 - DNA, 71 bp, chicken (Gallus Gallus)
  misc_feature (36): n=c or t
taataccctagaaaatccttttcaaattgacttcanttaatttctgtcaattttgatgcttttgttcttct

SEQ ID NO: 21341 - DNA, 71 bp, chicken (Gallus Gallus)
  misc_feature (36): n=a or g
agttaactttggcttgcaaatcattttgtacctaanagaaaaaagaaaaaaccttactgcagaagaagtgc

SEQ ID NO: 21342 - DNA, 71 bp, chicken (Gallus Gallus)
  misc_feature (36): n=c or t
tccatgtgaactaaccatgccataattaatatacanatgacttgctactgtgaacattccttaagtttaag

SEQ ID NO: 21343 - DNA, 71 bp, chicken (Gallus Gallus)
  misc_feature (36): n=a or g
tgtctgatccatagctctcgacaaacatgtcgagtnctgtacactaaacatttaacactatcttttggaaa

SEQ ID NO: 21344 - DNA, 71 bp, chicken (Gallus Gallus)
  misc_feature (36): n=a or t
gctacaaatgtggaacagttgtgggtttctcttaantgttgcagctgcatttagatatatatttaggcttg

SEQ ID NO: 21345 - DNA, 71 bp, chicken (Gallus Gallus)
  misc_feature (36): n=a or g
tcattttagaagattacactactatcattagctacnatctgtgaaggtctctcaaagtgaaagtaaaatac

SEQ ID NO: 21346 - DNA, 71 bp, chicken (Gallus Gallus)
  misc_feature (36): n=c or t
aggggacagttttccttcttggccttctgccatacngttagttgggctgcagcgagccatgtttacagttc

SEQ ID NO: 21347 - DNA, 71 bp, chicken (Gallus Gallus)
  misc_feature (36): n=a or g
gagaagcgaaaaagttcatcctcgttctctgtcgtntggtccacgtttagctgagtcacctgcagcccatc

SEQ ID NO: 21348 - DNA, 71 bp, chicken (Gallus Gallus)
  misc_feature (36): n=g or t
caacattatggctcggtcacttatcgcacatgccancttggattaaacactgcgatttgtgtcagattaca

SEQ ID NO: 21349 - DNA, 71 bp, chicken (Gallus Gallus)
  misc_feature (36): n=c or t
ttctaggcatctgagtagaagagcctgaaagccttngcagagcttgaccgctgtgcatattaaccctgcaa

SEQ ID NO: 21350 - DNA, 71 bp, chicken (Gallus Gallus)
  misc_feature (36): n=c or t
taaatatcagagaaacaaggctttcatcccatcgtncctaaaataacaaaaactgagttggaatcaaagac

SEQ ID NO: 21351 - DNA, 71 bp, chicken (Gallus Gallus)
  misc_feature (36): n=a or g
gaccaattacttagaagtcttattgtaactaagaangtaaattggaagaaaagataaggaaggaatgctgg

SEQ ID NO: 21352 - DNA, 71 bp, chicken (Gallus Gallus)
  misc_feature (36): n=a or g
catttgacactgtttcttaaagaactctcctggagnaacaggctgcttatggtttggacaaggtttagagt

SEQ ID NO: 21353 - DNA, 71 bp, chicken (Gallus Gallus)
  misc_feature (36): n=a or g
aaacatacatgaacacatagaagtgttgaacttacntttctcatttagttaatggtgaaaagaatattctg

SEQ ID NO: 21354 - DNA, 71 bp, chicken (Gallus Gallus)
  misc_feature (36): n=a or g
gagaaggggaaagggtgtcggcaagttcaggcagcnttttctgcaagttacaactggctgctgtgtaactc

SEQ ID NO: 21355 - DNA, 71 bp, chicken (Gallus Gallus)
  misc_feature (36): n=a or g
taatgctgaagtttgaagtcgaagtttggataaagnttcacattcttggcagtggcaaggagaataaatgt

SEQ ID NO: 21356 - DNA, 71 bp, chicken (Gallus Gallus)
  misc_feature (36): n=a or g
tttaaagcgtagattcaagatactgaacactgtcantattttcacaggtgaaaatacagagcacactgtat

SEQ ID NO: 21357 - DNA, 71 bp, chicken (Gallus Gallus)
  misc_feature (36): n=a or g
gtacagcaggctggagccttttgtgtatggagacancagccaagctacaaaagctattttgagttcatagt

SEQ ID NO: 21358 - DNA, 71 bp, chicken (Gallus Gallus)
  misc_feature (36): n=c or t
ctgtatgttccaaccaaagaatctgcataaaaaggngtgtcacctgaaaaagcaacatgacaaaaattaaa

SEQ ID NO: 21359 - DNA, 71 bp, chicken (Gallus Gallus)
  misc_feature (36): n=a or g
tttagttttgagtgcaactgcaaaaaacaaagccancttccttgtgaaccctttgagctcctgatggagct

SEQ ID NO: 21360 - DNA, 71 bp, chicken (Gallus Gallus)
  misc_feature (36): n=c or t
attcctggccaccatggatgtctcaggaaaaagccnctgtgaatttagtacccagtgcgattcgtcccttg

SEQ ID NO: 21361 - DNA, 71 bp, chicken (Gallus Gallus)
  misc_feature (36): n=a or g
tgatgtccttttagatctccatcttctcagttatgntttccctcagacatggccaccagatgtgtgtgagg

SEQ ID NO: 21362 - DNA, 71 bp, chicken (Gallus Gallus)
  misc_feature (36): n=c or t
catcttcctcagtgacctgggtgaagggatagagtncactctcaggaagttaaggatcatataaagctggg

SEQ ID NO: 21363 - DNA, 71 bp, chicken (Gallus Gallus)
  misc_feature (36): n=c or t
ccaatacaaggatccatttgataatttaggtttgancctctgcaatttttcaacagggatgtcctcagcag

SEQ ID NO: 21364 - DNA, 71 bp, chicken (Gallus Gallus)
  misc_feature (36): n=c or t
cctcctgaagtttgtgcatctggctgagctggcagnctcgtttacatgaagatgacacatttaggctccat

SEQ ID NO: 21365 - DNA, 71 bp, chicken (Gallus Gallus)
  misc_feature (36): n=a or g
tctctcctgtgctatgggctgccttcttgatcctgngcagctgaaagtcaccatgaagactgctgtcaggg

SEQ ID NO: 21366 - DNA, 71 bp, chicken (Gallus Gallus)
  misc_feature (36): n=a or c
tttggcttctgtaggggctaatttagctgactctanagcacttctttaatgcaaacaaggaaaatgctggt

SEQ ID NO: 21367 - DNA, 71 bp, chicken (Gallus Gallus)
  misc_feature (36): n=c or t
aaggggggtttgattctgtgattctgcttggacaanttagattctgcttactctgataaaatagaaagggg

SEQ ID NO: 21368 - DNA, 71 bp, chicken (Gallus Gallus)
  misc_feature (36): n=a or t
cttaattatctaaatctgtccagatataatcatacntttcccagcatttctgaagcacatttattttacat

SEQ ID NO: 21369 - DNA, 71 bp, chicken (Gallus Gallus)
  misc_feature (36): n=a or c
cttggatctgaaactgcatatcattcacaccttaanagaccattttttacagtcacgaggccaaatccatg

SEQ ID NO: 21370 - DNA, 71 bp, chicken (Gallus Gallus)
  misc_feature (36): n=c or t
caaatgtgttcaggcatttctaggctaaccagacantatagctttagatcttttcctgtaagagaagaaag

SEQ ID NO: 21371 - DNA, 71 bp, chicken (Gallus Gallus)
  misc_feature (36): n=a or c
tctcatctagtaaacctgtttcttaatttcttcacntgcattttattctgagataagtttctgcccaaatg

SEQ ID NO: 21372 - DNA, 71 bp, chicken (Gallus Gallus)
  misc_feature (36): n=a or t
gaaaagacaaacttttctggatgcagaagagtagcnctgtctttagatgcctgaagagtatgagacaaaca

SEQ ID NO: 21373 - DNA, 71 bp, chicken (Gallus Gallus)
  misc_feature (36): n=c or t
ggaacatgtctacgttaatactgtgagactcataangtacagtaaagcttatgataacatgatattatgtt

SEQ ID NO: 21374 - DNA, 71 bp, chicken (Gallus Gallus)
  misc_feature (36): n=c or t
ctcacacctcagccgtcattccaatgctctaccccnctgaactatcaagatgcaacctcccagagaagaag

SEQ ID NO: 21375 - DNA, 71 bp, chicken (Gallus Gallus)
  misc_feature (36): n=c or t
atatggacaaacaagtcagagaatcctgtaacaccnaggagcgttcctgcccatcctgaatccattttgcc

SEQ ID NO: 21376 - DNA, 71 bp, chicken (Gallus Gallus)
  misc_feature (36): n=c or t
agtgtcagaacacaggtagaccacatcagcagattngttagaaatagaaggaacataaaaattgaattatc

SEQ ID NO: 21377 - DNA, 71 bp, chicken (Gallus Gallus)
  misc_feature (36): n=c or t
agactggaggaacaggagcgaaatagaacaaatcangacagtaagaacaaagcaaagtttctaggaaaaac

SEQ ID NO: 21378 - DNA, 71 bp, chicken (Gallus Gallus)
  misc_feature (36): n=a or g
tataattaaaaaaaagaaaaaaaaaaaaaggctatntgatcagctctttttgttcaacatgcctgtaaatg

SEQ ID NO: 21379 - DNA, 71 bp, chicken (Gallus Gallus)
  misc_feature (36): n=a or g
ccgacgtcctggatatgaaaatgttacctgaagaangagtacaattgttaaaaagcacgtttgtgtccaat

SEQ ID NO: 21380 - DNA, 71 bp, chicken (Gallus Gallus)
  misc_feature (36): n=c or t
gtatcggagggcttttagtcttagctgagcagacangtattgaaagaacactgcataattttaacagacct

SEQ ID NO: 21381 - DNA, 71 bp, chicken (Gallus Gallus)
  misc_feature (36): n=g or t
atccaagacttcgttagactaaattggtttcagtangacattagtcattggtccccctctcacagctccat

SEQ ID NO: 21382 - DNA, 71 bp, chicken (Gallus Gallus)
  misc_feature (36): n=a or t
tagtattggcaaaggaagtccaaatagagaaaaaantggaaaaaagtagaaacttgaatgtgaagcttcaa

SEQ ID NO: 21383 - DNA, 71 bp, chicken (Gallus Gallus)
  misc_feature (36): n=c or t
tacgttacgctaagtccgcgcgcacaacagtggagngttaatacctttgcttaaaacaattcatttttgta

SEQ ID NO: 21384 - DNA, 71 bp, chicken (Gallus Gallus)
  misc_feature (36): n=a or t
cgcaatgctgttctgaactttctcacagattcacangtccaaattctattttctgtgcttaaaccgttact

SEQ ID NO: 21385 - DNA, 71 bp, chicken (Gallus Gallus)
  misc_feature (36): n=a or c
tatcttttatagtttccatggaaataaataggaggnattactttcagagacacctatgtatattcgtaaag

SEQ ID NO: 21386 - DNA, 71 bp, chicken (Gallus Gallus)
  misc_feature (36): n=c or t
cataaaatctttcatctgtagatttcgtgacttctntgaaggagaggaagcattgttcttagcagaacgct

SEQ ID NO: 21387 - DNA, 71 bp, chicken (Gallus Gallus)
  misc_feature (36): n=a or g
gcttaattttgacaacagtgctggatttatctttgntatattaatgtttgtgtttgtgtacgcgtgcagta

SEQ ID NO: 21388 - DNA, 71 bp, chicken (Gallus Gallus)
  misc_feature (36): n=a or g
ttgaaagtattgtggtcccaaataaaatttctcatnctggacacactaaggcagcagtgaaaggtgaggga

SEQ ID NO: 21389 - DNA, 71 bp, chicken (Gallus Gallus)
  misc_feature (36): n=c or t
gctatcccttttcgacactatcatgatggatggatntacaataccagtacaaaacaagtttgttatctgta

SEQ ID NO: 21390 - DNA, 71 bp, chicken (Gallus Gallus)
  misc_feature (36): n=c or g
accaaggagatggaatctacccagctgatttaatanctggtactgagcagccaacgactgatctgaaacag

SEQ ID NO: 21391 - DNA, 71 bp, chicken (Gallus Gallus)
  misc_feature (36): n=a or c
taagggctgtcttgtccaacccacttgcaatgaacngggacatctacagctagctcagattgttcaaagtt

SEQ ID NO: 21392 - DNA, 71 bp, chicken (Gallus Gallus)
  misc_feature (36): n=c or t
ggtataaagtcagtactggtgatgttctgcacatgntcaagttttgcagtgttcccaacctcaatagccaa

SEQ ID NO: 21393 - DNA, 71 bp, chicken (Gallus Gallus)
  misc_feature (36): n=c or g
aatacacacatagggaacatgcagatggtcaggaanatcagttatgaccccaagctcacaagatagagagg

SEQ ID NO: 21394 - DNA, 71 bp, chicken (Gallus Gallus)
  misc_feature (36): n=a or t
tatgtttagcaacacaatgcttgaagcagttgattnctcacataacagagtaaaagactgctggttttgtt

SEQ ID NO: 21395 - DNA, 71 bp, chicken (Gallus Gallus)
  misc_feature (36): n=c or t
cagttacaagaacgccttctcagttcctggaggcantcaaggccaggctggatgtggctctgggcagcccg

SEQ ID NO: 21396 - DNA, 71 bp, chicken (Gallus Gallus)
  misc_feature (36): n=g or t
ctgttgtctttgtggtgatttatgatggcagaggtncagcagggacataactttgggaaggcccttctcaa

SEQ ID NO: 21397 - DNA, 71 bp, chicken (Gallus Gallus)
  misc_feature (36): n=c or g
agaaaacaaaccacactcagacaaaccatgtgatgntaatgctgggaagacacagatgtggatcagaaagt

SEQ ID NO: 21398 - DNA, 71 bp, chicken (Gallus Gallus)
  misc_feature (36): n=c or t
cgctgcacaactgtcactcagcattgaccaactatnggtgcgccactaaccgcatctgggctgaaaccagg

SEQ ID NO: 21399 - DNA, 71 bp, chicken (Gallus Gallus)
  misc_feature (36): n=a or c
cattttgccagagcaggttccgttgcacattctcangttcccagttcacatgctcattctgtcccagggcc

SEQ ID NO: 21400 - DNA, 71 bp, chicken (Gallus Gallus)
  misc_feature (36): n=g or t
ctgcctgcctgtccagctgatgctgggattctggtnttcccaaactcctggaaggtttcccaaatatatga

SEQ ID NO: 21401 - DNA, 71 bp, chicken (Gallus Gallus)
  misc_feature (36): n=c or t
cagtagtaatctttagcatatcctgtcatttctctngtctcctcagtcttcagtacagtaggtcaagctgt

SEQ ID NO: 21402 - DNA, 71 bp, chicken (Gallus Gallus)
  misc_feature (36): n=c or g
gctctttaatattttcacacacacacacacacacanagagagagagaaaagtgcctaaattctaatcaagg

SEQ ID NO: 21403 - DNA, 71 bp, chicken (Gallus Gallus)
  misc_feature (36): n=a or g
tgagatataagacacctacagcatgaagaaggaaanctaggagatggtcaggaaggaaggagaggaggtaa

SEQ ID NO: 21404 - DNA, 71 bp, chicken (Gallus Gallus)
  misc_feature (36): n=c or t
acgaatttataaagaaaatacagctgcccaaagctngttctcctccgcctctctttcctggctggctccct

SEQ ID NO: 21405 - DNA, 71 bp, chicken (Gallus Gallus)
  misc_feature (36): n=c or t
taaagaagctacgtatcctcaatgccaaagtcactngaggaaggaggaacacagagtctcgcattttgcat

SEQ ID NO: 21406 - DNA, 71 bp, chicken (Gallus Gallus)
  misc_feature (36): n=c or t
aaaatttccccgttcaggagagcaggaggaaaactngcagtattgtatgaatcccctttgagctttcaaac

SEQ ID NO: 21407 - DNA, 71 bp, chicken (Gallus Gallus)
  misc_feature (36): n=a or g
ttgaaaaacatatcccagataactgtgaggctgttntttggccatgctgcccttcccttctccactcatct

SEQ ID NO: 21408 - DNA, 71 bp, chicken (Gallus Gallus)
  misc_feature (36): n=c or t
ctattccttcgacatcactgtactgcactgaagcanaggtctttgtgttcacatttgggacagccaggcac

SEQ ID NO: 21409 - DNA, 71 bp, chicken (Gallus Gallus)
  misc_feature (36): n=c or t
cctgtttgatggtctgtcttcctctttgcctctatnctatttatctttttattctgtgatgataagttttt

SEQ ID NO: 21410 - DNA, 71 bp, chicken (Gallus Gallus)
  misc_feature (36): n=c or t
cagcctccttggtcatttgtgcctctgtttggagcnggccaatacttttctacctggataagatcaaacat

SEQ ID NO: 21411 - DNA, 71 bp, chicken (Gallus Gallus)
  misc_feature (36): n=c or t
aattcataatggaaagatttgtattatggctctctntgctgaaacttgtgctttagattcttttttctcta

SEQ ID NO: 21412 - DNA, 71 bp, chicken (Gallus Gallus)
  misc_feature (36): n=c or t
ctggacatgctaaatgtgcttagcacaacactgagngtaaaggctagaagcctctgtacactcttagcttt

SEQ ID NO: 21413 - DNA, 71 bp, chicken (Gallus Gallus)
  misc_feature (36): n=a or g
aagttacaaaagcatttccaaatcactaagtccaanatcatgctgagtgacactaagatgaagcaacaaga

SEQ ID NO: 21414 - DNA, 71 bp, chicken (Gallus Gallus)
  misc_feature (36): n=g or t
cacaatccatgtcaatccataatctcaaggaatttngaatcatcgtagcaaccctagtgttattccaaaaa

SEQ ID NO: 21415 - DNA, 71 bp, chicken (Gallus Gallus)
  misc_feature (36): n=a or g
gaagaaaaagtaacctgtgttgtgtctataggaaanccttaggtgggatgagcagtggcttgtgaacgttc

SEQ ID NO: 21416 - DNA, 71 bp, chicken (Gallus Gallus)
  misc_feature (36): n=a or t
cacctttcttttgagatacccttctccacaatgatnaccctgatcttcccccagttacctgtccctaggaa

SEQ ID NO: 21417 - DNA, 71 bp, chicken (Gallus Gallus)
  misc_feature (36): n=a or g
gcatctgctatgaatgttaaaggagaaatttcggcntacgcttcccttgtggtaaagagtaggtttgcaaa

SEQ ID NO: 21418 - DNA, 71 bp, chicken (Gallus Gallus)
  misc_feature (36): n=a or g
gaagcacctactgtggcctacacagctatgaatgcnttaagaattcatcacaccttcctgtactttgctga

SEQ ID NO: 21419 - DNA, 71 bp, chicken (Gallus Gallus)
  misc_feature (36): n=c or t
ttcagagctatgtctgcacaaagatttaggcacaanagtttttggaggaatgtacaagcagtggaaaatac

SEQ ID NO: 21420 - DNA, 71 bp, chicken (Gallus Gallus)
  misc_feature (36): n=a or g
agatggtgacaaaaatgtcttgaagtaacagactgngggatagaaatgagcagtagaatttcccccaaatt

SEQ ID NO: 21421 - DNA, 71 bp, chicken (Gallus Gallus)
  misc_feature (36): n=a or g
cctatgtagatctgcagttgatttatgtacttctantaagtcccgcgtacatacattccctcccccttcac

SEQ ID NO: 21422 - DNA, 71 bp, chicken (Gallus Gallus)
  misc_feature (36): n=c or t
aaatctttctcgagtcctctatgtaaaagccagatnatcattttacttgataaatcttgctccccagcctt

SEQ ID NO: 21423 - DNA, 71 bp, chicken (Gallus Gallus)
  misc_feature (36): n=c or t
agagggtctttctgacttggaacctaagcggtcacngcaatagatcaggctgatgcaagttgattccttaa

SEQ ID NO: 21424 - DNA, 71 bp, chicken (Gallus Gallus)
  misc_feature (36): n=c or t
tcaacttcagcaagctaataggtactcttgtcaganaagtgataccagctaacacctatgttccctgtttt

SEQ ID NO: 21425 - DNA, 71 bp, chicken (Gallus Gallus)
  misc_feature (36): n=c or t
tttctcacaccacatctgctgcagtgggtatttctngaggcgaatggttaacatgcttgctcagtatgatc

SEQ ID NO: 21426 - DNA, 71 bp, chicken (Gallus Gallus)
  misc_feature (36): n=a or g
tagtagaaagaataaaaagaacagataatgataccngccttagcatcaaacactttcgacctgtagcttag

SEQ ID NO: 21427 - DNA, 71 bp, chicken (Gallus Gallus)
  misc_feature (36): n=a or g
tactttagaggtcaaggtgtttcttttgctgcagantaacttctgtcatctctactaccacttctttatac

SEQ ID NO: 21428 - DNA, 71 bp, chicken (Gallus Gallus)
  misc_feature (36): n=a or c
agcttccatacttttgcaagttgcagcttcatgggnggcaatttcataggttgcttttgtcacatttaatg

SEQ ID NO: 21429 - DNA, 71 bp, chicken (Gallus Gallus)
  misc_feature (36): n=a or c
tgctatggagctctctagcatgctgttctctcgaantgtgcaaagttcatgtttttcctctcaacctgagc

SEQ ID NO: 21430 - DNA, 71 bp, chicken (Gallus Gallus)
  misc_feature (36): n=a or g
atccttcctgaactgttgcacaaacagaggagtgcntgttgctgtctctctgtaacatttcgagtgtgttt

SEQ ID NO: 21431 - DNA, 71 bp, chicken (Gallus Gallus)
  misc_feature (36): n=a or c
ctttatacctagacttgctctgacggcgtagtctcngctagggcaggatcatgttcccagattttttcccc

SEQ ID NO: 21432 - DNA, 71 bp, chicken (Gallus Gallus)
  misc_feature (36): n=g or t
aactaggagaaacataattgtccatcaaaggaatangtgtgttttcaaaccatggatatacccaaagaaat

SEQ ID NO: 21433 - DNA, 71 bp, chicken (Gallus Gallus)
  misc_feature (36): n=a or g
aggtttttatggagttctctacagtaaatttaggtntctctgatctgggtccaatttttgtctcccatctc

SEQ ID NO: 21434 - DNA, 71 bp, chicken (Gallus Gallus)
  misc_feature (36): n=c or t
ttctcagtagctttttccccctctaatcttctcatntaggcactgaaaatgccatctgaatgactgaaggc

SEQ ID NO: 21435 - DNA, 71 bp, chicken (Gallus Gallus)
  misc_feature (36): n=a or g
agctaaaagcgttaatgctgtactatttgaattatnttccagtaagagcaaatctgaattaaaaacattaa

SEQ ID NO: 21436 - DNA, 71 bp, chicken (Gallus Gallus)
  misc_feature (36): n=a or g
aaataaacttgttgattgtatttctattttttatcnaacttgagagtattaaaatcaatattttatttctt

SEQ ID NO: 21437 - DNA, 71 bp, chicken (Gallus Gallus)
  misc_feature (36): n=a or g
ctttgttgaaaagtgaaaaactatgcactcctcaantctatgcagtacagcttatgcagcaaaaaggcagt

SEQ ID NO: 21438 - DNA, 71 bp, chicken (Gallus Gallus)
  misc_feature (36): n=a or g
ggggttcacattaataaaagaaacaaatgaacagtntacataattacatacagctgtggcaaaaagccaga

SEQ ID NO: 21439 - DNA, 71 bp, chicken (Gallus Gallus)
  misc_feature (36): n=a or t
tatttatttgtttgttttaaaatgttgaagtcaagngttctggctttcagttacagggtattagtgtgaca

SEQ ID NO: 21440 - DNA, 71 bp, chicken (Gallus Gallus)
  misc_feature (36): n=a or g
tggtctttgaacagaccaaagctattgctggtaagngaagaaaactgacttcttttctttggacagctggg

SEQ ID NO: 21441 - DNA, 71 bp, chicken (Gallus Gallus)
  misc_feature (36): n=c or g
aagaaaagagtattaatttatatgaatccatatctncttctgatgtagagataagatggggtacaaagctg

SEQ ID NO: 21442 - DNA, 71 bp, chicken (Gallus Gallus)
  misc_feature (36): n=a or g
tccagctctcagtagtcaaaaattaaatctttttanagctgcatttacatcaacttgctttgtgccctgtg

SEQ ID NO: 21443 - DNA, 71 bp, chicken (Gallus Gallus)
  misc_feature (36): n=g or t
tagaaagggatgtgtgaggaggatgttggactgccntatctcatcgctctgttcattttgacaagagacat

SEQ ID NO: 21444 - DNA, 71 bp, chicken (Gallus Gallus)
  misc_feature (36): n=g or t
atgaaagaagttctaatgtctgtatattacgttttnattgcttgcatttactaaatgtcataataaatctg

SEQ ID NO: 21445 - DNA, 71 bp, chicken (Gallus Gallus)
  misc_feature (36): n=c or t
gcgctttctttccatacttggtcacctgaaacaacngccagcatgtatggccatctcacacagtcccatca

SEQ ID NO: 21446 - DNA, 71 bp, chicken (Gallus Gallus)
  misc_feature (36): n=a or g
ttctcaagttgactttctgtcctcatttggccacanactacacgcataacggataaacatcggacacataa

SEQ ID NO: 21447 - DNA, 71 bp, chicken (Gallus Gallus)
  misc_feature (36): n=a or g
tggaaaggattctccatttgtgtgagtatgtatttncacatgtttatgtacacacacagagccctttacat

SEQ ID NO: 21448 - DNA, 71 bp, chicken (Gallus Gallus)
  misc_feature (36): n=c or t
cctgcacatttttatggtaacactgcagtactttcngtggtttggaagatcttctctctctgtagctactt

SEQ ID NO: 21449 - DNA, 71 bp, chicken (Gallus Gallus)
  misc_feature (36): n=a or g
gtattttgcttgtttcatttggtaggttttgcccantgtttcattagagtcaagcctaaagagctagagca

SEQ ID NO: 21450 - DNA, 71 bp, chicken (Gallus Gallus)
  misc_feature (36): n=a or g
gttatgccaaagcgtcagtctagcactggtatcatngaatcatagaatagctcgggttggaagggacctca

SEQ ID NO: 21451 - DNA, 71 bp, chicken (Gallus Gallus)
  misc_feature (36): n=a or g
ttaagtggagaagggagaactatcagagagcacctnggtgaccttagctggcaaaaagaccacactaccag

SEQ ID NO: 21452 - DNA, 71 bp, chicken (Gallus Gallus)
  misc_feature (36): n=c or t
tctcaactacagactccatctgccctttgtatctcncagccccactcttgacctctttggctctgaacact

SEQ ID NO: 21453 - DNA, 71 bp, chicken (Gallus Gallus)
  misc_feature (36): n=c or t
caacaacactgccgcactcagcaaagaaggaagcangctgtctgaagtttaaagacttgaataagtctttg

SEQ ID NO: 21454 - DNA, 71 bp, chicken (Gallus Gallus)
  misc_feature (36): n=a or g
tgtgcaagttaactaagctatgctatgctgatttgnaaaagaaaaaaatagtaaaggccatgaaattcagt

SEQ ID NO: 21455 - DNA, 71 bp, chicken (Gallus Gallus)
  misc_feature (36): n=a or g
ttatactcagtcatcaaaaaagaagctttaaaaagnaagattttatatttacatagtcttttttttttttt

SEQ ID NO: 21456 - DNA, 71 bp, chicken (Gallus Gallus)
  misc_feature (36): n=a or g
tacctctggacttgcaagtttgtgccatgactcacngaaacaaccttactgacttcctgagtaaattgctt

SEQ ID NO: 21457 - DNA, 71 bp, chicken (Gallus Gallus)
  misc_feature (36): n=c or t
atcacttttagcagtattctctcacagctcagatangtttctcaaagtctggctgtgagttttgtttggag

SEQ ID NO: 21458 - DNA, 71 bp, chicken (Gallus Gallus)
  misc_feature (36): n=a or g
tggcagtgctaaaggtagtttagtgactgatcaatngtctgaccaagatttctttggtccagctagcaaag

SEQ ID NO: 21459 - DNA, 71 bp, chicken (Gallus Gallus)
  misc_feature (36): n=c or t
cacagacctgtgtaaatacaaataaatcagcaccantgagaagaataaagggaaaggaaaatagaagaaag

SEQ ID NO: 21460 - DNA, 71 bp, chicken (Gallus Gallus)
  misc_feature (36): n=c or t
tcgtcttcattgttattcctttctcttgcaaaaatntactatcaacatacaccaacattttacttctctct

SEQ ID NO: 21461 - DNA, 71 bp, chicken (Gallus Gallus)
  misc_feature (36): n=a or g
tgataaactgtatggctacttccagcgtgaggcctnttttggaatatagtgctcattcaaattgcagttca

SEQ ID NO: 21462 - DNA, 71 bp, chicken (Gallus Gallus)
  misc_feature (36): n=a or g
gcattattttagcattaattacaggtcctagaatanatgtaatataaatatcaaatagtaatagcttctga

SEQ ID NO: 21463 - DNA, 71 bp, chicken (Gallus Gallus)
  misc_feature (36): n=a or g
tcaaaacccgtggtctctattttgcatttttctgcnagttccttgagctcttctctcaaaatctgcagtac

SEQ ID NO: 21464 - DNA, 71 bp, chicken (Gallus Gallus)
  misc_feature (36): n=a or g
tccctgcaatctgacaggaaaggtttgcatgtgtgncaggtgtatttcctaatttcctcttcaggtgcctt

SEQ ID NO: 21465 - DNA, 71 bp, chicken (Gallus Gallus)
  misc_feature (36): n=a or g
atactggtgtgtaagctatcgtgttttgaggcagangggcaaatgtgttttgtttattgctccttactctc

SEQ ID NO: 21466 - DNA, 71 bp, chicken (Gallus Gallus)
  misc_feature (36): n=a or g
tcagaggatttaaggactgaatgcgctacatgcaangggactggagacaatgaaaatctagtcaggtaggt

SEQ ID NO: 21467 - DNA, 71 bp, chicken (Gallus Gallus)
  misc_feature (36): n=a or g
gggatatgcaaaattcctgcaacagatacacccagnttttaggaacaaggtttttttggagccaattcagt

SEQ ID NO: 21468 - DNA, 71 bp, chicken (Gallus Gallus)
  misc_feature (36): n=a or g
tggcaaaaatctgggctatcactatgcatacataangagcagcaacagcctagagctctcattcctgccac

SEQ ID NO: 21469 - DNA, 71 bp, chicken (Gallus Gallus)
  misc_feature (36): n=c or t
acttgcactgaagaactttggtgataaaactcactnaagtataaaaactggccaagtaaattgcttttttt

SEQ ID NO: 21470 - DNA, 71 bp, chicken (Gallus Gallus)
  misc_feature (36): n=c or t
ggaactgcacatggatggatctataggatgttcttngggctccccaggctgaacgtgtgccctggcctcaa

SEQ ID NO: 21471 - DNA, 71 bp, chicken (Gallus Gallus)
  misc_feature (36): n=c or t
atccggcgaaggacaattctcagcagaccaaaccanctggagaaatggaagtggactaaatcttgcatttc

SEQ ID NO: 21472 - DNA, 71 bp, chicken (Gallus Gallus)
  misc_feature (36): n=a or g
cttaaagggtgcagctgagggaagtgggatcatttngtttctcctgaggagttacttcaggattgctgctc

SEQ ID NO: 21473 - DNA, 71 bp, chicken (Gallus Gallus)
  misc_feature (36): n=a or g
ttatttctttcttctcattaatgtacacagctcagntgtacaacagcattttggggtaccaagtccataaa

SEQ ID NO: 21474 - DNA, 71 bp, chicken (Gallus Gallus)
  misc_feature (36): n=a or g
gtcagctcgttaagggtgggtactgctcgcaatgcnggtggctgtaagctaggtcttgacatggatcagat

SEQ ID NO: 21475 - DNA, 71 bp, chicken (Gallus Gallus)
  misc_feature (36): n=a or g
ataacccatgtacgcatgtttaggagaaggaaaatntagggaaaaatctacagttctggagaaggagcccc

SEQ ID NO: 21476 - DNA, 71 bp, chicken (Gallus Gallus)
  misc_feature (36): n=c or t
tcaagggtatcccaggtggatttgaaaaagcatggnggccagcaagtacagggaagttctcctccccctat

SEQ ID NO: 21477 - DNA, 71 bp, chicken (Gallus Gallus)
  misc_feature (36): n=c or t
ccctcccagcttctctacctccagcctctttgaggntgagaaaagagagccttgacgctctgcaggtgctg

SEQ ID NO: 21478 - DNA, 71 bp, chicken (Gallus Gallus)
  misc_feature (36): n=c or t
acaaacatgtcgcctcacagcacaaggccgttctcnactctccccttcagcctctttcacagacttgtttg

SEQ ID NO: 21479 - DNA, 71 bp, chicken (Gallus Gallus)
  misc_feature (36): n=a or g
atgaggctcctcagagagctgatcttgtttacccanaaggaaaacagatttaggctgatctaaagggctgg

SEQ ID NO: 21480 - DNA, 71 bp, chicken (Gallus Gallus)
  misc_feature (36): n=c or t
caatttattcttattatactgctattaatatccttngccttagtttccatgacaaataatagaacggcttg

SEQ ID NO: 21481 - DNA, 71 bp, chicken (Gallus Gallus)
  misc_feature (36): n=c or t
aagccatgagtgtccagtcttttggcttgtctggantacatcacatgaagagaaatcgttctgggccacat

SEQ ID NO: 21482 - DNA, 71 bp, chicken (Gallus Gallus)
  misc_feature (36): n=c or t
aaatgagacacgtttcaactattatctgcaatgaanttatacaagtcaaattagagcacacagttcgcact

SEQ ID NO: 21483 - DNA, 71 bp, chicken (Gallus Gallus)
  misc_feature (36): n=a or t
agttgtgcggctcttgaaatattgttgaccattctntgacatcaagaattgcatagatgttttggtgcaaa

SEQ ID NO: 21484 - DNA, 71 bp, chicken (Gallus Gallus)
  misc_feature (36): n=c or t
agctaaacttgctgaagattaagtgaaaactggtcnaatttaaaacatcacccaaatgagcaggttaaacc

SEQ ID NO: 21485 - DNA, 71 bp, chicken (Gallus Gallus)
  misc_feature (36): n=a or g
tgctacctcctccttatttttctgagataaagactncttcactgaaactgctgactgtagtccaagccttt

SEQ ID NO: 21486 - DNA, 71 bp, chicken (Gallus Gallus)
  misc_feature (36): n=a or t
aacatcgctggacaaatatctgacatttaagtatgntggaggtgcaaggagtgtgttcctagaagggatca

SEQ ID NO: 21487 - DNA, 71 bp, chicken (Gallus Gallus)
  misc_feature (36): n=a or t
cctacagaaatgccttttactgttgaatagagtcanattatctgcttttcttcctcccttttcctcatccc

SEQ ID NO: 21488 - DNA, 71 bp, chicken (Gallus Gallus)
  misc_feature (36): n=g or t
cctcattgcgtgaaaaagccatggaacagataagcnagaaagaaaaaagaaaggggagatttagagagagg

SEQ ID NO: 21489 - DNA, 71 bp, chicken (Gallus Gallus)
  misc_feature (36): n=a or g
gattacttttagaaaaagagttttccaagtttacancagtccttctgaaaccactgtgtattgaaggccag

SEQ ID NO: 21490 - DNA, 71 bp, chicken (Gallus Gallus)
  misc_feature (36): n=c or t
tttctgaaagccaaaaagcttgaagatggataatantaacagttcaaactgaaatctagttgaagatttct

SEQ ID NO: 21491 - DNA, 71 bp, chicken (Gallus Gallus)
  misc_feature (36): n=c or t
ataaaaaaaaatagttaaaaagaggaggtaagtacnagaaacagttgcacttaggtttttgtctgatgcta

SEQ ID NO: 21492 - DNA, 71 bp, chicken (Gallus Gallus)
  misc_feature (36): n=a or g
aatcattactttggctgttgctgctttggattttantattggaaatgcttcattctttggaagccagtatt

SEQ ID NO: 21493 - DNA, 71 bp, chicken (Gallus Gallus)
  misc_feature (36): n=a or g
ggctggaggataggcatgctggaactaattaaggcntttgacttaaaggaatataattcacctgatatccc

SEQ ID NO: 21494 - DNA, 71 bp, chicken (Gallus Gallus)
  misc_feature (36): n=a or g
ggttgcataaagatattactggatgtgagggacagnctctcctggtatgcaaggccacccaatttgtcatg

SEQ ID NO: 21495 - DNA, 71 bp, chicken (Gallus Gallus)
  misc_feature (36): n=c or t
ctagggacaggcagatgggcagaacatagcagaatngcagttttcttaaaactaaaaaacagcttcctgcc

SEQ ID NO: 21496 - DNA, 71 bp, chicken (Gallus Gallus)
  misc_feature (36): n=c or t
gataaaaatgaggaatgatgcagggaacatccacanagagggagaacattttagatgagtgaccatgtcag

SEQ ID NO: 21497 - DNA, 71 bp, chicken (Gallus Gallus)
  misc_feature (36): n=a or g
tgaaatgctctggctgaaactgatgttcagaaaacnttaaatatggctgagaattgcccaagtttaatgca

SEQ ID NO: 21498 - DNA, 71 bp, chicken (Gallus Gallus)
  misc_feature (36): n=c or t
cagggagcaattttgtgatctatggcataaaggccnattggaaagagtgaaaagggacaaaagtgttgcca

SEQ ID NO: 21499 - DNA, 71 bp, chicken (Gallus Gallus)
  misc_feature (36): n=c or t
cccttctccttctcctctcatcatggatggcagcancatcttcctactcaccaggcgtaagcagtacacca

SEQ ID NO: 21500 - DNA, 71 bp, chicken (Gallus Gallus)
  misc_feature (36): n=a or g
ccgtatacatgtcccttttcagaacattttcaattnaaatacaagtatgaatagagtgttactcaagaaag

SEQ ID NO: 21501 - DNA, 71 bp, chicken (Gallus Gallus)
  misc_feature (36): n=c or t
gcacagttacactgatgctcatgctggggcattgcnttgcagttcagaataaagaatttttaaagaagttg

SEQ ID NO: 21502 - DNA, 71 bp, chicken (Gallus Gallus)
  misc_feature (36): n=c or g
ttttttgctgatgcaatcacagtgactgcctatttntcagatttctgtgtgattcttctgtggttccgtgc

SEQ ID NO: 21503 - DNA, 71 bp, chicken (Gallus Gallus)
  misc_feature (36): n=c or g
aataatatttttttaatggctgaggaatttcaggtntctgtctaagttacagttctaatgctacagacatt

SEQ ID NO: 21504 - DNA, 71 bp, chicken (Gallus Gallus)
  misc_feature (36): n=a or g
atcaaaagtgctttagaaatgtaggcatatcacagnaccagagcagttttgaaaatccaaccttactggag

SEQ ID NO: 21505 - DNA, 71 bp, chicken (Gallus Gallus)
  misc_feature (36): n=c or t
cagccatttgctcccaacacgaccgcttttactttnctaaagtccttccgcagagaactttctgctcatct

SEQ ID NO: 21506 - DNA, 71 bp, chicken (Gallus Gallus)
  misc_feature (36): n=c or t
ttcaattcaatctccatgtctgggctggacttcatngcagaagcaaccatggcatcacggagtttattgcc

SEQ ID NO: 21507 - DNA, 71 bp, chicken (Gallus Gallus)
  misc_feature (36): n=g or t
ggagataaggccaaaattaaaactcaaggaaagtangaccgaagacacagtgattatattatctactggta

SEQ ID NO: 21508 - DNA, 71 bp, chicken (Gallus Gallus)
  misc_feature (36): n=a or g
ttctgaagtgaattaaaaccgcagtgcctcgaagcnctgttgaggcaggaagcatcctttgatttactatt

SEQ ID NO: 21509 - DNA, 71 bp, chicken (Gallus Gallus)
  misc_feature (36): n=a or t
ctggttgggcttttttaaaggttcttaccagtgccnacagcttaagcactccctattttcctgagaataaa

SEQ ID NO: 21510 - DNA, 71 bp, chicken (Gallus Gallus)
  misc_feature (36): n=a or g
ttctgcaggttttaaaaccagccctgtccattaggntctgaacaataggactgtatgatttatgccaggca

SEQ ID NO: 21511 - DNA, 71 bp, chicken (Gallus Gallus)
  misc_feature (36): n=a or g
cacattttcttttttgtttctttctgattgttctgncaaccatggagtctgcacagctgacactatgttag

SEQ ID NO: 21512 - DNA, 71 bp, chicken (Gallus Gallus)
  misc_feature (36): n=g or t
gcagtgcagagcaaagaaacagctaggatgccttgnctgtggttgtgcagctgtacaggagctgtatagct

SEQ ID NO: 21513 - DNA, 71 bp, chicken (Gallus Gallus)
  misc_feature (36): n=c or t
ggtgcctgagatcctccacggaggcttcagcatctngaataaggtggccagtgtttcactgtcctctgcgc

SEQ ID NO: 21514 - DNA, 71 bp, chicken (Gallus Gallus)
  misc_feature (36): n=c or t
gtgttcttcaggggtcagtgttaaggccagtcctgnttaatgtcttaactgataatctggacaaggtattg

SEQ ID NO: 21515 - DNA, 71 bp, chicken (Gallus Gallus)
  misc_feature (36): n=c or t
aaatgtcgttagatcgccagcataaatctagggtanggtcctggtctaggaagtgcctgcagcattggttc

SEQ ID NO: 21516 - DNA, 71 bp, chicken (Gallus Gallus)
  misc_feature (36): n=c or t
ccttgctctcagagatgttctgttggaaaaccattntggaatgctgttggtgcgctgcacacctatcacca

SEQ ID NO: 21517 - DNA, 71 bp, chicken (Gallus Gallus)
  misc_feature (36): n=g or t
tctttgaggccttatgttcagagaataagtgcttgnagtttcctgaaaattatgtctctgttaacatattt

SEQ ID NO: 21518 - DNA, 71 bp, chicken (Gallus Gallus)
  misc_feature (36): n=c or t
catttttaatgcataagccctctcttgatcttgcantctggggaaaagaaaccagagttcctctaaacatc

SEQ ID NO: 21519 - DNA, 71 bp, chicken (Gallus Gallus)
  misc_feature (36): n=a or g
taaaagcaatctcaaaactaaaagcaggaaatgcangtctgggagccagaataacattctgcaaaactgaa

SEQ ID NO: 21520 - DNA, 71 bp, chicken (Gallus Gallus)
  misc_feature (36): n=a or g
gtccccattcaaccttgagttgcacctcattgtgantgttagaatcctaaaagaaattaaagctgccttac

SEQ ID NO: 21521 - DNA, 71 bp, chicken (Gallus Gallus)
  misc_feature (36): n=c or t
aatgcaggcattaaacacacaaaaaggatagtaggnggaattatgaagtaactaacatagccagttacaga

SEQ ID NO: 21522 - DNA, 71 bp, chicken (Gallus Gallus)
  misc_feature (36): n=c or t
catgatatagcatgctggatgccatgaaggcgtctntcagggcagatatctacaagagcagccatcctgac

SEQ ID NO: 21523 - DNA, 71 bp, chicken (Gallus Gallus)
  misc_feature (36): n=c or g
cctatccttgttttctatgaagtgtatgaaatgttntgcaggttttatcctgcagtccgttgctgctgctt

SEQ ID NO: 21524 - DNA, 71 bp, chicken (Gallus Gallus)
  misc_feature (36): n=a or c
gatgtgggaccaaagcgagatcttgtggctgaactngaaacatctgttagaaacagaactgacttgcgttt

SEQ ID NO: 21525 - DNA, 71 bp, chicken (Gallus Gallus)
  misc_feature (36): n=a or g
tgaattatactacaaattagctcttcgtcttttacnaatgtaaaaccccttacgactactttaaaacttta

SEQ ID NO: 21526 - DNA, 71 bp, chicken (Gallus Gallus)
  misc_feature (36): n=c or t
aaatagggagctttcccaccaacctgattctatgtntgaaaagtggatgacatgaaaaccaaaatcctatg

SEQ ID NO: 21527 - DNA, 71 bp, chicken (Gallus Gallus)
  misc_feature (36): n=c or g
agggagctgccagccttagctgctgcatacagactnctcagaaggccatgttcccttaacagtgtcaagag

SEQ ID NO: 21528 - DNA, 71 bp, chicken (Gallus Gallus)
  misc_feature (36): n=a or g
aatattctcaagggctcatctatgagagaagagaanaggcagttcagcaggaaggatgcatggcgattatc

SEQ ID NO: 21529 - DNA, 71 bp, chicken (Gallus Gallus)
  misc_feature (36): n=c or g
aattctaacaaaaatgccatgtgttatgacgtacangtgtaaactatgccactgtacagatgaataaagtc

SEQ ID NO: 21530 - DNA, 71 bp, chicken (Gallus Gallus)
  misc_feature (36): n=a or g
cttcatagcagtggagcttgaactattggagacgcnttatttcacggtcaagccaagtggacttacagaaa

SEQ ID NO: 21531 - DNA, 71 bp, chicken (Gallus Gallus)
  misc_feature (36): n=c or g
tgttcaagctttggacgtgctccaaagttcaaaacntctgatggattttccacattaaagatccaaaactg

SEQ ID NO: 21532 - DNA, 71 bp, chicken (Gallus Gallus)
  misc_feature (36): n=a or g
aataagagaaactggggaatacacttttgagatgcntccttcttaggaaattcttctgtgttgcactacta

SEQ ID NO: 21533 - DNA, 71 bp, chicken (Gallus Gallus)
  misc_feature (36): n=c or t
ttttttttttcacttttctttcagataggtgaaaanggagatcccaaagcctttctaatagaagtttcttg

SEQ ID NO: 21534 - DNA, 71 bp, chicken (Gallus Gallus)
  misc_feature (36): n=a or c
atccaccttccacttgcactcctctgtttcaacatnaccttggattctgacagtttggtttatatccatct

SEQ ID NO: 21535 - DNA, 71 bp, chicken (Gallus Gallus)
  misc_feature (36): n=c or t
tatttctgcagctaaaggacgggatttattatgcanctctgttccccacatgcaccccaagaactttttaa

SEQ ID NO: 21536 - DNA, 71 bp, chicken (Gallus Gallus)
  misc_feature (36): n=a or g
ctgtagcaaatgtggagacatggccaggtgatctgntgctgcttccctcctatgtatctctgaaaggatat

SEQ ID NO: 21537 - DNA, 71 bp, chicken (Gallus Gallus)
  misc_feature (36): n=a or g
ataattgtattttttttttccttcagtactggaacncagtgtacaaaactataaaggatttgttgagttag

SEQ ID NO: 21538 - DNA, 71 bp, chicken (Gallus Gallus)
  misc_feature (36): n=c or t
tgcagatctgacttacgagtggcatctctgtactcntattcagtgcctgcatacagaagaaaggtcaggtg

SEQ ID NO: 21539 - DNA, 71 bp, chicken (Gallus Gallus)
  misc_feature (36): n=c or t
tcagaaagccacctgagaaacccaagtctcctgggnttcagggagccattgtgtttgcgtgtgtgagacag

SEQ ID NO: 21540 - DNA, 71 bp, chicken (Gallus Gallus)
  misc_feature (36): n=a or c
caaactgcactgcaatgcttcccactttgaagttangtttctgaaggagtgaaaaaaagcaccacatgaat

SEQ ID NO: 21541 - DNA, 71 bp, chicken (Gallus Gallus)
  misc_feature (36): n=c or g
aaaaactggaagactgagtgagccacgcaaagaganctccgacgttcctgcatgccaggctctggagagag

SEQ ID NO: 21542 - DNA, 71 bp, chicken (Gallus Gallus)
  misc_feature (36): n=c or t
ggtgtaccaaaaattcagttagtaagtgacatcagnttgcagaatgaaggcaccacagtcatcaagaactc

SEQ ID NO: 21543 - DNA, 71 bp, chicken (Gallus Gallus)
  misc_feature (36): n=a or g
agaccaagtctatctagttctcctcccacccctccntgggcaaagatgcttcccaatagatcaggttggga

SEQ ID NO: 21544 - DNA, 71 bp, chicken (Gallus Gallus)
  misc_feature (36): n=g or t
ctcttagaagattagcctaaatcaaaacagactttnttttctttcatgttatcttactcatctacactgtg

SEQ ID NO: 21545 - DNA, 71 bp, chicken (Gallus Gallus)
  misc_feature (36): n=a or g
tttatactcctggaatttataattccaagaaagganaagtatcctcaattaacgagttttttcaatagaat

SEQ ID NO: 21546 - DNA, 71 bp, chicken (Gallus Gallus)
  misc_feature (36): n=a or g
tattttatcgtctcagcaaacacttctccagagttngccttttttctgttgtgggcagcagttataaaggg

SEQ ID NO: 21547 - DNA, 71 bp, chicken (Gallus Gallus)
  misc_feature (36): n=a or g
aaacaacagtgcaatctttctgcaacttaaagcagnactgtatgccagagtgggaacccatacattttgtc

SEQ ID NO: 21548 - DNA, 71 bp, chicken (Gallus Gallus)
  misc_feature (36): n=a or g
accttaaaatctgggcccaaacgacttggattttangctatctggggaaaaaaagcagtgatttgatcttt

SEQ ID NO: 21549 - DNA, 71 bp, chicken (Gallus Gallus)
  misc_feature (36): n=g or t
ttcacaaattccactactgctctggcatatgtgcantaactttgtgccaacctagcagaccgtgaatgtgc

SEQ ID NO: 21550 - DNA, 71 bp, chicken (Gallus Gallus)
  misc_feature (36): n=c or t
ctctatgggccagagaacagcgaggaagaagctatnctgaactgaagcatctgaagaacagagctgtattc

SEQ ID NO: 21551 - DNA, 71 bp, chicken (Gallus Gallus)
  misc_feature (36): n=a or g
tgtttacatgatgcagtgcaggtgtctgtaaggcanccagaacatgtttgagctcgcacagagcttagcag

SEQ ID NO: 21552 - DNA, 71 bp, chicken (Gallus Gallus)
  misc_feature (36): n=a or g
atgttgcggtagagtttccgtccttacatcatagcnacttaccccttgtggtaagccttgtgtccgtgttc

SEQ ID NO: 21553 - DNA, 71 bp, chicken (Gallus Gallus)
  misc_feature (36): n=a or g
tggctttgtggagaggatattgttgttgttacagcnctagcctgaagttcaggaggcgagagttcaattca

SEQ ID NO: 21554 - DNA, 71 bp, chicken (Gallus Gallus)
  misc_feature (36): n=c or t
agtaggagacttaagatgtgatgttagaaaaaaatncagcataatcttacagtattcctctttttgcccaa

SEQ ID NO: 21555 - DNA, 71 bp, chicken (Gallus Gallus)
  misc_feature (36): n=c or t
tgtgtactcactgtgcttgcaagtgccatctttacncaattttcccttttcttgaaggagataatgcaatc

SEQ ID NO: 21556 - DNA, 71 bp, chicken (Gallus Gallus)
  misc_feature (36): n=c or g
aatgttttactgacaagaaaatactgttcttaaggnagtgtagaactggggaaaggtaggactgaatcatg

SEQ ID NO: 21557 - DNA, 71 bp, chicken (Gallus Gallus)
  misc_feature (36): n=c or t
atcagcacaccacttgttcccattgatctggccttntcatatgcactgctcaagtccagtagtaaaatcga

SEQ ID NO: 21558 - DNA, 71 bp, chicken (Gallus Gallus)
  misc_feature (36): n=c or g
aatttccttagctgagatatgtatgctaattttgtnagatgggtgtgctatcagtcttcccaagcatctaa

SEQ ID NO: 21559 - DNA, 71 bp, chicken (Gallus Gallus)
  misc_feature (36): n=c or t
cctgcccaggttccaggacacagagttgctcacctnatgccgttcccaccctatctgcctagtggtagtgg

SEQ ID NO: 21560 - DNA, 71 bp, chicken (Gallus Gallus)
  misc_feature (36): n=a or c
ctagtgagcgagcaatatacgcacacaaaaaaaaancttgggtttcctttatgaatgactgaaattccagt

SEQ ID NO: 21561 - DNA, 71 bp, chicken (Gallus Gallus)
  misc_feature (36): n=a or g
ctgcctttgttgctgtagctggaactgtggcatgcnttggtatgtttgtgtgactttctttaatccatcgc

SEQ ID NO: 21562 - DNA, 71 bp, chicken (Gallus Gallus)
  misc_feature (36): n=g or t
acagcaggctctgcaaccagcctaaatttaggagtnagtcttgcagcagccagaaagtgaagcaagatgcg

SEQ ID NO: 21563 - DNA, 71 bp, chicken (Gallus Gallus)
  misc_feature (36): n=c or g
cataaaaacaactttcttctgtaaccaccacataanagcagcctctcagcccaacctgaaaatactgtaat

SEQ ID NO: 21564 - DNA, 71 bp, chicken (Gallus Gallus)
  misc_feature (36): n=g or t
tcactatctagaatatctgaagaacaaagcgttgtncctatatttgtcttcccattttggccagctctgcg

SEQ ID NO: 21565 - DNA, 71 bp, chicken (Gallus Gallus)
  misc_feature (36): n=c or t
ttgccatacagccttgtgcgtgagatctggagaagnaaatttggaagcattttaaaaagatttttggtttt

SEQ ID NO: 21566 - DNA, 71 bp, chicken (Gallus Gallus)
  misc_feature (36): n=a or t
ttctatttatgaaagtgacttaagagatcctaaaanatttaggatgataggtggttctattgaaagaagta

SEQ ID NO: 21567 - DNA, 71 bp, chicken (Gallus Gallus)
  misc_feature (36): n=g or t
attggttctaagtatcaagtgtaaggacagtggtgntactcagtccctactacatagtatatctttctctt

SEQ ID NO: 21568 - DNA, 71 bp, chicken (Gallus Gallus)
  misc_feature (36): n=a or c
tgacccatataaagtggccgcatataacctgtgacnatatggggcattctgagtatgggcagcttgtgctg

SEQ ID NO: 21569 - DNA, 71 bp, chicken (Gallus Gallus)
  misc_feature (36): n=a or c
ctggtgtttgcaacacctttttttttttttcaaagnagccttcagctgaccaaagtttgcattcatgacag

SEQ ID NO: 21570 - DNA, 71 bp, chicken (Gallus Gallus)
  misc_feature (36): n=a or g
cgggtgaccccaggcgacttaccagcagcttggccntgcagttctgctccccaacgtagcagaaatcccca

SEQ ID NO: 21571 - DNA, 71 bp, chicken (Gallus Gallus)
  misc_feature (36): n=c or g
gcttaataatacataccaggcaccaccatgccaagnaactttgcactgacaatcacataaataaatgcttt

SEQ ID NO: 21572 - DNA, 71 bp, chicken (Gallus Gallus)
  misc_feature (36): n=a or g
catctccactctcacagctctgaatgctgtgtggcncaggcactgaaccagtcatgtcactgggtaccttg

SEQ ID NO: 21573 - DNA, 71 bp, chicken (Gallus Gallus)
  misc_feature (36): n=a or c
ctcgcactagatcagctaggtgcagcgcagccaacntctgaacacacaaaagcaagaagtgtaagaacagg

SEQ ID NO: 21574 - DNA, 71 bp, chicken (Gallus Gallus)
  misc_feature (36): n=c or t
ttctcctgcaaggagtgattgcagcctttgaagcantgccaccatttcactgcagaacccaaggtgatgat

SEQ ID NO: 21575 - DNA, 71 bp, chicken (Gallus Gallus)
  misc_feature (36): n=a or g
caaaactatgtagaattcttcctgttactaatctancagcaaagcagtaatttaccacctgaaactttggg

SEQ ID NO: 21576 - DNA, 71 bp, chicken (Gallus Gallus)
  misc_feature (36): n=c or t
acatccttttttttttttcttttttgggctatttgnagataaatgacctcccttcttataattaaagaata

SEQ ID NO: 21577 - DNA, 71 bp, chicken (Gallus Gallus)
  misc_feature (36): n=g or t
tgcccatgtctttcatctgtatcttcagaactgtangtatatttttcaacccagtgagcaaaatacagggg

SEQ ID NO: 21578 - DNA, 71 bp, chicken (Gallus Gallus)
  misc_feature (36): n=a or g
attacacttgaaagtgactccacagtaagagaaacntttgtttttcattaaaaggcttcatacacattaaa

SEQ ID NO: 21579 - DNA, 71 bp, chicken (Gallus Gallus)
  misc_feature (36): n=a or g
ccatcttcctcctcctctcacatgcctgactggtcnacccacaagctgggattaagaattattctgggttt

SEQ ID NO: 21580 - DNA, 71 bp, chicken (Gallus Gallus)
  misc_feature (36): n=a or g
gcaacatgagaaagacatgttgagatgctgtcacangacagcagaagatctttatggatgatcctgggcct

SEQ ID NO: 21581 - DNA, 71 bp, chicken (Gallus Gallus)
  misc_feature (36): n=c or g
ttctgcatttggacactcataaagaagaaaaaaaanaactttgtggtctcatacaatatgctgaagtcact

SEQ ID NO: 21582 - DNA, 71 bp, chicken (Gallus Gallus)
  misc_feature (36): n=c or g
tttaatttattgttgttttttttccccattacatantaaagttttcgtttctacttttgtaatacgagaag

SEQ ID NO: 21583 - DNA, 71 bp, chicken (Gallus Gallus)
  misc_feature (36): n=a or t
agggatcgatatccgctaacgcaaaaggaggaaganttccttctaccgcaggttgcgttacctctctctaa

SEQ ID NO: 21584 - DNA, 71 bp, chicken (Gallus Gallus)
  misc_feature (36): n=c or t
gtttcttaggaggaatagtaacatttatcattttangactggagaactgagaaggcttctgcatgagcagg

SEQ ID NO: 21585 - DNA, 71 bp, chicken (Gallus Gallus)
  misc_feature (36): n=c or t
aatgtggtcggataactgacacaattggtgtgctgnggtaactggatagaggctctaaggaaaggataggc

SEQ ID NO: 21586 - DNA, 71 bp, chicken (Gallus Gallus)
  misc_feature (36): n=c or t
tctaagtaattaatattcttatcttcttttgtgccncaatcctaatcttcccctcccagcttcaaacagct

SEQ ID NO: 21587 - DNA, 71 bp, chicken (Gallus Gallus)
  misc_feature (36): n=c or t
acaggaagttggcaaggaaagatatgtgtgcagagncttacagtgttaaagatgtaaccactgtgagaaca

SEQ ID NO: 21588 - DNA, 71 bp, chicken (Gallus Gallus)
  misc_feature (36): n=c or g
attgtcttttggtgtcagactaagagtggctattangctataacagtgtctaattgtgaagttgcaggaga

SEQ ID NO: 21589 - DNA, 71 bp, chicken (Gallus Gallus)
  misc_feature (36): n=a or g
ctctgaggattctattctaagcaacaggaagaaggnaaaaaccgagcatgtatagttaacctggggaaata

SEQ ID NO: 21590 - DNA, 71 bp, chicken (Gallus Gallus)
  misc_feature (36): n=c or t
atccagccctgtggtgcattactttagaaaaacagnagagttgcagtatagttgcatccagcagtacacca

SEQ ID NO: 21591 - DNA, 71 bp, chicken (Gallus Gallus)
  misc_feature (36): n=c or t
tgagattaaatttgtttgagtcattttgggtacttngtcaggtctatggaatgttgcaaccccatggtgca

SEQ ID NO: 21592 - DNA, 71 bp, chicken (Gallus Gallus)
  misc_feature (36): n=c or t
tgtaatgataagaggtattttgatttttagtacagnagtggaatgttggggaaagtgcaggaagatgcagg

SEQ ID NO: 21593 - DNA, 71 bp, chicken (Gallus Gallus)
  misc_feature (36): n=c or t
tttatttaacaaagcatcgggggggtggggggcttncttttatttcttccccattatttttaggttttgtt

SEQ ID NO: 21594 - DNA, 71 bp, chicken (Gallus Gallus)
  misc_feature (36): n=c or t
tggctcttattcctttccacttctttgggcaattangctttttaaattaagagcttgggtgaattgtggtt

SEQ ID NO: 21595 - DNA, 71 bp, chicken (Gallus Gallus)
  misc_feature (36): n=c or t
ctggattaatcattggcaaaggcaatgtatctttangtatatgtgcatctctacgttaaaaaaaatgataa

SEQ ID NO: 21596 - DNA, 71 bp, chicken (Gallus Gallus)
  misc_feature (36): n=c or t
cagtacccagtggtctgcctcagctgtgtcctccanttagcttacagcccttgatctttttccctctaaag

SEQ ID NO: 21597 - DNA, 71 bp, chicken (Gallus Gallus)
  misc_feature (36): n=a or t
gatacttgcctttagctttaagactgaaaacagagnacttacataagtcacagatttatgagagaagcaag

SEQ ID NO: 21598 - DNA, 71 bp, chicken (Gallus Gallus)
  misc_feature (36): n=g or t
tgtgcactgaagctcatggtgtgtgtgtggtgtgtntctcatgttcacggtgcatgcaaagcccacacatg

SEQ ID NO: 21599 - DNA, 71 bp, chicken (Gallus Gallus)
  misc_feature (36): n=a or g
gaatgatttttggctgctgagaatctcaacagggantggtgtagtagagatgtgggtatgcatgagcatga

SEQ ID NO: 21600 - DNA, 71 bp, chicken (Gallus Gallus)
  misc_feature (36): n=a or g
cacataaaataggccttcagaaaatgaaaccatggnaaatcattaacatgagtgctctccctgagtcactg

SEQ ID NO: 21601 - DNA, 71 bp, chicken (Gallus Gallus)
  misc_feature (36): n=g or t
ctctttttaccaaaggaagcattttggtctgagatntctttttagttgatgtgctgcctaaataatttatg

SEQ ID NO: 21602 - DNA, 71 bp, chicken (Gallus Gallus)
  misc_feature (36): n=c or t
gtttaaaataaaactgaaaggttcttatgatgcatngaacattacaggcagcatgggaaagtgagggctct

SEQ ID NO: 21603 - DNA, 71 bp, chicken (Gallus Gallus)
  misc_feature (36): n=c or t
ataaatacatttttaatctccggcaccgtatgcttncaagacaattcacttcagaagtttcaaatgccttt

SEQ ID NO: 21604 - DNA, 71 bp, chicken (Gallus Gallus)
  misc_feature (36): n=c or t
aacacaggccattagcactttatgttgccagaggcntcagtgggagtgcaggtaagaatactggctttcag

SEQ ID NO: 21605 - DNA, 71 bp, chicken (Gallus Gallus)
  misc_feature (36): n=c or g
gaaggaacttaaaggccttggtgaaaggcggcacantcctgcccccagctcagacccgctgtcagctgctg

SEQ ID NO: 21606 - DNA, 71 bp, chicken (Gallus Gallus)
  misc_feature (36): n=a or g
gcaactgattgccccaaagaactcagagctaatggngacgcaatgccccaaaataaaaccagaagaatcaa

SEQ ID NO: 21607 - DNA, 71 bp, chicken (Gallus Gallus)
  misc_feature (36): n=c or g
agctatacatttaggaacagggagcgcaacctgacntacaaagcaggaagaggcacaagaaaacacctaca

SEQ ID NO: 21608 - DNA, 71 bp, chicken (Gallus Gallus)
  misc_feature (36): n=a or g
aagctgagcaaccccaattcactgaatcaccctacncttttaagattatgatgatccttgggtttcatctc

SEQ ID NO: 21609 - DNA, 71 bp, chicken (Gallus Gallus)
  misc_feature (36): n=a or g
acagaacttttaataatatattactaagtcagaatncacaaagatctgtattgcctgaaatgcaaaccgct

SEQ ID NO: 21610 - DNA, 71 bp, chicken (Gallus Gallus)
  misc_feature (36): n=c or t
acaagacaaccgtttcttttaaaggggaacatgcantgtgtcgtatgtgtttagaacccagcacaacgacc

SEQ ID NO: 21611 - DNA, 71 bp, chicken (Gallus Gallus)
  misc_feature (36): n=c or t
agggacaggcaatcaagagcaaactgggagcgcagnaggcatttgatacaggagcaggaaaagcaggcacc

SEQ ID NO: 21612 - DNA, 71 bp, chicken (Gallus Gallus)
  misc_feature (36): n=c or g
cctctgtgtggtgtcctccttgaaaaatagcatctngtctaagagactatttacggactgcagcttaacaa

SEQ ID NO: 21613 - DNA, 71 bp, chicken (Gallus Gallus)
  misc_feature (36): n=a or g
agacatgtccaatgtgagacttcagtttagctgcangcataattcatactatcaataaatcatctgccaca

SEQ ID NO: 21614 - DNA, 71 bp, chicken (Gallus Gallus)
  misc_feature (36): n=a or g
taagcaccttcagatagagaatacttatccattcancaaggcacacagagaggccaacaccaagcatcccc

SEQ ID NO: 21615 - DNA, 71 bp, chicken (Gallus Gallus)
  misc_feature (36): n=c or t
atacaggattttgattcaagtactaggcataaaaangtctgcttgcaaacaggtttcctagggaataccat

SEQ ID NO: 21616 - DNA, 71 bp, chicken (Gallus Gallus)
  misc_feature (36): n=c or t
gtaaataaaccagttaggtaagcaggaactgccacnacaggtccttcaacccagtcagtaagatcctttat

SEQ ID NO: 21617 - DNA, 71 bp, chicken (Gallus Gallus)
  misc_feature (36): n=a or g
gagggtgatactgcagaggtgcagggaagagatgcnaaagattggaactgtaaggaatgactgtaagaaca

SEQ ID NO: 21618 - DNA, 71 bp, chicken (Gallus Gallus)
  misc_feature (36): n=c or t
gcatgcagtctattgtgatggccatatccacagcantcctcaccccaggagcagagaaacaatactgcatt

SEQ ID NO: 21619 - DNA, 71 bp, chicken (Gallus Gallus)
  misc_feature (36): n=g or t
tctgtgattctaagctttggttcctcatcctcacgnaaaagcaacatggcatgagggcttaactggggacc

SEQ ID NO: 21620 - DNA, 71 bp, chicken (Gallus Gallus)
  misc_feature (36): n=c or t
aacttcgcttccaacacagcccagttactgctatantattgtcacccagtatcaatggatcacaatggctc

SEQ ID NO: 21621 - DNA, 71 bp, chicken (Gallus Gallus)
  misc_feature (36): n=a or g
ttatatgcttgtatagcatataatacagtaaatccncactaaatttctaaaacacaaatccctattttttc

SEQ ID NO: 21622 - DNA, 71 bp, chicken (Gallus Gallus)
  misc_feature (36): n=c or t
cactttctactttttgtttcacagcctccttcatangtaaggaaagctgatatggggaaatattattttgc

SEQ ID NO: 21623 - DNA, 71 bp, chicken (Gallus Gallus)
  misc_feature (36): n=c or t
ccttaaagcatgcatcctcactgtgttcccattccnacaagctgcatattgtttttgcattaggactaaat

SEQ ID NO: 21624 - DNA, 71 bp, chicken (Gallus Gallus)
  misc_feature (36): n=c or t
ctgaatgtcacgtggactgctttttcacctccttanaagttttctcaagggatttttctactaactgatgt

SEQ ID NO: 21625 - DNA, 71 bp, chicken (Gallus Gallus)
  misc_feature (36): n=a or g
tctgtgcttttctatgttgtttcagtggactttgcnctctctcccaggtggcattttctccttatagtgat

SEQ ID NO: 21626 - DNA, 71 bp, chicken (Gallus Gallus)
  misc_feature (36): n=c or t
tttttgtaataatgttaccatgccccaagaatacanacattcttaaaaaaaaaaaaaatccagaaaggcta

SEQ ID NO: 21627 - DNA, 71 bp, chicken (Gallus Gallus)
  misc_feature (36): n=c or g
atcagcaggggactaatacgacatgggagctacagnccaggcaatgaaaaacattataggcacagtggagg

SEQ ID NO: 21628 - DNA, 71 bp, chicken (Gallus Gallus)
  misc_feature (36): n=c or t
gtgctactgtccttatgtttgcattgaggattctgngtttgcacattctgcatagactcgctgtcaagctt

SEQ ID NO: 21629 - DNA, 71 bp, chicken (Gallus Gallus)
  misc_feature (36): n=a or g
cctcagacaagcaggcttattgctgagtgtaccacngctctctgtcactatgaaaatgtcacagttggttt

SEQ ID NO: 21630 - DNA, 71 bp, chicken (Gallus Gallus)
  misc_feature (36): n=c or t
ctactaagagtgtcagtcatattagttaccctaacnccttgacttctgtatttgttgctagtatttctgga

SEQ ID NO: 21631 - DNA, 71 bp, chicken (Gallus Gallus)
  misc_feature (36): n=a or g
gggtcagaattttacccaggctgctcatactgtacntgattcaaaaactgcaagcagttgcaaacagggag

SEQ ID NO: 21632 - DNA, 71 bp, chicken (Gallus Gallus)
  misc_feature (36): n=a or g
gcctggtcacattatactaacttttaataactgtgnagggatttccagatgactgaaaatgcactaggact

SEQ ID NO: 21633 - DNA, 71 bp, chicken (Gallus Gallus)
  misc_feature (36): n=c or t
tccattctgcagtgaagcttcttcagtcctgccacnaatcttatcaatctattttgcctattaacttttaa

SEQ ID NO: 21634 - DNA, 71 bp, chicken (Gallus Gallus)
  misc_feature (36): n=a or c
gtttggttactatagggacagtttgtctgattcttntgtttgctaatgtatcaagtgacgcatcggcagct

SEQ ID NO: 21635 - DNA, 71 bp, chicken (Gallus Gallus)
  misc_feature (36): n=c or t
taaagctgtagagcttgaagcaagttctactagatncaatgctaaaacaagtgccttatggtgggatttga

SEQ ID NO: 21636 - DNA, 71 bp, chicken (Gallus Gallus)
  misc_feature (36): n=c or t
gcagtgctcatcaggtggtggacttcagatactccnagtggtcatgcagtaagccaaatgctgctcttgaa

SEQ ID NO: 21637 - DNA, 71 bp, chicken (Gallus Gallus)
  misc_feature (36): n=c or t
tctgaaccatttatgaaaatactgaagaaaactgtncctaaaatggaaccctgcagagccccacaagtcac

SEQ ID NO: 21638 - DNA, 71 bp, chicken (Gallus Gallus)
  misc_feature (36): n=a or g
tcatcaataaagcattcatattgaccagaacttagnaccacctggatggcaggatgctgacacttagcttc

SEQ ID NO: 21639 - DNA, 71 bp, chicken (Gallus Gallus)
  misc_feature (36): n=c or t
tactaaattcatttgttcttaccctcatcaacccangcacacctgacatacgtgggcttcgatacgtaagt

SEQ ID NO: 21640 - DNA, 71 bp, chicken (Gallus Gallus)
  misc_feature (36): n=g or t
aagattctgttttccatccccttgatagagctcagngatttggcagacaaaaattccccgatactgagatt

SEQ ID NO: 21641 - DNA, 71 bp, chicken (Gallus Gallus)
  misc_feature (36): n=a or c
catatagattcttaattttctaaatctccagtcacngcagtagcttccttacctgcacagaccttcccgtc

SEQ ID NO: 21642 - DNA, 71 bp, chicken (Gallus Gallus)
  misc_feature (36): n=a or t
tgatgaacttggtgatattgtgagccttttcccacnggaacatttttccaagtagtagtacttttcaagtc

SEQ ID NO: 21643 - DNA, 71 bp, chicken (Gallus Gallus)
  misc_feature (36): n=c or t
atcaagcctttttaactcacacattatcattacagnggtgtagcccacattttgcataatagcctggtggt

SEQ ID NO: 21644 - DNA, 71 bp, chicken (Gallus Gallus)
  misc_feature (36): n=c or g
tctccctcagttttacctgccttattttcttctccnctcgctgccttttcttaagcacgcagttgcatata

SEQ ID NO: 21645 - DNA, 71 bp, chicken (Gallus Gallus)
  misc_feature (36): n=a or g
aatctgtttctggcgaactccattatatgttagaanctagaaaatgaaaacgaaatcctagtaccatgctc

SEQ ID NO: 21646 - DNA, 71 bp, chicken (Gallus Gallus)
  misc_feature (36): n=a or g
gatgctccgagcttctttttaaaatctctccatgtnaactaattcatgtgctctaggacattactgtattg

SEQ ID NO: 21647 - DNA, 71 bp, chicken (Gallus Gallus)
  misc_feature (36): n=c or t
gtggagtccctcaacaggaagtatgctcctgtgtcntacttggcaagtaatagctttacatatatattctg

SEQ ID NO: 21648 - DNA, 71 bp, chicken (Gallus Gallus)
  misc_feature (36): n=c or t
atttaaagaaaatgctatattttcctttcagtttanagtctttcaaccctgcaaagcagtttggtaataaa

SEQ ID NO: 21649 - DNA, 71 bp, chicken (Gallus Gallus)
  misc_feature (36): n=c or t
tcacaactaatttgaaaaataataattacacctttncacactgtgaacaaagagatcgctagcaatatctc

SEQ ID NO: 21650 - DNA, 71 bp, chicken (Gallus Gallus)
  misc_feature (36): n=g or t
ttcatattcagcagtgtgagagaatggcaaggattncagtgggcttggtgaggtaaataatagaattgttt

SEQ ID NO: 21651 - DNA, 71 bp, chicken (Gallus Gallus)
  misc_feature (36): n=a or g
tccaaagaggctacactgacttcatgacccccagtngcagcttaagcaggaacttcctatcacagtagctt

SEQ ID NO: 21652 - DNA, 71 bp, chicken (Gallus Gallus)
  misc_feature (36): n=a or t
ccacaaagtaactgacacctataaacagaaaaatgnaaatgagtcaggattttatcctttgaatataatgc

SEQ ID NO: 21653 - DNA, 71 bp, chicken (Gallus Gallus)
  misc_feature (36): n=a or g
gtgagacaggagtaccaggttgcagtggataaccantatctatgaatatgtgctaatttgtttgggttaag

SEQ ID NO: 21654 - DNA, 71 bp, chicken (Gallus Gallus)
  misc_feature (36): n=a or g
acaacagtggtacaatgccagaccagatacctcatnaaacaccaaaggtagtggtccaagtaatgccatat

SEQ ID NO: 21655 - DNA, 71 bp, chicken (Gallus Gallus)
  misc_feature (36): n=c or t
catttggcagccagatttgagaaatccaggagaganatcgttctccaagagtgactcaaactcctcaagtc

SEQ ID NO: 21656 - DNA, 71 bp, chicken (Gallus Gallus)
  misc_feature (36): n=a or g
ctgaagaagcatctcaactcacatgaaggaaagagngactatgtctgtgaaaaatgcaccaaggcttatct

SEQ ID NO: 21657 - DNA, 71 bp, chicken (Gallus Gallus)
  misc_feature (36): n=c or t
ggctggtgggaaatcttaagattgtgtatcttaatnctgaaaacattattacttattcactgttttatttt

SEQ ID NO: 21658 - DNA, 71 bp, chicken (Gallus Gallus)
  misc_feature (36): n=c or t
ccagaaactattatgctggtttttctgtctcccccntgtctctcaccttcttagatgatcttcattaagaa

SEQ ID NO: 21659 - DNA, 71 bp, chicken (Gallus Gallus)
  misc_feature (36): n=a or c
aagcaacagcagttgaagagagacctgcaaaactgngcctgccaatttttactgatcttcttcccaccagc

SEQ ID NO: 21660 - DNA, 71 bp, chicken (Gallus Gallus)
  misc_feature (36): n=a or g
aaactgccgttgaatacacactccctgcaccacacnggatcaagccttactaaaaaagaaaatggagcaag

SEQ ID NO: 21661 - DNA, 71 bp, chicken (Gallus Gallus)
  misc_feature (36): n=a or c
cagccgtgtttggcactcctcctcgagtcaggccanctatttatagcaaaacatttcttcagagcgttttg

SEQ ID NO: 21662 - DNA, 71 bp, chicken (Gallus Gallus)
  misc_feature (36): n=a or t
ttagcttgtgaatttgcctatgtttcctgtgtgatntggtatgtacaagacacctgcttgcgttgtttctt

SEQ ID NO: 21663 - DNA, 71 bp, chicken (Gallus Gallus)
  misc_feature (36): n=c or t
atccaaagtacccaaatcacaagaaatacaatagtntttgaactatcatatcatatctgatttatgctgat

SEQ ID NO: 21664 - DNA, 71 bp, chicken (Gallus Gallus)
  misc_feature (36): n=a or g
catatttcaattgagccctcttctgtatattgtatncacatttaaatctgaaaaacaatatacatatatat

SEQ ID NO: 21665 - DNA, 71 bp, chicken (Gallus Gallus)
  misc_feature (36): n=c or t
ccaggtaaattctctgctattcccatatctacaatntatttatttattttcatctataggtacatcacatc

SEQ ID NO: 21666 - DNA, 71 bp, chicken (Gallus Gallus)
  misc_feature (36): n=c or t
gaactagtgctagcagcagaaattagaagcaaatangacattctacaaaaggcaggtaaattgaaaggata

SEQ ID NO: 21667 - DNA, 71 bp, chicken (Gallus Gallus)
  misc_feature (36): n=a or t
aagcacactgatgaaggaaaaagagacagtacaganttttttccgtgtttacaaaagtctgctctttttac

SEQ ID NO: 21668 - DNA, 71 bp, chicken (Gallus Gallus)
  misc_feature (36): n=g or t
ttactaaaatgtactttggatgtgccaataaggctncatcgtttcatttgtcacagctgcagtagtaaaaa

SEQ ID NO: 21669 - DNA, 71 bp, chicken (Gallus Gallus)
  misc_feature (36): n=c or g
catcaaactgcagctgttcaagcttcaatgaagaantttcatttttgttctttttaagtaccagttactta

SEQ ID NO: 21670 - DNA, 71 bp, chicken (Gallus Gallus)
  misc_feature (36): n=c or g
cttcaagtttgcatctttgcctctttgcagagcttnaacagttatacaaaagcgcaactgcaaaactagcc

SEQ ID NO: 21671 - DNA, 71 bp, chicken (Gallus Gallus)
  misc_feature (36): n=a or c
aaatcaaaaagctgtgttttcaaatatgaaggacancttttttactttagaaatgatgtagaactagttac

SEQ ID NO: 21672 - DNA, 71 bp, chicken (Gallus Gallus)
  misc_feature (36): n=a or c
cagtcatgcacttcccttgtaataagtgataacaanttctgcagaatggcaaaaagtaagaataatttatc

SEQ ID NO: 21673 - DNA, 71 bp, chicken (Gallus Gallus)
  misc_feature (36): n=c or t
aacttaattagaatttgtatcttctacagtctcccntacatttaaatttccatcccacactttaacacctt

SEQ ID NO: 21674 - DNA, 71 bp, chicken (Gallus Gallus)
  misc_feature (36): n=c or t
atggtataaaacagagaccataacagacaaagcttntgattactttgactgtctctggaccagaagtccac

SEQ ID NO: 21675 - DNA, 71 bp, chicken (Gallus Gallus)
  misc_feature (36): n=c or t
tgaaaaacttctccccccaaagaaaactgctttgtnctaaccaattttgcttgcattaagccacagctgca

SEQ ID NO: 21676 - DNA, 71 bp, chicken (Gallus Gallus)
  misc_feature (36): n=a or g
aaacagtttctctgtgtatggagtattgtgtaatanagatggtaaagcttaagagaaccctgagaacaagc

SEQ ID NO: 21677 - DNA, 71 bp, chicken (Gallus Gallus)
  misc_feature (36): n=c or g
acccagtcgtctgaatgattcagatgtattttctcnaagtctagttcactggattgtacgtaaatgatatt

SEQ ID NO: 21678 - DNA, 71 bp, chicken (Gallus Gallus)
  misc_feature (36): n=a or t
aaagagcaggatgcagccaattacagaaggcagaantcattactgcttgtgtccttgtccccctcaacact

SEQ ID NO: 21679 - DNA, 71 bp, chicken (Gallus Gallus)
  misc_feature (36): n=a or g
ttcttctgaacccatcttccccaggagccctcctcnaagatcacctgcttgtacacttcgttctcccccaa

SEQ ID NO: 21680 - DNA, 71 bp, chicken (Gallus Gallus)
  misc_feature (36): n=a or g
atagtttatctgccttatacaaaagcacccccacanacatccccaatggaaccacatcgacagttagacgt

SEQ ID NO: 21681 - DNA, 71 bp, chicken (Gallus Gallus)
  misc_feature (36): n=c or t
ggtaggattcaagaaaatcaagtaagattgttagantgctcctaccaggcagaatttcatttcacagaatc

SEQ ID NO: 21682 - DNA, 71 bp, chicken (Gallus Gallus)
  misc_feature (36): n=c or t
ttttcccttccagattccatgatgcagtttgaagangctgttattattccaggaggaaacagaaggcccag

SEQ ID NO: 21683 - DNA, 71 bp, chicken (Gallus Gallus)
  misc_feature (36): n=a or g
actgaacagaacgaagacagtgaacagcgtatctcntttgtctttccttggtgaacaaactcacttcttgc

SEQ ID NO: 21684 - DNA, 71 bp, chicken (Gallus Gallus)
  misc_feature (36): n=a or g
ctgtcaagtgcttccctgatgaacgagtggcactgncatatatttactacattttttgattagcaatcaga

SEQ ID NO: 21685 - DNA, 71 bp, chicken (Gallus Gallus)
  misc_feature (36): n=a or g
agtgagtaagaagcttgaaatatgtacctgtattgngatacagagtcttcagttggcagctgttcctgaat

SEQ ID NO: 21686 - DNA, 71 bp, chicken (Gallus Gallus)
  misc_feature (36): n=c or t
agtttattatttgcaaaacagaatactttaaagatncagtcatcagtcttagcttaccaatattcccattt

SEQ ID NO: 21687 - DNA, 71 bp, chicken (Gallus Gallus)
  misc_feature (36): n=g or t
ttatcaacacagacctcaggacgcagagtcttctcntgattcccaaaacggcccttatgctactaggtagg

SEQ ID NO: 21688 - DNA, 71 bp, chicken (Gallus Gallus)
  misc_feature (36): n=c or t
tcttcctcctgtttgggtcagagttcaataagcctntaactcgatggtgagtctgggcgcagagcacctcg

SEQ ID NO: 21689 - DNA, 71 bp, chicken (Gallus Gallus)
  misc_feature (36): n=c or t
tttggtgtcttcgtgactctgggggagaaaagaccncagtgtgaagtaaaacaggaagttctgctacaaat

SEQ ID NO: 21690 - DNA, 71 bp, chicken (Gallus Gallus)
  misc_feature (36): n=a or t
tctgaaattaaggagaggaagacctgttggtaaagntatttgaaactacgctgtgggaaagcaaacacggt

SEQ ID NO: 21691 - DNA, 71 bp, chicken (Gallus Gallus)
  misc_feature (36): n=c or t
taaagatgttggtgtaatacttttgtgtgttttgtngttgttgtcatttttaataaactaaaaggaaatag

SEQ ID NO: 21692 - DNA, 71 bp, chicken (Gallus Gallus)
  misc_feature (36): n=c or g
aactggaggcagaagaggatggctgctatgaaatantccagtatccttcctcagctttgaatggcagggaa

SEQ ID NO: 21693 - DNA, 71 bp, chicken (Gallus Gallus)
  misc_feature (36): n=c or t
ggtgttcctggaagcaaaatagggcctgaaatccanaccaccaactctgaaatctaaagaaatatcttgaa

SEQ ID NO: 21694 - DNA, 71 bp, chicken (Gallus Gallus)
  misc_feature (36): n=c or t
agatacgagatggaagttaattgcagaggcagattngtgttgattctcctccaaaaactcgttccttgtag

SEQ ID NO: 21695 - DNA, 71 bp, chicken (Gallus Gallus)
  misc_feature (36): n=a or g
tggtgcatcaagttcaggtctactttaactctttgntgatgttgccaatatctgaatccagccaagtggga

SEQ ID NO: 21696 - DNA, 71 bp, chicken (Gallus Gallus)
  misc_feature (36): n=c or g
gtgttcagtccctttatgatgggaggcttgcttctnttgaaggttagtaattgtacctttgtgaaattttc

SEQ ID NO: 21697 - DNA, 71 bp, chicken (Gallus Gallus)
  misc_feature (36): n=c or t
tgtagcacattgttgacataaaggcagggagattgntcaccagttaccatcatgattgaagcagatttggc

SEQ ID NO: 21698 - DNA, 71 bp, chicken (Gallus Gallus)
  misc_feature (36): n=g or t
atgaggctcctctgtttggaaatgaagatgtgcaanagggtttgtggcagactgtgtaggtagatagattt

SEQ ID NO: 21699 - DNA, 71 bp, chicken (Gallus Gallus)
  misc_feature (36): n=a or g
atagagttgtggtaaaagcagttcgggttttagaanaggtcacataaaatgttcttcaatgctgcatgata

SEQ ID NO: 21700 - DNA, 71 bp, chicken (Gallus Gallus)
  misc_feature (36): n=c or t
agaacaggtcagttacactggaaggatgcttagcantgaaaagggctggccaaaatccatcacactttcaa

SEQ ID NO: 21701 - DNA, 71 bp, chicken (Gallus Gallus)
  misc_feature (36): n=a or g
gaagttgaaagccacagtgattcttgatcctggaangtctaatagggacttctccccatctgcactgagca

SEQ ID NO: 21702 - DNA, 71 bp, chicken (Gallus Gallus)
  misc_feature (36): n=g or t
tttgcactggattaccttttctgttgttaaatggantccagaagagcatcttgctgagtgttaatccatat

SEQ ID NO: 21703 - DNA, 71 bp, chicken (Gallus Gallus)
  misc_feature (36): n=c or t
agcagagggctttgcaggtaagtttattctgcttcntcttctgggaaaaggaaaacggggcttttctaaag

SEQ ID NO: 21704 - DNA, 71 bp, chicken (Gallus Gallus)
  misc_feature (36): n=c or t
accagatcaaatcaatgaaattgcaacagaattccnagcatagtgtcagccaacatctgcctagaatctca

SEQ ID NO: 21705 - DNA, 71 bp, chicken (Gallus Gallus)
  misc_feature (36): n=a or g
gagtttgtgaaatgtctttattatttacagaatcangaaacaaatcaagattgaagaaagtgatttcattt

SEQ ID NO: 21706 - DNA, 71 bp, chicken (Gallus Gallus)
  misc_feature (36): n=c or t
ttgcatatatgtacatgtccagattctataagtcantcatacttcaaggatgcattcattatgtcaatgct

SEQ ID NO: 21707 - DNA, 71 bp, chicken (Gallus Gallus)
  misc_feature (36): n=a or c
aataatatgtttgatctacatgaaattttgtatttnttttgtgctgtttaaacctaaagttatgcaatgtt

SEQ ID NO: 21708 - DNA, 71 bp, chicken (Gallus Gallus)
  misc_feature (36): n=c or t
taataactttccaacatgttttaaaacaggtattanaactgggcattggctgctccaatgattctgagttt

SEQ ID NO: 21709 - DNA, 71 bp, chicken (Gallus Gallus)
  misc_feature (36): n=a or c
ctccccctgtgctcccagcacacactggggtacccntgtcctctacagcaacttctgcaccgttaccccca

SEQ ID NO: 21710 - DNA, 71 bp, chicken (Gallus Gallus)
  misc_feature (36): n=c or t
gattacataattccttcctttgcattctatttctgngtttcatcaagcataccattagcattttggagatt

SEQ ID NO: 21711 - DNA, 71 bp, chicken (Gallus Gallus)
  misc_feature (36): n=c or t
ttgacagcctgagaataaagctatgaagtactattnaagtcttctacacatttttcctcatagtcaataga

SEQ ID NO: 21712 - DNA, 71 bp, chicken (Gallus Gallus)
  misc_feature (36): n=c or t
ggatctcctaacagaacctaatgtgaaaactcagtnccatagtgttaatcactggaataggctccccatga

SEQ ID NO: 21713 - DNA, 71 bp, chicken (Gallus Gallus)
  misc_feature (36): n=g or t
gtagttcaattgagtaatacattctggtgggttttntgtgtgtgtgtgtgtgtgtgtgtgtgtttatgtgt

SEQ ID NO: 21714 - DNA, 71 bp, chicken (Gallus Gallus)
  misc_feature (36): n=a or g
gacttgggttctctatgaaggtatatattaaggagngcattcttatttcaagggtcctctctgctgctttc

SEQ ID NO: 21715 - DNA, 71 bp, chicken (Gallus Gallus)
  misc_feature (36): n=c or t
ctcaaattatagttgccaaagatacaaaacagaccnaaatctttattatatgcagatgttttatttcactt

SEQ ID NO: 21716 - DNA, 71 bp, chicken (Gallus Gallus)
  misc_feature (36): n=c or t
ttaatttaccatcagtttttatcagttaggatttcnctttcacaggtggtagctgagtctgttgcagtgcg

SEQ ID NO: 21717 - DNA, 71 bp, chicken (Gallus Gallus)
  misc_feature (36): n=a or c
aattgtattaaattgcacaaacaaacttgtattgtnagactggtggtagtcaaatgccagacagtttataa

SEQ ID NO: 21718 - DNA, 71 bp, chicken (Gallus Gallus)
  misc_feature (36): n=a or t
cagaatggagtaactaattgcatttggagtgcgtgngcagtggtctttattgactagagcccttaaactgg

SEQ ID NO: 21719 - DNA, 71 bp, chicken (Gallus Gallus)
  misc_feature (36): n=a or t
ctaaacaaaatataaccaactgaacaaaaattaaantaaaaaaaaaaaatccctagatgtttagaagttat

SEQ ID NO: 21720 - DNA, 71 bp, chicken (Gallus Gallus)
  misc_feature (36): n=g or t
cttaaatgggatgaggttagcaatttagcagtagancagaatgaaacacgattccggaaaagtgcacaatg

SEQ ID NO: 21721 - DNA, 71 bp, chicken (Gallus Gallus)
  misc_feature (36): n=c or t
gagggtcaacatacagtatagcctagacatcagagnaacttcctttctgcatatttaccctctttgtcact

SEQ ID NO: 21722 - DNA, 71 bp, chicken (Gallus Gallus)
  misc_feature (36): n=c or t
atgcactgtctcaaacaccatcagtatttcctgtanatcatcactgcctaccgggcaccattggaaatagg

SEQ ID NO: 21723 - DNA, 71 bp, chicken (Gallus Gallus)
  misc_feature (36): n=a or g
atgattgactcctattcaaaaatatcagtatgtatnatttttctgtgcacttgatcaaacagttatagcca

SEQ ID NO: 21724 - DNA, 71 bp, chicken (Gallus Gallus)
  misc_feature (36): n=a or c
tggggagaacatgtaaaatatagggcatacatgccntgcccctgtaaacctcccagattctggcagtcagt

SEQ ID NO: 21725 - DNA, 71 bp, chicken (Gallus Gallus)
  misc_feature (36): n=c or t
tgcctccatgagtaactaaaagcacctttagagaangagatcagagcaagtatgtatagggacacttccca

SEQ ID NO: 21726 - DNA, 71 bp, chicken (Gallus Gallus)
  misc_feature (36): n=a or g
tatttataagcgtgtatgttccttcacagatcagcnaaaagattacttgatcaaatagttgaaaagggaag

SEQ ID NO: 21727 - DNA, 71 bp, chicken (Gallus Gallus)
  misc_feature (36): n=a or c
tgcctttcttaaaggggggagaaggatccttgaggngaagccagaagggctcatcaggagggcttcagaag

SEQ ID NO: 21728 - DNA, 71 bp, chicken (Gallus Gallus)
  misc_feature (36): n=c or t
acattctcccaaatattttttttgatactagagtanttagaaaaaactattcttgtcaccctctgtctccc

SEQ ID NO: 21729 - DNA, 71 bp, chicken (Gallus Gallus)
  misc_feature (36): n=a or g
aatatcataaaatcagctcattcctgcttttatganggctgctccagaggtaatgcctcttattttattat

SEQ ID NO: 21730 - DNA, 71 bp, chicken (Gallus Gallus)
  misc_feature (36): n=g or t
gttatgttgtccccttttccaagggtcaacattgcntatgatgcattttccagtattcgtgtaaaagtctg

SEQ ID NO: 21731 - DNA, 71 bp, chicken (Gallus Gallus)
  misc_feature (36): n=a or t
tttttccttttttttttctttttttttcaggaagangatgtcagattttagggactggaatcttttttttg

SEQ ID NO: 21732 - DNA, 71 bp, chicken (Gallus Gallus)
  misc_feature (36): n=a or g
gctgtgttcacggaaaactgatgatctgtccattcngtgttacaggaagattgtttctttttttttttttt

SEQ ID NO: 21733 - DNA, 71 bp, chicken (Gallus Gallus)
  misc_feature (36): n=c or t
attttaatgtggataagtccctttaaaattctgctncacctccacacctttttcacgtggcctctttttct

SEQ ID NO: 21734 - DNA, 71 bp, chicken (Gallus Gallus)
  misc_feature (36): n=c or g
caagcagcctgtaacagaggctccattctacgtcanaggaaattacattactaaatgtataaatgactatt

SEQ ID NO: 21735 - DNA, 71 bp, chicken (Gallus Gallus)
  misc_feature (36): n=c or t
ccttgagctgtgggactgatcttatccttcccattngacttttccctcaaccagtgagaaaagcaggacaa

SEQ ID NO: 21736 - DNA, 71 bp, chicken (Gallus Gallus)
  misc_feature (36): n=c or t
aagccacaagacaaaagggaaaaaaaaaactgatangaggtgcagaatgcattgtaaagcaaagacttgac

SEQ ID NO: 21737 - DNA, 71 bp, chicken (Gallus Gallus)
  misc_feature (36): n=c or g
cctgggcatataacataacaataagctaatcttgtngagtttgtttgttttcaagtcgcacaaaatgtaaa

SEQ ID NO: 21738 - DNA, 71 bp, chicken (Gallus Gallus)
  misc_feature (36): n=c or t
ctgcatttgattttgatatttgctctcaagaaatgnttatatacagttaagctgaaatactgaatacttgg

SEQ ID NO: 21739 - DNA, 71 bp, chicken (Gallus Gallus)
  misc_feature (36): n=g or t
taaagaaaggaggaatttcttgtcaattaaaatagncaatgagaataaaaacaaagcacaacgtcttgttt

SEQ ID NO: 21740 - DNA, 71 bp, chicken (Gallus Gallus)
  misc_feature (36): n=a or c
aacattgtttttttcattgaagctgaaaacttgaanagagatcagtgttgtaaatgaggattgctcattgc

SEQ ID NO: 21741 - DNA, 71 bp, chicken (Gallus Gallus)
  misc_feature (36): n=c or t
gaattggacacaagcacagtgcatgttatatcttcntggacacatcaaatgggaaaaaatagtttgtaact

SEQ ID NO: 21742 - DNA, 71 bp, chicken (Gallus Gallus)
  misc_feature (36): n=c or t
tgagtctgcacaagtctgatgatgaggacgtggtantggtgggctattctctgccccgtggggactcccta

SEQ ID NO: 21743 - DNA, 71 bp, chicken (Gallus Gallus)
  misc_feature (36): n=a or g
gataatgtttgtccaaggatcatggtcagatttagncaccagagtgtgaggggagcctcaggcaccctggg

SEQ ID NO: 21744 - DNA, 71 bp, chicken (Gallus Gallus)
  misc_feature (36): n=a or c
aaagagacctggatgtcagttcctcctttctttgcncaactttaaccattcagaatgaaattaaccttgct

SEQ ID NO: 21745 - DNA, 71 bp, chicken (Gallus Gallus)
  misc_feature (36): n=a or g
aactgccatttccaagtgttctgtcttctgctcttntttgctctgttgttcacgctgcttaacttctcaat

SEQ ID NO: 21746 - DNA, 71 bp, chicken (Gallus Gallus)
  misc_feature (36): n=c or g
cagaccagttctctacttcactgaaatcttcacagnaattcagagacttcagatcttcaaagggttattga

SEQ ID NO: 21747 - DNA, 71 bp, chicken (Gallus Gallus)
  misc_feature (36): n=a or g
agctgacagatatcctcccactattaagaatcccantataaaagaaaatctttgtaatacaagtatccaag

SEQ ID NO: 21748 - DNA, 71 bp, chicken (Gallus Gallus)
  misc_feature (36): n=c or t
aatttcaaaatgcaaataaaccataatctgtctatnttaaatataatgttatttaggcaagtgtttggaag

SEQ ID NO: 21749 - DNA, 71 bp, chicken (Gallus Gallus)
  misc_feature (36): n=a or g
tgtcttccacaagaatcaccacactaaattctgacnataatgaggccatagtataaattttcttcagctga

SEQ ID NO: 21750 - DNA, 71 bp, chicken (Gallus Gallus)
  misc_feature (36): n=g or t
cgtgggccttgagcatcactcagctgtcagtccctntaacagcctgcactgacaaaactttcctcagcttt

SEQ ID NO: 21751 - DNA, 71 bp, chicken (Gallus Gallus)
  misc_feature (36): n=c or t
ttttttttaaatatcagggtcagttttatttagtgnaactcacataatctttatatcagactatatgtact

SEQ ID NO: 21752 - DNA, 71 bp, chicken (Gallus Gallus)
  misc_feature (36): n=c or t
caaagcttcctgtatcatccagaatatctctacagntttgtcttacaagtagtagttcaggaagttcaatt

SEQ ID NO: 21753 - DNA, 71 bp, chicken (Gallus Gallus)
  misc_feature (36): n=c or t
caacctaaagaaggcggaccaaaaaaatgaatttanatagtccatcttgtgttaccaaaacagggagcaat

SEQ ID NO: 21754 - DNA, 71 bp, chicken (Gallus Gallus)
  misc_feature (36): n=a or t
gatgcctgtcctcctagcctgcgggtgaatacagcngctgctgctctgtgagcaagggattgcagagaagg

SEQ ID NO: 21755 - DNA, 71 bp, chicken (Gallus Gallus)
  misc_feature (36): n=a or g
agcatttttttctttcccctgccccttgctcagtgnattttttttcatttccatttcacaccataatacag

SEQ ID NO: 21756 - DNA, 71 bp, chicken (Gallus Gallus)
  misc_feature (36): n=c or t
gctgctccttctcccctgtctactgtcttcatgcangtacatcattgccattgcattgtcccagaagcaca

SEQ ID NO: 21757 - DNA, 71 bp, chicken (Gallus Gallus)
  misc_feature (36): n=a or c
cctgagagctgcaggagctggagtcaacttggaganaatagttccacattgtaagtctgctgaatttttgg

SEQ ID NO: 21758 - DNA, 71 bp, chicken (Gallus Gallus)
  misc_feature (36): n=a or g
tatttaaataaaatatctgagtggcttaaaggaaanaggagatgtgcagcacttcaaatttagagcaatac

SEQ ID NO: 21759 - DNA, 71 bp, chicken (Gallus Gallus)
  misc_feature (36): n=a or g
agataacaaacactctgaagaactgaaagatataancaaaactatcaaagtctgttttttaaagtagcttg

SEQ ID NO: 21760 - DNA, 71 bp, chicken (Gallus Gallus)
  misc_feature (36): n=a or g
gaagtctgaaagaatcagtaagccatcaattataanaatatctgctgtttggcttttattttggacagtaa

SEQ ID NO: 21761 - DNA, 71 bp, chicken (Gallus Gallus)
  misc_feature (36): n=c or g
aatgcctgtaagtctggacatctttttggctggaanagttcttctctctgccctcacctcctcttttgctt

SEQ ID NO: 21762 - DNA, 71 bp, chicken (Gallus Gallus)
  misc_feature (36): n=a or g
agtttatgggtgcactgactacaagcactttgccanaaaaagtggttccaaagcctatgaacaggtagcag

SEQ ID NO: 21763 - DNA, 71 bp, chicken (Gallus Gallus)
  misc_feature (36): n=a or g
aagtcgccatctctgcagtatattcttagcaagctntaagatgagagctgatctgctagcagtcatgtagc

SEQ ID NO: 21764 - DNA, 71 bp, chicken (Gallus Gallus)
  misc_feature (36): n=a or c
acacctatcttgtcaacaaaagggttttgggggagnctaatttcttctggcagattaatgtttgcataaag

SEQ ID NO: 21765 - DNA, 71 bp, chicken (Gallus Gallus)
  misc_feature (36): n=c or t
tctaacatttcagaatgtgaataataattatgaggnctatattactatagaattgaaatgtttaaggtgag

SEQ ID NO: 21766 - DNA, 71 bp, chicken (Gallus Gallus)
  misc_feature (36): n=a or g
atcaggacaacttcatatctggagtactgcgtgtcntagagaaggtatttgtacagtacgcttgtagaagc

SEQ ID NO: 21767 - DNA, 71 bp, chicken (Gallus Gallus)
  misc_feature (36): n=a or g
aaatgtgtagtgtagatgttctagttgttgtatttncaatcccatcttttaccttgaatattctaattcct

SEQ ID NO: 21768 - DNA, 71 bp, chicken (Gallus Gallus)
  misc_feature (36): n=c or t
tttaacttaaagtgaagcttgatgtttatgcctgcngatagaaccagagttcttaatcctgcttcagaagg

SEQ ID NO: 21769 - DNA, 71 bp, chicken (Gallus Gallus)
  misc_feature (36): n=a or g
cttctgtattaaactctgactagatagcagcagacntaactcttccctgtcccatgactatgactattagt

SEQ ID NO: 21770 - DNA, 71 bp, chicken (Gallus Gallus)
  misc_feature (36): n=c or t
cccacatattcacaaagccataaacatttgcaatgnatttttatgaagagagcactgaagagcttgatctc

SEQ ID NO: 21771 - DNA, 71 bp, chicken (Gallus Gallus)
  misc_feature (36): n=c or t
tttgctgtctcatctaagtgggtttggaaaaaaaangtgtttggcagcatttttaaagtcaggtaaacttt

SEQ ID NO: 21772 - DNA, 71 bp, chicken (Gallus Gallus)
  misc_feature (36): n=c or g
ggtctctacatacaactattaaaaattctgaaaaantacattttaatagaaatggaaatgaagatgtgtaa

SEQ ID NO: 21773 - DNA, 71 bp, chicken (Gallus Gallus)
  misc_feature (36): n=a or t
agctgtggcaaaaactcatgaagttcacgggggatntagagatgcatacaaaatgaatagtgtacaagccc

SEQ ID NO: 21774 - DNA, 71 bp, chicken (Gallus Gallus)
  misc_feature (36): n=c or t
gtttggtgttgaatattcaatgagccaggcattgantggtcatttagtgcttattagtctggaaacttact

SEQ ID NO: 21775 - DNA, 71 bp, chicken (Gallus Gallus)
  misc_feature (36): n=a or g
cagcctttttaataagcgcacgccagtcatgccccnctcttatgactacgctgttaatgcagcagatgaat

SEQ ID NO: 21776 - DNA, 71 bp, chicken (Gallus Gallus)
  misc_feature (36): n=a or c
gagaaggcccagctggcctggtacagccctgtacanacgggtggtgctgattgagcagcagccaggtggat

SEQ ID NO: 21777 - DNA, 71 bp, chicken (Gallus Gallus)
  misc_feature (36): n=a or g
tgcacgaaaggagtattggtgaattgtaatgcacanccctgcagcatgtcctcgtgaacttgttatgagga

SEQ ID NO: 21778 - DNA, 71 bp, chicken (Gallus Gallus)
  misc_feature (36): n=g or t
ctggttatttaatgaaatattcaagagaatgagatntatattaaagaatcaactagaatttggtataactg

SEQ ID NO: 21779 - DNA, 71 bp, chicken (Gallus Gallus)
  misc_feature (36): n=c or t
gtagtgggatatttgtatttgttccagaccctatgncctctttcctggcagcagaaagattaagtttttgc

SEQ ID NO: 21780 - DNA, 71 bp, chicken (Gallus Gallus)
  misc_feature (36): n=a or g
acagaagataactgctaagtttctacagaagaacanttctccgttttataacaagaagagagaaattacca

SEQ ID NO: 21781 - DNA, 71 bp, chicken (Gallus Gallus)
  misc_feature (36): n=c or t
tgcaggaatcaggaggttggtcatgttagtttcttntaagaaaaaaacctaagtcagtaagatcaagcatt

SEQ ID NO: 21782 - DNA, 71 bp, chicken (Gallus Gallus)
  misc_feature (36): n=c or t
taaatttactgcaatattaaaagttccgcaacctantttgaaactgaacacaaaacaaaatgattaataaa

SEQ ID NO: 21783 - DNA, 71 bp, chicken (Gallus Gallus)
  misc_feature (36): n=g or t
aacaataagcaaatgggacacaacgggacataattnctgaatgggatttctctgaaagattggtatgatga

SEQ ID NO: 21784 - DNA, 71 bp, chicken (Gallus Gallus)
  misc_feature (36): n=a or t
ctgctacactttccaacacttcactataatgtcagnatgctgatatcagattttagcataagcatacgctg

SEQ ID NO: 21785 - DNA, 71 bp, chicken (Gallus Gallus)
  misc_feature (36): n=c or t
tgaaggggacacttgtgcatgagtttacaaattttnctagaatttaaataccatctggaactgaacaacat

SEQ ID NO: 21786 - DNA, 71 bp, chicken (Gallus Gallus)
  misc_feature (36): n=a or t
acttgaagcataacatttgctgattactcacagcancttggtggtaatacaaaaaatgcagcaattcatgc

SEQ ID NO: 21787 - DNA, 71 bp, chicken (Gallus Gallus)
  misc_feature (36): n=c or t
tttaaacattaaaggtaacgtggctaaagcttgatnacagctgtaatttactctgagttttgtatttagac

SEQ ID NO: 21788 - DNA, 71 bp, chicken (Gallus Gallus)
  misc_feature (36): n=c or t
cctcaaaaacaaaagaacatcagacaaggtaggaanccctcctgcaaagagccggaaggattccaatacga

SEQ ID NO: 21789 - DNA, 71 bp, chicken (Gallus Gallus)
  misc_feature (36): n=c or t
aggcaaggaagtctaaatcagatcagaagagaaagntttattttaagacaaaatctctcacttcatctgca

SEQ ID NO: 21790 - DNA, 71 bp, chicken (Gallus Gallus)
  misc_feature (36): n=c or t
cttttcctggagcccacggacttgaaaaccagtcgngagctgaactgaagtggttgggatatgtgatctat

SEQ ID NO: 21791 - DNA, 71 bp, chicken (Gallus Gallus)
  misc_feature (36): n=c or g
caagctgttcagaagggataggcaaggcaggagtgnaggaggccttgccttcaaaatcaagaaacagataa

SEQ ID NO: 21792 - DNA, 71 bp, chicken (Gallus Gallus)
  misc_feature (36): n=c or t
gaggggacctttaaaggtcacgtagtccaactctcngtattgatatctgttcgtatcatttctgaagataa

SEQ ID NO: 21793 - DNA, 71 bp, chicken (Gallus Gallus)
  misc_feature (36): n=a or t
tgaaacaaaatcaaataaaacaacaatgaaaagcanccttacactctaacatttaaatgaattccttaact

SEQ ID NO: 21794 - DNA, 71 bp, chicken (Gallus Gallus)
  misc_feature (36): n=c or g
aggaaagtcatttaggaatttgctagaaaagggctnagatgttgctgcttggaaataggcaaccaggcaag

SEQ ID NO: 21795 - DNA, 71 bp, chicken (Gallus Gallus)
  misc_feature (36): n=a or g
catcagggtttaacaaggttcatcttttcaaatttntcatggcttgatttctatcacttaacttgcagttt

SEQ ID NO: 21796 - DNA, 71 bp, chicken (Gallus Gallus)
  misc_feature (36): n=a or g
agttacagtgaaggacaaataaactggttttgtacngagtaatgatgaaacagtttctgatcagataccca

SEQ ID NO: 21797 - DNA, 71 bp, chicken (Gallus Gallus)
  misc_feature (36): n=c or t
gtagaaaaaaattaaatataagccaagtattttccnctccatccaaatatcttctcatcctgcttatgtca

SEQ ID NO: 21798 - DNA, 71 bp, chicken (Gallus Gallus)
  misc_feature (36): n=c or t
taccttggtagatatattttaaacaaaacctgactnagacatagatggtaggtacagacaataagtatagt

SEQ ID NO: 21799 - DNA, 71 bp, chicken (Gallus Gallus)
  misc_feature (36): n=a or g
atttcctctcatctgcacccagcgtgactttacatntgcatgaaagtgctccgtccttaatgagtattgtg

SEQ ID NO: 21800 - DNA, 71 bp, chicken (Gallus Gallus)
  misc_feature (36): n=c or g
tatgtgagggaacagggctgccttaggagctgctanctacggatgactgcaggagcaagaaactgaaaaca

SEQ ID NO: 21801 - DNA, 71 bp, chicken (Gallus Gallus)
  misc_feature (36): n=g or t
tgtataccaccttgaaaaatgacattttccatcacngaagccaacaggaagtggccattcattttagtgtg

SEQ ID NO: 21802 - DNA, 71 bp, chicken (Gallus Gallus)
  misc_feature (36): n=c or g
aagtcatcgcaaacttaaatgaatagagcccagttntaaaatgctggaaaacagcaactaatggacagata

SEQ ID NO: 21803 - DNA, 71 bp, chicken (Gallus Gallus)
  misc_feature (36): n=c or t
attactggacaatcctgagcagcaaacagatacatncctgtccagcaactctatcatcataccagcaaggg

SEQ ID NO: 21804 - DNA, 71 bp, chicken (Gallus Gallus)
  misc_feature (36): n=a or t
gatgctgcaaagtaggaaaaaatgtactaggaggtntcagcagatgtttggtttctaagatttatgcatct

SEQ ID NO: 21805 - DNA, 71 bp, chicken (Gallus Gallus)
  misc_feature (36): n=a or g
tctgcacttgcaatacaaaaataatatcatagaacngttcaggttggaagggacctcaaagcccacccagc

SEQ ID NO: 21806 - DNA, 71 bp, chicken (Gallus Gallus)
  misc_feature (36): n=c or g
attcagagcatttacaagatctacaaaacaggtacnaggggtttatttcattttccatttgtaatcgtaca

SEQ ID NO: 21807 - DNA, 71 bp, chicken (Gallus Gallus)
  misc_feature (36): n=c or t
tctttcaacacattttctcatttttctcattatccnacagcctgagcttcaagtaaggaacaagggttgaa

SEQ ID NO: 21808 - DNA, 71 bp, chicken (Gallus Gallus)
  misc_feature (36): n=a or g
gcctcagttgggcttgaaatggtgtcttggaagccnaacgctaccttcaataatagatataatactgtaat

SEQ ID NO: 21809 - DNA, 71 bp, chicken (Gallus Gallus)
  misc_feature (36): n=c or g
aatcctgttgttggaagggagtcacctgctgcatgncccattgagcccgatgctcctccagcagagaagtc

SEQ ID NO: 21810 - DNA, 71 bp, chicken (Gallus Gallus)
  misc_feature (36): n=c or t
catacaggaacatgtttcttaaccatccaagaagtngtccattgcctgaatctggcactttcaaactgccc

SEQ ID NO: 21811 - DNA, 71 bp, chicken (Gallus Gallus)
  misc_feature (36): n=c or t
ggcacctttagggtaaacaccaggaaaaggacttanggggagctgctggtccatgcaaggaggaatccctt

SEQ ID NO: 21812 - DNA, 71 bp, chicken (Gallus Gallus)
  misc_feature (36): n=c or t
acatctttgaaggcggtgacagaataggcatggccnttcaccagcttcttgaaggtcactgcttccatatc

SEQ ID NO: 21813 - DNA, 71 bp, chicken (Gallus Gallus)
  misc_feature (36): n=c or g
ctcacctctgcactgtccacaggaacagagatggtntctctttatgttcataatttatatgatgacagaaa

SEQ ID NO: 21814 - DNA, 71 bp, chicken (Gallus Gallus)
  misc_feature (36): n=a or g
tcatttgtttgcatttcctgtacttagccaggaggnaatgccaggagaaggacaatcttgcacttcaagct

SEQ ID NO: 21815 - DNA, 71 bp, chicken (Gallus Gallus)
  misc_feature (36): n=a or g
atgcagttaaaataaaggtcagatcctgataaaaantttatttgactatctgtggaataattccatcttag

SEQ ID NO: 21816 - DNA, 71 bp, chicken (Gallus Gallus)
  misc_feature (36): n=c or t
tttgaaagaaaggattaaagtaagtatgggcatatngacctggcttcatacaaaaagaacccagtctctag

SEQ ID NO: 21817 - DNA, 71 bp, chicken (Gallus Gallus)
  misc_feature (36): n=c or g
ctcttagagatcaaatagagccaaagggcaaaagantgcgagtcagaccagctacagacacatagagctct

SEQ ID NO: 21818 - DNA, 71 bp, chicken (Gallus Gallus)
  misc_feature (36): n=a or g
ccaagaaagatgtagagatctagccaatcctgaggntacctctgattgctcatccacaatgctcattagcc

SEQ ID NO: 21819 - DNA, 71 bp, chicken (Gallus Gallus)
  misc_feature (36): n=a or c
actccatatcctgtgaagtctaaatatcacagtccntaccaccatcccagagtggtcataactcccatgag

SEQ ID NO: 21820 - DNA, 71 bp, chicken (Gallus Gallus)
  misc_feature (36): n=c or t
acaatcatgcgaataagtaatatccaggtcttgcanccaccctttccatcccaaaacacattgctgtaaat

SEQ ID NO: 21821 - DNA, 71 bp, chicken (Gallus Gallus)
  misc_feature (36): n=c or t
aaacatataaggtgtacttttgcctttcaataattnctcttaatttttacggagcactttttcagactgca

SEQ ID NO: 21822 - DNA, 71 bp, chicken (Gallus Gallus)
  misc_feature (36): n=a or c
ggatcttttcaaacaatgcacaaaggtttgcaggcngggaggctgacattgattattgtgacactgtaata

SEQ ID NO: 21823 - DNA, 71 bp, chicken (Gallus Gallus)
  misc_feature (36): n=c or t
ttagtaatgccgatggcacgtctgtcagttttacangcagagaaaacttctaccacctgcctgtggatatt

SEQ ID NO: 21824 - DNA, 71 bp, chicken (Gallus Gallus)
  misc_feature (36): n=c or t
tgaaagttaacttttctttggtttaattttttgganatcttttcaatattaacacacataaatagtataga

SEQ ID NO: 21825 - DNA, 71 bp, chicken (Gallus Gallus)
  misc_feature (36): n=a or g
acatttccgtggcatgctgctagacgatcagaagcnatgtaattaatactaaggccattgtagtttgtttt

SEQ ID NO: 21826 - DNA, 71 bp, chicken (Gallus Gallus)
  misc_feature (36): n=c or g
cttaacattcttgattgtcttatgctacctaccttntcttgaggagtggcattattctagaccagcaggaa

SEQ ID NO: 21827 - DNA, 71 bp, chicken (Gallus Gallus)
  misc_feature (36): n=a or t
aataaaatattaaattcataaattccaatagtcaanatgaagtattggtcatgaaagtagctagactgtaa

SEQ ID NO: 21828 - DNA, 71 bp, chicken (Gallus Gallus)
  misc_feature (36): n=a or c
gggctactgacagtgtaagacatttcagtgtttccnttgggaatgtgaggttgtaaaaagatgcatttagc

SEQ ID NO: 21829 - DNA, 71 bp, chicken (Gallus Gallus)
  misc_feature (36): n=c or t
tgtgctgatgactggagagtaaaatgttggtaagcngttagagttgttctcttagggctgtgtagttagca

SEQ ID NO: 21830 - DNA, 71 bp, chicken (Gallus Gallus)
  misc_feature (36): n=a or c
tctggtccaattcacaactccacagaagctctactnattatgggccaaagaactggagcaggcaggttaag

SEQ ID NO: 21831 - DNA, 71 bp, chicken (Gallus Gallus)
  misc_feature (36): n=a or c
tttagagaaaacaattcaggtcagtggataggacancaccatattatttattaatgtactagaaaaggata

SEQ ID NO: 21832 - DNA, 71 bp, chicken (Gallus Gallus)
  misc_feature (36): n=c or t
ccctcagctggagctgagatggtgaggaacaaaagnactctatttttcaggcagacccaaacctccttcct

SEQ ID NO: 21833 - DNA, 71 bp, chicken (Gallus Gallus)
  misc_feature (36): n=a or c
gcaggcaaggctttatagtaatggctttcatattgnaaaggagtcataaccaatctgttttggatattaga

SEQ ID NO: 21834 - DNA, 71 bp, chicken (Gallus Gallus)
  misc_feature (36): n=c or t
ataagaatggatgtgtcctgtaaattggatttgtantgactcctctgactctctcatttactgaggaatga

SEQ ID NO: 21835 - DNA, 71 bp, chicken (Gallus Gallus)
  misc_feature (36): n=a or c
gtatgtaagaacaaagagcatggtagaagatgatgnagttacaaaggtgaggcaagagagattgcccattt

SEQ ID NO: 21836 - DNA, 71 bp, chicken (Gallus Gallus)
  misc_feature (36): n=g or t
gcatcaaagagaggggtggccaggagggagcgggangttattgtcctcctctacactgcccttgtgaagcc

SEQ ID NO: 21837 - DNA, 71 bp, chicken (Gallus Gallus)
  misc_feature (36): n=a or g
gcattattaaagtatttagaactgaaacttgaaatngaatcatttgggcctcggtgctatcttacttcaga

SEQ ID NO: 21838 - DNA, 71 bp, chicken (Gallus Gallus)
  misc_feature (36): n=a or g
tgtttgtagctataatggagaactgtttttagaaantgtaatttatgtgtttaatccaagctatttgatga

SEQ ID NO: 21839 - DNA, 71 bp, chicken (Gallus Gallus)
  misc_feature (36): n=a or g
cagaagttctctggtcacctctccaagtacttaaancccatgatcaggattgactttgcagaaaaaaatga

SEQ ID NO: 21840 - DNA, 71 bp, chicken (Gallus Gallus)
  misc_feature (36): n=a or g
tgacttatttcagacagtgcaggagatttctctgcntgtggatagtcatcagaggtcccttctttttcagc

SEQ ID NO: 21841 - DNA, 71 bp, chicken (Gallus Gallus)
  misc_feature (36): n=c or t
aaagacttcaagggaggattttcaaatacgaagcgntagagaaatgccagccatcatcactaacaacaacc

SEQ ID NO: 21842 - DNA, 71 bp, chicken (Gallus Gallus)
  misc_feature (36): n=a or c
ttcaatgtttaaggaatgaatattcaatgaaagtanaagaagtgatgcagtgattttgtatacagatagat

SEQ ID NO: 21843 - DNA, 71 bp, chicken (Gallus Gallus)
  misc_feature (36): n=c or g
tgacacttccttggtgtggcacctgcctgtcccctnaggttgtcccatcacagaagagaagcgtgctgttt

SEQ ID NO: 21844 - DNA, 71 bp, chicken (Gallus Gallus)
  misc_feature (36): n=g or t
tgggccatactatattatcaaaactgcacagctgantatttgcgttgctcttctgaatgctcagaggataa

SEQ ID NO: 21845 - DNA, 71 bp, chicken (Gallus Gallus)
  misc_feature (36): n=c or t
cagattacgtggggagccctatttcggcatgaggtnctgtctcgcgaccccttgttgctggctatgatccc

SEQ ID NO: 21846 - DNA, 71 bp, chicken (Gallus Gallus)
  misc_feature (36): n=a or g
aactcgcccgtaaaccgcaagcgagtgaaattatcngggaaagcggcacacagaatagcgcccggtgtcac

SEQ ID NO: 21847 - DNA, 71 bp, chicken (Gallus Gallus)
  misc_feature (36): n=c or g
aggagcttatcagactgaagcacacctaaagatcanactcagcttgctcatcatgccttccaacataacag

SEQ ID NO: 21848 - DNA, 71 bp, chicken (Gallus Gallus)
  misc_feature (36): n=a or t
ctaatgagtagttagttacatcccaaagtcctgtcnttttcaaaaacacatctactgtgaaagacaacaag

SEQ ID NO: 21849 - DNA, 71 bp, chicken (Gallus Gallus)
  misc_feature (36): n=c or t
tgcaggaggacctatgccacctttctgtagcctggnaacttgctctgtggcaatgagattctcatatggta

SEQ ID NO: 21850 - DNA, 71 bp, chicken (Gallus Gallus)
  misc_feature (36): n=c or g
acacagttcatgttgtatacaaactgggaaacttanttgagaaacttttgcttactctgttaaactgtctg

SEQ ID NO: 21851 - DNA, 71 bp, chicken (Gallus Gallus)
  misc_feature (36): n=g or t
gccaacaaatagagcttgattcctgtgaaaaaaganatttgtgtcagacttcagttttagtagctaagtcg

SEQ ID NO: 21852 - DNA, 71 bp, chicken (Gallus Gallus)
  misc_feature (36): n=a or t
tacagcaccacacacacctgctgccatagctgctgngtgcttccagagacaaattttgccacagaagtgct

SEQ ID NO: 21853 - DNA, 71 bp, chicken (Gallus Gallus)
  misc_feature (36): n=a or t
atttttttccttatatctaattgcagcctgtgctcntaacaccccccccccctttttttttttaaacatac

SEQ ID NO: 21854 - DNA, 71 bp, chicken (Gallus Gallus)
  misc_feature (36): n=a or g
cacagagccagacgtcatagaatcatacaagcaggntgatcttttcagtctcagaagttctcatgggatag

SEQ ID NO: 21855 - DNA, 71 bp, chicken (Gallus Gallus)
  misc_feature (36): n=a or g
ctgagagcttctttataaaactcagctgctttttcntagtctccatttgcaaaaacagtatttcctttgtt

SEQ ID NO: 21856 - DNA, 71 bp, chicken (Gallus Gallus)
  misc_feature (36): n=c or t
atgccttgttacctgcattgtttcaataaattacantgcttcttcatacaaatggtaaatgttattgcacc

SEQ ID NO: 21857 - DNA, 71 bp, chicken (Gallus Gallus)
  misc_feature (36): n=a or g
gccctaggagacaaagaaaataatcaggacctgcanctttggatgtttttctgtcttttcgggcctatgca

SEQ ID NO: 21858 - DNA, 71 bp, chicken (Gallus Gallus)
  misc_feature (36): n=c or t
ctgcttttatttaataaaggaaaaaaaagtaggagncctccggtggtcaaaatatactccagctaactcat

SEQ ID NO: 21859 - DNA, 71 bp, chicken (Gallus Gallus)
  misc_feature (36): n=g or t
ctggaatggcaaaagagtaggtttttctcaagtcanaggggacttactcactgggtcagctagtgggtggc

SEQ ID NO: 21860 - DNA, 71 bp, chicken (Gallus Gallus)
  misc_feature (36): n=c or t
ggcagccaacacataggagtgcataggcagtcttanttggggtgggaggaaagggaaaaccccaccagtga

SEQ ID NO: 21861 - DNA, 71 bp, chicken (Gallus Gallus)
  misc_feature (36): n=c or g
tttttcctcatccctttgaaaaacaaagcttgcagntatctataaatcagctgctgtctccctacagacac

SEQ ID NO: 21862 - DNA, 71 bp, chicken (Gallus Gallus)
  misc_feature (36): n=c or t
ttaaagaaattcctactccttagtaccacacaggtnttaagggattatctatcagactggtgttttgttca

SEQ ID NO: 21863 - DNA, 71 bp, chicken (Gallus Gallus)
  misc_feature (36): n=g or t
gttttacacataaggcatgagaaccagcggcagtantttgctgttggattcctcagggctgtgaatggaga

SEQ ID NO: 21864 - DNA, 71 bp, chicken (Gallus Gallus)
  misc_feature (36): n=a or g
catcaccattactgagaagtagtactacccattagncaagtctggaggggctctgagcaatctgatcttgc

SEQ ID NO: 21865 - DNA, 71 bp, chicken (Gallus Gallus)
  misc_feature (36): n=a or t
ttatctctctatttcctttccaatcttatattaaanctgacgaaacagttctttgcctcttctcgtagata

SEQ ID NO: 21866 - DNA, 71 bp, chicken (Gallus Gallus)
  misc_feature (36): n=a or c
tttatgtgaatatttactcatttaccgaaaaaaaanccatcagtcttgcagtgtaaagaaggtaatatttt

SEQ ID NO: 21867 - DNA, 71 bp, chicken (Gallus Gallus)
  misc_feature (36): n=a or c
atttctttccaacatctagatctagctcttgttaantgggcctgtaaagcgtgaaaataatttcccttcct

SEQ ID NO: 21868 - DNA, 71 bp, chicken (Gallus Gallus)
  misc_feature (36): n=a or g
ttgtctgaataaacaccattctcctcatttccttgngaaatgcctaattccaggaggccggctgctgtaaa

SEQ ID NO: 21869 - DNA, 71 bp, chicken (Gallus Gallus)
  misc_feature (36): n=a or g
ttaataaatttcattttagcctgaatatccttcccngatccaggaaacccaaagttttctgctcagtgaag

SEQ ID NO: 21870 - DNA, 71 bp, chicken (Gallus Gallus)
  misc_feature (36): n=a or g
tacagacatgaaaactgtagtcagtttggaccagtnatgtcagctgctgcatagtacaggatcatgcttag

SEQ ID NO: 21871 - DNA, 71 bp, chicken (Gallus Gallus)
  misc_feature (36): n=a or g
gagagaaagctctattatagaattactctagttcangtgtcaatacgtctgtctcaaagtggaaaaatttc

SEQ ID NO: 21872 - DNA, 71 bp, chicken (Gallus Gallus)
  misc_feature (36): n=c or t
agtcagattatagggataagggaaatacagtagganagtttcagtttttaatgtattttttctttatgact

SEQ ID NO: 21873 - DNA, 71 bp, chicken (Gallus Gallus)
  misc_feature (36): n=c or t
atacagcagcatgtaaacaaaatcaatgtctgtagntcagtaatttccttcttcactatctcaaatggtat

SEQ ID NO: 21874 - DNA, 71 bp, chicken (Gallus Gallus)
  misc_feature (36): n=c or t
agaaaagaaagcccatctattaaattatcatgaagntgaaaatgataaaacccatatcacagcaggcttcc

SEQ ID NO: 21875 - DNA, 71 bp, chicken (Gallus Gallus)
  misc_feature (36): n=a or g
gacctggtcatgaggtagctttgccatacaggttantgtggtctgctctgctggaaacttgctgcagtttg

SEQ ID NO: 21876 - DNA, 71 bp, chicken (Gallus Gallus)
  misc_feature (36): n=a or t
tatgcctatatataaggtattgggcctacagcacancttccggttgtgcgccttccttgctcagcctgctg

SEQ ID NO: 21877 - DNA, 71 bp, chicken (Gallus Gallus)
  misc_feature (36): n=a or g
atgtccagtagcaatgacttaaaagcttctaaaccngtgtttcattcaggatgttgagtttaacagtgctt

SEQ ID NO: 21878 - DNA, 71 bp, chicken (Gallus Gallus)
  misc_feature (36): n=a or g
agaagggagagggggacagggggacagggagagggngagaggattattatcaccactttacaattcacaac

SEQ ID NO: 21879 - DNA, 71 bp, chicken (Gallus Gallus)
  misc_feature (36): n=c or t
cttgagtagttaggcagttatttgtatactaaagcngattcttgtatttagatgacagtctgtgtcatcta

SEQ ID NO: 21880 - DNA, 71 bp, chicken (Gallus Gallus)
  misc_feature (36): n=c or t
gaaaactgagaaaaaatgagataagaccatcaaacnccgttaaatttgatcaaacagtttaaagaatggcc

SEQ ID NO: 21881 - DNA, 71 bp, chicken (Gallus Gallus)
  misc_feature (36): n=c or t
gctactttttgtagcatataaactccccccaggctnctgaatgagttgaagttagtattttcagctactaa

SEQ ID NO: 21882 - DNA, 71 bp, chicken (Gallus Gallus)
  misc_feature (36): n=c or t
gtgagctgtgtagaccctgctatatcataaacttcnaaccttgcacccttatgcatgatagagccaattct

SEQ ID NO: 21883 - DNA, 71 bp, chicken (Gallus Gallus)
  misc_feature (36): n=a or t
cacaaacatattagaacacttaactaatctttcacncagattctcctgatggatatcatctctcttctact

SEQ ID NO: 21884 - DNA, 71 bp, chicken (Gallus Gallus)
  misc_feature (36): n=a or t
ccaagtctctgaatacttctgatacggtgattttantcggtggacagcaggtctgctgaatacaaaaaacc

SEQ ID NO: 21885 - DNA, 71 bp, chicken (Gallus Gallus)
  misc_feature (36): n=c or t
tttaataagctttccatctcacagaaaactcgtatngcatggagacatggaaaaaggtggtctttgcaatt

SEQ ID NO: 21886 - DNA, 71 bp, chicken (Gallus Gallus)
  misc_feature (36): n=a or g
tgccttgggtccagttatgttatgctcaatatttangcctagaggagaaagatttgggttttttttccccc

SEQ ID NO: 21887 - DNA, 71 bp, chicken (Gallus Gallus)
  misc_feature (36): n=c or t
ctggcttcttgtcctggggacagaaaacgagtcctngcagactgagtttgtctttacagatcaacaaactg

SEQ ID NO: 21888 - DNA, 71 bp, chicken (Gallus Gallus)
  misc_feature (36): n=a or g
cattctgggagattcagtggttatctctgagagccngacaaatgcccaggtgtcagcacgagttaacaagc

SEQ ID NO: 21889 - DNA, 71 bp, chicken (Gallus Gallus)
  misc_feature (36): n=a or g
tctattatattcttcttagtgttgctatctggtacnctcacacacacggatttaataccacatagttcaat

SEQ ID NO: 21890 - DNA, 71 bp, chicken (Gallus Gallus)
  misc_feature (36): n=c or t
tcttctactgcggtgattaaaaaggaccattttccnagtagagctttctgttcaataaatatatatttaat

SEQ ID NO: 21891 - DNA, 71 bp, chicken (Gallus Gallus)
  misc_feature (36): n=c or t
tttgtttgtttgtttgctttaattttattatggggnttgtatccattttcattgcttcatgcattctgtgt

SEQ ID NO: 21892 - DNA, 71 bp, chicken (Gallus Gallus)
  misc_feature (36): n=c or t
gacactctctctaaagaaagcaattccaacccagcngaagctaaaacaaaaggtcaaaatgctccttctga

SEQ ID NO: 21893 - DNA, 71 bp, chicken (Gallus Gallus)
  misc_feature (36): n=c or t
ataccaaggctcatatgtcttacagttacacagaanacttcaatagagatggaaaatatgatacttactgg

SEQ ID NO: 21894 - DNA, 71 bp, chicken (Gallus Gallus)
  misc_feature (36): n=g or t
tattcataacagccattcaactttaactattgcaanagacttggcagctctttttagagctacttacagac

SEQ ID NO: 21895 - DNA, 71 bp, chicken (Gallus Gallus)
  misc_feature (36): n=c or g
catagttaatgataaaccacttggaaatagacccantcctttagacatagacaaatcagatttaccaaagc

SEQ ID NO: 21896 - DNA, 71 bp, chicken (Gallus Gallus)
  misc_feature (36): n=c or g
ctgaagaataagatgagagtttttactaatcccctncaaatcattttaggaaatgaaaacagggtgccaac

SEQ ID NO: 21897 - DNA, 71 bp, chicken (Gallus Gallus)
  misc_feature (36): n=a or g
gccattcagagagtctgacaatacttctgcagattnttgcacaagtagatccaataaaaagacaaaagtgt

SEQ ID NO: 21898 - DNA, 71 bp, chicken (Gallus Gallus)
  misc_feature (36): n=g or t
aactggcaaagtgtgatttgctacctgaatgagctntatcttatcgacacattctgaagtctgtgaataca

SEQ ID NO: 21899 - DNA, 71 bp, chicken (Gallus Gallus)
  misc_feature (36): n=c or t
tttctagtctcaaattgttggccaacactctgtaanagattcccttggaaaaataaaggcagtgagcaaga

SEQ ID NO: 21900 - DNA, 71 bp, chicken (Gallus Gallus)
  misc_feature (36): n=a or c
ctatatctctactctgaaacattcccgaagcacaantttgacaaagaatgagttcagaccaaaggaacaaa

SEQ ID NO: 21901 - DNA, 71 bp, chicken (Gallus Gallus)
  misc_feature (36): n=a or g
ggaacctaaaacacttaaagtgttcagaaatgatgntctctgcaaaacctcatgccaggcaagcttcacaa

SEQ ID NO: 21902 - DNA, 71 bp, chicken (Gallus Gallus)
  misc_feature (36): n=c or t
ttcttcctaacatgtattgggtaatctctaaatttncccattattaaagacactctatttaattactccac

SEQ ID NO: 21903 - DNA, 71 bp, chicken (Gallus Gallus)
  misc_feature (36): n=c or t
tactatagagtagctgtattttactgacatttgaanattattaaccttgaggtagagcacgaaaagagcat

SEQ ID NO: 21904 - DNA, 71 bp, chicken (Gallus Gallus)
  misc_feature (36): n=a or g
tcattctcattatacaccttcctatcagggcagcantgaatttgtccccaggcatttccctgctgtgttga

SEQ ID NO: 21905 - DNA, 71 bp, chicken (Gallus Gallus)
  misc_feature (36): n=c or g
ttccttggaactattctctcagagttgagaggaagntgatggaagcatttctggtgaagacagtgggctgt

SEQ ID NO: 21906 - DNA, 71 bp, chicken (Gallus Gallus)
  misc_feature (36): n=c or t
aggtgtccactctggaaggaacaccgtggatctagnagggatctgttctgaaatagaacatatctaaggaa

SEQ ID NO: 21907 - DNA, 71 bp, chicken (Gallus Gallus)
  misc_feature (36): n=c or t
ccttggatcatttctctgctttttagagatttgttngaaaccattgtccgtgctccattaatggccagagc

SEQ ID NO: 21908 - DNA, 71 bp, chicken (Gallus Gallus)
  misc_feature (36): n=a or c
gaaaatatccaaaattataataagtggagatggaanaaatactagcttaggcagggaattttggatgtttt

SEQ ID NO: 21909 - DNA, 71 bp, chicken (Gallus Gallus)
  misc_feature (36): n=a or g
gacgaagcttattttctgtggcagtggataacctangggaaaataatgaaggaaaaacgtcagggattcag

SEQ ID NO: 21910 - DNA, 71 bp, chicken (Gallus Gallus)
  misc_feature (36): n=c or t
tttatttctctgagaaatatgaaggattttatatanggaaataaaataagcatattcgaaagtgatgcatt

SEQ ID NO: 21911 - DNA, 71 bp, chicken (Gallus Gallus)
  misc_feature (36): n=c or g
gccacttgtgacatttctaccatgattagcgaagtnaatctccatctccaaaggaataaagatgctccaac

SEQ ID NO: 21912 - DNA, 71 bp, chicken (Gallus Gallus)
  misc_feature (36): n=a or g
ctgctttcctttcagaaatacgtgatggtagctttnggtttcatatgtaggaccagtttgctatgggaaca

SEQ ID NO: 21913 - DNA, 71 bp, chicken (Gallus Gallus)
  misc_feature (36): n=a or t
tggctttatgcagttaagtacttctgcatctaaatntattaaaacaagtatatgcaaaataagaataatag

SEQ ID NO: 21914 - DNA, 71 bp, chicken (Gallus Gallus)
  misc_feature (36): n=a or g
tgttaatttagtagttaaggccttctgagtgctttnccatggggttacattttgatactgaaccctgagct

SEQ ID NO: 21915 - DNA, 71 bp, chicken (Gallus Gallus)
  misc_feature (36): n=c or t
tacagttaagcagaaatcatgaacataaagaagttnactgaaggtcaaatttgcattaaagtatgaagaca

SEQ ID NO: 21916 - DNA, 71 bp, chicken (Gallus Gallus)
  misc_feature (36): n=c or t
cctctaaatgcaagctgccttttgatacagtcaaangaaaaactttttgcaaatatagaataagtagaata

SEQ ID NO: 21917 - DNA, 71 bp, chicken (Gallus Gallus)
  misc_feature (36): n=a or g
attaagacctaacagcctggtgcttgtggtttgaancgttcctcacaaacatacatcacttgcatgctgct

SEQ ID NO: 21918 - DNA, 71 bp, chicken (Gallus Gallus)
  misc_feature (36): n=a or g
gaacttggtcctgttttcctgctactctgttcttgnttctgtgaaaactgggcccagcctgacaccaagga

SEQ ID NO: 21919 - DNA, 71 bp, chicken (Gallus Gallus)
  misc_feature (36): n=a or g
gttgagacaggcaaatgttaagtgtcaagtactgcnctgaaagggcatgcatctcataaaatagcagtcag

SEQ ID NO: 21920 - DNA, 71 bp, chicken (Gallus Gallus)
  misc_feature (36): n=a or g
tataggtgacaagagagttgggattcagaaaagcancatctggaggaatggctggttaccatcttctgtgg

SEQ ID NO: 21921 - DNA, 71 bp, chicken (Gallus Gallus)
  misc_feature (36): n=c or t
tttgcccttcccaagccttacacctgacagaactgngcactataactatttaatcttacaatttaataact

SEQ ID NO: 21922 - DNA, 71 bp, chicken (Gallus Gallus)
  misc_feature (36): n=a or g
gctcagtgcaagtcctcatccctgctaagcagggcncttgctgcccactggttgtattttatggatgtcac

SEQ ID NO: 21923 - DNA, 71 bp, chicken (Gallus Gallus)
  misc_feature (36): n=g or t
tttgccacactacacaagcatcaaacacagacatanttttattcttttcatctcacactttgatcttttca

SEQ ID NO: 21924 - DNA, 71 bp, chicken (Gallus Gallus)
  misc_feature (36): n=a or g
atagctcagcggtgattaatacattcagtacactcnggtttccgggtgttacaactctcgacaaaaacact

SEQ ID NO: 21925 - DNA, 71 bp, chicken (Gallus Gallus)
  misc_feature (36): n=a or g
gatacaataagccatataaaagttagtgcaagtcantacatatacagtatctgcaagacagaatgtgcaag

SEQ ID NO: 21926 - DNA, 71 bp, chicken (Gallus Gallus)
  misc_feature (36): n=a or g
cttgcttacgtacttgttttgactgcccaacctcanctccaagaaacattgcccatgtaactacatgaatc

SEQ ID NO: 21927 - DNA, 71 bp, chicken (Gallus Gallus)
  misc_feature (36): n=c or t
gctgcaaaatgtttcttttcaggtttactctggttnggcagtcgtgttattgcctatcactttaaggaatt

SEQ ID NO: 21928 - DNA, 71 bp, chicken (Gallus Gallus)
  misc_feature (36): n=a or g
gatctgaagaccactgatttaagggatttactcccnatctgcaatggaaaaggaagaagagaataaggctg

SEQ ID NO: 21929 - DNA, 71 bp, chicken (Gallus Gallus)
  misc_feature (36): n=c or t
tggaaatgcttaatatggagggatgcttcatactcntagttttgcccacttttgagaaattcacactcttt

SEQ ID NO: 21930 - DNA, 71 bp, chicken (Gallus Gallus)
  misc_feature (36): n=c or t
ccagagtgacctcactggaggtgcaaacaggaaaanggggtcccacaaagctgcttttctaagtttacccc

SEQ ID NO: 21931 - DNA, 71 bp, chicken (Gallus Gallus)
  misc_feature (36): n=a or t
cagggagggggcatccacaatctcagtgattagttnggtgtgtaattttacattgttcagtgtgcacagtc

SEQ ID NO: 21932 - DNA, 71 bp, chicken (Gallus Gallus)
  misc_feature (36): n=a or g
tggggttatattttcccagaaaatgagagattttcntcataatacataggggcataatggcagtaaatctc

SEQ ID NO: 21933 - DNA, 71 bp, chicken (Gallus Gallus)
  misc_feature (36): n=g or t
gattcttgcgtaacttagtgatacttgacactgttntgccgcagacattcttcatagaattctatgtgaat

SEQ ID NO: 21934 - DNA, 71 bp, chicken (Gallus Gallus)
  misc_feature (36): n=a or g
ccacttaattggaatgcatttgcatagtactgctcntaatagcgttagtattggggaataaaaatttcagc

SEQ ID NO: 21935 - DNA, 71 bp, chicken (Gallus Gallus)
  misc_feature (36): n=a or t
gaccttatttttaggcaaatgcccacatacttattntgtctccagtgaaaatcatttggagacatctcacg

SEQ ID NO: 21936 - DNA, 71 bp, chicken (Gallus Gallus)
  misc_feature (36): n=a or g
tattaaccctaaccacaattcttaagcactaacttngacgtaagagaaggaaatataaactatctaggacc

SEQ ID NO: 21937 - DNA, 71 bp, chicken (Gallus Gallus)
  misc_feature (36): n=c or t
aaacaaggcaaattttttgcaagccttgtgaaactngttcatacatttaggtagataaaaaaaaaaaatca

SEQ ID NO: 21938 - DNA, 71 bp, chicken (Gallus Gallus)
  misc_feature (36): n=g or t
tttgaaaaatcatggctgtcttgtgaagtcctcagngactggaaaaagggcaacattactcccatttttaa

SEQ ID NO: 21939 - DNA, 71 bp, chicken (Gallus Gallus)
  misc_feature (36): n=a or g
agtttgaagcttttcttgaattctagcatgaaactntgaatgttcagaggctctggtttgggaatgaatga

SEQ ID NO: 21940 - DNA, 71 bp, chicken (Gallus Gallus)
  misc_feature (36): n=a or g
agtgtggaacaaaagagaggtatcccagttgccccnggcctttgaacaaacagaatcagagagttggtgag

SEQ ID NO: 21941 - DNA, 71 bp, chicken (Gallus Gallus)
  misc_feature (36): n=a or g
acaccgtgtttaatattggccaaatatctccaaagntggagactccacaatttcatatgtatagtgtggtt

SEQ ID NO: 21942 - DNA, 71 bp, chicken (Gallus Gallus)
  misc_feature (36): n=a or t
tcaataaaactgtgccacacactgagctttgacttngtcagtattgctcccttgtcaacattatccctggc

SEQ ID NO: 21943 - DNA, 71 bp, chicken (Gallus Gallus)
  misc_feature (36): n=a or g
tacttgtagcctgacacagctttgggtcatctgtgnctttaacaaacctcatctttcttccagaaagcagc

SEQ ID NO: 21944 - DNA, 71 bp, chicken (Gallus Gallus)
  misc_feature (36): n=c or t
ttgttaaatgagattgtatctagcaaatggatctancaaaagagaacaggaggatttgtggaagcagggaa

SEQ ID NO: 21945 - DNA, 71 bp, chicken (Gallus Gallus)
  misc_feature (36): n=c or t
actattaaattcattctattctgtactgcagagtanaaaactttaagacttgagaggtaaatttccataac

SEQ ID NO: 21946 - DNA, 71 bp, chicken (Gallus Gallus)
  misc_feature (36): n=c or t
gtatgaacgatagcttgtattatattttacagctanaaagtttatttttgcatatgtatacaaccatattt

SEQ ID NO: 21947 - DNA, 71 bp, chicken (Gallus Gallus)
  misc_feature (36): n=a or g
tgtgaaccactatcagcacagttaaaattggaattnctaaggctaccaaagtaaaagtatttgaagattgt

SEQ ID NO: 21948 - DNA, 71 bp, chicken (Gallus Gallus)
  misc_feature (36): n=c or t
atggcagcagtgagattatttttcacagaaccacanggaatggtttggttggaagtgacattacagaccat

SEQ ID NO: 21949 - DNA, 71 bp, chicken (Gallus Gallus)
  misc_feature (36): n=a or c
tatgataccattacctcatccttccattgtccattncgatgctcctcctcagtgtttttcctacagtaatg

SEQ ID NO: 21950 - DNA, 71 bp, chicken (Gallus Gallus)
  misc_feature (36): n=a or g
caacatactccaacactggtttcagtgttgcatgcntagcatattgtacatctgttatcaatactatgacc

SEQ ID NO: 21951 - DNA, 71 bp, chicken (Gallus Gallus)
  misc_feature (36): n=a or g
ttatgatgttgcagtgacaatcacaaatattacctncaaggctataagcaccagtctgatattgtggtaac

SEQ ID NO: 21952 - DNA, 71 bp, chicken (Gallus Gallus)
  misc_feature (36): n=a or g
ctgtcatatctccccaccacaaggactttcattcanccattacagggatgtttgcacttctggtcttacgg

SEQ ID NO: 21953 - DNA, 71 bp, chicken (Gallus Gallus)
  misc_feature (36): n=a or g
aaatattaagttgtacataaacacaaagtcacagantcacagcatggccaagattggaagggccctctgga

SEQ ID NO: 21954 - DNA, 71 bp, chicken (Gallus Gallus)
  misc_feature (36): n=c or t
ttgggaagaaaatgcaatgcaaatgctcaaaaatangtagagaaaggaacagcgagaagtgaaatgcatca

SEQ ID NO: 21955 - DNA, 71 bp, chicken (Gallus Gallus)
  misc_feature (36): n=a or t
atacatttcagaaagtagtgcaggatacacagaaanattactgattctgcttttaaatccattaaaacact

SEQ ID NO: 21956 - DNA, 71 bp, chicken (Gallus Gallus)
  misc_feature (36): n=a or g
cttgattttattttggtgtgaagtaattctactgcnggtgcaacatctgcccctttggaaacttggagagt

SEQ ID NO: 21957 - DNA, 71 bp, chicken (Gallus Gallus)
  misc_feature (36): n=a or c
tttcttgcacagaggctgagcaaaataaactgatancattggtcttctgaatttatgaccagtctgtcttc

SEQ ID NO: 21958 - DNA, 71 bp, chicken (Gallus Gallus)
  misc_feature (36): n=a or g
tgcttagctgaacatgcagctgtttgtcagtggccnattacaagggttgggagagagatgagttggagggt

SEQ ID NO: 21959 - DNA, 71 bp, chicken (Gallus Gallus)
  misc_feature (36): n=c or t
ttcctgctcccttgttcagttttgcctagctctttncctttagaaaagttactagtagatctttccagtaa

SEQ ID NO: 21960 - DNA, 71 bp, chicken (Gallus Gallus)
  misc_feature (36): n=a or g
tttaaaagcatttctggagaattagtgagctctacnaggtctgaaaagaaaggggaaagtgttactggtct

SEQ ID NO: 21961 - DNA, 71 bp, chicken (Gallus Gallus)
  misc_feature (36): n=a or c
cctgtgcaagcaaccgtggcatatttgcatgtgtanatcatcagcaattctggcaggattcaggaccatag

SEQ ID NO: 21962 - DNA, 71 bp, chicken (Gallus Gallus)
  misc_feature (36): n=g or t
atcttgtaaagatattaatagtacctgaatatcttngattgttactgtttctccttagctgaggctgaact

SEQ ID NO: 21963 - DNA, 71 bp, chicken (Gallus Gallus)
  misc_feature (36): n=c or t
cacctggctccacacaggaccacccaaaaatcagancatggatatggtggtccttcagaagccaggaacac

SEQ ID NO: 21964 - DNA, 71 bp, chicken (Gallus Gallus)
  misc_feature (36): n=a or g
gctcttctgtattccagcgtcctgcagatgacagcnagcaggtctggctttaggaactgactcgagggcct

SEQ ID NO: 21965 - DNA, 71 bp, chicken (Gallus Gallus)
  misc_feature (36): n=a or c
cgctccttgttggactggggagtgctgatctggggnacgacgggactgaggagtttgttcatcagctctaa

SEQ ID NO: 21966 - DNA, 71 bp, chicken (Gallus Gallus)
  misc_feature (36): n=c or g
gtacgttcaaatgcctttcagctgacattcttaaanttttcagtgcttaacagaattgtaatgtaactgta

SEQ ID NO: 21967 - DNA, 71 bp, chicken (Gallus Gallus)
  misc_feature (36): n=a or t
gtctttaacaagtgtgaacacaaaatcattaatctnggctactagacaggtgaactgcactgcttgtgtat

SEQ ID NO: 21968 - DNA, 71 bp, chicken (Gallus Gallus)
  misc_feature (36): n=c or t
aacacgatcaagcaaatcctcttatcatctggtcanggataacagtcaagactttgcaggcctactctgag

SEQ ID NO: 21969 - DNA, 71 bp, chicken (Gallus Gallus)
  misc_feature (36): n=a or t
gaagaaaagtaatcatgcgtctgtaacctgtagtcngtaatgggctacccaaagatgagcaccaaaaccaa

SEQ ID NO: 21970 - DNA, 71 bp, chicken (Gallus Gallus)
  misc_feature (36): n=a or g
aaggaagctgaaaggctggagtgtctgttatttgtngatcctgaaaccagaactgtgatcgtcctggagat

SEQ ID NO: 21971 - DNA, 71 bp, chicken (Gallus Gallus)
  misc_feature (36): n=c or t
ataaatactcatctgtatgactagtgaagtgaaatntaaattgcccctataagacaatgtttagtgtttag

SEQ ID NO: 21972 - DNA, 71 bp, chicken (Gallus Gallus)
  misc_feature (36): n=a or g
ttgcatgatgcaaacagcctagtccacttcaggcanagcacacaccgaggtgatatgcgtgctgtggctgg

SEQ ID NO: 21973 - DNA, 71 bp, chicken (Gallus Gallus)
  misc_feature (36): n=a or g
atctaactcaacaaactttgtactcatccaaaactntttcctacgattctcactgctcatccaatgccaca

SEQ ID NO: 21974 - DNA, 71 bp, chicken (Gallus Gallus)
  misc_feature (36): n=c or g
tgtttgctgcccacctggtaccaccatgttgctgcntacaggatccatttgtatgaaccagcaggatctac

SEQ ID NO: 21975 - DNA, 71 bp, chicken (Gallus Gallus)
  misc_feature (36): n=c or g
gaacaggtcagcttttaagctcacaggtaccagcantgtaatctcccatgacaccagcattttaatttcca

SEQ ID NO: 21976 - DNA, 71 bp, chicken (Gallus Gallus)
  misc_feature (36): n=a or g
aatcctctaaagaagaatcgactttcttaccattcnttgttgacatctgactctacctttcctctctagaa

SEQ ID NO: 21977 - DNA, 71 bp, chicken (Gallus Gallus)
  misc_feature (36): n=a or g
cagttcctcttttcccatgttccagggcactccctngaatgccatttgcagcccttttagaaaaagggtgc

SEQ ID NO: 21978 - DNA, 71 bp, chicken (Gallus Gallus)
  misc_feature (36): n=c or t
gacaaaattaaaagcataatttaattaaaagtggtnggggaaagggcacttgagatgctatgaatatgtag

SEQ ID NO: 21979 - DNA, 71 bp, chicken (Gallus Gallus)
  misc_feature (36): n=a or t
tttcagattcaaacctggcagtgccaaagacccttnagaatgcagttgtgtgtaaaataaatacaggggaa

SEQ ID NO: 21980 - DNA, 71 bp, chicken (Gallus Gallus)
  misc_feature (36): n=a or g
actaagaaatgagacagtacctttgcccacatctcngagggatgctgtgtggtcccagggtgaagcagaga

SEQ ID NO: 21981 - DNA, 71 bp, chicken (Gallus Gallus)
  misc_feature (36): n=a or g
cagaaggtgatgatgggtgtaagcattcagtggccntcagcaaaacatgctggggatctgtttctaactac

SEQ ID NO: 21982 - DNA, 71 bp, chicken (Gallus Gallus)
  misc_feature (36): n=c or t
aagaattcatttcattgctatagaataaaatgcttntggactgttgtaataacttcagagctgtgtctttc

SEQ ID NO: 21983 - DNA, 71 bp, chicken (Gallus Gallus)
  misc_feature (36): n=a or g
catgtagacacaattgactgttcagcaagttcttgnacaaagtctggtgttgtccttcaaggctttagggg

SEQ ID NO: 21984 - DNA, 71 bp, chicken (Gallus Gallus)
  misc_feature (36): n=g or t
aagacgtatttctctttctctgataaaggtagcatngtagtgtgtgagcatgaatagagtaatggcattag

SEQ ID NO: 21985 - DNA, 71 bp, chicken (Gallus Gallus)
  misc_feature (36): n=a or g
cagtgaatgggaggcaagatcggtaacagaaaaagnctggtagaaattttcctagaattatgaaattctaa

SEQ ID NO: 21986 - DNA, 71 bp, chicken (Gallus Gallus)
  misc_feature (36): n=c or t
tttcttgaatttttagaacagaattaacccaatcanttcctcaacatctggcaaataccctaaatgccctg

SEQ ID NO: 21987 - DNA, 71 bp, chicken (Gallus Gallus)
  misc_feature (36): n=c or t
tttggaatttggtatttagagcaggaaaaacatttngattagactattcgtttgataatcatagaattggt

SEQ ID NO: 21988 - DNA, 71 bp, chicken (Gallus Gallus)
  misc_feature (36): n=g or t
agactgatatggcagaagataaaatgagttatgaanctgttctttccttcagtagaaattgcaagtgtctg

SEQ ID NO: 21989 - DNA, 71 bp, chicken (Gallus Gallus)
  misc_feature (36): n=c or t
tcctgacatctctcccacgttgttatcactgcaggntacactcagtctcttcagtgacgcagtagcaggtg

SEQ ID NO: 21990 - DNA, 71 bp, chicken (Gallus Gallus)
  misc_feature (36): n=a or g
gtacttaggaacatagtttagtaagcagtattggtngtagttggacagttggacaagatgacctcagaggc

SEQ ID NO: 21991 - DNA, 71 bp, chicken (Gallus Gallus)
  misc_feature (36): n=a or g
ttgtggcattgccaatggtggagtggaaggaatccnccatctgaaaagaaatgtgtggaaatatgtatttt

SEQ ID NO: 21992 - DNA, 71 bp, chicken (Gallus Gallus)
  misc_feature (36): n=c or g
aaagtggaatcttaaatcaatataaaagaatctatnatagctttaatttcatatgcttaccaatattcgtg

SEQ ID NO: 21993 - DNA, 71 bp, chicken (Gallus Gallus)
  misc_feature (36): n=a or g
agattctctgcatttggacaggaggaggacagaagnaagtttgcctgaacctggggcagcctcctgagagc

SEQ ID NO: 21994 - DNA, 71 bp, chicken (Gallus Gallus)
  misc_feature (36): n=c or t
tgaagagttacagtggacgagagtacaaacatctgnaattccttttcctcagcatatttggcctattgtgc

SEQ ID NO: 21995 - DNA, 71 bp, chicken (Gallus Gallus)
  misc_feature (36): n=c or t
atgtctatcacataagacaaatcagcatgcacatangcttgcccatgcatcaacattgttaactcagtttc

SEQ ID NO: 21996 - DNA, 71 bp, chicken (Gallus Gallus)
  misc_feature (36): n=a or g
atcaagtttgaccttatccacacattttaattattnccatatagataatctgagttctatgcttatagaag

SEQ ID NO: 21997 - DNA, 71 bp, chicken (Gallus Gallus)
  misc_feature (36): n=c or g
taaattttgacagaaataaaagcaactgaagcaatncttatagtgggaacttgtacaatgctgacaggtat

SEQ ID NO: 21998 - DNA, 71 bp, chicken (Gallus Gallus)
  misc_feature (36): n=a or g
aagtgaagcattttctggctaaaacaaaatgaaaanatttgtcttcaatttttagattagaaacacaaatt

SEQ ID NO: 21999 - DNA, 71 bp, chicken (Gallus Gallus)
  misc_feature (36): n=a or g
cctgttctgtacattcctaattaagctaggctttgnatcagataactcccagcggtcccttctgatctcag

SEQ ID NO: 22000 - DNA, 71 bp, chicken (Gallus Gallus)
  misc_feature (36): n=a or g
gagacgcatctgagccccttcccaatctggggaaanaaatgagttgaattctgccctcagatgtgctcgtg

SEQ ID NO: 22001 - DNA, 71 bp, chicken (Gallus Gallus)
  misc_feature (36): n=g or t
ccaggagcaaggatacatagtttgaactatagagancatgagaataacaagaaggctcagaatcatagaac

SEQ ID NO: 22002 - DNA, 71 bp, chicken (Gallus Gallus)
  misc_feature (36): n=c or t
tacagggacatgatccttaccttcaacctaagcatngatgaagccacacctgcagtgctctgtccagttct

SEQ ID NO: 22003 - DNA, 71 bp, chicken (Gallus Gallus)
  misc_feature (36): n=a or g
taaactacactatttactccctctcattactgcttngacaactttgagttcacttttgttttctcagttta

SEQ ID NO: 22004 - DNA, 71 bp, chicken (Gallus Gallus)
  misc_feature (36): n=c or g
cagtcttgagggatatgtaaaggatagttaaactcnacgttgcaatatgggagcagaagagtggttttgtt

SEQ ID NO: 22005 - DNA, 71 bp, chicken (Gallus Gallus)
  misc_feature (36): n=c or t
gaaaaggagttagtttgtctctgtattatcttgctnctctgcctcagggaaagattgggtttgggcaggat

SEQ ID NO: 22006 - DNA, 71 bp, chicken (Gallus Gallus)
  misc_feature (36): n=a or g
gaggggatagcaggtggtttcatctacactattcanggtaagtctgcagacagcattgcatttgatgttat

SEQ ID NO: 22007 - DNA, 71 bp, chicken (Gallus Gallus)
  misc_feature (36): n=a or g
cctttctgagctactgataatatttcattatctccnaggcagccaaagtcagctcccacagtttcagtggg

SEQ ID NO: 22008 - DNA, 71 bp, chicken (Gallus Gallus)
  misc_feature (36): n=c or t
agaagggaggctaaaggaatactgtagggcaaccangtgcaggaaagttgatttgtttttcaggatgtcca

SEQ ID NO: 22009 - DNA, 71 bp, chicken (Gallus Gallus)
  misc_feature (36): n=c or t
ctgtcatcaaaacagaatacttgttgggttgttttntttaattcaactatttcactttctacatcaagata

SEQ ID NO: 22010 - DNA, 71 bp, chicken (Gallus Gallus)
  misc_feature (36): n=c or t
ttctgggagttgttgtaggcaagtgttgtagtcccngagccaaagcaaggaagtgaaaataaccattcagc

SEQ ID NO: 22011 - DNA, 71 bp, chicken (Gallus Gallus)
  misc_feature (36): n=a or g
ctgtatacactgtgtgtacatctccatgtacgctcnattgcaaaatcagtgctgtttccttagcacgtggg

SEQ ID NO: 22012 - DNA, 71 bp, chicken (Gallus Gallus)
  misc_feature (36): n=a or g
ttttcatggctgtttcctgatgctgagctgcatggntccacaaaactaacatccatgtgttttgcagttgc

SEQ ID NO: 22013 - DNA, 71 bp, chicken (Gallus Gallus)
  misc_feature (36): n=c or g
atctctgcctggggtttgggatttttttcccttctnagtttgtctcttggttctggaatctctcaggaggt

SEQ ID NO: 22014 - DNA, 71 bp, chicken (Gallus Gallus)
  misc_feature (36): n=c or t
agagctctgttggactagaacaaggttgccaccaanccagccttgcttctcagcgttgtatggctcttcac

SEQ ID NO: 22015 - DNA, 71 bp, chicken (Gallus Gallus)
  misc_feature (36): n=a or g
tccgcaaatgattttactgtttcattagaatattgngcctgctgtttcttcctagcctgctgtttcttcct

SEQ ID NO: 22016 - DNA, 71 bp, chicken (Gallus Gallus)
  misc_feature (36): n=c or t
ttttcactaaattactgctaattcacagtcacatanacagttgtggttcttagaacgtcaggttataactg

SEQ ID NO: 22017 - DNA, 71 bp, chicken (Gallus Gallus)
  misc_feature (36): n=a or g
gaactgctacaaggtatgcatgctgagatatagatnatagtttgaaaaacataactttgaaaagcaaaaaa

SEQ ID NO: 22018 - DNA, 71 bp, chicken (Gallus Gallus)
  misc_feature (36): n=a or g
aaaattgggacacattcagtttgtgatgggacttcntggaactgcataattttaaggaataattatacagg

SEQ ID NO: 22019 - DNA, 71 bp, chicken (Gallus Gallus)
  misc_feature (36): n=a or g
taataggcaattgctgatgcagtgatgcagggtttnatctataacaaagttttactaactcttttagagat

SEQ ID NO: 22020 - DNA, 71 bp, chicken (Gallus Gallus)
  misc_feature (36): n=a or g
tgtgtatgtgtatatcaacatatcatccatccatcntgttacttttttggacttggcactctgtaaatttg

SEQ ID NO: 22021 - DNA, 71 bp, chicken (Gallus Gallus)
  misc_feature (36): n=c or t
actacattcttttctaataaagctaacaaagaaaantaaaaggtagttaaaacataggaattggaaatgtt

SEQ ID NO: 22022 - DNA, 71 bp, chicken (Gallus Gallus)
  misc_feature (36): n=c or t
aagcaccaaaaagctctaaattgctttaaattccanggaggtggtgaactcagggtgccaaatcttgtggc

SEQ ID NO: 22023 - DNA, 71 bp, chicken (Gallus Gallus)
  misc_feature (36): n=c or t
agcaagtccagactgctccatacaagaaggtgagcnaggaggtgatgccagtataagtctggcagggacaa

SEQ ID NO: 22024 - DNA, 71 bp, chicken (Gallus Gallus)
  misc_feature (36): n=a or g
tctaatcatctatacacacatgtacaactggtcacntggatcacagacactcagagcactcacgtggacac

SEQ ID NO: 22025 - DNA, 71 bp, chicken (Gallus Gallus)
  misc_feature (36): n=a or g
gatttcttgcacttacgtttcattatctgacggccncaggttgacactaattgtgaaataaattagtccca

SEQ ID NO: 22026 - DNA, 71 bp, chicken (Gallus Gallus)
  misc_feature (36): n=g or t
tctgattagctgaggtatcctgatgatactttctgnccagacttcaggttgttttgatgaaaagcttagca

SEQ ID NO: 22027 - DNA, 71 bp, chicken (Gallus Gallus)
  misc_feature (36): n=c or t
aaagttactgatattttcagctccaagatctctaangggtggtacttaacaaaggaaaagagttatttatc

SEQ ID NO: 22028 - DNA, 71 bp, chicken (Gallus Gallus)
  misc_feature (36): n=c or t
gggggacccctctgtttcctccttttgaatggctgnccatgagttttaatttttcaccttcccatatagaa

SEQ ID NO: 22029 - DNA, 71 bp, chicken (Gallus Gallus)
  misc_feature (36): n=a or g
tggaaggcatgggaagtaaaagatcttttgattatnggagctaagataggtatgtggaacactctaaaaag

SEQ ID NO: 22030 - DNA, 71 bp, chicken (Gallus Gallus)
  misc_feature (36): n=c or t
ttgatcctctcctgagaagtttacaagatgccatcnagaaggttcttgacaggcttgagagatctgccctt

SEQ ID NO: 22031 - DNA, 71 bp, chicken (Gallus Gallus)
  misc_feature (36): n=c or t
tctacttactctttacattctttggacacgtgaggnggcactgtgtatttgcagtccattatcatagtcag

SEQ ID NO: 22032 - DNA, 71 bp, chicken (Gallus Gallus)
  misc_feature (36): n=a or c
aaatctcagtttgtttaaattatgttcagctaacanttttgttgcctacagaatgacaactacgtaaaagc

SEQ ID NO: 22033 - DNA, 71 bp, chicken (Gallus Gallus)
  misc_feature (36): n=c or t
attatagtgccctcagtatctttttaacagggtacngtgctgttacactttctttaatctaaaactgagga

SEQ ID NO: 22034 - DNA, 71 bp, chicken (Gallus Gallus)
  misc_feature (36): n=c or t
cactgagctgctctccagcccctcatcccacactcngaacatatatcaaaagctgcaccatcccaggtgca

SEQ ID NO: 22035 - DNA, 71 bp, chicken (Gallus Gallus)
  misc_feature (36): n=c or t
acagattaacttaaacaagagtaattaatcatatcngaataacatttttgtaaaaaacaaaataatttgtt

SEQ ID NO: 22036 - DNA, 71 bp, chicken (Gallus Gallus)
  misc_feature (36): n=a or g
aacattgcaaggaaaacgtcttgtgatctaagcacnctttgccttcactctggcaatcttgttgtactgag

SEQ ID NO: 22037 - DNA, 71 bp, chicken (Gallus Gallus)
  misc_feature (36): n=g or t
caagctaacctcacatacctactgaaattgttatanggagggtttattttttcagtatccttgatcaaagt

SEQ ID NO: 22038 - DNA, 71 bp, chicken (Gallus Gallus)
  misc_feature (36): n=c or g
tccaatttgactgtttttcccattaaagaagctagnacttaacctttaagttaaatactttatcttcaaaa

SEQ ID NO: 22039 - DNA, 71 bp, chicken (Gallus Gallus)
  misc_feature (36): n=a or t
actaactcctaactgggcacactgccaagtgaaatntatctccattcaccaagcaagtgggtaagaacttc

SEQ ID NO: 22040 - DNA, 71 bp, chicken (Gallus Gallus)
  misc_feature (36): n=c or t
gctgtgctgtttgctatgatcccttatgggctgaangtccgagtttgggaagatgtgtcgttcttcagctg

SEQ ID NO: 22041 - DNA, 71 bp, chicken (Gallus Gallus)
  misc_feature (36): n=c or t
gcgacttaatttccaagggaatctgttatcctctangaactgtgggtgttactttatcataagcaccacag

SEQ ID NO: 22042 - DNA, 71 bp, chicken (Gallus Gallus)
  misc_feature (36): n=a or g
ataactggtaccattatctgccaggtgccaggatcnttgtgctgtctggaagattccaaaccctgtgagct

SEQ ID NO: 22043 - DNA, 71 bp, chicken (Gallus Gallus)
  misc_feature (36): n=a or g
agaaatgatgttaatgtttctttatggacattcagnagtcagtggtggaatcccaaggtataaggaacaat

SEQ ID NO: 22044 - DNA, 71 bp, chicken (Gallus Gallus)
  misc_feature (36): n=a or g
gttgctctaataaatgagccatcttttcaaagcaanttctattcatgaaataatttatgggaaaacaatac

SEQ ID NO: 22045 - DNA, 71 bp, chicken (Gallus Gallus)
  misc_feature (36): n=a or g
gttcttgacatgcttacccaagagcttgtttggagngagcttcctgaacacggcagcagcagaatgaattg

SEQ ID NO: 22046 - DNA, 71 bp, chicken (Gallus Gallus)
  misc_feature (36): n=a or g
agcaatttcagacaaacctacatttgtttttttttnggcttggttaatgaattatttggcactatttctaa

SEQ ID NO: 22047 - DNA, 71 bp, chicken (Gallus Gallus)
  misc_feature (36): n=a or g
taggcacatatcctgaatctctactcttgctgaagncattagttctgttaataaagttcaaaattgcaaaa

SEQ ID NO: 22048 - DNA, 71 bp, chicken (Gallus Gallus)
  misc_feature (36): n=a or g
aaaaaaaatccaagaaaccttcatatggcatttcantactcctgctgttattctcagctggaacagagaag

SEQ ID NO: 22049 - DNA, 71 bp, chicken (Gallus Gallus)
  misc_feature (36): n=a or g
tgactccaaaaattctgctgcaaccagctgagatcnattttaatttaatcttgctgatagaatttgtgcag

SEQ ID NO: 22050 - DNA, 71 bp, chicken (Gallus Gallus)
  misc_feature (36): n=a or g
ggattgcaaaatgacttgcaagaagcaaaggatgtncaaagaaacttgaatagtttttgcaaataaaagag

SEQ ID NO: 22051 - DNA, 71 bp, chicken (Gallus Gallus)
  misc_feature (36): n=a or g
attttgctaatcttgtggtcgacctccatgctctgncttaagtgaaaatggagaaccctatttagcacttc

SEQ ID NO: 22052 - DNA, 71 bp, chicken (Gallus Gallus)
  misc_feature (36): n=c or t
tctaggatttctgggcccttggacagggcactgatnatgttttgtgccattggtcttcctgaccctaccca

SEQ ID NO: 22053 - DNA, 71 bp, chicken (Gallus Gallus)
  misc_feature (36): n=c or t
tttaattatcatcttttctgtaccacttcattaagngtgagggcctacatgttagatcagttgattaactt

SEQ ID NO: 22054 - DNA, 71 bp, chicken (Gallus Gallus)
  misc_feature (36): n=a or g
tttcttccacagcaatggataaagaggcagatttcngggaaaggcagcttctggattggacttacagattc

SEQ ID NO: 22055 - DNA, 71 bp, chicken (Gallus Gallus)
  misc_feature (36): n=c or g
agagcccagcaggaggacagtcactaccagagaatnccaggtgctgataccttgggacaatgctactcaat

SEQ ID NO: 22056 - DNA, 71 bp, chicken (Gallus Gallus)
  misc_feature (36): n=c or g
gccacatttacactcagaaatgcgggcacatgtagnaggattcttgtcactcatgtacgcatccagcctga

SEQ ID NO: 22057 - DNA, 71 bp, chicken (Gallus Gallus)
  misc_feature (36): n=a or g
gcaggaacaactcaaatcagaatagagaagaaaagnaatttgggatgatcaccaatcatgtaaggagatat

SEQ ID NO: 22058 - DNA, 71 bp, chicken (Gallus Gallus)
  misc_feature (36): n=g or t
tgaggccctcactgtgcaaagcacaccctgagcaanggagatgtgttcctgcatgtcaaccaaatgacgct

SEQ ID NO: 22059 - DNA, 71 bp, chicken (Gallus Gallus)
  misc_feature (36): n=c or g
gctcgtcattccctcctcttcatcaatcctatgtgnatttagtgaacaaaccacttctcaagactgctgcc

SEQ ID NO: 22060 - DNA, 71 bp, chicken (Gallus Gallus)
  misc_feature (36): n=a or g
actattattacaaactgcaggatgctaatgggaacnatcaaatccacatggacagagctaccgaggtgaaa

SEQ ID NO: 22061 - DNA, 71 bp, chicken (Gallus Gallus)
  misc_feature (36): n=a or g
gagtatttccagaatttttctttttgaagtgttcantaagttctgcttgtttttaaaaatcaatactcttc

SEQ ID NO: 22062 - DNA, 71 bp, chicken (Gallus Gallus)
  misc_feature (36): n=a or g
gagttgtgttttcagattgttgaaatgggttggganacaccgtagctcattgttttctggaagtgagtttc

SEQ ID NO: 22063 - DNA, 71 bp, chicken (Gallus Gallus)
  misc_feature (36): n=c or t
taaaacctttgcggtggctctgaagttgactgttcntctttcctttggaggcaggtgctgcattcaactga

SEQ ID NO: 22064 - DNA, 71 bp, chicken (Gallus Gallus)
  misc_feature (36): n=a or g
ttcagtgggaagtagaagcaaggtgcacacattgcntgtgaagctgtagcccaagggtctgatacatctat

SEQ ID NO: 22065 - DNA, 71 bp, chicken (Gallus Gallus)
  misc_feature (36): n=c or t
gatttacgtctgccacacgtaataccggttaatggnagctgtgaacctcttccattgattgagatacttaa

SEQ ID NO: 22066 - DNA, 71 bp, chicken (Gallus Gallus)
  misc_feature (36): n=a or c
gtatactttctaagagtgatgctcactgtgagctgntaagttaaaaaaatcatttttaattataaaaatta

SEQ ID NO: 22067 - DNA, 71 bp, chicken (Gallus Gallus)
  misc_feature (36): n=g or t
cagagcctctcacaatacacagagaagggcaagctntaactatgagaaactcctgcctgtgactcggaggt

SEQ ID NO: 22068 - DNA, 71 bp, chicken (Gallus Gallus)
  misc_feature (36): n=a or g
gaacgctccgctgggcccacctcaggcagtgaggcntctcggaagatgcgaccctagaaacattgtaaatc

SEQ ID NO: 22069 - DNA, 71 bp, chicken (Gallus Gallus)
  misc_feature (36): n=a or g
atcatttccagcagggtttctttttcttgttccatngcagatgctgcgtcacggaaagcctctaccctggg

SEQ ID NO: 22070 - DNA, 71 bp, chicken (Gallus Gallus)
  misc_feature (36): n=c or g
tgattttagaaatatttgagtatttgaataacttanatcagactttttcaacagaaggttgggaaattaaa

SEQ ID NO: 22071 - DNA, 71 bp, chicken (Gallus Gallus)
  misc_feature (36): n=g or t
ctcccgacaaacagctatgaaatggcagctcagagnataattagtgttttctttggtgtggaggatctggg

SEQ ID NO: 22072 - DNA, 71 bp, chicken (Gallus Gallus)
  misc_feature (36): n=g or t
atcaaattaggaattggtgcaaacagccgtgactcngtcagcaatgttccccgttggcaccaacttgggtc

SEQ ID NO: 22073 - DNA, 71 bp, chicken (Gallus Gallus)
  misc_feature (36): n=a or g
gtttgtacttgacagaagaactgttctaagaatagntttaattcatttagcactgcctgggaagaactacc

SEQ ID NO: 22074 - DNA, 71 bp, chicken (Gallus Gallus)
  misc_feature (36): n=a or g
gctgctgctgctgttgctgctgtatagacagaaaanaagggttatcagagcactgcacgagaagggctgaa

SEQ ID NO: 22075 - DNA, 71 bp, chicken (Gallus Gallus)
  misc_feature (36): n=a or g
tgtggtgttgcacttccttcatttctagtagaatgngtggcaaggaatgtgggagctggctggacctctcc

SEQ ID NO: 22076 - DNA, 71 bp, chicken (Gallus Gallus)
  misc_feature (36): n=c or g
aagaaaaaatggtaatgaaccagttactctagaganaaattactttgacggatgaagcagtttctcagttt

SEQ ID NO: 22077 - DNA, 71 bp, chicken (Gallus Gallus)
  misc_feature (36): n=c or t
ttttgccatactcctcccttaactgagagttcatantgcaagcatgaaaatgaagatagacaccaccaaca

SEQ ID NO: 22078 - DNA, 71 bp, chicken (Gallus Gallus)
  misc_feature (36): n=a or t
gcagaacttacatttacccattatttctgggaacanctttttggtaagcctctcaaaatcagtaggcatta

SEQ ID NO: 22079 - DNA, 71 bp, chicken (Gallus Gallus)
  misc_feature (36): n=a or c
ttcacatcaggtccaacggagggtatctccctctgnaagagcactctcttcagttaagcactgtctcaggc

SEQ ID NO: 22080 - DNA, 71 bp, chicken (Gallus Gallus)
  misc_feature (36): n=c or g
atgactttctgcattgcacaagaatcttgacggaangcaaagatgtgaccttctgcataacatcctttctg

SEQ ID NO: 22081 - DNA, 71 bp, chicken (Gallus Gallus)
  misc_feature (36): n=c or t
cagtcgaatgaaaccaggccaatgcagcaagaaagngatcaaacacttaacccagacaacccatacaacgt

SEQ ID NO: 22082 - DNA, 71 bp, chicken (Gallus Gallus)
  misc_feature (36): n=c or t
ccctcactgatgttccatttgctgtttctggaaagngctgtaatcaaatcagtgctgttatacaaaatgtg

SEQ ID NO: 22083 - DNA, 71 bp, chicken (Gallus Gallus)
  misc_feature (36): n=c or t
ttttttttaatgctagaatcatctgctagaaactcngtttaggtctgctaaactttgatctttagatgcct

SEQ ID NO: 22084 - DNA, 71 bp, chicken (Gallus Gallus)
  misc_feature (36): n=a or g
cagcaacaaaatagattcatactgagagaacgaacntattgaattagtttatgaatcttaatagatgagtt

SEQ ID NO: 22085 - DNA, 71 bp, chicken (Gallus Gallus)
  misc_feature (36): n=c or g
aaaattgacacctttaatttgatatgctgctgtagntgcaccccaagcaaatccagctggaaaagcaatat

SEQ ID NO: 22086 - DNA, 71 bp, chicken (Gallus Gallus)
  misc_feature (36): n=a or g
cacttttactaagtctacttttactcaaaattcagngttttgcagggaaggcttttctggttccatttttc

SEQ ID NO: 22087 - DNA, 71 bp, chicken (Gallus Gallus)
  misc_feature (36): n=a or t
aaggcctgacatgatatacagatgtacagcgcatanatacacctgctcagtaatgaggatgttcttgcata

SEQ ID NO: 22088 - DNA, 71 bp, chicken (Gallus Gallus)
  misc_feature (36): n=a or t
tcaaactttgccattgaaaactactttttttgaagngatagcaggtttctcccaaaatcataaaattccaa

SEQ ID NO: 22089 - DNA, 71 bp, chicken (Gallus Gallus)
  misc_feature (36): n=a or c
agaggtggttaagaaaacaacaaaggcatttttagncatgccacagaactgctcagatgcttataagtatt

SEQ ID NO: 22090 - DNA, 71 bp, chicken (Gallus Gallus)
  misc_feature (36): n=a or g
tgcttctagatcttgttgaaagcagcaatgtcgacnctttgcacctggaacacgacaagagcaacagcaag

SEQ ID NO: 22091 - DNA, 71 bp, chicken (Gallus Gallus)
  misc_feature (36): n=a or g
aaaggtttcaacatacgtacatctaaaggcaaacgnaaagcaaaatcctaactctccaattgtagcagcaa

SEQ ID NO: 22092 - DNA, 71 bp, chicken (Gallus Gallus)
  misc_feature (36): n=a or g
tctatacaacctttcaattgaagcattcagtaggtnctttataagtctttttcatattctaaagtattttt

SEQ ID NO: 22093 - DNA, 71 bp, chicken (Gallus Gallus)
  misc_feature (36): n=c or t
aaaaaaaaaaaaagaaaatatttttaatctttttgngtttgcagcagactgacacagtagatgtacatgtg

SEQ ID NO: 22094 - DNA, 71 bp, chicken (Gallus Gallus)
  misc_feature (36): n=a or c
tctgtctaagtatatgggaggaaaatttaccacttntgagaaatgaattaatttcctgaatacaagtctac

SEQ ID NO: 22095 - DNA, 71 bp, chicken (Gallus Gallus)
  misc_feature (36): n=g or t
aaaggtacagccaatctgctattaaatgtctcaagngagaaggaaagcattatatccataacaagctgtgt

SEQ ID NO: 22096 - DNA, 71 bp, chicken (Gallus Gallus)
  misc_feature (36): n=a or g
atcacaagtgtgagtgcagccagaaaagcatctccnataagagttctgagtgagtatacgtctgctcttgg

SEQ ID NO: 22097 - DNA, 71 bp, chicken (Gallus Gallus)
  misc_feature (36): n=g or t
accagagctctttcctaactataatgacagcgaacntcagagatttttaggatccctgtctactctcattt

SEQ ID NO: 22098 - DNA, 71 bp, chicken (Gallus Gallus)
  misc_feature (36): n=a or g
ggctcacaaactgaggagagaggtgggccttgggangaagcatgcactcaggagtataaatgcttttgaga

SEQ ID NO: 22099 - DNA, 71 bp, chicken (Gallus Gallus)
  misc_feature (36): n=c or t
caaccctctggaagctatgtctttacacctttccantcctcaagatacagatttggagacaattaagtttg

SEQ ID NO: 22100 - DNA, 71 bp, chicken (Gallus Gallus)
  misc_feature (36): n=c or t
gtttgtggtgtacaaaatgcatgacaaatcatttgnctcaacctaaataattattgttgtaacctcctacc

SEQ ID NO: 22101 - DNA, 71 bp, chicken (Gallus Gallus)
  misc_feature (36): n=g or t
tgtcagcaagttttttgtccatctcactaaatgagnaattaaaattaatgaactttgtgtttctgcaagaa

SEQ ID NO: 22102 - DNA, 71 bp, chicken (Gallus Gallus)
  misc_feature (36): n=c or t
ctaagagtgagaagaaacacattctgtagcaggtancctggacaaaatgtcatcctacaaggttctcagcc

SEQ ID NO: 22103 - DNA, 71 bp, chicken (Gallus Gallus)
  misc_feature (36): n=c or t
ggtgggtaggagtcaagcagtctgtaaacactgagngagaagagtttgtgtgaagtctaaacaagttaata

SEQ ID NO: 22104 - DNA, 71 bp, chicken (Gallus Gallus)
  misc_feature (36): n=a or g
aaaacttcttatcaacgcttaccccataataaaccncaatgttttcctgtaactcaattacaaaggaatat

SEQ ID NO: 22105 - DNA, 71 bp, chicken (Gallus Gallus)
  misc_feature (36): n=c or t
gttccgcagcacttttaacattcacacgcactctgntgactttaaggaagtctgtgcctggccctgcgcag

SEQ ID NO: 22106 - DNA, 71 bp, chicken (Gallus Gallus)
  misc_feature (36): n=g or t
aactaaattccaaatagtctaacactgttatttctnctttcctttctccctcaagccccctctaatttatc

SEQ ID NO: 22107 - DNA, 71 bp, chicken (Gallus Gallus)
  misc_feature (36): n=g or t
cagagcctctagtctctgcacatttatctgcagcanagtgaacaagcactcttgcctctcttgtaggcagg

SEQ ID NO: 22108 - DNA, 71 bp, chicken (Gallus Gallus)
  misc_feature (36): n=a or c
cagtttcataataaatgaatttctgaattgtcaganttctcacagaagggacagtaaagggcaggcttcaa

SEQ ID NO: 22109 - DNA, 71 bp, chicken (Gallus Gallus)
  misc_feature (36): n=c or t
acaccttcactgagttcatgtatcttctttattctncttcataaacagaccattggatcctttggacttcc

SEQ ID NO: 22110 - DNA, 71 bp, chicken (Gallus Gallus)
  misc_feature (36): n=a or t
acacactagatcacattgataatattttcctagtcntagatagaagatattttacttactgtttcaaataa

SEQ ID NO: 22111 - DNA, 71 bp, chicken (Gallus Gallus)
  misc_feature (36): n=a or g
cacttgaatattgaacattggcccattttacaagcnacaaagcctgagagttctccacctcactgccaagt

SEQ ID NO: 22112 - DNA, 71 bp, chicken (Gallus Gallus)
  misc_feature (36): n=a or t
taatgtaaagaagaatggagaacagaaaatagatcntttttttttttctttcaggacttaacagggaaaag

SEQ ID NO: 22113 - DNA, 71 bp, chicken (Gallus Gallus)
  misc_feature (36): n=a or g
aaatatttgcaaaaactcttggaatattataaaaantttacctccaaactgaaatagccagatgtttgagt

SEQ ID NO: 22114 - DNA, 71 bp, chicken (Gallus Gallus)
  misc_feature (36): n=c or g
agtagcaggatcccaatgcacaaatccctcattggnaagatctaaaacagagcagtggtaccagggaacct

SEQ ID NO: 22115 - DNA, 71 bp, chicken (Gallus Gallus)
  misc_feature (36): n=a or g
aatacttatgtgaattttttatttgtttgctattgnctggctttgtttttttttgttttttttctttttcc

SEQ ID NO: 22116 - DNA, 71 bp, chicken (Gallus Gallus)
  misc_feature (36): n=c or t
tccaagatcatctagttcatccatcagcccatcacnaccatgactgctaaccatgtccctcagtgtcacat

SEQ ID NO: 22117 - DNA, 71 bp, chicken (Gallus Gallus)
  misc_feature (36): n=a or g
ggtattattcacaaaatagccttgatttgtttgctngatttctctgctctgcctaataaggtagaaagctg

SEQ ID NO: 22118 - DNA, 71 bp, chicken (Gallus Gallus)
  misc_feature (36): n=c or t
gtaaacccatctaaaaatcttgaaatacaatttttntttttaaaaaaacagcaaagacaaaatccccaaac

SEQ ID NO: 22119 - DNA, 71 bp, chicken (Gallus Gallus)
  misc_feature (36): n=a or g
ggaggagataaatgcaatggatctgtgcaacaacantaattactgcacttggaaaaagaaagaaaggtgaa

SEQ ID NO: 22120 - DNA, 71 bp, chicken (Gallus Gallus)
  misc_feature (36): n=a or g
ggatcaactcacaaaaaatggaattattgcattatngtagtcagctacaatgccatcccctgaattttcac

SEQ ID NO: 22121 - DNA, 71 bp, chicken (Gallus Gallus)
  misc_feature (36): n=c or t
tttttggtttttttttaagtctatctatgtttgctntatgtcatggtatagcaaattgcaggattgcattc

SEQ ID NO: 22122 - DNA, 71 bp, chicken (Gallus Gallus)
  misc_feature (36): n=c or t
gtaactacgtccagttgatatttctcccaagaacantggtgagaaatctattaaattgaaagttttgtctt

SEQ ID NO: 22123 - DNA, 71 bp, chicken (Gallus Gallus)
  misc_feature (36): n=c or t
atttatatatcacgtatacatattaaaaacagaagntgccttatttaaagttggtctgacgaagttaaacc

SEQ ID NO: 22124 - DNA, 71 bp, chicken (Gallus Gallus)
  misc_feature (36): n=c or t
taattagtgaactgcaaatgactaatgcacccatantgtgcaaattcctcttttcatattcaaagcatagc

SEQ ID NO: 22125 - DNA, 71 bp, chicken (Gallus Gallus)
  misc_feature (36): n=c or t
tccattagaaggagatacgtatttttaatttggtanacatctacagagaaagacaaggattgttcttgcac

SEQ ID NO: 22126 - DNA, 71 bp, chicken (Gallus Gallus)
  misc_feature (36): n=g or t
cccactgttgaaaaatcactcaacaatgaaacccantaactgataataatgcaaaacatcactgtgtttgg

SEQ ID NO: 22127 - DNA, 71 bp, chicken (Gallus Gallus)
  misc_feature (36): n=c or g
aaagttaccaacgctcttaaccattaagctttaaancatctaaagggaattaaaggatctttttcatggcc

SEQ ID NO: 22128 - DNA, 71 bp, chicken (Gallus Gallus)
  misc_feature (36): n=c or t
agagcatccttatagtatgaggcgtggttcccaatngtctggtagtacttgctggagagatcatagaagcg

SEQ ID NO: 22129 - DNA, 71 bp, chicken (Gallus Gallus)
  misc_feature (36): n=a or c
tgcaaatgtcccagaacttttgcagggttaagaccncctggctgcgtctcatgtctacaaaatcaaggaca

SEQ ID NO: 22130 - DNA, 71 bp, chicken (Gallus Gallus)
  misc_feature (36): n=c or t
cagagtacatcttgccatccaaaattaaaaaatatnggtaagtcataatgttttgtgtctcaaatggtatc

SEQ ID NO: 22131 - DNA, 71 bp, chicken (Gallus Gallus)
  misc_feature (36): n=g or t
aactgatttaaaagcatgaattagattatcattccnatgtagataatgtatgtgtttgaagattagttccg

SEQ ID NO: 22132 - DNA, 71 bp, chicken (Gallus Gallus)
  misc_feature (36): n=a or g
aagcagcgagctctgcccagtttattttcacatccnttgtgttatgccctgctctttcaggcatcagaagt

SEQ ID NO: 22133 - DNA, 71 bp, chicken (Gallus Gallus)
  misc_feature (36): n=a or g
ccagagaaaggagctatagcacaaattccctgaatnctcactttcctccagccactttaatagttctaaca

SEQ ID NO: 22134 - DNA, 71 bp, chicken (Gallus Gallus)
  misc_feature (36): n=c or t
aattgaaactttgcagtcaacccaaaaatgagatcnccaacattggaatgctggagcacatgcctattgtg

SEQ ID NO: 22135 - DNA, 71 bp, chicken (Gallus Gallus)
  misc_feature (36): n=a or t
cctctttcttggatgagttatgttttagacctctgngtctctccattatttaccagtctgttttacttgtc

SEQ ID NO: 22136 - DNA, 71 bp, chicken (Gallus Gallus)
  misc_feature (36): n=c or t
acagaacgctttcctgctctgcaaggcgactggtcngtgcaggctgtgtgcgagcaataacttgtgtggat

SEQ ID NO: 22137 - DNA, 71 bp, chicken (Gallus Gallus)
  misc_feature (36): n=c or t
tctgagaaagttcagacttctttttatggatgcccngttgaatccccaccagttgctctcctccataagaa

SEQ ID NO: 22138 - DNA, 71 bp, chicken (Gallus Gallus)
  misc_feature (36): n=g or t
tcatgactgcttggggtagatttaattctttttctnctcaaatcagaaagttgtatggcaaatgtatcgca

SEQ ID NO: 22139 - DNA, 71 bp, chicken (Gallus Gallus)
  misc_feature (36): n=a or t
attcacagagtatggaattgagttaaactggacctnatttcaattagaaatatttatattttgttctagag

SEQ ID NO: 22140 - DNA, 71 bp, chicken (Gallus Gallus)
  misc_feature (36): n=a or g
gagtaccttttccctcacttggcaatattaggggcntgtgtgtacggctgtatttcaataaaacctcgcca

SEQ ID NO: 22141 - DNA, 71 bp, chicken (Gallus Gallus)
  misc_feature (36): n=a or t
aaactgttgacactattaacactttatttatgtatncgcagatataatcacacagtcataaaggaaaccat

SEQ ID NO: 22142 - DNA, 71 bp, chicken (Gallus Gallus)
  misc_feature (36): n=c or t
ctaacttcactctgtgctgctgcttttcctccaccnagactcaccactccatcctttttcttctctcttta

SEQ ID NO: 22143 - DNA, 71 bp, chicken (Gallus Gallus)
  misc_feature (36): n=c or t
caaaatagcaacagaaaacagggggttaataccagncttttttctcaaagaacaaaaacatagtaggtaat

SEQ ID NO: 22144 - DNA, 71 bp, chicken (Gallus Gallus)
  misc_feature (36): n=c or t
tttcacagctcaacttcttattcaagtaaatatttnatttgcttacaaactcttaatctgcctctcaacat

SEQ ID NO: 22145 - DNA, 71 bp, chicken (Gallus Gallus)
  misc_feature (36): n=c or t
tccttctttgaagcttatgcattattactttattantgtgaggtgctttcaatgtggaacaggcagttttg

SEQ ID NO: 22146 - DNA, 71 bp, chicken (Gallus Gallus)
  misc_feature (36): n=a or g
tcttctgccaaactgagaacgatttctgtaatctcngcaaccaaggatatacgcatctaatttgtttgctt

SEQ ID NO: 22147 - DNA, 71 bp, chicken (Gallus Gallus)
  misc_feature (36): n=a or t
cacaatattctgtgaatcattcataaatatacaatntaatgcctaatgacttttatcacagttcaaagaat

SEQ ID NO: 22148 - DNA, 71 bp, chicken (Gallus Gallus)
  misc_feature (36): n=c or t
aacagtcatcaataagtagcaatgcagaactgattngaccatcttggtacatcacaacttaaaaaaatact

SEQ ID NO: 22149 - DNA, 71 bp, chicken (Gallus Gallus)
  misc_feature (36): n=g or t
caagagatttatattcaaaacacgagcatcttcatngaaacgcatgattctcctattcagttttttatatg

SEQ ID NO: 22150 - DNA, 71 bp, chicken (Gallus Gallus)
  misc_feature (36): n=c or t
gaagcctggcctgtggtgcaaaaaaagagagcacantgcatcctttataaccctcaaaatagaaaagtgtg

SEQ ID NO: 22151 - DNA, 71 bp, chicken (Gallus Gallus)
  misc_feature (36): n=a or g
gtggaaacacaatacgtccagggtacgcactgagtncgctgctggccccacatggagcaaagggcatcagc

SEQ ID NO: 22152 - DNA, 71 bp, chicken (Gallus Gallus)
  misc_feature (36): n=a or g
ttttgtcaaggagtgttttcatgtgacagaatgagncaatatcatcacattacatgtacccttgggagcaa

SEQ ID NO: 22153 - DNA, 71 bp, chicken (Gallus Gallus)
  misc_feature (36): n=a or g
ccatagcccaactgatgcatattatgcacagaaaantatcttccttctgaaattctaaatttcttccagtg

SEQ ID NO: 22154 - DNA, 71 bp, chicken (Gallus Gallus)
  misc_feature (36): n=a or g
gtagacaattacacaatgtcctggttctacatgcantgaaatggtcacatgaggccaactgaggttctaaa

SEQ ID NO: 22155 - DNA, 71 bp, chicken (Gallus Gallus)
  misc_feature (36): n=a or g
tcagcaacatagcagaactgcgcatcagaactgagnatttagctgttaaaacaacgggttttcaatcttta

SEQ ID NO: 22156 - DNA, 71 bp, chicken (Gallus Gallus)
  misc_feature (36): n=c or t
tataaaatagatatcagtttgaaatacacgaaatangaaaaaactggggtggaagcagtacttcctgtgta

SEQ ID NO: 22157 - DNA, 71 bp, chicken (Gallus Gallus)
  misc_feature (36): n=c or t
tgttcatgacagaacttctgaagaagctttaattcnattcttgccatggctggagagccactatacactct

SEQ ID NO: 22158 - DNA, 71 bp, chicken (Gallus Gallus)
  misc_feature (36): n=c or t
tacagtagttatctcattgcagccactgttatttcngagcttattggatgctgccgtgtttgtagtggagc

SEQ ID NO: 22159 - DNA, 71 bp, chicken (Gallus Gallus)
  misc_feature (36): n=a or g
cactagatcacagaatttaactttgatgaatgcctnctggggaattgcatccaggagataatggtgtgcaa

SEQ ID NO: 22160 - DNA, 71 bp, chicken (Gallus Gallus)
  misc_feature (36): n=a or t
acaaaattgtgaaaggtaattttaggtcaatatacnataagcatgccagcttgctatgtgaaaatctctct

SEQ ID NO: 22161 - DNA, 71 bp, chicken (Gallus Gallus)
  misc_feature (36): n=a or g
aaagatttcaggtagaatgtaaatgtaatctcaccnagaaattaaaggcttacaacccgttctgttttctt

SEQ ID NO: 22162 - DNA, 71 bp, chicken (Gallus Gallus)
  misc_feature (36): n=c or t
gttttaaaatatctttcataaaaataactatttganatatccaaaatatgtgaaatgtttacacaaagtac

SEQ ID NO: 22163 - DNA, 71 bp, chicken (Gallus Gallus)
  misc_feature (36): n=g or t
agacttaccccagacaggcttcccaagaccagtctnactaactgcttcacatatgaaaaagatggggcaca

SEQ ID NO: 22164 - DNA, 71 bp, chicken (Gallus Gallus)
  misc_feature (36): n=g or t
tttttttttctactgcatactttgtgaatccaaganacagaatattaaccaccttcagctcataagtactt

SEQ ID NO: 22165 - DNA, 71 bp, chicken (Gallus Gallus)
  misc_feature (36): n=c or t
ctttctgttccaggtagtcactactatggctcatgnggatgaatgcaattcaggacaagtgtgataaaaac

SEQ ID NO: 22166 - DNA, 71 bp, chicken (Gallus Gallus)
  misc_feature (36): n=c or t
tggatgagcactggtggtagatctgcaatgcatctnacggattctctatgtaggtaatgataaaatattca

SEQ ID NO: 22167 - DNA, 71 bp, chicken (Gallus Gallus)
  misc_feature (36): n=g or t
ccctaactgagttgctggcatcaggaaggcctgganttggagcttttattaacacttgatgggcatttctt

SEQ ID NO: 22168 - DNA, 71 bp, chicken (Gallus Gallus)
  misc_feature (36): n=c or t
ttgtgttaaaatgattggtgtttatcaatgtttagnctttatcttacaattttagtccttttttttttttt

SEQ ID NO: 22169 - DNA, 71 bp, chicken (Gallus Gallus)
  misc_feature (36): n=g or t
gccgggagtttcagggcgagagcaaggaaagaaggncaagaatgacagctttaggaaaaagatattagctg

SEQ ID NO: 22170 - DNA, 71 bp, chicken (Gallus Gallus)
  misc_feature (36): n=a or g
ttttttttttttttttaattagattgttatgaaatntagattaattcactctgcatggatatgcagagatg

SEQ ID NO: 22171 - DNA, 71 bp, chicken (Gallus Gallus)
  misc_feature (36): n=c or t
gagcctttggctttgaagcctcatcttttttcccantcccaacagcaggcatgcccatatgcacacaacac

SEQ ID NO: 22172 - DNA, 71 bp, chicken (Gallus Gallus)
  misc_feature (36): n=g or t
tgcttgaaatggtttaattttacagcccatccgagngtaactctgttctatgaaagcttttcaccttttcc

SEQ ID NO: 22173 - DNA, 71 bp, chicken (Gallus Gallus)
  misc_feature (36): n=g or t
aatttactagagaatttcccactggctcttggcttnttcccaaatgagaatgtaatcttttaaagattaca

SEQ ID NO: 22174 - DNA, 71 bp, chicken (Gallus Gallus)
  misc_feature (36): n=c or t
agtgtcctatccattctgcttccaaacttcaccatncctctttactatctaaacagaaaaaatccccattc

SEQ ID NO: 22175 - DNA, 71 bp, chicken (Gallus Gallus)
  misc_feature (36): n=a or t
gacttattgtcccactgctgtgaatgatgttcaggntcttacatattatgaaacccatctgtttataactg

SEQ ID NO: 22176 - DNA, 71 bp, chicken (Gallus Gallus)
  misc_feature (36): n=a or g
taacgaggtttctacttcgggcagacggctccgggnctggaacaccgctcagtgtagagtgcagatcgcgc

SEQ ID NO: 22177 - DNA, 71 bp, chicken (Gallus Gallus)
  misc_feature (36): n=c or t
ctttttacaacacattattccagaatacactcatangctgctatgtatgactttaaataaatgaataaata

SEQ ID NO: 22178 - DNA, 71 bp, chicken (Gallus Gallus)
  misc_feature (36): n=a or g
tccaactctaaggattctatgattctctgatatatntttgtaagaaatgtagctttcaggtagagtttttt

SEQ ID NO: 22179 - DNA, 71 bp, chicken (Gallus Gallus)
  misc_feature (36): n=c or t
attaaaatgtttttggagatgcaagaataagatttngctgtgttacgagagatagtacagttttacccagt

SEQ ID NO: 22180 - DNA, 71 bp, chicken (Gallus Gallus)
  misc_feature (36): n=a or g
gtttctcgtccctacaactggacggctcagagggtntaatttgtgccttgctcattgctcccccttgcact

SEQ ID NO: 22181 - DNA, 71 bp, chicken (Gallus Gallus)
  misc_feature (36): n=g or t
taaagacaacattgttcataaagtaaaagcacattnatatcaatctgctcatactgaattagaacaaatat

SEQ ID NO: 22182 - DNA, 71 bp, chicken (Gallus Gallus)
  misc_feature (36): n=c or t
tagtttggatgtaaagcccttgcagggcagcttttngggctatcctaaagaagtggctgcaacaaataggc

SEQ ID NO: 22183 - DNA, 71 bp, chicken (Gallus Gallus)
  misc_feature (36): n=a or g
ttccttctgcaccaagcaaggttatccttggtcacntgtatacttcatagtatagggattattctgcacaa

SEQ ID NO: 22184 - DNA, 71 bp, chicken (Gallus Gallus)
  misc_feature (36): n=a or g
tgggtagtcagttcctgcaattctttgctgctacanccatgtctgactgactgcacatcaactgtgtcata

SEQ ID NO: 22185 - DNA, 71 bp, chicken (Gallus Gallus)
  misc_feature (36): n=g or t
agtttgcctgttaatttaaacaaatgaatattgccnaagctgttcataatgttttacatggtaagaccagc

SEQ ID NO: 22186 - DNA, 71 bp, chicken (Gallus Gallus)
  misc_feature (36): n=a or g
cacaatggcagaacgtggcccagcattcagcactcnagaaattttaaaaatagcagtgcctcaattaaatt

SEQ ID NO: 22187 - DNA, 71 bp, chicken (Gallus Gallus)
  misc_feature (36): n=a or g
gaggtggtagatataaatgaggtgagtccttatcantttgttcttgaaggaatcttggagagtatcagggt

SEQ ID NO: 22188 - DNA, 71 bp, chicken (Gallus Gallus)
  misc_feature (36): n=a or t
agacaattgtttcctttgagggttgttaaatggatncttcatcttttgctgttcctataacacagacataa

SEQ ID NO: 22189 - DNA, 71 bp, chicken (Gallus Gallus)
  misc_feature (36): n=a or g
aaaatactgtaaccctaaccttaggcctaaccttanccttgtgctgcacaaggctttggctgcaggatgag

SEQ ID NO: 22190 - DNA, 71 bp, chicken (Gallus Gallus)
  misc_feature (36): n=c or t
aatctaacgagagagttagaactttccaagcgttanagccgtgctctgaggcccagcataaatggacgaag

SEQ ID NO: 22191 - DNA, 71 bp, chicken (Gallus Gallus)
  misc_feature (36): n=a or g
aacaatcttccaatgtccagtaatgctgagcagtcngcaataccagctgtacttaggctaatataaaagac

SEQ ID NO: 22192 - DNA, 71 bp, chicken (Gallus Gallus)
  misc_feature (36): n=c or g
acggctgctagtatgctgtgattgcatttttgctcnttttttcctcttgagatttgttgctgaaaactagt

SEQ ID NO: 22193 - DNA, 71 bp, chicken (Gallus Gallus)
  misc_feature (36): n=a or g
ggttcagagcaaatgtgcttttaataaacgtttcgnctgaaattgagctcttcccccccaaagcaatttgt

SEQ ID NO: 22194 - DNA, 71 bp, chicken (Gallus Gallus)
  misc_feature (36): n=a or g
agaagtaaaactgaaacagtataaatcaaaagtacnttaacaaatactgctgcttaaagtgtgtgtagggc

SEQ ID NO: 22195 - DNA, 71 bp, chicken (Gallus Gallus)
  misc_feature (36): n=c or t
actggtttgctctggttttataatccaacaggacanggtcctacgtgattagcccagtacatcaataattt

SEQ ID NO: 22196 - DNA, 71 bp, chicken (Gallus Gallus)
  misc_feature (36): n=c or t
gcagctgtgaaataatgggtcacctacattggtgcngacttttaagagcaaggcatgcaggctcttgtctg

SEQ ID NO: 22197 - DNA, 71 bp, chicken (Gallus Gallus)
  misc_feature (36): n=c or t
ggattatttctcatatctcaccctcatgaacagctnctgatgtttcatcattgcattattgttgcttgttt

SEQ ID NO: 22198 - DNA, 71 bp, chicken (Gallus Gallus)
  misc_feature (36): n=c or t
ctatgggggaattagtgacacctgtaaagtagcaantatggttgataagcagatgtagtcggattgtagct

SEQ ID NO: 22199 - DNA, 71 bp, chicken (Gallus Gallus)
  misc_feature (36): n=a or g
taggatgtctgtccacatgaggacataatgaggcgnccaacaaaggtaagaccaggaatgtcctttttgat

SEQ ID NO: 22200 - DNA, 71 bp, chicken (Gallus Gallus)
  misc_feature (36): n=c or g
gtgaatgtgcaatattggtgggatttagcagtgctnccacagtaagggcaatcctctccacagcccacctc

SEQ ID NO: 22201 - DNA, 71 bp, chicken (Gallus Gallus)
  misc_feature (36): n=c or g
tcaacattgactctcactgaacagctctttaatatnacccactccttcacattgctgaccagtcacctcac

SEQ ID NO: 22202 - DNA, 71 bp, chicken (Gallus Gallus)
  misc_feature (36): n=c or t
tttagggacttgctttgcaggaatctgatgcagtcntttcacctccaatgatctgaggtcaaagtctgtaa

SEQ ID NO: 22203 - DNA, 71 bp, chicken (Gallus Gallus)
  misc_feature (36): n=c or t
ccaacgtcacgccagatcatcatctgctgtcacccncagccattgctcatgcctgacacacacctatgggc

SEQ ID NO: 22204 - DNA, 71 bp, chicken (Gallus Gallus)
  misc_feature (36): n=a or c
atagtgaagaaaaaccttttaatacttgatggggancagtgtagtgttctagcttgggataagcccatggg

SEQ ID NO: 22205 - DNA, 71 bp, chicken (Gallus Gallus)
  misc_feature (36): n=c or t
agttattccttcttcagaaatgaatttttgagtgangttttatctggattgtttctatcattgctggcaga

SEQ ID NO: 22206 - DNA, 71 bp, chicken (Gallus Gallus)
  misc_feature (36): n=a or g
tgctctaaatgaaagattgtttttccatcttaaacntcatcttccaatagaaatcttcctatattttcaat

SEQ ID NO: 22207 - DNA, 71 bp, chicken (Gallus Gallus)
  misc_feature (36): n=c or t
cttaacttttcctctgttaagtcctgacagtctaantcccaaggctcccaagaaccataacgaatgatgtc

SEQ ID NO: 22208 - DNA, 71 bp, chicken (Gallus Gallus)
  misc_feature (36): n=c or t
ttgaagtacatattaagcaatgtagtgcatttactnttgaaagatgcatctgtatgtttctgaagacaaga

SEQ ID NO: 22209 - DNA, 71 bp, chicken (Gallus Gallus)
  misc_feature (36): n=c or t
gttatataactatgcaggcagaaaaactccttctgncaacaggctctgtctctaaagaaagggatcttttt

SEQ ID NO: 22210 - DNA, 71 bp, chicken (Gallus Gallus)
  misc_feature (36): n=g or t
ttaattaaggtgcaatcttatctaaataatcagtgngctgtaaaacaccagagtcaaactacatagctgca

SEQ ID NO: 22211 - DNA, 71 bp, chicken (Gallus Gallus)
  misc_feature (36): n=c or t
tgtcttatactttctaaaatgcaactggtagatgtnctcttgctttagctcttcagcctgagaaacctgca

SEQ ID NO: 22212 - DNA, 71 bp, chicken (Gallus Gallus)
  misc_feature (36): n=a or g
cgtgtttctagaattgcattctctcaatacgtggancaactgaagaagagagctgcaccattatggggctt

SEQ ID NO: 22213 - DNA, 71 bp, chicken (Gallus Gallus)
  misc_feature (36): n=c or t
catctcacagttgaataatttgtctagaaggattcnatgagggatggtgtcaaaggtcctactgaaataca

SEQ ID NO: 22214 - DNA, 71 bp, chicken (Gallus Gallus)
  misc_feature (36): n=a or g
tctactataacaggaaattcagacaccctctccaanggatcttccacagtatccagctttgctagtctcat

SEQ ID NO: 22215 - DNA, 71 bp, chicken (Gallus Gallus)
  misc_feature (36): n=c or t
cagcaactgaagaggcagttttaggaagcgatgtcnggcaggtttagtgcggtaattcttaagtctggtgt

SEQ ID NO: 22216 - DNA, 71 bp, chicken (Gallus Gallus)
  misc_feature (36): n=c or t
tctttctgctgaacctaacttttgcttttctttatncatgacaaaaagaaaggcaactacaataatgcatc

SEQ ID NO: 22217 - DNA, 71 bp, chicken (Gallus Gallus)
  misc_feature (36): n=a or g
tttgtacaaatatgataaaaaaacatgcctactctntgtttacttcatttatgtctttccaaggtggttat

SEQ ID NO: 22218 - DNA, 71 bp, chicken (Gallus Gallus)
  misc_feature (36): n=c or t
agatctgcaaggcagatagatattttcctttgagcnagtcatgatgagctccacttgtcatcaagagagac

SEQ ID NO: 22219 - DNA, 71 bp, chicken (Gallus Gallus)
  misc_feature (36): n=c or t
acttatttcaggttcatgactcaagaggacaatctncttttctcaattccaatctatggtttgtttgcaaa

SEQ ID NO: 22220 - DNA, 71 bp, chicken (Gallus Gallus)
  misc_feature (36): n=a or t
tatagcaactacttcaacacaaagtgaggagaaganagagacaatttaactaattagtgtaagtcacgatg

SEQ ID NO: 22221 - DNA, 71 bp, chicken (Gallus Gallus)
  misc_feature (36): n=a or g
gggttagcatatcagaagggactgcacagaaagccntggtaccctcagtggatgctgtaaacagacacagc

SEQ ID NO: 22222 - DNA, 71 bp, chicken (Gallus Gallus)
  misc_feature (36): n=g or t
tccttaaaaatggggtgctttgctctggactctccncaggttttccatgagattcttcaagttgcagcagt

SEQ ID NO: 22223 - DNA, 71 bp, chicken (Gallus Gallus)
  misc_feature (36): n=c or t
atcagagaccagctcccagaacttgcaggactaaanttcctctcccaataactcattgcttcaatgagagt

SEQ ID NO: 22224 - DNA, 71 bp, chicken (Gallus Gallus)
  misc_feature (36): n=a or c
cataaagattattaagagtcttgagcatctcccttnctaggcaaagagacctgggactgtttagcctggag

SEQ ID NO: 22225 - DNA, 71 bp, chicken (Gallus Gallus)
  misc_feature (36): n=a or g
gagtgaagagttccttctgtcaatgtctaacttgcntattgttgaccaggtcacccgagttcatgtttact

SEQ ID NO: 22226 - DNA, 71 bp, chicken (Gallus Gallus)
  misc_feature (36): n=c or t
atgcatgtgctgaggaagcagggaaggagatttcanagacttggcaactcaccaagatgaatggctatttg

SEQ ID NO: 22227 - DNA, 71 bp, chicken (Gallus Gallus)
  misc_feature (36): n=a or c
gaggagctagttcacctattctctagaaaatacaanaggaacatattctagactctcttccagttcttcag

SEQ ID NO: 22228 - DNA, 71 bp, chicken (Gallus Gallus)
  misc_feature (36): n=a or g
tagggcattgctacagaattgaagaaaacaacaagncagcaaacactgttaacccacagggtactgactgt

SEQ ID NO: 22229 - DNA, 71 bp, chicken (Gallus Gallus)
  misc_feature (36): n=a or g
aacaagagcaatttcctctctgtgagctggctcatntggatcctcttggggcacagtctggagaacatgct

SEQ ID NO: 22230 - DNA, 71 bp, chicken (Gallus Gallus)
  misc_feature (36): n=a or t
gggggattctgatttatgccattatttgcacatccncagatcttgttttgagtgggtatttcccatgtgtc

SEQ ID NO: 22231 - DNA, 71 bp, chicken (Gallus Gallus)
  misc_feature (36): n=a or t
cactacttcctaatcacagtccagtatattctgggnttggtaatttgctcactgaacaggcaggtaagtca

SEQ ID NO: 22232 - DNA, 71 bp, chicken (Gallus Gallus)
  misc_feature (36): n=c or t
cagtgtaaatatagcacaatagtatgtcatctgttngaggatttttttgcttgtttttggaaaaaaaggta

SEQ ID NO: 22233 - DNA, 71 bp, chicken (Gallus Gallus)
  misc_feature (36): n=a or g
cgagctccatagagatacaaatgcataattcaagcntcccacaaatgatcatataaaatgcacatcaagga

SEQ ID NO: 22234 - DNA, 71 bp, chicken (Gallus Gallus)
  misc_feature (36): n=a or g
cctgaggtctttttggaacctgaatttaggtacatntcctggctgcatccaccatgacagtgagaagagac

SEQ ID NO: 22235 - DNA, 71 bp, chicken (Gallus Gallus)
  misc_feature (36): n=c or g
ttttgtgtcagataacgacaatgaatagcaaaagtntgtctttgacaggaatacatatactgaccttcaat

SEQ ID NO: 22236 - DNA, 71 bp, chicken (Gallus Gallus)
  misc_feature (36): n=a or t
tatattgggttaaagtgctgaacttgaaaaccaacntgcaattatttttcctgtgttgtcccccagcctta

SEQ ID NO: 22237 - DNA, 71 bp, chicken (Gallus Gallus)
  misc_feature (36): n=a or c
cttctctctggcctgttcctgcattttgcaggaaanatctattgagtaataagataatcatctggagagta

SEQ ID NO: 22238 - DNA, 71 bp, chicken (Gallus Gallus)
  misc_feature (36): n=c or t
aaagcgtagagatttgaaaaataccaagagttcagngctgtgcctactagtataacagataggcaattctg

SEQ ID NO: 22239 - DNA, 71 bp, chicken (Gallus Gallus)
  misc_feature (36): n=g or t
acagatctctggatctaaaagattacaagaagaaancagaatctcttacttcagggtggtgcagtagtgaa

SEQ ID NO: 22240 - DNA, 71 bp, chicken (Gallus Gallus)
  misc_feature (36): n=c or t
gaagttatgtacagtgtcatttaactatgtattgantacaaccagatgccttctcggtgtttttggagaca

SEQ ID NO: 22241 - DNA, 71 bp, chicken (Gallus Gallus)
  misc_feature (36): n=g or t
actcctttcagcaaacagataacaaagaagctacanacacatatactgtaagtatcttgtatgtaatttgc

SEQ ID NO: 22242 - DNA, 71 bp, chicken (Gallus Gallus)
  misc_feature (36): n=a or g
aaaattagcaagaatagttgtatcggtgctggttgnctctcaaatacatgcccatgggttgcttctcagaa

SEQ ID NO: 22243 - DNA, 71 bp, chicken (Gallus Gallus)
  misc_feature (36): n=c or t
ctagaggatgaacagaataattgtagaggcttaatnctgtggaactgtactccgttagattccagcatcag

SEQ ID NO: 22244 - DNA, 71 bp, chicken (Gallus Gallus)
  misc_feature (36): n=a or t
tcagaaaggctgcatttaaaatgatatgaaaatttntaaaaaattaaagaataaaaaacatctcttcttta

SEQ ID NO: 22245 - DNA, 71 bp, chicken (Gallus Gallus)
  misc_feature (36): n=a or g
atttatgtttagttatagttttagattaattaaatntgggaaagaagaggacaagttctaagttgtgatac

SEQ ID NO: 22246 - DNA, 71 bp, chicken (Gallus Gallus)
  misc_feature (36): n=c or t
aggagcctgagatccaaaaatagagagctgtcatantcccagtgcaggaaatacaggcaccttattagaag

SEQ ID NO: 22247 - DNA, 71 bp, chicken (Gallus Gallus)
  misc_feature (36): n=a or c
actgacagtgcgtgtattcgatagacgctgttattntatccttaccagattttacttcaagatggcagttc

SEQ ID NO: 22248 - DNA, 71 bp, chicken (Gallus Gallus)
  misc_feature (36): n=g or t
aaggggaatgaagtttcagttggtgtgactgtattnggggcaagaagaacaaatcagagaaggcttcaagc

SEQ ID NO: 22249 - DNA, 71 bp, chicken (Gallus Gallus)
  misc_feature (36): n=a or t
tacctcaactcaaaggcttttttgtcaccctacttnttccctcttttctgttgaggagggggagtgagaga

SEQ ID NO: 22250 - DNA, 71 bp, chicken (Gallus Gallus)
  misc_feature (36): n=c or g
tagaaacagctgtgctgcttcccctatcgctgaatntgtcacttctaactgttcctatccagagctgaaag

SEQ ID NO: 22251 - DNA, 71 bp, chicken (Gallus Gallus)
  misc_feature (36): n=a or c
aaagcataaaaagacttaagattctggaaataaaanagaacccgtccaaaaaaaaaaaaaaaaaaaaaaag

SEQ ID NO: 22252 - DNA, 71 bp, chicken (Gallus Gallus)
  misc_feature (36): n=g or t
atgaagtacaaagcatcagcagcaagctattagaancatcccttcaaggtacagttttaaatgaaccgatc

SEQ ID NO: 22253 - DNA, 71 bp, chicken (Gallus Gallus)
  misc_feature (36): n=c or g
ggatagaatccccaaaaggagacaagcaagggtatntttgtgtacttccaaatgaaacgtatgatatttta

SEQ ID NO: 22254 - DNA, 71 bp, chicken (Gallus Gallus)
  misc_feature (36): n=a or g
aaggttcatccaactcccttcagtctcactggagancacataagacccagaaagagaatggataaaagtca

SEQ ID NO: 22255 - DNA, 71 bp, chicken (Gallus Gallus)
  misc_feature (36): n=c or t
cagacaccagctgcctgcagatagtaaggtgactangcataaaggaagcagataggtcaaggagttatgcc

SEQ ID NO: 22256 - DNA, 71 bp, chicken (Gallus Gallus)
  misc_feature (36): n=a or g
atatcataaactgtcttttttaccttttaggaagcntaattgagggtactcaaactgttatgtggagtagg

SEQ ID NO: 22257 - DNA, 71 bp, chicken (Gallus Gallus)
  misc_feature (36): n=c or t
accttgaagatattatcctgtaatcataatagtaanctttctttaacacctaaaattgctaaaggtcctat

SEQ ID NO: 22258 - DNA, 71 bp, chicken (Gallus Gallus)
  misc_feature (36): n=a or g
gcaatgggaaatgtggtttaataaggtgctagctgnaaagctctatcctcttaataaaaaaatattgcagt

SEQ ID NO: 22259 - DNA, 71 bp, chicken (Gallus Gallus)
  misc_feature (36): n=c or t
aagctcggttttggttttgtgaaagaaatatttccnattgtctttcagagagccatttcggtttcactgga

SEQ ID NO: 22260 - DNA, 71 bp, chicken (Gallus Gallus)
  misc_feature (36): n=c or t
tcgtactgaaggaagattagagaatcaaacatctgnctctaaaaagtattttaagactacatctggtctct

SEQ ID NO: 22261 - DNA, 71 bp, chicken (Gallus Gallus)
  misc_feature (36): n=a or g
ttcctaaggatgaatttcagcaaaggttgcccgccngtcttcaacaccttacgatcattatataaagacaa

SEQ ID NO: 22262 - DNA, 71 bp, chicken (Gallus Gallus)
  misc_feature (36): n=g or t
gaccaagagcacatatcatggcgggtataaatcctnctcaaagacaaaagcacatacttagtttacaagac

SEQ ID NO: 22263 - DNA, 71 bp, chicken (Gallus Gallus)
  misc_feature (36): n=a or t
tttcatagcttttaaaaattagaatccatttatcancatcaatcattttgcaaacattgtgcagtaaagcc

SEQ ID NO: 22264 - DNA, 71 bp, chicken (Gallus Gallus)
  misc_feature (36): n=c or t
acatatcctagccaaagataacagtaaggaatttcngggagaaaaaaaaaataggaaaaaaagaaaaaaaa

SEQ ID NO: 22265 - DNA, 71 bp, chicken (Gallus Gallus)
  misc_feature (36): n=a or t
aataacattattgatgaggcttccatttctgtatantattttctaacattgtaattgcaaggcttttctta

SEQ ID NO: 22266 - DNA, 71 bp, chicken (Gallus Gallus)
  misc_feature (36): n=c or t
gacatgcaattggcttataaaatgaaatctgcttangtacatgttttccctctcatttgtctacttgtgag

SEQ ID NO: 22267 - DNA, 71 bp, chicken (Gallus Gallus)
  misc_feature (36): n=c or t
catatcctctggaagtcagaggcactgacagaatgnactccagcactgcatgttttaccataccacagcac

SEQ ID NO: 22268 - DNA, 71 bp, chicken (Gallus Gallus)
  misc_feature (36): n=a or c
agcgttccagctttcccatttctgtatgccaagatnacagccttctttgtagactccttgcaagcagactc

SEQ ID NO: 22269 - DNA, 71 bp, chicken (Gallus Gallus)
  misc_feature (36): n=c or t
ttcctaaaatacagtttaataaaattaaaatgtttnggttatggctgtgggtagcatttaagcattgtgaa

SEQ ID NO: 22270 - DNA, 71 bp, chicken (Gallus Gallus)
  misc_feature (36): n=c or t
agaaaatggtggatattctggtgacactcctatctnggaacccaacctagtcagtgagcagtggtcttgta

SEQ ID NO: 22271 - DNA, 71 bp, chicken (Gallus Gallus)
  misc_feature (36): n=g or t
ataagaaaccagaggacagtgtatactcatttgagngtatctggctacagcacgaactttcagagaagatt

SEQ ID NO: 22272 - DNA, 71 bp, chicken (Gallus Gallus)
  misc_feature (36): n=c or t
cagtgtctaatactttaccctggagaaaacatcagnttacttttaaagccttttttgttgccatttcagac

SEQ ID NO: 22273 - DNA, 71 bp, chicken (Gallus Gallus)
  misc_feature (36): n=a or c
gaaggaatccgtttttgttcacacaaagtcaagcancttcaattaaaaactggttatttattgacaaaaca

SEQ ID NO: 22274 - DNA, 71 bp, chicken (Gallus Gallus)
  misc_feature (36): n=a or g
ttccattgatgatagaagaaataggtaattaccccntggtttgtaacaaaaattaaaaagcacagaaaacc

SEQ ID NO: 22275 - DNA, 71 bp, chicken (Gallus Gallus)
  misc_feature (36): n=c or t
tttggcagagggatacccttaacatagattcacaanacagctgtgcttttcttcctgaaagtacttggctt

SEQ ID NO: 22276 - DNA, 71 bp, chicken (Gallus Gallus)
  misc_feature (36): n=a or g
aagacgcctactacaacaggctggtaaaaggcttgnaaaaagtggatacaggttatgctagttattcatct

SEQ ID NO: 22277 - DNA, 71 bp, chicken (Gallus Gallus)
  misc_feature (36): n=c or t
tttctttgtgaactatgccgaattgttagctgtatntgtcccaatggagactgccccagagttgttccgct

SEQ ID NO: 22278 - DNA, 71 bp, chicken (Gallus Gallus)
  misc_feature (36): n=a or g
aaaaatttagttgttttaattttgtagatcaaaccntaggtagcacagtgatatgcttaaaattagaaaat

SEQ ID NO: 22279 - DNA, 71 bp, chicken (Gallus Gallus)
  misc_feature (36): n=c or t
ctccttgtcccacctttctttctcctatgaggacantgacagagccaatctaagataaatactgaatttaa

SEQ ID NO: 22280 - DNA, 71 bp, chicken (Gallus Gallus)
  misc_feature (36): n=c or g
cttttatatatatattgaaattggaatagatgtgtngaggtcctgtagttggatcatatcatatcatatca

SEQ ID NO: 22281 - DNA, 71 bp, chicken (Gallus Gallus)
  misc_feature (36): n=a or g
gtttttgggggctctaaaattcaaagagcagctttncctctcaaaaatactaacaaaaaatctacaacaag

SEQ ID NO: 22282 - DNA, 71 bp, chicken (Gallus Gallus)
  misc_feature (36): n=a or g
tcagctagagaataactacaaaacacattttattcncattttgacattattatccttaagtccagcctcac

SEQ ID NO: 22283 - DNA, 71 bp, chicken (Gallus Gallus)
  misc_feature (36): n=a or g
tctcaatgacaaatacaggaaagtaagtgtaaatanaagtgtgtaattagaaaggtgtgtatgtattccag

SEQ ID NO: 22284 - DNA, 71 bp, chicken (Gallus Gallus)
  misc_feature (36): n=a or g
aataaacacttaaatgcaacattttacaatggcagncaaaaaatcccccagactgcgttggtagatactat

SEQ ID NO: 22285 - DNA, 71 bp, chicken (Gallus Gallus)
  misc_feature (36): n=c or t
cacatctgcacagaagaatgctttttacagtaaacngctgactgcatgatgcacaccgcttctaccgctgc

SEQ ID NO: 22286 - DNA, 71 bp, chicken (Gallus Gallus)
  misc_feature (36): n=c or t
tccacaccagcaccggcaagatatttttcatacagntgcccatcatgtttaaaagcttaatcactgattga

SEQ ID NO: 22287 - DNA, 71 bp, chicken (Gallus Gallus)
  misc_feature (36): n=c or t
acatagctttactcttagtttgtaagcgttagacanagtgctcacttctctatgagctcctcatacttctc

SEQ ID NO: 22288 - DNA, 71 bp, chicken (Gallus Gallus)
  misc_feature (36): n=c or t
cctttgcaaattatgcaaagttcaacgagagcaaangcaaggtcctgcatctgggtcagggcaatcctaag

SEQ ID NO: 22289 - DNA, 71 bp, chicken (Gallus Gallus)
  misc_feature (36): n=a or c
tgctggcaggagaaagccagaggaacctgtgagagngtgtgagacgttgcttgccaagaggcaaggagcag

SEQ ID NO: 22290 - DNA, 71 bp, chicken (Gallus Gallus)
  misc_feature (36): n=a or g
agtgttcagtgataacgcagcatttcgaacactatnaagtattcaattgcaatgtcgacctaacaggaatg

SEQ ID NO: 22291 - DNA, 71 bp, chicken (Gallus Gallus)
  misc_feature (36): n=c or t
ggcaaaatattgggaaatttgtatctgatggctganttggtatccaaagaaaatgttttgaaaagtgatag

SEQ ID NO: 22292 - DNA, 71 bp, chicken (Gallus Gallus)
  misc_feature (36): n=c or t
ctttacagtccccaagggtataattctttggtcaancataagaaatataaatacttctataaacctatact

SEQ ID NO: 22293 - DNA, 71 bp, chicken (Gallus Gallus)
  misc_feature (36): n=c or t
ggcctgtgaaaaacacaaatgcaaagccactttctnttaatgagcacaccccagcaatgagtagctgtaag

SEQ ID NO: 22294 - DNA, 71 bp, chicken (Gallus Gallus)
  misc_feature (36): n=a or g
cacagaactgattcatcccaacgtaccacattttcnagaaggcattttctgttcaaatggctttgtaaaag

SEQ ID NO: 22295 - DNA, 71 bp, chicken (Gallus Gallus)
  misc_feature (36): n=a or g
taccagacccttttgaattctaatcccataatcccntatctttcagcacttttcaacttactattacatgg

SEQ ID NO: 22296 - DNA, 71 bp, chicken (Gallus Gallus)
  misc_feature (36): n=a or g
ggtttaggctcagttttaggtggaagggttttttcncgttccatcatctatctcgacagactctccatgtg

SEQ ID NO: 22297 - DNA, 71 bp, chicken (Gallus Gallus)
  misc_feature (36): n=c or t
tgtagtcttagtttatttcttatgagtgcctcaatncagtaaatgcattcaggtatcagaggtgcacttac

SEQ ID NO: 22298 - DNA, 71 bp, chicken (Gallus Gallus)
  misc_feature (36): n=a or g
ctctatgattatggagtcccaccttcggcctggacnggaagtgtggacatcctcttggaatattacagttc

SEQ ID NO: 22299 - DNA, 71 bp, chicken (Gallus Gallus)
  misc_feature (36): n=c or t
tttaaagggtttgagaaatggcagaagaccattttnctgaagtaactcacggttacatgacaatgtcttgc

SEQ ID NO: 22300 - DNA, 71 bp, chicken (Gallus Gallus)
  misc_feature (36): n=g or t
tttaaccttttccatcctatttgctaattacttatnttgtaattaacccattatgcatctgtcattgtatt

SEQ ID NO: 22301 - DNA, 71 bp, chicken (Gallus Gallus)
  misc_feature (36): n=c or t
tccctccaacttattctagcaatgctttctgttcanagactcatttaatggtttgggttggaagggacttt

SEQ ID NO: 22302 - DNA, 71 bp, chicken (Gallus Gallus)
  misc_feature (36): n=a or g
gctgaaaattgctgaactggaagtaaaccatggaanagctttaaatccctccactcctttggatcttgctg

SEQ ID NO: 22303 - DNA, 71 bp, chicken (Gallus Gallus)
  misc_feature (36): n=a or g
ctctatttaaaaaaaaaaaatcattcttttatcccngtctttgaagatggttgttgccatggaaacatgcg

SEQ ID NO: 22304 - DNA, 71 bp, chicken (Gallus Gallus)
  misc_feature (36): n=a or g
tatagggccatgtaggctgacctactccaggacccnaaaatatcttagggaaaataatcttcagataaaat

SEQ ID NO: 22305 - DNA, 71 bp, chicken (Gallus Gallus)
  misc_feature (36): n=a or g
acaaagaaactggaaaaactccagaatcttcacacncacctccttttcaccctgacacgcacgtaatgctt

SEQ ID NO: 22306 - DNA, 71 bp, chicken (Gallus Gallus)
  misc_feature (36): n=a or c
aacaaacaacacatcagtaagtcactgtcttgatanaactgcatccctgtaccactgtatcagaagtatac

SEQ ID NO: 22307 - DNA, 71 bp, chicken (Gallus Gallus)
  misc_feature (36): n=c or t
cttgctgttgtgtcttaacctggtgggcagctgagncctgcacagacatttgcttactcctcctaagtgga

SEQ ID NO: 22308 - DNA, 71 bp, chicken (Gallus Gallus)
  misc_feature (36): n=a or g
tccagaaatattaaggcaataaaggacatggggtcntaatatctaatagctttttctcagagaggtttcct

SEQ ID NO: 22309 - DNA, 71 bp, chicken (Gallus Gallus)
  misc_feature (36): n=a or g
cagacatcattatctagtaaatgtacttgtcattancattctaatattctaagccacattaaaatgtctga

SEQ ID NO: 22310 - DNA, 71 bp, chicken (Gallus Gallus)
  misc_feature (36): n=a or g
taaaggagacacttgttaaagctccttgcaagacangctcctgaagatttaagttgctatggtgtaggagg

SEQ ID NO: 22311 - DNA, 71 bp, chicken (Gallus Gallus)
  misc_feature (36): n=a or t
cttcttcaccggacctatcaatgtttcccactcacnttcacctcagttcaatctcaggtgagatagtctta

SEQ ID NO: 22312 - DNA, 71 bp, chicken (Gallus Gallus)
  misc_feature (36): n=c or t
atgcagtttttaaggagccttttttcagatgctttnctatgcttcagtaactcagtaacagtttgtactta

SEQ ID NO: 22313 - DNA, 71 bp, chicken (Gallus Gallus)
  misc_feature (36): n=c or t
ttgaggaatttaagtatgactgtatcacctgttccncactttaaacacaaatggacaatattctgaaacac

SEQ ID NO: 22314 - DNA, 71 bp, chicken (Gallus Gallus)
  misc_feature (36): n=a or g
tttggatagaagagaaggtggcgttcatggtattancaaatcatgttattaccaggaggaatatataccag

SEQ ID NO: 22315 - DNA, 71 bp, chicken (Gallus Gallus)
  misc_feature (36): n=a or c
gtccttaaaagtaatggttcacctactcttcatatntctcaagccatcatcccctacaaatcaagaagaac

SEQ ID NO: 22316 - DNA, 71 bp, chicken (Gallus Gallus)
  misc_feature (36): n=a or g
gttaaccctttctgataaatgagaaaggagaaatgntaacagcagacatggcttttagtttaaatagattc

SEQ ID NO: 22317 - DNA, 71 bp, chicken (Gallus Gallus)
  misc_feature (36): n=a or t
tgaagctctgctggatacctcagatcactgtctcancttgtattgccagttttcaaaactgaattgaaaag

SEQ ID NO: 22318 - DNA, 71 bp, chicken (Gallus Gallus)
  misc_feature (36): n=c or g
tgacggtgatttggatgtcttggaaagagtgggacntgagcatgctggagatggtatagagtggggggaga

SEQ ID NO: 22319 - DNA, 71 bp, chicken (Gallus Gallus)
  misc_feature (36): n=a or g
ggaaattttgttcttatcactttgcttcatagagcntgtaggtttcatatccctgcatgttgcacagcttt

SEQ ID NO: 22320 - DNA, 71 bp, chicken (Gallus Gallus)
  misc_feature (36): n=a or g
aatccattttacatatctgcagctagtataatgtgngttttgtcattaaccaagtcatttcagatccgtct

SEQ ID NO: 22321 - DNA, 71 bp, chicken (Gallus Gallus)
  misc_feature (36): n=c or t
cagtatctggtgcccttactctaacaacgcatcgcnctgggtgctgacatttaatctgttcgtcaacagat

SEQ ID NO: 22322 - DNA, 71 bp, chicken (Gallus Gallus)
  misc_feature (36): n=a or g
ggtggacagggcaagaaaaccaagaaacaaaaccantccacccaatagagctagaagagcgagctgtggtt

SEQ ID NO: 22323 - DNA, 71 bp, chicken (Gallus Gallus)
  misc_feature (36): n=a or g
agaaaggatgaaggctagaaaagcttttattggatncagtaaagtgacaacacagtttctgaagataagct

SEQ ID NO: 22324 - DNA, 71 bp, chicken (Gallus Gallus)
  misc_feature (36): n=c or t
acttttgagcagtttaaagaagctcttcaggaactntccaagaagcgatttaaagaaaaaagtgatgagga

SEQ ID NO: 22325 - DNA, 71 bp, chicken (Gallus Gallus)
  misc_feature (36): n=a or g
agctgacatccaagcatcaaacagaaaaagatttgnaggattgcctttttaaggaagatttgcaggattat

SEQ ID NO: 22326 - DNA, 71 bp, chicken (Gallus Gallus)
  misc_feature (36): n=a or g
ttatatgtagttgaagtgctactgcactgcagcaangagagtctgaaaaattctgctactgaggctgcaaa

SEQ ID NO: 22327 - DNA, 71 bp, chicken (Gallus Gallus)
  misc_feature (36): n=c or g
agcttacttagtcaaacccctgtgctcttccatttnaagtcttagcttattcatgatacagtctatttaga

SEQ ID NO: 22328 - DNA, 71 bp, chicken (Gallus Gallus)
  misc_feature (36): n=g or t
tcttaagcatgcgttacatttttttgaacaagacantaacgatgaaaaaggaattgtttgggaaaaactaa

SEQ ID NO: 22329 - DNA, 71 bp, chicken (Gallus Gallus)
  misc_feature (36): n=a or c
gatttcaatccaaattggctctgattacaaccaagncgagcccgtggtgagcgggatgctgcagaagcagt

SEQ ID NO: 22330 - DNA, 71 bp, chicken (Gallus Gallus)
  misc_feature (36): n=c or t
aaagatttttttcttctctgtatgctgtagaaaatngccaaaataaattgagttgatctcaagtgaatacc

SEQ ID NO: 22331 - DNA, 71 bp, chicken (Gallus Gallus)
  misc_feature (36): n=c or t
agcaaggacttctgtgcacagaaggccacagtctangttagcatccatcagcagaatcgtggatcactttg

SEQ ID NO: 22332 - DNA, 71 bp, chicken (Gallus Gallus)
  misc_feature (36): n=c or g
gattttttgttgttgacgtttggattttttactaanttgggccaagtcatttcagagactgagataattgt

SEQ ID NO: 22333 - DNA, 71 bp, chicken (Gallus Gallus)
  misc_feature (36): n=c or g
tttggtggtttgatggttggagtagatagatcttantggtcttcttcaagcttagtaattccatgattcta

SEQ ID NO: 22334 - DNA, 71 bp, chicken (Gallus Gallus)
  misc_feature (36): n=c or t
tctctggtggagctgaatagagtctaaggctgcatnttcttttacagctaagcttcagattcaaacttatt

SEQ ID NO: 22335 - DNA, 71 bp, chicken (Gallus Gallus)
  misc_feature (36): n=a or g
attgctgtaatgtaatattgccataatgcatcaaanccttcctcactgatgatgtaatatgaccaccagtg

SEQ ID NO: 22336 - DNA, 71 bp, chicken (Gallus Gallus)
  misc_feature (36): n=a or g
ataagtggataaatgccatctgaataaaatgctccnaaaagatcccataaagagcctccaagcacaatcct

SEQ ID NO: 22337 - DNA, 71 bp, chicken (Gallus Gallus)
  misc_feature (36): n=a or c
tcttgcagctgagcatttatagagtattatcttaanaaatggaaaagatagtgaaatgtaacaaaataaca

SEQ ID NO: 22338 - DNA, 71 bp, chicken (Gallus Gallus)
  misc_feature (36): n=c or t
tctggaaggcatatataggctgaacagaaacacatngtaagatttattttagctgaataatcctgtgcaca

SEQ ID NO: 22339 - DNA, 71 bp, chicken (Gallus Gallus)
  misc_feature (36): n=a or c
tatgttggcacgcttccaaaacctgaccaaaaaaanccccaacaaccctcaagttgtcttcccccccagcc

SEQ ID NO: 22340 - DNA, 71 bp, chicken (Gallus Gallus)
  misc_feature (36): n=c or t
tccacttggatgtcctgggcaatagactcaaacccnttcagtgttgaggagctactgggaaggcctggact

SEQ ID NO: 22341 - DNA, 71 bp, chicken (Gallus Gallus)
  misc_feature (36): n=c or t
gattgaagctactgagtgaaccgcatagttacctcnctgcctcagagcagtttctactcggagctttgctc

SEQ ID NO: 22342 - DNA, 71 bp, chicken (Gallus Gallus)
  misc_feature (36): n=a or g
tacaccagaagctgctaagttttattgggaaacagncagtgtgttgtgataatgcaaaaatgctcttcaca

SEQ ID NO: 22343 - DNA, 71 bp, chicken (Gallus Gallus)
  misc_feature (36): n=a or g
ataggtattatactttctttttactttagcaaagtnaaatcctcaagctgtctttcatttccttgacaaaa

SEQ ID NO: 22344 - DNA, 71 bp, chicken (Gallus Gallus)
  misc_feature (36): n=c or g
cagcttaataaaaacttacagtgaaagctgtgcagnttaccagggcttccaaaagcaaggtgtgtattctt

SEQ ID NO: 22345 - DNA, 71 bp, chicken (Gallus Gallus)
  misc_feature (36): n=a or g
cgatccctttacccctcggataaatgaacacatccnaggttttgaggtgctaaatgcaggcatatatctgc

SEQ ID NO: 22346 - DNA, 71 bp, chicken (Gallus Gallus)
  misc_feature (36): n=a or t
aatggctggagaagcagctatgggtgggatcttatnctcttttcctaaggttcctaatattttggatgaaa

SEQ ID NO: 22347 - DNA, 71 bp, chicken (Gallus Gallus)
  misc_feature (36): n=c or g
tctgaagtgacttatcagcagactttgtttcatctntggcattcaggtgctcattagttagctttattagc

SEQ ID NO: 22348 - DNA, 71 bp, chicken (Gallus Gallus)
  misc_feature (36): n=a or t
cagtaacaacaacaacaaacataactttttcttccngattattcaatacaggacacaaacatcataaataa

SEQ ID NO: 22349 - DNA, 71 bp, chicken (Gallus Gallus)
  misc_feature (36): n=a or g
gtgctaattgtaagagataaaaccatgatatacaantgtctattaacattacagaaaatactgtactcaga

SEQ ID NO: 22350 - DNA, 71 bp, chicken (Gallus Gallus)
  misc_feature (36): n=a or c
ggacctgaattgcagaggattcctcttgtaaccctntagaaaaaaaaaaaaaaaggaaggtaaagtagtga

SEQ ID NO: 22351 - DNA, 71 bp, chicken (Gallus Gallus)
  misc_feature (36): n=a or g
gagaaacttatgcagtaattacttaggtagccatgngccacggacagcttggagggactgtagctggctga

SEQ ID NO: 22352 - DNA, 71 bp, chicken (Gallus Gallus)
  misc_feature (36): n=a or g
tacagccagggctcattcacagtgtagagattcacnctcaggtttgctgccatgtagtctctgccagaagg

SEQ ID NO: 22353 - DNA, 71 bp, chicken (Gallus Gallus)
  misc_feature (36): n=a or g
taagtactgtattggaaaaacaaaaacttgcagtgntggcactacaagggagcaaggtgagtgtggaaggc

SEQ ID NO: 22354 - DNA, 71 bp, chicken (Gallus Gallus)
  misc_feature (36): n=c or t
ttggactttccatctaaaatgtttgacattgatctntttggcagttactgtgtaaaactagcctatatttt

SEQ ID NO: 22355 - DNA, 71 bp, chicken (Gallus Gallus)
  misc_feature (36): n=c or g
gtgctgctgggtctatggtcgcattgaaaataggtnctggcacagcatcttccagcatccaggcagaagca

SEQ ID NO: 22356 - DNA, 71 bp, chicken (Gallus Gallus)
  misc_feature (36): n=c or g
aggataatgcaacaatacttttccagagcaaatctnaactctgttttttataggatcagagatatcggggg

SEQ ID NO: 22357 - DNA, 71 bp, chicken (Gallus Gallus)
  misc_feature (36): n=a or g
tttttgtggaagcctcctttctgcaatacactacancattttgcattcctcctctccatgaaagattcttt

SEQ ID NO: 22358 - DNA, 71 bp, chicken (Gallus Gallus)
  misc_feature (36): n=a or t
tttcttaactgttaagcaaacatcaggattccagcncattcagtccaacaagcatcaaacattcacacagg

SEQ ID NO: 22359 - DNA, 71 bp, chicken (Gallus Gallus)
  misc_feature (36): n=a or g
tagctgaatcaaagatttaagggaagagtgaaaacntgcagtttttgtagctgctttaaactcttcactgc

SEQ ID NO: 22360 - DNA, 71 bp, chicken (Gallus Gallus)
  misc_feature (36): n=a or g
ctccttgctagtttatctttggttcatcttaacatntggtttaatacatccaagatgtcttaaaacttttt

SEQ ID NO: 22361 - DNA, 71 bp, chicken (Gallus Gallus)
  misc_feature (36): n=c or t
gatatcgattctgagacttcagggcacttcagaganactctcatgaacctggctcaggtactgcaaaaaca

SEQ ID NO: 22362 - DNA, 71 bp, chicken (Gallus Gallus)
  misc_feature (36): n=a or g
ctttgggagatacaacacggaattggaagagaagcntggatctacctgaagggcagttcgctgcattcttg

SEQ ID NO: 22363 - DNA, 71 bp, chicken (Gallus Gallus)
  misc_feature (36): n=c or t
tggctgtttccttgtttgtaacaaagggccaatacnacctcgtcatcagagtgttatccgattaggatttc

SEQ ID NO: 22364 - DNA, 71 bp, chicken (Gallus Gallus)
  misc_feature (36): n=a or g
gatattggttggattctacaggagacaaacctctgngtgtgtataacattcccactgggccatcagaacct

SEQ ID NO: 22365 - DNA, 71 bp, chicken (Gallus Gallus)
  misc_feature (36): n=c or t
tgtttacttttctaggaaactagcattctgagcatncatgagtcagaacattgcattatttactgtgcaaa

SEQ ID NO: 22366 - DNA, 71 bp, chicken (Gallus Gallus)
  misc_feature (36): n=a or g
atgcaatgtataaaaccacatggcagaaaattcacncacacacacacacaaaaaaaacctatcaattggaa

SEQ ID NO: 22367 - DNA, 71 bp, chicken (Gallus Gallus)
  misc_feature (36): n=a or c
caggaaatttgatagatgttaatatactgataattntagtaagttaattgcttctgtaagaaagaagaaag

SEQ ID NO: 22368 - DNA, 71 bp, chicken (Gallus Gallus)
  misc_feature (36): n=a or g
tgatgaacatggttgattgttcgaaatgtctttgtncagtgacagtaaatctgatcaatatctgcaaatca

SEQ ID NO: 22369 - DNA, 71 bp, chicken (Gallus Gallus)
  misc_feature (36): n=a or g
aagtctacagtatccattctagtgtacagtaggaancagccctgtaccaataaagacagtggccaaacgac

SEQ ID NO: 22370 - DNA, 71 bp, chicken (Gallus Gallus)
  misc_feature (36): n=a or g
acttgcaatcaaaaatctgatcacgtctctttaccngactttcataagccctaccttagcagagagaaata

SEQ ID NO: 22371 - DNA, 71 bp, chicken (Gallus Gallus)
  misc_feature (36): n=c or g
taacagattttggcttagtttgctgctctttttctntttcccaagcctctctccagagacttagtcaacaa

SEQ ID NO: 22372 - DNA, 71 bp, chicken (Gallus Gallus)
  misc_feature (36): n=a or g
agaacttcaatttgaaattttgcatgaaagcagatncagtcacccttatatcacttctgtggtagccatca

SEQ ID NO: 22373 - DNA, 71 bp, chicken (Gallus Gallus)
  misc_feature (36): n=c or t
aagtcttaactgtaagtacacttctatgataaatgnagggactgaacactgctggcatctttatgtttgga

SEQ ID NO: 22374 - DNA, 71 bp, chicken (Gallus Gallus)
  misc_feature (36): n=a or g
actgatactaatgaaaagataccataagccacatantaaagaatattacttctagcaaaaaaatataagaa

SEQ ID NO: 22375 - DNA, 71 bp, chicken (Gallus Gallus)
  misc_feature (36): n=c or g
ctataacttcagattgccacggtggtcagccctagnatcagcagtgaaactcagtagtgctagttgctaac

SEQ ID NO: 22376 - DNA, 71 bp, chicken (Gallus Gallus)
  misc_feature (36): n=a or c
agcatcatcaaacattccctagatctgctctgctanaacacagatcccaattacttagttatttttgggaa

SEQ ID NO: 22377 - DNA, 71 bp, chicken (Gallus Gallus)
  misc_feature (36): n=c or t
gtcactcaccatcagacttcaaagcatattccaatntgggtaaacacatattgcctaaatcaatctcccta

SEQ ID NO: 22378 - DNA, 71 bp, chicken (Gallus Gallus)
  misc_feature (36): n=a or g
tgccaaactgctgttgatcagttagtgcctgcaacnaaagagaaacctatgtatcaatacataatcaaaac

SEQ ID NO: 22379 - DNA, 71 bp, chicken (Gallus Gallus)
  misc_feature (36): n=a or c
cagagtcatttccttagaaacttaggagcagtatgnatttattagtttgatttgtaaatatctgtgcgatt

SEQ ID NO: 22380 - DNA, 71 bp, chicken (Gallus Gallus)
  misc_feature (36): n=c or g
tgctgctatactaagccctatggtaagcttccccgnttttatatgtgaatgtacaggtgtagcaccccaaa

SEQ ID NO: 22381 - DNA, 71 bp, chicken (Gallus Gallus)
  misc_feature (36): n=a or g
aaagtggattaaaaaaaagtgtgcaaaggaaatggnagaattagtgctatccagaattaatcttcaacttc

SEQ ID NO: 22382 - DNA, 71 bp, chicken (Gallus Gallus)
  misc_feature (36): n=c or t
ttcaacattttcttctgtgaattaatcaagtatttntcattctaattactggcatacattgtcttcttaat

SEQ ID NO: 22383 - DNA, 71 bp, chicken (Gallus Gallus)
  misc_feature (36): n=c or t
ataaacacacacttaaaagcaatctataggcaaagnaaagagatgctttatttcttattagtattcttgat

SEQ ID NO: 22384 - DNA, 71 bp, chicken (Gallus Gallus)
  misc_feature (36): n=g or t
gtaactgaagtagcctgctttgccagaaggagatgnttgtgctttgaccacatgctggatggacttgtctg

SEQ ID NO: 22385 - DNA, 71 bp, chicken (Gallus Gallus)
  misc_feature (36): n=a or c
tgcaatagttgcaaataaaatttgaaaatgttctanatgaggttatggtatctttcaaagtacttctgaag

SEQ ID NO: 22386 - DNA, 71 bp, chicken (Gallus Gallus)
  misc_feature (36): n=a or g
gcacttcctgaatttgtaagtgcctacaaaatgacntttcggctggtgctgtggaggctttctgtcagccg

SEQ ID NO: 22387 - DNA, 71 bp, chicken (Gallus Gallus)
  misc_feature (36): n=a or c
taagaaagtgctcaaaactacacagagtgaaaaacnacagcagaagagagcatagtttggaaaacctgagc

SEQ ID NO: 22388 - DNA, 71 bp, chicken (Gallus Gallus)
  misc_feature (36): n=a or g
ttagtcattcccttagacattaatttttgccttccnccatagtttttaaagacaaatatctgcaattgaac

SEQ ID NO: 22389 - DNA, 71 bp, chicken (Gallus Gallus)
  misc_feature (36): n=c or t
tattctttgcctccttaccatttcctgttatttttncatttgctagatctatgcttcaaactacatgttga

SEQ ID NO: 22390 - DNA, 71 bp, chicken (Gallus Gallus)
  misc_feature (36): n=c or t
ctttgtcaatgatcatgtttgtaggctaggactcangaacatggattcaacagcatattacagatttcctt

SEQ ID NO: 22391 - DNA, 71 bp, chicken (Gallus Gallus)
  misc_feature (36): n=c or t
aaaaaaaaatgggggcatgaaaagtttgctggaagngaagactcaaagtttcagagaccaaactgacagta

SEQ ID NO: 22392 - DNA, 71 bp, chicken (Gallus Gallus)
  misc_feature (36): n=c or t
aggaagccaaaactttatctctggaaagtagttggnacagcagcaaatatcttctaaatactaaatctgtg

SEQ ID NO: 22393 - DNA, 71 bp, chicken (Gallus Gallus)
  misc_feature (36): n=a or t
ctgtaaaataatgcagtatcaacaagcaaagacagnaactccagctcattagtctcaggatttacacagtt

SEQ ID NO: 22394 - DNA, 71 bp, chicken (Gallus Gallus)
  misc_feature (36): n=a or t
ttaaatttccttcctttgaaggatatgattgatgtnacttcttcctgtgttttgggagtgaaaattaatga

SEQ ID NO: 22395 - DNA, 71 bp, chicken (Gallus Gallus)
  misc_feature (36): n=c or t
attgaaggaagtaggttggcatgcaaatagcctcanagaagatttgaaacaattttgttaattccttgcat

SEQ ID NO: 22396 - DNA, 71 bp, chicken (Gallus Gallus)
  misc_feature (36): n=a or c
tgttggactttctggggttccaagactattatgttnctattcaaatggagaaatgtagaaaggaagaatta

SEQ ID NO: 22397 - DNA, 71 bp, chicken (Gallus Gallus)
  misc_feature (36): n=a or g
gtgagcaacacaaatgtaaatcagctctgattgcanagcagcattgcagcacgcttcagggcatgggagat

SEQ ID NO: 22398 - DNA, 71 bp, chicken (Gallus Gallus)
  misc_feature (36): n=g or t
gcagcttcatccaagtcgtcacaggcaagaattttnaggccactagcagttattaaagctttggcatcatc

SEQ ID NO: 22399 - DNA, 71 bp, chicken (Gallus Gallus)
  misc_feature (36): n=a or t
gtaatcatgctttagaagaagtaaaagaagtagggntttttgtctgcaggactgccaattaattcatttac

SEQ ID NO: 22400 - DNA, 71 bp, chicken (Gallus Gallus)
  misc_feature (36): n=c or t
gactactcccactgcctaggttttttcttgatgacngttcatgtgccaaaaagtatatgccactttattct

SEQ ID NO: 22401 - DNA, 71 bp, chicken (Gallus Gallus)
  misc_feature (36): n=c or g
acggctcacgtttcataagctccatggctactctgncacaatatattttgtgagcactaacatcaacagta

SEQ ID NO: 22402 - DNA, 71 bp, chicken (Gallus Gallus)
  misc_feature (36): n=a or t
gtaaatggtttgaagcaagattcagttctaaaggtnagaggataattcattccccattcttattcattctt

SEQ ID NO: 22403 - DNA, 71 bp, chicken (Gallus Gallus)
  misc_feature (36): n=c or t
catacctagattggctttggaaaatttgctccactngatgataactgatcttcaaaaacttgtgatctctc

SEQ ID NO: 22404 - DNA, 71 bp, chicken (Gallus Gallus)
  misc_feature (36): n=a or t
cattagaatggcattaactgtatcaatactcgtcantttataacagaattaatattttcaggtaggtgaag

SEQ ID NO: 22405 - DNA, 71 bp, chicken (Gallus Gallus)
  misc_feature (36): n=a or g
caagggctgggggggttggtttggttaagatcattngcttatccctattaaggaggaccaaatgcataggg

SEQ ID NO: 22406 - DNA, 71 bp, chicken (Gallus Gallus)
  misc_feature (36): n=a or t
caggaggctgcttctgtttctgctgatgtctgtgcnattagttttcttctgctcttctaaacgtctgtcat

SEQ ID NO: 22407 - DNA, 71 bp, chicken (Gallus Gallus)
  misc_feature (36): n=a or t
tctgccagagtagctctgctagaaagctttttcttngagatgaactggaaggctttggaaccgtgggttct

SEQ ID NO: 22408 - DNA, 71 bp, chicken (Gallus Gallus)
  misc_feature (36): n=c or t
tttaaaacctgaagatccccacagtccttcctgatnctgtgtcatgtacaggatggttatgttattccctc

SEQ ID NO: 22409 - DNA, 71 bp, chicken (Gallus Gallus)
  misc_feature (36): n=a or t
aacacttgtatcctccactggaatgtctaacaactnattcctgaaattacaatttctttaactagcattaa

SEQ ID NO: 22410 - DNA, 71 bp, chicken (Gallus Gallus)
  misc_feature (36): n=c or t
ttggatctggctgtatttcaactgggcagtggcaangtgcctgtatcagttctgacttttgctagtgcata

SEQ ID NO: 22411 - DNA, 71 bp, chicken (Gallus Gallus)
  misc_feature (36): n=a or g
ccttcctgttcaaaattttataccagaaagctaccnccttcccacagttaagaaaaaggtatggcaaatgc

SEQ ID NO: 22412 - DNA, 71 bp, chicken (Gallus Gallus)
  misc_feature (36): n=c or t
cttcaattggatgtcaaataattctattcataactntgttttccaaataatttttctagacaccttctaga

SEQ ID NO: 22413 - DNA, 71 bp, chicken (Gallus Gallus)
  misc_feature (36): n=a or g
ccagagaagtgtggttttcactgtaccttcatgaantctccatataaatagtcttttactgtttatttaag

SEQ ID NO: 22414 - DNA, 71 bp, chicken (Gallus Gallus)
  misc_feature (36): n=a or g
ataatgtacgtgtcacaatattaaacacaagcagcnttttaaatgcaaatttttggttgcagtgcaaacgt

SEQ ID NO: 22415 - DNA, 71 bp, chicken (Gallus Gallus)
  misc_feature (36): n=g or t
ctcctctttgcccaggaatctgcttaaatatcagtntaatgattactactggtagatggaattgggaaatc

SEQ ID NO: 22416 - DNA, 71 bp, chicken (Gallus Gallus)
  misc_feature (36): n=a or c
tgtgaaatataacacctcgcatctcttaagcaaacnaaaggtttttattttgggcccaattaaacatttaa

SEQ ID NO: 22417 - DNA, 71 bp, chicken (Gallus Gallus)
  misc_feature (36): n=a or g
tttatgcactgtaggatttgtgaaagagaaatcttngagcaactgtaagatttctctcaaaactgaagacc

SEQ ID NO: 22418 - DNA, 71 bp, chicken (Gallus Gallus)
  misc_feature (36): n=g or t
gaaacagttgctcaaatgctggttcttttcttagcnacaaaaatttttgaggaaaaggatcataagaggaa

SEQ ID NO: 22419 - DNA, 71 bp, chicken (Gallus Gallus)
  misc_feature (36): n=c or t
gttggcctttagatggaggaatgtattttcagggantgagttgtttttttcatgtttgaaacccacagatt

SEQ ID NO: 22420 - DNA, 71 bp, chicken (Gallus Gallus)
  misc_feature (36): n=c or t
actagggcaactaatgctaataggtgcaattaagtncctggcaccaggtcagtggtgttcatcaggagctc

SEQ ID NO: 22421 - DNA, 71 bp, chicken (Gallus Gallus)
  misc_feature (36): n=c or t
gagtgggaattgtgactgttttttcccctcagcagnagttttctgttacttgagctcggatgtaaatttgg

SEQ ID NO: 22422 - DNA, 71 bp, chicken (Gallus Gallus)
  misc_feature (36): n=c or g
tccaagttcttctgtgacacccagatatgtaagtgncctcaatagaaggctaaagcaggcagaacagaaat

SEQ ID NO: 22423 - DNA, 71 bp, chicken (Gallus Gallus)
  misc_feature (36): n=a or g
tgatccctactaagatataatacaaacaatatacantaacctctaaaagctaaagaaaataaagacaaagg

SEQ ID NO: 22424 - DNA, 71 bp, chicken (Gallus Gallus)
  misc_feature (36): n=c or t
ttcccaggggagttcatgagctaatgaaaagtaacnattctgctgggcttcttcctttacttcaaagccag

SEQ ID NO: 22425 - DNA, 71 bp, chicken (Gallus Gallus)
  misc_feature (36): n=a or g
gcaataatgagaagtcaagggctcttgtttgcccantgagtgtgtggtgaggctggaaaaaatctcccaca

SEQ ID NO: 22426 - DNA, 71 bp, chicken (Gallus Gallus)
  misc_feature (36): n=c or t
tttctcttgtaggattaccttgattgtatcactgancaatccaaactgcccctggggactgaagagcgatc

SEQ ID NO: 22427 - DNA, 71 bp, chicken (Gallus Gallus)
  misc_feature (36): n=a or g
gagtgtgcccagccatgagttatcagcatagctcantgcacctctcttgtgtagaggcagatttattgtgt

SEQ ID NO: 22428 - DNA, 71 bp, chicken (Gallus Gallus)
  misc_feature (36): n=a or g
catctgacgttaagaattacagaactgggaaaacantaaagtagtatgttattagtgtctgttttattgaa

SEQ ID NO: 22429 - DNA, 71 bp, chicken (Gallus Gallus)
  misc_feature (36): n=a or t
tcttcctcttgtatttttcccatcaatttcttcttnccattcctttttttttttttttctttttcaataat

SEQ ID NO: 22430 - DNA, 71 bp, chicken (Gallus Gallus)
  misc_feature (36): n=a or g
accttaataactataatttcagttaaactgctgaangtagagctacattgagaatttcctgacttcttagt

SEQ ID NO: 22431 - DNA, 71 bp, chicken (Gallus Gallus)
  misc_feature (36): n=c or t
aacccaagccattctatgatacgaccgtcaggctgnacataccaagaatatcaacaaagatgtatgtatat

SEQ ID NO: 22432 - DNA, 71 bp, chicken (Gallus Gallus)
  misc_feature (36): n=c or t
taagttatgtgtaaatctatgtgaatgaaatatganataagtgaaagcagtttagtaaacacaagcataca

SEQ ID NO: 22433 - DNA, 71 bp, chicken (Gallus Gallus)
  misc_feature (36): n=a or g
ttggaaaatgttgacagggtgcattgattctacagngtgattggagagtcttcagttcttaatgtgtttgc

SEQ ID NO: 22434 - DNA, 71 bp, chicken (Gallus Gallus)
  misc_feature (36): n=c or t
gagagtcgtggttgcccacagcccttcccctaggtnatgttgtgttgcagaagccaaccttggtttctatt

SEQ ID NO: 22435 - DNA, 71 bp, chicken (Gallus Gallus)
  misc_feature (36): n=c or t
ttttattcatgagatggagattctgacctcagaaangtatctggagcctttcacctttcattatgctcggt

SEQ ID NO: 22436 - DNA, 71 bp, chicken (Gallus Gallus)
  misc_feature (36): n=a or g
gctcctctagaacctagagttaactttttcctattngaatgccaaatagggttactacagcaatttcagtt

SEQ ID NO: 22437 - DNA, 71 bp, chicken (Gallus Gallus)
  misc_feature (36): n=c or t
aaatataacaaaagcatctgaatgcacaaatgcagngcgcacctgtatgcaaaatgtgtaacaaagggaaa

SEQ ID NO: 22438 - DNA, 71 bp, chicken (Gallus Gallus)
  misc_feature (36): n=c or g
ccacgtaacagacgttttcagatacctgcaatatanttagcgtcatgtcagagtgttactttctcttccac

SEQ ID NO: 22439 - DNA, 71 bp, chicken (Gallus Gallus)
  misc_feature (36): n=a or g
gcagctgttgaatatgccataaaccactgccagacnggcacacatggctgcgacatccctcagcgggctca

SEQ ID NO: 22440 - DNA, 71 bp, chicken (Gallus Gallus)
  misc_feature (36): n=c or t
gtccgagattttttttactgaatgtctttaagcaangtgaggtagtgcatgtccaaattcacttgacacca

SEQ ID NO: 22441 - DNA, 71 bp, chicken (Gallus Gallus)
  misc_feature (36): n=a or g
ttcattccttgtcctctatgaaaaaaagataatgcnaaaaaacttccatagatgtgatagagaagatttta

SEQ ID NO: 22442 - DNA, 71 bp, chicken (Gallus Gallus)
  misc_feature (36): n=a or g
cagaacagtgtcattaaggctatgtagtcacttgantacttcacagctttcattgccctctacacttcata

SEQ ID NO: 22443 - DNA, 71 bp, chicken (Gallus Gallus)
  misc_feature (36): n=a or g
acactgatcattttttggtactcaaaatactgttcntgatggccacgttcctccatatgaaagacggctca

SEQ ID NO: 22444 - DNA, 71 bp, chicken (Gallus Gallus)
  misc_feature (36): n=c or t
gttatgaatgtacttcacaacaaagctgatattcantgatgatgtgtttcacaaaatatgattgtaacaca

SEQ ID NO: 22445 - DNA, 71 bp, chicken (Gallus Gallus)
  misc_feature (36): n=c or t
catcttgtctgactgctctgtactgaaacggtaagntataaaacttttctgttttctgtttctatttgtaa

SEQ ID NO: 22446 - DNA, 71 bp, chicken (Gallus Gallus)
  misc_feature (36): n=c or t
atctacactagagctagaattaatcagcgtgacaangtgatgaaaacaacttaacccaagcatttgatagt

SEQ ID NO: 22447 - DNA, 71 bp, chicken (Gallus Gallus)
  misc_feature (36): n=a or g
tacagcagtgtcttacagccttctctagggcacgcntagagctgtgatttcttttaaacaaacaggtaaca

SEQ ID NO: 22448 - DNA, 71 bp, chicken (Gallus Gallus)
  misc_feature (36): n=c or t
tttgggggaaagttctgctgtatatgtgaaatgttngaccccagtatccaactctgaaatcactgtctgtg

SEQ ID NO: 22449 - DNA, 71 bp, chicken (Gallus Gallus)
  misc_feature (36): n=a or g
gaataacagaaattatactaatgtgatgtacaggtnaaggctaactgtagccttggctgcatgttaattat

SEQ ID NO: 22450 - DNA, 71 bp, chicken (Gallus Gallus)
  misc_feature (36): n=a or g
ttgccctcactctttatttaacaccaagtagcactnctgaacacatatgaactgaacacatctactggttt

SEQ ID NO: 22451 - DNA, 71 bp, chicken (Gallus Gallus)
  misc_feature (36): n=c or t
tgtagtgcgttttctcagttaccacagacaaacagnttctgattcagacgagcttaagagataagaatgga

SEQ ID NO: 22452 - DNA, 71 bp, chicken (Gallus Gallus)
  misc_feature (36): n=a or g
aacccgtgatacagtctgaatgaagtctaccagcancacaggcaaagctttcagcaattatcaaatgacaa

SEQ ID NO: 22453 - DNA, 71 bp, chicken (Gallus Gallus)
  misc_feature (36): n=c or t
ggttaattatgcacaacggtaacactgttcatctcntcttactctcaaatattatttagtttaacctcctt

SEQ ID NO: 22454 - DNA, 71 bp, chicken (Gallus Gallus)
  misc_feature (36): n=c or t
gcagctcactgtcacttgaaaataatcctacaacanagataagtagtaattgtttttgatgctattttcat

SEQ ID NO: 22455 - DNA, 71 bp, chicken (Gallus Gallus)
  misc_feature (36): n=g or t
agatcccctcgcaagttcgattctttaactgaactncagttcctttaaatcaattcccatttattctcaaa

SEQ ID NO: 22456 - DNA, 71 bp, chicken (Gallus Gallus)
  misc_feature (36): n=c or t
acaatgcactacaagcctcctagtgaaggtgtttgntacaggagagcagtcaagctgaaacacatcttcca

SEQ ID NO: 22457 - DNA, 71 bp, chicken (Gallus Gallus)
  misc_feature (36): n=a or g
agtgttgtggagtcaatataaagatgtctcaagtgngtgattttagtttgttattcattccttactgctct

SEQ ID NO: 22458 - DNA, 71 bp, chicken (Gallus Gallus)
  misc_feature (36): n=c or t
ctcctgcttacagtgttttgtggctgttttcagtangttttattgtgcctttctcagctgtggaggaggaa

SEQ ID NO: 22459 - DNA, 71 bp, chicken (Gallus Gallus)
  misc_feature (36): n=a or g
tgtccaagaagacacttcaatatgtgtatgaaatcncacaagcttacatgtctgccatgccttcctttcca

SEQ ID NO: 22460 - DNA, 71 bp, chicken (Gallus Gallus)
  misc_feature (36): n=c or t
ttaacaaaaatccccagagtaggaggaaaaaatgangggcagttttaagaaagcaaattcctattgtattg

SEQ ID NO: 22461 - DNA, 71 bp, chicken (Gallus Gallus)
  misc_feature (36): n=a or g
cctactcacacttccttggaagtgaggagtggaccnaggccaaaaaaaggtgcgatgcaggcacgtacaca

SEQ ID NO: 22462 - DNA, 71 bp, chicken (Gallus Gallus)
  misc_feature (36): n=a or g
ttttaatagtgaacagtaaagtgcttctaagactcnaaagttagggagttgaaatttgcagtgtacatttg

SEQ ID NO: 22463 - DNA, 71 bp, chicken (Gallus Gallus)
  misc_feature (36): n=c or t
gtgcagtgcttagatgccaacaaggattatgtcatngtgtcttggaaacagccagctgttgatggaggaaa

SEQ ID NO: 22464 - DNA, 71 bp, chicken (Gallus Gallus)
  misc_feature (36): n=g or t
ctaattttagtttcccagtttaaaagagtcaacagncaatagagaaaaagaggcatctacacaagggcaat

SEQ ID NO: 22465 - DNA, 71 bp, chicken (Gallus Gallus)
  misc_feature (36): n=c or t
acttagaacacaaactgcaccggtgtctccactaanttcacctgtaactaacagaaagtatgccaatttat

SEQ ID NO: 22466 - DNA, 71 bp, chicken (Gallus Gallus)
  misc_feature (36): n=a or g
aaataattactaccctagaagttcatttttaacagnttacattttatttgcttcagttgaacaccattatt

SEQ ID NO: 22467 - DNA, 71 bp, chicken (Gallus Gallus)
  misc_feature (36): n=a or t
ccagccggtcaccagtggtgttcctcaagggtcagnattggagcccatcctgcttaacatctgtattgatg

SEQ ID NO: 22468 - DNA, 71 bp, chicken (Gallus Gallus)
  misc_feature (36): n=a or c
atctgtcttgagcactggacaaaacacggaggtttngagattttgccttgtggttggtggaatggacaaaa

SEQ ID NO: 22469 - DNA, 71 bp, chicken (Gallus Gallus)
  misc_feature (36): n=a or g
gaagaatggaaacagataccagcaaccacttgttcntccagatctgtagggactgagtgttcaaagtgggg

SEQ ID NO: 22470 - DNA, 71 bp, chicken (Gallus Gallus)
  misc_feature (36): n=c or t
agctcccctttttttaccttaccttttccatttgcngaagctcttcggaaaactgatggtcttagccaaaa

SEQ ID NO: 22471 - DNA, 71 bp, chicken (Gallus Gallus)
  misc_feature (36): n=a or t
atgcaacagggaaaaacaaagcctcagttacccatngagaacagagacggccaaactttggcagtatagta

SEQ ID NO: 22472 - DNA, 71 bp, chicken (Gallus Gallus)
  misc_feature (36): n=a or g
atatattactagtttctggaataagagagagtgagngagtgcctggaagccctggactgcagtccacgttg

SEQ ID NO: 22473 - DNA, 71 bp, chicken (Gallus Gallus)
  misc_feature (36): n=c or t
caaaggttttggtcagaaaggtcggaagtaagtgtnctgtgggcaatcttaattataatcattaccaatgc

SEQ ID NO: 22474 - DNA, 71 bp, chicken (Gallus Gallus)
  misc_feature (36): n=a or g
gttcattagtggcaaaaaatgcagagctaatggtgntgattgtgttgcaaaatagttttttgtagctgaga

SEQ ID NO: 22475 - DNA, 71 bp, chicken (Gallus Gallus)
  misc_feature (36): n=a or g
ataattttcgtggcctttctctgcatgactccttcntgtgttagggttttcctttagagaagctggttacc

SEQ ID NO: 22476 - DNA, 71 bp, chicken (Gallus Gallus)
  misc_feature (36): n=c or t
tttgtttgtttgtttttacaaaatgcctgactccangaagaggtggttgcatttgattttgtcatgtttta

SEQ ID NO: 22477 - DNA, 71 bp, chicken (Gallus Gallus)
  misc_feature (36): n=c or t
cagataagacttctgcactctgtgtatatacacagngatacacatagatgttcttcctatctgagctttct

SEQ ID NO: 22478 - DNA, 71 bp, chicken (Gallus Gallus)
  misc_feature (36): n=a or g
gtaattaaaattactttttttttttaagaaaagatnaatgcgaaagctgttgacataattattacatcaaa

SEQ ID NO: 22479 - DNA, 71 bp, chicken (Gallus Gallus)
  misc_feature (36): n=a or t
tgccagtaaatagcatttgaagagcttgacaagtantatgtccttgcaacgtctcttcatgaaatgagttt

SEQ ID NO: 22480 - DNA, 71 bp, chicken (Gallus Gallus)
  misc_feature (36): n=a or g
tttgttcactttgttttttaagaaataatgtttcancaatattgaatttggagtggattgtaatgtgtctg

SEQ ID NO: 22481 - DNA, 71 bp, chicken (Gallus Gallus)
  misc_feature (36): n=a or g
atcaacttgtttgatcttgcacatatgtgggtgaanctgtcacacagcatagtcatgtctgaagccaatag

SEQ ID NO: 22482 - DNA, 71 bp, chicken (Gallus Gallus)
  misc_feature (36): n=a or g
cctgaaatgtttgcagttcaatttaaggatagagtntagaggatcatagagaagaggagggaagattaatt

SEQ ID NO: 22483 - DNA, 71 bp, chicken (Gallus Gallus)
  misc_feature (36): n=c or t
aaaagttgattttcaagtagaatttcgttgtctacnggacatttgtgacctgcatctctacaacgccagaa

SEQ ID NO: 22484 - DNA, 71 bp, chicken (Gallus Gallus)
  misc_feature (36): n=a or g
acttgctggggaagcgaaggtctaatgagacatgcngtttgttgctcagccagcccatttggcagccttgg

SEQ ID NO: 22485 - DNA, 71 bp, chicken (Gallus Gallus)
  misc_feature (36): n=c or g
gaagaggaaataacattactgacctgagaagattgnagaatgcattttgggttgattaaacatttaactca

SEQ ID NO: 22486 - DNA, 71 bp, chicken (Gallus Gallus)
  misc_feature (36): n=a or g
acttttaaatacaagaacagatgttacccaaaagtngctgatcctaacactgaaagtatagcataagcaaa

SEQ ID NO: 22487 - DNA, 71 bp, chicken (Gallus Gallus)
  misc_feature (36): n=g or t
agaggctgagtattctgaagcagaatattctgtgcngtacaagtcagtgctcctcatctggctgtgccact

SEQ ID NO: 22488 - DNA, 71 bp, chicken (Gallus Gallus)
  misc_feature (36): n=a or g
gttagatataaaaagaaatagagtaattcttggccnttgcaaaactttttttatgattcatattttcagca

SEQ ID NO: 22489 - DNA, 71 bp, chicken (Gallus Gallus)
  misc_feature (36): n=a or c
ctgaagcaatcagaaaggtacctacatatgcagagngctcctcaggcagtttcagcaaagctgaaagaaaa

SEQ ID NO: 22490 - DNA, 71 bp, chicken (Gallus Gallus)
  misc_feature (36): n=a or g
gaagcccttacagaagtcttggatgcaactctctcnaagaggtaactgtatggtctgtactctccactgcc

SEQ ID NO: 22491 - DNA, 71 bp, chicken (Gallus Gallus)
  misc_feature (36): n=c or t
tttcccacctaatgatgctaacaaaagtgacctggnggttttcctttaattaaaatgaacctatctgaatt

SEQ ID NO: 22492 - DNA, 71 bp, chicken (Gallus Gallus)
  misc_feature (36): n=c or t
tggaggtggctgtgatttagtgctggagaaggccantgtatgcccatttataatgggtttcagcacacttc

SEQ ID NO: 22493 - DNA, 71 bp, chicken (Gallus Gallus)
  misc_feature (36): n=a or c
taattgcccatcttcttacaacattattgaaggagnaggtattgtatggcttgtttggtgtccctagagaa

SEQ ID NO: 22494 - DNA, 71 bp, chicken (Gallus Gallus)
  misc_feature (36): n=a or g
tgcttcctgaagctcttgtcctttcatcacaggagnaacacaatcttaattatactgacagtcctgtgaaa

SEQ ID NO: 22495 - DNA, 71 bp, chicken (Gallus Gallus)
  misc_feature (36): n=c or t
gcataaaacacttttacacgacctctatgcacttangtttctactgtgttctgggacatgagatggagtga

SEQ ID NO: 22496 - DNA, 71 bp, chicken (Gallus Gallus)
  misc_feature (36): n=c or t
ctctacccctgtccccatctctcttctcttttgttngtgctgtttgcttccccgttgctcttctacagagg

SEQ ID NO: 22497 - DNA, 71 bp, chicken (Gallus Gallus)
  misc_feature (36): n=a or t
tataacacaacataccaaacactgtaaaggtgaaanggtttaccttagaaacatcaggtttctttatttca

SEQ ID NO: 22498 - DNA, 71 bp, chicken (Gallus Gallus)
  misc_feature (36): n=g or t
tggtgaactaatacatttccctgagttctcaatatnctttttcaaaatcactgtcccagagttagggagat

SEQ ID NO: 22499 - DNA, 71 bp, chicken (Gallus Gallus)
  misc_feature (36): n=a or c
ttcttcaaagttcactctggagcacttcttctcatntcaatggaacactccatcttattcttttttctttc

SEQ ID NO: 22500 - DNA, 71 bp, chicken (Gallus Gallus)
  misc_feature (36): n=g or t
gcatcagagtcttcccagcaacgatcaaactaaagntgatcgtgggaacagcaaaaagaggatgccttgga

SEQ ID NO: 22501 - DNA, 71 bp, chicken (Gallus Gallus)
  misc_feature (36): n=a or c
aatttctaccttgtggaaggaatatgcaagcaacantgacctctcccttccacctctgcttcttgacctat

SEQ ID NO: 22502 - DNA, 71 bp, chicken (Gallus Gallus)
  misc_feature (36): n=c or g
gtgatgtcagacagaagagaatacttctaaggtctntaaactgaggcactggggatttgaatcccattggc

SEQ ID NO: 22503 - DNA, 71 bp, chicken (Gallus Gallus)
  misc_feature (36): n=a or g
tggctgaaacacagggattggggacctgactgtcantgcgtccccccagaacatctttcccccaactcctc

SEQ ID NO: 22504 - DNA, 71 bp, chicken (Gallus Gallus)
  misc_feature (36): n=a or g
acttcacaacctcactgtagtttgtgctgaaggcanaagtgtaaaactttcaagcatttctgtgccgaata

SEQ ID NO: 22505 - DNA, 71 bp, chicken (Gallus Gallus)
  misc_feature (36): n=c or g
cagagaggtccaggggacacagccagcatatgaganagtttattttagtctataatgtatttagtgtccaa

SEQ ID NO: 22506 - DNA, 71 bp, chicken (Gallus Gallus)
  misc_feature (36): n=a or g
cacatctttcatagaagtacattttgtcagtacccnaggatttgtgttgggatgcgtaaagtgtggcagca

SEQ ID NO: 22507 - DNA, 71 bp, chicken (Gallus Gallus)
  misc_feature (36): n=a or g
tcaaactaatgatgtgggagttggtactgaacattnagactttcacagcaatccctaaagaattggtatat

SEQ ID NO: 22508 - DNA, 71 bp, chicken (Gallus Gallus)
  misc_feature (36): n=a or g
ttagtaactctcttcaaaggtttgtttttaaaagtngctaaatttgtttggtgtttcatttctacaggctg

SEQ ID NO: 22509 - DNA, 71 bp, chicken (Gallus Gallus)
  misc_feature (36): n=a or c
atacttattcagtcactgttttgtttttaaaggagnctacttatttttaccctccttggaaagtgatctgc

SEQ ID NO: 22510 - DNA, 71 bp, chicken (Gallus Gallus)
  misc_feature (36): n=c or t
ttttgttagaaagcacatcctggcctttgaatgaanaaacaaacaaacaaacaaataaataaagactgatt

SEQ ID NO: 22511 - DNA, 71 bp, chicken (Gallus Gallus)
  misc_feature (36): n=a or g
agcttatctgagtacataaggagtgcaagtggtgcncgtgactcgcaatcactaccactgagatcatacaa

SEQ ID NO: 22512 - DNA, 71 bp, chicken (Gallus Gallus)
  misc_feature (36): n=a or g
ctctttagtatcactctgtagagaactcatatgtgnaaacagatcagcacaaaagcttatgcagcacagat

SEQ ID NO: 22513 - DNA, 71 bp, chicken (Gallus Gallus)
  misc_feature (36): n=a or g
ttcttctactaaatgtaacaggtaattaaatttcanttattttacatcatcaggcttgcatgtgttactag

SEQ ID NO: 22514 - DNA, 71 bp, chicken (Gallus Gallus)
  misc_feature (36): n=g or t
caaagaaaacttcagactacatgtaagatgcaaaanccaagtaatccttatcttccccttttgctacagga

SEQ ID NO: 22515 - DNA, 71 bp, chicken (Gallus Gallus)
  misc_feature (36): n=a or g
cgcagtgcgcccggcgccggacagcactcaccctcngccagcagcgcagtacagacggaaatgaatacgat

SEQ ID NO: 22516 - DNA, 71 bp, chicken (Gallus Gallus)
  misc_feature (36): n=a or g
gaggaaaggggattaggaggagaaacctctagctcnggcaaccttggagtcttttcacaaggagggagctc

SEQ ID NO: 22517 - DNA, 71 bp, chicken (Gallus Gallus)
  misc_feature (36): n=c or t
gtaagaaagcctgtgcagtgatgagtccttcatagngattaccatagtttacagcaatcttgtgttgagat

SEQ ID NO: 22518 - DNA, 71 bp, chicken (Gallus Gallus)
  misc_feature (36): n=a or g
gttctccacaacttctctgggaagcctgtgatagtncttcatcaatctctaaataaagagtttcctctaaa

SEQ ID NO: 22519 - DNA, 71 bp, chicken (Gallus Gallus)
  misc_feature (36): n=c or t
tacagccaaaatagttacgaagaaaacaaaaccacnttagcttctgacacaatggaagaaaataaacataa

SEQ ID NO: 22520 - DNA, 71 bp, chicken (Gallus Gallus)
  misc_feature (36): n=c or t
cctggagagatgaaaatgccgtgggaggaaagcagngaatcccattgccctgaacgcgttgccctgctgaa

SEQ ID NO: 22521 - DNA, 71 bp, chicken (Gallus Gallus)
  misc_feature (36): n=a or g
tgttgttgcactaggtagggtgtgctctttttaccnggaataaacaatctctgggaatggctaagctatca

SEQ ID NO: 22522 - DNA, 71 bp, chicken (Gallus Gallus)
  misc_feature (36): n=a or c
atttcttatgaaacttctgtagattgttcgtcttancgcacgtcattccccataaaaagacacagcaagcg

SEQ ID NO: 22523 - DNA, 71 bp, chicken (Gallus Gallus)
  misc_feature (36): n=c or g
agtacaacacagtgaatgtgccttgctataacatanatcataaactggcagctgagcccatttcaggctgt

SEQ ID NO: 22524 - DNA, 71 bp, chicken (Gallus Gallus)
  misc_feature (36): n=c or g
gattcttggaagcctgctacagagtcttggctatcngttattcagtcctgctttcttctcccttcagcagg

SEQ ID NO: 22525 - DNA, 71 bp, chicken (Gallus Gallus)
  misc_feature (36): n=g or t
tgtttccagcagactttcaagaaccttaaggtctgngtctggatgttccacttaaacatctataacactta

SEQ ID NO: 22526 - DNA, 71 bp, chicken (Gallus Gallus)
  misc_feature (36): n=c or t
acagcttgtgacagatgaagaactgcatttcttgangttcctttgtaataattctggctaaataagttgtt

SEQ ID NO: 22527 - DNA, 71 bp, chicken (Gallus Gallus)
  misc_feature (36): n=c or t
aaggacttagctgacattatttgcaatagagacacntcatttgattttatgtaattgaatgaactgaacag

SEQ ID NO: 22528 - DNA, 71 bp, chicken (Gallus Gallus)
  misc_feature (36): n=g or t
cttttggacaattttcttccatttagttttttaatnaagctttctgaaagtactttaatagaagcaaataa

SEQ ID NO: 22529 - DNA, 71 bp, chicken (Gallus Gallus)
  misc_feature (36): n=c or g
ctctactctgtactcgggagacatcatctggactanagatgtggagtcctcactataggagagacatggac

SEQ ID NO: 22530 - DNA, 71 bp, chicken (Gallus Gallus)
  misc_feature (36): n=c or t
cactgataattaaagcagaattaaggtgacagaagntgcatctgacgcaggggcagctctgagaacaggtt

SEQ ID NO: 22531 - DNA, 71 bp, chicken (Gallus Gallus)
  misc_feature (36): n=c or g
tgataaattgtgcgctctgtattctgtggtgagtgnacagcagaaccgcttctgaagtgtaaaagcagatg

SEQ ID NO: 22532 - DNA, 71 bp, chicken (Gallus Gallus)
  misc_feature (36): n=a or g
taagttttactagccaacatagtaactttacaaagnaaataggggaagatcagagtttattaactctctaa

SEQ ID NO: 22533 - DNA, 71 bp, chicken (Gallus Gallus)
  misc_feature (36): n=c or t
ctctacagttaaaggttatgtcagcattttcatganagaaaccctgtttcagaggtcagtaactctgctgg

SEQ ID NO: 22534 - DNA, 71 bp, chicken (Gallus Gallus)
  misc_feature (36): n=c or t
gaactgattcctgttcctcttgaaaaaggcctagantcccactttgcccataagacaaaatcatttaagaa

SEQ ID NO: 22535 - DNA, 71 bp, chicken (Gallus Gallus)
  misc_feature (36): n=a or g
ttcatatcttggagtttaaaataaccagcagactcnctgtgtatcataggataataaaatctggaaaagac

SEQ ID NO: 22536 - DNA, 71 bp, chicken (Gallus Gallus)
  misc_feature (36): n=c or t
tctctttatccttcagtcgtggtggttttggacttngtcaacataaacatgtattcaatagttttcatttt

SEQ ID NO: 22537 - DNA, 71 bp, chicken (Gallus Gallus)
  misc_feature (36): n=a or g
aactcattaggaacaaataaccttgtcttcaaattnctctgcttttatccatttgtggtacaaggttattg

SEQ ID NO: 22538 - DNA, 71 bp, chicken (Gallus Gallus)
  misc_feature (36): n=c or t
aatgcctggcgctctgcattaatagattagtccagntagccctcagaaaacatctcagacttccatcactt

SEQ ID NO: 22539 - DNA, 71 bp, chicken (Gallus Gallus)
  misc_feature (36): n=c or t
agtctctcttctttggataagtcttttatccctgcntgcaagtctcggtgtaaacagttcagtagaaactc

SEQ ID NO: 22540 - DNA, 71 bp, chicken (Gallus Gallus)
  misc_feature (36): n=a or c
ttactgattgtatttttgaaaagtggaaatgcaganttgtacttcataggacttaggagcacaggaagaat

SEQ ID NO: 22541 - DNA, 71 bp, chicken (Gallus Gallus)
  misc_feature (36): n=g or t
acagctgacaaagactacagtaagaagggaacaganataactctgaatttccacattcaggtgataatctg

SEQ ID NO: 22542 - DNA, 71 bp, chicken (Gallus Gallus)
  misc_feature (36): n=c or t
agtagatgaaacaaaacctgcacatacaagaaaagngaaataaggaattaatttcctgcttaatatcagtg

SEQ ID NO: 22543 - DNA, 71 bp, chicken (Gallus Gallus)
  misc_feature (36): n=c or t
tgttgatgacaggatttctctaatgtctccacgtgnaccctctttctcaaaagggtaagggcagagagtgc

SEQ ID NO: 22544 - DNA, 71 bp, chicken (Gallus Gallus)
  misc_feature (36): n=a or c
agtacaaacatgcagccatgattaccattcccttcnatacagttgtagcagcaactggacactgatcactt

SEQ ID NO: 22545 - DNA, 71 bp, chicken (Gallus Gallus)
  misc_feature (36): n=c or t
agagataatattagtatcttttcaggacagcaacangcactgcagtagttttcccttcttttgtggacaga

SEQ ID NO: 22546 - DNA, 71 bp, chicken (Gallus Gallus)
  misc_feature (36): n=c or t
gaaaacttatccaaaagtaaaaacatttaacactangctcctaaactgagtttctgagcagaaccatttat

SEQ ID NO: 22547 - DNA, 71 bp, chicken (Gallus Gallus)
  misc_feature (36): n=g or t
gggactgagttgctaaataaagcggaaaacataaancagtatgtgtatcaaatatgggctgaaattaactt

SEQ ID NO: 22548 - DNA, 71 bp, chicken (Gallus Gallus)
  misc_feature (36): n=a or g
acacctccagggatggtgatcccaccacctccccgngcagcctgttcaaatgcttcaccaccactcttttg

SEQ ID NO: 22549 - DNA, 71 bp, chicken (Gallus Gallus)
  misc_feature (36): n=a or t
cactaggttgtatccaatgtaaattgttccaaaatntaagtcttgctgacaacaaaatctctgcaaacttc

SEQ ID NO: 22550 - DNA, 71 bp, chicken (Gallus Gallus)
  misc_feature (36): n=g or t
aagcagaagactttttaaaagagcaggttctcacgnttggctttcaagcgaatgctgcagctacaggaatg

SEQ ID NO: 22551 - DNA, 71 bp, chicken (Gallus Gallus)
  misc_feature (36): n=g or t
catttagcaatatcccaatggtacatccatcttcancatacgtgtctgggaatctgcattacttccctcag

SEQ ID NO: 22552 - DNA, 71 bp, chicken (Gallus Gallus)
  misc_feature (36): n=a or g
taatctgagagttcatatttccctgaccaccatttnatacatatctgcatttcatcctgcatttgaaattt

SEQ ID NO: 22553 - DNA, 71 bp, chicken (Gallus Gallus)
  misc_feature (36): n=a or c
tatggcctgatagctgactgaagccaaagtagtggnccaaaatagcaccagagttgaatttacagccctag

SEQ ID NO: 22554 - DNA, 71 bp, chicken (Gallus Gallus)
  misc_feature (36): n=c or t
atttctaggcttttcctggtgttttaagatatagtnttcatccaatcgtctaaaattgcaacgagataatt

SEQ ID NO: 22555 - DNA, 71 bp, chicken (Gallus Gallus)
  misc_feature (36): n=a or c
atttctttctccttcctccattatgtatgtaaaatnaagattaatcatatatgtagattcactctagccag

SEQ ID NO: 22556 - DNA, 71 bp, chicken (Gallus Gallus)
  misc_feature (36): n=a or g
aagatcagtttaaaaacactcaaaaagttggaatcngtaaattttaacacacacttcttactgaaatttca

SEQ ID NO: 22557 - DNA, 71 bp, chicken (Gallus Gallus)
  misc_feature (36): n=a or g
tacaccagtatttggaaataccagccagtaagtggngttggtatatcatggatctgaaatagtttatcagt

SEQ ID NO: 22558 - DNA, 71 bp, chicken (Gallus Gallus)
  misc_feature (36): n=a or t
ccaatttccaggactattttccttatgggtatcagntcagttataattttggatgactcaagcaagcacca

SEQ ID NO: 22559 - DNA, 71 bp, chicken (Gallus Gallus)
  misc_feature (36): n=a or c
taaaaagactatctatcgcaatctgatggtataatnggacacctttttcactcaagttgtggcaaaagctt

SEQ ID NO: 22560 - DNA, 71 bp, chicken (Gallus Gallus)
  misc_feature (36): n=a or g
atgtatttatgtgtacttttaaaatctatgttattncatcacctagggagaagttttaaagtttacctctg

SEQ ID NO: 22561 - DNA, 71 bp, chicken (Gallus Gallus)
  misc_feature (36): n=c or t
cattctcttccctttgtattcatgctgccctagagnagtatctcagtatgtttaaaagcatcctctttcta

SEQ ID NO: 22562 - DNA, 71 bp, chicken (Gallus Gallus)
  misc_feature (36): n=a or g
atatgcaagagatgtgggcagtttccacttcatccntctttgccactgagttcatgtacaaacagtctaca

SEQ ID NO: 22563 - DNA, 71 bp, chicken (Gallus Gallus)
  misc_feature (36): n=c or t
tgggctataaattgtgatgaatctcaccagataaanggaaagaaaattgccagtaacaatgaaacaaatgt

SEQ ID NO: 22564 - DNA, 71 bp, chicken (Gallus Gallus)
  misc_feature (36): n=c or t
agtggattccactttacactcatcttccgaggttanactttctgcagcatttcctccatgtatctcttcac

SEQ ID NO: 22565 - DNA, 71 bp, chicken (Gallus Gallus)
  misc_feature (36): n=a or c
ggcagggaggcagtagatggatttaaaacaaccaancaaacaatgacaacgatctgaggagggatggtaac

SEQ ID NO: 22566 - DNA, 71 bp, chicken (Gallus Gallus)
  misc_feature (36): n=c or g
agccgggtgggcagacctctcagtcccttcagctcntcaggatttgcatctattcagacgtatgtcacaat

SEQ ID NO: 22567 - DNA, 71 bp, chicken (Gallus Gallus)
  misc_feature (36): n=g or t
attccagaggcctgggaagattaatcacccagcagnacttcaaatcagcttcttcccccatgggcaaagct

SEQ ID NO: 22568 - DNA, 71 bp, chicken (Gallus Gallus)
  misc_feature (36): n=a or c
tcacacaaacatagatacacacatgacaacaacaanaaaaaaagatgtgacatttttatgaattacacatg

SEQ ID NO: 22569 - DNA, 71 bp, chicken (Gallus Gallus)
  misc_feature (36): n=c or g
ttaaatccatggagtttaaaatacttgattttattntggcaggctgagaattaggttctataagcaacaat

SEQ ID NO: 22570 - DNA, 71 bp, chicken (Gallus Gallus)
  misc_feature (36): n=a or g
ttaatttattgctaacatgcctagaaaacgtgcacntgactgctaacacacacttaagatttactcactgg

SEQ ID NO: 22571 - DNA, 71 bp, chicken (Gallus Gallus)
  misc_feature (36): n=a or g
tagggttttttgtaaatacaggcagaattatatgtngttgtttaaatacttgcaatggcacacttgagatt

SEQ ID NO: 22572 - DNA, 71 bp, chicken (Gallus Gallus)
  misc_feature (36): n=a or g
ggaaggaaggctggagcttcttctgaagcgtgcacnaatctgggccgcaggaatcataatgtgttgccgga

SEQ ID NO: 22573 - DNA, 71 bp, chicken (Gallus Gallus)
  misc_feature (36): n=a or g
ctttggaagaggatttgtatctgggagcatgacacngcaagtatcaaaataaatggacttctaattgcctg

SEQ ID NO: 22574 - DNA, 71 bp, chicken (Gallus Gallus)
  misc_feature (36): n=c or g
ttctagtggtgattgtgaagtctcagctgggaatgntgttttaagaaatgcataccaattgtcaagagtcc

SEQ ID NO: 22575 - DNA, 71 bp, chicken (Gallus Gallus)
  misc_feature (36): n=c or t
aagtcatgtgaaaatttgcccatatgaagatgtttnagaagaggctggaataaagcagcccgtaatccaca

SEQ ID NO: 22576 - DNA, 71 bp, chicken (Gallus Gallus)
  misc_feature (36): n=c or t
atgcagaattcccaaaagtgtgctttggcttgttanatgtagtctgacatgttgctgtttaaaaggtgaaa

SEQ ID NO: 22577 - DNA, 71 bp, chicken (Gallus Gallus)
  misc_feature (36): n=a or g
attgagatgccttaatttttgtttgttgatagtacntgtagttatgtgaagccattgagaattagaatttt

SEQ ID NO: 22578 - DNA, 71 bp, chicken (Gallus Gallus)
  misc_feature (36): n=c or t
ttaagtagaacagaaggagaagaggaaccttaatgnactttaaatcatgatagaccagataatgcctagaa

SEQ ID NO: 22579 - DNA, 71 bp, chicken (Gallus Gallus)
  misc_feature (36): n=c or t
taccagagggcaatgtgcagttgcaacctgcaatancttaatcaataccactgttgtgtccattcagtgcc

SEQ ID NO: 22580 - DNA, 71 bp, chicken (Gallus Gallus)
  misc_feature (36): n=g or t
tgctataattttcctgccatatttccataatttttnaattgttcattatcattagccataggctagacatc

SEQ ID NO: 22581 - DNA, 71 bp, chicken (Gallus Gallus)
  misc_feature (36): n=c or t
gctcttagtgctcgttttgcaattggaaaagcatgngcatccacatagctgattactgcaggttatgtaaa

SEQ ID NO: 22582 - DNA, 71 bp, chicken (Gallus Gallus)
  misc_feature (36): n=a or c
tcattgagtcactggtgcattaaaagcatctttgtnataaacactaaggggttttgaaaatttttgttttt

SEQ ID NO: 22583 - DNA, 71 bp, chicken (Gallus Gallus)
  misc_feature (36): n=c or t
acacaaggctcaaggtgatacttggatttcactcangtattagttctcatacagtcattttccttttggga

SEQ ID NO: 22584 - DNA, 71 bp, chicken (Gallus Gallus)
  misc_feature (36): n=a or t
accctgttttgatcaacaggttgactttggtgcacntgaacccacttctagtgcttactgacaaaaacact

SEQ ID NO: 22585 - DNA, 71 bp, chicken (Gallus Gallus)
  misc_feature (36): n=a or t
attcaaaagtcttcaagatgtaactattcatgctgntaaaacagagcttcagctatgaacaggctgaagtt

SEQ ID NO: 22586 - DNA, 71 bp, chicken (Gallus Gallus)
  misc_feature (36): n=a or t
gactcttttaagaaacagtcctacactgatataatnaatattactaatttaactttacaatcagattacaa

SEQ ID NO: 22587 - DNA, 71 bp, chicken (Gallus Gallus)
  misc_feature (36): n=c or t
caggtcactgttaacagaaggcctgctcttgttccnacttcactgaaagcagagttcagcctctaatttag

SEQ ID NO: 22588 - DNA, 71 bp, chicken (Gallus Gallus)
  misc_feature (36): n=c or t
aacagccacttattactaagcaaacagatttagtanagtctgttttcctcataaacactaaatgagatcac

SEQ ID NO: 22589 - DNA, 71 bp, chicken (Gallus Gallus)
  misc_feature (36): n=a or g
gccattatcgctatgcagggggaggataatactgancttgtggataactactctacactgaatctggaagt

SEQ ID NO: 22590 - DNA, 71 bp, chicken (Gallus Gallus)
  misc_feature (36): n=a or g
gtggtagcaagagtaatgggaggacgtttgaactangtgatcttataggtactttccaaccttgagattct

SEQ ID NO: 22591 - DNA, 71 bp, chicken (Gallus Gallus)
  misc_feature (36): n=g or t
tagcttttccttttccaaaatatctattgcctctgnacaaactacttacctaagaaaactttaaatctaac

SEQ ID NO: 22592 - DNA, 71 bp, chicken (Gallus Gallus)
  misc_feature (36): n=a or g
accaacatctagtagagccaaagtagactgaccatntgctgatcaaataactggtagcaagtttgctgtga

SEQ ID NO: 22593 - DNA, 71 bp, chicken (Gallus Gallus)
  misc_feature (36): n=a or g
actttgagcactttattggtaatcagaaaccctacntgacctgtggccagaatacggagagtctgagcacc

SEQ ID NO: 22594 - DNA, 71 bp, chicken (Gallus Gallus)
  misc_feature (36): n=c or t
attcagtagtattctgaaagaaggatacaacttganttcattttgagaaatatctatgtgtgaggagaaaa

SEQ ID NO: 22595 - DNA, 71 bp, chicken (Gallus Gallus)
  misc_feature (36): n=a or g
gtttgagttttgttttttttttttttttgcttttgnagttaaagggctaatgtgggttaaatccttacagc

SEQ ID NO: 22596 - DNA, 71 bp, chicken (Gallus Gallus)
  misc_feature (36): n=a or g
tgagtgttggtgaccagacccagcgttgtaactcantggttcttgtcttgtgtcttctcccaggttatgat

SEQ ID NO: 22597 - DNA, 71 bp, chicken (Gallus Gallus)
  misc_feature (36): n=c or t
tgggttcttggtgatagctacctaattgtggacttnttcccttgccagaatgtcctttcattcactttgcc

SEQ ID NO: 22598 - DNA, 71 bp, chicken (Gallus Gallus)
  misc_feature (36): n=a or g
tccacataaagaataatgaccgaccatactgtttcnggagaattaatccaatctctttccctacttccctt

SEQ ID NO: 22599 - DNA, 71 bp, chicken (Gallus Gallus)
  misc_feature (36): n=c or t
ccagatctgcccactgtggtccagtattctcagatnggtgatttctcaccagcaaatgaaaggatatatat

SEQ ID NO: 22600 - DNA, 71 bp, chicken (Gallus Gallus)
  misc_feature (36): n=c or t
ccactgcagctgccagaactgtcctgcagcatgtgnattagaagctaggagagtaaaccagcagacagatc

SEQ ID NO: 22601 - DNA, 71 bp, chicken (Gallus Gallus)
  misc_feature (36): n=c or t
ttgtatgcctttatctcagtaaagtttaaacaaaanataaagcaagctactactaactgcaaacttagttt

SEQ ID NO: 22602 - DNA, 71 bp, chicken (Gallus Gallus)
  misc_feature (36): n=c or t
gccttccagaaagaggaatgaaggctgctgaaattnaaagaatggccatttgaataaagatgtttccagaa

SEQ ID NO: 22603 - DNA, 71 bp, chicken (Gallus Gallus)
  misc_feature (36): n=a or g
aaagagccttataaataatgtggccagcacaagagntgaaattttaatggaaacccttcccctccttgctc

SEQ ID NO: 22604 - DNA, 71 bp, chicken (Gallus Gallus)
  misc_feature (36): n=a or g
acagttagtcctatggttaccaagctcttgcccagnatgtgtctcataacgactctgtaacagagaatgtt

SEQ ID NO: 22605 - DNA, 71 bp, chicken (Gallus Gallus)
  misc_feature (36): n=c or t
ttactaaatgtgacttttgtccctgaatgaggtaangattagacatcacatacaatgggtatatgggcata

SEQ ID NO: 22606 - DNA, 71 bp, chicken (Gallus Gallus)
  misc_feature (36): n=c or t
acccttccaaatcaaatggtgtgattttcctcatantttaccttcatgaatttttactggtgctcactaga

SEQ ID NO: 22607 - DNA, 71 bp, chicken (Gallus Gallus)
  misc_feature (36): n=a or g
tcagaacacatcgatctcaggaggaagagaaatgantgctgaatgtgaaaagcgcattgtatgtaaggttg

SEQ ID NO: 22608 - DNA, 71 bp, chicken (Gallus Gallus)
  misc_feature (36): n=a or g
acactctatgacttcagggacccatactccccaagnatgcccacattatatggtcaccctgatgaaggaga

SEQ ID NO: 22609 - DNA, 71 bp, chicken (Gallus Gallus)
  misc_feature (36): n=c or g
attgtatttaagaacacccaagaatgggtgctccanggaaaacagcttatcttaggagagctgcagtggtc

SEQ ID NO: 22610 - DNA, 71 bp, chicken (Gallus Gallus)
  misc_feature (36): n=a or g
gataaaggagagctacagctcttctctcatccagancctgattgtttctaattcctttcctgtcctttgtg

SEQ ID NO: 22611 - DNA, 71 bp, chicken (Gallus Gallus)
  misc_feature (36): n=c or t
ggagtgactttggctttcctctagttctcaggcacntctcctgttctccacaactttacaaaagatgaaag

SEQ ID NO: 22612 - DNA, 71 bp, chicken (Gallus Gallus)
  misc_feature (36): n=a or g
cattctgatatgtggaggacaaatgcaaggcctttnctttcattgagaagagccctgcagttgctgtggac

SEQ ID NO: 22613 - DNA, 71 bp, chicken (Gallus Gallus)
  misc_feature (36): n=a or g
tgtggagatgcaaaccgaggcacagctgtggagccnatcccatacaccatcctgtatccttttggatgcag

SEQ ID NO: 22614 - DNA, 71 bp, chicken (Gallus Gallus)
  misc_feature (36): n=c or t
ctcttgtgactatgaaagccaggacttgcaaacctnagtgagcagctcaggccaaaaaattgaggcagttt

SEQ ID NO: 22615 - DNA, 71 bp, chicken (Gallus Gallus)
  misc_feature (36): n=c or t
gcacatcaggacttttcaaagatgaaacaatcaaanaatgaatctaatttgagagaagaagttttgaagaa

SEQ ID NO: 22616 - DNA, 71 bp, chicken (Gallus Gallus)
  misc_feature (36): n=g or t
gtagttttttgtttgtttgtttgtttgtttgtttgntttgttttgatttggagcctcacatattggttaaa

SEQ ID NO: 22617 - DNA, 71 bp, chicken (Gallus Gallus)
  misc_feature (36): n=c or t
acagcagcgtgcctagcaagaagagatgactacagntgtcaaagccaaagaaaaacacactgcagataagt

SEQ ID NO: 22618 - DNA, 71 bp, chicken (Gallus Gallus)
  misc_feature (36): n=c or t
ttgacaggtaaaacttagttagaggggaattaatgngttgtggtccttctttatataagaatatcaaacca

SEQ ID NO: 22619 - DNA, 71 bp, chicken (Gallus Gallus)
  misc_feature (36): n=a or g
tataaaagtacatgatgcaaaattgcatggcttacngcatgttaccttgtataggaatcataatagaagga

SEQ ID NO: 22620 - DNA, 71 bp, chicken (Gallus Gallus)
  misc_feature (36): n=c or g
agcagcccaaaccatcactagtctttctaactaganagacacaaagacctgatggaaaaagaccaaaataa

SEQ ID NO: 22621 - DNA, 71 bp, chicken (Gallus Gallus)
  misc_feature (36): n=c or t
tatgcaacactgaagaagagttgatatggcacttanggaggaacatatgattcaaaaactgtgaaatcctt

SEQ ID NO: 22622 - DNA, 71 bp, chicken (Gallus Gallus)
  misc_feature (36): n=a or g
tctgtgctgtgctgtgtggtattgagctggatcctnctaatgtgtgaggtaacaagcattctcctgtgttc

SEQ ID NO: 22623 - DNA, 71 bp, chicken (Gallus Gallus)
  misc_feature (36): n=c or t
cattttttctcttattttagatcgcctgtatactgntaaaattaagcaatgttttggttcagataatttca

SEQ ID NO: 22624 - DNA, 71 bp, chicken (Gallus Gallus)
  misc_feature (36): n=c or t
agggcacattccttgagccggtaaaaacacagagantcaatggcagggctgctgcctcccaccctgcccca

SEQ ID NO: 22625 - DNA, 71 bp, chicken (Gallus Gallus)
  misc_feature (36): n=a or g
taatatttttagttactatttttttttccccaagcnctctgtgaatagagccagatatctgatttttattt

SEQ ID NO: 22626 - DNA, 71 bp, chicken (Gallus Gallus)
  misc_feature (36): n=a or g
aacctgcagatagaaatgtaggcaacatgctgacantactctgtgcaactgttcctaatgcactgaaatat

SEQ ID NO: 22627 - DNA, 71 bp, chicken (Gallus Gallus)
  misc_feature (36): n=a or c
gctttgccaatggctcccttgtttgcctcaaactgnacaatgttaactgttttgtatgatgtagttaaggg

SEQ ID NO: 22628 - DNA, 71 bp, chicken (Gallus Gallus)
  misc_feature (36): n=c or t
tttgtccagagctacaggtcaccattatttggaaangcactttgtatatgtgtgagaatgaatagataaca

SEQ ID NO: 22629 - DNA, 71 bp, chicken (Gallus Gallus)
  misc_feature (36): n=c or t
taaatcagaccctagtggtgtgcaagttagtatcantatgatattgtataatacttctccaaaatctcagt

SEQ ID NO: 22630 - DNA, 71 bp, chicken (Gallus Gallus)
  misc_feature (36): n=a or c
caggaaatgagtactagaaaaaaagagcagacttgnaaatacctgcactcccacttctttaacttcacatc

SEQ ID NO: 22631 - DNA, 71 bp, chicken (Gallus Gallus)
  misc_feature (36): n=a or g
tccaaaccaaaaaactgatggcaggaggaaagcacntatcactaccagcctattgaaacactcgccagcgt

SEQ ID NO: 22632 - DNA, 71 bp, chicken (Gallus Gallus)
  misc_feature (36): n=a or g
gcaggcaaaatgtaaagctcctttgaatactgtttnttgtcagttttttttttcttttttttttccaagtc

SEQ ID NO: 22633 - DNA, 71 bp, chicken (Gallus Gallus)
  misc_feature (36): n=c or g
gatgctttctactgatactgaggagagtatctacanatactgaggagaagagaggtgttactggcttgaag

SEQ ID NO: 22634 - DNA, 71 bp, chicken (Gallus Gallus)
  misc_feature (36): n=c or g
cagtggttcccatcaacaaagccactacgtcagatntgggcagctactggtgttcgaaacacgttctgccc

SEQ ID NO: 22635 - DNA, 71 bp, chicken (Gallus Gallus)
  misc_feature (36): n=c or t
tttagaaatatgctttagcacatctaagcaacttcnattaaacagaattagaactgacttcagtaacgcat

SEQ ID NO: 22636 - DNA, 71 bp, chicken (Gallus Gallus)
  misc_feature (36): n=g or t
tcgttcatgtacatccagacttcttcctttggtttnggatacgcctcatattcaactgttaaatttccatt

SEQ ID NO: 22637 - DNA, 71 bp, chicken (Gallus Gallus)
  misc_feature (36): n=c or t
tactggtgaattgctcttagtgcactgaaagaatcngttgtcatgactgaggactttttttgctacctctt

SEQ ID NO: 22638 - DNA, 71 bp, chicken (Gallus Gallus)
  misc_feature (36): n=c or t
tggtgcttaaaggaaaacagaatgcatgttaaaacnttacaaaaagtcaagtgtgagtagaaggataatta

SEQ ID NO: 22639 - DNA, 71 bp, chicken (Gallus Gallus)
  misc_feature (36): n=c or t
tagccttgctatgtctcttcacacaagctacatctncagtctcagctgctgctctataaataaccacatag

SEQ ID NO: 22640 - DNA, 71 bp, chicken (Gallus Gallus)
  misc_feature (36): n=c or t
tgtactgccagcttgaacaactaatcacgaaaatangatctccttgattagtacttcactgtaatagtaat

SEQ ID NO: 22641 - DNA, 71 bp, chicken (Gallus Gallus)
  misc_feature (36): n=a or g
acattaaatgaataggattttgcatattatcagtcnttctaggctctttaaattggtatgtttgtgttttg

SEQ ID NO: 22642 - DNA, 71 bp, chicken (Gallus Gallus)
  misc_feature (36): n=g or t
tatattattatgccatcaatctatggcaaacttctntgattactagctctgcttctagcacttgcatctcc

SEQ ID NO: 22643 - DNA, 71 bp, chicken (Gallus Gallus)
  misc_feature (36): n=c or t
tggctgggaattttcacgggttggcttcatacacantgcgttactggtgttagctcacagggaactcgaat

SEQ ID NO: 22644 - DNA, 71 bp, chicken (Gallus Gallus)
  misc_feature (36): n=a or g
caatatacactcccgcagacagtcctttttctgtcntgtgctttctaactggggagttctctccaacatgg

SEQ ID NO: 22645 - DNA, 71 bp, chicken (Gallus Gallus)
  misc_feature (36): n=a or t
ttagttggttatttcttttgacttcagttgtttaanctgactgcttgctacattcaaatgctcaacataaa

SEQ ID NO: 22646 - DNA, 71 bp, chicken (Gallus Gallus)
  misc_feature (36): n=a or g
ttctttaggtgggaattttcaagttttcagtgtccnttattggaaaataaagacaagccatgcggacatta

SEQ ID NO: 22647 - DNA, 71 bp, chicken (Gallus Gallus)
  misc_feature (36): n=c or t
aatgtattagtgttttagaagccacatcccaatganagtgaagttgctaaaatacaacccaatatatttgg

SEQ ID NO: 22648 - DNA, 71 bp, chicken (Gallus Gallus)
  misc_feature (36): n=c or g
gatatcaaagttaacaaaacctgttaccattgcagnttgtttgtatgttcagtgagttgtaagcaaatgat

SEQ ID NO: 22649 - DNA, 71 bp, chicken (Gallus Gallus)
  misc_feature (36): n=c or t
gtggaaactacaacaggtacgaagtggagatgaccnactgtcatagctgctgtgattgcgtcactgatgaa

SEQ ID NO: 22650 - DNA, 71 bp, chicken (Gallus Gallus)
  misc_feature (36): n=a or g
gcagtaagtagagagtcttttaacatcttgaacacntgtgcttgaaaaaagtagttacatcaaagcagttc

SEQ ID NO: 22651 - DNA, 71 bp, chicken (Gallus Gallus)
  misc_feature (36): n=c or t
ggatcttcaggtggtactcctgtggctgtcctgtcngtgttattaagtgctaccattttcggatgtgcaca

SEQ ID NO: 22652 - DNA, 71 bp, chicken (Gallus Gallus)
  misc_feature (36): n=c or t
tatgacccactgaagggagaatttgaagtttacacncaatatgctactcttatttgcaagccagaagttta

SEQ ID NO: 22653 - DNA, 71 bp, chicken (Gallus Gallus)
  misc_feature (36): n=a or g
cgtccagactacctaaaccataagcgaagaacaacnctattttacctacagcaggctacagccactgaaca

SEQ ID NO: 22654 - DNA, 71 bp, chicken (Gallus Gallus)
  misc_feature (36): n=g or t
tgcaaccctcgtgcttaaaaaggctatacaaatcangcggagtttctcacaccataaaaatgtcacagttt

SEQ ID NO: 22655 - DNA, 71 bp, chicken (Gallus Gallus)
  misc_feature (36): n=g or t
aacacactgtaggatcctgcttatcctgaatgcccntaccagaaagcaaaaaattcagtctcctttcttca

SEQ ID NO: 22656 - DNA, 71 bp, chicken (Gallus Gallus)
  misc_feature (36): n=c or t
ctcacaaacagaatgtctgctacgttctgctgaagngccattataggttgagataaattaggatcaccata

SEQ ID NO: 22657 - DNA, 71 bp, chicken (Gallus Gallus)
  misc_feature (36): n=c or g
caagtcccagccctgaagatagaaattcttacactnttagccaagcacacattttcagcacccacttcagt

SEQ ID NO: 22658 - DNA, 71 bp, chicken (Gallus Gallus)
  misc_feature (36): n=c or t
gctacaatcagctgactgccctgaggaaacctggtnagactgacagctgtttcacagcacctttgctttac

SEQ ID NO: 22659 - DNA, 71 bp, chicken (Gallus Gallus)
  misc_feature (36): n=g or t
tcttgaaaactagatttaaagcagtttaaatgaaantgaaatctggtttgctgagtaaaagaagtatgaag

SEQ ID NO: 22660 - DNA, 71 bp, chicken (Gallus Gallus)
  misc_feature (36): n=a or g
atgtgtttcctgtttctgtttttaattagcaggaanacagaaggtacagaagatgcatattctttttcacc

SEQ ID NO: 22661 - DNA, 71 bp, chicken (Gallus Gallus)
  misc_feature (36): n=c or t
actgaaaaagagttttaggatcaatgggggcttgtnttctttcaagaagcatagacaaagaaatggtattt

SEQ ID NO: 22662 - DNA, 71 bp, chicken (Gallus Gallus)
  misc_feature (36): n=g or t
acaagagccagcatgtcacacttataaaaatctgtntggcactctcgaatgtgacttgtcttttactattg

SEQ ID NO: 22663 - DNA, 71 bp, chicken (Gallus Gallus)
  misc_feature (36): n=a or g
ataagttaaaacaaaagtagacctcagcactcctcnacacatgtatgacagcacaagtgaatgtatgcaca

SEQ ID NO: 22664 - DNA, 71 bp, chicken (Gallus Gallus)
  misc_feature (36): n=c or t
tccccagtggatatccccagaagctccagcacctgntcccgtggtatcttctgcaacatcaaggtaaggag

SEQ ID NO: 22665 - DNA, 71 bp, chicken (Gallus Gallus)
  misc_feature (36): n=a or c
tagcatgcacacataataattaaataaagttctaangagaaagcttaagactagattatttcaaaaagcta

SEQ ID NO: 22666 - DNA, 71 bp, chicken (Gallus Gallus)
  misc_feature (36): n=c or t
aaacaaagaatagactcttataaaacaagagacctnttaaacaacaagcaggctcagcatcctacttcaga

SEQ ID NO: 22667 - DNA, 71 bp, chicken (Gallus Gallus)
  misc_feature (36): n=a or g
gacaaaaaagaagtttgtgtcacagtgaaaaatatngaataaaatgtgttaatttcataccagtgtttcag

SEQ ID NO: 22668 - DNA, 71 bp, chicken (Gallus Gallus)
  misc_feature (36): n=c or t
atcgtgacttctctcccttatctttacccattctcnattgtgattgtttgtattgcaacataacttggaaa

SEQ ID NO: 22669 - DNA, 71 bp, chicken (Gallus Gallus)
  misc_feature (36): n=a or g
ggaaagggcccgctgacaaagaacaaagcttcttcncagccctctgagtgaggtgttaggtctgtccaggg

SEQ ID NO: 22670 - DNA, 71 bp, chicken (Gallus Gallus)
  misc_feature (36): n=c or g
aactactgtccttcgcctgcagaggggaaggaattncatcaggagaaaaagaaggagtctttggcaagaca

SEQ ID NO: 22671 - DNA, 71 bp, chicken (Gallus Gallus)
  misc_feature (36): n=a or g
taaaattgggtttatgaacccaccaaaggtcacacnagtgagttagcagcaaaacaaagaatagtgcctct

SEQ ID NO: 22672 - DNA, 71 bp, chicken (Gallus Gallus)
  misc_feature (36): n=a or t
tgataaatattgaattaatttgtttcaagaccgcantattttactgtagtgaaaagcccatgccactctgt

SEQ ID NO: 22673 - DNA, 71 bp, chicken (Gallus Gallus)
  misc_feature (36): n=c or t
gatgtaaccatgggtgaaactcctctttcagggaangtaggtgagatgtttcagtgtgttacatttcgttc

SEQ ID NO: 22674 - DNA, 71 bp, chicken (Gallus Gallus)
  misc_feature (36): n=a or g
tccaaaatacacacagcaagtaacagttaatcaacncttcatgtcctgaaatcccctttgtactacactgt

SEQ ID NO: 22675 - DNA, 71 bp, chicken (Gallus Gallus)
  misc_feature (36): n=a or g
gtgttttaaacagctcaaaagctacctcagacttcntatttcatgctttttgtaggcaacgttgccttgga

SEQ ID NO: 22676 - DNA, 71 bp, chicken (Gallus Gallus)
  misc_feature (36): n=c or t
tgcccatggcacggagattagaactagatgagtttnaaggtcccttgcaaataaaaaaagaagaatagata

SEQ ID NO: 22677 - DNA, 71 bp, chicken (Gallus Gallus)
  misc_feature (36): n=c or t
ccccagtatgcaatattaagctcacccatttagccngtactgcatcaagtaaattggtagaaaaaacaaag

SEQ ID NO: 22678 - DNA, 71 bp, chicken (Gallus Gallus)
  misc_feature (36): n=c or t
gtggtggatctcagtgaccaggtggcacctactganattgaagaaggcatgagagttgggtaagcagaatc

SEQ ID NO: 22679 - DNA, 71 bp, chicken (Gallus Gallus)
  misc_feature (36): n=a or g
gctggcagagggacatcacaatcaaggccaggttcnatgggactgagcaaactgttctagaagaaggtgtc

SEQ ID NO: 22680 - DNA, 71 bp, chicken (Gallus Gallus)
  misc_feature (36): n=a or g
acattttaaactggtgcaaaactcatctgaaaagcnccacttggccaagcctgacatcgggtgggtggtat

SEQ ID NO: 22681 - DNA, 71 bp, chicken (Gallus Gallus)
  misc_feature (36): n=g or t
ttccatgagaagttctagtaggatgaaaatctatantccttattgcaacagcaattcaggttttggctaca

SEQ ID NO: 22682 - DNA, 71 bp, chicken (Gallus Gallus)
  misc_feature (36): n=a or g
cccctataagtgttatttttttcatcgtgggacctnaaagtggagctgagctttctgattggctctgcatt

SEQ ID NO: 22683 - DNA, 71 bp, chicken (Gallus Gallus)
  misc_feature (36): n=c or t
acaggtgaaaaagtagggtagacttctttctattangttgggtatatcacagtacgtgtttcttccagtaa

SEQ ID NO: 22684 - DNA, 71 bp, chicken (Gallus Gallus)
  misc_feature (36): n=a or g
aatcaagttgaaactggagctttccctgtagcaagncacactgctatctccctctgctgctctgccagcca

SEQ ID NO: 22685 - DNA, 71 bp, chicken (Gallus Gallus)
  misc_feature (36): n=a or g
catctgctggaacatacggcacaacaggatgtacantattgtgccacgatatacaccttgggtgcagtgtg

SEQ ID NO: 22686 - DNA, 71 bp, chicken (Gallus Gallus)
  misc_feature (36): n=a or t
aggtctagcgttttttcttttttgcagttttgtttngtatctatgcatgtagaacttagacacattaagat

SEQ ID NO: 22687 - DNA, 71 bp, chicken (Gallus Gallus)
  misc_feature (36): n=a or g
aaatatgtactggagacttggctccagccaataganggacctgtagcagaagttaagaagagtcttggctg

SEQ ID NO: 22688 - DNA, 71 bp, chicken (Gallus Gallus)
  misc_feature (36): n=a or g
tcagctatacaggagacaacaggcttccttctgccnggcagtacagcatgcaaagcagagccagagctgcc

SEQ ID NO: 22689 - DNA, 71 bp, chicken (Gallus Gallus)
  misc_feature (36): n=c or g
ctacagctatcattggagaatgtgctctggagctanaagtaaaaagatacaaactctgttaataactattt

SEQ ID NO: 22690 - DNA, 71 bp, chicken (Gallus Gallus)
  misc_feature (36): n=c or g
ctttcttttttccacttacaattttttaaaaatgtncttatgacttattttgaagccattaggctttactg

SEQ ID NO: 22691 - DNA, 71 bp, chicken (Gallus Gallus)
  misc_feature (36): n=c or t
accaaaacactgagtgaaactgaggtgaaaacttanaaggacatcgtatcaagaccagggttgatgaaaca

SEQ ID NO: 22692 - DNA, 71 bp, chicken (Gallus Gallus)
  misc_feature (36): n=a or g
agatgatttctcacaaggctgttggctttagaagtntgcaatacatcctacatgctgcagcttgcaggact

SEQ ID NO: 22693 - DNA, 71 bp, chicken (Gallus Gallus)
  misc_feature (36): n=c or t
tgaggaacgcctcaggcaccagatttgcctgttcanggcatgggcactggggtgggctggggacagatgag

SEQ ID NO: 22694 - DNA, 71 bp, chicken (Gallus Gallus)
  misc_feature (36): n=a or g
aactgaacagttcaagtatttggctgaggaatcacngaatcataaagatatagaatatcctgagttggaag

SEQ ID NO: 22695 - DNA, 71 bp, chicken (Gallus Gallus)
  misc_feature (36): n=a or t
gtctacatataagaacaggagaaaaaaaaaagttgncttagtttgaatttgcatttcaaatatcacagaat

SEQ ID NO: 22696 - DNA, 71 bp, chicken (Gallus Gallus)
  misc_feature (36): n=c or t
aaaattaatagaattattattaattattatatctantaatagaattatcctacccagacccatttacaagc

SEQ ID NO: 22697 - DNA, 71 bp, chicken (Gallus Gallus)
  misc_feature (36): n=a or g
catgccaaatacaatataatgagagaaaactggcantgctgacttactgaaggtttatttcccacaggctg

SEQ ID NO: 22698 - DNA, 71 bp, chicken (Gallus Gallus)
  misc_feature (36): n=a or g
ttttttctctagtagcttccagaggaatgagatagngccattttggtcaatgttctgcaacagcaaaatag

SEQ ID NO: 22699 - DNA, 71 bp, chicken (Gallus Gallus)
  misc_feature (36): n=g or t
tccagagacatatggatagacgctcatgttcatttntcccagaagcccactgtgaccagaaagttactcca

SEQ ID NO: 22700 - DNA, 71 bp, chicken (Gallus Gallus)
  misc_feature (36): n=a or g
tcaaatggatcgacagtgcatcacaagcagctatcnatatcaaaatctgtattctggtgggactacctcct

SEQ ID NO: 22701 - DNA, 71 bp, chicken (Gallus Gallus)
  misc_feature (36): n=c or t
tgtccaccagagcctgtatgtagagtcaccatatgngggtaaagtagctgatttcagccacctttctatgt

SEQ ID NO: 22702 - DNA, 71 bp, chicken (Gallus Gallus)
  misc_feature (36): n=a or g
tgtataccaacagaatgttggtttcacttgttatcntatcatcaccagaaccttctgcacctacctgatgt

SEQ ID NO: 22703 - DNA, 71 bp, chicken (Gallus Gallus)
  misc_feature (36): n=a or g
aaatttgtttgggtttcttttcattttccagttagnaatgcaccagtatttgctaggaaaggaaatacaca

SEQ ID NO: 22704 - DNA, 71 bp, chicken (Gallus Gallus)
  misc_feature (36): n=c or g
tacaaaggccccatgataggcctcatcctgactganagaacctttacctagtaacaagagctatagatgaa

SEQ ID NO: 22705 - DNA, 71 bp, chicken (Gallus Gallus)
  misc_feature (36): n=c or t
tactaataagaatactttgtgaattgaaaagacgtnagagcacccatctgctctttatttaattcatagag

SEQ ID NO: 22706 - DNA, 71 bp, chicken (Gallus Gallus)
  misc_feature (36): n=a or g
gtatgatcatcttttccacattaaacttaatatgantttttgagacaattgcagaaaatgtaaagaatcta

SEQ ID NO: 22707 - DNA, 71 bp, chicken (Gallus Gallus)
  misc_feature (36): n=a or g
taaggcatccattagtggcatgactagaggagaatnggagagatgattaagtaataggtttgttcttcatc

SEQ ID NO: 22708 - DNA, 71 bp, chicken (Gallus Gallus)
  misc_feature (36): n=a or c
tcctttggaaacagaattagctgaagacttaaccantgatttctgtagtatgaggctttcagaaattcaga

SEQ ID NO: 22709 - DNA, 71 bp, chicken (Gallus Gallus)
  misc_feature (36): n=a or t
ataaagatgtgtccatatgcacacattctttactgnttttttgggttgttttgttgttgctatgagaaact

SEQ ID NO: 22710 - DNA, 71 bp, chicken (Gallus Gallus)
  misc_feature (36): n=c or t
gttttatggtagatcgtatttaagtcacaaacaatngaacaaattcatgcagctatagagaattccatcca

SEQ ID NO: 22711 - DNA, 71 bp, chicken (Gallus Gallus)
  misc_feature (36): n=a or g
tgaatgtttatggagactaaagagtgggtgtgagcngtggtgatggcagtgtgaaagagactacagccatg

SEQ ID NO: 22712 - DNA, 71 bp, chicken (Gallus Gallus)
  misc_feature (36): n=c or g
atctccactggttggacagtgagactggaagcacanagaagcgataaagaacaacgcgagcggattcaaag

SEQ ID NO: 22713 - DNA, 71 bp, chicken (Gallus Gallus)
  misc_feature (36): n=c or g
tatggagaaggcatactaatatctttctctagcacnatgtgcaaaggaaaggatgtgcttttcatcaggtc

SEQ ID NO: 22714 - DNA, 71 bp, chicken (Gallus Gallus)
  misc_feature (36): n=a or g
gggtagcaaacaccatttcgagaacatggaaactcntctctttggcacatggtgcagttggtttcatccct

SEQ ID NO: 22715 - DNA, 71 bp, chicken (Gallus Gallus)
  misc_feature (36): n=a or g
tccacttcttcaccatctccctcactgtctgtctgnggagcccaaaggctacacaattccagatgtggtca

SEQ ID NO: 22716 - DNA, 71 bp, chicken (Gallus Gallus)
  misc_feature (36): n=g or t
gttggtgctggcccttctcacttggcctgcagcctnctgtaccacacttggcattgaaaaatcattgctgc

SEQ ID NO: 22717 - DNA, 71 bp, chicken (Gallus Gallus)
  misc_feature (36): n=c or t
aacaatccaaggcacatttttagtgccagttaagcnttacttggtgaccctttcaaaccaccactggcctt

SEQ ID NO: 22718 - DNA, 71 bp, chicken (Gallus Gallus)
  misc_feature (36): n=c or t
ttaaaaggtagaaaaacatgaggatttcctgcagtntctagcactaaggagtttgaaaattcatgcaaatt

SEQ ID NO: 22719 - DNA, 71 bp, chicken (Gallus Gallus)
  misc_feature (36): n=a or g
ttgtgggcaaagaacttggtctgggatcttcaactntggtacagacaaactcattaaatcttttaatgttt

SEQ ID NO: 22720 - DNA, 71 bp, chicken (Gallus Gallus)
  misc_feature (36): n=a or c
tagagtttaacacaaaaggattttgatttcaactcnatgttgaaaaagctgaagctgcttttgaaaccaaa

SEQ ID NO: 22721 - DNA, 71 bp, chicken (Gallus Gallus)
  misc_feature (36): n=a or g
gacatctgtaaaatgaatgctttccagtaaaaatantaaaagctcattctcccggttaataaataaatagc

SEQ ID NO: 22722 - DNA, 71 bp, chicken (Gallus Gallus)
  misc_feature (36): n=a or t
ttagattttaggtaaattttagagtatctgtaagtnacatacaggagatgacgcagtgaagagaaactggt

SEQ ID NO: 22723 - DNA, 71 bp, chicken (Gallus Gallus)
  misc_feature (36): n=c or t
aaaggtttctgagtgtaaaactgttgctctgctgtnagaagtggtagaatccagccttccgttttctgtgt

SEQ ID NO: 22724 - DNA, 71 bp, chicken (Gallus Gallus)
  misc_feature (36): n=g or t
gaaagccccattctcgacatacagaacacccactangcagtcactagtgataatttcattttctttcattg

SEQ ID NO: 22725 - DNA, 71 bp, chicken (Gallus Gallus)
  misc_feature (36): n=c or t
gtgaaatacagagtcagaatgatacagggcaaagcnggacaatgagtgaaaaaggaggcagaaagagagcc

SEQ ID NO: 22726 - DNA, 71 bp, chicken (Gallus Gallus)
  misc_feature (36): n=c or t
aaaattaaaagaaaacaaaatgcaaaaatcatttanccttcctattgctttgatcaatcataaaattcatg

SEQ ID NO: 22727 - DNA, 71 bp, chicken (Gallus Gallus)
  misc_feature (36): n=c or t
aagatagagcacaaaagaagaaagatgcaaaacatngtatagcttatatttcagtcagttaccagttaatc

SEQ ID NO: 22728 - DNA, 71 bp, chicken (Gallus Gallus)
  misc_feature (36): n=c or t
aacagcttctacttgctgaacaaagtgcactgttangtgttacaagagatcataactgcttggtaatttgt

SEQ ID NO: 22729 - DNA, 71 bp, chicken (Gallus Gallus)
  misc_feature (36): n=g or t
aattaaaaaaatagaagtcaagtctttgtcctctgnagtccctctttctctgagtccatgtactcttttgg

SEQ ID NO: 22730 - DNA, 71 bp, chicken (Gallus Gallus)
  misc_feature (36): n=a or g
ggagaatcttgctcagatgcagaatggcgcagccantgtgtggcttccatatcctgtccttctacgatgca

SEQ ID NO: 22731 - DNA, 71 bp, chicken (Gallus Gallus)
  misc_feature (36): n=a or t
tgcaaactagcagtgaagcagactgctgtttgtgtngtctcacttcctgttgctacctgtagctctgacag

SEQ ID NO: 22732 - DNA, 71 bp, chicken (Gallus Gallus)
  misc_feature (36): n=c or t
tcgcagaacaaggcagtcacaaatattccacatcanataaagccagagaagtacagggaactaaaaggcag

SEQ ID NO: 22733 - DNA, 71 bp, chicken (Gallus Gallus)
  misc_feature (36): n=g or t
ctaaatatctgaaatgtcacagcacggttttgtctncatgttaccagctcaggtggatttattttcactat

SEQ ID NO: 22734 - DNA, 71 bp, chicken (Gallus Gallus)
  misc_feature (36): n=a or g
taatatattacattgtactatgtggtattaatttcntcaagtgctcatttgcatcagctttgggcctcact

SEQ ID NO: 22735 - DNA, 71 bp, chicken (Gallus Gallus)
  misc_feature (36): n=c or g
gtttgctgtaatcaatcacatcattttcagttcttntcctttcctctccaaacactcaaactggctgaaga

SEQ ID NO: 22736 - DNA, 71 bp, chicken (Gallus Gallus)
  misc_feature (36): n=c or t
agggctggtgacccaagcttccttctaggtgattgngcatgaatgtgcaaagctaaatggttggcttctct

SEQ ID NO: 22737 - DNA, 71 bp, chicken (Gallus Gallus)
  misc_feature (36): n=c or t
gagagctataatggagagcatggatctgtattcgtnacaggtggtttatctaaccatcaagttattttctg

SEQ ID NO: 22738 - DNA, 71 bp, chicken (Gallus Gallus)
  misc_feature (36): n=c or t
agaaaatggaatggctactgaaaatggggctcaaanaaggacctaccccagctcttggctgttctccccat

SEQ ID NO: 22739 - DNA, 71 bp, chicken (Gallus Gallus)
  misc_feature (36): n=c or t
atgttcatcctcatgtccgaggtttgatactagatncctgaacctccctccaaattccccagtgagaagga

SEQ ID NO: 22740 - DNA, 71 bp, chicken (Gallus Gallus)
  misc_feature (36): n=c or t
tttaaaggaggatgtagatactggtatgaataatcngtaaaaaaatatggcaggaagaccagatgtatttt

SEQ ID NO: 22741 - DNA, 71 bp, chicken (Gallus Gallus)
  misc_feature (36): n=c or g
tggggatcatctactccattccttgcttaaaatggntatagttaggtcagcttgctcagggctatgtccag

SEQ ID NO: 22742 - DNA, 71 bp, chicken (Gallus Gallus)
  misc_feature (36): n=c or t
cccacacaaacactgcagctaggacatggtgcttcntgatgctctccacatcaacataaggattcatgaaa

SEQ ID NO: 22743 - DNA, 71 bp, chicken (Gallus Gallus)
  misc_feature (36): n=a or c
tcctgctcctttcagatactaccagacacaatttgnaaatcaggaggttgcagctttccttcaccccgttc

SEQ ID NO: 22744 - DNA, 71 bp, chicken (Gallus Gallus)
  misc_feature (36): n=c or t
aaaacaaaatgcaaagaagagatgcaacttgtacanaccaaccaagttggcagaaacacagaaaacgtttt

SEQ ID NO: 22745 - DNA, 71 bp, chicken (Gallus Gallus)
  misc_feature (36): n=c or t
gctaagcttctgtgctcctaatcaccctcctgccancagccagtttcacctaccaactgctttgactccag

SEQ ID NO: 22746 - DNA, 71 bp, chicken (Gallus Gallus)
  misc_feature (36): n=c or g
taagaattctgattgcttctgtgattgaggcaaatntctgtgggaggagatttattctactacatgtctag

SEQ ID NO: 22747 - DNA, 71 bp, chicken (Gallus Gallus)
  misc_feature (36): n=c or t
cattcttgagcagttctctctgatgcagcaaagggntttgccactgttgtggtttaggtgtgtttaccagc

SEQ ID NO: 22748 - DNA, 71 bp, chicken (Gallus Gallus)
  misc_feature (36): n=a or t
ttttgtagacagaaagaattcacagatattgaaccngatactgactcctttttctgaaggaggaaatactc

SEQ ID NO: 22749 - DNA, 71 bp, chicken (Gallus Gallus)
  misc_feature (36): n=g or t
ctaaaaaacaaattccctgggaggcatggatgactntcacctctgaaaatcaatatatttgggtaaaaggt

SEQ ID NO: 22750 - DNA, 71 bp, chicken (Gallus Gallus)
  misc_feature (36): n=a or g
aattaattgttttatccaggtatatgaaaataaatntaagatcagtgggaaatctactctatttctttcta

SEQ ID NO: 22751 - DNA, 71 bp, chicken (Gallus Gallus)
  misc_feature (36): n=a or g
aagaaagaaggggttgcagctctgattggataaatncctgcatgaatggttgaggggtgtttgtagaatgc

SEQ ID NO: 22752 - DNA, 71 bp, chicken (Gallus Gallus)
  misc_feature (36): n=a or g
aatggaaaggaatacatgtgatctcatgttgtgatnggaagctagcgacaaaggaatattaaaccaggaga

SEQ ID NO: 22753 - DNA, 71 bp, chicken (Gallus Gallus)
  misc_feature (36): n=c or t
gagagatgtgcagaatgtgctgttttagggagatcntgggtttgtttttaatcgcgagcaatacaaaaccc

SEQ ID NO: 22754 - DNA, 71 bp, chicken (Gallus Gallus)
  misc_feature (36): n=c or t
attgttgagtttatatttttattattaaccatagtngtgtattatttgttcttaaagcagagacaagaagc

SEQ ID NO: 22755 - DNA, 71 bp, chicken (Gallus Gallus)
  misc_feature (36): n=a or g
atcccgggctgtgtcataagagatgtgaccagcacngagaggaaggtgattgttcccctctactctgccct

SEQ ID NO: 22756 - DNA, 71 bp, chicken (Gallus Gallus)
  misc_feature (36): n=c or t
ttgtgcagtcagtctgttgtgcagcagagtttcgcngcagcatccttgaccatatctccaacacatgggac

SEQ ID NO: 22757 - DNA, 71 bp, chicken (Gallus Gallus)
  misc_feature (36): n=c or t
acataatctttgggcagaagtacagactgaggaaantgaatatgaaagtaaactactttttggatatatct

SEQ ID NO: 22758 - DNA, 71 bp, chicken (Gallus Gallus)
  misc_feature (36): n=c or g
taatagatctaaaaatttgtccagtgttgctgtganagcacctgaagaaatgatcacgcacaattaccctg

SEQ ID NO: 22759 - DNA, 71 bp, chicken (Gallus Gallus)
  misc_feature (36): n=c or g
gctcttcatctctgaccatcttaactgactccactnaatctgaacttatcacttttgaacactgggcagat

SEQ ID NO: 22760 - DNA, 71 bp, chicken (Gallus Gallus)
  misc_feature (36): n=a or c
acttttcttctcagttttcaggttcagccaacatgncagaaaactaattattcacatagaccacactcctt

SEQ ID NO: 22761 - DNA, 71 bp, chicken (Gallus Gallus)
  misc_feature (36): n=a or g
cagacatggctccctggagaagcaagtgagcatccnatgtcatttctttgggctgctgcatctcttcctgc

SEQ ID NO: 22762 - DNA, 71 bp, chicken (Gallus Gallus)
  misc_feature (36): n=a or g
attgcactgaattaaaactggcgaggacaatcccancaactttctttaccccagaacaaatatcagagagc

SEQ ID NO: 22763 - DNA, 71 bp, chicken (Gallus Gallus)
  misc_feature (36): n=a or g
agacaacagtataaaaaaaataccatagcattcacncagttccagaccattctgaggtgggtcactataag

SEQ ID NO: 22764 - DNA, 71 bp, chicken (Gallus Gallus)
  misc_feature (36): n=a or g
actatatttaatacatgtagaagattaaatatggcnagaggcaatagttcttcagttcactgtgttaaaga

SEQ ID NO: 22765 - DNA, 71 bp, chicken (Gallus Gallus)
  misc_feature (36): n=c or g
tcatgttcactctcaacagcaaatgaatggccatangctatccaggcaggtccgtaggttctctcaagtgt

SEQ ID NO: 22766 - DNA, 71 bp, chicken (Gallus Gallus)
  misc_feature (36): n=c or t
caggaagtatttaaggtccttggattgcttctttgngatgtgttttactgcctaggccattttgtggtgat

SEQ ID NO: 22767 - DNA, 71 bp, chicken (Gallus Gallus)
  misc_feature (36): n=c or t
tacagttcactgctgcagtgcatcaaatagcacagngtgtcacgtgctatttctccataaaaaggccactg

SEQ ID NO: 22768 - DNA, 71 bp, chicken (Gallus Gallus)
  misc_feature (36): n=a or g
ttgatcagcaactgagttgcatgttgcatcagtatngatggttgatgaccttatagatttttttatggttg

SEQ ID NO: 22769 - DNA, 71 bp, chicken (Gallus Gallus)
  misc_feature (36): n=a or g
tgatgctcttttaaaaagcctccatactcgcccagnaaggtttacaagtcacataaaaagtcttgaaaagg

SEQ ID NO: 22770 - DNA, 71 bp, chicken (Gallus Gallus)
  misc_feature (36): n=c or t
aagatctgctctattgacttagtcagaggtctccanttacgatacagaatcacttccttcagatgaaggat

SEQ ID NO: 22771 - DNA, 71 bp, chicken (Gallus Gallus)
  misc_feature (36): n=g or t
gttgtgcataaaatcatacatccatgacaatgcagngggcactgtatacatagtcactcaggaatgtacaa

SEQ ID NO: 22772 - DNA, 71 bp, chicken (Gallus Gallus)
  misc_feature (36): n=a or g
ctgcatctagctctgtgacatttctggtggccccanatacctctattgtgcgagattctccttgaaaagat

SEQ ID NO: 22773 - DNA, 71 bp, chicken (Gallus Gallus)
  misc_feature (36): n=c or t
atgttatgttcaagacaaaatgtaaacctaccctgntgtaaacaaaccaaactactgctatatttcagaag

SEQ ID NO: 22774 - DNA, 71 bp, chicken (Gallus Gallus)
  misc_feature (36): n=a or c
gtcatcaggaattataataaacaggacattaagtcnatttccagtaaaatatcagagctctgtacctcagc

SEQ ID NO: 22775 - DNA, 71 bp, chicken (Gallus Gallus)
  misc_feature (36): n=a or t
ataaattcttagtacatattcagtcactgctgatantagcatgcttaacatcacctgacttttctattaag

SEQ ID NO: 22776 - DNA, 71 bp, chicken (Gallus Gallus)
  misc_feature (36): n=a or g
ttttgttccagtgtatttgatatcaaagaaaatcantgtatcttttgatgcatattctggctttatgtatg

SEQ ID NO: 22777 - DNA, 71 bp, chicken (Gallus Gallus)
  misc_feature (36): n=c or t
tgaaggtaccagatcaggaaattatctcaagtctantttcaggaaatgaaagcagaatctgatcctttgtt

SEQ ID NO: 22778 - DNA, 71 bp, chicken (Gallus Gallus)
  misc_feature (36): n=c or t
gaaacatgcattataaaactccttcggtgtgtggtnggtgtttgatctaggttgccttaaaatcctagtgt

SEQ ID NO: 22779 - DNA, 71 bp, chicken (Gallus Gallus)
  misc_feature (36): n=c or t
ctatgactcaaacatgcgtgtgattaagccaaaaangagctttcttacctgcactgtgttatctcctagaa

SEQ ID NO: 22780 - DNA, 71 bp, chicken (Gallus Gallus)
  misc_feature (36): n=c or t
tctcaatgtgctaggggcagcacatgggaaaaatgnagcaggggcagatgtgtttcgcctggtcaactttc

SEQ ID NO: 22781 - DNA, 71 bp, chicken (Gallus Gallus)
  misc_feature (36): n=c or t
ttctatcaaagttcttggtgcaaccagcagatgaangagaacttgcattccatccacagcgccactgaagc

SEQ ID NO: 22782 - DNA, 71 bp, chicken (Gallus Gallus)
  misc_feature (36): n=a or g
caatagaatttataacatgatctgtaacactttganggacaaagaaactaaagcatatttgtggtttaata

SEQ ID NO: 22783 - DNA, 71 bp, chicken (Gallus Gallus)
  misc_feature (36): n=c or t
atcttccttagtacttgaagatgcaccatcagcaangtaatcccttaatcccttacttccttcagcaatct

SEQ ID NO: 22784 - DNA, 71 bp, chicken (Gallus Gallus)
  misc_feature (36): n=g or t
ttcatacataagcctttttatttataaattgaaaanaatattatatctgtaagtcattgaaatatagacat

SEQ ID NO: 22785 - DNA, 71 bp, chicken (Gallus Gallus)
  misc_feature (36): n=c or g
aatgtgaaactcagttagggctacagtgatagagtnaaattccatgctgattagcttgaatattgtgcaag

SEQ ID NO: 22786 - DNA, 71 bp, chicken (Gallus Gallus)
  misc_feature (36): n=c or t
aaaaaaaaaaaaaaactctgacctttcagacaacangtccagccagtcaagggctcctaaaggcagattca

SEQ ID NO: 22787 - DNA, 71 bp, chicken (Gallus Gallus)
  misc_feature (36): n=c or t
caccaggagcaatatttatttctgcaagatggaggnggcaggagcacctgcaatcaggtatagcacggaca

SEQ ID NO: 22788 - DNA, 71 bp, chicken (Gallus Gallus)
  misc_feature (36): n=a or g
gatgcagatccatgttagccctatatcatgtgaagnctggtgtacatttctgctatatctttttagttctt

SEQ ID NO: 22789 - DNA, 71 bp, chicken (Gallus Gallus)
  misc_feature (36): n=a or g
caaattaaatcctcgggggctgctagaaatagtctngatgttattcaccagacagaagtctcacgggaacc

SEQ ID NO: 22790 - DNA, 71 bp, chicken (Gallus Gallus)
  misc_feature (36): n=a or g
tccaagttttagataagaatgtggtgcgggaccacntcaagtgcctaaaatagtttaggttgaaaaatatc

SEQ ID NO: 22791 - DNA, 71 bp, chicken (Gallus Gallus)
  misc_feature (36): n=a or g
agcttccattgcaattccctcaggttacggaagacnacatatggtacttctggcactggcaataagtatgt

SEQ ID NO: 22792 - DNA, 71 bp, chicken (Gallus Gallus)
  misc_feature (36): n=a or g
aagcctgtcccacttaattccgcaggtagtggaacnaccatttagtctgcacgctagaaacatctaaactg

SEQ ID NO: 22793 - DNA, 71 bp, chicken (Gallus Gallus)
  misc_feature (36): n=a or g
tgtgtttcagagtcaacattgctcttagtggctacntttcagagtttttgctgaaggaaagttttctgtta

SEQ ID NO: 22794 - DNA, 71 bp, chicken (Gallus Gallus)
  misc_feature (36): n=a or g
gtccctgacatagagttctcggtaaataatataacntatagtataatgtacaaggtctgctccaaaagtag

SEQ ID NO: 22795 - DNA, 71 bp, chicken (Gallus Gallus)
  misc_feature (36): n=c or g
ctgcctgaaggaaacctgaaggagggagaaggaaanagctcagttttgaagagggaaaaaaggaatggtaa

SEQ ID NO: 22796 - DNA, 71 bp, chicken (Gallus Gallus)
  misc_feature (36): n=c or t
ctgtgagatgcacagaggtgacttgtctcttttacntttctctgttcatcttgttgcttgtctttgtaggt

SEQ ID NO: 22797 - DNA, 71 bp, chicken (Gallus Gallus)
  misc_feature (36): n=a or g
aattagttttatttatcacatgtaaaacaataaacnccatgtctaacattcatatttacacgtagaaagga

SEQ ID NO: 22798 - DNA, 71 bp, chicken (Gallus Gallus)
  misc_feature (36): n=a or g
taggcaataagaacacgtccagcagaaaagctaacnaggtcaatagagaatttgttgtgtttgtaaaatgg

SEQ ID NO: 22799 - DNA, 71 bp, chicken (Gallus Gallus)
  misc_feature (36): n=a or g
atggcagagtggtcagcagcaagcaccagcgtttcnaaaggctctttgcacagcccatgtttgcagaagca

SEQ ID NO: 22800 - DNA, 71 bp, chicken (Gallus Gallus)
  misc_feature (36): n=a or g
tgagtacagggggaagataagagaatacgttggtgngtcttcttgtgtccaggctgtcattatgtgtgctg

SEQ ID NO: 22801 - DNA, 71 bp, chicken (Gallus Gallus)
  misc_feature (36): n=c or t
gcttcaacacatacttcaggaaaatgtagaagaaantgcagggacctttctgcccattcccactcaacttt

SEQ ID NO: 22802 - DNA, 71 bp, chicken (Gallus Gallus)
  misc_feature (36): n=a or g
atcctggtttccaagcaaagaaaagactccacgtgnaccccgagtcaaagagatctttagagacagctggg

SEQ ID NO: 22803 - DNA, 71 bp, chicken (Gallus Gallus)
  misc_feature (36): n=a or c
aagaagtggcattcttcagcacacacactaagctgnattatgttttttttttttttatggtactgtaattt

SEQ ID NO: 22804 - DNA, 71 bp, chicken (Gallus Gallus)
  misc_feature (36): n=a or g
tcaaggttggtttggggaattcggagccatgatgantaaggtcaatggcagccatgagtttaggttcaaga

SEQ ID NO: 22805 - DNA, 71 bp, chicken (Gallus Gallus)
  misc_feature (36): n=a or c
gaaattgtccttttaagaatcaagcagccaccaganttggccatgctagatgctagggataggatctcccc

SEQ ID NO: 22806 - DNA, 71 bp, chicken (Gallus Gallus)
  misc_feature (36): n=a or g
aatatacttagtatatactttctttcctcgtcttgngacatagtcatttccccttcagagactttgctttt

SEQ ID NO: 22807 - DNA, 71 bp, chicken (Gallus Gallus)
  misc_feature (36): n=g or t
cacttgccagacccatggaccatccagtccttaggnttcctggtttaaatgatgatttccccacatgttcc

SEQ ID NO: 22808 - DNA, 71 bp, chicken (Gallus Gallus)
  misc_feature (36): n=g or t
aaaaaagcaaaccatttcacagtgaaatactttcgnctagctttacagaatcaaataaagtttactttaca

SEQ ID NO: 22809 - DNA, 71 bp, chicken (Gallus Gallus)
  misc_feature (36): n=c or t
tagttgattgtgaaagctcagccaagtctgtacttnggagagatgtactcagcgttacttggagaagtacc

SEQ ID NO: 22810 - DNA, 71 bp, chicken (Gallus Gallus)
  misc_feature (36): n=c or t
tattccagacaacacaacactgaaaataatgctggnacttacctgagctgccagtgccttccgatgcactt

SEQ ID NO: 22811 - DNA, 71 bp, chicken (Gallus Gallus)
  misc_feature (36): n=c or t
tgttctgtatttctctttttaagttccattacatcncttgccttcaccgcaccacctctcctttgctgttc

SEQ ID NO: 22812 - DNA, 71 bp, chicken (Gallus Gallus)
  misc_feature (36): n=g or t
ttcatctagcacgaatagttgatggaaggaagggangatatgtgagttaataagttacttatgtcggtttt

SEQ ID NO: 22813 - DNA, 71 bp, chicken (Gallus Gallus)
  misc_feature (36): n=c or t
tttgtcaatgagaagtgaatgtttcgtcccagcaangatctggacctcctgtatggctcttgtcttggact

SEQ ID NO: 22814 - DNA, 71 bp, chicken (Gallus Gallus)
  misc_feature (36): n=c or t
cctctgggagagatatcatgtgacctctaatcagtntgtgaacaagctacgtgaggagtggtgcttagcac

SEQ ID NO: 22815 - DNA, 71 bp, chicken (Gallus Gallus)
  misc_feature (36): n=a or g
tggaattccatcattgccttcaactgcagaccaganaatgaacccacaaagggttgaacccatcaaccctt

SEQ ID NO: 22816 - DNA, 71 bp, chicken (Gallus Gallus)
  misc_feature (36): n=g or t
ttacaaataaattgaataattttatgtgaagtgggntttcttgatgtgggactgatagttcacagaccact

SEQ ID NO: 22817 - DNA, 71 bp, chicken (Gallus Gallus)
  misc_feature (36): n=a or g
catgagtttttggataaaggaattgggggcgggggnggaagtcaaatacaaacactgggtatgttgatggc

SEQ ID NO: 22818 - DNA, 71 bp, chicken (Gallus Gallus)
  misc_feature (36): n=c or t
aaacgatgtagataaaaatattgtaatagatctttnttacgcctcagatagtgtgtgctgttacaaagctt

SEQ ID NO: 22819 - DNA, 71 bp, chicken (Gallus Gallus)
  misc_feature (36): n=c or t
gtaactacctgtcagcaggactctgcatggtctagncacttttccagacaccttactgtctatctgaggtc

SEQ ID NO: 22820 - DNA, 71 bp, chicken (Gallus Gallus)
  misc_feature (36): n=a or g
gcctctgtatttgagtcatgcttatacaaatgtttntgtagttacattctgcaaattcttatagaaaacct

SEQ ID NO: 22821 - DNA, 71 bp, chicken (Gallus Gallus)
  misc_feature (36): n=a or g
tgtgaaaactgaccataatcagcttttcagtgtccntgtttgtctttttggtcacagaggcactggtattt

SEQ ID NO: 22822 - DNA, 71 bp, chicken (Gallus Gallus)
  misc_feature (36): n=c or t
tggttctaactcaaagctcctgagaggacttcaagncctcttcacagcctttttgctctcacgcagcatca

SEQ ID NO: 22823 - DNA, 71 bp, chicken (Gallus Gallus)
  misc_feature (36): n=c or t
cttcagagattttgagatctaggcagtgaaaggtangcttcacctgatctggtgctggcaatagtcactat

SEQ ID NO: 22824 - DNA, 71 bp, chicken (Gallus Gallus)
  misc_feature (36): n=a or c
cagcagagttattttgaagagtgatttataagaggntttggatggtattggaatcacctgaaagttcaggt

SEQ ID NO: 22825 - DNA, 71 bp, chicken (Gallus Gallus)
  misc_feature (36): n=a or g
tcactaggaaatggtgcttctcagaatgtaagatgntaacgaggactgtatgctttgtttttgtattatca

SEQ ID NO: 22826 - DNA, 71 bp, chicken (Gallus Gallus)
  misc_feature (36): n=a or g
ttgtgttactttgttttactttgcttccatacatangatcaatattctcaatatttggcacttgttctgca

SEQ ID NO: 22827 - DNA, 71 bp, chicken (Gallus Gallus)
  misc_feature (36): n=g or t
cttacctatttggaataaggttatgttaaaacactnaacaaaaataatgcttaactaaaaaaaagaaagca

SEQ ID NO: 22828 - DNA, 71 bp, chicken (Gallus Gallus)
  misc_feature (36): n=a or g
tttaatttctgctgtgaattgcagactgttttctcncttccagcatgatgcctccagtcattgaacaggaa

SEQ ID NO: 22829 - DNA, 71 bp, chicken (Gallus Gallus)
  misc_feature (36): n=c or t
ttttccccagcattgcacgctgattgtgacttttanacatgaatctttgttgcttccctttaagaaaaaga

SEQ ID NO: 22830 - DNA, 71 bp, chicken (Gallus Gallus)
  misc_feature (36): n=a or c
aagaagtggtctgagcttcaaaaacaaatgtaagcnggttttaagggattaaaaactttgaaaatgaagtg

SEQ ID NO: 22831 - DNA, 71 bp, chicken (Gallus Gallus)
  misc_feature (36): n=c or g
gttttgggagttttgttcatttattatgtgaataanttatgttaatgagttattaaagtagaaaggaactt

SEQ ID NO: 22832 - DNA, 71 bp, chicken (Gallus Gallus)
  misc_feature (36): n=c or g
gagttaaagatcggccgtgatacagtcaaagacatnagaattaggtctgtcaacatatctaagctggttta

SEQ ID NO: 22833 - DNA, 71 bp, chicken (Gallus Gallus)
  misc_feature (36): n=g or t
ggaatataaataaggaatataagttgatcaaacttnaaataaaaagcatgactaacaacctactgcatctc

SEQ ID NO: 22834 - DNA, 71 bp, chicken (Gallus Gallus)
  misc_feature (36): n=c or t
tggttgacacagacgcctgacacttctagcagctgngaggaatctgctcctgtgatggtatctggaaagcg

SEQ ID NO: 22835 - DNA, 71 bp, chicken (Gallus Gallus)
  misc_feature (36): n=a or g
ttaaaccatttctgaatggtggaagaagaaacacangtttggtaatctgtaatatttcctaagcaaagagt

SEQ ID NO: 22836 - DNA, 71 bp, chicken (Gallus Gallus)
  misc_feature (36): n=c or t
actccacagtctccctgggtaacccagttccagtgnatgaccaggcccacagtgaaggtattcttcttttc

SEQ ID NO: 22837 - DNA, 71 bp, chicken (Gallus Gallus)
  misc_feature (36): n=g or t
aacacattcctcaacttgggttgtagagaaaaagcnctacttcaaaaaaaaccctctttttagcacagcct

SEQ ID NO: 22838 - DNA, 71 bp, chicken (Gallus Gallus)
  misc_feature (36): n=a or g
atgacctgatgaaagtactaataaggtcaggacacntgacagctatcgcttccgtcttgcctgtatattct

SEQ ID NO: 22839 - DNA, 71 bp, chicken (Gallus Gallus)
  misc_feature (36): n=c or t
ttctcttcttctagtttttgttataagcgtgcagcnttttattgatgagaaactgatatgctctgttatat

SEQ ID NO: 22840 - DNA, 71 bp, chicken (Gallus Gallus)
  misc_feature (36): n=a or g
attatatattttgctgaaggcacatatagcctgtantaatactttaaaaggtagaacattaaaaaattgtt

SEQ ID NO: 22841 - DNA, 71 bp, chicken (Gallus Gallus)
  misc_feature (36): n=c or t
attctttttgcatccttccagctgtaataaatagcngaaagattcagtgtgtggctttttctcttagcttt

SEQ ID NO: 22842 - DNA, 71 bp, chicken (Gallus Gallus)
  misc_feature (36): n=c or t
ttcatcttcaatatattctcaccatataaatttaantttgttcatatgtatagttttacaaatccactggt

SEQ ID NO: 22843 - DNA, 71 bp, chicken (Gallus Gallus)
  misc_feature (36): n=c or t
ttttccttggaaaagaaactggtgctggagctggangctttgcaagaagctgattgaattaggatgtcagg

SEQ ID NO: 22844 - DNA, 71 bp, chicken (Gallus Gallus)
  misc_feature (36): n=a or g
tctatatattagattgtatatgtcattcatttctcnctggtgctgtttagctaaaccaccacttcacttac

SEQ ID NO: 22845 - DNA, 71 bp, chicken (Gallus Gallus)
  misc_feature (36): n=c or t
acaaaactctccttcagcttcaggtactcttcatantctctcttctcctcttcttcctttgccttcctttt

SEQ ID NO: 22846 - DNA, 71 bp, chicken (Gallus Gallus)
  misc_feature (36): n=a or t
tagctactacatgtgtaaaaacactgaatcttactncttagatacatacaggtgaatcaatgactacagat

SEQ ID NO: 22847 - DNA, 71 bp, chicken (Gallus Gallus)
  misc_feature (36): n=c or t
actggcattgcaattgggctcttctgatttgtcgcntcttcagatccaaaaatcctgagtgcagtagaaat

SEQ ID NO: 22848 - DNA, 71 bp, chicken (Gallus Gallus)
  misc_feature (36): n=a or c
ctctctgcattcagacatttctgctgtgctacttcngttcgaggacatggttttcatatgctaaaattctg

SEQ ID NO: 22849 - DNA, 71 bp, chicken (Gallus Gallus)
  misc_feature (36): n=a or g
cttgtagccataaggatgctagaatttttctccctntgtagcaaagccctgtttgcatgcaatttacatgc

SEQ ID NO: 22850 - DNA, 71 bp, chicken (Gallus Gallus)
  misc_feature (36): n=c or t
tgagcaacattttacaaatgtatttatttctccttnggtcagcccttattactgctcatgtttaaaacggt

SEQ ID NO: 22851 - DNA, 71 bp, chicken (Gallus Gallus)
  misc_feature (36): n=c or t
gccatctcttacatttctgcttgcttcacagagagngtatacagagataggaaagactcagcagacgttaa

SEQ ID NO: 22852 - DNA, 71 bp, chicken (Gallus Gallus)
  misc_feature (36): n=c or t
cgcagtgattatctggagagatcaaaaaatctgtgnctaaaatctgatcacaagacctgagtcagaacaca

SEQ ID NO: 22853 - DNA, 71 bp, chicken (Gallus Gallus)
  misc_feature (36): n=c or t
cttctcagggactccagaacagggtgcatgagctgnaggacatatgcaaaacactgttaaaaggataaaat

SEQ ID NO: 22854 - DNA, 71 bp, chicken (Gallus Gallus)
  misc_feature (36): n=a or t
tactgacataacatatttccctctgtagaagccganggcaacgaattcattatttaaaatggagccgtcat

SEQ ID NO: 22855 - DNA, 71 bp, chicken (Gallus Gallus)
  misc_feature (36): n=c or t
caagcattaaatatacacaattctactctacttgcnatttacaatggacattatgattctgccgtgaatac

SEQ ID NO: 22856 - DNA, 71 bp, chicken (Gallus Gallus)
  misc_feature (36): n=c or t
ggataaaggaacaaaagtgaagagccgcttagagantcggcactgtaggggctgaatagctcagtgcaagc

SEQ ID NO: 22857 - DNA, 71 bp, chicken (Gallus Gallus)
  misc_feature (36): n=a or g
ctctacagattgaggttgtgttgaatttggtacatnggctgaaaaagatataagaattctggtggtgtatt

SEQ ID NO: 22858 - DNA, 71 bp, chicken (Gallus Gallus)
  misc_feature (36): n=a or g
aggaaaaagagtagactgtaaatggtttatatcctngagaaagaaagcaattcttggaaacccgtatacga

SEQ ID NO: 22859 - DNA, 71 bp, chicken (Gallus Gallus)
  misc_feature (36): n=c or t
aaggaactaattccactgttgatgtatttctccttnccacgtatgggaagactctcatgctaactggtaat

SEQ ID NO: 22860 - DNA, 71 bp, chicken (Gallus Gallus)
  misc_feature (36): n=a or c
tatgtcactaaaaacacagctccaaaatgatgtctnttcactgatctgtttattttgtgcttcccaattgt

SEQ ID NO: 22861 - DNA, 71 bp, chicken (Gallus Gallus)
  misc_feature (36): n=a or c
atagctggatggaaattcagtcacagagcaaagganactaagcactcagtggatttctaacagtaattaag

SEQ ID NO: 22862 - DNA, 71 bp, chicken (Gallus Gallus)
  misc_feature (36): n=a or g
gtaaagttcttgtgcagcacactttcactttcgacngtgccataattgccatcttgaacatgcagttcctc

SEQ ID NO: 22863 - DNA, 71 bp, chicken (Gallus Gallus)
  misc_feature (36): n=a or g
acaatgatcagtgggaataaatccaggcaggctttncaggaggagggcagttgtttttacggtgctaactg

SEQ ID NO: 22864 - DNA, 71 bp, chicken (Gallus Gallus)
  misc_feature (36): n=a or g
agattgttgcttcctatactaaaaaaaaagtagctntttctctattccttttgtgtattaaaaaatatgaa

SEQ ID NO: 22865 - DNA, 71 bp, chicken (Gallus Gallus)
  misc_feature (36): n=c or t
gcacactgcaaagtcactgactccccgcagtccccntctccctaagtcacactcacaacacacacatttga

SEQ ID NO: 22866 - DNA, 71 bp, chicken (Gallus Gallus)
  misc_feature (36): n=c or t
gaaatttgagattaaagccgatcattttctactgcnggttgccatctagaaaaccaaagtaggaatggaaa

SEQ ID NO: 22867 - DNA, 71 bp, chicken (Gallus Gallus)
  misc_feature (36): n=c or t
caagatgttctgatgggtttcacaacacatgcacantttattcttttttttttttttaatatgaagattta

SEQ ID NO: 22868 - DNA, 71 bp, chicken (Gallus Gallus)
  misc_feature (36): n=c or t
agaactgccgaatatcatcgtcagtgccgtgcaaanatggcatgattttttctacacaaaaccagaagcaa

SEQ ID NO: 22869 - DNA, 71 bp, chicken (Gallus Gallus)
  misc_feature (36): n=a or g
tgctttttcttgactgcatttacaggatgaaagggngaaggctgctcaatgtactacacaagcttttcatt

SEQ ID NO: 22870 - DNA, 71 bp, chicken (Gallus Gallus)
  misc_feature (36): n=c or g
ctatggtgaagtgttgactttatccttgtaagactnttccttccctgtcccccatcttgtattttacaaag

SEQ ID NO: 22871 - DNA, 71 bp, chicken (Gallus Gallus)
  misc_feature (36): n=c or t
tctcattaagaaaacctagcatttaccttggtggtnagatcctgttcagcaggaagagtctctctcagggc

SEQ ID NO: 22872 - DNA, 71 bp, chicken (Gallus Gallus)
  misc_feature (36): n=a or g
tgatggaaaccttgttactcaacgcctttggcatgntctcaaggcctttgatatggtccccaaccacatcc

SEQ ID NO: 22873 - DNA, 71 bp, chicken (Gallus Gallus)
  misc_feature (36): n=a or g
agtggagttcccatccctggaagtatacgagagacntgcagatgctgctcttagggatgtgctttagtggt

SEQ ID NO: 22874 - DNA, 71 bp, chicken (Gallus Gallus)
  misc_feature (36): n=c or t
actgcaagggctcagcacatgccataaacatattcnactggagaggctgtctgctgaagcattccaggcat

SEQ ID NO: 22875 - DNA, 71 bp, chicken (Gallus Gallus)
  misc_feature (36): n=a or t
ctataatatttgttggtttgtgaatttaggtacccnatctacaagaatttgttaatgtaatttgtaaatct

SEQ ID NO: 22876 - DNA, 71 bp, chicken (Gallus Gallus)
  misc_feature (36): n=a or c
acttccaagtctgagtgagctgtcagttatgcaaanagacttaagatgtcatctaggcaagcatatgtatt

SEQ ID NO: 22877 - DNA, 71 bp, chicken (Gallus Gallus)
  misc_feature (36): n=c or t
gagaagacaattatttctgtctgctccagagcagtnactgtaagtagaagctaggttttgatggaatcctg

SEQ ID NO: 22878 - DNA, 71 bp, chicken (Gallus Gallus)
  misc_feature (36): n=a or g
gaatagggacttaatcattcgtacacgtaccttaanattgagttgtgttgtcagaagtttgtcctgtgtct

SEQ ID NO: 22879 - DNA, 71 bp, chicken (Gallus Gallus)
  misc_feature (36): n=a or c
attacatcaacgccatatatagccatcagctgttgnaagacagcttctgattttctgttactgagccccca

SEQ ID NO: 22880 - DNA, 71 bp, chicken (Gallus Gallus)
  misc_feature (36): n=c or g
cttgcacactgtctcttccatgttctctctcttccnattgactgctggaagtggtgaagatgcccaagtgg

SEQ ID NO: 22881 - DNA, 71 bp, chicken (Gallus Gallus)
  misc_feature (36): n=a or t
ttaacagaaggagctgaaacggacattgacagacgnatgtaaatggactcagacccatgaatgaacaataa

SEQ ID NO: 22882 - DNA, 71 bp, chicken (Gallus Gallus)
  misc_feature (36): n=a or g
aaaatgtttctgatgagctgtcataaatgttattgncaaaatagaaatagaatttaacgtgccattttgtc

SEQ ID NO: 22883 - DNA, 71 bp, chicken (Gallus Gallus)
  misc_feature (36): n=c or t
acttcttcagtgctgcctggaatgcatctgcaagcnttcacatctctgtccatttgagctgggattctcct

SEQ ID NO: 22884 - DNA, 71 bp, chicken (Gallus Gallus)
  misc_feature (36): n=g or t
agccaaagtgttagatgtttgcttgctttatgatanatagatggctccaaggactacttgttcatgtctta

SEQ ID NO: 22885 - DNA, 71 bp, chicken (Gallus Gallus)
  misc_feature (36): n=a or g
ttttctcaccagaaacatatagcctgcatttgtaangaggtcctttatcaagcctgtcatcacctgccacg

SEQ ID NO: 22886 - DNA, 71 bp, chicken (Gallus Gallus)
  misc_feature (36): n=c or t
caggccactatgtggtccccccactcccccttcccnatctgattccctgaagaaatgatttttcatttcta

SEQ ID NO: 22887 - DNA, 71 bp, chicken (Gallus Gallus)
  misc_feature (36): n=a or c
gtggtctgatcttaaatattacaactctgtaaaaantaagaacaacatttttttttttaacttccaaagaa

SEQ ID NO: 22888 - DNA, 71 bp, chicken (Gallus Gallus)
  misc_feature (36): n=c or t
ttcaataaacagtattcctcacaggaaggtgagccngacattttggccaataatgttctcaagcattaact

SEQ ID NO: 22889 - DNA, 71 bp, chicken (Gallus Gallus)
  misc_feature (36): n=c or t
ttaccgtgtcaccttctaccttagataccacagcangacctcttaagtaaaagtagggctcccagaagttc

SEQ ID NO: 22890 - DNA, 71 bp, chicken (Gallus Gallus)
  misc_feature (36): n=a or g
ctttccactaccatttgaatattagtaccgtaagcntctggattccaaatagctattagttagcaatgttt

SEQ ID NO: 22891 - DNA, 71 bp, chicken (Gallus Gallus)
  misc_feature (36): n=c or t
catataaaagaatagttgttagagccagaagggacngttgtgatccgtttgtttgacttactgcatggcac

SEQ ID NO: 22892 - DNA, 71 bp, chicken (Gallus Gallus)
  misc_feature (36): n=c or t
agccgaggtagaaaacacagctgctgctgcctcggntaaaaagctttctccaattaagcatcctttttcag

SEQ ID NO: 22893 - DNA, 71 bp, chicken (Gallus Gallus)
  misc_feature (36): n=g or t
taaacgtttccactctgtcatatatttgtactgatnggattttatctgtggttcactagtaacttgacatg

SEQ ID NO: 22894 - DNA, 71 bp, chicken (Gallus Gallus)
  misc_feature (36): n=c or t
cctcatgatgccacgcagacttcccgcaccgacatnggcagcactgcttgtgttgattgtaactacgtttg

SEQ ID NO: 22895 - DNA, 71 bp, chicken (Gallus Gallus)
  misc_feature (36): n=a or c
atgtccatgctgcgctcagaagccaacttggactcngaaaacagtcttatctcctgtagaatgaagcttaa

SEQ ID NO: 22896 - DNA, 71 bp, chicken (Gallus Gallus)
  misc_feature (36): n=g or t
gctaggattaaagcccgcaaaatccactgtggcagngttgtcattgtggaggaggactcccagaggaacgg

SEQ ID NO: 22897 - DNA, 71 bp, chicken (Gallus Gallus)
  misc_feature (36): n=c or g
ggctcctctgttacaatcaacagccaaggcgatccnatggccatggaacatgtgcagcaccagccaagctg

SEQ ID NO: 22898 - DNA, 71 bp, chicken (Gallus Gallus)
  misc_feature (36): n=c or t
agagcttgagaagagcaaatggtaaaactgaacttntggaggggcttgtttttccctagaatagtcaggcc

SEQ ID NO: 22899 - DNA, 71 bp, chicken (Gallus Gallus)
  misc_feature (36): n=a or g
gccaatgatatcctgcagtgcattaacaggagtgtngccaggaggacaagggcagcggtcctccctctctg

SEQ ID NO: 22900 - DNA, 71 bp, chicken (Gallus Gallus)
  misc_feature (36): n=c or t
tctctgttttgctttgtatttattaggtttggaatncgaaatctggacatgcgggctgccctccatacaaa

SEQ ID NO: 22901 - DNA, 71 bp, chicken (Gallus Gallus)
  misc_feature (36): n=a or g
tcctgctgcagacagcagcggggctgcagcaccacnaggtcctagtctttgctcagcagaaaaagccagac

SEQ ID NO: 22902 - DNA, 71 bp, chicken (Gallus Gallus)
  misc_feature (36): n=a or g
caggctttagtaaatgatatccagactatccagccnagtttgaacagtgttaatgagattgggaagaaaat

SEQ ID NO: 22903 - DNA, 71 bp, chicken (Gallus Gallus)
  misc_feature (36): n=c or t
agactgggtgaatgaacagcacacctgcctcacctncaagctctctgcctacaagtgtgtaaaggggctgt

SEQ ID NO: 22904 - DNA, 71 bp, chicken (Gallus Gallus)
  misc_feature (36): n=a or g
atgtgtaagtaaatatgggtttacatgagaggtcancacatttttaacccagttaaattactcccatctct

SEQ ID NO: 22905 - DNA, 71 bp, chicken (Gallus Gallus)
  misc_feature (36): n=c or t
ccctgctgcaacagatacttgtggagaggtttatanatctttgacctacgcatgatgtctgcacacaacac

SEQ ID NO: 22906 - DNA, 71 bp, chicken (Gallus Gallus)
  misc_feature (36): n=a or g
agtgatatcttttggtatgtcatttctggctaaaanaacaggtattttgtctcagtatcacaacgacatca

SEQ ID NO: 22907 - DNA, 71 bp, chicken (Gallus Gallus)
  misc_feature (36): n=a or t
cttcaactgcaacatttaacattgggcagattacangagattggggtgcagtcctccttgtgatggaattg

SEQ ID NO: 22908 - DNA, 71 bp, chicken (Gallus Gallus)
  misc_feature (36): n=a or g
atgttggagtggtgttacagaacaagcaacagagangtgcttagagttcagtaagcaactggacatgtgca

SEQ ID NO: 22909 - DNA, 71 bp, chicken (Gallus Gallus)
  misc_feature (36): n=a or g
ttgctacagtgtttgcatctggaaaaaacatttccnaagactaaagagttgtcacaaattaagaactgaca

SEQ ID NO: 22910 - DNA, 71 bp, chicken (Gallus Gallus)
  misc_feature (36): n=a or g
gcttgtgttaaaaaaagagcccaacattgttggacnttgttcaactttgaagggagagaagtaaccacttc

SEQ ID NO: 22911 - DNA, 71 bp, chicken (Gallus Gallus)
  misc_feature (36): n=a or t
gctaaaagagacttttgcatttaaaggaaagaagcntgtctcttccattctgagtgtgtcattttgaggtc

SEQ ID NO: 22912 - DNA, 71 bp, chicken (Gallus Gallus)
  misc_feature (36): n=c or t
taagctcccatccctccagtgttagggccttcatcnccatcctttagcctcttgtggtcttgggctggggg

SEQ ID NO: 22913 - DNA, 71 bp, chicken (Gallus Gallus)
  misc_feature (36): n=a or g
tgccaaaggcaaataaccaagttgaagtgttgtttntaggttggtagactaaggtgtatgtatctttaacc

SEQ ID NO: 22914 - DNA, 71 bp, chicken (Gallus Gallus)
  misc_feature (36): n=c or t
ttaaatgagcaggatggctttttttttcatagaaangttcactgactgtggtaactcaaatgaatccttta

SEQ ID NO: 22915 - DNA, 71 bp, chicken (Gallus Gallus)
  misc_feature (36): n=c or t
ctcaccatgtcagcctgatgtccttactttgtctcngtgcttctggattttgatgttggcacttggagact

SEQ ID NO: 22916 - DNA, 71 bp, chicken (Gallus Gallus)
  misc_feature (36): n=a or g
taggatggcacagcagataccatgagagggacttcngccactaaacagcaagcaccacccagtaaaccaac

SEQ ID NO: 22917 - DNA, 71 bp, chicken (Gallus Gallus)
  misc_feature (36): n=c or t
ggggtttggtttataacactggtagcagtctgtcanacatatcttcagacttggaaagttatgctgaagag

SEQ ID NO: 22918 - DNA, 71 bp, chicken (Gallus Gallus)
  misc_feature (36): n=a or g
tacatttacactgatcagggttagataaaacaggancagccaaatttcttccccacggatcccatcagttc

SEQ ID NO: 22919 - DNA, 71 bp, chicken (Gallus Gallus)
  misc_feature (36): n=a or g
cataaacatttctctattaatatatactacactatncctatttttactttgcagaatcctcctccttagct

SEQ ID NO: 22920 - DNA, 71 bp, chicken (Gallus Gallus)
  misc_feature (36): n=c or g
catgtgcagagctctgcaatattgccagtcatcacnagtgacctccttcagcaactcgtgcttgcaatata

SEQ ID NO: 22921 - DNA, 71 bp, chicken (Gallus Gallus)
  misc_feature (36): n=a or c
cctttactgtctctcacagtggtatttggagcaagnagctcaggtttctgtcattgaagagtttttaagcc

SEQ ID NO: 22922 - DNA, 71 bp, chicken (Gallus Gallus)
  misc_feature (36): n=a or g
ggtgggcaaagtgcacatgcaaaggagccaggaganagtcagcctgcaataggttttctcatcactccagc

SEQ ID NO: 22923 - DNA, 71 bp, chicken (Gallus Gallus)
  misc_feature (36): n=a or g
gctgttgtgtcgtctgctggcatcgtggctgttgtntttttgggaactgtgcgtaatagcagggagctgca

SEQ ID NO: 22924 - DNA, 71 bp, chicken (Gallus Gallus)
  misc_feature (36): n=g or t
tttgacatgtatttgatatcaatgccaaaaatttcngttgttgattcacttacctttaggattctatcttt

SEQ ID NO: 22925 - DNA, 71 bp, chicken (Gallus Gallus)
  misc_feature (36): n=a or c
gcaaactcaaatgaaagctttttcttattgtttcangtgtatgtggttatctgaacattttgagaaattca

SEQ ID NO: 22926 - DNA, 71 bp, chicken (Gallus Gallus)
  misc_feature (36): n=a or t
tgctgtaatctctgtcccttgcaactctttcctagnccatgtgcctttgaattcccctcccattttcagct

SEQ ID NO: 22927 - DNA, 71 bp, chicken (Gallus Gallus)
  misc_feature (36): n=a or g
tgcctgaagttctgttcagctagatgccctgatctngctttttgcaaaaagaattttttgcactttttaaa

SEQ ID NO: 22928 - DNA, 71 bp, chicken (Gallus Gallus)
  misc_feature (36): n=g or t
aagaggaaatggaagtagttgcaaattctttggaanttcaacagcagatcttttacttatgaagcatcaac

SEQ ID NO: 22929 - DNA, 71 bp, chicken (Gallus Gallus)
  misc_feature (36): n=c or t
caggactgtgttcagccagtgtaccaaagtgcatanagttacgtgccatcactgagtcagcactgcactgc

SEQ ID NO: 22930 - DNA, 71 bp, chicken (Gallus Gallus)
  misc_feature (36): n=a or c
catgtataatcctgtgtatacatttgctggggaatntggacatggaaacaaatgaattaagaaaatctctt

SEQ ID NO: 22931 - DNA, 71 bp, chicken (Gallus Gallus)
  misc_feature (36): n=a or g
aagttatatgtcatttctacatctgttctcagaggnataaactggtgtcatacgtactccagccactgaca

SEQ ID NO: 22932 - DNA, 71 bp, chicken (Gallus Gallus)
  misc_feature (36): n=c or t
acacagaatgacatcttacgaggacagcaattactngaaaaagtaacttaccatgacaatagatggctgta

SEQ ID NO: 22933 - DNA, 71 bp, chicken (Gallus Gallus)
  misc_feature (36): n=g or t
tgtcttcagtgttcggaagtgctgaatattactatnttctaatgcggtcatcctgttgaatgttgactcca

SEQ ID NO: 22934 - DNA, 71 bp, chicken (Gallus Gallus)
  misc_feature (36): n=c or t
tttatatgctaacagttttcgttgtttgttttatgngcagtgctttgtacctctcaatgaaagatcctgaa

SEQ ID NO: 22935 - DNA, 71 bp, chicken (Gallus Gallus)
  misc_feature (36): n=a or t
gtggagtagtggtgctccatctaaagacactcaganattcagctgagtgctgagaaaaggtgctgttgctt

SEQ ID NO: 22936 - DNA, 71 bp, chicken (Gallus Gallus)
  misc_feature (36): n=c or t
tccagtgtttgcaccaagagctaaattctctgaatnatttcccttaagtatggattaaatatggaatcaga

SEQ ID NO: 22937 - DNA, 71 bp, chicken (Gallus Gallus)
  misc_feature (36): n=a or g
ttgggataaaacaatggttgtttttccactgctgcngacctagaagccccagagctaccatctatttcttg

SEQ ID NO: 22938 - DNA, 71 bp, chicken (Gallus Gallus)
  misc_feature (36): n=c or t
cgcccctcggtgatgctatttttgctacttcatttntaacccagctccggcgtggagcctgaaacgaagcc

SEQ ID NO: 22939 - DNA, 71 bp, chicken (Gallus Gallus)
  misc_feature (36): n=c or g
ctacttgaggattttaaagatgttatcatcattaangatacgtaagcaatgtgagttaagacattgcttgt

SEQ ID NO: 22940 - DNA, 71 bp, chicken (Gallus Gallus)
  misc_feature (36): n=a or g
ctggggccctggggctcacagtgagtgttttctgcntggtcagcctgagatgtctcaaaggaaaccgtttt

SEQ ID NO: 22941 - DNA, 71 bp, chicken (Gallus Gallus)
  misc_feature (36): n=a or g
tggaagctgtcatgctgttttcagcaggactattcntggagcacaatcccaagtaggacaaggaaaagtat

SEQ ID NO: 22942 - DNA, 71 bp, chicken (Gallus Gallus)
  misc_feature (36): n=c or t
ctaccagtggaaagtcttccattatccagactatcnctcttaccttcagggtctcgagctcctgagggtta

SEQ ID NO: 22943 - DNA, 71 bp, chicken (Gallus Gallus)
  misc_feature (36): n=c or t
acataaaacatactggcaatatgcaagaagaaaaantacttagatcttatacagctgactgtacattaaca

SEQ ID NO: 22944 - DNA, 71 bp, chicken (Gallus Gallus)
  misc_feature (36): n=c or t
taaatgttgggcaaagctaaaatattttaggccttnggggtttttgtttgtttgtttgcttatttttggta

SEQ ID NO: 22945 - DNA, 71 bp, chicken (Gallus Gallus)
  misc_feature (36): n=g or t
ttaggtttggatatgggttgctgaggcaaagtcttnagaggtgcgtggtcttggacctcagtgtggaggaa

SEQ ID NO: 22946 - DNA, 71 bp, chicken (Gallus Gallus)
  misc_feature (36): n=a or g
ttaacaactaattttatgtgcaaaacaaactcttcntcacggctctcttcattctctgaatcaacaatgat

SEQ ID NO: 22947 - DNA, 71 bp, chicken (Gallus Gallus)
  misc_feature (36): n=c or t
tttaaagtttcatattcaaaatgtaatagcaatacnttttattttcatctaggacaaatttgacacagatt

SEQ ID NO: 22948 - DNA, 71 bp, chicken (Gallus Gallus)
  misc_feature (36): n=a or g
gagatacagcaactggttcatcccagcagtgacacncggttgttgatcgcgtttcagtctcatcacacatt

SEQ ID NO: 22949 - DNA, 71 bp, chicken (Gallus Gallus)
  misc_feature (36): n=c or t
catgggtggggagtcaatacagccatatttgtgtantgaaatgggtattatctgtaaccaaaaaaccccat

SEQ ID NO: 22950 - DNA, 71 bp, chicken (Gallus Gallus)
  misc_feature (36): n=a or g
ttttttaataggaaaaaatgtattaggagcaggcantggaaatgaggaccccatgtggatttgtttaagga

SEQ ID NO: 22951 - DNA, 71 bp, chicken (Gallus Gallus)
  misc_feature (36): n=c or t
ttttataaagaataaaagaagcatctgtgagagttnctacatgagatattaaagggaattattctcagcca

SEQ ID NO: 22952 - DNA, 71 bp, chicken (Gallus Gallus)
  misc_feature (36): n=g or t
ctactctgctcttgtgaggctccacctggactactntgtccagtctggagtccagtacaagaaggacagag

SEQ ID NO: 22953 - DNA, 71 bp, chicken (Gallus Gallus)
  misc_feature (36): n=c or g
ctgctttagcagacgttgcaatcagctcttgatgcntcagccagcttgcagcttccagactgtaactgtgc

SEQ ID NO: 22954 - DNA, 71 bp, chicken (Gallus Gallus)
  misc_feature (36): n=a or g
tggacagctggctaagatcaggcacctagtgttttntatggccacatttaggtcagatgaatccctacgta

SEQ ID NO: 22955 - DNA, 71 bp, chicken (Gallus Gallus)
  misc_feature (36): n=a or g
agtgatagagtattgatagaggagttgcaatttccntatcaaaacaacctaatttggcttcatggcttaag

SEQ ID NO: 22956 - DNA, 71 bp, chicken (Gallus Gallus)
  misc_feature (36): n=c or t
aacacagattaaaatgcagggtcacagccagggacnttggtttcttgctcttctttttttggtgctacttg

SEQ ID NO: 22957 - DNA, 71 bp, chicken (Gallus Gallus)
  misc_feature (36): n=c or t
gcagctgatgtgtcagcctctttgtcctctgtgcancacaagccagtttgccagttgtacctctgttacaa

SEQ ID NO: 22958 - DNA, 71 bp, chicken (Gallus Gallus)
  misc_feature (36): n=c or t
gctgtgcaggtttctatatgctttgcttcatagaanggcagtacagtctctgtggctcattcaggacacat

SEQ ID NO: 22959 - DNA, 71 bp, chicken (Gallus Gallus)
  misc_feature (36): n=a or g
gccttgcatggtggccaaggataacgagcacaagtngcccaccgtgatcactgaggggcactccccaccac

SEQ ID NO: 22960 - DNA, 71 bp, chicken (Gallus Gallus)
  misc_feature (36): n=c or g
cgagtgaaagaggtgctgttcataatccatttgatntattcagctctactgaaagtggtatcaagggctat

SEQ ID NO: 22961 - DNA, 71 bp, chicken (Gallus Gallus)
  misc_feature (36): n=a or g
aggctttcttagtgaccacagtcccagttttccatnttaagttaccagtgaacaggaggggctgtcttcaa

SEQ ID NO: 22962 - DNA, 71 bp, chicken (Gallus Gallus)
  misc_feature (36): n=a or c
gtggatgttggatgtgtaaagtggaacaggggaagnagggtgtagggtgtaaacacctaagaaatccctct

SEQ ID NO: 22963 - DNA, 71 bp, chicken (Gallus Gallus)
  misc_feature (36): n=c or t
tctgaagaaacatcgaggggtaaaaatcttagctanaggttttctttttactcttccagtgtacagtcact

SEQ ID NO: 22964 - DNA, 71 bp, chicken (Gallus Gallus)
  misc_feature (36): n=g or t
gatcagtggtcattaagagcagggagaggaccaagnaggcattagtgattttgctggctgttttctgtttt

SEQ ID NO: 22965 - DNA, 71 bp, chicken (Gallus Gallus)
  misc_feature (36): n=c or t
gcagttcccatatactcattaaataagaggctgtcngccttttctgctaagtaccaagaagggcattaaat

SEQ ID NO: 22966 - DNA, 71 bp, chicken (Gallus Gallus)
  misc_feature (36): n=a or g
ttttccgaccgtaatgattctctggttaagctgccnaaatggaagaagcgtaacattaacccttcagcagc

SEQ ID NO: 22967 - DNA, 71 bp, chicken (Gallus Gallus)
  misc_feature (36): n=a or g
acaggagttgctgaggtttgaggcttccctaagcantcggccatctctgctactatgaatcatctcctgct

SEQ ID NO: 22968 - DNA, 71 bp, chicken (Gallus Gallus)
  misc_feature (36): n=a or g
gcgatggggagaggcatattgaagcgtagcccaagngtttcatgccaacccactgaaatgcatggcttggt

SEQ ID NO: 22969 - DNA, 71 bp, chicken (Gallus Gallus)
  misc_feature (36): n=c or t
ttgctgcacgtgtgaggctgccaatttctaaacganttggcctgagaagctgtgctctgagtgaagctcct

SEQ ID NO: 22970 - DNA, 71 bp, chicken (Gallus Gallus)
  misc_feature (36): n=c or t
agttaacttctacctcagatggggctagaattaaangtgtcatggaagcttttccctttgttttgtctaat

SEQ ID NO: 22971 - DNA, 71 bp, chicken (Gallus Gallus)
  misc_feature (36): n=c or g
ccagtgtccataacatggtaaggcaagaaattcagnctgagaatcaagtcttgtcttcctaggatctttgg

SEQ ID NO: 22972 - DNA, 71 bp, chicken (Gallus Gallus)
  misc_feature (36): n=a or g
gcagctcttttggcaaactccaggtgaagctgatcnattgtttcaagcaatttctctgtcctctgtatagg

SEQ ID NO: 22973 - DNA, 71 bp, chicken (Gallus Gallus)
  misc_feature (36): n=a or c
tctttgtttttgaaacaatttgatgatccactgtantgggaactatttagaaatggaaattattcagtcct

SEQ ID NO: 22974 - DNA, 71 bp, chicken (Gallus Gallus)
  misc_feature (36): n=a or g
gatatttcaaatggactttgttttgactgattctantgtcctcagtccaaacataaccagcaagtgtcata

SEQ ID NO: 22975 - DNA, 71 bp, chicken (Gallus Gallus)
  misc_feature (36): n=a or g
agttaacctcttgaatttggtctatatattaaaccntacacacataaacaaacctctgtgtttgtccaaat

SEQ ID NO: 22976 - DNA, 71 bp, chicken (Gallus Gallus)
  misc_feature (36): n=a or g
taatttctgaggggtccaaaccttcaaggaattgcntggctgaacactaaagcttgaaacaacagcacttg

SEQ ID NO: 22977 - DNA, 71 bp, chicken (Gallus Gallus)
  misc_feature (36): n=a or c
tcctacggaattccttgcagctattaaaaaaggganatataaagaaatttatttatgcccaacttcaaatt

SEQ ID NO: 22978 - DNA, 71 bp, chicken (Gallus Gallus)
  misc_feature (36): n=a or g
tccctgattgaggctataaattataaggtgcttagntattatgtagatgagaaacctgtaaaaataccgca

SEQ ID NO: 22979 - DNA, 71 bp, chicken (Gallus Gallus)
  misc_feature (36): n=c or t
aagtgcaagctcagagctgacaatgtgtaacacttntagttaagaccaaaaaaaaggtatgtagtcattct

SEQ ID NO: 22980 - DNA, 71 bp, chicken (Gallus Gallus)
  misc_feature (36): n=c or g
catagaaactcccaactaaaagtttgggatttgtanagtatgttggttttctgctattgcttccattcaaa

SEQ ID NO: 22981 - DNA, 71 bp, chicken (Gallus Gallus)
  misc_feature (36): n=a or g
tttggtggctaggagaggattctgagcctcaagcantgtttcagttggaaaagtatgtctgatggttcatt

SEQ ID NO: 22982 - DNA, 71 bp, chicken (Gallus Gallus)
  misc_feature (36): n=g or t
gtttttgttttgttttttcccctaatattttaaatnagcagctttggttacatctaaaatcctatttgagg

SEQ ID NO: 22983 - DNA, 71 bp, chicken (Gallus Gallus)
  misc_feature (36): n=c or t
ctgggatacaacagggacttggacaggcagttctantcctcagatttttttgaataaatgtttaaaatcat

SEQ ID NO: 22984 - DNA, 71 bp, chicken (Gallus Gallus)
  misc_feature (36): n=a or c
ggagtttctagaagattacgcttctgggtccagagnattttttgtccaaaatacaagcatgttcatggttg

SEQ ID NO: 22985 - DNA, 71 bp, chicken (Gallus Gallus)
  misc_feature (36): n=c or t
atctctactatgtttgttatgctacagtccatttangaatgctactctcacccttccagcaatagctgttc

SEQ ID NO: 22986 - DNA, 71 bp, chicken (Gallus Gallus)
  misc_feature (36): n=g or t
ctcctaccagcagcaccccgacccacagtgccaacncttatttagggatccccgtctcacagccaggctcg

SEQ ID NO: 22987 - DNA, 71 bp, chicken (Gallus Gallus)
  misc_feature (36): n=a or g
atgaacacttctgaattaagttgcatgttatagtgnagtcagcctatgcagcaaggggaagacagacagaa

SEQ ID NO: 22988 - DNA, 71 bp, chicken (Gallus Gallus)
  misc_feature (36): n=c or g
gatctgtcctaatacagaattgtaaaaagaaaaacnatgcttttttaatatgttgccagatttttacattt

SEQ ID NO: 22989 - DNA, 71 bp, chicken (Gallus Gallus)
  misc_feature (36): n=c or t
ggtgaaaacggacaagattttgatgcctgaacatangtggccctgtctagagaacagtcccatcttggatt

SEQ ID NO: 22990 - DNA, 71 bp, chicken (Gallus Gallus)
  misc_feature (36): n=g or t
ctgagagaaactttgtgaaacaaagggaagaggaanagaacataggtgacctgaaagtgacctgaaagtga

SEQ ID NO: 22991 - DNA, 71 bp, chicken (Gallus Gallus)
  misc_feature (36): n=a or g
tgctctgtggagtagtaaacatacaatgcctcagcnttaggagtagtctgttttgatcaagccacagggat

SEQ ID NO: 22992 - DNA, 71 bp, chicken (Gallus Gallus)
  misc_feature (36): n=a or c
ggcatctatcagcaatgcaatgtgactgcctctcanaatcactgcccttactctcacggactggtggttgc

SEQ ID NO: 22993 - DNA, 71 bp, chicken (Gallus Gallus)
  misc_feature (36): n=c or g
ttcccaattaaaatttcatgactgtttcccagtccntagcactgactttaaaagagttgggatgaacatgg

SEQ ID NO: 22994 - DNA, 71 bp, chicken (Gallus Gallus)
  misc_feature (36): n=a or c
aaggttattctcattacctgcccaagaatctttttntcactagtctgtaatatttctactatactactcat

SEQ ID NO: 22995 - DNA, 71 bp, chicken (Gallus Gallus)
  misc_feature (36): n=a or g
gagagctaagccatgtagggagaatggctatataantgcacggcagcgtgttcaccaaagtcattagtcca

SEQ ID NO: 22996 - DNA, 71 bp, chicken (Gallus Gallus)
  misc_feature (36): n=c or t
ggaaaacaaggggaataacagtcaaggtgcagcttnctgacaaacagaaatggcagcagacattcaaagta

SEQ ID NO: 22997 - DNA, 71 bp, chicken (Gallus Gallus)
  misc_feature (36): n=c or t
tatagaccccttagaggataatgttctgagaaaatngttcttttgatgccttgatttgaaacttatgtttt

SEQ ID NO: 22998 - DNA, 71 bp, chicken (Gallus Gallus)
  misc_feature (36): n=c or t
gagaaaggaggtaatgggatgtttgtttgacggtgngcagtcggggtctttggcctggggggagggaaggt

SEQ ID NO: 22999 - DNA, 71 bp, chicken (Gallus Gallus)
  misc_feature (36): n=c or t
gcaatgatgttgaacaatgtgtccaacatgtgtggntgcagtgaagacattattcttaacaaccattatct

SEQ ID NO: 23000 - DNA, 71 bp, chicken (Gallus Gallus)
  misc_feature (36): n=a or g
atgaccaacttccttgtcattggcaaacaaatccangtgaagagattacattctagcctagttcaaaagcc

SEQ ID NO: 23001 - DNA, 71 bp, chicken (Gallus Gallus)
  misc_feature (36): n=c or t
gcaatgggttattttgcttaatgtgggcagttgaanattggcaacatcttgagagttcactttcacttgat

SEQ ID NO: 23002 - DNA, 71 bp, chicken (Gallus Gallus)
  misc_feature (36): n=a or g
tactgagtagctttctaatctgttcacaatgcatcnactcttcatcttcataagaatgcagcagaactgta

SEQ ID NO: 23003 - DNA, 71 bp, chicken (Gallus Gallus)
  misc_feature (36): n=c or t
gtatttactaacattagaaatatgggttgctttgcngaacacagtagaaatagtccagtggagagagaagt

SEQ ID NO: 23004 - DNA, 71 bp, chicken (Gallus Gallus)
  misc_feature (36): n=c or t
acacgtaaaagactgagcaatcttacctcaccaaancctcaaaataaaaactcagctttccttcagtgtct

SEQ ID NO: 23005 - DNA, 71 bp, chicken (Gallus Gallus)
  misc_feature (36): n=a or g
gtatggatttcacccatttcacaagcagtaagattnaagtgtagagtagcattgtaattcttagacagggc

SEQ ID NO: 23006 - DNA, 71 bp, chicken (Gallus Gallus)
  misc_feature (36): n=a or g
aaaatgagacgtgcatatgagtagtgaggatgatcnttgtaggagtctgttagtattgcaagctactcatt

SEQ ID NO: 23007 - DNA, 71 bp, chicken (Gallus Gallus)
  misc_feature (36): n=c or t
gatactgtgactgatggtgcctgtgtaacttcaaanggcacaagcatcatttcttgcacactagatccttg

SEQ ID NO: 23008 - DNA, 71 bp, chicken (Gallus Gallus)
  misc_feature (36): n=a or g
gagccagcagtgtgctcaggtggccaagaaggccantggcatgatggcttgtttaagaggtagtgctgcta

SEQ ID NO: 23009 - DNA, 71 bp, chicken (Gallus Gallus)
  misc_feature (36): n=a or t
acacattattaagtaaagttttgtagtccagaaacntcccagctttcacactgtataataaccttcaaact

SEQ ID NO: 23010 - DNA, 71 bp, chicken (Gallus Gallus)
  misc_feature (36): n=c or t
atccccattgcttggtgctttgtggccatcccatgngctcggagggtgagagaaagatgtaaataaatccg

SEQ ID NO: 23011 - DNA, 71 bp, chicken (Gallus Gallus)
  misc_feature (36): n=c or t
agtgggaacaggttgtgacctccagctcttcttatnccagcagttgtagggaaatcctccataggcagaca

SEQ ID NO: 23012 - DNA, 71 bp, chicken (Gallus Gallus)
  misc_feature (36): n=a or g
ctcatggcactgtgatgcaatatataattgggcccngtgccaggccacgtgtcatactttaaatgacttac

SEQ ID NO: 23013 - DNA, 71 bp, chicken (Gallus Gallus)
  misc_feature (36): n=g or t
ccaaaacatttacatattgatggcaacagcaagagncattcaacaaattattttcctatttcagaatcagt

SEQ ID NO: 23014 - DNA, 71 bp, chicken (Gallus Gallus)
  misc_feature (36): n=c or g
tcaattctatcaattcttgaaagagaattaaggtgnactgtttgatatctaaaaggcctgtgtccacgagg

SEQ ID NO: 23015 - DNA, 71 bp, chicken (Gallus Gallus)
  misc_feature (36): n=a or t
ttataaattgcagatgatttggaagcatattacagnctgtttgctgttatttggctttaaacctcattaag

SEQ ID NO: 23016 - DNA, 71 bp, chicken (Gallus Gallus)
  misc_feature (36): n=a or g
tcagcagaaggaaataaaagtagttccctgaggccnaaagtagatatctgaaatgggacaacagagaatca

SEQ ID NO: 23017 - DNA, 71 bp, chicken (Gallus Gallus)
  misc_feature (36): n=c or t
cacgagagtttgattaaccttcctgcagtccaaaangttaaactgaatgtctcctgtacctgtgcatcccc

SEQ ID NO: 23018 - DNA, 71 bp, chicken (Gallus Gallus)
  misc_feature (36): n=a or c
taaggactgagaaagaatacaattggaaaaaagccntggagctctgttttttgagaagatgcatgttattg

SEQ ID NO: 23019 - DNA, 71 bp, chicken (Gallus Gallus)
  misc_feature (36): n=c or t
ttgaaacagggatgagaaaacagcactttaacttcntttcacagtgccaacatatccatgtcctcttccag

SEQ ID NO: 23020 - DNA, 71 bp, chicken (Gallus Gallus)
  misc_feature (36): n=a or c
ctttaaattttaaattgttttgcttcaaattcctantgaattaaatgagtactctatatacattacatatg

SEQ ID NO: 23021 - DNA, 71 bp, chicken (Gallus Gallus)
  misc_feature (36): n=a or c
gtaccagttctcttaaacagagaatgtcttcatcancagtttatgaatgcgtgtgctctcatccgtatgca

SEQ ID NO: 23022 - DNA, 71 bp, chicken (Gallus Gallus)
  misc_feature (36): n=c or t
caccactgccgacagttacaatgtctgaagtgagtngccgggctgtgcttgtaagagcgtgtgttgccatt

SEQ ID NO: 23023 - DNA, 71 bp, chicken (Gallus Gallus)
  misc_feature (36): n=a or g
ctcagcaaccttatttcccatcatttaaattgaccntgatcaattaatacaccagtgatgcaccttcatgc

SEQ ID NO: 23024 - DNA, 71 bp, chicken (Gallus Gallus)
  misc_feature (36): n=a or c
ggaggtttaatttcaaggtatttctaagcacagtcnttagatttcttgtactactagaatctaccctgtct

SEQ ID NO: 23025 - DNA, 71 bp, chicken (Gallus Gallus)
  misc_feature (36): n=c or t
aagtgtaacagaacatgctcattaggtgagaaatgngtatccttcttacagagctaaagtacaaattacgt

SEQ ID NO: 23026 - DNA, 71 bp, chicken (Gallus Gallus)
  misc_feature (36): n=c or t
caacacttggtgatctcataaattcttttagttatntaacaggtggtagtcaattggatgaatccaggctc

SEQ ID NO: 23027 - DNA, 71 bp, chicken (Gallus Gallus)
  misc_feature (36): n=c or t
ggagcactaacttgcattagcagtcctgcatcatangacttcagtgcaattgttactgggtcatggctcac

SEQ ID NO: 23028 - DNA, 71 bp, chicken (Gallus Gallus)
  misc_feature (36): n=c or t
ggtgagctacaggtttcgtttttttggtaagactgnatgagttgatcatgtactcagatagtttgttgtta

SEQ ID NO: 23029 - DNA, 71 bp, chicken (Gallus Gallus)
  misc_feature (36): n=a or g
tgttgtctcatgagcagccctgtaagtgtaacatanagcatggggagctggaggaggtattttgatattag

SEQ ID NO: 23030 - DNA, 71 bp, chicken (Gallus Gallus)
  misc_feature (36): n=c or g
gaccttgataattaaaatgtcaactaagttagattnctcttcctgtatgaatgacatctcttgttaattat

SEQ ID NO: 23031 - DNA, 71 bp, chicken (Gallus Gallus)
  misc_feature (36): n=a or g
tttgctgaaggctgtcatggacatctagccaaacanctgtacacaaaatacaacctaagggagaaatgcca

SEQ ID NO: 23032 - DNA, 71 bp, chicken (Gallus Gallus)
  misc_feature (36): n=a or c
atatgtatatgctacctatacaatgatatacatganaaaaacattatacctgtccaggcttagatgctgct

SEQ ID NO: 23033 - DNA, 71 bp, chicken (Gallus Gallus)
  misc_feature (36): n=a or g
cactttgaatctgaccttgtatagtttatttaggtncacaaacaggctatgacagagcaaagaactgaact

SEQ ID NO: 23034 - DNA, 71 bp, chicken (Gallus Gallus)
  misc_feature (36): n=c or t
agcacacaggatgcaatcctgaaacacatatgcacngagaatctatttttgtctagataataaatacactc

SEQ ID NO: 23035 - DNA, 71 bp, chicken (Gallus Gallus)
  misc_feature (36): n=a or t
ttatatgtcaaagtaaacacactctttggtttatgngtttggaaaaaatcaaagccatgaggaagaatcct

SEQ ID NO: 23036 - DNA, 71 bp, chicken (Gallus Gallus)
  misc_feature (36): n=c or t
gtccaaaaatgaaagaatttgggaacacagatttanaataatgacagatcttccttcctcagcaacactaa

SEQ ID NO: 23037 - DNA, 71 bp, chicken (Gallus Gallus)
  misc_feature (36): n=a or g
cagcacacaacaattttacttgaactttatggccancaagcccactgcacacccccaacaagccgagccct

SEQ ID NO: 23038 - DNA, 71 bp, chicken (Gallus Gallus)
  misc_feature (36): n=a or g
gctcaggtactgaaatggtggcagtgcctacagaanacgttcttcttttcaggtgtgttataattgctatg

SEQ ID NO: 23039 - DNA, 71 bp, chicken (Gallus Gallus)
  misc_feature (36): n=a or g
tctttacatattactcacggcagatgttataaaacntttaggcagaatcctacctttatttaaaatagata

SEQ ID NO: 23040 - DNA, 71 bp, chicken (Gallus Gallus)
  misc_feature (36): n=a or g
catggtgtaaaagcctgaatcagaatgcattctacnaactactttgtgtagctttcctcccagtttgggca

SEQ ID NO: 23041 - DNA, 71 bp, chicken (Gallus Gallus)
  misc_feature (36): n=c or g
ccagaacaactcaggcagaatgagttccttcaggtntgtgttaatagggatctgaagtaaaataacagcac

SEQ ID NO: 23042 - DNA, 71 bp, chicken (Gallus Gallus)
  misc_feature (36): n=c or t
tgggatttttttcagattgaatagctatagcacatnttttcctttaggttaattgagctcttgtgtatttt

SEQ ID NO: 23043 - DNA, 71 bp, chicken (Gallus Gallus)
  misc_feature (36): n=a or g
tctgatctgcagctagctggactcagattgttgacnaatatgtctgttaccaatgcctatcattataagat

SEQ ID NO: 23044 - DNA, 71 bp, chicken (Gallus Gallus)
  misc_feature (36): n=a or g
cgcatttccagggcctcctgggcaggaggagatcantggcccttacaaaacagggctatggaaatggctgg

SEQ ID NO: 23045 - DNA, 71 bp, chicken (Gallus Gallus)
  misc_feature (36): n=c or t
ggaaaagaaggctgcagaccctgtgtatttttgctntgcaatttcttcagatgcaatctgctgagaaacct

SEQ ID NO: 23046 - DNA, 71 bp, chicken (Gallus Gallus)
  misc_feature (36): n=a or g
tgcacagaagcagaactgcaaactttgaaagtagcnaaggagagtgcaatttgcatgttctttcacactga

SEQ ID NO: 23047 - DNA, 71 bp, chicken (Gallus Gallus)
  misc_feature (36): n=c or t
taagttgttctgaagactttaaaacaaaataaaacncacaagtaaataacgcagaagctctccctggacac

SEQ ID NO: 23048 - DNA, 71 bp, chicken (Gallus Gallus)
  misc_feature (36): n=c or t
caggtaaacactggttcgttcttcattgttttatgnttcttatagaagtaacagcattttattttgaggtc

SEQ ID NO: 23049 - DNA, 71 bp, chicken (Gallus Gallus)
  misc_feature (36): n=c or t
acccccgtgaagggctggaagtgaaataaagggagngtacagtattgttaagcaatttgtggttaaagtca

SEQ ID NO: 23050 - DNA, 71 bp, chicken (Gallus Gallus)
  misc_feature (36): n=c or t
tccttcattttagaacactattcatgatcatgaagnagctgccttaccattttactgtacttaaattccgt

SEQ ID NO: 23051 - DNA, 71 bp, chicken (Gallus Gallus)
  misc_feature (36): n=c or t
ttcacttaagcctcaccaccaaactcatttcattantctcagctcccatctctaatacttccagcatctca

SEQ ID NO: 23052 - DNA, 71 bp, chicken (Gallus Gallus)
  misc_feature (36): n=c or t
gcctctacttgaacattgcaaatctctgcttttcanagacatttgcaaatacaacagcttcttacttaggg

SEQ ID NO: 23053 - DNA, 71 bp, chicken (Gallus Gallus)
  misc_feature (36): n=a or g
gtatattttctacaattgtaagaggaaaaaatcagnaactctcaaacctgttgcacagatgtatgtatgca

SEQ ID NO: 23054 - DNA, 71 bp, chicken (Gallus Gallus)
  misc_feature (36): n=g or t
atgtgctatgaacccacctggcttctttctgtaganggacaggattggagttttgcaacttcaagggaatt

SEQ ID NO: 23055 - DNA, 71 bp, chicken (Gallus Gallus)
  misc_feature (36): n=c or t
atggatattgtgaggagagaatgttacttcagtganggagttgggcacacaggggtgagcattcactgaag

SEQ ID NO: 23056 - DNA, 71 bp, chicken (Gallus Gallus)
  misc_feature (36): n=a or g
ttttggatatcaaataattattgtatattattaatnatacctgtattatattaaaatttaacagggaattt

SEQ ID NO: 23057 - DNA, 71 bp, chicken (Gallus Gallus)
  misc_feature (36): n=g or t
ctctgtcagaatgggactttgcccccgctctctccntttttcttttaaatatcaacatccgcttaatccac

SEQ ID NO: 23058 - DNA, 71 bp, chicken (Gallus Gallus)
  misc_feature (36): n=a or g
ccctttattgccatatatcattttctgttaccactntggagaccacagaatcactgaatcgtttgggttgg

SEQ ID NO: 23059 - DNA, 71 bp, chicken (Gallus Gallus)
  misc_feature (36): n=a or g
aaagccctgctgctttctgaaagagactgttggtcnccattactttgtagcaatatcactgtcacaacttc

SEQ ID NO: 23060 - DNA, 71 bp, chicken (Gallus Gallus)
  misc_feature (36): n=c or t
tggattttggaatccttcacatgctgccacatgccngtacctgtccacccatctcagcaggtatcctcatt

SEQ ID NO: 23061 - DNA, 71 bp, chicken (Gallus Gallus)
  misc_feature (36): n=c or g
tctgagaggtcttctccaaccttaatgactcagtgnttctaaagccaaagagaaaccaaatgtacccacca

SEQ ID NO: 23062 - DNA, 71 bp, chicken (Gallus Gallus)
  misc_feature (36): n=c or t
gtgcccgtcctcagaggcaggcgtgctgatcttccnccttcctaaaagaggactgtgttctgagggctaca

SEQ ID NO: 23063 - DNA, 71 bp, chicken (Gallus Gallus)
  misc_feature (36): n=a or c
tatgcagtgttgtgaaaacctacagaatagacaggngtggtatacaataactctgagcgttgtcataggag

SEQ ID NO: 23064 - DNA, 71 bp, chicken (Gallus Gallus)
  misc_feature (36): n=c or g
aattaatgagttaattaattagagttgctatctggntatgttgcaaaaacagaggaacactgaacctatac

SEQ ID NO: 23065 - DNA, 71 bp, chicken (Gallus Gallus)
  misc_feature (36): n=a or t
tcatatacgcagaatgagtgacaacaacttgaaaanctttataaaaaactgtatcatctaagataaaccaa

SEQ ID NO: 23066 - DNA, 71 bp, chicken (Gallus Gallus)
  misc_feature (36): n=c or t
aaacagagaggaactgtcatatcagcattatctggngggaccccttttcttgggagatgttaatagggaca

SEQ ID NO: 23067 - DNA, 71 bp, chicken (Gallus Gallus)
  misc_feature (36): n=a or g
atccctgaggttccctaacacttgttagattttatnttaatggtccatcaagtcagtccactctgtctcct

SEQ ID NO: 23068 - DNA, 71 bp, chicken (Gallus Gallus)
  misc_feature (36): n=g or t
ttctgaattcagaaagcaatctgcaaaccttggagnccacgctcaccaactcacagctgcaaatttcaaaa

SEQ ID NO: 23069 - DNA, 71 bp, chicken (Gallus Gallus)
  misc_feature (36): n=g or t
tggaaagggaaaaaaaaaacattttttctcctaatntttcaatgaggctgttctagctttttttgaataaa

SEQ ID NO: 23070 - DNA, 71 bp, chicken (Gallus Gallus)
  misc_feature (36): n=c or t
gcctggggttattgtggctgaagtgcaggacccggnatttggtcttgttggatcccatcccattggcttca

SEQ ID NO: 23071 - DNA, 71 bp, chicken (Gallus Gallus)
  misc_feature (36): n=c or t
tgcaatttgtggctctgtaaccagcatttgcagtgntgttgggctttatggaatttaattacaggatcttt

SEQ ID NO: 23072 - DNA, 71 bp, chicken (Gallus Gallus)
  misc_feature (36): n=a or g
tatgattgaagacattcttgttggttgtaacagcanttggtgtacgcttatggcttctagtgatagagaac

SEQ ID NO: 23073 - DNA, 71 bp, chicken (Gallus Gallus)
  misc_feature (36): n=c or t
aggaatgaagaggagaaagcaacgcacactcactgnccgtgcctgcgggaaagctcctgtgcccatctgat

SEQ ID NO: 23074 - DNA, 71 bp, chicken (Gallus Gallus)
  misc_feature (36): n=a or g
cattcatcagcaaggtggttttcaaaaatcctcccnatggacccattgagattgtgtagtcacttacttgt

SEQ ID NO: 23075 - DNA, 71 bp, chicken (Gallus Gallus)
  misc_feature (36): n=a or g
ctttataaaccagtaagactctcccagacataaagnacagtagtaaacaaggttttctaaatcttttgtac

SEQ ID NO: 23076 - DNA, 71 bp, chicken (Gallus Gallus)
  misc_feature (36): n=a or g
aaacaaacaggacaatgaatggaatcaatacatccnacaaagcaatcagcattcaagcagcccatgtaatt

SEQ ID NO: 23077 - DNA, 71 bp, chicken (Gallus Gallus)
  misc_feature (36): n=a or g
tggccaaaaccaggttctggccctgagaagattccntctaactacaggattgttttcagtgtgagtacatt

SEQ ID NO: 23078 - DNA, 71 bp, chicken (Gallus Gallus)
  misc_feature (36): n=c or t
tcttccagaattttcacaacttcataaaaacgcttnatggagcttgtttgattgattgctttcttttaggt

SEQ ID NO: 23079 - DNA, 71 bp, chicken (Gallus Gallus)
  misc_feature (36): n=a or g
gtttggttttgtatctacccacttagagaagtgccnttgtggtgctgcaaatgctttaggcatgtgcagcc

SEQ ID NO: 23080 - DNA, 71 bp, chicken (Gallus Gallus)
  misc_feature (36): n=a or c
ttggatggtaaaatcatgagcacaaatcccatgctngcttcatagtttgtgcctaattctgtaattagaag

SEQ ID NO: 23081 - DNA, 71 bp, chicken (Gallus Gallus)
  misc_feature (36): n=a or c
actgacaaccaccaaaccccccccgctcccatgagnagcttccactttgaaagtctttgtggttacccaca

SEQ ID NO: 23082 - DNA, 71 bp, chicken (Gallus Gallus)
  misc_feature (36): n=a or g
tgaaaattagttgagtactcaacccatggcattaanacatctccccaggacctcaagatgattaaaatttg

SEQ ID NO: 23083 - DNA, 71 bp, chicken (Gallus Gallus)
  misc_feature (36): n=a or g
tgcactgcaggtttcctgaggtttctgtggctgtanaagggtagatgcagcctttatgtaagcttttcaaa

SEQ ID NO: 23084 - DNA, 71 bp, chicken (Gallus Gallus)
  misc_feature (36): n=a or c
ttgttcctttcaaaatttcagcagaatttaagtatntggatatatagataataaaaatataattcctgcaa

SEQ ID NO: 23085 - DNA, 71 bp, chicken (Gallus Gallus)
  misc_feature (36): n=a or g
gggacagcagaaacatctgcccaaacgatggggacnttcatccgcacacatccaagtgtcctcccagctca

SEQ ID NO: 23086 - DNA, 71 bp, chicken (Gallus Gallus)
  misc_feature (36): n=c or t
ttttctctgttttctccatgttttctcacagacccngtcttgatatccaggtgttgatgtttaaccccttg

SEQ ID NO: 23087 - DNA, 71 bp, chicken (Gallus Gallus)
  misc_feature (36): n=c or t
ttgcattatcaccgctgaaaagaaagcaaaggaagnagtctgattacattgccaaaagttttatgcaagtt

SEQ ID NO: 23088 - DNA, 71 bp, chicken (Gallus Gallus)
  misc_feature (36): n=a or c
agattcttaagtattagttaagtggtcagttatttntctccatctttgttgaaagagagaagcaatgcttt

SEQ ID NO: 23089 - DNA, 71 bp, chicken (Gallus Gallus)
  misc_feature (36): n=a or g
atttctgtatggctgctaacaaaaagaatgggaggntgaaaggtgacatgcaagcacatataataagacta

SEQ ID NO: 23090 - DNA, 71 bp, chicken (Gallus Gallus)
  misc_feature (36): n=a or t
acaagatacataatgtaaactgttttgacaagctanagtgtcttaagtattgacgttacataaagcaaaac

SEQ ID NO: 23091 - DNA, 71 bp, chicken (Gallus Gallus)
  misc_feature (36): n=a or g
tattcagttgatactactgttcccttatgattttgntgactcaagatggaaagtcactgatcctctagtta

SEQ ID NO: 23092 - DNA, 71 bp, chicken (Gallus Gallus)
  misc_feature (36): n=c or g
ttcatttcagaaaaaactcttaacatttctgagtancactgacaggaatgaatttagggatatgcttaaac

SEQ ID NO: 23093 - DNA, 71 bp, chicken (Gallus Gallus)
  misc_feature (36): n=a or g
tgctccttgctgtgatcttcctgctaacctatttgntaaaggttatttaaaaaaaaaaaaaaaaaggcata

SEQ ID NO: 23094 - DNA, 71 bp, chicken (Gallus Gallus)
  misc_feature (36): n=c or t
gcgttaccgctttgttatctattccaggtctacaangttcactacaccatgagcattaatggaaaagtgca

SEQ ID NO: 23095 - DNA, 71 bp, chicken (Gallus Gallus)
  misc_feature (36): n=a or t
tttcaatacaatgcattattgtattaaaaattatanatatattaacatttgatgatggaaggtaagtgacc

SEQ ID NO: 23096 - DNA, 71 bp, chicken (Gallus Gallus)
  misc_feature (36): n=g or t
actgggactgtcacaagcagggaatacttgagtctngagatgctcaaagcctgaggctaggctactgccgt

SEQ ID NO: 23097 - DNA, 71 bp, chicken (Gallus Gallus)
  misc_feature (36): n=c or t
tctggccgggacagctctgaagctgcgaacctcggngatcaatgttagcttcctcctggagcaccggccag

SEQ ID NO: 23098 - DNA, 71 bp, chicken (Gallus Gallus)
  misc_feature (36): n=c or t
ttagcccttcttgtttttcttgatgattttgcactngtacactgccaatcatactttgtccataccaacct

SEQ ID NO: 23099 - DNA, 71 bp, chicken (Gallus Gallus)
  misc_feature (36): n=c or t
ggtaggaaaagtgctgtatcagagacaaatctgaantgctatgtaaccaatcatatcagtctgtagttttg

SEQ ID NO: 23100 - DNA, 71 bp, chicken (Gallus Gallus)
  misc_feature (36): n=g or t
aaactcaggaattgttaacatgtaatgagcttggtngctgtagtagtagcatactgatacaaagaacaagt

SEQ ID NO: 23101 - DNA, 71 bp, chicken (Gallus Gallus)
  misc_feature (36): n=a or g
tataaaactcctacgtgcacaaatcagatatccaantttagctgaagactaagccattccccccttcaaca

SEQ ID NO: 23102 - DNA, 71 bp, chicken (Gallus Gallus)
  misc_feature (36): n=a or g
taaacatttagggttagtgatacataatggagtgcntttgttagatgggcagtactgtggtcatactgagt

SEQ ID NO: 23103 - DNA, 71 bp, chicken (Gallus Gallus)
  misc_feature (36): n=a or g
ttatcaaattcattgtttaaatcaatttgagacacnagtgtgaggattttctgagtcaaaccctgctccat

SEQ ID NO: 23104 - DNA, 71 bp, chicken (Gallus Gallus)
  misc_feature (36): n=c or t
tccaatggatcctccctacctacaacataccccatngattcactttcattgctgtgccttaactagcaaag

SEQ ID NO: 23105 - DNA, 71 bp, chicken (Gallus Gallus)
  misc_feature (36): n=c or t
cagagcattgaggaaggtagcattcaggtggtttcntgaaattgcttgatttgtcacctacttgtatgacc

SEQ ID NO: 23106 - DNA, 71 bp, chicken (Gallus Gallus)
  misc_feature (36): n=c or t
ccaaatggaaagccaggattcaaactgaaagctccntccatcttcagagcatcctcccagttctaaagaga

SEQ ID NO: 23107 - DNA, 71 bp, chicken (Gallus Gallus)
  misc_feature (36): n=a or g
ccgaagggagctgtgcaagaattccaggactagaantcattctcacacatacctgtccttcctcagtataa

SEQ ID NO: 23108 - DNA, 71 bp, chicken (Gallus Gallus)
  misc_feature (36): n=c or t
cgtgttttccagattcaaatcataattgcatcttgnattttgaaatctggctttacaatgaatttctttca

SEQ ID NO: 23109 - DNA, 71 bp, chicken (Gallus Gallus)
  misc_feature (36): n=c or g
tattataaataaataaaaaaatagaaatgtgagacncgttaatctctgtctgctttctgtatgcttcacag

SEQ ID NO: 23110 - DNA, 71 bp, chicken (Gallus Gallus)
  misc_feature (36): n=c or g
tgttttggggatcagggctcggtagcacttatcaantgtaatgtctagaacagagtggagctgtggttgct

SEQ ID NO: 23111 - DNA, 71 bp, chicken (Gallus Gallus)
  misc_feature (36): n=g or t
aggtggcgagaagataggaagggacgtaccatcagncaggagcacgcttgcacatctgtataagcataaga

SEQ ID NO: 23112 - DNA, 71 bp, chicken (Gallus Gallus)
  misc_feature (36): n=a or t
tctggttagctgttttcttcttctgttgctctttgngccagaagacatcagctagacttttggaagacgga

SEQ ID NO: 23113 - DNA, 71 bp, chicken (Gallus Gallus)
  misc_feature (36): n=c or t
cactcctttttttcctgacaaaacattcaccacacnaaaacattggtcaacaaacaagttgaccaaaatag

SEQ ID NO: 23114 - DNA, 71 bp, chicken (Gallus Gallus)
  misc_feature (36): n=c or t
ctttatatgaatcacttttcattaagaatgaggttnaaatttaaagcatatactaatttcccatttcatag

SEQ ID NO: 23115 - DNA, 71 bp, chicken (Gallus Gallus)
  misc_feature (36): n=c or t
acctattgatgagtacttgctttagaagaggttcangagtggtgctccccaggggtcggtgctggggcctc

SEQ ID NO: 23116 - DNA, 71 bp, chicken (Gallus Gallus)
  misc_feature (36): n=c or t
ctcaaagtcaagctggccactgttgtaaaagataanaacattttttttttttacaaatatattgccagtaa

SEQ ID NO: 23117 - DNA, 71 bp, chicken (Gallus Gallus)
  misc_feature (36): n=c or t
acaaaaacgatccaaaggatggaacattttccttangaggacaggctgagagagctggtgctgttcagcat

SEQ ID NO: 23118 - DNA, 71 bp, chicken (Gallus Gallus)
  misc_feature (36): n=c or t
gtcataaggaccagagacagaattgtttaaccaacntgttcataatgattttggtggtttcaaggctgctc

SEQ ID NO: 23119 - DNA, 71 bp, chicken (Gallus Gallus)
  misc_feature (36): n=a or g
tatctgtgacactgccagtcagcttgggttaaaacnatgcagttccaccagtagtttcatgaaggaaagat

SEQ ID NO: 23120 - DNA, 71 bp, chicken (Gallus Gallus)
  misc_feature (36): n=c or t
aaccctagaggtccttgatgacctgttggagcctgntgacatccaggacattccctgagaccctgaaagta

SEQ ID NO: 23121 - DNA, 71 bp, chicken (Gallus Gallus)
  misc_feature (36): n=a or g
tgaaatctgcttttagggaaggcttaaaaatccacntgtcccatcctgggttccacattgctagatgtagt

SEQ ID NO: 23122 - DNA, 71 bp, chicken (Gallus Gallus)
  misc_feature (36): n=a or g
cttatattcttccctaaaatgacaatcaatccctcntgtgaattatactctatagcagatggaatgaattt

SEQ ID NO: 23123 - DNA, 71 bp, chicken (Gallus Gallus)
  misc_feature (36): n=c or t
ttttgctgatttttcattttaatgttaaaaatgtcnttgaaaaaaattcaataataactctgaagttcagg

SEQ ID NO: 23124 - DNA, 71 bp, chicken (Gallus Gallus)
  misc_feature (36): n=c or t
acacacaacagatttcaggttaagggtctgctgttntacctacgtagctttctcttctgctgacaagaaaa

SEQ ID NO: 23125 - DNA, 71 bp, chicken (Gallus Gallus)
  misc_feature (36): n=c or t
attctctttctttcacgggaaaccccacatccttgnaccatgtaccatcagtactgttttccctctccttt

SEQ ID NO: 23126 - DNA, 71 bp, chicken (Gallus Gallus)
  misc_feature (36): n=c or t
gaaggagttttgaaggggttgggacttcatcatgcnctcttctattgctcagtgagctagctggtcaatga

SEQ ID NO: 23127 - DNA, 71 bp, chicken (Gallus Gallus)
  misc_feature (36): n=c or t
tgaagtttaatgaaatcaagcgcaaggtcctgaacntgcatcagggcaatcctaaacatgagtattggctg

SEQ ID NO: 23128 - DNA, 71 bp, chicken (Gallus Gallus)
  misc_feature (36): n=a or c
agagtaaattattttatgtaactggagattcatctntagctctaaatatacaaatatgtaagtaaaaaaaa

SEQ ID NO: 23129 - DNA, 71 bp, chicken (Gallus Gallus)
  misc_feature (36): n=a or c
gatgcttaatttctactgagcgtcttaaaatagagnagaaggaaagacgcagcacagtttatagcataaaa

SEQ ID NO: 23130 - DNA, 71 bp, chicken (Gallus Gallus)
  misc_feature (36): n=c or t
gggacctccccacagattttgtcagcatctcaggcngtgataaagaattggcaggtggtaggatggtggtc

SEQ ID NO: 23131 - DNA, 71 bp, chicken (Gallus Gallus)
  misc_feature (36): n=c or t
tgcaaagatcagcatgcaaaaggtactcaaagttgntcctcagatattaggtctgatcagcactgtagcag

SEQ ID NO: 23132 - DNA, 71 bp, chicken (Gallus Gallus)
  misc_feature (36): n=c or t
agcagccttggtaggctgaggtctctcaaggaaaanactgaagcagcctgagaaacaaattactgtagata

SEQ ID NO: 23133 - DNA, 71 bp, chicken (Gallus Gallus)
  misc_feature (36): n=c or t
ctgtctggtttataaggtgatagatttacatgccangaggaataacagggtatatttcctgacctttagag

SEQ ID NO: 23134 - DNA, 71 bp, chicken (Gallus Gallus)
  misc_feature (36): n=c or t
tctctttaatgtcttcataaatgacttagatgtagnactagaagttgttttaagcaagtctgtagatgata

SEQ ID NO: 23135 - DNA, 71 bp, chicken (Gallus Gallus)
  misc_feature (36): n=a or g
cagccaaaggtctctagttaactgtgagtcatatancatagcaagggataatgcaaatgctgaaaaaaata

SEQ ID NO: 23136 - DNA, 71 bp, chicken (Gallus Gallus)
  misc_feature (36): n=c or t
attaaacagagaagagcaggactgaacgaattcatncaaaacttagttagacagccagagctatgcaacca

SEQ ID NO: 23137 - DNA, 71 bp, chicken (Gallus Gallus)
  misc_feature (36): n=c or t
agcatgtgcttcaaaactgctatgtcacagagatgnggtggtggatttttttttggagaagcattcacacc

SEQ ID NO: 23138 - DNA, 71 bp, chicken (Gallus Gallus)
  misc_feature (36): n=a or g
acagtcacaaataaacctggagccttgatcaacagnccacaagtctgaccattaaagtcaaaaggataata

SEQ ID NO: 23139 - DNA, 71 bp, chicken (Gallus Gallus)
  misc_feature (36): n=c or t
atttctactactcttccagctgatcttgcactcaangtcacaaaaagtttcaggtttcagtgccaggacaa

SEQ ID NO: 23140 - DNA, 71 bp, chicken (Gallus Gallus)
  misc_feature (36): n=c or t
acaaaggaagatccagatccggtggctgtggagagngagaagtgtctcgggatggataaatttaaggctgc

SEQ ID NO: 23141 - DNA, 71 bp, chicken (Gallus Gallus)
  misc_feature (36): n=a or c
gaattgtttttttattagttatgtagctcataaatntgatcctacttaagcttttccacctgacattattg

SEQ ID NO: 23142 - DNA, 71 bp, chicken (Gallus Gallus)
  misc_feature (36): n=c or t
ttctgtacctgtgcaatttgcgcctcaaaaatgttnagaacactatgcccctgtacatctgaatacagaaa

SEQ ID NO: 23143 - DNA, 71 bp, chicken (Gallus Gallus)
  misc_feature (36): n=a or g
tcctctttcctttacttcctttttaaccagaagacngtaaagttcagcatccctacacagggaaatttttt

SEQ ID NO: 23144 - DNA, 71 bp, chicken (Gallus Gallus)
  misc_feature (36): n=c or t
agtaatgcgtagtatattaaaagccctgtaaattgngtgtctctgaactaaaagtgctcatgaaaataatc

SEQ ID NO: 23145 - DNA, 71 bp, chicken (Gallus Gallus)
  misc_feature (36): n=c or t
cttgggtagttcataaacatgcttatatgtcatggntctttgtaaccgcaggggacaaccttgatcaactg

SEQ ID NO: 23146 - DNA, 71 bp, chicken (Gallus Gallus)
  misc_feature (36): n=g or t
tactagatttagttgtggcagcaatctcattcattntctaagtgtctagtagcatcttttacttaatcata

SEQ ID NO: 23147 - DNA, 71 bp, chicken (Gallus Gallus)
  misc_feature (36): n=c or t
gaatgaagtgcagacaatttaagttagaaggcccanaggaggacatctagtccaacctccagggttaagct

SEQ ID NO: 23148 - DNA, 71 bp, chicken (Gallus Gallus)
  misc_feature (36): n=c or t
aggacaaggaacactgtgaggaatatggaagaatgntgcaggctgatcccaacaaagtctcttcgagagca

SEQ ID NO: 23149 - DNA, 71 bp, chicken (Gallus Gallus)
  misc_feature (36): n=c or t
tatacagaagacagggagatagcctttatgatatantcattctacactggtttgggtgtactggtggatgg

SEQ ID NO: 23150 - DNA, 71 bp, chicken (Gallus Gallus)
  misc_feature (36): n=a or c
gccacagagaacaccaccactgaataatttctgtanggatatgtagaggcatgtaatcacttgtgtggttt

SEQ ID NO: 23151 - DNA, 71 bp, chicken (Gallus Gallus)
  misc_feature (36): n=a or g
tttgtgggagggtgctgtgtggggagcccatgcttnctcaaaatccatttgtaccctccagtacacaaatg

SEQ ID NO: 23152 - DNA, 71 bp, chicken (Gallus Gallus)
  misc_feature (36): n=a or g
ttgtttgttttgttgttgttgttttgttttctcccntactggctttatcttttttagtttgaggcactgca

SEQ ID NO: 23153 - DNA, 71 bp, chicken (Gallus Gallus)
  misc_feature (36): n=a or g
gaatagacatgtaatactgtcgttatgtaagattgnagagtgttaagagttgctggctcagtactgctttg

SEQ ID NO: 23154 - DNA, 71 bp, chicken (Gallus Gallus)
  misc_feature (36): n=a or g
agagaaatactccttctgagaactgggaagaaaacnaaaaaggggggaaaggggaataagaagctacaggt

SEQ ID NO: 23155 - DNA, 71 bp, chicken (Gallus Gallus)
  misc_feature (36): n=g or t
taacacaggcaccagctctgcacccattcacagtgntccatacagttcaattgtcatcactctccttggtg

SEQ ID NO: 23156 - DNA, 71 bp, chicken (Gallus Gallus)
  misc_feature (36): n=c or t
aacaccaggaaaactccaaggaacgtcactgggaangcaaagcagcaaagagatgccgtggggctgagcac

SEQ ID NO: 23157 - DNA, 71 bp, chicken (Gallus Gallus)
  misc_feature (36): n=c or t
tgccaaaggtaatcatttgtatagaccatgaattgntttttttcttcactttacccaaaacagaggttctc

SEQ ID NO: 23158 - DNA, 71 bp, chicken (Gallus Gallus)
  misc_feature (36): n=a or g
ttactgggagtgttccatcgaaacagtgtgtttggntgttgctttagaaccgtttcacttcagcaaatgac

SEQ ID NO: 23159 - DNA, 71 bp, chicken (Gallus Gallus)
  misc_feature (36): n=a or g
attcattgataatcaatggcacaggataaccttggncaactcactaagtcacgggatgtttgttagccaag

SEQ ID NO: 23160 - DNA, 71 bp, chicken (Gallus Gallus)
  misc_feature (36): n=a or g
tactgtcagcagtgtagtgccatcactggtggaacnggaataagttccacctgtttggaaagcttggaaaa

SEQ ID NO: 23161 - DNA, 71 bp, chicken (Gallus Gallus)
  misc_feature (36): n=c or t
agttactgccagaatgagaaagatgagagaaaacangtgctagataatcaagggaaaaaaagacttcacac

SEQ ID NO: 23162 - DNA, 71 bp, chicken (Gallus Gallus)
  misc_feature (36): n=c or t
gctaacctggcttgcttttatgtaatttaaatgttnaagaaagaaatccctcaccgtgaagctcctgagca

SEQ ID NO: 23163 - DNA, 71 bp, chicken (Gallus Gallus)
  misc_feature (36): n=a or g
agtggctttagtaatgctgaagctgagctttgaganacagcaactggtcagagtcttatcataactgatag

SEQ ID NO: 23164 - DNA, 71 bp, chicken (Gallus Gallus)
  misc_feature (36): n=c or t
gactttgattaactactgtcaattagaaggcgcatntgccccccactgacacatacacaagcccactctta

SEQ ID NO: 23165 - DNA, 71 bp, chicken (Gallus Gallus)
  misc_feature (36): n=c or t
gtatgcaacaacatataactatcacagcttctaatnacaaatccagagaatggacagaaatagacagctgc

SEQ ID NO: 23166 - DNA, 71 bp, chicken (Gallus Gallus)
  misc_feature (36): n=a or g
gaggtcaaggacaagaaaataattaatcagaagaanaggttcatcagaacctcatagttcatcagaaaaga

SEQ ID NO: 23167 - DNA, 71 bp, chicken (Gallus Gallus)
  misc_feature (36): n=a or g
gcccttgcagacgcacactgtgatacaacctctacnttacagaaagaatactcactataacaagtaagatc

SEQ ID NO: 23168 - DNA, 71 bp, chicken (Gallus Gallus)
  misc_feature (36): n=a or g
cttccaaagtcagtaagttgtgaactcaaaaaaagnatgatgttactcaaatgtaaacagaaacatgaaaa

SEQ ID NO: 23169 - DNA, 71 bp, chicken (Gallus Gallus)
  misc_feature (36): n=c or g
gtgcttatttctgtattttgaaatttatgccattanaggaaaaaaataaaattaaaaaaaaaaaaagacat

SEQ ID NO: 23170 - DNA, 71 bp, chicken (Gallus Gallus)
  misc_feature (36): n=a or g
taattagcaaagtaattgtattattgtggcaatacnaaaaatctgctacctctgggttgtatgtggaatat

SEQ ID NO: 23171 - DNA, 71 bp, chicken (Gallus Gallus)
  misc_feature (36): n=a or g
ggagtgactaaagtatagaacactgctatctacaanaaaaggcagaactgccctgctctgcaaggaatgag

SEQ ID NO: 23172 - DNA, 71 bp, chicken (Gallus Gallus)
  misc_feature (36): n=a or g
atcatctaatgccatggtttataaaaaattggcccnttcatttttctctctcaacctactcagtgtgttcc

SEQ ID NO: 23173 - DNA, 71 bp, chicken (Gallus Gallus)
  misc_feature (36): n=a or g
ctatttcactgttcactcatctatcccacattcctnagcttatctacaaggatgtaattggaggcagtgtc

SEQ ID NO: 23174 - DNA, 71 bp, chicken (Gallus Gallus)
  misc_feature (36): n=c or t
ccctgttaatatcttgggaacaaggaagttcagatngctcattttgtagttctgagttgcagggtatgaca

SEQ ID NO: 23175 - DNA, 71 bp, chicken (Gallus Gallus)
  misc_feature (36): n=c or t
ctgaaagcaggaatcaattttcactataatcttcanattcagacttgagagaatttccaatctaatgccaa

SEQ ID NO: 23176 - DNA, 71 bp, chicken (Gallus Gallus)
  misc_feature (36): n=c or t
ttcttttctcggtcctggagggccaactttgcattntgaagcatcttctgtgcattgctgtattcttcggc

SEQ ID NO: 23177 - DNA, 71 bp, chicken (Gallus Gallus)
  misc_feature (36): n=a or c
accagctcaccgtttcaaacaccagcagcttacagnatcaaatccaagttctaaatgtgcagggacatagt

SEQ ID NO: 23178 - DNA, 71 bp, chicken (Gallus Gallus)
  misc_feature (36): n=c or t
aagaggaaaaccacaatcaaacagaaagcaggaggnagtggcatgggcctacaaaacaaaaggatgggtta

SEQ ID NO: 23179 - DNA, 71 bp, chicken (Gallus Gallus)
  misc_feature (36): n=a or g
ttccatgttcaagtttgtgatcatctctgcagagtngctttatggatcttacataaatcagaggctctgtg

SEQ ID NO: 23180 - DNA, 71 bp, chicken (Gallus Gallus)
  misc_feature (36): n=c or t
caggattacacagtgctttgttttctccattactcngagagttttgaggatataaacaagaatataaagac

SEQ ID NO: 23181 - DNA, 71 bp, chicken (Gallus Gallus)
  misc_feature (36): n=c or t
taacaacaagatactgagattgacttcagctccatntaatgagggataattaacccacccatcacaaggcc

SEQ ID NO: 23182 - DNA, 71 bp, chicken (Gallus Gallus)
  misc_feature (36): n=a or c
cgtctggcaagaattgcaaaatcctcatcagactgngaggaaggaacaaataatcacacaccagtttcact

SEQ ID NO: 23183 - DNA, 71 bp, chicken (Gallus Gallus)
  misc_feature (36): n=a or g
agtctataggtcaggtcagagaacagtctctgtacngttaagggctatattctagatgtttgcagggaata

SEQ ID NO: 23184 - DNA, 71 bp, chicken (Gallus Gallus)
  misc_feature (36): n=c or t
tcccgtgagctcagcaactgctgttttctctctgtnacagctgaacatctctcaaacatttacttccgttc

SEQ ID NO: 23185 - DNA, 71 bp, chicken (Gallus Gallus)
  misc_feature (36): n=c or g
ctgtatttcaatctatttgctcccatagtccttgtnccatgctgaagttatttgttcaccctgaaaaacaa

SEQ ID NO: 23186 - DNA, 71 bp, chicken (Gallus Gallus)
  misc_feature (36): n=a or t
tggtctttggtcttggttaagcagaccatctgactngtcttctaaactggtttaggtagttaatctgcgtc

SEQ ID NO: 23187 - DNA, 71 bp, chicken (Gallus Gallus)
  misc_feature (36): n=c or t
ttactgatgtaaaggatgatctatgtcaaagaaagngatgggagagagagactgccaggaagcactactgc

SEQ ID NO: 23188 - DNA, 71 bp, chicken (Gallus Gallus)
  misc_feature (36): n=c or t
gaaattaaactgtggttggcttctaccttcagtacngttcagtagtactacttacagattacttctactgg

SEQ ID NO: 23189 - DNA, 71 bp, chicken (Gallus Gallus)
  misc_feature (36): n=a or g
gaatacaattccctgcagtcctgctgtaaaattgcntgcaaagtatccttaaaggtttgaatataaaatgt

SEQ ID NO: 23190 - DNA, 71 bp, chicken (Gallus Gallus)
  misc_feature (36): n=a or g
aaatggggttttgtgacactacattcgggctcctgnggttcttgctgccacaagatttgttatctgcattt

SEQ ID NO: 23191 - DNA, 71 bp, chicken (Gallus Gallus)
  misc_feature (36): n=c or t
gggactgaacatctcttgatctgttatacacttctncacttcattggagagactgttcagcttcttcctaa

SEQ ID NO: 23192 - DNA, 71 bp, chicken (Gallus Gallus)
  misc_feature (36): n=g or t
gtgaagaaagatgagtgcaatattaattcatttcanaatagtttacataaatatgctttatttcacttttg

SEQ ID NO: 23193 - DNA, 71 bp, chicken (Gallus Gallus)
  misc_feature (36): n=a or t
agcagaaaatgtgggaggaggctctgggaaggcagnttcactgaaaacatcttatttctatgaggcttttc

SEQ ID NO: 23194 - DNA, 71 bp, chicken (Gallus Gallus)
  misc_feature (36): n=a or g
tgtcagaagcatattgctgatctgcatgcaggttcnaattccacttccttttggttttgttataaaacatc

SEQ ID NO: 23195 - DNA, 71 bp, chicken (Gallus Gallus)
  misc_feature (36): n=c or t
ggagcttaacagctcatcacactttcaagaaaatanatattgtgaagataggacaattaatatcttgcaga

SEQ ID NO: 23196 - DNA, 71 bp, chicken (Gallus Gallus)
  misc_feature (36): n=c or t
tgacaaacttctccaatcatgaaaaggaagaatctntactggtggactcagttccagatagtataaatcta

SEQ ID NO: 23197 - DNA, 71 bp, chicken (Gallus Gallus)
  misc_feature (36): n=g or t
gttttattattactttgcaaaaatgaagctcctagntacagcagcctatcctgaagacactgaacatatct

SEQ ID NO: 23198 - DNA, 71 bp, chicken (Gallus Gallus)
  misc_feature (36): n=c or t
atacgagtgttcaacgcacctgcatacagagcatcntgagatgcattagcacatcctcttggtgtcctctg

SEQ ID NO: 23199 - DNA, 71 bp, chicken (Gallus Gallus)
  misc_feature (36): n=c or t
ccatgcttttcgcagacattagcagaatgagacagntcatctgcagtttatattggcttcaagattttata

SEQ ID NO: 23200 - DNA, 71 bp, chicken (Gallus Gallus)
  misc_feature (36): n=a or c
tcaacgtcttcatcagcaacatggatgaagggatanagtgtgtaccctcagcaagtttgctgacaatacaa

SEQ ID NO: 23201 - DNA, 71 bp, chicken (Gallus Gallus)
  misc_feature (36): n=a or g
tctgtttggcattctctttttttaaagaagaaaacncaaaccccactaatcgctttcatttacagaggact

SEQ ID NO: 23202 - DNA, 71 bp, chicken (Gallus Gallus)
  misc_feature (36): n=a or c
aacagtttgagtcataaacctatgacaatggggctntggttctcttactgtgacaaagaaataagaaaggt

SEQ ID NO: 23203 - DNA, 71 bp, chicken (Gallus Gallus)
  misc_feature (36): n=c or t
ctcattggaactttagtgctaaaaacacgtgcttcnaggactcagacagtattttgattttctgctttaaa

SEQ ID NO: 23204 - DNA, 71 bp, chicken (Gallus Gallus)
  misc_feature (36): n=c or t
agatagaagaaacttttggatacctatcacgtgttntgggaagaaggggtcatggctgcagcacaagtgga

SEQ ID NO: 23205 - DNA, 71 bp, chicken (Gallus Gallus)
  misc_feature (36): n=c or t
agatggcagtgtcaggaagggatggtgttcaggggntgaagtttctgggctttgcagtgaggacttgtcca

SEQ ID NO: 23206 - DNA, 71 bp, chicken (Gallus Gallus)
  misc_feature (36): n=c or t
actcacatcaaaccagactactcagagtaagtctcntcatctgggatgaaaatggcaaaatctgcacttgg

SEQ ID NO: 23207 - DNA, 71 bp, chicken (Gallus Gallus)
  misc_feature (36): n=c or t
taaaaataattaacctaccagttaaacacataaaangtctgactacactgagtccagatttaaaaacattt

SEQ ID NO: 23208 - DNA, 71 bp, chicken (Gallus Gallus)
  misc_feature (36): n=c or t
tcagtgttttacaagaacttcacggccttggcagtntccctcacttcagttgttatcaaggaaaaaaaaag

SEQ ID NO: 23209 - DNA, 71 bp, chicken (Gallus Gallus)
  misc_feature (36): n=a or g
catctccctgattgattagcatttgtaataaactgntcagaccaccatttgaactattgtttcttaatccc

SEQ ID NO: 23210 - DNA, 71 bp, chicken (Gallus Gallus)
  misc_feature (36): n=a or g
tacattatccatcatgaaatgaagatatggacaaanactggaagtaaatccatacacacactacgaaggtt

SEQ ID NO: 23211 - DNA, 71 bp, chicken (Gallus Gallus)
  misc_feature (36): n=c or t
atgatatttcctgttttttcacacgttacgggacanacagagaaacctattgaaacagccatggtttaaca

SEQ ID NO: 23212 - DNA, 71 bp, chicken (Gallus Gallus)
  misc_feature (36): n=a or g
agcttacagaaaggtggctctacaaagtgatatgcntttctcagagaagcaagagaatggaaatgggaacc

SEQ ID NO: 23213 - DNA, 71 bp, chicken (Gallus Gallus)
  misc_feature (36): n=c or t
aggttaatacaaaggggtctcttggggttcctgtgncacactgtttttgccactcaggatgatctcttaaa

SEQ ID NO: 23214 - DNA, 71 bp, chicken (Gallus Gallus)
  misc_feature (36): n=c or t
atctctcagtaataagttaaaggaagtatataaacngcctttgatctagttggtgcatgtcagattttgca

SEQ ID NO: 23215 - DNA, 71 bp, chicken (Gallus Gallus)
  misc_feature (36): n=a or g
gtgagttttttgttgtttctttttctcatacaaaangcctttttacttaaaggatgacaataaactcttaa

SEQ ID NO: 23216 - DNA, 71 bp, chicken (Gallus Gallus)
  misc_feature (36): n=a or g
gaaaacccctacttaaacttaggggaatggctgtgntaggcagaattctggtgtgaagccttctttctcct

SEQ ID NO: 23217 - DNA, 71 bp, chicken (Gallus Gallus)
  misc_feature (36): n=c or g
gggaggcatttggatgtggggactctgaacaactcncagagcaagcaggcactgggcagaagctgctggag

SEQ ID NO: 23218 - DNA, 71 bp, chicken (Gallus Gallus)
  misc_feature (36): n=a or g
aggcgatgggcattcacaaagtggacttaactgaantttcacaagcattctcatttttagtatttcttaac

SEQ ID NO: 23219 - DNA, 71 bp, chicken (Gallus Gallus)
  misc_feature (36): n=a or t
gtaggagctgtggttgatggcaataggactgaaatngtggtctacagagccagggttctggcaacagtagc

SEQ ID NO: 23220 - DNA, 71 bp, chicken (Gallus Gallus)
  misc_feature (36): n=a or g
gtgaagtggttatggagggtgggaaatacaacaaanatggaagaattttaaattctgaggacctgctccct

SEQ ID NO: 23221 - DNA, 71 bp, chicken (Gallus Gallus)
  misc_feature (36): n=c or t
agacttgtgtgtgttattggcaaaaattgatgttangtaaacgtgacattggcatcctacttgataaaaaa

SEQ ID NO: 23222 - DNA, 71 bp, chicken (Gallus Gallus)
  misc_feature (36): n=g or t
gcataccagaagccctcaatttttacactgaagagnttttggtaacctgccaaatctctgaggctgttcac

SEQ ID NO: 23223 - DNA, 71 bp, chicken (Gallus Gallus)
  misc_feature (36): n=c or t
ctgaggagcttggtgaccttcggtttgctttgctcnatttggtttgccgtcccgtgcagtgggcttttgtt

SEQ ID NO: 23224 - DNA, 71 bp, chicken (Gallus Gallus)
  misc_feature (36): n=c or t
aagtattttgaggccttttggtggagaagggaatgngaggtgatgaaagtgagagatgctaagcttcattt

SEQ ID NO: 23225 - DNA, 71 bp, chicken (Gallus Gallus)
  misc_feature (36): n=a or c
atgcataatttgcacataaagaaatgtagtattganagtttagtactgaactttctatttttcctgtattt

SEQ ID NO: 23226 - DNA, 71 bp, chicken (Gallus Gallus)
  misc_feature (36): n=a or g
cttatcttaattcattctgaaaagaaaaggtcacangaggagaggttccagcgtaaaggagtggagctgat

SEQ ID NO: 23227 - DNA, 71 bp, chicken (Gallus Gallus)
  misc_feature (36): n=a or g
gaatgcctccagtgaataaaggtaaatgacttcaanacaagcatatcacatagagttcaagagcaccttta

SEQ ID NO: 23228 - DNA, 71 bp, chicken (Gallus Gallus)
  misc_feature (36): n=a or g
gcagatcaagtccactcttcagtgtaggcaataagntcaaaaatgatgatacaggaaaacaaagatactga

SEQ ID NO: 23229 - DNA, 71 bp, chicken (Gallus Gallus)
  misc_feature (36): n=g or t
cctcccacacctaagagcaactgccagatagacaangagaagtcacggtcttccatatcgcgagtttctta

SEQ ID NO: 23230 - DNA, 71 bp, chicken (Gallus Gallus)
  misc_feature (36): n=g or t
atattactttcacggttagttcatttaggtgttttngggaaagtctaaaacagataaagtaaaacctgctc

SEQ ID NO: 23231 - DNA, 71 bp, chicken (Gallus Gallus)
  misc_feature (36): n=a or g
accatgctctagctaataagattagaatctcagaangagcgcgcacagattattaagatttaaatatatac

SEQ ID NO: 23232 - DNA, 71 bp, chicken (Gallus Gallus)
  misc_feature (36): n=c or t
gagcttgcctggagcctttgcctaggtgtaattcangagatacctctcagctgttccaaaacagaaggacg

SEQ ID NO: 23233 - DNA, 71 bp, chicken (Gallus Gallus)
  misc_feature (36): n=a or c
cctcaaaaagaagcaaactcggtaagagaagttatnttctaacaaaccattgaatgccattaaaagaaaaa

SEQ ID NO: 23234 - DNA, 71 bp, chicken (Gallus Gallus)
  misc_feature (36): n=a or g
catgttaacataaacatttctgtttctcacttattncaaaagatatatagggcacttatttttgaataact

SEQ ID NO: 23235 - DNA, 71 bp, chicken (Gallus Gallus)
  misc_feature (36): n=a or c
gaaggttttagtagactccatatcctgcactcaaanatttctcatccatgagagtgtcttacccattatat

SEQ ID NO: 23236 - DNA, 71 bp, chicken (Gallus Gallus)
  misc_feature (36): n=a or c
acaaacaaacaaaaaaaacaaaaaagaaaaaccagncacaatcatattgaacggtcttaatagcaattgtg

SEQ ID NO: 23237 - DNA, 71 bp, chicken (Gallus Gallus)
  misc_feature (36): n=c or g
gaaaagtgcatcttttcgagaacactcatcagaagnaaaatgctgcagtaattcatgaaaagaatatgcag

SEQ ID NO: 23238 - DNA, 71 bp, chicken (Gallus Gallus)
  misc_feature (36): n=c or t
tcttttccacattccctaaaatatgtgctgaaagcntccacttaagacaaagtttggaatataactgaaag

SEQ ID NO: 23239 - DNA, 71 bp, chicken (Gallus Gallus)
  misc_feature (36): n=c or t
aatatccctgctttttctttccaagttacattattngtccttcctccctcactccatccaacacagatgca

SEQ ID NO: 23240 - DNA, 71 bp, chicken (Gallus Gallus)
  misc_feature (36): n=a or g
aacaaatcagaatttctgaggcttcccagttttgcnacaggtttcttacaaacttcatgtcctggtcacat

SEQ ID NO: 23241 - DNA, 71 bp, chicken (Gallus Gallus)
  misc_feature (36): n=a or g
ttattgattgcataccatctcttacaatttgctctngtaggaggatgtttgtgtgcagtcctgctggcata

SEQ ID NO: 23242 - DNA, 71 bp, chicken (Gallus Gallus)
  misc_feature (36): n=c or t
tctgacggtcagtctgaagacataaatgacttcttntcctaaagctcctctacaagctgatacagatggaa

SEQ ID NO: 23243 - DNA, 71 bp, chicken (Gallus Gallus)
  misc_feature (36): n=c or t
ttacaatctgttaaacacccttccatatttgcacanttgcacattttaataaaaaatgttttcctctcatg

SEQ ID NO: 23244 - DNA, 71 bp, chicken (Gallus Gallus)
  misc_feature (36): n=c or t
agctcatcacatctcacaaccttaggcagaatttcngcctaggtgagcacttggtagtttcaccatgccca

SEQ ID NO: 23245 - DNA, 71 bp, chicken (Gallus Gallus)
  misc_feature (36): n=c or t
gcttgccttcagtggcaagaaacatttaatgtaaangtagaggtgctttatgccgcaagaacagaccaagt

SEQ ID NO: 23246 - DNA, 71 bp, chicken (Gallus Gallus)
  misc_feature (36): n=a or g
tcttacaaatactgattaaaaaaccctgccactcantaactcctttgatggctgtatgaggaaaaatgaaa

SEQ ID NO: 23247 - DNA, 71 bp, chicken (Gallus Gallus)
  misc_feature (36): n=c or t
gtctttcacctagtggcatattttgtatcgttacanataaagaaatttttaagtgtgaaatttgaggagag

SEQ ID NO: 23248 - DNA, 71 bp, chicken (Gallus Gallus)
  misc_feature (36): n=a or t
taatcagaaaaccaagccatggctgaatgcctcatnctgagaagggacatttataaacacatcacctgtaa

SEQ ID NO: 23249 - DNA, 71 bp, chicken (Gallus Gallus)
  misc_feature (36): n=c or t
gcaaaattgccaaacctcatgatatgtacagtgctntctggaagactgtacactgcagttacttgaatata

SEQ ID NO: 23250 - DNA, 71 bp, chicken (Gallus Gallus)
  misc_feature (36): n=a or t
gtaaaccttctaattgcagaatttggaatctaattnaacagaggactaagctattgggtatgatggaaact

SEQ ID NO: 23251 - DNA, 71 bp, chicken (Gallus Gallus)
  misc_feature (36): n=a or g
ttctgtctgaggtggcactgatcaagatgagttctnccttattattttccttttacgtgtcttaacacgtt

SEQ ID NO: 23252 - DNA, 71 bp, chicken (Gallus Gallus)
  misc_feature (36): n=a or t
actgggccagacctgtaatttgttttctctaacatntattttccctcttctgcacatcttttgttttgctg

SEQ ID NO: 23253 - DNA, 71 bp, chicken (Gallus Gallus)
  misc_feature (36): n=c or t
tttgctttcaggatgcaattggacagagtgacaganaacctcatctaggctcctttgtcccaggaaaagtt

SEQ ID NO: 23254 - DNA, 71 bp, chicken (Gallus Gallus)
  misc_feature (36): n=a or g
tatagcattaccacgttatgcaatagtgttgcaagntgtacttagtgaacaaatatctcttcagatttata

SEQ ID NO: 23255 - DNA, 71 bp, chicken (Gallus Gallus)
  misc_feature (36): n=c or t
aatatgcatctctaagactggataaaagatatatgntagaataataaataaacacaacatagaagccagcc

SEQ ID NO: 23256 - DNA, 71 bp, chicken (Gallus Gallus)
  misc_feature (36): n=a or g
ggaaagagaataagctgagttacatttgtttgcccncagcttcctccagcagagcttgccagtgaatgaaa

SEQ ID NO: 23257 - DNA, 71 bp, chicken (Gallus Gallus)
  misc_feature (36): n=a or g
catggggctgtgcatagtttgaaacagaagttcacnttacacatgtggatgtcagtggaagagggaaaata

SEQ ID NO: 23258 - DNA, 71 bp, chicken (Gallus Gallus)
  misc_feature (36): n=g or t
gtcaatgtgttcatttatagcagagagaaacttctncacaaagcttgttctaccaaaaccacaatctgtca

SEQ ID NO: 23259 - DNA, 71 bp, chicken (Gallus Gallus)
  misc_feature (36): n=a or g
ctccagattgtcttagatctgtactatgcaaaatcnctggctgaacaggaatctattgcatttgataggac

SEQ ID NO: 23260 - DNA, 71 bp, chicken (Gallus Gallus)
  misc_feature (36): n=c or t
tcatttgagtgacaacaggtagttaaaatcttcagngttccgtgacaggaatagctatagtttctggtaac

SEQ ID NO: 23261 - DNA, 71 bp, chicken (Gallus Gallus)
  misc_feature (36): n=a or g
tataccaaatcctgaccaggcattgaagaccgctgngtaggcccacgggtagcaaagggtccgcccgtgtg

SEQ ID NO: 23262 - DNA, 71 bp, chicken (Gallus Gallus)
  misc_feature (36): n=a or g
tcctgacacaagcaagaaagaaagaatcaagccatnctgccagagacattttgacccatcagtaacaattc

SEQ ID NO: 23263 - DNA, 71 bp, chicken (Gallus Gallus)
  misc_feature (36): n=a or t
ctgacataaccactcaacttcagaaaagtaaacaangtccctgtaatcagcatctgtacttttaaggaatt

SEQ ID NO: 23264 - DNA, 71 bp, chicken (Gallus Gallus)
  misc_feature (36): n=c or t
atgctagttataggtgacattttaatatttaaatgnatgactgcaaaatttttatgtcttatttctttgct

SEQ ID NO: 23265 - DNA, 71 bp, chicken (Gallus Gallus)
  misc_feature (36): n=c or t
gcatttccaggcacactgacacaggattttcacaanggaaagccatttttactatcaatgctatcagcacg

SEQ ID NO: 23266 - DNA, 71 bp, chicken (Gallus Gallus)
  misc_feature (36): n=a or g
atactgtcaacctggataaaaatgtctataaatacntatgtacagctctgacattttattccaacgtatga

SEQ ID NO: 23267 - DNA, 71 bp, chicken (Gallus Gallus)
  misc_feature (36): n=c or t
ttttacttttgacagttttcaagaagcatggcatgncagcgagttgagcagatatgcaaaactgcagctgc

SEQ ID NO: 23268 - DNA, 71 bp, chicken (Gallus Gallus)
  misc_feature (36): n=c or t
ggtagttcacacacggccgctcctaactaatcattnactgcatgaaaataatgacttcttgacaaaataag

SEQ ID NO: 23269 - DNA, 71 bp, chicken (Gallus Gallus)
  misc_feature (36): n=c or g
caatcccagttccctcagttcaaatactgactgctncctcggtgtgtcatgtcttagttgtctccattttg

SEQ ID NO: 23270 - DNA, 71 bp, chicken (Gallus Gallus)
  misc_feature (36): n=c or t
tgtctaaacttccttcacaaaggcaatgtagaaganagggaagcaaagaagagctgaggcaaatactaagg

SEQ ID NO: 23271 - DNA, 71 bp, chicken (Gallus Gallus)
  misc_feature (36): n=a or c
ggtctgaattcagagctgcctctgctttgagcaggnggctggactagaaacctactgaggtacctttccac

SEQ ID NO: 23272 - DNA, 71 bp, chicken (Gallus Gallus)
  misc_feature (36): n=c or t
ccacgatgcatccaacataagtgcagatgttctacnctgccaggtacatgcaataagccaacacttcccag

SEQ ID NO: 23273 - DNA, 71 bp, chicken (Gallus Gallus)
  misc_feature (36): n=a or g
acccaagcatagcctattgaagaagggaaggggctntgcaagacaggagaacgagacagtgctaaggtcca

SEQ ID NO: 23274 - DNA, 71 bp, chicken (Gallus Gallus)
  misc_feature (36): n=a or g
actcagtatttcagacattatctcacagttgcccangatggtgacatccattttagaagttaacttctagt

SEQ ID NO: 23275 - DNA, 71 bp, chicken (Gallus Gallus)
  misc_feature (36): n=a or g
agaatcgttttctcatgtgatgaacaagaactcaanttgtatcaaaaatcaaatgtaagcgtgttctacaa

SEQ ID NO: 23276 - DNA, 71 bp, chicken (Gallus Gallus)
  misc_feature (36): n=c or t
gaatcccaatgcaaaacttacttccaaacttccacncataccgctgatactgagtacagtgcatctgcatg

SEQ ID NO: 23277 - DNA, 71 bp, chicken (Gallus Gallus)
  misc_feature (36): n=c or t
tctgtggtccccagttcaaaaccttcccaatctgcngagtggagtagcttaaatactgacaaccatttaag

SEQ ID NO: 23278 - DNA, 71 bp, chicken (Gallus Gallus)
  misc_feature (36): n=a or g
tcactgtttttcaacacagtcacaatttactatgcntttacatctttcagtcaggtaagttaaagagataa

SEQ ID NO: 23279 - DNA, 71 bp, chicken (Gallus Gallus)
  misc_feature (36): n=a or g
tccctgcggtaactgtggtaacaaaattccctttangaggaacaggcctttcattccttactcagttcaga

SEQ ID NO: 23280 - DNA, 71 bp, chicken (Gallus Gallus)
  misc_feature (36): n=c or t
gatgctaatattacggcagataaaaatgagcatttnatattctattcgtacatctactgatccccagctgg

SEQ ID NO: 23281 - DNA, 71 bp, chicken (Gallus Gallus)
  misc_feature (36): n=a or g
tgttccaaaagttgcaaagctactgtcttcgcttcnagtccttagatacagtggtgaaaataacctttgaa

SEQ ID NO: 23282 - DNA, 71 bp, chicken (Gallus Gallus)
  misc_feature (36): n=a or g
gtaactaaactacagtgtcttcaactgttggttacnggcaggtcatcctccatccccaatgctcgttcata

SEQ ID NO: 23283 - DNA, 71 bp, chicken (Gallus Gallus)
  misc_feature (36): n=c or t
caggggcaagcatttatccctcatttcatcacccanagtcagtttgtatttggccaggaccaagacacaaa

SEQ ID NO: 23284 - DNA, 71 bp, chicken (Gallus Gallus)
  misc_feature (36): n=c or t
taaagcataacatctactgggacggctgtgccattnaccaaaatgtcattactccacttgagtaaactaaa

SEQ ID NO: 23285 - DNA, 71 bp, chicken (Gallus Gallus)
  misc_feature (36): n=c or t
cttctgagtgttttcttcagtatacttttttcagtnctgtgtcttattctctttccttgcatcatgtatcc

SEQ ID NO: 23286 - DNA, 71 bp, chicken (Gallus Gallus)
  misc_feature (36): n=a or g
gggtcagtcatatgtgcatggaagagtaaactcacngggcctttaaatcagtcagtatttctcacagttgg

SEQ ID NO: 23287 - DNA, 71 bp, chicken (Gallus Gallus)
  misc_feature (36): n=c or t
aactaatgttaatgaattctgcataccataaatagngaattacccctgccagtacaaacatccacaaagat

SEQ ID NO: 23288 - DNA, 71 bp, chicken (Gallus Gallus)
  misc_feature (36): n=c or t
tacattccattccttgcagcgtgctcaaatagctgntgagatagcttcctggttttccatctcctatttga

SEQ ID NO: 23289 - DNA, 71 bp, chicken (Gallus Gallus)
  misc_feature (36): n=g or t
aaacatggcagaccttcacgttaatcagtgagaggnaaaggtagggatgcttgctcattaacatcagcctg

SEQ ID NO: 23290 - DNA, 71 bp, chicken (Gallus Gallus)
  misc_feature (36): n=c or t
tcagtgcagatttgccatgacactcacatggctggntaaagcatgctgcagctttgaacttttgctgtttt

SEQ ID NO: 23291 - DNA, 71 bp, chicken (Gallus Gallus)
  misc_feature (36): n=c or t
tctcagtgcagtttagagcagatcatctcaagtagngttcttaggataagattattttctcggcctctcta

SEQ ID NO: 23292 - DNA, 71 bp, chicken (Gallus Gallus)
  misc_feature (36): n=a or t
tttggggcccacgagttgaagatgtagtcactgagntactgaacaatactgagatggcttctgcagtactg

SEQ ID NO: 23293 - DNA, 71 bp, chicken (Gallus Gallus)
  misc_feature (36): n=c or t
ttaaatacataactgcttttactgcttgtgtcattntctttcataccgaatagttccattttctgtgtttt

SEQ ID NO: 23294 - DNA, 71 bp, chicken (Gallus Gallus)
  misc_feature (36): n=c or t
agaaacacgagccctttgtttttagtaccaaaaaangcccatttatatttagagtatcttgaaaaactact

SEQ ID NO: 23295 - DNA, 71 bp, chicken (Gallus Gallus)
  misc_feature (36): n=c or t
tttatcacactacaagctactctgtaagaaagtatntggaattagttgctttctgatacttataaagttac

SEQ ID NO: 23296 - DNA, 71 bp, chicken (Gallus Gallus)
  misc_feature (36): n=a or c
gttaggtaggcctgcctccagttctgagcttttgcntgagtttgtggaccatccaactagtggcaccaaca

SEQ ID NO: 23297 - DNA, 71 bp, chicken (Gallus Gallus)
  misc_feature (36): n=c or t
tcagcactgaatactggacgtggcagcaaagcagcnccaaaattaccagatgaggtgaatgaaaagctggc

SEQ ID NO: 23298 - DNA, 71 bp, chicken (Gallus Gallus)
  misc_feature (36): n=g or t
cttcccctttatagttgccttggcaccacttagtgntgcgtgataggtgagggtgagaagtaatgggaaga

SEQ ID NO: 23299 - DNA, 71 bp, chicken (Gallus Gallus)
  misc_feature (36): n=c or t
caagaaatggagaataagtccttttgaatgaaatanaaaaagctattacctcctgtagtaattaagtttta

SEQ ID NO: 23300 - DNA, 71 bp, chicken (Gallus Gallus)
  misc_feature (36): n=a or g
gtctttgacacagtggaaaaaggaaagatattaccncaactgagcactgagactttaatatggggaatata

SEQ ID NO: 23301 - DNA, 71 bp, chicken (Gallus Gallus)
  misc_feature (36): n=c or t
tcacctacacagattcctacagggatggatacttgncatatggctgagcagaatgagcgcattccactcct

SEQ ID NO: 23302 - DNA, 71 bp, chicken (Gallus Gallus)
  misc_feature (36): n=a or c
taagggcaggatagctgttatttctgtaccaacaanaaaaaaaaaaaaaaaaaaaaaaaaaaaaaaaaaaa

SEQ ID NO: 23303 - DNA, 71 bp, chicken (Gallus Gallus)
  misc_feature (36): n=g or t
tatactccaaatcctcagtataggtcaatcctatanctcagtgactttaatgcagcagtgatgattttggc

SEQ ID NO: 23304 - DNA, 71 bp, chicken (Gallus Gallus)
  misc_feature (36): n=a or c
aacctcatgcagcaggagctgctgtcctaaggctgntgcttcagaagggtgagatggtaggaagctgtaag

SEQ ID NO: 23305 - DNA, 71 bp, chicken (Gallus Gallus)
  misc_feature (36): n=a or g
ttgccccttcatatcattttaggttctaaaaacccnccagttccaagaatgagttagaatctcaaacttgt

SEQ ID NO: 23306 - DNA, 71 bp, chicken (Gallus Gallus)
  misc_feature (36): n=a or c
gtaagatttatgtccttcctcagtacgttagagacnaagttacatgtctgctcttagtaacctgtggcttc

SEQ ID NO: 23307 - DNA, 71 bp, chicken (Gallus Gallus)
  misc_feature (36): n=a or c
actgcacacaaacagtctgcaaggtataaagatgtnatttttgtttccctacttaacaaatttgagtatga

SEQ ID NO: 23308 - DNA, 71 bp, chicken (Gallus Gallus)
  misc_feature (36): n=a or c
aaaaaatagacaagctttaaatagtcttagaggttncctggttttcctaagagtagcaatttctcctgtaa

SEQ ID NO: 23309 - DNA, 71 bp, chicken (Gallus Gallus)
  misc_feature (36): n=c or t
accagagaggatgagttgggcaggggacaaactgangtccagcattcgagcatcagctggaaagtgtgagg

SEQ ID NO: 23310 - DNA, 71 bp, chicken (Gallus Gallus)
  misc_feature (36): n=a or g
taagatgtttataagatgttgcagtagccatgtcanaacagtttcatgaaagtagctgtgtatggagctgt

SEQ ID NO: 23311 - DNA, 71 bp, chicken (Gallus Gallus)
  misc_feature (36): n=c or t
gtgatcccacagcggtcttttcagtacaaaagaggngcagcccacagcctctgggacctcccaggagattg

SEQ ID NO: 23312 - DNA, 71 bp, chicken (Gallus Gallus)
  misc_feature (36): n=a or c
atgataaacgtctgccatgctttttctttacttagngcatccagtgctgttggaatcaaagcaaaacatag

SEQ ID NO: 23313 - DNA, 71 bp, chicken (Gallus Gallus)
  misc_feature (36): n=c or t
aatgaatttcagtagcatggaagaacctgtaaatcnctcagtcattttgttaaatttctcctttatttctc

SEQ ID NO: 23314 - DNA, 71 bp, chicken (Gallus Gallus)
  misc_feature (36): n=g or t
tcatttttctcaaaattgcctgaaatgctgaaaaanggaaaccacatccttccattgtccattctttcaat

SEQ ID NO: 23315 - DNA, 71 bp, chicken (Gallus Gallus)
  misc_feature (36): n=a or c
acagcacctcaataattttaatggaagagtggaatnattttttgccctagcaatcaactggccagcaaacg

SEQ ID NO: 23316 - DNA, 71 bp, chicken (Gallus Gallus)
  misc_feature (36): n=c or t
gggcagcactggcgcaggttctctctgcattttganacctttgaaagacttctccttcacgttgatgtgga

SEQ ID NO: 23317 - DNA, 71 bp, chicken (Gallus Gallus)
  misc_feature (36): n=a or g
ttttgcttaaaaccattcccccttgtcctatcactnttttcccatgtaaaaacttgacttatttcctgctt

SEQ ID NO: 23318 - DNA, 71 bp, chicken (Gallus Gallus)
  misc_feature (36): n=c or g
aaaactcagcagatgtatttcatgagatatataacnttttcaaagctcattttttttatcctgaaggcata

SEQ ID NO: 23319 - DNA, 71 bp, chicken (Gallus Gallus)
  misc_feature (36): n=a or g
caataggatctggaggatagacgtggagtttcccanttctcatgtgggaggtggaaagtatgaaggagctg

SEQ ID NO: 23320 - DNA, 71 bp, chicken (Gallus Gallus)
  misc_feature (36): n=a or c
gagtggttaaccatggcaacacctaaaaataattgntcttacttcatcaagcataaggaatgcctaattta

SEQ ID NO: 23321 - DNA, 71 bp, chicken (Gallus Gallus)
  misc_feature (36): n=c or t
ccaaactgctgtctctgtccagaccagaagatctgntttttcagataaatgctctccgttcccgtacagca

SEQ ID NO: 23322 - DNA, 71 bp, chicken (Gallus Gallus)
  misc_feature (36): n=a or g
ccacatggtgcctttgtgcagaatgtggttccaaancatctacctttgcaccagccatgccaataatacgt

SEQ ID NO: 23323 - DNA, 71 bp, chicken (Gallus Gallus)
  misc_feature (36): n=a or c
tcttttcacagcgtattaatctaagtgtgatctttntagcaaggataaaaacattaggtataaattagcaa

SEQ ID NO: 23324 - DNA, 71 bp, chicken (Gallus Gallus)
  misc_feature (36): n=a or g
agggaatcagaagccagctatcaacagcatcacaantctagtatactcctatgataaattgaatgccaaat

SEQ ID NO: 23325 - DNA, 71 bp, chicken (Gallus Gallus)
  misc_feature (36): n=g or t
atctccctcagcagcatgttatccctaattcattgnctgtctgaagaagccttacaagagatctaaattga

SEQ ID NO: 23326 - DNA, 71 bp, chicken (Gallus Gallus)
  misc_feature (36): n=c or t
atttttctatacttctaaacactatgaatcacttanggaaagaatctgattattttatgttattcataagt

SEQ ID NO: 23327 - DNA, 71 bp, chicken (Gallus Gallus)
  misc_feature (36): n=c or t
ttagacattcctatgacatttgcaatcttacagttnctatgccggttgaaacaataaaaagacgatccaca

SEQ ID NO: 23328 - DNA, 71 bp, chicken (Gallus Gallus)
  misc_feature (36): n=c or t
ttcttcttttgcacagaagtagcacataatctttanggaaagaaggttctgtttggcaagtctcagagcta

SEQ ID NO: 23329 - DNA, 71 bp, chicken (Gallus Gallus)
  misc_feature (36): n=c or t
gcttcaggtctcactcaaagacagaagtcaggaagngaatttagcaaggatgtgaggagttgtaccacata

SEQ ID NO: 23330 - DNA, 71 bp, chicken (Gallus Gallus)
  misc_feature (36): n=a or t
aggctgaaaatatgctgcttccacctctgagctttntaattccagaagcagggttggtgctttctatctgg

SEQ ID NO: 23331 - DNA, 71 bp, chicken (Gallus Gallus)
  misc_feature (36): n=a or g
aaattattgatctctacaagcgaactgaaaccaccnctggaattctgcaggaatctgcactattcaacaca

SEQ ID NO: 23332 - DNA, 71 bp, chicken (Gallus Gallus)
  misc_feature (36): n=c or t
tgtcacaattaaatccccagtttggctacaccaggntggtggcatataatattattggttttcttttacca

SEQ ID NO: 23333 - DNA, 71 bp, chicken (Gallus Gallus)
  misc_feature (36): n=a or g
catttcagaaaacaagctgaacaaaaggctgtaacntgctaataattccatctgcatggatatagttctgt

SEQ ID NO: 23334 - DNA, 71 bp, chicken (Gallus Gallus)
  misc_feature (36): n=a or g
gaagctagagcttttttgtacagtcgcagagtcatngaatatcctgagttggaaggaacccataaggatca

SEQ ID NO: 23335 - DNA, 71 bp, chicken (Gallus Gallus)
  misc_feature (36): n=a or g
tagtcttcagttttcgcttccatttcctcagcatcntcatctccatccacttcagcattttccctctccag

SEQ ID NO: 23336 - DNA, 71 bp, chicken (Gallus Gallus)
  misc_feature (36): n=a or t
ctgaataaagcatccaataacatagagcaatattgntgtgcaaaccaaaagaagctaacacctgaatacat

SEQ ID NO: 23337 - DNA, 71 bp, chicken (Gallus Gallus)
  misc_feature (36): n=c or t
aataaagcagttgagtgaatttagctgcagttttgntgggacttgtatgagtgaggttttcgaagagttgt

SEQ ID NO: 23338 - DNA, 71 bp, chicken (Gallus Gallus)
  misc_feature (36): n=a or g
gacaatgtgcaggaagaggtttgggactcattcccngtaggtactcatttcagatgatccttcttcactat

SEQ ID NO: 23339 - DNA, 71 bp, chicken (Gallus Gallus)
  misc_feature (36): n=c or t
aaggggatttaagttttttcctcctgttttcaaatntctttggaagacccagcattgcattggagttacgg

SEQ ID NO: 23340 - DNA, 71 bp, chicken (Gallus Gallus)
  misc_feature (36): n=c or t
caaaattaggtttgggaatgagacacagattggtangcgtgtttgaaatatgcagtgctctgaagtaaaca

SEQ ID NO: 23341 - DNA, 71 bp, chicken (Gallus Gallus)
  misc_feature (36): n=a or g
aacaccattcttctttgtttaactgaagctcatgcnctgctggcagcaaggtggcagagaactgctcagga

SEQ ID NO: 23342 - DNA, 71 bp, chicken (Gallus Gallus)
  misc_feature (36): n=c or t
attattttttttcccaacagcaactaaaatgacttntttagatgttatctttatgaactaatctatttaga

SEQ ID NO: 23343 - DNA, 71 bp, chicken (Gallus Gallus)
  misc_feature (36): n=c or t
caatttattcttttgttgataccttggtgagtaaanccaggaaatgcagggcatggtgagctgtatctgac

SEQ ID NO: 23344 - DNA, 71 bp, chicken (Gallus Gallus)
  misc_feature (36): n=c or t
tttatcatgggccttgctgattgcagttaggagtgngatcctttttcctgacagcaccaagtgctacatag

SEQ ID NO: 23345 - DNA, 71 bp, chicken (Gallus Gallus)
  misc_feature (36): n=c or t
ctcaaaagaagagaaaaacaccctcttcctcacgangtttagcttttctttcacgctggttcccagttatc

SEQ ID NO: 23346 - DNA, 71 bp, chicken (Gallus Gallus)
  misc_feature (36): n=c or t
tttaaactaactgaattattttggtcacaatttagntttatagcagataaatgggaagacaagaaaacaaa

SEQ ID NO: 23347 - DNA, 71 bp, chicken (Gallus Gallus)
  misc_feature (36): n=a or c
ttttctttccccctgaatcaggcatgcttatttgcnagagctgattgcaatcaccagcatcttttgcaaga

SEQ ID NO: 23348 - DNA, 71 bp, chicken (Gallus Gallus)
  misc_feature (36): n=g or t
aaaaaggtttggtaaattcgaattggagcgcaggtnacttggagtctggcccttcacaggacgggtcagta

SEQ ID NO: 23349 - DNA, 71 bp, chicken (Gallus Gallus)
  misc_feature (36): n=a or g
taggagagggaaaaaaaaaagggcttttatttagcnacagtattactgtatgcaagaaaaaaatctcagtg

SEQ ID NO: 23350 - DNA, 71 bp, chicken (Gallus Gallus)
  misc_feature (36): n=a or g
tagcataatataggaaattgctaagtacaaccactncaaactggctggggtccatagaaacactgtgaaag

SEQ ID NO: 23351 - DNA, 71 bp, chicken (Gallus Gallus)
  misc_feature (36): n=c or t
tatgattctgtgatgtgtagagacagtgggaacctngggggtctgagtgggctgaggtgcccatggggtgg

SEQ ID NO: 23352 - DNA, 71 bp, chicken (Gallus Gallus)
  misc_feature (36): n=a or g
attgtaatggacaacatagccatagttctgcatgcntgaaaaaaaagaacatcttgttctgactttttgtt

SEQ ID NO: 23353 - DNA, 71 bp, chicken (Gallus Gallus)
  misc_feature (36): n=a or g
ggagtaataaatgaatatttatcttgcttttgccantgagataggattttctttcaatttctgagttcagg

SEQ ID NO: 23354 - DNA, 71 bp, chicken (Gallus Gallus)
  misc_feature (36): n=a or g
ccttctcttccctgtgattgtgttcaagaaggacantaggcaacatttgacctgttaattactagcatcaa

SEQ ID NO: 23355 - DNA, 71 bp, chicken (Gallus Gallus)
  misc_feature (36): n=a or c
aaattatgtgcattagttaaataagaaaaagcaganatttgttaaggaacagtccaaatagagcttcaaat

SEQ ID NO: 23356 - DNA, 71 bp, chicken (Gallus Gallus)
  misc_feature (36): n=a or g
tctttcattttgcactaccctcaggcctctttctcnaatccctctcacctcatcttactgtccacctacac

SEQ ID NO: 23357 - DNA, 71 bp, chicken (Gallus Gallus)
  misc_feature (36): n=c or g
ccattgccattgtcctgttgctggcctagccccacntacttgacacctacccttcagatgtttatcagtgt

SEQ ID NO: 23358 - DNA, 71 bp, chicken (Gallus Gallus)
  misc_feature (36): n=a or t
ctagtattctgtctgtctccagtaatggctcataangaatactttaaaacaaagcaaaacaaaacaacaaa

SEQ ID NO: 23359 - DNA, 71 bp, chicken (Gallus Gallus)
  misc_feature (36): n=c or t
gaggagaagatagatcaattgcatcaagaacaagcntttgctgatttctacatgttctcagagctgcttgg

SEQ ID NO: 23360 - DNA, 71 bp, chicken (Gallus Gallus)
  misc_feature (36): n=g or t
ctccaggcagctatgggttgctgctctaaattgggntctcacctgctttatctcacaggtatgtcagtcta

SEQ ID NO: 23361 - DNA, 71 bp, chicken (Gallus Gallus)
  misc_feature (36): n=a or t
cttaaaactttcatgggatcacaaaggaatagtgangaaccaagaataccatttgaaatttcttctgttca

SEQ ID NO: 23362 - DNA, 71 bp, chicken (Gallus Gallus)
  misc_feature (36): n=a or g
cttatactgttatagaaatataatattttctgcaantatttccttagtgcaattttaagtcattttgaaga

SEQ ID NO: 23363 - DNA, 71 bp, chicken (Gallus Gallus)
  misc_feature (36): n=a or g
tctattcgaagtcttcatcatgcaaaggtgcctaanaacgagaccgaccaaatcccgggtttggtcttgat

SEQ ID NO: 23364 - DNA, 71 bp, chicken (Gallus Gallus)
  misc_feature (36): n=a or c
acttcaaagtacaaataacctaggctatttctaacnctctgtactaccaaacgcaggcttttatgcaagag

SEQ ID NO: 23365 - DNA, 71 bp, chicken (Gallus Gallus)
  misc_feature (36): n=a or g
aacacatccgctcactcatctgccctccatactccntgccaacgcacacaggtagctttaggtacagctaa

SEQ ID NO: 23366 - DNA, 71 bp, chicken (Gallus Gallus)
  misc_feature (36): n=a or c
cacccaaaatctttatacagtattggtttgtagtgntgatttgctacacagaaatgtcaactcagtgctca

SEQ ID NO: 23367 - DNA, 71 bp, chicken (Gallus Gallus)
  misc_feature (36): n=a or g
caagttctatcattaacatttctgtacttcaaaagnaagtagagtcagtgaagaagagaacatgagaagtt

SEQ ID NO: 23368 - DNA, 71 bp, chicken (Gallus Gallus)
  misc_feature (36): n=g or t
catgtatagttagttaatatattgcagtaagtcagntagtactaggaaaagctcttcacaattgacagcag

SEQ ID NO: 23369 - DNA, 71 bp, chicken (Gallus Gallus)
  misc_feature (36): n=a or g
tacaggaaacaacagcaagatcttgttttaagttantgcacttttatatttctaagcaagaaattaagatt

SEQ ID NO: 23370 - DNA, 71 bp, chicken (Gallus Gallus)
  misc_feature (36): n=a or g
tggtaaggagctttcttaaatgctttgaattctttnagtgccaaagttcatattggacttctttttaaatc

SEQ ID NO: 23371 - DNA, 71 bp, chicken (Gallus Gallus)
  misc_feature (36): n=a or g
agaggctttttgttcctcactgtgttatactttggncgtaacagtctctctcctgtgtttctttcccatca

SEQ ID NO: 23372 - DNA, 71 bp, chicken (Gallus Gallus)
  misc_feature (36): n=c or t
tagatagactgaaagtaatcttcagtaatgtccccngtgagagttaaaattgtgactcagaacaagcattt

SEQ ID NO: 23373 - DNA, 71 bp, chicken (Gallus Gallus)
  misc_feature (36): n=a or g
gtggctttcgtgagccgtcgggatccgttaggaacnaatcggttcttttaaccccgtgcagaataacgcgg

SEQ ID NO: 23374 - DNA, 71 bp, chicken (Gallus Gallus)
  misc_feature (36): n=c or g
agccagagaacactcatcatctttaactgtgaaganaagctctctttctccagagatgggaagtgggaatg

SEQ ID NO: 23375 - DNA, 71 bp, chicken (Gallus Gallus)
  misc_feature (36): n=a or g
ataatcatattaactctgatttttccagtaatttgnatctcatgtccagtttcaaactcagcagatgggca

SEQ ID NO: 23376 - DNA, 71 bp, chicken (Gallus Gallus)
  misc_feature (36): n=a or g
tggctctatctcagcttgatttccagagaagattcnttctctcaaagctaattttgcattgtttccataac

SEQ ID NO: 23377 - DNA, 71 bp, chicken (Gallus Gallus)
  misc_feature (36): n=a or c
ttatgggtgtttctttatatatgagcatgagacccnaaaaaaaaagagttagttttagaaatacgtgagag

SEQ ID NO: 23378 - DNA, 71 bp, chicken (Gallus Gallus)
  misc_feature (36): n=c or t
ttgcacacagtacacaactgcagaaagatttgtttnatcttagtttttaacttaaaccagaaagcagaatt

SEQ ID NO: 23379 - DNA, 71 bp, chicken (Gallus Gallus)
  misc_feature (36): n=g or t
aaaatggagaataaagcaaagaactccattttatanagatgttttacaaattttgcttgaaacttgtatac

SEQ ID NO: 23380 - DNA, 71 bp, chicken (Gallus Gallus)
  misc_feature (36): n=a or g
cacattactggactaaccctgatcaacaaactgagnatgatgtggcagaaggggagcacagctcacacctt

SEQ ID NO: 23381 - DNA, 71 bp, chicken (Gallus Gallus)
  misc_feature (36): n=a or c
agatggagattgggcaggatgtgatttattggaatntttcaatgcagagagaggaataatgaagatttcag

SEQ ID NO: 23382 - DNA, 71 bp, chicken (Gallus Gallus)
  misc_feature (36): n=c or t
ctactggatgtttgaaacagaatcttctctgatgantaaaaaaattaattttcatatgttcatagtgttgt

SEQ ID NO: 23383 - DNA, 71 bp, chicken (Gallus Gallus)
  misc_feature (36): n=c or g
gatcttcactgcaaacagctggcagcccaccagaancactgataatgcaaacacagtaaccagcacaggtc

SEQ ID NO: 23384 - DNA, 71 bp, chicken (Gallus Gallus)
  misc_feature (36): n=c or t
ttttttttttttcccataaaatggaagcaattaggnctgtctggggaatggatctgtccaccagtgagaca

SEQ ID NO: 23385 - DNA, 71 bp, chicken (Gallus Gallus)
  misc_feature (36): n=c or t
acaagagtaaaacagagtggggcaatcacctccctnaccctcatggctacccctcttttcacagaataata

SEQ ID NO: 23386 - DNA, 71 bp, chicken (Gallus Gallus)
  misc_feature (36): n=a or g
accctccccttcatggtgtagtgggtgtccttcacntctgtctaagttacacaatgcctcagcagtgcaca

SEQ ID NO: 23387 - DNA, 71 bp, chicken (Gallus Gallus)
  misc_feature (36): n=a or t
gcaatcatacacatattcacttacagcaaaattatntaggcccataaggcactggagaatgtctttttcaa

SEQ ID NO: 23388 - DNA, 71 bp, chicken (Gallus Gallus)
  misc_feature (36): n=c or t
ctctggtcacttgtgcaaggagcagcagccatcctnagctggtggcaatggtttctgtcacagttgtttga

SEQ ID NO: 23389 - DNA, 71 bp, chicken (Gallus Gallus)
  misc_feature (36): n=a or g
gtcacaaggcgactctgagatttcaaagtggggctntttgacgtgagagatggtctctggtgttgcaatgg

SEQ ID NO: 23390 - DNA, 71 bp, chicken (Gallus Gallus)
  misc_feature (36): n=g or t
accatcagtaatactgctgaggtcaatggtgatgantgtgttggaacagagaagcagactttctatataag

SEQ ID NO: 23391 - DNA, 71 bp, chicken (Gallus Gallus)
  misc_feature (36): n=a or g
ttagacttacatgttttaactggtcacagaaactantgcattagaaaggctcattaataagtactcaaaca

SEQ ID NO: 23392 - DNA, 71 bp, chicken (Gallus Gallus)
  misc_feature (36): n=a or g
taagatatctagccatgaaaaaccacctgacagccnctggtataggaaacacagttactcagctgctagaa

SEQ ID NO: 23393 - DNA, 71 bp, chicken (Gallus Gallus)
  misc_feature (36): n=g or t
tatgagaaggacagaacacttagggtagtgtgaagntaaatcaatgcccccgttacagtggaaggagtgtg

SEQ ID NO: 23394 - DNA, 71 bp, chicken (Gallus Gallus)
  misc_feature (36): n=a or g
ttttgtgaattatcttgcactttttaaaggacaatngcaatcatttggataatccctgagatttagctgac

SEQ ID NO: 23395 - DNA, 71 bp, chicken (Gallus Gallus)
  misc_feature (36): n=c or g
taaactaggtacgaaggggagtgggagtgtaactgnggtcattagaacggagcccgtttgtaacgtgccag

SEQ ID NO: 23396 - DNA, 71 bp, chicken (Gallus Gallus)
  misc_feature (36): n=a or t
gaagggttgcatggctttggtaggtctgtcatgttngcaaagttatgcattattcttcttctgggttgcat

SEQ ID NO: 23397 - DNA, 71 bp, chicken (Gallus Gallus)
  misc_feature (36): n=a or t
agaggaaaaacactcgttaatctgctctgttctctncccatttaaataaaacatcttttctcagatgtgta

SEQ ID NO: 23398 - DNA, 71 bp, chicken (Gallus Gallus)
  misc_feature (36): n=a or g
atgccacttggttggagtactgagagagtaaggganatgttgtccacacaggggagaggaaattctactga

SEQ ID NO: 23399 - DNA, 71 bp, chicken (Gallus Gallus)
  misc_feature (36): n=a or g
gtgtcaaagatgtgatggtgacacttcttattctancaccacaaaactgaccagaaaataatttggaacag

SEQ ID NO: 23400 - DNA, 71 bp, chicken (Gallus Gallus)
  misc_feature (36): n=a or g
gttaacacagactaatgtagtctagtaacatcattncttcaaactgtggtcttcaaactgatatcccaacc

SEQ ID NO: 23401 - DNA, 71 bp, chicken (Gallus Gallus)
  misc_feature (36): n=c or t
gctaggaaaaaaacactgggactcacctcctgtgcngccacgagcttggtggaggcatttccacctgtgaa

SEQ ID NO: 23402 - DNA, 71 bp, chicken (Gallus Gallus)
  misc_feature (36): n=a or g
cagggcccgtgtagataaatatagtaagccattatnctttgatatagttgtattgcctaggaaattactac

SEQ ID NO: 23403 - DNA, 71 bp, chicken (Gallus Gallus)
  misc_feature (36): n=g or t
gttttgtatttaattgcctgcaccaatgtataactnttctttcttcccctcatgacactctaatagaagta

SEQ ID NO: 23404 - DNA, 71 bp, chicken (Gallus Gallus)
  misc_feature (36): n=a or g
tatgatcggaagcgacaagacaactgtccggtgggnttgaagaatgtgggaaatacgtgctggtttagtgc

SEQ ID NO: 23405 - DNA, 71 bp, chicken (Gallus Gallus)
  misc_feature (36): n=a or g
tgataagctttatccctaaaatgttttcaattcccngtggaacataaagcaatacactagggggtgagggg

SEQ ID NO: 23406 - DNA, 71 bp, chicken (Gallus Gallus)
  misc_feature (36): n=c or t
gtttccatagactctctgatggggccaatcctgatnagttaagtcaactgtttttaagacaacaaataacc

SEQ ID NO: 23407 - DNA, 71 bp, chicken (Gallus Gallus)
  misc_feature (36): n=c or t
gaaccatcgagagagctggcagaacaaactttgaanaatgtgaagcagttcaaaaaatacatcgataatcc

SEQ ID NO: 23408 - DNA, 71 bp, chicken (Gallus Gallus)
  misc_feature (36): n=c or g
attgttttgcaggagggagaacggaaagcgggaatncgacgtgcaagaacagcttctgtggttcattattt

SEQ ID NO: 23409 - DNA, 71 bp, chicken (Gallus Gallus)
  misc_feature (36): n=c or t
ttgtgtgtgctttttttttttaaatatctctaaaangactgcttttcctaccgaatagagcaagtctacgg

SEQ ID NO: 23410 - DNA, 71 bp, chicken (Gallus Gallus)
  misc_feature (36): n=a or g
aattgttggaaatgtattaataagttttaccagcanctgatgaacctgggaagtttagcaatttgcttttt

SEQ ID NO: 23411 - DNA, 71 bp, chicken (Gallus Gallus)
  misc_feature (36): n=a or t
acactaatgatagcataattgtccatcatatcattnataaaatccagtcacataagactaagaaaacaagt

SEQ ID NO: 23412 - DNA, 71 bp, chicken (Gallus Gallus)
  misc_feature (36): n=a or t
caaggcatctgaccgtttttgtgttatcttgtcttnatctgtgtggctcattgcttcttcattatgtgaga

SEQ ID NO: 23413 - DNA, 71 bp, chicken (Gallus Gallus)
  misc_feature (36): n=a or g
gttcattatctccatcccgtgagttgctttgcatcntatcacactgtgctttttctgaagtgaatccactg

SEQ ID NO: 23414 - DNA, 71 bp, chicken (Gallus Gallus)
  misc_feature (36): n=a or t
aagttcaacccccccttcttctttctgaagtaaaancatattaatagacaactgtgtggaacctgagggag

SEQ ID NO: 23415 - DNA, 71 bp, chicken (Gallus Gallus)
  misc_feature (36): n=c or g
cccaactaaatcagatagaaactaagtcagcgtccntggaggtgttcaaaaaacattctgatgttatagta

SEQ ID NO: 23416 - DNA, 71 bp, chicken (Gallus Gallus)
  misc_feature (36): n=c or t
tttttttttctcttgtctcttcccttttgctagagnttgcagtacttggatgtttctgtcctgggtgagct

SEQ ID NO: 23417 - DNA, 71 bp, chicken (Gallus Gallus)
  misc_feature (36): n=a or g
ataaatgactctggatgtcaaatcctatgtttagtncaagctgaaaggtttggtaacatggtattaagatc

SEQ ID NO: 23418 - DNA, 71 bp, chicken (Gallus Gallus)
  misc_feature (36): n=c or g
aagtcctctctggaccacgtcctcttggcagattgntttgaaagaaaagccaggtgatgatacgtcttggc

SEQ ID NO: 23419 - DNA, 71 bp, chicken (Gallus Gallus)
  misc_feature (36): n=c or t
gagtgacacagcatagtaacaaaaataagccacagnttaaaaagtattttatattttcattaatacatgtg

SEQ ID NO: 23420 - DNA, 71 bp, chicken (Gallus Gallus)
  misc_feature (36): n=a or t
tttctttgctaatttaggggaagacactcttcctgntcattttacagaccagcagtttcccaaaagatgct

SEQ ID NO: 23421 - DNA, 71 bp, chicken (Gallus Gallus)
  misc_feature (36): n=a or g
ctcacctgtttgttcttttttgcagactcagttatnaaatttcactagctctttctccaagaatcattttg

SEQ ID NO: 23422 - DNA, 71 bp, chicken (Gallus Gallus)
  misc_feature (36): n=c or t
gatacacatggaattccaagaagtttgcaatacttnatcaaggatataaagaaataaaatgtgtacagaaa

SEQ ID NO: 23423 - DNA, 71 bp, chicken (Gallus Gallus)
  misc_feature (36): n=c or t
aggccatgcagacaagtagataccacgagtgtcttntaaagatgcttctttgtgtgccccttcatatatcc

SEQ ID NO: 23424 - DNA, 71 bp, chicken (Gallus Gallus)
  misc_feature (36): n=a or t
taaaaaagaatttaaatgaggaggcactgtatgccncagccttaattttgttgtgtcggcaactggaaaac

SEQ ID NO: 23425 - DNA, 71 bp, chicken (Gallus Gallus)
  misc_feature (36): n=g or t
gcaaagtagaggaactggctgtttgtatgtttgtangatctccaactcaaggcaaacgatgacagacacat

SEQ ID NO: 23426 - DNA, 71 bp, chicken (Gallus Gallus)
  misc_feature (36): n=a or t
cagtattttgcttcacctagtgaacctgtctagagnaaggtgtgatatttgacacatctctgggggcagat

SEQ ID NO: 23427 - DNA, 71 bp, chicken (Gallus Gallus)
  misc_feature (36): n=a or g
tactaataagtttatcaacaagtatttggtattatngaaaagctctacaagaacattaacctatttgtcac

SEQ ID NO: 23428 - DNA, 71 bp, chicken (Gallus Gallus)
  misc_feature (36): n=a or g
tcctctttttcacatggcactttccatccttcaatntttatttgttttcatgttgcccttgctacaattca

SEQ ID NO: 23429 - DNA, 71 bp, chicken (Gallus Gallus)
  misc_feature (36): n=c or g
gattctcagctttagcttattactttctactgtatntaaatatagttatgaagagggtattagcaactatt

SEQ ID NO: 23430 - DNA, 71 bp, chicken (Gallus Gallus)
  misc_feature (36): n=g or t
actaccagggaaaacaaacgtttgcattaatgcctngtgctgcacagcccaactccacgccaaaggcgctc

SEQ ID NO: 23431 - DNA, 71 bp, chicken (Gallus Gallus)
  misc_feature (36): n=g or t
agattattgatttagcccattttgatttttaacatnatactatttaacggaagattaaattcttacaggcc

SEQ ID NO: 23432 - DNA, 71 bp, chicken (Gallus Gallus)
  misc_feature (36): n=c or t
gttattgttcacttatatctaatgaacacaagatcntactgtttaaaacaaaagctagctgtattttttta

SEQ ID NO: 23433 - DNA, 71 bp, chicken (Gallus Gallus)
  misc_feature (36): n=g or t
atctcatggccatggtgtgagccagatcttgtagtncctgctcaccaaagcacagcccggcacagccccca

SEQ ID NO: 23434 - DNA, 71 bp, chicken (Gallus Gallus)
  misc_feature (36): n=c or t
tcatgttagtatcagcactatactttccacattatnttctttcagtaaaacccatacttgagtttcattgt

SEQ ID NO: 23435 - DNA, 71 bp, chicken (Gallus Gallus)
  misc_feature (36): n=a or g
ttttaaatgcttaaaaaagttgaaaggctttttaangagggaaatcaattgaaaaaggtgttctataagat

SEQ ID NO: 23436 - DNA, 71 bp, chicken (Gallus Gallus)
  misc_feature (36): n=a or g
gactgtttagaaaggaaatctcctgcttgcagcagngtattgccaaaatagaacttggggcttatggctgc

SEQ ID NO: 23437 - DNA, 71 bp, chicken (Gallus Gallus)
  misc_feature (36): n=a or g
caccattttaattcagtgagaagaggaaggacattntgaaaatgaagaaggaaatatctacttgtaactgt

SEQ ID NO: 23438 - DNA, 71 bp, chicken (Gallus Gallus)
  misc_feature (36): n=g or t
gactatgtgatgtatgttatgtataatggcactctnaaggcagagatgggcagtcgtccctcaggagattg

SEQ ID NO: 23439 - DNA, 71 bp, chicken (Gallus Gallus)
  misc_feature (36): n=c or t
gtttgtagtagtagcactaaggagtttctctgtgcngaccagatgcggcacagctgcctactgagttctgt

SEQ ID NO: 23440 - DNA, 71 bp, chicken (Gallus Gallus)
  misc_feature (36): n=c or t
aatcattaaggggactaaatctgtaatgatctgcangggtcttttatacctacagatgcaaaaggttgtat

SEQ ID NO: 23441 - DNA, 71 bp, chicken (Gallus Gallus)
  misc_feature (36): n=c or t
gtgctaagcaggtgctccaccaagtctggtgatgcnttgctgtctgaaaaccttcctgcccccacaccacg

SEQ ID NO: 23442 - DNA, 71 bp, chicken (Gallus Gallus)
  misc_feature (36): n=a or g
aatataatatccacaatatagatttgcagtgcctcnggcttacctaggtcaatgagcagtaaattctcaag

SEQ ID NO: 23443 - DNA, 71 bp, chicken (Gallus Gallus)
  misc_feature (36): n=c or g
agatgccagataacttactgcatatctcccaaatgnttttggatagaaaaggaaatcttgtattttcccaa

SEQ ID NO: 23444 - DNA, 71 bp, chicken (Gallus Gallus)
  misc_feature (36): n=c or t
ctccatatttttctgttacagacagctaggaggtgngtgtgttgggtgggaaaaatcggcagcctcacaga

SEQ ID NO: 23445 - DNA, 71 bp, chicken (Gallus Gallus)
  misc_feature (36): n=a or g
gacttcgaaaagatattcttgactatcagtaagctnatgtgacagctttacaattctacctcttctgttca

SEQ ID NO: 23446 - DNA, 71 bp, chicken (Gallus Gallus)
  misc_feature (36): n=a or c
aaaagaaaaaaaaagaaaagttaggagaaaactcancgtttctgtttctcttctcgagcaccaccatgcag

SEQ ID NO: 23447 - DNA, 71 bp, chicken (Gallus Gallus)
  misc_feature (36): n=c or t
tttatgtcagtgagttatacatggacatttccttangcttatcatttgtatctagtaaaatgttgattgta

SEQ ID NO: 23448 - DNA, 71 bp, chicken (Gallus Gallus)
  misc_feature (36): n=a or g
tgatttaaagtgttaacattccaatgtctttattcnagattcaattcccacttgctggattttcataccta

SEQ ID NO: 23449 - DNA, 71 bp, chicken (Gallus Gallus)
  misc_feature (36): n=a or c
atttttattttctcctactttgtagggcgataaaanccacagaagatgaggagaaagggctaatgccactg

SEQ ID NO: 23450 - DNA, 71 bp, chicken (Gallus Gallus)
  misc_feature (36): n=a or c
gggatggagacctcttgtgctttctggagggcatcnttgaagagtagccagccctcctcaacatctttatc

SEQ ID NO: 23451 - DNA, 71 bp, chicken (Gallus Gallus)
  misc_feature (36): n=a or g
tcctgaattgagagtttctatctcctgcaaagctcngaatgcagtctctgctctacttcattctttttctt

SEQ ID NO: 23452 - DNA, 71 bp, chicken (Gallus Gallus)
  misc_feature (36): n=a or g
ttagctattgaacagagttgcacttgtgtttgtgtncatgtgcgtgtttgttgtttttataattcctcttg

SEQ ID NO: 23453 - DNA, 71 bp, chicken (Gallus Gallus)
  misc_feature (36): n=a or g
catatcagcttctatgaccaagcagaaaataagaantcaaatgaatcatctacagaaagatggtctaccaa

SEQ ID NO: 23454 - DNA, 71 bp, chicken (Gallus Gallus)
  misc_feature (36): n=a or g
ggagttatgaaggtagatgatgggtacctaacaacngtgatgctaacgtcagaaaagcttcgtgaacgtat

SEQ ID NO: 23455 - DNA, 71 bp, chicken (Gallus Gallus)
  misc_feature (36): n=a or g
atgcagagaatgaacaatgccaagtagggtaatacntacttattaatgtacatgatttatttactttatat

SEQ ID NO: 23456 - DNA, 71 bp, chicken (Gallus Gallus)
  misc_feature (36): n=c or g
gcatttataacttttacgagaagacatttcttcatntgttgcccttcacctgagatgtgagattgacaatt

SEQ ID NO: 23457 - DNA, 71 bp, chicken (Gallus Gallus)
  misc_feature (36): n=c or t
gtgtctttacacactgctgttttgttcagtgacagnatttagattaagttatttcctcctaccatctccac

SEQ ID NO: 23458 - DNA, 71 bp, chicken (Gallus Gallus)
  misc_feature (36): n=a or g
attttctgatgttcgatttcaggacatacatgaacntatacgtactgtagagtgtactttcaaacattttg

SEQ ID NO: 23459 - DNA, 71 bp, chicken (Gallus Gallus)
  misc_feature (36): n=a or g
attaattcctttagcttcctgcaacttcacagattnaaatggttgtgaaatactggatttatctgatcaga

SEQ ID NO: 23460 - DNA, 71 bp, chicken (Gallus Gallus)
  misc_feature (36): n=c or g
ttataccctccatgcccagcaggcatattgtaaagntgctcatggctctgttggccaaggagacctgtagg

SEQ ID NO: 23461 - DNA, 71 bp, chicken (Gallus Gallus)
  misc_feature (36): n=a or g
ctcacattcaagatcctgtgtgcttccacgactctntcaagcttcttatctaaatcttttatctgctggtc

SEQ ID NO: 23462 - DNA, 71 bp, chicken (Gallus Gallus)
  misc_feature (36): n=c or t
agccagcccttccctcagcccctccatgtgtgagcntacaacaaggtatgagccattcctgctctccttca

SEQ ID NO: 23463 - DNA, 71 bp, chicken (Gallus Gallus)
  misc_feature (36): n=a or c
tttatgtgtattggaaagattccctggtgtgacctngatgttggaggttattccctgctgcaaattaggtc

SEQ ID NO: 23464 - DNA, 71 bp, chicken (Gallus Gallus)
  misc_feature (36): n=a or g
atacaacaaagataaatcagtagctatacccccacntagaaaacagtgacaaaaaagtgaacaacagctct

SEQ ID NO: 23465 - DNA, 71 bp, chicken (Gallus Gallus)
  misc_feature (36): n=c or t
gattccagacagaatcagacagcaaaacccattggntgaattggcttgggcagtgctgatcctgaatactg

SEQ ID NO: 23466 - DNA, 71 bp, chicken (Gallus Gallus)
  misc_feature (36): n=c or t
tctgaatcatactgtaacgtaaaaaataaacattgntatgataaatgcatagtaggtcttgcagctagcta

SEQ ID NO: 23467 - DNA, 71 bp, chicken (Gallus Gallus)
  misc_feature (36): n=a or c
taaccccaatccccacagctgctcctcattaagatntgttctctacagccttctttggatcaagatgacct

SEQ ID NO: 23468 - DNA, 71 bp, chicken (Gallus Gallus)
  misc_feature (36): n=c or t
gtgttttgtaactgaggatttgctctatcaaacagngttattgtgctttgcgttgtcaatttccacggaaa

SEQ ID NO: 23469 - DNA, 71 bp, chicken (Gallus Gallus)
  misc_feature (36): n=c or t
agtaaacggtagagtggaaactctgttgtgagatanatcaacagctgacagattaggatgctaagcaaact

SEQ ID NO: 23470 - DNA, 71 bp, chicken (Gallus Gallus)
  misc_feature (36): n=a or g
gtcatcgaggctaaattccctctatgaacagggacntctacagctccatcaggttgctcagaaccctgtcc

SEQ ID NO: 23471 - DNA, 71 bp, chicken (Gallus Gallus)
  misc_feature (36): n=c or t
tattggtaagtgaagcttcctactttcaatctgtgnatcttcatgaacgtagcccacaagcttactgtaaa

SEQ ID NO: 23472 - DNA, 71 bp, chicken (Gallus Gallus)
  misc_feature (36): n=c or t
gacaattgtaggagacagctttattctacaacaaangaaaacatttttagtgtacttaagaatccaagata

SEQ ID NO: 23473 - DNA, 71 bp, chicken (Gallus Gallus)
  misc_feature (36): n=a or c
aaccaatgtaacacagtggttccaaatttattattnatttttatttgagaacaggatctggcccatagtct

SEQ ID NO: 23474 - DNA, 71 bp, chicken (Gallus Gallus)
  misc_feature (36): n=a or g
ccccagcttgtcacaaagggctttgacacattcacnagcaataaacccagcagcccaggtcaccctgatgt

SEQ ID NO: 23475 - DNA, 71 bp, chicken (Gallus Gallus)
  misc_feature (36): n=c or t
tattggtattttttcatttgttcacgcctctttganttgaaatgctcaaatacacatttagcctatgagca

SEQ ID NO: 23476 - DNA, 71 bp, chicken (Gallus Gallus)
  misc_feature (36): n=c or t
gaagatgacatattgaatggaagatttttttaagcngccatattattaactttcttatttaaaagaaaatg

SEQ ID NO: 23477 - DNA, 71 bp, chicken (Gallus Gallus)
  misc_feature (36): n=c or t
ggaggtgtacctaagggacgtggtttagtggtggcnttggtagtgttagatgagtgatgatcttgaagatc

SEQ ID NO: 23478 - DNA, 71 bp, chicken (Gallus Gallus)
  misc_feature (36): n=a or g
attttatgaaagcattttacctcataggattcttcntcacctgcaaccatgccgacagttttaatgaaagg

SEQ ID NO: 23479 - DNA, 71 bp, chicken (Gallus Gallus)
  misc_feature (36): n=c or t
tgagaaactgatgaactgtagggtagagtagaatcntccacgtgaaatcgaatggacatgaaatcttctga

SEQ ID NO: 23480 - DNA, 71 bp, chicken (Gallus Gallus)
  misc_feature (36): n=a or c
agttttccaattaattgtaattactagggaacacanaattttactaagtggaaatttatctatgacccaaa

SEQ ID NO: 23481 - DNA, 71 bp, chicken (Gallus Gallus)
  misc_feature (36): n=c or t
tctgagtccaaattagttgtctggaaattgttctcngagggaaaaccatactgctggctgtgctggaggtg

SEQ ID NO: 23482 - DNA, 71 bp, chicken (Gallus Gallus)
  misc_feature (36): n=c or t
accaaaagcacattattgtaaaaaatcataatgcangaaactaattcattttcaaatgacacaataggcaa

SEQ ID NO: 23483 - DNA, 71 bp, chicken (Gallus Gallus)
  misc_feature (36): n=a or t
tccatgttatagccttctcttcattcttgtctcagncctcatccacttctgtgccaagctatgttccctat

SEQ ID NO: 23484 - DNA, 71 bp, chicken (Gallus Gallus)
  misc_feature (36): n=a or g
atcattaaagtggcaattctgagtttcttttccatntctgagcgcttgaaatgtgtttattccaggggtgg

SEQ ID NO: 23485 - DNA, 71 bp, chicken (Gallus Gallus)
  misc_feature (36): n=a or g
atgtattagcactttcttttgctacaataactgatnctttttggtttacgtataattaataattgataaat

SEQ ID NO: 23486 - DNA, 71 bp, chicken (Gallus Gallus)
  misc_feature (36): n=a or g
tcttttatcttttcagttgtatatagctgataggantcaaagtgactgggaaagaagagttatcttcagca

SEQ ID NO: 23487 - DNA, 71 bp, chicken (Gallus Gallus)
  misc_feature (36): n=c or g
acatagtttcagaaacaaattctaatcagagctcangaaattgagctttcctttgagactagggaagggaa

SEQ ID NO: 23488 - DNA, 71 bp, chicken (Gallus Gallus)
  misc_feature (36): n=c or t
ggaagtgcggatgaaacaaaaggtgtgttgctgaantcctccatgcagaaaaaatggcccccacagacact

SEQ ID NO: 23489 - DNA, 71 bp, chicken (Gallus Gallus)
  misc_feature (36): n=a or g
ttagaaccagaatttggtcatccatttttatgctcngttaccaccaggtggtagtattttaaaacattgct

SEQ ID NO: 23490 - DNA, 71 bp, chicken (Gallus Gallus)
  misc_feature (36): n=a or g
gttctgacaaagagagggagaagatacatggtagcngagtaggcaatgaatttagagaattatgggtctta

SEQ ID NO: 23491 - DNA, 71 bp, chicken (Gallus Gallus)
  misc_feature (36): n=c or t
taggtctgggggcagtcagtgtgaattttttattcngtactcttccttggagctgatgtttttcagatttg

SEQ ID NO: 23492 - DNA, 71 bp, chicken (Gallus Gallus)
  misc_feature (36): n=c or t
agggaagaatatgaaagataagctttactaataagnaataaagagcattttttgacttaagtccacacgca

SEQ ID NO: 23493 - DNA, 71 bp, chicken (Gallus Gallus)
  misc_feature (36): n=a or g
tttactgagggtctcacttaaatcattaattcacancctacaggttgtttaaagagctgtaataatgggct

SEQ ID NO: 23494 - DNA, 71 bp, chicken (Gallus Gallus)
  misc_feature (36): n=a or g
tcttttagtgaaccttccaatgatttggatcttatnctcccaggtccaggagacttatcccatttgttttc

SEQ ID NO: 23495 - DNA, 71 bp, chicken (Gallus Gallus)
  misc_feature (36): n=c or t
ttctaagaaacaagggtaccaatggaagttgatatnctgtaacaactaggtctaccacactgcttattcaa

SEQ ID NO: 23496 - DNA, 71 bp, chicken (Gallus Gallus)
  misc_feature (36): n=c or t
tacctatgctgatgcgtagatatgattagtttcagnccagtgaattgttaagagattgcgaggaaaggatg

SEQ ID NO: 23497 - DNA, 71 bp, chicken (Gallus Gallus)
  misc_feature (36): n=c or t
cccaggaggagatatgtaagagccttgacatagctngggaatcaattgccaattccatgaaggaggatcag

SEQ ID NO: 23498 - DNA, 71 bp, chicken (Gallus Gallus)
  misc_feature (36): n=g or t
ctcagtctgtcttaagagagcaaaatgttagtaaangggcatgtttcccaaagacacagtacctgttcttt

SEQ ID NO: 23499 - DNA, 71 bp, chicken (Gallus Gallus)
  misc_feature (36): n=a or g
caaattggattgtgccttgctagcaggattggtgtncagtcaacaaggacgagtgcacatacacatgtgca

SEQ ID NO: 23500 - DNA, 71 bp, chicken (Gallus Gallus)
  misc_feature (36): n=c or t
tttttataattatcattagatgattgggaccagtgnttcttttagacctttcccacagggcaagtacaatt

SEQ ID NO: 23501 - DNA, 71 bp, chicken (Gallus Gallus)
  misc_feature (36): n=c or t
tacattattgatattttaaaatccactcaaaagtantgacctatagaaaatgtttaattttgaaattctag

SEQ ID NO: 23502 - DNA, 71 bp, chicken (Gallus Gallus)
  misc_feature (36): n=a or t
tttgcaggacaaggacttcaatgtgaaagtacgatntcatttctgtgctctgtccgtccttaatggagcaa

SEQ ID NO: 23503 - DNA, 71 bp, chicken (Gallus Gallus)
  misc_feature (36): n=a or g
ttatgtggaggaccctgagcttagtgtttatattgnactggttttaattatatgctgtactgataatgcaa

SEQ ID NO: 23504 - DNA, 71 bp, chicken (Gallus Gallus)
  misc_feature (36): n=c or t
tcttctggacaaggacgtgatgtcaatgctggctanctatgaaaacctcagaaacttcaataccagcaaag

SEQ ID NO: 23505 - DNA, 71 bp, chicken (Gallus Gallus)
  misc_feature (36): n=a or t
tttcactggtagggctataaaaagtgaagatctgcntcttttcctttcttatgtataaattaactggaagc

SEQ ID NO: 23506 - DNA, 71 bp, chicken (Gallus Gallus)
  misc_feature (36): n=a or c
tattttagatgcctaagttatctgcaacctggggcngaaaacatggcattagagaaaatctgagtcctgga

SEQ ID NO: 23507 - DNA, 71 bp, chicken (Gallus Gallus)
  misc_feature (36): n=a or g
tcccatgagatgggaaaatgtaaggaccttcattcntaactgatggggacctgaagctggtgcaatctaac

SEQ ID NO: 23508 - DNA, 71 bp, chicken (Gallus Gallus)
  misc_feature (36): n=c or g
tcctagggttgttctccttaccttgagggcatactnctcacctcaaggacatgctcctcaccttggggaca

SEQ ID NO: 23509 - DNA, 71 bp, chicken (Gallus Gallus)
  misc_feature (36): n=a or g
aggaacagatcatgcaggctgaaggaattgcagtcnaagtctctcctacctgctgtctcaaggctcaacta

SEQ ID NO: 23510 - DNA, 71 bp, chicken (Gallus Gallus)
  misc_feature (36): n=c or t
aaaaaatgacttgaggagctgttccagtatatatcnaacacacagtgcaattctggactagactttttgca

SEQ ID NO: 23511 - DNA, 71 bp, chicken (Gallus Gallus)
  misc_feature (36): n=a or c
tttcttccaaactggcaagcaaagggctaaatattntattgttgtgtccctatatgtgggagggtactgta

SEQ ID NO: 23512 - DNA, 71 bp, chicken (Gallus Gallus)
  misc_feature (36): n=c or t
gccatctttgaggtttcttaggtaaatctgtgcctnttccccttgtcaggaagcatgtatatgtagtggag

SEQ ID NO: 23513 - DNA, 71 bp, chicken (Gallus Gallus)
  misc_feature (36): n=a or c
aatttctgctttttaaccccagagcttctggggtancctttgtatttacgtatttatagtgcttaattcag

SEQ ID NO: 23514 - DNA, 71 bp, chicken (Gallus Gallus)
  misc_feature (36): n=g or t
gcacgtaggagtggggcaggcattacgttaccggcngtgggttttgtgcaaacactgggcagtatttcagg

SEQ ID NO: 23515 - DNA, 71 bp, chicken (Gallus Gallus)
  misc_feature (36): n=c or t
gttcaatctgtcctcctacaggaagcttttatgttncttcttttaaaaatatatatttttaaatggctaat

SEQ ID NO: 23516 - DNA, 71 bp, chicken (Gallus Gallus)
  misc_feature (36): n=c or t
atatttacattagtattaaaatataggtctaactantacaatagttgaaccttaggcgatcagatttagtc

SEQ ID NO: 23517 - DNA, 71 bp, chicken (Gallus Gallus)
  misc_feature (36): n=a or g
aagagcctacctctcgcagcagttgaggctagttcnctcccttcactgaaccaaatgttcctcaatatgtt

SEQ ID NO: 23518 - DNA, 71 bp, chicken (Gallus Gallus)
  misc_feature (36): n=c or t
tctgcagagctcctttccagctgatcaggccctagnctattccagttcatgcagttatttctcctgggggt

SEQ ID NO: 23519 - DNA, 71 bp, chicken (Gallus Gallus)
  misc_feature (36): n=a or g
tcagaatatgacccaagagatctctgaagatgatcncttccacagatgttacagagtacagcctcatggta

SEQ ID NO: 23520 - DNA, 71 bp, chicken (Gallus Gallus)
  misc_feature (36): n=a or t
ggaagagttccccaaagactatcattagcttaagcnatcctgtaaatactgagaagtgtaataaatatata

SEQ ID NO: 23521 - DNA, 71 bp, chicken (Gallus Gallus)
  misc_feature (36): n=c or g
gcttatgggttaagggtttctgtttgtagactatgnagtgcttttggccaaggcttatggatgatgtccaa

SEQ ID NO: 23522 - DNA, 71 bp, chicken (Gallus Gallus)
  misc_feature (36): n=c or g
ctacaaagagactggaagagagttgtacaccctagnttgatgaagctagatgtggattctagtaggatgtg

SEQ ID NO: 23523 - DNA, 71 bp, chicken (Gallus Gallus)
  misc_feature (36): n=a or t
ttttgtcaaatctcttgtgaaaagctttgcatgagngcttagtagcccccacattcttattttagccaaaa

SEQ ID NO: 23524 - DNA, 71 bp, chicken (Gallus Gallus)
  misc_feature (36): n=c or t
tgatacacttaaaaattaaagcctcggatatgttgncatctagataagataaactgtttctgtccaatcac

SEQ ID NO: 23525 - DNA, 71 bp, chicken (Gallus Gallus)
  misc_feature (36): n=c or t
gcagtaggcagatgctgccatttaatatatgggctnttgagtaagaactatagtcttttgcgtcagcatcc

SEQ ID NO: 23526 - DNA, 71 bp, chicken (Gallus Gallus)
  misc_feature (36): n=c or t
actgcagattcttcctgcatttattttgatcttaantgaatttccatacattaaaggatgtgaatctctga

SEQ ID NO: 23527 - DNA, 71 bp, chicken (Gallus Gallus)
  misc_feature (36): n=a or c
ctctgagtgacagctcacgcctgcacatacaggtgngaattattgctattaagcatctcgactcactgacc

SEQ ID NO: 23528 - DNA, 71 bp, chicken (Gallus Gallus)
  misc_feature (36): n=a or t
acaacaaagggaggtaggtaaaaatcatcagctaanactgacttcattcctagagtcttctaaaataagca

SEQ ID NO: 23529 - DNA, 71 bp, chicken (Gallus Gallus)
  misc_feature (36): n=a or g
gaaaaatatgtaacatacaacaatgttcttgctgcntttaactgagttcatttgtcccagaaatatgtatt

SEQ ID NO: 23530 - DNA, 71 bp, chicken (Gallus Gallus)
  misc_feature (36): n=c or g
tggggagctcccttctctgcttctgctcctgggccntgctggtatttaaccaagctacaatgtacacatgg

SEQ ID NO: 23531 - DNA, 71 bp, chicken (Gallus Gallus)
  misc_feature (36): n=a or c
ccaggttcacaggaatctgaagtccaaatttcacanatctgacctagattgtcatcttttggaagcagaat

SEQ ID NO: 23532 - DNA, 71 bp, chicken (Gallus Gallus)
  misc_feature (36): n=c or t
gatattattttataacactaagtcacatgagaagantcataggggttccttagttccaggtttatgatttc

SEQ ID NO: 23533 - DNA, 71 bp, chicken (Gallus Gallus)
  misc_feature (36): n=a or g
atcttcattccaattatatgtatatatctaaaaaanaccactgaaactgacaaactgatttagcacaagtc

SEQ ID NO: 23534 - DNA, 71 bp, chicken (Gallus Gallus)
  misc_feature (36): n=a or t
agtgcgtggattgattcaaatagttgtcttgccttnataggaccatacattcttattagctttgtgtagta

SEQ ID NO: 23535 - DNA, 71 bp, chicken (Gallus Gallus)
  misc_feature (36): n=a or g
gtctcttgctaacagggtgactattttaaaggatgnttacatttatttgctgaagctttctgtgttttacc

SEQ ID NO: 23536 - DNA, 71 bp, chicken (Gallus Gallus)
  misc_feature (36): n=a or g
tggaggtcttggtggctcttccatcaaattctggtntcagcttttctgatctagggggtgaaatagcactt

SEQ ID NO: 23537 - DNA, 71 bp, chicken (Gallus Gallus)
  misc_feature (36): n=c or t
gcccatcaccttactctttaaaaggttgatgtctcnctcacaacacaccatggcaactgcacttgtagttg

SEQ ID NO: 23538 - DNA, 71 bp, chicken (Gallus Gallus)
  misc_feature (36): n=c or t
cgtagcatacagcagtaaccctatggtaagagttgngaggtctctgttctacctcgagagcagggctgacg

SEQ ID NO: 23539 - DNA, 71 bp, chicken (Gallus Gallus)
  misc_feature (36): n=c or t
cttgtaaatcgaggcttcgaaaaagcattggaagcngaggttaggctagaaaaagcactgttgctgcagtg

SEQ ID NO: 23540 - DNA, 71 bp, chicken (Gallus Gallus)
  misc_feature (36): n=c or t
taaggattgcttgcacttattctcatgctgtaactntgaataactttttcaacttcattctggattgacag

SEQ ID NO: 23541 - DNA, 71 bp, chicken (Gallus Gallus)
  misc_feature (36): n=c or t
ctttctgcaatggagatggtatttctatccacatantgtgttaaaaattctaaaatgaattcaaatttttc

SEQ ID NO: 23542 - DNA, 71 bp, chicken (Gallus Gallus)
  misc_feature (36): n=c or t
cagcaaaaactgtgctctcatagcaccacagagtancaggtgccatgcttgttcccaggctgcggagcctt

SEQ ID NO: 23543 - DNA, 71 bp, chicken (Gallus Gallus)
  misc_feature (36): n=a or t
aacagttgaacaaccatttcctaaaatgaattctanctatctcctgtcttacaacactgtctccctatata

SEQ ID NO: 23544 - DNA, 71 bp, chicken (Gallus Gallus)
  misc_feature (36): n=a or g
agcaggttgtccagagagcttggcacatctccatcntcaataaagaaaacatccctggacaggccttgaac

SEQ ID NO: 23545 - DNA, 71 bp, chicken (Gallus Gallus)
  misc_feature (36): n=a or g
ggaagagttatgcccttcttcaccaagtgaaggccngatgtggaaatacatttagacaattgtatttaggc

SEQ ID NO: 23546 - DNA, 71 bp, chicken (Gallus Gallus)
  misc_feature (36): n=c or t
gcttttgcttcttgttagccacagttcataggtatngtcttagtactttcaagttagaatgcagtcagtcc

SEQ ID NO: 23547 - DNA, 71 bp, chicken (Gallus Gallus)
  misc_feature (36): n=c or t
caaggcattcgtcaatatctgaaatgtggtttgaanagatcagggcaattcaactagaaacagcagtaaca

SEQ ID NO: 23548 - DNA, 71 bp, chicken (Gallus Gallus)
  misc_feature (36): n=c or t
aaaaagtattctggcttcagacatgctaaaacttangttaataccagtgaagcaaacaatttctaatgaag

SEQ ID NO: 23549 - DNA, 71 bp, chicken (Gallus Gallus)
  misc_feature (36): n=a or t
agtgtagaagaaagcagcagggctacatgtcatacnaacttcaagataatatgtgcaagagtctccgttaa

SEQ ID NO: 23550 - DNA, 71 bp, chicken (Gallus Gallus)
  misc_feature (36): n=c or t
ctggttctatttttttttttcagtgctaagcagaantcaaggacacaacagctactgtgcaaatgttaaaa

SEQ ID NO: 23551 - DNA, 71 bp, chicken (Gallus Gallus)
  misc_feature (36): n=c or t
atttgaatcaatgttaaagctttcacctttgttgcngaagataaaatcgcaggcaaaaccctcactccctg

SEQ ID NO: 23552 - DNA, 71 bp, chicken (Gallus Gallus)
  misc_feature (36): n=c or g
gaagccatctgaaaacagtaaaaattgaaatactgncctcagcgtcttgcttaaggtcactgaccagctca

SEQ ID NO: 23553 - DNA, 71 bp, chicken (Gallus Gallus)
  misc_feature (36): n=a or c
ggatgtatattggttgtggcacctacatatttatangatgccatccatgcctgttcatcttcaacagttac

SEQ ID NO: 23554 - DNA, 71 bp, chicken (Gallus Gallus)
  misc_feature (36): n=a or c
aagacatgagcactgtttcagagcatgtctctctancaacgatatcagctgggatcatctcagacgctaca

SEQ ID NO: 23555 - DNA, 71 bp, chicken (Gallus Gallus)
  misc_feature (36): n=a or g
ccatttgtgctgtttatccgtctagagaaaatctcnggattgtaattgctccaagtttcactacttaacta

SEQ ID NO: 23556 - DNA, 71 bp, chicken (Gallus Gallus)
  misc_feature (36): n=a or g
tcttgctgtcagcattaggatgtgttgcttgaccanctgctcctatttccagagcacattgataactctaa

SEQ ID NO: 23557 - DNA, 71 bp, chicken (Gallus Gallus)
  misc_feature (36): n=c or t
gctaaaggcagcttgcctgaagtttggatttagtcnctataccagtattttcagttatgtgggaaacaata

SEQ ID NO: 23558 - DNA, 71 bp, chicken (Gallus Gallus)
  misc_feature (36): n=a or g
gctgatggtgtaatgagaacaatggctcctgaaaanttgctgaagagtatgccaatactacaggcacaaat

SEQ ID NO: 23559 - DNA, 71 bp, chicken (Gallus Gallus)
  misc_feature (36): n=c or t
caagagatccactagagggggttgaaagaaaagtcntaaaatcttcactgaggatttgaaatttatgagag

SEQ ID NO: 23560 - DNA, 71 bp, chicken (Gallus Gallus)
  misc_feature (36): n=a or g
atattagggttccaacggattgggcggctcactacngcatagctgtcaccgtcaaactggactgtcccttc

SEQ ID NO: 23561 - DNA, 71 bp, chicken (Gallus Gallus)
  misc_feature (36): n=c or t
aatttgtagatcccaagcttcatccagctaaataangcaaagtaagcaacattttgtgttttctgcatttt

SEQ ID NO: 23562 - DNA, 71 bp, chicken (Gallus Gallus)
  misc_feature (36): n=a or c
gtaaaaggcaggaagtcatatctgagctgcagtacnttgcttacagaacaaagctgtcattggaatgatga

SEQ ID NO: 23563 - DNA, 71 bp, chicken (Gallus Gallus)
  misc_feature (36): n=a or g
gcagaattaattctggggcagaacccaggatctganggcagaacccaccaagcaaggaacaatttcttgtc

SEQ ID NO: 23564 - DNA, 71 bp, chicken (Gallus Gallus)
  misc_feature (36): n=c or t
attttgtgaaactgcataagctgaagtttccttcgngaactgcttaaaaacaaagttctgcataaaacctg

SEQ ID NO: 23565 - DNA, 71 bp, chicken (Gallus Gallus)
  misc_feature (36): n=g or t
tgcccctccaaacttcgatgtaacaaatgcaggaancatgtctgactaccacctatctacaaagtcagaag

SEQ ID NO: 23566 - DNA, 71 bp, chicken (Gallus Gallus)
  misc_feature (36): n=a or t
ttaaaagcagtcatgggagatgggaggtagcatcangtttagatcacgatcagtttgttcccgcttaagtg

SEQ ID NO: 23567 - DNA, 71 bp, chicken (Gallus Gallus)
  misc_feature (36): n=g or t
ttaaaggtctcttccaactcaagcaattctaaaatnctatgattcgaagtaaaatgctggattccactcga

SEQ ID NO: 23568 - DNA, 71 bp, chicken (Gallus Gallus)
  misc_feature (36): n=c or t
gttctcagtaatgcagtgtgtaatatatccttttanatttctagggcacatggaagtttcaacgggaggcc

SEQ ID NO: 23569 - DNA, 71 bp, chicken (Gallus Gallus)
  misc_feature (36): n=c or t
cctgggttgtctgggttcacctcattgatgagtagnttgcctgcttgtctagagggctctgctgttccttc

SEQ ID NO: 23570 - DNA, 71 bp, chicken (Gallus Gallus)
  misc_feature (36): n=c or t
gggatcaaagcagcggagaggtgttgctgcacagcncaaaaagccataatgaagtgaacttcatagggcac

SEQ ID NO: 23571 - DNA, 71 bp, chicken (Gallus Gallus)
  misc_feature (36): n=a or g
gcagcgtgttctcctgctgatggtgtcccatgcaantgggagataggagtgcttgaaggcaatttctggaa

SEQ ID NO: 23572 - DNA, 71 bp, chicken (Gallus Gallus)
  misc_feature (36): n=a or g
aaatcagaactacaaaaaagcccatacattcctaantcaaatctacttctcttccccttccccaatcccac

SEQ ID NO: 23573 - DNA, 71 bp, chicken (Gallus Gallus)
  misc_feature (36): n=c or t
catacacagacacacacatatttcacagggactccnctcagtccaccttgctttccttcccaagcacaggc

SEQ ID NO: 23574 - DNA, 71 bp, chicken (Gallus Gallus)
  misc_feature (36): n=a or t
gagtctctcatgatgccccatcctacttaataccanatcttcttggacagaaatgtgctttttctactgtt

SEQ ID NO: 23575 - DNA, 71 bp, chicken (Gallus Gallus)
  misc_feature (36): n=c or t
caccctgtagtacatctagttgtaacacactgcttnatagggaagagaaagcaaatcatattaaggtgaaa

SEQ ID NO: 23576 - DNA, 71 bp, chicken (Gallus Gallus)
  misc_feature (36): n=c or g
cttgctgaaaagctggagtggcagcatgagcacagntttgtgcgattgcagctgcatctagctcaggtctc

SEQ ID NO: 23577 - DNA, 71 bp, chicken (Gallus Gallus)
  misc_feature (36): n=c or g
gctccagatatgagctaagcaacataagctgcaaancaaacattctcgtgcaaaaacgcttcgtaataaaa

SEQ ID NO: 23578 - DNA, 71 bp, chicken (Gallus Gallus)
  misc_feature (36): n=a or g
caatactcttacctccatacaaggtctaagcacacngattttatggcgggcgaggagggactggagatggt

SEQ ID NO: 23579 - DNA, 71 bp, chicken (Gallus Gallus)
  misc_feature (36): n=a or t
acagagtaagatctacctaaaatgttatatttttangagctaaaatagtaaagtggattaaacatttcaga

SEQ ID NO: 23580 - DNA, 71 bp, chicken (Gallus Gallus)
  misc_feature (36): n=c or t
caacatcctattaatgtttgtaattaacaatggatngacaaatattttgaactcatgcttcagctagcaga

SEQ ID NO: 23581 - DNA, 71 bp, chicken (Gallus Gallus)
  misc_feature (36): n=c or t
gaacacattcttgcaatgtatggtatggtcttcacnggctgtcctgaaaattccttctcagtgggaaactt

SEQ ID NO: 23582 - DNA, 71 bp, chicken (Gallus Gallus)
  misc_feature (36): n=c or t
ccgcatttcttgtatcttggaaaggtgttcttatanaccaccgtttctcccagtactgagaaatctgaaaa

SEQ ID NO: 23583 - DNA, 71 bp, chicken (Gallus Gallus)
  misc_feature (36): n=a or g
tcttattataattgttattaaaaagaaaagagaganataatttggtccatgaactgtgaagaaacttgtac

SEQ ID NO: 23584 - DNA, 71 bp, chicken (Gallus Gallus)
  misc_feature (36): n=c or t
ctgcacatcaatcaacagtcctaatgaatgaggaancagacaaactatacacaagtatacacaatctgttt

SEQ ID NO: 23585 - DNA, 71 bp, chicken (Gallus Gallus)
  misc_feature (36): n=c or t
ttatatctaaatctgtgtttcccttttttctcttgntttttattccttaaggaatgaggcacagaaccctt

SEQ ID NO: 23586 - DNA, 71 bp, chicken (Gallus Gallus)
  misc_feature (36): n=c or g
aatgcatttaactatatattaattgtcttggaattnaatccttctattcttgattgccttcccagactaga

SEQ ID NO: 23587 - DNA, 71 bp, chicken (Gallus Gallus)
  misc_feature (36): n=a or g
caatagattgcttatgagctgtctgaacagtctgtngtgttaaagatagaagaacaaaaccaaaactagaa

SEQ ID NO: 23588 - DNA, 71 bp, chicken (Gallus Gallus)
  misc_feature (36): n=g or t
ctctccatcctacttctaccttgtcccagaggaaancaaatgtcccagattgcaggatgtagatgtgagtc

SEQ ID NO: 23589 - DNA, 71 bp, chicken (Gallus Gallus)
  misc_feature (36): n=c or t
tatctggccgtggcagttttaactggcgaaagcagnagagttctccatggataattttcgttagttagcag

SEQ ID NO: 23590 - DNA, 71 bp, chicken (Gallus Gallus)
  misc_feature (36): n=c or t
actaccattcccaactgttatttcttccttgtattngggctttgttaacacgcggtgaattttagatagaa

SEQ ID NO: 23591 - DNA, 71 bp, chicken (Gallus Gallus)
  misc_feature (36): n=a or c
gatctctgcctgctacccatccgttgtctcctttcntagctggcacagttctccttccgtacagtccttga

SEQ ID NO: 23592 - DNA, 71 bp, chicken (Gallus Gallus)
  misc_feature (36): n=a or c
atccctcctaattcacaaattattattttgacttanctgaaatcttcctccatctttcccagtcttttaaa

SEQ ID NO: 23593 - DNA, 71 bp, chicken (Gallus Gallus)
  misc_feature (36): n=c or g
tcaatctaaaaagtcagccaatttgacttattaaanagaaggaaactcaggctttacctcttgcatataaa

SEQ ID NO: 23594 - DNA, 71 bp, chicken (Gallus Gallus)
  misc_feature (36): n=a or t
tgcatcggtctcaggctactcaaagcaaccacaatncaggtcccagctgcacatgtagtgatttgtacact

SEQ ID NO: 23595 - DNA, 71 bp, chicken (Gallus Gallus)
  misc_feature (36): n=a or g
aagctttcaagaagtttcattatggacaggatagcncgttttggacaggcctccaaagctgactggccttt

SEQ ID NO: 23596 - DNA, 71 bp, chicken (Gallus Gallus)
  misc_feature (36): n=c or t
tcaaaccattttcttttgtctacttggaacacaatngcgatcatgatgaatttaactctgttcagctcatt

SEQ ID NO: 23597 - DNA, 71 bp, chicken (Gallus Gallus)
  misc_feature (36): n=c or t
acagtttagcacagttcagcacatatttcctgctgntcacaggagctcactagggaatgtactttaatatc

SEQ ID NO: 23598 - DNA, 71 bp, chicken (Gallus Gallus)
  misc_feature (36): n=a or t
ctcgatgtggtgcccttcaaagtgccaggtgaaagngcacatattgctagcatgcactagtttggtaaaga

SEQ ID NO: 23599 - DNA, 71 bp, chicken (Gallus Gallus)
  misc_feature (36): n=a or g
agcctttgtaatataagaatggagtatgagacgatnacgaagatgccagagaagctatagtgctttcaaca

SEQ ID NO: 23600 - DNA, 71 bp, chicken (Gallus Gallus)
  misc_feature (36): n=a or c
aaactgccctgaaatattattcagaaaagaaattantatggaaaacctctagcccctgcagaaataactca

SEQ ID NO: 23601 - DNA, 71 bp, chicken (Gallus Gallus)
  misc_feature (36): n=c or t
ataccagatagaaacaaagagctcccaagcccaaanaggccttctccatccaagtcccctcccagaagtgg

SEQ ID NO: 23602 - DNA, 71 bp, chicken (Gallus Gallus)
  misc_feature (36): n=c or t
caggagaattttcccggttcattcacacactgatantgacatatataacttgaagttctgcattcatcagt

SEQ ID NO: 23603 - DNA, 71 bp, chicken (Gallus Gallus)
  misc_feature (36): n=a or g
tttgattttcttttatttttaggctcagcagaaganagactggctctggagactgctgtaatgtatggtgt

SEQ ID NO: 23604 - DNA, 71 bp, chicken (Gallus Gallus)
  misc_feature (36): n=g or t
cagtattgaatcaaatggcttctttccatgctttancctcataaaatgctggaaacaaagctcaattggtc

SEQ ID NO: 23605 - DNA, 71 bp, chicken (Gallus Gallus)
  misc_feature (36): n=c or t
tctgatgttaaaggtatcctcttaataaagactttncttgcaacctgaacaagtttctgccaaggtctccc

SEQ ID NO: 23606 - DNA, 71 bp, chicken (Gallus Gallus)
  misc_feature (36): n=c or t
gagctgtaagacataacaagtgtgattgtcctgttntgtgcttttctctagacttctgttttatgctgtag

SEQ ID NO: 23607 - DNA, 71 bp, chicken (Gallus Gallus)
  misc_feature (36): n=g or t
agtaacttcctgagtagtagtttaattgtcctaagnttactctttcattactggagaatataaatcacaca

SEQ ID NO: 23608 - DNA, 71 bp, chicken (Gallus Gallus)
  misc_feature (36): n=a or g
atgcacttagctaccttagatttgaaattgtccacngggaacaatcttagaagtgaaagtcatcattagag

SEQ ID NO: 23609 - DNA, 71 bp, chicken (Gallus Gallus)
  misc_feature (36): n=c or t
tttcataacatggaagaggagaagcaaatacgacanatcagtgagtttctttgaatatctattgaaacttt

SEQ ID NO: 23610 - DNA, 71 bp, chicken (Gallus Gallus)
  misc_feature (36): n=c or t
ccaatgagtgaggtttgttgggggcttaggtaaccnggcccagcactctcttggcacatgatttcctccag

SEQ ID NO: 23611 - DNA, 71 bp, chicken (Gallus Gallus)
  misc_feature (36): n=c or g
gatgggacaggagggataagcagcagcatgttagantttgcaaagagaattctcaaaaactgcaataccaa

SEQ ID NO: 23612 - DNA, 71 bp, chicken (Gallus Gallus)
  misc_feature (36): n=a or c
aaatctttatttgccaaaacgtctataaagtgaatntaaatatacatgtaaattaattatagcaaatgctg

SEQ ID NO: 23613 - DNA, 71 bp, chicken (Gallus Gallus)
  misc_feature (36): n=a or c
tcagcccatccccaccatgcccaccaaccatgtccntaaggtgccacttctacacgttccttgggacacct

SEQ ID NO: 23614 - DNA, 71 bp, chicken (Gallus Gallus)
  misc_feature (36): n=a or c
tgtgccaggcagaaggcacagaaactaataggtgtnatttgtttaagaagatattaccaagcttttgtcac

SEQ ID NO: 23615 - DNA, 71 bp, chicken (Gallus Gallus)
  misc_feature (36): n=a or g
ggcctacagagaccaaaccttacaggagctcaatgnaaatggtattcccagttcacacaatttgcttcaga

SEQ ID NO: 23616 - DNA, 71 bp, chicken (Gallus Gallus)
  misc_feature (36): n=c or t
acttactcttagcctgatgctttccttaatacaccnttccaaagctgcttttgtgcagatcctttttagtc

SEQ ID NO: 23617 - DNA, 71 bp, chicken (Gallus Gallus)
  misc_feature (36): n=a or g
ataaagaaataaaaggaacaagggggagcaaggccncagtggcttctccattaatgcatttatcccatttg

SEQ ID NO: 23618 - DNA, 71 bp, chicken (Gallus Gallus)
  misc_feature (36): n=c or t
tttttttttttgatacaatatacctcttgtaagtanaataccagaattataatttatgaggactactctga

SEQ ID NO: 23619 - DNA, 71 bp, chicken (Gallus Gallus)
  misc_feature (36): n=c or t
aacctgtgccagtacctcaccaccctcattgtatangtctgtttccttgtttccaagctaaatctttcctc

SEQ ID NO: 23620 - DNA, 71 bp, chicken (Gallus Gallus)
  misc_feature (36): n=a or g
ttcttgatgaggtgctgtagtcacgtttccctcatnttcactaaggtaaaagttaaatcactttgattttc

SEQ ID NO: 23621 - DNA, 71 bp, chicken (Gallus Gallus)
  misc_feature (36): n=c or t
gaggcacatccaccctgtaaaaagctagttacttcngctttactatatataagcgcttgatctaaaagaat

SEQ ID NO: 23622 - DNA, 71 bp, chicken (Gallus Gallus)
  misc_feature (36): n=c or t
gtgaaagtgcagaattgagctgcaactgaaaaccancatcttcctgactgcatcttttccagtcggtgggt

SEQ ID NO: 23623 - DNA, 71 bp, chicken (Gallus Gallus)
  misc_feature (36): n=a or t
agatactctaagattaagatcagaggtcacaatacntaagcaaataaggcagagtgaagttaggatataat

SEQ ID NO: 23624 - DNA, 71 bp, chicken (Gallus Gallus)
  misc_feature (36): n=a or t
gtctagtcaatgattctaagcaaataccaagtaatnttttcatataggtaaccaagggtatggaagacaag

SEQ ID NO: 23625 - DNA, 71 bp, chicken (Gallus Gallus)
  misc_feature (36): n=c or t
gtctcctcctgccacccacgttcttcttgtatgtgngttccctccatctgctccattgggatgtatgtcta

SEQ ID NO: 23626 - DNA, 71 bp, chicken (Gallus Gallus)
  misc_feature (36): n=c or t
actggctgcaaaaggcaacaacagttcttctcatgntgggttttgaagctctcagagtttcatgaaaattg

SEQ ID NO: 23627 - DNA, 71 bp, chicken (Gallus Gallus)
  misc_feature (36): n=c or t
ttgctttctagtaaaaatccaagctgaacaataaangatatcagaaaaaaaaaaaaacagaagctaatgta

SEQ ID NO: 23628 - DNA, 71 bp, chicken (Gallus Gallus)
  misc_feature (36): n=a or g
cctgaggttttgaattcatgtgtaacaacatctgcntgccttgctgtttacaaaagatagttgttatgtat

SEQ ID NO: 23629 - DNA, 71 bp, chicken (Gallus Gallus)
  misc_feature (36): n=a or g
agcaggaagtatgtttttcccaattcctaacttctnacatggtccccaaccactatgaacattaaatccgg

SEQ ID NO: 23630 - DNA, 71 bp, chicken (Gallus Gallus)
  misc_feature (36): n=a or g
ccccccacgaggtcacagatctacacccagagagcnatcagaaggacaataagcctcagtgttcagacctc

SEQ ID NO: 23631 - DNA, 71 bp, chicken (Gallus Gallus)
  misc_feature (36): n=a or g
ttacttttgaaattctattcttgtatgttatttgtntaggtgtcatttttagtgtcagtatgtcccagaga

SEQ ID NO: 23632 - DNA, 71 bp, chicken (Gallus Gallus)
  misc_feature (36): n=a or g
tgggggaaaattggagttcattcgttcattcattcnttcattctgcataccatttccatacccgcccaaac

SEQ ID NO: 23633 - DNA, 71 bp, chicken (Gallus Gallus)
  misc_feature (36): n=a or t
tactgtgtaatcaccagcagtaagcagcctttgctnggtgctggtcctgtaattacagattaataaaaggg

SEQ ID NO: 23634 - DNA, 71 bp, chicken (Gallus Gallus)
  misc_feature (36): n=c or t
aatgccgatggtggtcgttccagttacctgactgtntgattttacagaaggttcaatttattcagatttcc

SEQ ID NO: 23635 - DNA, 71 bp, chicken (Gallus Gallus)
  misc_feature (36): n=g or t
acaaagcctaccacttattttcctgtacataccaanaaatcaactctagctctctggtttgggcttgcagc

SEQ ID NO: 23636 - DNA, 71 bp, chicken (Gallus Gallus)
  misc_feature (36): n=a or g
gcaaatctgaaaatacagccacgtagaagacatgcnagtgcacccagtcatgttcagccctctgattctga

SEQ ID NO: 23637 - DNA, 71 bp, chicken (Gallus Gallus)
  misc_feature (36): n=c or t
ttcacagactttccactctttcctcccacttctccntcacttccattaattatgtcacatttcctctcaag

SEQ ID NO: 23638 - DNA, 71 bp, chicken (Gallus Gallus)
  misc_feature (36): n=a or g
atatgaacatatataccaatatctcaatgctgttcntctgaagtgtttttgtttgcctttttctttgtttc

SEQ ID NO: 23639 - DNA, 71 bp, chicken (Gallus Gallus)
  misc_feature (36): n=c or g
gcctgcgatggtctcagcacagagtagcaagagagntgtctctgttgggactgtgagacggtgagaaatgc

SEQ ID NO: 23640 - DNA, 71 bp, chicken (Gallus Gallus)
  misc_feature (36): n=a or g
tgaactcttgaaaagtggtgactgcttcttcgctgntaagctaatgtgaatggggtttcctgaatattgtg

SEQ ID NO: 23641 - DNA, 71 bp, chicken (Gallus Gallus)
  misc_feature (36): n=c or g
ttgcatataaaaatagacaattttcacacaataaancagtttaataaatcatcgcttaggttctttggcat

SEQ ID NO: 23642 - DNA, 71 bp, chicken (Gallus Gallus)
  misc_feature (36): n=a or g
cctttatttcaggacacttgcttgcagagggagatncgtttctggttgctgttgacgtcgcatgttttgtt

SEQ ID NO: 23643 - DNA, 71 bp, chicken (Gallus Gallus)
  misc_feature (36): n=a or g
gacatagctaaggaaacgcaaaatgtttccaggtcngtttgcatccacacagagagaaactgcaacccatc

SEQ ID NO: 23644 - DNA, 71 bp, chicken (Gallus Gallus)
  misc_feature (36): n=c or t
atacatgctgctctatgccagcagcccctagctagntaatgccaagctggaagcatttccctgacattgca

SEQ ID NO: 23645 - DNA, 71 bp, chicken (Gallus Gallus)
  misc_feature (36): n=a or c
catctatcagtttccacctgttactcttgtcatttntttcacttattgtttctgaagtttgacttttagct

SEQ ID NO: 23646 - DNA, 71 bp, chicken (Gallus Gallus)
  misc_feature (36): n=a or g
tgagtaagtcataaatgccactggtttgtccaaatnagaaagatgttttaacagtccctgatgggatgtgt

SEQ ID NO: 23647 - DNA, 71 bp, chicken (Gallus Gallus)
  misc_feature (36): n=a or g
tcacctttcacttgtaagggcgtgttattactcccntgatacgtgttttcttgcaaatgtgcttctgattc

SEQ ID NO: 23648 - DNA, 71 bp, chicken (Gallus Gallus)
  misc_feature (36): n=c or g
atttctcaagtttaggatagttaatgagacagaaanaatctagcacctctttatgaacattgaaattgcat

SEQ ID NO: 23649 - DNA, 71 bp, chicken (Gallus Gallus)
  misc_feature (36): n=g or t
tttggcacaagtcacttaatccatgtcccttagaanggacaagagaactggccaaaggcagagacattgca

SEQ ID NO: 23650 - DNA, 71 bp, chicken (Gallus Gallus)
  misc_feature (36): n=c or t
caagaaagtgtgtaaagaatatatatttgcaaatgnacttgctatttggaataataattaaaacacttgca

SEQ ID NO: 23651 - DNA, 71 bp, chicken (Gallus Gallus)
  misc_feature (36): n=a or g
cttcagtaccctgcagcacaggagaaaggaaacaanagatgaatgtctgtttgggaacctacttgatgccc

SEQ ID NO: 23652 - DNA, 71 bp, chicken (Gallus Gallus)
  misc_feature (36): n=c or t
ctgtggatccacgtgggctttgaaggcttcctcatntgtctgaacatgttctattaacagagcttgcctgt

SEQ ID NO: 23653 - DNA, 71 bp, chicken (Gallus Gallus)
  misc_feature (36): n=a or g
tctgaagtcagattcttaattgctctcaaatgcatnactgttagcaaaaaggatagcactatgatttaagt

SEQ ID NO: 23654 - DNA, 71 bp, chicken (Gallus Gallus)
  misc_feature (36): n=c or g
tctcatcccgtcttcaaattccattgcttaggcaanaaatttccttgcttgtgtgaagtgaaagccagaaa

SEQ ID NO: 23655 - DNA, 71 bp, chicken (Gallus Gallus)
  misc_feature (36): n=c or t
acaagtactggtgttaaaggatccacctacagtttngcagagaacggatggacaacaatggagtaccagag

SEQ ID NO: 23656 - DNA, 71 bp, chicken (Gallus Gallus)
  misc_feature (36): n=c or t
cttttccttttggcttagataaaggaaagatcagantgaattctcctatactacagactgtatgagaatgg

SEQ ID NO: 23657 - DNA, 71 bp, chicken (Gallus Gallus)
  misc_feature (36): n=c or t
agtctgagctttggtctgctgagatctttggtccangatctactgagacccagaaacttaaatcttgcctt

SEQ ID NO: 23658 - DNA, 71 bp, chicken (Gallus Gallus)
  misc_feature (36): n=a or g
atcacagttcagggcgtttgctttccttcttcaaanttagtataagtgaactctccttcactgccaaaaag

SEQ ID NO: 23659 - DNA, 71 bp, chicken (Gallus Gallus)
  misc_feature (36): n=a or t
tagaaggggattgaattctattaaaggacctggctntctgcttgctgatggaagcttggtgtcaggctagg

SEQ ID NO: 23660 - DNA, 71 bp, chicken (Gallus Gallus)
  misc_feature (36): n=g or t
gctttttgcctcaagttccttcctgcccgcatgtgnttatattgcttccagatcaatgccgactcacataa

SEQ ID NO: 23661 - DNA, 71 bp, chicken (Gallus Gallus)
  misc_feature (36): n=a or g
gtaaaatgttggttggtcattctgctgcacagagangggttatgtgctgttttgttgctcatttctaaatt

SEQ ID NO: 23662 - DNA, 71 bp, chicken (Gallus Gallus)
  misc_feature (36): n=a or g
gaaggggcactgcaaattgaatcaaaaagcaccaancatttctaaagcttctggaatcagttcaagctctt

SEQ ID NO: 23663 - DNA, 71 bp, chicken (Gallus Gallus)
  misc_feature (36): n=c or t
atcacagaaaacaagaaagaaatagagatctctagnaggactcagctgagaaggtgtggtgacgagaatag

SEQ ID NO: 23664 - DNA, 71 bp, chicken (Gallus Gallus)
  misc_feature (36): n=a or g
tagtcacttaatagtcatgtcagctgctaagcaggnaaaaaaaaagagaaaaaagatgagcagaagcatca

SEQ ID NO: 23665 - DNA, 71 bp, chicken (Gallus Gallus)
  misc_feature (36): n=a or g
ggtgtacggaaactgcggaaaaccaaagaaggagancagatagtaatgtgtatatagccaacagattttcc

SEQ ID NO: 23666 - DNA, 71 bp, chicken (Gallus Gallus)
  misc_feature (36): n=a or g
gcagacagtaagtaaagattagaaacatcagtctcnaaaagtactgtttttgtgtcctagcattatgagca

SEQ ID NO: 23667 - DNA, 71 bp, chicken (Gallus Gallus)
  misc_feature (36): n=c or t
gtagtaagtgattaataggtgcaaaaatttgtaagngattagtgattaaacaaatgcttttggtcactgca

SEQ ID NO: 23668 - DNA, 71 bp, chicken (Gallus Gallus)
  misc_feature (36): n=a or g
tggatttacttcatctcatgaaaattgttcatttcnagcttcaccatgcagtgttcagaaatagaagctag

SEQ ID NO: 23669 - DNA, 71 bp, chicken (Gallus Gallus)
  misc_feature (36): n=c or t
tgcaaggacagacttctctgtgcaactgtgagagangtaaaatctaacattttctgtaagcattcttgtgg

SEQ ID NO: 23670 - DNA, 71 bp, chicken (Gallus Gallus)
  misc_feature (36): n=c or t
tattccaaatacttctgaagtggtgattttcttcanttagacttttaggtaacttaagcatggtcagttct

SEQ ID NO: 23671 - DNA, 71 bp, chicken (Gallus Gallus)
  misc_feature (36): n=c or t
ttcctgatgctgatctaaggagtaagaatagactanttctaatgctattctgtcttacagtcccaagtgtg

SEQ ID NO: 23672 - DNA, 71 bp, chicken (Gallus Gallus)
  misc_feature (36): n=c or t
aaaagactgtactttttcttttcttttcttttcttntttttttaagccaagataattagctttgtattttg

SEQ ID NO: 23673 - DNA, 71 bp, chicken (Gallus Gallus)
  misc_feature (36): n=c or t
tcataaaaggcaattcaacttcagaaggaatgtcangattgaagtgaaagcttagcagctgctctgcagga

SEQ ID NO: 23674 - DNA, 71 bp, chicken (Gallus Gallus)
  misc_feature (36): n=c or t
actcagttccttcacaactgctaacacctattaaantgctattaaaaaataaatacaccaacataaaaaaa

SEQ ID NO: 23675 - DNA, 71 bp, chicken (Gallus Gallus)
  misc_feature (36): n=c or t
tgttctgttcttatcagcagacctcatagcctttangtcttacgttgattgcagtttaggtaatcatttct

SEQ ID NO: 23676 - DNA, 71 bp, chicken (Gallus Gallus)
  misc_feature (36): n=a or t
ttttttttctttttttttttttttttttgaaactgngaaaaagcactcttgtcttgggctagaagtagtat

SEQ ID NO: 23677 - DNA, 71 bp, chicken (Gallus Gallus)
  misc_feature (36): n=c or t
cttgcacaactgcccgtccttgcagacattccacanttgtaaacaacgcctcttgtgctggaagaagatgc

SEQ ID NO: 23678 - DNA, 71 bp, chicken (Gallus Gallus)
  misc_feature (36): n=a or g
ggtctatgaaccgtgcatgtctgagcttgaatgaanggtgggatatcccttggatagagggaagggcagca

SEQ ID NO: 23679 - DNA, 71 bp, chicken (Gallus Gallus)
  misc_feature (36): n=a or g
ctttttattcagaagcacctcaccccacttgaatgnagcacctacatattttctttcacacacacacacac

SEQ ID NO: 23680 - DNA, 71 bp, chicken (Gallus Gallus)
  misc_feature (36): n=c or g
gcaatttatgtgtgcctaaaaagtgcctttggcttncgtagttaaaatatctctgctgttttagcctatag

SEQ ID NO: 23681 - DNA, 71 bp, chicken (Gallus Gallus)
  misc_feature (36): n=a or t
tccaactcaacccgttccattctatgttccagcaanatgagatgtctccacgcatctctctggagaaagaa

SEQ ID NO: 23682 - DNA, 71 bp, chicken (Gallus Gallus)
  misc_feature (36): n=c or t
cctgaggagatgcagtgagtgccctggctgccagcnatctgtgcacactgacttaaacctgagggcctact

SEQ ID NO: 23683 - DNA, 71 bp, chicken (Gallus Gallus)
  misc_feature (36): n=c or t
tgtgttaagccaagtccctccctgttactaagttcngtagttcataaaaagacagcctatatgctgtcagt

SEQ ID NO: 23684 - DNA, 71 bp, chicken (Gallus Gallus)
  misc_feature (36): n=c or t
aatatgtcctttggtaagcattaacaagatccttcncaaccacctgcagacatgtagaaagaagctccaga

SEQ ID NO: 23685 - DNA, 71 bp, chicken (Gallus Gallus)
  misc_feature (36): n=c or g
atttaaagttcatcagcacaacagagaattaactcnaggctgatttctagaggtggctggaacaagcagtg

SEQ ID NO: 23686 - DNA, 71 bp, chicken (Gallus Gallus)
  misc_feature (36): n=a or t
caccattgaaaaacgtagtccttttatcgtattganccctgtaaaagatgctgcttttcttatttcatcct

SEQ ID NO: 23687 - DNA, 71 bp, chicken (Gallus Gallus)
  misc_feature (36): n=c or t
tgcatccgctgggttgtcatctctacccagtacccntcttgtttcagagctggctgggacttgcatgggtc

SEQ ID NO: 23688 - DNA, 71 bp, chicken (Gallus Gallus)
  misc_feature (36): n=c or t
ggttggaaaattgtgctcttgcaacgagacatccanggtttgtgtcttgcagatgacccaaacatgggtgt

SEQ ID NO: 23689 - DNA, 71 bp, chicken (Gallus Gallus)
  misc_feature (36): n=c or t
gtgtcttcaaaatgaaattcttgcagtgccatgacnactgacccacccacaaccattgcaggcgtatagtc

SEQ ID NO: 23690 - DNA, 71 bp, chicken (Gallus Gallus)
  misc_feature (36): n=a or t
aattcaaggtaaaactgattttgaactcaaacatcnctgcagaaactatcacgtggaagttttccatttga

SEQ ID NO: 23691 - DNA, 71 bp, chicken (Gallus Gallus)
  misc_feature (36): n=a or g
acatgcagtggattaaaaagggagtgtttgcataangggatgttcaggttacaaaaaaggaatggatattt

SEQ ID NO: 23692 - DNA, 71 bp, chicken (Gallus Gallus)
  misc_feature (36): n=c or t
gaaagcaagctttggggatttagttttacggaattncatgctggtgataaaagatttctgaggaaagcact

SEQ ID NO: 23693 - DNA, 71 bp, chicken (Gallus Gallus)
  misc_feature (36): n=a or g
tacagttgttaaagatgaccatgtaagtacagcttncttagagaataaatggttccaattacccccagaga

SEQ ID NO: 23694 - DNA, 71 bp, chicken (Gallus Gallus)
  misc_feature (36): n=a or c
acattcataagacatactgtactttaaagggtccantcctgttcacgtccacagaagcagaagctttgcca

SEQ ID NO: 23695 - DNA, 71 bp, chicken (Gallus Gallus)
  misc_feature (36): n=a or t
tacatagtgcaaacagctccctgtgtgtgtgatacntaaaagtgatacataaaagaaataaggaagagtgt

SEQ ID NO: 23696 - DNA, 71 bp, chicken (Gallus Gallus)
  misc_feature (36): n=a or g
tttcacatacacagtagtgacataattcctttttgnttgttacattattaaaatgatttatggactgttct

SEQ ID NO: 23697 - DNA, 71 bp, chicken (Gallus Gallus)
  misc_feature (36): n=g or t
agaaactcaaataagtgctactactggctatggagngaagttactgatatcccacagaaatatttctgtaa

SEQ ID NO: 23698 - DNA, 71 bp, chicken (Gallus Gallus)
  misc_feature (36): n=g or t
ttaccaagctgggtggaagaaggttggagctacatnaaatttgtttcatgcctgcttgatttcaaatgtga

SEQ ID NO: 23699 - DNA, 71 bp, chicken (Gallus Gallus)
  misc_feature (36): n=c or t
actgcagagctccaaatgagatcacttttcttcgcnctgcaagggaggagggtggatgaggtgagccagag

SEQ ID NO: 23700 - DNA, 71 bp, chicken (Gallus Gallus)
  misc_feature (36): n=a or g
ttaagtatacttccacttctctgatagttgcatcancacacatctagtaataccctgtgcattaaagcctc

SEQ ID NO: 23701 - DNA, 71 bp, chicken (Gallus Gallus)
  misc_feature (36): n=c or g
cttactcgtgggttggtaatgtaaactgggttagtngaaggaggagctgggatatgtcagagacttgggaa

SEQ ID NO: 23702 - DNA, 71 bp, chicken (Gallus Gallus)
  misc_feature (36): n=c or t
acccatatttttggaaagagaacacttggccttttnacagtctaccccccagataactaggcttctatttc

SEQ ID NO: 23703 - DNA, 71 bp, chicken (Gallus Gallus)
  misc_feature (36): n=c or t
gccacctctgtctaactgtgttcctgctgccctcanggtcactttggttcttgttaaaaaccaacatgaag

SEQ ID NO: 23704 - DNA, 71 bp, chicken (Gallus Gallus)
  misc_feature (36): n=a or t
ggcatacaaaaaaagaacagtaataggctggacatntcagatattttgtggggaaagagtgtcttgcatga

SEQ ID NO: 23705 - DNA, 71 bp, chicken (Gallus Gallus)
  misc_feature (36): n=g or t
ggagaggatggagattacaggaataaaaacagcacngcttacaggaagggaatctaatcggtgttttcatg

SEQ ID NO: 23706 - DNA, 71 bp, chicken (Gallus Gallus)
  misc_feature (36): n=a or g
ttttagcttcactttattttgtactcttttcaatgngcttcttcaatgattaactattttccagcttccac

SEQ ID NO: 23707 - DNA, 71 bp, chicken (Gallus Gallus)
  misc_feature (36): n=a or g
ttccactagatggagacaggacactggatcactttntcctccaggaggacgctgacaatcaggaacacgaa

SEQ ID NO: 23708 - DNA, 71 bp, chicken (Gallus Gallus)
  misc_feature (36): n=c or t
ggaaaacacacaatagaggtcccagtccccagtganggtgaatatgttgttgaggtccgagcacacagtga

SEQ ID NO: 23709 - DNA, 71 bp, chicken (Gallus Gallus)
  misc_feature (36): n=c or t
agcttcctgtctcgctgttctgctcaccatccattntaatgcacagtactttctgcttccagtcggtccat

SEQ ID NO: 23710 - DNA, 71 bp, chicken (Gallus Gallus)
  misc_feature (36): n=a or g
tgtaagcagttggtcttaacagaaccatgttacctnaaatgtgcctttagagttcttttaaacgctggctt

SEQ ID NO: 23711 - DNA, 71 bp, chicken (Gallus Gallus)
  misc_feature (36): n=c or g
aggtgtgaacaatatttagaaaactgatgatgttgnagtcacactcgtgttctgcagcacagattacaaca

SEQ ID NO: 23712 - DNA, 71 bp, chicken (Gallus Gallus)
  misc_feature (36): n=c or t
atggcaaaaccaaattttgagtaattaagagacttnagaagcctcccatcaagtaacctctttgagctaac

SEQ ID NO: 23713 - DNA, 71 bp, chicken (Gallus Gallus)
  misc_feature (36): n=g or t
gcaaaatggaggattctcaaccaaacagaactggangtaggatgcagagggaatacttgagcctgcaacca

SEQ ID NO: 23714 - DNA, 71 bp, chicken (Gallus Gallus)
  misc_feature (36): n=g or t
gctttgcaaacatccaatatctgaacctccattccnagatgtccaatagttagcaaagatgcacagatata

SEQ ID NO: 23715 - DNA, 71 bp, chicken (Gallus Gallus)
  misc_feature (36): n=c or t
agctttctcttcttccattctttgttctcgtactcntttatagctttttgggaatcacagatgtgtgaggc

SEQ ID NO: 23716 - DNA, 71 bp, chicken (Gallus Gallus)
  misc_feature (36): n=a or g
ctgagggtatctctgcagctacagcactcctgcagncagcctactcttagcccctacactcacctacctgt

SEQ ID NO: 23717 - DNA, 71 bp, chicken (Gallus Gallus)
  misc_feature (36): n=c or g
tcaagagtgcaaacagataaagactacagcaaggtnctgcttgcttctttggtgtgccagaattcaaggac

SEQ ID NO: 23718 - DNA, 71 bp, chicken (Gallus Gallus)
  misc_feature (36): n=a or t
aaaaatatattccaacatatatcttctagaaaagcngcaaaaaatgtaatacttgatcattttctaaacaa

SEQ ID NO: 23719 - DNA, 71 bp, chicken (Gallus Gallus)
  misc_feature (36): n=a or c
gaaggttctctctcttagttttagtgatatgatacnaactgcaaactgcaatggtacaataccagttgcta

SEQ ID NO: 23720 - DNA, 71 bp, chicken (Gallus Gallus)
  misc_feature (36): n=a or g
ttcattttgtctgtttgtataggttccttcttgaancagtctcaaatagttgattcctgaattctgtcaaa

SEQ ID NO: 23721 - DNA, 71 bp, chicken (Gallus Gallus)
  misc_feature (36): n=a or g
tctggctcttctggctggcactcaacattctctgtntcctttttggtcataggataatgctgacgtggaac

SEQ ID NO: 23722 - DNA, 71 bp, chicken (Gallus Gallus)
  misc_feature (36): n=a or t
tgagacccagtgccatataggaacttgtgtttgcanaggctggtcaccaaattaaagaggcccagaaggga

SEQ ID NO: 23723 - DNA, 71 bp, chicken (Gallus Gallus)
  misc_feature (36): n=a or g
attctgaagtatttcttcaacaataaaatacacccntagaatcatagaatgatttgggttggaggggacca

SEQ ID NO: 23724 - DNA, 71 bp, chicken (Gallus Gallus)
  misc_feature (36): n=a or g
atacagcttatttgatctaaaatttaagtaggtttnatttgtgtcagacactaaccccagaggatggaaag

SEQ ID NO: 23725 - DNA, 71 bp, chicken (Gallus Gallus)
  misc_feature (36): n=a or g
acataactgtggcctggacctatctcaccgacatgngcaggaaatatactctacatgtatacagtctaaac

SEQ ID NO: 23726 - DNA, 71 bp, chicken (Gallus Gallus)
  misc_feature (36): n=a or c
attatagaattatagtaagaagtatacataaaaatnatgattggatacattggtttaaaatggatgtgaaa

SEQ ID NO: 23727 - DNA, 71 bp, chicken (Gallus Gallus)
  misc_feature (36): n=g or t
cctcctattctgttatgttgcaccatgacatcagangtggatgttggtggtacagcagtaggggttgaacc

SEQ ID NO: 23728 - DNA, 71 bp, chicken (Gallus Gallus)
  misc_feature (36): n=c or t
gattggaaagaaccagtggaagtcaaatgatctatntgccatctcaagcatacttacccagaactgcttcc

SEQ ID NO: 23729 - DNA, 71 bp, chicken (Gallus Gallus)
  misc_feature (36): n=a or g
ttctgttactatagcaataccagctgcaaatagtangtagataaatagggttttgcatgtattcatccaga

SEQ ID NO: 23730 - DNA, 71 bp, chicken (Gallus Gallus)
  misc_feature (36): n=a or g
atgcagtgcctcctgagcaccaattgcctctgtgcngctgacttgattgccttagcgctgtttcagtggaa

SEQ ID NO: 23731 - DNA, 71 bp, chicken (Gallus Gallus)
  misc_feature (36): n=a or g
aaccacagatgaatttagccttcagcaaattagcancttccagtgggaaaagagcctgtctgaaacacaga

SEQ ID NO: 23732 - DNA, 71 bp, chicken (Gallus Gallus)
  misc_feature (36): n=c or t
tattaaatttttccttttcctggtttgtccatgganttgctgagtaattgtagcaaactcactatttgttt

SEQ ID NO: 23733 - DNA, 71 bp, chicken (Gallus Gallus)
  misc_feature (36): n=a or g
tttcagctttatttaatatgtgtagttaaaaaaagnaaaaagaggggggtttcaatatttgctattattaa

SEQ ID NO: 23734 - DNA, 71 bp, chicken (Gallus Gallus)
  misc_feature (36): n=c or t
ctctctcttttcattcatcagagagggtacactaanctttgcccatttcttctgtctaatgcagctaaaga

SEQ ID NO: 23735 - DNA, 71 bp, chicken (Gallus Gallus)
  misc_feature (36): n=c or t
tgtttctttttcttcttgtcctgttagcctcacagntggcacttgttgcacttgtctctacttttctccat

SEQ ID NO: 23736 - DNA, 71 bp, chicken (Gallus Gallus)
  misc_feature (36): n=a or g
ggaagagacagctattgctgaagaatggatagtctngggcaaaactaatcacggatctgaaaaacagacct

SEQ ID NO: 23737 - DNA, 71 bp, chicken (Gallus Gallus)
  misc_feature (36): n=c or t
gtgatttttttttttttcctaaattgtataagtacnccctatggatttcaatgcaattattttaatttatg

SEQ ID NO: 23738 - DNA, 71 bp, chicken (Gallus Gallus)
  misc_feature (36): n=a or g
agctctgcagtaaatctgaatgtgagaagcctatcntggtttgctgttgtcaagtaggtttgagcatttga

SEQ ID NO: 23739 - DNA, 71 bp, chicken (Gallus Gallus)
  misc_feature (36): n=c or t
atactcaatagagggcttacatcagaaagaaatacngcttacactgacaagtgacacattagaaaacacgt

SEQ ID NO: 23740 - DNA, 71 bp, chicken (Gallus Gallus)
  misc_feature (36): n=c or t
ttattacatgggatcactataacctagatgaaaaantgcatattcactgcttttttcttttcttgtttttt

SEQ ID NO: 23741 - DNA, 71 bp, chicken (Gallus Gallus)
  misc_feature (36): n=c or t
tttctacacagacttcaaaaccacaaatgattttcncacaagatgagataaaagtactgagagaagcaact

SEQ ID NO: 23742 - DNA, 71 bp, chicken (Gallus Gallus)
  misc_feature (36): n=a or c
gaatcccctttttaatcaggaagcttagctttcacngttaaaataagacatacaattattttgatgttttt

SEQ ID NO: 23743 - DNA, 71 bp, chicken (Gallus Gallus)
  misc_feature (36): n=a or t
tttccctaccaagtgtttcaagactggacagaaaanaaaccaacaaacatttctacaacggacagtggacc

SEQ ID NO: 23744 - DNA, 71 bp, chicken (Gallus Gallus)
  misc_feature (36): n=c or g
atctaaaaatatatctacatgcatggctcacatttnaagtttacagagagctcagtgacaacgtaaccatg

SEQ ID NO: 23745 - DNA, 71 bp, chicken (Gallus Gallus)
  misc_feature (36): n=c or g
tgaaaaggataagaaacaagaagatagacatgaganggtaatgataaagaactgcaggagcttgagtgaaa

SEQ ID NO: 23746 - DNA, 71 bp, chicken (Gallus Gallus)
  misc_feature (36): n=a or g
aatatgactacagagtctgccagcaggatgtgacanggttgtcctggggtcactgtcattgctaccgagtc

SEQ ID NO: 23747 - DNA, 71 bp, chicken (Gallus Gallus)
  misc_feature (36): n=a or g
ttacaggaaattcttgttcgttttaattatcatccnttagatgtttttcatgactgtcgtgagtaaaactt

SEQ ID NO: 23748 - DNA, 71 bp, chicken (Gallus Gallus)
  misc_feature (36): n=g or t
tctttagtgacccttctcttgaggtgtgcactgatngattgttgccaatgtcttctgtagcaagtgatttg

SEQ ID NO: 23749 - DNA, 71 bp, chicken (Gallus Gallus)
  misc_feature (36): n=c or g
ggctggaaggtaaggctgaacaggactcattccctntcctaacctcgcagctttgctccctcccttcttgt

SEQ ID NO: 23750 - DNA, 71 bp, chicken (Gallus Gallus)
  misc_feature (36): n=a or g
aggaagtgactaagttcagtcagaaggcagtcaatnctaaattggtgtcactgcttgaatttcattgttta

SEQ ID NO: 23751 - DNA, 71 bp, chicken (Gallus Gallus)
  misc_feature (36): n=a or g
acagaattgctgcatttgtaacaaagaacggcaaanaaagatgtaccacaaaccctaatccgcacaaaaag

SEQ ID NO: 23752 - DNA, 71 bp, chicken (Gallus Gallus)
  misc_feature (36): n=a or c
aagacataataaattcacaaaaaaaattacaatagnttgcttacttgagaatgaagcaggtgggttcaaga

SEQ ID NO: 23753 - DNA, 71 bp, chicken (Gallus Gallus)
  misc_feature (36): n=a or g
tacaacgactgctccaaaagcaatgtctccattatnttatgttggcctacaaagttagaggcagatgttgg

SEQ ID NO: 23754 - DNA, 71 bp, chicken (Gallus Gallus)
  misc_feature (36): n=c or t
attttgatgttgtaattgcctttgaatcaggtcacnctaatctcattatttaactgaccagggatctaaac

SEQ ID NO: 23755 - DNA, 71 bp, chicken (Gallus Gallus)
  misc_feature (36): n=c or g
acatgcttgtttctctaaagttaacctgtgctttcngtactgctcagtgggaaaatgctgtgactccctga

SEQ ID NO: 23756 - DNA, 71 bp, chicken (Gallus Gallus)
  misc_feature (36): n=a or g
tgttaatgctttaaaaagaaacacagtaacaaacancctccacccccagaaacacaaagaaaccccactcc

SEQ ID NO: 23757 - DNA, 71 bp, chicken (Gallus Gallus)
  misc_feature (36): n=c or t
caccagctctaagtgcactgtgcttgaagcaaatgngttcatcttagatagtcattcattagaaatccttg

SEQ ID NO: 23758 - DNA, 71 bp, chicken (Gallus Gallus)
  misc_feature (36): n=a or g
aagatctgtttattttcctagtaggctgtcacgctncaacaaggttaacttgtccactgtgaaacaaaaaa

SEQ ID NO: 23759 - DNA, 71 bp, chicken (Gallus Gallus)
  misc_feature (36): n=c or t
cctccttgtcccctcctctctcactccccttttttnacttcctatgaatggaaaaaccttcagaatacttg

SEQ ID NO: 23760 - DNA, 71 bp, chicken (Gallus Gallus)
  misc_feature (36): n=a or t
ttgtaaatactagtgaaataggataaaattaggctntttcagattcagtgacttcccaaattcctattaca

SEQ ID NO: 23761 - DNA, 71 bp, chicken (Gallus Gallus)
  misc_feature (36): n=a or c
tcggtgcggccggcaagccaaaaaattagatattcntgattgtatggtatttaataccaggataagtctct

SEQ ID NO: 23762 - DNA, 71 bp, chicken (Gallus Gallus)
  misc_feature (36): n=c or t
caggctcacaagacagattttactgttgtttatgantcatggtttacaaaattctattctcctatgtggga

SEQ ID NO: 23763 - DNA, 71 bp, chicken (Gallus Gallus)
  misc_feature (36): n=c or t
agaaatacacattccacattgtaagcagttcctatnatatcataagttatggaagaaccattttttgtcat

SEQ ID NO: 23764 - DNA, 71 bp, chicken (Gallus Gallus)
  misc_feature (36): n=a or t
ttgctccatgaacaaggagttctctaagaagtgggncaaggcactctgaaacattctggctttggaatact

SEQ ID NO: 23765 - DNA, 71 bp, chicken (Gallus Gallus)
  misc_feature (36): n=c or g
aagacactatggaaatgatttgatctaagctcaggntctgggtcatataagactttctggtgggtattttg

SEQ ID NO: 23766 - DNA, 71 bp, chicken (Gallus Gallus)
  misc_feature (36): n=c or t
tgaataccaggatttagcctgctaccttatgctganaatgttctagtgacctgcatgaaagcattcaccat

SEQ ID NO: 23767 - DNA, 71 bp, chicken (Gallus Gallus)
  misc_feature (36): n=c or t
aaactgacttgcaaatggcagaaagaagacagcaantcttcatgtattcccatactggcaaaatcactaaa

SEQ ID NO: 23768 - DNA, 71 bp, chicken (Gallus Gallus)
  misc_feature (36): n=a or c
agtaggatgaatgcatagaaaaagctgtgtgttgcnttaaaattactaatattttggagaaaacacatcta

SEQ ID NO: 23769 - DNA, 71 bp, chicken (Gallus Gallus)
  misc_feature (36): n=a or g
gaagacggtcaagtgccattatgttaaggacatccnatttcagtatctgtaagtattaatacagttttcag

SEQ ID NO: 23770 - DNA, 71 bp, chicken (Gallus Gallus)
  misc_feature (36): n=c or t
gtgactagactacgtatctcattttcactccaatgncttttttttttttttttttaattgtataattttaa

SEQ ID NO: 23771 - DNA, 71 bp, chicken (Gallus Gallus)
  misc_feature (36): n=c or t
tagacctttttttactcaggagggtaatccttaccngacctctacaatctccacctaaaccacaaatgtat

SEQ ID NO: 23772 - DNA, 71 bp, chicken (Gallus Gallus)
  misc_feature (36): n=a or g
agaattattcccaaccatggagtgtgtttggaaatntacagttcttaacattatgttttgcttaatacagc

SEQ ID NO: 23773 - DNA, 71 bp, chicken (Gallus Gallus)
  misc_feature (36): n=g or t
aagcacccaagagaattcatggcctgtcttcctctntaaaatccttgccactcttgacatgtagcatgctc

SEQ ID NO: 23774 - DNA, 71 bp, chicken (Gallus Gallus)
  misc_feature (36): n=c or t
tggtggtacacaggaaaaacaaatctgagctaatanactgaaacagaaaactgttatctgtgatctgtgtc

SEQ ID NO: 23775 - DNA, 71 bp, chicken (Gallus Gallus)
  misc_feature (36): n=a or g
gggaagaagatcaccagggggcagaggaaggcttcnaaagagatggtgaagtgctaagcaaaagcagccat

SEQ ID NO: 23776 - DNA, 71 bp, chicken (Gallus Gallus)
  misc_feature (36): n=a or g
tattcatactattgagctgatcgacctggacaaagngctgggtaccaacctgcatgttcagtatgctacat

SEQ ID NO: 23777 - DNA, 71 bp, chicken (Gallus Gallus)
  misc_feature (36): n=a or g
cccatgcacttattacagggcattaaggaaggagtntctgcagtcttctagagcaagcaagcggaaagaga

SEQ ID NO: 23778 - DNA, 71 bp, chicken (Gallus Gallus)
  misc_feature (36): n=c or t
aggaccacctcaactggtctttaaaaacaggaggcngacagccaatccaatgcatgtactcgttacttttt

SEQ ID NO: 23779 - DNA, 71 bp, chicken (Gallus Gallus)
  misc_feature (36): n=c or t
cccgggctgtgctggggctttaattacctctttggnagttctcacagccatcacatgttgctcacatatca

SEQ ID NO: 23780 - DNA, 71 bp, chicken (Gallus Gallus)
  misc_feature (36): n=c or t
taatctaaataacataggcagcaaccaagagagaantgaacttctctaaatccatcactgaggaacattaa

SEQ ID NO: 23781 - DNA, 71 bp, chicken (Gallus Gallus)
  misc_feature (36): n=a or g
agcaggtcatgacagtctacagacagtggaatctgnaacagaaggagcagaaacttcaagagaccaaggca

SEQ ID NO: 23782 - DNA, 71 bp, chicken (Gallus Gallus)
  misc_feature (36): n=c or t
atgtcttgatcatatgctcaagagcaaacctgtcantgtatcttggaggaggatggaagcttcctccaaga

SEQ ID NO: 23783 - DNA, 71 bp, chicken (Gallus Gallus)
  misc_feature (36): n=a or t
cagctcttgagaaaattctctgttgtgcaggtggancacagaatcatagattggcttgaatgggaagagac

SEQ ID NO: 23784 - DNA, 71 bp, chicken (Gallus Gallus)
  misc_feature (36): n=c or t
tcaagtgccatcagttgaatttgtaataacgttcangagaaacataacagatttgctggaagtagtaatga

SEQ ID NO: 23785 - DNA, 71 bp, chicken (Gallus Gallus)
  misc_feature (36): n=a or c
tagtaacacgtgggactggagtttgagatggaaatntttatggtatgttgactttctgggagtgtccaact

SEQ ID NO: 23786 - DNA, 71 bp, chicken (Gallus Gallus)
  misc_feature (36): n=g or t
tgcatattcacagtgcagagaacaagtgtgcaagtnctgttagccattattgttactatcttcctctaatc

SEQ ID NO: 23787 - DNA, 71 bp, chicken (Gallus Gallus)
  misc_feature (36): n=c or t
ctgaataaattttcccaaagaaaaacgcactcatancaatgagctgctggtttcccactcagcagttttcc

SEQ ID NO: 23788 - DNA, 71 bp, chicken (Gallus Gallus)
  misc_feature (36): n=a or g
taattgcgcacagacaatcacatatcacatcctagntctgttattcacataaaatgatacgctagttggat

SEQ ID NO: 23789 - DNA, 71 bp, chicken (Gallus Gallus)
  misc_feature (36): n=a or t
tcggaagcagctcagaggcatctaaggactgctganacctaggcatgtgtcattgggaggtatccaggaat

SEQ ID NO: 23790 - DNA, 71 bp, chicken (Gallus Gallus)
  misc_feature (36): n=a or g
agccattaggacacctgggctgggatgtgaagtctntgctgtcagcctcattcggaagcaaaaaaagtaga

SEQ ID NO: 23791 - DNA, 71 bp, chicken (Gallus Gallus)
  misc_feature (36): n=c or t
tacatttctgccttagccaaatggtagaagcagacngattgagcaaactgacgaatagtaaattgacttcc

SEQ ID NO: 23792 - DNA, 71 bp, chicken (Gallus Gallus)
  misc_feature (36): n=a or g
atgtttaaaaaagcagtggtcacaatacatcattangcagtagtatgttagatttcagactcggcctttgt

SEQ ID NO: 23793 - DNA, 71 bp, chicken (Gallus Gallus)
  misc_feature (36): n=a or g
ttggtttgtacttgagatggttgtttaccaggaaanccaaacactcgaagtctataaaatacttgccaata

SEQ ID NO: 23794 - DNA, 71 bp, chicken (Gallus Gallus)
  misc_feature (36): n=c or t
tctgaaactatgttggctagaaaatgaaatccgtantgaagtgagaaaggtgacaataagaaacatgttga

SEQ ID NO: 23795 - DNA, 71 bp, chicken (Gallus Gallus)
  misc_feature (36): n=a or g
acaagtagaagttacaaattcacaagtagaaggccnttatttctctgagaccagtcatacacagcaaggtg

SEQ ID NO: 23796 - DNA, 71 bp, chicken (Gallus Gallus)
  misc_feature (36): n=a or g
ttcaatttattacttgcctccatgggaatgttatgntctttggagtcacaaagtctttggcccacttgtga

SEQ ID NO: 23797 - DNA, 71 bp, chicken (Gallus Gallus)
  misc_feature (36): n=a or t
gaatatttatctggttaattcagccttacgtagagntgtaaaacactctttaaccagttaagtgtttgtca

SEQ ID NO: 23798 - DNA, 71 bp, chicken (Gallus Gallus)
  misc_feature (36): n=c or t
aagtggctggccttgccaatgagtccgatttattangagtgacaaattgtctgccaggtggcagctgtttc

SEQ ID NO: 23799 - DNA, 71 bp, chicken (Gallus Gallus)
  misc_feature (36): n=a or g
tctgtgtgaaagcagtcatttaggtgtgctaaatantgagtcatgttagaaaaatctcaaaagtataagac

SEQ ID NO: 23800 - DNA, 71 bp, chicken (Gallus Gallus)
  misc_feature (36): n=c or g
aatctgacagtgttagtattttaaaatgataccacntgcttttttctgcgttagaaatggttatttaaaag

SEQ ID NO: 23801 - DNA, 71 bp, chicken (Gallus Gallus)
  misc_feature (36): n=g or t
ctaggaagtaccagaaaaataaacttaactcaaatnaagatattttgtcagcccttgtaatccttggcaga

SEQ ID NO: 23802 - DNA, 71 bp, chicken (Gallus Gallus)
  misc_feature (36): n=c or t
caaaaagcgctgcccaggtgctgagcagaacagagngagacagagcaacccttttcagctcaaaggcagat

SEQ ID NO: 23803 - DNA, 71 bp, chicken (Gallus Gallus)
  misc_feature (36): n=a or g
gatactccttcaggacgtaggatgctctgtgtagancaggtaacattttctgactttcaccagaaatttca

SEQ ID NO: 23804 - DNA, 71 bp, chicken (Gallus Gallus)
  misc_feature (36): n=c or t
gcttcccgtttacatacttaccatagcatattctgnaaaacaattcttacacaaagtctgacaaataaaca

SEQ ID NO: 23805 - DNA, 71 bp, chicken (Gallus Gallus)
  misc_feature (36): n=a or g
gaaatgttgggaaccagatctgacccaagtttttcngccagccaggtcgctccgctgtgaatgccagtcct

SEQ ID NO: 23806 - DNA, 71 bp, chicken (Gallus Gallus)
  misc_feature (36): n=a or g
ggctttgctttcagagcagtccttgtatatagatgntgactatagaatcgctgctgtcagatgactgctct

SEQ ID NO: 23807 - DNA, 71 bp, chicken (Gallus Gallus)
  misc_feature (36): n=c or t
gttcagccatgcttttctagatcacatcttcaccanctgcaaaactctgaacgtctcacttccaaccaaca

SEQ ID NO: 23808 - DNA, 71 bp, chicken (Gallus Gallus)
  misc_feature (36): n=a or g
tctcatcaatggagagtgcatggagtgagctggacncctctatggatgcagttgcatgttgatctcatgca

SEQ ID NO: 23809 - DNA, 71 bp, chicken (Gallus Gallus)
  misc_feature (36): n=a or g
ccctatccatgcagtggtgacgtttataggctggancagggctcggggggatgctgcttggtgctgctttc

SEQ ID NO: 23810 - DNA, 71 bp, chicken (Gallus Gallus)
  misc_feature (36): n=a or c
ccgaatgctctcggcttttactggatccagaattancgttctcagaaatccattttgcacagcaggacatt

SEQ ID NO: 23811 - DNA, 71 bp, chicken (Gallus Gallus)
  misc_feature (36): n=c or t
acttaaggccattagctctcatgctatctcttttcngcctaggagaagaggctgaaccccacttcgctaca

SEQ ID NO: 23812 - DNA, 71 bp, chicken (Gallus Gallus)
  misc_feature (36): n=a or g
ttttgttttgttttgttttggacatcatattatctnacaaatgtgatcttttcagttctgtttattgttca

SEQ ID NO: 23813 - DNA, 71 bp, chicken (Gallus Gallus)
  misc_feature (36): n=a or g
ctttgggagcttgaatcgatgacagtgatgcttcangagagtttctacagtgcattctgtgaagtgtatgt

SEQ ID NO: 23814 - DNA, 71 bp, chicken (Gallus Gallus)
  misc_feature (36): n=c or t
gattcagctttagcgtgtatcacaagtttcattccngattatttaaatgtaatttttattttcgtttgata

SEQ ID NO: 23815 - DNA, 71 bp, chicken (Gallus Gallus)
  misc_feature (36): n=a or g
aatggacaggcttaaagagtgtattgtaaacaggtnggaaagatttgaagcttagatgcgcttttaaataa

SEQ ID NO: 23816 - DNA, 71 bp, chicken (Gallus Gallus)
  misc_feature (36): n=a or g
gactgcagaagcccaacagaaaggaaaggcaaaggnttatgcacctagatttcagagggcatgatttatgg

SEQ ID NO: 23817 - DNA, 71 bp, chicken (Gallus Gallus)
  misc_feature (36): n=a or g
aacaatcccaaactgaatgctgcacttgtctggaancttccccagttccacaaagaacaaaaacaggcact

SEQ ID NO: 23818 - DNA, 71 bp, chicken (Gallus Gallus)
  misc_feature (36): n=a or c
gaatgaaagagcataactcacgtggtctggtagatntggtggggttttgttttgtttgtttttgttttttg

SEQ ID NO: 23819 - DNA, 71 bp, chicken (Gallus Gallus)
  misc_feature (36): n=a or g
tccacctttttcgtgtcccggactgctcctgttggnaggatcactctgtgcagcatctcatctttgcactg

SEQ ID NO: 23820 - DNA, 71 bp, chicken (Gallus Gallus)
  misc_feature (36): n=c or t
atcagaagttacaagaatttaaaatgtaagaggccncagaattgaaaaaaggccaacatccaagaggagaa

SEQ ID NO: 23821 - DNA, 71 bp, chicken (Gallus Gallus)
  misc_feature (36): n=c or t
gcctttttgcatcatttctccaagctagaaacactngtaactacagtgctgaaggctgggatacagggcct

SEQ ID NO: 23822 - DNA, 71 bp, chicken (Gallus Gallus)
  misc_feature (36): n=a or g
taagaaatgggaagccctcaactgctgcatcactcnttttctgtctccttcccagcctctccattctttgc

SEQ ID NO: 23823 - DNA, 71 bp, chicken (Gallus Gallus)
  misc_feature (36): n=a or g
gctttgtgctaccccccaggttcacagagatctgtngtaccataagggcagcggagatacaatccaggtga

SEQ ID NO: 23824 - DNA, 71 bp, chicken (Gallus Gallus)
  misc_feature (36): n=a or g
gctttgcagtacacaacttcacatggacaaaatatntcatgactaaatgaggctgtagtacagagagtagg

SEQ ID NO: 23825 - DNA, 71 bp, chicken (Gallus Gallus)
  misc_feature (36): n=a or g
tatctggggactccagttaggacctagatttttaantcagtagagataaatcagcaggaaatttggctctg

SEQ ID NO: 23826 - DNA, 71 bp, chicken (Gallus Gallus)
  misc_feature (36): n=c or g
gggggaagtcatttgtccaggagcagtatgtaccancttgccaagaagtgctggttcttgtcatagtctgc

SEQ ID NO: 23827 - DNA, 71 bp, chicken (Gallus Gallus)
  misc_feature (36): n=c or g
gagatagggcaaaccagcttctaacaggaagaaaanagctctctttgctcccagtgtgatggcaatgtggc

SEQ ID NO: 23828 - DNA, 71 bp, chicken (Gallus Gallus)
  misc_feature (36): n=a or g
tttatttcttctttgttatctgaaatatgaccagtntttgcaaaagatttctctagaatctcctattcacc

SEQ ID NO: 23829 - DNA, 71 bp, chicken (Gallus Gallus)
  misc_feature (36): n=g or t
cccttgaagctgtgcttttctccaaaagcaaattgngcatcctgcccgtttgcagtcactttaaatacctg

SEQ ID NO: 23830 - DNA, 71 bp, chicken (Gallus Gallus)
  misc_feature (36): n=g or t
taacacttcagatatggggaacagaatgtcaaaacnccatcctttttgtaaccaagaggctgtggttgccc

SEQ ID NO: 23831 - DNA, 71 bp, chicken (Gallus Gallus)
  misc_feature (36): n=c or t
ttgaggagcatgagattaaaactattgtttttacanttcacattattcaaacaaagtttctcattgctaaa

SEQ ID NO: 23832 - DNA, 71 bp, chicken (Gallus Gallus)
  misc_feature (36): n=g or t
ctttggcacaacagatttttcctaccaaacatgagntaggtggcatacatacagcttcttcagccggcaaa

SEQ ID NO: 23833 - DNA, 71 bp, chicken (Gallus Gallus)
  misc_feature (36): n=c or t
aatgtcccatggtcaacattctattccatgtccttnaatttctgtggtaacttaacagaatttaaattaat

SEQ ID NO: 23834 - DNA, 71 bp, chicken (Gallus Gallus)
  misc_feature (36): n=c or g
agcttccaacatgaaatacagactatattagaggancatcccaaagtatctctacagtaaaaagtgattta

SEQ ID NO: 23835 - DNA, 71 bp, chicken (Gallus Gallus)
  misc_feature (36): n=a or g
gacttttcatccaaaattattaatttcaaataagcncttggcatagcatttttcctctgagactgacatta

SEQ ID NO: 23836 - DNA, 71 bp, chicken (Gallus Gallus)
  misc_feature (36): n=a or g
tgggcagggatttgtaaatgggaaataagcaacgcnctttgggtttattgttcagcctttgtgtttactgg

SEQ ID NO: 23837 - DNA, 71 bp, chicken (Gallus Gallus)
  misc_feature (36): n=a or g
agaagctacctaaacagcacttccagcaacataaantatgtctgttttgtgtctttcaggcttaccatgat

SEQ ID NO: 23838 - DNA, 71 bp, chicken (Gallus Gallus)
  misc_feature (36): n=a or g
gtttttatacctctcagggcagtgatttgtcatggnattttacttctgattgggaataccttcactgtagt

SEQ ID NO: 23839 - DNA, 71 bp, chicken (Gallus Gallus)
  misc_feature (36): n=c or t
attttagtagtttcatagttgtttacactacatganctttgctctgttattccttctagaatcagtaaatt

SEQ ID NO: 23840 - DNA, 71 bp, chicken (Gallus Gallus)
  misc_feature (36): n=a or g
gactgggaactgcactaaacaatgagcttctctctntccagccatggagggcccaccgcagctggctgtgc

SEQ ID NO: 23841 - DNA, 71 bp, chicken (Gallus Gallus)
  misc_feature (36): n=a or g
ataattatgacacctcttatgtttaacaactgctcnaagtactttatattctttcatcagggcgtagcatt

SEQ ID NO: 23842 - DNA, 71 bp, chicken (Gallus Gallus)
  misc_feature (36): n=c or t
gtaaaactagtaacttttccagtttatttttcctcntctctctggaagagttgtcagtcatccatagaaca

SEQ ID NO: 23843 - DNA, 71 bp, chicken (Gallus Gallus)
  misc_feature (36): n=a or g
ctctctttttttttttttattattaattagagcaancataaattaatccatctccatttctgcagccatta

SEQ ID NO: 23844 - DNA, 71 bp, chicken (Gallus Gallus)
  misc_feature (36): n=a or g
cagcagcactttatagaagcagtagccatttacatncagaaatttcttagaatccttttctctaccatgtg

SEQ ID NO: 23845 - DNA, 71 bp, chicken (Gallus Gallus)
  misc_feature (36): n=a or g
agaatataaaaatgtcagcattcgtgttcattcagncctgatgctgtgacacaagcattaaagagagggtc

SEQ ID NO: 23846 - DNA, 71 bp, chicken (Gallus Gallus)
  misc_feature (36): n=a or g
cgttgcttatcaggatggatataagtgcctgacttntctctgaatgctaagtaaggtcatatttatgttcc

SEQ ID NO: 23847 - DNA, 71 bp, chicken (Gallus Gallus)
  misc_feature (36): n=a or c
atgtgttgtactttatgagtaatcctgttctatagnctatgcacccaaagggctttggattctgtgcaaaa

SEQ ID NO: 23848 - DNA, 71 bp, chicken (Gallus Gallus)
  misc_feature (36): n=c or t
tgtgggaagccacccttacggctgaaggggaaaaangctaagagtagtgaagaaagagctgttgtaggggt

SEQ ID NO: 23849 - DNA, 71 bp, chicken (Gallus Gallus)
  misc_feature (36): n=c or t
agaaagctttcaaagtgactgacaaaaacaattaanggagataaaaatattcacctgtctgttcctttaca

SEQ ID NO: 23850 - DNA, 71 bp, chicken (Gallus Gallus)
  misc_feature (36): n=a or g
tcttcaataaataaacctttggggattcttgcagcncagctttttggagatggcacaacacttactctgga

SEQ ID NO: 23851 - DNA, 71 bp, chicken (Gallus Gallus)
  misc_feature (36): n=a or g
tagcaatagttactaaatggcatacacagtccctcnaggctgaccagaacaaaagtataagtcaggtgtcc

SEQ ID NO: 23852 - DNA, 71 bp, chicken (Gallus Gallus)
  misc_feature (36): n=g or t
cacagaattaaatgtcaatcaccttgaatttctcancaaatacaaattcctttttttctggccaggttgtg

SEQ ID NO: 23853 - DNA, 71 bp, chicken (Gallus Gallus)
  misc_feature (36): n=a or c
acagaaacgttgaagccttgctatttagacacccantgctttgaaagctttctataaaggaatttttattt

SEQ ID NO: 23854 - DNA, 71 bp, chicken (Gallus Gallus)
  misc_feature (36): n=c or t
gtagaagaacatgtttgtttttcacacattttctcnctcatggaaccagtattttaaagcctgcattctga

SEQ ID NO: 23855 - DNA, 71 bp, chicken (Gallus Gallus)
  misc_feature (36): n=c or t
tattttcttaacagtcagtagaaagagaaagatccncttatggcatttgtcatagcatctgctttcaggga

SEQ ID NO: 23856 - DNA, 71 bp, chicken (Gallus Gallus)
  misc_feature (36): n=a or g
ccttcagaagtgctatagttccatggagctagtgtncaagtaaaaaattgcatgtagaactgtccatttca

SEQ ID NO: 23857 - DNA, 71 bp, chicken (Gallus Gallus)
  misc_feature (36): n=a or g
ccttgaatttaggtcttaaaattgaaaggtctcatntttttgccttttacaaatttcaggttacttttcaa

SEQ ID NO: 23858 - DNA, 71 bp, chicken (Gallus Gallus)
  misc_feature (36): n=c or t
tccctttgctttgcagtcttcccacctctgctcatncccgtgtatttccaaatccaaatcatctcaaccat

SEQ ID NO: 23859 - DNA, 71 bp, chicken (Gallus Gallus)
  misc_feature (36): n=c or t
acatttcttttttgccactttttcaacacttttttncatgcgtttgtcacctcaagtttggattgtgtaga

SEQ ID NO: 23860 - DNA, 71 bp, chicken (Gallus Gallus)
  misc_feature (36): n=a or g
agttaattctgctaatacaataaggctatggaatcntaactgttacgctgataggtaaaatttttcatatc

SEQ ID NO: 23861 - DNA, 71 bp, chicken (Gallus Gallus)
  misc_feature (36): n=c or t
aagcaagactgtatgcagtatgtttctcccagtgantgtaccaggctcctgtctggttcaggactctgaaa

SEQ ID NO: 23862 - DNA, 71 bp, chicken (Gallus Gallus)
  misc_feature (36): n=a or g
ggtggtcaggatgttccctctgtccataaaaatctnttaacctcactgtgcaccaggcatggctcagaatt

SEQ ID NO: 23863 - DNA, 71 bp, chicken (Gallus Gallus)
  misc_feature (36): n=c or t
catgtggtccctccagagactgctccgtgccgagcngtatgtatctagaaatctgaggcagtatacttttc

SEQ ID NO: 23864 - DNA, 71 bp, chicken (Gallus Gallus)
  misc_feature (36): n=a or c
tatcagtattgttatgaaaaataattatcttttccngagtctttgtggcccctttcttcttagaacgttta

SEQ ID NO: 23865 - DNA, 71 bp, chicken (Gallus Gallus)
  misc_feature (36): n=a or c
caaaattggtcctattcactctttgtgtctaagtgnaccgtagtcctagctgagaatatatacagcatttg

SEQ ID NO: 23866 - DNA, 71 bp, chicken (Gallus Gallus)
  misc_feature (36): n=a or g
gacagcaaacctccaggactgctgctctgggtgacntggaggcggcacacggttctatgggtatttttgtg

SEQ ID NO: 23867 - DNA, 71 bp, chicken (Gallus Gallus)
  misc_feature (36): n=a or t
cttacagcaatggttttcctctgagcaagtagaatngaataaggataatactatgaaaaataccagagcaa

SEQ ID NO: 23868 - DNA, 71 bp, chicken (Gallus Gallus)
  misc_feature (36): n=c or t
ttttctccacagatccctcacaggattgggaagtgngagctatacttctgacagattgaaatgggaatata

SEQ ID NO: 23869 - DNA, 71 bp, chicken (Gallus Gallus)
  misc_feature (36): n=g or t
agggtgagggctcatgttctcagtgaacaaatggtngattcgtatgcacagtgtaagcgtctggatttggt

SEQ ID NO: 23870 - DNA, 71 bp, chicken (Gallus Gallus)
  misc_feature (36): n=a or g
gggagccaccactgccacacgatttttggtcagaanctccagatgcatttgggcaaggctggttctggatt

SEQ ID NO: 23871 - DNA, 71 bp, chicken (Gallus Gallus)
  misc_feature (36): n=c or t
aacagaagaataagaagttccagggtagtagtttanacccagcttttggcttaaaatacataggtttgcca

SEQ ID NO: 23872 - DNA, 71 bp, chicken (Gallus Gallus)
  misc_feature (36): n=a or g
gtcccactgcaaggccatttgttttgctcagcgcanccccattatcaccaaaacttttgagtaattattct

SEQ ID NO: 23873 - DNA, 71 bp, chicken (Gallus Gallus)
  misc_feature (36): n=a or g
aaggttttgttgaggatcagcatggttcccatgtcnttaagagtttagatgggtgatgagaaggatacaaa

SEQ ID NO: 23874 - DNA, 71 bp, chicken (Gallus Gallus)
  misc_feature (36): n=g or t
ttcagcctcctaaagtcacagtataaaaatcacttnctaaaacagatatcagataatgatgttgggtctgc

SEQ ID NO: 23875 - DNA, 71 bp, chicken (Gallus Gallus)
  misc_feature (36): n=c or t
aacaaaaggttgcaagcataaattgaagacatgagncacaaatgtaaaggcagttacccaccaacacccaa

SEQ ID NO: 23876 - DNA, 71 bp, chicken (Gallus Gallus)
  misc_feature (36): n=g or t
gcagtgcagtaatggacctgaaagactcattctgancttgttgttcatccctgtgtacctagtagcatttc

SEQ ID NO: 23877 - DNA, 71 bp, chicken (Gallus Gallus)
  misc_feature (36): n=c or t
attgttaatattgaatgtgttgttttctatatacangtctttttttctttctttctggtttcctttttgag

SEQ ID NO: 23878 - DNA, 71 bp, chicken (Gallus Gallus)
  misc_feature (36): n=a or g
ttgaggaagtggcgctgacagaatttggaaagggcnccatacacaaatgtgttaaaataaagtttatagat

SEQ ID NO: 23879 - DNA, 71 bp, chicken (Gallus Gallus)
  misc_feature (36): n=a or g
ttacattcagaattttatatgttagatagtcttacnagtagctgaaatcttgacttcgtagggtggtagta

SEQ ID NO: 23880 - DNA, 71 bp, chicken (Gallus Gallus)
  misc_feature (36): n=a or g
taagcctcctttggttgtctgagcgttcccctcacncagttcttcaggaagtccaccttgtggcattgtgg

SEQ ID NO: 23881 - DNA, 71 bp, chicken (Gallus Gallus)
  misc_feature (36): n=c or g
agttagcaggggaaaactgtagaaatcaacctcaanaagagaaatcttaggtgaaatattaagccataaaa

SEQ ID NO: 23882 - DNA, 71 bp, chicken (Gallus Gallus)
  misc_feature (36): n=c or t
gtcctgcatgtacaggatagatgcaagaccactctngatttcctcccttgcattgaagaactaggaaggag

SEQ ID NO: 23883 - DNA, 71 bp, chicken (Gallus Gallus)
  misc_feature (36): n=a or g
agagagttcctacttttaaccttttcctcaaaaagngcctggattgggcaaaaaggaagtgtgacaatgaa

SEQ ID NO: 23884 - DNA, 71 bp, chicken (Gallus Gallus)
  misc_feature (36): n=c or t
catagaaacctctttcacataagaggaatggagctnctccttttcctttgctgtatttagaggtccttcag

SEQ ID NO: 23885 - DNA, 71 bp, chicken (Gallus Gallus)
  misc_feature (36): n=c or t
ctggaacaggatgcccagggaggtggtggagtcacngtccctggaagtcttcaagaaatttttagatactg

SEQ ID NO: 23886 - DNA, 71 bp, chicken (Gallus Gallus)
  misc_feature (36): n=a or g
gatgtgtgtgaaagcagcatgtctgcaattctgaanaatttgattcatttataaatggctaggttcatttt

SEQ ID NO: 23887 - DNA, 71 bp, chicken (Gallus Gallus)
  misc_feature (36): n=c or t
gtaaataaatccaagtctgagttatgaaaagctttnctcccccctgccttctcccccgcaaataaaaataa

SEQ ID NO: 23888 - DNA, 71 bp, chicken (Gallus Gallus)
  misc_feature (36): n=c or t
tgtttccatgccagtgtagatagcaacacctgaaangagacaacttgttttactaaagattacgcagtaca

SEQ ID NO: 23889 - DNA, 71 bp, chicken (Gallus Gallus)
  misc_feature (36): n=g or t
atcatacttaactcactgggagaactaacagaaatntgcaggctttagaagctgtttgtggtatgtttgta

SEQ ID NO: 23890 - DNA, 71 bp, chicken (Gallus Gallus)
  misc_feature (36): n=a or c
tgcttagcattttgctaaaaaattaatctgaattanggatcatgaacccatttctttttacttgtgcttta

SEQ ID NO: 23891 - DNA, 71 bp, chicken (Gallus Gallus)
  misc_feature (36): n=c or t
acataaaacataattttgttaataatttactgtaangattatatggtgagggctattttttttccaattac

SEQ ID NO: 23892 - DNA, 71 bp, chicken (Gallus Gallus)
  misc_feature (36): n=a or g
attttgttcaggatattttctaataacgattaacantgagaacgaggctttcatttcactgttccattatt

SEQ ID NO: 23893 - DNA, 71 bp, chicken (Gallus Gallus)
  misc_feature (36): n=c or t
gtctgtaaggttaggcactcagcagttaggaaatanttgatttaaaatcgcccttgccatctgagcacagc

SEQ ID NO: 23894 - DNA, 71 bp, chicken (Gallus Gallus)
  misc_feature (36): n=a or c
taacagcaataataaaagtagatgcctcttccattnataaggcataggaacactgcaacatgaggatgaac

SEQ ID NO: 23895 - DNA, 71 bp, chicken (Gallus Gallus)
  misc_feature (36): n=a or g
ctaaataaaacctcacaatataatgaatgtactttncacaatttcagaagaagcattaggaaaaaagttac

SEQ ID NO: 23896 - DNA, 71 bp, chicken (Gallus Gallus)
  misc_feature (36): n=c or t
tggagcaaagcagagattcacaccacaccacctcanctgttcagtgagtaaccctggattctggaacacca

SEQ ID NO: 23897 - DNA, 71 bp, chicken (Gallus Gallus)
  misc_feature (36): n=c or t
tttatttccatactcgagggttcaaaattagagacncccctcctgggggctgtgtgtgctaaatattcttg

SEQ ID NO: 23898 - DNA, 71 bp, chicken (Gallus Gallus)
  misc_feature (36): n=g or t
tgttgtaatatgcacagctgcatatttctcgcaggnaactacttcactgatttcagtaggttagtgtgcag

SEQ ID NO: 23899 - DNA, 71 bp, chicken (Gallus Gallus)
  misc_feature (36): n=a or g
cttctaatgatacaagtatgctttcagtaatgcacnctaaaaaaaagtttcggtatcctttcctcttttga

SEQ ID NO: 23900 - DNA, 71 bp, chicken (Gallus Gallus)
  misc_feature (36): n=g or t
cataaatatatacataaataaaaccctcatggtttnattttgattttatatgattttatcttgtagcattg

SEQ ID NO: 23901 - DNA, 71 bp, chicken (Gallus Gallus)
  misc_feature (36): n=a or g
gtgctagtactcctttggtatggagagcaaaagttnccgcatttctgcctccttgtccaaaggaaacttcc

SEQ ID NO: 23902 - DNA, 71 bp, chicken (Gallus Gallus)
  misc_feature (36): n=a or g
ggaatgttttatatcacaaattaagtcctttagganaaatgaggttgtcacatcctggctatgacaacgat

SEQ ID NO: 23903 - DNA, 71 bp, chicken (Gallus Gallus)
  misc_feature (36): n=a or g
tggcctttgtcttgctcattagttaaaagttaacanaactaactcattttaaggcaaagctcatgaaccag

SEQ ID NO: 23904 - DNA, 71 bp, chicken (Gallus Gallus)
  misc_feature (36): n=c or g
ctgttttttctcaatttcatatcttaatatccactngtgtcatttaagaccattggtttttgtgccctttc

SEQ ID NO: 23905 - DNA, 71 bp, chicken (Gallus Gallus)
  misc_feature (36): n=a or c
tgctgtaactgttacgcttagtggtccaacataacnaacatctcttaattttatgatgtgtgttgtgctgc

SEQ ID NO: 23906 - DNA, 71 bp, chicken (Gallus Gallus)
  misc_feature (36): n=c or t
agcagactgactgtcctatacccaaaataatgcccntgtcatatttcaaaacccagaagctctgtagctgg

SEQ ID NO: 23907 - DNA, 71 bp, chicken (Gallus Gallus)
  misc_feature (36): n=a or g
catgtcctatgctatttgtactccagtgttcttcanaagaggaaaactgtatacatccctgagctaataat

SEQ ID NO: 23908 - DNA, 71 bp, chicken (Gallus Gallus)
  misc_feature (36): n=a or t
caatctcactgtgtctagcttcaagagagtagaggncagataggttggaacttctcggtgctgtcttcctg

SEQ ID NO: 23909 - DNA, 71 bp, chicken (Gallus Gallus)
  misc_feature (36): n=c or t
cccattgccaccttgtccactaaaccacatgcctcngacttgctgtgttccttctagttttattataagag

SEQ ID NO: 23910 - DNA, 71 bp, chicken (Gallus Gallus)
  misc_feature (36): n=a or t
attcagggtggtaattgcttcaaccaaagctgtcantaacatagcctataaccttttattattgaatccag

SEQ ID NO: 23911 - DNA, 71 bp, chicken (Gallus Gallus)
  misc_feature (36): n=a or g
tgttacaaactcaggaaaataaaagtttcttctgcntgtatcactcagttttataacttctcaacactgaa

SEQ ID NO: 23912 - DNA, 71 bp, chicken (Gallus Gallus)
  misc_feature (36): n=c or t
agaggctgtctcttaccttgaaaacattttacctgngatccagccctcgtggcttttatctcagaccagat

SEQ ID NO: 23913 - DNA, 71 bp, chicken (Gallus Gallus)
  misc_feature (36): n=a or g
gagatgctgcaatgtcttcaatttcattgtttggtntatttgggtggatcttatgtttggttttgagaaca

SEQ ID NO: 23914 - DNA, 71 bp, chicken (Gallus Gallus)
  misc_feature (36): n=a or g
gtagcttgtgctgcacactttcacaactcccatgtnaagccagcagagggtactcttaagcttccaagaag

SEQ ID NO: 23915 - DNA, 71 bp, chicken (Gallus Gallus)
  misc_feature (36): n=c or g
tctgcatttctttctgacttcttacataatcacacnagctgaaatcagtgaataatacctcactattaatc

SEQ ID NO: 23916 - DNA, 71 bp, chicken (Gallus Gallus)
  misc_feature (36): n=g or t
cattgtctctttggcctactgtctttctttctctcncctctctgattcacacagctacaggaattgcttta

SEQ ID NO: 23917 - DNA, 71 bp, chicken (Gallus Gallus)
  misc_feature (36): n=a or g
ccaagctgcaacagaaaagccccgaggaatactgancacctccaaaaggcagcttcaagaggaaaagctca

SEQ ID NO: 23918 - DNA, 71 bp, chicken (Gallus Gallus)
  misc_feature (36): n=c or t
gaaatagctttaaaatcatcaagagtatctgttaangaaccacgctgaaacccagaccattcaaaaaagac

SEQ ID NO: 23919 - DNA, 71 bp, chicken (Gallus Gallus)
  misc_feature (36): n=c or g
tttagttgggataggttgctgcaagaaacaaagtancctctcaagcaatggatcctgagtttttggtgaat

SEQ ID NO: 23920 - DNA, 71 bp, chicken (Gallus Gallus)
  misc_feature (36): n=c or t
tgacactgcttactgctccattttatgcctaatgcngtcagctgtgcagtaattacacagaaatgtgttgg

SEQ ID NO: 23921 - DNA, 71 bp, chicken (Gallus Gallus)
  misc_feature (36): n=a or t
ttgtgactgtgggatctgcttccttgccaaagctgnacagctaggagttacctggttcctgtcctccctca

SEQ ID NO: 23922 - DNA, 71 bp, chicken (Gallus Gallus)
  misc_feature (36): n=c or t
aaactcatcctgattaggcataacatagaaggattngaagggataacacatggctctgttccctctcacct

SEQ ID NO: 23923 - DNA, 71 bp, chicken (Gallus Gallus)
  misc_feature (36): n=c or t
gtatattaaatcccatttgagcacattaagtacttntctagtcctcattgccacctaagtgctctctagct

SEQ ID NO: 23924 - DNA, 71 bp, chicken (Gallus Gallus)
  misc_feature (36): n=a or g
tacaagtttcaaggttgcaacctgactgcaccaccnaaaccacaaattcataggactcaaatatttattga

SEQ ID NO: 23925 - DNA, 71 bp, chicken (Gallus Gallus)
  misc_feature (36): n=c or t
cttgctgggatgcagctgagtctgctgttgggatanggaaatctgtgttccacagctgctccaaggactct

SEQ ID NO: 23926 - DNA, 71 bp, chicken (Gallus Gallus)
  misc_feature (36): n=c or t
tgtgaagcctcatctgacctcagctcctgtgcccanggaacctaaccaatcacacagattaaatgcatctg

SEQ ID NO: 23927 - DNA, 71 bp, chicken (Gallus Gallus)
  misc_feature (36): n=c or t
gatgattatctgtaacgacatttgtgagcagtcagnaggatggcaaacaaaatgtgtggcttggaggcagt

SEQ ID NO: 23928 - DNA, 71 bp, chicken (Gallus Gallus)
  misc_feature (36): n=a or g
atggaagttttttgttggtttttttttgtttgtttntttatttatcctaattttgttgtgttctctgctct

SEQ ID NO: 23929 - DNA, 71 bp, chicken (Gallus Gallus)
  misc_feature (36): n=a or t
ctgttttgaatcctaagcctggaactctgcaatgtnttatcagccagtatttctttcaaataaacctttgg

SEQ ID NO: 23930 - DNA, 71 bp, chicken (Gallus Gallus)
  misc_feature (36): n=c or t
caaagttgtgcttgttcaaaggaaaaggtttgccancagctcctgggggcttggtaccctccagccttggc

SEQ ID NO: 23931 - DNA, 71 bp, chicken (Gallus Gallus)
  misc_feature (36): n=a or t
tgttataggaaaaattttttgctaataaggattacnatagcagcactgaatttaaaagtgctattaaactc

SEQ ID NO: 23932 - DNA, 71 bp, chicken (Gallus Gallus)
  misc_feature (36): n=a or g
tgtgattgcttgagggcaatgagacagctggcagantaccatcgcagcactgaaattaaagttacaagctg

SEQ ID NO: 23933 - DNA, 71 bp, chicken (Gallus Gallus)
  misc_feature (36): n=a or g
ctcacagtcaccacccaaatcatcccctatcccccntagacataacaggaaatctgtttcctagtgaagtt

SEQ ID NO: 23934 - DNA, 71 bp, chicken (Gallus Gallus)
  misc_feature (36): n=g or t
ttcctttctcaaggatcgtccccaatgtctctccanatgttgtctctgagcccttatgcttcattctttgg

SEQ ID NO: 23935 - DNA, 71 bp, chicken (Gallus Gallus)
  misc_feature (36): n=c or t
ttttcaatgatcaggttgtcctctggcgatccaaanggtctgatccacaaattccttcttttctaatactc

SEQ ID NO: 23936 - DNA, 71 bp, chicken (Gallus Gallus)
  misc_feature (36): n=a or t
ttttgtctgactttggaatgagagcatgctccagtnaaaagtaatgggttctatctgaatgtgtgtctgct

SEQ ID NO: 23937 - DNA, 71 bp, chicken (Gallus Gallus)
  misc_feature (36): n=c or g
gatttgagtacagtggtggaagtaacatgaaatatnagagaaagattaatttttcatagagatctccattt

SEQ ID NO: 23938 - DNA, 71 bp, chicken (Gallus Gallus)
  misc_feature (36): n=c or g
cagcttcatgcattctaagaagcttgggttttcatntatcaaaagtttagttcagtagtcagtcaccatct

SEQ ID NO: 23939 - DNA, 71 bp, chicken (Gallus Gallus)
  misc_feature (36): n=c or t
ggaggaaaaccaaaaccaaactatcctgtttacttngtccttccctgctgatacaagattgtacgattgtt

SEQ ID NO: 23940 - DNA, 71 bp, chicken (Gallus Gallus)
  misc_feature (36): n=c or t
aaaagaaaaaagaaaaaaaaaagacatctgtgacanagttagtaaaattcataatcactgttctggttacc

SEQ ID NO: 23941 - DNA, 71 bp, chicken (Gallus Gallus)
  misc_feature (36): n=a or g
aatatgatcctgcaggtgtttgtgcccctgagagcntgaggagactgctgccatgcatcagtttttcttgt

SEQ ID NO: 23942 - DNA, 71 bp, chicken (Gallus Gallus)
  misc_feature (36): n=a or g
cttaaatttatggtaatcgccagactttggtccacngtttcactgcaaaactggaaaactctttgcattct

SEQ ID NO: 23943 - DNA, 71 bp, chicken (Gallus Gallus)
  misc_feature (36): n=a or g
aacagagtgtcaggggttcacccgagtgtcaacacngagacaaacaagggagtatcttaactaatgaagaa

SEQ ID NO: 23944 - DNA, 71 bp, chicken (Gallus Gallus)
  misc_feature (36): n=g or t
atttgtgctattctttcaagcatcaaattatcgccnaattaacttttacaaaattaatttagaagctatga

SEQ ID NO: 23945 - DNA, 71 bp, chicken (Gallus Gallus)
  misc_feature (36): n=c or t
tacaaagcccctttccaccagctaagaatatcatanggtactaacaaaggaaagaattacactgaagagga

SEQ ID NO: 23946 - DNA, 71 bp, chicken (Gallus Gallus)
  misc_feature (36): n=c or t
atgtctgtgagagcagtctcaagagaaaaacatagnacaattgtaactctaactgagataaagtcaaaacc

SEQ ID NO: 23947 - DNA, 71 bp, chicken (Gallus Gallus)
  misc_feature (36): n=a or g
ttggaaccaaaagggaagaggaagatatattctganagaaaaacaatcagaggcatataaggtttgccctg

SEQ ID NO: 23948 - DNA, 71 bp, chicken (Gallus Gallus)
  misc_feature (36): n=c or g
tagcaaaatgccccttccccagcacttcagaaaaanccaagatgatcttaaaatctaagaatgaaagtttt

SEQ ID NO: 23949 - DNA, 71 bp, chicken (Gallus Gallus)
  misc_feature (36): n=a or g
tcataaacaaaaataatagcttctgaaaataacccnatactcagaacgcaacagaaggtctccagacacaa

SEQ ID NO: 23950 - DNA, 71 bp, chicken (Gallus Gallus)
  misc_feature (36): n=a or c
cttctaaaatgcatctctgctgtgagtttaatggtnagtttgactctgaatgcagttttgtaactcaatgg

SEQ ID NO: 23951 - DNA, 71 bp, chicken (Gallus Gallus)
  misc_feature (36): n=c or g
gatactttaaagcaatgcatttgggtatgataatanggtttaccttcacagagattgtaccagggcccaaa

SEQ ID NO: 23952 - DNA, 71 bp, chicken (Gallus Gallus)
  misc_feature (36): n=c or t
ctcttcttttgcccaaggccaaaaagactttcccantgcaaccccttcaatatttttcttcctccagggac

SEQ ID NO: 23953 - DNA, 71 bp, chicken (Gallus Gallus)
  misc_feature (36): n=a or t
cttctgtatgttgcggggtgccaactatcaatcctnaagtccagaaatactgacgggttttaggaggggta

SEQ ID NO: 23954 - DNA, 71 bp, chicken (Gallus Gallus)
  misc_feature (36): n=c or t
cttccgtgtttcccaaaaagctgcttagaagtctgntggaattatttctatattttcaatgagtctttaat

SEQ ID NO: 23955 - DNA, 71 bp, chicken (Gallus Gallus)
  misc_feature (36): n=a or g
tttgattactggaataatagttgatagtaaactacncagcccaatatttgtgttagtggaaaccttttttc

SEQ ID NO: 23956 - DNA, 71 bp, chicken (Gallus Gallus)
  misc_feature (36): n=c or t
atccagttaaagagaagcatgaacatgtaatctgcnggtcttccatcaaaagcccctgtaaatagaaagta

SEQ ID NO: 23957 - DNA, 71 bp, chicken (Gallus Gallus)
  misc_feature (36): n=c or t
tgtgaacgcaccaagaagatccatctggttcacttncgggctctgctccacgctggggctgcctgggagct

SEQ ID NO: 23958 - DNA, 71 bp, chicken (Gallus Gallus)
  misc_feature (36): n=a or g
caaatgaaaaatgaattttaaaaaggcaataggatncacactattcccttccactagggataaactgtgga

SEQ ID NO: 23959 - DNA, 71 bp, chicken (Gallus Gallus)
  misc_feature (36): n=g or t
aacgtgtctcttgtttaatagacaaatactggttanatgatggatatcaaaaagtaaaaagtgggatgact

SEQ ID NO: 23960 - DNA, 71 bp, chicken (Gallus Gallus)
  misc_feature (36): n=a or g
aatatgagaacttaattttatttgaataaaatcctntgcttgctgaacatgaccttatgatagtagtattt

SEQ ID NO: 23961 - DNA, 71 bp, chicken (Gallus Gallus)
  misc_feature (36): n=a or g
ctcaccagttaatcacacacttgtttgctaggcacngctgccaggaatgaaagccacgtcctttgagcgca

SEQ ID NO: 23962 - DNA, 71 bp, chicken (Gallus Gallus)
  misc_feature (36): n=a or g
ccccctccttccaagaactcgagtccagccagtctnttgtttctcctgtgccaatgagtattctcaactct

SEQ ID NO: 23963 - DNA, 71 bp, chicken (Gallus Gallus)
  misc_feature (36): n=a or g
ttttaaattacaaaatgatttcagtctctaacaccntaacattcaatttttctgtaaaggcacaaggcgtc

SEQ ID NO: 23964 - DNA, 71 bp, chicken (Gallus Gallus)
  misc_feature (36): n=c or t
catggcagcaagggagcaagaaggcagactcaaaanggggtaagagggtcctggaggagggagaagcccca

SEQ ID NO: 23965 - DNA, 71 bp, chicken (Gallus Gallus)
  misc_feature (36): n=a or g
gctgtggctctcatggtacagagccctaatgtccancctcctcacgcatctcaaggagcccaaatcatctc

SEQ ID NO: 23966 - DNA, 71 bp, chicken (Gallus Gallus)
  misc_feature (36): n=a or g
ggaagtggactcaggtgcctgaacagggagccaccncccttgggatatcccatgctatctagactatcatt

SEQ ID NO: 23967 - DNA, 71 bp, chicken (Gallus Gallus)
  misc_feature (36): n=c or t
tcctggaaactccgttatggaggccttcttgcagcnctgccagaaaggcatgggccatagctatgtcttgc

SEQ ID NO: 23968 - DNA, 71 bp, chicken (Gallus Gallus)
  misc_feature (36): n=a or g
aactaagatttcaagttacagaatgaagagagtttnttatagaaaatcaaaaagaacatttgtaacaattc

SEQ ID NO: 23969 - DNA, 71 bp, chicken (Gallus Gallus)
  misc_feature (36): n=a or g
ctgaagggcaaggcaccttcagccaaggccaaatgnagatgggcgtacatggtgcttgctttgcaaaatag

SEQ ID NO: 23970 - DNA, 71 bp, chicken (Gallus Gallus)
  misc_feature (36): n=a or g
ttagtctaagaaagaaacttcaagtatacatgcggntgctcatgatgggaaagaaagcacttaagtataac

SEQ ID NO: 23971 - DNA, 71 bp, chicken (Gallus Gallus)
  misc_feature (36): n=c or t
caaaaataatatttgaaaatcttggttctgagttcngagaagaagacttttaccagaaatgtgataggtag

SEQ ID NO: 23972 - DNA, 71 bp, chicken (Gallus Gallus)
  misc_feature (36): n=a or g
ctctgaaagagctagaaaatccattttataaactgntgacaagaactggtctttgagtaggaaatgaacaa

SEQ ID NO: 23973 - DNA, 71 bp, chicken (Gallus Gallus)
  misc_feature (36): n=a or g
gttctgtccctgattcagcacagatcattttatcanattaattcttagagacttgagtcagggtgctcaga

SEQ ID NO: 23974 - DNA, 71 bp, chicken (Gallus Gallus)
  misc_feature (36): n=a or g
tcctttttttctttctcgtttctccagtgggaaganattagtggtgttgatgagcattatactccaatcag

SEQ ID NO: 23975 - DNA, 71 bp, chicken (Gallus Gallus)
  misc_feature (36): n=a or g
tgttttgcagggaagatgaaaaactaatcagaaagngagcacgctttgactctgaggcccagcgctgcgag

SEQ ID NO: 23976 - DNA, 71 bp, chicken (Gallus Gallus)
  misc_feature (36): n=c or t
ctctagctactggcattggaaagaattcactccagntccagtcacagcagcagaagaagtacactatggct

SEQ ID NO: 23977 - DNA, 71 bp, chicken (Gallus Gallus)
  misc_feature (36): n=c or t
atcaccaccatcactgtcaaataagcatgtattccnggtggcagcttaaatcagcaatacaaacgatgtgc

SEQ ID NO: 23978 - DNA, 71 bp, chicken (Gallus Gallus)
  misc_feature (36): n=a or g
atgacactgacatttgtgtagtggcaggtacaaacntttcttgcagtttatattcatacttaaataccaca

SEQ ID NO: 23979 - DNA, 71 bp, chicken (Gallus Gallus)
  misc_feature (36): n=a or g
gaatggatttttccagagagttttgacaaatcttgntgaaacatcttgcaaacaagtccccagtactattt

SEQ ID NO: 23980 - DNA, 71 bp, chicken (Gallus Gallus)
  misc_feature (36): n=a or g
tggtagaattgctagaaatggcttcctgttgctgtnttagagtgggtgtttgtaactgaatttttttggtg

SEQ ID NO: 23981 - DNA, 71 bp, chicken (Gallus Gallus)
  misc_feature (36): n=a or g
acatttcccaaaaatatatagactcacagccaacanctatctatctgagactcaacacttgctacaaggca

SEQ ID NO: 23982 - DNA, 71 bp, chicken (Gallus Gallus)
  misc_feature (36): n=a or c
cagcagcaaatgggaacgcaccactccgctgagtgngggctgagcaccgctcatcacccgccgaggtcggt

SEQ ID NO: 23983 - DNA, 71 bp, chicken (Gallus Gallus)
  misc_feature (36): n=a or g
ataaagatgcagaattctacacactgccttggaagncaggggctctgtctgttggagcacaaagccttgga

SEQ ID NO: 23984 - DNA, 71 bp, chicken (Gallus Gallus)
  misc_feature (36): n=a or g
ctaagtactaaaatgtaggttcatcatctctatacntttttttaagaagctgcaactaggtggttattgta

SEQ ID NO: 23985 - DNA, 71 bp, chicken (Gallus Gallus)
  misc_feature (36): n=a or c
caggaggagtggcttaccttggagataaacttaaanctcgctttgtagagcttagcctgacaagtccttgt

SEQ ID NO: 23986 - DNA, 71 bp, chicken (Gallus Gallus)
  misc_feature (36): n=a or g
ttcactatgaggtaatttctcaggtcttcaatgccntatctgtaacttttctctgaattctctcttctttc

SEQ ID NO: 23987 - DNA, 71 bp, chicken (Gallus Gallus)
  misc_feature (36): n=g or t
ctgatcttgatgcaattacttgattatcttgatttngggatatcatgtaatgagttcttgaagtattgttg

SEQ ID NO: 23988 - DNA, 71 bp, chicken (Gallus Gallus)
  misc_feature (36): n=c or t
tatataggaaaatttggttgttctatgactatttcncaaaacagttacctttatttttcgatcatcataca

SEQ ID NO: 23989 - DNA, 71 bp, chicken (Gallus Gallus)
  misc_feature (36): n=c or t
cctagcagttcccttacactttcccaccaataacgnattccatgttgttgctgtgtgacagatggcagcag

SEQ ID NO: 23990 - DNA, 71 bp, chicken (Gallus Gallus)
  misc_feature (36): n=c or t
cccacctcaaggtaggacagttctgtaatgtgcatnccactgtttttgcagtgttatctgactttcagaga

SEQ ID NO: 23991 - DNA, 71 bp, chicken (Gallus Gallus)
  misc_feature (36): n=c or t
gatgaactccaatctgaaagtagaaatccctctaanaggacacagaagttcccaaaattaagtctgaaatg

SEQ ID NO: 23992 - DNA, 71 bp, chicken (Gallus Gallus)
  misc_feature (36): n=g or t
tttttccaggtgaaaaacaatgcttgctaagggatngttaagtctctatgcttcagcaacctggcatattc

SEQ ID NO: 23993 - DNA, 71 bp, chicken (Gallus Gallus)
  misc_feature (36): n=c or t
gaagaagttttctatgtcaccctgcacaaggcaagngcaggtgtagtgttttgactatctgtacaacagga

SEQ ID NO: 23994 - DNA, 71 bp, chicken (Gallus Gallus)
  misc_feature (36): n=a or g
gaactcccagtgtgcttatgaattctcatctggacntggtagaactaaacactgtttgctgtccaaaccat

SEQ ID NO: 23995 - DNA, 71 bp, chicken (Gallus Gallus)
  misc_feature (36): n=a or g
ctgctcatgttgagcagtgtggctgggataaatagntgagagatacaaaagaagaaatggccattttgtgt

SEQ ID NO: 23996 - DNA, 71 bp, chicken (Gallus Gallus)
  misc_feature (36): n=a or g
tgacatgcagtggattaaattgggaagcgtatcccnccctttctcccagtacttcctcttgctgcctccat

SEQ ID NO: 23997 - DNA, 71 bp, chicken (Gallus Gallus)
  misc_feature (36): n=c or g
tggcatagatttgaataactacttaatgactctttnagttgagagtattgaaatacacggttagttcaagg

SEQ ID NO: 23998 - DNA, 71 bp, chicken (Gallus Gallus)
  misc_feature (36): n=c or g
ctttttagataatcatgctgtcagcacaggtgctgntctgaacagtgctcaggtgcctgtcctctcctgtg

SEQ ID NO: 23999 - DNA, 71 bp, chicken (Gallus Gallus)
  misc_feature (36): n=c or t
attaacatgtaggaaaattcatttatacataaatanttccttaaaaaccattggagtggtgaaacacttga

SEQ ID NO: 24000 - DNA, 71 bp, chicken (Gallus Gallus)
  misc_feature (36): n=a or g
ataaacacaaatatttctattgcctcataaaagctntgagtctaatggcaatggcgagttggtacacaaac

SEQ ID NO: 24001 - DNA, 71 bp, chicken (Gallus Gallus)
  misc_feature (36): n=a or g
taggcaatagcctctccttactgactagccctgctnggatcatgagctggggtgagcaaggcatctttgct

SEQ ID NO: 24002 - DNA, 71 bp, chicken (Gallus Gallus)
  misc_feature (36): n=a or g
acagttgaataaagagatccacaaggactttctggnggcagacatgcaagatgtttaactacaaaaatact

SEQ ID NO: 24003 - DNA, 71 bp, chicken (Gallus Gallus)
  misc_feature (36): n=c or t
gcgtggtgccctgcagcagcccctgcagccctcccnacttcagggttgctcattttcaccctatggtgtgg

SEQ ID NO: 24004 - DNA, 71 bp, chicken (Gallus Gallus)
  misc_feature (36): n=c or t
aagtgactgtagaactaagacacacattgaagcaantcaaaagaaactggtgtgaatatcgatttccttct

SEQ ID NO: 24005 - DNA, 71 bp, chicken (Gallus Gallus)
  misc_feature (36): n=a or t
tccactgttaccacagtggtatttgcttagcgaggntatgtgattattttacagtgatggaagtttcatta

SEQ ID NO: 24006 - DNA, 71 bp, chicken (Gallus Gallus)
  misc_feature (36): n=c or g
aaatcaagttttctgttctctgaatgacagccaaanacaagggacactaaggaacaaaaagattcctggaa

SEQ ID NO: 24007 - DNA, 71 bp, chicken (Gallus Gallus)
  misc_feature (36): n=c or t
ggatagggagaaatttggcagccttttccaattacnggattagtatttgcatctaatttttcaagctgaac

SEQ ID NO: 24008 - DNA, 71 bp, chicken (Gallus Gallus)
  misc_feature (36): n=c or t
ttgtatgaaagtaaatttccacctgtgaggaaacanggggaaaggtgaagctggtgcacaaataaatgttt

SEQ ID NO: 24009 - DNA, 71 bp, chicken (Gallus Gallus)
  misc_feature (36): n=a or g
gtgatgtcattgaccaggtgcttctgctcactgcanaacaaacagacaaaaccaacaacatataatcaaga

SEQ ID NO: 24010 - DNA, 71 bp, chicken (Gallus Gallus)
  misc_feature (36): n=c or t
aataagctttctagagagcgtgtttgttttcctttnttgttgttgtttggtccatacttttcaatcttaac

SEQ ID NO: 24011 - DNA, 71 bp, chicken (Gallus Gallus)
  misc_feature (36): n=a or g
cttatttgaagtgttgcagcaagatgtgaattaatncctgtgtcaggcttctccaaagaaggatttttgta

SEQ ID NO: 24012 - DNA, 71 bp, chicken (Gallus Gallus)
  misc_feature (36): n=c or g
ttttcagagaattcctttcatttttcctccttccantctattgtattcactacagatataaaagctcattt

SEQ ID NO: 24013 - DNA, 71 bp, chicken (Gallus Gallus)
  misc_feature (36): n=a or g
cagctacctctggctacctatatatactatatcacngagattggtgcattatccagggctaccactcatgc

SEQ ID NO: 24014 - DNA, 71 bp, chicken (Gallus Gallus)
  misc_feature (36): n=c or t
gaagaatcatctgagttagaaacaattcccaataangtgaactatgttctttccattccaagacgctggat

SEQ ID NO: 24015 - DNA, 71 bp, chicken (Gallus Gallus)
  misc_feature (36): n=a or g
aactggatggtgcattgataatccctcacagataantaacaaattacatcaagagattgaaagcaatgtgg

SEQ ID NO: 24016 - DNA, 71 bp, chicken (Gallus Gallus)
  misc_feature (36): n=c or t
actgtaaaggtttcatttatgcctaaagcaaacaangggtactttgctaccatggtgatgaacacagcaaa

SEQ ID NO: 24017 - DNA, 71 bp, chicken (Gallus Gallus)
  misc_feature (36): n=a or g
tgttggtagaccacttgttagttttcctgtaaccantacatcatttgggaagaatattgtatggttttggc

SEQ ID NO: 24018 - DNA, 71 bp, chicken (Gallus Gallus)
  misc_feature (36): n=g or t
cacatgaacaaagctcagaaaagaaacagtgaattnaaggaaatgtaaaaccatccaaaattatctttcat

SEQ ID NO: 24019 - DNA, 71 bp, chicken (Gallus Gallus)
  misc_feature (36): n=c or t
tttttttttttgaagtgtcattgcttagaattaaancacttggtctgttctgaatgttattttaatagggc

SEQ ID NO: 24020 - DNA, 71 bp, chicken (Gallus Gallus)
  misc_feature (36): n=a or g
cagcagcatctgtccaagggaacacctcaaataacntctctgaccactgctctctgagaggttgaaacaag

SEQ ID NO: 24021 - DNA, 71 bp, chicken (Gallus Gallus)
  misc_feature (36): n=c or t
aagaatatcttagaggtgtctttattcacagaatgnttgaattgagacgtagcaaaaacttattatttcat

SEQ ID NO: 24022 - DNA, 71 bp, chicken (Gallus Gallus)
  misc_feature (36): n=a or t
attagtgaaaggagaggcacagagaaaactctcccngaatcttttattcaactcttaaggacttcaagtca

SEQ ID NO: 24023 - DNA, 71 bp, chicken (Gallus Gallus)
  misc_feature (36): n=a or t
acagataccagctgtggaaagtccatatgctcgtangctgcctaaagcttgggtacctactttttttgact

SEQ ID NO: 24024 - DNA, 71 bp, chicken (Gallus Gallus)
  misc_feature (36): n=c or t
ccaacggcccacctgaggcccagcatagctcagaangcagccatccccagacccacactataaaagcagca

SEQ ID NO: 24025 - DNA, 71 bp, chicken (Gallus Gallus)
  misc_feature (36): n=a or g
aaactcacacaaacccaccaaagcagagaattcagnccatatttgcagctgtatgaaaaagatacattgtc

SEQ ID NO: 24026 - DNA, 71 bp, chicken (Gallus Gallus)
  misc_feature (36): n=c or t
cgtgttgcgttataaacaactccagtaatgtaatantaagtcattattagggatacctgctgaccatgctg

SEQ ID NO: 24027 - DNA, 71 bp, chicken (Gallus Gallus)
  misc_feature (36): n=a or g
gacccattatttctatgaatgagttatataaaagcngtatcttcttgtgtggaagcaaatggtgccttatg

SEQ ID NO: 24028 - DNA, 71 bp, chicken (Gallus Gallus)
  misc_feature (36): n=a or g
ctacctgcagcaaaagtgattgtaggtggccttccntgcagaaggaggatggaacttaagctcacgtctct

SEQ ID NO: 24029 - DNA, 71 bp, chicken (Gallus Gallus)
  misc_feature (36): n=c or t
attcatattgtcgttggtacagatcaatagtggttntaatttacttatagaaaaggttgcatttttccatg

SEQ ID NO: 24030 - DNA, 71 bp, chicken (Gallus Gallus)
  misc_feature (36): n=c or t
ttgttggcgtgcttcatgacaagtgaccctgatgangcttgttagaatccggtgatgactttatttcacct

SEQ ID NO: 24031 - DNA, 71 bp, chicken (Gallus Gallus)
  misc_feature (36): n=g or t
tgaccatgattttatttttattttcacacttcaaanctactcccaaattgcttggtttgcatgtgatgtta

SEQ ID NO: 24032 - DNA, 71 bp, chicken (Gallus Gallus)
  misc_feature (36): n=c or g
ttggttgtaatagctgctgatgaattgatggtgacnttagagagggactttcaagaacaagtgatagagta

SEQ ID NO: 24033 - DNA, 71 bp, chicken (Gallus Gallus)
  misc_feature (36): n=a or g
cactgagcatagcagagcattgatttctgtacaggnagctgagtagagggaaaaagaaaggccaatattcc

SEQ ID NO: 24034 - DNA, 71 bp, chicken (Gallus Gallus)
  misc_feature (36): n=c or t
tggcagaaatccagcataaccatcaaaaatacacangcacacgcagggtatagaaacatcttcatttcaca

SEQ ID NO: 24035 - DNA, 71 bp, chicken (Gallus Gallus)
  misc_feature (36): n=a or g
gactaaatgcttggcttttagatagttagatgcagntggaatcaatccagctttgaagacataagctctgc

SEQ ID NO: 24036 - DNA, 71 bp, chicken (Gallus Gallus)
  misc_feature (36): n=c or t
ttgaccactgacaaatctccattgggtaaaatcagngaccagtcaagtgcaaatctgtagtgggtgacttt

SEQ ID NO: 24037 - DNA, 71 bp, chicken (Gallus Gallus)
  misc_feature (36): n=a or t
gttttagtgtaacagtaaggcacttaaaaaagcaantttcaaagctctcacataataattcaaatttgtgt

SEQ ID NO: 24038 - DNA, 71 bp, chicken (Gallus Gallus)
  misc_feature (36): n=c or g
tccttctgctccccttctgccagcactcctctgatncactgagccaattcagcttactgacctcaaattaa

SEQ ID NO: 24039 - DNA, 71 bp, chicken (Gallus Gallus)
  misc_feature (36): n=a or g
ttagcatgccattcccacagcaaaggcttggttttnggttcttagcatccaacactaaaaaataggtcgca

SEQ ID NO: 24040 - DNA, 71 bp, chicken (Gallus Gallus)
  misc_feature (36): n=c or t
gtgaaaaatttacactttgcagatgcagaagctgangaaacataacctcaagatcagtttgacataactta

SEQ ID NO: 24041 - DNA, 71 bp, chicken (Gallus Gallus)
  misc_feature (36): n=a or g
agctatatggtttttcttcattagccaaatgtttanctttctcacttaataataaatactatttagagaga

SEQ ID NO: 24042 - DNA, 71 bp, chicken (Gallus Gallus)
  misc_feature (36): n=a or t
ttgaagcaagttagcaaagttataaaacccttcaangtaattgaggggtaaagatggaaatatcagaccta

SEQ ID NO: 24043 - DNA, 71 bp, chicken (Gallus Gallus)
  misc_feature (36): n=c or t
agtcatttgaaaatagggcacctttttccgattccntacaaacttttaattaaagaggaaattcttatttg

SEQ ID NO: 24044 - DNA, 71 bp, chicken (Gallus Gallus)
  misc_feature (36): n=c or t
cagaaactttgaagctaatgttacatgtggtaattntatgaaaaactattgccactcagttcaattgtttg

SEQ ID NO: 24045 - DNA, 71 bp, chicken (Gallus Gallus)
  misc_feature (36): n=c or t
tattttaaacctggtggtactacgtatatctcttantgtctgcaacattttccagaggtgtgtaaagaaga

SEQ ID NO: 24046 - DNA, 71 bp, chicken (Gallus Gallus)
  misc_feature (36): n=a or t
ttagaatctcttgtgctatatataacaaatccatanttttttatccatataaaatcttgtctcaaatacac

SEQ ID NO: 24047 - DNA, 71 bp, chicken (Gallus Gallus)
  misc_feature (36): n=c or t
tttcatcaatgacatcaactctgggatcaagtgtanaatcagcaagtttgcagatgacaccatgctgattt

SEQ ID NO: 24048 - DNA, 71 bp, chicken (Gallus Gallus)
  misc_feature (36): n=c or t
tcgttatggattggagaaaagtgtatcttccccttnggaagacaagtacagactatgttaagagctggcct

SEQ ID NO: 24049 - DNA, 71 bp, chicken (Gallus Gallus)
  misc_feature (36): n=a or g
tcctgaaatcaggagagcccaccaggaagtttgtanctaagctacacacactgtgtctttgaaatcctagt

SEQ ID NO: 24050 - DNA, 71 bp, chicken (Gallus Gallus)
  misc_feature (36): n=a or g
gaaaagattcagaagacagagagagagagggaaacntgaagtattgtttattgttcattgtattggaagta

SEQ ID NO: 24051 - DNA, 71 bp, chicken (Gallus Gallus)
  misc_feature (36): n=a or g
aatgcaaccaagtggctgtttatgccactaccacanaacccaagaccatgtggtatgctgtatactttgtg

SEQ ID NO: 24052 - DNA, 71 bp, chicken (Gallus Gallus)
  misc_feature (36): n=c or t
cgcagtccacagtctggggtgaacagacagacactnccgaaaggagaggagaaaggttggaggagacgatt

SEQ ID NO: 24053 - DNA, 71 bp, chicken (Gallus Gallus)
  misc_feature (36): n=a or g
attatcttcattctcatgcagttgcttggtttatgnactcagtacgacttcttttttaacttcagtaattt

SEQ ID NO: 24054 - DNA, 71 bp, chicken (Gallus Gallus)
  misc_feature (36): n=c or g
agcattttcaccaacatctatcattgtttagatcanaaaacgagtagtacgatcctgtggataatgcaaat

SEQ ID NO: 24055 - DNA, 71 bp, chicken (Gallus Gallus)
  misc_feature (36): n=g or t
tcaatattcttaatttaaaccaggttatttggattncacgtgcactgatggatttatcaatgcaaaaacaa

SEQ ID NO: 24056 - DNA, 71 bp, chicken (Gallus Gallus)
  misc_feature (36): n=g or t
cacacagtaaagcgcactggcctgcatgttcccttnatctttgcatagcccgtgttaaaggcatttatcac

SEQ ID NO: 24057 - DNA, 71 bp, chicken (Gallus Gallus)
  misc_feature (36): n=c or g
atgacagagctccactctctggggcctgtattgatnagtattggaaacagaggtgacattcacccatgcag

SEQ ID NO: 24058 - DNA, 71 bp, chicken (Gallus Gallus)
  misc_feature (36): n=a or g
ctaacccctaagctttcaaagttttctcacaaacanctgcatgcatacgttaaaccatcttcttcaggcat

SEQ ID NO: 24059 - DNA, 71 bp, chicken (Gallus Gallus)
  misc_feature (36): n=c or g
tttcccacccaaaatgctgaacaaggcaactcactncaagtgttccaattacatctctcccttcctacatt

SEQ ID NO: 24060 - DNA, 71 bp, chicken (Gallus Gallus)
  misc_feature (36): n=a or g
tgataggttattcaatcttgcagcacagtgttgccnagaggatgcttcagttttatatattgtgctgaata

SEQ ID NO: 24061 - DNA, 71 bp, chicken (Gallus Gallus)
  misc_feature (36): n=a or g
aagatgacaaaatggcatgttctgtaaaagcagaantagccaataaacctgatgatatttcctgtaacact

SEQ ID NO: 24062 - DNA, 71 bp, chicken (Gallus Gallus)
  misc_feature (36): n=a or g
atctccaaaggatctgtcttaaagcacttgtcagcntttttcttcataagacagaaaaatgtgcatgtgcc

SEQ ID NO: 24063 - DNA, 71 bp, chicken (Gallus Gallus)
  misc_feature (36): n=a or g
gacatctgttattaaggtaatgatattaatacagangtaaaaatgttgcacattcacatcttttacaaaga

SEQ ID NO: 24064 - DNA, 71 bp, chicken (Gallus Gallus)
  misc_feature (36): n=c or t
gattgtatgttttaattttatccctactttttgtcngtgaatgtacattacactttaaagtgcactttgat

SEQ ID NO: 24065 - DNA, 71 bp, chicken (Gallus Gallus)
  misc_feature (36): n=c or t
agcacactgtttctacagaaatgagggagttaaaanaagacctagcctgttaatatagacatttttaaaag

SEQ ID NO: 24066 - DNA, 71 bp, chicken (Gallus Gallus)
  misc_feature (36): n=a or g
tgatcctataaaatgtcagatgtaaacacgaaagcncttgacaaaaatcatttctcagaatcagtcacagc

SEQ ID NO: 24067 - DNA, 71 bp, chicken (Gallus Gallus)
  misc_feature (36): n=a or g
gaggtttgcaaagggccttccattagtactgtcctnagacttcataggctgtcctgggagggaaaaaaaag

SEQ ID NO: 24068 - DNA, 71 bp, chicken (Gallus Gallus)
  misc_feature (36): n=a or g
agttgcttctgccattgtcaaaccacatgaatgcanctatcctacaaacaatatctttatggcttgcgtgc

SEQ ID NO: 24069 - DNA, 71 bp, chicken (Gallus Gallus)
  misc_feature (36): n=a or g
aaaatacaatgggaataaaagttatctacactttcncagatctcaaagtttgggttgaccagtacttggaa

SEQ ID NO: 24070 - DNA, 71 bp, chicken (Gallus Gallus)
  misc_feature (36): n=a or t
gctccccaataggactgttgcctgcattttacaagnaggagcagcattgtgcaagggcagatggccgaacc

SEQ ID NO: 24071 - DNA, 71 bp, chicken (Gallus Gallus)
  misc_feature (36): n=c or t
attctgctaggtaaagtagcatgtattttggaaatnctaattgtgaggaggagaattgaagggatgcccag

SEQ ID NO: 24072 - DNA, 71 bp, chicken (Gallus Gallus)
  misc_feature (36): n=c or t
acatgctctcatttcactttatagcttgtagtatangtagcgcacaaagtaagagcacaatatgagtgtgt

SEQ ID NO: 24073 - DNA, 71 bp, chicken (Gallus Gallus)
  misc_feature (36): n=a or g
gtacattcactcagagttttgagtacagctctgaanctaacatgggaaccagggcaggtcttgcatattcc

SEQ ID NO: 24074 - DNA, 71 bp, chicken (Gallus Gallus)
  misc_feature (36): n=c or t
ccagaggctctgaggaatctctccttctggttacanttcaccataacacctacctcacttttgactgttga

SEQ ID NO: 24075 - DNA, 71 bp, chicken (Gallus Gallus)
  misc_feature (36): n=a or c
cagggtaagttggacacgtagaaaagacttaatgtnagcggtttgccaatcttctggttgtttgtgaattt

SEQ ID NO: 24076 - DNA, 71 bp, chicken (Gallus Gallus)
  misc_feature (36): n=c or t
atttgtaaaccagttgtgaggtattcagctctgggngcgtgtcacagagggaactgagtgctgtgaaccac

SEQ ID NO: 24077 - DNA, 71 bp, chicken (Gallus Gallus)
  misc_feature (36): n=a or c
ccacaacatgaaggcatgtggggatgcaaggctcanctcaccccccaggcacctctgggtgcgtaggcaca

SEQ ID NO: 24078 - DNA, 71 bp, chicken (Gallus Gallus)
  misc_feature (36): n=a or g
cattctgaggttactgacaaaagtgctcatgagacnactgtagaaaagacattcatatagttatgtataac

SEQ ID NO: 24079 - DNA, 71 bp, chicken (Gallus Gallus)
  misc_feature (36): n=a or g
tacagaaataaaaaacgatcctctaaggtcaatggnactactgtggaaaagacgaactcaacatgagaaag

SEQ ID NO: 24080 - DNA, 71 bp, chicken (Gallus Gallus)
  misc_feature (36): n=a or g
gttctggacatacctgatcattgatgggattttcantggaaacatggagcaggtaagggaggcaggaccca

SEQ ID NO: 24081 - DNA, 71 bp, chicken (Gallus Gallus)
  misc_feature (36): n=c or t
ataaatgccagaattactatcagaacagggacaaanccaggatggttatgagatcctatgaatccaaaccg

SEQ ID NO: 24082 - DNA, 71 bp, chicken (Gallus Gallus)
  misc_feature (36): n=c or t
tattgcaacatgacatgccttctctaaaggaaaacngtgatttgtggcactaatgtttttggaatttcatc

SEQ ID NO: 24083 - DNA, 71 bp, chicken (Gallus Gallus)
  misc_feature (36): n=a or g
catgcagactgaccagctgcccatcacaaataacantgtacaaagcccgagtttcatgtgcctttctccta

SEQ ID NO: 24084 - DNA, 71 bp, chicken (Gallus Gallus)
  misc_feature (36): n=a or g
tgaatggctgcctgcatatttgtgttaaaatgttcntggaaggtagaaactgagcaggatctgctcctggg

SEQ ID NO: 24085 - DNA, 71 bp, chicken (Gallus Gallus)
  misc_feature (36): n=a or g
aatccccaggccacaaatcactagaggtgaggaagncacaccagggaagtcagtttgcctcaggaatgtgc

SEQ ID NO: 24086 - DNA, 71 bp, chicken (Gallus Gallus)
  misc_feature (36): n=a or g
aatccatactctcaacaaagttgttttctgcaagtnaacggcttttacaacatacaaacatatataaaaga

SEQ ID NO: 24087 - DNA, 71 bp, chicken (Gallus Gallus)
  misc_feature (36): n=c or g
agggtaaatgggtaaatgaattgggtctattctcanagcttacgaataagaaccgcagctgctctcagtac

SEQ ID NO: 24088 - DNA, 71 bp, chicken (Gallus Gallus)
  misc_feature (36): n=c or t
tctattagacccactacagtggcctacttggcctgntattttttcctgtttctgagtgcagtcagcacagc

SEQ ID NO: 24089 - DNA, 71 bp, chicken (Gallus Gallus)
  misc_feature (36): n=c or t
cttaatgattctatgattctatccaatctgtgagangcactgtcataaatgcacccagctcttgcccttgc

SEQ ID NO: 24090 - DNA, 71 bp, chicken (Gallus Gallus)
  misc_feature (36): n=a or c
gggcttttagatggcaaaaacccagcaaaggtttancagtaagtatctcatactattggcaaagggagact

SEQ ID NO: 24091 - DNA, 71 bp, chicken (Gallus Gallus)
  misc_feature (36): n=a or g
tactctggggcggctctcttttgctttacctaggtnccatgtaatggtcttaattttttaaaggttaaatt

SEQ ID NO: 24092 - DNA, 71 bp, chicken (Gallus Gallus)
  misc_feature (36): n=c or t
tgtgtgaaaattcatcccattaaaataacgtgttantcttttattatttgtaagactgaatgtaaagataa

SEQ ID NO: 24093 - DNA, 71 bp, chicken (Gallus Gallus)
  misc_feature (36): n=a or g
tggtcccgccaaccatgacacctaaatttatcaccncgagcctcagaaatgaacttgcatggttggtattt

SEQ ID NO: 24094 - DNA, 71 bp, chicken (Gallus Gallus)
  misc_feature (36): n=c or t
atatacttcttttactagagtgaagccaagataagngaagataaaatgttcctcttcaaagtgaggtgggt

SEQ ID NO: 24095 - DNA, 71 bp, chicken (Gallus Gallus)
  misc_feature (36): n=c or t
aaaaatggggtaacctctagactgctaatgcgatgngttcatgccagctagtattactgcactgtttcctt

SEQ ID NO: 24096 - DNA, 71 bp, chicken (Gallus Gallus)
  misc_feature (36): n=c or t
tgcactcacaggttcttcctctccagctgtctattncacacgttcttcatgttttaggtcaggcatgactt

SEQ ID NO: 24097 - DNA, 71 bp, chicken (Gallus Gallus)
  misc_feature (36): n=a or g
ctgggagcaatgctagacaggtactgtgatactganaaggcttgctgtgtgggtaaagtgcaaagatgctt

SEQ ID NO: 24098 - DNA, 71 bp, chicken (Gallus Gallus)
  misc_feature (36): n=c or t
agaaaatgttttgtataactgatctccctcagaaangaatattttatttatccctggtaagtccttgttag

SEQ ID NO: 24099 - DNA, 71 bp, chicken (Gallus Gallus)
  misc_feature (36): n=c or g
gagcttccagtttacatcatatcctatgtcctgctnccctcattccctacaaacacactctggagactcac

SEQ ID NO: 24100 - DNA, 71 bp, chicken (Gallus Gallus)
  misc_feature (36): n=g or t
ctttgaataatagataaggtttgagaagatggtagntccagtgactgagatagcagagagataagcagacc

SEQ ID NO: 24101 - DNA, 71 bp, chicken (Gallus Gallus)
  misc_feature (36): n=a or g
aagaaaaccttgaaaaagattattaaaaagcatagnaagtatttcttgaagacagtaccatcccccatttc

SEQ ID NO: 24102 - DNA, 71 bp, chicken (Gallus Gallus)
  misc_feature (36): n=a or g
tttatagtccttatatcagttctaaaacctcaggtngagttttgcattgacagacttaaattaataatagt

SEQ ID NO: 24103 - DNA, 71 bp, chicken (Gallus Gallus)
  misc_feature (36): n=c or t
taaaactgctattgtaacagaagacaagctgttagnaaattagtggttatggttacagtaaatggaaaaca

SEQ ID NO: 24104 - DNA, 71 bp, chicken (Gallus Gallus)
  misc_feature (36): n=c or t
atctccaatgatggaaccgtgttctattcctgagangaatatcctttttttttttttttttttttgaaaga

SEQ ID NO: 24105 - DNA, 71 bp, chicken (Gallus Gallus)
  misc_feature (36): n=g or t
gtctcattgcacggaattagtaagacctcagttctncgttaacccaagatgccatgggtgggttctgctgg

SEQ ID NO: 24106 - DNA, 71 bp, chicken (Gallus Gallus)
  misc_feature (36): n=c or t
ctctctggagatttcagatctggtagggttcagtcngtgttcacgatatggagtagggaaaaagaacatat

SEQ ID NO: 24107 - DNA, 71 bp, chicken (Gallus Gallus)
  misc_feature (36): n=a or g
aaaagtgagattgaggagaagtaagaacgaagaaanatccatgcacatttttgacgataaaaaacatagct

SEQ ID NO: 24108 - DNA, 71 bp, chicken (Gallus Gallus)
  misc_feature (36): n=a or t
ggacatgttggccactctgatcttcttaacagcacntccatgaagcagaatatctcataacaaattcaaag

SEQ ID NO: 24109 - DNA, 71 bp, chicken (Gallus Gallus)
  misc_feature (36): n=c or t
tcactgagctcacgtctattgtttggttcggcaaangttcggcaaacatcaatgaatgtcaaagagtgcaa

SEQ ID NO: 24110 - DNA, 71 bp, chicken (Gallus Gallus)
  misc_feature (36): n=c or t
actactgcatatacaccccagtgcatacacaactangataatggaatatgcctcaaatgatatatgcctta

SEQ ID NO: 24111 - DNA, 71 bp, chicken (Gallus Gallus)
  misc_feature (36): n=a or g
ttgctttgactgctttctcaagccccacctccccangcattgcttcacttgcacatctcccatttgcatcg

SEQ ID NO: 24112 - DNA, 71 bp, chicken (Gallus Gallus)
  misc_feature (36): n=a or t
agaagttttgcttggattattgctgggattagaagnatgtgaatttgaactatgaagagcactgtggttat

SEQ ID NO: 24113 - DNA, 71 bp, chicken (Gallus Gallus)
  misc_feature (36): n=c or t
aaagccgtgtgaataaacttattttgatggctcacngaaatactttaaatgcaaaaggtagcataaagcac

SEQ ID NO: 24114 - DNA, 71 bp, chicken (Gallus Gallus)
  misc_feature (36): n=a or g
ctccattcatttatggtagtctctaaggtaggaacntattctggcctagtaggagccagagatttgagttt

SEQ ID NO: 24115 - DNA, 71 bp, chicken (Gallus Gallus)
  misc_feature (36): n=a or g
acagaattatgtgcccacaagatatgattaaggtcnaaggaagtagagataatccagctttatgcaaaatg

SEQ ID NO: 24116 - DNA, 71 bp, chicken (Gallus Gallus)
  misc_feature (36): n=a or t
atctttacaccacagtttatcgtgtgtcatagtttntagcaaacaggaagggaactagtctgtctatatag

SEQ ID NO: 24117 - DNA, 71 bp, chicken (Gallus Gallus)
  misc_feature (36): n=a or g
cccagtctgaaaggtaatgatatgatgagcagactntttgatggaggaggagctggttacaagattatacc

SEQ ID NO: 24118 - DNA, 71 bp, chicken (Gallus Gallus)
  misc_feature (36): n=a or g
tcgtagggtgatttgtcccaagaagaaaatcctctncaaagatggagcccgtggggaacctacagggatgc

SEQ ID NO: 24119 - DNA, 71 bp, chicken (Gallus Gallus)
  misc_feature (36): n=a or g
ttcatcagtgtgtgactcttcagtgcatgccagccnaggagaaagcatgtttgtttttcaaatagggtaat

SEQ ID NO: 24120 - DNA, 71 bp, chicken (Gallus Gallus)
  misc_feature (36): n=a or g
tatttacttgctgtggagatgtaaatagataaaatnttatgaaaatcttgcatttgtacaagctagctgaa

SEQ ID NO: 24121 - DNA, 71 bp, chicken (Gallus Gallus)
  misc_feature (36): n=a or g
gagtttgatagaaatccagtaacttggtagctcttntaagaaatgcatagcaaacaccaaatgttgaattt

SEQ ID NO: 24122 - DNA, 71 bp, chicken (Gallus Gallus)
  misc_feature (36): n=a or t
gtttgttttcttcagatcttgatagtactatcttgnttcataaaagatgtgccttcttcctgtaaatctta

SEQ ID NO: 24123 - DNA, 71 bp, chicken (Gallus Gallus)
  misc_feature (36): n=a or g
gtaatttggattccatgttcctgccatatgctctcnggaaacctttcagaatagctctggcctggtttctg

SEQ ID NO: 24124 - DNA, 71 bp, chicken (Gallus Gallus)
  misc_feature (36): n=g or t
tttatgttcatttcaaaaccactttcacactgaacntttttggttttctgtctgttcagaaaggatatccc

SEQ ID NO: 24125 - DNA, 71 bp, chicken (Gallus Gallus)
  misc_feature (36): n=g or t
tcagtcaaacaaggaaccttttcagctctttgcctntataatcataaggtataaactctcaactttcatac

SEQ ID NO: 24126 - DNA, 71 bp, chicken (Gallus Gallus)
  misc_feature (36): n=a or c
ttgtgtagaggtgtaggtcagagctgcttattctcncagctgtgtgcatcacacggctttttggagggaca

SEQ ID NO: 24127 - DNA, 71 bp, chicken (Gallus Gallus)
  misc_feature (36): n=c or t
acccccctttggagatggggaggtttctcaggccanacttatatgcttgtgctgtggacttttgttccaca

SEQ ID NO: 24128 - DNA, 71 bp, chicken (Gallus Gallus)
  misc_feature (36): n=a or g
aatgagtgggagtaaagcagcaagagacgagaaaantgcctatgacaatgaggggaaatcaaatgaaatac

SEQ ID NO: 24129 - DNA, 71 bp, chicken (Gallus Gallus)
  misc_feature (36): n=a or g
ctattgcctcacataaaactaaaaataagtgcatgngttcagtttacaagattttgtttctacatcttctc

SEQ ID NO: 24130 - DNA, 71 bp, chicken (Gallus Gallus)
  misc_feature (36): n=a or g
tgtagtttgagggcgggtgtttcttggttgtccctnttgtgaagtgttgtaaagaaggctgtactgaaacc

SEQ ID NO: 24131 - DNA, 71 bp, chicken (Gallus Gallus)
  misc_feature (36): n=a or g
ctagcacggggaaaagcaacaagctgatagtccctncagtatggctttgccgctctgttatcttgccctga

SEQ ID NO: 24132 - DNA, 71 bp, chicken (Gallus Gallus)
  misc_feature (36): n=c or t
gctattctagtatatgatataaccgatgaggactcnttccagaaggtactggacagatttttacctctgtg

SEQ ID NO: 24133 - DNA, 71 bp, chicken (Gallus Gallus)
  misc_feature (36): n=a or g
agttatttgccaacttctgtcatttaccactttacnttttacatcattgtttatatagctcttcagtctct

SEQ ID NO: 24134 - DNA, 71 bp, chicken (Gallus Gallus)
  misc_feature (36): n=a or g
caaacactgtgaaaaatcactgtgagaaaaatcctnttctgagcaagggtgtcagcatgcctgtgcaactg

SEQ ID NO: 24135 - DNA, 71 bp, chicken (Gallus Gallus)
  misc_feature (36): n=a or g
caaaccataatcattttgaccctctgtgttacaggntttggtttattttcttcttcttccagaacacgagc

SEQ ID NO: 24136 - DNA, 71 bp, chicken (Gallus Gallus)
  misc_feature (36): n=a or g
aagggcctgcttgagatactccttgagattgtctcntttgcagtatcagaggccaagctcttgttttgtat

SEQ ID NO: 24137 - DNA, 71 bp, chicken (Gallus Gallus)
  misc_feature (36): n=a or g
agggattttaaattatacgctttgggagaagatganacagtttgcccaagtaagatgtgcactcagagaca

SEQ ID NO: 24138 - DNA, 71 bp, chicken (Gallus Gallus)
  misc_feature (36): n=a or g
gtgagatataattacaaacttagtggaattaaagcngtgttccatttgcatcaatattaggattttccttt

SEQ ID NO: 24139 - DNA, 71 bp, chicken (Gallus Gallus)
  misc_feature (36): n=a or g
gcttctgtatttcaactctgcgataggcagaccacngaatgtaaacggaaactggaaaggatttgagaaga

SEQ ID NO: 24140 - DNA, 71 bp, chicken (Gallus Gallus)
  misc_feature (36): n=a or g
caccccctccaaactctcacaggtttaaaagcatcnccaataaccagatgttcaaaggaaatcagacacta

SEQ ID NO: 24141 - DNA, 71 bp, chicken (Gallus Gallus)
  misc_feature (36): n=a or g
ttcaggtgtttctttccgtatttatcctccctgcanaaggtgagccttaaacgtttattgaagttgaagga

SEQ ID NO: 24142 - DNA, 71 bp, chicken (Gallus Gallus)
  misc_feature (36): n=g or t
aggacaagagccgtaaagtgatcttagtaagtgctncttcttgccagcttgctcaagctgtgcagtcttac

SEQ ID NO: 24143 - DNA, 71 bp, chicken (Gallus Gallus)
  misc_feature (36): n=g or t
tacttagtgttaacctatatagctagcattttgcantgttgagcttattttaatatagcttgagtgtcatc

SEQ ID NO: 24144 - DNA, 71 bp, chicken (Gallus Gallus)
  misc_feature (36): n=a or t
gtgaagagcattctacaaactgaagaatgttgaaanaatgggtaatgcagcttattgtgtaattcagaaaa

SEQ ID NO: 24145 - DNA, 71 bp, chicken (Gallus Gallus)
  misc_feature (36): n=a or g
ataggtagttccaaagctgaaccccgcatccctaancaggtacaacttggagttttcagagtgacagcagg

SEQ ID NO: 24146 - DNA, 71 bp, chicken (Gallus Gallus)
  misc_feature (36): n=a or g
tcacctccctgtccctgctgtccacccctcttctcntggaacccaggatacacttggtctttccggttgca

SEQ ID NO: 24147 - DNA, 71 bp, chicken (Gallus Gallus)
  misc_feature (36): n=c or g
accggctctcgcatctgccaggctgcagaagctaancgtagtaacatagaggcttctcccaagcaaaatat

SEQ ID NO: 24148 - DNA, 71 bp, chicken (Gallus Gallus)
  misc_feature (36): n=c or t
catcaagtcagtccttcccagaggaatcccataatnccaacgttgtgaatggaacaaagagactgtcagac

SEQ ID NO: 24149 - DNA, 71 bp, chicken (Gallus Gallus)
  misc_feature (36): n=a or g
aacaaaaaaaaaacccacacaccatgaattagatgngatttttgtcttgtaaaacattaaaaaatgcaatg

SEQ ID NO: 24150 - DNA, 71 bp, chicken (Gallus Gallus)
  misc_feature (36): n=c or t
tctacagtgacgctgatgaaactcttcagctttgtngctgctcactcccagatcaatttgctgtccttatt

SEQ ID NO: 24151 - DNA, 71 bp, chicken (Gallus Gallus)
  misc_feature (36): n=c or t
tgtagacatagttctgggagaagcacgaacaaaagnagacggtgggttcttcgggatcttctttactaaat

SEQ ID NO: 24152 - DNA, 71 bp, chicken (Gallus Gallus)
  misc_feature (36): n=g or t
aacactgatttcaaaaggaaggaagggagaatgacnagatgatgtgggactgcaatcagtttccgcagtag

SEQ ID NO: 24153 - DNA, 71 bp, chicken (Gallus Gallus)
  misc_feature (36): n=a or g
tccataatcagttggtttccaccctcacacctcagngacttcagcagatgttaacagtagaaaatattgaa

SEQ ID NO: 24154 - DNA, 71 bp, chicken (Gallus Gallus)
  misc_feature (36): n=a or c
aggctgtcctgtagatggagaggagctgctactttnctctagtagctgtgtagggcgtaaataccttagga

SEQ ID NO: 24155 - DNA, 71 bp, chicken (Gallus Gallus)
  misc_feature (36): n=a or g
tcatatcttaaagcaatgaggataagtacctagganattacctaatgttctaccaaatttaagatctgcaa

SEQ ID NO: 24156 - DNA, 71 bp, chicken (Gallus Gallus)
  misc_feature (36): n=c or g
ctccaagtccaggttagaggtggctgtgagcagaanaagagggaagtgagggaccgtgcttcctgcgagtg

SEQ ID NO: 24157 - DNA, 71 bp, chicken (Gallus Gallus)
  misc_feature (36): n=a or g
tgggaaagagctaattcctcccagcaagtaacctgngagttgcaccttgttttctttgacttcagcttaca

SEQ ID NO: 24158 - DNA, 71 bp, chicken (Gallus Gallus)
  misc_feature (36): n=g or t
atttgccagtattaacaagtgttttctctgaaagcntagacatttaattggcacatgctcagactgtgaac

SEQ ID NO: 24159 - DNA, 71 bp, chicken (Gallus Gallus)
  misc_feature (36): n=c or t
tttgaagatcccaagaaaccaggagaaaaacagtangcgtatcagaattcctggggcattacaactcgaac

SEQ ID NO: 24160 - DNA, 71 bp, chicken (Gallus Gallus)
  misc_feature (36): n=c or t
tggtatctcatctacccatcttcttaacgctgcctnactcatgtgtccagctgtagggttggttgggtgct

SEQ ID NO: 24161 - DNA, 71 bp, chicken (Gallus Gallus)
  misc_feature (36): n=a or t
catctgatacaggagaatgtttatcacactgtaaancatgaatcaaagaggatagaagagtcttttccagt

SEQ ID NO: 24162 - DNA, 71 bp, chicken (Gallus Gallus)
  misc_feature (36): n=a or g
aacagggctaattagataatgctgtctgtgctcatntacaagagcagccataccaagaactgatggcagtt

SEQ ID NO: 24163 - DNA, 71 bp, chicken (Gallus Gallus)
  misc_feature (36): n=c or t
tctcaggtcttcttggcggggatggaagtattggcnttaggccacagggtcattggagagtgaccatagca

SEQ ID NO: 24164 - DNA, 71 bp, chicken (Gallus Gallus)
  misc_feature (36): n=c or t
tgagctcatgattgtccagagatgtactctgctccntggggaacgtacgcataggtgcattaatgggactg

SEQ ID NO: 24165 - DNA, 71 bp, chicken (Gallus Gallus)
  misc_feature (36): n=a or g
gttcttttagattgccagtaagcaattcactgtctncaaagtgtctcaggtggcaaggttaaccaaaaaca

SEQ ID NO: 24166 - DNA, 71 bp, chicken (Gallus Gallus)
  misc_feature (36): n=c or t
gttgaaatgactgcaagcaactgtatagtttatttnaattcatggcaatttgatgataaaacctacaaaaa

SEQ ID NO: 24167 - DNA, 71 bp, chicken (Gallus Gallus)
  misc_feature (36): n=c or t
atttcttcacaacattattcagattagtctgattanagctgttgctaataatttaattagaaacaaaccac

SEQ ID NO: 24168 - DNA, 71 bp, chicken (Gallus Gallus)
  misc_feature (36): n=a or g
ggaacaagcctctgtgtcaatctaggatcatcagcnggtggtcctcatgggtggtggcttccctgaggtct

SEQ ID NO: 24169 - DNA, 71 bp, chicken (Gallus Gallus)
  misc_feature (36): n=a or g
ttttactttgaattccaggattacatacaaaaggcnaaatctttaccccattgaaattgagacagaactcc

SEQ ID NO: 24170 - DNA, 71 bp, chicken (Gallus Gallus)
  misc_feature (36): n=c or g
taaatcagatctggtaaaagaatacacaatagtaanggagataacttttctgactctgctagagagtcagg

SEQ ID NO: 24171 - DNA, 71 bp, chicken (Gallus Gallus)
  misc_feature (36): n=a or t
ttacagtaggcaaaatctttgtcaaacaagacatanggtgttggactcctgcatgacgggatcacacccaa

SEQ ID NO: 24172 - DNA, 71 bp, chicken (Gallus Gallus)
  misc_feature (36): n=a or g
ccgggggttgcagggtggtccccaggtcaagtgatnctttgacaggggctcaccccaaacacctccatcct

SEQ ID NO: 24173 - DNA, 71 bp, chicken (Gallus Gallus)
  misc_feature (36): n=a or t
tctgaatttcaccaaagtttgcaagcaaaaggtttnatttttttgcaaaactccttagagtctattactgt

SEQ ID NO: 24174 - DNA, 71 bp, chicken (Gallus Gallus)
  misc_feature (36): n=c or t
ccgctcttggctttgagtacaagtggtggaacatcntaccaagcaacatgaagacttcttgctttaatgtt

SEQ ID NO: 24175 - DNA, 71 bp, chicken (Gallus Gallus)
  misc_feature (36): n=a or g
aagatgattctgtgtgactgacaaagcctgctttgnagcccaacatatctagaagccaggaattccagata

SEQ ID NO: 24176 - DNA, 71 bp, chicken (Gallus Gallus)
  misc_feature (36): n=a or g
tctaggtgctgctacaggaaatgcaaaaacaggccnacctggaaacctgaaaagggtgagacataatgact

SEQ ID NO: 24177 - DNA, 71 bp, chicken (Gallus Gallus)
  misc_feature (36): n=c or t
ccttttaaaataggagctgtttttatttatgtacanaagggatgcaactgtctctctccttctttcttaaa

SEQ ID NO: 24178 - DNA, 71 bp, chicken (Gallus Gallus)
  misc_feature (36): n=c or t
gttgttgtttaggataggaatgctatgtatgcatcnatattcagataaagagaagagcttcatcacccagg

SEQ ID NO: 24179 - DNA, 71 bp, chicken (Gallus Gallus)
  misc_feature (36): n=c or t
aactctaggcataaatataccaacactggaaattcntgacaatactgtactatgccttacatcatgcaaaa

SEQ ID NO: 24180 - DNA, 71 bp, chicken (Gallus Gallus)
  misc_feature (36): n=a or g
gataattgggaaatatttataatgtggccattcatnccatacaatgaattatcctatgcaaaatacgtaat

SEQ ID NO: 24181 - DNA, 71 bp, chicken (Gallus Gallus)
  misc_feature (36): n=a or c
agagttcctctttacctactgcttgctctcacaacntagacaagcttggtacgtgcaattaagttttgtaa

SEQ ID NO: 24182 - DNA, 71 bp, chicken (Gallus Gallus)
  misc_feature (36): n=a or g
gtcaaatgtaattacagctccaattgttgctctatngaatctatgcttttggctaagccccaggacaagta

SEQ ID NO: 24183 - DNA, 71 bp, chicken (Gallus Gallus)
  misc_feature (36): n=c or t
tgtttaaaagcaattcagatgaagaaaaggctgtantgtagaattctctcggtggcagaagtttgtatcct

SEQ ID NO: 24184 - DNA, 71 bp, chicken (Gallus Gallus)
  misc_feature (36): n=a or t
tcttccccttcattgtattcaaaactcaaacaattnattctgaaagtcctctagcttcacacttcttattt

SEQ ID NO: 24185 - DNA, 71 bp, chicken (Gallus Gallus)
  misc_feature (36): n=a or c
tgacatgcttccaccacaccactgccaatggtttcncttttattggaaaaaaatcagttcaaaatgagtga

SEQ ID NO: 24186 - DNA, 71 bp, chicken (Gallus Gallus)
  misc_feature (36): n=a or g
agtgctgagagacatttaattatatttggtaagagnagaagagccaaaaattctctgtgatgcctagaagt

SEQ ID NO: 24187 - DNA, 71 bp, chicken (Gallus Gallus)
  misc_feature (36): n=c or t
gtcatggccacttaaaaatgcactacttcaagacanagaaatatgttttagctatgtcagtaacaaagatg

SEQ ID NO: 24188 - DNA, 71 bp, chicken (Gallus Gallus)
  misc_feature (36): n=c or t
gttttgttttttttttttttctgaatgatggctcantttcaaatatcttggaagccctacctttgggaaat

SEQ ID NO: 24189 - DNA, 71 bp, chicken (Gallus Gallus)
  misc_feature (36): n=a or g
ctacacctttaagaagcatgggcatcattttcaaanataacactactaatcctatgaagagatgacagata

SEQ ID NO: 24190 - DNA, 71 bp, chicken (Gallus Gallus)
  misc_feature (36): n=c or t
taaatcttattaacgttattgggactggattgtctnatcagtacaaggagactaaattctgctataaataa

SEQ ID NO: 24191 - DNA, 71 bp, chicken (Gallus Gallus)
  misc_feature (36): n=a or g
aggcctctgactctgctctatgttgccagctgttcntgccctttatccagtgctttacacaggctccaacc

SEQ ID NO: 24192 - DNA, 71 bp, chicken (Gallus Gallus)
  misc_feature (36): n=a or g
taaagaatttcaacttactacattcatttctgtganctactctgagttacaatagcaaaaaaagatctcgt

SEQ ID NO: 24193 - DNA, 71 bp, chicken (Gallus Gallus)
  misc_feature (36): n=a or g
gttcactggaaaggacaaactttcctcctcattggnaaggctttgtctccccatataagttctagaaccct

SEQ ID NO: 24194 - DNA, 71 bp, chicken (Gallus Gallus)
  misc_feature (36): n=c or t
ccagtgcagagcaggagcaggagtccgtccctgtcnactgaaccaggctcctccattttccacaaaccaaa

SEQ ID NO: 24195 - DNA, 71 bp, chicken (Gallus Gallus)
  misc_feature (36): n=c or t
ataatctgaattccttgtttcatttcagacttgtanagctatctggaacatgaattggagagttcttctgt

SEQ ID NO: 24196 - DNA, 71 bp, chicken (Gallus Gallus)
  misc_feature (36): n=c or t
tactactacactgaatcaccttcataagcacttcanacctgtataatcaacaaatatacagactggcatgg

SEQ ID NO: 24197 - DNA, 71 bp, chicken (Gallus Gallus)
  misc_feature (36): n=c or t
gctggctgtgactgagcagctgtattgaggtgtagnagctctgttacccattctcttaatacagggctcct

SEQ ID NO: 24198 - DNA, 71 bp, chicken (Gallus Gallus)
  misc_feature (36): n=c or t
gtaaaatcggaaccgcttcaagatgatgctaaagancttccatgtggttcagtcagtagttatttttttcc

SEQ ID NO: 24199 - DNA, 71 bp, chicken (Gallus Gallus)
  misc_feature (36): n=a or t
ctacctctaaaaatcaaacaagtaataaaaaaaaantatgaatattagatttgcaattaatctgctctaac

SEQ ID NO: 24200 - DNA, 71 bp, chicken (Gallus Gallus)
  misc_feature (36): n=c or t
agaatgctatttgggactgtttcttcttctgtcttnaatgcagtactttaaatcattttcatctttcatgt

SEQ ID NO: 24201 - DNA, 71 bp, chicken (Gallus Gallus)
  misc_feature (36): n=c or t
tacaaatgtaaattgatctagataaactatgacaanattgggatacgtatgtaattagttttagaaggctg

SEQ ID NO: 24202 - DNA, 71 bp, chicken (Gallus Gallus)
  misc_feature (36): n=c or g
gagctgccttcttcaccagcgagccccacatgcggnctccaaacaaagatttgcaaatgtaactcccacca

SEQ ID NO: 24203 - DNA, 71 bp, chicken (Gallus Gallus)
  misc_feature (36): n=a or g
aattaagcatttctgtttttaactgtttatcaacangaaaagttccctttaaaacagagatgagcttcact

SEQ ID NO: 24204 - DNA, 71 bp, chicken (Gallus Gallus)
  misc_feature (36): n=c or t
tattgccttgaaactaaagcagagttctgagttttnacaagaagcgttatggttgacaccagcctggcagt

SEQ ID NO: 24205 - DNA, 71 bp, chicken (Gallus Gallus)
  misc_feature (36): n=a or g
cctgggctagaagtaagcaggaagcagagtactgcnggctgtagctatcacaccacagcagattctgcccc

SEQ ID NO: 24206 - DNA, 71 bp, chicken (Gallus Gallus)
  misc_feature (36): n=a or g
ctttaaattgattctattttttctgatagcataatncttgatcataagggcagaatacagaaagaaaatcc

SEQ ID NO: 24207 - DNA, 71 bp, chicken (Gallus Gallus)
  misc_feature (36): n=c or g
cactggaagcctacaattatttagcaggtggaagantacggtgtcgtttctgaagacctcagcagttcctg

SEQ ID NO: 24208 - DNA, 71 bp, chicken (Gallus Gallus)
  misc_feature (36): n=c or g
taggactgagcagacagtcaaatatagaagaggctntatgactaattgtgctatataaagttgtatcatac

SEQ ID NO: 24209 - DNA, 71 bp, chicken (Gallus Gallus)
  misc_feature (36): n=c or t
tgtaatgatctttggtatttgctgttcaccacgtanaagcatgtcctggtcttcaagttcatgactgaaaa

SEQ ID NO: 24210 - DNA, 71 bp, chicken (Gallus Gallus)
  misc_feature (36): n=a or t
gttatagttcctatttttctaaactcgtgaaggacngttagggttgttcctacagcactgttcatgagtgc

SEQ ID NO: 24211 - DNA, 71 bp, chicken (Gallus Gallus)
  misc_feature (36): n=a or g
agaacgtatggatgaaattgccaacggtgtatatcngtagtagatccacaccttgcaagttgaatttagag

SEQ ID NO: 24212 - DNA, 71 bp, chicken (Gallus Gallus)
  misc_feature (36): n=a or g
tcagtagtaacacagtgtctctcttgcattcccttnttctcagggtgagcgtggtgctcctggtaacccag

SEQ ID NO: 24213 - DNA, 71 bp, chicken (Gallus Gallus)
  misc_feature (36): n=a or g
ttctgaaagtaatgactcctatttattgtcatgganactgctactacaaagagcaccatagcgctattgga

SEQ ID NO: 24214 - DNA, 71 bp, chicken (Gallus Gallus)
  misc_feature (36): n=c or t
acgtaaatttggacaattaagttattctctttccanctcagttatccagtagaattgtaatcctaatttgt

SEQ ID NO: 24215 - DNA, 71 bp, chicken (Gallus Gallus)
  misc_feature (36): n=a or g
agggcaaaaaaagaaggaaataccagatgcaaaagngtttctgtcactagattcagtgataaaatctgcat

SEQ ID NO: 24216 - DNA, 71 bp, chicken (Gallus Gallus)
  misc_feature (36): n=a or g
attatctgaagaaaacagtatgtagtttatatatantattcctaaccgctctgaagctcaggtgcaaaaag

SEQ ID NO: 24217 - DNA, 71 bp, chicken (Gallus Gallus)
  misc_feature (36): n=g or t
actgttcagctgtgaggagcagtttgagcctgagcnccaagagcagctgttcagtgagctacatctgagct

SEQ ID NO: 24218 - DNA, 71 bp, chicken (Gallus Gallus)
  misc_feature (36): n=a or g
aggaagagtggggataaagaggaggtgagcactcanttggctcaatttcaattctgaagctatacccacag

SEQ ID NO: 24219 - DNA, 71 bp, chicken (Gallus Gallus)
  misc_feature (36): n=c or t
catgaataacaatatattgccatcaacaaaaacaangttttaaaatatagctgttgaaccacctcttttag

SEQ ID NO: 24220 - DNA, 71 bp, chicken (Gallus Gallus)
  misc_feature (36): n=c or t
tctttgtaggcttcataggtgatcatgagagcagcngggacttggaagaggcatcctctgtttttatcatt

SEQ ID NO: 24221 - DNA, 71 bp, chicken (Gallus Gallus)
  misc_feature (36): n=a or g
ccttctcctgctccatccctctcttccttctgtgcnaggtagatgcgtggccaccatttaaacatgagaca

SEQ ID NO: 24222 - DNA, 71 bp, chicken (Gallus Gallus)
  misc_feature (36): n=c or g
acctaatgcttttataacagttttccaaatcctaantgatcagatcaccacaatgctgtacagaaacagat

SEQ ID NO: 24223 - DNA, 71 bp, chicken (Gallus Gallus)
  misc_feature (36): n=c or t
atttttaaccctgaactttgaaattcttgaaaaggnctcaacagaaaagtaagattacctccaaaataatt

SEQ ID NO: 24224 - DNA, 71 bp, chicken (Gallus Gallus)
  misc_feature (36): n=a or g
cctgagtaaatgggagcaaagtggcgtggcctggcntgtgttgtaaggtgacaagcaccagtgctgcttta

SEQ ID NO: 24225 - DNA, 71 bp, chicken (Gallus Gallus)
  misc_feature (36): n=a or t
ttgcaagtatgaagcaaagagaaaaataatttccanccattaggtggagattgaataaattaaaaaattaa

SEQ ID NO: 24226 - DNA, 71 bp, chicken (Gallus Gallus)
  misc_feature (36): n=a or c
tttagatgcatcaagaaggggtttgctgtgttagcntaccctgataggaaagcgtcagtgagcgtacagaa

SEQ ID NO: 24227 - DNA, 71 bp, chicken (Gallus Gallus)
  misc_feature (36): n=c or g
cacagtggataaaatagaacatgtttcacccatggnccacccaggagccaggaaaaggggtcaaagtccag

SEQ ID NO: 24228 - DNA, 71 bp, chicken (Gallus Gallus)
  misc_feature (36): n=c or t
cctactgctgcagattcattcatgttgttgtgagcngaaagggcagacatgaggacagcgctgtgctcggc

SEQ ID NO: 24229 - DNA, 71 bp, chicken (Gallus Gallus)
  misc_feature (36): n=a or g
ctgaagatgaaaacttcaaaccagtgccttttaatnctatgccagctctaaaacttcctcaagaaaaataa

SEQ ID NO: 24230 - DNA, 71 bp, chicken (Gallus Gallus)
  misc_feature (36): n=c or g
attcactttgacctcattcttgacatagtgagccanggtaaagttctttgttaacctcctaaaacccgtct

SEQ ID NO: 24231 - DNA, 71 bp, chicken (Gallus Gallus)
  misc_feature (36): n=g or t
taactcagttatcagacatttctttgtatgcaactntatataaatgattattttctttccatgacatagat

SEQ ID NO: 24232 - DNA, 71 bp, chicken (Gallus Gallus)
  misc_feature (36): n=c or t
cagcttaggtcttgtgttagatatcaggtcttacantatttaagaatcagatttttttcatcagtgagtaa

SEQ ID NO: 24233 - DNA, 71 bp, chicken (Gallus Gallus)
  misc_feature (36): n=a or c
aacctctgctgcagaccaaccaaccaccagcgcctncctacgattttcatacggttcggtcggtaaacaac

SEQ ID NO: 24234 - DNA, 71 bp, chicken (Gallus Gallus)
  misc_feature (36): n=a or g
gattccagttttattcacttttagtatgtagtacanttaagacactttgggaggaattttaggagttaagc

SEQ ID NO: 24235 - DNA, 71 bp, chicken (Gallus Gallus)
  misc_feature (36): n=c or g
caggaaagggtacatcattcagcagaggtcctgganccaaggaggcaggtcattcagtgataaatattcct

SEQ ID NO: 24236 - DNA, 71 bp, chicken (Gallus Gallus)
  misc_feature (36): n=a or g
ctacaaaatgcaaagctatataaggtgagagcatcntcatcatagtggcagatcacagcacagtgctgatg

SEQ ID NO: 24237 - DNA, 71 bp, chicken (Gallus Gallus)
  misc_feature (36): n=c or t
agaaacagcaaaaggtacaacatgcaagagaaaacnacgagtgtaaaagcaatattccatcccatggagaa

SEQ ID NO: 24238 - DNA, 71 bp, chicken (Gallus Gallus)
  misc_feature (36): n=a or g
tttcaaaaaaaaaaaaaaaaaaaggaatatattacncacaactgtgctgtagctgagagatatgtgagaaa

SEQ ID NO: 24239 - DNA, 71 bp, chicken (Gallus Gallus)
  misc_feature (36): n=c or t
agtgaataaaaacaggtgccagtcgtttttatttgnttttaccctagcagctgagttttctgatgctttaa

SEQ ID NO: 24240 - DNA, 71 bp, chicken (Gallus Gallus)
  misc_feature (36): n=a or g
tcttcccttttgaacaaagccccacttcaatgcagncatgtttactgtcagaaggagtaaggaacaccagt

SEQ ID NO: 24241 - DNA, 71 bp, chicken (Gallus Gallus)
  misc_feature (36): n=c or t
tgggattgtaagaagctgcactttcccccattctgnggtttcactggttatgacagagaaacagtgtggcc

SEQ ID NO: 24242 - DNA, 71 bp, chicken (Gallus Gallus)
  misc_feature (36): n=c or t
ttattacgctgtctgtttcagtttaaagcttaatgncaatgtaagatgttttgatattagcaaacatgaaa

SEQ ID NO: 24243 - DNA, 71 bp, chicken (Gallus Gallus)
  misc_feature (36): n=a or g
aatattctctctgttcgtgcatatgtacaggaaggngaacagctgtttacgagggtggatagtgataggac

SEQ ID NO: 24244 - DNA, 71 bp, chicken (Gallus Gallus)
  misc_feature (36): n=c or g
ttaaaagtggcctctgattctgaactagtaaaagtnatgtaactgaaatggagacttctcatttcttatgg

SEQ ID NO: 24245 - DNA, 71 bp, chicken (Gallus Gallus)
  misc_feature (36): n=c or g
ttggaacgttccattggccccagtagccaactccancttctgagtctaacctgtgttagactccagctact

SEQ ID NO: 24246 - DNA, 71 bp, chicken (Gallus Gallus)
  misc_feature (36): n=c or t
ggtggcttcaaataagtaatgagcagcaaatgagcntattagggaaactgttctcaagccttttattttgt

SEQ ID NO: 24247 - DNA, 71 bp, chicken (Gallus Gallus)
  misc_feature (36): n=c or t
gcatttacattaatattttcatgcttcagatgcacnagttaggggcaagacacgctgactgatgaagatgt

SEQ ID NO: 24248 - DNA, 71 bp, chicken (Gallus Gallus)
  misc_feature (36): n=a or g
cttatttacatttttctgagagtattttcactaggnagtaaaatgaaagggcagttgctgaccgcacttca

SEQ ID NO: 24249 - DNA, 71 bp, chicken (Gallus Gallus)
  misc_feature (36): n=a or g
actagtgaaaaatccgcgtcccaaatgagcgggacngtttggaaagaggagaatccagatcgtcaccgctc

SEQ ID NO: 24250 - DNA, 71 bp, chicken (Gallus Gallus)
  misc_feature (36): n=a or g
ggtgcttagggttttcttccagatagcctgctgtgntacctaatgtcagaagtgtctctaagtacaaattt

SEQ ID NO: 24251 - DNA, 71 bp, chicken (Gallus Gallus)
  misc_feature (36): n=c or g
ttcagttattttacaactactctaaattaggatganatcttgtaccagctgagctttgaggctaaaaagaa

SEQ ID NO: 24252 - DNA, 71 bp, chicken (Gallus Gallus)
  misc_feature (36): n=c or t
atggattcgtattcttctgcctccttcccttacttntagctgactaatgatttacacaagtttacctctca

SEQ ID NO: 24253 - DNA, 71 bp, chicken (Gallus Gallus)
  misc_feature (36): n=c or t
ctctgccactcccatcccagagaaggccacacacangcagcaagggcattaagggatttcatactcctctg

SEQ ID NO: 24254 - DNA, 71 bp, chicken (Gallus Gallus)
  misc_feature (36): n=a or g
ctagtgacatttaactccgctgctcacaataaaccntcattaataagggacctcttagatactgtgcttcc

SEQ ID NO: 24255 - DNA, 71 bp, chicken (Gallus Gallus)
  misc_feature (36): n=c or t
taactttatagaaatagttttatgtattgctagcantgaggaaaattgctcggactgctattctgataata

SEQ ID NO: 24256 - DNA, 71 bp, chicken (Gallus Gallus)
  misc_feature (36): n=c or t
gaaaaaagcatacacatactacaaatgtacaacatnagaaatgcaggtaggttagaacgtccttatactgg

SEQ ID NO: 24257 - DNA, 71 bp, chicken (Gallus Gallus)
  misc_feature (36): n=a or g
tttgggatcgtgcaaaactacctttttcacagtcanaaggggctctttactgttttcttggtgatatgtta

SEQ ID NO: 24258 - DNA, 71 bp, chicken (Gallus Gallus)
  misc_feature (36): n=c or g
ggtggtgataataaagtattctggaacctggataanattttattctgtcactatggttttcttgctctggt

SEQ ID NO: 24259 - DNA, 71 bp, chicken (Gallus Gallus)
  misc_feature (36): n=a or g
tgatacttgcactgagtctatttgataaatggacangtatataattccaacaaagtaattttttcagttta

SEQ ID NO: 24260 - DNA, 71 bp, chicken (Gallus Gallus)
  misc_feature (36): n=a or g
aaaaatataggcatctaatttgaaacagtattaccnagtggcttatgacaacaactgttaagagtgtttga

SEQ ID NO: 24261 - DNA, 71 bp, chicken (Gallus Gallus)
  misc_feature (36): n=c or t
gatgaggtatggtttgagaatgctttgttagaagangcttccctcaaaaagctggtacaccatgggttaag

SEQ ID NO: 24262 - DNA, 71 bp, chicken (Gallus Gallus)
  misc_feature (36): n=a or g
ttgggtagagctctacgtgcagtgaaatacaatcanattgcttgtcatgactctgtcctaacacacggtca

SEQ ID NO: 24263 - DNA, 71 bp, chicken (Gallus Gallus)
  misc_feature (36): n=a or g
ttacacagaggaaacactctatgaatactgtaaatntgtacttttctcaattatactgacagagatcttgt

SEQ ID NO: 24264 - DNA, 71 bp, chicken (Gallus Gallus)
  misc_feature (36): n=a or g
aaaactgagttattggagacctccttgactttcctnaaacaagtctttattgtatatggttcattagtctc

SEQ ID NO: 24265 - DNA, 71 bp, chicken (Gallus Gallus)
  misc_feature (36): n=a or g
aatcagaattgacttgagaacagcatgagatggtcngaggcagaagggaagctgacctgttaatggtccct

SEQ ID NO: 24266 - DNA, 71 bp, chicken (Gallus Gallus)
  misc_feature (36): n=a or g
tccaaggaatggtcttttttttttcccctagtgcanaggaataaatatttgaaagacaaaaatagcaattt

SEQ ID NO: 24267 - DNA, 71 bp, chicken (Gallus Gallus)
  misc_feature (36): n=a or g
gaattgttaaacatatacataaatacatataaaganctaaaattatgtaagatataagttgctaattatgg

SEQ ID NO: 24268 - DNA, 71 bp, chicken (Gallus Gallus)
  misc_feature (36): n=a or g
taggaaatggctaatgaaatctgctacttttgtcantggatgtttatgtttcaaagccacactagattgtt

SEQ ID NO: 24269 - DNA, 71 bp, chicken (Gallus Gallus)
  misc_feature (36): n=g or t
tggaaacaaaatgcctgcttttaagggcattttttngatctgctgttaacgaatcgtacattgtcagtgtt

SEQ ID NO: 24270 - DNA, 71 bp, chicken (Gallus Gallus)
  misc_feature (36): n=c or t
ctagtcaatcacagtaaagtggctaataacagatgnggcaattaagctgaagaattctgtctctcttttaa

SEQ ID NO: 24271 - DNA, 71 bp, chicken (Gallus Gallus)
  misc_feature (36): n=a or t
gccccattttcccttgttttagcagctgacagtcanggacataaactttgtctcttttgagttaatgcagt

SEQ ID NO: 24272 - DNA, 71 bp, chicken (Gallus Gallus)
  misc_feature (36): n=c or t
gattcttacatacaagctgaaagggccaaacttccntacgaacttcagaagatgccgaatggctctgtagg

SEQ ID NO: 24273 - DNA, 71 bp, chicken (Gallus Gallus)
  misc_feature (36): n=c or t
acaagtagtttggcccactgtactccttgttgtttnctttttattgatgtaattattataactttatgttt

SEQ ID NO: 24274 - DNA, 71 bp, chicken (Gallus Gallus)
  misc_feature (36): n=a or g
ccactgttcagctgtatactacagaatatccagcanacctggactatcacaactcttttctttcctcttag

SEQ ID NO: 24275 - DNA, 71 bp, chicken (Gallus Gallus)
  misc_feature (36): n=c or t
taatgacttttctaggatcgtgtattctggattganggagagaacgaggcagtctatggtgccaacaaatt

SEQ ID NO: 24276 - DNA, 71 bp, chicken (Gallus Gallus)
  misc_feature (36): n=c or t
catgggattacaagctacccaactgtaggtgcgtangaaacatctcagttaagtccagttctgttagaatt

SEQ ID NO: 24277 - DNA, 71 bp, chicken (Gallus Gallus)
  misc_feature (36): n=a or g
aatttcattttgtagatctatcggcattcatacacngcgcattatgtcctcagcaaaattcctcacgggta

SEQ ID NO: 24278 - DNA, 71 bp, chicken (Gallus Gallus)
  misc_feature (36): n=c or t
aaatgctttaagtttccaaggatccactttttgtangtatgtaccatgctgcatatatttctagtcattct

SEQ ID NO: 24279 - DNA, 71 bp, chicken (Gallus Gallus)
  misc_feature (36): n=a or t
actttaagaagttacaggtttacttgctacgtgagnttgcagatgctcactgtaatcattaaccaacagct

SEQ ID NO: 24280 - DNA, 71 bp, chicken (Gallus Gallus)
  misc_feature (36): n=a or g
atatttctagggatctgggatcaaagtcatttattncacttgcaagtcagtttattcaagatggccagtga

SEQ ID NO: 24281 - DNA, 71 bp, chicken (Gallus Gallus)
  misc_feature (36): n=c or g
cttgtcaaattgacatttctgctccaaaacctcacngaacagcaaggtccttacgatgaccctctgcccta

SEQ ID NO: 24282 - DNA, 71 bp, chicken (Gallus Gallus)
  misc_feature (36): n=c or t
gtgtgtaaagcctggatctgactgaaacacaagccnggtgccactaggtgggccaccatctcggtgtgagt

SEQ ID NO: 24283 - DNA, 71 bp, chicken (Gallus Gallus)
  misc_feature (36): n=c or t
aggagaaaatcattagagaattgtgctgtagagtgnttagaggagatacaggtgttcaaaataaaacagag

SEQ ID NO: 24284 - DNA, 71 bp, chicken (Gallus Gallus)
  misc_feature (36): n=c or t
aaaagtaatgaatttgggaaaccagctcaggctctncaaatggattatgctatatgcgtacgctgcctgat

SEQ ID NO: 24285 - DNA, 71 bp, chicken (Gallus Gallus)
  misc_feature (36): n=a or g
gcgcttatatcctttgaagataagagaattagcccnatggcaaaagataatcaggactttccctctgcacg

SEQ ID NO: 24286 - DNA, 71 bp, chicken (Gallus Gallus)
  misc_feature (36): n=a or g
ttctggccttgaagctcattaaatgttcattactgncaatatttgcatcataatccacaagaaagaaaaac

SEQ ID NO: 24287 - DNA, 71 bp, chicken (Gallus Gallus)
  misc_feature (36): n=a or g
actatcttttttttccttcaactttttcaatgtgtnccaatcgcataacttctagttatcaattacacact

SEQ ID NO: 24288 - DNA, 71 bp, chicken (Gallus Gallus)
  misc_feature (36): n=a or c
tgtagcctgcacttacactactaatgacggccttcntttgaaagaatgcttggaaattccacactacgaag

SEQ ID NO: 24289 - DNA, 71 bp, chicken (Gallus Gallus)
  misc_feature (36): n=c or t
atgaaaagataagctgtgcctacctacccaggtacntatcttttcatattactctctgggaataggtcagt

SEQ ID NO: 24290 - DNA, 71 bp, chicken (Gallus Gallus)
  misc_feature (36): n=a or g
cctaggtacctctagatgtactctcctgtagagacncagaactctggtatgcttttgtagtgcacaaagtt

SEQ ID NO: 24291 - DNA, 71 bp, chicken (Gallus Gallus)
  misc_feature (36): n=g or t
gctcttggcttattttatgccactgcaagaaactgntttttttgactctcctcttgcaatttcaatagctt

SEQ ID NO: 24292 - DNA, 71 bp, chicken (Gallus Gallus)
  misc_feature (36): n=a or t
catgatttggcatatagagctgagaatgtgagagcnatgtgaaatttattatctgtgcaaccttcagttgt

SEQ ID NO: 24293 - DNA, 71 bp, chicken (Gallus Gallus)
  misc_feature (36): n=c or t
agttgattcttgctgtaataacttcattaataagcnggaaggaaaagtaaatagcatgtaaatgagttctg

SEQ ID NO: 24294 - DNA, 71 bp, chicken (Gallus Gallus)
  misc_feature (36): n=a or g
tccatagcacgcttgggaacttcttgttaaaaaaantaaaatgaagaattggggtagagaacgggagagaa

SEQ ID NO: 24295 - DNA, 71 bp, chicken (Gallus Gallus)
  misc_feature (36): n=a or g
aaacagtttcaaaaaggggcactcagactcctttanctttcatggggacattgggaggcttcagaagaggc

SEQ ID NO: 24296 - DNA, 71 bp, chicken (Gallus Gallus)
  misc_feature (36): n=a or c
gtaactgctgtcattcctgctccataggtgacctgncagatttagatgtcaattttgttaatactattttt

SEQ ID NO: 24297 - DNA, 71 bp, chicken (Gallus Gallus)
  misc_feature (36): n=a or g
catgtccccaacctgctggagttcaagaaacatttngacaatgctgtcagacacagtttggattttaggtg

SEQ ID NO: 24298 - DNA, 71 bp, chicken (Gallus Gallus)
  misc_feature (36): n=g or t
taaagatgaaggtctggttaatctgtattttgcagncttgttgaaaatctggacatatttaatataagatg

SEQ ID NO: 24299 - DNA, 71 bp, chicken (Gallus Gallus)
  misc_feature (36): n=a or g
gtgttttacaaagctgacaagtataattaaatctantatataggataatgatctgaggcacagtgaagtga

SEQ ID NO: 24300 - DNA, 71 bp, chicken (Gallus Gallus)
  misc_feature (36): n=a or g
tgtaacctactcataaagccttctaaaggctcaacntcagtacttttggttagtatctaaaaaaagccaaa

SEQ ID NO: 24301 - DNA, 71 bp, chicken (Gallus Gallus)
  misc_feature (36): n=a or g
actttttatgagggcaggtagtgagaggacaagggnaaatagctttaaactggaggaggttagattcagac

SEQ ID NO: 24302 - DNA, 71 bp, chicken (Gallus Gallus)
  misc_feature (36): n=c or t
ggagtaataacacaacaccaacatcttcccaagccnatttgcataaattacagcagtcctttactctttgt

SEQ ID NO: 24303 - DNA, 71 bp, chicken (Gallus Gallus)
  misc_feature (36): n=c or t
cacgttccaggcagagcaatatgtttgccgctgccnataacaaattctgctaaaacttttgggccatttat

SEQ ID NO: 24304 - DNA, 71 bp, chicken (Gallus Gallus)
  misc_feature (36): n=a or c
catttacagtagatgtttgcctgaccaaagagagcnattcaagtgtgaaatccactcaggaaaaaatagga

SEQ ID NO: 24305 - DNA, 71 bp, chicken (Gallus Gallus)
  misc_feature (36): n=c or t
gaaaaaatgaaaatacaaaccaggtatattacttcnctgtggtgttctgcaaggattccttacaatagctg

SEQ ID NO: 24306 - DNA, 71 bp, chicken (Gallus Gallus)
  misc_feature (36): n=a or t
cataggtattcagttacacatagcctttgatcttcnatagctgctactggtacctacaggggtctgtgcgt

SEQ ID NO: 24307 - DNA, 71 bp, chicken (Gallus Gallus)
  misc_feature (36): n=a or t
aatttggccgagttctgttcaaagaaacatcactgncgtccagtttttccattctctgttgtttccattct

SEQ ID NO: 24308 - DNA, 71 bp, chicken (Gallus Gallus)
  misc_feature (36): n=a or g
gttaaattcattttttcgtagaaaagcaacagcccntgatacacatgtattgctactctcacagtttacag

SEQ ID NO: 24309 - DNA, 71 bp, chicken (Gallus Gallus)
  misc_feature (36): n=a or g
ttgggattgtagactgtattgatatatgtcttccangagcttaagtaaaatgttattttgtatctgccgta

SEQ ID NO: 24310 - DNA, 71 bp, chicken (Gallus Gallus)
  misc_feature (36): n=c or t
gtcccttccaacatgagagcgagtgtgtttttccangactacagcctttccaactgcgaaaggaaggagga

SEQ ID NO: 24311 - DNA, 71 bp, chicken (Gallus Gallus)
  misc_feature (36): n=c or t
tctatctttcgttgggccctgtaccctaattaccangtctgctgcagctccctgacactaaactttgctgc

SEQ ID NO: 24312 - DNA, 71 bp, chicken (Gallus Gallus)
  misc_feature (36): n=c or t
caggcagagctggtccctttggggaacaacctaagnaaatttaccctcctaaccatttggagacagtttgt

SEQ ID NO: 24313 - DNA, 71 bp, chicken (Gallus Gallus)
  misc_feature (36): n=a or g
taactaaaacatttttgttttctctatgtactttcnaagtagaagtgtatctacttttcaggcaggtatta

SEQ ID NO: 24314 - DNA, 71 bp, chicken (Gallus Gallus)
  misc_feature (36): n=g or t
cctgaacttgtcatttcagattggattggactctanagctgtcgatacctactgcgttaccacatcggtta

SEQ ID NO: 24315 - DNA, 71 bp, chicken (Gallus Gallus)
  misc_feature (36): n=a or g
gtaagtttacttgttagaataggcatgaatttctanaatgttatgtggcagacaaatcaatcaaaccattt

SEQ ID NO: 24316 - DNA, 71 bp, chicken (Gallus Gallus)
  misc_feature (36): n=c or t
agaccattttctgctcccagatcaaaggaagataanaagcaatgaggagaatacttcatagtcatatacgg

SEQ ID NO: 24317 - DNA, 71 bp, chicken (Gallus Gallus)
  misc_feature (36): n=c or g
tgtttggtgtgtcacttcaggagctgatgaaaatantgaagactttcttgagtattctgttatatactgac

SEQ ID NO: 24318 - DNA, 71 bp, chicken (Gallus Gallus)
  misc_feature (36): n=c or t
tctttctggcttggacataagaaatcagagcaaaangtctttcttctgtcacatgaggactgcaccgggtc

SEQ ID NO: 24319 - DNA, 71 bp, chicken (Gallus Gallus)
  misc_feature (36): n=a or c
ctgattagctagtagagaatgataataaacattatnattgtactttgcaatatcatgacacagtaccacct

SEQ ID NO: 24320 - DNA, 71 bp, chicken (Gallus Gallus)
  misc_feature (36): n=c or t
tcaaaaaccaaaatgcttttatctagctaggtatgntgtggagctgtggaagaggtaaatcaggctgatgt

SEQ ID NO: 24321 - DNA, 71 bp, chicken (Gallus Gallus)
  misc_feature (36): n=c or g
acagcttacccattgctctcttctgtctgtcaccantgggagcagaataaactagcgctataaagttgcat

SEQ ID NO: 24322 - DNA, 71 bp, chicken (Gallus Gallus)
  misc_feature (36): n=a or g
ctcagatatgctggcaattcagacaaaccatttctntgagctttagcaaagtaagggcaacaacaagaacc

SEQ ID NO: 24323 - DNA, 71 bp, chicken (Gallus Gallus)
  misc_feature (36): n=c or t
gcccaggtggaggataagagctgtgtttgcccaccngctgtaaccccaaatgaagaatccagactgaggat

SEQ ID NO: 24324 - DNA, 71 bp, chicken (Gallus Gallus)
  misc_feature (36): n=a or g
aaccagaaattagctgtagtgccacgagcaaaggangcttgttggtgtttggatgcaacactgacctgaga

SEQ ID NO: 24325 - DNA, 71 bp, chicken (Gallus Gallus)
  misc_feature (36): n=c or t
tttcccccttgacagcattatgaatgcaaattactncatctactgaattcatacgaagatagaaggagctg

SEQ ID NO: 24326 - DNA, 71 bp, chicken (Gallus Gallus)
  misc_feature (36): n=a or g
atctacttctatgccctcttttttcctttagttgtncttttttagcacaacaatctctagtatcaacttct

SEQ ID NO: 24327 - DNA, 71 bp, chicken (Gallus Gallus)
  misc_feature (36): n=a or g
atgtgctggtggtgctcctaatggcaacagcctttntattcctaattattatgttttgtcagtaatgcagt

SEQ ID NO: 24328 - DNA, 71 bp, chicken (Gallus Gallus)
  misc_feature (36): n=a or t
gagcttataatctattgcaattcactttatttctantggttacattttatgatgtcttaataataatctaa

SEQ ID NO: 24329 - DNA, 71 bp, chicken (Gallus Gallus)
  misc_feature (36): n=c or t
agctttataaagggagcaggaaaaccctctcagctnccgtagatgtgtcacaggtcaatgagctgctgctg

SEQ ID NO: 24330 - DNA, 71 bp, chicken (Gallus Gallus)
  misc_feature (36): n=a or g
attacccatatacgctgaatttgaatttgacccatnacgagcaagtgctattgggaatgcagtgatgttcc

SEQ ID NO: 24331 - DNA, 71 bp, chicken (Gallus Gallus)
  misc_feature (36): n=a or g
aaaggctgtatcagaaatctgaaccacagccagtancacaagtttcaggcttctgtagtgtaccctctgca

SEQ ID NO: 24332 - DNA, 71 bp, chicken (Gallus Gallus)
  misc_feature (36): n=c or g
gtcattaggcagaggaattgctactgaagatgtttntcccttccagcagctgagcccagtattgtgttccc

SEQ ID NO: 24333 - DNA, 71 bp, chicken (Gallus Gallus)
  misc_feature (36): n=c or t
cattcaaagatccacacacaataaaactcggtgttngggcaggagtacgggctgttggtacgtgtaagggg

SEQ ID NO: 24334 - DNA, 71 bp, chicken (Gallus Gallus)
  misc_feature (36): n=c or t
atgatgtatggtgtgggactgtgttccttttgcctncagaattttttcctttctgagctttttctgacact

SEQ ID NO: 24335 - DNA, 71 bp, chicken (Gallus Gallus)
  misc_feature (36): n=c or g
accagacatacaggtgcatgtacagaacacctgcanaggagcaccacgctgtcatgtttgtatgcaccttc

SEQ ID NO: 24336 - DNA, 71 bp, chicken (Gallus Gallus)
  misc_feature (36): n=c or t
caaatgtacattcagcatggagtaaaatgctgtttngtgacaaagtgtaatataggtatgtgagatagctt

SEQ ID NO: 24337 - DNA, 71 bp, chicken (Gallus Gallus)
  misc_feature (36): n=a or c
tacactacctgatatacaccgctgcctgcaagcggnaactgcgctctgactttgagtgcaatgtaaaaatt

SEQ ID NO: 24338 - DNA, 71 bp, chicken (Gallus Gallus)
  misc_feature (36): n=c or t
caatgctacgctaaaatgaaggaagaccagaacagngtttatgttattcagattgtaacattggagagagt

SEQ ID NO: 24339 - DNA, 71 bp, chicken (Gallus Gallus)
  misc_feature (36): n=c or t
actattcaaacacaaataatatcgtaaatcaaatanattgttatatgtatcaactagtactgaagtgactc

SEQ ID NO: 24340 - DNA, 71 bp, chicken (Gallus Gallus)
  misc_feature (36): n=c or t
tattagaaatctcaaatatttattaacaacgcacanaaaggtacgaatgcagcctacgtattctgaacaca

SEQ ID NO: 24341 - DNA, 71 bp, chicken (Gallus Gallus)
  misc_feature (36): n=c or t
aaaattaggcacaatttctccttgcctttactgtcntgaataacagcattttaaggagattgctggttttt

SEQ ID NO: 24342 - DNA, 71 bp, chicken (Gallus Gallus)
  misc_feature (36): n=c or t
taatggtctttctacagtagaacactttaatattcnttattctgtaacgtgtcctttctgaaaacatcatt

SEQ ID NO: 24343 - DNA, 71 bp, chicken (Gallus Gallus)
  misc_feature (36): n=a or g
tggtgacaaaccatgctgattgagcatttctcagantgttagaatgtgtcaacagaacattgaataaatac

SEQ ID NO: 24344 - DNA, 71 bp, chicken (Gallus Gallus)
  misc_feature (36): n=c or t
ctattatagactgatattgtagcatttgaatatacngcgtataccatgctgctattttaaagacattagac

SEQ ID NO: 24345 - DNA, 71 bp, chicken (Gallus Gallus)
  misc_feature (36): n=c or t
gcttttggaagcctcttgcaagcattctattaaaancaaagcctgccaaaccaactgctgcctccttaccc

SEQ ID NO: 24346 - DNA, 71 bp, chicken (Gallus Gallus)
  misc_feature (36): n=g or t
gcaagatctaatcctgttggttttgaattttatttntcatgaaatgtttccctcttgcatagcaatgtctc

SEQ ID NO: 24347 - DNA, 71 bp, chicken (Gallus Gallus)
  misc_feature (36): n=g or t
aattcacatgggatgaagtttgaactccagcttgcngagaaactcagatcaggtccccgacaacgttccct

SEQ ID NO: 24348 - DNA, 71 bp, chicken (Gallus Gallus)
  misc_feature (36): n=c or t
gaagtttatagccagaagtaaggaggctgtgatgcncagtgccacagacattctgggaaaggacaggtagg

SEQ ID NO: 24349 - DNA, 71 bp, chicken (Gallus Gallus)
  misc_feature (36): n=a or t
cctcttttgaaacatagatctattctatgaatccanacagtttcagagagagagagagagagatgtacata

SEQ ID NO: 24350 - DNA, 71 bp, chicken (Gallus Gallus)
  misc_feature (36): n=a or g
ttggaaggagcacctggatgctcagctggatcaggnggcttgtttcaccaaaaattaattgctctgttact

SEQ ID NO: 24351 - DNA, 71 bp, chicken (Gallus Gallus)
  misc_feature (36): n=a or c
cttttatgctgcattgagcaaagaggtgggcagagnctcccaggctgtctccttcagaagcagaatgatcc

SEQ ID NO: 24352 - DNA, 71 bp, chicken (Gallus Gallus)
  misc_feature (36): n=c or t
gcttttccttctgtgaggtcattctgcctctacacnggcactgcctttgtcttctgctatgtctacgttat

SEQ ID NO: 24353 - DNA, 71 bp, chicken (Gallus Gallus)
  misc_feature (36): n=c or g
atacattagaacgtattagaaggtaataaactaatnctggatgcctcaggaaaataatgaagagatataga

SEQ ID NO: 24354 - DNA, 71 bp, chicken (Gallus Gallus)
  misc_feature (36): n=a or g
tgagtttttcgagccagtcccagtccggtgcagagnaggtgtttcttcacactctttcatagactctggtg

SEQ ID NO: 24355 - DNA, 71 bp, chicken (Gallus Gallus)
  misc_feature (36): n=a or g
gtttgtcctgctgccctgcactggcattgctcacanaatgcctttgctgtgcaactcagcacccatttgtt

SEQ ID NO: 24356 - DNA, 71 bp, chicken (Gallus Gallus)
  misc_feature (36): n=c or t
gtttttcacatgatgagtgtcctttgcagtatacanatgatgtataatattataaaattattataatccat

SEQ ID NO: 24357 - DNA, 71 bp, chicken (Gallus Gallus)
  misc_feature (36): n=c or g
cctctatttcaacagtcatctccagcatctcagctnctttctgtcctgggtgacaggaatggttcataggc

SEQ ID NO: 24358 - DNA, 71 bp, chicken (Gallus Gallus)
  misc_feature (36): n=g or t
tccatttgaattaaaaagaaaagtagaatgctgatnaccgttctattcagatattactataatatatatag

SEQ ID NO: 24359 - DNA, 71 bp, chicken (Gallus Gallus)
  misc_feature (36): n=a or g
tttttactgatacacagaatattgcctattgataancataagatatgtaacattatatttatgccagtgaa

SEQ ID NO: 24360 - DNA, 71 bp, chicken (Gallus Gallus)
  misc_feature (36): n=g or t
ttattcttttagaaggtggtacttacaactaagacntgttttttcttctgtttcagaggagtacttggatc

SEQ ID NO: 24361 - DNA, 71 bp, chicken (Gallus Gallus)
  misc_feature (36): n=c or t
cagaggattgtaggaaataaaggaaatgtaattggngggaatcaaagaagtaagaagtggaaaaggaagaa

SEQ ID NO: 24362 - DNA, 71 bp, chicken (Gallus Gallus)
  misc_feature (36): n=a or g
gaagacatcagcagaagaagtaaatgaaacttctcnaagacataagaaatggcagtgtcagatccacctca

SEQ ID NO: 24363 - DNA, 71 bp, chicken (Gallus Gallus)
  misc_feature (36): n=a or t
tgttactgagttgttccagtcttgtcatagagcaanggcatgttctgtcttagctaatatcacctgtattt

SEQ ID NO: 24364 - DNA, 71 bp, chicken (Gallus Gallus)
  misc_feature (36): n=g or t
gatggatacttctcgttaacaccatagcactatcanaaagcagtattataatactgcaccaagagaacgaa

SEQ ID NO: 24365 - DNA, 71 bp, chicken (Gallus Gallus)
  misc_feature (36): n=g or t
agacattagtgtgcttactgcctatgtaccaaactngtatctgaatgtttgccacaaaactaaatgctgga

SEQ ID NO: 24366 - DNA, 71 bp, chicken (Gallus Gallus)
  misc_feature (36): n=a or g
agaagagttgctagaaatctgacaagggtctagagngagtcccttgaaacccatgctaagtaacctatcat

SEQ ID NO: 24367 - DNA, 71 bp, chicken (Gallus Gallus)
  misc_feature (36): n=g or t
gcttagacaggcagaagtaaagtcgatcctctctgntaacaagagaccgggagatttcttgtgacccctac

SEQ ID NO: 24368 - DNA, 71 bp, chicken (Gallus Gallus)
  misc_feature (36): n=a or g
attcacctgtgactttctgcaggtaaataacttgcntgccagatgccttaggatggcaatggttgggaagt

SEQ ID NO: 24369 - DNA, 71 bp, chicken (Gallus Gallus)
  misc_feature (36): n=a or g
tttgcttcacaatttttaaactgctcttgaacacanaaccatagaattgttcgagtgggaagggaccctta

SEQ ID NO: 24370 - DNA, 71 bp, chicken (Gallus Gallus)
  misc_feature (36): n=a or t
taaggtctatctatagatgaatttcaaaggattgtncttgttactttctcattagacttccctgtttcatc

SEQ ID NO: 24371 - DNA, 71 bp, chicken (Gallus Gallus)
  misc_feature (36): n=a or g
aatgtgatattggctgcatgttcaaaatgtaagcanatgaatgtttccacttcaatagcacaaagtgaggt

SEQ ID NO: 24372 - DNA, 71 bp, chicken (Gallus Gallus)
  misc_feature (36): n=a or g
aagcttcagtccttcactatcaataactatctggcnaataactagtgtcaaataactcatgataataaaga

SEQ ID NO: 24373 - DNA, 71 bp, chicken (Gallus Gallus)
  misc_feature (36): n=c or g
ggagttgtgttccctggttgggatgagtggctgcanttgtgtctcaacctcctattccatctactccatcc

SEQ ID NO: 24374 - DNA, 71 bp, chicken (Gallus Gallus)
  misc_feature (36): n=c or t
cgtgcccagaaaatgaagcacaggagttgtatgcantgctcttatatagagtattaacactcaaaatttga

SEQ ID NO: 24375 - DNA, 71 bp, chicken (Gallus Gallus)
  misc_feature (36): n=a or g
gagtttaagacatcggtaaattctaggaaggcaacntatgatttttaacctcgagcaccctctacccccaa

SEQ ID NO: 24376 - DNA, 71 bp, chicken (Gallus Gallus)
  misc_feature (36): n=g or t
gctcggagtacatcccctacctacgtgcatcttcanatttacaaaggagcgttccactgcagcagaaccta

SEQ ID NO: 24377 - DNA, 71 bp, chicken (Gallus Gallus)
  misc_feature (36): n=g or t
taaattatgcaattaatggcccattgcagtaccagntagggacatcatagactcagcagaagcaagacaca

SEQ ID NO: 24378 - DNA, 71 bp, chicken (Gallus Gallus)
  misc_feature (36): n=a or g
gttggccccatagattgatgcttgagcttgtggacntacacaagagctacctaatactgttcttcatgcag

SEQ ID NO: 24379 - DNA, 71 bp, chicken (Gallus Gallus)
  misc_feature (36): n=g or t
tgggaaaaagacccaaaccctcatatgaaatgccancagaatcccatgtgcggtacttacagagtagcttg

SEQ ID NO: 24380 - DNA, 71 bp, chicken (Gallus Gallus)
  misc_feature (36): n=g or t
ttctgaaccatgcaaagccaagcactgatccacctncaggaggaagttgtaaggtgtaggaaacttaaata

SEQ ID NO: 24381 - DNA, 71 bp, chicken (Gallus Gallus)
  misc_feature (36): n=g or t
tcagtttcataaatttagccgttcattttcttttcngtgtgtaccaagtattcaagagaaagcatttcttt

SEQ ID NO: 24382 - DNA, 71 bp, chicken (Gallus Gallus)
  misc_feature (36): n=g or t
ttttttctgtcaggttagtgagataaacaggctggnagaatggtgcagtaaactttggatctgaagtgagt

SEQ ID NO: 24383 - DNA, 71 bp, chicken (Gallus Gallus)
  misc_feature (36): n=a or t
taatttactggctgttgacattaggcattgtttggnaatagctttccgaataaaactgaagtctttattct

SEQ ID NO: 24384 - DNA, 71 bp, chicken (Gallus Gallus)
  misc_feature (36): n=c or t
agagttaattcaacatccgtagcacagtggaacctngataaagtggtcagatcagtctcatctctgacttt

SEQ ID NO: 24385 - DNA, 71 bp, chicken (Gallus Gallus)
  misc_feature (36): n=a or g
agctattccagttgccatgcatccagtctagaaaanattatggctcccattcaaatatgaaagaaagaatt

SEQ ID NO: 24386 - DNA, 71 bp, chicken (Gallus Gallus)
  misc_feature (36): n=g or t
cattatcttcttgttgtatgtaattgctattagatncaatggattatcttttcaaagtaaaaagattgaag

SEQ ID NO: 24387 - DNA, 71 bp, chicken (Gallus Gallus)
  misc_feature (36): n=a or g
cagctgcagtgatgacagatgtggtttctgtaaacntgtaagcagttttcacctgttgttatttgtgttga

SEQ ID NO: 24388 - DNA, 71 bp, chicken (Gallus Gallus)
  misc_feature (36): n=c or t
gctcacttgactttgagtcttgttcccttttcccanatgtcctggagtgaatgagaggctgttgcacggta

SEQ ID NO: 24389 - DNA, 71 bp, chicken (Gallus Gallus)
  misc_feature (36): n=a or g
ccatttcatggatgaaacacaagcacgcagcacagnatgctctacagcttctcctttaagtctcttgcaaa

SEQ ID NO: 24390 - DNA, 71 bp, chicken (Gallus Gallus)
  misc_feature (36): n=g or t
ggagtgcttttcctgtttctgcagttaaattttccntgaaaccaaaatccgtacgtatgcggtaactcctg

SEQ ID NO: 24391 - DNA, 71 bp, chicken (Gallus Gallus)
  misc_feature (36): n=a or g
tggacagcccactgaaacagtcaatacagactgatnttgcctgccacatacatcttaaattaacaaagatc

SEQ ID NO: 24392 - DNA, 71 bp, chicken (Gallus Gallus)
  misc_feature (36): n=a or g
ctccatgtgctgcactgccttctgctgtcaaaacantcctttctatgtcagaaatgtgtaaacaccatttt

SEQ ID NO: 24393 - DNA, 71 bp, chicken (Gallus Gallus)
  misc_feature (36): n=a or g
tgtattatatcagtcattggcattggcacaggatcntgtgcagtgcagaggacaagagagtctgctgtccc

SEQ ID NO: 24394 - DNA, 71 bp, chicken (Gallus Gallus)
  misc_feature (36): n=c or t
gcactgtacagattcagtgccctggacagatcttgntctgtatgcctccatcccaagcttcaccctcttct

SEQ ID NO: 24395 - DNA, 71 bp, chicken (Gallus Gallus)
  misc_feature (36): n=a or g
ttttctaatactctagcagcaaattccattcagaantacatggcgtaagtgattaacgtatgaactatgaa

SEQ ID NO: 24396 - DNA, 71 bp, chicken (Gallus Gallus)
  misc_feature (36): n=a or t
atgaactgccttttacaagccagtcaacatttgacntggagaagagagacaaatctttttcatacctgcta

SEQ ID NO: 24397 - DNA, 71 bp, chicken (Gallus Gallus)
  misc_feature (36): n=c or t
tgtacagaaaatcactggtcccaccaatttcagcangctactaaggaattaaaagtacagaatgccttgag

SEQ ID NO: 24398 - DNA, 71 bp, chicken (Gallus Gallus)
  misc_feature (36): n=c or t
aaaggctgattattaagtttgcttgacctttatttnctcagttagggaaaccaacgtatttctctcttgtt

SEQ ID NO: 24399 - DNA, 71 bp, chicken (Gallus Gallus)
  misc_feature (36): n=c or t
tcagcattttcttttggaagcaactttctgcgcacngagcacaagcttgcacaaactgctggcttttcctc

SEQ ID NO: 24400 - DNA, 71 bp, chicken (Gallus Gallus)
  misc_feature (36): n=c or t
ttttattactcaagattctttctacgcttgaaaaangaaggcagaatattagaagtgcttttctaaatacg

SEQ ID NO: 24401 - DNA, 71 bp, chicken (Gallus Gallus)
  misc_feature (36): n=c or t
tcaaaaatggtcatttatagttaatatgattttttntcatgcacaataaagggaattttatgtaattaagg

SEQ ID NO: 24402 - DNA, 71 bp, chicken (Gallus Gallus)
  misc_feature (36): n=a or t
cgaaaagtgctgaaaaccaataccagtaagtaaacngagcatgacgttaatttaatgtcagcaaatgtttt

SEQ ID NO: 24403 - DNA, 71 bp, chicken (Gallus Gallus)
  misc_feature (36): n=a or g
gcaatctgtaaaactatgaactgtttcaaccaaagnctctttttgaaaagcaatgcccaattaattataca

SEQ ID NO: 24404 - DNA, 71 bp, chicken (Gallus Gallus)
  misc_feature (36): n=a or t
gcagctgtcaggtattttacattgcacagacatgcnctctgctccctcttgctagtgactgtattgccatt

SEQ ID NO: 24405 - DNA, 71 bp, chicken (Gallus Gallus)
  misc_feature (36): n=c or t
aattttttgctgtaagtgtacttgactgacacttgnaaccatagcggatggaatttgtaaattctcatcta

SEQ ID NO: 24406 - DNA, 71 bp, chicken (Gallus Gallus)
  misc_feature (36): n=c or t
cttcccaaaggaattcccatcgaggccgtgacagangctgaaacacactatgggagaggaaacccttgctg

SEQ ID NO: 24407 - DNA, 71 bp, chicken (Gallus Gallus)
  misc_feature (36): n=a or g
agaaaaagttagcatgaaattaatattcctatttancaagataaatttggtcattttaatgaacacttcta

SEQ ID NO: 24408 - DNA, 71 bp, chicken (Gallus Gallus)
  misc_feature (36): n=a or c
gctttgcacagggatgggtatactgctgataattcntggcttcctgtctcagtgaaaaacagcacctcttt

SEQ ID NO: 24409 - DNA, 71 bp, chicken (Gallus Gallus)
  misc_feature (36): n=a or g
ttctgggtgtcagagacaggaagagaattggaaaanaagaaaaaaaagaaagaaaaagaaaaagggaaaag

SEQ ID NO: 24410 - DNA, 71 bp, chicken (Gallus Gallus)
  misc_feature (36): n=a or g
actgcctgtcaacttgtgttcacttacaggctaaantaaagtgggtatgtatggggtgagtgaagttagtt

SEQ ID NO: 24411 - DNA, 71 bp, chicken (Gallus Gallus)
  misc_feature (36): n=a or g
tttccaagagtgtccttctgggccaccatcagcacnctctgtctgatgttcaagcagtccagcttctcaga

SEQ ID NO: 24412 - DNA, 71 bp, chicken (Gallus Gallus)
  misc_feature (36): n=a or g
actggaacagtctgcccagggaagtggtagccaccntccctggaaacgttcaaaaacacatagtactgagg

SEQ ID NO: 24413 - DNA, 71 bp, chicken (Gallus Gallus)
  misc_feature (36): n=a or g
gccatgcatttgggtattctgctcatcagggcccantggcctctggttaagggttgagctgcagcctcaca

SEQ ID NO: 24414 - DNA, 71 bp, chicken (Gallus Gallus)
  misc_feature (36): n=c or t
tccttcctcgtaaagaattttctggtacgttaaganattgttaatgctacagaagccttgtgcaactgtct

SEQ ID NO: 24415 - DNA, 71 bp, chicken (Gallus Gallus)
  misc_feature (36): n=c or t
cccactctctttctgggacatcagaaggagcagaangattcaggtgatactgcaacactgagtgacttcct

SEQ ID NO: 24416 - DNA, 71 bp, chicken (Gallus Gallus)
  misc_feature (36): n=c or g
tgccagttagttatttgaaagcaggaaacgatctgnttgtgtgcttgtttgcagcatgtttggttttagaa

SEQ ID NO: 24417 - DNA, 71 bp, chicken (Gallus Gallus)
  misc_feature (36): n=a or t
tgctgcaggggatgagtgctgtacacccctatttcncacataatagagtttctatttgaagcagggaggag

SEQ ID NO: 24418 - DNA, 71 bp, chicken (Gallus Gallus)
  misc_feature (36): n=a or g
ccataatgctgcaaatggcacgtgaattgcttcgcncaggctgtgcaatttgctttcccatcctcattaaa

SEQ ID NO: 24419 - DNA, 71 bp, chicken (Gallus Gallus)
  misc_feature (36): n=g or t
gctttgtttgactccattcttgacagcactcagccnacctaaatgggctccacagaccaacagctcttgtg

SEQ ID NO: 24420 - DNA, 71 bp, chicken (Gallus Gallus)
  misc_feature (36): n=c or g
gcagtaactccaggtgaggtgacaaacagcaattanctctcaagctgtttgcagcctcaatatccctccag

SEQ ID NO: 24421 - DNA, 71 bp, chicken (Gallus Gallus)
  misc_feature (36): n=a or g
tactttatgatggctgttctttggaaaagagttggnacttctcactctagatggtgatcatctgtcattgt

SEQ ID NO: 24422 - DNA, 71 bp, chicken (Gallus Gallus)
  misc_feature (36): n=c or t
taattttgaagccaaaacccacacattcttaacttngtttcccagcttaagagccaatatactcatgtatt

SEQ ID NO: 24423 - DNA, 71 bp, chicken (Gallus Gallus)
  misc_feature (36): n=a or c
gttttatagttatgcactggaagtttttttggtggnaaaaagtggaattttatttttctatgtttatgata

SEQ ID NO: 24424 - DNA, 71 bp, chicken (Gallus Gallus)
  misc_feature (36): n=c or t
aagtgattctcactactatcctgctgtagaactgtntgagatgctggcaacacagctcctgaagaaaacac

SEQ ID NO: 24425 - DNA, 71 bp, chicken (Gallus Gallus)
  misc_feature (36): n=c or g
cttcccatatgttgaacaacatggaaccagtactancaaaagtctccaactcaggcaagctatctctagtt

SEQ ID NO: 24426 - DNA, 71 bp, chicken (Gallus Gallus)
  misc_feature (36): n=c or t
ggggatacacaaatctcagatctgcaggtttctaantgggtctgtaaaagcaacaacctcctgtccatctc

SEQ ID NO: 24427 - DNA, 71 bp, chicken (Gallus Gallus)
  misc_feature (36): n=c or t
aatcccataggctattaaactataaattgcaaaacntaattattaggcagtttcttgtctggttttcacaa

SEQ ID NO: 24428 - DNA, 71 bp, chicken (Gallus Gallus)
  misc_feature (36): n=a or t
gtataattaaacctgagaggatctcattttctaacnctaacaaactgatcccaagccctgtttcctggtgt

SEQ ID NO: 24429 - DNA, 71 bp, chicken (Gallus Gallus)
  misc_feature (36): n=a or t
ttcaagcagaattaaaaccttcatattaatggcatnaggatctgctacccagaagctgttgtgttggtctg

SEQ ID NO: 24430 - DNA, 71 bp, chicken (Gallus Gallus)
  misc_feature (36): n=c or t
gctaccttggcgctacccacagattggtgtgcatgnctccagaaacagagatcaagctctgtaagccactg

SEQ ID NO: 24431 - DNA, 71 bp, chicken (Gallus Gallus)
  misc_feature (36): n=c or t
tctctttgacaacaccttatgaggaaagtttctcanggtgtgagttgctataaatatacagaattttctga

SEQ ID NO: 24432 - DNA, 71 bp, chicken (Gallus Gallus)
  misc_feature (36): n=c or t
gtttttacttccaaacaagaatgagtatttgttcanacgacagaacaagatgcatttgaaatgccacaaac

SEQ ID NO: 24433 - DNA, 71 bp, chicken (Gallus Gallus)
  misc_feature (36): n=a or g
tgttatttattctcatttgggaattgaaatggcccntggcaatattaaggtaattctagggcatgcagcag

SEQ ID NO: 24434 - DNA, 71 bp, chicken (Gallus Gallus)
  misc_feature (36): n=a or g
agataaaacagaaaccctataaagcaaataaatgtntattgttcatcatacgtttcttcctggcaataaca

SEQ ID NO: 24435 - DNA, 71 bp, chicken (Gallus Gallus)
  misc_feature (36): n=c or t
tggagtggatccatgtaagaaacctgaacaagagancatggagctggaaatctacattagctggttttgct

SEQ ID NO: 24436 - DNA, 71 bp, chicken (Gallus Gallus)
  misc_feature (36): n=a or g
acaattcacagggagaatcctcagcatggagaaacngcccagcacgatgggctcagcctcagctgaagagg

SEQ ID NO: 24437 - DNA, 71 bp, chicken (Gallus Gallus)
  misc_feature (36): n=a or c
ttcaatacagattagtcaattataatctagtactancatttcagagtataacagctattattggacttcaa

SEQ ID NO: 24438 - DNA, 71 bp, chicken (Gallus Gallus)
  misc_feature (36): n=c or t
catagcgtcaaaatggctgaacaaagctggaacagngcaaggatatgctacatctggtagcgtgccctttg

SEQ ID NO: 24439 - DNA, 71 bp, chicken (Gallus Gallus)
  misc_feature (36): n=c or t
tagaattgggccagggcaatgttagctcagctgctnctgaacacacctgttttaatttaatttgtaattaa

SEQ ID NO: 24440 - DNA, 71 bp, chicken (Gallus Gallus)
  misc_feature (36): n=c or t
agcattgtagcttctgttatagtcagctttttttcnggctgatataaggtcaggattggcaggttgatcta

SEQ ID NO: 24441 - DNA, 71 bp, chicken (Gallus Gallus)
  misc_feature (36): n=c or t
gtttctctttttctgctttgcctttgttttgtgtgnaaattcaggcctaccaaaacactaaacgaaaagat

SEQ ID NO: 24442 - DNA, 71 bp, chicken (Gallus Gallus)
  misc_feature (36): n=a or g
aagaaatatttcaaagtagtgtaaatgaatatatanaatcatagaatagcttaggttggaagggactttaa

SEQ ID NO: 24443 - DNA, 71 bp, chicken (Gallus Gallus)
  misc_feature (36): n=c or t
cttgatattttaagaatcgtagacatttgagcaagnacttgcattcttaattattgatcagcatatgtttc

SEQ ID NO: 24444 - DNA, 71 bp, chicken (Gallus Gallus)
  misc_feature (36): n=c or g
agcaataaaatgccagtggaagttttatcttaaagnaaaactctgttgaacattatgtttctcagtaaggg

SEQ ID NO: 24445 - DNA, 71 bp, chicken (Gallus Gallus)
  misc_feature (36): n=c or g
tacccagtgagaatgctgttactgtttgccttttanttctttcataaccataaatgtgaagcaaaaagtca

SEQ ID NO: 24446 - DNA, 71 bp, chicken (Gallus Gallus)
  misc_feature (36): n=a or c
aaggccaaactcaaggcaaagacgaaatgtagacancaaagtcacaccaaaaagatttctggtgtacctgt

SEQ ID NO: 24447 - DNA, 71 bp, chicken (Gallus Gallus)
  misc_feature (36): n=c or t
actgtctgcggatgaagaataaagtggtgatagccntgaattaaacctctcagttaagtgcataatgttgg

SEQ ID NO: 24448 - DNA, 71 bp, chicken (Gallus Gallus)
  misc_feature (36): n=c or t
tcacactctcttctttttccctggttccctctcccnttttcaggaggtttcagaacctggtatttaacacc

SEQ ID NO: 24449 - DNA, 71 bp, chicken (Gallus Gallus)
  misc_feature (36): n=c or g
tctcctcctccttggggtctccatcttgtcctcttntcttgaggctcttgatcttcttggagtcttcatct

SEQ ID NO: 24450 - DNA, 71 bp, chicken (Gallus Gallus)
  misc_feature (36): n=a or c
ttaatatatttacatatacattgtagtgtatgtttntgaggagtggctctgaggagctgctagcctgtata

SEQ ID NO: 24451 - DNA, 71 bp, chicken (Gallus Gallus)
  misc_feature (36): n=a or g
tcttccttaggtattgttacttaacatatgtcttgnagctttttggcgtgtggttttctcttggagaattt

SEQ ID NO: 24452 - DNA, 71 bp, chicken (Gallus Gallus)
  misc_feature (36): n=a or g
cgagaaatgtcaggatgaggcagatactactttcanaagttaaataaagttttattagaatcatctcatta

SEQ ID NO: 24453 - DNA, 71 bp, chicken (Gallus Gallus)
  misc_feature (36): n=c or t
aattcagccaaaatgttcgatggaaaccaataaaangaaaaatgaaaattctaaaaatcttactacagtgg

SEQ ID NO: 24454 - DNA, 71 bp, chicken (Gallus Gallus)
  misc_feature (36): n=a or g
agaaatgcttcggagcctcctgcagttcacagcacnctcccaaagtcagatctaaatggaatgattttgct

SEQ ID NO: 24455 - DNA, 71 bp, chicken (Gallus Gallus)
  misc_feature (36): n=a or g
taccagctcatcacaattatacaataaaattcaganttcatttggaggaaagagtgattgaggtcagccgt

SEQ ID NO: 24456 - DNA, 71 bp, chicken (Gallus Gallus)
  misc_feature (36): n=c or t
ccccatactgtgctactttacaagagaaacctgcancccagcagctgcagagactgtactttgcaccagag

SEQ ID NO: 24457 - DNA, 71 bp, chicken (Gallus Gallus)
  misc_feature (36): n=a or g
atatcctaaaagacccatgtacaatgtagtctgtcngtgtatcttctgtacaactgaaaagatggtagaca

SEQ ID NO: 24458 - DNA, 71 bp, chicken (Gallus Gallus)
  misc_feature (36): n=c or t
tttgttatacattagagctaaactatagcaggaacngagttatttgcaacatgcctctagaagttacaaag

SEQ ID NO: 24459 - DNA, 71 bp, chicken (Gallus Gallus)
  misc_feature (36): n=c or t
tgtgagggcacccaaaaaggcactttaagaatttcnagttaaatctagagagcctacaaaaatgctctgat

SEQ ID NO: 24460 - DNA, 71 bp, chicken (Gallus Gallus)
  misc_feature (36): n=a or g
tagcaggtgcaaaactatctcgccttggatcatgangggcttattctgttctccatccctatctaccagca

SEQ ID NO: 24461 - DNA, 71 bp, chicken (Gallus Gallus)
  misc_feature (36): n=a or g
tttccccctatcttttcttattttagagccacaacnacaagtgagcaaagaaatagatatgtcttgtctgg

SEQ ID NO: 24462 - DNA, 71 bp, chicken (Gallus Gallus)
  misc_feature (36): n=a or c
ctgcttctcctcctacgtgattcccattccttctgncaacaaatactacatttctaccttctggtctcgtc

SEQ ID NO: 24463 - DNA, 71 bp, chicken (Gallus Gallus)
  misc_feature (36): n=a or g
tttggagtagaagcagcacctctccagtgctgtacntagaggaggttccctgctctgctgtgtgtggggtg

SEQ ID NO: 24464 - DNA, 71 bp, chicken (Gallus Gallus)
  misc_feature (36): n=a or t
ctttaacaggaattgcattttccagggtagtaagancatgtacagctcattgaactcaaagccaagatagc

SEQ ID NO: 24465 - DNA, 71 bp, chicken (Gallus Gallus)
  misc_feature (36): n=a or t
cctgctgtaaataaagcagccacagttcttgagacnactctatgacaatttcattttagttctttcagtaa

SEQ ID NO: 24466 - DNA, 71 bp, chicken (Gallus Gallus)
  misc_feature (36): n=c or g
cgcaccctctttgagcacagaaatctcaggataatntaagtgcctgaaagacatcagtgttgaaggaagag

SEQ ID NO: 24467 - DNA, 71 bp, chicken (Gallus Gallus)
  misc_feature (36): n=c or t
gcatataaaggatatacctttgttctgttgaggtangcattaggtgaaaacaccccccatgtattcagcac

SEQ ID NO: 24468 - DNA, 71 bp, chicken (Gallus Gallus)
  misc_feature (36): n=a or t
ccagttgccatcgtgcaccgaactgtcttcttgctnttcttgctttgccttgtgtgaagctggctttctga

SEQ ID NO: 24469 - DNA, 71 bp, chicken (Gallus Gallus)
  misc_feature (36): n=a or t
tggtagattccattttagttctgttttgcccacatnttccagaggaataaccactgatacccattttttaa

SEQ ID NO: 24470 - DNA, 71 bp, chicken (Gallus Gallus)
  misc_feature (36): n=a or g
cagtggatattcagtctgaatggcatgtagggttcntgcaccgggagccttggaaagagctggatagcctg

SEQ ID NO: 24471 - DNA, 71 bp, chicken (Gallus Gallus)
  misc_feature (36): n=a or g
ccttaacctacctctagacatttgtgataagttgcntcaacatatcagcagattctcttgcacagaagttt

SEQ ID NO: 24472 - DNA, 71 bp, chicken (Gallus Gallus)
  misc_feature (36): n=c or g
agagctggaaggaagttgcgagaggagatgactgantgatttatactcaaagtgcaagagaaagggaggca

SEQ ID NO: 24473 - DNA, 71 bp, chicken (Gallus Gallus)
  misc_feature (36): n=c or t
ggcaatcgcatatcaatgcacaacagctgacatttncttagtattaaattaggtaaatctccctgaacgct

SEQ ID NO: 24474 - DNA, 71 bp, chicken (Gallus Gallus)
  misc_feature (36): n=a or g
cggggttgctgtctgtgggcttgtgtggaagatccnggctagtatcccagcgaactcagctgttgaaaact

SEQ ID NO: 24475 - DNA, 71 bp, chicken (Gallus Gallus)
  misc_feature (36): n=a or g
gtttgagctctaagaccctaccacaaccaaagagcngtatttggatcgttttttctctagcagctacagaa

SEQ ID NO: 24476 - DNA, 71 bp, chicken (Gallus Gallus)
  misc_feature (36): n=c or g
tcgtgttgtccagatcatttcacaacgaagatgganacttctccatgcactaccacatgtttcgtccatgc

SEQ ID NO: 24477 - DNA, 71 bp, chicken (Gallus Gallus)
  misc_feature (36): n=a or g
cattttaactgaaaagccaaaggaaagccaaaggancagtcctaaattgaacttgtattactttgttattt

SEQ ID NO: 24478 - DNA, 71 bp, chicken (Gallus Gallus)
  misc_feature (36): n=a or g
accttaaaattacacagaatattctattatgccctnagatattaattaaaaattgtgaagcaattgtaaat

SEQ ID NO: 24479 - DNA, 71 bp, chicken (Gallus Gallus)
  misc_feature (36): n=a or c
ctgtaggatcttcatgtctacttttggtactgaagntggagcataaggactgaagcaaagtcgctactcaa

SEQ ID NO: 24480 - DNA, 71 bp, chicken (Gallus Gallus)
  misc_feature (36): n=c or t
caaagaactgttttttccatcagtagatgaatgttntaaattcagtaaagttcaccttgaagacactggta

SEQ ID NO: 24481 - DNA, 71 bp, chicken (Gallus Gallus)
  misc_feature (36): n=a or g
cctgggagagggttaggcatgatattactagctctnctgttctaaaggattcttttcctcacatcaacaga

SEQ ID NO: 24482 - DNA, 71 bp, chicken (Gallus Gallus)
  misc_feature (36): n=c or t
ctttgctaggacaagtacctcttgaacaggcttgcntgctgtgagcattggatgtgatagaggttggaacc

SEQ ID NO: 24483 - DNA, 71 bp, chicken (Gallus Gallus)
  misc_feature (36): n=a or g
gagctctgtcacatattgtgaagaagttccttcacntattggtgcagaacattctatgctcctgtttatgg

SEQ ID NO: 24484 - DNA, 71 bp, chicken (Gallus Gallus)
  misc_feature (36): n=a or g
cttgataaatactgtctatctggaacccattcacangaataatgaaattaagaatcaagtaacatagtctg

SEQ ID NO: 24485 - DNA, 71 bp, chicken (Gallus Gallus)
  misc_feature (36): n=a or g
tctgtaccttaaaaatattaaaatatctttaaagcnggactggtaaaaaggcaacttttacagccaatctt

SEQ ID NO: 24486 - DNA, 71 bp, chicken (Gallus Gallus)
  misc_feature (36): n=a or g
tttagctgtgtttatataaattaataattgcattanatgtccaaggcaaataagttttttatctacttatt

SEQ ID NO: 24487 - DNA, 71 bp, chicken (Gallus Gallus)
  misc_feature (36): n=c or t
tttgaaaggtaaaagtgggtcatgtggggggtatcntggcttgggagtcacagtgaggagtcaagagaggg

SEQ ID NO: 24488 - DNA, 71 bp, chicken (Gallus Gallus)
  misc_feature (36): n=a or g
taaaacccactccgaagttggtctgcggcaaaagcngggtaaaaagaaacacagatgtgaactaaagattc

SEQ ID NO: 24489 - DNA, 71 bp, chicken (Gallus Gallus)
  misc_feature (36): n=a or c
agcaaaaggcagtttggaaggaaaggctcttcgccnagaaatcatcttcaaagttaaacgttaatatttac

SEQ ID NO: 24490 - DNA, 71 bp, chicken (Gallus Gallus)
  misc_feature (36): n=a or g
tttgtgaagaaattggacactgacttcaattccacnttaattcaccctattgatgatgtgtagacacttgt

SEQ ID NO: 24491 - DNA, 71 bp, chicken (Gallus Gallus)
  misc_feature (36): n=c or g
cagtgaagattagaagacctggcttatacagagagntgaacaattaaacattcccagtcttcccctctaaa

SEQ ID NO: 24492 - DNA, 71 bp, chicken (Gallus Gallus)
  misc_feature (36): n=a or g
ggaaaaaagtgaagaggcacatgagtgaaactgtgnaactccttgccaaaggggactgtagaaactaaaac

SEQ ID NO: 24493 - DNA, 71 bp, chicken (Gallus Gallus)
  misc_feature (36): n=c or t
tactgaaatttgctttaaataaactaatcggtgtantatttagttataaagatgagtcttctgtagcatgt

SEQ ID NO: 24494 - DNA, 71 bp, chicken (Gallus Gallus)
  misc_feature (36): n=c or t
gctgtcaaggtgagccaggcactcattcccccatgntggtcattaatcattgtcccactggtggagctaca

SEQ ID NO: 24495 - DNA, 71 bp, chicken (Gallus Gallus)
  misc_feature (36): n=c or t
tcatagtttgctaaaccctcccctgactgctgaggngctttggtgaaagatttgtttgactgaagacatgg

SEQ ID NO: 24496 - DNA, 71 bp, chicken (Gallus Gallus)
  misc_feature (36): n=c or t
ttacatatgccttctccactttccttacctaacccntccggtcaacccaggaaaaactcctaccagaactg

SEQ ID NO: 24497 - DNA, 71 bp, chicken (Gallus Gallus)
  misc_feature (36): n=c or t
ttctgtgctagcatcaacttgcaagaaacatttccncaagacaacagcaccagtatctacacagcaatttt

SEQ ID NO: 24498 - DNA, 71 bp, chicken (Gallus Gallus)
  misc_feature (36): n=g or t
gtattttgttagcataggctgcagaggttcaacatnacttcagcatgttattgattttatttgttgctgag

SEQ ID NO: 24499 - DNA, 71 bp, chicken (Gallus Gallus)
  misc_feature (36): n=c or g
atgtattttgcagcatgatgttgctgttccttgttncttttgcttagcacctgacagttcaagatgtttga

SEQ ID NO: 24500 - DNA, 71 bp, chicken (Gallus Gallus)
  misc_feature (36): n=a or g
ccagactgtgaacaaaaaatatacatatagtatacnttacaaaatacctgaaaatatcacaacacttttcc

SEQ ID NO: 24501 - DNA, 71 bp, chicken (Gallus Gallus)
  misc_feature (36): n=a or g
tttcaaggagttatgttcctctcttttaagttagcnttcactgctatattgcattaaatgttcattgctgc

SEQ ID NO: 24502 - DNA, 71 bp, chicken (Gallus Gallus)
  misc_feature (36): n=c or t
ctttggacacttcagggccagtaacacacagcaagnaaagcagctcctcatgcataacaatgagatacaca

SEQ ID NO: 24503 - DNA, 71 bp, chicken (Gallus Gallus)
  misc_feature (36): n=c or t
aacaagagtaaggttagtggtgacattcagtagtangaatttttcacatcctgatgttgtacagaattctg

SEQ ID NO: 24504 - DNA, 71 bp, chicken (Gallus Gallus)
  misc_feature (36): n=c or t
aggttttgctgctgcagagagcattcgtggcagcantgactgaatgtctgcaaacctcacagctcggaagt

SEQ ID NO: 24505 - DNA, 71 bp, chicken (Gallus Gallus)
  misc_feature (36): n=c or t
ttgaaatatctaatcatggttctgagacctcagggnatgtatagatgtataggtgcatgcataaagatggc

SEQ ID NO: 24506 - DNA, 71 bp, chicken (Gallus Gallus)
  misc_feature (36): n=c or t
cagaaagaagactcatggcattcttacatagactangagatatttattcacgtgagtataaaaaatatcac

SEQ ID NO: 24507 - DNA, 71 bp, chicken (Gallus Gallus)
  misc_feature (36): n=a or g
ggctaagaaattctgggaggcattacagtctaaagnactacatggtgaattgtctgtaaatggactgttat

SEQ ID NO: 24508 - DNA, 71 bp, chicken (Gallus Gallus)
  misc_feature (36): n=a or g
tgtccaaatctcttttgaataagggagcaggatganaacaggtgtttgaatgtctttgtgcattgtgtcct

SEQ ID NO: 24509 - DNA, 71 bp, chicken (Gallus Gallus)
  misc_feature (36): n=a or g
aaacagtattccagcgtttcctctctgtgacacggngatgaagagcatcctatagttacgacattttaatg

SEQ ID NO: 24510 - DNA, 71 bp, chicken (Gallus Gallus)
  misc_feature (36): n=a or g
ccataatgccactctagatggagtgaattgtacttngtatagaggaaacccacctaatggtatgggggcaa

SEQ ID NO: 24511 - DNA, 71 bp, chicken (Gallus Gallus)
  misc_feature (36): n=c or t
gaggtatgggagagcatttcagcattccatgctggngttattcctgcccacgcacagctgcttgagctgga

SEQ ID NO: 24512 - DNA, 71 bp, chicken (Gallus Gallus)
  misc_feature (36): n=a or g
aacacctgagaatctgaagtgagggttttctctcanttgctttttgaatatctgttgcaaacactgaatgt

SEQ ID NO: 24513 - DNA, 71 bp, chicken (Gallus Gallus)
  misc_feature (36): n=a or c
gcctatcttctgccagagatcagtcttgaactaatntcacaatattagaacggtcccagcaaaaaataata

SEQ ID NO: 24514 - DNA, 71 bp, chicken (Gallus Gallus)
  misc_feature (36): n=a or g
tatttacctaaaccgctacacaagagaaggaggtcnacgataaaatcatgcagccaaatatcctcaaaatc

SEQ ID NO: 24515 - DNA, 71 bp, chicken (Gallus Gallus)
  misc_feature (36): n=a or g
aaaagaaatggcatttgtctaagtcacggcctctcnttaaactgtgacctgatgtgaaaacatgagggatt

SEQ ID NO: 24516 - DNA, 71 bp, chicken (Gallus Gallus)
  misc_feature (36): n=a or t
ccagaggcagattattctctcagttctggcaataangaggtaactgtgaaaagatatgtttaagcagtagc

SEQ ID NO: 24517 - DNA, 71 bp, chicken (Gallus Gallus)
  misc_feature (36): n=c or g
accattacagctttcaaggggcaatttttaaaacanttctttgatgttatccacaaccttgtacaatatca

SEQ ID NO: 24518 - DNA, 71 bp, chicken (Gallus Gallus)
  misc_feature (36): n=c or t
aaaaaaattgttttccagacagaagacctgcataantgattatgtaagagaggtcacttactattaattat

SEQ ID NO: 24519 - DNA, 71 bp, chicken (Gallus Gallus)
  misc_feature (36): n=a or g
ggagcgcattgggctgcagccttcccttgtggtgtntgggaaatgtagaagcaaggatgacccgcattgat

SEQ ID NO: 24520 - DNA, 71 bp, chicken (Gallus Gallus)
  misc_feature (36): n=c or t
agaaggacacacagatgcttttcttttctgtttctngtctcatccacgcatactgtgacaaagatggtatt

SEQ ID NO: 24521 - DNA, 71 bp, chicken (Gallus Gallus)
  misc_feature (36): n=c or t
cttctgtgggtgctgcctttctgaacggccatgctnggttacatgcttgcctgaagtgctggtgtactggg

SEQ ID NO: 24522 - DNA, 71 bp, chicken (Gallus Gallus)
  misc_feature (36): n=a or g
caaaagggaaaaaaaagaaaaagaaaaaagagcacnaaaacctcctgtactgtacttttattaattaatac

SEQ ID NO: 24523 - DNA, 71 bp, chicken (Gallus Gallus)
  misc_feature (36): n=c or t
gactatttaaaagatctcaaataatgaagggtcctnttacccttaacagagatgttgaacgtagatgaaca

SEQ ID NO: 24524 - DNA, 71 bp, chicken (Gallus Gallus)
  misc_feature (36): n=a or g
ataaacttttcattacattactttcctctggaaaanatcaattaagataaacagtggaagagagggtaaag

SEQ ID NO: 24525 - DNA, 71 bp, chicken (Gallus Gallus)
  misc_feature (36): n=c or t
tcctgttttatgatgatcgtttatcatttgtattanagtcatgcttagaggcctcaagcaagatcagggcc

SEQ ID NO: 24526 - DNA, 71 bp, chicken (Gallus Gallus)
  misc_feature (36): n=c or t
gtctctggcagagggagactcagacaacagatatgngttcggggacaaggtgaggtggctgccaccttgga

SEQ ID NO: 24527 - DNA, 71 bp, chicken (Gallus Gallus)
  misc_feature (36): n=c or t
ggcttttaatactgattaactcaaactttgggtagntttaagtgattcaaaaactaggaaacaaagctacc

SEQ ID NO: 24528 - DNA, 71 bp, chicken (Gallus Gallus)
  misc_feature (36): n=a or g
aagagctaaggcaataccaaaggagaggtttcttgntgcttgctcattccaacactgaacccacaggacag

SEQ ID NO: 24529 - DNA, 71 bp, chicken (Gallus Gallus)
  misc_feature (36): n=a or g
gctgcgattttccgtcctgttttcaggtggaaggtngaaggcctttttgcagctcaggtaattcagagtgg

SEQ ID NO: 24530 - DNA, 71 bp, chicken (Gallus Gallus)
  misc_feature (36): n=c or t
gactgggtgcttcaatcactctgtcctattttagcntcttaatggcaaagatgacaggaatgcaagatgca

SEQ ID NO: 24531 - DNA, 71 bp, chicken (Gallus Gallus)
  misc_feature (36): n=a or g
ttaggtatgagcagagcattgtcagcctcgtgttcnagataattaaagcttgctgctagaaaacgtgtgat

SEQ ID NO: 24532 - DNA, 71 bp, chicken (Gallus Gallus)
  misc_feature (36): n=a or g
aagcctctgaggagtccttttaaagtcaagcacacntatgagggcacactccagttcctcattaccaatca

SEQ ID NO: 24533 - DNA, 71 bp, chicken (Gallus Gallus)
  misc_feature (36): n=g or t
tgttgggaaggtgatacctggcaggagccaggaggnatcatggtgcaaccgggcaaaaatgtaggaaaaag

SEQ ID NO: 24534 - DNA, 71 bp, chicken (Gallus Gallus)
  misc_feature (36): n=a or g
catgtgattgcagatttgattgtggctgtgcatgangaagagcttggaaagaaaggaggtagcaaaagtcc

SEQ ID NO: 24535 - DNA, 71 bp, chicken (Gallus Gallus)
  misc_feature (36): n=c or t
atagtcttatttcagaaaaatggcatgatgttcttngccttcttttagggctttttcaactatgcagccat

SEQ ID NO: 24536 - DNA, 71 bp, chicken (Gallus Gallus)
  misc_feature (36): n=a or g
gaagccagaagcctgagaagagttttaaggaggccntgttggcttgacttgcatgggccagttacacccca

SEQ ID NO: 24537 - DNA, 71 bp, chicken (Gallus Gallus)
  misc_feature (36): n=a or g
tgcattgtctctggtaaaacctccttgtcaaatcantgaaggagtgctttttctctcatcctgactgtcct

SEQ ID NO: 24538 - DNA, 71 bp, chicken (Gallus Gallus)
  misc_feature (36): n=a or g
caatataaagcctctgtttgtatgacttggtttctnatgcagttttatgatgtatgggagagtgtagttaa

SEQ ID NO: 24539 - DNA, 71 bp, chicken (Gallus Gallus)
  misc_feature (36): n=c or t
gacatagctccatttgtagaataccaacagaggtangaaaaaaaaaatagtagttcagaggtttttcttct

SEQ ID NO: 24540 - DNA, 71 bp, chicken (Gallus Gallus)
  misc_feature (36): n=a or t
gaatattattttcactgtcttagtaactggccctgntatatttttctgggcttagtggcaatgcaaaggca

SEQ ID NO: 24541 - DNA, 71 bp, chicken (Gallus Gallus)
  misc_feature (36): n=c or t
gaacatgtgctcttcattcacttattttatcatccngttccacaaaactgcatttccacaccgagccacag

SEQ ID NO: 24542 - DNA, 71 bp, chicken (Gallus Gallus)
  misc_feature (36): n=a or g
cactacatgactgctgacaaaccctttccctcctcntgttggtgccctatcttgcctgccatgcataaccc

SEQ ID NO: 24543 - DNA, 71 bp, chicken (Gallus Gallus)
  misc_feature (36): n=a or c
cgttttttgcattttttctaataagccatagtgttntgtttcctccactaatatttctaatcagaatagat

SEQ ID NO: 24544 - DNA, 71 bp, chicken (Gallus Gallus)
  misc_feature (36): n=c or t
cagtaccttaattaaggtcagaatgtatgtgttttnttgtctttaatatcctgctttttaaacatagagat

SEQ ID NO: 24545 - DNA, 71 bp, chicken (Gallus Gallus)
  misc_feature (36): n=c or t
tagttagagtgacagagtaattagtctttaggcttnttagaggtgaagttgcttgatactgtgttactggt

SEQ ID NO: 24546 - DNA, 71 bp, chicken (Gallus Gallus)
  misc_feature (36): n=a or g
agctgttgatggttgagaaagaatatatataaaaanaaaaaaaaaaagaaaaaaaagaaaaaacatattac

SEQ ID NO: 24547 - DNA, 71 bp, chicken (Gallus Gallus)
  misc_feature (36): n=c or t
gtcccatgagtcagtcactgctggtacgaatatttntatgccatatcctccttacctccaaaacatacgct

SEQ ID NO: 24548 - DNA, 71 bp, chicken (Gallus Gallus)
  misc_feature (36): n=c or g
aatcatccaaaattcagttcaggaaaaaattactanataaggtgtctggagcggaacagtctggaaattat

SEQ ID NO: 24549 - DNA, 71 bp, chicken (Gallus Gallus)
  misc_feature (36): n=a or g
tcaccaacaaaccaccaaaaatatctggaaaccccngcaatttttaagaaatcacaggatcatagagtggc

SEQ ID NO: 24550 - DNA, 71 bp, chicken (Gallus Gallus)
  misc_feature (36): n=a or g
ctgtggacaagtttgtgttagaagtgctttctcagnagagattttcacttctaagaatttctaatgcattg

SEQ ID NO: 24551 - DNA, 71 bp, chicken (Gallus Gallus)
  misc_feature (36): n=a or c
atggaggcagaacaagagatggcaactttttatagnagactccatgattgcttgcttaggtttgttcatct

SEQ ID NO: 24552 - DNA, 71 bp, chicken (Gallus Gallus)
  misc_feature (36): n=c or g
gaagtgttcattctttaagcgtttgggttcagccanccacaaaatgttgctctgagcagtccctcaccatg

SEQ ID NO: 24553 - DNA, 71 bp, chicken (Gallus Gallus)
  misc_feature (36): n=g or t
aataatgaattgtgctattggtagagatactgaagnttactccatctggagcagttacacgagtgcattaa

SEQ ID NO: 24554 - DNA, 71 bp, chicken (Gallus Gallus)
  misc_feature (36): n=c or t
ctccttctcagaagttgtagacagcaatgagatcancattcagcctcttcttctcattggatattgcaagt

SEQ ID NO: 24555 - DNA, 71 bp, chicken (Gallus Gallus)
  misc_feature (36): n=a or t
ttccaacttgggatgttctatcattctatgatcctntattgtgttacaaataaggatagaaatgtttcatt

SEQ ID NO: 24556 - DNA, 71 bp, chicken (Gallus Gallus)
  misc_feature (36): n=c or t
aattacttcttactgtgattgaatttttcagaaaangtgctgagattctgatctagtaaagctcttatgct

SEQ ID NO: 24557 - DNA, 71 bp, chicken (Gallus Gallus)
  misc_feature (36): n=c or t
aggagctttaaaaatttaacagcttattgcaattanaatcaagactgaaagaccctcggggattaatctag

SEQ ID NO: 24558 - DNA, 71 bp, chicken (Gallus Gallus)
  misc_feature (36): n=a or g
tcttgaaagctggaaatactttcaagccagcccacngtaggcaggatggtacaagaagaaacttcattaaa

SEQ ID NO: 24559 - DNA, 71 bp, chicken (Gallus Gallus)
  misc_feature (36): n=a or g
tccttttttatcttgtagcacatggattcaggaacntttgcatataggatattcatttaggtctgttggaa

SEQ ID NO: 24560 - DNA, 71 bp, chicken (Gallus Gallus)
  misc_feature (36): n=c or g
ttttactgcaaactctttcagggcaacttacccaangggttacttgacataacctctgagggtgacctagt

SEQ ID NO: 24561 - DNA, 71 bp, chicken (Gallus Gallus)
  misc_feature (36): n=a or g
tggaaattgccaggagtatcctgcactgtgtggctnctctgttgcctccagttcttggaaaactggagaga

SEQ ID NO: 24562 - DNA, 71 bp, chicken (Gallus Gallus)
  misc_feature (36): n=a or g
tgttgctattaacaggagcgtgtgttgtcagctctntgcaaccttacctcaagtggctttgtggtgtccat

SEQ ID NO: 24563 - DNA, 71 bp, chicken (Gallus Gallus)
  misc_feature (36): n=c or t
agcagtcaatctctctaagcaacccattctggattntggtttaaaaccactacatatttgaagttagaaac

SEQ ID NO: 24564 - DNA, 71 bp, chicken (Gallus Gallus)
  misc_feature (36): n=c or t
ctcattagaaagtcagcttcttccatattcacagcngcagagcaagaatttacatttaaccaagtttatct

SEQ ID NO: 24565 - DNA, 71 bp, chicken (Gallus Gallus)
  misc_feature (36): n=c or t
caggctgctgtctcaaaagcagggtagtaagtaaanagggaattcccatacaagtttcacaactctgtact

SEQ ID NO: 24566 - DNA, 71 bp, chicken (Gallus Gallus)
  misc_feature (36): n=a or g
caacccaaggactacacatgtcctcagtacagcctntcagcatgttgtcagattttccattgtggtgtggt

SEQ ID NO: 24567 - DNA, 71 bp, chicken (Gallus Gallus)
  misc_feature (36): n=c or g
ataaaacaccagattggtgtgaagactacaagcatnactatgctattaagtaagataaagcacaaaaacat

SEQ ID NO: 24568 - DNA, 71 bp, chicken (Gallus Gallus)
  misc_feature (36): n=a or g
gagttctgggacattttcacaaattgtaaggttatnttgtgatcacgcttgaaggaagaagttctattgca

SEQ ID NO: 24569 - DNA, 71 bp, chicken (Gallus Gallus)
  misc_feature (36): n=a or t
atgtagcataataatgaaattcctaaatttttaatnatgattatagttaaaggattgtcttcaggttacaa

SEQ ID NO: 24570 - DNA, 71 bp, chicken (Gallus Gallus)
  misc_feature (36): n=a or g
gtgcattatttcttctttatcagaagaatacttgcntgtgtctgtaaccacgctgctgcctagtatgtggc

SEQ ID NO: 24571 - DNA, 71 bp, chicken (Gallus Gallus)
  misc_feature (36): n=c or t
gggaaaattgtatttctaggtgtgaaccttttgtcntctgccctctcctcatagagacttaacaaccagtt

SEQ ID NO: 24572 - DNA, 71 bp, chicken (Gallus Gallus)
  misc_feature (36): n=a or t
cctagtgctcgagatttccagatgaactatggaganccagtcactggagcctatagagcgatctggacaac

SEQ ID NO: 24573 - DNA, 71 bp, chicken (Gallus Gallus)
  misc_feature (36): n=c or t
gatcactgaaataattttatgctactatatggaatnactcatctctatttgcaaatcattagcaaatacag

SEQ ID NO: 24574 - DNA, 71 bp, chicken (Gallus Gallus)
  misc_feature (36): n=c or g
aagcagatctagaaaataacagatgacatcaaggtnttctccctcgtggactggaataagaacaattattt

SEQ ID NO: 24575 - DNA, 71 bp, chicken (Gallus Gallus)
  misc_feature (36): n=c or t
caatagtttgttgtcaatatgcatccaatggggctnaaggcatttgcttgtcctagatgtggttcttttca

SEQ ID NO: 24576 - DNA, 71 bp, chicken (Gallus Gallus)
  misc_feature (36): n=c or t
agaacatgtttactttgaggcaaagtactgaagggnataataatcctttaaagtcttacacaagttgtatt

SEQ ID NO: 24577 - DNA, 71 bp, chicken (Gallus Gallus)
  misc_feature (36): n=c or t
ggactgtggtgtgaaatcaagggagaggctagaggnacatcctgctttaaaatctgggcaagaccaggagg

SEQ ID NO: 24578 - DNA, 71 bp, chicken (Gallus Gallus)
  misc_feature (36): n=a or g
tctcgcaaaagtagtggttggaggagctcatgtacnacatgtacgtcgtactcatgtacgactcactttac

SEQ ID NO: 24579 - DNA, 71 bp, chicken (Gallus Gallus)
  misc_feature (36): n=a or g
ctcccctccatagctgggctccagtggcaaggaacntgggactccttgtccattgggttgaacccagtgct

SEQ ID NO: 24580 - DNA, 71 bp, chicken (Gallus Gallus)
  misc_feature (36): n=a or g
tggtagattttgtctcatgtctgggaagggcttggngttagttcatgaaggagaagttttagggcttcata

SEQ ID NO: 24581 - DNA, 71 bp, chicken (Gallus Gallus)
  misc_feature (36): n=g or t
aattctcttaaaactcttgaagtgagaatgtccgcnaactattaagaaagaaaatgttcttcagagaatct

SEQ ID NO: 24582 - DNA, 71 bp, chicken (Gallus Gallus)
  misc_feature (36): n=a or t
gtttggattagtttaagggattgctccaaggtacanaaagaaaataacttgaagacaggacagaagcaagg

SEQ ID NO: 24583 - DNA, 71 bp, chicken (Gallus Gallus)
  misc_feature (36): n=a or g
actcattaaacttcaatgttgaagccccagtcagantacaaggctttctgtagttctatcacgtgtgttta

SEQ ID NO: 24584 - DNA, 71 bp, chicken (Gallus Gallus)
  misc_feature (36): n=g or t
tagttgttcaggaaatgtggagctgtggtacttagnagcatggttagtgagcaatactggtagtaggtgga

SEQ ID NO: 24585 - DNA, 71 bp, chicken (Gallus Gallus)
  misc_feature (36): n=c or t
actgtaagatatttgagcatcaggagttggcatgangtccattcctttccctactgtctgttgatgactga

SEQ ID NO: 24586 - DNA, 71 bp, chicken (Gallus Gallus)
  misc_feature (36): n=c or t
tatacctgcaaggaaccctcccaaaaccatcttgantctgtgagaattttagcctgtttagacaaacccca

SEQ ID NO: 24587 - DNA, 71 bp, chicken (Gallus Gallus)
  misc_feature (36): n=c or t
tacaacttcaaagcaaattataatctttaagacagngaagactggatctctaaagcagtgtggggcctctg

SEQ ID NO: 24588 - DNA, 71 bp, chicken (Gallus Gallus)
  misc_feature (36): n=a or g
gtccccttcttaaaatttttggtagaagaggtgtcntaattctcaatttttgtcaagaaaacgaaaaacta

SEQ ID NO: 24589 - DNA, 71 bp, chicken (Gallus Gallus)
  misc_feature (36): n=a or g
agatgtcccacgtatttagtgaagcaacaagaggangaaggggaataggacaggcgggtaactttgccttc

SEQ ID NO: 24590 - DNA, 71 bp, chicken (Gallus Gallus)
  misc_feature (36): n=c or t
agcaatacatttctaattgcaatagatcacaccctngaagactagactttcagattagtttctcagtcctt

SEQ ID NO: 24591 - DNA, 71 bp, chicken (Gallus Gallus)
  misc_feature (36): n=a or c
tttttgtccaagtaaaacatactgcattgatttacnctgctgtcatagtagactaataagtagatagtgaa

SEQ ID NO: 24592 - DNA, 71 bp, chicken (Gallus Gallus)
  misc_feature (36): n=a or g
gcctgctgcacccattagctgctgaggggcaaaacnagttagagagggcatctgtcaatacagaaaatggt

SEQ ID NO: 24593 - DNA, 71 bp, chicken (Gallus Gallus)
  misc_feature (36): n=c or t
gttgtcatctggtgtctaagatgtgcaggagacaangttagaaatgtcaaaaatctcttaggaacagttga

SEQ ID NO: 24594 - DNA, 71 bp, chicken (Gallus Gallus)
  misc_feature (36): n=c or t
atatttatcctcagtgcatatgattacatattttgnttctgcatgtgtctgacttattcaacttcagttgt

SEQ ID NO: 24595 - DNA, 71 bp, chicken (Gallus Gallus)
  misc_feature (36): n=c or t
gagcacagtctagaaacatcacagatgcataaaaanggaatgaaaaagcttcatcaagtcataggatcgag

SEQ ID NO: 24596 - DNA, 71 bp, chicken (Gallus Gallus)
  misc_feature (36): n=a or g
tgcttgcggggatggacggttcttgcatttggaganggtgatccctgaaaattaaccacttctcctgagcc

SEQ ID NO: 24597 - DNA, 71 bp, chicken (Gallus Gallus)
  misc_feature (36): n=c or t
gtgaaacagtttctggattaaggtgttttcttttcngaataagcctgagactccttttgtgaaagactcat

SEQ ID NO: 24598 - DNA, 71 bp, chicken (Gallus Gallus)
  misc_feature (36): n=a or c
acattacatagaccgtatatgaatggattaacttangaatgttctgttctggggggatggaaactgaacag

SEQ ID NO: 24599 - DNA, 71 bp, chicken (Gallus Gallus)
  misc_feature (36): n=c or t
accattgctgccaacttctgtaaggagcattgattngtatcagttttgacctatgtgaactgacaagctag

SEQ ID NO: 24600 - DNA, 71 bp, chicken (Gallus Gallus)
  misc_feature (36): n=a or t
actctactacagtactcattctgcttactatactgncatgtatatttatgagtgcagcagttctgagaagc

SEQ ID NO: 24601 - DNA, 71 bp, chicken (Gallus Gallus)
  misc_feature (36): n=c or t
cagagagtcaatgggaaagtcaaaggacgagtcttngtaggaaataaccccgttccagttacatttgagaa

SEQ ID NO: 24602 - DNA, 71 bp, chicken (Gallus Gallus)
  misc_feature (36): n=a or g
ttaaaaattttccaaagcctttgtcaataactgacnattatgttgtaaagtagatacataatagccttctg

SEQ ID NO: 24603 - DNA, 71 bp, chicken (Gallus Gallus)
  misc_feature (36): n=a or g
ccccagatccttcctttgaccttcagcccgtggagnaaacacccctctaattgatgggtcacaatgatact

SEQ ID NO: 24604 - DNA, 71 bp, chicken (Gallus Gallus)
  misc_feature (36): n=a or t
aactgttcaaaacaaataactttcaggccaactggnacattttgcagtatttctacttcagtatttcttta

SEQ ID NO: 24605 - DNA, 71 bp, chicken (Gallus Gallus)
  misc_feature (36): n=g or t
tgatctcaagagaccatcaagttcaacccccaactntaaagcaggttcaagacttttataatggactttag

SEQ ID NO: 24606 - DNA, 71 bp, chicken (Gallus Gallus)
  misc_feature (36): n=a or g
aaaatccaacaggtttccagatgaggactggctganacagctggggctgttcagccttgagaagagaaggc

SEQ ID NO: 24607 - DNA, 71 bp, chicken (Gallus Gallus)
  misc_feature (36): n=c or t
atgcaacatttgtgagcacaaaaaagagaaagcagntgcttaccttcagaaggcctcaggtacacagggat

SEQ ID NO: 24608 - DNA, 71 bp, chicken (Gallus Gallus)
  misc_feature (36): n=a or g
ttaacaggcagctttgcttagctgagacagacccangttcagataccttcctgaatctcacatagcagggg

SEQ ID NO: 24609 - DNA, 71 bp, chicken (Gallus Gallus)
  misc_feature (36): n=c or t
gtgacttaagggactccattatgaagaacagtctgncaatggggagaaaaaaatatcgtgtcaaataagcc

SEQ ID NO: 24610 - DNA, 71 bp, chicken (Gallus Gallus)
  misc_feature (36): n=a or g
ttttgcttttatccagtcatgtctcataactagagncatacacatttcagcagtaaaattgctgcattttt

SEQ ID NO: 24611 - DNA, 71 bp, chicken (Gallus Gallus)
  misc_feature (36): n=a or c
tgtctgaaacaaatagcgttgcaagaccagagaacnttacttgaccagagatatagtctgagatatgattt

SEQ ID NO: 24612 - DNA, 71 bp, chicken (Gallus Gallus)
  misc_feature (36): n=c or g
ataacaaatcacaatgacttatttcaaataaaacgntactttaagaagtaaaactattcttccaatcaatt

SEQ ID NO: 24613 - DNA, 71 bp, chicken (Gallus Gallus)
  misc_feature (36): n=g or t
ttctactgtctcattgactgtctgttgtttgtttgntttttttttgctgtattttggtgacccagcataca

SEQ ID NO: 24614 - DNA, 71 bp, chicken (Gallus Gallus)
  misc_feature (36): n=a or g
ttttatctgactttccttatgatatgaaccactacntttaaacacgatttgagtatcagcctcataacttc

SEQ ID NO: 24615 - DNA, 71 bp, chicken (Gallus Gallus)
  misc_feature (36): n=g or t
cagattttctctgtacttgagctacagctgtgcctnatgggtggatcctaccataacgtcatgaaatcagc

SEQ ID NO: 24616 - DNA, 71 bp, chicken (Gallus Gallus)
  misc_feature (36): n=c or t
caaaactcaagtgaggtttttatggccctcagagtntgtgctaaagttctacaaaatgctgcataccacat

SEQ ID NO: 24617 - DNA, 71 bp, chicken (Gallus Gallus)
  misc_feature (36): n=a or c
agacagcttagtaaacacacgccaagcataggtacngtgctcttacttgcgcccggagggcctcagcgatg

SEQ ID NO: 24618 - DNA, 71 bp, chicken (Gallus Gallus)
  misc_feature (36): n=c or g
cctggagctcgcccacattatcctgtgctgtacttncaactttattctatagattgtgtggacatggagaa

SEQ ID NO: 24619 - DNA, 71 bp, chicken (Gallus Gallus)
  misc_feature (36): n=c or t
tctacacaaaatcatgtagaagaggaaaagtgaggnatcccttaaatgaaaagatgggtaaatatcttccc

SEQ ID NO: 24620 - DNA, 71 bp, chicken (Gallus Gallus)
  misc_feature (36): n=g or t
agcagcaatatctgtacctacatctgcatacgtccntgaaatatgttcatttccttcatctgcgggttgta

SEQ ID NO: 24621 - DNA, 71 bp, chicken (Gallus Gallus)
  misc_feature (36): n=a or c
gaaaagcagcaaaagcaagtccaaagaggagtgaangtaccttttgtcttaaaaggaggcagagataagat

SEQ ID NO: 24622 - DNA, 71 bp, chicken (Gallus Gallus)
  misc_feature (36): n=c or g
tcctgtgttgtagtatgtgctggccttattcactantatgaatagttctgttatataagtacaaacattgt

SEQ ID NO: 24623 - DNA, 71 bp, chicken (Gallus Gallus)
  misc_feature (36): n=g or t
aaaagccttattgtttgaggatttacaatggatcanaaaacacattagaaaatataaaataagaattcttc

SEQ ID NO: 24624 - DNA, 71 bp, chicken (Gallus Gallus)
  misc_feature (36): n=a or g
ctgttatgttgtattttctctttatatgctagtctnaggaaattttttttttaaattcatggcattcttac

SEQ ID NO: 24625 - DNA, 71 bp, chicken (Gallus Gallus)
  misc_feature (36): n=c or t
ctccctgaaggtcaccttgcttcaggatcagcctgngcatgcagccaggactacagcaggcaggtacatct

SEQ ID NO: 24626 - DNA, 71 bp, chicken (Gallus Gallus)
  misc_feature (36): n=a or g
taggttgtagcagctggatgcagtcatacttgtcanccctaactgcctgtttcttgtgctagttctgtttc

SEQ ID NO: 24627 - DNA, 71 bp, chicken (Gallus Gallus)
  misc_feature (36): n=c or t
agatcagcgtaacactgtctatccttcccttctaangactgcacaaatgacttacaaagggaagattatcc

SEQ ID NO: 24628 - DNA, 71 bp, chicken (Gallus Gallus)
  misc_feature (36): n=c or t
tgcatgcaaaagatatcgtttcctaaagcaaataantgcagaaggggaaatctctgaccgctcaggaaacc

SEQ ID NO: 24629 - DNA, 71 bp, chicken (Gallus Gallus)
  misc_feature (36): n=a or g
ttgacttgttcccactgtgcaagtggtgcaggatcngggctgtatttttctgttgtctgtactggcaaact

SEQ ID NO: 24630 - DNA, 71 bp, chicken (Gallus Gallus)
  misc_feature (36): n=a or g
aatattagtaattatacctggcagtgtgcaggatancatccaattttcctatctatttgtatgtctttcat

SEQ ID NO: 24631 - DNA, 71 bp, chicken (Gallus Gallus)
  misc_feature (36): n=a or g
atattgtgtctaaatgttatttggatatataagcantggatttttttcctgttgtactgttccagtatgca

SEQ ID NO: 24632 - DNA, 71 bp, chicken (Gallus Gallus)
  misc_feature (36): n=a or g
tttgtctttgtaacataaagtaggaagactctcagnaaatcctgatcattgttacctgaggaaagaatgtc

SEQ ID NO: 24633 - DNA, 71 bp, chicken (Gallus Gallus)
  misc_feature (36): n=c or t
gttatatttcttacaggcctctgaaaagatgcagcnttaacacacctttctttggaaataaaaatggaaga

SEQ ID NO: 24634 - DNA, 71 bp, chicken (Gallus Gallus)
  misc_feature (36): n=a or t
agtgtcattgatgggctgcatggaaaccaagcctangtttcttcctgtgatcaagagagccttccatgatt

SEQ ID NO: 24635 - DNA, 71 bp, chicken (Gallus Gallus)
  misc_feature (36): n=c or t
tgtgttgttcccatctcctatagaaacaatatttgngttgcaggaatgtgtgatcaaatttatttattgca

SEQ ID NO: 24636 - DNA, 71 bp, chicken (Gallus Gallus)
  misc_feature (36): n=c or t
aacccatgacttaaaatcttgacctttcactttgantcacataatgagaaataaaataactactcttcaat

SEQ ID NO: 24637 - DNA, 71 bp, chicken (Gallus Gallus)
  misc_feature (36): n=c or g
gccgtggatattttgtagttggcaaggtgtaagaantggaaatacagacaattttacaataagatgctgga

SEQ ID NO: 24638 - DNA, 71 bp, chicken (Gallus Gallus)
  misc_feature (36): n=a or g
ggagttggactagatggcctataatggtcctttccngctaaaacaattttataattatatgattctatgaa

SEQ ID NO: 24639 - DNA, 71 bp, chicken (Gallus Gallus)
  misc_feature (36): n=c or t
taaatgatggcaatggtagtgccactggaatgcatnggacttcagatacatgtaggaagctgacacttgta

SEQ ID NO: 24640 - DNA, 71 bp, chicken (Gallus Gallus)
  misc_feature (36): n=a or g
actctcaaccatctggcaataagggaaagagaaagngaattttatttaattaaaaagaaggctggattatc

SEQ ID NO: 24641 - DNA, 71 bp, chicken (Gallus Gallus)
  misc_feature (36): n=a or t
ccccatgtgcccatcctgcagagaacaggctatagnagtgcagattgctggcacactgcaaagagctcaaa

SEQ ID NO: 24642 - DNA, 71 bp, chicken (Gallus Gallus)
  misc_feature (36): n=a or g
acggttaatgaagttacgaatgtgtgtcttgtcgtnttcacggacagttttgtattttggggctcttgacg

SEQ ID NO: 24643 - DNA, 71 bp, chicken (Gallus Gallus)
  misc_feature (36): n=a or t
agagagatccagcaattatttttgactccacttcanctcgcatctcaaactatttcttacttctctaccag

SEQ ID NO: 24644 - DNA, 71 bp, chicken (Gallus Gallus)
  misc_feature (36): n=c or t
tatccagtgacaaggaaagttatataaatattcttngcagattaatattaaaggaagacttataaagatta

SEQ ID NO: 24645 - DNA, 71 bp, chicken (Gallus Gallus)
  misc_feature (36): n=a or g
accaacaccaacatgaaacattaatttgttcacacnctacttcttggcaatctacccattggcaactaagg

SEQ ID NO: 24646 - DNA, 71 bp, chicken (Gallus Gallus)
  misc_feature (36): n=c or t
ttagagtacaaggagttctctgataaagtgtcaccntcattcctcagtgccattaatttctctgtccaaga

SEQ ID NO: 24647 - DNA, 71 bp, chicken (Gallus Gallus)
  misc_feature (36): n=a or g
acacagtagtttttggatctcatatgtcaagctccntatttcactgaagttgtttgaagtagtgctagata

SEQ ID NO: 24648 - DNA, 71 bp, chicken (Gallus Gallus)
  misc_feature (36): n=a or c
cagtttatattctttattcttcttcttttcaacacnctgtttcagggagttgttcttctaatcctttactc

SEQ ID NO: 24649 - DNA, 71 bp, chicken (Gallus Gallus)
  misc_feature (36): n=g or t
tggactagttaggcatggcagtgatctgcattgtgntttgagcctttatttactgaacatattggtactgt

SEQ ID NO: 24650 - DNA, 71 bp, chicken (Gallus Gallus)
  misc_feature (36): n=a or c
tgtttttaaaataattctctcagttaaagtgcaatngaagaattatctttggtctggttgaaatttcttat

SEQ ID NO: 24651 - DNA, 71 bp, chicken (Gallus Gallus)
  misc_feature (36): n=a or g
aacaacacatctctgccgattataatgaatgccttntaggacaggagatttcaaactaataatccacacag

SEQ ID NO: 24652 - DNA, 71 bp, chicken (Gallus Gallus)
  misc_feature (36): n=a or t
atggataagaagaaggtcactcaaattatttcagcnctggaagaagagttggttttgcacaaggttgtgaa

SEQ ID NO: 24653 - DNA, 71 bp, chicken (Gallus Gallus)
  misc_feature (36): n=c or t
ctcaaagacaaagataaagctcctgggggtagctancctctgaattgctctgaatgtgggaggaggatttc

SEQ ID NO: 24654 - DNA, 71 bp, chicken (Gallus Gallus)
  misc_feature (36): n=c or t
ttatattaaattaatacatattagcatcacacttcnctctgactgcaaagttgaattcatgataaatatta

SEQ ID NO: 24655 - DNA, 71 bp, chicken (Gallus Gallus)
  misc_feature (36): n=c or t
gattatcacctgctcctccctaaatacgtccaacgnttccaccaagacctcaatcccactctgcctccagt

SEQ ID NO: 24656 - DNA, 71 bp, chicken (Gallus Gallus)
  misc_feature (36): n=g or t
aatatttacattaaagttttaaatggcagcaataantattttaaacacaaactctgtatttcttgttacac

SEQ ID NO: 24657 - DNA, 71 bp, chicken (Gallus Gallus)
  misc_feature (36): n=a or c
ttagcatggagtactattttgcaatgagcactggcngtggaaagaaacattcaaactatggacatactcac

SEQ ID NO: 24658 - DNA, 71 bp, chicken (Gallus Gallus)
  misc_feature (36): n=a or c
gaaagctgtaactactgtaagagctattttgtaagngatcacctcatacttccatgaggcctatgtctttt

SEQ ID NO: 24659 - DNA, 71 bp, chicken (Gallus Gallus)
  misc_feature (36): n=c or t
attattatttaaataatatgataggatgacaacccntggaaataataactgcagcttcttggaaaacagtg

SEQ ID NO: 24660 - DNA, 71 bp, chicken (Gallus Gallus)
  misc_feature (36): n=c or t
cagtgttgcacctgtttttccaggtaatttgtatgntgaacaacactgttccccgtgggaccaattacttc

SEQ ID NO: 24661 - DNA, 71 bp, chicken (Gallus Gallus)
  misc_feature (36): n=c or t
tagaatactgccttgatacttgatttaattacaaanctgatctgtgtagttgggaacacaaggaaaattgc

SEQ ID NO: 24662 - DNA, 71 bp, chicken (Gallus Gallus)
  misc_feature (36): n=a or g
tgatgactcctgcatgcttctaactttgaggacccnagctgctgcagagctctttgctagattactgcttc

SEQ ID NO: 24663 - DNA, 71 bp, chicken (Gallus Gallus)
  misc_feature (36): n=a or g
gtaccaggtttatgtcaaaagattcaaaggttttgngaaaggcaaaaggcaggtggatggagaaacacacc

SEQ ID NO: 24664 - DNA, 71 bp, chicken (Gallus Gallus)
  misc_feature (36): n=c or t
aaagtcagcaccatagttctgctgacaccagttgcncacgacagggctgccagtgtcatacaccatcctgg

SEQ ID NO: 24665 - DNA, 71 bp, chicken (Gallus Gallus)
  misc_feature (36): n=c or t
tctttgcttgaaagagatcagctggagacaaactgnttgttaagtcccttaaatatatgtatccttttcca

SEQ ID NO: 24666 - DNA, 71 bp, chicken (Gallus Gallus)
  misc_feature (36): n=c or t
tggctgttcttttgctagatacgattttgttcttcnggagtgctctactgtgaagaagatgaccactttta

SEQ ID NO: 24667 - DNA, 71 bp, chicken (Gallus Gallus)
  misc_feature (36): n=c or t
aaaggaactctgttctgttgaaatctctttaaacangtcagtataccaaagaagcagggttgttcttcttg

SEQ ID NO: 24668 - DNA, 71 bp, chicken (Gallus Gallus)
  misc_feature (36): n=c or t
ctatgatctagattgacaagaggagctgcagagtgnaaatgaatgcatcacatttgattgccttagaaaag

SEQ ID NO: 24669 - DNA, 71 bp, chicken (Gallus Gallus)
  misc_feature (36): n=a or g
ataactctgtatcctcactgggaattttcttcaccnctatgttcaactgggacattaaataaagactatct

SEQ ID NO: 24670 - DNA, 71 bp, chicken (Gallus Gallus)
  misc_feature (36): n=c or t
atcttgtgttctctgcactgtacctgccgaccacantgatcttcacgatgttgtggctattcaagtcccag

SEQ ID NO: 24671 - DNA, 71 bp, chicken (Gallus Gallus)
  misc_feature (36): n=g or t
gatagagatagctgatgacttctcctctccatgacntcactacctacccacatatggttgataactgaagc

SEQ ID NO: 24672 - DNA, 71 bp, chicken (Gallus Gallus)
  misc_feature (36): n=c or g
atctgtgaagaaattaaaaatctacaacttctaatntactcaacagtgcaaaaatatctactagttgaagt

SEQ ID NO: 24673 - DNA, 71 bp, chicken (Gallus Gallus)
  misc_feature (36): n=a or c
atttcctgcacaagtaacagcacactgcagctctgntaggcacttggaaggctgctacatatttaataagc

SEQ ID NO: 24674 - DNA, 71 bp, chicken (Gallus Gallus)
  misc_feature (36): n=a or g
ttttccttccagaaattggacaaatgtgtgttgccnagagcagtcagctggagatatttggacacttgaaa

SEQ ID NO: 24675 - DNA, 71 bp, chicken (Gallus Gallus)
  misc_feature (36): n=a or g
ataggccccactctcaagaaaatgcatgtttaagcntatctgagctactgtgttcttaatcaaacttggct

SEQ ID NO: 24676 - DNA, 71 bp, chicken (Gallus Gallus)
  misc_feature (36): n=a or t
tatcatcttgcacagtcacaataaatagcccgtgtncttgtaaactgatacatatgatcagcttcacatta

SEQ ID NO: 24677 - DNA, 71 bp, chicken (Gallus Gallus)
  misc_feature (36): n=c or t
ctttgttgtttttttttcccctgtaattagaactantaactctgtcatttctgttttcctactaagatttt

SEQ ID NO: 24678 - DNA, 71 bp, chicken (Gallus Gallus)
  misc_feature (36): n=a or g
actctgtatgttattttcttgttaaggaaagtgacnagagattttttttaacagtggaaagtggaagaata

SEQ ID NO: 24679 - DNA, 71 bp, chicken (Gallus Gallus)
  misc_feature (36): n=a or g
actattctgaatgccatggtaaacactgcatcctcnagtaaagaatacatcaagttgacaaaaaaagtaaa

SEQ ID NO: 24680 - DNA, 71 bp, chicken (Gallus Gallus)
  misc_feature (36): n=c or t
aagttttaaattggatatcaggaagaacttcttcanggagagaatgatgaggaactgtaataggctgccca

SEQ ID NO: 24681 - DNA, 71 bp, chicken (Gallus Gallus)
  misc_feature (36): n=c or t
tactcgcaggtgtcctgtcaaatagtgtgaccactnggtaggtgcattattggtgcatctgagtactataa

SEQ ID NO: 24682 - DNA, 71 bp, chicken (Gallus Gallus)
  misc_feature (36): n=a or g
tccatacaagcacactatttagggcaggcatatgtntggaaggtcagcttgtggtgactggcaggatgtgc

SEQ ID NO: 24683 - DNA, 71 bp, chicken (Gallus Gallus)
  misc_feature (36): n=a or g
tgggctcttttgtttgaatgggagtgttgtgagacnctttgacctggcaatgcagtggcttttagctattg

SEQ ID NO: 24684 - DNA, 71 bp, chicken (Gallus Gallus)
  misc_feature (36): n=c or t
gcatttaaactgcccaaagatcctatggtatgtgtnagatacatcaaggggtgctaaaaattcccagtcct

SEQ ID NO: 24685 - DNA, 71 bp, chicken (Gallus Gallus)
  misc_feature (36): n=a or g
aatttgcgtcagcccccatgcaggaccttgcactcngtcttgttgaactttatgaggtcattattgtggca

SEQ ID NO: 24686 - DNA, 71 bp, chicken (Gallus Gallus)
  misc_feature (36): n=c or t
aagtaacagccatgtgaaatccttgctcccagttcntctactgaggatacaaagtgacttcagggatattt

SEQ ID NO: 24687 - DNA, 71 bp, chicken (Gallus Gallus)
  misc_feature (36): n=c or t
gcttttttaacgcagttttttgcttttaagacacgntgatctgatggattatctcaagcacaaataggtgt

SEQ ID NO: 24688 - DNA, 71 bp, chicken (Gallus Gallus)
  misc_feature (36): n=c or t
caagttgatagaagttttctattgctctacctccancatggggctctagctgtgcaatcaattcctgttct

SEQ ID NO: 24689 - DNA, 71 bp, chicken (Gallus Gallus)
  misc_feature (36): n=a or g
tgccatacctgttcacatgagtgtatgaaattcctntggagcctgccttacatcatatattttcctgtgta

SEQ ID NO: 24690 - DNA, 71 bp, chicken (Gallus Gallus)
  misc_feature (36): n=a or g
tgccatgcttattttgtgtaaactcttcttcctacnacacagctgtagtacttccatacgtaattcctttc

SEQ ID NO: 24691 - DNA, 71 bp, chicken (Gallus Gallus)
  misc_feature (36): n=c or t
gaaattgtttgtctaaagaacacaaatggacatgtngaggacattgctggatcttggtagtgactatccct

SEQ ID NO: 24692 - DNA, 71 bp, chicken (Gallus Gallus)
  misc_feature (36): n=a or c
tgttaccaacaacatgacagcaaatgcaagtgttanctgaatacagcctgacagtgtaaaagttactaaaa

SEQ ID NO: 24693 - DNA, 71 bp, chicken (Gallus Gallus)
  misc_feature (36): n=c or g
gatataacataaggttaatatctgcagtaaaaaaanaacattccagcaaagccttttgcaaaaacttacca

SEQ ID NO: 24694 - DNA, 71 bp, chicken (Gallus Gallus)
  misc_feature (36): n=a or c
gtgaaatgtactatgaggtcagggggagagtttagnggcattggaatggcaattcacagagacgttccaga

SEQ ID NO: 24695 - DNA, 71 bp, chicken (Gallus Gallus)
  misc_feature (36): n=c or t
gtggagggattcaattgttctcaatacaagaaaagncaaggtttatactcctcaaaggcatctctccagat

SEQ ID NO: 24696 - DNA, 71 bp, chicken (Gallus Gallus)
  misc_feature (36): n=a or g
ccaccgtgccctgtggtggaaggcaacctgaagcantgagcaaggactcacctgaaacttcaaagctaagc

SEQ ID NO: 24697 - DNA, 71 bp, chicken (Gallus Gallus)
  misc_feature (36): n=c or t
gtcactacataaaccaaagaacaaaaagcgtccaantcacctcaaacacttgcaaccaaaatgtaatacaa

SEQ ID NO: 24698 - DNA, 71 bp, chicken (Gallus Gallus)
  misc_feature (36): n=c or t
gctgcagcagtagatgtgggtggtgagtcttgtggnagaacacatgagttctttgtctttgctcaggagac

SEQ ID NO: 24699 - DNA, 71 bp, chicken (Gallus Gallus)
  misc_feature (36): n=a or g
ctccccacttgtgttcctgcagcgagatcttctgcnagtaggaaggtcctgatgtgctgattcctgtcctg

SEQ ID NO: 24700 - DNA, 71 bp, chicken (Gallus Gallus)
  misc_feature (36): n=c or t
taaccgagtaacagactctttggaagagaaagatangtcttatgggagcacacaagtaaggtgccttgtaa

SEQ ID NO: 24701 - DNA, 71 bp, chicken (Gallus Gallus)
  misc_feature (36): n=a or g
ccaggcctgatttattaacagcttctgtagatagcntgtaacacttacagaggagatggagagtttggtag

SEQ ID NO: 24702 - DNA, 71 bp, chicken (Gallus Gallus)
  misc_feature (36): n=a or t
ctcagaaattcttatgaggtacttccattagattangctgatgatgccagctcagtgctacaaagattaaa

SEQ ID NO: 24703 - DNA, 71 bp, chicken (Gallus Gallus)
  misc_feature (36): n=a or g
aggggaaaagtgtgaggaggaaggagtggcagaggngagctgttatggattgatggcagcacccattcccc

SEQ ID NO: 24704 - DNA, 71 bp, chicken (Gallus Gallus)
  misc_feature (36): n=a or g
tttgttgagcgtgaggtgccctgttcaggacaaccnttctgctttcctttaggttgtatactccctataag

SEQ ID NO: 24705 - DNA, 71 bp, chicken (Gallus Gallus)
  misc_feature (36): n=c or g
ggccttggtattgcaataatgcttcttcttctgtanactgtcctactactttgcctgtgtgtgtgtgcaca

SEQ ID NO: 24706 - DNA, 71 bp, chicken (Gallus Gallus)
  misc_feature (36): n=c or t
agcaaaataaggaaacaactagaagcaaaagagctngtccatgtcacatgtcagcaccttgtgtcagaaca

SEQ ID NO: 24707 - DNA, 71 bp, chicken (Gallus Gallus)
  misc_feature (36): n=a or g
aaatgtccaaatctctgctagcaaaggagaggatgnaatcactcctctggacaggatggaggtcacctctc

SEQ ID NO: 24708 - DNA, 71 bp, chicken (Gallus Gallus)
  misc_feature (36): n=a or g
ttcccgttgctttggacagcaagcacaactcctccntgtaaaagtggctttagttactttttcagagcagc

SEQ ID NO: 24709 - DNA, 71 bp, chicken (Gallus Gallus)
  misc_feature (36): n=g or t
ttttaatgctgttactaaatatttagtgctttgttnttccattacttcattatttttctggcaggaaaatg

SEQ ID NO: 24710 - DNA, 71 bp, chicken (Gallus Gallus)
  misc_feature (36): n=c or t
ttaaaggagactcctttacagtgaggctgaagtgcngcgtcttctcattgagagtaagcagcgagggcttc

SEQ ID NO: 24711 - DNA, 71 bp, chicken (Gallus Gallus)
  misc_feature (36): n=a or c
cagaaatccagttatttcaaactggcaaaagcactnatttataaatttgaacactgggattatggtttgtt

SEQ ID NO: 24712 - DNA, 71 bp, chicken (Gallus Gallus)
  misc_feature (36): n=c or t
atttgcaaaaatagatcaaccactattctgtatttnacattcttctatcctcaaaccccagcctcagaagg

SEQ ID NO: 24713 - DNA, 71 bp, chicken (Gallus Gallus)
  misc_feature (36): n=c or t
ggagaaatgtattatcaaaatgtaaaggaatcagcnatgcccatcttttccttccacaacccagccacaca

SEQ ID NO: 24714 - DNA, 71 bp, chicken (Gallus Gallus)
  misc_feature (36): n=a or g
atatctgtattcaagaggttttcagaacagggagcntttgaatagcatggagagtgctggactgacatcct

SEQ ID NO: 24715 - DNA, 71 bp, chicken (Gallus Gallus)
  misc_feature (36): n=c or t
gagaaggaagagtactggtatgtcagacaggaactnaattttcaaaaaaaaaaaaaaaaaaaaaggagtaa

SEQ ID NO: 24716 - DNA, 71 bp, chicken (Gallus Gallus)
  misc_feature (36): n=a or g
acgttaaatcacaaaacatttcttgttaaagtaaangtaaaacttgcagacaattcaacagcattactgtt

SEQ ID NO: 24717 - DNA, 71 bp, chicken (Gallus Gallus)
  misc_feature (36): n=a or c
taggaaaacttggatattgtgaataagatgttaatnatggaataaacttgctattcctttttttttaatca

SEQ ID NO: 24718 - DNA, 71 bp, chicken (Gallus Gallus)
  misc_feature (36): n=a or g
agcaaagatgctttctggtttacccaaaatgtattncttgtgactaagtcaaaaaaagattctgcattcaa

SEQ ID NO: 24719 - DNA, 71 bp, chicken (Gallus Gallus)
  misc_feature (36): n=a or g
ctgcaccagggaccaaattttcagagaaatctctancagagggtccaaaggcatcacagttcacctacacc

SEQ ID NO: 24720 - DNA, 71 bp, chicken (Gallus Gallus)
  misc_feature (36): n=c or g
atgcgataaattatcagcaacaggaagaaaatgcantgttcaagactatgctcattgcattttctgtagca

SEQ ID NO: 24721 - DNA, 71 bp, chicken (Gallus Gallus)
  misc_feature (36): n=a or g
atgtggaagaagtcattttaaacatcccaccagganggaagattgccaaactgaagattttaagaggttct

SEQ ID NO: 24722 - DNA, 71 bp, chicken (Gallus Gallus)
  misc_feature (36): n=c or t
tgtactttggggagcgtttcagtacgtgcagtgctngggggagactccggaacggggttatcttttagctg

SEQ ID NO: 24723 - DNA, 71 bp, chicken (Gallus Gallus)
  misc_feature (36): n=c or t
aattaatcacgttttggagaagtttcatttttgctncccaaggaaacactttcatcatctcctctcttttg

SEQ ID NO: 24724 - DNA, 71 bp, chicken (Gallus Gallus)
  misc_feature (36): n=c or t
ggaagctcccagttctgttcggtttggctctttctnttttactacctatgcaccaacactgcggcacaggg

SEQ ID NO: 24725 - DNA, 71 bp, chicken (Gallus Gallus)
  misc_feature (36): n=c or t
caaaggcagagtttgtcaaattgttcttaaacatangaaataaagcatacttttttcttctttcctgttct

SEQ ID NO: 24726 - DNA, 71 bp, chicken (Gallus Gallus)
  misc_feature (36): n=a or g
ctatccaaacagaaaagacactgtggcaagccctantgttcaggttctgagcctatgacatttgtggaaga

SEQ ID NO: 24727 - DNA, 71 bp, chicken (Gallus Gallus)
  misc_feature (36): n=c or t
gggctaccccaagcagcacctagtgttgaacagcantcagacttcagagttgctccattgatatttatctc

SEQ ID NO: 24728 - DNA, 71 bp, chicken (Gallus Gallus)
  misc_feature (36): n=a or g
gccatgatgatattggaggttagtgctcaaataccntcacagatttacagatactgcaggacacacttttt

SEQ ID NO: 24729 - DNA, 71 bp, chicken (Gallus Gallus)
  misc_feature (36): n=a or g
tgcctgcctgccttcagaaggacttggggaaaactnctcagcagatatctaaagaatactttcaagatgag

SEQ ID NO: 24730 - DNA, 71 bp, chicken (Gallus Gallus)
  misc_feature (36): n=a or g
aaaatatgtgcaattctttaacatgatggagagaancagagaagggattttctagagctgagtgatcacct

SEQ ID NO: 24731 - DNA, 71 bp, chicken (Gallus Gallus)
  misc_feature (36): n=c or g
aatttggcagagtactatatataatacaggctcttnatgtcattagcttcagtgactaaaacattcatcaa

SEQ ID NO: 24732 - DNA, 71 bp, chicken (Gallus Gallus)
  misc_feature (36): n=c or t
aattatgaaactgtgctaggaaaaaaaaaaaatccngggaggcaagtgttcaatgacaaggtatccagccg

SEQ ID NO: 24733 - DNA, 71 bp, chicken (Gallus Gallus)
  misc_feature (36): n=a or g
ggatggacatttcctgctggaggattaaaaagcatncagctcaagcaaagagggcagcagccctgcactga

SEQ ID NO: 24734 - DNA, 71 bp, chicken (Gallus Gallus)
  misc_feature (36): n=c or t
ttgaaaagagatatgagaccactcttttaaggggtntaagccactgttcaaaatagcatggccaaagaagt

SEQ ID NO: 24735 - DNA, 71 bp, chicken (Gallus Gallus)
  misc_feature (36): n=a or t
ttatcaaggtgcatcagtatgttaaagctgtatttntgggttctagtctcactgctgtgagaactgaagat

SEQ ID NO: 24736 - DNA, 71 bp, chicken (Gallus Gallus)
  misc_feature (36): n=c or t
gtctcagagggaagaagtacagcaagaaaacagatngtcctgagatattcccagcccatgaacacaaagaa

SEQ ID NO: 24737 - DNA, 71 bp, chicken (Gallus Gallus)
  misc_feature (36): n=a or t
aacagacctcaaaatatttttactttgccatgagtngtgttcttcaacataaatagtgttgaatatgaaag

SEQ ID NO: 24738 - DNA, 71 bp, chicken (Gallus Gallus)
  misc_feature (36): n=a or g
ctagtaattactcttttaaaacacacttgctgtagnactgtagtctaaatttagcatagtgaatgttttgt

SEQ ID NO: 24739 - DNA, 71 bp, chicken (Gallus Gallus)
  misc_feature (36): n=c or t
acagcgacaccaaaattgccaagcgcatggctatantgatcttcacagacttcctctgcatggcaccaata

SEQ ID NO: 24740 - DNA, 71 bp, chicken (Gallus Gallus)
  misc_feature (36): n=c or g
tcagcctgtctgtagcatcacatcatttcagatccnatacctttatcagctacgagccactcgcaggtgcc

SEQ ID NO: 24741 - DNA, 71 bp, chicken (Gallus Gallus)
  misc_feature (36): n=c or t
tttaatttgtaaaaataccttaagttccattcctgnggaaggaggacatccctgcagtctgtgggtacgct

SEQ ID NO: 24742 - DNA, 71 bp, chicken (Gallus Gallus)
  misc_feature (36): n=c or t
aaacactgagtaggaccaccatgggctgaggattancagcgactaacaatgtattttttgcacatgtgact

SEQ ID NO: 24743 - DNA, 71 bp, chicken (Gallus Gallus)
  misc_feature (36): n=a or g
tcaagaaagcatgtgaagtcagggccttgccctctntctgaggaagtaagcatcttctgcagcaaagaaaa

SEQ ID NO: 24744 - DNA, 71 bp, chicken (Gallus Gallus)
  misc_feature (36): n=c or t
gtcagcataagaaatgaaagcaatggaaaccagtanccccctcatatacatttaccacaatgatataagta

SEQ ID NO: 24745 - DNA, 71 bp, chicken (Gallus Gallus)
  misc_feature (36): n=c or t
atgcagcactgctacattttgtattgaggagagtanggttagaaagtgaataaagagcagtgaaattagtg

SEQ ID NO: 24746 - DNA, 71 bp, chicken (Gallus Gallus)
  misc_feature (36): n=c or t
ggggatgggacttccacacccagcattgagatgcangggaccagagccttctcatttttttcccaggggta

SEQ ID NO: 24747 - DNA, 71 bp, chicken (Gallus Gallus)
  misc_feature (36): n=a or g
cttcatcgttcaatggatgaaatcatttgataaagntttaccatagtccagcattacttttgtttcataaa

SEQ ID NO: 24748 - DNA, 71 bp, chicken (Gallus Gallus)
  misc_feature (36): n=c or g
ttggatgtgaagtttgtagtggtgtctttctggggnttatcttgtgaatcaagcaagctctcggttaaact

SEQ ID NO: 24749 - DNA, 71 bp, chicken (Gallus Gallus)
  misc_feature (36): n=c or t
aaacgctgcaatacagtcttattttgggagaatacncatgcttcaattcagccctcttgttccacaataca

SEQ ID NO: 24750 - DNA, 71 bp, chicken (Gallus Gallus)
  misc_feature (36): n=a or g
tgatttgaatccatgaccaagttagactgggaatcncaaccaacataacaataagtttcaaagtcctcaat

SEQ ID NO: 24751 - DNA, 71 bp, chicken (Gallus Gallus)
  misc_feature (36): n=c or t
catgaaccagttttcagtggttatttcaggtgtcgnagtagacaaaaatagactcaatttttgccgtgctt

SEQ ID NO: 24752 - DNA, 71 bp, chicken (Gallus Gallus)
  misc_feature (36): n=c or t
ccagctgcttggtattttcattaaatcctcactagntctcatcataaacaataaataactggtcccccaac

SEQ ID NO: 24753 - DNA, 71 bp, chicken (Gallus Gallus)
  misc_feature (36): n=a or g
aggtagagcctaacgcctgtacctgttttactacancttcacctgctgaagggcatcctcttgttggctac

SEQ ID NO: 24754 - DNA, 71 bp, chicken (Gallus Gallus)
  misc_feature (36): n=g or t
attcatcacaaggtataagtggatctataacgtctnaaatcgcccgttgaagattaactggatgtattgtg

SEQ ID NO: 24755 - DNA, 71 bp, chicken (Gallus Gallus)
  misc_feature (36): n=c or t
ctgtactatttgtttcttttattataaaggaaaagntttggtccttgaagcagagcagtttctatgttcta

SEQ ID NO: 24756 - DNA, 71 bp, chicken (Gallus Gallus)
  misc_feature (36): n=a or g
tgggtttctgagcactgtgcattttgttaattaggnaattcaaatagttttattttttaccaaaaaaaggg

SEQ ID NO: 24757 - DNA, 71 bp, chicken (Gallus Gallus)
  misc_feature (36): n=c or t
attattactttctttaccagtcaaactaaaaatctncatccacacattgctatttgtcaaagtttattttt

SEQ ID NO: 24758 - DNA, 71 bp, chicken (Gallus Gallus)
  misc_feature (36): n=a or g
gcaacagatgcataacctgcctgcagagctgctgcntcttagtcaaacagaatattgtttaaaaaaataat

SEQ ID NO: 24759 - DNA, 71 bp, chicken (Gallus Gallus)
  misc_feature (36): n=c or t
aatatttcttttacagcctttggtactaccttactnctttctaactctgtctttagctttggtggcttctt

SEQ ID NO: 24760 - DNA, 71 bp, chicken (Gallus Gallus)
  misc_feature (36): n=g or t
caaaaattatgactcgatagcatcccacttaagcanaagctttacaacttcatcacatatataaaagcata

SEQ ID NO: 24761 - DNA, 71 bp, chicken (Gallus Gallus)
  misc_feature (36): n=c or t
atacataaaccgttcacacaatcacgaattcctccngatctgccaatgcatccagcaccaaggcacatcac

SEQ ID NO: 24762 - DNA, 71 bp, chicken (Gallus Gallus)
  misc_feature (36): n=a or g
tgcagattggaaatttcctagcctcagcagagggcnatgcctagctgtctggatgcactagggctaccaca

SEQ ID NO: 24763 - DNA, 71 bp, chicken (Gallus Gallus)
  misc_feature (36): n=a or t
tttgtaggtgaagcctgtaccatagttctgcgtggngcaacacaacaaattctagatgaagctgagaggtc

SEQ ID NO: 24764 - DNA, 71 bp, chicken (Gallus Gallus)
  misc_feature (36): n=a or c
gatataacttttattgttgcttgcttgtcaaggatnaggaaaaaatgtggtgttactccttcagtttaaac

SEQ ID NO: 24765 - DNA, 71 bp, chicken (Gallus Gallus)
  misc_feature (36): n=a or g
gaacctctgcaggtggttgctgttttaaagaatggngcacttcctttcatgctttctgcccatgacctttc

SEQ ID NO: 24766 - DNA, 71 bp, chicken (Gallus Gallus)
  misc_feature (36): n=a or t
tacaacaatgaggggggataaataaattactacacngatttagcaattaaagattaatttcttttcaaaat

SEQ ID NO: 24767 - DNA, 71 bp, chicken (Gallus Gallus)
  misc_feature (36): n=g or t
cttttggtgccaaagcaggcagagatgatagatganatgagttgcaaacctcaagtgatcaccagtttgag

SEQ ID NO: 24768 - DNA, 71 bp, chicken (Gallus Gallus)
  misc_feature (36): n=a or c
taatagctaatataatcagtagcttaaatcaaatanatttcaaacagtaatgatgaattaatgcatctgta

SEQ ID NO: 24769 - DNA, 71 bp, chicken (Gallus Gallus)
  misc_feature (36): n=a or t
cattgccttttaatgccttaacaatcatttgtaaantctgtgattaatgaaatctttggatccagaagctc

SEQ ID NO: 24770 - DNA, 71 bp, chicken (Gallus Gallus)
  misc_feature (36): n=c or t
aattagtgatgattttattatcattttaaagattgntcactttcccagtatttccagcatttgacctagta

SEQ ID NO: 24771 - DNA, 71 bp, chicken (Gallus Gallus)
  misc_feature (36): n=a or c
gtctctactctcttgacaacatcaaacaaatccagnttaagcccagagcaaaatcttggaaaaaataatta

SEQ ID NO: 24772 - DNA, 71 bp, chicken (Gallus Gallus)
  misc_feature (36): n=c or t
ataaacagaagtaatggtgaccttgggttgcattancgtttctcctgtaatgctcctaatgctttacaatg

SEQ ID NO: 24773 - DNA, 71 bp, chicken (Gallus Gallus)
  misc_feature (36): n=c or t
ggggccttctccatctacaccggcttcatctacaangagtgcttcagcaaagccactgtcatcttcccctc

SEQ ID NO: 24774 - DNA, 71 bp, chicken (Gallus Gallus)
  misc_feature (36): n=a or g
tgtgtgacctaagttctgatgtaaccattctcccanctgctaccacttaggatctaagataattttcctaa

SEQ ID NO: 24775 - DNA, 71 bp, chicken (Gallus Gallus)
  misc_feature (36): n=c or t
aaccaacgacattgaatcaattgaaatattgcacanggagtcacaggcacagtataatagtacttttctga

SEQ ID NO: 24776 - DNA, 71 bp, chicken (Gallus Gallus)
  misc_feature (36): n=c or t
aaggcttagccataccctgaaatcacaccaaagagnactccagtacatctcatgggaagcacatgcataag

SEQ ID NO: 24777 - DNA, 71 bp, chicken (Gallus Gallus)
  misc_feature (36): n=c or t
tttcatgacacaagtactaaagatgccttttggcangagatcatctgtcttttctcttttctccctcgaaa

SEQ ID NO: 24778 - DNA, 71 bp, chicken (Gallus Gallus)
  misc_feature (36): n=a or g
gcacaggtctggcagtatgaagtactgtgcaatcantgtaagatgaggtagtttaaaggaccttgtgggac

SEQ ID NO: 24779 - DNA, 71 bp, chicken (Gallus Gallus)
  misc_feature (36): n=a or g
ttttggggtcttacattggaaaatcatcattctaanccctgaaaggtttttgaggctaattcctgtataca

SEQ ID NO: 24780 - DNA, 71 bp, chicken (Gallus Gallus)
  misc_feature (36): n=c or t
gacactttgtgaagggctgtggaagctagagagtgngtgtgagtagatagctccctggaatgacttgcttc

SEQ ID NO: 24781 - DNA, 71 bp, chicken (Gallus Gallus)
  misc_feature (36): n=c or t
ggcatagaaacagcatattcaggccacctgcccttncgcagtacaataaaaaatgtactaggcatacctgc

SEQ ID NO: 24782 - DNA, 71 bp, chicken (Gallus Gallus)
  misc_feature (36): n=a or g
aaaatgttaccaggctgttattttcgattacttaantcccttcttaataacaggcaaatcccatacagaat

SEQ ID NO: 24783 - DNA, 71 bp, chicken (Gallus Gallus)
  misc_feature (36): n=c or t
tacttaagcaagttttgtaaatgtatgtgtctgtcnatatgtattaaagtatacagatagtttttatccta

SEQ ID NO: 24784 - DNA, 71 bp, chicken (Gallus Gallus)
  misc_feature (36): n=c or t
tccatttttaacagctgactcttaaacctttgttcnctctttgaataggcatagacaaacatataatttgt

SEQ ID NO: 24785 - DNA, 71 bp, chicken (Gallus Gallus)
  misc_feature (36): n=a or g
tttgcaataagttactaacttaagtatgactctgtntcttctataaataaaacatcgttatcaagatactc

SEQ ID NO: 24786 - DNA, 71 bp, chicken (Gallus Gallus)
  misc_feature (36): n=c or g
ctatggctttcagtacatcatcctcattacagtcantgttaaaagaatggtctaatttgtataatataata

SEQ ID NO: 24787 - DNA, 71 bp, chicken (Gallus Gallus)
  misc_feature (36): n=c or t
gaaaatatagatatattatctcatgatatcttactntctagcattttcagagattaccagtcttcatccat

SEQ ID NO: 24788 - DNA, 71 bp, chicken (Gallus Gallus)
  misc_feature (36): n=a or g
taaaagacaagacgggtaaaaagaaccaaaaccgantgctctgtgaactacctgtggccatcacggtcccc

SEQ ID NO: 24789 - DNA, 71 bp, chicken (Gallus Gallus)
  misc_feature (36): n=c or t
ccaaaacagacttctgagatgctcactctggggcangacttccgatttcttctgcatttgaggaccttctt

SEQ ID NO: 24790 - DNA, 71 bp, chicken (Gallus Gallus)
  misc_feature (36): n=c or t
tctctaagaatcatgtgcttaaagattgtgtcattnaaaagcatgcttcagccaatgttagggaagttact

SEQ ID NO: 24791 - DNA, 71 bp, chicken (Gallus Gallus)
  misc_feature (36): n=c or t
actatgcaatccatagctgctattcaattgtatatngtagtgttctgctgaagatgaagtcaaaatcttcc

SEQ ID NO: 24792 - DNA, 71 bp, chicken (Gallus Gallus)
  misc_feature (36): n=a or g
gattgtatctcagaaaggaggcagaaatgagagtcnaatcaaactgttcatttcaggtaattctggcttta

SEQ ID NO: 24793 - DNA, 71 bp, chicken (Gallus Gallus)
  misc_feature (36): n=c or g
gtatgccaccagtgacattaacgtttagactgaggnctaatgggctctttcttagttctgtgaaaacaaaa

SEQ ID NO: 24794 - DNA, 71 bp, chicken (Gallus Gallus)
  misc_feature (36): n=a or g
ttcattccttgtcaatacagttggtcatgaaacagntacatcaagctggttttatctgtggtataccagtc

SEQ ID NO: 24795 - DNA, 71 bp, chicken (Gallus Gallus)
  misc_feature (36): n=a or g
ctgcaaatgggaactgttatgagaacaaaaatttgnctagaactgatttctataccctggcatgcattatg

SEQ ID NO: 24796 - DNA, 71 bp, chicken (Gallus Gallus)
  misc_feature (36): n=c or t
atttacaaagcactgctctgtattaatcacattttnggtgaaaacataattatagtaattaagtatatagt

SEQ ID NO: 24797 - DNA, 71 bp, chicken (Gallus Gallus)
  misc_feature (36): n=a or g
gattgagcaagagagcttccccatgggaagaaaacntgccctaagtcagacctctcagtgactccatctca

SEQ ID NO: 24798 - DNA, 71 bp, chicken (Gallus Gallus)
  misc_feature (36): n=a or g
ctctggatttagaaatgcactaggcttttttgaagnttggatacatggaaagatgtctgccttcagcactt

SEQ ID NO: 24799 - DNA, 71 bp, chicken (Gallus Gallus)
  misc_feature (36): n=a or g
tcagccaataccctcaggaccctgggattcattacngtttttacaactgtgcaaatttttatgagaactaa

SEQ ID NO: 24800 - DNA, 71 bp, chicken (Gallus Gallus)
  misc_feature (36): n=g or t
taaacaagcacacttattcagaacttgacaattctnaaacactatatagctatttgctaagccttaaaatg

SEQ ID NO: 24801 - DNA, 71 bp, chicken (Gallus Gallus)
  misc_feature (36): n=a or t
gctgaaattgaatgtcatgactgaaccatggtgcanactagcactgtgactgtcaacaacttctgcagtac

SEQ ID NO: 24802 - DNA, 71 bp, chicken (Gallus Gallus)
  misc_feature (36): n=a or g
tagccatgctgtctcactcactgtggctgatttgcnctgacaggcagtctcagagctcctcttggagtgta

SEQ ID NO: 24803 - DNA, 71 bp, chicken (Gallus Gallus)
  misc_feature (36): n=c or t
gatttacactcctcagacttcataacgtgtctgggnggagcttctactcttacattcttttcacttctttt

SEQ ID NO: 24804 - DNA, 71 bp, chicken (Gallus Gallus)
  misc_feature (36): n=c or t
tttggaatatgcattgttcaataattaatggtcacntcagaaaacagctatccttccagactgcctcctaa

SEQ ID NO: 24805 - DNA, 71 bp, chicken (Gallus Gallus)
  misc_feature (36): n=c or t
atttgaatctgctgtatgctaatgatactcatgatngctttattgattgcctatgatagttatggctggtc

SEQ ID NO: 24806 - DNA, 71 bp, chicken (Gallus Gallus)
  misc_feature (36): n=a or c
atattgaatcgagaattattgaatcaagaattacangctttactagaaaacataaaatcctgcagacgttt

SEQ ID NO: 24807 - DNA, 71 bp, chicken (Gallus Gallus)
  misc_feature (36): n=a or t
cagaatttgagaaacatgatgaaaaccctttgtttnttcaaaatagcagaggtgtcaggacctctttactt

SEQ ID NO: 24808 - DNA, 71 bp, chicken (Gallus Gallus)
  misc_feature (36): n=a or g
tgtcaaggatatgccatacaaagaggattgggcccntacttgcagctgttttcaattaacattttaatgta

SEQ ID NO: 24809 - DNA, 71 bp, chicken (Gallus Gallus)
  misc_feature (36): n=a or g
ttaattatgtgtgaaggtggattagtgcatggcgtnccatgagttgttaatgctaatcaatcagaattaca

SEQ ID NO: 24810 - DNA, 71 bp, chicken (Gallus Gallus)
  misc_feature (36): n=c or t
aggccatgagtcactccatatccttggtttggggcnacaaacatagtcaattttagatttaaaataattct

SEQ ID NO: 24811 - DNA, 71 bp, chicken (Gallus Gallus)
  misc_feature (36): n=c or t
cctggggtactctgatgagtgaacatgaatgggagncccttgattgtttcaaggagccttgagtgtggttc

SEQ ID NO: 24812 - DNA, 71 bp, chicken (Gallus Gallus)
  misc_feature (36): n=c or t
gcactgctgcctgacgagcaaaacatgaatgtccangacaaacaactgctgcgccaggcaatcaacacagt

SEQ ID NO: 24813 - DNA, 71 bp, chicken (Gallus Gallus)
  misc_feature (36): n=a or g
agatgaaattacagtaaacaaaaataagacactaancttaaagcaatacttaactttcacactcataagat

SEQ ID NO: 24814 - DNA, 71 bp, chicken (Gallus Gallus)
  misc_feature (36): n=a or g
cactgttcctcctttcagcgacggtgcctgtttccnttcttcgactcggcgtatcaaggttttgcctctgg

SEQ ID NO: 24815 - DNA, 71 bp, chicken (Gallus Gallus)
  misc_feature (36): n=a or g
gaggcagatttcaagaggcaatcatcaggatgtctngtttgcttttgtaccctaagtgctgccagagtaag

SEQ ID NO: 24816 - DNA, 71 bp, chicken (Gallus Gallus)
  misc_feature (36): n=g or t
gttattctgcgttgagggatcagatggttcccaccnactttggacactgaaatgagaagggaagattacct

SEQ ID NO: 24817 - DNA, 71 bp, chicken (Gallus Gallus)
  misc_feature (36): n=a or g
ttcaataaatgtggaaaatggagatagaatgggttnttttggtttaaagaacatttttcagaatacacttg

SEQ ID NO: 24818 - DNA, 71 bp, chicken (Gallus Gallus)
  misc_feature (36): n=a or t
ctgctatcttcagtctatttacctacagtcagtagnattcagacttcattcagaggctgttggagttcatt

SEQ ID NO: 24819 - DNA, 71 bp, chicken (Gallus Gallus)
  misc_feature (36): n=c or t
cttaggagcaggtagaaaagaaagactttgcaacgnagaggaaaagctgttgtgttaccatacagtttagt

SEQ ID NO: 24820 - DNA, 71 bp, chicken (Gallus Gallus)
  misc_feature (36): n=c or t
tatgaagatggagaggaccagccaaagcaagtgtanatggataagcttcaggagctaagagtaaggcttca

SEQ ID NO: 24821 - DNA, 71 bp, chicken (Gallus Gallus)
  misc_feature (36): n=a or g
ttaagagacttcttgtttttctttgctgccttagcnccagtgaaaggtgctatatggagagcctgggggat

SEQ ID NO: 24822 - DNA, 71 bp, chicken (Gallus Gallus)
  misc_feature (36): n=c or t
cgttttcttcctgagaatatgttcagatgagctctntgattaagagacaacttacgacactaataactaat

SEQ ID NO: 24823 - DNA, 71 bp, chicken (Gallus Gallus)
  misc_feature (36): n=c or t
ttcctctgatacacatctgatgtagtctgttagtangcagactcatatttagctaatgattaatctgagtg

SEQ ID NO: 24824 - DNA, 71 bp, chicken (Gallus Gallus)
  misc_feature (36): n=a or g
atttgtgggatattgcttaataagttctgcacatantaaaaacttgtctttgaagggctccaggcacagtt

SEQ ID NO: 24825 - DNA, 71 bp, chicken (Gallus Gallus)
  misc_feature (36): n=a or g
cctgcaggtgacaggtgatcacaccacgcatctccnatactttatgctcacaaaatcgtctgtgcttccta

SEQ ID NO: 24826 - DNA, 71 bp, chicken (Gallus Gallus)
  misc_feature (36): n=c or t
aacaagctcatcacccctaatgaagatagaaagctncaaccagtgagtaaccctttgaataacatctaatc

SEQ ID NO: 24827 - DNA, 71 bp, chicken (Gallus Gallus)
  misc_feature (36): n=a or g
gtgcacttttgaatatggttttaattgtggtatttnttgtgttcacatctgtgctgcacatgttcttcctg

SEQ ID NO: 24828 - DNA, 71 bp, chicken (Gallus Gallus)
  misc_feature (36): n=c or t
gaaagatcaccatctctatcagtgcaaatcaacatntttttattttatttttttttaatgttgaattttcg

SEQ ID NO: 24829 - DNA, 71 bp, chicken (Gallus Gallus)
  misc_feature (36): n=a or c
gaagtgatagagtggatgaacaatgctgtgagtgcncaggctaagaagagcttagatcaggatccagctgt

SEQ ID NO: 24830 - DNA, 71 bp, chicken (Gallus Gallus)
  misc_feature (36): n=a or g
aatgattctgcactgcattctataaggtttgctatntaactcatcatttcagaaattaatcagtggagatt

SEQ ID NO: 24831 - DNA, 71 bp, chicken (Gallus Gallus)
  misc_feature (36): n=a or g
tctagattatttgggtttcagcctctggatgcgttnttttgcagagatggattggtgattgtaactaaaag

SEQ ID NO: 24832 - DNA, 71 bp, chicken (Gallus Gallus)
  misc_feature (36): n=a or t
gcttttcgtattccactggtctgtaaaacgtgtttntaacctctctgaataggatgtgccctgagggcagc

SEQ ID NO: 24833 - DNA, 71 bp, chicken (Gallus Gallus)
  misc_feature (36): n=g or t
agcactgcagagagctgtcatctctaccacatcctnagatttagttacacagttattaagatagaaggaaa

SEQ ID NO: 24834 - DNA, 71 bp, chicken (Gallus Gallus)
  misc_feature (36): n=c or t
agcttactggtgacatcccattaaccagttagcacnatacacaacaagcaaagcacatcaagtgcaatatg

SEQ ID NO: 24835 - DNA, 71 bp, chicken (Gallus Gallus)
  misc_feature (36): n=a or g
ctctccacttcctgactatgtaagtattgagcttcntgttgtagtaggtgctccaaaatacaggaggtaca

SEQ ID NO: 24836 - DNA, 71 bp, chicken (Gallus Gallus)
  misc_feature (36): n=c or t
tttccttttggctttacagactgaagccaacatccntctactacacaacctggctgtgaaggcactctttt

SEQ ID NO: 24837 - DNA, 71 bp, chicken (Gallus Gallus)
  misc_feature (36): n=a or g
tttcataatgtgatcgtgaaacataacagtcaaagnattttctcagaagtaggaaatgtctaaaagttggc

SEQ ID NO: 24838 - DNA, 71 bp, chicken (Gallus Gallus)
  misc_feature (36): n=a or g
accagcagtgcaaaataaacaaaacctgacttgaantcataacaaatctgaaagacaacttgaatttgaac

SEQ ID NO: 24839 - DNA, 71 bp, chicken (Gallus Gallus)
  misc_feature (36): n=a or g
ttcaagtacacctggacttttttatacttcttccantcttcaagtaatggtttccagacaagttcttataa

SEQ ID NO: 24840 - DNA, 71 bp, chicken (Gallus Gallus)
  misc_feature (36): n=a or t
aaaaagactaattactgtttactcgtggtaaagtantttaaacatacccacacagccttttttgactccta

SEQ ID NO: 24841 - DNA, 71 bp, chicken (Gallus Gallus)
  misc_feature (36): n=c or t
cagcattaggtttttggatgccttccttggacttgngccctgaactcactttaaaccccatttaagattcc

SEQ ID NO: 24842 - DNA, 71 bp, chicken (Gallus Gallus)
  misc_feature (36): n=a or g
gttgatgtgatgtttttcatctcctactacctactntaccactgaccagtatagacaccatagctttagtt

SEQ ID NO: 24843 - DNA, 71 bp, chicken (Gallus Gallus)
  misc_feature (36): n=g or t
cagactcacttcaccttttcagctaaacccaaaaanaaacaactgaacacagagggtaacaccattaaaac

SEQ ID NO: 24844 - DNA, 71 bp, chicken (Gallus Gallus)
  misc_feature (36): n=a or g
tatctgccctcgaaaagctgcttttaactacttcangctacagcctggtgtactgaggtacactggactta

SEQ ID NO: 24845 - DNA, 71 bp, chicken (Gallus Gallus)
  misc_feature (36): n=c or t
aaattttaaattttaccaaaggagggaaactgttanacgataattttgcttaagaaattaaacatgtattt

SEQ ID NO: 24846 - DNA, 71 bp, chicken (Gallus Gallus)
  misc_feature (36): n=a or g
attatcttagaaatcgatgtgctgaaacgttgttcntgtattttcttcttttcttcttttcttcattctca

SEQ ID NO: 24847 - DNA, 71 bp, chicken (Gallus Gallus)
  misc_feature (36): n=c or t
caaatgcaaagcaggtttttttagtactaggatcantttcttcaaattgtttcatcaggaccatttcatca

SEQ ID NO: 24848 - DNA, 71 bp, chicken (Gallus Gallus)
  misc_feature (36): n=c or t
aattggaaaatgatgtatgaactgattttgtttgtnggcatgaaataacaagtgagataacaaacttcttt

SEQ ID NO: 24849 - DNA, 71 bp, chicken (Gallus Gallus)
  misc_feature (36): n=a or g
agtctatcctatcccagagatagagtagaaacgtgntctgattgaaagagaggttttagaaagagagacaa

SEQ ID NO: 24850 - DNA, 71 bp, chicken (Gallus Gallus)
  misc_feature (36): n=g or t
gtgttgggatgttcctggccaaactttttagacgtnagtttctctgaggatttcatcctgaatctcgttgt

SEQ ID NO: 24851 - DNA, 71 bp, chicken (Gallus Gallus)
  misc_feature (36): n=c or t
caccctgctgaccacgcatcttttgttgcagactangatgcagttgcctctctgggctgtgagggcacatt

SEQ ID NO: 24852 - DNA, 71 bp, chicken (Gallus Gallus)
  misc_feature (36): n=c or t
gcaagacatggccggggcaccaagatttgtagtcanggtgacggataaacaagggcctcttgaagtatttt

SEQ ID NO: 24853 - DNA, 71 bp, chicken (Gallus Gallus)
  misc_feature (36): n=a or t
tgtttgtttgtttgtttgtttgtttgttttaactangtgccaggaaattaaggcttgtgaggaacaacaga

SEQ ID NO: 24854 - DNA, 71 bp, chicken (Gallus Gallus)
  misc_feature (36): n=a or t
tttaactggatttatggagactggaagtactgcagntataccaggtgtttatccagagtgatatttatgca

SEQ ID NO: 24855 - DNA, 71 bp, chicken (Gallus Gallus)
  misc_feature (36): n=a or g
tctttaaaaattactgtgcttgaactattaattatnatttgtaaccttcaggcttcttgctaaaaagctca

SEQ ID NO: 24856 - DNA, 71 bp, chicken (Gallus Gallus)
  misc_feature (36): n=a or g
aagttaaagttgggagctagagttgtgtgatacagnagaaaatcctgtgcttaagaataatctacatgtgt

SEQ ID NO: 24857 - DNA, 71 bp, chicken (Gallus Gallus)
  misc_feature (36): n=a or g
agaaaattgcttggttttggctgtttgtgcccctcngactgctttgctgtgggtcagacgagctccagtgc

SEQ ID NO: 24858 - DNA, 71 bp, chicken (Gallus Gallus)
  misc_feature (36): n=a or g
gatattctaccaggaatcacagacagagcaaactgngggagatacatcgtgtctgtccgaacaatatgtat

SEQ ID NO: 24859 - DNA, 71 bp, chicken (Gallus Gallus)
  misc_feature (36): n=g or t
ctggttcctgcttaagtttttcaaaaaggctgttgntatcatccaggtcatctttgctgaatattttggtc

SEQ ID NO: 24860 - DNA, 71 bp, chicken (Gallus Gallus)
  misc_feature (36): n=c or t
ttgttatccagctaataagtagctgcttattcctanttttaaactactagatctaataagggttgtatgtt

SEQ ID NO: 24861 - DNA, 71 bp, chicken (Gallus Gallus)
  misc_feature (36): n=a or c
agaacagcttttaaaatacggtgaatcgtagatggnatgctcttcagtggaagaactgtgagtcaccccat

SEQ ID NO: 24862 - DNA, 71 bp, chicken (Gallus Gallus)
  misc_feature (36): n=c or t
gcccagctctttcatcaccagcatcttctaacacangttgtctctctcttctcaccccctttttactcctc

SEQ ID NO: 24863 - DNA, 71 bp, chicken (Gallus Gallus)
  misc_feature (36): n=c or g
cctatggcagtaggaatgttttgtatacatactttnagttgctgtaaaactggtactgctgaatccagaaa

SEQ ID NO: 24864 - DNA, 71 bp, chicken (Gallus Gallus)
  misc_feature (36): n=a or g
tgtattggaactggtgaagggtctggtaaattacanagcaaactgaacttttgcgttatccttgctatggc

SEQ ID NO: 24865 - DNA, 71 bp, chicken (Gallus Gallus)
  misc_feature (36): n=a or g
ccacaagcataagaattagcccacaggtaagaagtnccacttgggaataccccacgtggcctcgaggaacc

SEQ ID NO: 24866 - DNA, 71 bp, chicken (Gallus Gallus)
  misc_feature (36): n=c or t
gacctgcgtaaacgtcacagcaatgtaaacaaatantgaggtagtgttaatgaacaagcctttccccttct

SEQ ID NO: 24867 - DNA, 71 bp, chicken (Gallus Gallus)
  misc_feature (36): n=c or t
tctattctgaaagtggcatagcaaaaagatggtttngctaacattataagcttgctggaaatgctttgctg

SEQ ID NO: 24868 - DNA, 71 bp, chicken (Gallus Gallus)
  misc_feature (36): n=c or t
aataggtctaattcaactggctgtgatcagttctcnttcctagtattagttcctattttggccagaattca

SEQ ID NO: 24869 - DNA, 71 bp, chicken (Gallus Gallus)
  misc_feature (36): n=a or g
atatagtgttcctcagaggaaactggtagactcacnttttggcaagaaggccaggaatgcggtacatccat

SEQ ID NO: 24870 - DNA, 71 bp, chicken (Gallus Gallus)
  misc_feature (36): n=c or t
ttatgtggaaaatagtaaatctgagaaattgtgccntttggtttcttcttattttgctcatatttgcatac

SEQ ID NO: 24871 - DNA, 71 bp, chicken (Gallus Gallus)
  misc_feature (36): n=a or t
gttaagaatactttccttaagtctggaaggttttanagtcagtgtaagagatatttaaaatatgtatttaa

SEQ ID NO: 24872 - DNA, 71 bp, chicken (Gallus Gallus)
  misc_feature (36): n=c or t
agagtttctttaggtttatctatctgtagtagatanaaatttgaatcttgcaccctgctttatgaaactga

SEQ ID NO: 24873 - DNA, 71 bp, chicken (Gallus Gallus)
  misc_feature (36): n=c or t
tctttttctctcttccccctccaggcaccagagtcntataagaatgtgacagatgtcgttaatacctgcca

SEQ ID NO: 24874 - DNA, 71 bp, chicken (Gallus Gallus)
  misc_feature (36): n=a or t
tttcagcttacgaggcagttcagtaaaaaaaaaaanttcactttcagtaatttttcttccttctaaattgc

SEQ ID NO: 24875 - DNA, 71 bp, chicken (Gallus Gallus)
  misc_feature (36): n=c or t
acagtatccatggtgcttatgatattggttatccanttactttttgctgctccctttttttattctaccta

SEQ ID NO: 24876 - DNA, 71 bp, chicken (Gallus Gallus)
  misc_feature (36): n=a or g
atcttcttttaaaaataaaaagaaatgaatgcatantatttgtctttttactacataactattgaatcatt

SEQ ID NO: 24877 - DNA, 71 bp, chicken (Gallus Gallus)
  misc_feature (36): n=a or g
acgtatctgagcatgattaaattccacaggaaaacntacatatctccctggccccagtgttggttcctgtt

SEQ ID NO: 24878 - DNA, 71 bp, chicken (Gallus Gallus)
  misc_feature (36): n=a or g
tgcaaaacacttttgcccatgcgaaggtctgtgtgngttctgcagggatctctcacaaaaacattctcaga

SEQ ID NO: 24879 - DNA, 71 bp, chicken (Gallus Gallus)
  misc_feature (36): n=c or t
gacgtgattgccttaacgatgataccaatggacatnccccgccctgaactgcggtggacaggtgcaaaggt

SEQ ID NO: 24880 - DNA, 71 bp, chicken (Gallus Gallus)
  misc_feature (36): n=a or g
ggcactcaactgtattaatgttctactgtactcatntagtagatgtcagcaatgtaaggaaaattgcagtt

SEQ ID NO: 24881 - DNA, 71 bp, chicken (Gallus Gallus)
  misc_feature (36): n=c or t
tgtccttgtactttttcagaagtaaaatttactccntagtatcctatgaccacttacagaagataaataca

SEQ ID NO: 24882 - DNA, 71 bp, chicken (Gallus Gallus)
  misc_feature (36): n=c or t
tgggttgtgggaaatgaactactgtggtgctcttgnctaccgtgcaatatttcaggaattaaaataacaga

SEQ ID NO: 24883 - DNA, 71 bp, chicken (Gallus Gallus)
  misc_feature (36): n=c or t
aagattgcttactcctcccacagcctcagatcaaanggaataataaagccataaagatgctggcataagga

SEQ ID NO: 24884 - DNA, 71 bp, chicken (Gallus Gallus)
  misc_feature (36): n=c or t
catctgcttcaggatgtgggtggctagctaggaacntctgggatgaatgagaaaaacacatgcatcttgac

SEQ ID NO: 24885 - DNA, 71 bp, chicken (Gallus Gallus)
  misc_feature (36): n=a or g
cttatccaggaggcctctgacaacatatttggtccncttatggggctgacatagaagctttttcaggtacc

SEQ ID NO: 24886 - DNA, 71 bp, chicken (Gallus Gallus)
  misc_feature (36): n=c or t
tgttggcatgcaattctctgagaaatcctaaaacangaaacccaaagagcaacaggtcagtgaaaggagaa

SEQ ID NO: 24887 - DNA, 71 bp, chicken (Gallus Gallus)
  misc_feature (36): n=c or t
gtgtggccttccacctgcccagagttaggggtttgnaacagaaggatgaagtaaatcagcaccttgggtgt

SEQ ID NO: 24888 - DNA, 71 bp, chicken (Gallus Gallus)
  misc_feature (36): n=c or t
tacacagcctaaaagtaaggcacgctttaagaaaangaagcccctttgtaaggaatatccttcattcctct

SEQ ID NO: 24889 - DNA, 71 bp, chicken (Gallus Gallus)
  misc_feature (36): n=g or t
tttcatgtattgttagcataaaataaaatagtttcnaagtcccttctagcctatctggtgagtccgttctt

SEQ ID NO: 24890 - DNA, 71 bp, chicken (Gallus Gallus)
  misc_feature (36): n=a or g
ccttgtgtcattgagatggatggctgaaaatctacntgctaggtttcccaacatagccagccacctttcta

SEQ ID NO: 24891 - DNA, 71 bp, chicken (Gallus Gallus)
  misc_feature (36): n=c or t
cctttaggtggaagtcgtcattgataaaaacaaacngcttgtagaagctcttaaatgtgtcacctgtgagg

SEQ ID NO: 24892 - DNA, 71 bp, chicken (Gallus Gallus)
  misc_feature (36): n=c or t
aaaagcatctcctcaaaatagaaaccccaagttgangctcctctaaatataatatacaagtagaagagcca

SEQ ID NO: 24893 - DNA, 71 bp, chicken (Gallus Gallus)
  misc_feature (36): n=a or g
aatttttaccttcaaatgctaggcatgatactccangttgcagtatttcttagccaagccgtagtcacaac

SEQ ID NO: 24894 - DNA, 71 bp, chicken (Gallus Gallus)
  misc_feature (36): n=c or t
gcataatgctgaatcttttaatttctctcagtagcngttctgcttccatttcttaaaggcaatattagaac

SEQ ID NO: 24895 - DNA, 71 bp, chicken (Gallus Gallus)
  misc_feature (36): n=c or t
atcagcatggccccaacaatgttcctttgggaatgnctggcactgtgaccatttgattcttgggtttttcc

SEQ ID NO: 24896 - DNA, 71 bp, chicken (Gallus Gallus)
  misc_feature (36): n=c or t
atggatggaagcttcaggttgtaatgtttagatcancaggcacagaaaatgtcctgtgctaaactggatcc

SEQ ID NO: 24897 - DNA, 71 bp, chicken (Gallus Gallus)
  misc_feature (36): n=a or g
agcacctaactgaacattttaacacaaacccaaatncattaacttaactgaaagagggcttaggtaaatcc

SEQ ID NO: 24898 - DNA, 71 bp, chicken (Gallus Gallus)
  misc_feature (36): n=g or t
gctactcagttttttgacaggacttcttagtcaatntatcgcatcagtatgagacaggtgtaaaaactgat

SEQ ID NO: 24899 - DNA, 71 bp, chicken (Gallus Gallus)
  misc_feature (36): n=g or t
tgattacttgctcttgctgagcagtggaaaaaaatnttggattaaaaagtacaataatagaactatcttgc

SEQ ID NO: 24900 - DNA, 71 bp, chicken (Gallus Gallus)
  misc_feature (36): n=a or g
acacagcatgtacagaaataaaaaaattcaaccacncaatctgagttaacacctatttgcagtatttaaat

SEQ ID NO: 24901 - DNA, 71 bp, chicken (Gallus Gallus)
  misc_feature (36): n=c or t
gacatctggtcagaaaagaacttcaggctgcccaangaagaagcctggttggcacttccactggaacttat

SEQ ID NO: 24902 - DNA, 71 bp, chicken (Gallus Gallus)
  misc_feature (36): n=a or c
catggggaaagggtctttatgtgcagatgctgttanaaaactggaaattctggaacattccaagtaggctt

SEQ ID NO: 24903 - DNA, 71 bp, chicken (Gallus Gallus)
  misc_feature (36): n=c or t
tcaacaaatgctgcagccatctgagatttcatgtgnacgcagcgaggtgcagaagtatatttccaaaaatg

SEQ ID NO: 24904 - DNA, 71 bp, chicken (Gallus Gallus)
  misc_feature (36): n=c or t
tcctcgatgtacctcccacaggctacgtgggagcanttcagacaagcccagattgattcagttgtctggca

SEQ ID NO: 24905 - DNA, 71 bp, chicken (Gallus Gallus)
  misc_feature (36): n=c or t
aatacaactgtgttgagaatagaagtatataccttncgattgttcaggatggatgtctgcctatctgtaac

SEQ ID NO: 24906 - DNA, 71 bp, chicken (Gallus Gallus)
  misc_feature (36): n=a or g
aaatcttaagttctaacttcatagtgtagacagaanaggagcaccaattaaaaaacttgtggctgtcaaga

SEQ ID NO: 24907 - DNA, 71 bp, chicken (Gallus Gallus)
  misc_feature (36): n=c or t
caatcatttaagacccacagctggctttaggttcancctaataatgacaattcaggatgctttaaagaaaa

SEQ ID NO: 24908 - DNA, 71 bp, chicken (Gallus Gallus)
  misc_feature (36): n=a or g
ttaacaatagtccattaatttgaggtctaataacantaatgatcccagagaaaagatggtctataatttac

SEQ ID NO: 24909 - DNA, 71 bp, chicken (Gallus Gallus)
  misc_feature (36): n=a or g
tttccaactatctcttgacctaataaaatatgttanttgtccctcaaaaatttaatatgcagtattctaaa

SEQ ID NO: 24910 - DNA, 71 bp, chicken (Gallus Gallus)
  misc_feature (36): n=c or t
tagcttcacctagcaaggaaacacacacaaaacctntgtcttttggagaaaagtaccttaacagaagtatt

SEQ ID NO: 24911 - DNA, 71 bp, chicken (Gallus Gallus)
  misc_feature (36): n=c or t
accccatttgcatcccagtccccttataaatctccntttatacacgaacagtcctccctgggctcacagta

SEQ ID NO: 24912 - DNA, 71 bp, chicken (Gallus Gallus)
  misc_feature (36): n=a or g
tctgttgtggatctggctacccaaagttttgtcttngcagctattctgacgtatttgcaacaggaggtaaa

SEQ ID NO: 24913 - DNA, 71 bp, chicken (Gallus Gallus)
  misc_feature (36): n=c or t
tgtactgagtgctattagccatgaatcagggacctncaactctggtttcacttaagaaaagaaaaagaact

SEQ ID NO: 24914 - DNA, 71 bp, chicken (Gallus Gallus)
  misc_feature (36): n=a or g
acagagaccagggcaatgcaggcgcccacatcctgnaaagcaaggtaaaatcctttttttgttagaggccc

SEQ ID NO: 24915 - DNA, 71 bp, chicken (Gallus Gallus)
  misc_feature (36): n=a or g
aactgttgtatgcaccgagagttttttgattttgtncaaagtccttcactagtaagttatagtaaacagtt

SEQ ID NO: 24916 - DNA, 71 bp, chicken (Gallus Gallus)
  misc_feature (36): n=c or t
cccttctcttgctgaaagcaattagaggaaagcatngcttccgatcggctctcctccaaaagtggaaacaa

SEQ ID NO: 24917 - DNA, 71 bp, chicken (Gallus Gallus)
  misc_feature (36): n=a or g
tggctgctcacatgagtaaaacctcagcgctatgantatgaactacagcccaggtctgaacaccactggaa

SEQ ID NO: 24918 - DNA, 71 bp, chicken (Gallus Gallus)
  misc_feature (36): n=a or g
ttacacagtattttagctttgtgttaacggtttcanactgcctgctgctagctgtaacggcatatgaccag

SEQ ID NO: 24919 - DNA, 71 bp, chicken (Gallus Gallus)
  misc_feature (36): n=c or g
gttccagctatttctggactttctgtatggaaaagnatatttcagcctggaagcaaacagaggtagcaaca

SEQ ID NO: 24920 - DNA, 71 bp, chicken (Gallus Gallus)
  misc_feature (36): n=c or t
ttatttcaatcagtttcttaatctacaatgaaacanaggtaacagcactcacctcctcacttaactttcta

SEQ ID NO: 24921 - DNA, 71 bp, chicken (Gallus Gallus)
  misc_feature (36): n=c or t
accttatgtaagagaacattaccttaacttttttgnttaaaatagcagtgagattaaggtaattctggttt

SEQ ID NO: 24922 - DNA, 71 bp, chicken (Gallus Gallus)
  misc_feature (36): n=a or g
tccagcacctcaccactctcatagtaaagaaatacntacaactgcatttattatcagtgctgtttaatgct

SEQ ID NO: 24923 - DNA, 71 bp, chicken (Gallus Gallus)
  misc_feature (36): n=c or t
ccagagatttaaatacttaagtatgagctagatatnctaaataccacttcatgtattgatttcaaacagtg

SEQ ID NO: 24924 - DNA, 71 bp, chicken (Gallus Gallus)
  misc_feature (36): n=c or t
agctggagcctgtgacatcactctccacctccccangctctggtctaataaaagttatttcacagttcttg

SEQ ID NO: 24925 - DNA, 71 bp, chicken (Gallus Gallus)
  misc_feature (36): n=g or t
aggtaaatccatctgaattatttttgtagtgaatanattaagttggatatctaaaataaacttgaaagtag

SEQ ID NO: 24926 - DNA, 71 bp, chicken (Gallus Gallus)
  misc_feature (36): n=c or t
ggctgagggggctttgaggtcccttccatccttatncattctatgtatgttgctccgaaagaaatgcctcc

SEQ ID NO: 24927 - DNA, 71 bp, chicken (Gallus Gallus)
  misc_feature (36): n=a or t
atactgtactttcagtaccggaacctacaattcttnaaggtttttaaaactactcagaattgcaagagata

SEQ ID NO: 24928 - DNA, 71 bp, chicken (Gallus Gallus)
  misc_feature (36): n=a or c
ttactgaacattaattccagccttttcctgaagcancttcaccatgcaagtaaatagctatactaggcaga

SEQ ID NO: 24929 - DNA, 71 bp, chicken (Gallus Gallus)
  misc_feature (36): n=c or t
ttgattctttcaattctgtcattatgatagcagttncatcatctaatttccagttttttggaggtctctgc

SEQ ID NO: 24930 - DNA, 71 bp, chicken (Gallus Gallus)
  misc_feature (36): n=c or t
tgccttctgaaggttgtgtgacacacctatcaaacncacactgatatttcaaatgctctaaggcatctcag

SEQ ID NO: 24931 - DNA, 71 bp, chicken (Gallus Gallus)
  misc_feature (36): n=a or g
agctgtaaagtcttatgtattttcaactgctgtagnatttgtaaataaatataatatattatatttactat

SEQ ID NO: 24932 - DNA, 71 bp, chicken (Gallus Gallus)
  misc_feature (36): n=a or g
aaactatctcataagatggaaagactgaacgctgcncacagcccagtcattcccaaaagactgttttctcc

SEQ ID NO: 24933 - DNA, 71 bp, chicken (Gallus Gallus)
  misc_feature (36): n=c or g
cttgctgtgatggagtgttgctggcttatggtcagnatgttgtccaccaggaccccgaggttcttcctctc

SEQ ID NO: 24934 - DNA, 71 bp, chicken (Gallus Gallus)
  misc_feature (36): n=a or c
gcaaaagggctttatgcaacgtctctgtggttcagntgtacttaattgtgttcccacatcataaggctgat

SEQ ID NO: 24935 - DNA, 71 bp, chicken (Gallus Gallus)
  misc_feature (36): n=g or t
caaaatggtctctagactacatcactacataggatnttgtgggtgggaacaacagctcctgcatatgctct

SEQ ID NO: 24936 - DNA, 71 bp, chicken (Gallus Gallus)
  misc_feature (36): n=a or g
tcaaaatttggtattgcttcagttaatgaaaagggnactaaaaacatcatcggtattaaatgtttgttctt

SEQ ID NO: 24937 - DNA, 71 bp, chicken (Gallus Gallus)
  misc_feature (36): n=c or t
ttaagcatctattactgaactttgttgcctttttangggacctgaatgtctgccattttgttttcgagaga

SEQ ID NO: 24938 - DNA, 71 bp, chicken (Gallus Gallus)
  misc_feature (36): n=c or t
ttgatgcctctcaaacaagatgctgtccctcacatncccaagggaatgagtttcagaaaacagtttccagt

SEQ ID NO: 24939 - DNA, 71 bp, chicken (Gallus Gallus)
  misc_feature (36): n=a or g
agctactatctgttgcatttgaattctcacagattnactcctttggaacagctttggctaataagctttgg

SEQ ID NO: 24940 - DNA, 71 bp, chicken (Gallus Gallus)
  misc_feature (36): n=c or g
ttcctttcttgctagcctgaacgtgtcttttgactnttgtagtcatagatttgctggaggcggtagcgtag

SEQ ID NO: 24941 - DNA, 71 bp, chicken (Gallus Gallus)
  misc_feature (36): n=a or c
gctacacctcatatgccacctagtggcttctgaagnaggaaattccttactgaacatgattttagactccc

SEQ ID NO: 24942 - DNA, 71 bp, chicken (Gallus Gallus)
  misc_feature (36): n=a or g
tagtttaaggcacaaacaggtaagactagtttgtgngctgcagaggtaaatagtcgttttaaatacaggat

SEQ ID NO: 24943 - DNA, 71 bp, chicken (Gallus Gallus)
  misc_feature (36): n=c or t
tgggggcagcagaggaaagattgcaaagcagttgcngggctgagcgctggtcggggaggtgcagtggggaa

SEQ ID NO: 24944 - DNA, 71 bp, chicken (Gallus Gallus)
  misc_feature (36): n=a or c
tcttgtgaacatgagaaatgaagttcagtcagaagngtgaaaacttctcacattgcaagcatttgcaggat

SEQ ID NO: 24945 - DNA, 71 bp, chicken (Gallus Gallus)
  misc_feature (36): n=a or g
aaactggcaggctattgaggctgggcacttaaaccngttacactaattgtgcttgtacaaaacaggcaaac

SEQ ID NO: 24946 - DNA, 71 bp, chicken (Gallus Gallus)
  misc_feature (36): n=a or g
aagggggaaaggataaagatgtcagaagagatttgntagagtttgaatgactatgctggtgtgattcaaaa

SEQ ID NO: 24947 - DNA, 71 bp, chicken (Gallus Gallus)
  misc_feature (36): n=c or t
ctatgggcataatttaaactaatcaaatatgctagnttggcaggataactttctcacactttagtaatcta

SEQ ID NO: 24948 - DNA, 71 bp, chicken (Gallus Gallus)
  misc_feature (36): n=a or c
tgtaagcagcatcataatacctgtgatgaagatagnatgtgtaaataaatctgagaggcattggcactttg

SEQ ID NO: 24949 - DNA, 71 bp, chicken (Gallus Gallus)
  misc_feature (36): n=c or t
gttctcagtgcacacgctagtgttatagcatgcttntgtgactgaaaaatctccagttttattagatatat

SEQ ID NO: 24950 - DNA, 71 bp, chicken (Gallus Gallus)
  misc_feature (36): n=c or t
taatgctcacagagagaggtaatgtgtaggactcanccagtgcaacacaccacagggaagtgagtggtaat

SEQ ID NO: 24951 - DNA, 71 bp, chicken (Gallus Gallus)
  misc_feature (36): n=c or t
aaaaattaaggatgtggctcaaacagcctgagagcnaatgaccacagaggtggctgatgtttgtttccttt

SEQ ID NO: 24952 - DNA, 71 bp, chicken (Gallus Gallus)
  misc_feature (36): n=a or g
aaataaaagcaactttgctcctgtatttatgtttangatggcaaagtgatgaagacaaatttccactagac

SEQ ID NO: 24953 - DNA, 71 bp, chicken (Gallus Gallus)
  misc_feature (36): n=a or c
cttaacttcacataatggggagaaaatctctttganaagtattcagtctcttacctggtgctgaatttagt

SEQ ID NO: 24954 - DNA, 71 bp, chicken (Gallus Gallus)
  misc_feature (36): n=a or g
gtctggagcacactgagtgtaactgagcaaggctgnaggtgatttcagagaaggtgccctctcgctttgct

SEQ ID NO: 24955 - DNA, 71 bp, chicken (Gallus Gallus)
  misc_feature (36): n=g or t
atgaattcttggggtatttccaagaggagcctcgantgagagcccggaaacatagatgaagtaagaggacc

SEQ ID NO: 24956 - DNA, 71 bp, chicken (Gallus Gallus)
  misc_feature (36): n=c or t
ggtgttattgagagtgctcccaacaaaagggctaanagttttggttttgctatttcattgttagaactcat

SEQ ID NO: 24957 - DNA, 71 bp, chicken (Gallus Gallus)
  misc_feature (36): n=c or t
tttcccccagttccagggaaatagggctgtattagngatataatttatttcagaatcacattcgaaattca

SEQ ID NO: 24958 - DNA, 71 bp, chicken (Gallus Gallus)
  misc_feature (36): n=g or t
atgggccagtaaaggagtataagaagaaatgagaanactgtagtagagcctttagtccacgtgcttcctga

SEQ ID NO: 24959 - DNA, 71 bp, chicken (Gallus Gallus)
  misc_feature (36): n=a or g
gttttcagacctgacgtttctatcaaagctagaccnagcccaacttcttcattgatgctatcaacttcagg

SEQ ID NO: 24960 - DNA, 71 bp, chicken (Gallus Gallus)
  misc_feature (36): n=c or t
ctcaatgtaaatgtgctgtgatgtcacaggccttanagttccagaagataaatgcttttaaagcagtcaga

SEQ ID NO: 24961 - DNA, 71 bp, chicken (Gallus Gallus)
  misc_feature (36): n=a or g
tgattttttttttcctaagtatcctattttaacagnataagaactgatttcctagtaatattataatagtt

SEQ ID NO: 24962 - DNA, 71 bp, chicken (Gallus Gallus)
  misc_feature (36): n=a or g
tggggcatgcaatgtgaagcaaataactttcctacntgcttttggcttttctctcttttccacgcttttac

SEQ ID NO: 24963 - DNA, 71 bp, chicken (Gallus Gallus)
  misc_feature (36): n=c or t
actggatagaaatgttccagtttacatcagtggagnttccagccacacatcttgataatatttaaggtaat

SEQ ID NO: 24964 - DNA, 71 bp, chicken (Gallus Gallus)
  misc_feature (36): n=g or t
aaaggacagttactgaagatgaattggcaaagacanctctggaaagcctcagcggagggaccagcctgcgt

SEQ ID NO: 24965 - DNA, 71 bp, chicken (Gallus Gallus)
  misc_feature (36): n=a or g
gctgagaatgtccatgtgacaagaactgacagatcntaagaatgaccagttaacccacagtagatttaagt

SEQ ID NO: 24966 - DNA, 71 bp, chicken (Gallus Gallus)
  misc_feature (36): n=a or c
acattagatatgcattttttgagagctcctccaaangtactgcctcctattttattatgttgacccatgat

SEQ ID NO: 24967 - DNA, 71 bp, chicken (Gallus Gallus)
  misc_feature (36): n=c or t
acctctgtctttttgcttttcagagtgtctttgggnaggagaactgagggatgtaagttaacattgcactg

SEQ ID NO: 24968 - DNA, 71 bp, chicken (Gallus Gallus)
  misc_feature (36): n=c or g
tgcaatggaaaaaatctgtgctggttgcatacatancaagtgaaagcccagtattcccagactgaaagctt

SEQ ID NO: 24969 - DNA, 71 bp, chicken (Gallus Gallus)
  misc_feature (36): n=c or t
gacaagaatattttgcaagttcttattaaatgtagngagttgatttgcaacaaattctctactgcatatgc

SEQ ID NO: 24970 - DNA, 71 bp, chicken (Gallus Gallus)
  misc_feature (36): n=c or t
gatatgagcacagtgagatggggaggtggtacgttncagtgatggcagcagctacatgaaagacaaaccat

SEQ ID NO: 24971 - DNA, 71 bp, chicken (Gallus Gallus)
  misc_feature (36): n=c or t
attacctaacaggattcagaaaagaggagctgaatnaatgtcctgcagctgtattcacagatgagcctcca

SEQ ID NO: 24972 - DNA, 71 bp, chicken (Gallus Gallus)
  misc_feature (36): n=a or g
ggattcctaataacttcttaaatcttagtctggggntattttgaattttctggtaggcgtgtaacccattt

SEQ ID NO: 24973 - DNA, 71 bp, chicken (Gallus Gallus)
  misc_feature (36): n=a or g
acccaggtgcaggactttgtgtgtttggtagcatgntaggtgatgttttgatactgcagtttgtattttgt

SEQ ID NO: 24974 - DNA, 71 bp, chicken (Gallus Gallus)
  misc_feature (36): n=c or t
cagtgtgtggtttaacaagctagtttgtctcattantctgtaatacgtcacattgatatgtgacaagaaac

SEQ ID NO: 24975 - DNA, 71 bp, chicken (Gallus Gallus)
  misc_feature (36): n=c or t
gtcttctatcacacagaagaaataaaacaggaaganaagtcccaaaatgtattctcttggttcaggtgtaa

SEQ ID NO: 24976 - DNA, 71 bp, chicken (Gallus Gallus)
  misc_feature (36): n=c or t
aattatattaataagtagcaacagaggagatgtggnccaggcaatccagggaagatctggaaaatgaaaac

SEQ ID NO: 24977 - DNA, 71 bp, chicken (Gallus Gallus)
  misc_feature (36): n=a or g
acatgtaatttagagcatcagtacagcagacataanaacatacacctcttctttctggaaaaagaaaaaaa

SEQ ID NO: 24978 - DNA, 71 bp, chicken (Gallus Gallus)
  misc_feature (36): n=a or g
taaccccctgtgagatagatgaagggattttgcacnttgctctggcctgtgactttgcattgtttgtgaag

SEQ ID NO: 24979 - DNA, 71 bp, chicken (Gallus Gallus)
  misc_feature (36): n=c or t
tcttatctagcaggcacagctgtcacataacgaaangcttttatttatgttgtctctggctagaaatatta

SEQ ID NO: 24980 - DNA, 71 bp, chicken (Gallus Gallus)
  misc_feature (36): n=c or g
caatatttgttacgtttacatccgtgtgtgaatttnaaaaggtctcttttataatttctcttatttttgtc

SEQ ID NO: 24981 - DNA, 71 bp, chicken (Gallus Gallus)
  misc_feature (36): n=c or t
ctgcagtaagaacacagctgctgcggtgcatctttnctgctggactttttgttctgctccaaagagttccc

SEQ ID NO: 24982 - DNA, 71 bp, chicken (Gallus Gallus)
  misc_feature (36): n=a or g
taaataggtttgttctgtagaaggcatatttcttancaagtgcctgtctggcaaatcaggccttacatttt

SEQ ID NO: 24983 - DNA, 71 bp, chicken (Gallus Gallus)
  misc_feature (36): n=c or t
atttaaatttgagtcttcgatttctctacaaaatanatttttccttggatgatgtgacagtaaatcatgcg

SEQ ID NO: 24984 - DNA, 71 bp, chicken (Gallus Gallus)
  misc_feature (36): n=c or t
tggggtttatttcttagccaggtttcctaggaaggngaagtatattgagtcaaactatcactccctctaat

SEQ ID NO: 24985 - DNA, 71 bp, chicken (Gallus Gallus)
  misc_feature (36): n=a or g
ttcatactgcatacttgggggattgaattccagccnttgtttcatttttggaccaaaatgaaatagtttgc

SEQ ID NO: 24986 - DNA, 71 bp, chicken (Gallus Gallus)
  misc_feature (36): n=g or t
accacgcatcctccccagcatcttctctcagacagnggccacagattctaagactggagaagtgctgcagg

SEQ ID NO: 24987 - DNA, 71 bp, chicken (Gallus Gallus)
  misc_feature (36): n=g or t
ccctaaagaaaaatcatgtgaggggcaggaggcctnagggacacttggtcacctctgaagcatgtccttgg

SEQ ID NO: 24988 - DNA, 71 bp, chicken (Gallus Gallus)
  misc_feature (36): n=c or g
acaccaatgcacacagcatggataagcaggacaagntagaaaccctgatgcacttggaaaattatgatctg

SEQ ID NO: 24989 - DNA, 71 bp, chicken (Gallus Gallus)
  misc_feature (36): n=a or g
caatgagacatctgataggaaatcaatgataaagcnatgatactgtagcaaaaagcactgcatatgtgtat

SEQ ID NO: 24990 - DNA, 71 bp, chicken (Gallus Gallus)
  misc_feature (36): n=a or g
gcagctcatcacactgcccaagtggttaactccacnttgaaatcctaactcagaagctgctctgttctgga

SEQ ID NO: 24991 - DNA, 71 bp, chicken (Gallus Gallus)
  misc_feature (36): n=a or g
tccataccatatgacatcatatggaaaaacctgaangcggtggggaaatggcctggcaggagctgcttggg

SEQ ID NO: 24992 - DNA, 71 bp, chicken (Gallus Gallus)
  misc_feature (36): n=c or g
gatggggcagttgcatgcaggagcactgggttcctncactgagacactgagccgactaaagagcagcagag

SEQ ID NO: 24993 - DNA, 71 bp, chicken (Gallus Gallus)
  misc_feature (36): n=c or t
tctgcctcaccttcatgactgtaatctccaaaaacngacttctcacataccttcttattgagtgagagaaa

SEQ ID NO: 24994 - DNA, 71 bp, chicken (Gallus Gallus)
  misc_feature (36): n=a or t
tccatacagaaaggaataataattaaaaaaaaaaanagtgtaaatgcacacagattagaattgctgaatta

SEQ ID NO: 24995 - DNA, 71 bp, chicken (Gallus Gallus)
  misc_feature (36): n=c or t
tcattatttgttctgcttgtattttaggaaacatangaaaaactactaaacgttcagaaacatcaagacca

SEQ ID NO: 24996 - DNA, 71 bp, chicken (Gallus Gallus)
  misc_feature (36): n=c or t
gctgagggtaaggcaagcaattgttcctcaccttgnatcttgccctccaaaatctgtcatctcacagtact

SEQ ID NO: 24997 - DNA, 71 bp, chicken (Gallus Gallus)
  misc_feature (36): n=c or t
ggatttatgtgttgtacgattaggaaaccccagganagggatggtatgtaggttttatggctgcttggggt

SEQ ID NO: 24998 - DNA, 71 bp, chicken (Gallus Gallus)
  misc_feature (36): n=a or g
cagggaaggccatatccttcgaccttatgcctctgngccatttattgctggccgctttcgtttgccacaac

SEQ ID NO: 24999 - DNA, 71 bp, chicken (Gallus Gallus)
  misc_feature (36): n=c or g
ttcattgtattcccaaaggaggcttacgcagccggnaaagatctttcctggcagtctgggagtaaccagaa

SEQ ID NO: 25000 - DNA, 71 bp, chicken (Gallus Gallus)
  misc_feature (36): n=g or t
ccttccaagccttactgtgattctcaccagtctatnaagagatgcacaagatctgacaagactctgggcgg

SEQ ID NO: 25001 - DNA, 71 bp, chicken (Gallus Gallus)
  misc_feature (36): n=c or t
aaaatggcttacattgctctggcattttattatacngtttgcataaaaaataagctcatacctatttgcct

SEQ ID NO: 25002 - DNA, 71 bp, chicken (Gallus Gallus)
  misc_feature (36): n=c or g
cagcacagatgctgtggcatgtctgcacagatactncaggctcacaggaggtcagtgaagtctgctgtaca

SEQ ID NO: 25003 - DNA, 71 bp, chicken (Gallus Gallus)
  misc_feature (36): n=a or g
atccaaccatctgttggaaggggagactactgctcngttgggaactccacatttagccagtagtgctgtat

SEQ ID NO: 25004 - DNA, 71 bp, chicken (Gallus Gallus)
  misc_feature (36): n=c or g
catgaactcaagagattatgcataactattttctcngggtgataaatcctgtccatatattttctgtaata

SEQ ID NO: 25005 - DNA, 71 bp, chicken (Gallus Gallus)
  misc_feature (36): n=c or t
gctttctgtgtcccgatgaggctctaactatgtacnccgttaagagtcagtggagatccgaagtgctgtaa

SEQ ID NO: 25006 - DNA, 71 bp, chicken (Gallus Gallus)
  misc_feature (36): n=a or c
ttgggtatttctttcaaagggaaaactaaaaaaaancatgaggccttgttcatctctgccaaaaaagcata

SEQ ID NO: 25007 - DNA, 71 bp, chicken (Gallus Gallus)
  misc_feature (36): n=c or t
agtctctgcccagtggcagatgcattaaatagttangccaagtgctacaggagcagaactcatgatcattg

SEQ ID NO: 25008 - DNA, 71 bp, chicken (Gallus Gallus)
  misc_feature (36): n=c or t
ctgcttcctcactttgaatcattagatatttccatnaaacatcttgcacagctttattttggctctcaggt

SEQ ID NO: 25009 - DNA, 71 bp, chicken (Gallus Gallus)
  misc_feature (36): n=a or g
ggtaaaataaatcagcacagctaaagacttggtttncatgtagaaagatcgtgaaaatagctacattctgc

SEQ ID NO: 25010 - DNA, 71 bp, chicken (Gallus Gallus)
  misc_feature (36): n=c or t
ctgcctgacgaaaggctgcaactatagaaaaaatanggaaactaaaaagataaaatgtaggaatagctccc

SEQ ID NO: 25011 - DNA, 71 bp, chicken (Gallus Gallus)
  misc_feature (36): n=a or g
agtttcagccactaaagaaaaatacaataactaacnaagagcacttaatacagaggcacagactacctatg

SEQ ID NO: 25012 - DNA, 71 bp, chicken (Gallus Gallus)
  misc_feature (36): n=a or c
tcccgcttggatgaaggaatttaagaacaggtttcnggacttccaaaaaaattgataattttttttgtata

SEQ ID NO: 25013 - DNA, 71 bp, chicken (Gallus Gallus)
  misc_feature (36): n=c or t
acagatgtgtgaatgttatgtatgtttctcttctgntttatctttttcaggatcttttagtacactataca

SEQ ID NO: 25014 - DNA, 71 bp, chicken (Gallus Gallus)
  misc_feature (36): n=c or g
tcagcacacaaagcaagaaaaccatctgtgaagggnctctgaaacatgggatctagccaaagaacagcagc

SEQ ID NO: 25015 - DNA, 71 bp, chicken (Gallus Gallus)
  misc_feature (36): n=a or g
aaagtgtgagacaaaaatgaagcaaagagaccccanaatagttttctgctgtggtaacttgacagggtata

SEQ ID NO: 25016 - DNA, 71 bp, chicken (Gallus Gallus)
  misc_feature (36): n=a or g
aaaacaatctgaacactactgaatggacagctttcnttctattgttcgcataataacatgaagtttgcttc

SEQ ID NO: 25017 - DNA, 71 bp, chicken (Gallus Gallus)
  misc_feature (36): n=a or g
gtatctgacgcaatctacaacaaagagagaaaaatnttttcctgcaataacctacatgacaatcaaaacca

SEQ ID NO: 25018 - DNA, 71 bp, chicken (Gallus Gallus)
  misc_feature (36): n=c or t
agtcataaccagaaagctatgtctaaaccagaaatnttctttttttctgtgtatatctgaatttataactg

SEQ ID NO: 25019 - DNA, 71 bp, chicken (Gallus Gallus)
  misc_feature (36): n=c or t
tcaaggatttaagatgaaaatagcatcctcactgcnatctgttctttaccataccctacaaacatgctgac

SEQ ID NO: 25020 - DNA, 71 bp, chicken (Gallus Gallus)
  misc_feature (36): n=c or t
gtgaaatcagtacatgttgttaagatttacaaatanacacaaaacctgtccagatgcagatgcacatgtat

SEQ ID NO: 25021 - DNA, 71 bp, chicken (Gallus Gallus)
  misc_feature (36): n=a or t
agatacaggaagaacgttaactttgtaggttgcagnttgtctgtttcaattttgtaccaacagaagaaaat

SEQ ID NO: 25022 - DNA, 71 bp, chicken (Gallus Gallus)
  misc_feature (36): n=a or g
agaagaaatcatgctccactaattaaacataagagnaatcaaccatttcaattaattgtacctgagctttt

SEQ ID NO: 25023 - DNA, 71 bp, chicken (Gallus Gallus)
  misc_feature (36): n=c or t
gaaaaattgatttctttttcctatgcttctgtacanctgcaacctcgattttatgctgcagtttcttctca

SEQ ID NO: 25024 - DNA, 71 bp, chicken (Gallus Gallus)
  misc_feature (36): n=g or t
ttttccaaaatcaccgggataagcttcgaaagtttncttaggttgtatggcaatccctgtatgctggcggc

SEQ ID NO: 25025 - DNA, 71 bp, chicken (Gallus Gallus)
  misc_feature (36): n=a or t
catattagaggtggtactttttgcgattagaaattnaaacaaatagaaatgtttcatttttaccaggattt

SEQ ID NO: 25026 - DNA, 71 bp, chicken (Gallus Gallus)
  misc_feature (36): n=g or t
gactagcatttggagatgcttgttgtacaagaaganaacttgtgatgacggagcccaagctatgggtacat

SEQ ID NO: 25027 - DNA, 71 bp, chicken (Gallus Gallus)
  misc_feature (36): n=a or g
tctcttttccttttagatatgcgtgataaaatgagnaaatggagggaagaaaactaccgaaacagtgagca

SEQ ID NO: 25028 - DNA, 71 bp, chicken (Gallus Gallus)
  misc_feature (36): n=a or g
tagaaatgagtacagagaaagttagaaaatgagganaaatatgtgcatctagtgcaaatcactgtagaaga

SEQ ID NO: 25029 - DNA, 71 bp, chicken (Gallus Gallus)
  misc_feature (36): n=g or t
taaagatggaattgataatgatgattctgtccaganaaattaaaatgggtatatggtttaaactcataatt

SEQ ID NO: 25030 - DNA, 71 bp, chicken (Gallus Gallus)
  misc_feature (36): n=g or t
gcatgtttttggttgtttatatatctatatataganagagagagttatatactacaatgtacaattgcaca

SEQ ID NO: 25031 - DNA, 71 bp, chicken (Gallus Gallus)
  misc_feature (36): n=c or t
ttactgtatcatatcaccaaaataaagccttatggnatctcacgtaagatattgcctggtttggaatctca

SEQ ID NO: 25032 - DNA, 71 bp, chicken (Gallus Gallus)
  misc_feature (36): n=a or g
tgatagctgtatgggagagccaaatttcttccttgncaatcactaaaccccacttgatgatgaacatgcat

SEQ ID NO: 25033 - DNA, 71 bp, chicken (Gallus Gallus)
  misc_feature (36): n=c or t
gtgtaaaggtgaagcactgtcctgttgattcatttntaatccattactggcaggactatgcaaagtatgat

SEQ ID NO: 25034 - DNA, 71 bp, chicken (Gallus Gallus)
  misc_feature (36): n=c or t
ttttatctctggaggtcttgagagataaaaacttgnagtctccagttctgttaagtcagcttcacaattgt

SEQ ID NO: 25035 - DNA, 71 bp, chicken (Gallus Gallus)
  misc_feature (36): n=a or t
aagactgtaccattggcagaagtggcaatgctgctntttaataaagttttccagacacttgcttcttggaa

SEQ ID NO: 25036 - DNA, 71 bp, chicken (Gallus Gallus)
  misc_feature (36): n=a or g
ttgatgctaattcatgaaagtttgggatagtttcantttctttcccacttgttgacagcatgctccagggg

SEQ ID NO: 25037 - DNA, 71 bp, chicken (Gallus Gallus)
  misc_feature (36): n=c or t
cacaagtctggaacagtggctccttttatttttagnaagcgtgggtaccacattaatctgagaagaactgc

SEQ ID NO: 25038 - DNA, 71 bp, chicken (Gallus Gallus)
  misc_feature (36): n=a or t
ctgtctgaaggttgcacccatatctccatattcacngtcatccttgaaaatcagtcttgaagtgtttgcta

SEQ ID NO: 25039 - DNA, 71 bp, chicken (Gallus Gallus)
  misc_feature (36): n=a or g
ctttggttctaattttattctcaaatacaaagagcntcagtattttctaaaagcagacacaagtgcatgcc

SEQ ID NO: 25040 - DNA, 71 bp, chicken (Gallus Gallus)
  misc_feature (36): n=a or t
taagttactgtgttgaacgctttcatgatgatcacncatcagatagcgttttaacacagtgtgagcaattg

SEQ ID NO: 25041 - DNA, 71 bp, chicken (Gallus Gallus)
  misc_feature (36): n=a or g
gaacctgcaccaaccagtagcaccctattagggaancgaaggagtgaataggaggaaccaaagcaagagaa

SEQ ID NO: 25042 - DNA, 71 bp, chicken (Gallus Gallus)
  misc_feature (36): n=a or g
cttagtgcactggcatgtatgtacagcgaggaaaanccacatggatcggagcctgctacatatacagcaga

SEQ ID NO: 25043 - DNA, 71 bp, chicken (Gallus Gallus)
  misc_feature (36): n=a or c
aaaccaagattttgtttgatatcacacatgcaatangttctaccattctctctctttttgtgtctttacca

SEQ ID NO: 25044 - DNA, 71 bp, chicken (Gallus Gallus)
  misc_feature (36): n=a or g
cagacagtgctgccagcaaaatgcaaatgcaagccnataaaaatgtacttggcagcatcccctttaagcac

SEQ ID NO: 25045 - DNA, 71 bp, chicken (Gallus Gallus)
  misc_feature (36): n=a or g
cccacataccgtgcctggggagtgtgcttattttangcccttcttgtcttgggcagttccctttgctcagc

SEQ ID NO: 25046 - DNA, 71 bp, chicken (Gallus Gallus)
  misc_feature (36): n=g or t
ggaaaagaaagtctggagcttaacttttttccacancagtagaacagatctatacttttcaacttgaaaag

SEQ ID NO: 25047 - DNA, 71 bp, chicken (Gallus Gallus)
  misc_feature (36): n=c or t
aagcagccattaggtttaatttgagagacctggagnacattagctgccgttattgaataaacgagcctcgg

SEQ ID NO: 25048 - DNA, 71 bp, chicken (Gallus Gallus)
  misc_feature (36): n=a or t
atttaattttttcttatgttaggaacaattgttgancagattatgagctgtctccaagcagcacgttgtca

SEQ ID NO: 25049 - DNA, 71 bp, chicken (Gallus Gallus)
  misc_feature (36): n=c or t
gccttgtcacacttacggcagcaaaatgaggctggntctccctgtgctacagtatggaggctcttctgctt

SEQ ID NO: 25050 - DNA, 71 bp, chicken (Gallus Gallus)
  misc_feature (36): n=a or c
tgtgaaaatcagactgtgtctcatcctaatcaaagntgtaaccatcatgttaaaatgggtaaaagcacata

SEQ ID NO: 25051 - DNA, 71 bp, chicken (Gallus Gallus)
  misc_feature (36): n=c or t
acaaaatagtatttgaaatgactcagtaagtgctancaggagaactggaatagtcatagtgtaagaagcaa

SEQ ID NO: 25052 - DNA, 71 bp, chicken (Gallus Gallus)
  misc_feature (36): n=a or c
ccttctagctcagtgtttggacagacttttactttnctgtttatggctacatgagcttggcaaaaatagtc

SEQ ID NO: 25053 - DNA, 71 bp, chicken (Gallus Gallus)
  misc_feature (36): n=a or g
gcagcattcaaacatttctgaaatattatgtgtacnttgaaaatatctttgatgcatacctgaggaactga

SEQ ID NO: 25054 - DNA, 71 bp, chicken (Gallus Gallus)
  misc_feature (36): n=c or t
tgtggtttaggatttaatcggaggcatttgcttttngctcagcagcacatcatttttgtttccacagggtg

SEQ ID NO: 25055 - DNA, 71 bp, chicken (Gallus Gallus)
  misc_feature (36): n=a or t
gctttccagcaaacccgctatttggtactttggacnttgggataagcaataaggagtataaagcaattaag

SEQ ID NO: 25056 - DNA, 71 bp, chicken (Gallus Gallus)
  misc_feature (36): n=a or g
tccatttcagttgtcttatccagtggtgcaggtaanaagtttagctttgctggcagtttacctttgtgtat

SEQ ID NO: 25057 - DNA, 71 bp, chicken (Gallus Gallus)
  misc_feature (36): n=c or t
actactacgatttttagcaattttggaaaggtatgnccatggaaaatgtctaccatggatgcacttcaagt

SEQ ID NO: 25058 - DNA, 71 bp, chicken (Gallus Gallus)
  misc_feature (36): n=a or g
ctgttaatattgtcacaagatatgcaaaggtatgtncgtagataagactacttcagggatacacagaaagc

SEQ ID NO: 25059 - DNA, 71 bp, chicken (Gallus Gallus)
  misc_feature (36): n=c or t
taatcataatagtaacagtaataataacaaatgaantgaataaaaaagggccctgaaacatatctttcttt

SEQ ID NO: 25060 - DNA, 71 bp, chicken (Gallus Gallus)
  misc_feature (36): n=c or t
gtgtagacatgctttgtgagatgcaaagcatctganaagcagcattgaaaagtcaaaatgctggttggtat

SEQ ID NO: 25061 - DNA, 71 bp, chicken (Gallus Gallus)
  misc_feature (36): n=a or c
taaactacctcaatcacataactgacgtattttgtnctgtcctagttctggagagcaggacaacaacgctg

SEQ ID NO: 25062 - DNA, 71 bp, chicken (Gallus Gallus)
  misc_feature (36): n=a or t
atggaaatgtgatctctgagtacagttttgtgatcngattggtcaggtacagcagattcaatacctgctcc

SEQ ID NO: 25063 - DNA, 71 bp, chicken (Gallus Gallus)
  misc_feature (36): n=g or t
aaaataaacccttcaattaacgggaaagaatgcagntatggaggctacagtaattattgaaatcaatgaac

SEQ ID NO: 25064 - DNA, 71 bp, chicken (Gallus Gallus)
  misc_feature (36): n=c or t
aacacaacatccaaacattccttgaacacctccagngaattcctctatgaaattggtcttcatgtataaga

SEQ ID NO: 25065 - DNA, 71 bp, chicken (Gallus Gallus)
  misc_feature (36): n=c or t
gatgctacaggaagagctacatatactgtgacctangtttcaccactcaaaataacacaagctgttgttca

SEQ ID NO: 25066 - DNA, 71 bp, chicken (Gallus Gallus)
  misc_feature (36): n=a or t
tgcacaatatggtaaaacttcaccctacagtttcanccaaaaataaacatctatcatgcctcatctgagga

SEQ ID NO: 25067 - DNA, 71 bp, chicken (Gallus Gallus)
  misc_feature (36): n=a or g
tgtatttgcctacaaagacatttgtgcatcaataancagtttctattctgtgttaatgttatactttcagc

SEQ ID NO: 25068 - DNA, 71 bp, chicken (Gallus Gallus)
  misc_feature (36): n=a or g
ggcagctttattgggtggaagtctgtgggttaagcnggcaacagcaattcccactcagtggttctggtgct

SEQ ID NO: 25069 - DNA, 71 bp, chicken (Gallus Gallus)
  misc_feature (36): n=a or t
catatgctaccaatattcccattcatgtcagtcagnccctcacagaataaaacacctcagctcctgaagca

SEQ ID NO: 25070 - DNA, 71 bp, chicken (Gallus Gallus)
  misc_feature (36): n=c or t
gaaaaagatgttccatctacaaagccaggtaggcantcctgcattttatgcgatcattacttttgaaacta

SEQ ID NO: 25071 - DNA, 71 bp, chicken (Gallus Gallus)
  misc_feature (36): n=a or g
gatgtagtaagaggataggaggcaatagaaaatgtnagtttttgatatctgtttgatttggaaatccattc

SEQ ID NO: 25072 - DNA, 71 bp, chicken (Gallus Gallus)
  misc_feature (36): n=a or t
gcagatcattctctactagccagactcagaatcagnatacaaaacttgatggaccacagctctgccagttt

SEQ ID NO: 25073 - DNA, 71 bp, chicken (Gallus Gallus)
  misc_feature (36): n=c or t
cttatgtgctgttcctgacttggtcttagtctgaanttcagtggcaggacccagctcagcagtactggtga

SEQ ID NO: 25074 - DNA, 71 bp, chicken (Gallus Gallus)
  misc_feature (36): n=a or g
tttctagtaagttcagctgtaaaatctaagtgtgcngttgtgcaaatgctccctgtagtcagtggagggtg

SEQ ID NO: 25075 - DNA, 71 bp, chicken (Gallus Gallus)
  misc_feature (36): n=c or g
aaagccccatgataggggatttttattatctggagnaagcttctggttttgaaattggaatgaaaaccatc

SEQ ID NO: 25076 - DNA, 71 bp, chicken (Gallus Gallus)
  misc_feature (36): n=c or t
caaacgtggtccagtgcatgaggagtgataattcantggaaagctccaacgggagctgcaggaccagaggt

SEQ ID NO: 25077 - DNA, 71 bp, chicken (Gallus Gallus)
  misc_feature (36): n=c or g
cagaccatcaagaaacatgctcacaaaagccaagtntcagagtcagcttgggctcctcagcctccttgaag

SEQ ID NO: 25078 - DNA, 71 bp, chicken (Gallus Gallus)
  misc_feature (36): n=c or g
cagagctgccatttctagaagccaaaacgttgtctntttatgaacttaagagtggtttcttcacagattac

SEQ ID NO: 25079 - DNA, 71 bp, chicken (Gallus Gallus)
  misc_feature (36): n=c or t
tggccctactgaaactcatacagttaaccttggccngttgatccagagctatttgcaggagctgaccatcc

SEQ ID NO: 25080 - DNA, 71 bp, chicken (Gallus Gallus)
  misc_feature (36): n=a or c
cctgtaaaactgaatgatgactttcatattccagancaatttctagctattgcctttatgaataatatttg

SEQ ID NO: 25081 - DNA, 71 bp, chicken (Gallus Gallus)
  misc_feature (36): n=c or t
gtcggttcttctgtggaacagtagcaagagctaagntgtgtatcccagagaagaatctctagcagtaaggg

SEQ ID NO: 25082 - DNA, 71 bp, chicken (Gallus Gallus)
  misc_feature (36): n=c or t
accaactgcgcatctccagctcttacaaggctcttncaggctgtgccttgctttatgatgtgtcctttttt

SEQ ID NO: 25083 - DNA, 71 bp, chicken (Gallus Gallus)
  misc_feature (36): n=c or t
tgcccatgcaggagagcccaagggagatccctctcntgagatgaacccaatcccaaaggaacttccactcc

SEQ ID NO: 25084 - DNA, 71 bp, chicken (Gallus Gallus)
  misc_feature (36): n=a or g
tcctgctgagaatgctaaatgcttcattggcctgantggcattaagatcacctctgtgaaatctgagggtt

SEQ ID NO: 25085 - DNA, 71 bp, chicken (Gallus Gallus)
  misc_feature (36): n=c or t
gtatatcctaccaattgtcttacacagcctttgtanccgagtcacaccgcaagacatgtagcagcactgag

SEQ ID NO: 25086 - DNA, 71 bp, chicken (Gallus Gallus)
  misc_feature (36): n=c or t
ttttaatttgaaagagggtagattgagattagatgngtggaagaaattctgtgctactagagtgatgtgat

SEQ ID NO: 25087 - DNA, 71 bp, chicken (Gallus Gallus)
  misc_feature (36): n=a or g
gtagaatgccatcttttcacataacctaatacaganaaggttgcagataagagttggttacttaaaaatgt

SEQ ID NO: 25088 - DNA, 71 bp, chicken (Gallus Gallus)
  misc_feature (36): n=a or g
tacaaaagagactgattaatacaggttcaggctaancttgcatttggtgactctgcactggaagtgtagaa

SEQ ID NO: 25089 - DNA, 71 bp, chicken (Gallus Gallus)
  misc_feature (36): n=a or g
gcatgaatgcaacatgtggaattctggttctcttcncctttgatgccttgcttttagctttgaagttatca

SEQ ID NO: 25090 - DNA, 71 bp, chicken (Gallus Gallus)
  misc_feature (36): n=c or g
gttcactcctctaataagggaaacagaaacgtgtanagttggcatatgttgtgaaggtaatgcatataaag

SEQ ID NO: 25091 - DNA, 71 bp, chicken (Gallus Gallus)
  misc_feature (36): n=a or g
tatttcaattaaagtgcagtcttaataggactactnatgggttttaaaatctattactctcaaagtgttgg

SEQ ID NO: 25092 - DNA, 71 bp, chicken (Gallus Gallus)
  misc_feature (36): n=c or t
tgcctggtctcaagctactgcttcctcctgaattanattggcagattgaggtgagtaggcagggaaaggtg

SEQ ID NO: 25093 - DNA, 71 bp, chicken (Gallus Gallus)
  misc_feature (36): n=g or t
acattcttatctctgagtcaaaaagatatggacttnaaagctggactatttggtggataaagaattggttg

SEQ ID NO: 25094 - DNA, 71 bp, chicken (Gallus Gallus)
  misc_feature (36): n=c or t
atgaagactccagtaacactcaaacaaagaagagtngttgagcacaaccaggtatgtttcatttagtggca

SEQ ID NO: 25095 - DNA, 71 bp, chicken (Gallus Gallus)
  misc_feature (36): n=c or t
taaatacatgcatttccagagtatcatgaagaatangagcttctcctttattgggtagacatttcttctat

SEQ ID NO: 25096 - DNA, 71 bp, chicken (Gallus Gallus)
  misc_feature (36): n=c or t
cggaagggcacgcgcaggagcttgatgggggagttnacccgctggcagccgatggtcagcttgtatacata

SEQ ID NO: 25097 - DNA, 71 bp, chicken (Gallus Gallus)
  misc_feature (36): n=a or t
ctaatgcagagagattagccttttctttcttacagncccaaacttggagatatttgaccatgaacaaaggt

SEQ ID NO: 25098 - DNA, 71 bp, chicken (Gallus Gallus)
  misc_feature (36): n=c or t
agctatctgcttacactgaatgtgaattcatatagnagcacagctaaggtggcaggggggctgctgtggcc

SEQ ID NO: 25099 - DNA, 71 bp, chicken (Gallus Gallus)
  misc_feature (36): n=a or g
ggaaactgccgtagtggagtagtatggggaaagtgnacaaaaggttactgtggtgataaggcttgtcctgt

SEQ ID NO: 25100 - DNA, 71 bp, chicken (Gallus Gallus)
  misc_feature (36): n=a or g
taggggtgctgttggagctttcattgaggctttttntggttattgatcagcaagtactctcacctgcagct

SEQ ID NO: 25101 - DNA, 71 bp, chicken (Gallus Gallus)
  misc_feature (36): n=a or c
gtcttttataaaaattttgaatgaaaaagtaaagcnatatataatgctaccaaggtattctgcgtcaccac

SEQ ID NO: 25102 - DNA, 71 bp, chicken (Gallus Gallus)
  misc_feature (36): n=a or g
tgtagtaatggagtctaaaaagagaggaaaaccacnaagtttccttgcaatgtgtagcagtttgacactag

SEQ ID NO: 25103 - DNA, 71 bp, chicken (Gallus Gallus)
  misc_feature (36): n=c or t
acgacccggaggtgagagctcctggatccgattacngggccaaagcattgaggtcccagacatttatttgt

SEQ ID NO: 25104 - DNA, 71 bp, chicken (Gallus Gallus)
  misc_feature (36): n=g or t
ctgatactcagacagaagggtgtttttttttttttntttttcatgttcctgtgatttgtcagtctacaaat

SEQ ID NO: 25105 - DNA, 71 bp, chicken (Gallus Gallus)
  misc_feature (36): n=a or c
tttcttggaaatacaatgacataaaagagtgttacnagccatgctattccacagctctcccagccttcaac

SEQ ID NO: 25106 - DNA, 71 bp, chicken (Gallus Gallus)
  misc_feature (36): n=c or t
ggctgtgtgctttaaggctctggtgatgctgctaantgtaccttttactgcacactagatgtgtaatagac

SEQ ID NO: 25107 - DNA, 71 bp, chicken (Gallus Gallus)
  misc_feature (36): n=c or t
attgcacagtctgttccataggcaccttgtgttacnttggataaatgacttaatttcttcatgccgcagtt

SEQ ID NO: 25108 - DNA, 71 bp, chicken (Gallus Gallus)
  misc_feature (36): n=a or g
agtgacccagccccgctcagaagcaccacgcggccncaccatgcggcgttccaagccacaaagtaaagccc

SEQ ID NO: 25109 - DNA, 71 bp, chicken (Gallus Gallus)
  misc_feature (36): n=c or t
attcattctgctccatagactagttaagtgggagcnggcatattgccagggaaagcctgactacaaacaga

SEQ ID NO: 25110 - DNA, 71 bp, chicken (Gallus Gallus)
  misc_feature (36): n=c or t
tcaatgccataagctttagtcaagatgtattctaanttccagttcgattcatttttcttgttagcatctct

SEQ ID NO: 25111 - DNA, 71 bp, chicken (Gallus Gallus)
  misc_feature (36): n=a or t
gtgtgtcctttgttgtacatgtgttccacatcatgnatttaaaaaccatctgaatacagggactgcctgct

SEQ ID NO: 25112 - DNA, 71 bp, chicken (Gallus Gallus)
  misc_feature (36): n=a or g
aaaaaaaaatctctggggggcttcgtgcaagtcatntgattttctcacaatatagtcagtccagctgactg

SEQ ID NO: 25113 - DNA, 71 bp, chicken (Gallus Gallus)
  misc_feature (36): n=c or t
ggctgaaggaagaagttattgggcttgatgtgtctnccagctcccccctccccaccatccatggctgtgtg

SEQ ID NO: 25114 - DNA, 71 bp, chicken (Gallus Gallus)
  misc_feature (36): n=a or g
acaagaaaccatgtaaaaacatcagaagacagattntaataaattgttacactttttctctctggatgtct

SEQ ID NO: 25115 - DNA, 71 bp, chicken (Gallus Gallus)
  misc_feature (36): n=a or c
ccactgctgtggtcaacagagaaaatctcatatctntacacactgacctagcagacaaaagatttcacaat

SEQ ID NO: 25116 - DNA, 71 bp, chicken (Gallus Gallus)
  misc_feature (36): n=g or t
gtatgtgagatgtttgaaggacaagcctccagcacnttggaaaacatcctctactgaactactgtgcttta

SEQ ID NO: 25117 - DNA, 71 bp, chicken (Gallus Gallus)
  misc_feature (36): n=c or t
atgcctaatggagtgggagcagactgccaacacttngctgctgtacatacaccaccgtatcacaatctaga

SEQ ID NO: 25118 - DNA, 71 bp, chicken (Gallus Gallus)
  misc_feature (36): n=a or t
gcttgctttccatatagtctgtttctaggtaggtancagtgaaacatctgttccaaattttacatgccctc

SEQ ID NO: 25119 - DNA, 71 bp, chicken (Gallus Gallus)
  misc_feature (36): n=c or t
ccttggagataatgggacccctgttcccagtgcaanacagcgttttccacacagatgtttttgttcgaagg

SEQ ID NO: 25120 - DNA, 71 bp, chicken (Gallus Gallus)
  misc_feature (36): n=a or t
ctaaactttgacaagggtgcagagatcttttagaanatagaaaatttgctatttttgtgctcagaacaggc

SEQ ID NO: 25121 - DNA, 71 bp, chicken (Gallus Gallus)
  misc_feature (36): n=a or g
taattttatttttttctttttccaaagattatcccntatttcagactgaggagaaatttcttaaaatggct

SEQ ID NO: 25122 - DNA, 71 bp, chicken (Gallus Gallus)
  misc_feature (36): n=a or c
agcaactagcagcaccagaacagctctcagctgtgnatgaaagcaacaagcaaacttttgcttctagcaaa

SEQ ID NO: 25123 - DNA, 71 bp, chicken (Gallus Gallus)
  misc_feature (36): n=c or t
tgtagttgacaagtttgatcttcctatttttcaagngcagaggtgctgggattaaattcatgaggctgcgc

SEQ ID NO: 25124 - DNA, 71 bp, chicken (Gallus Gallus)
  misc_feature (36): n=c or t
ttctatgaattggagacagaaagagaagcaattctntatctcaccaattaaatatatgaatgactgagtaa

SEQ ID NO: 25125 - DNA, 71 bp, chicken (Gallus Gallus)
  misc_feature (36): n=a or g
gccagatctcaaaggcgcggtcatccccttccacantgtcgttcacgtctatgttgttcagctgcgaacag

SEQ ID NO: 25126 - DNA, 71 bp, chicken (Gallus Gallus)
  misc_feature (36): n=c or t
atactgagcctcttccccagccttcttatggacacnttttccaagaagctgacttttgtttctacagttaa

SEQ ID NO: 25127 - DNA, 71 bp, chicken (Gallus Gallus)
  misc_feature (36): n=g or t
gcttgtaaaactcagtaccagtggcagtgacccacngtttctcatctgatagaatggtgtcattcctagga

SEQ ID NO: 25128 - DNA, 71 bp, chicken (Gallus Gallus)
  misc_feature (36): n=a or g
tcagtaacaaagtgagtgagtaggggatttcccccnctggaggaatgttgaaattggtctggtgttgttcg

SEQ ID NO: 25129 - DNA, 71 bp, chicken (Gallus Gallus)
  misc_feature (36): n=a or g
ttttctcagtaggactgctattttcttgggaaacangagtgagtcttgggatatttgaaaggcttactctg

SEQ ID NO: 25130 - DNA, 71 bp, chicken (Gallus Gallus)
  misc_feature (36): n=c or t
ataatatgagcaacatacttcccacaaggcatacanttatcacgccaccttacaaaggctaagaaaaagtc

SEQ ID NO: 25131 - DNA, 71 bp, chicken (Gallus Gallus)
  misc_feature (36): n=a or g
actctcctgtgattttttgcagctggagaccaattnttagtcacttacttcctcaccaaataggtcaaatc

SEQ ID NO: 25132 - DNA, 71 bp, chicken (Gallus Gallus)
  misc_feature (36): n=c or t
gctatttctttgctgctctgatggctcagctctcantcacttgtatgtgaagacataccctcagaagatga

SEQ ID NO: 25133 - DNA, 71 bp, chicken (Gallus Gallus)
  misc_feature (36): n=a or t
tgatcacaatttatggctatttcttgcttttaagcnaccccagttttgttcaatccaaaatagcagctcct

SEQ ID NO: 25134 - DNA, 71 bp, chicken (Gallus Gallus)
  misc_feature (36): n=g or t
tgaatatatttattaaatgaatttgttaatcttttntttgtctttctaaaaagcgtgaataaaataacaag

SEQ ID NO: 25135 - DNA, 71 bp, chicken (Gallus Gallus)
  misc_feature (36): n=c or t
actgctgtcagatacaagagatgattctttctgtgngaggtaacagataacaagtttaaagcaagaaggag

SEQ ID NO: 25136 - DNA, 71 bp, chicken (Gallus Gallus)
  misc_feature (36): n=a or g
cggcatagctgcactcttccacattccttataattngaattaaaaaagattcttgttccacaccgctggag

SEQ ID NO: 25137 - DNA, 71 bp, chicken (Gallus Gallus)
  misc_feature (36): n=g or t
catgatatgatctgttttattcggatgagtgcatanttgttgcccagtggtcacatcatctgttactccaa

SEQ ID NO: 25138 - DNA, 71 bp, chicken (Gallus Gallus)
  misc_feature (36): n=a or g
taaataatgaatccgtttgctatcaaagcagatgangttagttgttttggaattaaagtagaattagtttt

SEQ ID NO: 25139 - DNA, 71 bp, chicken (Gallus Gallus)
  misc_feature (36): n=c or t
ttgtttgtcatgtaagtattatccagtacgccccanggttaattttctcttggattgcagcacagcactcc

SEQ ID NO: 25140 - DNA, 71 bp, chicken (Gallus Gallus)
  misc_feature (36): n=a or g
aagaacagtattttatctgaggagatgtttctcacnttattgatgcttaccacaaaacgtgtcttaaaaat

SEQ ID NO: 25141 - DNA, 71 bp, chicken (Gallus Gallus)
  misc_feature (36): n=a or g
agcataagcacttgtgcgtctgcacacagaatactngggaattaattcagctgaaaaataacatttgttac

SEQ ID NO: 25142 - DNA, 71 bp, chicken (Gallus Gallus)
  misc_feature (36): n=a or g
ctaaaattgactgctttgggatttcatttccatgcnctggaacaacaacactatcactcctgacatacacg

SEQ ID NO: 25143 - DNA, 71 bp, chicken (Gallus Gallus)
  misc_feature (36): n=c or t
ccacctggtccaagccctgctccagcaggaaaaccnagatcaggctacccaagctcatgtccaggtggctt

SEQ ID NO: 25144 - DNA, 71 bp, chicken (Gallus Gallus)
  misc_feature (36): n=c or g
tagggaagagcttctcagaaggaagagcttcttcantgtaagagtgacagagtactgggacaggctgccct

SEQ ID NO: 25145 - DNA, 71 bp, chicken (Gallus Gallus)
  misc_feature (36): n=a or g
gaaagaatgtagttaaaaagtacagcacagaaaacnacacagcaattcttactacaagcagagaatttaaa

SEQ ID NO: 25146 - DNA, 71 bp, chicken (Gallus Gallus)
  misc_feature (36): n=a or c
aactccttcatttcccaagttgcatgtttttgttcnggaaaagtgaattttactgggtaaaacttttgttg

SEQ ID NO: 25147 - DNA, 71 bp, chicken (Gallus Gallus)
  misc_feature (36): n=c or t
agagaaagtgttcagttggagcaatatctctgatanggggatggattgtgatagtgggttgtaactgggtg

SEQ ID NO: 25148 - DNA, 71 bp, chicken (Gallus Gallus)
  misc_feature (36): n=a or g
ctctctcttatttatttatttactactgagacactnctaggatattttcttctaccttcaggttcaatatt

SEQ ID NO: 25149 - DNA, 71 bp, chicken (Gallus Gallus)
  misc_feature (36): n=c or g
aggtgtctttgaaatatgtattccttacttttagantgtttaatactagcagttctcagtgtcagagagaa

SEQ ID NO: 25150 - DNA, 71 bp, chicken (Gallus Gallus)
  misc_feature (36): n=c or t
ccaaagggttttctttgtctggtgtaaaatgtttanagctcatacagttcattacagcctgaacttgccca

SEQ ID NO: 25151 - DNA, 71 bp, chicken (Gallus Gallus)
  misc_feature (36): n=c or g
ttccaaaaaggatctgaattgtcatcccatttaganaaagtgttgcttctcaaatctgaagaatcatagta

SEQ ID NO: 25152 - DNA, 71 bp, chicken (Gallus Gallus)
  misc_feature (36): n=a or g
gctgtcgtctctgagaaaatctgcatcccaaaaccncgtccagctgcttttgtataatcacctgccttgca

SEQ ID NO: 25153 - DNA, 71 bp, chicken (Gallus Gallus)
  misc_feature (36): n=c or t
gttattcctccgagtcttgcctaattacattgtggnagcaacccctgctgaccagggtaggcgcgactcag

SEQ ID NO: 25154 - DNA, 71 bp, chicken (Gallus Gallus)
  misc_feature (36): n=a or g
tgtatttttacttttgttaattaattaattaatttntgcttatttttgtatagattatatacaaaggtaag

SEQ ID NO: 25155 - DNA, 71 bp, chicken (Gallus Gallus)
  misc_feature (36): n=c or t
aggcagctcccatgtctcagttttaaaaccaatcantgaatcaatggtcaaattgtaaactgtacaaataa

SEQ ID NO: 25156 - DNA, 71 bp, chicken (Gallus Gallus)
  misc_feature (36): n=a or g
accaatttttagttgttgctgagcagtgctgtacanagccagtgacagttgagtttctcagcttctggtac

SEQ ID NO: 25157 - DNA, 71 bp, chicken (Gallus Gallus)
  misc_feature (36): n=c or t
caatgcttctaacaccagtaacaataggggctttcnctgcaaataacattttcaggatgaaagaagtagta

SEQ ID NO: 25158 - DNA, 71 bp, chicken (Gallus Gallus)
  misc_feature (36): n=a or g
tggtgtcataaaatacgaatcaaaactccaggtccntgaagggagttaaggatccaaagcacttttattca

SEQ ID NO: 25159 - DNA, 71 bp, chicken (Gallus Gallus)
  misc_feature (36): n=c or t
acttgctgacatcttgttacttcctcatcccttcangtagatcaatgacagcaacaaggggctgtggataa

SEQ ID NO: 25160 - DNA, 71 bp, chicken (Gallus Gallus)
  misc_feature (36): n=c or t
tggttgccgggacgggagtcactgaattttgtcacngagatccttaaatccacaggcaaactttctgatgc

SEQ ID NO: 25161 - DNA, 71 bp, chicken (Gallus Gallus)
  misc_feature (36): n=g or t
ttgaaaaaatccatagaggaaaaaaatagacaattnaatgattatttcctagtcttataaaacacaccgag

SEQ ID NO: 25162 - DNA, 71 bp, chicken (Gallus Gallus)
  misc_feature (36): n=c or t
ttttgtcttgaggtaaattaattcatctatgtcatnggtgtatctgatgatatccgaaatttagttttaaa

SEQ ID NO: 25163 - DNA, 71 bp, chicken (Gallus Gallus)
  misc_feature (36): n=a or c
caaacttcgccatgccttttccttagcacgttgtcnttatagttaatttcctgctgcctctgacaatatag

SEQ ID NO: 25164 - DNA, 71 bp, chicken (Gallus Gallus)
  misc_feature (36): n=c or g
ctcagcatccctctgcttttcaactggcctagtccnctagatggtcaccaagggagtccctttttttctgg

SEQ ID NO: 25165 - DNA, 71 bp, chicken (Gallus Gallus)
  misc_feature (36): n=c or t
cttactgttcctcctggattcgttccaagagttcangaccgacctgataccttggtttcactgacagcctt

SEQ ID NO: 25166 - DNA, 71 bp, chicken (Gallus Gallus)
  misc_feature (36): n=c or t
acagctattcccacagccactgcggtgcctcacagngatgcatatttattggctggggagatatgcatcct

SEQ ID NO: 25167 - DNA, 71 bp, chicken (Gallus Gallus)
  misc_feature (36): n=a or c
tttttttcatgcacacttgcaaactttaaatgcagngactgaacttttgaggaagagtagtaatacttcca

SEQ ID NO: 25168 - DNA, 71 bp, chicken (Gallus Gallus)
  misc_feature (36): n=c or g
agcactgctggagaaatgggaaggaagattgtttanaatcaattctgcaatgttgtacacagatagccagg

SEQ ID NO: 25169 - DNA, 71 bp, chicken (Gallus Gallus)
  misc_feature (36): n=a or t
gctctgacactgaattccattcagcaatatttggancttgttcttcctcaaagcagggcagcttttcagga

SEQ ID NO: 25170 - DNA, 71 bp, chicken (Gallus Gallus)
  misc_feature (36): n=a or g
aaatcttaaaaagcctgtatattttcagggctgacngatgaaatacccaaagcataaaccttccccttaag

SEQ ID NO: 25171 - DNA, 71 bp, chicken (Gallus Gallus)
  misc_feature (36): n=a or g
gcaaaataagacagggcagagccactgcattacagnattttagtaccaaatttaagttggtatccctttgt

SEQ ID NO: 25172 - DNA, 71 bp, chicken (Gallus Gallus)
  misc_feature (36): n=g or t
taacatttttttagcaaagggatatgtgtatattcnctctcctccaagcaatcatttaagatacctagcta

SEQ ID NO: 25173 - DNA, 71 bp, chicken (Gallus Gallus)
  misc_feature (36): n=a or g
tgagtcatacccctgtctgtaggtacatttaatatnctaggctctatagactacacagctcaaagagaaga

SEQ ID NO: 25174 - DNA, 71 bp, chicken (Gallus Gallus)
  misc_feature (36): n=a or g
ttgcacatggacttcatggggatgctgatgacagtngtgaaggagcggctgcacgacataacatttggatg

SEQ ID NO: 25175 - DNA, 71 bp, chicken (Gallus Gallus)
  misc_feature (36): n=g or t
gctttaaaaaaaagtgtgtagataaaaggatacacnggataaaaggtcttgagttttggctgctttcccac

SEQ ID NO: 25176 - DNA, 71 bp, chicken (Gallus Gallus)
  misc_feature (36): n=a or g
tctgtagaacaggacacgaagcagacgccgtaacancagcagcaaaaccaggctccctgtgttccactcac

SEQ ID NO: 25177 - DNA, 71 bp, chicken (Gallus Gallus)
  misc_feature (36): n=c or t
tctctttatgaaagtatttaatataaatctgagtcnccttcaataaagcatagtatgaaatgaacctcatg

SEQ ID NO: 25178 - DNA, 71 bp, chicken (Gallus Gallus)
  misc_feature (36): n=c or t
aatctccttattattctctctgagaactaagcaatnagcataagctataatgtaaaccactagactactct

SEQ ID NO: 25179 - DNA, 71 bp, chicken (Gallus Gallus)
  misc_feature (36): n=a or g
tggtcaaacacttcttggctcctccgtctgataccnaacccacttgcagctcttcagacactttctcagat

SEQ ID NO: 25180 - DNA, 71 bp, chicken (Gallus Gallus)
  misc_feature (36): n=a or g
aaaggcttctatcaagaagtgggcttctgagccacnctttactgaaaatgaaatgtttttcccctttaatg

SEQ ID NO: 25181 - DNA, 71 bp, chicken (Gallus Gallus)
  misc_feature (36): n=c or g
tgatgaataaagtattctcagtgtacttctcattantttcctttgtgttaataagaaacttctacccagat

SEQ ID NO: 25182 - DNA, 71 bp, chicken (Gallus Gallus)
  misc_feature (36): n=c or t
ttcccttttgctaggatgattacttttgagctactntaattggaaaaataaaaatcttattctctgctcat

SEQ ID NO: 25183 - DNA, 71 bp, chicken (Gallus Gallus)
  misc_feature (36): n=c or t
actattggtgtaatgacaatgattcatggagataangtggggttggtgctcccgcctcgagtagcttgtgt

SEQ ID NO: 25184 - DNA, 71 bp, chicken (Gallus Gallus)
  misc_feature (36): n=c or t
ccaggagaactacagaaaggtcagagaaaaaagatngctttgtaattagccagccttgatttttttgacat

SEQ ID NO: 25185 - DNA, 71 bp, chicken (Gallus Gallus)
  misc_feature (36): n=c or g
gatagtcatgcaggtactgcttagatgagcaacttnagccctacttacctttgcacttgcagagaaaatgt

SEQ ID NO: 25186 - DNA, 71 bp, chicken (Gallus Gallus)
  misc_feature (36): n=a or g
actgcacttacagataaacatgcttcgttgaagacnctcattatttaggtccttggctgtctctgaagaaa

SEQ ID NO: 25187 - DNA, 71 bp, chicken (Gallus Gallus)
  misc_feature (36): n=c or t
gcatatttaactcctatactgaggtcattcagaacnaagatgaattgcaccttcatacatttgcatgtgat

SEQ ID NO: 25188 - DNA, 71 bp, chicken (Gallus Gallus)
  misc_feature (36): n=a or g
ttgggagccagacggtcacgctgaccttgtgtaacngcagcaagcgtttgctcctggttttgtccaaatgc

SEQ ID NO: 25189 - DNA, 71 bp, chicken (Gallus Gallus)
  misc_feature (36): n=a or g
tccctttattaccagcaggttttcccctttctgtancagtattatcatgagacctcattttacaaagcatt

SEQ ID NO: 25190 - DNA, 71 bp, chicken (Gallus Gallus)
  misc_feature (36): n=a or g
taaagtaaatgcattcacagtgtggcttctcttgantcttgtaagagtctaagaacagggaaagtctgcct

SEQ ID NO: 25191 - DNA, 71 bp, chicken (Gallus Gallus)
  misc_feature (36): n=c or t
ctgctgctaattgctttaatgtgatcaaatagatanctcatgaagtgcagaaatgcttatctaagtaatga

SEQ ID NO: 25192 - DNA, 71 bp, chicken (Gallus Gallus)
  misc_feature (36): n=c or t
atatattcaaaatgtggcataatttcaaagaaaaantatgagaattgtagattaagatgaaagtatatgtt

SEQ ID NO: 25193 - DNA, 71 bp, chicken (Gallus Gallus)
  misc_feature (36): n=a or t
taacataccggaggttctctgttctctttctagcancagtttctctgatatggtatcagtgcttgttgaag

SEQ ID NO: 25194 - DNA, 71 bp, chicken (Gallus Gallus)
  misc_feature (36): n=a or c
ataccttgaaaaatgtccactgttcccagcaaaatngatttttcaccaacgctgatctcattttcaaggaa

SEQ ID NO: 25195 - DNA, 71 bp, chicken (Gallus Gallus)
  misc_feature (36): n=a or g
cgtacccacctgagccgcaaaaatccccatagcctngaagctctgtgattgtgcacagtcctggagaaaaa

SEQ ID NO: 25196 - DNA, 71 bp, chicken (Gallus Gallus)
  misc_feature (36): n=a or c
gtgcaacacgagctgcaaaggagaatgatgtttcanaacagcagtgggatgaagatactcttgaaaacagt

SEQ ID NO: 25197 - DNA, 71 bp, chicken (Gallus Gallus)
  misc_feature (36): n=a or g
tgttcctagagaaacataaattgctctagttgaggnttaaatagtcttaaatgacttagaaaatataggaa

SEQ ID NO: 25198 - DNA, 71 bp, chicken (Gallus Gallus)
  misc_feature (36): n=g or t
acaaaagaaaggatataggcttgttttcaaccttgntgtaactccactgaagttaggtgagatacaccaga

SEQ ID NO: 25199 - DNA, 71 bp, chicken (Gallus Gallus)
  misc_feature (36): n=c or t
ggagtagggcagcttcctgtaaatcacatggatcancccatgctgtattatgaaacagtcttctgaagcac

SEQ ID NO: 25200 - DNA, 71 bp, chicken (Gallus Gallus)
  misc_feature (36): n=a or t
agacatagtacctgccatagagctcattttattatnttttttttactttcctggtgatactattaaaacta

SEQ ID NO: 25201 - DNA, 71 bp, chicken (Gallus Gallus)
  misc_feature (36): n=a or g
catgggcaaggtatcaaaatattgccatagttctcngttgtttaagtgatctgggacacaaccctgctact

SEQ ID NO: 25202 - DNA, 71 bp, chicken (Gallus Gallus)
  misc_feature (36): n=a or c
ctgctggggccagacacctgaattcagactctccantgttgccataatggaattatgtgcctgaggaatac

SEQ ID NO: 25203 - DNA, 71 bp, chicken (Gallus Gallus)
  misc_feature (36): n=c or t
tgtggtcaacacaaaggacaactgtggagaactacngtgggcaacaactatggacaatttcaagggacaac

SEQ ID NO: 25204 - DNA, 71 bp, chicken (Gallus Gallus)
  misc_feature (36): n=c or t
agaatcggataaaaagaccatccttatcctagtttntgtgatcaggttttatcttagagatctgcagtagt

SEQ ID NO: 25205 - DNA, 71 bp, chicken (Gallus Gallus)
  misc_feature (36): n=a or g
ctgctgaaatgatagtgagttttcatagtatatagnggaaaaatgaagcacaggacagctgtgtacctctt

SEQ ID NO: 25206 - DNA, 71 bp, chicken (Gallus Gallus)
  misc_feature (36): n=c or t
taacaatggaggaagtgtcagctcagaaaggagaangcacactgccattatacactacagcaaggatgggc

SEQ ID NO: 25207 - DNA, 71 bp, chicken (Gallus Gallus)
  misc_feature (36): n=a or g
cgcccattctcaccaccaccccatcatgacatgcantggattaaattgggaagcgtatcccgccctttctc

SEQ ID NO: 25208 - DNA, 71 bp, chicken (Gallus Gallus)
  misc_feature (36): n=c or t
gacagtagagtgggaaaggtagttcagtgatgcacnataacctgacttctggaagggcaacacgtgtaggt

SEQ ID NO: 25209 - DNA, 71 bp, chicken (Gallus Gallus)
  misc_feature (36): n=g or t
cctggccttgggcacctccaggggcatggaggtttngggcatctctatctcatctccatacatctgttttc

SEQ ID NO: 25210 - DNA, 71 bp, chicken (Gallus Gallus)
  misc_feature (36): n=a or g
gacagtcactgggcaaaattaagtcaattttgaggnaaaaacaaaaacacgtgccaccagaaagaaaaaaa

SEQ ID NO: 25211 - DNA, 71 bp, chicken (Gallus Gallus)
  misc_feature (36): n=c or t
tactctattaatttccaaaatcattacaatgaacangtctttcaattatttagtgcttttcagaagagatt

SEQ ID NO: 25212 - DNA, 71 bp, chicken (Gallus Gallus)
  misc_feature (36): n=c or t
ctaaagctgaagaaacaacacccgacaccaactcgngtcccatcccatttgctgcccttggtactgcagtc

SEQ ID NO: 25213 - DNA, 71 bp, chicken (Gallus Gallus)
  misc_feature (36): n=a or g
cctgtcatttcaattttaaacaagagttgactttcngttacattcaagtttgttgttcacattgggaatta

SEQ ID NO: 25214 - DNA, 71 bp, chicken (Gallus Gallus)
  misc_feature (36): n=a or g
aaccaaaattcacaggtatcctcccattttgcacangttgagcacacattcaccatctccctgctcacaga

SEQ ID NO: 25215 - DNA, 71 bp, chicken (Gallus Gallus)
  misc_feature (36): n=a or g
cctgaagaatgaataaatattaggatcacaattcantgccagtggaacaggatggcattaacatgaacaag

SEQ ID NO: 25216 - DNA, 71 bp, chicken (Gallus Gallus)
  misc_feature (36): n=a or g
actaataaagagctaaggagttcattattctttgcntgaatgtatatatagttacaaaataacactgaaaa

SEQ ID NO: 25217 - DNA, 71 bp, chicken (Gallus Gallus)
  misc_feature (36): n=c or t
atcagacctacagaagtccactttttcacagctacnttttttgcatctcactaagcattggatgagtaccc

SEQ ID NO: 25218 - DNA, 71 bp, chicken (Gallus Gallus)
  misc_feature (36): n=a or g
gagcctaatgggagcatcactgcccttagtaatgcnttcagcttgcttggagagctggtggatgccccatc

SEQ ID NO: 25219 - DNA, 71 bp, chicken (Gallus Gallus)
  misc_feature (36): n=a or t
gccaaggatccctatcaggaacagacaaagagatangattgataatatttcactaagagtcaccatgcacc

SEQ ID NO: 25220 - DNA, 71 bp, chicken (Gallus Gallus)
  misc_feature (36): n=a or g
gatattcaaactatggaatcaaattagagttaatcngctggagcattttgtaactaataagaaggtcatat

SEQ ID NO: 25221 - DNA, 71 bp, chicken (Gallus Gallus)
  misc_feature (36): n=c or t
aaatcaatcaccacaacaggtaaaggctacctcagngtctgctagttgccctcaccacgctcctttttgta

SEQ ID NO: 25222 - DNA, 71 bp, chicken (Gallus Gallus)
  misc_feature (36): n=a or g
cccaacctgacacagctgtttcacctttaatggcancaggtaccttgggatacagctggcgctccagcgtg

SEQ ID NO: 25223 - DNA, 71 bp, chicken (Gallus Gallus)
  misc_feature (36): n=a or c
tctgcagagttctgtcccagtagccaggacttctgntccacatgggctacagagagttagctctgctggcc

SEQ ID NO: 25224 - DNA, 71 bp, chicken (Gallus Gallus)
  misc_feature (36): n=a or g
ttgctaaaaataacagcagggtgcctacgtcagcantgcgtttaggaaatgggtctcagtgcaatctctct

SEQ ID NO: 25225 - DNA, 71 bp, chicken (Gallus Gallus)
  misc_feature (36): n=c or t
tggcacctccaaagctgtgcctgttctctgttcatnggagagcattggaaaactgccggatgaattcttgt

SEQ ID NO: 25226 - DNA, 71 bp, chicken (Gallus Gallus)
  misc_feature (36): n=c or g
aacactactgataactctttgtgactaatatttttngtttgagttttgtttttaatttttgtctgtcttgt

SEQ ID NO: 25227 - DNA, 71 bp, chicken (Gallus Gallus)
  misc_feature (36): n=c or t
gcatgtcagctgttaagatgtaaattttcagtgctntgagttcaaagttatccatttagttcacatgggca

SEQ ID NO: 25228 - DNA, 71 bp, chicken (Gallus Gallus)
  misc_feature (36): n=a or c
acgttatttgtcatgctcaagtgaggggctaccgangagcccgctgacaccgggctgcatttgtttctcct

SEQ ID NO: 25229 - DNA, 71 bp, chicken (Gallus Gallus)
  misc_feature (36): n=c or t
ggtgagaatccattttctcttcatgtcctctctgcntaggaacactacttcatacctgtttgacacttctt

SEQ ID NO: 25230 - DNA, 71 bp, chicken (Gallus Gallus)
  misc_feature (36): n=c or g
tgaaatcttgaaaatgtatagcaaacatatttggtncatgattgctgctgaagaaccctgaaacagagctg

SEQ ID NO: 25231 - DNA, 71 bp, chicken (Gallus Gallus)
  misc_feature (36): n=c or t
ctgttcatagaaaattgatgagcaaaactaagaatngaatttgcagcctcgtgtctgatgatagggtctaa

SEQ ID NO: 25232 - DNA, 71 bp, chicken (Gallus Gallus)
  misc_feature (36): n=c or t
gatacgttaactttcaggctggaagcacttgatacnttatttcaaaacacaaagattactcacacctcatt

SEQ ID NO: 25233 - DNA, 71 bp, chicken (Gallus Gallus)
  misc_feature (36): n=c or t
atgagatgatatgattaaaacttcctatgcaatccnaatcccagactctcttgtttaaagggcatactgaa

SEQ ID NO: 25234 - DNA, 71 bp, chicken (Gallus Gallus)
  misc_feature (36): n=c or t
gcaagaacattgtcccattaatgctgatagtgggantgtgattgcattgcttaaggtagccacaattggcc

SEQ ID NO: 25235 - DNA, 71 bp, chicken (Gallus Gallus)
  misc_feature (36): n=c or t
gtaccaggccatctggatttgtttctgtgagatgcnggtttaatacacttaaaatttcccattcaatctga

SEQ ID NO: 25236 - DNA, 71 bp, chicken (Gallus Gallus)
  misc_feature (36): n=c or t
tgggcgctaaggacagcgctaaaaagactgctcacngctaaaatggacacagggttgtttcagttccaatg

SEQ ID NO: 25237 - DNA, 71 bp, chicken (Gallus Gallus)
  misc_feature (36): n=c or t
ggaaagaggcctccagaaggtatcacaaatgaagcngaactgctctcttctcaagaaaaaactaagttaca

SEQ ID NO: 25238 - DNA, 71 bp, chicken (Gallus Gallus)
  misc_feature (36): n=a or g
taataagagtctgcatgaagcactcataacaatctntaccagtgcaggagacccgctgtcgctactgccgc

SEQ ID NO: 25239 - DNA, 71 bp, chicken (Gallus Gallus)
  misc_feature (36): n=c or t
tgtggtcccctgcagtggaaaggtaccaaaagattngcctttccaatgcaatcacttaagcaagaaggaca

SEQ ID NO: 25240 - DNA, 71 bp, chicken (Gallus Gallus)
  misc_feature (36): n=a or g
agtttcattacacccaattagccctacagtgatgtntactactgtggctgcatatgaacccatataggcaa

SEQ ID NO: 25241 - DNA, 71 bp, chicken (Gallus Gallus)
  misc_feature (36): n=c or g
tgtttctctaaaagtcaacaaagagcaaataatgtntccgtgctccaaacctgaagtttctactttcagtt

SEQ ID NO: 25242 - DNA, 71 bp, chicken (Gallus Gallus)
  misc_feature (36): n=a or t
cataaagtacctgctcctaaacttgactgtctactnccagtagcatggaggtaaatgtttccattcaacat

SEQ ID NO: 25243 - DNA, 71 bp, chicken (Gallus Gallus)
  misc_feature (36): n=c or t
caaacaaaaggttctgtaattctgagactcatggcnactaattattatgctttgatcatctgagatactgg

SEQ ID NO: 25244 - DNA, 71 bp, chicken (Gallus Gallus)
  misc_feature (36): n=a or g
tgctgtgattgtttgagatcacaatccaacatggancgctgcttttcagcttctaacaaccgattttctac

SEQ ID NO: 25245 - DNA, 71 bp, chicken (Gallus Gallus)
  misc_feature (36): n=a or g
gttgcaggattcgttacccggcagtcattttgcacnttgcttttaagaggacacgcagcagcagtgaacca

SEQ ID NO: 25246 - DNA, 71 bp, chicken (Gallus Gallus)
  misc_feature (36): n=a or g
ctagggaatcttggcaaaagttgctgcagtcacccntagtatttcctatatcatccgttgccacagcctgt

SEQ ID NO: 25247 - DNA, 71 bp, chicken (Gallus Gallus)
  misc_feature (36): n=g or t
aaaaggtggagataaacctggatgtattctgtacancacggtcttaaatttatttcttggaaatttataca

SEQ ID NO: 25248 - DNA, 71 bp, chicken (Gallus Gallus)
  misc_feature (36): n=c or t
tttttaaacatgtatctccatatggccacgcacacncaacccgtgtaggctgcatttccaccagttgtcat

SEQ ID NO: 25249 - DNA, 71 bp, chicken (Gallus Gallus)
  misc_feature (36): n=c or t
tttgtcctcaacttaacttgacaggtaaatcccatnatctctcatccagttttaatattttgatgttaatg

SEQ ID NO: 25250 - DNA, 71 bp, chicken (Gallus Gallus)
  misc_feature (36): n=a or g
gcgtatcagctgcaaagttgacaagtttatctctcnccacccattcagccctctgttctcctcgcaggcaa

SEQ ID NO: 25251 - DNA, 71 bp, chicken (Gallus Gallus)
  misc_feature (36): n=c or t
aaagtaacaatcaatgaagactcagtgaaccctaangcaaaggagtaaatatatttgatgtcttcttgatt

SEQ ID NO: 25252 - DNA, 71 bp, chicken (Gallus Gallus)
  misc_feature (36): n=a or c
tacaagcacatacagcaaacatcaatattcaaatanggtatcacctctgcttgtaatctgacggtatgtaa

SEQ ID NO: 25253 - DNA, 71 bp, chicken (Gallus Gallus)
  misc_feature (36): n=c or t
gttgttcaagaaacctctcacttgctttaaccaaanagttctgtgttaatcagaaatgatagacgttttaa

SEQ ID NO: 25254 - DNA, 71 bp, chicken (Gallus Gallus)
  misc_feature (36): n=a or t
tatgaaaatgtcattcttttccctctcagtaattcnataggtttcaagccattagtgttctttcagtcttt

SEQ ID NO: 25255 - DNA, 71 bp, chicken (Gallus Gallus)
  misc_feature (36): n=a or c
tgctcagcaaattctttacccagatttttcaaacanactccagcacgtcctcttggtgttctggatacctg

SEQ ID NO: 25256 - DNA, 71 bp, chicken (Gallus Gallus)
  misc_feature (36): n=g or t
acatggttatgagtttggatatggctttgcaaaaanttggccagaaaatataccattgcaaaacccttttc

SEQ ID NO: 25257 - DNA, 71 bp, chicken (Gallus Gallus)
  misc_feature (36): n=a or g
agaggtgttttccaattttttttctaatttctatgncttgattgctcacagtgcagcattagcaaacagct

SEQ ID NO: 25258 - DNA, 71 bp, chicken (Gallus Gallus)
  misc_feature (36): n=a or g
ccttggattagctgtcattttctagcctagttttcngaacagaatgtaatatttcaagctatatgtgacag

SEQ ID NO: 25259 - DNA, 71 bp, chicken (Gallus Gallus)
  misc_feature (36): n=a or g
atttttttttttaaatttttttttctcttcccagtntcattagttcaaggctgggttacctaagtgatgta

SEQ ID NO: 25260 - DNA, 71 bp, chicken (Gallus Gallus)
  misc_feature (36): n=a or t
tatatagaaaaaacactgatcagtctgtgccacagnctcccaagacaaacgtgagggattaatttatatgg

SEQ ID NO: 25261 - DNA, 71 bp, chicken (Gallus Gallus)
  misc_feature (36): n=a or g
tgtgggaaaagtctttgaagcagcaaattctccgtncacctctccttgataaatgcatgagtttactagac

SEQ ID NO: 25262 - DNA, 71 bp, chicken (Gallus Gallus)
  misc_feature (36): n=c or t
aggaaaaaatcagggaagaaagggtgagtgtctcantcagggatgctggggctgatgttcttgaaggcgtg

SEQ ID NO: 25263 - DNA, 71 bp, chicken (Gallus Gallus)
  misc_feature (36): n=g or t
actgtaagccactgggaactcatatttccatggaanaaggactgccatgacatgttctttttcagaacatg

SEQ ID NO: 25264 - DNA, 71 bp, chicken (Gallus Gallus)
  misc_feature (36): n=c or t
acccagccccgcttgggtttggagacacgagggacngcgtagctcttggagatcttatcgctctctgcagt

SEQ ID NO: 25265 - DNA, 71 bp, chicken (Gallus Gallus)
  misc_feature (36): n=c or t
taaggggaagagagtacttactgttttgcactttantgaatattttagtaccaattttaaagtggaagaga

SEQ ID NO: 25266 - DNA, 71 bp, chicken (Gallus Gallus)
  misc_feature (36): n=c or t
tgctgacatcatcaaggccatgttttcattccaagnatgctgatccctttggaataaatgcatatgagaag

SEQ ID NO: 25267 - DNA, 71 bp, chicken (Gallus Gallus)
  misc_feature (36): n=c or t
atgttatgatatgttttggacctcccctaggaggtngatgtaagaaggtgcagaaggtataattactcatg

SEQ ID NO: 25268 - DNA, 71 bp, chicken (Gallus Gallus)
  misc_feature (36): n=c or t
aagttttaaatagactgaactctgttcttgtaattnacttttacatacgagaagcaaaatgagcactgaat

SEQ ID NO: 25269 - DNA, 71 bp, chicken (Gallus Gallus)
  misc_feature (36): n=c or g
tgctttttttttttttaatagaatctcacctgatanactgggccaacatacattgctttctggagatgtat

SEQ ID NO: 25270 - DNA, 71 bp, chicken (Gallus Gallus)
  misc_feature (36): n=a or g
acacgaaatgtctgcatactgactccaggggcaaantccaaattacgactgatacctacataatctactcc

SEQ ID NO: 25271 - DNA, 71 bp, chicken (Gallus Gallus)
  misc_feature (36): n=a or c
tatatttggatagcttgttagattaagattaagganaaatggacttggatatcattaggtataaacctgta

SEQ ID NO: 25272 - DNA, 71 bp, chicken (Gallus Gallus)
  misc_feature (36): n=a or t
gaaaacaccttctgcctctctttctcttcttgtccnttgtctgctttggctatagatattctgtgacagag

SEQ ID NO: 25273 - DNA, 71 bp, chicken (Gallus Gallus)
  misc_feature (36): n=c or t
gcagaatggctgaatttgtcctcctgacctacccanaagaaagtgaggcaaaacttatgcctttttttttt

SEQ ID NO: 25274 - DNA, 71 bp, chicken (Gallus Gallus)
  misc_feature (36): n=c or t
taatgtacaacatctggaagagtgtgaagggcatcnaatggctttttttttttttttttttaacaacaaaa

SEQ ID NO: 25275 - DNA, 71 bp, chicken (Gallus Gallus)
  misc_feature (36): n=a or g
ctactaagaagttcacaattcggagatgtgagatgnaggacagggctgtgccagctgtgagctggacggtg

SEQ ID NO: 25276 - DNA, 71 bp, chicken (Gallus Gallus)
  misc_feature (36): n=a or g
ggagggaaaggcaaacgaggtttttggagcatccanaagatatgggaaaaagatctctttttcttcgcttt

SEQ ID NO: 25277 - DNA, 71 bp, chicken (Gallus Gallus)
  misc_feature (36): n=c or g
ggaagcataattcaaaacagactcctttactgaaanatgtctggcttcacagccatttcagcctattttct

SEQ ID NO: 25278 - DNA, 71 bp, chicken (Gallus Gallus)
  misc_feature (36): n=c or t
gagaaattaaaatctggtttgctctcagcgaggtcntctgcacatcactgtttcccagaatcactgtgcag

SEQ ID NO: 25279 - DNA, 71 bp, chicken (Gallus Gallus)
  misc_feature (36): n=a or c
aaaatgaaatctaagaatatatgtttagtatccaanagatctctattaatttaaactggaaattaaaggaa

SEQ ID NO: 25280 - DNA, 71 bp, chicken (Gallus Gallus)
  misc_feature (36): n=a or t
taccgcccagggggcatggaggtttccccagggagntctgcccttgcatcctggtattttcaaaagtgaaa

SEQ ID NO: 25281 - DNA, 71 bp, chicken (Gallus Gallus)
  misc_feature (36): n=c or t
ggtacaactctcaagagaggaaagaacaatgactgnagtacactcagaacagcgtgaggagaagttctgcc

SEQ ID NO: 25282 - DNA, 71 bp, chicken (Gallus Gallus)
  misc_feature (36): n=a or g
tttcaaaatggatacccatgtgagcaaccacccacnaagagctgtgggtactatactaacaagatgctact

SEQ ID NO: 25283 - DNA, 71 bp, chicken (Gallus Gallus)
  misc_feature (36): n=c or t
aaaagatgagtgaatttgtctctcttgggaaggatngattcaaatccctgctaaagagatcagaaggaaaa

SEQ ID NO: 25284 - DNA, 71 bp, chicken (Gallus Gallus)
  misc_feature (36): n=c or t
agtttcagacatatctaaattccttatttcaggccngtattcctgataaagtccccttctgcataaacata

SEQ ID NO: 25285 - DNA, 71 bp, chicken (Gallus Gallus)
  misc_feature (36): n=g or t
ttgcagcaaggtctgccaccgtttaactaaaagttnatagaatcacttcctttgctcttgcctgctctctg

SEQ ID NO: 25286 - DNA, 71 bp, chicken (Gallus Gallus)
  misc_feature (36): n=c or t
gaaataatcactcctgctgtctaagtttctgttcangtagccatttacgtagttttcactgctgacctata

SEQ ID NO: 25287 - DNA, 71 bp, chicken (Gallus Gallus)
  misc_feature (36): n=c or t
ctcagagtcatgtttctgtggttaaggtgattgttnctagtcatttccatttacacactggcacaaaaacc

SEQ ID NO: 25288 - DNA, 71 bp, chicken (Gallus Gallus)
  misc_feature (36): n=c or t
tgatccctactggcttccagaaattgttattgctgntagtaactatcgtgaatccactgttctttctgtaa

SEQ ID NO: 25289 - DNA, 71 bp, chicken (Gallus Gallus)
  misc_feature (36): n=g or t
atattcacagtgaagtacctacatcttgcgtagatnaagactcttatgacaaatagtacttattgctgaga

SEQ ID NO: 25290 - DNA, 71 bp, chicken (Gallus Gallus)
  misc_feature (36): n=a or g
atgtaccaggaggtgtgcgtacattgccttcagagncaatttgcatagcttctgtttcctgtcatttgcct

SEQ ID NO: 25291 - DNA, 71 bp, chicken (Gallus Gallus)
  misc_feature (36): n=a or c
ctctctcaagtgatgccaaagttaatactctttcancctcctgctttgcaagaaagaccagctataagaaa

SEQ ID NO: 25292 - DNA, 71 bp, chicken (Gallus Gallus)
  misc_feature (36): n=a or g
tcaacattgtgcattaaaaatgccaaaataaataancaaacaaagaaaaaaccatacattatagcaattaa

SEQ ID NO: 25293 - DNA, 71 bp, chicken (Gallus Gallus)
  misc_feature (36): n=c or g
acagtgtgtgaacttagtaaagcatgtgctctactngaagatccctggaaatgctcaagaaaagggtgggc

SEQ ID NO: 25294 - DNA, 71 bp, chicken (Gallus Gallus)
  misc_feature (36): n=c or t
caagctagactttccatccaaataacaacccaaganggacacattacctactatcaggttattgggccgct

SEQ ID NO: 25295 - DNA, 71 bp, chicken (Gallus Gallus)
  misc_feature (36): n=a or t
cctaccaccttgttgatgcagttaagcactgttacngcttaatgtggaaataaagccatttcttctaagtg

SEQ ID NO: 25296 - DNA, 71 bp, chicken (Gallus Gallus)
  misc_feature (36): n=c or t
ttgagggaaggaggcaatcgaaagacggccgaaaanatcggatttctttctccctatcccatcttcaccat

SEQ ID NO: 25297 - DNA, 71 bp, chicken (Gallus Gallus)
  misc_feature (36): n=c or t
tccagaggtcacacaagtggttttacaactgtcttngggtttttcctatctgcaggaaaaatctgctcaac

SEQ ID NO: 25298 - DNA, 71 bp, chicken (Gallus Gallus)
  misc_feature (36): n=c or t
tcagtcttggctcagtgctctgagccagccaagggnttcctttatattactaccattggatcatttctcct

SEQ ID NO: 25299 - DNA, 71 bp, chicken (Gallus Gallus)
  misc_feature (36): n=c or t
ttatttttaaaaggaacaccttgtataaggccaaanttacataagcttaaacatacaaaatatatgataaa

SEQ ID NO: 25300 - DNA, 71 bp, chicken (Gallus Gallus)
  misc_feature (36): n=c or t
gttgacctaaacatgggcctaaggtatcatttaagnttgtcatctctaataatacacaggtcataatagca

SEQ ID NO: 25301 - DNA, 71 bp, chicken (Gallus Gallus)
  misc_feature (36): n=c or t
acccagctaagctgtctaaaagaattagatttttcngtctctttggaaacagttttcttgctacgtagaat

SEQ ID NO: 25302 - DNA, 71 bp, chicken (Gallus Gallus)
  misc_feature (36): n=a or t
ggcctggtttcacaggtgtttcagccctactcctgngtggatttggccttttcctacttgactcaaaatat

SEQ ID NO: 25303 - DNA, 71 bp, chicken (Gallus Gallus)
  misc_feature (36): n=c or t
tatgcatttcacttctctcagctataatgtatagangagaccttgaatgaaagccttgaatccatcggtca

SEQ ID NO: 25304 - DNA, 71 bp, chicken (Gallus Gallus)
  misc_feature (36): n=g or t
ggaattaccaaaatttcagtcctctaagggagaaanaatggaaagctggttactggagtatacaaataaga

SEQ ID NO: 25305 - DNA, 71 bp, chicken (Gallus Gallus)
  misc_feature (36): n=c or t
atgctccaaaataaatacaacttagtcgtctactgnacatcagtagtgtgcaccagatgtttgaaagctgt

SEQ ID NO: 25306 - DNA, 71 bp, chicken (Gallus Gallus)
  misc_feature (36): n=a or g
taagaattaatcacacattaatacttacttctgtgngtacatgccaggaaactctagtattcataacacta

SEQ ID NO: 25307 - DNA, 71 bp, chicken (Gallus Gallus)
  misc_feature (36): n=c or t
agttctgtaattatgaccatgtccctgggtaactanaggtggtggtgtcaagaaaagatactgctactaca

SEQ ID NO: 25308 - DNA, 71 bp, chicken (Gallus Gallus)
  misc_feature (36): n=a or c
cccttaagtctatggtgtttttccatattgtatttnttcacatatagttacaatgaccaaaatacagcgtt

SEQ ID NO: 25309 - DNA, 71 bp, chicken (Gallus Gallus)
  misc_feature (36): n=a or g
catctggacaacacagagcaaccagcagaagccacnacacacatgcagaaatgttatctgttttcattctt

SEQ ID NO: 25310 - DNA, 71 bp, chicken (Gallus Gallus)
  misc_feature (36): n=a or g
ttataaactagatatggcttgctagaagagtgatanaagtattacagcactgaaacacccttcatggtgtt

SEQ ID NO: 25311 - DNA, 71 bp, chicken (Gallus Gallus)
  misc_feature (36): n=c or t
atcgaaaatgtttgggctttaatttccacgtatgtnggtttctctccgttgaagaggagtgatgcttgcac

SEQ ID NO: 25312 - DNA, 71 bp, chicken (Gallus Gallus)
  misc_feature (36): n=c or g
ccccccccccttttttttacatagggtgtagtgggntaatggaagcatataattactgtgttagtattagg

SEQ ID NO: 25313 - DNA, 71 bp, chicken (Gallus Gallus)
  misc_feature (36): n=a or g
acttaatgagtattttctgcagaaaacaagtttgcnagaaagagcaccccgctccaataatttcccttaat

SEQ ID NO: 25314 - DNA, 71 bp, chicken (Gallus Gallus)
  misc_feature (36): n=a or t
ccaaagcagtaaaattctcatcagcgaggtcggtgnccatcatataaatcctttatctccctatccctgaa

SEQ ID NO: 25315 - DNA, 71 bp, chicken (Gallus Gallus)
  misc_feature (36): n=a or g
actacccagaggggttcacgacccaagacagggttnaagagaggaatacaatgttgatacagatcaacttc

SEQ ID NO: 25316 - DNA, 71 bp, chicken (Gallus Gallus)
  misc_feature (36): n=c or g
tactggtacttcattcttaataactctaacctcaangtgaggggaaaaagaggaacaaattgaggaaagta

SEQ ID NO: 25317 - DNA, 71 bp, chicken (Gallus Gallus)
  misc_feature (36): n=c or t
atccttgcttaaacagcatttatgtttgagacttangtgtgagacttaaaaaacaacacacacacacacac

SEQ ID NO: 25318 - DNA, 71 bp, chicken (Gallus Gallus)
  misc_feature (36): n=a or g
tgcgtaagtgtggaatacgaaacagttagaatatcnacatcagtgatttaaacatgtttaaaaaaaatgag

SEQ ID NO: 25319 - DNA, 71 bp, chicken (Gallus Gallus)
  misc_feature (36): n=a or g
tggctatcccaagtaaaaggaaaatgagggagcatnaactgtatgataaaaggtgagacaaagaaaagatc

SEQ ID NO: 25320 - DNA, 71 bp, chicken (Gallus Gallus)
  misc_feature (36): n=g or t
tgtagtagataaccaggactaatatgtaactttacnaagtactgatgtgctcattgttcccagtgagatac

SEQ ID NO: 25321 - DNA, 71 bp, chicken (Gallus Gallus)
  misc_feature (36): n=c or t
ttctttctaaacagtttcagcaagtcatgctactangtcaactgtgcgaagcttcctacctagcctactac

SEQ ID NO: 25322 - DNA, 71 bp, chicken (Gallus Gallus)
  misc_feature (36): n=a or g
aatgttaacacttcaccaacacacaacaggattctntgaaaagctcagaacaatgcttgaggattgtgctt

SEQ ID NO: 25323 - DNA, 71 bp, chicken (Gallus Gallus)
  misc_feature (36): n=c or t
catatacggaagagtacaaacacaaataccattttntgtagtacatgagcccattttcccacagttcctgc

SEQ ID NO: 25324 - DNA, 71 bp, chicken (Gallus Gallus)
  misc_feature (36): n=c or g
aagagctcatcaaaacttctggaggatccaagcagnagcttggatgccacacaagttaaacagcaaagaag

SEQ ID NO: 25325 - DNA, 71 bp, chicken (Gallus Gallus)
  misc_feature (36): n=a or g
gtttctctgaaatgatccattatgagtaaaacaggngtatgtgtcagcagtagcctacagatacacacatt

SEQ ID NO: 25326 - DNA, 71 bp, chicken (Gallus Gallus)
  misc_feature (36): n=g or t
tgaagagaacaggtacctcgttcagggttgcagatntcactgcaaaattgagcactgaaagttatacaagg

SEQ ID NO: 25327 - DNA, 71 bp, chicken (Gallus Gallus)
  misc_feature (36): n=a or c
cacaaatgctgctgccctaagccctcaggcaataanagagttcagtggagagcatcgatataattcagcag

SEQ ID NO: 25328 - DNA, 71 bp, chicken (Gallus Gallus)
  misc_feature (36): n=a or g
cagtgcatgtggccacctgaccgaagttttgcttcnatatgctgtcttaacagtagtgggttctctctccc

SEQ ID NO: 25329 - DNA, 71 bp, chicken (Gallus Gallus)
  misc_feature (36): n=c or t
cttccattttcccgtttctcttatttgcgttcagtntgtacctctcacagtgggccataatgcttctgatt

SEQ ID NO: 25330 - DNA, 71 bp, chicken (Gallus Gallus)
  misc_feature (36): n=g or t
gtcatttccctttgcagtttcccttttgtcttaccngaaaagattttggaatagtttttgaatagaagcag

SEQ ID NO: 25331 - DNA, 71 bp, chicken (Gallus Gallus)
  misc_feature (36): n=c or g
tcactgatggataagtaatgtgagcaactggctgantgatgtcaaatacctcctcatgctgcatgagaaat

SEQ ID NO: 25332 - DNA, 71 bp, chicken (Gallus Gallus)
  misc_feature (36): n=a or g
tgctgacaggggcttgtgtgcttccacatatgcccnggttgtagactggtagactccagaggtgtgttaac

SEQ ID NO: 25333 - DNA, 71 bp, chicken (Gallus Gallus)
  misc_feature (36): n=c or g
taactgtgtccagtgcaaaaagacctgaaatgtcanaaaacttttctgtccctgtatttctgggaggacac

SEQ ID NO: 25334 - DNA, 71 bp, chicken (Gallus Gallus)
  misc_feature (36): n=g or t
tttatctggcaaatccacagccctattttaggtatngcatgtcacctcccagctggattattttgtgtaga

SEQ ID NO: 25335 - DNA, 71 bp, chicken (Gallus Gallus)
  misc_feature (36): n=a or g
ctgtatttgtttggatgaattaatttaaaagttgtnccaatgaaggcacatatcaggaatttcatttccta

SEQ ID NO: 25336 - DNA, 71 bp, chicken (Gallus Gallus)
  misc_feature (36): n=a or g
gagctgtggtccctagggatgcatgcaaaagggacntttctttgatgcaactggcacgtgcagatcttttc

SEQ ID NO: 25337 - DNA, 71 bp, chicken (Gallus Gallus)
  misc_feature (36): n=g or t
ctcttctcagtatttgttagaggattttaatgggangggggggaggggaggaagctgtgctttgaacgaac

SEQ ID NO: 25338 - DNA, 71 bp, chicken (Gallus Gallus)
  misc_feature (36): n=c or t
gggggccttcttcaatcacggttctatttcatcccngttcgtgctagaatccattttatgccctgtttctt

SEQ ID NO: 25339 - DNA, 71 bp, chicken (Gallus Gallus)
  misc_feature (36): n=a or t
agaattgagggtgaattttttataacagtctacaantaagactcttgactctaaatcctttctttcttaaa

SEQ ID NO: 25340 - DNA, 71 bp, chicken (Gallus Gallus)
  misc_feature (36): n=a or g
ttaggggaatagaaatatttgtgtgtgcatattgtnaaaattctgaactgtgatcactgtagacaagcagt

SEQ ID NO: 25341 - DNA, 71 bp, chicken (Gallus Gallus)
  misc_feature (36): n=a or g
actggcaacattcagtccttgctccacagaacacanccaatacgtacttatcattcccagataacttaatc

SEQ ID NO: 25342 - DNA, 71 bp, chicken (Gallus Gallus)
  misc_feature (36): n=c or g
agaatgaacctaagataaagatttaagcggaaaacnctttacagccaagtgaagagccatattaaagatct

SEQ ID NO: 25343 - DNA, 71 bp, chicken (Gallus Gallus)
  misc_feature (36): n=a or g
atctgctattgttttggagatagtatctcagccacngaatgtaattccatatatttctggtgttcatttca

SEQ ID NO: 25344 - DNA, 71 bp, chicken (Gallus Gallus)
  misc_feature (36): n=a or g
gctgtttggatattccagttatcaagaaacatcttnaagcttgtggaagactgcaagagaaaaacagaaca

SEQ ID NO: 25345 - DNA, 71 bp, chicken (Gallus Gallus)
  misc_feature (36): n=c or t
ggcgtgtccggcggtgcagcgaggcgctcgcctcgngagctgcaaggagcgttcatttaaatgcagcatgg

SEQ ID NO: 25346 - DNA, 71 bp, chicken (Gallus Gallus)
  misc_feature (36): n=a or g
aagtatagctacaagtacattaggagagagcttgcnagtattttttgcaactaatgaaaactactgttact

SEQ ID NO: 25347 - DNA, 71 bp, chicken (Gallus Gallus)
  misc_feature (36): n=c or g
aggtgggacgcagcatttaaaattcagaagtcttanactgttaggccaagagctttcagcgtatcttcaga

SEQ ID NO: 25348 - DNA, 71 bp, chicken (Gallus Gallus)
  misc_feature (36): n=a or g
tttcacatcttgtctcaagagatagctacaactcgntgtaagaaacagtgaaatgatgatgtaagcatttg

SEQ ID NO: 25349 - DNA, 71 bp, chicken (Gallus Gallus)
  misc_feature (36): n=c or g
aaaagcaaggaaatggtccaactcaaaacatgccanccggccatcagtgtagtacagccaatacttccaaa

SEQ ID NO: 25350 - DNA, 71 bp, chicken (Gallus Gallus)
  misc_feature (36): n=a or c
cttgatgaggaatatagtctctggaacatctgaaancttcattcattttgaaatgatgagattgaaaacaa

SEQ ID NO: 25351 - DNA, 71 bp, chicken (Gallus Gallus)
  misc_feature (36): n=c or t
cagggtgggccttaggttcctaaccctccccgcctnctgtagggcagcttctctcctttgacatcggggaa

SEQ ID NO: 25352 - DNA, 71 bp, chicken (Gallus Gallus)
  misc_feature (36): n=c or t
ctgagctagcagtgttaactgcagcagtggcaatancgtgttcagaataatttgctgaaaagtagatctgc

SEQ ID NO: 25353 - DNA, 71 bp, chicken (Gallus Gallus)
  misc_feature (36): n=a or g
acagaaatgcacacctttgtcaggctacagctaggnaatcattttcatgagaaaaggtcaagtcagacctg

SEQ ID NO: 25354 - DNA, 71 bp, chicken (Gallus Gallus)
  misc_feature (36): n=c or t
cacacacatattttgatactggaaaagaagttgttnggaaggacatgtttatcactgttcctacagaaggc

SEQ ID NO: 25355 - DNA, 71 bp, chicken (Gallus Gallus)
  misc_feature (36): n=a or g
taacaggtgcttgtccgtgtgaggaaaactgatgcnttaccatacccacttcatgagcaagataacctcat

SEQ ID NO: 25356 - DNA, 71 bp, chicken (Gallus Gallus)
  misc_feature (36): n=a or g
ttttctgtttcaagtaaataaggaaggtggttgagnaattagatgtagtgagaattttctcttctgtgaca

SEQ ID NO: 25357 - DNA, 71 bp, chicken (Gallus Gallus)
  misc_feature (36): n=a or c
gcacgacaacttccttagtgaaacagggaaaaaaanacagaagcaccttcagactcgtccagaactcagta

SEQ ID NO: 25358 - DNA, 71 bp, chicken (Gallus Gallus)
  misc_feature (36): n=a or g
ttgcatctttaacctttttgcttagacatcaaatancgctgtcttggtaagagtgtttgggagggatagtg

SEQ ID NO: 25359 - DNA, 71 bp, chicken (Gallus Gallus)
  misc_feature (36): n=a or g
tttccaggcccttaatttcacccagctgctcatacnttggcttttctctacccataacaagtttcatacac

SEQ ID NO: 25360 - DNA, 71 bp, chicken (Gallus Gallus)
  misc_feature (36): n=c or g
ctgattatcaggaagtaagcacttagtattttctgnaaagcaagttcctttaaaatgcttccgatttagca

SEQ ID NO: 25361 - DNA, 71 bp, chicken (Gallus Gallus)
  misc_feature (36): n=c or t
cccaggtggtagcattccttctcttgagtctattcngatcccaagttgtgaggttgatgttagtcaattta

SEQ ID NO: 25362 - DNA, 71 bp, chicken (Gallus Gallus)
  misc_feature (36): n=c or t
tgagaacaaaagggttgggttatcttttgctggctntgacaggcatgttgtgtatttaaggacagacagtg

SEQ ID NO: 25363 - DNA, 71 bp, chicken (Gallus Gallus)
  misc_feature (36): n=c or g
cataaatctgcctttcctattttttactttctgtanaagggaaactctgaattcgttgtaaatgcaatcaa

SEQ ID NO: 25364 - DNA, 71 bp, chicken (Gallus Gallus)
  misc_feature (36): n=a or g
attgctggtagcaactcagtttccccattgcagacnattaatacagtctgttctcaccccacagcagtctg

SEQ ID NO: 25365 - DNA, 71 bp, chicken (Gallus Gallus)
  misc_feature (36): n=a or g
agcctatgaagatgagaatttctccactgtaacccnttaaatctacttgtctgctaccctactaggccatg

SEQ ID NO: 25366 - DNA, 71 bp, chicken (Gallus Gallus)
  misc_feature (36): n=a or g
gaaattttagtcctagcttttagtgtttattaaatntcctgtcttgcttgaaccccagtttcttgaagaag

SEQ ID NO: 25367 - DNA, 71 bp, chicken (Gallus Gallus)
  misc_feature (36): n=c or t
catgccccggcgtttcaggttcccagtctggactgncgtgtgcttagaaatgaaagcatcgctacctgaag

SEQ ID NO: 25368 - DNA, 71 bp, chicken (Gallus Gallus)
  misc_feature (36): n=c or t
ttcacaaaagaaaacttgatttcacacgacattctnctcatcaaaatattgctcatacacgcatctgagct

SEQ ID NO: 25369 - DNA, 71 bp, chicken (Gallus Gallus)
  misc_feature (36): n=c or t
atttatatttgtggataaacattactgcaggaaaantgtattttcaatacaagatgatgaattagggctgt

SEQ ID NO: 25370 - DNA, 71 bp, chicken (Gallus Gallus)
  misc_feature (36): n=c or t
agcattcatacacagcatgattttgtatagctgttnttgaacttctcctaaaccgtctgaaacttaagtta

SEQ ID NO: 25371 - DNA, 71 bp, chicken (Gallus Gallus)
  misc_feature (36): n=a or g
taacaaagtacaccatttcacacacaaactgacagnagtcacagcaacaaccagatgcatgagttaaacaa

SEQ ID NO: 25372 - DNA, 71 bp, chicken (Gallus Gallus)
  misc_feature (36): n=g or t
agagtgcagcagagagaagataatcttcttcatganatacattatttaaaacaagctacttttatactatt

SEQ ID NO: 25373 - DNA, 71 bp, chicken (Gallus Gallus)
  misc_feature (36): n=c or t
aaactgtaatggagattgaaagtgggtgttggcgangacaccaaagagaaggggggaggggagagagaggg

SEQ ID NO: 25374 - DNA, 71 bp, chicken (Gallus Gallus)
  misc_feature (36): n=g or t
gtgaaggggggatgtgctcactgtggacagtagacnaacacagatgcactgtactcacaagaacctttttt

SEQ ID NO: 25375 - DNA, 71 bp, chicken (Gallus Gallus)
  misc_feature (36): n=c or t
cacccaaaacccaaaccctgcatctgagcatgttgnccaaatgcttcttgagctctggcagcccagggcca

SEQ ID NO: 25376 - DNA, 71 bp, chicken (Gallus Gallus)
  misc_feature (36): n=a or t
ttggaaatttttccttgctatgagggtgatcagacnccagaacagtacccaaagtcactggagaagaaacc

SEQ ID NO: 25377 - DNA, 71 bp, chicken (Gallus Gallus)
  misc_feature (36): n=c or t
atgttttctcccttggcaaagtgtatatctcctcangtacagccttctgagcagcaattctctagcagaag

SEQ ID NO: 25378 - DNA, 71 bp, chicken (Gallus Gallus)
  misc_feature (36): n=a or g
tgcttactcagctgcatgctctacttatgctggcangcagatggagagtggtgatgatctgtgtgcttgag

SEQ ID NO: 25379 - DNA, 71 bp, chicken (Gallus Gallus)
  misc_feature (36): n=c or t
ttaccagtttaatttgtgctctgccgctggactttnggcccaacactttgagtttcttcttctggatttgg

SEQ ID NO: 25380 - DNA, 71 bp, chicken (Gallus Gallus)
  misc_feature (36): n=a or c
cttacctctcaataattcttgtgcaaataaaaaatnatttagctaaggatagaggaataatatcataattg

SEQ ID NO: 25381 - DNA, 71 bp, chicken (Gallus Gallus)
  misc_feature (36): n=a or t
taagagatgcaccttcactgcagatttaataaagcncttcactggactagttaactcactcagcttccaga

SEQ ID NO: 25382 - DNA, 71 bp, chicken (Gallus Gallus)
  misc_feature (36): n=a or g
acctctattcaactctttaattgattctgaatgaancaggaattgccctactatttgcctaatccaaatta

SEQ ID NO: 25383 - DNA, 71 bp, chicken (Gallus Gallus)
  misc_feature (36): n=c or t
gttatttcattgaatcatacagtcatagagtcattngagttgcaagagacacttaaaggccgtctggtccc

SEQ ID NO: 25384 - DNA, 71 bp, chicken (Gallus Gallus)
  misc_feature (36): n=c or t
catctttttcttgccatgttttacagagtgtgttgnatgtgaagtatctgtagcctttaagttttaaacac

SEQ ID NO: 25385 - DNA, 71 bp, chicken (Gallus Gallus)
  misc_feature (36): n=a or g
gatgggggagggagattagaagtctacttttattcnttttaaacctaagctttccatcatagtttactgag

SEQ ID NO: 25386 - DNA, 71 bp, chicken (Gallus Gallus)
  misc_feature (36): n=a or g
gtcaaatctgccactacacaagagtgcttgaacaanctgagccttaattttttcccaggccagctgactgt

SEQ ID NO: 25387 - DNA, 71 bp, chicken (Gallus Gallus)
  misc_feature (36): n=a or c
tgaagccaatcataaaccttgcccacagtttggggnaaaattagctgcgatgcaaatccttggcacaggct

SEQ ID NO: 25388 - DNA, 71 bp, chicken (Gallus Gallus)
  misc_feature (36): n=a or t
tgtgaataccttcatatgcagatacatcttattggngggtgattaaattttcaatctcaatatataatttt

SEQ ID NO: 25389 - DNA, 71 bp, chicken (Gallus Gallus)
  misc_feature (36): n=a or g
gtaggtcaccatgacaggaacaggtcaatagaacantgcagttgctgctgaggaccttgcagtcatgcact

SEQ ID NO: 25390 - DNA, 71 bp, chicken (Gallus Gallus)
  misc_feature (36): n=c or t
ttgaaggacataccctataaatctgcacaacctatngtctgtctatagagaaataggagaaaccactattc

SEQ ID NO: 25391 - DNA, 71 bp, chicken (Gallus Gallus)
  misc_feature (36): n=c or t
gagcagcagttttgaataacacttgacaagctctgntaaggtttcttctctggaaaaatcttgcttgtttt

SEQ ID NO: 25392 - DNA, 71 bp, chicken (Gallus Gallus)
  misc_feature (36): n=c or t
aaaggaagttctaccatcacaaggtgcataaggcgntaatgaacaaagacaaataatgcatcttgcctacc

SEQ ID NO: 25393 - DNA, 71 bp, chicken (Gallus Gallus)
  misc_feature (36): n=g or t
gtcacttgctcactccccaccccgcaatgagacagnggagagaacaggaaaagataagtgagaaaatgcat

SEQ ID NO: 25394 - DNA, 71 bp, chicken (Gallus Gallus)
  misc_feature (36): n=a or c
gtacctattatcagagaatgttttgcagtgctgtgntggggaataagcttaagctagtcataaaaccttaa

SEQ ID NO: 25395 - DNA, 71 bp, chicken (Gallus Gallus)
  misc_feature (36): n=a or g
tgtactccatacttgtccacagtggatcaattccantatgcacattcatgagcaggacatagtacttcaga

SEQ ID NO: 25396 - DNA, 71 bp, chicken (Gallus Gallus)
  misc_feature (36): n=a or g
aggactggagatggaattcaggattcgggtaggganatttggatagggagatattagggtagtatggttag

SEQ ID NO: 25397 - DNA, 71 bp, chicken (Gallus Gallus)
  misc_feature (36): n=g or t
gttgtgcccaaagtaatcaatgaaatattgatgatngtgtgcatctaaagataaacacaaagatggtgttt

SEQ ID NO: 25398 - DNA, 71 bp, chicken (Gallus Gallus)
  misc_feature (36): n=a or g
agaatttaaggcagatttggttctttagccattgcntgtggacattaagtctctcaccttaatgttcctgc

SEQ ID NO: 25399 - DNA, 71 bp, chicken (Gallus Gallus)
  misc_feature (36): n=c or g
ttgaagcaaacaattttgtaataacttttgcaagcncatggggtggaaaagtgcttctttttccttctttt

SEQ ID NO: 25400 - DNA, 71 bp, chicken (Gallus Gallus)
  misc_feature (36): n=a or c
aaagggagaaggagagtccctttacagtaaggaccntgtgcaacctattacaagtacagaaggcatggcgg

SEQ ID NO: 25401 - DNA, 71 bp, chicken (Gallus Gallus)
  misc_feature (36): n=c or t
gttcctagaaaacctctctatttgttaagctctttntttgttaaggtctcagggatctgaatcattctgct

SEQ ID NO: 25402 - DNA, 71 bp, chicken (Gallus Gallus)
  misc_feature (36): n=a or t
aactgcgtgcagagcagatgagaagctaatcaagtnaatttagatgacaattaaaggacagtaaggacctt

SEQ ID NO: 25403 - DNA, 71 bp, chicken (Gallus Gallus)
  misc_feature (36): n=a or g
agtttcttagggcagaaaattatcgaagacagaaanaagggaaaaaaaaaaaaggagctttagtgcatatt

SEQ ID NO: 25404 - DNA, 71 bp, chicken (Gallus Gallus)
  misc_feature (36): n=a or g
acaccatcctgcaaggcatggaggaggtcagcagcnatgcattactcattatttcccacagccataagtgg

SEQ ID NO: 25405 - DNA, 71 bp, chicken (Gallus Gallus)
  misc_feature (36): n=a or g
attattttttccgtgttctaaaagaaaatgaaaagnctttcagaatgtgtcttcctagtgagaccttttac

SEQ ID NO: 25406 - DNA, 71 bp, chicken (Gallus Gallus)
  misc_feature (36): n=c or g
aagaaggtacttctatctgtagatacctcataactntagaaagattccttgagccctgtaaaaattttgag

SEQ ID NO: 25407 - DNA, 71 bp, chicken (Gallus Gallus)
  misc_feature (36): n=a or g
ccactgttaaaatttcagtcacatggaaagcttgcntacagttatcagaaggtacgtaagactgagccact

SEQ ID NO: 25408 - DNA, 71 bp, chicken (Gallus Gallus)
  misc_feature (36): n=c or t
aaagaaaccagttgtctgcaaaactagtacttctancgagaaatttagtaggttcagtagaccagcagaag

SEQ ID NO: 25409 - DNA, 71 bp, chicken (Gallus Gallus)
  misc_feature (36): n=g or t
gaagtgaccactagtcttgtggattcatttggtttnaaatatctctgtatagagatgacagcaaattatta

SEQ ID NO: 25410 - DNA, 71 bp, chicken (Gallus Gallus)
  misc_feature (36): n=a or g
aacagagttaaatgagctatatgcaatatctgttgnggttcacagacagtgtcccgtttgcgccaatgagc

SEQ ID NO: 25411 - DNA, 71 bp, chicken (Gallus Gallus)
  misc_feature (36): n=a or g
ctatatatattcttatgacatacgtacaaatatatntaataaataacatgttactaccaattgcagtgtgt

SEQ ID NO: 25412 - DNA, 71 bp, chicken (Gallus Gallus)
  misc_feature (36): n=a or g
tggttctgaagacctactgacctgcttcctgctgtncccaaaccctccctgccttcctcttttttttttta

SEQ ID NO: 25413 - DNA, 71 bp, chicken (Gallus Gallus)
  misc_feature (36): n=a or g
gaaagccaaggaaatgaaactagttatttttggaantgactcagaagctctcttgtaccaagtacttattt

SEQ ID NO: 25414 - DNA, 71 bp, chicken (Gallus Gallus)
  misc_feature (36): n=c or t
ccttctgcctttttctgttcttctccaaaatctgcntgtcttcctgggtctctgaaagttagcataatctg

SEQ ID NO: 25415 - DNA, 71 bp, chicken (Gallus Gallus)
  misc_feature (36): n=c or t
gcagctgtttggtgcagactgctgtgctgttcctcnggcttgcaactcagatactacaaatctgactccgc

SEQ ID NO: 25416 - DNA, 71 bp, chicken (Gallus Gallus)
  misc_feature (36): n=a or c
atcccacggaaagaactggttgtggcctatgttatntttttccctagctatctgttcctgttgctgcctta

SEQ ID NO: 25417 - DNA, 71 bp, chicken (Gallus Gallus)
  misc_feature (36): n=a or c
tttaaaacgccacagaaaagaataagcagactttgnaaatccagtttggaggctaacatcttgacagtggt

SEQ ID NO: 25418 - DNA, 71 bp, chicken (Gallus Gallus)
  misc_feature (36): n=a or c
tgtgccaggcgtgcagtgggcacagtgctgcacacngctttcctagccttgtaccagcacacagaccacgt

SEQ ID NO: 25419 - DNA, 71 bp, chicken (Gallus Gallus)
  misc_feature (36): n=c or t
caaatacagcaacaggaagacaaccctatgcacatntgtcaggagctattgaaccaatgtgagactgaagg

SEQ ID NO: 25420 - DNA, 71 bp, chicken (Gallus Gallus)
  misc_feature (36): n=c or t
tgtgttttagtgactaaaactgaaataaatatatcncgagagtgttcagagatctgcaaataataataaca

SEQ ID NO: 25421 - DNA, 71 bp, chicken (Gallus Gallus)
  misc_feature (36): n=c or t
tccaaaacttagtataccataatgtttgtaggtaangggattaaaattctgggaaaccctgacttttatgg

SEQ ID NO: 25422 - DNA, 71 bp, chicken (Gallus Gallus)
  misc_feature (36): n=a or g
agtccactgaagttctcgatcttccagatgtaaatnccattacattgttgtgcctccatttcagtaatctt

SEQ ID NO: 25423 - DNA, 71 bp, chicken (Gallus Gallus)
  misc_feature (36): n=c or t
cgcagagatcaaaagttgttccggttaaagtgctgngcagatttcagtgtgccaagtggaatgatatgaca

SEQ ID NO: 25424 - DNA, 71 bp, chicken (Gallus Gallus)
  misc_feature (36): n=c or t
atttgggtataccaaggcacagtccttgttcactcnaagcccgttatgtgaggattaagaaggttggagcc

SEQ ID NO: 25425 - DNA, 71 bp, chicken (Gallus Gallus)
  misc_feature (36): n=a or t
atacaactctccgtatgctttatgtgttccagcaanaattaactcttactcaagcctttatcactgtaatt

SEQ ID NO: 25426 - DNA, 71 bp, chicken (Gallus Gallus)
  misc_feature (36): n=a or g
atcgagttagtatagtctccatagattgcctttgcngtaactgcagctctcaagaaaagacattcaggttt

SEQ ID NO: 25427 - DNA, 71 bp, chicken (Gallus Gallus)
  misc_feature (36): n=a or g
catgtttgcatggcattctttggattgcagtatggnagccccaccttgacatccttgatggaatatggaaa

SEQ ID NO: 25428 - DNA, 71 bp, chicken (Gallus Gallus)
  misc_feature (36): n=a or g
ttttaaaatatagctccaggtcttgaaaaagaaaantgttctttctcattccccgttgaaaaggaagacaa

SEQ ID NO: 25429 - DNA, 71 bp, chicken (Gallus Gallus)
  misc_feature (36): n=a or g
catgtgcgtgttgctgtgttaaagaccaatgatagnaaagatcaggtctgaaagtcattaatctgacttag

SEQ ID NO: 25430 - DNA, 71 bp, chicken (Gallus Gallus)
  misc_feature (36): n=a or g
gaagatctatgtgctgtctcttactctgaggaacanatttataggacctaaaaacaattttgcctttaatg

SEQ ID NO: 25431 - DNA, 71 bp, chicken (Gallus Gallus)
  misc_feature (36): n=a or c
tgcaacgggcatatatgcatgtccacctcttagagngcacactagatgatattcatctcagctaacttctg

SEQ ID NO: 25432 - DNA, 71 bp, chicken (Gallus Gallus)
  misc_feature (36): n=a or g
atcctactagtatattgcacaaagcaagttattacnttcctcagcaaaagtattttggatgcaagaactat

SEQ ID NO: 25433 - DNA, 71 bp, chicken (Gallus Gallus)
  misc_feature (36): n=c or t
gcaactgtttccaactgcttataagaatatcaaaantaggcagacacaatgcagcaccttcacaaccctgt

SEQ ID NO: 25434 - DNA, 71 bp, chicken (Gallus Gallus)
  misc_feature (36): n=c or t
ggagaaactacccttgaaacattttttcttgtatcnggtgtttgcctttgtttctcatcttgaaattaaaa

SEQ ID NO: 25435 - DNA, 71 bp, chicken (Gallus Gallus)
  misc_feature (36): n=a or t
tccagacagtgtttatatgtgggcacatgctctccnacacttgaaaaccagcatacgaaatctttggctgg

SEQ ID NO: 25436 - DNA, 71 bp, chicken (Gallus Gallus)
  misc_feature (36): n=c or g
aacataaccttgcatggccactggagatgaagctanggcttcacttatcatgaaatcctcaaacagtatta

SEQ ID NO: 25437 - DNA, 71 bp, chicken (Gallus Gallus)
  misc_feature (36): n=a or g
acttacactttatacctctatttctccactaaactnaattttaaactgcaattttaccttggtatctgaat

SEQ ID NO: 25438 - DNA, 71 bp, chicken (Gallus Gallus)
  misc_feature (36): n=a or g
caaaatgtgtacgtaacagtagtgaaaagatctgangacatttgacattttatgttctccttgagccgact

SEQ ID NO: 25439 - DNA, 71 bp, chicken (Gallus Gallus)
  misc_feature (36): n=a or g
tgaagttttccaaggaaaatgggagcagaatgaaantagaggatggagtcttttttcctatgttttgagta

SEQ ID NO: 25440 - DNA, 71 bp, chicken (Gallus Gallus)
  misc_feature (36): n=c or g
tgcatttatgtttaggaatttaccacaactgctctntcttttgaagtaaatttgtgaattctagctatgtg

SEQ ID NO: 25441 - DNA, 71 bp, chicken (Gallus Gallus)
  misc_feature (36): n=c or t
tgggaaaaagaaacaggagggaaagaactgagggtncctcacctccacaccagggcagcaagaggtgaggc

SEQ ID NO: 25442 - DNA, 71 bp, chicken (Gallus Gallus)
  misc_feature (36): n=g or t
tgtttttctctcttaaagaagtgggcagaaattcanccatctctcatgaagagagaccttgtttctataga

SEQ ID NO: 25443 - DNA, 71 bp, chicken (Gallus Gallus)
  misc_feature (36): n=c or t
gcactgaactgttcagcctgagctcatcaagtcacngcaacaagtggaaattattacttctggtgagcaag

SEQ ID NO: 25444 - DNA, 71 bp, chicken (Gallus Gallus)
  misc_feature (36): n=c or t
ttcacacatgtgcaggatacctttcatcccaggggntgtgttcaagcagaaagacaaacagagcctttttg

SEQ ID NO: 25445 - DNA, 71 bp, chicken (Gallus Gallus)
  misc_feature (36): n=a or g
agaaattacatttccaaacaacctaacagataacanttgccagtgtacagggaaatacaaaatacctcttt

SEQ ID NO: 25446 - DNA, 71 bp, chicken (Gallus Gallus)
  misc_feature (36): n=a or g
taaagacttatcgtcctagaacaaagaagcataatngatcaattagctgagaagattgagaatcagttgtg

SEQ ID NO: 25447 - DNA, 71 bp, chicken (Gallus Gallus)
  misc_feature (36): n=a or g
gaaattctgatactgacattatcttaggtttctgcngtattgaatagtgagaaatacgtaagttatagcaa

SEQ ID NO: 25448 - DNA, 71 bp, chicken (Gallus Gallus)
  misc_feature (36): n=a or g
aaataagttctctcttctccacactgccatgctganagcttatctacatcaaaagtaaagactcccagaga

SEQ ID NO: 25449 - DNA, 71 bp, chicken (Gallus Gallus)
  misc_feature (36): n=c or t
acccagtcggccacgcagaagctctgcagcagcttngttgcagtctcaaatgcaggtgtttcccgagtctt

SEQ ID NO: 25450 - DNA, 71 bp, chicken (Gallus Gallus)
  misc_feature (36): n=c or t
ttggactgagtgaaaaacatacagaagagagaacangcagcaaaggggtttgttaggtgacttgtgtgggc

SEQ ID NO: 25451 - DNA, 71 bp, chicken (Gallus Gallus)
  misc_feature (36): n=c or t
agtgtgaatgctttctaaagtagaggacaaaatatntagtgaagaaggcatgtctcaagaagcatgtgttc

SEQ ID NO: 25452 - DNA, 71 bp, chicken (Gallus Gallus)
  misc_feature (36): n=c or g
atattcatttgtcatctgtgctctttccttgtcatntcagcctgaaccctgacatttctccacacccaggc

SEQ ID NO: 25453 - DNA, 71 bp, chicken (Gallus Gallus)
  misc_feature (36): n=a or g
catgccgttgctcgtgtatctacaatttggttgtgntgtaactggtttttagtacttaacataaaataacg

SEQ ID NO: 25454 - DNA, 71 bp, chicken (Gallus Gallus)
  misc_feature (36): n=a or g
taattgcagttctttgcaaagtactctttaaacttncaatgaaagaactcatgtaaaatggaactgtttac

SEQ ID NO: 25455 - DNA, 71 bp, chicken (Gallus Gallus)
  misc_feature (36): n=a or t
ttgtatgatcatacaaagtaaaatacagaagtggantttttattgttagttccagtggatctcataactca

SEQ ID NO: 25456 - DNA, 71 bp, chicken (Gallus Gallus)
  misc_feature (36): n=a or g
gggacacatcctccgtttcttgcaaaatggatacanaagggtactatcctcacaacccttcaatgtccagt

SEQ ID NO: 25457 - DNA, 71 bp, chicken (Gallus Gallus)
  misc_feature (36): n=a or g
aattaatatggcactttgcctggcccaatgagttcngtttctttaattaggctaggcaggatgctgatgtg

SEQ ID NO: 25458 - DNA, 71 bp, chicken (Gallus Gallus)
  misc_feature (36): n=c or t
gtagtctaccctccaaggccggtcgtgggtgcttcngaaaactgtgtccttgcatggtgtggtaaatctgt

SEQ ID NO: 25459 - DNA, 71 bp, chicken (Gallus Gallus)
  misc_feature (36): n=a or t
ttttttaaaaatagagaagtgaaatctcttttaaanggagaatgattcagaaacccctactaaaaaggtat

SEQ ID NO: 25460 - DNA, 71 bp, chicken (Gallus Gallus)
  misc_feature (36): n=c or g
tacctttaaacacctcactgaacagagctgggcaantgaggagcaaattatatcactagcaaaatgagagc

SEQ ID NO: 25461 - DNA, 71 bp, chicken (Gallus Gallus)
  misc_feature (36): n=c or t
ctgcaatttgctaagcgtttgcctggaattaacagnctgatagtactcagacaggagtaatgttttcaagt

SEQ ID NO: 25462 - DNA, 71 bp, chicken (Gallus Gallus)
  misc_feature (36): n=a or g
tactcctagtttctacagtctgaatttcgtgtctcnttattcagtgaatgttgagagtaagtacatatata

SEQ ID NO: 25463 - DNA, 71 bp, chicken (Gallus Gallus)
  misc_feature (36): n=c or t
gaaaagaagctggaaacgggggacattctgcaagangaacgatttcagcagcttattgagattgtggattc

SEQ ID NO: 25464 - DNA, 71 bp, chicken (Gallus Gallus)
  misc_feature (36): n=c or t
ttcatccacctacgtatacccttaattaaatactanagactaaagacaattttttgagtaagaaaagagca

SEQ ID NO: 25465 - DNA, 71 bp, chicken (Gallus Gallus)
  misc_feature (36): n=c or t
tatgtgaaggcagcaagggggtctcctctgagccanctcctctaagggatgaaacgaccacataggctctc

SEQ ID NO: 25466 - DNA, 71 bp, chicken (Gallus Gallus)
  misc_feature (36): n=c or t
taaatgtaaatcatcacattcacttttaaaagcagnataattacattactgcaatctgataatttcacaat

SEQ ID NO: 25467 - DNA, 71 bp, chicken (Gallus Gallus)
  misc_feature (36): n=a or g
tttcttacttatttaataggttgtgctaaaatacanaggtcttaaaaaatctttatttgggtgagaggggg

SEQ ID NO: 25468 - DNA, 71 bp, chicken (Gallus Gallus)
  misc_feature (36): n=a or c
gcatgcatgctctttgaaataagaacgttctagtcnactgactataggttcatgtaagtatataagtaatg

SEQ ID NO: 25469 - DNA, 71 bp, chicken (Gallus Gallus)
  misc_feature (36): n=a or g
gattccttgagtgtacaacttagtttgaattcttcncaggatcttgcaaactctcgcgtgctttattttag

SEQ ID NO: 25470 - DNA, 71 bp, chicken (Gallus Gallus)
  misc_feature (36): n=c or t
aagtggggcagggtcttggttcaacttttgctgcantggagccttactaagctgcagttgtacagagtagt

SEQ ID NO: 25471 - DNA, 71 bp, chicken (Gallus Gallus)
  misc_feature (36): n=c or g
gttgagagagttatctgttcttgaaagttatgcaancacataaaattgtatttaaataatatattcttatt

SEQ ID NO: 25472 - DNA, 71 bp, chicken (Gallus Gallus)
  misc_feature (36): n=c or t
ttccactccatggctcacagttctctgcagtgatanattttcacagaatggtgccttttttgtaacatttc

SEQ ID NO: 25473 - DNA, 71 bp, chicken (Gallus Gallus)
  misc_feature (36): n=a or c
acgttgctcctttctcgtagctggctgatatccagngtggaactgtaatgctgtggaatgtgaaagactgc

SEQ ID NO: 25474 - DNA, 71 bp, chicken (Gallus Gallus)
  misc_feature (36): n=a or g
ttacaaacaatattttggaaatgactgctgactacntacgctatatacattcatgctattaaacacaaatt

SEQ ID NO: 25475 - DNA, 71 bp, chicken (Gallus Gallus)
  misc_feature (36): n=a or g
aaagcagaaccaaaatgaactgtgaaagacagatgncaagacaaaagtatctctgaagtaaacttcagtgc

SEQ ID NO: 25476 - DNA, 71 bp, chicken (Gallus Gallus)
  misc_feature (36): n=a or g
ctctttttagaacaaactatttttcccagtcttgcnataatttctctattactccaaagtcgtttttatat

SEQ ID NO: 25477 - DNA, 71 bp, chicken (Gallus Gallus)
  misc_feature (36): n=g or t
acagtcacagtgctgttgtgctcctagcattaagtnagaaatcagtgttactgggggagcaaactcccaaa

SEQ ID NO: 25478 - DNA, 71 bp, chicken (Gallus Gallus)
  misc_feature (36): n=c or g
gtcattacagcatacttccagtcctctagtttaagnctcctgtaagagggaattgtggaagaagtgaaagt

SEQ ID NO: 25479 - DNA, 71 bp, chicken (Gallus Gallus)
  misc_feature (36): n=c or t
cctacttttaaatctgcaaaattctgtggttacctntgctccctcgcttcagttatttgtttttgtgatgc

SEQ ID NO: 25480 - DNA, 71 bp, chicken (Gallus Gallus)
  misc_feature (36): n=g or t
acatctgttattttccaaatagtgaaaaaaacttgncctttcttataggttttatatgctctctgtaatga

SEQ ID NO: 25481 - DNA, 71 bp, chicken (Gallus Gallus)
  misc_feature (36): n=a or t
aggagtattcagtatttcagtatttttaacttcacngctcttggagcatttttttgtaagacttcttgtga

SEQ ID NO: 25482 - DNA, 71 bp, chicken (Gallus Gallus)
  misc_feature (36): n=c or t
ttctcttgtattcagccctgagattcagtttctttnatggctttttaatccacagatcaaaatttctttct

SEQ ID NO: 25483 - DNA, 71 bp, chicken (Gallus Gallus)
  misc_feature (36): n=c or g
atgagatgagataccaggtaaattccctttccccangtgtgattgggtcaggctatagttttcaaaatctg

SEQ ID NO: 25484 - DNA, 71 bp, chicken (Gallus Gallus)
  misc_feature (36): n=c or t
acaaaacggaacaaaccgattggaatcgcttgctcngtttacacacagcatgtgtaggatgttttgggatc

SEQ ID NO: 25485 - DNA, 71 bp, chicken (Gallus Gallus)
  misc_feature (36): n=c or t
aggtcttttccaacttcagcgattctgtgattctangatgattctgcagttattctcctcgtgctctctac

SEQ ID NO: 25486 - DNA, 71 bp, chicken (Gallus Gallus)
  misc_feature (36): n=a or g
cttctcatagtgaaaatatattcctgctaatcatantaactgatcacatcatggtcagaatgtggggacta

SEQ ID NO: 25487 - DNA, 71 bp, chicken (Gallus Gallus)
  misc_feature (36): n=c or t
ctttccttgttttcttctcttgtgagctcctcaatnctatctcgtaagtagcccaccaaacaactctcatt

SEQ ID NO: 25488 - DNA, 71 bp, chicken (Gallus Gallus)
  misc_feature (36): n=c or t
agaccatgtataaagcctctgctgcctaggaccacnttaggagtaattagggtttggggttgctggcaaga

SEQ ID NO: 25489 - DNA, 71 bp, chicken (Gallus Gallus)
  misc_feature (36): n=a or g
tcgcagtgctgtattgcatacagctgtagcgctgcnttggatattttcatgttatggtgttgtcacatttt

SEQ ID NO: 25490 - DNA, 71 bp, chicken (Gallus Gallus)
  misc_feature (36): n=g or t
ttgaagaaaaaaaataatgttgagtatctggagatngtcttcagagtggaagagaacaaatcattctttgt

SEQ ID NO: 25491 - DNA, 71 bp, chicken (Gallus Gallus)
  misc_feature (36): n=c or t
ataggcatttatatattattcaaaataagcagcaanagaaaaatcaggaaaacaaaacaaaaaaaaaccaa

SEQ ID NO: 25492 - DNA, 71 bp, chicken (Gallus Gallus)
  misc_feature (36): n=c or t
tgtcaggaggatgcctaaggatcactccatttacgngctggcacagcattagctcttatctcctccgtcag

SEQ ID NO: 25493 - DNA, 71 bp, chicken (Gallus Gallus)
  misc_feature (36): n=g or t
cgttagttcagaataaaaagactgatagctttagantattctgtttcatcatctcaagcaaactgaaacag

SEQ ID NO: 25494 - DNA, 71 bp, chicken (Gallus Gallus)
  misc_feature (36): n=a or g
gccagttctcaggctttttgagattttcttccccanattcatccctgctgaaatgttacttttgtaacttc

SEQ ID NO: 25495 - DNA, 71 bp, chicken (Gallus Gallus)
  misc_feature (36): n=a or g
tatacaagctcaaaatattttgaattatttttgctnttctacagaatttaagctttcatatttcaagacca

SEQ ID NO: 25496 - DNA, 71 bp, chicken (Gallus Gallus)
  misc_feature (36): n=a or g
ttatttcataagctattattttatgtaagtatatgnaaaatacatctatgtttcttcttaagttgcaactc

SEQ ID NO: 25497 - DNA, 71 bp, chicken (Gallus Gallus)
  misc_feature (36): n=g or t
ttttgaaaaacagataatggaaaatccttttgacanagtacaaaagaccaaatccattgctgacatcccta

SEQ ID NO: 25498 - DNA, 71 bp, chicken (Gallus Gallus)
  misc_feature (36): n=c or t
attactaagtccagctcagtgtctgacccagaggantcatccagaaaggcatgctttatgcctcactaaat

SEQ ID NO: 25499 - DNA, 71 bp, chicken (Gallus Gallus)
  misc_feature (36): n=c or t
ttaaaaactaaggaaacaaatcaaaaaaactgaacncttacagaaagagcgtgagtccacaagtgctatcc

SEQ ID NO: 25500 - DNA, 71 bp, chicken (Gallus Gallus)
  misc_feature (36): n=g or t
tttcatgtttgttttttgtcagctattcttcactancataagttctcactgggaatacgtttcaaagtctc

SEQ ID NO: 25501 - DNA, 71 bp, chicken (Gallus Gallus)
  misc_feature (36): n=a or g
atgccatggcagagatcagatggaaaggctgaatcntatctcctgggttgtaagcattcaggcaattccaa

SEQ ID NO: 25502 - DNA, 71 bp, chicken (Gallus Gallus)
  misc_feature (36): n=a or c
gggcactgctttgagatgcaaccgtcagtcacttancttaagttgcatgaattacactggaaaaccattca

SEQ ID NO: 25503 - DNA, 71 bp, chicken (Gallus Gallus)
  misc_feature (36): n=c or t
tgttgacctctaaacctgttcttgcgttatctatanatcttattgctcttggcataaattctcaggagtat

SEQ ID NO: 25504 - DNA, 71 bp, chicken (Gallus Gallus)
  misc_feature (36): n=c or t
gactttgtacaatgtcactaaatcagtaataggaanggctttcaagctgtcatgtccacagacaagaacac

SEQ ID NO: 25505 - DNA, 71 bp, chicken (Gallus Gallus)
  misc_feature (36): n=a or g
ctttattcctggcttacctgtattgatttggatacncttttaactgaggaaatcagacattgccctgtatt

SEQ ID NO: 25506 - DNA, 71 bp, chicken (Gallus Gallus)
  misc_feature (36): n=a or t
gctaggatggggctgcagacagaaataaaacagatntcatcatttactttattttatatatatttacctat

SEQ ID NO: 25507 - DNA, 71 bp, chicken (Gallus Gallus)
  misc_feature (36): n=a or g
tgtaaggaccttaatttatgccagctcaggttctcntacttctcttttaggacacgtggtatgattggttt

SEQ ID NO: 25508 - DNA, 71 bp, chicken (Gallus Gallus)
  misc_feature (36): n=a or t
ttgtagtattgtcagcgtaggggctggaagggaccnctggagatcgtttagtaataagttatataaatata

SEQ ID NO: 25509 - DNA, 71 bp, chicken (Gallus Gallus)
  misc_feature (36): n=c or t
gctaaatcctattttgttgattttaatccttctttnaactgcagcttctccatttcttatcacttttgtat

SEQ ID NO: 25510 - DNA, 71 bp, chicken (Gallus Gallus)
  misc_feature (36): n=a or g
tcctattgattctttgtctcaagatctatagctagncagcagcattacaaccctaactcggatcctgctga

SEQ ID NO: 25511 - DNA, 71 bp, chicken (Gallus Gallus)
  misc_feature (36): n=a or g
tctgtcttacttctctaggataacaacctaaaaatnttgattatcaaaatcaagaggaacaatacaatcca

SEQ ID NO: 25512 - DNA, 71 bp, chicken (Gallus Gallus)
  misc_feature (36): n=c or t
atgttgaaaggctattgatctggcaggtgaaaaacnccacatttcatttccagggaaaatgaaacagagac

SEQ ID NO: 25513 - DNA, 71 bp, chicken (Gallus Gallus)
  misc_feature (36): n=a or t
ataaagtcaaccctctctatatgcaaattatttatntatatatatatatataaaatatttatgtatgcata

SEQ ID NO: 25514 - DNA, 71 bp, chicken (Gallus Gallus)
  misc_feature (36): n=c or t
gatgtttcctgtataaaacatgattccatttggganggattttttaatctaacagggcaatcagagtggta

SEQ ID NO: 25515 - DNA, 71 bp, chicken (Gallus Gallus)
  misc_feature (36): n=a or g
ttcatagccatcagctctccagtgtcaacactaatncaggtatatactttcccatattggccttcacctgc

SEQ ID NO: 25516 - DNA, 71 bp, chicken (Gallus Gallus)
  misc_feature (36): n=a or g
caacactatctgatgaaatctacaaggactactgcnaaactggtggtgaagctgtagatgggagcagctct

SEQ ID NO: 25517 - DNA, 71 bp, chicken (Gallus Gallus)
  misc_feature (36): n=c or t
gcaggagtcccagacttcatttgttatgcagagagngttcaggcaaagctgctagtgtctgctgttattgc

SEQ ID NO: 25518 - DNA, 71 bp, chicken (Gallus Gallus)
  misc_feature (36): n=a or t
tactagattatggatgctttattttggttttgtcantttttttctactttcagagactcacattagtaagt

SEQ ID NO: 25519 - DNA, 71 bp, chicken (Gallus Gallus)
  misc_feature (36): n=a or t
agaagaaaaacctcaactaaaagtagctgttctatngaatcacatttgccaaagagaatagcagcagtgaa

SEQ ID NO: 25520 - DNA, 71 bp, chicken (Gallus Gallus)
  misc_feature (36): n=a or c
attttcccatgcattcactctgaaaccaaagaagcnttctgcatgcctaattaaacacagcacacttataa

SEQ ID NO: 25521 - DNA, 71 bp, chicken (Gallus Gallus)
  misc_feature (36): n=c or t
tttagcaaaaagggctgtctgtgcaggagagatttngcacttagacgtggagcttactaataacatggcaa

SEQ ID NO: 25522 - DNA, 71 bp, chicken (Gallus Gallus)
  misc_feature (36): n=c or t
agaagatttgatatgcttttaatttgttttgcagantttggtggaggaggttgtctgaacaccagtgatcc

SEQ ID NO: 25523 - DNA, 71 bp, chicken (Gallus Gallus)
  misc_feature (36): n=a or g
caaactcactcacatgaaacagcctgtccatatacngcaacagaattaatggacctggtacaacggttctg

SEQ ID NO: 25524 - DNA, 71 bp, chicken (Gallus Gallus)
  misc_feature (36): n=a or g
ttttatcacatctactctcaaagaaaaggggaaaantcgccaggaagcccacgtggaagtcaccgcgttcg

SEQ ID NO: 25525 - DNA, 71 bp, chicken (Gallus Gallus)
  misc_feature (36): n=g or t
ttaattaagttctgagaaatttttcccagcaggagntttttttagctgggaagatgcaaagtggcattctc

SEQ ID NO: 25526 - DNA, 71 bp, chicken (Gallus Gallus)
  misc_feature (36): n=c or t
gtctttttggagacaaggatacacattaaagatatntttcttttcctcaccaaacaagcagacaaactcat

SEQ ID NO: 25527 - DNA, 71 bp, chicken (Gallus Gallus)
  misc_feature (36): n=a or g
attacccgttttccactcagtcatcacttgtttttngaaaaaatacacgttgtcttaaaggagtacaacat

SEQ ID NO: 25528 - DNA, 71 bp, chicken (Gallus Gallus)
  misc_feature (36): n=c or t
cagcagccttgcaggtgagttttgccaaaataccanttaaaacactgaagtacttatatctgaagtaggca

SEQ ID NO: 25529 - DNA, 71 bp, chicken (Gallus Gallus)
  misc_feature (36): n=a or t
aagttagggtaaggggatgaggcaagggaaccggancctctttggttgatatgatgtcctgctgttctctt

SEQ ID NO: 25530 - DNA, 71 bp, chicken (Gallus Gallus)
  misc_feature (36): n=c or g
gctgctaaatgaatatgtgtttgcgttaaagaaaanaggaaaggaaaaagggaaactttccattttctgga

SEQ ID NO: 25531 - DNA, 71 bp, chicken (Gallus Gallus)
  misc_feature (36): n=c or t
gcaatgacctgcactgctgtccctggagagttgacnggtttccttctcaagcacagttttacaagggttgg

SEQ ID NO: 25532 - DNA, 71 bp, chicken (Gallus Gallus)
  misc_feature (36): n=c or t
ggaacatattctttcagtgaaccacaaaagctggtntccaaagctactactgagttctgtggcatacaagg

SEQ ID NO: 25533 - DNA, 71 bp, chicken (Gallus Gallus)
  misc_feature (36): n=a or g
aaccttctgcgtgtttatatgcagaagtgtgctctntgattgcatttattttaggtatttataaacttaga

SEQ ID NO: 25534 - DNA, 71 bp, chicken (Gallus Gallus)
  misc_feature (36): n=c or t
gaaaaagtaagctcctagaacacacagaaggtatcnggaggagaaaaaacaaacaaacaaagaacaaaaca

SEQ ID NO: 25535 - DNA, 71 bp, chicken (Gallus Gallus)
  misc_feature (36): n=a or g
tcagttgtctctgatgcatcataaaaataattgtcnttctgttaattgaataccactctgtaattgcaaaa

SEQ ID NO: 25536 - DNA, 71 bp, chicken (Gallus Gallus)
  misc_feature (36): n=c or t
tggtaagcttttatttatttatttctcgaacaatgngttagcttatgcacagtcacaagaggccatatcac

SEQ ID NO: 25537 - DNA, 71 bp, chicken (Gallus Gallus)
  misc_feature (36): n=a or c
tcatgaacactcagagagttaaataatatctcaccntcactgtatgttgcctgaccaagcagtacccttta

SEQ ID NO: 25538 - DNA, 71 bp, chicken (Gallus Gallus)
  misc_feature (36): n=a or c
tgtggtagaacaaaactgattttcctggtcaaaganaaaagcataaacaacatctttcaattcaactgaaa

SEQ ID NO: 25539 - DNA, 71 bp, chicken (Gallus Gallus)
  misc_feature (36): n=a or t
atccttccactagtagatggaaatggcctacaaatntgaggcactactttatttgtggaatgccatccaga

SEQ ID NO: 25540 - DNA, 71 bp, chicken (Gallus Gallus)
  misc_feature (36): n=c or t
tgctgaactctgtagcacacaggcctgtaccactgntgggacaatgtcattttgacttccaggcatcacca

SEQ ID NO: 25541 - DNA, 71 bp, chicken (Gallus Gallus)
  misc_feature (36): n=c or t
ctgagtcctccaacacccaagtcccctgcagagctntttttgctttgaatgcccttgcacagatcctgttg

SEQ ID NO: 25542 - DNA, 71 bp, chicken (Gallus Gallus)
  misc_feature (36): n=a or t
tagttttatttttttaaacctgtattctttatgaantgacatagcagattaacttgcatggaacgctaaat

SEQ ID NO: 25543 - DNA, 71 bp, chicken (Gallus Gallus)
  misc_feature (36): n=a or g
aaaagaatcaaactaaattttcacacctgtgaagantaaatgtctacattccgaaatggattgacagctat

SEQ ID NO: 25544 - DNA, 71 bp, chicken (Gallus Gallus)
  misc_feature (36): n=a or g
ttatgtagcagttacagcaggataatcaagtcttgngttcttttctttaagaacaagcaatgcagtcttcc

SEQ ID NO: 25545 - DNA, 71 bp, chicken (Gallus Gallus)
  misc_feature (36): n=a or g
atgagcagaagtagctcaactcaaagaatctctatntgtaccaggcccaaaagtctattgaaaaagagatt

SEQ ID NO: 25546 - DNA, 71 bp, chicken (Gallus Gallus)
  misc_feature (36): n=a or g
ataaatgtgatggtcttctgcaatgtggttacagcnttggtggataagggaagagcatttgatatcaccta

SEQ ID NO: 25547 - DNA, 71 bp, chicken (Gallus Gallus)
  misc_feature (36): n=a or g
aaatgatcaccagttacattgcttcttccatctatntattatgctaatggtgctctgaagatgtctttaca

SEQ ID NO: 25548 - DNA, 71 bp, chicken (Gallus Gallus)
  misc_feature (36): n=c or t
ggatttcacttccttcaacactgaagaaagctgatntttccactaaagaaaattttccattagagtgtttt

SEQ ID NO: 25549 - DNA, 71 bp, chicken (Gallus Gallus)
  misc_feature (36): n=c or t
tttttgcacatgcctcctgatattactgagcatcanggagatatgagggagttctttcttagctcttctca

SEQ ID NO: 25550 - DNA, 71 bp, chicken (Gallus Gallus)
  misc_feature (36): n=a or g
aattaataactcctggaaggcagaatgggagaagangatagaaaaagaaattgggtcatattttgctctct

SEQ ID NO: 25551 - DNA, 71 bp, chicken (Gallus Gallus)
  misc_feature (36): n=a or c
gggttgcgaaggagaagtctctggatatttatatgntgtccacaaacaagctattacgcagcttctggaag

SEQ ID NO: 25552 - DNA, 71 bp, chicken (Gallus Gallus)
  misc_feature (36): n=c or t
cagacacctcacagttaggaaaggatccttgatttnttctagctaggtctatttgtgcttcactgattgtg

SEQ ID NO: 25553 - DNA, 71 bp, chicken (Gallus Gallus)
  misc_feature (36): n=c or t
gccagaggaaaatgttacatcatatttgcactttgntacctcactggtcatctgttcttccctgtagcatt

SEQ ID NO: 25554 - DNA, 71 bp, chicken (Gallus Gallus)
  misc_feature (36): n=a or g
attacagaaggggcaatgaggaccacacaggtgctnccaactatccaaatttaaccaggaagcccacaaca

SEQ ID NO: 25555 - DNA, 71 bp, chicken (Gallus Gallus)
  misc_feature (36): n=c or t
cttccagcagtttttgagagaaatgtgcaagaagcnatcaataactacagttggtatgcaataacttctga

SEQ ID NO: 25556 - DNA, 71 bp, chicken (Gallus Gallus)
  misc_feature (36): n=a or g
ttttattggttctgtagtactctcttttttttgtcntgagtgatagttaatatgaatgcttcatttttcgt

SEQ ID NO: 25557 - DNA, 71 bp, chicken (Gallus Gallus)
  misc_feature (36): n=a or g
aggctagattccatagtaatttagactgtgatgacncagctggatgtttaatatactcttctaatgtgctc

SEQ ID NO: 25558 - DNA, 71 bp, chicken (Gallus Gallus)
  misc_feature (36): n=a or g
acccatcagttggacctctcagcatgtcctgtgctngcacagtacttaagccagcatctgatagatcagca

SEQ ID NO: 25559 - DNA, 71 bp, chicken (Gallus Gallus)
  misc_feature (36): n=a or g
ctgaatcggggaaagcttagtctggcagttcttgcngatgaacctacagggtatcatgctgaaatttagtt

SEQ ID NO: 25560 - DNA, 71 bp, chicken (Gallus Gallus)
  misc_feature (36): n=g or t
tgagatgcggggctggagacaaagagatggaggagnctgaatctccgtacgacgtctgaacacagatgtaa

SEQ ID NO: 25561 - DNA, 71 bp, chicken (Gallus Gallus)
  misc_feature (36): n=c or t
tggttgctgagaatttgctttatcaaataatgttantgtgctcaatcagttgtaatttatacaccttcact

SEQ ID NO: 25562 - DNA, 71 bp, chicken (Gallus Gallus)
  misc_feature (36): n=g or t
cagctgcacactacatgtcctccactcccacccgtntctcactgttaaggaccctgcaagaccaatttcta

SEQ ID NO: 25563 - DNA, 71 bp, chicken (Gallus Gallus)
  misc_feature (36): n=a or g
gacagggttcaatacttacaagatactgtatctctnagaaataaagggggattcatgaatcaggaccctac

SEQ ID NO: 25564 - DNA, 71 bp, chicken (Gallus Gallus)
  misc_feature (36): n=a or g
taacaataggcacgtctagcaccaaaacatcaaccngtaatgaagaaagcaagtactaggaaataacagac

SEQ ID NO: 25565 - DNA, 71 bp, chicken (Gallus Gallus)
  misc_feature (36): n=a or g
gatcagactccaaaacccagtccctggcataagacntgctgtcccctggtttctgacacctacagcactag

SEQ ID NO: 25566 - DNA, 71 bp, chicken (Gallus Gallus)
  misc_feature (36): n=a or g
tagaagtgaggcctacttcaacttgtaaagataccnttgtctattgactttaaaatcacgaagagtagagt

SEQ ID NO: 25567 - DNA, 71 bp, chicken (Gallus Gallus)
  misc_feature (36): n=c or t
accttcactggatcaatgttccaatgtttgtgaaangacactggaatctggtgagaaaggtagtctttggg

SEQ ID NO: 25568 - DNA, 71 bp, chicken (Gallus Gallus)
  misc_feature (36): n=a or g
ctgctcggtatacagctgtaaagtctgaaggagcanggcctggtgtgcagcacggctcagacaacgtcgag

SEQ ID NO: 25569 - DNA, 71 bp, chicken (Gallus Gallus)
  misc_feature (36): n=a or g
gcacctacagcccttcagtccctggatggaacagtncctgctcctctaagggcttcaggtccgggggggac

SEQ ID NO: 25570 - DNA, 71 bp, chicken (Gallus Gallus)
  misc_feature (36): n=a or g
tcctgcctcttctgcctgatttcttgtactggggantggagagctccgtttttctcagaagggccacatct

SEQ ID NO: 25571 - DNA, 71 bp, chicken (Gallus Gallus)
  misc_feature (36): n=a or g
tataaagtggtgggatgtacaaattgaataggtctncgtggtttcaagctcaccttatttcaggcagaatg

SEQ ID NO: 25572 - DNA, 71 bp, chicken (Gallus Gallus)
  misc_feature (36): n=a or g
agaatgcttattagtgtaatatgtcaatggcatttnaagttctgtaaacactatgatgcaatgagtgaaat

SEQ ID NO: 25573 - DNA, 71 bp, chicken (Gallus Gallus)
  misc_feature (36): n=a or g
tgaagaaagaaagtaggtaaagttattgccattgcncagatgggaagattgaggcagaaataccacacatc

SEQ ID NO: 25574 - DNA, 71 bp, chicken (Gallus Gallus)
  misc_feature (36): n=a or g
aacgtgctataaagaagtcttgcatggtaattctgnatttacagcagaagaactcaatatacagtttagct

SEQ ID NO: 25575 - DNA, 71 bp, chicken (Gallus Gallus)
  misc_feature (36): n=a or g
gtctgtgatacatttccaagtgtgtgtctgtatgtntgtattttaaaaatgtgtgtacacatatgtctata

SEQ ID NO: 25576 - DNA, 71 bp, chicken (Gallus Gallus)
  misc_feature (36): n=a or t
acttcatgtcagattcaggacattaaaatattttcntctgtttgtccttctgatctagagaccgctgccag

SEQ ID NO: 25577 - DNA, 71 bp, chicken (Gallus Gallus)
  misc_feature (36): n=c or t
tcttccaaagcttatttaagtttactttgtatttgnttcttttgtttagtcaccaaatttgaaaattccca

SEQ ID NO: 25578 - DNA, 71 bp, chicken (Gallus Gallus)
  misc_feature (36): n=c or t
tctccttctctgttaactaaacttctgattgggcanatcagataaacttaaatgtagatactcattctcca

SEQ ID NO: 25579 - DNA, 71 bp, chicken (Gallus Gallus)
  misc_feature (36): n=a or g
tgggggtgcacacaaatccccttgtccaaatcatcngtaaagttgttaaggtcagctgtaatactgacccc

SEQ ID NO: 25580 - DNA, 71 bp, chicken (Gallus Gallus)
  misc_feature (36): n=c or t
taattctgatggttaataaaatctggtgattgtttnaagtttgcatttggaattttttaggctctttcagc

SEQ ID NO: 25581 - DNA, 71 bp, chicken (Gallus Gallus)
  misc_feature (36): n=c or t
gtggccatgcataagaatttacatccataagtctanggatcctgataagatgtatcccatagtcctgagga

SEQ ID NO: 25582 - DNA, 71 bp, chicken (Gallus Gallus)
  misc_feature (36): n=a or g
tatgactatggaagtgcttgctgaatgaaagtaacntggttttgttcagatataaaagaaatatgaaattt

SEQ ID NO: 25583 - DNA, 71 bp, chicken (Gallus Gallus)
  misc_feature (36): n=c or t
catgctggataaatccatacatatttgccaacttcncgaacaaaactttcatcgtttttatgtaatgtaat

SEQ ID NO: 25584 - DNA, 71 bp, chicken (Gallus Gallus)
  misc_feature (36): n=a or g
aatctaggtcacagctgaaaacataagcttacagcnttaatgaggccaacgctaaaaggctaattagagtt

SEQ ID NO: 25585 - DNA, 71 bp, chicken (Gallus Gallus)
  misc_feature (36): n=a or g
gcagggaaaatggagcgcctcatccccttctctagnctcttgccagctggaaggaagaggctctgtgacag

SEQ ID NO: 25586 - DNA, 71 bp, chicken (Gallus Gallus)
  misc_feature (36): n=a or g
attgattcctggatagataaagcatcagggagcacnctcaatttattgaaacatgttgggtactgaaaaaa

SEQ ID NO: 25587 - DNA, 71 bp, chicken (Gallus Gallus)
  misc_feature (36): n=c or g
acccaaatcgacgtcttcatggtctccatgttttcnctggtccagtttaatcaacccaacactgacagatg

SEQ ID NO: 25588 - DNA, 71 bp, chicken (Gallus Gallus)
  misc_feature (36): n=c or t
tcttctcatatcagacgcgcccttgttctgtatctngcttgtgtggggatagcaatatgtgtaactagcaa

SEQ ID NO: 25589 - DNA, 71 bp, chicken (Gallus Gallus)
  misc_feature (36): n=c or g
gtcttctgtgctacagcagatgtgagagaggaatantactgccatgcagcaggagtccctcatcattacag

SEQ ID NO: 25590 - DNA, 71 bp, chicken (Gallus Gallus)
  misc_feature (36): n=c or t
gaatgtaaaatatcacttcccactttgcatttttgntagaaaacaagcaccacagttagcctaaaatatga

SEQ ID NO: 25591 - DNA, 71 bp, chicken (Gallus Gallus)
  misc_feature (36): n=c or t
taggatattgtggaaaaatcacacatgtctggaagnatgtttaatttataccttcaccagaactacgtaga

SEQ ID NO: 25592 - DNA, 71 bp, chicken (Gallus Gallus)
  misc_feature (36): n=g or t
cccttcaatctttagctcatggcagtcttctgaganctgaggaagaaaagaagcccgagtcatccatgctg

SEQ ID NO: 25593 - DNA, 71 bp, chicken (Gallus Gallus)
  misc_feature (36): n=a or g
taaaaaagtgaagtatatgtctttgctcttcatgangtactgaacatgttcctgcatgagctaagagaacc

SEQ ID NO: 25594 - DNA, 71 bp, chicken (Gallus Gallus)
  misc_feature (36): n=c or t
aaatctttcaacagtgagaatcccagaaaccgaaancatcaccaatctgatattcaaagaaatggaatgcc

SEQ ID NO: 25595 - DNA, 71 bp, chicken (Gallus Gallus)
  misc_feature (36): n=g or t
gaatttcctaaaatcagcatagtatcagtgatgggncttcagtagcaacatcatcctatagatacactcca

SEQ ID NO: 25596 - DNA, 71 bp, chicken (Gallus Gallus)
  misc_feature (36): n=c or g
gtctctgtttcattctgctcattttccatatcaaanctaaaacttccttttcccgcaattcctcaatttca

SEQ ID NO: 25597 - DNA, 71 bp, chicken (Gallus Gallus)
  misc_feature (36): n=c or t
gaaatatttgtgaaccactgttgcaggttaaagaanatgttataagccaagatgcttgtctcttttatata

SEQ ID NO: 25598 - DNA, 71 bp, chicken (Gallus Gallus)
  misc_feature (36): n=a or g
caggagcttaaatatggactttgcaccttcagcacngacccccagtttatcctagtttatattcacaacta

SEQ ID NO: 25599 - DNA, 71 bp, chicken (Gallus Gallus)
  misc_feature (36): n=c or t
ggcgttgcaggagtgctcccagagctctgctccggnacagaacaggtttttcagggtcagcaggaggcaac

SEQ ID NO: 25600 - DNA, 71 bp, chicken (Gallus Gallus)
  misc_feature (36): n=a or g
caatttgaagtcagtgaagattgtggattgctgctngatttctaattctgcaattgcataattacaggcac

SEQ ID NO: 25601 - DNA, 71 bp, chicken (Gallus Gallus)
  misc_feature (36): n=a or g
aacatatctcaagcttgaaacaggcataaaatgctntgttaaatgtagtcattggtcatcctaggacttta

SEQ ID NO: 25602 - DNA, 71 bp, chicken (Gallus Gallus)
  misc_feature (36): n=a or g
atttaattggaatgatgtgttttacccattaaaatntttgtaagtgtttcctggatgaaatgagagcttat

SEQ ID NO: 25603 - DNA, 71 bp, chicken (Gallus Gallus)
  misc_feature (36): n=a or c
ccacaccatgctgagtttgtgtgcgccaatggaaanaaatgtgttcaaaacgctcagagctggagatgcag

SEQ ID NO: 25604 - DNA, 71 bp, chicken (Gallus Gallus)
  misc_feature (36): n=a or c
caggagcattacaactttcttagtcataaaagtttnaggcttggctgggccagaataattcacatatttga

SEQ ID NO: 25605 - DNA, 71 bp, chicken (Gallus Gallus)
  misc_feature (36): n=c or t
taaggatccagaattaggccctcaatgtgagacctnagactccttaaaaaaaatagcaatatctttgaaag

SEQ ID NO: 25606 - DNA, 71 bp, chicken (Gallus Gallus)
  misc_feature (36): n=a or t
agtatgttgtatattatgcaggaatttattgtaacnacttataaccccaggcaatgctacaggcttggggc

SEQ ID NO: 25607 - DNA, 71 bp, chicken (Gallus Gallus)
  misc_feature (36): n=c or t
gaaatgcaggtcagatgaagattaggttggtaacanttgaggaaagagcagtgagaggaaaatacaagaac

SEQ ID NO: 25608 - DNA, 71 bp, chicken (Gallus Gallus)
  misc_feature (36): n=c or t
gataaatttttgtatggatttacatttctgagaaangtggcctctctttctgttaaaaagtgtccacacct

SEQ ID NO: 25609 - DNA, 71 bp, chicken (Gallus Gallus)
  misc_feature (36): n=a or g
cactttgggcataaacaccaatacttccctcttacncttctaggagccctttcactcaacctagcagaaag

SEQ ID NO: 25610 - DNA, 71 bp, chicken (Gallus Gallus)
  misc_feature (36): n=a or c
caaattaaaggactttaatctttgctcataaaatanatatttctgaaggctcttgttaagatacattcctt

SEQ ID NO: 25611 - DNA, 71 bp, chicken (Gallus Gallus)
  misc_feature (36): n=c or t
cgacatgcaatatctatgggacatcagtttattcanagccatgtgtgctccagcttgattattcatgctaa

SEQ ID NO: 25612 - DNA, 71 bp, chicken (Gallus Gallus)
  misc_feature (36): n=c or t
cttcatcaaactcttctgttttctatatctgtttcngtagtgtagtttacctgccagatgcctagaggtct

SEQ ID NO: 25613 - DNA, 71 bp, chicken (Gallus Gallus)
  misc_feature (36): n=c or t
ccgcccaggtcctgcagtgaatggctcagccaatgngtttaaatccaccaattttaggactggccaccgac

SEQ ID NO: 25614 - DNA, 71 bp, chicken (Gallus Gallus)
  misc_feature (36): n=a or g
cttctcacgatacagtgttttagccacagcaaaacncagctccatgctttttccaattctgtctgttcctt

SEQ ID NO: 25615 - DNA, 71 bp, chicken (Gallus Gallus)
  misc_feature (36): n=a or g
cagaccattggtatttccttgtgttctggttcagtncaattgaagtggttatttctagatgatagcctgtt

SEQ ID NO: 25616 - DNA, 71 bp, chicken (Gallus Gallus)
  misc_feature (36): n=a or g
tccttcactgatcttccacggaagcgcattaactcngtaactgtggtacacttgtctgggttcactacact

SEQ ID NO: 25617 - DNA, 71 bp, chicken (Gallus Gallus)
  misc_feature (36): n=c or g
tctatgggctccatgctgtgtttaaaaagaccctanggtcagttgcttcctcacctggtgaactgtagata

SEQ ID NO: 25618 - DNA, 71 bp, chicken (Gallus Gallus)
  misc_feature (36): n=c or t
gagttaaatacagagttgcatttattattatctatngttttcttttaagaaaataatcaataaaaaaagac

SEQ ID NO: 25619 - DNA, 71 bp, chicken (Gallus Gallus)
  misc_feature (36): n=a or g
acaacaaccattattcagaacatacaaaaaaatcantgtgaagaaacgttcccttttctctctaatcgttc

SEQ ID NO: 25620 - DNA, 71 bp, chicken (Gallus Gallus)
  misc_feature (36): n=a or g
aggaaaagaatctgagggtgttagctggctgacagnttaatatgaggcagtgaacagggattatttagtct

SEQ ID NO: 25621 - DNA, 71 bp, chicken (Gallus Gallus)
  misc_feature (36): n=a or g
gcagagataaaacatcagtaccatcactgtcctganatacttcataataccaatagttgctaatccccaat

SEQ ID NO: 25622 - DNA, 71 bp, chicken (Gallus Gallus)
  misc_feature (36): n=c or t
cagctgttctgattaatctaagtaatgtcaaacagnagtaactgtggaactctggagctgaatccactttt

SEQ ID NO: 25623 - DNA, 71 bp, chicken (Gallus Gallus)
  misc_feature (36): n=a or g
tgaatacagaatgaaattgagatattgaaagctganaatgatcgtctaaaggcagagactggaaatactgg

SEQ ID NO: 25624 - DNA, 71 bp, chicken (Gallus Gallus)
  misc_feature (36): n=a or t
actgattgcagttcttcacgttcaaaatatcatganataaatcatttgataggtttgcattcgttacatta

SEQ ID NO: 25625 - DNA, 71 bp, chicken (Gallus Gallus)
  misc_feature (36): n=c or t
aaataaacatagacttggaaactgaatttgaactgngatttcacaagactaatttattttgttcttaataa

SEQ ID NO: 25626 - DNA, 71 bp, chicken (Gallus Gallus)
  misc_feature (36): n=a or c
gatcttggacaatggctctctaacaaaagagacagnccaaattcctattcttgaaccagcaacgtggccaa

SEQ ID NO: 25627 - DNA, 71 bp, chicken (Gallus Gallus)
  misc_feature (36): n=c or t
tgcaggtactttgctgggtaagcataagcttctagnaggcacagataaccaacagaatatagaaaataccg

SEQ ID NO: 25628 - DNA, 71 bp, chicken (Gallus Gallus)
  misc_feature (36): n=c or t
attgctaagtggtgcccagctctgccaactataagnttgcacagaagcagtacaagtctgaataggatctc

SEQ ID NO: 25629 - DNA, 71 bp, chicken (Gallus Gallus)
  misc_feature (36): n=c or t
aaaaccaaagcagaaagaaaagacgtacattaatancgacacagtatggacagccagtcaaaagaggtgat

SEQ ID NO: 25630 - DNA, 71 bp, chicken (Gallus Gallus)
  misc_feature (36): n=g or t
gctcttttaaacacaaatggcatagaaaattcaganatacttttagcactaagatacgaatcaatatattc

SEQ ID NO: 25631 - DNA, 71 bp, chicken (Gallus Gallus)
  misc_feature (36): n=c or t
gcctagataggcttcatcatgtgattttagacttcncttgcttctcttagtgctgaagagttattgaaggg

SEQ ID NO: 25632 - DNA, 71 bp, chicken (Gallus Gallus)
  misc_feature (36): n=a or g
tccagatcccacaactcttgtgtaggtcctggatcntatctgctggtctacacagatgtgtaattactagg

SEQ ID NO: 25633 - DNA, 71 bp, chicken (Gallus Gallus)
  misc_feature (36): n=a or g
gttaaagagagtaatgttttgtgtagagaataggantatctttcactagagaggttatttgtggtgaggaa

SEQ ID NO: 25634 - DNA, 71 bp, chicken (Gallus Gallus)
  misc_feature (36): n=a or c
ttcggaactaaatcattcatgctgtaacctgctgcntttctcaggtaatataaggttataaggtctgtgac

SEQ ID NO: 25635 - DNA, 71 bp, chicken (Gallus Gallus)
  misc_feature (36): n=g or t
ctttgcctatataggcagtggccactgaatgcactnttttcttgcaccttgctcaggagtctggtgcatga

SEQ ID NO: 25636 - DNA, 71 bp, chicken (Gallus Gallus)
  misc_feature (36): n=c or t
aaaatgacttatttattgagaaatgtaacagaaagnctgcattacatacagtatttaattttctttctcat

SEQ ID NO: 25637 - DNA, 71 bp, chicken (Gallus Gallus)
  misc_feature (36): n=c or g
aaaattcccagtattatattctggctactctaactncacgtaggcttctgtcacaaacgttcccagctgag

SEQ ID NO: 25638 - DNA, 71 bp, chicken (Gallus Gallus)
  misc_feature (36): n=a or c
caagcctgccttatcatctgggcaaccgaattttantccttgatgtgcagtacaccaccttgcttttttat

SEQ ID NO: 25639 - DNA, 71 bp, chicken (Gallus Gallus)
  misc_feature (36): n=c or t
gtaatctaaatgtctgggtgaaacactgttccctgnaaatgtgtgggtggttttttttttttttgtagcct

SEQ ID NO: 25640 - DNA, 71 bp, chicken (Gallus Gallus)
  misc_feature (36): n=a or g
tttttctccaatttggtgaccaggatgttgtatagnacagtttgttgcaatttaatttgatttctgtgtag

SEQ ID NO: 25641 - DNA, 71 bp, chicken (Gallus Gallus)
  misc_feature (36): n=a or c
ccacagaagcaactaagcacctagacaaggttaccnaaacgctgtggtgcatcccaaagctactgcccttt

SEQ ID NO: 25642 - DNA, 71 bp, chicken (Gallus Gallus)
  misc_feature (36): n=a or g
accgattagatgatgggcaggtatctcggcattaangccaatggttgatttcattaagctgaggaatctgt

SEQ ID NO: 25643 - DNA, 71 bp, chicken (Gallus Gallus)
  misc_feature (36): n=a or t
ctggcaaattgtgaacttgcatggtaaaatactatntagagagaaaggtgcattcaaaaacctaaatatga

SEQ ID NO: 25644 - DNA, 71 bp, chicken (Gallus Gallus)
  misc_feature (36): n=c or g
ttgcatgtctgctgtatacctcttggcaggttttancctagcttttatgttgtgtttttaaaaattaaaaa

SEQ ID NO: 25645 - DNA, 71 bp, chicken (Gallus Gallus)
  misc_feature (36): n=a or g
agaacaaagcctttttatgctctgaaatgattcttntagagaccaggcagctgctctgtatggggagcccc

SEQ ID NO: 25646 - DNA, 71 bp, chicken (Gallus Gallus)
  misc_feature (36): n=c or t
ttaagagaaccattcatgagttcatataatgagganagaagcctttgaggcaccctggaacatgcaggatc

SEQ ID NO: 25647 - DNA, 71 bp, chicken (Gallus Gallus)
  misc_feature (36): n=c or t
ggtttagtgcttttaagtgcttcttttacttgtgtnttagaagagcgtattgaccagaaattcttttcttg

SEQ ID NO: 25648 - DNA, 71 bp, chicken (Gallus Gallus)
  misc_feature (36): n=a or g
aaacaccacaacctacagaggtccttagcgtgtatngctacaaaaataattactttgcacgtctgaggggg

SEQ ID NO: 25649 - DNA, 71 bp, chicken (Gallus Gallus)
  misc_feature (36): n=a or c
ttcctatgtcccaggtatggagacaggatcttctgnatggctcttaccttgcagggaacatgcagtcatgt

SEQ ID NO: 25650 - DNA, 71 bp, chicken (Gallus Gallus)
  misc_feature (36): n=a or g
atttttttgttttacaacatatattttttttcactnttgtttgaatattaccccaaaaaatattctagtag

SEQ ID NO: 25651 - DNA, 71 bp, chicken (Gallus Gallus)
  misc_feature (36): n=a or g
atgaagttaataaagctttatctcaaagctatgcangttgtttgcctcttcattactcatactgaaaggcc

SEQ ID NO: 25652 - DNA, 71 bp, chicken (Gallus Gallus)
  misc_feature (36): n=a or g
acatgtgcacctacaaggaatatattcactgttacntgtaattaaacaccactacttacatattcttcctt

SEQ ID NO: 25653 - DNA, 71 bp, chicken (Gallus Gallus)
  misc_feature (36): n=a or g
cacctgactgcaagcattggtcagcgtcgtataganaggattacgataccatccaaaaatctgtcttctaa

SEQ ID NO: 25654 - DNA, 71 bp, chicken (Gallus Gallus)
  misc_feature (36): n=a or g
aacacatacatgcctgttttccgctgcctctagcancactaagtcccagttctcatctatattctgactcc

SEQ ID NO: 25655 - DNA, 71 bp, chicken (Gallus Gallus)
  misc_feature (36): n=a or g
acaaggtcttttatataaacatccatctgtccaccntgtaactgtgctggggcaagttttgtagattgggt

SEQ ID NO: 25656 - DNA, 71 bp, chicken (Gallus Gallus)
  misc_feature (36): n=c or g
tggcatgctgcgcctgtaaaccacacttgacacaantcagtgctatcaggaggcagcattagtcctgtgct

SEQ ID NO: 25657 - DNA, 71 bp, chicken (Gallus Gallus)
  misc_feature (36): n=g or t
tgcgtatttgagacatggcaacttgcattatctganggcattagcctgtctgcaaattcttattcatggta

SEQ ID NO: 25658 - DNA, 71 bp, chicken (Gallus Gallus)
  misc_feature (36): n=a or t
aaaccttcctccattcaattcgagattaaggctaanactgcccatgtttaatacagaaacttatctcagga

SEQ ID NO: 25659 - DNA, 71 bp, chicken (Gallus Gallus)
  misc_feature (36): n=c or t
agtataaaagaagccccagatttcactaacgacaantaagtttaactttgcagaatacacacaacaagaaa

SEQ ID NO: 25660 - DNA, 71 bp, chicken (Gallus Gallus)
  misc_feature (36): n=c or t
ccatgtctcatgctgatgaacatcctcctctagctntatgacagactgctatttactgaacatgaggtctt

SEQ ID NO: 25661 - DNA, 71 bp, chicken (Gallus Gallus)
  misc_feature (36): n=c or t
tcagttccaaagccaattgctacaaaaacaacaggnacatttttctgaaggagctcagacagcaatagaga

SEQ ID NO: 25662 - DNA, 71 bp, chicken (Gallus Gallus)
  misc_feature (36): n=c or t
gagctacagcatcaagggagtgactgccaagtaagncaaacaacgatctgtattaaagctgtcacagtcac

SEQ ID NO: 25663 - DNA, 71 bp, chicken (Gallus Gallus)
  misc_feature (36): n=a or g
tacagtttgtagagtacacagtcagagtgaaaatgntttatgtttgaagaacaacaacacatttagctatg

SEQ ID NO: 25664 - DNA, 71 bp, chicken (Gallus Gallus)
  misc_feature (36): n=c or g
aaaacagattaatgttccaaacgggtttatctgttnacagtgaaatactccttggctttactgatgcagat

SEQ ID NO: 25665 - DNA, 71 bp, chicken (Gallus Gallus)
  misc_feature (36): n=a or g
caaaaattagtttcttctgtataatgtgtttgtgtnacagcagtgttgagattcttttcctttgtaaagag

SEQ ID NO: 25666 - DNA, 71 bp, chicken (Gallus Gallus)
  misc_feature (36): n=a or g
ggtttggtttaacacacttctttccttaggtcccantttgaagaactgtgtgctgacctgctgcaaaggat

SEQ ID NO: 25667 - DNA, 71 bp, chicken (Gallus Gallus)
  misc_feature (36): n=c or t
cggagatttacatttcaaatgtctgatttatagaangtgcaacttacaggacaagcaactgatttattatg

SEQ ID NO: 25668 - DNA, 71 bp, chicken (Gallus Gallus)
  misc_feature (36): n=c or t
ctgggagagggctctgaatgagcatagctggtagangagcctggtgggtggaaatgcttcacagagatgct

SEQ ID NO: 25669 - DNA, 71 bp, chicken (Gallus Gallus)
  misc_feature (36): n=a or t
gtcaatttttaactcattcttcagtcagacctccangtcctccaaaccagaccattccttgatcacaaatt

SEQ ID NO: 25670 - DNA, 71 bp, chicken (Gallus Gallus)
  misc_feature (36): n=a or g
ctgccctccacagtgcttaaggagcagaggatcccntggtttccccattgatttttctctcctctctcctc

SEQ ID NO: 25671 - DNA, 71 bp, chicken (Gallus Gallus)
  misc_feature (36): n=g or t
acagatcagtcacagagatcatctaaaatatggtgngggtttttttctttcttttttttttttttcatgat

SEQ ID NO: 25672 - DNA, 71 bp, chicken (Gallus Gallus)
  misc_feature (36): n=g or t
cccctgctctttgagacagaagtgaaaccagcctanagaacagccaaaagctgggcaattcccatgcagct

SEQ ID NO: 25673 - DNA, 71 bp, chicken (Gallus Gallus)
  misc_feature (36): n=c or t
gaataaaacacttgaaccattcgaagcatattgaangtgtttgtttatgtgactggtaacaattgggatta

SEQ ID NO: 25674 - DNA, 71 bp, chicken (Gallus Gallus)
  misc_feature (36): n=c or t
aatttttatcaagcagaatctaaaaaataaaaaacnctttcctgatcaccttagttcagtgctcctttgtg

SEQ ID NO: 25675 - DNA, 71 bp, chicken (Gallus Gallus)
  misc_feature (36): n=a or g
ggagctgatgcttctgtgatgcttacagcctggccnagttcctgagcaactgtaacatggcagatttggag

SEQ ID NO: 25676 - DNA, 71 bp, chicken (Gallus Gallus)
  misc_feature (36): n=g or t
aataaacacgtgcttagaaatgatcatagaatgatnaaggttggaaaagaccaccgaggtcatctcgtgca

SEQ ID NO: 25677 - DNA, 71 bp, chicken (Gallus Gallus)
  misc_feature (36): n=a or g
aaatgtatcaccaggattttttagtatagttaaatntatttttgggatctggtacaatgttaagcttgtat

SEQ ID NO: 25678 - DNA, 71 bp, chicken (Gallus Gallus)
  misc_feature (36): n=c or t
atgtaatacaagcttaacaatgaataaaattctcanttgtgtatcacctgcaagagttttagggggctgtg

SEQ ID NO: 25679 - DNA, 71 bp, chicken (Gallus Gallus)
  misc_feature (36): n=c or t
cgctcctgattgattgagtcgcctggtacgtatcangaggaataaaggaatgctgctttctaacaccacag

SEQ ID NO: 25680 - DNA, 71 bp, chicken (Gallus Gallus)
  misc_feature (36): n=c or t
tctatcctgaggtcaagggacttcagaattgatttnatatattggtctcctgaaatgcttttccaaagaca

SEQ ID NO: 25681 - DNA, 71 bp, chicken (Gallus Gallus)
  misc_feature (36): n=a or t
agtgactgttccattgctagaaaagaaacccagagntaagatgaacgtggtaggttgttattagaatgcca

SEQ ID NO: 25682 - DNA, 71 bp, chicken (Gallus Gallus)
  misc_feature (36): n=a or g
ttattattctttttacagtgatctggtttaaaaaanggtgctatgttttaaatatgccgtatgtcattcac

SEQ ID NO: 25683 - DNA, 71 bp, chicken (Gallus Gallus)
  misc_feature (36): n=a or g
aggagtaaaaaatttgccagcaacacgactgctcancagaacatacttggcttcctttgccacagcagcag

SEQ ID NO: 25684 - DNA, 71 bp, chicken (Gallus Gallus)
  misc_feature (36): n=a or g
cacatcagaggacaggagagcagacctagttaaccntgtattttgtatttaagatctaaatataaaatgta

SEQ ID NO: 25685 - DNA, 71 bp, chicken (Gallus Gallus)
  misc_feature (36): n=c or t
gagtgactctttctgggataatgcagccaattgcanggggctcaatctgctgcctgctctgtccctgccct

SEQ ID NO: 25686 - DNA, 71 bp, chicken (Gallus Gallus)
  misc_feature (36): n=c or t
aagttccattccttggttctctcttatgaagtcctngattctgtcattgtgttagttctgtatgtgagtag

SEQ ID NO: 25687 - DNA, 71 bp, chicken (Gallus Gallus)
  misc_feature (36): n=g or t
tctgtgcaacacttccataactgctatctgtttttngctagcagggttctgctgtcatgcacactggctca

SEQ ID NO: 25688 - DNA, 71 bp, chicken (Gallus Gallus)
  misc_feature (36): n=c or t
tcctggactcctgagcctaaggaattacttctgctnctcggtgctcagcctgggcatcagtgtcaaagagc

SEQ ID NO: 25689 - DNA, 71 bp, chicken (Gallus Gallus)
  misc_feature (36): n=c or t
cggtgaagaactttctgggtgttaatttgcacttantgctctacacagtcgtatttaggtctgtaaaaaac

SEQ ID NO: 25690 - DNA, 71 bp, chicken (Gallus Gallus)
  misc_feature (36): n=c or g
tgatctccattctttttttctgaataacaacatganaattcttctctccaagtgcaggaataatggggctc

SEQ ID NO: 25691 - DNA, 71 bp, chicken (Gallus Gallus)
  misc_feature (36): n=c or t
aggctcaccaacatcacccaagtcagttcagagganagaatgcagtgaattagctacttgtcccattcagg

SEQ ID NO: 25692 - DNA, 71 bp, chicken (Gallus Gallus)
  misc_feature (36): n=g or t
caaactccagtgttaggaactgtccttctgttcttnagtttgcagacctgtccagcgcatgactgaacctc

SEQ ID NO: 25693 - DNA, 71 bp, chicken (Gallus Gallus)
  misc_feature (36): n=c or t
agacattaaaaaaatatttatgataacaaacactcnagagattatgagattttgttccctctcatgctaag

SEQ ID NO: 25694 - DNA, 71 bp, chicken (Gallus Gallus)
  misc_feature (36): n=a or t
aattgacgtttaaccatattaagcatatttagcttnaatctttcttcattggcactgttgccttcaagtct

SEQ ID NO: 25695 - DNA, 71 bp, chicken (Gallus Gallus)
  misc_feature (36): n=c or t
tagtttgctgcttcaaatttgctttgaattatgtgnctgtagatatgtgatgtgatcttctagattgaaca

SEQ ID NO: 25696 - DNA, 71 bp, chicken (Gallus Gallus)
  misc_feature (36): n=a or g
cagagtaagattgtcaatattggaccataatatccnataattttgccatgtcattgaagatagataaaaag

SEQ ID NO: 25697 - DNA, 71 bp, chicken (Gallus Gallus)
  misc_feature (36): n=g or t
ctgtacagctgatttttttaatgaaatttaagcatnagttcagcttcagaaatttaaattctagtccaggc

SEQ ID NO: 25698 - DNA, 71 bp, chicken (Gallus Gallus)
  misc_feature (36): n=a or t
atttttctagctataacatagcctgaatggcttcgnaatctaaattaatgcaggattatacaaacattcag

SEQ ID NO: 25699 - DNA, 71 bp, chicken (Gallus Gallus)
  misc_feature (36): n=c or t
agcagtaccagtcactgcttcatgggtatttgcgcngctaccagttctcatgtctcagttaggagtcattt

SEQ ID NO: 25700 - DNA, 71 bp, chicken (Gallus Gallus)
  misc_feature (36): n=c or t
atgaaagtctggtaaagagacatgatctattttttngagttcaatgcctgattgtcactctgtacattcta

SEQ ID NO: 25701 - DNA, 71 bp, chicken (Gallus Gallus)
  misc_feature (36): n=a or t
tgatacctgatggggtgctaccaggaatacagtctnctttgaagtcatcaccttccagttcaaaactaacc

SEQ ID NO: 25702 - DNA, 71 bp, chicken (Gallus Gallus)
  misc_feature (36): n=c or t
tttttccaccttagcaattccaaatggtctgttaantccacttagcttgttgaaacaactagccatgatga

SEQ ID NO: 25703 - DNA, 71 bp, chicken (Gallus Gallus)
  misc_feature (36): n=a or c
ctttttttacacgctcaatacaacacataggcaatnttaggccacagagagccagagaaaactgcattctg

SEQ ID NO: 25704 - DNA, 71 bp, chicken (Gallus Gallus)
  misc_feature (36): n=c or t
ccatgggttcctacagatgagctcatctgaaggtancctttggtgggtgaataattaaccagtgcttcagt

SEQ ID NO: 25705 - DNA, 71 bp, chicken (Gallus Gallus)
  misc_feature (36): n=c or t
cttagtaaatggtttttatctcaacttgcaaattcnagttctttctttttttttttctaattctctccccc

SEQ ID NO: 25706 - DNA, 71 bp, chicken (Gallus Gallus)
  misc_feature (36): n=a or g
ttgatgaggagggaatagaaagatttctttaaccantgagacaaaagctttacagaaaccaatgtcttatt

SEQ ID NO: 25707 - DNA, 71 bp, chicken (Gallus Gallus)
  misc_feature (36): n=a or g
agatcaagacacctaatggaaattcagtaggttctnatgccctgattggtactgcatacttagcaaagaat

SEQ ID NO: 25708 - DNA, 71 bp, chicken (Gallus Gallus)
  misc_feature (36): n=g or t
ctacaactcagccactggtcagattttgaacaatangagtctaaggacactgtatctaagaaaaaaagggg

SEQ ID NO: 25709 - DNA, 71 bp, chicken (Gallus Gallus)
  misc_feature (36): n=g or t
taaatatatatattctgaaacggaaactagcccaanttctagtacaccaggaatagaaaagtgacattatc

SEQ ID NO: 25710 - DNA, 71 bp, chicken (Gallus Gallus)
  misc_feature (36): n=c or t
aaaaaaatttccagttgttttctgggaggtttgaangagggtgtgctgctattggtgtgtttcattgattt

SEQ ID NO: 25711 - DNA, 71 bp, chicken (Gallus Gallus)
  misc_feature (36): n=c or t
tcactccaccaaagttctcaactaggagaatgcagntataagccacctagcaagcctcatgtaatatattc

SEQ ID NO: 25712 - DNA, 71 bp, chicken (Gallus Gallus)
  misc_feature (36): n=c or t
ctatttagtgatctctgaaaaaatcatatgtagaantctgttcagctctcaaatccaaacttttaatatgc

SEQ ID NO: 25713 - DNA, 71 bp, chicken (Gallus Gallus)
  misc_feature (36): n=a or g
gggaatagctgggcacaggcagaataaaagggctcncaggactcttctgtctctctgggggtatggccaag

SEQ ID NO: 25714 - DNA, 71 bp, chicken (Gallus Gallus)
  misc_feature (36): n=c or t
acggagcaggaccaaaggtgagataaacaggaggcngtgaaaagcaagcagcataacccagcagctctcag

SEQ ID NO: 25715 - DNA, 71 bp, chicken (Gallus Gallus)
  misc_feature (36): n=a or g
aagtcaatgctgggaatcacacggtgctgctggatntcagaaaggcttcattcagggaactgtcagacctg

SEQ ID NO: 25716 - DNA, 71 bp, chicken (Gallus Gallus)
  misc_feature (36): n=a or g
ttaagatcgtatgcaacttggctaattagaaagatngcaatacaaactatacctttctgtgctataattaa

SEQ ID NO: 25717 - DNA, 71 bp, chicken (Gallus Gallus)
  misc_feature (36): n=c or t
gtgcttaaaactgtttctcaacttccaaagaaaggnagtgctgtgggtcaaatcttttttatttatttatt

SEQ ID NO: 25718 - DNA, 71 bp, chicken (Gallus Gallus)
  misc_feature (36): n=a or t
aatggaaagggctatcagaatacccaccagagtttnagctcagcaaacaggcatccctgcagttgcaggtg

SEQ ID NO: 25719 - DNA, 71 bp, chicken (Gallus Gallus)
  misc_feature (36): n=c or t
ctggtatttcatctttcatctatgcttcagtccctngtatgtataattggaagaagaatatctcacagagg

SEQ ID NO: 25720 - DNA, 71 bp, chicken (Gallus Gallus)
  misc_feature (36): n=a or g
tgaagtattaaatcaaggcaatggcttccagcatantcacatttccatgcaaatggattttgcaaaatcca

SEQ ID NO: 25721 - DNA, 71 bp, chicken (Gallus Gallus)
  misc_feature (36): n=a or g
agccctggcagcagggctcggtgcccctgcaacacncttagcacagacaaagccattacatttctcctgag

SEQ ID NO: 25722 - DNA, 71 bp, chicken (Gallus Gallus)
  misc_feature (36): n=a or g
aaaggttctcaataaggcttcttcactcacatcaanggtgaaccactgggtcagcaagagggtctgtaacc

SEQ ID NO: 25723 - DNA, 71 bp, chicken (Gallus Gallus)
  misc_feature (36): n=a or g
gactgttcatgggaatcctcagggtgaaggaactcngagcgaaggcagagttggggcgcggtgctgctccg

SEQ ID NO: 25724 - DNA, 71 bp, chicken (Gallus Gallus)
  misc_feature (36): n=a or g
gcacatactgcgatctccaagagtacactaatcacnctttactccatgcctagaaacaatcccactaaggt

SEQ ID NO: 25725 - DNA, 71 bp, chicken (Gallus Gallus)
  misc_feature (36): n=c or t
ctctgaaaaaacaaagatcttttgtttcctctcctncttgggacacattgcttctattgccacccatgata

SEQ ID NO: 25726 - DNA, 71 bp, chicken (Gallus Gallus)
  misc_feature (36): n=a or g
gtccgcactttccttcaccgtatgattatttgcctngaggaagaagttcttccattcataccttctgcctc

SEQ ID NO: 25727 - DNA, 71 bp, chicken (Gallus Gallus)
  misc_feature (36): n=c or t
ctgtacacgtgctttttcatgttacttgtgtcttantgttattggagaatattcgttttctttacattatt

SEQ ID NO: 25728 - DNA, 71 bp, chicken (Gallus Gallus)
  misc_feature (36): n=c or g
ttgtagtatgcttgttgatacattttacctaacagnctcttctcaagccatccttgatgccgggaggtgct

SEQ ID NO: 25729 - DNA, 71 bp, chicken (Gallus Gallus)
  misc_feature (36): n=c or t
gcagagatttttttctatgaatgaatgtttagctcngagggggaggagggatgggacaggctgctctgtcc

SEQ ID NO: 25730 - DNA, 71 bp, chicken (Gallus Gallus)
  misc_feature (36): n=c or t
taagctggtttaagattcttaaaaattctgtgcctngtctataaaagaatgctaacatttcttatctcaga

SEQ ID NO: 25731 - DNA, 71 bp, chicken (Gallus Gallus)
  misc_feature (36): n=a or g
accatgagtttgcatattgctaataattcattagcnttacaaaatatttctgctgggcaccgtgacaacta

SEQ ID NO: 25732 - DNA, 71 bp, chicken (Gallus Gallus)
  misc_feature (36): n=a or g
actgcaccaactgctgagccttcaaactctgacttncacctctgccctgtggaaaggatcacagagctggg

SEQ ID NO: 25733 - DNA, 71 bp, chicken (Gallus Gallus)
  misc_feature (36): n=a or g
cttaataagggttcacatatattcagattactgctnaaaagctggaaagttgactggctggaaggagagga

SEQ ID NO: 25734 - DNA, 71 bp, chicken (Gallus Gallus)
  misc_feature (36): n=c or t
ttcagtttgtatggcatcttttcaggattcttctcnattgcttatgctcaaaatactcgtgtaaacacttc

SEQ ID NO: 25735 - DNA, 71 bp, chicken (Gallus Gallus)
  misc_feature (36): n=a or g
gtaatggttcagattaaccctattaaaaacaacatnttagcttactgccatttactgatcttacatggaaa

SEQ ID NO: 25736 - DNA, 71 bp, chicken (Gallus Gallus)
  misc_feature (36): n=g or t
gatggtaaatgagatcttttggttgcaagaaattanaatatgcatttcaaggagagtaaacagaacagaag

SEQ ID NO: 25737 - DNA, 71 bp, chicken (Gallus Gallus)
  misc_feature (36): n=a or g
ttctgatgtgacacagagctctgagcagggtgacantttcaagtctttgccagaagtagtgtgaatttgtg

SEQ ID NO: 25738 - DNA, 71 bp, chicken (Gallus Gallus)
  misc_feature (36): n=c or t
gactaaattgctgcaaatactttgattgtaatcctncgggcgtttaagcatctcagcacatcggcttcttt

SEQ ID NO: 25739 - DNA, 71 bp, chicken (Gallus Gallus)
  misc_feature (36): n=a or g
ttccaccgggtactccttggaggaaaatgttgcacngtctctgcacacaaaggcacggtgcagagctgaag

SEQ ID NO: 25740 - DNA, 71 bp, chicken (Gallus Gallus)
  misc_feature (36): n=a or t
ataattagataaacagtgctattgccacctctcttntatttgcacaaagaacaccaatgcctgattttgtt

SEQ ID NO: 25741 - DNA, 71 bp, chicken (Gallus Gallus)
  misc_feature (36): n=c or t
tcagatataatgcaatgggctggtttgcaatcttangtatagccagtatgcagatgtaagtgcctacaagt

SEQ ID NO: 25742 - DNA, 71 bp, chicken (Gallus Gallus)
  misc_feature (36): n=a or g
tccctgtggcagttacctgttcgggtcttgtaaagntctatgaagtaatggtctgttttttgaatgccctc

SEQ ID NO: 25743 - DNA, 71 bp, chicken (Gallus Gallus)
  misc_feature (36): n=c or t
cagtggttgttgtttttttttttttcagtcaacagnagtcccactcacagttcaagcagactgaaaaatca

SEQ ID NO: 25744 - DNA, 71 bp, chicken (Gallus Gallus)
  misc_feature (36): n=c or t
cactgcttagcgaggtgcgcagctgcacggccgggntcagaagtaccacttacgaaaccccacaaagtttt

SEQ ID NO: 25745 - DNA, 71 bp, chicken (Gallus Gallus)
  misc_feature (36): n=c or t
gcatgaaaaagtcaataaggttcttctcagcatatncttgtgcctcctagtaaactctgcatagtccagac

SEQ ID NO: 25746 - DNA, 71 bp, chicken (Gallus Gallus)
  misc_feature (36): n=a or g
ggaaatgagaagtcaaactttctgattttacttgtntctctaaaatgcaacaaaaggctcattagcttact

SEQ ID NO: 25747 - DNA, 71 bp, chicken (Gallus Gallus)
  misc_feature (36): n=a or g
atgaatgtctgttgaacatatttagatgttgtatgncgttagttttgccactgcaactgaagcttgatatg

SEQ ID NO: 25748 - DNA, 71 bp, chicken (Gallus Gallus)
  misc_feature (36): n=c or t
cttaaaaccaaagcactgagacttcctctttgaggnactgttttttcccccctcccctcaccaggatgagc

SEQ ID NO: 25749 - DNA, 71 bp, chicken (Gallus Gallus)
  misc_feature (36): n=c or t
cttccaggatacaagcaaaggtatatggtgaatcangctgctgaaagatatgttccaggatttgacagctg

SEQ ID NO: 25750 - DNA, 71 bp, chicken (Gallus Gallus)
  misc_feature (36): n=a or t
cttagaaatgaggttgatgaaactggtgctttctgnattatacagctcaaaataaacacacacacacacac

SEQ ID NO: 25751 - DNA, 71 bp, chicken (Gallus Gallus)
  misc_feature (36): n=c or t
gagtttggtactgattaaaacaaaagaagctgaacngtttggaggtctccagtgcatggcattcaaggggc

SEQ ID NO: 25752 - DNA, 71 bp, chicken (Gallus Gallus)
  misc_feature (36): n=a or g
aacattattactctctcagaaatcgtaaaatcgaantaaaggaggatggcgaggcactctaaccccagcag

SEQ ID NO: 25753 - DNA, 71 bp, chicken (Gallus Gallus)
  misc_feature (36): n=c or t
agctgtctctctgctttatggtttctgtgcatttgntaattttgtgcagacctacaagcttacattttcct

SEQ ID NO: 25754 - DNA, 71 bp, chicken (Gallus Gallus)
  misc_feature (36): n=c or t
gcatttgcattctgtgactgtgagctaacagagtancagttttcatccaagaagtttgaaatagttgggtt

SEQ ID NO: 25755 - DNA, 71 bp, chicken (Gallus Gallus)
  misc_feature (36): n=a or g
taactaactattagatctaaggattattttactacntttacagatccaagtaaattttgtttcaaatcaac

SEQ ID NO: 25756 - DNA, 71 bp, chicken (Gallus Gallus)
  misc_feature (36): n=a or g
gaggagaagctgatctgagatagcttttgagttggngagggatgatctcgtctcatttctaacttgctcca

SEQ ID NO: 25757 - DNA, 71 bp, chicken (Gallus Gallus)
  misc_feature (36): n=a or c
ttctcctgtgatgccactgcagtttgcttccagttnggaatcctcacccatcttcttaagagcaaatatgt

SEQ ID NO: 25758 - DNA, 71 bp, chicken (Gallus Gallus)
  misc_feature (36): n=c or t
acaattctgttgcagccttcagagtgcactgaatgnagtagcaaactaaaactcgccacctttgaatgtaa

SEQ ID NO: 25759 - DNA, 71 bp, chicken (Gallus Gallus)
  misc_feature (36): n=a or g
aggaaaattacaacatttctgaaggatgtgaaacantctcaaccagtggaactttcgtcttatgtaagaga

SEQ ID NO: 25760 - DNA, 71 bp, chicken (Gallus Gallus)
  misc_feature (36): n=c or t
ctctaagaaagtggtttacactgcaagctgcactanagaaataccacttgagagatactactcggtattaa

SEQ ID NO: 25761 - DNA, 71 bp, chicken (Gallus Gallus)
  misc_feature (36): n=a or g
taataataatcaataagtaggtgactattcgaaaanaagaagaagaagaagaagaagaagaagaagaagaa

SEQ ID NO: 25762 - DNA, 71 bp, chicken (Gallus Gallus)
  misc_feature (36): n=g or t
ttgcggttgggaattgcagtgattcatggggaagcncaagatgctgagtctgacatggtagatggtcgaca

SEQ ID NO: 25763 - DNA, 71 bp, chicken (Gallus Gallus)
  misc_feature (36): n=a or g
tactcagtagggggaaatgtttttgtcatgtcaacntgtaccctctctagtgttgtggtctttggcatctc

SEQ ID NO: 25764 - DNA, 71 bp, chicken (Gallus Gallus)
  misc_feature (36): n=c or g
gcttctctatttttgcatctgttttactgcaatagngtactgaccaatgctattaatgcactgagtactca

SEQ ID NO: 25765 - DNA, 71 bp, chicken (Gallus Gallus)
  misc_feature (36): n=c or g
agtgcgctgggcaggcactgcactgcagtgtctggnaacagaaagtctcctcggtcagaggagtttatagg

SEQ ID NO: 25766 - DNA, 71 bp, chicken (Gallus Gallus)
  misc_feature (36): n=c or t
tggcaccttgctctgaaaagtgtggctcctcacagngagaaagacattaaaaccctggagtgtatccagac

SEQ ID NO: 25767 - DNA, 71 bp, chicken (Gallus Gallus)
  misc_feature (36): n=c or t
agattgcagcaatatttgttgaaacgttttaacttnatagagatgtgcttttttcacatgaaaggcttaat

SEQ ID NO: 25768 - DNA, 71 bp, chicken (Gallus Gallus)
  misc_feature (36): n=a or g
caaaagagctagaagtgaaataactggggccgttgnccgttgttctagggtctgattttgtcactggcaac

SEQ ID NO: 25769 - DNA, 71 bp, chicken (Gallus Gallus)
  misc_feature (36): n=a or g
ctatagtgacagtaagtcattagaagtgctggatcngaaaatgtatggcaggacagtacagaaaatcacag

SEQ ID NO: 25770 - DNA, 71 bp, chicken (Gallus Gallus)
  misc_feature (36): n=a or t
aactggaaaattcaggtatgacaccgcatttctatnaaagacaacagatggcatattttctactttctgta

SEQ ID NO: 25771 - DNA, 71 bp, chicken (Gallus Gallus)
  misc_feature (36): n=a or g
acatgctttatgagtcactttgaagcttgaggcacnaggttctagttcttcatactttcttaattaatcta

SEQ ID NO: 25772 - DNA, 71 bp, chicken (Gallus Gallus)
  misc_feature (36): n=c or t
aaggaatacctctctgcatccccatcttcgacccanttatcttctgttttagccctaccttaacagagcag

SEQ ID NO: 25773 - DNA, 71 bp, chicken (Gallus Gallus)
  misc_feature (36): n=a or g
aatgcatttgttgagtgtataagatccatttgtggngagtagtggaaggctgcagagaaacaaagagataa

SEQ ID NO: 25774 - DNA, 71 bp, chicken (Gallus Gallus)
  misc_feature (36): n=a or g
gtgtgtttgaaagaggttaaattcagcccttggctntcggaacaggcaactgcattgcagcatgactgggc

SEQ ID NO: 25775 - DNA, 71 bp, chicken (Gallus Gallus)
  misc_feature (36): n=c or t
tatctgtgctgtggctgctcttaactgaccttcagntcctcctgcaaggtggcatacatctcatttatctt

SEQ ID NO: 25776 - DNA, 71 bp, chicken (Gallus Gallus)
  misc_feature (36): n=a or g
cataaccttgtctgccattgatttgatatttgtacnatgttcacctcaaagatttaatgtggcttatagca

SEQ ID NO: 25777 - DNA, 71 bp, chicken (Gallus Gallus)
  misc_feature (36): n=a or t
tcatttaaaaatatcctccttgattttctctgggcncataaggagattagtacctgcttctaggcaagaca

SEQ ID NO: 25778 - DNA, 71 bp, chicken (Gallus Gallus)
  misc_feature (36): n=a or c
ctcattcgggacacttttacattagcataaaggttngattaacagccatgaataaaagtgatttatgggac

SEQ ID NO: 25779 - DNA, 71 bp, chicken (Gallus Gallus)
  misc_feature (36): n=g or t
tggcatatcagaaacactatcctgatttgcaaactnctgcatcatcatcaaggtattcctcggtaatcaat

SEQ ID NO: 25780 - DNA, 71 bp, chicken (Gallus Gallus)
  misc_feature (36): n=c or t
acagaacgtgtttagagctttttttcccccactttngcttattaaaaaaaagtgttgtcttactcaatcat

SEQ ID NO: 25781 - DNA, 71 bp, chicken (Gallus Gallus)
  misc_feature (36): n=a or g
tgcatacaaaaattcccgctgatactggattaaacntttgtaaaatcaaagcaagattctacttcagtatt

SEQ ID NO: 25782 - DNA, 71 bp, chicken (Gallus Gallus)
  misc_feature (36): n=a or g
aaagctgtggaggatctaggtgaatccctggggatntctgaggatgaattagttctgtccaaattgtcatc

SEQ ID NO: 25783 - DNA, 71 bp, chicken (Gallus Gallus)
  misc_feature (36): n=a or g
caatgaagaggccatttcaggtaagctgttaatggnaagacagggattttccagctttgttatagcatgaa

SEQ ID NO: 25784 - DNA, 71 bp, chicken (Gallus Gallus)
  misc_feature (36): n=a or g
tggcctgccagaaagtggtggcacagtcttctaacntattgctggcaaacaatatgtatgatggaattgtt

SEQ ID NO: 25785 - DNA, 71 bp, chicken (Gallus Gallus)
  misc_feature (36): n=c or t
aagtaaccaccagaatttctaattcatagtgatgtntctaaaatgtgtggggctttttggtttgtttgttc

SEQ ID NO: 25786 - DNA, 71 bp, chicken (Gallus Gallus)
  misc_feature (36): n=c or t
ccccagggtacggtaggccctttgggctgccagggnacagtgcttactcagattcaactctctgtcagcca

SEQ ID NO: 25787 - DNA, 71 bp, chicken (Gallus Gallus)
  misc_feature (36): n=a or t
tttttgtatagcacaagaacattgctctcacaaccnctcatacagaaataaaatgatataaaacggaacta

SEQ ID NO: 25788 - DNA, 71 bp, chicken (Gallus Gallus)
  misc_feature (36): n=c or t
acttaaaaaaacaacttgacatcagagtctaatcantgagaatctttttagaatggaaaatatttattcct

SEQ ID NO: 25789 - DNA, 71 bp, chicken (Gallus Gallus)
  misc_feature (36): n=c or t
accccggcaggcagcagggtgataggctctcctatnacgagctctcaatatgatacagtacccagtgatga

SEQ ID NO: 25790 - DNA, 71 bp, chicken (Gallus Gallus)
  misc_feature (36): n=c or g
caaactgaaagtcccttttgtcacttcctgtggctncagttttcagaagttaagcaaaatcagcctaagga

SEQ ID NO: 25791 - DNA, 71 bp, chicken (Gallus Gallus)
  misc_feature (36): n=a or t
tagggaataagggctgccattatgcacgaaataccnacccttctcctttttctttttttttcatctccctt

SEQ ID NO: 25792 - DNA, 71 bp, chicken (Gallus Gallus)
  misc_feature (36): n=c or t
atgggtcctgagtatattcagagaaagagactgccnagcctctcaggacagcctgattttattctcctcca

SEQ ID NO: 25793 - DNA, 71 bp, chicken (Gallus Gallus)
  misc_feature (36): n=c or t
tgaaatacatctaaaccaaagtacatacccaaacangacctctgaggcttagtttccttttaacctcagta

SEQ ID NO: 25794 - DNA, 71 bp, chicken (Gallus Gallus)
  misc_feature (36): n=a or g
tggcatggagcaaagatatggcacatactaaaatcntctcaggaaatgaatgcaactgaagaaattaattg

SEQ ID NO: 25795 - DNA, 71 bp, chicken (Gallus Gallus)
  misc_feature (36): n=c or t
tcccttgacagacacaatgcaattttcgcaggttanggatgaggctagtgcagcactaaaaactgcaatct

SEQ ID NO: 25796 - DNA, 71 bp, chicken (Gallus Gallus)
  misc_feature (36): n=c or g
aaagaaaaagaagggggataaagaagcttgtgcaantgaatcagtagtacgtttgtccagctcagggtgca

SEQ ID NO: 25797 - DNA, 71 bp, chicken (Gallus Gallus)
  misc_feature (36): n=c or t
tccatgtcaggtattcatttgtcagcagcactgttnttggagacagctcggagtgacgggttattcttgtc

SEQ ID NO: 25798 - DNA, 71 bp, chicken (Gallus Gallus)
  misc_feature (36): n=c or t
gatgttgctaggcaggcttctgttacaggactgagntgccaaagaatgggtgcttttctgctcctcctcag

SEQ ID NO: 25799 - DNA, 71 bp, chicken (Gallus Gallus)
  misc_feature (36): n=c or t
caaagagaattgtggtctggaataatactttggatngtgtatattcaaggtatggtgtatgcagtttaaac

SEQ ID NO: 25800 - DNA, 71 bp, chicken (Gallus Gallus)
  misc_feature (36): n=c or t
cagcccaattttcttctcaaattaacttcttttagnttggctgtcttctgtaacagagcttaacaagaaga

SEQ ID NO: 25801 - DNA, 71 bp, chicken (Gallus Gallus)
  misc_feature (36): n=a or g
gtagtttggtgatgggagaagctctttgagggtagngagatttgggtgcagttctaactaagccatgttac

SEQ ID NO: 25802 - DNA, 71 bp, chicken (Gallus Gallus)
  misc_feature (36): n=a or g
tccaagatgacaaatatttgctcaagaagaaagcangaaaagcactgttgtcacagccttggcatgacagc

SEQ ID NO: 25803 - DNA, 71 bp, chicken (Gallus Gallus)
  misc_feature (36): n=a or g
aaggccaattttcagctacagtcttacctgtcagtnacagtgctgggcagaaactcaaacaacacagaaaa

SEQ ID NO: 25804 - DNA, 71 bp, chicken (Gallus Gallus)
  misc_feature (36): n=c or t
ataaataatttttaaatgtttagtgaaaaatagcancaaactgtaaacagaccccttctagaatactaaaa

SEQ ID NO: 25805 - DNA, 71 bp, chicken (Gallus Gallus)
  misc_feature (36): n=a or c
ccaaaaagccttagagtgtagtcttataagcattgntgcagaagtttgaattaatgacaatgtttgactga

SEQ ID NO: 25806 - DNA, 71 bp, chicken (Gallus Gallus)
  misc_feature (36): n=a or g
ggatagtaattggttagaaactttccaggcaggtangggctgcaaaatttacttactttgtgctttgtgtc

SEQ ID NO: 25807 - DNA, 71 bp, chicken (Gallus Gallus)
  misc_feature (36): n=g or t
aagtagactggtcgttctaggaaattcagcaatctngtcacctagaagcaagtaaacttcaagctatcaat

SEQ ID NO: 25808 - DNA, 71 bp, chicken (Gallus Gallus)
  misc_feature (36): n=c or g
tcccactggaaccaggcccaataattcagcaacctnatggagcaatctgctaggaaactcatcccctggca

SEQ ID NO: 25809 - DNA, 71 bp, chicken (Gallus Gallus)
  misc_feature (36): n=a or t
atcaaagacagatacaatcttcacattaaagggcanaaacttgtgataaacatagaagaacagctcagaca

SEQ ID NO: 25810 - DNA, 71 bp, chicken (Gallus Gallus)
  misc_feature (36): n=a or g
gcatctttccatatcaaacccagtacccaagccgtncctacttggccatttggcatagcttagtcccagca

SEQ ID NO: 25811 - DNA, 71 bp, chicken (Gallus Gallus)
  misc_feature (36): n=c or t
ggggtaattcggcaggcagcaaacagcatccaggangcagaagctacaatttgattaagcatagcatggaa

SEQ ID NO: 25812 - DNA, 71 bp, chicken (Gallus Gallus)
  misc_feature (36): n=c or t
gctgatgtccatataacataactgaatatcctacgntactttgaacttcaaagctttttctttagtacagg

SEQ ID NO: 25813 - DNA, 71 bp, chicken (Gallus Gallus)
  misc_feature (36): n=a or g
ttccacacacaggtaaatatttctgagctgtgagtntgatctgtggaggatttgtgatgcccttaaaggaa

SEQ ID NO: 25814 - DNA, 71 bp, chicken (Gallus Gallus)
  misc_feature (36): n=c or g
agtaatccttacaaactgcatgctattactagaaanctaaaagctgcagctgtattaaataactactgcct

SEQ ID NO: 25815 - DNA, 71 bp, chicken (Gallus Gallus)
  misc_feature (36): n=a or g
caagtatcacaagaagcatggctaaaaccagtcgcngaggggtgttcaacccaaagtgaggacggagcagc

SEQ ID NO: 25816 - DNA, 71 bp, chicken (Gallus Gallus)
  misc_feature (36): n=a or t
catagcacagcttgattctgatgtcagcagtagatngtgataaatattaatagcaagatgcacaccatcct

SEQ ID NO: 25817 - DNA, 71 bp, chicken (Gallus Gallus)
  misc_feature (36): n=a or g
aataataagacttggcattgtggcttaggtggcatngatgagggagctcctgaagttccctgcagcctcgc

SEQ ID NO: 25818 - DNA, 71 bp, chicken (Gallus Gallus)
  misc_feature (36): n=a or g
acacaaaacctactgtatgcttactgcatggaaaantgaacgataaaatggccagggaagcgcaaagaatt

SEQ ID NO: 25819 - DNA, 71 bp, chicken (Gallus Gallus)
  misc_feature (36): n=a or g
tttctatatataacaatatagaaacaacaataacantaacacttgcataagcagcaccatgagatagcata

SEQ ID NO: 25820 - DNA, 71 bp, chicken (Gallus Gallus)
  misc_feature (36): n=c or t
gaatgtagaattaaaagcaaattatttattaattanttattaagcaaagtattttgactaccctaatgaac

SEQ ID NO: 25821 - DNA, 71 bp, chicken (Gallus Gallus)
  misc_feature (36): n=a or g
tagcaacagaagtaatgaaatctggctgatttcttnctgttgaactttatagtgtctaacaaggggaaaat

SEQ ID NO: 25822 - DNA, 71 bp, chicken (Gallus Gallus)
  misc_feature (36): n=a or g
gagattgtttaccatgtcaaagacagaaaataaaanggagagctggtggtccagcacagtgagttgaaagg

SEQ ID NO: 25823 - DNA, 71 bp, chicken (Gallus Gallus)
  misc_feature (36): n=a or g
ttacagtattaaacagccaggatcaatctggaggtnaaatcaactaagtagcagttaatcattttagtcat

SEQ ID NO: 25824 - DNA, 71 bp, chicken (Gallus Gallus)
  misc_feature (36): n=g or t
acttttgtgtaataaagacaacacaaagctaggaanggaaaaagaaagattcccatttgcttccatgatta

SEQ ID NO: 25825 - DNA, 71 bp, chicken (Gallus Gallus)
  misc_feature (36): n=c or g
gatttttctgtccacttagctaggtcatcttctgtntccaaagtggcagaaaggggctttagtgctgtttg

SEQ ID NO: 25826 - DNA, 71 bp, chicken (Gallus Gallus)
  misc_feature (36): n=c or t
catcatttcccaccccagaacataagattctatganatggcatagcttgggagtgcctctctgttgtgaag

SEQ ID NO: 25827 - DNA, 71 bp, chicken (Gallus Gallus)
  misc_feature (36): n=a or g
ataattagctttagggacatttgactgatgtagtancatcagcaaagaaaaaaaacaaaacaaaacaaaaa

SEQ ID NO: 25828 - DNA, 71 bp, chicken (Gallus Gallus)
  misc_feature (36): n=a or g
ctacacgttgcagccaggtacgaagaacaagaattnaagaacagtcacacagcaacacagaccacacggca

SEQ ID NO: 25829 - DNA, 71 bp, chicken (Gallus Gallus)
  misc_feature (36): n=a or c
ctttcacaccaagtttcatggaaacacttcctgagntatctagatctctcaaagaacagtgaagggcactg

SEQ ID NO: 25830 - DNA, 71 bp, chicken (Gallus Gallus)
  misc_feature (36): n=c or t
ataatcccacagctttcttgtatgaaaagatattcncttgtaattgtaccgcatggattagaatcagcaaa

SEQ ID NO: 25831 - DNA, 71 bp, chicken (Gallus Gallus)
  misc_feature (36): n=c or t
tttaatttggatttgcctctcacagatacagctttntctctgttacagtgcaaacacaatagctggtatta

SEQ ID NO: 25832 - DNA, 71 bp, chicken (Gallus Gallus)
  misc_feature (36): n=a or g
gatcactaaggttattgtttttctaacaatgattcntggcactaacattttggaaagtgagggtctagggt

SEQ ID NO: 25833 - DNA, 71 bp, chicken (Gallus Gallus)
  misc_feature (36): n=a or g
ctcccaacatcatcaggcttgaactgagttaagtcntaaccttttcaatgtgcttgtccctctgagaaccg

SEQ ID NO: 25834 - DNA, 71 bp, chicken (Gallus Gallus)
  misc_feature (36): n=a or g
attgctccaaagctcattgcaaggcttaagtgtgcntggactgtttaaaggggaggatgtttacaagagaa

SEQ ID NO: 25835 - DNA, 71 bp, chicken (Gallus Gallus)
  misc_feature (36): n=c or t
atgagggtttctgagccacaaaatgtattcaacttnatttttttagtgcagaagtatttttttaaatatta

SEQ ID NO: 25836 - DNA, 71 bp, chicken (Gallus Gallus)
  misc_feature (36): n=a or c
ggagatgcatctctctgatgtcctatgccaggacantgaacgctaaaaaaaatgaatagacctgaatcagt

SEQ ID NO: 25837 - DNA, 71 bp, chicken (Gallus Gallus)
  misc_feature (36): n=c or t
tctttcccactttagatgtatttcacctctctgagntcaaaggttccccatatctttcagtaataatacta

SEQ ID NO: 25838 - DNA, 71 bp, chicken (Gallus Gallus)
  misc_feature (36): n=c or t
tagtagtgtagtccattataagagctgccagcccangccccagggatgattgtgatcaattcaaccatagt

SEQ ID NO: 25839 - DNA, 71 bp, chicken (Gallus Gallus)
  misc_feature (36): n=c or t
ggatgtgatttgggtaataagggaacattcgtattngattgatagaagttttgagctttcaaagtattttg

SEQ ID NO: 25840 - DNA, 71 bp, chicken (Gallus Gallus)
  misc_feature (36): n=c or t
gaaagtcctgcctggcacctcacaagttgtgtgatngtatcactggcattctcatggctgcacactggtgg

SEQ ID NO: 25841 - DNA, 71 bp, chicken (Gallus Gallus)
  misc_feature (36): n=c or t
gcagaaacaccaaagcagaaattgctaaaaatgatnggtgatatgaaagtggaagtgaccaccaagaggaa

SEQ ID NO: 25842 - DNA, 71 bp, chicken (Gallus Gallus)
  misc_feature (36): n=a or g
gctgtatgtcaagttttagttgcttctttctgtgtnaagttgggagtgttatctgtgtactcacatttaaa

SEQ ID NO: 25843 - DNA, 71 bp, chicken (Gallus Gallus)
  misc_feature (36): n=c or t
agttaatgttaacaaaactacttacaaagctcacantggtacaggagtcatttagaataagtcaggactcc

SEQ ID NO: 25844 - DNA, 71 bp, chicken (Gallus Gallus)
  misc_feature (36): n=a or c
agttccaggaaagtaacgtccgcatctccaccctcntgtacaaggctggtgatttcattgtacaagcttat

SEQ ID NO: 25845 - DNA, 71 bp, chicken (Gallus Gallus)
  misc_feature (36): n=a or g
ggatacatgaaaagttgaatgttctctgtattctgnctgttactgtttctgtgtattcttctaacagttca

SEQ ID NO: 25846 - DNA, 71 bp, chicken (Gallus Gallus)
  misc_feature (36): n=a or g
tttacttatatgaaagagcttggttcactttgaccnctttccctaagccagaagtcgctgtgttctgggac

SEQ ID NO: 25847 - DNA, 71 bp, chicken (Gallus Gallus)
  misc_feature (36): n=a or c
gtctttgttgtctccattatctctgcattatatacnatagggacttggaggtactgcaagttcattgcagg

SEQ ID NO: 25848 - DNA, 71 bp, chicken (Gallus Gallus)
  misc_feature (36): n=c or t
aattatgaactttgttcaccaaaggaaatgaaaccnctcttgtttattttctctacatctgtttttgtaac

SEQ ID NO: 25849 - DNA, 71 bp, chicken (Gallus Gallus)
  misc_feature (36): n=a or g
ctcagacccttccttgggaagctttgccactggaanaagaggaatgacaattatgggactagaatgcaggg

SEQ ID NO: 25850 - DNA, 71 bp, chicken (Gallus Gallus)
  misc_feature (36): n=c or t
ataagcaattacaaacagcacttgtcttgacaccangtatgagtttttttcattgagaaggaatcaaaaaa

SEQ ID NO: 25851 - DNA, 71 bp, chicken (Gallus Gallus)
  misc_feature (36): n=a or g
tgaagacaaataacaccttcactaaccataactccnggcaacagttttttaagctggctgtattgtgcatg

SEQ ID NO: 25852 - DNA, 71 bp, chicken (Gallus Gallus)
  misc_feature (36): n=c or t
cttaagaaaaccattataatgttcaatgaggcctgnccccgttggattatatgacagatggaattgccatt

SEQ ID NO: 25853 - DNA, 71 bp, chicken (Gallus Gallus)
  misc_feature (36): n=g or t
ctgaaacgcccaagcagaagtcttggatctaagcangtactgacactgaatatatctaaaatacaactcct

SEQ ID NO: 25854 - DNA, 71 bp, chicken (Gallus Gallus)
  misc_feature (36): n=a or g
gtggctctgcagagatacctttggactggagagcancacaagcacagcagtgtgatatttgtaaggttagc

SEQ ID NO: 25855 - DNA, 71 bp, chicken (Gallus Gallus)
  misc_feature (36): n=a or g
caatgccacatgctcttcagtacctcagagagtccntgccatcatgtcacccccatgctctacctttgagg

SEQ ID NO: 25856 - DNA, 71 bp, chicken (Gallus Gallus)
  misc_feature (36): n=g or t
acctacctctcttgtgggaatatttattttatgccncactcactgagcagatttttcttcactgcttttgt

SEQ ID NO: 25857 - DNA, 71 bp, chicken (Gallus Gallus)
  misc_feature (36): n=a or g
gaaatggtatctttaaatcatggaagcacaagtttncctgtgcagctttcagatccttttcctgctgccac

SEQ ID NO: 25858 - DNA, 71 bp, chicken (Gallus Gallus)
  misc_feature (36): n=c or t
atgctagttttccctgaaaattgcctacttttgacnagtgaagaagagtggatgctgtcaaacctggcttc

SEQ ID NO: 25859 - DNA, 71 bp, chicken (Gallus Gallus)
  misc_feature (36): n=a or g
taggtttcatgatgagatatcatttttaagggaganggaagcttcatttgtgtgtgtgtgctatcttttga

SEQ ID NO: 25860 - DNA, 71 bp, chicken (Gallus Gallus)
  misc_feature (36): n=c or t
cttccccctttgtagtacacctgcaaagcattaagnggcatcttgatcttatacagcttactaagataaat

SEQ ID NO: 25861 - DNA, 71 bp, chicken (Gallus Gallus)
  misc_feature (36): n=a or g
tgaacaaccttgcagaaacaagcatctaaaaccagngctaatgggtagagctgggaaaggaccaggtcccc

SEQ ID NO: 25862 - DNA, 71 bp, chicken (Gallus Gallus)
  misc_feature (36): n=a or g
tccacgaatgctggtgtattaacagaatggtgcccnccactcaattccattttactcccaggtttgtgcta

SEQ ID NO: 25863 - DNA, 71 bp, chicken (Gallus Gallus)
  misc_feature (36): n=a or c
agtctctgtcatatacaaatatgcaagaaaaaaggncctaaaaatttagaagttggtgcaaatttaacctt

SEQ ID NO: 25864 - DNA, 71 bp, chicken (Gallus Gallus)
  misc_feature (36): n=g or t
ggttcttccggccacgagccaaatgttgaaagcttnaatgtgaaaaataatgaaagcagattaataaggcc

SEQ ID NO: 25865 - DNA, 71 bp, chicken (Gallus Gallus)
  misc_feature (36): n=a or t
aaccctaaagagtctttaaagatggactttttgaanaataaaaattagctgtctatcagctaagtaactga

SEQ ID NO: 25866 - DNA, 71 bp, chicken (Gallus Gallus)
  misc_feature (36): n=a or t
agactataggaacatgttggtagtggatgaaatatnatatagacttcggagaaataggaaggagactcaaa

SEQ ID NO: 25867 - DNA, 71 bp, chicken (Gallus Gallus)
  misc_feature (36): n=a or g
aaggaggacatggttttccagcaagttttcacagcncacgacccagaaacaccatgacaacggcagtccac

SEQ ID NO: 25868 - DNA, 71 bp, chicken (Gallus Gallus)
  misc_feature (36): n=c or t
aagtgtgtatgtatattttatctcttacagtatcanatgttttcctatgtggtaacctaagcacttttata

SEQ ID NO: 25869 - DNA, 71 bp, chicken (Gallus Gallus)
  misc_feature (36): n=c or t
ggaaatctccatgggcacttcaattgcccttcactngagctatatacatagaacagaattagaaattactt

SEQ ID NO: 25870 - DNA, 71 bp, chicken (Gallus Gallus)
  misc_feature (36): n=c or t
tatccatcttgttgctgaatgaaagggtttggaatngcttccattccatcctgtgggcaaatgagaaccac

SEQ ID NO: 25871 - DNA, 71 bp, chicken (Gallus Gallus)
  misc_feature (36): n=a or g
tgatcttcaaggtcttttccaatttgagctattctntgattcttgagatgcagcttaacgcttctccaaca

SEQ ID NO: 25872 - DNA, 71 bp, chicken (Gallus Gallus)
  misc_feature (36): n=c or t
agaaactgagttttccttccatgtttcttactgtcntctgtgctttttgtagagaaatatctttttctaac

SEQ ID NO: 25873 - DNA, 71 bp, chicken (Gallus Gallus)
  misc_feature (36): n=c or t
ggggccaggctgagccacccttggctgtgggcatcngtagggtaaatgagcaaaagggaaaagcaggccgt

SEQ ID NO: 25874 - DNA, 71 bp, chicken (Gallus Gallus)
  misc_feature (36): n=a or c
tggttttatgaaggaatcagcaccgactagattggncagattgatttgtcagccagaatctgaagaaagat

SEQ ID NO: 25875 - DNA, 71 bp, chicken (Gallus Gallus)
  misc_feature (36): n=a or g
attttgtttttatttcttcatttattttattcttantctataagcattctcaaaatgtttttcacaaaatc

SEQ ID NO: 25876 - DNA, 71 bp, chicken (Gallus Gallus)
  misc_feature (36): n=a or g
gtcttaacgtggtattcctgtgacctaattttcccncacctccaaagaaactagtatctttgaaagatgcc

SEQ ID NO: 25877 - DNA, 71 bp, chicken (Gallus Gallus)
  misc_feature (36): n=c or t
cggtccctcagcgtggcggtgtgaggcgttcggttnacggtgtcaaagtcaattgtgatcccaaaggccac

SEQ ID NO: 25878 - DNA, 71 bp, chicken (Gallus Gallus)
  misc_feature (36): n=a or c
aagaagactacaaagattctattcaatattttttanagttttttttttaagttctatttactttcaaaata

SEQ ID NO: 25879 - DNA, 71 bp, chicken (Gallus Gallus)
  misc_feature (36): n=a or t
tgggatacaataaaggtgatacttttgctgtacccnctaaacatgtctcatccttaagaaagaaaagcaga

SEQ ID NO: 25880 - DNA, 71 bp, chicken (Gallus Gallus)
  misc_feature (36): n=a or c
aatccaaatctaccctctttccattgaaagctgttntctcttgtcctaccactgcactctctgataaagag

SEQ ID NO: 25881 - DNA, 71 bp, chicken (Gallus Gallus)
  misc_feature (36): n=c or t
cacaccactttgcagtcgcatttgcttcacaagttntggtaatgctgatagctcccatttcatttccacta

SEQ ID NO: 25882 - DNA, 71 bp, chicken (Gallus Gallus)
  misc_feature (36): n=c or g
acaagttgctgcctagcagtgaagtatgaaggggtntgttaatgagctgcccagcacttctatagaacttt

SEQ ID NO: 25883 - DNA, 71 bp, chicken (Gallus Gallus)
  misc_feature (36): n=a or g
tttatcattatttattttcatttacccaaatcatgncacaaacgtgagggagactagaagagtgtatgtgt

SEQ ID NO: 25884 - DNA, 71 bp, chicken (Gallus Gallus)
  misc_feature (36): n=a or g
gaacacacggtgtttgtttgattaaagcagcctgtngctggacacatcttcccatacctttgagacaccaa

SEQ ID NO: 25885 - DNA, 71 bp, chicken (Gallus Gallus)
  misc_feature (36): n=a or g
aacatcagcactgtcttcagcagaaagataaggtcnttaatccgtagctcaggtctattggtttgctgtag

SEQ ID NO: 25886 - DNA, 71 bp, chicken (Gallus Gallus)
  misc_feature (36): n=a or g
tttaaagctaagttacagcactacgtttcaaacacntgggacaaaatgttctgactcaacattatttgacc

SEQ ID NO: 25887 - DNA, 71 bp, chicken (Gallus Gallus)
  misc_feature (36): n=c or t
cttgaaatggaattgaaaatctacacactcctttanggtaattagactactaaggtgctgtgaactctgct

SEQ ID NO: 25888 - DNA, 71 bp, chicken (Gallus Gallus)
  misc_feature (36): n=a or g
ggaaaattaaaaacagaaagataaaggccaggaggnaaagaaatcctgataaaaaacagctaggagacaaa

SEQ ID NO: 25889 - DNA, 71 bp, chicken (Gallus Gallus)
  misc_feature (36): n=a or g
cttcaagtgcaagggctgcatcaaagactacagtanaagtgttatgtagttgcataatactttcacaattg

SEQ ID NO: 25890 - DNA, 71 bp, chicken (Gallus Gallus)
  misc_feature (36): n=a or g
gctcgtgacattaagcaacgggacgttcatgtatcntaagtgctgcagcagtcttattgcaggctccacgg

SEQ ID NO: 25891 - DNA, 71 bp, chicken (Gallus Gallus)
  misc_feature (36): n=g or t
ctgccccttaccacccttttgcagtaagtgcctganaatttggggtgtggagattcatttgtgggagccct

SEQ ID NO: 25892 - DNA, 71 bp, chicken (Gallus Gallus)
  misc_feature (36): n=a or c
atgtgtttggaggctgctctttaggactgaattagnagaaagtcatttagcaggacttgatgttctttatt

SEQ ID NO: 25893 - DNA, 71 bp, chicken (Gallus Gallus)
  misc_feature (36): n=a or g
aaagggtgcatccaaacagggagatacaccaagaanggcaacaaatagaatcaatggaattttagggaatg

SEQ ID NO: 25894 - DNA, 71 bp, chicken (Gallus Gallus)
  misc_feature (36): n=a or g
agactgcagaggaagaagaagtaaggtatttatacntaccagataccataaagattaattgtctgtagtat

SEQ ID NO: 25895 - DNA, 71 bp, chicken (Gallus Gallus)
  misc_feature (36): n=c or t
atcatagtctgaactgcggtctggattagtttgtangaagactgatttttctttccaaacatcaaattcgg

SEQ ID NO: 25896 - DNA, 71 bp, chicken (Gallus Gallus)
  misc_feature (36): n=c or t
cacacctgaacagcaccagctcagccattctgattncctgcttcagttctgggacattaggctacagcagc

SEQ ID NO: 25897 - DNA, 71 bp, chicken (Gallus Gallus)
  misc_feature (36): n=a or g
tctttagagtccagtgagtatttcatggtactaagntgaccaagactgtcactcatttctctgttatttca

SEQ ID NO: 25898 - DNA, 71 bp, chicken (Gallus Gallus)
  misc_feature (36): n=c or g
tgctactagttttatatttctttttgctcacagccnaggaaactcaggctgcaagcctgtttaaccatgtg

SEQ ID NO: 25899 - DNA, 71 bp, chicken (Gallus Gallus)
  misc_feature (36): n=c or t
cttgttgcaattcttcagccaaatgctacttttacnctcctcacagctcccaaaagagctgctatttatga

SEQ ID NO: 25900 - DNA, 71 bp, chicken (Gallus Gallus)
  misc_feature (36): n=c or t
caatacatcttttgagaggggtcatttttgaacaanagtttgtatgaagtatggtttattctttcatgctt

SEQ ID NO: 25901 - DNA, 71 bp, chicken (Gallus Gallus)
  misc_feature (36): n=c or t
tttatcctctaggttctctttgcatgacattccaangagaatgcagggctgtacttgtgcaaaatttgtct

SEQ ID NO: 25902 - DNA, 71 bp, chicken (Gallus Gallus)
  misc_feature (36): n=g or t
ggaggaggcagtgtctacagctttcaaacaaagacntgtcatgcttttaggtgtgcttgtgacatatgctg

SEQ ID NO: 25903 - DNA, 71 bp, chicken (Gallus Gallus)
  misc_feature (36): n=c or t
actgcaggagctacaggatggagctatctccccatnccctttgatgaaacaataaatactccagcaaccga

SEQ ID NO: 25904 - DNA, 71 bp, chicken (Gallus Gallus)
  misc_feature (36): n=a or g
taatggaagttatcctcaaaaccaattccatgtctnaatcattccactgttatggacatcatttaattctt

SEQ ID NO: 25905 - DNA, 71 bp, chicken (Gallus Gallus)
  misc_feature (36): n=c or t
acaatgatgctacagctaaggtaagcacaatgtggnaaaatagtgaactggaagcattgaatcctaagggt

SEQ ID NO: 25906 - DNA, 71 bp, chicken (Gallus Gallus)
  misc_feature (36): n=a or g
tcttcattaagtgaccgcgctagatgtaaccctgangcaggctgacatttgatactgaagaggttcagaca

SEQ ID NO: 25907 - DNA, 71 bp, chicken (Gallus Gallus)
  misc_feature (36): n=a or t
ctcctatgaagatagtctgagggagatggggttgtntagactggggaacgctacacagattttactgcagc

SEQ ID NO: 25908 - DNA, 71 bp, chicken (Gallus Gallus)
  misc_feature (36): n=a or g
ttcagtgttgagaagcagtaaaatttgaagacttcnatagtgccttaccatgactggtctaggctgggagc

SEQ ID NO: 25909 - DNA, 71 bp, chicken (Gallus Gallus)
  misc_feature (36): n=c or g
aaaatttagcaaaagtattaggccatatctaatctnaagttaatttaacgatcaacaatgcagtaatttta

SEQ ID NO: 25910 - DNA, 71 bp, chicken (Gallus Gallus)
  misc_feature (36): n=c or t
tgtgaaagaggcagtagaaacatgcactatgagcantccctctaatgttcttccatagacaaaaacacaca

SEQ ID NO: 25911 - DNA, 71 bp, chicken (Gallus Gallus)
  misc_feature (36): n=c or t
tttttgagttatttttgttattgtccactgtaattncagaggttcacagaatataagcaaatccatggcta

SEQ ID NO: 25912 - DNA, 71 bp, chicken (Gallus Gallus)
  misc_feature (36): n=c or t
ggtgtgaaggattttggttccactcctggaaacgcntgtctcatgagcagctttgctctacagtgtcagta

SEQ ID NO: 25913 - DNA, 71 bp, chicken (Gallus Gallus)
  misc_feature (36): n=c or t
tatgcaaaaaaatacattttagtgtttatctcttcnaccgagtgccttcttgatgagggaaatgggcagat

SEQ ID NO: 25914 - DNA, 71 bp, chicken (Gallus Gallus)
  misc_feature (36): n=c or g
ctgagttatcctttgaagtcctactccaaatataangcaatagtaatctgtgagatattctgtcagtatta

SEQ ID NO: 25915 - DNA, 71 bp, chicken (Gallus Gallus)
  misc_feature (36): n=c or g
caggtctctactgaatggacacagcgaggcactcanctgggtgtcaccctcatgcattaatgcaaaagtga

SEQ ID NO: 25916 - DNA, 71 bp, chicken (Gallus Gallus)
  misc_feature (36): n=g or t
ttttttccacgggagaaataaaaagctgcgattacncattaacgctgaccggttatactcctgagtgtata

SEQ ID NO: 25917 - DNA, 71 bp, chicken (Gallus Gallus)
  misc_feature (36): n=c or t
aatccacagacttttccctataatttttggagtccngttagtgggcaagacttgccactgggttcccacat

SEQ ID NO: 25918 - DNA, 71 bp, chicken (Gallus Gallus)
  misc_feature (36): n=a or g
gcgctgagtgataggtggacagctattaacaaaacnactgccattttggcatgagtggttctcatttgaga

SEQ ID NO: 25919 - DNA, 71 bp, chicken (Gallus Gallus)
  misc_feature (36): n=c or t
ctggcttcacacagcaccactcaaaaatcaagctcnatgtctgagagtacagtccaaatgtttcttgaact

SEQ ID NO: 25920 - DNA, 71 bp, chicken (Gallus Gallus)
  misc_feature (36): n=c or t
ctgtcttcatgagacaaagcttctaggcagtcctgnctcacaggggtttctagagatctgaatgagggagg

SEQ ID NO: 25921 - DNA, 71 bp, chicken (Gallus Gallus)
  misc_feature (36): n=a or g
cctgactcaccaagccggggtgtctcacgggatggnatcagaaggagggcatagaacagcctgtggggagg

SEQ ID NO: 25922 - DNA, 71 bp, chicken (Gallus Gallus)
  misc_feature (36): n=a or g
gaaaagaggttggctttccttttgtggatacgaacngtatgtctgattgtggccattctgtccccttggag

SEQ ID NO: 25923 - DNA, 71 bp, chicken (Gallus Gallus)
  misc_feature (36): n=a or g
gcctgcaaagcactacacaatttaacggtcaaaccncagcacaaatgaggtttttccacaggtatcagaag

SEQ ID NO: 25924 - DNA, 71 bp, chicken (Gallus Gallus)
  misc_feature (36): n=c or t
gggtgaacacatcaggaaaaggagtagaaactgcangtctgttagatgacttattttctgtgaaattcatt

SEQ ID NO: 25925 - DNA, 71 bp, chicken (Gallus Gallus)
  misc_feature (36): n=a or c
gtgttgaatgagagtgatgctgaactgaagctttanaagtgataagttaaaagccccagtagcttgtcgtg

SEQ ID NO: 25926 - DNA, 71 bp, chicken (Gallus Gallus)
  misc_feature (36): n=a or g
aaatctgcttgtaagctgacagtgacttgcataatngctagttacacttattctcatagtatttttcttga

SEQ ID NO: 25927 - DNA, 71 bp, chicken (Gallus Gallus)
  misc_feature (36): n=a or g
tcaatctctagggatagtttggagaagatacagcantggagtctttgctcttgaagaattatgaatgaaat

SEQ ID NO: 25928 - DNA, 71 bp, chicken (Gallus Gallus)
  misc_feature (36): n=c or t
ttgaagctatagcctgtactggatatgggtaatttncatatgtttgctccccgttttaagccatgattgca

SEQ ID NO: 25929 - DNA, 71 bp, chicken (Gallus Gallus)
  misc_feature (36): n=c or t
aatgccaatctgcacagggaaaaaatacctcaagcngcaaaatacttaagtgttctccagtcgattttgga

SEQ ID NO: 25930 - DNA, 71 bp, chicken (Gallus Gallus)
  misc_feature (36): n=a or g
aggggagacctcatcactatgtacaattctctgaanggagattgtggtgatggggaagtcagcttcttctc

SEQ ID NO: 25931 - DNA, 71 bp, chicken (Gallus Gallus)
  misc_feature (36): n=a or t
tatgcactcttggctcttcctcttgaactttagaantaaaaaaaatacatgattaaaaagctcaatgaaag

SEQ ID NO: 25932 - DNA, 71 bp, chicken (Gallus Gallus)
  misc_feature (36): n=c or t
gacaagatgtctgacattgaccgcacggccatccangaggtgatggagcagggccgtgtcaccatcgccaa

SEQ ID NO: 25933 - DNA, 71 bp, chicken (Gallus Gallus)
  misc_feature (36): n=a or g
atcaatgggcaaaatttcttcttggtaacaacaacntcaatctgaagacatctcagcagccaactgaattt

SEQ ID NO: 25934 - DNA, 71 bp, chicken (Gallus Gallus)
  misc_feature (36): n=a or g
tatttagctttgattccaagtgctagagaagacagnctgacctgttatcagagatctgcctgttgatctgg

SEQ ID NO: 25935 - DNA, 71 bp, chicken (Gallus Gallus)
  misc_feature (36): n=a or c
cccagctacctcctgccacataaaaacaaggcctcnaagaggaagacgcccgtggtgaagaagaccctcaa

SEQ ID NO: 25936 - DNA, 71 bp, chicken (Gallus Gallus)
  misc_feature (36): n=a or g
ataccagtagaaaaacaaaaggaaggatgaaggatngattttctccactttctgtacttcttttaacaact

SEQ ID NO: 25937 - DNA, 71 bp, chicken (Gallus Gallus)
  misc_feature (36): n=a or g
ctcctctaatatatattttggattacctcctaggcngacaggaatgtcaaaattaggcatgacatttccta

SEQ ID NO: 25938 - DNA, 71 bp, chicken (Gallus Gallus)
  misc_feature (36): n=c or t
acaaagtcctattcatgagttccaagtacatgtatngtcttcttctcagtgtttttgtaagttggttggtt

SEQ ID NO: 25939 - DNA, 71 bp, chicken (Gallus Gallus)
  misc_feature (36): n=a or c
ggtaggccagtgctaaggccaggataccagatttanaaggttaatgatctatccattatgctaaatcctct

SEQ ID NO: 25940 - DNA, 71 bp, chicken (Gallus Gallus)
  misc_feature (36): n=g or t
tctcctttcttttaaatatagatatgtttctgtccntacatgtttgttggatacttttatattaatatgta

SEQ ID NO: 25941 - DNA, 71 bp, chicken (Gallus Gallus)
  misc_feature (36): n=c or t
tgaagaatgctgctgttattttcctgttttgcacgnggaactgcatttagtttcacttgaaaagagatgca

SEQ ID NO: 25942 - DNA, 71 bp, chicken (Gallus Gallus)
  misc_feature (36): n=a or g
tttgcagtagttaaatagaggcagaaggaaaggttntccgtgtgtgtaaatagacttttttgaccaaaatt

SEQ ID NO: 25943 - DNA, 71 bp, chicken (Gallus Gallus)
  misc_feature (36): n=a or g
agaagctttacatctaacaagtttaattggtatcangtattgtttagctgtgctgaatgatgaacttagct

SEQ ID NO: 25944 - DNA, 71 bp, chicken (Gallus Gallus)
  misc_feature (36): n=c or t
ccataacaaagaacatgcccgtgactgactacaggngttggtgccatccgacagccaaaatgggtgggcca

SEQ ID NO: 25945 - DNA, 71 bp, chicken (Gallus Gallus)
  misc_feature (36): n=a or c
aaacaatggtgctctgaaggcatttgactgcctctntgaaagaagttcgttgaagacagtatggccctgga

SEQ ID NO: 25946 - DNA, 71 bp, chicken (Gallus Gallus)
  misc_feature (36): n=a or t
agggctaacctaagactgggcttgtacatataacanctttaacttgttagcttcacatacaagaggcaaat

SEQ ID NO: 25947 - DNA, 71 bp, chicken (Gallus Gallus)
  misc_feature (36): n=a or g
tgaagacctttctttgttgcctgtcaggtgaacacngggcaacatacctggagacacatttacacagctag

SEQ ID NO: 25948 - DNA, 71 bp, chicken (Gallus Gallus)
  misc_feature (36): n=a or g
tggttttcagagatcacaaaaagtgaaatcaatagnatgttttgtttgttaaaccatgttttggtagcaca

SEQ ID NO: 25949 - DNA, 71 bp, chicken (Gallus Gallus)
  misc_feature (36): n=a or g
gtggtgaacaggcagcagaacagtgtctttcttacnggttcaaagttagaaaaacttgggcttcctttgca

SEQ ID NO: 25950 - DNA, 71 bp, chicken (Gallus Gallus)
  misc_feature (36): n=c or t
gaatctaagttgtaagtggtcatttgtggtatcagntttttattacaagattctgagatcatccagtacct

SEQ ID NO: 25951 - DNA, 71 bp, chicken (Gallus Gallus)
  misc_feature (36): n=c or t
tgtttaatcacccaagattgaatttctagatggccngcctaccagctgctttggctgatggggcagcaaat

SEQ ID NO: 25952 - DNA, 71 bp, chicken (Gallus Gallus)
  misc_feature (36): n=c or t
ccaatgtttgtttacaaccacaaatccatgattctnctccatcacagggaggccaggcagctgctccgatc

SEQ ID NO: 25953 - DNA, 71 bp, chicken (Gallus Gallus)
  misc_feature (36): n=c or t
tacttatactagatcctccactgaatgatgtggganggggtaagcaatggttatgtgaaagaagatctatg

SEQ ID NO: 25954 - DNA, 71 bp, chicken (Gallus Gallus)
  misc_feature (36): n=a or g
ttgggcaagaacacagctagagcagttgcaactgtngctctaacaaatgagcccagcccgtggctgacagg

SEQ ID NO: 25955 - DNA, 71 bp, chicken (Gallus Gallus)
  misc_feature (36): n=c or t
cgctattaggcttacatgagattacaaaagcctacngataatagagttaaattcaatttcaaagcactgca

SEQ ID NO: 25956 - DNA, 71 bp, chicken (Gallus Gallus)
  misc_feature (36): n=a or g
ttgggaaagccacactagaaccgaggaactgatatntgcagttttgcgatgctaaaaggagacacagtttg

SEQ ID NO: 25957 - DNA, 71 bp, chicken (Gallus Gallus)
  misc_feature (36): n=g or t
tgaagtctcttctctctcagtttattacattctcancagattgctaaagagcaaagatcccagaagagcaa

SEQ ID NO: 25958 - DNA, 71 bp, chicken (Gallus Gallus)
  misc_feature (36): n=c or t
aatccataagaaaatccaggttagataaagatgtanctcccagtattaaactaagcagatcatttatctcc

SEQ ID NO: 25959 - DNA, 71 bp, chicken (Gallus Gallus)
  misc_feature (36): n=a or g
gtttcaattgttctagaccaaatgtttgcacgtgtnttaaaattttatttcataggaaatctcagagctgt

SEQ ID NO: 25960 - DNA, 71 bp, chicken (Gallus Gallus)
  misc_feature (36): n=c or t
agccaccagagaaatcccatgctctcttttgccagnattgagcccagaagtacactgcaacaaatacgggc

SEQ ID NO: 25961 - DNA, 71 bp, chicken (Gallus Gallus)
  misc_feature (36): n=a or g
ataaatgtccaaggtatgagttagagagtaagcctntatgtttagcctgatgcataagttcgtattggatt

SEQ ID NO: 25962 - DNA, 71 bp, chicken (Gallus Gallus)
  misc_feature (36): n=a or g
gaggaaaggcaacaactgaatatccatggactgttnccaccttgctttctcagtcaagatgtccaggtttt

SEQ ID NO: 25963 - DNA, 71 bp, chicken (Gallus Gallus)
  misc_feature (36): n=a or t
tgttttaatcttgctttaaataaatgtttgctttgntggaggtttgaacatcctaatttgctggatgtagc

SEQ ID NO: 25964 - DNA, 71 bp, chicken (Gallus Gallus)
  misc_feature (36): n=c or t
acttttactgtaaatagattctcgcatgagaagggncagagggggaggttctatccagcatgtttgtctct

SEQ ID NO: 25965 - DNA, 71 bp, chicken (Gallus Gallus)
  misc_feature (36): n=a or c
gtatctagagatatctcttccttgtacatcttgttnatctctgccctttatctctagtcttctcaaaatat

SEQ ID NO: 25966 - DNA, 71 bp, chicken (Gallus Gallus)
  misc_feature (36): n=a or g
ccctgaggtgcctgtacagatgtttggtagtagagngtgagattcacatggagtgagatgtacagtaatga

SEQ ID NO: 25967 - DNA, 71 bp, chicken (Gallus Gallus)
  misc_feature (36): n=g or t
gcttcagctcttatagtcaacttcagtctcccatantcagcactgttccatttgcctttcaagaagcatct

SEQ ID NO: 25968 - DNA, 71 bp, chicken (Gallus Gallus)
  misc_feature (36): n=a or g
ttgaatgctttgcctaacaatcctctaaatgttccncaggtatttccagggatactggagtggcacatgtt

SEQ ID NO: 25969 - DNA, 71 bp, chicken (Gallus Gallus)
  misc_feature (36): n=a or t
actcaagtaatttatataggaattgaactgagaaantgtatctgcttctttaaatatctaggtaggaaaga

SEQ ID NO: 25970 - DNA, 71 bp, chicken (Gallus Gallus)
  misc_feature (36): n=c or g
aaaaccctttcagtttggtagtagctgctgatcctntgggacggtaacttcttgacttatgtccttctttt

SEQ ID NO: 25971 - DNA, 71 bp, chicken (Gallus Gallus)
  misc_feature (36): n=a or t
agtcttgaaaaaggaaatgataaattcccttgtagngagtgagaaaaggcaattctacctgtctctagttg

SEQ ID NO: 25972 - DNA, 71 bp, chicken (Gallus Gallus)
  misc_feature (36): n=c or t
ctgtttcacacgtcaactagagctgcacagtgtgcnttaaccactcctgaaaagctgggttgaaacaaagc

SEQ ID NO: 25973 - DNA, 71 bp, chicken (Gallus Gallus)
  misc_feature (36): n=c or g
gtatttgtgtaaatctttgtagtaaataagaaaatnaaaaacaaaaccttgaaatagtttttccagaaggg

SEQ ID NO: 25974 - DNA, 71 bp, chicken (Gallus Gallus)
  misc_feature (36): n=a or g
ttaatttttatcaagtcttttagaattcagaagtanaaattattcagtgaatgaagatgggacagattggg

SEQ ID NO: 25975 - DNA, 71 bp, chicken (Gallus Gallus)
  misc_feature (36): n=c or t
ttgcacagtgtgaccttgcaaagagaaaaaacgcangagcagaactgtgcaaagggccagggcaagcccct

SEQ ID NO: 25976 - DNA, 71 bp, chicken (Gallus Gallus)
  misc_feature (36): n=c or t
gagttgctggaagccatcacgtggcaagaaaactgntgtttagttgccgttactgaaacatggtgggattg

SEQ ID NO: 25977 - DNA, 71 bp, chicken (Gallus Gallus)
  misc_feature (36): n=a or g
gcagaagtcagagcaaattccacacagcatattcangactatgcaatttactttttccttcacacctattt

SEQ ID NO: 25978 - DNA, 71 bp, chicken (Gallus Gallus)
  misc_feature (36): n=c or t
taaagagtggagttaactgctaaagccagctcagancatgtatattcctcgtaaacacaattatatattta

SEQ ID NO: 25979 - DNA, 71 bp, chicken (Gallus Gallus)
  misc_feature (36): n=c or t
tgcaggaagtattaacaggaggatggaagtgaaaangggtaaaagttaacataaagctgttgtgtgcctgt

SEQ ID NO: 25980 - DNA, 71 bp, chicken (Gallus Gallus)
  misc_feature (36): n=a or g
tagtgcttggtgacaagttgaacaactagtgacaanccagctatccttacagcaatctttactgtaaagct

SEQ ID NO: 25981 - DNA, 71 bp, chicken (Gallus Gallus)
  misc_feature (36): n=a or t
tctatcaggatctctaagtcctccctcagcagagcnactctaaaggaattctggtcccagtctgtagatat

SEQ ID NO: 25982 - DNA, 71 bp, chicken (Gallus Gallus)
  misc_feature (36): n=c or t
ctgacatttcagcatcgttccctatttttttctttnctcagtctgatgttagaattactctcaaatgttgc

SEQ ID NO: 25983 - DNA, 71 bp, chicken (Gallus Gallus)
  misc_feature (36): n=c or t
ttctagagtctaaattcctggtgtggaatacattcnacagacagtaagagcaacgtagacgtatttctttt

SEQ ID NO: 25984 - DNA, 71 bp, chicken (Gallus Gallus)
  misc_feature (36): n=g or t
ccttgacttctaagaaatgcatgcagtattttatantaccctaatcagatgaaattaaaccactgtaggaa

SEQ ID NO: 25985 - DNA, 71 bp, chicken (Gallus Gallus)
  misc_feature (36): n=a or g
agaggaggatgctcagaccttaggtgcatttccacntgctggaagaagtcgtgatcctgaggaggtaagaa

SEQ ID NO: 25986 - DNA, 71 bp, chicken (Gallus Gallus)
  misc_feature (36): n=g or t
gaacgcaagttaaaggcctttctgactgcctcagtnagagggtgtttcaggtgggtctgggggtttaaaat

SEQ ID NO: 25987 - DNA, 71 bp, chicken (Gallus Gallus)
  misc_feature (36): n=g or t
gggagaggggggaggaaggaatgagctgcacacacnactctccctacctctgacaatcaccgaggaaaagc

SEQ ID NO: 25988 - DNA, 71 bp, chicken (Gallus Gallus)
  misc_feature (36): n=a or c
aagtgctcaaaccactcattaaataactcagcccantagttagcatggttggcatcagagggaagaataat

SEQ ID NO: 25989 - DNA, 71 bp, chicken (Gallus Gallus)
  misc_feature (36): n=c or t
atagaacaaaaagcaattctaaatccaggagtttanaccctaaatatacatcaaaatgtccaaagaataca

SEQ ID NO: 25990 - DNA, 71 bp, chicken (Gallus Gallus)
  misc_feature (36): n=c or t
caccttgcaggtcttcagtgtgttttaatgattccnggccctattttttggccatttaacaccatttttgc

SEQ ID NO: 25991 - DNA, 71 bp, chicken (Gallus Gallus)
  misc_feature (36): n=c or g
tttgatgagtacaaagttctgcacccagagcattanagtaaccatttttgctttaaaagcacatcctccca

SEQ ID NO: 25992 - DNA, 71 bp, chicken (Gallus Gallus)
  misc_feature (36): n=a or g
tactttgtgactgaagttacaatgaatgatttatcnagcgagacttaaaataacccacttgacataaataa

SEQ ID NO: 25993 - DNA, 71 bp, chicken (Gallus Gallus)
  misc_feature (36): n=g or t
ctctgtaatcaggccaaggaaaacagtctgaggganggatagccatatagaagaactaaggctgagtcact

SEQ ID NO: 25994 - DNA, 71 bp, chicken (Gallus Gallus)
  misc_feature (36): n=a or g
gtactccaagtggagatttctgtgatatcgttagcnattaaagtctcttttaaagtctcagggattaaata

SEQ ID NO: 25995 - DNA, 71 bp, chicken (Gallus Gallus)
  misc_feature (36): n=a or g
gtgggaaagtctctctcagtgctttaagacatctcntgtgctcctaattattcttcataaacatttttcct

SEQ ID NO: 25996 - DNA, 71 bp, chicken (Gallus Gallus)
  misc_feature (36): n=a or c
ctggaaaaccgtgtcagctcactgtgaatgtcatgnaggactgggaagtctcctttccttgcaagttttta

SEQ ID NO: 25997 - DNA, 71 bp, chicken (Gallus Gallus)
  misc_feature (36): n=a or g
cacagccttgacagaaacgagtccatgaagcagagngcatgcagggcttctgccttccctggcacccacgg

SEQ ID NO: 25998 - DNA, 71 bp, chicken (Gallus Gallus)
  misc_feature (36): n=c or t
tgaaatgacttcatttaacatacataaaaggtttgnaacaagtaaataaacaagatcagacaaaaaacacg

SEQ ID NO: 25999 - DNA, 71 bp, chicken (Gallus Gallus)
  misc_feature (36): n=c or t
cagcagctggcttccttcaaatacctaaagaaagcntataaacaggaggggagccagctctttgaaagggt

SEQ ID NO: 26000 - DNA, 71 bp, chicken (Gallus Gallus)
  misc_feature (36): n=a or g
agattttctctgggaatgtttgaggataaactgtgnttttggaacatgtttagctttgctttctttgctac

SEQ ID NO: 26001 - DNA, 71 bp, chicken (Gallus Gallus)
  misc_feature (36): n=a or g
agatatggcatttccaggtacaggaaatccaagctnttttgatagctactgctgcttacacctgtgtcgca

SEQ ID NO: 26002 - DNA, 71 bp, chicken (Gallus Gallus)
  misc_feature (36): n=a or g
gtaagaaatcactagcttcatcgtaacataaatgcncagaacactttttgaggtataatctgagttgctta

SEQ ID NO: 26003 - DNA, 71 bp, chicken (Gallus Gallus)
  misc_feature (36): n=a or g
tctcgtgttgtttatttacatgtcctgcccaatgcngcgattttaggttttttataaagtttttaatacca

SEQ ID NO: 26004 - DNA, 71 bp, chicken (Gallus Gallus)
  misc_feature (36): n=c or t
caaaaaaactgagaccctaaagaaagagacttaagngattctgaagtgctgccaacttcaaacccttcctt

SEQ ID NO: 26005 - DNA, 71 bp, chicken (Gallus Gallus)
  misc_feature (36): n=c or t
agacttaaaatgcattagatgtaagaaaagttgggnatcctaaacaggcacctagtgctaattgtaattgg

SEQ ID NO: 26006 - DNA, 71 bp, chicken (Gallus Gallus)
  misc_feature (36): n=c or t
tttgcaagagcactcaaccagaggcacctcctgacntgcacttggctgtaagctgttgactctgtgggggg

SEQ ID NO: 26007 - DNA, 71 bp, chicken (Gallus Gallus)
  misc_feature (36): n=a or g
atctttcaaacgttacttcaactcaatggagaaaancacagacacttgagggacaaaacagcaacagtagc

SEQ ID NO: 26008 - DNA, 71 bp, chicken (Gallus Gallus)
  misc_feature (36): n=g or t
taatgcttacttataacagacttagcccatgcatanctttgtgtttatgctcaaaatcaaacttcttccac

SEQ ID NO: 26009 - DNA, 71 bp, chicken (Gallus Gallus)
  misc_feature (36): n=c or t
caaatgtagaaaaaaactgctaagaaaaatgcctangggttatgtagcaactgctgaggaaaaaattaact

SEQ ID NO: 26010 - DNA, 71 bp, chicken (Gallus Gallus)
  misc_feature (36): n=a or g
ttaaagctgagttcatcttgctcttggccctcgtantcatagagtgcacgcactctcacctccattgcagg

SEQ ID NO: 26011 - DNA, 71 bp, chicken (Gallus Gallus)
  misc_feature (36): n=a or t
caacctaagccctgagcaacagatctgtgacttccnccagtgtcagagggaaccagtggtgacctggcaca

SEQ ID NO: 26012 - DNA, 71 bp, chicken (Gallus Gallus)
  misc_feature (36): n=a or g
cttgactagaaaaagggggcaagaggaatctaatcntgttcaacaaagggaatactgactagcatattggt

SEQ ID NO: 26013 - DNA, 71 bp, chicken (Gallus Gallus)
  misc_feature (36): n=a or g
aggctggatagaagaggtgtgtctttttctctcacntcttttgttggttaccattcttgggaagagaggaa

SEQ ID NO: 26014 - DNA, 71 bp, chicken (Gallus Gallus)
  misc_feature (36): n=a or t
cagcaaatctcatggtatcacaagacaaatcattgnatttgggtaagttaagtgttcattagttcagtgcg

SEQ ID NO: 26015 - DNA, 71 bp, chicken (Gallus Gallus)
  misc_feature (36): n=c or g
gtaccttctttttcatgcagggacctggcagcacgnaactgcttagttggagaaaaccacgtggtgaaggt

SEQ ID NO: 26016 - DNA, 71 bp, chicken (Gallus Gallus)
  misc_feature (36): n=c or t
gctcaaacattcatacttaaagcattgaaactcttngtaacctattgcagctgaggtcagagctacaccta

SEQ ID NO: 26017 - DNA, 71 bp, chicken (Gallus Gallus)
  misc_feature (36): n=a or g
tccctctccagaacaaactgtactgtgatttaggcnctcacgtgaaaaaactggagataccaattcaaatc

SEQ ID NO: 26018 - DNA, 71 bp, chicken (Gallus Gallus)
  misc_feature (36): n=c or t
aaattagtccctcaaattatatgggatatagtgggnttgggtctcagggctggacacccaacaaaccctga

SEQ ID NO: 26019 - DNA, 71 bp, chicken (Gallus Gallus)
  misc_feature (36): n=a or t
tgctaaggttgcattcaaggaccgttatcgaagtgnatgcaggtcttaactggatggtcatttgcaagttt

SEQ ID NO: 26020 - DNA, 71 bp, chicken (Gallus Gallus)
  misc_feature (36): n=a or g
tttttttccctgttagcaattagaggaattcagatnttctcagcagccacattgcttaatatttctctaag

SEQ ID NO: 26021 - DNA, 71 bp, chicken (Gallus Gallus)
  misc_feature (36): n=c or t
aacttcccttctttgccagaacgtcgctttgcatangcattaatctccgtgttgcaagtttgaaaagttgc

SEQ ID NO: 26022 - DNA, 71 bp, chicken (Gallus Gallus)
  misc_feature (36): n=a or g
agtggcacttttccctacaggaaaccacaagttggnaaaattgaagcacctattgcctgttttgttctggg

SEQ ID NO: 26023 - DNA, 71 bp, chicken (Gallus Gallus)
  misc_feature (36): n=c or t
aatgaggagattctctcctcggtctgtactccttgnggagcatgtgaggcagttagagctgcctacatatt

SEQ ID NO: 26024 - DNA, 71 bp, chicken (Gallus Gallus)
  misc_feature (36): n=a or g
atcctggataaactgcaagggtacatctgaatgagnaatgggaaaacacagtgggaaaaggagtagagaaa

SEQ ID NO: 26025 - DNA, 71 bp, chicken (Gallus Gallus)
  misc_feature (36): n=a or g
agcagaagctttgccagtgatacttagaaagagacnccagtatataaggagaatagtttagttttctgcct

SEQ ID NO: 26026 - DNA, 71 bp, chicken (Gallus Gallus)
  misc_feature (36): n=c or t
catctccattttcactgtcactttggctgttttctntccgtgttacccttgacattctcaatacagccact

SEQ ID NO: 26027 - DNA, 71 bp, chicken (Gallus Gallus)
  misc_feature (36): n=a or g
aatcacagtgcagctagaacagtcacattttgtgcnctgttcaaatacaccgtagcccaaagctgtccgtg

SEQ ID NO: 26028 - DNA, 71 bp, chicken (Gallus Gallus)
  misc_feature (36): n=a or t
cttcccactttgagaagaaatcactactgttgctcnatgtcactttccctgattgctttttgacacacatt

SEQ ID NO: 26029 - DNA, 71 bp, chicken (Gallus Gallus)
  misc_feature (36): n=c or g
ccgagaatagaaagatttggtaattgttatgactanagttggagttgggatgcacctcccacaaggttaaa

SEQ ID NO: 26030 - DNA, 71 bp, chicken (Gallus Gallus)
  misc_feature (36): n=c or t
acagtatttgtcactcataactattttcacccacanattttataattcatcacagcattgttctgagtagc

SEQ ID NO: 26031 - DNA, 71 bp, chicken (Gallus Gallus)
  misc_feature (36): n=a or g
ggtgagagagtttgtgttttggtcttggtttgatcnagcaagttgtgtatattgcctgggagacatgtcat

SEQ ID NO: 26032 - DNA, 71 bp, chicken (Gallus Gallus)
  misc_feature (36): n=c or t
catgtttagtttgttttttgatttttttttctcttngtaagtagtctgatcaagaataggagaaaaccaag

SEQ ID NO: 26033 - DNA, 71 bp, chicken (Gallus Gallus)
  misc_feature (36): n=a or g
cttcttgcttcagctgtaagaagcatcaaactcacnggctctcatcccgatgagagatttcaaccacccag

SEQ ID NO: 26034 - DNA, 71 bp, chicken (Gallus Gallus)
  misc_feature (36): n=a or g
ttacacactgcctttccctggctgcatttctctgcngtcatcatccccttctatccagcgtaaaattctga

SEQ ID NO: 26035 - DNA, 71 bp, chicken (Gallus Gallus)
  misc_feature (36): n=c or t
tgtggagatatcatcagcacctggtaaagcaccacnggcatcatctctcttgaatccttcatttcttctca

SEQ ID NO: 26036 - DNA, 71 bp, chicken (Gallus Gallus)
  misc_feature (36): n=a or g
ccgtgtgcaaatccaacactttccttgcttaaacantttgtagcttgaagtccttgtgttgaaaaactgtc

SEQ ID NO: 26037 - DNA, 71 bp, chicken (Gallus Gallus)
  misc_feature (36): n=a or c
gctttaaatgtgacctaagggtagttttattctagntatctgtgaataggagcatgtttgtgttctcagtg

SEQ ID NO: 26038 - DNA, 71 bp, chicken (Gallus Gallus)
  misc_feature (36): n=a or g
tgaaatttttttttcaagctgaaacatgcatacatncaaggtggtgatgttgctctaacatgaaaaagaaa

SEQ ID NO: 26039 - DNA, 71 bp, chicken (Gallus Gallus)
  misc_feature (36): n=a or g
ctcctgcttatggatctaatacactatttttttgtnttcctattcaaaccatctgttttgttggttttgtt

SEQ ID NO: 26040 - DNA, 71 bp, chicken (Gallus Gallus)
  misc_feature (36): n=c or t
ctcagctggcagactctgtgaggagtgtttctctcnctgctctggcaaaaattactcattcagttaaaaga

SEQ ID NO: 26041 - DNA, 71 bp, chicken (Gallus Gallus)
  misc_feature (36): n=c or t
gacagcacaaattttctgctccctgctgatgggtanataatctttgttggctgtgtcagcaaagttgtgcc

SEQ ID NO: 26042 - DNA, 71 bp, chicken (Gallus Gallus)
  misc_feature (36): n=c or t
gctaaactgactttgtcataatgggaagcaataggnagtgttcatggtaggcagtgctaccttccatacaa

SEQ ID NO: 26043 - DNA, 71 bp, chicken (Gallus Gallus)
  misc_feature (36): n=a or g
actttgtactttccaggattcttcagagcaagaatnagagctccatgacctcccatggaatggccaaaaac

SEQ ID NO: 26044 - DNA, 71 bp, chicken (Gallus Gallus)
  misc_feature (36): n=a or g
acctgcacaaaatggtccctgaccacactgtctctncctgataacaactgtgttctgatcacattctgcct

SEQ ID NO: 26045 - DNA, 71 bp, chicken (Gallus Gallus)
  misc_feature (36): n=a or g
gtgaagaaaaggatgctctatctccagctgtcacancttgtacaactgtgccaccctgctcctgtcgggca

SEQ ID NO: 26046 - DNA, 71 bp, chicken (Gallus Gallus)
  misc_feature (36): n=a or t
tgcggttaatgagtgtaactctgctaatctcaatanaatttcagtgctaactctgaagctgatgaagctct

SEQ ID NO: 26047 - DNA, 71 bp, chicken (Gallus Gallus)
  misc_feature (36): n=c or t
aagtatacttgtctacagattactctgcagacatanggatgacaccatagtgagaaagttcattttgcgtt

SEQ ID NO: 26048 - DNA, 71 bp, chicken (Gallus Gallus)
  misc_feature (36): n=c or t
agagccctctgccctttctctgatactcacacaatngccctgtggctaacaagcaaatgcagcttttgctt

SEQ ID NO: 26049 - DNA, 71 bp, chicken (Gallus Gallus)
  misc_feature (36): n=a or g
gcacgatgcaggcaatggaagacttggcacagcacngcagggctgctcgcagcacaacatgagcagcacgg

SEQ ID NO: 26050 - DNA, 71 bp, chicken (Gallus Gallus)
  misc_feature (36): n=a or g
agccactcagcctccttgaaaaatgagtggaagctngagacctgtttcttgagcaaactttgaacttcacg

SEQ ID NO: 26051 - DNA, 71 bp, chicken (Gallus Gallus)
  misc_feature (36): n=c or g
aagaaagagtgatcaggagccagagattgtgcatanagcatctccccagcagctggcaaggggctgctcat

SEQ ID NO: 26052 - DNA, 71 bp, chicken (Gallus Gallus)
  misc_feature (36): n=a or c
ttgaaacttcctattcctgtggataaattcagaggngcacacatccgctgtgaattccggcactgttccag

SEQ ID NO: 26053 - DNA, 71 bp, chicken (Gallus Gallus)
  misc_feature (36): n=a or c
ttcctgtcctcttttgcaggcctgggaccaaacatnaaggagatactgaacaaagctcctggtccaggtcc

SEQ ID NO: 26054 - DNA, 71 bp, chicken (Gallus Gallus)
  misc_feature (36): n=a or g
acaggaatgtgctttactaaaaggtaattcagattncatacattctaaccattctctacatgttagataca

SEQ ID NO: 26055 - DNA, 71 bp, chicken (Gallus Gallus)
  misc_feature (36): n=a or g
ctctagcagcattctgtggaattttagtctgaggtngatgaaggagatggggaatgtgcatgccagtggaa

SEQ ID NO: 26056 - DNA, 71 bp, chicken (Gallus Gallus)
  misc_feature (36): n=a or g
ggttaaaactgaggaataatcaggatatctgagccntctggaggtttttaaacacaagagatgatcaaaat

SEQ ID NO: 26057 - DNA, 71 bp, chicken (Gallus Gallus)
  misc_feature (36): n=a or g
aaactgggtggagaaagatgtaaaaatgctgaggtngctgcctgtcagcatatttgctttaatatttgtgc

SEQ ID NO: 26058 - DNA, 71 bp, chicken (Gallus Gallus)
  misc_feature (36): n=a or g
aagaggatgaagttgactggagctgaatctaccacncagggatacaattccacttaaatctgaggaattta

SEQ ID NO: 26059 - DNA, 71 bp, chicken (Gallus Gallus)
  misc_feature (36): n=a or g
tcagtgtttcttgatctgatgattaaattttcttgnaaatgaggtagccgtgggattcctcctgcattcta

SEQ ID NO: 26060 - DNA, 71 bp, chicken (Gallus Gallus)
  misc_feature (36): n=a or g
atagaacaagagggaacggcatcaagttgcaccatntgaggttcaagttggatattaggaaatacttcttc

SEQ ID NO: 26061 - DNA, 71 bp, chicken (Gallus Gallus)
  misc_feature (36): n=a or c
gcccagaggtgtcatcagacaatgactaacagtatntgtgctgacctcaactaaactatgggattagcgaa

SEQ ID NO: 26062 - DNA, 71 bp, chicken (Gallus Gallus)
  misc_feature (36): n=c or t
ggaattgtagagtcaccaatgttggaaagatcatgnagtcaaccatccacctatcaccaatatttccccct

SEQ ID NO: 26063 - DNA, 71 bp, chicken (Gallus Gallus)
  misc_feature (36): n=a or g
tgctcattgtgctgtaactcagcagtgacagaacancgtgggagaggtgaggccttgcccggggcccacaa

SEQ ID NO: 26064 - DNA, 71 bp, chicken (Gallus Gallus)
  misc_feature (36): n=c or t
tgcaatgcataaaaatgtatttgagctcctctgganggaataacccagtctaaagtgcacttgtatgctgc

SEQ ID NO: 26065 - DNA, 71 bp, chicken (Gallus Gallus)
  misc_feature (36): n=c or t
cctgcaagtcagacaggaatagagtaacacagaaanaagatgattttgcaaggaactggaatcaggcaata

SEQ ID NO: 26066 - DNA, 71 bp, chicken (Gallus Gallus)
  misc_feature (36): n=c or t
ctagctaacagtgaacagattaaacctactcttaanttttgaaactgaaaagctgaaagtttactgaaatt

SEQ ID NO: 26067 - DNA, 71 bp, chicken (Gallus Gallus)
  misc_feature (36): n=a or g
agctggtctttggaaggaaaggaatttgaaaggtgnatgtcttgaaatgagcactcctgggtgagaagtag

SEQ ID NO: 26068 - DNA, 71 bp, chicken (Gallus Gallus)
  misc_feature (36): n=c or t
atcttttcaaacattaatgattctatcacaccaggngaactgtggtgtgaagggctttgttcaccacttct

SEQ ID NO: 26069 - DNA, 71 bp, chicken (Gallus Gallus)
  misc_feature (36): n=c or t
tgatttctttttttttttttttttttttttcctaangtgatatgctcaaactagaatatagaatagcctga

SEQ ID NO: 26070 - DNA, 71 bp, chicken (Gallus Gallus)
  misc_feature (36): n=c or t
aattatttcacttgatcgtgtgaaaggatgcttgcngctgaactgctgctttccctgccaccaggctgcac

SEQ ID NO: 26071 - DNA, 71 bp, chicken (Gallus Gallus)
  misc_feature (36): n=c or t
attttagcaggttagtgtgtggttttaaaatactgntttggtgctgttttatgagatgcatcaaatccctg

SEQ ID NO: 26072 - DNA, 71 bp, chicken (Gallus Gallus)
  misc_feature (36): n=c or t
gttaacttctttggaatagagaatattgacagtagntttggtgcatagataccatttgctttatgtagcct

SEQ ID NO: 26073 - DNA, 71 bp, chicken (Gallus Gallus)
  misc_feature (36): n=g or t
gggcaactgatataatctacctggacacgtgcaagncttttgacatggtcccacaccacatctttatctct

SEQ ID NO: 26074 - DNA, 71 bp, chicken (Gallus Gallus)
  misc_feature (36): n=a or g
aattcccactaaaagtaaagctactcagcattacangaaaaggaattttggctcagtgataggtgagaagc

SEQ ID NO: 26075 - DNA, 71 bp, chicken (Gallus Gallus)
  misc_feature (36): n=c or g
ccagtcccagagtaagacattagaaaagtttttagnaaaaggaaaacaaatattaagaagtcctggaataa

SEQ ID NO: 26076 - DNA, 71 bp, chicken (Gallus Gallus)
  misc_feature (36): n=c or g
tactattttccatttagatggtaatttcaggggatnttgtgaactattagtcgagaaaatgtgattgctaa

SEQ ID NO: 26077 - DNA, 71 bp, chicken (Gallus Gallus)
  misc_feature (36): n=c or g
caattgtaaacacatggcaaccctgaacttcaacangtatatggaatctacatgctttaccccaccaccgc

SEQ ID NO: 26078 - DNA, 71 bp, chicken (Gallus Gallus)
  misc_feature (36): n=a or g
aaaaaaaaacaaaacaaaacaaaaaaaaacccacanccttgaatcttgatttttgaaaaaaaatgttatta

SEQ ID NO: 26079 - DNA, 71 bp, chicken (Gallus Gallus)
  misc_feature (36): n=c or t
cacaagaagggccatagctgatggtttctgaagaanttcgtggcttccctgcagactactcaggaaataaa

SEQ ID NO: 26080 - DNA, 71 bp, chicken (Gallus Gallus)
  misc_feature (36): n=c or t
ccagattaagcaaatattctttcacattagtaactngcaacaaggatactgttattgttccagacagactt

SEQ ID NO: 26081 - DNA, 71 bp, chicken (Gallus Gallus)
  misc_feature (36): n=a or t
atctgagttttggttgcagtttcaggtagttagcanatatgttgttctttgcatccagctatgtcaggaat

SEQ ID NO: 26082 - DNA, 71 bp, chicken (Gallus Gallus)
  misc_feature (36): n=c or t
gcatccatacgaacaaagaggaaggaaattacatcngcaaaaccctatgagaaccataactgaaggaaatt

SEQ ID NO: 26083 - DNA, 71 bp, chicken (Gallus Gallus)
  misc_feature (36): n=a or g
attctgctttccaaacactcttgatgttaagccacngttagaaaattaaaaagcctagaactgcaaccagc

SEQ ID NO: 26084 - DNA, 71 bp, chicken (Gallus Gallus)
  misc_feature (36): n=a or g
cctaatgcagtttatctctttctggaaatccatatnaacactcatcagagttgcagaacagccacctgctg

SEQ ID NO: 26085 - DNA, 71 bp, chicken (Gallus Gallus)
  misc_feature (36): n=a or c
gatgatagactcatccccagctcatatctgctgtanacacaagatgagattttgttggtaatgagagcctc

SEQ ID NO: 26086 - DNA, 71 bp, chicken (Gallus Gallus)
  misc_feature (36): n=c or t
tcagtgagacagctggagaagtcaaaaagcatgagntttgccagataggctctaaggaatcctccctaaag

SEQ ID NO: 26087 - DNA, 71 bp, chicken (Gallus Gallus)
  misc_feature (36): n=a or g
tatattaagaaaaagaatctgttccatttattgtanggtatcatgtgtgccgtccagcacaatactgaatg

SEQ ID NO: 26088 - DNA, 71 bp, chicken (Gallus Gallus)
  misc_feature (36): n=a or g
aaactcaacctacaggcttttaattaaggtgctatntaagaatgtatctgttttttcctccccccatagct

SEQ ID NO: 26089 - DNA, 71 bp, chicken (Gallus Gallus)
  misc_feature (36): n=c or t
gcagcatgtagtacacatttccgagctctcttcacngtagcagaaggagatcaaaccatgaatatgattca

SEQ ID NO: 26090 - DNA, 71 bp, chicken (Gallus Gallus)
  misc_feature (36): n=c or t
gtccaccaagtctacacgcaacgtgctcaacagagngcataaataaatagctacaggatggtctcccttcc

SEQ ID NO: 26091 - DNA, 71 bp, chicken (Gallus Gallus)
  misc_feature (36): n=c or t
aacatccttttttacaggcgtctaactaaggaaaangtgaaaccatctggaaggcagattgggaagctcag

SEQ ID NO: 26092 - DNA, 71 bp, chicken (Gallus Gallus)
  misc_feature (36): n=a or t
acacagtgacatcatccaatttcaatgcatttatgngcagtactccggtgattatgtctacttcaatttag

SEQ ID NO: 26093 - DNA, 71 bp, chicken (Gallus Gallus)
  misc_feature (36): n=c or t
ccttcaagtgcatcatcccatgaagggtaggaaagngaataggggaataccattcctgttcctgatatcag

SEQ ID NO: 26094 - DNA, 71 bp, chicken (Gallus Gallus)
  misc_feature (36): n=g or t
aaatcatgaatgtgcagactggctttttcaaacctncctcattcatttaaaatacctgtccctgcagggtc

SEQ ID NO: 26095 - DNA, 71 bp, chicken (Gallus Gallus)
  misc_feature (36): n=c or t
caccacaagcttcccaataggttattcagcagcagngcccactgccgtgtgtgtcagggggttattaatta

SEQ ID NO: 26096 - DNA, 71 bp, chicken (Gallus Gallus)
  misc_feature (36): n=a or g
ggtttaggggttttggaactcctgttcccagcctcntgaaagttgtcaccttagtgtgcttcttttgatgc

SEQ ID NO: 26097 - DNA, 71 bp, chicken (Gallus Gallus)
  misc_feature (36): n=a or g
tgccagagcattttatagtccttagaatgcttcacncatttctactagaaagcaagatgttacctgcccaa

SEQ ID NO: 26098 - DNA, 71 bp, chicken (Gallus Gallus)
  misc_feature (36): n=c or t
caaagggaaatgtgtaaaccagatctgacttttgcnccaccgaaaatgtaaaaggacagggaagtagtctt

SEQ ID NO: 26099 - DNA, 71 bp, chicken (Gallus Gallus)
  misc_feature (36): n=c or t
taaggatctgcttatgggggtagacctgaaggaaantaatttttagccacttctgagtcaaagagaaatga

SEQ ID NO: 26100 - DNA, 71 bp, chicken (Gallus Gallus)
  misc_feature (36): n=a or g
attgcttacttggcacaaattggctgccatgcatantggatgttgagtctcaccaacaagttgtctgaaaa

SEQ ID NO: 26101 - DNA, 71 bp, chicken (Gallus Gallus)
  misc_feature (36): n=a or t
aatttgtgaattctagctatgtgatgtttgtagtcnaagtggaaaaataatgcatttttcacataagcaag

SEQ ID NO: 26102 - DNA, 71 bp, chicken (Gallus Gallus)
  misc_feature (36): n=a or g
gcattgcgtggccttgtacaaagaaaaactctcacnctgtgcagcagctaatggcaaagaattgcacatgg

SEQ ID NO: 26103 - DNA, 71 bp, chicken (Gallus Gallus)
  misc_feature (36): n=a or g
ttggcaattcagcaataattatagataaagtacagngggagacccccaaaatcccggtaattacattcaat

SEQ ID NO: 26104 - DNA, 71 bp, chicken (Gallus Gallus)
  misc_feature (36): n=a or c
agcttgaagacatttaacaaggtgccaaaatgcaantgtagcagaaataaggctctacaattctattatgc

SEQ ID NO: 26105 - DNA, 71 bp, chicken (Gallus Gallus)
  misc_feature (36): n=c or g
aaggaaagtaaaaatgaagatataattttcctttgntctccatctgctttgaagttcgcatctacatatgt

SEQ ID NO: 26106 - DNA, 71 bp, chicken (Gallus Gallus)
  misc_feature (36): n=c or g
taaagacccctcatgaattaatataacatcatcaantgtttttctgtctgagaacaagtctgaacaaatgc

SEQ ID NO: 26107 - DNA, 71 bp, chicken (Gallus Gallus)
  misc_feature (36): n=c or t
agaggggttgggagagatggggactgagcaagatgnagattatactcagagagatggaaagatgcagagat

SEQ ID NO: 26108 - DNA, 71 bp, chicken (Gallus Gallus)
  misc_feature (36): n=a or g
ggtctgaacattcccagttctgaagtcgccacaccnatgaaggctgggcttctttcccacttcctatgggc

SEQ ID NO: 26109 - DNA, 71 bp, chicken (Gallus Gallus)
  misc_feature (36): n=a or g
ctcttgctgcccacttgctgtcactacttgcaatantgcctgaagaagggccaagaagctgcctattgcaa

SEQ ID NO: 26110 - DNA, 71 bp, chicken (Gallus Gallus)
  misc_feature (36): n=a or g
tagaatatagaaataatgtagaaggaatgaattacntgtacattgcatgaaaagcgcgcatacctgctgtt

SEQ ID NO: 26111 - DNA, 71 bp, chicken (Gallus Gallus)
  misc_feature (36): n=a or g
tgcttgcagtgtgtaaggtaaaggtaaatgaaaagncatcttggtttgtcaaataattgttgttctggatg

SEQ ID NO: 26112 - DNA, 71 bp, chicken (Gallus Gallus)
  misc_feature (36): n=a or g
tagtcaaaatgggaaaaactggggtggcatgaaatntatgttcttgtggaaaattgattcagtcaccacag

SEQ ID NO: 26113 - DNA, 71 bp, chicken (Gallus Gallus)
  misc_feature (36): n=a or g
atgtatgtaattattgctgtgtgtagcataggtcantgaaaacctgagggaacgtaggtagaggatttgaa

SEQ ID NO: 26114 - DNA, 71 bp, chicken (Gallus Gallus)
  misc_feature (36): n=c or t
ggacatgcagtgactaagcgtgcagaatgaacactngtcttctttcatagtgtaggaagctcatgcatggt

SEQ ID NO: 26115 - DNA, 71 bp, chicken (Gallus Gallus)
  misc_feature (36): n=c or t
ttcatgttcttgagatacaagttattactcaagttntatgggctttctcttttggaactcacaagacaata

SEQ ID NO: 26116 - DNA, 71 bp, chicken (Gallus Gallus)
  misc_feature (36): n=c or t
caaatgtaaatattgattttaaactgatgttataangttgaaagatggcacaaggcttactagctggcatg

SEQ ID NO: 26117 - DNA, 71 bp, chicken (Gallus Gallus)
  misc_feature (36): n=c or t
gctcaccaagcacgtgacagtttaggtactagaggnggtctctacagaaacctgactagagagaccacgat

SEQ ID NO: 26118 - DNA, 71 bp, chicken (Gallus Gallus)
  misc_feature (36): n=a or c
cagttggaaaattgtactgactaccagcaagggagngctctctcatgggctatgtggggcgtgagtttgtg

SEQ ID NO: 26119 - DNA, 71 bp, chicken (Gallus Gallus)
  misc_feature (36): n=g or t
tataattgaaaaagaaacagcaaatcaagtcacagnttcccaagcttatgtttgctgtcaacagaaggact

SEQ ID NO: 26120 - DNA, 71 bp, chicken (Gallus Gallus)
  misc_feature (36): n=g or t
tgtaagtgcttaattacaagcatttgacacacgagncatacagattcattttaactggaataattctatag

SEQ ID NO: 26121 - DNA, 71 bp, chicken (Gallus Gallus)
  misc_feature (36): n=c or t
gttgaatgacattcaaacactcttcagatttctccntcatactcctgtgttctctgtacgtgtatacacac

SEQ ID NO: 26122 - DNA, 71 bp, chicken (Gallus Gallus)
  misc_feature (36): n=c or g
agacactacactgttcatatggctattgtgcacatntaatttcattttgttctattgcttaatgaggagca

SEQ ID NO: 26123 - DNA, 71 bp, chicken (Gallus Gallus)
  misc_feature (36): n=c or g
agggagagatgctgagctctggtgtgctatcctganagacctgtttactgttcatcctgtctaatttgcaa

SEQ ID NO: 26124 - DNA, 71 bp, chicken (Gallus Gallus)
  misc_feature (36): n=c or t
gaattttgcttagtctccagtatattccagtccttnaagtgctcaggtttggattcatcttacctgacttt

SEQ ID NO: 26125 - DNA, 71 bp, chicken (Gallus Gallus)
  misc_feature (36): n=c or g
ctgttataacagggcattcctggttccttggctgtnccccctgtgggatgagctttggttgtctctcagta

SEQ ID NO: 26126 - DNA, 71 bp, chicken (Gallus Gallus)
  misc_feature (36): n=a or g
ttcaaagctctgacacgattgtttatcttctttcantcctcaaaggagtacatttcctattttctctcctt

SEQ ID NO: 26127 - DNA, 71 bp, chicken (Gallus Gallus)
  misc_feature (36): n=a or c
catctatttagctccttgtgtcttatcctttaatcnttgaatgatttttgtgattttcttggcattttttt

SEQ ID NO: 26128 - DNA, 71 bp, chicken (Gallus Gallus)
  misc_feature (36): n=a or c
taatacaaatttgtgttcaaactgattatcctgagnggttcagagctcacattcgattcaaacagttgtgt

SEQ ID NO: 26129 - DNA, 71 bp, chicken (Gallus Gallus)
  misc_feature (36): n=g or t
agtggattgatctcttgctggctgggcaaaacttgngagctgttgactcacagctccatgctaattaataa

SEQ ID NO: 26130 - DNA, 71 bp, chicken (Gallus Gallus)
  misc_feature (36): n=c or t
ttcagtcggggattcagatgtaatgcaatgtctttngagtcacttgatttcaggtttattgtaaagctgga

SEQ ID NO: 26131 - DNA, 71 bp, chicken (Gallus Gallus)
  misc_feature (36): n=a or g
aattctctccagatgcagttctggagagtgattaanttgtagaaggttgaaccaagaagcttaggcagccc

SEQ ID NO: 26132 - DNA, 71 bp, chicken (Gallus Gallus)
  misc_feature (36): n=c or t
aatacaacacaacacaacaaaccaagtcattctttntttttcggtccacctgaatcgttaaagaatcagat

SEQ ID NO: 26133 - DNA, 71 bp, chicken (Gallus Gallus)
  misc_feature (36): n=c or t
aaatatgagcaaccagattcgtgcggaggctccttngtagccctcatgaatatataatgtaaagctccgta

SEQ ID NO: 26134 - DNA, 71 bp, chicken (Gallus Gallus)
  misc_feature (36): n=c or t
cacaggaagaggtaaaagcagccttaaagagcatcntgatcttcctggtcccattacattctcactgcctt

SEQ ID NO: 26135 - DNA, 71 bp, chicken (Gallus Gallus)
  misc_feature (36): n=a or g
ttacaaatgagcttttaaagccgggatgcaaattangaatgtaaatgcggcttccaaattggctatgtaaa

SEQ ID NO: 26136 - DNA, 71 bp, chicken (Gallus Gallus)
  misc_feature (36): n=c or t
acttagagagtagcaatcagtgctaactttgagatntgataagggtgggaagaagctggaaaggtctcggt

SEQ ID NO: 26137 - DNA, 71 bp, chicken (Gallus Gallus)
  misc_feature (36): n=a or g
atatttctgtagtgtataggatagtgggtagttgantcttgcaaatattggagtttagaaaatgtgttctt

SEQ ID NO: 26138 - DNA, 71 bp, chicken (Gallus Gallus)
  misc_feature (36): n=a or g
cttccatctttttttatacttacagagtcaatgatnattgttgctgaaaatttcttctcattgatagattc

SEQ ID NO: 26139 - DNA, 71 bp, chicken (Gallus Gallus)
  misc_feature (36): n=a or c
ctaaaatggtacacatttttaactgagaattatttnaacgtagacaacattatttttcttacctacctcca

SEQ ID NO: 26140 - DNA, 71 bp, chicken (Gallus Gallus)
  misc_feature (36): n=c or g
cttttactggttcaaagactttcaaagactgacccncttagaagtcccaccaccttggatccacacaggaa

SEQ ID NO: 26141 - DNA, 71 bp, chicken (Gallus Gallus)
  misc_feature (36): n=a or g
ttttggcccatgggccaaagaaacaattggggtgtnggctgtgaaaaacaatttatgccactgtaccatgg

SEQ ID NO: 26142 - DNA, 71 bp, chicken (Gallus Gallus)
  misc_feature (36): n=g or t
aggcatgtctgtagaagcagtaatgaagtaggaatnctgggcagactggggtgagagggatggtgaaaact

SEQ ID NO: 26143 - DNA, 71 bp, chicken (Gallus Gallus)
  misc_feature (36): n=c or t
tgctataatgttatgttataatgcattgcaggcctngtatatattcagctttaatttcatttttcatttaa

SEQ ID NO: 26144 - DNA, 71 bp, chicken (Gallus Gallus)
  misc_feature (36): n=a or g
tccaaaacagactattccggttgagagttttctcancctgccttcttttcagtcttggaataactactcat

SEQ ID NO: 26145 - DNA, 71 bp, chicken (Gallus Gallus)
  misc_feature (36): n=c or t
ataacatttaacttctgtttgactttaacttctcanggctttcagccatttccataaatgcctcctaccca

SEQ ID NO: 26146 - DNA, 71 bp, chicken (Gallus Gallus)
  misc_feature (36): n=a or g
ggtctactgcatgaggactggccctcagaagctgcncaccgactgatgaagcactcgttgtcactccaaac

SEQ ID NO: 26147 - DNA, 71 bp, chicken (Gallus Gallus)
  misc_feature (36): n=a or g
actctgattaattacagaatttgcttgctttcagcnctggaactgtacaaagtaccagcagaaacgctaca

SEQ ID NO: 26148 - DNA, 71 bp, chicken (Gallus Gallus)
  misc_feature (36): n=c or t
agtgtggaactccctgaggcagagattatgctgacngccctgaggttccccaggaggttaaacagatcagg

SEQ ID NO: 26149 - DNA, 71 bp, chicken (Gallus Gallus)
  misc_feature (36): n=c or t
ctgaaaatgtactttcagacactcagtcctaaggtntgcgctgtcatggagatttagccaacttgattgac

SEQ ID NO: 26150 - DNA, 71 bp, chicken (Gallus Gallus)
  misc_feature (36): n=g or t
agcaaggacaaaacaagtttcactagcagaattcangtcataatttatacaacctgagattgctagttagg

SEQ ID NO: 26151 - DNA, 71 bp, chicken (Gallus Gallus)
  misc_feature (36): n=a or t
cttcaggtatgtgaagcttctcatttctgtagtcangctcacaggtcttctttacacacgctcttgtctga

SEQ ID NO: 26152 - DNA, 71 bp, chicken (Gallus Gallus)
  misc_feature (36): n=a or g
tgcagcaaagacaaaactgctacagtgacacagcangcagttgcgtctgtagagtgggaggaccacagtgg

SEQ ID NO: 26153 - DNA, 71 bp, chicken (Gallus Gallus)
  misc_feature (36): n=a or g
atgacttgtaagatatgtgattaaatgaaatggggnaggttgcaattattgcagccaatttttgactgcac

SEQ ID NO: 26154 - DNA, 71 bp, chicken (Gallus Gallus)
  misc_feature (36): n=c or t
agaagaaaaatactacaaaattgtttgaagaaaacntgggagagagtcaatgttgtgaagtttgtggatgt

SEQ ID NO: 26155 - DNA, 71 bp, chicken (Gallus Gallus)
  misc_feature (36): n=c or t
atcttactgaactatttaaaaaacagacttcacttnctaactgtccctgttgtctgaccccagccagggtt

SEQ ID NO: 26156 - DNA, 71 bp, chicken (Gallus Gallus)
  misc_feature (36): n=a or g
atgcacattataaacattcagacatctgctgtgaanaaacacaagtacattgaaagtgatcccaatatgtt

SEQ ID NO: 26157 - DNA, 71 bp, chicken (Gallus Gallus)
  misc_feature (36): n=a or t
gagtatcttgaattaacttagtgcatagatttgagnccctggagacaggttaaacagcagcaactagagtc

SEQ ID NO: 26158 - DNA, 71 bp, chicken (Gallus Gallus)
  misc_feature (36): n=a or g
gctccttaagagacataaaccatgaaatggtacacntaaaggcaatgctaagagttaaattgcaagaagga

SEQ ID NO: 26159 - DNA, 71 bp, chicken (Gallus Gallus)
  misc_feature (36): n=a or c
gttatgaacttgaactaatatggcaatcttcactgnttggccttaggattcaacagtgattttccattcac

SEQ ID NO: 26160 - DNA, 71 bp, chicken (Gallus Gallus)
  misc_feature (36): n=c or t
ggaaatacgcaacttggtacagatcttgcaagttcnatcactgtaaaaatgttgcactgctactctgatct

SEQ ID NO: 26161 - DNA, 71 bp, chicken (Gallus Gallus)
  misc_feature (36): n=a or c
ctctaaaagtagatgatgatttgaatgggctattanaacattgtattcattgtaacactggttatatgctg

SEQ ID NO: 26162 - DNA, 71 bp, chicken (Gallus Gallus)
  misc_feature (36): n=a or g
agaacttttggaaactcttgcatgattaataagaancagagattgatactaggatcatttcttctgagagt

SEQ ID NO: 26163 - DNA, 71 bp, chicken (Gallus Gallus)
  misc_feature (36): n=a or g
ctgtagcagctgcactgcttgctagcagtggagccntgctggtgtgaaacaaaacatggatggtctgtgtg

SEQ ID NO: 26164 - DNA, 71 bp, chicken (Gallus Gallus)
  misc_feature (36): n=a or g
aacaacgttttagtacttaatatcttcccagcactnatctacagtgtgatctggatcaatgtgatttattt

SEQ ID NO: 26165 - DNA, 71 bp, chicken (Gallus Gallus)
  misc_feature (36): n=c or t
gatatccagatttgaagatgtttgtggttgacttgntgcaggtattggagaacaaagggatataatacagc

SEQ ID NO: 26166 - DNA, 71 bp, chicken (Gallus Gallus)
  misc_feature (36): n=g or t
aattaagtgttgattttccactacgaaaaaagcctnatctgcttcaaagatcttagcattatgcaacctca

SEQ ID NO: 26167 - DNA, 71 bp, chicken (Gallus Gallus)
  misc_feature (36): n=c or t
tgcttggttatttattgataatactctggttgagangaaaagccttttttgtttctttcattattttttcc

SEQ ID NO: 26168 - DNA, 71 bp, chicken (Gallus Gallus)
  misc_feature (36): n=g or t
tcctttttaagctgttattgagaacagcaatgccanacagctgttccagtgaagtcttttctgttgcaaaa

SEQ ID NO: 26169 - DNA, 71 bp, chicken (Gallus Gallus)
  misc_feature (36): n=c or t
ttagtgacaggaaaaggggaaatggtcttaaaatgnagattagattacatataagggagatattcttgaca

SEQ ID NO: 26170 - DNA, 71 bp, chicken (Gallus Gallus)
  misc_feature (36): n=a or g
tttcatctgctatgagcaaatttgtcagagagatcngtctctattcccagctctgccgcatgcctcaatac

SEQ ID NO: 26171 - DNA, 71 bp, chicken (Gallus Gallus)
  misc_feature (36): n=c or t
actcctgcattaattatgaaagagtgacgtagcttnaagatttctttatggagttatttttcactctggtc

SEQ ID NO: 26172 - DNA, 71 bp, chicken (Gallus Gallus)
  misc_feature (36): n=a or g
ttatctgagtcaatgaaagcactggactctggcttntgaggaccctgtctgaaaggttcatgcaaaacccc

SEQ ID NO: 26173 - DNA, 71 bp, chicken (Gallus Gallus)
  misc_feature (36): n=c or t
gttcattcaacacagggaactgccctacgcaaacanggtgaccaaaaggctaaactgagaccctactgatt

SEQ ID NO: 26174 - DNA, 71 bp, chicken (Gallus Gallus)
  misc_feature (36): n=a or g
catgctgtgaactgcaaggatgaccacaagcggacntaccccgagagatgcaggcaccaaaggggcagggg

SEQ ID NO: 26175 - DNA, 71 bp, chicken (Gallus Gallus)
  misc_feature (36): n=a or g
atgaagttctccaccgttttcgggacaacctttccnaacaacccaatcgtgattctgccaacgtctctgtc

SEQ ID NO: 26176 - DNA, 71 bp, chicken (Gallus Gallus)
  misc_feature (36): n=a or c
caaaattctatgtggaataatttcctggatcacagntgtgtgaaatgtgaatgacaccaaaagctaaaaaa

SEQ ID NO: 26177 - DNA, 71 bp, chicken (Gallus Gallus)
  misc_feature (36): n=a or g
aaaaaaagcaacagctccaatggctctctggcactncatgatcttctcacaggagtttcactgataaaaat

SEQ ID NO: 26178 - DNA, 71 bp, chicken (Gallus Gallus)
  misc_feature (36): n=c or t
tcttgacagtaatatggaagatcatcaacaaaaacngaaatttctcccatgcacacagatcacttacttct

SEQ ID NO: 26179 - DNA, 71 bp, chicken (Gallus Gallus)
  misc_feature (36): n=a or g
cttcaagattttaattgctgaaatcaatttgacctntcgcatgaataaatctacaacataatttggtacct

SEQ ID NO: 26180 - DNA, 71 bp, chicken (Gallus Gallus)
  misc_feature (36): n=a or g
taagcaattccagtttaaaacaacacaacacaaacncacaccaataaacctcagggctgaagaatgaccat

SEQ ID NO: 26181 - DNA, 71 bp, chicken (Gallus Gallus)
  misc_feature (36): n=a or c
ctctacgtgttactcttgtttgtagaatagaagtgnagttgccttataccacagctatggccaaagctggc

SEQ ID NO: 26182 - DNA, 71 bp, chicken (Gallus Gallus)
  misc_feature (36): n=a or g
gtttattgtatctttattgatgaaaaggggtgtgcntgtgtgcactcatagaatgtatcactgtgcaactc

SEQ ID NO: 26183 - DNA, 71 bp, chicken (Gallus Gallus)
  misc_feature (36): n=a or g
aacaaaatctgcatgcttaaaaatgcttgctaatgnacaaaagactcaacattttgctttgctgttaaaat

SEQ ID NO: 26184 - DNA, 71 bp, chicken (Gallus Gallus)
  misc_feature (36): n=a or g
gagaaatcattgaggccagaaatttcaattagtaangctaccaaagaagttgctgggagaggctctgattc

SEQ ID NO: 26185 - DNA, 71 bp, chicken (Gallus Gallus)
  misc_feature (36): n=a or g
tagactgcaacatgccaaaaacaaattataaatcantagggcccataactaacatattaaacctctaattc

SEQ ID NO: 26186 - DNA, 71 bp, chicken (Gallus Gallus)
  misc_feature (36): n=a or g
cagatatatgcagacatcggtgtatctgtctccacntacatccatccataactgaaagttgtgcttaaggt

SEQ ID NO: 26187 - DNA, 71 bp, chicken (Gallus Gallus)
  misc_feature (36): n=c or g
gttttcaatcatcatcagcctcttcttgggccccangtccaaaaagggatgaaattttagctgttttcagt

SEQ ID NO: 26188 - DNA, 71 bp, chicken (Gallus Gallus)
  misc_feature (36): n=a or c
agaaccagcagtaacgggagtaaggatagctctacnagtagctctttgccagagagagtcagcaatgccag

SEQ ID NO: 26189 - DNA, 71 bp, chicken (Gallus Gallus)
  misc_feature (36): n=a or g
gataacgctgtaccttccatgacaaaggagttcctnctgaatactttacaaaatcaataggaggtaaatgc

SEQ ID NO: 26190 - DNA, 71 bp, chicken (Gallus Gallus)
  misc_feature (36): n=c or t
caagcacttccctgctcacaactttctgctctaaancaggcatttaacaacctggaggattacagaacagg

SEQ ID NO: 26191 - DNA, 71 bp, chicken (Gallus Gallus)
  misc_feature (36): n=a or g
actgccccaagccttgccatgcacaggcagcgatgntgcttaccattaatgatgggcatgattgtcagctg

SEQ ID NO: 26192 - DNA, 71 bp, chicken (Gallus Gallus)
  misc_feature (36): n=c or t
aacattgggaagtactgatgacagacctatgccatntctatttactcatattattcaaaattaaattgggc

SEQ ID NO: 26193 - DNA, 71 bp, chicken (Gallus Gallus)
  misc_feature (36): n=c or g
tgaccatgtgttgttcattaactcatctgtatactnaatgggtgacaagagaaaaagattcatttgatggg

SEQ ID NO: 26194 - DNA, 71 bp, chicken (Gallus Gallus)
  misc_feature (36): n=a or g
ttctcctaacctaacttttaaagtctactctctcantatctataactgaactagtcatgtaggcttttatt

SEQ ID NO: 26195 - DNA, 71 bp, chicken (Gallus Gallus)
  misc_feature (36): n=c or t
aaaaaaagtgaaaaacagactgaaaaataacttgtncagacattactgccattagaaccaaattatttttt

SEQ ID NO: 26196 - DNA, 71 bp, chicken (Gallus Gallus)
  misc_feature (36): n=a or g
caaaggcaaatagctttaacaggaatttagttttcnttctcaagaggagaagtcttcaggtagttggccat

SEQ ID NO: 26197 - DNA, 71 bp, chicken (Gallus Gallus)
  misc_feature (36): n=a or g
aaagctttggataggtaaaagataaagtagcaatcngtgtcactcctggggtagtagcaatggggagttag

SEQ ID NO: 26198 - DNA, 71 bp, chicken (Gallus Gallus)
  misc_feature (36): n=a or g
ttgtggtatcgcttgcgacttctaaaaccgcaacanaacataattcctacagtaaagtaagtatgtttcat

SEQ ID NO: 26199 - DNA, 71 bp, chicken (Gallus Gallus)
  misc_feature (36): n=a or g
cctgccagctggcagtgaaacttcagagttttgtcntgccacaaggacatttatgttgctttacatgttct

SEQ ID NO: 26200 - DNA, 71 bp, chicken (Gallus Gallus)
  misc_feature (36): n=a or c
tgtgacaaagatcagattatatgatactagtagatnatatgagtacctccgtaagacataggcatgtagca

SEQ ID NO: 26201 - DNA, 71 bp, chicken (Gallus Gallus)
  misc_feature (36): n=a or g
ttcaaatgaggatacaattatttgtacttcctatcntaatccatgtttttcaagcagtaattttgcaccaa

SEQ ID NO: 26202 - DNA, 71 bp, chicken (Gallus Gallus)
  misc_feature (36): n=c or t
ggctgagctgggagacatcagttgttctctgtgctnttaaccacacggtggcaccgttgtaccacagaaag

SEQ ID NO: 26203 - DNA, 71 bp, chicken (Gallus Gallus)
  misc_feature (36): n=a or g
ctgtttcatctttttcacactatatcattctgtcanaagcaaggacatatatgatcagtgacttgcataag

SEQ ID NO: 26204 - DNA, 71 bp, chicken (Gallus Gallus)
  misc_feature (36): n=a or g
ccattttgaaccgtgaatgctgtgctcagggctatngataggcaaattttcttctgtttcctcaacacaga

SEQ ID NO: 26205 - DNA, 71 bp, chicken (Gallus Gallus)
  misc_feature (36): n=a or g
gtgatcgtttctggatatggagcattattactacantaccttgatttatatattcatgctgcaggcttccc

SEQ ID NO: 26206 - DNA, 71 bp, chicken (Gallus Gallus)
  misc_feature (36): n=c or t
aagtgggacctctctctccagctgcagtgtagaagntgtttttggtggttctgtagatggccccttacctg

SEQ ID NO: 26207 - DNA, 71 bp, chicken (Gallus Gallus)
  misc_feature (36): n=c or t
cactttcttcaagatgattgttcttatctgaaaaangggatttctttatacataactacatgacaactaaa

SEQ ID NO: 26208 - DNA, 71 bp, chicken (Gallus Gallus)
  misc_feature (36): n=c or t
tcccttacttctgtagagacattgcttcttgtgccncggaatgtgacgctatcagcgtgagaagctgcttc

SEQ ID NO: 26209 - DNA, 71 bp, chicken (Gallus Gallus)
  misc_feature (36): n=c or t
agctcactgtcacttacatcatggccaagtaatccntgaagaagtgccgcagccggccagcctgctgcaca

SEQ ID NO: 26210 - DNA, 71 bp, chicken (Gallus Gallus)
  misc_feature (36): n=c or t
ttgttggattatgtcagtggtatttccactcttccntagtgtgattcacagcctgcagctgtggcatgtga

SEQ ID NO: 26211 - DNA, 71 bp, chicken (Gallus Gallus)
  misc_feature (36): n=c or t
ttgtttgtttttctttttcttttttctttttttttnctgagaatttacaatgaataaagaaaggttcatgt

SEQ ID NO: 26212 - DNA, 71 bp, chicken (Gallus Gallus)
  misc_feature (36): n=c or t
gcttttgctgaaggtgagctactgggctgagtgaangactgggtcagtgctttgtgacggctcctcattta

SEQ ID NO: 26213 - DNA, 71 bp, chicken (Gallus Gallus)
  misc_feature (36): n=a or c
attaggtttgttgcaataatgtggactaaaatcacntcagtgtgccactttactttagattgaagccacac

SEQ ID NO: 26214 - DNA, 71 bp, chicken (Gallus Gallus)
  misc_feature (36): n=a or g
ggcctacaggaaagctgacgagagactttttagaangacatgtaacgtcagggggaaatggttttaaactg

SEQ ID NO: 26215 - DNA, 71 bp, chicken (Gallus Gallus)
  misc_feature (36): n=c or g
taaatgctgtatttgtttgtctggcaaaattatacnaagaaaaaggacagaatgtggtcaagcaactgata

SEQ ID NO: 26216 - DNA, 71 bp, chicken (Gallus Gallus)
  misc_feature (36): n=a or g
aacgtttggattgagtcatggaaaaacatgataacntggtgcagtacaattcactgcagacacttctgtaa

SEQ ID NO: 26217 - DNA, 71 bp, chicken (Gallus Gallus)
  misc_feature (36): n=c or g
ccaacagtaaaaattattcttttcttttatgaaaantgcatgaaattttaaatgagaaaacatgcaagtaa

SEQ ID NO: 26218 - DNA, 71 bp, chicken (Gallus Gallus)
  misc_feature (36): n=c or t
ttcaccagcatcatctctcacctgacaggataggantggggagacaatgctcagatttctttctcctcttt

SEQ ID NO: 26219 - DNA, 71 bp, chicken (Gallus Gallus)
  misc_feature (36): n=a or g
catgtactcagatgtttcttatctttatgcctttgntcttgcgagagtgtgaaagcggcactgcagccaga

SEQ ID NO: 26220 - DNA, 71 bp, chicken (Gallus Gallus)
  misc_feature (36): n=c or g
attgcgctattaacgcaagtgctccaggtgctcttnaggactcggagagctgtgataccaatccggggaac

SEQ ID NO: 26221 - DNA, 71 bp, chicken (Gallus Gallus)
  misc_feature (36): n=a or c
agcagccagtgggaacaaatagctttttaaattcangttgcactttccgcagtgcaagattcacaaacatt

SEQ ID NO: 26222 - DNA, 71 bp, chicken (Gallus Gallus)
  misc_feature (36): n=a or g
agacagttcctcactgttagagcaagtgcactttgnaatattctccagttgagtaacagaggttaaaaccc

SEQ ID NO: 26223 - DNA, 71 bp, chicken (Gallus Gallus)
  misc_feature (36): n=a or g
tatcagttgcttcagctccgacctgcacaacgagcntcatggattggctatgctattgcttaccatctgtt

SEQ ID NO: 26224 - DNA, 71 bp, chicken (Gallus Gallus)
  misc_feature (36): n=c or t
tcagggcattatgagagtgctttactcgctatctgngctggagatgctgaagattattaagaaagaagatg

SEQ ID NO: 26225 - DNA, 71 bp, chicken (Gallus Gallus)
  misc_feature (36): n=c or t
atctcttcttccctgtgagatatatatggagagtantgcactactgataggctgactatcctgataaaacc

SEQ ID NO: 26226 - DNA, 71 bp, chicken (Gallus Gallus)
  misc_feature (36): n=a or t
tgaatgtaaagatggcataggcatgaaatttgatgnagttgtgagccacaaaaatctgcatgcagcctgga

SEQ ID NO: 26227 - DNA, 71 bp, chicken (Gallus Gallus)
  misc_feature (36): n=a or g
cacttctgctttcactgaatggatccatatttctanttgtgacatctgctgaaagtcctggagtcaggaat

SEQ ID NO: 26228 - DNA, 71 bp, chicken (Gallus Gallus)
  misc_feature (36): n=a or g
ctctagtttgtgttcttaatgggcttagtcccacanaacagactcacacaaagttttcaccacaagaaaga

SEQ ID NO: 26229 - DNA, 71 bp, chicken (Gallus Gallus)
  misc_feature (36): n=a or g
cttctaattttggtccaaacacagatctaccatgcntggtgttcatatgtataaattgtgtgctgtacaaa

SEQ ID NO: 26230 - DNA, 71 bp, chicken (Gallus Gallus)
  misc_feature (36): n=c or g
catttcagtcttttgaagcttatgttggtatgccanaaccttgtaaactttggcaaaagtctcagaagaat

SEQ ID NO: 26231 - DNA, 71 bp, chicken (Gallus Gallus)
  misc_feature (36): n=a or c
tgtagaaaaatgaccatgtgacttttaaaacagttntgtatgtgtcttagacattggttgtttttaaatag

SEQ ID NO: 26232 - DNA, 71 bp, chicken (Gallus Gallus)
  misc_feature (36): n=c or t
cttaaagattatgcaatctcttccttaccagtttangtgtaaaattcgagatgggtcacttggtcttcaga

SEQ ID NO: 26233 - DNA, 71 bp, chicken (Gallus Gallus)
  misc_feature (36): n=a or g
gatcgatgttatgctgttgaagtttgaaagcttatntcactattctagtcaactgctttgatgatagcata

SEQ ID NO: 26234 - DNA, 71 bp, chicken (Gallus Gallus)
  misc_feature (36): n=a or c
gttcctcaaaggggggaaataatgtaagcggtacanggaattttatagccctcttgttgcagtaactgtgt

SEQ ID NO: 26235 - DNA, 71 bp, chicken (Gallus Gallus)
  misc_feature (36): n=a or t
tgtagaaagtagggaaatggaggctcaggtgtaaanttgcagtcacttatagagaggacagagcaaaaata

SEQ ID NO: 26236 - DNA, 71 bp, chicken (Gallus Gallus)
  misc_feature (36): n=c or t
accagagcagagcagagagagaggatgacctctgcntctgttctgctctggtgaggacacatttttgtgaa

SEQ ID NO: 26237 - DNA, 71 bp, chicken (Gallus Gallus)
  misc_feature (36): n=c or t
attgatttaactaaccagtaatttcaccagggtcanctcttcacaggcctgggacaatacaatctctgcgt

SEQ ID NO: 26238 - DNA, 71 bp, chicken (Gallus Gallus)
  misc_feature (36): n=a or g
cttccctcactaaaagagaaattttggtaaagatcntgtagatttttaaagaatatggataggctatgcaa

SEQ ID NO: 26239 - DNA, 71 bp, chicken (Gallus Gallus)
  misc_feature (36): n=a or g
ctatatcgtgccatgttattcgatgcccacaggtantcgtgcgtgacttaagattctggcttttcatagtt

SEQ ID NO: 26240 - DNA, 71 bp, chicken (Gallus Gallus)
  misc_feature (36): n=c or t
gagaactgtacttcttgttgctgactgatccaattngtggtcctttacctccaagtcatggtcagtgactg

SEQ ID NO: 26241 - DNA, 71 bp, chicken (Gallus Gallus)
  misc_feature (36): n=c or t
tactttgcctggtatcataaagaacacattagaagngattttgctgcttcctaggactgactatagttaaa

SEQ ID NO: 26242 - DNA, 71 bp, chicken (Gallus Gallus)
  misc_feature (36): n=a or c
acagctctcagttaaagaagtggctcaggtttctgnacccaaatttcagaagcgtgtgcccccatgttctc

SEQ ID NO: 26243 - DNA, 71 bp, chicken (Gallus Gallus)
  misc_feature (36): n=a or g
aaacattttcctggctcaccatctttcttcagtgangagacccactaaatgtagaaaagacttcctgagtg

SEQ ID NO: 26244 - DNA, 71 bp, chicken (Gallus Gallus)
  misc_feature (36): n=c or t
ttggtttaagttgctcagatctcaatgcatattttngacacgcaaacattcccaggagaactatcaatctg

SEQ ID NO: 26245 - DNA, 71 bp, chicken (Gallus Gallus)
  misc_feature (36): n=a or g
attttttcaacgcagcccattttagatacacagaangtagcccgttattattgatccaccgaagggtcaat

SEQ ID NO: 26246 - DNA, 71 bp, chicken (Gallus Gallus)
  misc_feature (36): n=a or g
cacaacaactgtaaaaatccagtctctgctgccacntagtcatggctgttatgctccacatgtctcttggc

SEQ ID NO: 26247 - DNA, 71 bp, chicken (Gallus Gallus)
  misc_feature (36): n=a or g
gcctacagaagctcatcacaattcagatatgaacantgtaaaatgtgtctttctgttgactgcaaagacaa

SEQ ID NO: 26248 - DNA, 71 bp, chicken (Gallus Gallus)
  misc_feature (36): n=c or g
cacttactaacatggcagtaatttacagatctcatnttgctatttgcagggctggaaggtttgtgttcttt

SEQ ID NO: 26249 - DNA, 71 bp, chicken (Gallus Gallus)
  misc_feature (36): n=c or t
tgaagagttgtgtgagttaggaaatgtctttcttantatgcacaggtgtgagggcaaaaaaaaaaaaagcc

SEQ ID NO: 26250 - DNA, 71 bp, chicken (Gallus Gallus)
  misc_feature (36): n=a or g
ctagaagtgtccatttctctgcatgattacaaaagnaactcacagtgacaagtacggagttagaggtctac

SEQ ID NO: 26251 - DNA, 71 bp, chicken (Gallus Gallus)
  misc_feature (36): n=c or t
ctatttatttaatggcttgtgggacttcagagagcngctcgctttcctccgtcagagacaccagaccttga

SEQ ID NO: 26252 - DNA, 71 bp, chicken (Gallus Gallus)
  misc_feature (36): n=a or g
ctagatcaggatatactggcaagacctcagtgtccnagaaggaagatgtttttaaggagatacatccctta

SEQ ID NO: 26253 - DNA, 71 bp, chicken (Gallus Gallus)
  misc_feature (36): n=c or t
tgtagaaattgtaaattatcttgtataaattatttnaaactgtacagtattataacaacataaaattatag

SEQ ID NO: 26254 - DNA, 71 bp, chicken (Gallus Gallus)
  misc_feature (36): n=c or t
aaaaaacatttaactatcttcctgaatgacattggntttgtactcacagctgtgagaagtgatttgtcaga

SEQ ID NO: 26255 - DNA, 71 bp, chicken (Gallus Gallus)
  misc_feature (36): n=a or g
agagatgttgcgtaaggtctgtgagtaggttcatanagtgggcttctaaagcaatctgtttcactgcctta

SEQ ID NO: 26256 - DNA, 71 bp, chicken (Gallus Gallus)
  misc_feature (36): n=c or t
agtggtgtctgtcctctcttgtgatgtgccctccangctgtccccacacgctgtctcctccacagcgtccc

SEQ ID NO: 26257 - DNA, 71 bp, chicken (Gallus Gallus)
  misc_feature (36): n=a or t
atagattaaacaacaacaatgaaaaccatgagctanacatgtagctgcacttccttggtttgtcctaaagt

SEQ ID NO: 26258 - DNA, 71 bp, chicken (Gallus Gallus)
  misc_feature (36): n=c or g
atatcacgtccccaagttgatcctacgtttctgctntttaatccttattgaaagtctgccatctcaagcat

SEQ ID NO: 26259 - DNA, 71 bp, chicken (Gallus Gallus)
  misc_feature (36): n=c or t
ggttttgataggagattcctttaaggcattttgtantgacaaggttattttttctgtgcatgtgctgcaga

SEQ ID NO: 26260 - DNA, 71 bp, chicken (Gallus Gallus)
  misc_feature (36): n=c or t
gtgccggttttctcctgcgacacgaacacagtcagncccacaggttgattctgcaactcttcttggctcct

SEQ ID NO: 26261 - DNA, 71 bp, chicken (Gallus Gallus)
  misc_feature (36): n=c or t
gttatcctatgcaccctacaaaccttgaatttagantgaaagacatcttgtactcacgtataagaacattt

SEQ ID NO: 26262 - DNA, 71 bp, chicken (Gallus Gallus)
  misc_feature (36): n=a or g
gagcctcccctggtgcagcttaaagacatccatctntatgaattgttcaagcacttcccaagggaaagaga

SEQ ID NO: 26263 - DNA, 71 bp, chicken (Gallus Gallus)
  misc_feature (36): n=c or g
tccattacatatactatagctattttgacataggantactccaaccagtatgaatccttgtataatttgca

SEQ ID NO: 26264 - DNA, 71 bp, chicken (Gallus Gallus)
  misc_feature (36): n=a or t
attttaagaaaagaaattagaaatgcagtatatgancggaaatttgataatactatcaatattgcatcatg

SEQ ID NO: 26265 - DNA, 71 bp, chicken (Gallus Gallus)
  misc_feature (36): n=c or g
tcacacctgcaattgaaatgctgcagtccgcacagnctcagaaaaggctttagaatatctcactcctacaa

SEQ ID NO: 26266 - DNA, 71 bp, chicken (Gallus Gallus)
  misc_feature (36): n=c or t
gccagcctaggataaaatcagcccacaaagcctgangttcggcctccattcaccccagggatgatggcact

SEQ ID NO: 26267 - DNA, 71 bp, chicken (Gallus Gallus)
  misc_feature (36): n=a or g
gtagtaagctaataggaaggggactatttcccacantgagtgtgctttatattgctctgctctgccagaag

SEQ ID NO: 26268 - DNA, 71 bp, chicken (Gallus Gallus)
  misc_feature (36): n=c or t
acttcaggtagcaaaaatgcttgtattcaagttagnggagcaagaagagttacttttagctctcaaaaggt

SEQ ID NO: 26269 - DNA, 71 bp, chicken (Gallus Gallus)
  misc_feature (36): n=a or t
agatacaaaacataaaaatacagtgcagaggggagngctagagtcttagaggaagatcttatgagattact

SEQ ID NO: 26270 - DNA, 71 bp, chicken (Gallus Gallus)
  misc_feature (36): n=c or t
agatgcatatcacctcctacaggtattaagtcttangacaccactgaagcaccttgagttttaatatgaaa

SEQ ID NO: 26271 - DNA, 71 bp, chicken (Gallus Gallus)
  misc_feature (36): n=a or c
atctataaggaatgcccaggctgtaacatgttacanttcactgccctaccacttatttcacagggcttact

SEQ ID NO: 26272 - DNA, 71 bp, chicken (Gallus Gallus)
  misc_feature (36): n=c or t
gatgttaaaactgagcttctactgtcgattctctcnaaagcattgtttgatcttcagactgctgcttccaa

SEQ ID NO: 26273 - DNA, 71 bp, chicken (Gallus Gallus)
  misc_feature (36): n=a or g
tcattttttgaccttactagggaattttcaaatagntttgagataaacagaacaggcctataaaatagcac

SEQ ID NO: 26274 - DNA, 71 bp, chicken (Gallus Gallus)
  misc_feature (36): n=c or t
gtccatttgggtccgtgtacgtccacttggacagancccacctctctacagagcagggaggcacaaccact

SEQ ID NO: 26275 - DNA, 71 bp, chicken (Gallus Gallus)
  misc_feature (36): n=a or c
tgaaacttgcagataatccctgtccatagtatattncaccctatgcacgtgcaaagcattttttttggttt

SEQ ID NO: 26276 - DNA, 71 bp, chicken (Gallus Gallus)
  misc_feature (36): n=a or g
cccggagatgttctacacttcaaagcagagcaggtntttcactctgcagcaaagcaactgttttattgtgg

SEQ ID NO: 26277 - DNA, 71 bp, chicken (Gallus Gallus)
  misc_feature (36): n=g or t
ttagaatttacatgtggattttgcagcagttaagancaccaacttcttgtgacatgagtaagagtgatctg

SEQ ID NO: 26278 - DNA, 71 bp, chicken (Gallus Gallus)
  misc_feature (36): n=a or g
aaatatgacctcaagtctaggtaaaaccaagcacanttaaaaacctgtgctgtccattaacacactcatac

SEQ ID NO: 26279 - DNA, 71 bp, chicken (Gallus Gallus)
  misc_feature (36): n=g or t
tcatcaaaataacttagacaaaaccttgaggatttnatctccccattataaatcatttttatttaaataac

SEQ ID NO: 26280 - DNA, 71 bp, chicken (Gallus Gallus)
  misc_feature (36): n=c or t
gctaaaatattccttcccatgaatggatagactggntataaggaagaagatttttacagtaagggtggtga

SEQ ID NO: 26281 - DNA, 71 bp, chicken (Gallus Gallus)
  misc_feature (36): n=a or g
cgctttgagatgtttggagtccagctgaagttctangtttaagtctgaaaacgtgatgctttgaagttgag

SEQ ID NO: 26282 - DNA, 71 bp, chicken (Gallus Gallus)
  misc_feature (36): n=a or g
acaaagaagaaaactgcttactcccgtaaagatttnttggttagttttctatgataaaattcattatagaa

SEQ ID NO: 26283 - DNA, 71 bp, chicken (Gallus Gallus)
  misc_feature (36): n=c or t
tcacagcacagcccaatcctgaccactcttgtaagnctctttcctctcaaaacagctgacccttggggcct

SEQ ID NO: 26284 - DNA, 71 bp, chicken (Gallus Gallus)
  misc_feature (36): n=a or g
agtaactgaagtttcaggaacagaaatcagtgtatnttgtacaaagtgttgaaagaacttgggaaaaaaaa

SEQ ID NO: 26285 - DNA, 71 bp, chicken (Gallus Gallus)
  misc_feature (36): n=c or t
taagttgtttgctaaccacttggctagctcattcanggcaggaatatctgtatgagcagctgcatcatact

SEQ ID NO: 26286 - DNA, 71 bp, chicken (Gallus Gallus)
  misc_feature (36): n=c or t
ctccacagaggtggtagagaacatggatggttatgncccgatgggggccagcactgacaaaggcaccacgg

SEQ ID NO: 26287 - DNA, 71 bp, chicken (Gallus Gallus)
  misc_feature (36): n=c or t
actaaaatggcctccttccatcacacatcacacacnctttgacagggccctaccgttcttcttgttgtgtc

SEQ ID NO: 26288 - DNA, 71 bp, chicken (Gallus Gallus)
  misc_feature (36): n=a or g
ctctaacaggtcagaattgtagaagcacaaaggagnaaactcccctttcactatctgtttggtaaatcact

SEQ ID NO: 26289 - DNA, 71 bp, chicken (Gallus Gallus)
  misc_feature (36): n=c or t
cccaaactaaggtaggccaacatctgtctgttcaancctttctttcattctccagtttggatcgttcacct

SEQ ID NO: 26290 - DNA, 71 bp, chicken (Gallus Gallus)
  misc_feature (36): n=a or g
aatcaggatttcaggagccagaaaatattcttaaanagatttttgaaccatagcagcacattctacttaca

SEQ ID NO: 26291 - DNA, 71 bp, chicken (Gallus Gallus)
  misc_feature (36): n=c or t
caaagcaagaaactcactgggaatctaacattattnaagaatgatttctctttttaaagaacagttctaag

SEQ ID NO: 26292 - DNA, 71 bp, chicken (Gallus Gallus)
  misc_feature (36): n=a or t
agtcataaataagtctgcagcatcctctcattaaantaaatgaacatcaaattatataatgtgcacggttg

SEQ ID NO: 26293 - DNA, 71 bp, chicken (Gallus Gallus)
  misc_feature (36): n=g or t
cactgtagccaacaggatacatacctggagaactcnccccacttctgccagcattggccccaggcacctcg

SEQ ID NO: 26294 - DNA, 71 bp, chicken (Gallus Gallus)
  misc_feature (36): n=c or t
caggcagccacattttttgttgcataagctttgtangatatcagaatttgtaaatcatacatttgaaagga

SEQ ID NO: 26295 - DNA, 71 bp, chicken (Gallus Gallus)
  misc_feature (36): n=c or t
tcaggcacgaatctggttgttctgtagtatggcatnggttcctctagcttatatctcagtgtcacatctcc

SEQ ID NO: 26296 - DNA, 71 bp, chicken (Gallus Gallus)
  misc_feature (36): n=c or t
agtttacctcaaaatgattacaacgcaattcacttntgtacccttgttatttctttcagtacaacggttct

SEQ ID NO: 26297 - DNA, 71 bp, chicken (Gallus Gallus)
  misc_feature (36): n=c or g
aggcattgctgcagctggggctgtcccttagcaccnatggcagctgttcagggcttgtttggatctacctg

SEQ ID NO: 26298 - DNA, 71 bp, chicken (Gallus Gallus)
  misc_feature (36): n=a or g
aacttgtcattacctggtgagtaaagcacatttcantttgctgctatcacgcatttgtatggacttttccc

SEQ ID NO: 26299 - DNA, 71 bp, chicken (Gallus Gallus)
  misc_feature (36): n=a or g
atgaaatttcctgctagagaactgggtcaaactaancaggactgcaaaccttaaaggctcttaacagctgt

SEQ ID NO: 26300 - DNA, 71 bp, chicken (Gallus Gallus)
  misc_feature (36): n=a or g
tgcagcacaaataccttcatcagcctaagctgctcntcagttcaaaagcaagctgtagaaagaaggaggca

SEQ ID NO: 26301 - DNA, 71 bp, chicken (Gallus Gallus)
  misc_feature (36): n=c or t
aagctcacaaaagcaagaagcaggaatattttacantgaggttaacagacaaacatagacagtaaagcttc

SEQ ID NO: 26302 - DNA, 71 bp, chicken (Gallus Gallus)
  misc_feature (36): n=a or g
caatgatattgaaattcatgcagagtaaaacaagtngttgtccattgggttgggagcttctgccagatcag

SEQ ID NO: 26303 - DNA, 71 bp, chicken (Gallus Gallus)
  misc_feature (36): n=c or t
tgcacaatcccccaacttcaaatactgggaagaatncacctttgcttctcaggttcctaccttatctcagc

SEQ ID NO: 26304 - DNA, 71 bp, chicken (Gallus Gallus)
  misc_feature (36): n=c or t
ccagtgcctgaggtccagtgattctaaaaatggcanctttcctgaacatctgagccctcgcaggaggacaa

SEQ ID NO: 26305 - DNA, 71 bp, chicken (Gallus Gallus)
  misc_feature (36): n=c or t
gagacaccttcctctctatacagagttgctgctgtnctattacaacataatctcatagatttggaagatct

SEQ ID NO: 26306 - DNA, 71 bp, chicken (Gallus Gallus)
  misc_feature (36): n=a or g
taaaaagaaacacctatcacaaaggggaagacagcnttgctggaggaatttttttatttgactttttctaa

SEQ ID NO: 26307 - DNA, 71 bp, chicken (Gallus Gallus)
  misc_feature (36): n=c or t
cagttgagcttctgttttgttgactaccatgagtgncactgaagggggctcaggatggacgtctgtaacct

SEQ ID NO: 26308 - DNA, 71 bp, chicken (Gallus Gallus)
  misc_feature (36): n=c or t
aggtacagatttcagcactgatagggttcgtgtgcnagggcatacttgattgggactctgtgaattgactg

SEQ ID NO: 26309 - DNA, 71 bp, chicken (Gallus Gallus)
  misc_feature (36): n=g or t
tccttatccgagagggtccaacgtgatgtgacagcnggtcaggagtggtggagtagagttgtttatgtttc

SEQ ID NO: 26310 - DNA, 71 bp, chicken (Gallus Gallus)
  misc_feature (36): n=c or t
attattcttttcatgtattcctcttgcttttcttgncactacaactgaatctttgggctctataacctatg

SEQ ID NO: 26311 - DNA, 71 bp, chicken (Gallus Gallus)
  misc_feature (36): n=c or t
ttccctaatccctttgcagggaagaaatgaaattantcccagaaagagtcattagaactgacacaagaaaa

SEQ ID NO: 26312 - DNA, 71 bp, chicken (Gallus Gallus)
  misc_feature (36): n=c or t
catcagttggcccactggcatttcacagtaggctcngattttacctgctctcttgctggaaataaaacaac

SEQ ID NO: 26313 - DNA, 71 bp, chicken (Gallus Gallus)
  misc_feature (36): n=g or t
gataaatacatgtgcttcacctgtactgaattaacntaaaatcagccaatggtgaatgacttaccttaaaa

SEQ ID NO: 26314 - DNA, 71 bp, chicken (Gallus Gallus)
  misc_feature (36): n=c or t
tcttcattacacagtgaagctcccatctgtaacctngacctttcttcctgcatctgcccagctttcaagat

SEQ ID NO: 26315 - DNA, 71 bp, chicken (Gallus Gallus)
  misc_feature (36): n=c or t
ttttattcacgagttcctttttctgctcacagttantacttgaccttaaggacaaagaagggtcccagact

SEQ ID NO: 26316 - DNA, 71 bp, chicken (Gallus Gallus)
  misc_feature (36): n=c or t
agatgctttatatagtgtattgatttctagactaangtacttgctgtgatacatcctctgctttgacactt

SEQ ID NO: 26317 - DNA, 71 bp, chicken (Gallus Gallus)
  misc_feature (36): n=a or c
gtgaaaccattgtgtgccatgctctatacagccctntaataatttgctttattgaaagtggatgaggtata

SEQ ID NO: 26318 - DNA, 71 bp, chicken (Gallus Gallus)
  misc_feature (36): n=a or g
ttatctccagtacattgagataacgatatgtatttngggtctcttggaacttttgcctattcaacaggttt

SEQ ID NO: 26319 - DNA, 71 bp, chicken (Gallus Gallus)
  misc_feature (36): n=a or g
attggagcatacagctgtttctgactaagcacaacnggactatgatggtggttggttttttgttgtttttt

SEQ ID NO: 26320 - DNA, 71 bp, chicken (Gallus Gallus)
  misc_feature (36): n=a or t
atatacatgtactgatatactaaaataagggtttgntttttgtaatgttggcttttgtgtaaaaagccaag

SEQ ID NO: 26321 - DNA, 71 bp, chicken (Gallus Gallus)
  misc_feature (36): n=c or t
tcttttttttttaaggtctataggtggctcaaatanatgaatcatccaataggttttgtcaggttgtctct

SEQ ID NO: 26322 - DNA, 71 bp, chicken (Gallus Gallus)
  misc_feature (36): n=a or g
tgatcttgtcctgaaaggtgaaggctacacgcatgngaccttgaaagatttctgcaggctgcagtaggata

SEQ ID NO: 26323 - DNA, 71 bp, chicken (Gallus Gallus)
  misc_feature (36): n=c or g
cttctgtacataaatgtgtgctggcctctttcgctncatccttgcgcctgttatggcagagtgactcttat

SEQ ID NO: 26324 - DNA, 71 bp, chicken (Gallus Gallus)
  misc_feature (36): n=a or g
aggcagacattatagctgtataaaagtctgtgaatnttctgaggaatttgttgtggaagtgtggcagaatg

SEQ ID NO: 26325 - DNA, 71 bp, chicken (Gallus Gallus)
  misc_feature (36): n=c or t
ttcttgtgagttactagaagcttactctaaacttcngcaatgagaaatgtatgagctgtataaagaatggc

SEQ ID NO: 26326 - DNA, 71 bp, chicken (Gallus Gallus)
  misc_feature (36): n=a or g
tggaaccagttcagatgttctcctgacatttctaanagaccaaaagctgcctgaatctcagcgcaagaagg

SEQ ID NO: 26327 - DNA, 71 bp, chicken (Gallus Gallus)
  misc_feature (36): n=a or t
attgcattttctagagaggtcagaaacatgttttanaagaatgcttccaaattgctaaaaattctcttgta

SEQ ID NO: 26328 - DNA, 71 bp, chicken (Gallus Gallus)
  misc_feature (36): n=a or g
aagctgattttattgcttttcaagtgacattgtccncgatttaatcacccccatcacctttttttaaagaa

SEQ ID NO: 26329 - DNA, 71 bp, chicken (Gallus Gallus)
  misc_feature (36): n=a or g
taaaagaaaaaaaaaaagaaaaaaggtattttgggncattgtgaaaatgctgaagactgaaatagcactct

SEQ ID NO: 26330 - DNA, 71 bp, chicken (Gallus Gallus)
  misc_feature (36): n=a or c
ttaccatgaagcaaaacaactctattccatgatatnaggttgctgtcaacgtttctgtcagaaaatagtaa

SEQ ID NO: 26331 - DNA, 71 bp, chicken (Gallus Gallus)
  misc_feature (36): n=a or g
aggatgtggcttgtccttccacttgagaacccatgnggtggcctcatcttctcagaggtgccacaaagctc

SEQ ID NO: 26332 - DNA, 71 bp, chicken (Gallus Gallus)
  misc_feature (36): n=c or t
aagtatctgagcccaattgctaataaaagaaaacantgaaataaacttctagattgttaggttttttatga

SEQ ID NO: 26333 - DNA, 71 bp, chicken (Gallus Gallus)
  misc_feature (36): n=a or t
gtgatggtaaggatttattttaaaagttcctaatgntgccatacaaaatacaaggttttaacagtttaaca

SEQ ID NO: 26334 - DNA, 71 bp, chicken (Gallus Gallus)
  misc_feature (36): n=c or t
ccattaactccaggctacattattcttttcaaccanagacccatattgagtgaggtatggctcttccctga

SEQ ID NO: 26335 - DNA, 71 bp, chicken (Gallus Gallus)
  misc_feature (36): n=a or g
tcatttaattaaggttttgtcattctctgaaaaacnttggtaactcattacccgaacagctccaatgcttt

SEQ ID NO: 26336 - DNA, 71 bp, chicken (Gallus Gallus)
  misc_feature (36): n=c or t
gggcaaggtctgctagggatgggggcttatgtatangcagccaatacatcagctagggagaatgtatgagc

SEQ ID NO: 26337 - DNA, 71 bp, chicken (Gallus Gallus)
  misc_feature (36): n=a or c
tccaaatggtccgtgctgatgggggctgcaagtccnacgtgttgctctgagcccagcagtgttcttactga

SEQ ID NO: 26338 - DNA, 71 bp, chicken (Gallus Gallus)
  misc_feature (36): n=a or g
tgctattaatcaaggtttcatacagtgaaatcgtcntgctcaggtgacagttgcatatttgctttatgttt

SEQ ID NO: 26339 - DNA, 71 bp, chicken (Gallus Gallus)
  misc_feature (36): n=a or g
tcagccatctctgctcaaaatttcatggggactcangaagtcaagtatgagagaaaagtctcctgtcatcc

SEQ ID NO: 26340 - DNA, 71 bp, chicken (Gallus Gallus)
  misc_feature (36): n=c or t
aaaagagctggaagccctgctgacaatgagaaactncagaaggaataaaaagataggcccagcacactgca

SEQ ID NO: 26341 - DNA, 71 bp, chicken (Gallus Gallus)
  misc_feature (36): n=c or t
gcacatctacacctttgaatctcacatccagctttncctctcagcttccagttctaccaggcttgacaatc

SEQ ID NO: 26342 - DNA, 71 bp, chicken (Gallus Gallus)
  misc_feature (36): n=a or g
aaagtcatgctcataaccacagaataccaactaacnagtaattatcctcattagctaatcagactggctga

SEQ ID NO: 26343 - DNA, 71 bp, chicken (Gallus Gallus)
  misc_feature (36): n=c or t
agtaatcatttccctctgactcggataattgctttncagaaggaagctcatgctcaggatgctgttgctgc

SEQ ID NO: 26344 - DNA, 71 bp, chicken (Gallus Gallus)
  misc_feature (36): n=c or t
tcacaacattcttttccataaatcaacaatacaagngttcccagaaaacacatctctgagtgaacaactgc

SEQ ID NO: 26345 - DNA, 71 bp, chicken (Gallus Gallus)
  misc_feature (36): n=c or t
gcacatctctttgtcttgggtttcccattaggctcnaacacagtgcctgctcagaccttcctcagtcctac

SEQ ID NO: 26346 - DNA, 71 bp, chicken (Gallus Gallus)
  misc_feature (36): n=a or t
ctgggcctgagaagaagagctagattgcatgctgtnttaaaatagatgtatggcaatctaaagcatggcag

SEQ ID NO: 26347 - DNA, 71 bp, chicken (Gallus Gallus)
  misc_feature (36): n=c or t
gggaaaaaaaaaaggatgatatgtgactgggaaatngtaccaagatatatataaaaaaaataaaaataaaa

SEQ ID NO: 26348 - DNA, 71 bp, chicken (Gallus Gallus)
  misc_feature (36): n=a or g
agcagaagttatgcttgtatacaatttgtattatcnaagactggcatagcaagaaaaaagcccaaagctgt

SEQ ID NO: 26349 - DNA, 71 bp, chicken (Gallus Gallus)
  misc_feature (36): n=c or t
ataagtctagcagatctgatctctatcattcctgtnctcctgtatgttgcagtatagtgtagacagaacaa

SEQ ID NO: 26350 - DNA, 71 bp, chicken (Gallus Gallus)
  misc_feature (36): n=a or t
tctctctttaccttaaatatgtaactaagatatatnacagagtaaggtaattaatgagatatattgcataa

SEQ ID NO: 26351 - DNA, 71 bp, chicken (Gallus Gallus)
  misc_feature (36): n=a or g
tggtatttggaggcatgtactgactagcagcaatantattacttcatgagagaccttctagtggttcctag

SEQ ID NO: 26352 - DNA, 71 bp, chicken (Gallus Gallus)
  misc_feature (36): n=a or g
tcacagctgctgacctcctctgtggtttggcaaacnttgtcgttggcggtattggagttgtagatttggtt

SEQ ID NO: 26353 - DNA, 71 bp, chicken (Gallus Gallus)
  misc_feature (36): n=a or g
ctggagctgttcggcctggaaaagagaatgccctgnggtgacctgataatggcctttcggtatctaaaagg

SEQ ID NO: 26354 - DNA, 71 bp, chicken (Gallus Gallus)
  misc_feature (36): n=g or t
caaatttggcaggcagagaaactacacaaaagactnctcaggaggcaggatggttgcttggtatttcaaac

SEQ ID NO: 26355 - DNA, 71 bp, chicken (Gallus Gallus)
  misc_feature (36): n=g or t
aggaaaatgttctcctaaaactccacatcctggaancgtaccataaatgtcagttccccttgatgaactgc

SEQ ID NO: 26356 - DNA, 71 bp, chicken (Gallus Gallus)
  misc_feature (36): n=a or g
aaaaacagcagaatagtatggtatgttggtggcatntaagtgggagaagctcacatgcaacagcctggagc

SEQ ID NO: 26357 - DNA, 71 bp, chicken (Gallus Gallus)
  misc_feature (36): n=a or g
acacagtttgctggagacctcaaccactttctgaanttcagtctcaagtgacagccatagaagtagttcac

SEQ ID NO: 26358 - DNA, 71 bp, chicken (Gallus Gallus)
  misc_feature (36): n=a or c
cccccatttcttcgtgctaacatttttatcttttcnttatttcattagtgagtgttcagatatttataaaa

SEQ ID NO: 26359 - DNA, 71 bp, chicken (Gallus Gallus)
  misc_feature (36): n=a or g
gagtttagatgaccttgccatgattttcagtagccntaagactgggctttttaataatggattccttgggg

SEQ ID NO: 26360 - DNA, 71 bp, chicken (Gallus Gallus)
  misc_feature (36): n=c or t
tagtatactaaatatttactgagttgttcttcccangtttatattccttatttgtttgattgactcaattg

SEQ ID NO: 26361 - DNA, 71 bp, chicken (Gallus Gallus)
  misc_feature (36): n=a or g
tccaggagggcataatccctctggtgagtgacacangcaggctggtaacaagcctggagaaggaggctgag

SEQ ID NO: 26362 - DNA, 71 bp, chicken (Gallus Gallus)
  misc_feature (36): n=c or t
taaaatcaattctttgctaactggcttctcatgaangttctgaaagtgtattttttcccaattcccagtaa

SEQ ID NO: 26363 - DNA, 71 bp, chicken (Gallus Gallus)
  misc_feature (36): n=a or g
ttcctcctcaagttctggaagtgcacccacccacantttacttcattttataaaacaagaagacatttacc

SEQ ID NO: 26364 - DNA, 71 bp, chicken (Gallus Gallus)
  misc_feature (36): n=a or g
ttaatttgtatgatgctttcaatattactactgtgnatatgtaatgacttaactaactgaccatttaatat

SEQ ID NO: 26365 - DNA, 71 bp, chicken (Gallus Gallus)
  misc_feature (36): n=a or g
taccactattagagcaaataagcagggaatcacatnatcaatagtatgcttgcaaatgtaagataaccttt

SEQ ID NO: 26366 - DNA, 71 bp, chicken (Gallus Gallus)
  misc_feature (36): n=a or g
aacagcaaaatgtaagggaagaccaaaacctacgtngctgcccttctttctaaacaccagaaaatgtttat

SEQ ID NO: 26367 - DNA, 71 bp, chicken (Gallus Gallus)
  misc_feature (36): n=a or g
cgctcatcttttccatgtaaactgagaggatgtggntggtggatgtctcacagcaggaatgcatggtgcca

SEQ ID NO: 26368 - DNA, 71 bp, chicken (Gallus Gallus)
  misc_feature (36): n=a or g
ccacacagctcccagagagctcccttcaactcggancatggggaaaaaattatgtttgtctgcagcaacct

SEQ ID NO: 26369 - DNA, 71 bp, chicken (Gallus Gallus)
  misc_feature (36): n=a or g
tttttcctctggcttcatgtgtcaagcagtatgtgnttcagtgagatcccatatctgagattgacagaaaa

SEQ ID NO: 26370 - DNA, 71 bp, chicken (Gallus Gallus)
  misc_feature (36): n=c or t
cttgcatggactccaggttgggcacaacacaggaanggatggaggtggcttgaggctgactgtggcaaggc

SEQ ID NO: 26371 - DNA, 71 bp, chicken (Gallus Gallus)
  misc_feature (36): n=a or g
tgtatgccatttgatcagacacatgaacagcagcangccagatttctcttccatgttctgtttctatactt

SEQ ID NO: 26372 - DNA, 71 bp, chicken (Gallus Gallus)
  misc_feature (36): n=c or t
ccttctctatattggagctgtttgtttaaaagcaanactaatatcatcgtactcatcattttgactaataa

SEQ ID NO: 26373 - DNA, 71 bp, chicken (Gallus Gallus)
  misc_feature (36): n=a or g
tagggtatcttacaaggcatgaggcaataaactgantccccagcctcctctttcacttactatgtgatgtt

SEQ ID NO: 26374 - DNA, 71 bp, chicken (Gallus Gallus)
  misc_feature (36): n=c or t
accgagttaggcctgtgtgccaggtactgctactantgatacctcgtaatgaagacatctactcttgagtc

SEQ ID NO: 26375 - DNA, 71 bp, chicken (Gallus Gallus)
  misc_feature (36): n=a or g
agctggcgcttttaagaaagccataaaactgtggtnatattgaataaatcagccaagctgccatttgttca

SEQ ID NO: 26376 - DNA, 71 bp, chicken (Gallus Gallus)
  misc_feature (36): n=c or t
ttgccttctatctccagttcacattgctaacagcancttaacatgatgcttacttaacatgaacatgagga

SEQ ID NO: 26377 - DNA, 71 bp, chicken (Gallus Gallus)
  misc_feature (36): n=c or t
caggtgcttcaggagaaaacaccaaactttgaccanagctgaatgaaaacaaacatagttaaaaacttcat

SEQ ID NO: 26378 - DNA, 71 bp, chicken (Gallus Gallus)
  misc_feature (36): n=a or g
atgcatcagatattgtttctgtacctttactacccngtacaaagggaaaatgtcctccactctttcaaacc

SEQ ID NO: 26379 - DNA, 71 bp, chicken (Gallus Gallus)
  misc_feature (36): n=c or g
cccagaacaaaaggggtgagggagcagagtgactgnaggaaaggaggttacttggaattgtttgcaggtgt

SEQ ID NO: 26380 - DNA, 71 bp, chicken (Gallus Gallus)
  misc_feature (36): n=a or g
ctgggtgttgccaggtacctggtgagccaaacagcnccggcagtgagcaaagtcagaaaacacgcaggcag

SEQ ID NO: 26381 - DNA, 71 bp, chicken (Gallus Gallus)
  misc_feature (36): n=a or c
aagactttctagcatcaactccttcactgaatgtcnatgtcaaaagggaaatcctccaaaaaacagaggga

SEQ ID NO: 26382 - DNA, 71 bp, chicken (Gallus Gallus)
  misc_feature (36): n=g or t
ggagccctcttgtggaggttcagatgcttttggcangaggagccttcgtgttacactcttctctccagcct

SEQ ID NO: 26383 - DNA, 71 bp, chicken (Gallus Gallus)
  misc_feature (36): n=g or t
agcctgatccatgccaacatttcccgtagaggcagnccaatatcccactcagctctcctcttcccagctca

SEQ ID NO: 26384 - DNA, 71 bp, chicken (Gallus Gallus)
  misc_feature (36): n=a or g
tgattcaacctttcaaaaacctgttaggattaatcngaggtgatgatgatggtggtgcttaggttgttcag

SEQ ID NO: 26385 - DNA, 71 bp, chicken (Gallus Gallus)
  misc_feature (36): n=c or t
ggaggcgatctgcctccttttccaggtgttttatantagaatctgcatcagcaacttcgtaagaaagaaca

SEQ ID NO: 26386 - DNA, 71 bp, chicken (Gallus Gallus)
  misc_feature (36): n=a or g
aatgatagggaagaacttctccaactcaaagcatcnaacatacatttctgtgcagaaatctagacaactat

SEQ ID NO: 26387 - DNA, 71 bp, chicken (Gallus Gallus)
  misc_feature (36): n=a or c
tgtcctttcattatccttgtttttttttttctcctnaatctcatttcttttccaaatctcttactgttttt

SEQ ID NO: 26388 - DNA, 71 bp, chicken (Gallus Gallus)
  misc_feature (36): n=a or g
acaaaaatatctttagtcttgaaacagctgatacanctacaaagcagttaaagaatcaagacttttagcga

SEQ ID NO: 26389 - DNA, 71 bp, chicken (Gallus Gallus)
  misc_feature (36): n=a or g
agcaaactgatttgtgctgtagtattttggaaggangagaggaagaaaagcttaaacagtatcaatcgcat

SEQ ID NO: 26390 - DNA, 71 bp, chicken (Gallus Gallus)
  misc_feature (36): n=g or t
cctaatatccaacccaaatggagtaatagaaatcancaaacatggatagggaatctccaagatgtcattgc

SEQ ID NO: 26391 - DNA, 71 bp, chicken (Gallus Gallus)
  misc_feature (36): n=a or t
agacatatcactcagtgcaagagatttcacacagcntctattttaaaacctattctgttatgcctttattt

SEQ ID NO: 26392 - DNA, 71 bp, chicken (Gallus Gallus)
  misc_feature (36): n=a or c
tttcaagatgcttcttgttcagttgtgctcttagcnaaatgggtctcctgacctggcaggtggggtggctg

SEQ ID NO: 26393 - DNA, 71 bp, chicken (Gallus Gallus)
  misc_feature (36): n=a or g
gtgcctctcctgtctgtgtgcttctgtgtgtgtggnggatcttcagaggtccagaaagcttaatgcagaaa

SEQ ID NO: 26394 - DNA, 71 bp, chicken (Gallus Gallus)
  misc_feature (36): n=a or c
gctccaggcactcctccccatccccatgcagggcanatctccctctcacgcctgcctgtaaattgattgac

SEQ ID NO: 26395 - DNA, 71 bp, chicken (Gallus Gallus)
  misc_feature (36): n=c or t
ctcctggactgcaatatagcctctgcttgctcgtgnttcatttcgggtaggtagccaagaaggacgatttc

SEQ ID NO: 26396 - DNA, 71 bp, chicken (Gallus Gallus)
  misc_feature (36): n=c or t
gggtgtctttttatggatgtttttgctgttacctgncgtgaaaatgtatttgccaacatcgctctagccaa

SEQ ID NO: 26397 - DNA, 71 bp, chicken (Gallus Gallus)
  misc_feature (36): n=c or g
agtttcttcatttttaaggacagatcatagctgtangtatatgcttgccttaccttaatgaaatcactttt

SEQ ID NO: 26398 - DNA, 71 bp, chicken (Gallus Gallus)
  misc_feature (36): n=a or g
gtcattttttttcacatggaagagttcagtgacacntctttgcatcatatacacttctatagtagacacca

SEQ ID NO: 26399 - DNA, 71 bp, chicken (Gallus Gallus)
  misc_feature (36): n=g or t
agcagaaagacagccagcatctgttcatacagaaanaatggcagatacagtgactgcagagtaatgagccc

SEQ ID NO: 26400 - DNA, 71 bp, chicken (Gallus Gallus)
  misc_feature (36): n=a or c
ttttaactggtaatgcatatacttggaatgtgatanattgctgaatggtttgccatgttctttgtcctcta

SEQ ID NO: 26401 - DNA, 71 bp, chicken (Gallus Gallus)
  misc_feature (36): n=a or g
aagtaagaaattacctcatgatttaaataagatgcntggttttttttttttctgtataattttataaaaca

SEQ ID NO: 26402 - DNA, 71 bp, chicken (Gallus Gallus)
  misc_feature (36): n=c or g
tgtttcaagactacagagaatttacaattataagcnacgatgatccttattagaaaaagaaaagaaaaaag

SEQ ID NO: 26403 - DNA, 71 bp, chicken (Gallus Gallus)
  misc_feature (36): n=g or t
ttattagctcggtggaattccttttgatttggctgngtgttggggagcactggagaagaggctgcatctct

SEQ ID NO: 26404 - DNA, 71 bp, chicken (Gallus Gallus)
  misc_feature (36): n=a or c
ccaatggggcaacctggaagaagaaggaagaactgncagaagaaagcattgaagtcagatactccagcttc

SEQ ID NO: 26405 - DNA, 71 bp, chicken (Gallus Gallus)
  misc_feature (36): n=a or g
tgataaggagtagaccagatgtcagaagcaaaagcnaccattaagtgctggactctgaaatacagttagac

SEQ ID NO: 26406 - DNA, 71 bp, chicken (Gallus Gallus)
  misc_feature (36): n=c or g
ggctgtgataacacatctgaagtgcagggatctganagagatcagaataaacctgaaacaaacattttgtt

SEQ ID NO: 26407 - DNA, 71 bp, chicken (Gallus Gallus)
  misc_feature (36): n=g or t
gagatgcagcaacctgtaagacttgagttgaaatgnaccatttatagtgtttcttctctttttattgacag

SEQ ID NO: 26408 - DNA, 71 bp, chicken (Gallus Gallus)
  misc_feature (36): n=a or g
ctctccagctttcttgtaggttctcttcaggtacangaaggtgctacaagttctccttggaaccttctctt

SEQ ID NO: 26409 - DNA, 71 bp, chicken (Gallus Gallus)
  misc_feature (36): n=c or t
gtaaggtttggctgcttgttattagagtaaacaaantaactacctgcaactgcggctctatgtgaggaagt

SEQ ID NO: 26410 - DNA, 71 bp, chicken (Gallus Gallus)
  misc_feature (36): n=a or g
taatgaaaaaaattgttctgttaaatgtttgttgantcaccattcattgaagggacaaatacagtccttag

SEQ ID NO: 26411 - DNA, 71 bp, chicken (Gallus Gallus)
  misc_feature (36): n=c or t
cctgatcagcactgaaggaaatggcacagccgctcngaactacagcaggtttaagcaattggctctctctg

SEQ ID NO: 26412 - DNA, 71 bp, chicken (Gallus Gallus)
  misc_feature (36): n=c or t
tagcacttaaaaagcaggaatttctcaagggtcccnggctaaacagtcttcttccactgtgcacttcattg

SEQ ID NO: 26413 - DNA, 71 bp, chicken (Gallus Gallus)
  misc_feature (36): n=c or t
tttgctttgggtgtcattatttagtttggcatcctngccagagaaacctttttactgactgcagttccttc

SEQ ID NO: 26414 - DNA, 71 bp, chicken (Gallus Gallus)
  misc_feature (36): n=c or g
taattataaagatgtacacacttttttctccaaacnagttcacaatgccttttaacttttaagatgaaaca

SEQ ID NO: 26415 - DNA, 71 bp, chicken (Gallus Gallus)
  misc_feature (36): n=a or c
tgtatctgtacagttatcagtttggctgggttaatnatttttttcaaaacttcactcattgtatttaacaa

SEQ ID NO: 26416 - DNA, 71 bp, chicken (Gallus Gallus)
  misc_feature (36): n=a or g
ccaataaaacgtaattatagcagggatcagcttganccttttatttagtacagagcaaggcatttcatcag

SEQ ID NO: 26417 - DNA, 71 bp, chicken (Gallus Gallus)
  misc_feature (36): n=a or g
cagaatttgcactaagatcctaaaatagagatgcanttattcctttcagatttactgcaagtccagtgagg

SEQ ID NO: 26418 - DNA, 71 bp, chicken (Gallus Gallus)
  misc_feature (36): n=c or t
taataatgataatatttagacagataactgtttaangtgctaactgtgctgtgaagccaagtggcatcctt

SEQ ID NO: 26419 - DNA, 71 bp, chicken (Gallus Gallus)
  misc_feature (36): n=a or t
tgttggcaacacttgaattcctgtgttgtgcctttnctgactgtgtaagatacctgaatgggggagacctg

SEQ ID NO: 26420 - DNA, 71 bp, chicken (Gallus Gallus)
  misc_feature (36): n=c or t
cttagggggaaaaaaatgtttaaattatctaaacantggaaatgtaaagaggatttttttttcttcatgtg

SEQ ID NO: 26421 - DNA, 71 bp, chicken (Gallus Gallus)
  misc_feature (36): n=a or g
tcagatcatctccgtaaaagtgagttatacatatancgatggtaagagattactctggttcataaagaaca

SEQ ID NO: 26422 - DNA, 71 bp, chicken (Gallus Gallus)
  misc_feature (36): n=c or t
cattaactcagaagtttaatgtgcacagtgaagagnaaacattagggttgctttccttccattcatatgta

SEQ ID NO: 26423 - DNA, 71 bp, chicken (Gallus Gallus)
  misc_feature (36): n=c or t
gctgcttacgttgccaaaaggaacctctttgcaacnggtgaaggagttagtgtcagcaaggtggccaagtc

SEQ ID NO: 26424 - DNA, 71 bp, chicken (Gallus Gallus)
  misc_feature (36): n=c or t
tttcattgaatctagttgattttcccttctatcttntctcttacactctaatccctcaggcttcccttcca

SEQ ID NO: 26425 - DNA, 71 bp, chicken (Gallus Gallus)
  misc_feature (36): n=c or t
tcaggatgcttgacctgcaccataggaacacccaangccaacagcacagcgctggagggctctgctgccac

SEQ ID NO: 26426 - DNA, 71 bp, chicken (Gallus Gallus)
  misc_feature (36): n=g or t
acatgaatcttcaagaactgcccttttctacagagntgaattttgcctcactgccaaactatcagtttctt

SEQ ID NO: 26427 - DNA, 71 bp, chicken (Gallus Gallus)
  misc_feature (36): n=c or t
ggtgctgctgagggcagagattctagcacagtagtntggtgctatgcagatgtgtagaagtatgacctgga

SEQ ID NO: 26428 - DNA, 71 bp, chicken (Gallus Gallus)
  misc_feature (36): n=a or g
ctgatagaaggtgtcactttgaaatcttctcctccnctggtgtagacttagactggtcctatctgatagag

SEQ ID NO: 26429 - DNA, 71 bp, chicken (Gallus Gallus)
  misc_feature (36): n=c or t
acaggagagatcaacatattctaagccaagatgtgnaccctgcctcagctacttgagtgaggagtaagaaa

SEQ ID NO: 26430 - DNA, 71 bp, chicken (Gallus Gallus)
  misc_feature (36): n=c or t
gagtcaatttttaacgaaaagaatcctaagggatanaggaaggcaggttttaactgaaatgtaatcaccca

SEQ ID NO: 26431 - DNA, 71 bp, chicken (Gallus Gallus)
  misc_feature (36): n=a or g
agaatacattcttgacagagaattcatagttttgantaagtgacactgatgaaaacttaatcctatttact

SEQ ID NO: 26432 - DNA, 71 bp, chicken (Gallus Gallus)
  misc_feature (36): n=c or t
acgtgagaaggatttgtggtcagttttcttaatttngggcattaataaatccttctgacctgcttttcctt

SEQ ID NO: 26433 - DNA, 71 bp, chicken (Gallus Gallus)
  misc_feature (36): n=a or g
gatggttttgcaagcaaaccagaccttgcaagatcncacagtccccctgaattacaaaggcattttcctga

SEQ ID NO: 26434 - DNA, 71 bp, chicken (Gallus Gallus)
  misc_feature (36): n=a or c
tgggtggagagctgagaatggactgtcaatttgaanacttaaaaacatgatttacaaattattctggtacg

SEQ ID NO: 26435 - DNA, 71 bp, chicken (Gallus Gallus)
  misc_feature (36): n=a or g
ggctgtcagtaatgaaagttaatggagggatatccnttgagtggtagtaccagggacaagtaaaagcactg

SEQ ID NO: 26436 - DNA, 71 bp, chicken (Gallus Gallus)
  misc_feature (36): n=c or t
aaatatgcacacgtacacaagcacacacataaatangctatgatttgaaagcatattttttctttcacaac

SEQ ID NO: 26437 - DNA, 71 bp, chicken (Gallus Gallus)
  misc_feature (36): n=a or g
ggctgcagagaggcaaagctgaggttacagcagtgncgaggagcatatcaagcccacctctgaatacttgc

SEQ ID NO: 26438 - DNA, 71 bp, chicken (Gallus Gallus)
  misc_feature (36): n=a or g
tatttaacatctcaggtgtgcacaaacaggtgaacnacttgtgtcttaggacggtgaaaagatgagagatg

SEQ ID NO: 26439 - DNA, 71 bp, chicken (Gallus Gallus)
  misc_feature (36): n=c or t
aaaaaatcaagtttctcaaatgaattaaagcctttnccctgctttcttttctccctttccttttagggaaa

SEQ ID NO: 26440 - DNA, 71 bp, chicken (Gallus Gallus)
  misc_feature (36): n=c or t
gaaactaaattgctttaattaaggatgagatgccancttatattttatagctatttccactggaattattt

SEQ ID NO: 26441 - DNA, 71 bp, chicken (Gallus Gallus)
  misc_feature (36): n=a or c
gacaaatgtgtgttaatgcggtcttaagatcctatncttaaagcagggcagccttcccataaaacttcagg

SEQ ID NO: 26442 - DNA, 71 bp, chicken (Gallus Gallus)
  misc_feature (36): n=a or g
agagctgaaaatatgactttttctagtgagttttcntcaccagaaatagttggcaatttgtttaaccaaga

SEQ ID NO: 26443 - DNA, 71 bp, chicken (Gallus Gallus)
  misc_feature (36): n=c or t
ctgtaacttcttcttaaaggacaggaacatcatagnttaaagtgtctttctaaaatctaaccctaatttgc

SEQ ID NO: 26444 - DNA, 71 bp, chicken (Gallus Gallus)
  misc_feature (36): n=g or t
gttctgttaggtggatggagacaacagtaagattcnctgtgagtcctctgttttgtaaggctgagcacacc

SEQ ID NO: 26445 - DNA, 71 bp, chicken (Gallus Gallus)
  misc_feature (36): n=a or c
ctttgaggacagttgggtccatcccagcaatgttancacagagggtaaggttggggtagcaaaagagagga

SEQ ID NO: 26446 - DNA, 71 bp, chicken (Gallus Gallus)
  misc_feature (36): n=c or t
tgaattttacaatgagaaacttaaatgtaggaacangtgtaggaaaaaaatacactagagaaattcagaag

SEQ ID NO: 26447 - DNA, 71 bp, chicken (Gallus Gallus)
  misc_feature (36): n=a or t
atctagaaatggccttgtgaaaacttgtctccagcngccctctcgcatccccggagttggcaaaatacaag

SEQ ID NO: 26448 - DNA, 71 bp, chicken (Gallus Gallus)
  misc_feature (36): n=a or c
agccgatacagtgctacagaaaaggcatccatggtntcatgtttcctctttctgctgcaccatcacagggt

SEQ ID NO: 26449 - DNA, 71 bp, chicken (Gallus Gallus)
  misc_feature (36): n=a or g
gaattagggaaaactcatcctttccttttttcaccntaatttcccgtggaattctacagcagcttgggttt

SEQ ID NO: 26450 - DNA, 71 bp, chicken (Gallus Gallus)
  misc_feature (36): n=a or g
gcatttagatgttaatttctttgcttttgtaattcnttagtgtcatttgcagtccttatgactagggaagt

SEQ ID NO: 26451 - DNA, 71 bp, chicken (Gallus Gallus)
  misc_feature (36): n=c or t
gaattgcacagataatattcttatttttgcaccatnttactgttcatactgctcttgtgacttcagtagaa

SEQ ID NO: 26452 - DNA, 71 bp, chicken (Gallus Gallus)
  misc_feature (36): n=c or t
agggtggtaggtgtctcttatttaaagatgggtatngatcgtagagatataaaaaatacatcggtacttac

SEQ ID NO: 26453 - DNA, 71 bp, chicken (Gallus Gallus)
  misc_feature (36): n=g or t
atttgatcagtaagttagggagagaaaatgagcttngagacggtgctttattaagagtcaaatttctgaat

SEQ ID NO: 26454 - DNA, 71 bp, chicken (Gallus Gallus)
  misc_feature (36): n=g or t
tgggcagcccttaccagcaaacacacagaagcattnacagctgttccacggccacactgagaatggctctt

SEQ ID NO: 26455 - DNA, 71 bp, chicken (Gallus Gallus)
  misc_feature (36): n=c or t
gttatgtcctgtactgattgcactcagactacatgngctgagtctgattctctaaggggcaaataaagttc

SEQ ID NO: 26456 - DNA, 71 bp, chicken (Gallus Gallus)
  misc_feature (36): n=a or g
taaatgacatctaaatgtgaaaagcagatgaagacnttcagctgaagttacagcgtagcctaggatttgag

SEQ ID NO: 26457 - DNA, 71 bp, chicken (Gallus Gallus)
  misc_feature (36): n=c or t
ataggctacacttgtagaaatgctgttctgcaacangtaagcatctgttaccacatcattatttcctgatt

SEQ ID NO: 26458 - DNA, 71 bp, chicken (Gallus Gallus)
  misc_feature (36): n=a or g
ttgtgtaaaaggaagaaggttttcacaataacagcnatgaggcactggcacagattgcccagacaggtgat

SEQ ID NO: 26459 - DNA, 71 bp, chicken (Gallus Gallus)
  misc_feature (36): n=c or g
tgaaatttcccagtgaggatgtatttgaaagttgtntcctctgttgtagttacacagcataagagaggcct

SEQ ID NO: 26460 - DNA, 71 bp, chicken (Gallus Gallus)
  misc_feature (36): n=a or g
tattgctgcccatggcagcgggatttgaactctatnggctttaaggttacttccaacccaagacattccat

SEQ ID NO: 26461 - DNA, 71 bp, chicken (Gallus Gallus)
  misc_feature (36): n=a or g
acaaatattcctgctgtacatgtggggcatcgcacngagctacgggagggagcagtaaataagagactcca

SEQ ID NO: 26462 - DNA, 71 bp, chicken (Gallus Gallus)
  misc_feature (36): n=c or g
taaagagcagaggggatggagggagaccaacagcangtacaagtgctctatttacaaagctctcttcccag

SEQ ID NO: 26463 - DNA, 71 bp, chicken (Gallus Gallus)
  misc_feature (36): n=a or g
ttctcaatgtccttgtagagctggtcaatgaaggcntccagctcttctcgttgcagcatggggagatccag

SEQ ID NO: 26464 - DNA, 71 bp, chicken (Gallus Gallus)
  misc_feature (36): n=a or g
actgaaaatttaatgaagcttcaataaaatagactnttcagttccatatttttctcacatgtttgcagatt

SEQ ID NO: 26465 - DNA, 71 bp, chicken (Gallus Gallus)
  misc_feature (36): n=c or g
tgtcacatttatttatcttcaaataactaaaacatnaagacaggttttctaccacataatttataatgtga

SEQ ID NO: 26466 - DNA, 71 bp, chicken (Gallus Gallus)
  misc_feature (36): n=c or t
aagaggaatcaggtctttagaaaatcctgggctcancctcatctacaaggacgtcccttcctgttcatctg

SEQ ID NO: 26467 - DNA, 71 bp, chicken (Gallus Gallus)
  misc_feature (36): n=c or t
gagatactgtagagagagagaaaatccctataatgngcatgaaaaacatgctagcaagacagttgggttat

SEQ ID NO: 26468 - DNA, 71 bp, chicken (Gallus Gallus)
  misc_feature (36): n=c or t
agaatgaagtacaaatatataatcacagaatcacangtggctaacgagactatcggagagatgaaaacccc

SEQ ID NO: 26469 - DNA, 71 bp, chicken (Gallus Gallus)
  misc_feature (36): n=g or t
cattggtggccttcaataaagcatattctttggtgntttttttcctcaagcacatttcaaaatggtctaca

SEQ ID NO: 26470 - DNA, 71 bp, chicken (Gallus Gallus)
  misc_feature (36): n=a or g
cttccacttgatatgttttaaaagtagactgatagnctggcctctctgtatctttagcaagatacagtctc

SEQ ID NO: 26471 - DNA, 71 bp, chicken (Gallus Gallus)
  misc_feature (36): n=c or t
taattcccacaggagttcaggcctgtctcacatccntctctttggaagggcttggcactgggcacagcata

SEQ ID NO: 26472 - DNA, 71 bp, chicken (Gallus Gallus)
  misc_feature (36): n=a or g
ctgctaaaaggtttgtaccaccagctgatacaaaanggaggtttaagaggggcaggaaggggcttcgctgc

SEQ ID NO: 26473 - DNA, 71 bp, chicken (Gallus Gallus)
  misc_feature (36): n=c or t
ttcattcatctccccacaacatcccactggcatctncagcagtttgtgctacgacaaaatgcggctgcgag

SEQ ID NO: 26474 - DNA, 71 bp, chicken (Gallus Gallus)
  misc_feature (36): n=a or c
ggactggaagatcttggaaggcttttccaaccctgntggttctatgatcctatgacaccaagtccagcagc

SEQ ID NO: 26475 - DNA, 71 bp, chicken (Gallus Gallus)
  misc_feature (36): n=c or t
taggagcaagaggccaataaagttgcatggaatggngaaaactgtaagaagacaaaacagaacaactttta

SEQ ID NO: 26476 - DNA, 71 bp, chicken (Gallus Gallus)
  misc_feature (36): n=c or t
caattactatttgctctacagcttgatctgttacanagaaaataatgaacagctcaagatctgtcacaacc

SEQ ID NO: 26477 - DNA, 71 bp, chicken (Gallus Gallus)
  misc_feature (36): n=c or t
gaattattgacagaaatgcacacaataattctaagnaagcaagaagggttaatatccaaggtattttgaaa

SEQ ID NO: 26478 - DNA, 71 bp, chicken (Gallus Gallus)
  misc_feature (36): n=g or t
gcaaattcatccgcaagctgtatccttcttgtttgnctaaatgcaatctctatactttaatgtagaattcc

SEQ ID NO: 26479 - DNA, 71 bp, chicken (Gallus Gallus)
  misc_feature (36): n=c or t
agatctgatattggccatttaccttttcttttgtanaataatttattagcagctgataaaaatcacataat

SEQ ID NO: 26480 - DNA, 71 bp, chicken (Gallus Gallus)
  misc_feature (36): n=c or t
tatgtatgttttaaaattattttttactgaagtggnaccaaatgctgtacgtacttgtatccaattccatc

SEQ ID NO: 26481 - DNA, 71 bp, chicken (Gallus Gallus)
  misc_feature (36): n=c or t
agataattagctatagagaagaattcttggtgtttngagttcaccttcctttccagtaggtaatgaggaga

SEQ ID NO: 26482 - DNA, 71 bp, chicken (Gallus Gallus)
  misc_feature (36): n=c or g
aaaaaaattgaaataagcacatttatgcggttttgntgttggttttccttgaaattattattatactctgt

SEQ ID NO: 26483 - DNA, 71 bp, chicken (Gallus Gallus)
  misc_feature (36): n=g or t
tcttgaagtaaacacaacttaagcatatttagattnaagcaggtgcttgcctgcttttctgaagaaagatg

SEQ ID NO: 26484 - DNA, 71 bp, chicken (Gallus Gallus)
  misc_feature (36): n=c or t
aatatcaaaaggtaaaaacaagcaacaatcgaagcnggctcacctatgcagaatagagtaaccacctgcag

SEQ ID NO: 26485 - DNA, 71 bp, chicken (Gallus Gallus)
  misc_feature (36): n=a or g
aaacttcttcttaccttcatgtttggaaagtacttnctgtctccacccccaaatcatttcaaaagaattta

SEQ ID NO: 26486 - DNA, 71 bp, chicken (Gallus Gallus)
  misc_feature (36): n=c or t
ttcaggattgtttataacaccctgacaattacaaangctgacaaaatattttaagattacactcagtaaaa

SEQ ID NO: 26487 - DNA, 71 bp, chicken (Gallus Gallus)
  misc_feature (36): n=c or t
aacagttttcatcaccacgttgagaccatgatacanatttgtgaaagcccagtcatcacctaggaacccca

SEQ ID NO: 26488 - DNA, 71 bp, chicken (Gallus Gallus)
  misc_feature (36): n=c or g
gcacatatgtaccttacactgtgtcttgtccaaaantgattattgtctagctattatgccagtgagatgca

SEQ ID NO: 26489 - DNA, 71 bp, chicken (Gallus Gallus)
  misc_feature (36): n=c or t
gtagaagtgtttcagttgccaggggaaatggtctgngtgtggggaggaagttacagccacactgtgtatgt

SEQ ID NO: 26490 - DNA, 71 bp, chicken (Gallus Gallus)
  misc_feature (36): n=a or g
tacttgaaataaggaaaacattgctcactttcacanagctttttaagtcgttgtttgaaaagagctgagaa

SEQ ID NO: 26491 - DNA, 71 bp, chicken (Gallus Gallus)
  misc_feature (36): n=a or t
ccagggtcttcttggaaacatggaatcccagcccanctttggagcagtgtcagaacaagtgcactcagtac

SEQ ID NO: 26492 - DNA, 71 bp, chicken (Gallus Gallus)
  misc_feature (36): n=c or t
ctggaaatccatctttcacattacatacacacaganagttaaaaaaaagtgcatgagtgaagggaagaaga

SEQ ID NO: 26493 - DNA, 71 bp, chicken (Gallus Gallus)
  misc_feature (36): n=a or g
aagtgtagaaaataattaatcatcagtgtgacctcnaagcagtagaagcacagtcatatttaggtagcttt

SEQ ID NO: 26494 - DNA, 71 bp, chicken (Gallus Gallus)
  misc_feature (36): n=a or g
atccactgttctctaatctagtgacagaacgttgcncaggacagtgtcaaacactttacataaatccaggt

SEQ ID NO: 26495 - DNA, 71 bp, chicken (Gallus Gallus)
  misc_feature (36): n=a or g
ttagtaccatgtacgtatatatcaactacagtggancttcctgtgtcaaggcccattctgagcgcttctgg

SEQ ID NO: 26496 - DNA, 71 bp, chicken (Gallus Gallus)
  misc_feature (36): n=a or t
gcaggattgcaaaacagatatactgtccttatattncataagacagctcttcaatgaattcatccagtagg

SEQ ID NO: 26497 - DNA, 71 bp, chicken (Gallus Gallus)
  misc_feature (36): n=c or t
tgagcaatgtatttactttggttgacatccatgtgngtgaggtgaacctgtgttactttttggcattctaa

SEQ ID NO: 26498 - DNA, 71 bp, chicken (Gallus Gallus)
  misc_feature (36): n=a or c
cgccatgccgtgtaatctcaaccaagatgatctccnctttctcacaacaaattccatgaatttctgtgtat

SEQ ID NO: 26499 - DNA, 71 bp, chicken (Gallus Gallus)
  misc_feature (36): n=c or t
gtcaatcattctgcttcagaatatttgacacatacnttcccatgtcttaatgttgatgcacaagaataatg

SEQ ID NO: 26500 - DNA, 71 bp, chicken (Gallus Gallus)
  misc_feature (36): n=a or g
tgtttaagaaggatgatattgcttgttacagaatcntagaatatactgagttggaagagaccctcaaagat

SEQ ID NO: 26501 - DNA, 71 bp, chicken (Gallus Gallus)
  misc_feature (36): n=c or t
aactccccctgcattctcagcgtgcactgcagaggncttgcatgacacagtggcatttatggtacatccag

SEQ ID NO: 26502 - DNA, 71 bp, chicken (Gallus Gallus)
  misc_feature (36): n=c or t
ccgatctcaaacttggcctgtagctgctgcaacaangcacgtgttgaacactgctattccatttaacacac

SEQ ID NO: 26503 - DNA, 71 bp, chicken (Gallus Gallus)
  misc_feature (36): n=c or t
gaaggcacaagggagcagaagttgatcttctttcangtctgttcctccacacacttgctgctagcatagag

SEQ ID NO: 26504 - DNA, 71 bp, chicken (Gallus Gallus)
  misc_feature (36): n=a or g
tcacagaatggaagaagttggacaggacatcagaanagcatctagtccaatgtccctacacaaagcagagt

SEQ ID NO: 26505 - DNA, 71 bp, chicken (Gallus Gallus)
  misc_feature (36): n=c or t
gaggatccttgtggatctattccaactcaggatatnttgtgattctatcatactattttttctcttctgct

SEQ ID NO: 26506 - DNA, 71 bp, chicken (Gallus Gallus)
  misc_feature (36): n=c or t
ggcatacagtcttcttttaactcgtttgttctgggncagggggaaaagtggtttggtttggtgtttgacga

SEQ ID NO: 26507 - DNA, 71 bp, chicken (Gallus Gallus)
  misc_feature (36): n=a or c
gtggatggactaccagaattattttcaggctactgnacacttctgttaaagttctagtggcagagaagcac

SEQ ID NO: 26508 - DNA, 71 bp, chicken (Gallus Gallus)
  misc_feature (36): n=a or g
aatttttcttcacctgtaagttattaaggctgatcnagaggactttaaattaggattgaaggctgcgggta

SEQ ID NO: 26509 - DNA, 71 bp, chicken (Gallus Gallus)
  misc_feature (36): n=a or g
agaccaaatctttcccatactgaagcatcctggtcngtgtaaccattctgtgggagcctccacatgtctgg

SEQ ID NO: 26510 - DNA, 71 bp, chicken (Gallus Gallus)
  misc_feature (36): n=c or t
aggtgttaaggaagtgttagcttaacacctattaantaaacagatcaaatatagaattgtacttgtgatat

SEQ ID NO: 26511 - DNA, 71 bp, chicken (Gallus Gallus)
  misc_feature (36): n=a or g
tggatgcattaaaagtggaagtgtttatacagtgtntattctcatgccagaatatcctctgttgcagaaca

SEQ ID NO: 26512 - DNA, 71 bp, chicken (Gallus Gallus)
  misc_feature (36): n=a or g
cacatgaagaaaattttgggggacaaactacatacncagtctccaaacattgaagactcttatcttccatc

SEQ ID NO: 26513 - DNA, 71 bp, chicken (Gallus Gallus)
  misc_feature (36): n=g or t
ttgaacataccagaaaagaggattcactgttaccanaggagaaagtctgattgaaaaccttgcttttgtag

SEQ ID NO: 26514 - DNA, 71 bp, chicken (Gallus Gallus)
  misc_feature (36): n=c or g
ataacaaccgcttaaaggagcttacaacttgttcantggcctgattcaaagtgagctggatttgtatttat

SEQ ID NO: 26515 - DNA, 71 bp, chicken (Gallus Gallus)
  misc_feature (36): n=c or t
tgcccttagcatgaagaagttattagtaggccagtngttttgcttttctaagcccaattatgaaaaatgcg

SEQ ID NO: 26516 - DNA, 71 bp, chicken (Gallus Gallus)
  misc_feature (36): n=g or t
gtttctctaaatctcattaaagagcacaaaaaacanacaaggttcaaaatccgatctaaagcgtgtgcagt

SEQ ID NO: 26517 - DNA, 71 bp, chicken (Gallus Gallus)
  misc_feature (36): n=a or g
tccacgaccatcttggaaaaaaactccttgctctgngagatcagcttagagctcagggctgtggctgcaca

SEQ ID NO: 26518 - DNA, 71 bp, chicken (Gallus Gallus)
  misc_feature (36): n=c or t
aaaaaatctgacactgcttttggcatcatctggcantgcctgttttggagtcttgttcctagactcatttt

SEQ ID NO: 26519 - DNA, 71 bp, chicken (Gallus Gallus)
  misc_feature (36): n=c or t
cattatgtaggcatgcattctctgggtgcaattccngaggaaaaaaactttcacaagccttgtatgcagga

SEQ ID NO: 26520 - DNA, 71 bp, chicken (Gallus Gallus)
  misc_feature (36): n=c or t
ggaaagatgctgcttacccagagaaataatgtctcntgttgaatagccctctgtgcttgaagataatctta

SEQ ID NO: 26521 - DNA, 71 bp, chicken (Gallus Gallus)
  misc_feature (36): n=a or c
cctaagcagaaagttttacaaacctttactttttgnatttgattcttcagaatatcttcagcagcacattt

SEQ ID NO: 26522 - DNA, 71 bp, chicken (Gallus Gallus)
  misc_feature (36): n=c or t
gaggaaaaaaaaaaaaaaaaaaaaaggaggagctgnagttaaaatatacatatattgctttttccccaagg

SEQ ID NO: 26523 - DNA, 71 bp, chicken (Gallus Gallus)
  misc_feature (36): n=a or g
ggaatgggaggggagcaggaatctgcattttctcgncaagaagggttttgtgtatgccaccacaggcagct

SEQ ID NO: 26524 - DNA, 71 bp, chicken (Gallus Gallus)
  misc_feature (36): n=a or c
caagaactaaggaaagaaaattggagaatgacttcnctgtggcatctgcactctatgagagagtctgtggt

SEQ ID NO: 26525 - DNA, 71 bp, chicken (Gallus Gallus)
  misc_feature (36): n=a or t
ctgtttcactcttttttcctaattaaatgaaaaaangcgatgtaaatccaaagaacctcttgcctgaggac

SEQ ID NO: 26526 - DNA, 71 bp, chicken (Gallus Gallus)
  misc_feature (36): n=c or t
aaaagaacaaaagcttaaggttaaaactgcaacccnaggactttctatccatttagagaaattaaattccc

SEQ ID NO: 26527 - DNA, 71 bp, chicken (Gallus Gallus)
  misc_feature (36): n=a or g
gagtaacctatgtatatgctgaatacaatacagtgntatgtgttctagtaggcgcttgacggggatatgtg

SEQ ID NO: 26528 - DNA, 71 bp, chicken (Gallus Gallus)
  misc_feature (36): n=a or c
aatgcacagaactgtcattactgacaaccagaaaanaaatacacccataacttaaatgatttctcagcact

SEQ ID NO: 26529 - DNA, 71 bp, chicken (Gallus Gallus)
  misc_feature (36): n=c or t
caggaatctccacattttcaatgttcaaggtgctangcacaaggagctatgtgtgttgaatacaactttca

SEQ ID NO: 26530 - DNA, 71 bp, chicken (Gallus Gallus)
  misc_feature (36): n=a or g
ctatattttccacactctatctgacttctttagctngcatcccttcttgacactctttgattcacctgcat

SEQ ID NO: 26531 - DNA, 71 bp, chicken (Gallus Gallus)
  misc_feature (36): n=g or t
ctttaagctttgccttggtttaaataattgagaagntaatagtgaatgattaaaattagcagaagatgatg

SEQ ID NO: 26532 - DNA, 71 bp, chicken (Gallus Gallus)
  misc_feature (36): n=c or g
gggaaatttaccttgtctaaacttaggagtttaaanttatgcctttgtttatgagacagcacttatatact

SEQ ID NO: 26533 - DNA, 71 bp, chicken (Gallus Gallus)
  misc_feature (36): n=c or t
ttttgatgataatgttctggataactttgcttctgnaaaagacatcacaaaacttcttacttgctgttact

SEQ ID NO: 26534 - DNA, 71 bp, chicken (Gallus Gallus)
  misc_feature (36): n=g or t
gcacagtagaaagcactttcccttggacctacccanctatggagcttcttggcctcagcaccaacttccct

SEQ ID NO: 26535 - DNA, 71 bp, chicken (Gallus Gallus)
  misc_feature (36): n=a or g
cccccccatttttttttttgttcgttagcatctagncaatgctgctctgaaataaagattgggaatcataa

SEQ ID NO: 26536 - DNA, 71 bp, chicken (Gallus Gallus)
  misc_feature (36): n=a or g
ggtacctggaatgggtggttgcacatgagggtaatncagatctcaggcacacaaataaacaaaatcatatt

SEQ ID NO: 26537 - DNA, 71 bp, chicken (Gallus Gallus)
  misc_feature (36): n=c or t
atttctgagggtgactgttcgccatgactgatgagngatagcttattgactctgctgcagtggcacatgtg

SEQ ID NO: 26538 - DNA, 71 bp, chicken (Gallus Gallus)
  misc_feature (36): n=a or g
taagtgcttccactccctaaaagtaacacctttccnttcagttttagctccggctccccgcttagctcttc

SEQ ID NO: 26539 - DNA, 71 bp, chicken (Gallus Gallus)
  misc_feature (36): n=c or t
atgttctttggggactgaagaaagaaaatactgggngctggatggaaggatatcactcacagctcccagag

SEQ ID NO: 26540 - DNA, 71 bp, chicken (Gallus Gallus)
  misc_feature (36): n=a or t
gttcgtattgtttagtttctctagcatggacagaantcattgtaggtgatgacctcaagattatgaatgtg

SEQ ID NO: 26541 - DNA, 71 bp, chicken (Gallus Gallus)
  misc_feature (36): n=a or g
ttggacttccttttacagcacacgtgtaactgctcnttaatccagcggcaagtaggttttctacattcttt

SEQ ID NO: 26542 - DNA, 71 bp, chicken (Gallus Gallus)
  misc_feature (36): n=c or t
ttgtagattaacgtaggaatgtatatagtatgctgnacttaactcctttgctgccctctgctaaacatatt

SEQ ID NO: 26543 - DNA, 71 bp, chicken (Gallus Gallus)
  misc_feature (36): n=a or g
atctccataattcctgaacacctccagggacacagnaacttcaactcagcaccattacctcactccactgc

SEQ ID NO: 26544 - DNA, 71 bp, chicken (Gallus Gallus)
  misc_feature (36): n=a or g
caccagctgatggacatacagccagtccttgagcantaccccttttcccgaccaactccccaagttttttc

SEQ ID NO: 26545 - DNA, 71 bp, chicken (Gallus Gallus)
  misc_feature (36): n=c or t
gctagcagtttgcctgagtcagttttcaagaaaagncagtgacagagagagaatttctgccaatcttctta

SEQ ID NO: 26546 - DNA, 71 bp, chicken (Gallus Gallus)
  misc_feature (36): n=c or t
taagatggctttattttattttatttgtttttgtcntggagtccatgtcactgtgcatctcactatgtaac

SEQ ID NO: 26547 - DNA, 71 bp, chicken (Gallus Gallus)
  misc_feature (36): n=c or t
gaagaaaagcacagatttattaagagagaaggggcnattttttcctcatttgcttcaaagtaaaacctgta

SEQ ID NO: 26548 - DNA, 71 bp, chicken (Gallus Gallus)
  misc_feature (36): n=a or c
aaatacacaaatgggcataccaggttaaatacttanggacactcaaaccaagagaaatatcatagaaagtg

SEQ ID NO: 26549 - DNA, 71 bp, chicken (Gallus Gallus)
  misc_feature (36): n=g or t
catattaaatctgatattgaagcaattagctgcatncagtattcaaatgaatcagctaaaggtataagtaa

SEQ ID NO: 26550 - DNA, 71 bp, chicken (Gallus Gallus)
  misc_feature (36): n=c or t
tgctcacagtcattcctctcttcaagcagatggatntgtggtgtctgtgaggaagaacggcaaatgaaatg

SEQ ID NO: 26551 - DNA, 71 bp, chicken (Gallus Gallus)
  misc_feature (36): n=a or c
acttagaattctgttcctcaacagcttggctatatntttttatccttagagaaaaatccatcctgtttgtc

SEQ ID NO: 26552 - DNA, 71 bp, chicken (Gallus Gallus)
  misc_feature (36): n=a or g
ctattttcctgtcttttagtcacagagaaatgtgantaacacaccataaaataacgagaaagtaaatacaa

SEQ ID NO: 26553 - DNA, 71 bp, chicken (Gallus Gallus)
  misc_feature (36): n=c or t
tttaaagacctaggcttggataatgctctagtcacnacatattgcttattccacactctacagtatactgc

SEQ ID NO: 26554 - DNA, 71 bp, chicken (Gallus Gallus)
  misc_feature (36): n=c or t
gtctttttcaatctgccctatactaaaggatacgangagctctcccctgaagtccatggcctccacgattg

SEQ ID NO: 26555 - DNA, 71 bp, chicken (Gallus Gallus)
  misc_feature (36): n=a or g
gcttctttattggcttccacagtgaggattgtagcntagaacttcagcattctgctcttgctctggtccag

SEQ ID NO: 26556 - DNA, 71 bp, chicken (Gallus Gallus)
  misc_feature (36): n=c or t
aatgtgttgtttaaagacaaacagatgttcagctcntaagctctgaggtcagtcctgtagtgcttggctgg

SEQ ID NO: 26557 - DNA, 71 bp, chicken (Gallus Gallus)
  misc_feature (36): n=c or t
gtcgtagagaggtttctccaaccacacctctgacangagagcttgcaagctggaagcctgcggcttgccgt

SEQ ID NO: 26558 - DNA, 71 bp, chicken (Gallus Gallus)
  misc_feature (36): n=a or g
aaatctggttttattttctgacagctgattgttccnaacataaatattagcaacatctttgcgattcagta

SEQ ID NO: 26559 - DNA, 71 bp, chicken (Gallus Gallus)
  misc_feature (36): n=a or g
gtggttttgcgtaaatctgggtagagaaatagcccngtgtgtctgtttctaagcagccactgggattgcaa

SEQ ID NO: 26560 - DNA, 71 bp, chicken (Gallus Gallus)
  misc_feature (36): n=a or g
ttatcctatgcaaacaagtgaaatagggcattatangcttgaaagttgttgaacctcagagactaaatgat

SEQ ID NO: 26561 - DNA, 71 bp, chicken (Gallus Gallus)
  misc_feature (36): n=g or t
ttttatctgcctgtttatcttattcagtttcataangttcttttgcagcaggtgacagccaatttttgttt

SEQ ID NO: 26562 - DNA, 71 bp, chicken (Gallus Gallus)
  misc_feature (36): n=a or g
aagggaaaaaaaatcagatttgctaatgttgacaantaaaatgtgggtaagcaacttaaatacaagagaca

SEQ ID NO: 26563 - DNA, 71 bp, chicken (Gallus Gallus)
  misc_feature (36): n=a or t
aaaagttattccacctggcattccccagctcctatnagacaacacgtacttgacacaacgttatctcccaa

SEQ ID NO: 26564 - DNA, 71 bp, chicken (Gallus Gallus)
  misc_feature (36): n=a or g
cctcagcaagtctgaattcttacaaagcttcacagntgagagaaaaacctaattgagcttttgttatgtat

SEQ ID NO: 26565 - DNA, 71 bp, chicken (Gallus Gallus)
  misc_feature (36): n=a or t
ttgtattgttagatgaaatttctctccatttttatnatgagtaagaagtaatagtataaagtagctgagaa

SEQ ID NO: 26566 - DNA, 71 bp, chicken (Gallus Gallus)
  misc_feature (36): n=g or t
atatgatgcatatccaacagcaaaactcagtgcagncagttccaaataaagcaagtacagcacctacctcc

SEQ ID NO: 26567 - DNA, 71 bp, chicken (Gallus Gallus)
  misc_feature (36): n=a or g
gatttcacagcttctgtagagctcttagctcctctnaggtgtaactttggatcttggctttgaggtgctgg

SEQ ID NO: 26568 - DNA, 71 bp, chicken (Gallus Gallus)
  misc_feature (36): n=a or g
ggaagtgtattgctttttgatgggaaagaagaagangagatctttggatggacacagcatagagcaacatc

SEQ ID NO: 26569 - DNA, 71 bp, chicken (Gallus Gallus)
  misc_feature (36): n=c or t
tttcttcatattacttatgctattatgattgtgacncaaggcatttcctggggaccaaagaacaactgaaa

SEQ ID NO: 26570 - DNA, 71 bp, chicken (Gallus Gallus)
  misc_feature (36): n=a or g
acaggagcaaaggaagcaatgatttctctagccctntgtataaatcttagagcttgaagtggctcctacag

SEQ ID NO: 26571 - DNA, 71 bp, chicken (Gallus Gallus)
  misc_feature (36): n=a or g
aagtcacagtagtaaaaagtcctaaaaagtagattntttcctctggattagtctagagtgatatttgaagc

SEQ ID NO: 26572 - DNA, 71 bp, chicken (Gallus Gallus)
  misc_feature (36): n=a or g
ggatcttgacgtaacacggcagccttgcttcttcancctctggctagttcagtaagggacagggtagatgt

SEQ ID NO: 26573 - DNA, 71 bp, chicken (Gallus Gallus)
  misc_feature (36): n=a or c
aaatattgctaaagataataatctctttcattatantatgcattgaaacaataaaaattgcaattacgact

SEQ ID NO: 26574 - DNA, 71 bp, chicken (Gallus Gallus)
  misc_feature (36): n=a or g
aaggcaaataaagatgcagcaaatgcagacagtccnaagggaataatggttcgagggtctcttttggctgc

SEQ ID NO: 26575 - DNA, 71 bp, chicken (Gallus Gallus)
  misc_feature (36): n=c or t
gcagggcacttttgtgctctttgcctagtgctgtantgaatgcaaacttgcaaccaaacatccagtgtggt

SEQ ID NO: 26576 - DNA, 71 bp, chicken (Gallus Gallus)
  misc_feature (36): n=c or t
gatgcatctgctgaactttatatacaggttatagcnacactgctgtgcaaagcatcacatggcctcatggc

SEQ ID NO: 26577 - DNA, 71 bp, chicken (Gallus Gallus)
  misc_feature (36): n=a or c
ttgaagttcgtttttcctgctaaccttgctaacagnagggccctatgtgactgtgctagtgaacccccaaa

SEQ ID NO: 26578 - DNA, 71 bp, chicken (Gallus Gallus)
  misc_feature (36): n=c or t
ttttgtgcctgaaggacaggcagaaccatgtgactnctgaaagtgggtaggcatcctcagagcaagcttag

SEQ ID NO: 26579 - DNA, 71 bp, chicken (Gallus Gallus)
  misc_feature (36): n=c or t
agtaagtcctactgtatttgcaggagcaattttctngacgcagaatggttctcgactgtttttctcccatt

SEQ ID NO: 26580 - DNA, 71 bp, chicken (Gallus Gallus)
  misc_feature (36): n=c or t
tctggtgcctattcatatacatcattattcctttangcttagaaagtattaggaccacgcatgagactttt

SEQ ID NO: 26581 - DNA, 71 bp, chicken (Gallus Gallus)
  misc_feature (36): n=g or t
ctatatataggccatttatgcatctaaaattccttncagtcttgaaaactgattggtaaattaaatggatt

SEQ ID NO: 26582 - DNA, 71 bp, chicken (Gallus Gallus)
  misc_feature (36): n=c or g
actttaatagaaaagtacctgattttcacatgattnagttatgttcaggcttcaaaaagttgctcacagat

SEQ ID NO: 26583 - DNA, 71 bp, chicken (Gallus Gallus)
  misc_feature (36): n=a or c
aatatatttgaactagcagaaaattggtttattctngcttgtctactatgtcagctttagagaaaaaatca

SEQ ID NO: 26584 - DNA, 71 bp, chicken (Gallus Gallus)
  misc_feature (36): n=a or g
ataagagaactcactctttggaagagctgacagatnactgcctgcttcatttctgcccatcttagctacta

SEQ ID NO: 26585 - DNA, 71 bp, chicken (Gallus Gallus)
  misc_feature (36): n=a or g
cagaggcaccatcgtgtactggcaggatgacaccancagtccagctcctggaaagcccatgtcaatggttt

SEQ ID NO: 26586 - DNA, 71 bp, chicken (Gallus Gallus)
  misc_feature (36): n=a or g
ctgtgctcatcggggaaaaaatgaaatgaaacaaanttttaagaaggccacatggttcctttttgttccct

SEQ ID NO: 26587 - DNA, 71 bp, chicken (Gallus Gallus)
  misc_feature (36): n=c or t
agggagggcaggacataatttctcagatacacagtngcaccggtggttcacatcagactgtctaagcagcc

SEQ ID NO: 26588 - DNA, 71 bp, chicken (Gallus Gallus)
  misc_feature (36): n=a or t
ttgccactcacgtaagtgaaaatctgaagaacctgncaaagaaagagttgcgattgttagcctggaagttg

SEQ ID NO: 26589 - DNA, 71 bp, chicken (Gallus Gallus)
  misc_feature (36): n=c or t
caggatagctttttctgcaagaaatttgtaaaagtntataaaatcctggtgaacagatgattgtcacaaaa

SEQ ID NO: 26590 - DNA, 71 bp, chicken (Gallus Gallus)
  misc_feature (36): n=a or g
ttgcttacactcacaggacagacagaagaataaagnttctttcctgcggtgctccagctcatatttaatgt

SEQ ID NO: 26591 - DNA, 71 bp, chicken (Gallus Gallus)
  misc_feature (36): n=c or t
ggtaaagtaagacataaagacgacacaatacttatngggaattttagctggggttatcaatatctttgaaa

SEQ ID NO: 26592 - DNA, 71 bp, chicken (Gallus Gallus)
  misc_feature (36): n=a or g
tatggtgtgatcatgctgtctggggttcaaatgggngaaaaaggcagagctatgagttatattggagcttt

SEQ ID NO: 26593 - DNA, 71 bp, chicken (Gallus Gallus)
  misc_feature (36): n=a or g
acatttactactacagtagacaagtaattttctggnggtcaactcagaacattgttctttgtaaagacttt

SEQ ID NO: 26594 - DNA, 71 bp, chicken (Gallus Gallus)
  misc_feature (36): n=a or g
cagatgtggtccaatgggactatcagatcaggaaanggaccaaccgttgtagtagcaataagacacacacc

SEQ ID NO: 26595 - DNA, 71 bp, chicken (Gallus Gallus)
  misc_feature (36): n=c or t
aaagtaatggaaagcactgggtagaaatatgtttangaagttactccacataatccacataagcgactaat

SEQ ID NO: 26596 - DNA, 71 bp, chicken (Gallus Gallus)
  misc_feature (36): n=g or t
attgaatacataaacaggagcatagcttgtaagatnaattggcatcagtcattcagttgagtcttatctga

SEQ ID NO: 26597 - DNA, 71 bp, chicken (Gallus Gallus)
  misc_feature (36): n=a or g
caaaaaacagctctccaaaacagtaatgtttatacnaggaatttagcaggctttgataggtagcaaataac

SEQ ID NO: 26598 - DNA, 71 bp, chicken (Gallus Gallus)
  misc_feature (36): n=a or g
aagtcttgactaataaaggtgaggaaattcccaatngcttgttaaaatttctgaattggtacacacactct

SEQ ID NO: 26599 - DNA, 71 bp, chicken (Gallus Gallus)
  misc_feature (36): n=c or t
aattaggagctcaggcaaaactatcagtgtggtgantgtactcaatcccagccggtctaggtctgcctaga

SEQ ID NO: 26600 - DNA, 71 bp, chicken (Gallus Gallus)
  misc_feature (36): n=c or t
tatttcctctgaactcagactgttatttctccttantttaaaagtcagatttttttcctgtccttttctga

SEQ ID NO: 26601 - DNA, 71 bp, chicken (Gallus Gallus)
  misc_feature (36): n=c or t
acatcaaagatattgcaaaaaatcgaattatatggntggttcttgtggttttttgactcagatctaaggga

SEQ ID NO: 26602 - DNA, 71 bp, chicken (Gallus Gallus)
  misc_feature (36): n=c or g
acggacatatgtatcctgcaggaatccataataaanttcaacagaaataacccagctttgcaggcagcctg

SEQ ID NO: 26603 - DNA, 71 bp, chicken (Gallus Gallus)
  misc_feature (36): n=c or t
gaggcctttccagcctaaggaataatccaaactgtncctccaaggtgacagcgagctagggatgtccactg

SEQ ID NO: 26604 - DNA, 71 bp, chicken (Gallus Gallus)
  misc_feature (36): n=c or t
ttgacagcttatattttgtaaatacataagttcttnagtgtgcaaaccattaactgattctcaattagaga

SEQ ID NO: 26605 - DNA, 71 bp, chicken (Gallus Gallus)
  misc_feature (36): n=a or c
tctttaaagtgaaggattggctgtgattctgaaggnagcccatccaggttcatatttgtttatgcaaacct

SEQ ID NO: 26606 - DNA, 71 bp, chicken (Gallus Gallus)
  misc_feature (36): n=a or c
gttaaaattgaagaaactgatattctttacttctanaatttgggaattgacaggtgtcacccttacagcaa

SEQ ID NO: 26607 - DNA, 71 bp, chicken (Gallus Gallus)
  misc_feature (36): n=a or g
caaagctcttcactccatttttaaagtcgcttaacngaaggtctataaggctctcacagctttcctagaca

SEQ ID NO: 26608 - DNA, 71 bp, chicken (Gallus Gallus)
  misc_feature (36): n=a or g
gggagaaatcaagttaacacagttcacttgaaactngattccgtgtttcacagaaccaaaactctgtcaaa

SEQ ID NO: 26609 - DNA, 71 bp, chicken (Gallus Gallus)
  misc_feature (36): n=a or g
cttttggctttatgtatttcactttgaattagggtnccaaactaggagaatgacactgcaggcttctgagg

SEQ ID NO: 26610 - DNA, 71 bp, chicken (Gallus Gallus)
  misc_feature (36): n=a or g
ctgtcctgtcaggtgccactctgcgtgttgatccgnacttccttacctcacgtacacacacagaaaggaca

SEQ ID NO: 26611 - DNA, 71 bp, chicken (Gallus Gallus)
  misc_feature (36): n=a or g
aaggaatttaagatgctcccacaacatgggaaaatnaagttcaagttgcagcacagtgcaaagcattattg

SEQ ID NO: 26612 - DNA, 71 bp, chicken (Gallus Gallus)
  misc_feature (36): n=c or t
aggtcactgagtatcttcctcaggattttctcaacntcaaggagtaaccttgagagacgttgctgctcgag

SEQ ID NO: 26613 - DNA, 71 bp, chicken (Gallus Gallus)
  misc_feature (36): n=a or g
ttttctgtttgtttttttttttttaagctaaaagcnattgatccctttctatgtaggccactccgatattt

SEQ ID NO: 26614 - DNA, 71 bp, chicken (Gallus Gallus)
  misc_feature (36): n=a or g
ctcacccagctagtgggcatcagctgacctctttgncacctgtagtgactggtcataaccattgcattcat

SEQ ID NO: 26615 - DNA, 71 bp, chicken (Gallus Gallus)
  misc_feature (36): n=g or t
agaaggaagaggggatgtctttcttttctccattgntctatagcttacatttccactaagcacctattcca

SEQ ID NO: 26616 - DNA, 71 bp, chicken (Gallus Gallus)
  misc_feature (36): n=a or g
ggaagaaagcgccagacgcaaaaataaggaaatgcnagtctgccgttcccagacagctctatggaactatt

SEQ ID NO: 26617 - DNA, 71 bp, chicken (Gallus Gallus)
  misc_feature (36): n=c or t
caatgaaaatagacacctagttttgttttctttgtngatagaagtatttcaacctctaacaggagaaaaaa

SEQ ID NO: 26618 - DNA, 71 bp, chicken (Gallus Gallus)
  misc_feature (36): n=a or g
tttatccttttctggggcaaagaggagaattagaanagtctcctaatcgaggctttctctcatattctcaa

SEQ ID NO: 26619 - DNA, 71 bp, chicken (Gallus Gallus)
  misc_feature (36): n=c or t
tggtaaggaaaaggtgtcgataagcagcaccaaatncattgtcttaaaacccaaaccagaaaaaaaagcta

SEQ ID NO: 26620 - DNA, 71 bp, chicken (Gallus Gallus)
  misc_feature (36): n=c or t
agggggatgtaggaagggtgcagtgaaccctagcanggaccgtttcatgaagacagtggactccaaagttg

SEQ ID NO: 26621 - DNA, 71 bp, chicken (Gallus Gallus)
  misc_feature (36): n=g or t
atttatgatggaaatatccaactggaatctcgatcntggtaggctaaaatccttttaattcaaaaatgtaa

SEQ ID NO: 26622 - DNA, 71 bp, chicken (Gallus Gallus)
  misc_feature (36): n=g or t
gttaaaagctcttctgcacagtacctggattagaantggtttgtatctgttagatagtatgaagtcaaaaa

SEQ ID NO: 26623 - DNA, 71 bp, chicken (Gallus Gallus)
  misc_feature (36): n=c or t
gttttctgggagaaggaagagtggatttaaatcaangatatgaaacaaaagtagcaggctacaagttgaat

SEQ ID NO: 26624 - DNA, 71 bp, chicken (Gallus Gallus)
  misc_feature (36): n=c or t
atattaacgccgagtatacatcagtctctttacagngttgctatctcggatgtctctgttctacttggcca

SEQ ID NO: 26625 - DNA, 71 bp, chicken (Gallus Gallus)
  misc_feature (36): n=c or t
aacactttaaattcttttagacaggaatccagaaangatgttaagcccattattttttatcttatcaacca

SEQ ID NO: 26626 - DNA, 71 bp, chicken (Gallus Gallus)
  misc_feature (36): n=a or c
tactttccttagagtgcaaggcagcttctagttttntgcacgttagccaagctagcaatagctactgtgat

SEQ ID NO: 26627 - DNA, 71 bp, chicken (Gallus Gallus)
  misc_feature (36): n=c or t
atacatttcttcaaatgtgtatgaaatctaatgcanaataatacaacactatattttgctcttgaatgagt

SEQ ID NO: 26628 - DNA, 71 bp, chicken (Gallus Gallus)
  misc_feature (36): n=c or t
ttagtataactgagataccttaacactgtactttcntaacagaagaatattttgtccacgtggtagagaaa

SEQ ID NO: 26629 - DNA, 71 bp, chicken (Gallus Gallus)
  misc_feature (36): n=a or g
tttacaaatgtatggcaaaatataaattacaggtgnatgccatctgcattgaccaatgactggagtcatct

SEQ ID NO: 26630 - DNA, 71 bp, chicken (Gallus Gallus)
  misc_feature (36): n=c or t
tagtgaataacctcaagaataaaatggaatcatganctgtaatttcagcttttccagtatcctgtgtaaac

SEQ ID NO: 26631 - DNA, 71 bp, chicken (Gallus Gallus)
  misc_feature (36): n=a or c
acagtctgacataatttttacagaatgatgtgtaangggacatctgaggtcacctgctccaacccctgctc

SEQ ID NO: 26632 - DNA, 71 bp, chicken (Gallus Gallus)
  misc_feature (36): n=c or t
catttttgctttttttttttctgatgaaagaaatangcattttagttacagtcaatttctgtggacataga

SEQ ID NO: 26633 - DNA, 71 bp, chicken (Gallus Gallus)
  misc_feature (36): n=a or g
agaacccacgcagcacaaagttactgagttcagtanagcagatacagaatggcatttttataaattgtctt

SEQ ID NO: 26634 - DNA, 71 bp, chicken (Gallus Gallus)
  misc_feature (36): n=a or c
taaaaagttcaaagcaattaaaagttggatatcagngaagtctttcaggaagtgcctggcagtctctaatc

SEQ ID NO: 26635 - DNA, 71 bp, chicken (Gallus Gallus)
  misc_feature (36): n=a or c
catgtggtaaattagtagtcctagtggcacaggtgnattgggaaattctgttgaaaattttgacaaatttc

SEQ ID NO: 26636 - DNA, 71 bp, chicken (Gallus Gallus)
  misc_feature (36): n=c or t
cagtctagaaggttccaggagtgtatggaagatggnttcatgacacaactggtaggagactctaccgggga

SEQ ID NO: 26637 - DNA, 71 bp, chicken (Gallus Gallus)
  misc_feature (36): n=c or t
aaaccagtaatatatccattagctgagttgagcagnaggcagaagaaattccttaatatttcccagcgaga

SEQ ID NO: 26638 - DNA, 71 bp, chicken (Gallus Gallus)
  misc_feature (36): n=a or g
cccagtcagattcaccatcagaggagcaaagtgaanagtcttcttcacttgaatagaccatatattgatac

SEQ ID NO: 26639 - DNA, 71 bp, chicken (Gallus Gallus)
  misc_feature (36): n=a or g
agggactttgtagaatgatgtctatagacaataccnactccaaactcacaaagcgacagtataaaagacag

SEQ ID NO: 26640 - DNA, 71 bp, chicken (Gallus Gallus)
  misc_feature (36): n=a or g
accagagctggtcatgcaccggtctgaggagtctanttggtggtttgattcaatcaggagttaaacacatc

SEQ ID NO: 26641 - DNA, 71 bp, chicken (Gallus Gallus)
  misc_feature (36): n=a or t
atttagttatgagaataatcacataatcaagataancagagaattcaattttgcagaaaaaaaaacttatt

SEQ ID NO: 26642 - DNA, 71 bp, chicken (Gallus Gallus)
  misc_feature (36): n=a or c
tggaaggcaagtgttaggagtgaggagttcaatgcnatgaaaccaaccataaattacagtttttggaaggt

SEQ ID NO: 26643 - DNA, 71 bp, chicken (Gallus Gallus)
  misc_feature (36): n=a or g
aattttaaagattaccagattagagactggtgagtnttgtgcttgttcattatgtgtgaggtctgcaggtt

SEQ ID NO: 26644 - DNA, 71 bp, chicken (Gallus Gallus)
  misc_feature (36): n=c or g
ggacatatgactcactacccagcagctccatacccnttactttttcctccagtcatcggtgggctgtcgct

SEQ ID NO: 26645 - DNA, 71 bp, chicken (Gallus Gallus)
  misc_feature (36): n=c or g
acttgaactttctgaggaaaaagcctatctctattntaatgccacaggtaactaggagaggacctctcagc

SEQ ID NO: 26646 - DNA, 71 bp, chicken (Gallus Gallus)
  misc_feature (36): n=a or g
tggtgcaggtactcttaagggtcctaataaggtacnggtacttacatttgttgtttgtaaaaagggagggt

SEQ ID NO: 26647 - DNA, 71 bp, chicken (Gallus Gallus)
  misc_feature (36): n=c or t
ataaaacaagcatcaccgaattacatcttcaagccnactccatatagttttgaggttgtgcttttttttct

SEQ ID NO: 26648 - DNA, 71 bp, chicken (Gallus Gallus)
  misc_feature (36): n=c or t
catgttaactcaatttctctctgtctctttgtctcngtctctgcctctttttctttctgaatgctataagg

SEQ ID NO: 26649 - DNA, 71 bp, chicken (Gallus Gallus)
  misc_feature (36): n=a or g
agcttctacttgttttaatttgattcttagtttggnaaggagtgatagataataaccttccattgggccta

SEQ ID NO: 26650 - DNA, 71 bp, chicken (Gallus Gallus)
  misc_feature (36): n=c or t
caagatgaaattatggtaagctccattttgagtgcntgaatgagactcacccagtataagaagttagatat

SEQ ID NO: 26651 - DNA, 71 bp, chicken (Gallus Gallus)
  misc_feature (36): n=c or t
agtaatctgggatcccatcaaagcaaacttctcttncaccagtgacccagggtgctactgcatcttcttgc

SEQ ID NO: 26652 - DNA, 71 bp, chicken (Gallus Gallus)
  misc_feature (36): n=a or g
gcacatgatataaatacatcctagatgaggtttacntgtgatagaaataactggaacttacagcaggttac

SEQ ID NO: 26653 - DNA, 71 bp, chicken (Gallus Gallus)
  misc_feature (36): n=c or t
actgataatggctgcaaggccaattaactgatcagncacaaatgaagcataacctggtgttctttacttgt

SEQ ID NO: 26654 - DNA, 71 bp, chicken (Gallus Gallus)
  misc_feature (36): n=c or t
tggcagacaaaccccctctctgcctaccttactttnctaggtgtttcttacatcagaggtatgaggctccg

SEQ ID NO: 26655 - DNA, 71 bp, chicken (Gallus Gallus)
  misc_feature (36): n=a or c
ccagacatcatgaggctctgctaataattttctcanccttgcccagactgtagctacatttatgatctgga

SEQ ID NO: 26656 - DNA, 71 bp, chicken (Gallus Gallus)
  misc_feature (36): n=a or g
taattcctgacactggatgttgcaaaaatgtccatnaagaggatgtatttgtaagtgaagcatacacaaga

SEQ ID NO: 26657 - DNA, 71 bp, chicken (Gallus Gallus)
  misc_feature (36): n=a or g
agcaataccaggaaaagacgacagacaacttccacntgaaagtcagagggttaccaagctttgtgactaat

SEQ ID NO: 26658 - DNA, 71 bp, chicken (Gallus Gallus)
  misc_feature (36): n=c or t
ctgtggaaataacagcacttttgtagcagtcacttncttgaatccaacatagaatttcaatttggaggaag

SEQ ID NO: 26659 - DNA, 71 bp, chicken (Gallus Gallus)
  misc_feature (36): n=a or g
tactaactaagtctctccttacccagatcttgaccntgtgctctttcatttccttgtacataaagaaggga

SEQ ID NO: 26660 - DNA, 71 bp, chicken (Gallus Gallus)
  misc_feature (36): n=c or t
acaggttgatgacctatgtctatctcatagtgaaanggcttctgtattacaaaatctatcaccacagctgg

SEQ ID NO: 26661 - DNA, 71 bp, chicken (Gallus Gallus)
  misc_feature (36): n=c or t
catacaatctgcctttgttacatcatgaacaagccnagtttatccaagctgaatcctatactaactttcct

SEQ ID NO: 26662 - DNA, 71 bp, chicken (Gallus Gallus)
  misc_feature (36): n=g or t
ctcacttattaccaatactctccaacaaacaggttngtctcctcgtagacacaacactattgcaacgcagg

SEQ ID NO: 26663 - DNA, 71 bp, chicken (Gallus Gallus)
  misc_feature (36): n=a or g
ttcagatttccatagtttcatccttgtcaccctatncatccatccatccaaaggttcctgtttctctgtcc

SEQ ID NO: 26664 - DNA, 71 bp, chicken (Gallus Gallus)
  misc_feature (36): n=a or g
ttattatgctgagggggctgaatggaagaatgcgcnttgctttgggcttctggagaaaagacctctttctg

SEQ ID NO: 26665 - DNA, 71 bp, chicken (Gallus Gallus)
  misc_feature (36): n=a or g
catgcaattcgagcagagcatggaagggctacgacnctgccaacaaacctttctccatctcctgctttttg

SEQ ID NO: 26666 - DNA, 71 bp, chicken (Gallus Gallus)
  misc_feature (36): n=a or g
tacgatagctagatcccagactgcaactcctgattncattagtaggacttgcagaggaatttaatgtggaa

SEQ ID NO: 26667 - DNA, 71 bp, chicken (Gallus Gallus)
  misc_feature (36): n=g or t
aatgaaatgttagttggtgttaatgaaaacctccantaaatccaaagcttaagctgagctgctgcttactg

SEQ ID NO: 26668 - DNA, 71 bp, chicken (Gallus Gallus)
  misc_feature (36): n=a or c
gctaaaagacagcaattttagtatcactatgttgtnctgagcagcttgccatgcagtcttcccacctcact

SEQ ID NO: 26669 - DNA, 71 bp, chicken (Gallus Gallus)
  misc_feature (36): n=c or t
tgcagtgaaataggtgatgaaagggttaaagtatgnaaaatgcattctaaaaacaattacaaaggtaaata

SEQ ID NO: 26670 - DNA, 71 bp, chicken (Gallus Gallus)
  misc_feature (36): n=c or t
tgctgctcttccatggtgaaggcagaatgaaaagtntctgttgacactattattaaaatgtagagagagag

SEQ ID NO: 26671 - DNA, 71 bp, chicken (Gallus Gallus)
  misc_feature (36): n=a or t
agttgcaagggagctcttctctctaagtacctttgnaagtacaagcagaataaatcctatgatgtattcaa

SEQ ID NO: 26672 - DNA, 71 bp, chicken (Gallus Gallus)
  misc_feature (36): n=a or g
cttctctatgtgataggacagcttcttgttctcccntgacatgttgcaagccagatgtaacaaaacgagtg

SEQ ID NO: 26673 - DNA, 71 bp, chicken (Gallus Gallus)
  misc_feature (36): n=g or t
cgctgtgaggagtcagtaaagcagtactgaatattnagctatggcaggaggagaagcctgttctgatctgt

SEQ ID NO: 26674 - DNA, 71 bp, chicken (Gallus Gallus)
  misc_feature (36): n=c or t
taaagaatagtgcatgtctgtcatttgggggatatntcagatttgctattgctggaagatatatatatata

SEQ ID NO: 26675 - DNA, 71 bp, chicken (Gallus Gallus)
  misc_feature (36): n=a or g
tgttgagagttcatcgtgtcttcctttaaccaggtnaaggtttgcccagagaagctgtgggtgccccatcc

SEQ ID NO: 26676 - DNA, 71 bp, chicken (Gallus Gallus)
  misc_feature (36): n=c or t
ccctagcctacttgctaccaaaccctttccccaggncatcctgtcctgatgctgcaaagccatatctcctg

SEQ ID NO: 26677 - DNA, 71 bp, chicken (Gallus Gallus)
  misc_feature (36): n=a or g
ccacaaccaggcgaggcaggggcactgggctccacncagctattagggctgtaacagcagtaacacacgaa

SEQ ID NO: 26678 - DNA, 71 bp, chicken (Gallus Gallus)
  misc_feature (36): n=a or t
tcagcactttggtttaacaatttgagtcagattatntttctcatgtcagttcactcttaagcccacctgaa

SEQ ID NO: 26679 - DNA, 71 bp, chicken (Gallus Gallus)
  misc_feature (36): n=c or t
agaaggaatattgcaattcaattacttattgccaangctgagagcttgatgctagcagatcattcacagcc

SEQ ID NO: 26680 - DNA, 71 bp, chicken (Gallus Gallus)
  misc_feature (36): n=c or t
gttttattcgtgagctgatctcccagttttctcttncagacctctttggtattttaggaaaattactaaat

SEQ ID NO: 26681 - DNA, 71 bp, chicken (Gallus Gallus)
  misc_feature (36): n=g or t
aagctaattaatgtgcagtgtacctgtgaatacaanaaataatgcccagctgcataataaagtgttagagg

SEQ ID NO: 26682 - DNA, 71 bp, chicken (Gallus Gallus)
  misc_feature (36): n=a or t
atgtttgtgactatagacaatggaatttatggatanggaagtttaagtgctttgctaaaagaagactgtaa

SEQ ID NO: 26683 - DNA, 71 bp, chicken (Gallus Gallus)
  misc_feature (36): n=c or t
ttagcacattcggaagaaattaaatatgtaggaatnagattcataaacagacagtaaatgaaataggatta

SEQ ID NO: 26684 - DNA, 71 bp, chicken (Gallus Gallus)
  misc_feature (36): n=c or t
gacagagcaaggactgctaattaccaacaagcaggnagcactgaagactcctcctatatgaggactagatg

SEQ ID NO: 26685 - DNA, 71 bp, chicken (Gallus Gallus)
  misc_feature (36): n=c or t
aagactccacatttacctaagcagctgagattctgncttgaagaaagccacaccaattaagtatatgtagg

SEQ ID NO: 26686 - DNA, 71 bp, chicken (Gallus Gallus)
  misc_feature (36): n=c or t
tcagacactttgaatttcctccttttttctcacttntacaaacagtgccctgaagagaagtactgtttttc

SEQ ID NO: 26687 - DNA, 71 bp, chicken (Gallus Gallus)
  misc_feature (36): n=a or g
taaaacacctactgagtttcttggattaatacagangaacagcatgtagaagaacaatttttgctatgatc

SEQ ID NO: 26688 - DNA, 71 bp, chicken (Gallus Gallus)
  misc_feature (36): n=a or g
gcctgactcccagtagcagcctaactgtttgtttcnaggggttttatttctcagaaggacttgcatctgcc

SEQ ID NO: 26689 - DNA, 71 bp, chicken (Gallus Gallus)
  misc_feature (36): n=a or g
attgaatgccatttcagggccacttcagtggaacancacatttttgggcatgctttaagtagtgtgaacac

SEQ ID NO: 26690 - DNA, 71 bp, chicken (Gallus Gallus)
  misc_feature (36): n=c or t
aaacagtcaacagtgttctttctgttcctgtgtgantattagtggggcctatctgacacaaattttatgat

SEQ ID NO: 26691 - DNA, 71 bp, chicken (Gallus Gallus)
  misc_feature (36): n=a or g
aggtcagggaacaccttgtgagaggaacagtataanacagaaattctcacacgtgctagtctctgtattcc

SEQ ID NO: 26692 - DNA, 71 bp, chicken (Gallus Gallus)
  misc_feature (36): n=c or t
ttcagtcaatagcaaatgatctgcttctcaataagntgttgctctccaggtggaagggcaagcctggtttt

SEQ ID NO: 26693 - DNA, 71 bp, chicken (Gallus Gallus)
  misc_feature (36): n=c or t
caacaaagaaagatatccgtgaacgtctctgctgtngtgaagagcgcaaatattatccagtacatcatcca

SEQ ID NO: 26694 - DNA, 71 bp, chicken (Gallus Gallus)
  misc_feature (36): n=c or t
ttccaagctttacacctggtggatgtagaagtagtngctttatgtaacttctcaatttctatttcaaaaga

SEQ ID NO: 26695 - DNA, 71 bp, chicken (Gallus Gallus)
  misc_feature (36): n=c or t
tcacatatcacacttttagacattgttccattatgntttttctctgctgcaaaactggaaaagataactta

SEQ ID NO: 26696 - DNA, 71 bp, chicken (Gallus Gallus)
  misc_feature (36): n=g or t
ggctgggggtgttttgtaattgcagtgggagttcantgcacaggcttggagatgccccagagaagattaat

SEQ ID NO: 26697 - DNA, 71 bp, chicken (Gallus Gallus)
  misc_feature (36): n=c or t
tgtttcttgtacatgcgtgttgcaaacgtgatgtgncatttttgtactgcagttgatagttttagtgagca

SEQ ID NO: 26698 - DNA, 71 bp, chicken (Gallus Gallus)
  misc_feature (36): n=c or t
tcaaaagcaaaacataaccccagtgctatgcttatngatgagcttaaatttcctggcattatatgacctaa

SEQ ID NO: 26699 - DNA, 71 bp, chicken (Gallus Gallus)
  misc_feature (36): n=a or g
taaatacgttgccatgagcaaagctttgccaaaagnaagatagctacagaacagctttgcttacccatcag

SEQ ID NO: 26700 - DNA, 71 bp, chicken (Gallus Gallus)
  misc_feature (36): n=a or g
ttatccaaggcactgtttctttctcttttgacttangtaactaatgattgttcagtagaaaggagtgtatt

SEQ ID NO: 26701 - DNA, 71 bp, chicken (Gallus Gallus)
  misc_feature (36): n=a or g
catacaaagcactacagacagaaatatccacatacnccatctgtaacatctacacagaacctgcagataaa

SEQ ID NO: 26702 - DNA, 71 bp, chicken (Gallus Gallus)
  misc_feature (36): n=c or t
ttctggagaaagcaaatctggtagttagcaccctgncccatatgcacacaaatccatgcaacacaaaacga

SEQ ID NO: 26703 - DNA, 71 bp, chicken (Gallus Gallus)
  misc_feature (36): n=g or t
cgagaaacagtcaggggaagatgaaatagttctcanttatgcagctggatttagtggaagagataggagtg

SEQ ID NO: 26704 - DNA, 71 bp, chicken (Gallus Gallus)
  misc_feature (36): n=c or t
gtggaatgacaagacaagggtggatttaaacaaatnaggaggaaattcttcacttggagggtggtgaggca

SEQ ID NO: 26705 - DNA, 71 bp, chicken (Gallus Gallus)
  misc_feature (36): n=g or t
aaaagataaagctgagaggtaatctcctaactgttnataaatacctaaagggtgggacccaagtcgatggg

SEQ ID NO: 26706 - DNA, 71 bp, chicken (Gallus Gallus)
  misc_feature (36): n=g or t
agctgtctatctacttgcccagagcccacgtgtttntatgggctgtgtgctcagaagcacctctgagacag

SEQ ID NO: 26707 - DNA, 71 bp, chicken (Gallus Gallus)
  misc_feature (36): n=c or g
gaagttaactcaatgggagaaaaatttgcttagcanctttttttatttgattcagtccccctagtttcacc

SEQ ID NO: 26708 - DNA, 71 bp, chicken (Gallus Gallus)
  misc_feature (36): n=a or g
aacactgagcacaagatagcaatgttcatgtgacanaaacaactttttctgttcaggacaaagtgtaccat

SEQ ID NO: 26709 - DNA, 71 bp, chicken (Gallus Gallus)
  misc_feature (36): n=c or t
agctcaaactaaatatggctgaggttatgggaaacnctcttacaataaaagaattcaagataactgaaaca

SEQ ID NO: 26710 - DNA, 71 bp, chicken (Gallus Gallus)
  misc_feature (36): n=c or t
actgatacaaagcagatggaattcaagtgtctttcntcagctacgcataatactgcctcagatataaagac

SEQ ID NO: 26711 - DNA, 71 bp, chicken (Gallus Gallus)
  misc_feature (36): n=c or t
ctctgttcactggcagatcatttttcagctttttcnctccctgctctcattttcttgcttttgtattgcac

SEQ ID NO: 26712 - DNA, 71 bp, chicken (Gallus Gallus)
  misc_feature (36): n=a or g
tacctcttcttcatcttccagagtcagtgctgccanttgcttagctctctgctccatcaagtttacatatc

SEQ ID NO: 26713 - DNA, 71 bp, chicken (Gallus Gallus)
  misc_feature (36): n=a or g
aacaccacataaacacaaacacccatagattagtanttaaacgtgaaggatgtttgctgggacagaaggat

SEQ ID NO: 26714 - DNA, 71 bp, chicken (Gallus Gallus)
  misc_feature (36): n=a or g
attgttgtttcataaatcatcagtcgcgaattacantctgaaattattttcttatgaatactgtctgaaac

SEQ ID NO: 26715 - DNA, 71 bp, chicken (Gallus Gallus)
  misc_feature (36): n=c or t
ctctggatgtgtgtgctctggtgttgctggtgaaanggaactatcagggtagtcctgtatgctgggcatct

SEQ ID NO: 26716 - DNA, 71 bp, chicken (Gallus Gallus)
  misc_feature (36): n=c or t
gacaacttcactttttaaaattaatagagcatccangaaaagactgcactgcagaggtaagttcatcagct

SEQ ID NO: 26717 - DNA, 71 bp, chicken (Gallus Gallus)
  misc_feature (36): n=c or t
accacacagaggtcgagctgcagccagaaaggagcngagaagttactgaattcagtgcaaggtagagctgg

SEQ ID NO: 26718 - DNA, 71 bp, chicken (Gallus Gallus)
  misc_feature (36): n=g or t
gagtgtaggaacaaccaagaagagttgcaggcatgnaaagtgcctaaagggctatgatgtcatgggcatca

SEQ ID NO: 26719 - DNA, 71 bp, chicken (Gallus Gallus)
  misc_feature (36): n=c or g
acaaggctgtctcactgttatctgattcaatgcccntttatcgggtgctttagaattaaatactgtacagt

SEQ ID NO: 26720 - DNA, 71 bp, chicken (Gallus Gallus)
  misc_feature (36): n=a or g
ataaaagtggcagatttaggatgagatagagtagtngaaaggtaagggagcatttagagcaacctaaacct

SEQ ID NO: 26721 - DNA, 71 bp, chicken (Gallus Gallus)
  misc_feature (36): n=a or g
ttacttagggaacaaacccatccaggaaaacacacnggacatcagtagatgcactcacttgctctctcaga

SEQ ID NO: 26722 - DNA, 71 bp, chicken (Gallus Gallus)
  misc_feature (36): n=c or t
agtggtggagttttcatgttgatttgtaaggcaagngtgagatgatgtattttgaagagtcctcttgagac

SEQ ID NO: 26723 - DNA, 71 bp, chicken (Gallus Gallus)
  misc_feature (36): n=c or t
ccagatgcagctgtcattgctgccacccaagtgtgnacactcatcttctaaagccttgcctgcagcaacct

SEQ ID NO: 26724 - DNA, 71 bp, chicken (Gallus Gallus)
  misc_feature (36): n=a or t
tctttcccataggaaatgctgcacgggacagcccantacaccccctgcagttatattttacacatcattac

SEQ ID NO: 26725 - DNA, 71 bp, chicken (Gallus Gallus)
  misc_feature (36): n=c or t
atcctattgcaatgagctattttgatctgaacaacncctgtcatgcctttataaagaacgtctctgtattg

SEQ ID NO: 26726 - DNA, 71 bp, chicken (Gallus Gallus)
  misc_feature (36): n=a or g
aacctacagctgtgaaggtgaaaacgtatcacaaancacttagcaaatttagcatcacctctgcaatggaa

SEQ ID NO: 26727 - DNA, 71 bp, chicken (Gallus Gallus)
  misc_feature (36): n=c or t
aatttaatatgttctagatcttcaataaaccaatangtggttaaaaccccctaagagatgcaaagttcctg

SEQ ID NO: 26728 - DNA, 71 bp, chicken (Gallus Gallus)
  misc_feature (36): n=c or t
aaccacttggcactgcctcaaaggaaagaaagaggnatgagctaatgaagcctctcgcactggtgatgtgt

SEQ ID NO: 26729 - DNA, 71 bp, chicken (Gallus Gallus)
  misc_feature (36): n=c or t
gaaaggcaaaggagccacattcagtatcagccttgnctgaactaggaaaagacatgaaacccccaagagaa

SEQ ID NO: 26730 - DNA, 71 bp, chicken (Gallus Gallus)
  misc_feature (36): n=c or g
ctggctgggaatactatatcaaatataacatccctnataatttctgcttcccgacacatgttcttcagcta

SEQ ID NO: 26731 - DNA, 71 bp, chicken (Gallus Gallus)
  misc_feature (36): n=a or t
atgacattatctatttttaatgtctgtgcaataaantttcttgatgtctgatgcaatgatggtttatcaaa

SEQ ID NO: 26732 - DNA, 71 bp, chicken (Gallus Gallus)
  misc_feature (36): n=c or t
gttggagttcaaagaatcattcattaagaacaagantcactagaaatcattgatggtttagtcctagaagt

SEQ ID NO: 26733 - DNA, 71 bp, chicken (Gallus Gallus)
  misc_feature (36): n=a or t
aaaaggtttgtcttttggaagacaaaaaatatgagngtgtcagaaaaatgagggtttggccttttacacag

SEQ ID NO: 26734 - DNA, 71 bp, chicken (Gallus Gallus)
  misc_feature (36): n=a or g
cataaaggacatggacaaaactgagcagtgctaatnaagggggcagcttcagtcacacctgctgtggatac

SEQ ID NO: 26735 - DNA, 71 bp, chicken (Gallus Gallus)
  misc_feature (36): n=c or t
ccttgggaaaatcccacagcggtcctctattatgcntttaacctgaataggaacacaaagaaccaattacg

SEQ ID NO: 26736 - DNA, 71 bp, chicken (Gallus Gallus)
  misc_feature (36): n=a or g
tctggcctcactcctatcttgcactgagtgccatgngagctgggttacatcctctacttgaagaaactgct

SEQ ID NO: 26737 - DNA, 71 bp, chicken (Gallus Gallus)
  misc_feature (36): n=c or t
gttttgtctttttgttttgttcagcactggttcacngagcttcctcctgtcttaacttttgagctgtcaag

SEQ ID NO: 26738 - DNA, 71 bp, chicken (Gallus Gallus)
  misc_feature (36): n=c or t
cttaagctcatttagtgaagcatgatattgtggtanttcctatatgacttcctatatgactctatctggca

SEQ ID NO: 26739 - DNA, 71 bp, chicken (Gallus Gallus)
  misc_feature (36): n=c or t
caatgaagaacacaaatgcaatcctttcatcatagngattatataataacttggtcctatccggagggaga

SEQ ID NO: 26740 - DNA, 71 bp, chicken (Gallus Gallus)
  misc_feature (36): n=c or t
cccctaactgttaatcaaaatcttatcattttcctngtgcattaggaagagaaacctgcagtagtctgaaa

SEQ ID NO: 26741 - DNA, 71 bp, chicken (Gallus Gallus)
  misc_feature (36): n=a or g
aatgcacaccacatataccctggattttaaaagaanaacaatgctttaggttatatttaaaccaaaacttc

SEQ ID NO: 26742 - DNA, 71 bp, chicken (Gallus Gallus)
  misc_feature (36): n=a or g
aacaagataagatccatgtatagacaatctgccacnttccttgagaatgaatttacatataaacttatttc

SEQ ID NO: 26743 - DNA, 71 bp, chicken (Gallus Gallus)
  misc_feature (36): n=a or g
gccactgaagaacagattcaatgtataacatatgantaatggcattctttaaaatacaaattaaagtgagg

SEQ ID NO: 26744 - DNA, 71 bp, chicken (Gallus Gallus)
  misc_feature (36): n=a or g
tctgactggcccaattttgcactttagtcaaggagnaatgatgcactccattagctccacttgggagaatg

SEQ ID NO: 26745 - DNA, 71 bp, chicken (Gallus Gallus)
  misc_feature (36): n=c or g
agtagtgatgcagtccaggaaactgtcacattttancccagtattggttcagtaggtcgtgacaaattttc

SEQ ID NO: 26746 - DNA, 71 bp, chicken (Gallus Gallus)
  misc_feature (36): n=c or g
ttatggaaacacatcctgaggcccaagagtcttcanacgcagtcagtgcctgagaaatttgcaaataaaga

SEQ ID NO: 26747 - DNA, 71 bp, chicken (Gallus Gallus)
  misc_feature (36): n=c or t
acttcagccttccaaaagaatttgaaaatactgganctttctgccacttgcatgcttcatatcagtttttt

SEQ ID NO: 26748 - DNA, 71 bp, chicken (Gallus Gallus)
  misc_feature (36): n=c or t
acagccctaagaaagtgctttggtctatagtcattngcttctaaaaaggtgccttaagaatgctttggttt

SEQ ID NO: 26749 - DNA, 71 bp, chicken (Gallus Gallus)
  misc_feature (36): n=c or t
tactgggtcataacttgcttaaatgcttttgtgcantgctttttcatttttagttttcttaaggtttttga

SEQ ID NO: 26750 - DNA, 71 bp, chicken (Gallus Gallus)
  misc_feature (36): n=c or g
ttggtcatttcaaaagacattccctgttcttccttntgtaggagttagttgtgatacgtgcataggtcaca

SEQ ID NO: 26751 - DNA, 71 bp, chicken (Gallus Gallus)
  misc_feature (36): n=c or t
gaaatgctatggaatcgtactcttatttacttagcnaagcttctaccgaaaaaaaaaaaaaatggaaatag

SEQ ID NO: 26752 - DNA, 71 bp, chicken (Gallus Gallus)
  misc_feature (36): n=c or t
atgactttgacctccatagctctactgcctgaagtnttttactgtgaacatataatgtgtataatatgtta

SEQ ID NO: 26753 - DNA, 71 bp, chicken (Gallus Gallus)
  misc_feature (36): n=a or g
agttaaaggaagacctttctttgatctgaaaaatantgcagttgcacacaaaactacataacagattgtgc

SEQ ID NO: 26754 - DNA, 71 bp, chicken (Gallus Gallus)
  misc_feature (36): n=c or t
ggcaaataatgactatccaagttcaagcttgacaangaaccaaaaagaacaaatttagataaagtaaagtc

SEQ ID NO: 26755 - DNA, 71 bp, chicken (Gallus Gallus)
  misc_feature (36): n=a or g
ttttagcacttcaaaagaacattacttacatcatcntcatcatcttcaatagcttctcctgtgaagtacaa

SEQ ID NO: 26756 - DNA, 71 bp, chicken (Gallus Gallus)
  misc_feature (36): n=a or g
aatctgtggtaatattcacataaaacgtgagggggnaaaaaaagagtgatctggagcatagtggttttaag

SEQ ID NO: 26757 - DNA, 71 bp, chicken (Gallus Gallus)
  misc_feature (36): n=g or t
agactactttaggaggagagaggaaccaaagagttntcagcctagttttggaaagatagtgctgtccatat

SEQ ID NO: 26758 - DNA, 71 bp, chicken (Gallus Gallus)
  misc_feature (36): n=c or t
aaatctgcgtttccttgtttttactcctgatgcaangtcaacaatttctggttttctcttgtaggctgaac

SEQ ID NO: 26759 - DNA, 71 bp, chicken (Gallus Gallus)
  misc_feature (36): n=a or g
taaatgtcagctgatggtcacagctgaaacatgcancaactctgacagaccacgagctccattcagaggac

SEQ ID NO: 26760 - DNA, 71 bp, chicken (Gallus Gallus)
  misc_feature (36): n=a or g
attcttatgtcagtatgacattctttagtcagtgtntatttctggcatgaaatctgaagtttatcaggttt

SEQ ID NO: 26761 - DNA, 71 bp, chicken (Gallus Gallus)
  misc_feature (36): n=c or t
atgtctaaactgatctattaaagtaatttgcctttnctgagctgattttaccttttttgtaattttatctt

SEQ ID NO: 26762 - DNA, 71 bp, chicken (Gallus Gallus)
  misc_feature (36): n=c or t
ttaagcccctaactgtacccctactctttaagatantgtgtgataccttaaaggcatatgagttgtctgct

SEQ ID NO: 26763 - DNA, 71 bp, chicken (Gallus Gallus)
  misc_feature (36): n=a or t
agaagcatttcaaatggaaagtgcaacaaaatctcnctttgacatggaaattttccttacattgtttttct

SEQ ID NO: 26764 - DNA, 71 bp, chicken (Gallus Gallus)
  misc_feature (36): n=a or g
gctaaaacttaagagataaactacataaatgacatnaaagcttttgaaggactattggtaaagctcacaaa

SEQ ID NO: 26765 - DNA, 71 bp, chicken (Gallus Gallus)
  misc_feature (36): n=a or g
ttggtaagtaatatgattggtctgcgactacatctnaaaagttcccccattcatatggacggatgcagtaa

SEQ ID NO: 26766 - DNA, 71 bp, chicken (Gallus Gallus)
  misc_feature (36): n=c or t
aatttttcaaatgaaatttaaagtacttggatctcngattaacaattatcttttttgctgtggggtctcat

SEQ ID NO: 26767 - DNA, 71 bp, chicken (Gallus Gallus)
  misc_feature (36): n=a or g
tttttttttttttggcatttccagtagaatgtcccntatagtagatctccttctttaccacatgtgaaatg

SEQ ID NO: 26768 - DNA, 71 bp, chicken (Gallus Gallus)
  misc_feature (36): n=a or c
gtgaaataatatatctttctagatttttttccccantttttagaaatagtgaggtttttttctggatattc

SEQ ID NO: 26769 - DNA, 71 bp, chicken (Gallus Gallus)
  misc_feature (36): n=c or t
aaagtcattaggttaatgatagaaaactctgctttngagacaaaacaatttacaggagcaatatggtttct

SEQ ID NO: 26770 - DNA, 71 bp, chicken (Gallus Gallus)
  misc_feature (36): n=a or g
tatccacagccatcatctttttgttcattttccctncagaaataaagaatcttaatgacaaaaagcctttt

SEQ ID NO: 26771 - DNA, 71 bp, chicken (Gallus Gallus)
  misc_feature (36): n=c or g
gattaaaactgttttattattgtgcatatttactantgaaacatacatacctgaaaaggcaaagaattata

SEQ ID NO: 26772 - DNA, 71 bp, chicken (Gallus Gallus)
  misc_feature (36): n=c or t
aagaataggatttaatctctgtctcttaaatccacngtcctactcaagggaaaaatcactctaaataacct

SEQ ID NO: 26773 - DNA, 71 bp, chicken (Gallus Gallus)
  misc_feature (36): n=a or g
taaactatcattacatcagaaattgagggctatacntacatggatgcacatcagaatcctcagtcttccca

SEQ ID NO: 26774 - DNA, 71 bp, chicken (Gallus Gallus)
  misc_feature (36): n=a or g
ttgacagaaaattccctgcttttacagcctggcccnctaaatcttgaacctgcattaccgctatttgtatt

SEQ ID NO: 26775 - DNA, 71 bp, chicken (Gallus Gallus)
  misc_feature (36): n=a or g
cttttgctggtgtgactgcatctgaagtaaaagttnttattgcctctgtgactgaattaaattggtgtaaa

SEQ ID NO: 26776 - DNA, 71 bp, chicken (Gallus Gallus)
  misc_feature (36): n=c or t
gctctagctgtgctaactggtacaagccagaaccangctggggccatgctaatgaaccaatcctgcctaaa

SEQ ID NO: 26777 - DNA, 71 bp, chicken (Gallus Gallus)
  misc_feature (36): n=a or g
ttttggaggctgattgtaatagctgctgaataaacntatttaaaatgctaacggctggtatgtagtctttc

SEQ ID NO: 26778 - DNA, 71 bp, chicken (Gallus Gallus)
  misc_feature (36): n=g or t
agtgtgtgcattattgtaacctttggcaaaagcatncaggtattgcattaaaaatgctacacggaacctgc

SEQ ID NO: 26779 - DNA, 71 bp, chicken (Gallus Gallus)
  misc_feature (36): n=c or t
cagataagaaaataaaactgcacacaactgagttanagttattatttaaactgactgtaggagtaataatt

SEQ ID NO: 26780 - DNA, 71 bp, chicken (Gallus Gallus)
  misc_feature (36): n=c or t
tgcataaaacatgattaacctacagatatagcattnttctttacagttgcttaaaaagcaagagccatgac

SEQ ID NO: 26781 - DNA, 71 bp, chicken (Gallus Gallus)
  misc_feature (36): n=a or g
atggctaaccttgttttttgtgctctcactgcatcnctgctgctgctgtgtcttactgctcatatatgttt

SEQ ID NO: 26782 - DNA, 71 bp, chicken (Gallus Gallus)
  misc_feature (36): n=c or t
caaaccacagcacaaggtgtatgacatgcatcaganggcagcagctgcacagggaaagggtttgagcccca

SEQ ID NO: 26783 - DNA, 71 bp, chicken (Gallus Gallus)
  misc_feature (36): n=a or g
aagactcagtatacccatcagctacccttcaccccntcccccttaaagagcaatgcatgtatttgtcatct

SEQ ID NO: 26784 - DNA, 71 bp, chicken (Gallus Gallus)
  misc_feature (36): n=c or t
ttaagcttttccacttgaaagcaaaatactttttanatgcagtttaagtagtaacagtttacaaaactgca

SEQ ID NO: 26785 - DNA, 71 bp, chicken (Gallus Gallus)
  misc_feature (36): n=c or t
aaagtaacaagacagaatctgcaattgggatgaaanatgattttttaaaaactttcttgcaacaaacttac

SEQ ID NO: 26786 - DNA, 71 bp, chicken (Gallus Gallus)
  misc_feature (36): n=c or t
aactctgaatttatgggcagacttttgtctacagangagaataagtagtcagccagtatctatgaatgact

SEQ ID NO: 26787 - DNA, 71 bp, chicken (Gallus Gallus)
  misc_feature (36): n=a or g
agggacagttacaaaaaatgtgtttcagtcacaccnctcctttctaacctcctgacccctggatcaggggg

SEQ ID NO: 26788 - DNA, 71 bp, chicken (Gallus Gallus)
  misc_feature (36): n=c or t
tggaaagagggctaataaaaccttgagactgtcttncgtagatttgttttggctattcatggttttagaac

SEQ ID NO: 26789 - DNA, 71 bp, chicken (Gallus Gallus)
  misc_feature (36): n=a or g
aacagtcatgtagtgaaaaatagtaaaactggtttnaaagactacacgtaaagagctgctttgatcaagca

SEQ ID NO: 26790 - DNA, 71 bp, chicken (Gallus Gallus)
  misc_feature (36): n=c or t
atggttttaaatcatttcagcagatatttgaacacngcctcagacaggcaccaaaactgtaattgttacta

SEQ ID NO: 26791 - DNA, 71 bp, chicken (Gallus Gallus)
  misc_feature (36): n=g or t
gaaatgcagtgcatgtggtttcagacggaatgtgcncaggcttacaaagcaatgaataaatttggagaagc

SEQ ID NO: 26792 - DNA, 71 bp, chicken (Gallus Gallus)
  misc_feature (36): n=a or c
tctttcacatctattgaagcctgggaggtgtgttgnaggttagaaggtgctgaggcagcagcttccccaaa

SEQ ID NO: 26793 - DNA, 71 bp, chicken (Gallus Gallus)
  misc_feature (36): n=c or t
tgttactgtgctccttctggtcgtttctgtggaaanaaataggaggcattacttttggagcaacttgtgta

SEQ ID NO: 26794 - DNA, 71 bp, chicken (Gallus Gallus)
  misc_feature (36): n=a or g
agcactaacttcaacagaacatggaatgagtacaancacggctttggaaacctcagcagggagttttggct

SEQ ID NO: 26795 - DNA, 71 bp, chicken (Gallus Gallus)
  misc_feature (36): n=a or g
gcatggctggagagcaggaatttgtttatcagagcngttgcctcctgtgataagacgtgctctactttccc

SEQ ID NO: 26796 - DNA, 71 bp, chicken (Gallus Gallus)
  misc_feature (36): n=a or g
gtagttcaaacacatctgccctttggcttgtttctntgagctaagccattcagtgaatttggcttgtgtgt

SEQ ID NO: 26797 - DNA, 71 bp, chicken (Gallus Gallus)
  misc_feature (36): n=c or t
tttgcttaataactggaatcaaagtcacacccaaangtatccctggtttgcattactattatcaataaaca

SEQ ID NO: 26798 - DNA, 71 bp, chicken (Gallus Gallus)
  misc_feature (36): n=a or g
tgctccagcagggttcttactgttggggtctagctnaacaactactgtgtatgacaaaggaaaccagtctt

SEQ ID NO: 26799 - DNA, 71 bp, chicken (Gallus Gallus)
  misc_feature (36): n=g or t
tttgaggtaggtacgtgataaagctttatataaacnactaaaattacaaccatttgaattaggcagaatgc

SEQ ID NO: 26800 - DNA, 71 bp, chicken (Gallus Gallus)
  misc_feature (36): n=a or g
ccatcgttttgtgttttcctctaattgctgatagangaccgcctggttctgttagcagatacagctgcaga

SEQ ID NO: 26801 - DNA, 71 bp, chicken (Gallus Gallus)
  misc_feature (36): n=a or g
tctatagcttttatttcataattttaacagcccagncagtccttttgaatttcagtaatgcagcattactg

SEQ ID NO: 26802 - DNA, 71 bp, chicken (Gallus Gallus)
  misc_feature (36): n=c or t
atacttcacccagaggaacagagtacaaacaagtgntaacttaaaagaagcctgacctgaagacagtatgc

SEQ ID NO: 26803 - DNA, 71 bp, chicken (Gallus Gallus)
  misc_feature (36): n=a or g
aagcaaagcaaactcaggatgctactgagaggagcncaggacaggaatcttggcaaaccacagaactacag

SEQ ID NO: 26804 - DNA, 71 bp, chicken (Gallus Gallus)
  misc_feature (36): n=c or t
tcagaaaatagtcttatgcaagtactctgtagtttnattaactacctgtaaaatggttgagaggtgtgaaa

SEQ ID NO: 26805 - DNA, 71 bp, chicken (Gallus Gallus)
  misc_feature (36): n=g or t
ccactgtctcctgtgggttctgagacttccaaagcnagtccagacaggaagtatgagaagaagatactgaa

SEQ ID NO: 26806 - DNA, 71 bp, chicken (Gallus Gallus)
  misc_feature (36): n=c or g
tttattggtctgtgtggtaggaatgtgcagaagcanatacaggcacagttatcatccagttcagttttgat

SEQ ID NO: 26807 - DNA, 71 bp, chicken (Gallus Gallus)
  misc_feature (36): n=a or c
ctacaactttggttgaaaaatcccatgtagcatccnaaacctttgtttgaactccagtccttttgtaccct

SEQ ID NO: 26808 - DNA, 71 bp, chicken (Gallus Gallus)
  misc_feature (36): n=c or t
ctctagtctttgacttttcagttgctgtcccttagnggagggttttccagccgcatggataagtgaaggat

SEQ ID NO: 26809 - DNA, 71 bp, chicken (Gallus Gallus)
  misc_feature (36): n=c or t
aaaatcaacctatttatcttccttattgttctcacnagctaacagctactggaacccagggaattcgactg

SEQ ID NO: 26810 - DNA, 71 bp, chicken (Gallus Gallus)
  misc_feature (36): n=a or g
tgaggcttatggtcagaacacagcagtttgtctgcnctgctccttcttcctcacactttcctctggctgca

SEQ ID NO: 26811 - DNA, 71 bp, chicken (Gallus Gallus)
  misc_feature (36): n=a or g
tctatatccagaggaataatcaggcaaaatgttacngcctgagacagagatcttgccttgcctcacccctc

SEQ ID NO: 26812 - DNA, 71 bp, chicken (Gallus Gallus)
  misc_feature (36): n=c or t
aaacaaaatctctgctctcaaatcctcaggccttgntcttcacacttgccagcaagcagcgcatgcaaatc

SEQ ID NO: 26813 - DNA, 71 bp, chicken (Gallus Gallus)
  misc_feature (36): n=a or g
ttattaaaacctacatctcctttttaaaacaaaacntaattgaaatcagctagaggaacgtttcatttctc

SEQ ID NO: 26814 - DNA, 71 bp, chicken (Gallus Gallus)
  misc_feature (36): n=a or g
agcaattgcttaggtattttctccagagagaacacntcagaaaaatgaaataattatgtaattgaatcaag

SEQ ID NO: 26815 - DNA, 71 bp, chicken (Gallus Gallus)
  misc_feature (36): n=a or g
ctcatggcccctgttgctggcttatggctctccgcngagatgcagaggtatgggtcactattcaaagctct

SEQ ID NO: 26816 - DNA, 71 bp, chicken (Gallus Gallus)
  misc_feature (36): n=a or g
atgtaagtcttagcaaatgagcactctgcaataacntttttagcaatgtcagtaatttaaaacgcatttct

SEQ ID NO: 26817 - DNA, 71 bp, chicken (Gallus Gallus)
  misc_feature (36): n=a or c
aatttacatctaaagatctcaaagggcttgagaaanaattcggtcttaaagagctaactaaaacaccatca

SEQ ID NO: 26818 - DNA, 71 bp, chicken (Gallus Gallus)
  misc_feature (36): n=c or t
agtaaaaatatctcagccaaaacagtgaaaatttanagatgtaaggaagagtttaaggtggacatttaggc

SEQ ID NO: 26819 - DNA, 71 bp, chicken (Gallus Gallus)
  misc_feature (36): n=c or t
tgctgcatgtatgcctatgtccactcttgtaccttnccagccttcatcccctgacttaactttccaacttg

SEQ ID NO: 26820 - DNA, 71 bp, chicken (Gallus Gallus)
  misc_feature (36): n=g or t
acacttacacaagttatttattgccttcagtactcntccaatatctgtagtatcctttcaatgttttccat

SEQ ID NO: 26821 - DNA, 71 bp, chicken (Gallus Gallus)
  misc_feature (36): n=c or g
ctttagacatctctttcaaactctcctctagagtanagactttcccccatggcttcccttgcactcccttg

SEQ ID NO: 26822 - DNA, 71 bp, chicken (Gallus Gallus)
  misc_feature (36): n=c or t
cctttcctggggtctcagtaggtgacactgcaaagnatggagctgcctgtttctggttgaaactgcattac

SEQ ID NO: 26823 - DNA, 71 bp, chicken (Gallus Gallus)
  misc_feature (36): n=a or g
tcccgcttcaataacacccctgcattattaaggttntttgaaagaaaaccctaaacaagtatttttacttg

SEQ ID NO: 26824 - DNA, 71 bp, chicken (Gallus Gallus)
  misc_feature (36): n=a or c
tcttcttctagttggtctgctcctacacactttacnctagcaaattcatcttgaataatagaagttttgca

SEQ ID NO: 26825 - DNA, 71 bp, chicken (Gallus Gallus)
  misc_feature (36): n=a or g
cagagctttgtcttcctgccaaaaactctaccttcnttctcacccccttaatctgtagtttcttcagagat

SEQ ID NO: 26826 - DNA, 71 bp, chicken (Gallus Gallus)
  misc_feature (36): n=a or g
ttacaacttcctcaagcctctcagtgccttgtcccnaccacctaatactctttcctcacattccaaaatgc

SEQ ID NO: 26827 - DNA, 71 bp, chicken (Gallus Gallus)
  misc_feature (36): n=c or t
tttattcagacacaaaaagaactgtgtttcccctcnatgcttgaagagaaaccaggcaccatcacggtgct

SEQ ID NO: 26828 - DNA, 71 bp, chicken (Gallus Gallus)
  misc_feature (36): n=a or t
gatggaaagataggttttccaagcaacatggaaatnttatacaatctccttaaacgtgcacttttggtaag

SEQ ID NO: 26829 - DNA, 71 bp, chicken (Gallus Gallus)
  misc_feature (36): n=c or t
tttatggtggagttctcttttctctatgatgcctcngtggccttctccttagagaaagggtttctacattt

SEQ ID NO: 26830 - DNA, 71 bp, chicken (Gallus Gallus)
  misc_feature (36): n=c or t
ctcatcatctgagcacagagagacagcattccctanaaatgttgacccctgatccaccaggtggcttggtg

SEQ ID NO: 26831 - DNA, 71 bp, chicken (Gallus Gallus)
  misc_feature (36): n=a or g
taacatagtagctaaaagacactatacttttatacnaagtgctacttcactgagctacttatgagaatgta

SEQ ID NO: 26832 - DNA, 71 bp, chicken (Gallus Gallus)
  misc_feature (36): n=c or t
atttaagtcatgtcctatatgaggaattgttgcagnaagttgcagagaagtgattcatgtactgcactgtc

SEQ ID NO: 26833 - DNA, 71 bp, chicken (Gallus Gallus)
  misc_feature (36): n=a or g
gcatagagacgccgtgaacgttggatgtagatctcnatgttcttcttctccagcgaggcgtagagctcctc

SEQ ID NO: 26834 - DNA, 71 bp, chicken (Gallus Gallus)
  misc_feature (36): n=g or t
aaatgtcaagttgtagatcttcaaaaatcatacctncaaagtgtttaaattctgctatgttttctctttga

SEQ ID NO: 26835 - DNA, 71 bp, chicken (Gallus Gallus)
  misc_feature (36): n=c or t
tttccaggtcggtgccaggcagtgggttgtgcaaanttcacttactacagctacatcagagggtgaaggaa

SEQ ID NO: 26836 - DNA, 71 bp, chicken (Gallus Gallus)
  misc_feature (36): n=a or g
gtgcaagtacaacacttcgagacatctctggttgcntccaggatttaccaacaagaatttagtgaatccta

SEQ ID NO: 26837 - DNA, 71 bp, chicken (Gallus Gallus)
  misc_feature (36): n=a or g
atcagagacaaaggatgaacaggaaatacccatggngtaaggaaggctgctcaaggactgaaaagcatgcc

SEQ ID NO: 26838 - DNA, 71 bp, chicken (Gallus Gallus)
  misc_feature (36): n=a or g
aggctgaactaacatgctgctgaagagagtcctaantgagctggaaaaaagatgcaagtaggaaaaagggc

SEQ ID NO: 26839 - DNA, 71 bp, chicken (Gallus Gallus)
  misc_feature (36): n=a or g
aagcaagagaagggtgcattaaaattccacgtgtgnctggctgttctctactgttgttctgtttaggacag

SEQ ID NO: 26840 - DNA, 71 bp, chicken (Gallus Gallus)
  misc_feature (36): n=a or g
gggctcactgtatttggacttggtgtgtgtgctacngtagcactcagtgtctgaaagagaagactcagtgg

SEQ ID NO: 26841 - DNA, 71 bp, chicken (Gallus Gallus)
  misc_feature (36): n=a or g
tatctgatgcatgagtctagtcaggttaccaccacngagtttacaccactgtgtttctggaatgatttttg

SEQ ID NO: 26842 - DNA, 71 bp, chicken (Gallus Gallus)
  misc_feature (36): n=c or t
gtatttatctgatgagagctgatgttgtttgtgtgngtgtttaaagtaagcctatcctatgttctgagatt

SEQ ID NO: 26843 - DNA, 71 bp, chicken (Gallus Gallus)
  misc_feature (36): n=c or t
gttaacattttataagccacaaagccctgtagagancaacaagatccttctgcaatggaacttatctcaca

SEQ ID NO: 26844 - DNA, 71 bp, chicken (Gallus Gallus)
  misc_feature (36): n=a or t
acagaactacttaccactgggtttttggattgaggncgtgattcaattacccatgtaacaccttgttgaag

SEQ ID NO: 26845 - DNA, 71 bp, chicken (Gallus Gallus)
  misc_feature (36): n=c or t
tgtacagtttattttctggtcctacttatgcaagcngctttatacaagataacagaaaaatatttattcta

SEQ ID NO: 26846 - DNA, 71 bp, chicken (Gallus Gallus)
  misc_feature (36): n=a or g
tcacggaaaaaggtgactacaggatgggaaatgacnatgtaagagcaagggagggggggaaaaaaccaaag

SEQ ID NO: 26847 - DNA, 71 bp, chicken (Gallus Gallus)
  misc_feature (36): n=a or g
aatggtaaatataaaagcaattttctactttctaantgatgtgatccaaaccaggagttgaacataacctg

SEQ ID NO: 26848 - DNA, 71 bp, chicken (Gallus Gallus)
  misc_feature (36): n=c or t
ggttcacttctattatttgttaaagggagttcctgngaacaacagattgcatatttcaggataagcaaagt

SEQ ID NO: 26849 - DNA, 71 bp, chicken (Gallus Gallus)
  misc_feature (36): n=a or g
gcagtaatggctgttatgtacttttataatatggcntttattaaagcgtaagcaggcaaacgtattgaata

SEQ ID NO: 26850 - DNA, 71 bp, chicken (Gallus Gallus)
  misc_feature (36): n=g or t
agcacatgaataagacgtgtctgtgaagctagaatntttttttctggtaagtggagtaaatcagcgctgtt

SEQ ID NO: 26851 - DNA, 71 bp, chicken (Gallus Gallus)
  misc_feature (36): n=a or g
acatggtcgtgaagggaactgcctctatcttgccantgggattatacattcttaaggcatcttataagctc

SEQ ID NO: 26852 - DNA, 71 bp, chicken (Gallus Gallus)
  misc_feature (36): n=c or t
catccacaataaatatggcaaagatctttatctagncattttgggaacattacctctcatttgcccagaga

SEQ ID NO: 26853 - DNA, 71 bp, chicken (Gallus Gallus)
  misc_feature (36): n=c or t
agtgacagttcccaagtgagtatgaaggatgaacangtctcagcagatgtcactggggtgtctctgtgcac

SEQ ID NO: 26854 - DNA, 71 bp, chicken (Gallus Gallus)
  misc_feature (36): n=a or g
ccacgtccctttgccctagtttccacgaacaagacngtagcagaagtctcttgtagtgacatttctccacc

SEQ ID NO: 26855 - DNA, 71 bp, chicken (Gallus Gallus)
  misc_feature (36): n=c or t
ctgcaacctgatatagaaaatctaccattataatangagattacttctgcttaatcctctgtgctctgagt

SEQ ID NO: 26856 - DNA, 71 bp, chicken (Gallus Gallus)
  misc_feature (36): n=a or g
ctggagaactcctccagtagatgaaaatatcccatnttatttctgcatttctatcataagcacactccaca

SEQ ID NO: 26857 - DNA, 71 bp, chicken (Gallus Gallus)
  misc_feature (36): n=a or g
atggcagggttgccaaccactagatcaggctgcccntgatcccatcctacttgactttgcttccagaggtt

SEQ ID NO: 26858 - DNA, 71 bp, chicken (Gallus Gallus)
  misc_feature (36): n=c or t
tgcaccttcccagggcatggcgaaggctcccattcngtagctgtttgggaatggttcccctaaggagctgg

SEQ ID NO: 26859 - DNA, 71 bp, chicken (Gallus Gallus)
  misc_feature (36): n=g or t
ggaagagcatgcttcagaaacaactcagaactcaanatcttaccacttgacttaatattgaagtcttaaaa

SEQ ID NO: 26860 - DNA, 71 bp, chicken (Gallus Gallus)
  misc_feature (36): n=c or g
ttagtacaaagtccagcagcttagcttgaatagtcntctctgacaatttcagctaagctattggactttgc

SEQ ID NO: 26861 - DNA, 71 bp, chicken (Gallus Gallus)
  misc_feature (36): n=a or g
ctgatctggcgggtggcaacattgtccacaaaacanacattggaagtgaatgttcgttaaggttccttctg

SEQ ID NO: 26862 - DNA, 71 bp, chicken (Gallus Gallus)
  misc_feature (36): n=a or c
gctccataacctcctgtgacactaaggtcaggctgncaggactgcatttccctggatccttctcagcatcc

SEQ ID NO: 26863 - DNA, 71 bp, chicken (Gallus Gallus)
  misc_feature (36): n=c or t
ccgcatctgcttaaagctgcatttatgcaatcctgntgagaaattccagcgaggaatcttgtcttgagtct

SEQ ID NO: 26864 - DNA, 71 bp, chicken (Gallus Gallus)
  misc_feature (36): n=a or c
tctcaagctgtagttagtcttttcgtagccagtcanctttgtacaatggtgggcatcattcttactgaaga

SEQ ID NO: 26865 - DNA, 71 bp, chicken (Gallus Gallus)
  misc_feature (36): n=a or g
gtgtcacgaccccaggcagggacatgggtttaaccncgtgtcatcaattaaggaaacatctcagcagcttg

SEQ ID NO: 26866 - DNA, 71 bp, chicken (Gallus Gallus)
  misc_feature (36): n=c or t
ggcgtttgactcagtgatttaaaacacctgggcttnttcagagagcctataaactgattggaaattgcaag

SEQ ID NO: 26867 - DNA, 71 bp, chicken (Gallus Gallus)
  misc_feature (36): n=c or t
atagccagctgaagggtaatgaatgtcaaggacatnaaggcgaaaaaggaaacacgtggatgcgaactggc

SEQ ID NO: 26868 - DNA, 71 bp, chicken (Gallus Gallus)
  misc_feature (36): n=a or g
gtgtttcaacacagcacaatgagaagaaagttgttngaacaccctgggacaagaacagcccactgtctaca

SEQ ID NO: 26869 - DNA, 71 bp, chicken (Gallus Gallus)
  misc_feature (36): n=a or g
tttctttttttccttagctttataagttagtcagcngagagtttaatgtcagaagtttctactttaatcaa

SEQ ID NO: 26870 - DNA, 71 bp, chicken (Gallus Gallus)
  misc_feature (36): n=a or g
caatatatttttgttcctaatgttaagtattcatantgttcagtctctctattggagcatttggaagagct

SEQ ID NO: 26871 - DNA, 71 bp, chicken (Gallus Gallus)
  misc_feature (36): n=c or g
tatgcttttgaagaatacttaaaggaattcttgtcntcagtgacaggtgaagtcaggattaaaagctttaa

SEQ ID NO: 26872 - DNA, 71 bp, chicken (Gallus Gallus)
  misc_feature (36): n=a or g
cacacccttttctactgtattatacctctgctacangaatgctggtgcgtaaggaaacagcctatcaatca

SEQ ID NO: 26873 - DNA, 71 bp, chicken (Gallus Gallus)
  misc_feature (36): n=a or c
aagagagagacatgtgacttgatagagaagatgtanctctgccaatgggctagccagcctgatgagaagaa

SEQ ID NO: 26874 - DNA, 71 bp, chicken (Gallus Gallus)
  misc_feature (36): n=a or g
aggaagcaccacaagcttcttttacaatgaaacctntgagacaaaagctaagagaaaaggtatttctctaa

SEQ ID NO: 26875 - DNA, 71 bp, chicken (Gallus Gallus)
  misc_feature (36): n=a or g
taattcatctgtggagttgctccatagaacttaacntggctgaggattgattcatagccaaacagagcctg

SEQ ID NO: 26876 - DNA, 71 bp, chicken (Gallus Gallus)
  misc_feature (36): n=a or g
aggtattattttctttgttaactagaaaaatgtagngtctctctcataagttataacttcctaaatagaac

SEQ ID NO: 26877 - DNA, 71 bp, chicken (Gallus Gallus)
  misc_feature (36): n=a or g
tattacttaaatcagcataagctagctctcattacncaatgattggaaagtatacagaaaaaacacgcatt

SEQ ID NO: 26878 - DNA, 71 bp, chicken (Gallus Gallus)
  misc_feature (36): n=a or g
atgaatgccatttttagcaagaaaaattttgagacnctctcagaggccttcagcgttgcttgtgccgcggg

SEQ ID NO: 26879 - DNA, 71 bp, chicken (Gallus Gallus)
  misc_feature (36): n=g or t
aacaatgagagcagatcagctctgtggagtatgttntacagtgctttggctcctaactgcagctcacaagc

SEQ ID NO: 26880 - DNA, 71 bp, chicken (Gallus Gallus)
  misc_feature (36): n=c or t
acttcacagaaattcccagtgctgaaaataattagnagatgtgtgttatgatacccagcagggaattaatg

SEQ ID NO: 26881 - DNA, 71 bp, chicken (Gallus Gallus)
  misc_feature (36): n=a or g
ggatgatggagtagaatcgcattatattcattccantgccatctccttagaaaggtgtaggtgaatagatt

SEQ ID NO: 26882 - DNA, 71 bp, chicken (Gallus Gallus)
  misc_feature (36): n=a or g
ccgaaaaaggtgatcttaagcatatgaagtaccagnaacacctatttcaggtagcaaattaggaatctgtg

SEQ ID NO: 26883 - DNA, 71 bp, chicken (Gallus Gallus)
  misc_feature (36): n=a or g
aaatttaattaattttatggaagtttcagagcttcntaatagaataaatctcttgtgtgaaatatttaggt

SEQ ID NO: 26884 - DNA, 71 bp, chicken (Gallus Gallus)
  misc_feature (36): n=a or c
caaggcatccggacaggcgtggagatttcagatacntgtcacaaaggttatctgcatctgtcttgtcaggg

SEQ ID NO: 26885 - DNA, 71 bp, chicken (Gallus Gallus)
  misc_feature (36): n=a or t
cctccaacctaagccattctgtggaaaaaaaaaaangtttttaaaagctgcctatgaataaaggaaactct

SEQ ID NO: 26886 - DNA, 71 bp, chicken (Gallus Gallus)
  misc_feature (36): n=a or c
ccaaggtttgaaagaactgaggagaatcacagctcnaactgaatgggaacaatcactgattctatttttct

SEQ ID NO: 26887 - DNA, 71 bp, chicken (Gallus Gallus)
  misc_feature (36): n=a or g
gcacgggtacaggttgagacatgaaggaaggaaagnagcctctgttttctcttcttaagttcctctgggtt

SEQ ID NO: 26888 - DNA, 71 bp, chicken (Gallus Gallus)
  misc_feature (36): n=c or g
tttggtgcaactgtacaatactcaattcttctcaantctgatgaggatcaggttcagaggattagtctgga

SEQ ID NO: 26889 - DNA, 71 bp, chicken (Gallus Gallus)
  misc_feature (36): n=c or t
ggtcacatctcttaactagttttttataagatctancctgacagaaaaaaaatatctctcacttcataatc

SEQ ID NO: 26890 - DNA, 71 bp, chicken (Gallus Gallus)
  misc_feature (36): n=c or t
ttcaactttttctacaagtaatttgtaccacagcantaataaaaatttctaaagtgactactgaacaggat

SEQ ID NO: 26891 - DNA, 71 bp, chicken (Gallus Gallus)
  misc_feature (36): n=c or t
tttcacatgaggtgaaccatgacatgaactctaccncctcccttccagtcaaaccatcaatttgtcctgga

SEQ ID NO: 26892 - DNA, 71 bp, chicken (Gallus Gallus)
  misc_feature (36): n=c or t
ttttttttttttcttttctatttaaagaattactgncttcataaaaatagcaggtaatgcaattgtctaaa

SEQ ID NO: 26893 - DNA, 71 bp, chicken (Gallus Gallus)
  misc_feature (36): n=c or t
catttaacatttttttaccaactataaattgtctcnggcaatactgaaatgcaggacactctttaccctct

SEQ ID NO: 26894 - DNA, 71 bp, chicken (Gallus Gallus)
  misc_feature (36): n=a or t
ttacttactgaatgatttttcttccagcacactggnaatactactacgcttactacatcactactactact

SEQ ID NO: 26895 - DNA, 71 bp, chicken (Gallus Gallus)
  misc_feature (36): n=a or c
cacagagggaaataaaaatgcaagaaatttgcttgnatagggtgttgaggaaacagcatgtttcttggtgt

SEQ ID NO: 26896 - DNA, 71 bp, chicken (Gallus Gallus)
  misc_feature (36): n=a or g
ggaatcgggatgggccagctgagcaaacatcagagnctctcagataacaaatagaaaagcaaaaacttctc

SEQ ID NO: 26897 - DNA, 71 bp, chicken (Gallus Gallus)
  misc_feature (36): n=a or g
tttatccatcacagaacaaccaagatttgttagaancatgcctgtaatgacaagtaaatacattctctctt

SEQ ID NO: 26898 - DNA, 71 bp, chicken (Gallus Gallus)
  misc_feature (36): n=c or t
aactcttatcttgtacaaggaggtagcattacaggnatgtcccgttcacctgcctcaatgagcttggtaaa

SEQ ID NO: 26899 - DNA, 71 bp, chicken (Gallus Gallus)
  misc_feature (36): n=a or g
accaggagcaagatgtagcagtagaagaacatgatnccctcggcccagagtggcagccccttcttctgggg

SEQ ID NO: 26900 - DNA, 71 bp, chicken (Gallus Gallus)
  misc_feature (36): n=c or g
catataataaattgagacaatgaataaaaaacatantgaagtctcctgcttccctactatattccaagagc

SEQ ID NO: 26901 - DNA, 71 bp, chicken (Gallus Gallus)
  misc_feature (36): n=a or g
gggaagtgacaaatgcctccagccatctgctccccnggatcagatttaaagctgttttggccagtgctgtg

SEQ ID NO: 26902 - DNA, 71 bp, chicken (Gallus Gallus)
  misc_feature (36): n=c or t
tcttcagggagtctataggaaattcaacacttccanctatgttttttcagtgaaatcttcaaaaacatgct

SEQ ID NO: 26903 - DNA, 71 bp, chicken (Gallus Gallus)
  misc_feature (36): n=a or g
gggacagtggttcgatgttattaccatcagtcacantactgacaatacatacctgcaccaatgagagtaaa

SEQ ID NO: 26904 - DNA, 71 bp, chicken (Gallus Gallus)
  misc_feature (36): n=c or t
aaaagcattgatttctctatgtatgtgaagtcttgncttgaatatatttctgtttttattgtatgtgggat

SEQ ID NO: 26905 - DNA, 71 bp, chicken (Gallus Gallus)
  misc_feature (36): n=a or t
ggtggcaacaaaacaactgcaaagaaatggtaaacntactagggctgctgaaattcttccaaagtcttcca

SEQ ID NO: 26906 - DNA, 71 bp, chicken (Gallus Gallus)
  misc_feature (36): n=a or g
ccaccccccagcagctgcgagagtcacgtcatttcnggcctcctacaccttatctgaaataagactttgat

SEQ ID NO: 26907 - DNA, 71 bp, chicken (Gallus Gallus)
  misc_feature (36): n=c or t
ccagagcctcaatgtctttcttgtagcgaggggccnataaaacacatatccaggtacagcaattatttcca

SEQ ID NO: 26908 - DNA, 71 bp, chicken (Gallus Gallus)
  misc_feature (36): n=a or c
gaattgctgttggtgggagcttggacaagaataaanaatgtccaaagttcagtatgcatttttcagtcaaa

SEQ ID NO: 26909 - DNA, 71 bp, chicken (Gallus Gallus)
  misc_feature (36): n=c or t
taagtattttattgtattaaactgaagttcaagtgncttgctttcttgaaccagtggctcaagcaacaact

SEQ ID NO: 26910 - DNA, 71 bp, chicken (Gallus Gallus)
  misc_feature (36): n=c or g
tgtctttttgccatgtactgagaaggtacaatactntgaaaaatttttcctgaagaaacaccaacatgttt

SEQ ID NO: 26911 - DNA, 71 bp, chicken (Gallus Gallus)
  misc_feature (36): n=a or g
gatggacaaaccccatgccttgaatagctttgaatntactgagcccaatgagaggcatctcagcagaaaaa

SEQ ID NO: 26912 - DNA, 71 bp, chicken (Gallus Gallus)
  misc_feature (36): n=g or t
tcaaagatagcactcaactgaacttcaagccttttnctatgtatacttcttccccagaaagtgttctcttt

SEQ ID NO: 26913 - DNA, 71 bp, chicken (Gallus Gallus)
  misc_feature (36): n=c or g
agtacaagagatacctcataagccatgcaaaaacanaggagaacaaaaagaccaccttcttaaatccttca

SEQ ID NO: 26914 - DNA, 71 bp, chicken (Gallus Gallus)
  misc_feature (36): n=g or t
gagagctcctcaagccttataaaacgctttcctctnctcaccatcaagtgctgcaggaattaatttgggtg

SEQ ID NO: 26915 - DNA, 71 bp, chicken (Gallus Gallus)
  misc_feature (36): n=c or t
cacctcaattaagacataagaatttctataagaagnaaaacctaaacaaattcctatttatttatttattt

SEQ ID NO: 26916 - DNA, 71 bp, chicken (Gallus Gallus)
  misc_feature (36): n=c or t
ggaaataatcccaatgtttcccatggtccaaatatntggaagcatttccatgtaggtagaaaattcctaat

SEQ ID NO: 26917 - DNA, 71 bp, chicken (Gallus Gallus)
  misc_feature (36): n=a or g
ccacagtgctggccttacaacacagttacagatgtnggttattctctgccactaacgagaattattttaaa

SEQ ID NO: 26918 - DNA, 71 bp, chicken (Gallus Gallus)
  misc_feature (36): n=c or g
gtgccatatctcaggtggtaatgccagtgtagactncaatttcttatctcccctatgggataactcaggag

SEQ ID NO: 26919 - DNA, 71 bp, chicken (Gallus Gallus)
  misc_feature (36): n=c or g
agctctggatatgcagtgctgtccttaaacaccgcngcatgaataccaccactatgccctgtgactgggca

SEQ ID NO: 26920 - DNA, 71 bp, chicken (Gallus Gallus)
  misc_feature (36): n=a or g
gtgcattaaccttagaaaagatttacagttggagcnctagtgttagttccctctctctgtatatcttcttt

SEQ ID NO: 26921 - DNA, 71 bp, chicken (Gallus Gallus)
  misc_feature (36): n=a or g
gttcacgtctgggccgcctctattcgccagcacccntgtgctggaattttatgtgatgtccagcaaagttt

SEQ ID NO: 26922 - DNA, 71 bp, chicken (Gallus Gallus)
  misc_feature (36): n=a or g
aacctttcgcctgaaaaccgactcatcgctgctgcntaacagtctcctaaacacgagaagctgacgtgact

SEQ ID NO: 26923 - DNA, 71 bp, chicken (Gallus Gallus)
  misc_feature (36): n=a or g
tctcagcctgaaaaccgcatgctgtcccatagcaanttgctctggtggtgcaatactaggggttcagcagt

SEQ ID NO: 26924 - DNA, 71 bp, chicken (Gallus Gallus)
  misc_feature (36): n=c or t
ataaaacatgaaaaagactacatacttgtcctcttnctcttatagctatgcagtatcttgcaccatatttt

SEQ ID NO: 26925 - DNA, 71 bp, chicken (Gallus Gallus)
  misc_feature (36): n=a or g
cgtcttccacttctagtataataacatatcctcttncaactactacctctagaatccctttactgtgataa

SEQ ID NO: 26926 - DNA, 71 bp, chicken (Gallus Gallus)
  misc_feature (36): n=a or c
caacagttaagcattcagtagatgaattgcaccttntccttatgatagggctgaacatcagcacaacacaa

SEQ ID NO: 26927 - DNA, 71 bp, chicken (Gallus Gallus)
  misc_feature (36): n=c or t
aataaagggagatctgccctcatctcttctttcagngagcagaaataaacgttagcagagcagtcgttctc

SEQ ID NO: 26928 - DNA, 71 bp, chicken (Gallus Gallus)
  misc_feature (36): n=c or t
tttacaatttaggaagcaaagagacacctttttaanggacagaggtatccttgacagaaaccaagaccaat

SEQ ID NO: 26929 - DNA, 71 bp, chicken (Gallus Gallus)
  misc_feature (36): n=a or g
ggagctgtacagtgataagacaataaacttgtcccnatggtgtgtgggttagataagagaggatttggagc

SEQ ID NO: 26930 - DNA, 71 bp, chicken (Gallus Gallus)
  misc_feature (36): n=c or t
atattttcatcttttgattcagtgtaattcttcttncccctttctgcaaagagaaaagtaaattttgtctg

SEQ ID NO: 26931 - DNA, 71 bp, chicken (Gallus Gallus)
  misc_feature (36): n=a or g
ccccacttctctggctgtcagaacaaactcctaccntccctttcccctctcctgtccaccctgcagtctcc

SEQ ID NO: 26932 - DNA, 71 bp, chicken (Gallus Gallus)
  misc_feature (36): n=a or c
atatgaaaaccaggagaatgagtgtattattttggnaaggattaacatactacaaaagaaaatgtccccct

SEQ ID NO: 26933 - DNA, 71 bp, chicken (Gallus Gallus)
  misc_feature (36): n=c or t
taaggctagactttgtctccctgatatataaaagantgtaagtatctacagaagtagttttgtgtttaaaa

SEQ ID NO: 26934 - DNA, 71 bp, chicken (Gallus Gallus)
  misc_feature (36): n=c or t
tcttcatgcgtaactggaaactagtatctatctacncatgcagtaatattctcatgcgagttagttgattt

SEQ ID NO: 26935 - DNA, 71 bp, chicken (Gallus Gallus)
  misc_feature (36): n=c or t
tatattttaattaggagggaggcagacattttacanggtctgatagtgataggacaagggggagtggcttt

SEQ ID NO: 26936 - DNA, 71 bp, chicken (Gallus Gallus)
  misc_feature (36): n=c or t
aatgaggataaataaaggcagatattattctagcangaaattaccagcacgataaatgagaggagagcagt

SEQ ID NO: 26937 - DNA, 71 bp, chicken (Gallus Gallus)
  misc_feature (36): n=a or g
aaagtttatattcttaattactggttatatgtagangggacacatctccaagaagagttgtctaaaatgtg

SEQ ID NO: 26938 - DNA, 71 bp, chicken (Gallus Gallus)
  misc_feature (36): n=a or g
aaatagctgaatgcttgagcatggtatattcaaatnacttataattataaaaatgaggcattttgtagatg

SEQ ID NO: 26939 - DNA, 71 bp, chicken (Gallus Gallus)
  misc_feature (36): n=a or g
ccagtagttaattggaagtcatgtccctaatgctgnaagattttgtctttggcaggacaaagatcacgcta

SEQ ID NO: 26940 - DNA, 71 bp, chicken (Gallus Gallus)
  misc_feature (36): n=c or t
gaaggctgtggggaaggagggctttggagtcgcatncaagacaaggctctggttaatggtcacaagatgga

SEQ ID NO: 26941 - DNA, 71 bp, chicken (Gallus Gallus)
  misc_feature (36): n=c or t
gagagcatattaggaaaaccagtaggaaagtgaacnatctcagtgcagggtttggttggttcacaaataca

SEQ ID NO: 26942 - DNA, 71 bp, chicken (Gallus Gallus)
  misc_feature (36): n=a or g
ttcccttaaatgcaatcaactcaaagagagaaccanacccagaaaatcaaaacaacaacaaaacacaacta

SEQ ID NO: 26943 - DNA, 71 bp, chicken (Gallus Gallus)
  misc_feature (36): n=c or t
ctgccttgcaaagaggttaaaccatagggcagcagncctccaaaaaaagaaaggggccccagatctagact

SEQ ID NO: 26944 - DNA, 71 bp, chicken (Gallus Gallus)
  misc_feature (36): n=c or t
agctgctaagtctgtgggaaatgtgtatgaaatacnacatttacatttacattttattacctcataagagg

SEQ ID NO: 26945 - DNA, 71 bp, chicken (Gallus Gallus)
  misc_feature (36): n=c or g
ctttagcaagctcctgtttgttgctacagcaacctntaaaggttgaaaactagattcaaagaagccaaaag

SEQ ID NO: 26946 - DNA, 71 bp, chicken (Gallus Gallus)
  misc_feature (36): n=a or c
gtctacagtaatcagaacaacatatcctttatgtgntgtgaggttgctacatcacatgagatcagaagggc

SEQ ID NO: 26947 - DNA, 71 bp, chicken (Gallus Gallus)
  misc_feature (36): n=c or t
ggccatggcaccattttgaaccatggcagtccaatnggtccattggccatgtcacaggagtcccactcaca

SEQ ID NO: 26948 - DNA, 71 bp, chicken (Gallus Gallus)
  misc_feature (36): n=c or g
cctcctgccttactttttgagatgcaaagctgtggnataaaaaaagcacctggacaatgctctcagatgtc

SEQ ID NO: 26949 - DNA, 71 bp, chicken (Gallus Gallus)
  misc_feature (36): n=a or g
tttagagctgttcttttgttcttgttgtctcctgtntaagttattctaaagagttagagggatttcttctg

SEQ ID NO: 26950 - DNA, 71 bp, chicken (Gallus Gallus)
  misc_feature (36): n=c or t
ctatttccatcagattttaagtagcttaagtttttncatgagaaattttatcaatctaagacacaatataa

SEQ ID NO: 26951 - DNA, 71 bp, chicken (Gallus Gallus)
  misc_feature (36): n=a or g
tataaacagttaaacttggtgccctcaagacaaatngtagataagacccttgggctaaataaccagttttg

SEQ ID NO: 26952 - DNA, 71 bp, chicken (Gallus Gallus)
  misc_feature (36): n=a or g
agacattcattgcatgcagtatgtttataaaatcantatgtaaaactagattttgcaaatctgacacagca

SEQ ID NO: 26953 - DNA, 71 bp, chicken (Gallus Gallus)
  misc_feature (36): n=a or g
gtcaagaatggcatcttactatgctcagtaatgcancatgaaattcccactgggattagcactggccgcac

SEQ ID NO: 26954 - DNA, 71 bp, chicken (Gallus Gallus)
  misc_feature (36): n=c or t
catggagatatctgtctttcagaaaaagcttgacanacttttgtaatggaaaagctttggcaacttaaact

SEQ ID NO: 26955 - DNA, 71 bp, chicken (Gallus Gallus)
  misc_feature (36): n=a or g
ttgccacctcttgactccagagaacagaggcagggnatcagggaacagatgggaaagatgctcagaattac

SEQ ID NO: 26956 - DNA, 71 bp, chicken (Gallus Gallus)
  misc_feature (36): n=g or t
gtagaaaagttgtgcaggagcattgtgtgcagtgtnataaataccccaccacctgcctttataaacaggta

SEQ ID NO: 26957 - DNA, 71 bp, chicken (Gallus Gallus)
  misc_feature (36): n=a or g
ccaagtgagaacaacaccagaaggtacaatggtgancctgacagtacggaaagaaatgacacatccagcaa

SEQ ID NO: 26958 - DNA, 71 bp, chicken (Gallus Gallus)
  misc_feature (36): n=c or t
cctcagttcaggtacctgaatgactccaataaagcngttatgttgacttcatcagcagagctttggaagta

SEQ ID NO: 26959 - DNA, 71 bp, chicken (Gallus Gallus)
  misc_feature (36): n=c or t
tcacatccaagactccaaatctcccaggagacgtangtggcttccctgcaataatgcactttcttactttg

SEQ ID NO: 26960 - DNA, 71 bp, chicken (Gallus Gallus)
  misc_feature (36): n=c or t
tgggccagctgcaacctccaactctaaagatgtgangtaactatttgttctaatcaaaagttttctaattt

SEQ ID NO: 26961 - DNA, 71 bp, chicken (Gallus Gallus)
  misc_feature (36): n=c or t
ttctagttgtgcttagaatggcttttacaatgagangtaggcttcttagtggagagaatttattctctatg

SEQ ID NO: 26962 - DNA, 71 bp, chicken (Gallus Gallus)
  misc_feature (36): n=c or t
cttcaacagcatttgtaagtgtttactttctagtantatgcctgtgttatctccttttcatttccttccaa

SEQ ID NO: 26963 - DNA, 71 bp, chicken (Gallus Gallus)
  misc_feature (36): n=a or t
gaaaataatggataatctgatcctagggtgggctgntatgtttccaggctatatctagatgactatttctt

SEQ ID NO: 26964 - DNA, 71 bp, chicken (Gallus Gallus)
  misc_feature (36): n=a or t
tacttattcaaagagagcccatatgagacaaaaganggaatgaaattgggtcatataggcacaacacaaat

SEQ ID NO: 26965 - DNA, 71 bp, chicken (Gallus Gallus)
  misc_feature (36): n=c or t
aaaacagacatctctgtgaatgtagagtgcgtaaangcatttttaaaatcttaattttaaatttaaaaagt

SEQ ID NO: 26966 - DNA, 71 bp, chicken (Gallus Gallus)
  misc_feature (36): n=c or t
tctgtactgtttagtactttcctttcagtctgtacngttattggaaagagtagtcatcaactgaacaacac

SEQ ID NO: 26967 - DNA, 71 bp, chicken (Gallus Gallus)
  misc_feature (36): n=a or g
attatcctaagttcttgcttatgtgagcttatttangggaaaaacaccatgagagatttggtgatggagat

SEQ ID NO: 26968 - DNA, 71 bp, chicken (Gallus Gallus)
  misc_feature (36): n=c or t
ccgattactccatattacatccattccacagattanggctgcacttgttctgtaaagtcaagtttgtaaag

SEQ ID NO: 26969 - DNA, 71 bp, chicken (Gallus Gallus)
  misc_feature (36): n=c or t
tcccttcctatgaattaacctctgagaaaatattcngagcagaagaaaactttatctcaggtgttttgctc

SEQ ID NO: 26970 - DNA, 71 bp, chicken (Gallus Gallus)
  misc_feature (36): n=a or g
cttttttctttttcaaaacatacgcagcagtgtttntgctcttagggtccagagggtcactccagcctcac

SEQ ID NO: 26971 - DNA, 71 bp, chicken (Gallus Gallus)
  misc_feature (36): n=a or g
attggtgagctcaagtcctgtgatggtccgctgaangatatgcaatttgggaataaaatggctgttctgag

SEQ ID NO: 26972 - DNA, 71 bp, chicken (Gallus Gallus)
  misc_feature (36): n=c or t
agaaggcctaagatatgtttaagcttccataaatgntctcagtttgtaaggaacagtgattagaaaagaac

SEQ ID NO: 26973 - DNA, 71 bp, chicken (Gallus Gallus)
  misc_feature (36): n=c or g
cgagtaatgagactcagacagttagttttataaatntaagctagaaactccaaatagcagttaagcaattc

SEQ ID NO: 26974 - DNA, 71 bp, chicken (Gallus Gallus)
  misc_feature (36): n=a or g
catataggacattttgtgaaccttctgtggagtgcncaggtaggggaaatattgtttgagagtatatgtga

SEQ ID NO: 26975 - DNA, 71 bp, chicken (Gallus Gallus)
  misc_feature (36): n=g or t
ttaaagacatctcaagagctgctgaggatatgaaanctttaacatttgatgcagtaagtccaaataatcca

SEQ ID NO: 26976 - DNA, 71 bp, chicken (Gallus Gallus)
  misc_feature (36): n=c or t
ttatatgctaatttaaaaagttatgggcttgcatanatgaaagattcacagcagtgcacatgatactgtgc

SEQ ID NO: 26977 - DNA, 71 bp, chicken (Gallus Gallus)
  misc_feature (36): n=a or g
tgaaaaacatcagaacacgtcaaatttaacgaccantgtgtccaaatctacaagacaaacaagtagatgaa

SEQ ID NO: 26978 - DNA, 71 bp, chicken (Gallus Gallus)
  misc_feature (36): n=a or c
aaagattggcaaggaaaattagcattgcactgtggncccaaaatatttccttccctctggtctaaagcaga

SEQ ID NO: 26979 - DNA, 71 bp, chicken (Gallus Gallus)
  misc_feature (36): n=c or g
gcggctttattgtgtcctgcagcaacaacagcagcnatctgtaacggcacacagaagccagcagccgaccc

SEQ ID NO: 26980 - DNA, 71 bp, chicken (Gallus Gallus)
  misc_feature (36): n=a or g
aactctcccaaagtaaacagcctgagtcctgcttgnaccgagggagccagaagctgaattacaccactgta

SEQ ID NO: 26981 - DNA, 71 bp, chicken (Gallus Gallus)
  misc_feature (36): n=c or t
taacttcaataatgaaagcttttgcttatagtcatncaaatctataccaaaacattaaagtattctgccaa

SEQ ID NO: 26982 - DNA, 71 bp, chicken (Gallus Gallus)
  misc_feature (36): n=a or g
atgtggtatggaggagtgtggtacagagatacggangcagtttttttggcacagtgcagtgctctggggtg

SEQ ID NO: 26983 - DNA, 71 bp, chicken (Gallus Gallus)
  misc_feature (36): n=c or t
tttatacaagcatccttccacaagcagtttcttacnatgctggcaacatgccttgacagcagcatacatta

SEQ ID NO: 26984 - DNA, 71 bp, chicken (Gallus Gallus)
  misc_feature (36): n=a or c
actcttcaaacagggagagcctgaacatagtatcanaaatgtacataggtcgaaaattcatttgagaattt

SEQ ID NO: 26985 - DNA, 71 bp, chicken (Gallus Gallus)
  misc_feature (36): n=a or g
actgaaggactccgctatacattatctcatagccanattatgcagggtattgtaaacatgttgtaaatttt

SEQ ID NO: 26986 - DNA, 71 bp, chicken (Gallus Gallus)
  misc_feature (36): n=a or g
aatctggtttgtctttcccactcatcctgtgctgantgatctgggtactacagaggtatcccccaaacacc

SEQ ID NO: 26987 - DNA, 71 bp, chicken (Gallus Gallus)
  misc_feature (36): n=a or g
tttaatctcaaagtgcatagttcccttgtcagcccntgcctttggcagcaaaacaaggagatctattcttt

SEQ ID NO: 26988 - DNA, 71 bp, chicken (Gallus Gallus)
  misc_feature (36): n=g or t
tcatcagaaaagaaaatcctgtagtaaactgtgagnagctcagggagagacagtaaaatgacttcaagtca

SEQ ID NO: 26989 - DNA, 71 bp, chicken (Gallus Gallus)
  misc_feature (36): n=g or t
gaatgccctatgaggttttgtgttctggatgagtgngaagtaagggctgctaaggcatagactccagtgtt

SEQ ID NO: 26990 - DNA, 71 bp, chicken (Gallus Gallus)
  misc_feature (36): n=c or t
tgggtaaatctccatgtactgcatcaaaaatgtaangctctctccatacagatatgcctaataaattctta

SEQ ID NO: 26991 - DNA, 71 bp, chicken (Gallus Gallus)
  misc_feature (36): n=c or g
aattggctgctaattctcctttattacagaagaaancttcaaccaacaggtctctgctgtacttcataagg

SEQ ID NO: 26992 - DNA, 71 bp, chicken (Gallus Gallus)
  misc_feature (36): n=a or g
atcttcttgtataagactcttgagaaagagcacacntgtaagctaatactattttctttctactgtactag

SEQ ID NO: 26993 - DNA, 71 bp, chicken (Gallus Gallus)
  misc_feature (36): n=c or t
tgcagtgttaagaaacctgcatggagatgtaacaantctgcatatctttagcatttgtattgtgctgggat

SEQ ID NO: 26994 - DNA, 71 bp, chicken (Gallus Gallus)
  misc_feature (36): n=c or g
tgtaaatgcaaaagcagcttgtgcaaaattactttnctgttgttagtgtttggctgtatggaggtgctcga

SEQ ID NO: 26995 - DNA, 71 bp, chicken (Gallus Gallus)
  misc_feature (36): n=a or g
acttgagcatcttgacataagacagcatttctcagncagtacaggtgatcttgttactcttacctggaaaa

SEQ ID NO: 26996 - DNA, 71 bp, chicken (Gallus Gallus)
  misc_feature (36): n=c or t
agaatttattaaaatgttacagaattattgtgctanatgtaatacagctgcagtacagctacaccttctaa

SEQ ID NO: 26997 - DNA, 71 bp, chicken (Gallus Gallus)
  misc_feature (36): n=c or g
tctagttgctaccactcttccactttggaaatattnacaatcaagtggcgctgtgcctaagtccagaacat

SEQ ID NO: 26998 - DNA, 71 bp, chicken (Gallus Gallus)
  misc_feature (36): n=c or t
aacttttatcttcccttttagttgctgcccacagangggatgattcgcaagcattcacatgtgaagattgg

SEQ ID NO: 26999 - DNA, 71 bp, chicken (Gallus Gallus)
  misc_feature (36): n=c or t
aatcattatcttaagatgcagaggaactaatcaaangtttaccactaggtactcagacactgcaagataga

SEQ ID NO: 27000 - DNA, 71 bp, chicken (Gallus Gallus)
  misc_feature (36): n=a or g
gagccacagctgcccctgtggtgacctccctccgcngaaggcttggctcattacctctcacttactcaggc

SEQ ID NO: 27001 - DNA, 71 bp, chicken (Gallus Gallus)
  misc_feature (36): n=a or g
tttcaaagtctcacttgaacaaggctagtagagacnaacatcaagattaaacaaaagcaattaccgtccca

SEQ ID NO: 27002 - DNA, 71 bp, chicken (Gallus Gallus)
  misc_feature (36): n=a or g
gacttgtgtatatggatgtgtacatcacctcagganggactctgtatttccaatgcattttgttcattcct

SEQ ID NO: 27003 - DNA, 71 bp, chicken (Gallus Gallus)
  misc_feature (36): n=a or t
gaaaaaattaaatgtgctgaactgacgaatgttttnatgaaaaatgtccacttttaaaatcttttgtagat

SEQ ID NO: 27004 - DNA, 71 bp, chicken (Gallus Gallus)
  misc_feature (36): n=g or t
tagtttttaaatctaaacaggagaatttttgtttgngtagattgcttacagcctgaaaatacaaggcagag

SEQ ID NO: 27005 - DNA, 71 bp, chicken (Gallus Gallus)
  misc_feature (36): n=c or t
tctgtcagcaccaatacgctttggccacaatttctnctaaacgagccaatgcattgccttttttctcaagg

SEQ ID NO: 27006 - DNA, 71 bp, chicken (Gallus Gallus)
  misc_feature (36): n=c or t
actaatcttgaaactcatcagatctgcaatggacanaatttgacagagaacgaagaaagaaaacagtttga

SEQ ID NO: 27007 - DNA, 71 bp, chicken (Gallus Gallus)
  misc_feature (36): n=c or t
agatatagggaaaaagtcagttttcctactgtgtcntctgtattaccttgtaatatatcttttcattacat

SEQ ID NO: 27008 - DNA, 71 bp, chicken (Gallus Gallus)
  misc_feature (36): n=c or t
tatatgtaccatatttaccagataaagactaatcanatgaatgctagttaagtcatggaagcaaaaaaacg

SEQ ID NO: 27009 - DNA, 71 bp, chicken (Gallus Gallus)
  misc_feature (36): n=a or g
tgaatacagcatgttccctatcagtgcctcttcaantaatgtgcagtcagtttgtttggatagcatcatct

SEQ ID NO: 27010 - DNA, 71 bp, chicken (Gallus Gallus)
  misc_feature (36): n=c or t
ttcatcaaagatcagtgaacaccttgagacctcacnaagaaatgcacgaaccaggcaggtgtgttagtttc

SEQ ID NO: 27011 - DNA, 71 bp, chicken (Gallus Gallus)
  misc_feature (36): n=a or g
acaatcacatacacttagtacaaaatacactgttgnaaatagttgcaagtaaattactgtatagttgacca

SEQ ID NO: 27012 - DNA, 71 bp, chicken (Gallus Gallus)
  misc_feature (36): n=c or t
tgaccatgaatcagtgaggtttataacaaatccagnccagatctcaagttgcaaagggcagtcactggtgt

SEQ ID NO: 27013 - DNA, 71 bp, chicken (Gallus Gallus)
  misc_feature (36): n=a or g
aacaatatgtttctcttatgtcactacggatttttncacacgacagtgaacatacaactttaattcaaaca

SEQ ID NO: 27014 - DNA, 71 bp, chicken (Gallus Gallus)
  misc_feature (36): n=c or g
aatgcttagggcttgaaaaagagaaagggactgaanatgatgcggcaggggagagaacattcagcgaaaca

SEQ ID NO: 27015 - DNA, 71 bp, chicken (Gallus Gallus)
  misc_feature (36): n=g or t
tacatcatctcattcaatcttctacacttcatcctntggctggtagaaggaccttatgccttgggctatat

SEQ ID NO: 27016 - DNA, 71 bp, chicken (Gallus Gallus)
  misc_feature (36): n=c or t
caagatactggatctgaaatttgttatggtctcagnatccatcccgtgtgctacccacgtcctatgaagag

SEQ ID NO: 27017 - DNA, 71 bp, chicken (Gallus Gallus)
  misc_feature (36): n=c or t
cagtattgtcacagtgaagcttcaaagctagaagtncaccggttgtcactttatagccatctcactaacga

SEQ ID NO: 27018 - DNA, 71 bp, chicken (Gallus Gallus)
  misc_feature (36): n=a or t
agggaaaatgttgatttttctgagggaaaaataganatgcaaaatatttttagctaccagctgagatacgg

SEQ ID NO: 27019 - DNA, 71 bp, chicken (Gallus Gallus)
  misc_feature (36): n=a or g
ggtcattcatgccatttgctggtaagagaagaagcnatcggtactcaggatttgcagtgcattgaaaacca

SEQ ID NO: 27020 - DNA, 71 bp, chicken (Gallus Gallus)
  misc_feature (36): n=a or g
tcagcaacgagcagtcctctgttttgttgtgccgtnagagaggccagcacacgccggctgagcacgtggtg

SEQ ID NO: 27021 - DNA, 71 bp, chicken (Gallus Gallus)
  misc_feature (36): n=c or g
cttttctgcacagagtcgcagtagtttatgcagaantgtttatggtagattgtcacacagtaggcaaacag

SEQ ID NO: 27022 - DNA, 71 bp, chicken (Gallus Gallus)
  misc_feature (36): n=a or g
tcctcaatgtaccaaaaaaaaaaaaaaaaaagaganagagagactgctgccaattttacctccatggccac

SEQ ID NO: 27023 - DNA, 71 bp, chicken (Gallus Gallus)
  misc_feature (36): n=c or t
atctggaaagctgaggaaattctgttcaggagagtngaaaatggttataggaacttgtgtggtgggaaaat

SEQ ID NO: 27024 - DNA, 71 bp, chicken (Gallus Gallus)
  misc_feature (36): n=c or t
atcagatcagcatatgttttgttttttttaagagcnggatagtttcatgggcccatatgttcctcttgcaa

SEQ ID NO: 27025 - DNA, 71 bp, chicken (Gallus Gallus)
  misc_feature (36): n=a or g
cggtattccaagaagaaagactgttgatctcttccnggaagatccaaagtaggatttttgcttttgaacat

SEQ ID NO: 27026 - DNA, 71 bp, chicken (Gallus Gallus)
  misc_feature (36): n=a or g
ctcagaagcaggaggtgggtgcccgcagagctcccngcagttcatctgattgaagcaaacttcacctcctg

SEQ ID NO: 27027 - DNA, 71 bp, chicken (Gallus Gallus)
  misc_feature (36): n=c or t
gcagaaatccccagtagccgaatgctttgatgactntgtggccaaagctgtatataaccatgaagtatgta

SEQ ID NO: 27028 - DNA, 71 bp, chicken (Gallus Gallus)
  misc_feature (36): n=c or t
aactacataatcacatgctacttttcccactgggtncctacctcattcactgcacgtaagacatgacgtgc

SEQ ID NO: 27029 - DNA, 71 bp, chicken (Gallus Gallus)
  misc_feature (36): n=a or g
agtctgtacctgattatacactcatgagtgaatcanctataatggttttataaaatctgacatgaatagca

SEQ ID NO: 27030 - DNA, 71 bp, chicken (Gallus Gallus)
  misc_feature (36): n=c or t
ccaatgtgacagacagttaaatgataaaataccttnctagtagctactcaagatgggaaatattatgtgaa

SEQ ID NO: 27031 - DNA, 71 bp, chicken (Gallus Gallus)
  misc_feature (36): n=g or t
atttctcctcaagtaattttatgtttataactagcnaagttaacagaagttgagtttctactttcagtctc

SEQ ID NO: 27032 - DNA, 71 bp, chicken (Gallus Gallus)
  misc_feature (36): n=a or g
atttcttcaagtttcaaatttgagaaatagaagatngccatggttgcaaactacagcaaatacttcaaaat

SEQ ID NO: 27033 - DNA, 71 bp, chicken (Gallus Gallus)
  misc_feature (36): n=a or g
tatgagatactcagatacttttgtcatgggatccantgacaagacacagccaaatgaagtgttctcagtcc

SEQ ID NO: 27034 - DNA, 71 bp, chicken (Gallus Gallus)
  misc_feature (36): n=a or g
aagtaaatccaatttccaagtccttatattgttatnttagttatgctttttagatacaaaaaatgtatggc

SEQ ID NO: 27035 - DNA, 71 bp, chicken (Gallus Gallus)
  misc_feature (36): n=a or g
gttaccctctccagatttcatgttcttcttccttgntgtttgataaataatgagctgaacttctgttgtct

SEQ ID NO: 27036 - DNA, 71 bp, chicken (Gallus Gallus)
  misc_feature (36): n=a or g
acacaatttgaggatacttgctgaagtgagtgtgtntgtgtgtgtgagagagagagggaaaaacagaggtg

SEQ ID NO: 27037 - DNA, 71 bp, chicken (Gallus Gallus)
  misc_feature (36): n=a or g
atgagtgccagacatgtatatttagcaacccatgtntcctgctctcatctctagttgatgaaagtctgttt

SEQ ID NO: 27038 - DNA, 71 bp, chicken (Gallus Gallus)
  misc_feature (36): n=a or g
ccagtctccttgcacctctgagggagagacttttancagctacctttgaaagttcattgtaattagacaaa

SEQ ID NO: 27039 - DNA, 71 bp, chicken (Gallus Gallus)
  misc_feature (36): n=c or t
ttagggggtggttcgtctcctgaagtatacatctanatgtgagtggataaactgaaccataagctccactg

SEQ ID NO: 27040 - DNA, 71 bp, chicken (Gallus Gallus)
  misc_feature (36): n=c or t
caggaacagtttaaattcacattttcaatccttgcnctcagtcagctacatgtgacatttcctcctgtgct

SEQ ID NO: 27041 - DNA, 71 bp, chicken (Gallus Gallus)
  misc_feature (36): n=c or g
tatttatctttatttggatttatttctggccacttncaactaaggtttccccactcagcctctctgataca

SEQ ID NO: 27042 - DNA, 71 bp, chicken (Gallus Gallus)
  misc_feature (36): n=c or t
aactgctgaaagactggttactagcaaaggatctcnttccttttaattttctcctataagcccagatgtat

SEQ ID NO: 27043 - DNA, 71 bp, chicken (Gallus Gallus)
  misc_feature (36): n=a or g
tgctttgaaagcagttttattctgcagatctgatcnggatatcatagaatcgtttgagttggaagggggac

SEQ ID NO: 27044 - DNA, 71 bp, chicken (Gallus Gallus)
  misc_feature (36): n=a or g
agtgtggtacatcatgcgaactggatgtcttggtcnatgccctggaaacaggaaacagtgcctacagctgt

SEQ ID NO: 27045 - DNA, 71 bp, chicken (Gallus Gallus)
  misc_feature (36): n=a or g
catcagggcccagggaatatcctcacatcagatcangcagatcttgtgggttttttttttccccacaatct

SEQ ID NO: 27046 - DNA, 71 bp, chicken (Gallus Gallus)
  misc_feature (36): n=c or t
acctgttctttccactgttttttactgattctcttnctttcaaacagaggttctgaaaatctgctatgttt

SEQ ID NO: 27047 - DNA, 71 bp, chicken (Gallus Gallus)
  misc_feature (36): n=c or t
tatcttgcctctggatgctgagatggaaattaaggntgatggcatctaccctcctatctgcatcctaacac

SEQ ID NO: 27048 - DNA, 71 bp, chicken (Gallus Gallus)
  misc_feature (36): n=c or g
taaggaattctgcaggactatatccacggggagagnttgtgaagcactgcatttgcagagcagcaccctgg

SEQ ID NO: 27049 - DNA, 71 bp, chicken (Gallus Gallus)
  misc_feature (36): n=a or g
atctgctttctccattccttagctgacttccacacntcaaagcagattgtgttcttacaactaacagcttg

SEQ ID NO: 27050 - DNA, 71 bp, chicken (Gallus Gallus)
  misc_feature (36): n=a or g
ttaccaaaaaaatagacttaaagttgatgagaatantaagttgattattatcagtatcttagcaatgtcaa

SEQ ID NO: 27051 - DNA, 71 bp, chicken (Gallus Gallus)
  misc_feature (36): n=c or t
ttggaaacagaggggaagctgaacagggctaaaagnggtaaaacgttttaaaagtttgtatttcacattgc

SEQ ID NO: 27052 - DNA, 71 bp, chicken (Gallus Gallus)
  misc_feature (36): n=a or t
gtctgtcctacaggtctgttgtctacacaaagatcnttataaaatgggtgaaccaaacttagtttttctca

SEQ ID NO: 27053 - DNA, 71 bp, chicken (Gallus Gallus)
  misc_feature (36): n=c or t
taagctttgtcaactatcctgatctaaaatatttgncaatgttggacttcttgatttacatcaagctttct

SEQ ID NO: 27054 - DNA, 71 bp, chicken (Gallus Gallus)
  misc_feature (36): n=a or g
tattgaaagctcatggacatagagctctcacctttntctaaggaaatactgaagccatagggtattgcaat

SEQ ID NO: 27055 - DNA, 71 bp, chicken (Gallus Gallus)
  misc_feature (36): n=a or g
acgttgtgcttcctgctaaggaggactgagagcacncggttgtgagagtacacacagtcgcgtagatgttc

SEQ ID NO: 27056 - DNA, 71 bp, chicken (Gallus Gallus)
  misc_feature (36): n=c or t
ttccatgacagtagaaaaagtcacagaggcctttcngagggagtccgttctccagcaacattgcatatatt

SEQ ID NO: 27057 - DNA, 71 bp, chicken (Gallus Gallus)
  misc_feature (36): n=a or g
gagattctctcagatctgcttctgaacagttatcantacaaaatcccaacctcttacacactctgcagggt

SEQ ID NO: 27058 - DNA, 71 bp, chicken (Gallus Gallus)
  misc_feature (36): n=c or g
ataatacagagggaattctctgaagtgagactgcantttgctctgcatttctatcttcttcagtgattcat

SEQ ID NO: 27059 - DNA, 71 bp, chicken (Gallus Gallus)
  misc_feature (36): n=a or t
cacccccatgccctatcaagctgctctttaagtgcnaccagatcctagtgagtctatgctctcctctttcc

SEQ ID NO: 27060 - DNA, 71 bp, chicken (Gallus Gallus)
  misc_feature (36): n=a or t
gattcataactttttcatttctttcccaaaaacatnagttaatttgcttgtttcttgagtctctgaacaag

SEQ ID NO: 27061 - DNA, 71 bp, chicken (Gallus Gallus)
  misc_feature (36): n=c or t
gatgactgtggtgatggtcattcctgaaatcaagcngcagataataaaagaaaaataatatgatacatact

SEQ ID NO: 27062 - DNA, 71 bp, chicken (Gallus Gallus)
  misc_feature (36): n=c or t
tcaacccatctataccatgcccattaaccacatccntcagtgccatgtccacattgtttcttgaatacatc

SEQ ID NO: 27063 - DNA, 71 bp, chicken (Gallus Gallus)
  misc_feature (36): n=g or t
gtcactttgcactgtgttacactgtctttctgcacntacagatctgctggaagaacaacttctaattatgg

SEQ ID NO: 27064 - DNA, 71 bp, chicken (Gallus Gallus)
  misc_feature (36): n=c or t
gtgccttggtgcagctgggtgttgaaaagaatcttntcttctctctctcaaagcgtgaagatttgccccat

SEQ ID NO: 27065 - DNA, 71 bp, chicken (Gallus Gallus)
  misc_feature (36): n=a or g
tactcttttttttttcccccttgtaatatgtgtatncctcgacctggaattcagccaggtgctattccttc

SEQ ID NO: 27066 - DNA, 71 bp, chicken (Gallus Gallus)
  misc_feature (36): n=a or t
atttactaacaaaagaaacaagtgtagctgcctcanggttcggtgttaaagagaaaatattttttaattac

SEQ ID NO: 27067 - DNA, 71 bp, chicken (Gallus Gallus)
  misc_feature (36): n=g or t
atcaagcagatttgtgataagcttctttggacgacnggaactaacaaaatatacgatctccgttgagtcaa

SEQ ID NO: 27068 - DNA, 71 bp, chicken (Gallus Gallus)
  misc_feature (36): n=c or t
catttaacaataaatttgctcatacctggtgttganggtctctccaacatattcaaatgatggtaaataaa

SEQ ID NO: 27069 - DNA, 71 bp, chicken (Gallus Gallus)
  misc_feature (36): n=c or t
tcagtcactcctgatacatgttcctctctgcactcntcaccatgtttgtagtctttgtttgtactcagtgc

SEQ ID NO: 27070 - DNA, 71 bp, chicken (Gallus Gallus)
  misc_feature (36): n=a or c
tcttgttagcaataccatttttcaattccagaatanatggaggtgttcttatgccctgtgactctgtcttg

SEQ ID NO: 27071 - DNA, 71 bp, chicken (Gallus Gallus)
  misc_feature (36): n=c or t
atatggcataagcaatgttgaaggcagtgggcaganagtgtgatattatgtgggtagtttgaaaacttcat

SEQ ID NO: 27072 - DNA, 71 bp, chicken (Gallus Gallus)
  misc_feature (36): n=c or t
tgcattagaaatgatttgtaatttgtgattgatgcngcaggaatggctattgagcagagttttccttttgt

SEQ ID NO: 27073 - DNA, 71 bp, chicken (Gallus Gallus)
  misc_feature (36): n=c or t
tctgttgaaaaatttgctgaatttggaccaatttcngaagaaagtgtttttatagcagaaggagaatgttt

SEQ ID NO: 27074 - DNA, 71 bp, chicken (Gallus Gallus)
  misc_feature (36): n=a or c
agcagcaaatttggacttcagattacttgagacttnatctgctacttaatatcctccttgggagggggagg

SEQ ID NO: 27075 - DNA, 71 bp, chicken (Gallus Gallus)
  misc_feature (36): n=a or g
atctgcgtttgttgctgaaacttcaccatcttgatnatagtgttacgactgcctttcttgagcgagaagtc

SEQ ID NO: 27076 - DNA, 71 bp, chicken (Gallus Gallus)
  misc_feature (36): n=c or g
tagagtttgagcatctttggaggaatccgagaaagnaggaattcataatttggcagactgtgtctcagttt

SEQ ID NO: 27077 - DNA, 71 bp, chicken (Gallus Gallus)
  misc_feature (36): n=a or g
caagacctttaaatgttaagtatttagcaaggaaanagtgctagcatgttggagggaattctatcaagaat

SEQ ID NO: 27078 - DNA, 71 bp, chicken (Gallus Gallus)
  misc_feature (36): n=a or g
tccttttgctgatagttctctcatcctcagcataancatagacaacataagtcttcagtgttggaaacaca

SEQ ID NO: 27079 - DNA, 71 bp, chicken (Gallus Gallus)
  misc_feature (36): n=a or c
tcaaaacaattctggaggatctaaaccagaaaacanacccaaacataccgctctcttttgtttaattttct

SEQ ID NO: 27080 - DNA, 71 bp, chicken (Gallus Gallus)
  misc_feature (36): n=a or c
aagaaaatgctagtaaatttaagaaccagtccaagnagttattgccagtctctcgtaggatcagctaccct

SEQ ID NO: 27081 - DNA, 71 bp, chicken (Gallus Gallus)
  misc_feature (36): n=a or g
ctgcttcaggattgcatcatacatttcaagacaagnaaaacaccattaggtcaattaaaggtccattctag

SEQ ID NO: 27082 - DNA, 71 bp, chicken (Gallus Gallus)
  misc_feature (36): n=c or g
aaagcactcacaagcaggtattatggtttagtcaanagttccttatcctagtgcagaaaccttaataatat

SEQ ID NO: 27083 - DNA, 71 bp, chicken (Gallus Gallus)
  misc_feature (36): n=c or t
actaactgatacaaactgagtcagtggatttcacantgaagacacatctctacagcaagctgggctcacat

SEQ ID NO: 27084 - DNA, 71 bp, chicken (Gallus Gallus)
  misc_feature (36): n=a or g
ctttgcgtgtctgcagatcacatctatgggctctcncattgcaccagattccgctttgctttgcatgactg

SEQ ID NO: 27085 - DNA, 71 bp, chicken (Gallus Gallus)
  misc_feature (36): n=c or t
tattactgtggaagaatgttagtctgatttgaaaanaacagtttttgacaaattccttctgagtgttatat

SEQ ID NO: 27086 - DNA, 71 bp, chicken (Gallus Gallus)
  misc_feature (36): n=a or g
ccaagcaaatgatttcatcatcagtttcctttcccngagaaggttcctggagcacaagcctaaaaattcac

SEQ ID NO: 27087 - DNA, 71 bp, chicken (Gallus Gallus)
  misc_feature (36): n=c or t
caaggctgttgtgctttaagaagtgctacagacaangatgtttaacacatttagtgcatgatggatgttgc

SEQ ID NO: 27088 - DNA, 71 bp, chicken (Gallus Gallus)
  misc_feature (36): n=a or c
ttgagtctaaaaccaacacattaacagaaaaatacnagaaaatatttaataaatacctaacaatgaaactt

SEQ ID NO: 27089 - DNA, 71 bp, chicken (Gallus Gallus)
  misc_feature (36): n=c or t
tttggtccagtgggactggaggcttttctgtagtgntgctcttattccctagaagagtatttgtctaattc

SEQ ID NO: 27090 - DNA, 71 bp, chicken (Gallus Gallus)
  misc_feature (36): n=c or g
tgtttggagaagcgagttgctgcttctctgcccaangtctgatgacaggttttgctcttaccagtgcttgg

SEQ ID NO: 27091 - DNA, 71 bp, chicken (Gallus Gallus)
  misc_feature (36): n=c or g
gttcaaaacttacactgtttgcctgtactctctgtnggtcttcagtgagaaagaaaaaatattacttccaa

SEQ ID NO: 27092 - DNA, 71 bp, chicken (Gallus Gallus)
  misc_feature (36): n=c or t
tttcttccttcttttttatattacatattcactttngccatggcacgatctacagttcttatctgttcaat

SEQ ID NO: 27093 - DNA, 71 bp, chicken (Gallus Gallus)
  misc_feature (36): n=a or c
aaggagataacagtggcattcaaacccttctgtganatggtggtcctttgcctccaagtacatttagctct

SEQ ID NO: 27094 - DNA, 71 bp, chicken (Gallus Gallus)
  misc_feature (36): n=c or t
tttgtgcagggaagacaaaggcagagcagatttccncatgaagctgtatgaagccaatggctttgagcttt

SEQ ID NO: 27095 - DNA, 71 bp, chicken (Gallus Gallus)
  misc_feature (36): n=c or t
catagaagatgaattacgctctgcaaactatacttncacatttgttagcggcagggatggaaccatgttgt

SEQ ID NO: 27096 - DNA, 71 bp, chicken (Gallus Gallus)
  misc_feature (36): n=c or g
gccactgggctggttatggggaatggcgctctttgncacagcctgctgtaataaggataaatttactctga

SEQ ID NO: 27097 - DNA, 71 bp, chicken (Gallus Gallus)
  misc_feature (36): n=c or t
aaaatattaagaaacaaaataacagaacttcaatangatgcttaaaaagtaagtctaacaaatgatattac

SEQ ID NO: 27098 - DNA, 71 bp, chicken (Gallus Gallus)
  misc_feature (36): n=g or t
aagaaagagtagaggtctcaattcttttcatcaatnaacttgcactacctgtgagcttttcaaaaacacct

SEQ ID NO: 27099 - DNA, 71 bp, chicken (Gallus Gallus)
  misc_feature (36): n=c or t
acactaacagggaaagggccgctgacctagaacttnactcgtgcaccgaaactattaatgaagtctgaaga

SEQ ID NO: 27100 - DNA, 71 bp, chicken (Gallus Gallus)
  misc_feature (36): n=c or t
gagggagaggggaatacttgtcacagcacaaggagnaaggtcccatactacaacctaccagtttcaaggac

SEQ ID NO: 27101 - DNA, 71 bp, chicken (Gallus Gallus)
  misc_feature (36): n=a or g
aatctaatccaataaacttgtcagagcggcaagacnaaatagatacatccattcctcagttttaattacct

SEQ ID NO: 27102 - DNA, 71 bp, chicken (Gallus Gallus)
  misc_feature (36): n=g or t
catttaggtcgcttgttaagagaaaattcttagagngtggtgaggcactggcacaggctgcccagagggtt

SEQ ID NO: 27103 - DNA, 71 bp, chicken (Gallus Gallus)
  misc_feature (36): n=a or t
tgaaaaaatactggaaggcaattctataaagccttnctcatatatttatgggatacaaaaaaaaaaaaaaa

SEQ ID NO: 27104 - DNA, 71 bp, chicken (Gallus Gallus)
  misc_feature (36): n=c or t
tttgtcatccatacttggaggcaaattgtccttacnctcagactgagaatagaaaattactcaacattaat

SEQ ID NO: 27105 - DNA, 71 bp, chicken (Gallus Gallus)
  misc_feature (36): n=a or c
gctattgtatgaacatagagacaacatacaagaagnagatggacaaggaaaaataaaataaaatattgtaa

SEQ ID NO: 27106 - DNA, 71 bp, chicken (Gallus Gallus)
  misc_feature (36): n=a or t
tcaccagaagaaataatgagatgagaaggacatgtnttatgacttcattattctcatgtgttatgatcttg

SEQ ID NO: 27107 - DNA, 71 bp, chicken (Gallus Gallus)
  misc_feature (36): n=a or t
ttctgtgaatttacttcacactatgtctgccatatntttggcattgcatgagtatgttgttctatgtaatt

SEQ ID NO: 27108 - DNA, 71 bp, chicken (Gallus Gallus)
  misc_feature (36): n=a or t
aatttttttcattgtatttagcaacaatattcacancagcactagacatagaccttgtcagtcaatctgtt

SEQ ID NO: 27109 - DNA, 71 bp, chicken (Gallus Gallus)
  misc_feature (36): n=a or g
ttcaacatatctcactgagatgctcaagacttagcncattgtttcatctctagtttgaaaaactacagaga

SEQ ID NO: 27110 - DNA, 71 bp, chicken (Gallus Gallus)
  misc_feature (36): n=a or g
cacccatggagatcagggcgattcatcacctcttgngtgatgttgccaccaatgagaggatgctatccttg

SEQ ID NO: 27111 - DNA, 71 bp, chicken (Gallus Gallus)
  misc_feature (36): n=c or t
actggagatgggaacagcttttctctttccaaaggnaatctcagtgaaaaatgcctcagtatgtctgaaag

SEQ ID NO: 27112 - DNA, 71 bp, chicken (Gallus Gallus)
  misc_feature (36): n=c or t
aacagaacaggaccactaaacattaaaagcaaatantctgttccaaagttacccatcttgcagagcacata

SEQ ID NO: 27113 - DNA, 71 bp, chicken (Gallus Gallus)
  misc_feature (36): n=c or t
gtttatttttccatcagcattctgcatctggaagantgtgcttgcatctacaggtatgtaagcaacgatta

SEQ ID NO: 27114 - DNA, 71 bp, chicken (Gallus Gallus)
  misc_feature (36): n=a or g
tcatgtctgtatcatggagacatcttcatctgcacncactccatagcccactgaatatttacttttctgtg

SEQ ID NO: 27115 - DNA, 71 bp, chicken (Gallus Gallus)
  misc_feature (36): n=a or g
aaaagttcttaagaacaactataatcctagttctcntgcaacaatagacaaatggagcatcctacagactg

SEQ ID NO: 27116 - DNA, 71 bp, chicken (Gallus Gallus)
  misc_feature (36): n=c or t
gttcttacagcaaacttctgtgtggtcagtgatttntctttctcgtggtggctgagaatttaagtgcatgg

SEQ ID NO: 27117 - DNA, 71 bp, chicken (Gallus Gallus)
  misc_feature (36): n=c or t
gtgcacgactaggttgcagatgcttgatctacatangtcctttttggtctgtgtatacagttctactgtgc

SEQ ID NO: 27118 - DNA, 71 bp, chicken (Gallus Gallus)
  misc_feature (36): n=c or t
atcactgagaaagatatcttcatatacacttagacnacccaagcatttcttcagagactactccatgttta

SEQ ID NO: 27119 - DNA, 71 bp, chicken (Gallus Gallus)
  misc_feature (36): n=c or t
gctgttacttgagaatctgcatctctttttgagcanatgacactgctgtcagtgcttttgttcccatttac

SEQ ID NO: 27120 - DNA, 71 bp, chicken (Gallus Gallus)
  misc_feature (36): n=a or g
tggctggattcattttgtgtagtgtagagccaaatntttggacctctcatctcctcttttcagatggcaag

SEQ ID NO: 27121 - DNA, 71 bp, chicken (Gallus Gallus)
  misc_feature (36): n=a or c
ctggcatgaatcacgtggggacaagacaaggctgtnatgttgcacaagaaactttcggacacgcggttctc

SEQ ID NO: 27122 - DNA, 71 bp, chicken (Gallus Gallus)
  misc_feature (36): n=g or t
tggagctcacaccacagcatttggctatttgtaacngagacactatttatcagctcaaccacagcaactat

SEQ ID NO: 27123 - DNA, 71 bp, chicken (Gallus Gallus)
  misc_feature (36): n=a or g
cataaatggtaactgagatcctctgaaatcgtaacnctcttggtatagaatgcttaaaattttcttctcag

SEQ ID NO: 27124 - DNA, 71 bp, chicken (Gallus Gallus)
  misc_feature (36): n=c or t
ttctgctgctatttaatggccacctagcaatgctgnaggagtgcctaaagcaataaagccacgtctgaaac

SEQ ID NO: 27125 - DNA, 71 bp, chicken (Gallus Gallus)
  misc_feature (36): n=c or g
agagaggaaagaagttcagttaatgactgcaatttntgattgctcaagcctttattgaatttttcttttct

SEQ ID NO: 27126 - DNA, 71 bp, chicken (Gallus Gallus)
  misc_feature (36): n=c or t
taagaaatgaaccttctgatatttcagtggaaaagnataatgtgcctcacagtacatctcatttttactgc

SEQ ID NO: 27127 - DNA, 71 bp, chicken (Gallus Gallus)
  misc_feature (36): n=a or g
taccccatatattcaatttggtttagtgcatttatncagcaaatataaacccaaacaagagcgagctcggt

SEQ ID NO: 27128 - DNA, 71 bp, chicken (Gallus Gallus)
  misc_feature (36): n=c or t
tattaccgaaatgtatacattacacagatggaaganaccttcacgacggtcataaggcatcatcacccact

SEQ ID NO: 27129 - DNA, 71 bp, chicken (Gallus Gallus)
  misc_feature (36): n=g or t
gctataccttgggactggggtcccacagagcaaggngatgcattgagaagcaaaaactctgctcaggctgg

SEQ ID NO: 27130 - DNA, 71 bp, chicken (Gallus Gallus)
  misc_feature (36): n=a or g
aaccacgtttagaaagctggagtctcacagctgacnccaatccactttggagcagagttacacaggtgttt

SEQ ID NO: 27131 - DNA, 71 bp, chicken (Gallus Gallus)
  misc_feature (36): n=g or t
ttcacctgcatggattcctagctgtagccaagcacntcctcatctttcataagcatcagattatcccacag

SEQ ID NO: 27132 - DNA, 71 bp, chicken (Gallus Gallus)
  misc_feature (36): n=c or t
taagtcttcctcaaacttgaagaagtcaaaatgagntgtatgcccagatccatccacagaggacattccca

SEQ ID NO: 27133 - DNA, 71 bp, chicken (Gallus Gallus)
  misc_feature (36): n=c or t
ggttttatattcctatagcttcagcttttggcaacngagttttcagttagaaaaacattctggtctttgtc

SEQ ID NO: 27134 - DNA, 71 bp, chicken (Gallus Gallus)
  misc_feature (36): n=c or g
tggacatgtgattcacccatcagcttttctaccagnatagatgctgtcctccatctactaggagtatacaa

SEQ ID NO: 27135 - DNA, 71 bp, chicken (Gallus Gallus)
  misc_feature (36): n=a or g
cttgacagtgtccctacccttacctcacaatcatcnttactttggtactcacctctcactctctctgtgct

SEQ ID NO: 27136 - DNA, 71 bp, chicken (Gallus Gallus)
  misc_feature (36): n=c or t
ggcaggaatccactgacttggaagattggattacangcggaggggaaaaaacctgttcgggtaaacagttt

SEQ ID NO: 27137 - DNA, 71 bp, chicken (Gallus Gallus)
  misc_feature (36): n=a or c
gaagacaaactttggcgtcttctaaagttttattcntacaggcagaactttatcttgagaaaagttcgcat

SEQ ID NO: 27138 - DNA, 71 bp, chicken (Gallus Gallus)
  misc_feature (36): n=a or g
gtttctttccgttcacacatcttctggtgtcaacantgagaaaaaatagctttactattttgcaagttcat

SEQ ID NO: 27139 - DNA, 71 bp, chicken (Gallus Gallus)
  misc_feature (36): n=c or t
tttcccataggaaaaaatgctggccaagaaacccantcccttctcttcatctgcttcaaagccagttaatc

SEQ ID NO: 27140 - DNA, 71 bp, chicken (Gallus Gallus)
  misc_feature (36): n=a or g
acttttggtgcatttttgacccacctgttaaaaacncagaaacgctacactttgtgtttggttttgaagaa

SEQ ID NO: 27141 - DNA, 71 bp, chicken (Gallus Gallus)
  misc_feature (36): n=a or g
attaagtgcaggtggtggcaaagcctcctacctcantgcttgtgaaatggctgcccatcccctctttcact

SEQ ID NO: 27142 - DNA, 71 bp, chicken (Gallus Gallus)
  misc_feature (36): n=c or t
cacaagaagaatgtcacaattcaatcagtcttttgntttattgatggctggaaatcaattagccctggtca

SEQ ID NO: 27143 - DNA, 71 bp, chicken (Gallus Gallus)
  misc_feature (36): n=c or t
cattgcactttgcatacagtacttcagccatgctgnggttataaagggacactgacttgatgacaccagag

SEQ ID NO: 27144 - DNA, 71 bp, chicken (Gallus Gallus)
  misc_feature (36): n=c or t
tggtgcaacgaaaacatctgtcaggctcttccatanggtttgcactgaaggcaagaccatgagacaggttc

SEQ ID NO: 27145 - DNA, 71 bp, chicken (Gallus Gallus)
  misc_feature (36): n=a or g
agcatttgtcctctcttctcggaagagccctggganctgggctacttcttttcatgtgtttacccgagagc

SEQ ID NO: 27146 - DNA, 71 bp, chicken (Gallus Gallus)
  misc_feature (36): n=a or g
cacatgctagcacaagttagatagatgcctggcaanctcaaaagacaaggtttggcttgccagactgttcc

SEQ ID NO: 27147 - DNA, 71 bp, chicken (Gallus Gallus)
  misc_feature (36): n=a or g
gtgttttttgaagcccaggacagtattttttatggnaggggcataaagcattgtcagtgagttgcacaaat

SEQ ID NO: 27148 - DNA, 71 bp, chicken (Gallus Gallus)
  misc_feature (36): n=a or g
ttgttgttctttctttttttttttttttttcttgcntttattgcagatttaggtacattaggcttttgtaa

SEQ ID NO: 27149 - DNA, 71 bp, chicken (Gallus Gallus)
  misc_feature (36): n=a or c
aaacatcttgtatgcagaaagtatagtgctagttantgtgagaaacgtggtgctgatgcttctggcctctc

SEQ ID NO: 27150 - DNA, 71 bp, chicken (Gallus Gallus)
  misc_feature (36): n=c or g
cgttaaacagtttggattttccttgagatatggctntcatacaccggtttgaggactgtattctttaggag

SEQ ID NO: 27151 - DNA, 71 bp, chicken (Gallus Gallus)
  misc_feature (36): n=a or g
tttttgacatggactgggagggttttcatttcttcnaatgctatgccaccatgttcaccaaagtatcaatt

SEQ ID NO: 27152 - DNA, 71 bp, chicken (Gallus Gallus)
  misc_feature (36): n=g or t
tgagaagccatcacctagagttgtattgggaagagnttaaactattgtataacgcttgtattgaaggcagt

SEQ ID NO: 27153 - DNA, 71 bp, chicken (Gallus Gallus)
  misc_feature (36): n=a or t
tcttggactggaagaaagcaatggccaacagatgtngaaaaagtattatctggggaaagctgtgagaacct

SEQ ID NO: 27154 - DNA, 71 bp, chicken (Gallus Gallus)
  misc_feature (36): n=a or g
ctgcagttgtagtagtactttttgcctgaagagctnatgtgttcagaccaatcatccgcagaatcgtaagc

SEQ ID NO: 27155 - DNA, 71 bp, chicken (Gallus Gallus)
  misc_feature (36): n=g or t
agatctaaagttgtgcctgccattttaccattgatnaacttgctgtttttatgcacttagacattttctgg

SEQ ID NO: 27156 - DNA, 71 bp, chicken (Gallus Gallus)
  misc_feature (36): n=a or g
aaatagttagtggatgtagtcaatgcatgtattgantgcttttcccttcaaaattgaatgttgaacatttg

SEQ ID NO: 27157 - DNA, 71 bp, chicken (Gallus Gallus)
  misc_feature (36): n=a or c
atagacctatgtataaaagtgtataaaaaaaggaantactgctgagaaagtcagcactgaaaagcttagaa

SEQ ID NO: 27158 - DNA, 71 bp, chicken (Gallus Gallus)
  misc_feature (36): n=a or g
gccatgcactgcaatccccaccccaccagtggctgnacatcacaaggaccgatatagggcgaagccagaca

SEQ ID NO: 27159 - DNA, 71 bp, chicken (Gallus Gallus)
  misc_feature (36): n=c or t
atttcagagttacatcagcccctagctatttgttcnttacttctcaaaagcatggcatcaaagaaaaaaaa

SEQ ID NO: 27160 - DNA, 71 bp, chicken (Gallus Gallus)
  misc_feature (36): n=a or t
gttacgtttttaaaacagtgtctataaagcatgacntagaaaagaaatccatgtagccaccagctacactg

SEQ ID NO: 27161 - DNA, 71 bp, chicken (Gallus Gallus)
  misc_feature (36): n=g or t
gttattcaaattaatagattcagcttgtttcccagnatttggagggggaggggatttaaatattttcttcc

SEQ ID NO: 27162 - DNA, 71 bp, chicken (Gallus Gallus)
  misc_feature (36): n=a or g
ctatctgggttgaaggtgaaactaacagcttgatgncagtgcccggatgtatgtggaccagggtgggccag

SEQ ID NO: 27163 - DNA, 71 bp, chicken (Gallus Gallus)
  misc_feature (36): n=a or g
aaggtagatcctccattgacttatggagggtctganttcactgatgcaaatggcattcaatactagctcaa

SEQ ID NO: 27164 - DNA, 71 bp, chicken (Gallus Gallus)
  misc_feature (36): n=c or t
acaggatgtgtgtttgagattggtggatggcaaccnagcacacagcaggggactggaaccaggtgatcctt

SEQ ID NO: 27165 - DNA, 71 bp, chicken (Gallus Gallus)
  misc_feature (36): n=c or t
atcggaggcattcagtctaagctattacgccaatangttttccagattcagctaaattgttgtaaccaagc

SEQ ID NO: 27166 - DNA, 71 bp, chicken (Gallus Gallus)
  misc_feature (36): n=a or g
tgatcaccccattcattaatcacaggcatgttgatntcatcaataaagacagtcattttcttccctgctgg

SEQ ID NO: 27167 - DNA, 71 bp, chicken (Gallus Gallus)
  misc_feature (36): n=g or t
cagtccctcagtcagctactttgcggctttatacanctttcgtaaagcactgaatagcattcagtggagga

SEQ ID NO: 27168 - DNA, 71 bp, chicken (Gallus Gallus)
  misc_feature (36): n=a or g
tgtatattaagtgatctcagtagcctgcatgcttancaattctctcttagacaaataacactaaatgctgg

SEQ ID NO: 27169 - DNA, 71 bp, chicken (Gallus Gallus)
  misc_feature (36): n=c or t
aaatgggaattgcattaatgttgtgtaatctcatangtaatgattggatactttctcagtcactgtttcta

SEQ ID NO: 27170 - DNA, 71 bp, chicken (Gallus Gallus)
  misc_feature (36): n=c or t
atgactatctttatacatcattaaatatcagaacantggtttttatgaaagtgatattatcaggaaaagaa

SEQ ID NO: 27171 - DNA, 71 bp, chicken (Gallus Gallus)
  misc_feature (36): n=a or g
gcagtaccgtggcaccaaggactggcatgctgtccntaaatttagcagtgatttagaaacatcctgcaatt

SEQ ID NO: 27172 - DNA, 71 bp, chicken (Gallus Gallus)
  misc_feature (36): n=a or t
taagagtgctttacagcctctgaaataaataaatgncttgacataacaggtgcaggaacatggatctttca

SEQ ID NO: 27173 - DNA, 71 bp, chicken (Gallus Gallus)
  misc_feature (36): n=a or c
atgaacccagacattaagaggagctcataaagcaantcagatcccactgtagctcatcaggaatctgactc

SEQ ID NO: 27174 - DNA, 71 bp, chicken (Gallus Gallus)
  misc_feature (36): n=a or g
aatgtctctgatctgaatccctaagaatgcatgggntggatgagtctggctgtaaaatactcatccaagat

SEQ ID NO: 27175 - DNA, 71 bp, chicken (Gallus Gallus)
  misc_feature (36): n=a or c
gctattaaaagaaagacaaataatgttctgtggagntccagtacctcttggggaaatttctctctctccat

SEQ ID NO: 27176 - DNA, 71 bp, chicken (Gallus Gallus)
  misc_feature (36): n=g or t
caagacaaggtggagggggccgtgtgcctgaccagnggcccatgttcatctccatcacatcatcctttcac

SEQ ID NO: 27177 - DNA, 71 bp, chicken (Gallus Gallus)
  misc_feature (36): n=c or t
attatcattatcagttatttgtttgtttttacttangttcattactagccatcacgtgaagaaaaaaaaac

SEQ ID NO: 27178 - DNA, 71 bp, chicken (Gallus Gallus)
  misc_feature (36): n=a or g
atccaacttcttgactggagtaaatcccaaggaganattaaatggaaagagtaggtaaaacagtcaaacgt

SEQ ID NO: 27179 - DNA, 71 bp, chicken (Gallus Gallus)
  misc_feature (36): n=a or g
caggcatcctgtgtgataggcagattattcttctgngtatcacctgttctttttatgttctagaaagaaca

SEQ ID NO: 27180 - DNA, 71 bp, chicken (Gallus Gallus)
  misc_feature (36): n=c or t
ggtgttaaaaaacaaactacacaacccaccacatancaaccacaaaaggatattgagatggatctgcaagt

SEQ ID NO: 27181 - DNA, 71 bp, chicken (Gallus Gallus)
  misc_feature (36): n=c or t
agtcaacagaagttgatcccccctgtgctcatttancttccttcctctccttgtttcatcagttaggtgta

SEQ ID NO: 27182 - DNA, 71 bp, chicken (Gallus Gallus)
  misc_feature (36): n=c or t
tcctcaatttctcatcacatggtgcatggagacagngtgaagctgtgcctttaggatttccttcttgaaga

SEQ ID NO: 27183 - DNA, 71 bp, chicken (Gallus Gallus)
  misc_feature (36): n=a or g
ataaaatttttgggcaaatatgtcatataaacagangaaaacttctatgtaaagaagttttatagcatccc

SEQ ID NO: 27184 - DNA, 71 bp, chicken (Gallus Gallus)
  misc_feature (36): n=c or t
gctgtgatgtattccaggagtagtatatccaggacngttaaatagttggcatgctaaggactttattaaag

SEQ ID NO: 27185 - DNA, 71 bp, chicken (Gallus Gallus)
  misc_feature (36): n=c or t
tgcagccagcccagcacgtttccccagaaagccaanacttagctatacctttctcttcctagcattggtct

SEQ ID NO: 27186 - DNA, 71 bp, chicken (Gallus Gallus)
  misc_feature (36): n=c or t
ttaggagttaacatcatcttgctcttcttgacttantgctaagatgaaagggcattggggaataaatgagg

SEQ ID NO: 27187 - DNA, 71 bp, chicken (Gallus Gallus)
  misc_feature (36): n=c or t
actttgagaaaactctacagtaacagggcaggaaantgtcttccactgaatttacaacaggttcagagagt

SEQ ID NO: 27188 - DNA, 71 bp, chicken (Gallus Gallus)
  misc_feature (36): n=a or g
gcacaaaggttttactccacttagttttgcaattcnatcaagacccttctactaccaaaaaaatggagcta

SEQ ID NO: 27189 - DNA, 71 bp, chicken (Gallus Gallus)
  misc_feature (36): n=c or t
atctgctctgcttcgtccaggcgcatctgcaggtcnttgatggtctgctccatgttcttcttcatccgctc

SEQ ID NO: 27190 - DNA, 71 bp, chicken (Gallus Gallus)
  misc_feature (36): n=a or g
atttctcttgaatctttgacttttttcttacttctnttcttagtccaagcattcacttttcaccactgtaa

SEQ ID NO: 27191 - DNA, 71 bp, chicken (Gallus Gallus)
  misc_feature (36): n=c or t
atgcgtcacaaaaatactgggacttcacatttttgngtctgtgatgtgcccatgcccagtctcttggatgg

SEQ ID NO: 27192 - DNA, 71 bp, chicken (Gallus Gallus)
  misc_feature (36): n=a or g
aagactgagaacagaaaggcagtgttagacctactntcccctcctcaaaacacagcagaggagaccaggat

SEQ ID NO: 27193 - DNA, 71 bp, chicken (Gallus Gallus)
  misc_feature (36): n=c or t
tctcagctatactgtatattttatgacataacttanattttaccacacttaaaggtaagacacatacttac

SEQ ID NO: 27194 - DNA, 71 bp, chicken (Gallus Gallus)
  misc_feature (36): n=c or t
agaccagtttgccaagaggggactttttcaaactangttaattgctgatgagagtcagagttataaggtac

SEQ ID NO: 27195 - DNA, 71 bp, chicken (Gallus Gallus)
  misc_feature (36): n=c or t
gttttctattgaaatgcatcagaggatggcccgttntctaatactctttttccctccctcctttccccaaa

SEQ ID NO: 27196 - DNA, 71 bp, chicken (Gallus Gallus)
  misc_feature (36): n=c or t
gctgagagaagagtgtagaaggaaaagagagtaggnaggtcccccttcacttaaaaaaaaaaataagttta

SEQ ID NO: 27197 - DNA, 71 bp, chicken (Gallus Gallus)
  misc_feature (36): n=a or g
aataccatcatgaagcttttttcattttagctatgncagctttggaaaacaaagatgaggaggctgagtgt

SEQ ID NO: 27198 - DNA, 71 bp, chicken (Gallus Gallus)
  misc_feature (36): n=a or t
ctgagtgcaaggaagtattcacggtgaacttcaatnactttaaacgaaaagggtctccaaaactactttta

SEQ ID NO: 27199 - DNA, 71 bp, chicken (Gallus Gallus)
  misc_feature (36): n=a or g
ttgcagtccccaaattaatgatttccagagcatttnccaggactgaaagctgaggaatcgttcttagagct

SEQ ID NO: 27200 - DNA, 71 bp, chicken (Gallus Gallus)
  misc_feature (36): n=c or t
gattaaaagatcagaaaagtctcttcatctggtcanctaccccaatcttccatggaaaagagcccaaaggg

SEQ ID NO: 27201 - DNA, 71 bp, chicken (Gallus Gallus)
  misc_feature (36): n=c or g
ctcactcttttcaggtgtttggttgttggttctagnagaaaaaaaatatcccccccccaaagtagaggcac

SEQ ID NO: 27202 - DNA, 71 bp, chicken (Gallus Gallus)
  misc_feature (36): n=c or t
gatcccagggtttgtaggcatgggctgaatggggtnggtgagcagaaataagtcagtggttaccttgtgag

SEQ ID NO: 27203 - DNA, 71 bp, chicken (Gallus Gallus)
  misc_feature (36): n=c or t
gaaataaggaagaagtctgcttttgttgagctaganggagaatagagaatcaagaatatgggctcaaaatt

SEQ ID NO: 27204 - DNA, 71 bp, chicken (Gallus Gallus)
  misc_feature (36): n=c or g
cagtcctctaccatgcaacacaaccacggtgagganagcgtagttaaatttgccttggcccaatccacgaa

SEQ ID NO: 27205 - DNA, 71 bp, chicken (Gallus Gallus)
  misc_feature (36): n=c or t
attattgtgaagtgagtgcataagtaatttggaacnatatacagagagcagttggcaatggtataccatta

SEQ ID NO: 27206 - DNA, 71 bp, chicken (Gallus Gallus)
  misc_feature (36): n=a or c
cttcacttagcaatgggtactggcataccaccaggnaaacctttttctgttcttaactaaattgatgcatt

SEQ ID NO: 27207 - DNA, 71 bp, chicken (Gallus Gallus)
  misc_feature (36): n=c or t
gctgcacatcgatcacagtttttcttcactcactantggagtagttgaacacaggagagaacagaattcat

SEQ ID NO: 27208 - DNA, 71 bp, chicken (Gallus Gallus)
  misc_feature (36): n=a or g
ggttagctcaacctggtgtctggatcaaactgtacntgaaaagcacacgagccaggtggcaaagtaccttt

SEQ ID NO: 27209 - DNA, 71 bp, chicken (Gallus Gallus)
  misc_feature (36): n=a or g
ctgcagcacaagtcttatcatctctgtggcccaccngtgtactctctccaagagatcgctgtcttttttcg

SEQ ID NO: 27210 - DNA, 71 bp, chicken (Gallus Gallus)
  misc_feature (36): n=a or g
aggatcctaggagtgtttttaaaactgcctgtttangaaacagttggatcagcctcagctataacagtgtt

SEQ ID NO: 27211 - DNA, 71 bp, chicken (Gallus Gallus)
  misc_feature (36): n=a or g
gcaaacacagttttctttttccataaatgaagtccnaagaatttgttgcaatataaaaatattatccacat

SEQ ID NO: 27212 - DNA, 71 bp, chicken (Gallus Gallus)
  misc_feature (36): n=a or g
gcttgtggaaaaggaagtttgcagaatgtgattccncattaactgacttgggaacaaacaaaaccaccatg

SEQ ID NO: 27213 - DNA, 71 bp, chicken (Gallus Gallus)
  misc_feature (36): n=c or g
tgtaaaatcgattttttctaaagtacgaccatgganaaaaattttcagcttgtggatttttatattgtttt

SEQ ID NO: 27214 - DNA, 71 bp, chicken (Gallus Gallus)
  misc_feature (36): n=a or g
aatctacagtttaaccatatggttatccagcatgcnctctcacaacttttattcccaagagctgatggttg

SEQ ID NO: 27215 - DNA, 71 bp, chicken (Gallus Gallus)
  misc_feature (36): n=c or g
tctccttgtagaccctctccttggtctacaaccctnagctaaaaacactaggatggcagaaaaaggtgaga

SEQ ID NO: 27216 - DNA, 71 bp, chicken (Gallus Gallus)
  misc_feature (36): n=c or t
cccaacttgtggctggagacctgggaattttagtgngtcaggacatctgcagagggtttacttttcatctg

SEQ ID NO: 27217 - DNA, 71 bp, chicken (Gallus Gallus)
  misc_feature (36): n=a or g
gcattggacactgctgcagaatgccaacactgaccntacagatgtagggaaaggaatggacagaagcactc

SEQ ID NO: 27218 - DNA, 71 bp, chicken (Gallus Gallus)
  misc_feature (36): n=a or g
cagctcggcatggccaatcacactgatgcgagggtngacacagatttggggcttttcttatctcattggca

SEQ ID NO: 27219 - DNA, 71 bp, chicken (Gallus Gallus)
  misc_feature (36): n=c or t
agacaaggtgatctagttgactggcaactggttganattgtctaagttagcaggtactgtgctgagaatgt

SEQ ID NO: 27220 - DNA, 71 bp, chicken (Gallus Gallus)
  misc_feature (36): n=a or g
caagtaattcccatacctgcacagtaggagggcatntagtcttagtttttagtattaaaataataataata

SEQ ID NO: 27221 - DNA, 71 bp, chicken (Gallus Gallus)
  misc_feature (36): n=a or g
tttagcttctacaaaacccactaatggcagtttaanctcaattgctctcatctacatctccaggacaatca

SEQ ID NO: 27222 - DNA, 71 bp, chicken (Gallus Gallus)
  misc_feature (36): n=a or g
caactataaattcaaaatgtatgatgcagttgaacnagatgttttagaggtcttttccaactttaataatt

SEQ ID NO: 27223 - DNA, 71 bp, chicken (Gallus Gallus)
  misc_feature (36): n=a or g
ttctctctccccaggttcaaatttttagcttttggngatgtgagagctaaaaataagaaagtaaaattcag

SEQ ID NO: 27224 - DNA, 71 bp, chicken (Gallus Gallus)
  misc_feature (36): n=g or t
catctttttgaacagaccatacagcatagccaaganactgtgcagctgattacctggcggccagaacgatg

SEQ ID NO: 27225 - DNA, 71 bp, chicken (Gallus Gallus)
  misc_feature (36): n=a or g
agttcccttctactgggcttaagtgcaaataatatnaggtttggaatccactgatcttacaataactattt

SEQ ID NO: 27226 - DNA, 71 bp, chicken (Gallus Gallus)
  misc_feature (36): n=c or g
caatctaatatagattatttcccacaacatagttcnataatgtccacaaaatgccaaaagctctggcagag

SEQ ID NO: 27227 - DNA, 71 bp, chicken (Gallus Gallus)
  misc_feature (36): n=a or g
ttgaaaatcatgaagtcaaaatatctcctactgagnaagcacaaaataacaggtacaactagttttctctg

SEQ ID NO: 27228 - DNA, 71 bp, chicken (Gallus Gallus)
  misc_feature (36): n=a or t
acaaaaggcgagatgtctttaagcaaacacaccatnagggcaactaacataagatcacagaatttctgaaa

SEQ ID NO: 27229 - DNA, 71 bp, chicken (Gallus Gallus)
  misc_feature (36): n=a or c
tatctatgctctgattctgcatttttagtttcaatncctaactgccttaatcccctaccacaaacatcttt

SEQ ID NO: 27230 - DNA, 71 bp, chicken (Gallus Gallus)
  misc_feature (36): n=a or g
acatttttacagcaaagtattctggaatggattgcnaaagtaaaccaaagatagacacacgtttgttgtgc

SEQ ID NO: 27231 - DNA, 71 bp, chicken (Gallus Gallus)
  misc_feature (36): n=c or t
tcagagcctggctctagctccttcaggaatgacttnggagatgtccttcactgcttgtgtttcacaagagc

SEQ ID NO: 27232 - DNA, 71 bp, chicken (Gallus Gallus)
  misc_feature (36): n=c or g
cctctacattttgagaaaaagtactttccaaatgtnaatgttttacatatccttctacttcctcaatgcat

SEQ ID NO: 27233 - DNA, 71 bp, chicken (Gallus Gallus)
  misc_feature (36): n=a or g
tggttgtggctttctgtgttccatacccacacgtancaggcctggtgctgaaaggctgagacaagagtttc

SEQ ID NO: 27234 - DNA, 71 bp, chicken (Gallus Gallus)
  misc_feature (36): n=c or t
tttcaaatgtgaataagagtccttcagagataaagnatcccaggttaaatctaatgatgtccaggggaatt

SEQ ID NO: 27235 - DNA, 71 bp, chicken (Gallus Gallus)
  misc_feature (36): n=c or t
ctgctattacctgtgtaatatttttcccagggttanacagaacaattcagtttcaaagggaatttgactgg

SEQ ID NO: 27236 - DNA, 71 bp, chicken (Gallus Gallus)
  misc_feature (36): n=c or t
catgtttctcactttctacttgctttgtaagaatanagaatcatataaatatttcaattggaaaagacctt

SEQ ID NO: 27237 - DNA, 71 bp, chicken (Gallus Gallus)
  misc_feature (36): n=g or t
agtgtgttttgtgatgtttaccctatgtattaaatnatgctaaaggagtaacagtacatcacacagtgatg

SEQ ID NO: 27238 - DNA, 71 bp, chicken (Gallus Gallus)
  misc_feature (36): n=a or g
tatttccacgtagctcacacagttccctaagagggngaaaataatgcataggatcagagcagaaaacttct

SEQ ID NO: 27239 - DNA, 71 bp, chicken (Gallus Gallus)
  misc_feature (36): n=c or t
agggcttgaaaatagtcttcttggagacacacagangatattcaaccactggccaacacatatgcagagcg

SEQ ID NO: 27240 - DNA, 71 bp, chicken (Gallus Gallus)
  misc_feature (36): n=a or g
gagttcatgctcattaaagggggggaaaaaacacancagtcactgcttgtaggaatgtgaatattttgatt

SEQ ID NO: 27241 - DNA, 71 bp, chicken (Gallus Gallus)
  misc_feature (36): n=c or t
acattacaggagttgtaaatctctgtgtaaatcatnagaggattatttccccttgtgagaaataagatagc

SEQ ID NO: 27242 - DNA, 71 bp, chicken (Gallus Gallus)
  misc_feature (36): n=a or g
tgaaagcctccgagcatgggatcgccactccagcanctctgctgtcattcctgtggctaaaaatcatgctg

SEQ ID NO: 27243 - DNA, 71 bp, chicken (Gallus Gallus)
  misc_feature (36): n=c or t
aacagatctgacagagacagtgtatatttcatcacngttatggcagggatatatatgtatatatactaata

SEQ ID NO: 27244 - DNA, 71 bp, chicken (Gallus Gallus)
  misc_feature (36): n=c or t
gtgttactttccaactcgaatagaatacaagatccnagtatcttaatgctacaaatagttattgatatttt

SEQ ID NO: 27245 - DNA, 71 bp, chicken (Gallus Gallus)
  misc_feature (36): n=c or t
tgagaagttttgtttcgtagacaatgaggtcccaanccagcaaagaaatttgagcactgtattcagttaat

SEQ ID NO: 27246 - DNA, 71 bp, chicken (Gallus Gallus)
  misc_feature (36): n=a or g
tctaaaggagattgtgatgttttaaaaacattaatntttgagtctcaacaaggaaggggtcataacttctt

SEQ ID NO: 27247 - DNA, 71 bp, chicken (Gallus Gallus)
  misc_feature (36): n=a or g
tgacatgatcagatattctgcacttgtttgctgctnttcagaccagcctgccctacagcctgagctttgtg

SEQ ID NO: 27248 - DNA, 71 bp, chicken (Gallus Gallus)
  misc_feature (36): n=c or g
tacttttcaaacagatttgtttgtttgtttttgctntgtcacttacaatgttacctagccaatctgccaca

SEQ ID NO: 27249 - DNA, 71 bp, chicken (Gallus Gallus)
  misc_feature (36): n=a or g
tcaagcacactgaagtggaagcctggatgcaagtantctcgtaccttgaggaaaccacacaacatgttttt

SEQ ID NO: 27250 - DNA, 71 bp, chicken (Gallus Gallus)
  misc_feature (36): n=a or g
gctgtcagcatagccagtatgaatggctgtgtaagntaattgcattgcatctctgtaacagccataacaca

SEQ ID NO: 27251 - DNA, 71 bp, chicken (Gallus Gallus)
  misc_feature (36): n=a or g
taaatctgagagatacacagatgttgtggataactngcaattaaataatttataatgttgacatgttgtca

SEQ ID NO: 27252 - DNA, 71 bp, chicken (Gallus Gallus)
  misc_feature (36): n=a or g
aactcagagagattcttcacttgtgaatcctgaaanctttgtatggtataagcatcaggagctcagtgcag

SEQ ID NO: 27253 - DNA, 71 bp, chicken (Gallus Gallus)
  misc_feature (36): n=c or t
tgcataaactgcacatgtggtgccttagctttcaantggcatccaaatcccaaaagcaacttatcatgaat

SEQ ID NO: 27254 - DNA, 71 bp, chicken (Gallus Gallus)
  misc_feature (36): n=c or t
tatcacatgtctgtgcacctttctcattgcacgganggatgggatttgttgtgttgggacttgaggtctcc

SEQ ID NO: 27255 - DNA, 71 bp, chicken (Gallus Gallus)
  misc_feature (36): n=c or t
ttcaaagccttcaattatcaagctagaaatttattnagggctacctttgaatacataatatactgtaacag

SEQ ID NO: 27256 - DNA, 71 bp, chicken (Gallus Gallus)
  misc_feature (36): n=c or t
aagcataacaaaggcagttccctgtttcacacaggnattggcaacatggccagcattgcaagatcatcgga

SEQ ID NO: 27257 - DNA, 71 bp, chicken (Gallus Gallus)
  misc_feature (36): n=g or t
aaagggcaactgacaacagttacgtagagaactttncaaagctgaaaactgtgacaaattgtccactgtca

SEQ ID NO: 27258 - DNA, 71 bp, chicken (Gallus Gallus)
  misc_feature (36): n=a or g
ttaacagagacttaagatttgagatggctagatacncttgattatctaccagatagagtataggcttaaac

SEQ ID NO: 27259 - DNA, 71 bp, chicken (Gallus Gallus)
  misc_feature (36): n=a or t
gcggtaactttgggatgctgagaatggtgggcattnttttcctgtgctaaccagagagtatggttgatctc

SEQ ID NO: 27260 - DNA, 71 bp, chicken (Gallus Gallus)
  misc_feature (36): n=c or t
tcatccctcacagaaatgatgaggtacactgctgcngaattttacagtgactgactttataatagaaagct

SEQ ID NO: 27261 - DNA, 71 bp, chicken (Gallus Gallus)
  misc_feature (36): n=g or t
ttaacagaagcacaaaccagccctaatgctgagatnctatatcggccaaaaagggattttgtctcctcagc

SEQ ID NO: 27262 - DNA, 71 bp, chicken (Gallus Gallus)
  misc_feature (36): n=c or t
caacagattgtactagccactgacttatggatcatnctgctttgtgcaggatgctcttctgtggcatcaga

SEQ ID NO: 27263 - DNA, 71 bp, chicken (Gallus Gallus)
  misc_feature (36): n=a or g
tctttgagagcatgcaccaaaaagtgttgaaaaacnttagaagtgtatgtgcgtattctttgagatgcaat

SEQ ID NO: 27264 - DNA, 71 bp, chicken (Gallus Gallus)
  misc_feature (36): n=g or t
gctaacctgaataactgtgttaaaagtcagagcatnaagatgttaataaattattccatctgagatgtttg

SEQ ID NO: 27265 - DNA, 71 bp, chicken (Gallus Gallus)
  misc_feature (36): n=c or t
tagccttggctcgaaatctcgttggtttggggccgnccagtttaacatgagatttttctttaaacgctgca

SEQ ID NO: 27266 - DNA, 71 bp, chicken (Gallus Gallus)
  misc_feature (36): n=c or t
caaactcttgcagttttgttgtagttcaaatgactncagtgttcgtatgtctaaggagaagtatgtgcgtt

SEQ ID NO: 27267 - DNA, 71 bp, chicken (Gallus Gallus)
  misc_feature (36): n=a or g
tgagagaaggaactgcatctggtaacatgttaactncaatgcaatcaacgggattcttttaaaactgtatt

SEQ ID NO: 27268 - DNA, 71 bp, chicken (Gallus Gallus)
  misc_feature (36): n=a or g
aaaacatagcatctatttcacctcagggtcaaaaantccaatctttttttaaacagagaacacttcaatta

SEQ ID NO: 27269 - DNA, 71 bp, chicken (Gallus Gallus)
  misc_feature (36): n=a or g
aaaagggacaaattaagtggacttgtatgtgggggnaaaaaaatgctattgggtagagtagcaggagtaaa

SEQ ID NO: 27270 - DNA, 71 bp, chicken (Gallus Gallus)
  misc_feature (36): n=a or g
gggacgttctcccgcatccacttccgattctcctcnttggcagcgatgtctttttcctcaaattctatttt

SEQ ID NO: 27271 - DNA, 71 bp, chicken (Gallus Gallus)
  misc_feature (36): n=c or t
ttctactaatagaagtattaatgcctttagaatctntacctaactacaactcaactagggaactgactaat

SEQ ID NO: 27272 - DNA, 71 bp, chicken (Gallus Gallus)
  misc_feature (36): n=c or t
gcatttagtattcctaactattgtggctcctaattntttgcttccataaattagcacagaaatgtccatct

SEQ ID NO: 27273 - DNA, 71 bp, chicken (Gallus Gallus)
  misc_feature (36): n=c or t
tcatatactccctcaaagagtaggattaatcttgcntagttttatccatacagaaatcatattgattttat

SEQ ID NO: 27274 - DNA, 71 bp, chicken (Gallus Gallus)
  misc_feature (36): n=c or t
tgagctaatgttgctattcacattcccgagttgttngttcagactgtcttggctccagaaaatgacaatat

SEQ ID NO: 27275 - DNA, 71 bp, chicken (Gallus Gallus)
  misc_feature (36): n=a or g
tagcttaaagcatcttgccaaaataatagttaacanctgtttacccatcatgattcacctccttcaggatc

SEQ ID NO: 27276 - DNA, 71 bp, chicken (Gallus Gallus)
  misc_feature (36): n=a or g
ctgttttctgtaatagcatgcttcaggggtaacganctgacctatcttctggaagtacattactatggggg

SEQ ID NO: 27277 - DNA, 71 bp, chicken (Gallus Gallus)
  misc_feature (36): n=a or g
caggaaaggggtgcaacagtgttagatcaagctttnctaggctggatggccaaggctgtggaataagtgat

SEQ ID NO: 27278 - DNA, 71 bp, chicken (Gallus Gallus)
  misc_feature (36): n=c or t
gaggacaaaaaaacctccatgtactgcagaagattnccaatgactcttcctaaaagccacatgtacttgga

SEQ ID NO: 27279 - DNA, 71 bp, chicken (Gallus Gallus)
  misc_feature (36): n=a or g
ccttcctgaagcagcccttggggtgaactggtgctnggttgcttgttacttgcgtggcctctgtaggctcc

SEQ ID NO: 27280 - DNA, 71 bp, chicken (Gallus Gallus)
  misc_feature (36): n=c or t
ttttcctcacttcttcttacacaggagaggtgagtngtgcttatatgttggcagtgctatgtcatctagga

SEQ ID NO: 27281 - DNA, 71 bp, chicken (Gallus Gallus)
  misc_feature (36): n=a or g
tatgttgagcagcttgcctttcctgaagcttcacanagtcacagagctgtaggggctgttaaggatctctg

SEQ ID NO: 27282 - DNA, 71 bp, chicken (Gallus Gallus)
  misc_feature (36): n=a or t
tttcttaacctcttttcctgattacagtgttagaangtttgttgatggaaaaatggagggcaaaaggatta

SEQ ID NO: 27283 - DNA, 71 bp, chicken (Gallus Gallus)
  misc_feature (36): n=c or t
gacagtgcactgctttgcgtaacggtggcatgcatntgacaaaggagtgcttttaaaaacaagctacagca

SEQ ID NO: 27284 - DNA, 71 bp, chicken (Gallus Gallus)
  misc_feature (36): n=c or t
gatgaggaagatgacttggatgaagaagtcattgangaagaagatgatgaagatgatgatctggaaggtga

SEQ ID NO: 27285 - DNA, 71 bp, chicken (Gallus Gallus)
  misc_feature (36): n=a or g
atggctaaagcacgaacagatatttgctggaaaccnttggcagcattttctcagcaaaggttattgttaga

SEQ ID NO: 27286 - DNA, 71 bp, chicken (Gallus Gallus)
  misc_feature (36): n=c or t
gaatcagaccctgtgtgctgggtgtctggaaccagntcattagcagcatctttgctgctcggtgctgattc

SEQ ID NO: 27287 - DNA, 71 bp, chicken (Gallus Gallus)
  misc_feature (36): n=a or g
tgtgcccagatggccaatgcagccagtggcagcctnactatatcagaaacagtgtaggcatcggcactaga

SEQ ID NO: 27288 - DNA, 71 bp, chicken (Gallus Gallus)
  misc_feature (36): n=a or g
tgaaacagtggtttgtgtgaccgagaagtaagggangggtaaggatgtctgctgaaataatgctgtttgag

SEQ ID NO: 27289 - DNA, 71 bp, chicken (Gallus Gallus)
  misc_feature (36): n=c or t
agtccagatgaggcccaacttatcctgaatttatcngtatttgcaggagtctttttctaggttggaagcat

SEQ ID NO: 27290 - DNA, 71 bp, chicken (Gallus Gallus)
  misc_feature (36): n=c or t
ttagagtaacagagggacatagggaactgcaagagngagaggaggttgatgacgtggctgaggtgaagagg

SEQ ID NO: 27291 - DNA, 71 bp, chicken (Gallus Gallus)
  misc_feature (36): n=c or t
attgctgggtggctatagagtgccatttgtaccggntgttctgtgtgatgtaaccatcactttcacgttaa

SEQ ID NO: 27292 - DNA, 71 bp, chicken (Gallus Gallus)
  misc_feature (36): n=a or g
tgatggtagggtcagaacgctttcacactgcttgangtacattggggtcaactgatggggaacagccacct

SEQ ID NO: 27293 - DNA, 71 bp, chicken (Gallus Gallus)
  misc_feature (36): n=c or t
tgtgacagtttatgcgtctcaaatacccatttgccngttgagacctgttttgcacaatatggatatttttt

SEQ ID NO: 27294 - DNA, 71 bp, chicken (Gallus Gallus)
  misc_feature (36): n=a or g
atctagattaattcctcactctagtgcaggaagacngataatctaagatcacctcagtatatgggaaggag

SEQ ID NO: 27295 - DNA, 71 bp, chicken (Gallus Gallus)
  misc_feature (36): n=a or g
atttggcaggcatgctatctctgagaaacagcaggngagaaagcactgtctcatggtgttgttgttgacta

SEQ ID NO: 27296 - DNA, 71 bp, chicken (Gallus Gallus)
  misc_feature (36): n=a or t
taatacctggaaagaagtaacttgtcagtacataangatctctgcagtattttgacaggcatttagcaatt

SEQ ID NO: 27297 - DNA, 71 bp, chicken (Gallus Gallus)
  misc_feature (36): n=c or t
catggctgccctcagcataggtttgcatccctcctngtaccatgttctctgcttctaggtgtcaccagtta

SEQ ID NO: 27298 - DNA, 71 bp, chicken (Gallus Gallus)
  misc_feature (36): n=a or g
ataattttcatcaaacacaaatgaagtacctaaagnaagaatctttattttcttgtttggattggggaaga

SEQ ID NO: 27299 - DNA, 71 bp, chicken (Gallus Gallus)
  misc_feature (36): n=a or c
gatagagctgctaagagttagtaggtaacttaagantacttccatggtgttttctgaagagatgcttaatg

SEQ ID NO: 27300 - DNA, 71 bp, chicken (Gallus Gallus)
  misc_feature (36): n=a or g
ttttcaaccttattaatttttatgagactaagaaantactggagcaggcttgagttgttactggtgggaaa

SEQ ID NO: 27301 - DNA, 71 bp, chicken (Gallus Gallus)
  misc_feature (36): n=a or c
taattaacatttcctcctattatatgcaattgttcntcattttctactaattattttctagactgttgata

SEQ ID NO: 27302 - DNA, 71 bp, chicken (Gallus Gallus)
  misc_feature (36): n=c or t
actgacatcactgagtcatcataggaacaggctttnctcacttgagttggaaataagatggggacttagtc

SEQ ID NO: 27303 - DNA, 71 bp, chicken (Gallus Gallus)
  misc_feature (36): n=a or g
ctgtcatgttaaaatgtatacataaaaactgagacntaacatctttggttttgttccggaaaaacatttca

SEQ ID NO: 27304 - DNA, 71 bp, chicken (Gallus Gallus)
  misc_feature (36): n=c or t
gttcatttcaaactaattgtatgtttatcaaaagcngtgaagtaatgacagaatgatttgcttttaaacaa

SEQ ID NO: 27305 - DNA, 71 bp, chicken (Gallus Gallus)
  misc_feature (36): n=a or g
aattcattaatgaggatataaaatgaagaagttgtnggaacatttctatgaatagagttatgttacaagaa

SEQ ID NO: 27306 - DNA, 71 bp, chicken (Gallus Gallus)
  misc_feature (36): n=a or c
ctatgataattcccagctgggaacaagaacaggcangtaggggaccttttggataccttcgggcagaggta

SEQ ID NO: 27307 - DNA, 71 bp, chicken (Gallus Gallus)
  misc_feature (36): n=c or t
ggcatcattccagtggcgtagtaataaattaaaaanggatatccttacccattttgtataaactcagtctt

SEQ ID NO: 27308 - DNA, 71 bp, chicken (Gallus Gallus)
  misc_feature (36): n=c or t
aattccaacaacagatcacaacacacactgacgagntgggattagaaatagctgggtagcatgctgctagc

SEQ ID NO: 27309 - DNA, 71 bp, chicken (Gallus Gallus)
  misc_feature (36): n=c or t
taactgtagaccaactttacttttcacagtggaaantttgacttttgatcatgatagaagtcttttctgtc

SEQ ID NO: 27310 - DNA, 71 bp, chicken (Gallus Gallus)
  misc_feature (36): n=a or g
tcttaagtgagcagcaccaggaaaaggcagctctcntgtaacaaaactgctagacctttttcttctagttt

SEQ ID NO: 27311 - DNA, 71 bp, chicken (Gallus Gallus)
  misc_feature (36): n=a or g
taacttgtggtcataactaccagccagctgtcctcncgccctggaatggtaacttcttaaatagaactaag

SEQ ID NO: 27312 - DNA, 71 bp, chicken (Gallus Gallus)
  misc_feature (36): n=a or g
aatttaaaccactttaactgctcataacttgatctncaacggaacatccagaaatgaattcagccttttca

SEQ ID NO: 27313 - DNA, 71 bp, chicken (Gallus Gallus)
  misc_feature (36): n=a or c
ggaaggctttttgtttttaaaccactgagctcttanataaatacttttcaatggagaagagacgtttctgg

SEQ ID NO: 27314 - DNA, 71 bp, chicken (Gallus Gallus)
  misc_feature (36): n=a or g
gggcagatctgtcactgctttgtaggatcttaaaangaactcagagataacggcagaatggctcttgctgc

SEQ ID NO: 27315 - DNA, 71 bp, chicken (Gallus Gallus)
  misc_feature (36): n=a or g
aaagtgagggataagtgcggcacaacttagcctgantaagactggagctggggtggggtatgaatttttca

SEQ ID NO: 27316 - DNA, 71 bp, chicken (Gallus Gallus)
  misc_feature (36): n=c or t
ttctcttcgtgcctcagacattgttacccaaactgngtgatgagcagcatgctgacagagacagctctctc

SEQ ID NO: 27317 - DNA, 71 bp, chicken (Gallus Gallus)
  misc_feature (36): n=a or g
aggcaacctgagcttgtagttggcatggaagacttngataaaagcctaactccactaagtcaatagcaaga

SEQ ID NO: 27318 - DNA, 71 bp, chicken (Gallus Gallus)
  misc_feature (36): n=c or t
tattcttattgggacaggagactgcattcaatatcnagattttatctagaagagcacaagtacaagtgaca

SEQ ID NO: 27319 - DNA, 71 bp, chicken (Gallus Gallus)
  misc_feature (36): n=a or g
ttgcctgcaactacatagtcactaccttaaactggnaaaaacaaacaaacattttttcaaaataaaaatag

SEQ ID NO: 27320 - DNA, 71 bp, chicken (Gallus Gallus)
  misc_feature (36): n=a or c
atttggctgataaatacaaaagctgttgatgaagtngggctccagcaaggaatgcgatatgttctcattct

SEQ ID NO: 27321 - DNA, 71 bp, chicken (Gallus Gallus)
  misc_feature (36): n=a or g
acatgaaagccagaatttctccactggatccagcanggcctcttagtctgcctcaatgaatcctcagtggt

SEQ ID NO: 27322 - DNA, 71 bp, chicken (Gallus Gallus)
  misc_feature (36): n=a or g
tgtctggatcctcatctagctttccaagctggaccngtaggagctggtgcatctttccaggtagtaagagt

SEQ ID NO: 27323 - DNA, 71 bp, chicken (Gallus Gallus)
  misc_feature (36): n=a or t
gcttctgaatgactttctttataaaacgtatccaancaaacaaatgaaacaaattataaaacttaaatgaa

SEQ ID NO: 27324 - DNA, 71 bp, chicken (Gallus Gallus)
  misc_feature (36): n=a or g
ttacttagcactcctgtaaatatgactggcacaggnagcacagctttgctatgtataaaaatagaacatta

SEQ ID NO: 27325 - DNA, 71 bp, chicken (Gallus Gallus)
  misc_feature (36): n=a or g
atcctcagttaccactgtgggtgctatggttggtancaagtgagcctccaggttttcagatgagatgtagg

SEQ ID NO: 27326 - DNA, 71 bp, chicken (Gallus Gallus)
  misc_feature (36): n=c or g
caacaaagcatgtaagcacgtagtgaactgtggcantacaaggttcagtgaagggcatctgctcttaacat

SEQ ID NO: 27327 - DNA, 71 bp, chicken (Gallus Gallus)
  misc_feature (36): n=a or g
gtttctgaaagtgagccaagtcctgcagttcttcanaagttaaaccatacaattattgcttttgcattttt

SEQ ID NO: 27328 - DNA, 71 bp, chicken (Gallus Gallus)
  misc_feature (36): n=a or c
gtgcagtcctcactggagtgctacaggcatccctantcaccttactgaaccagcttagtctacgggtcccc

SEQ ID NO: 27329 - DNA, 71 bp, chicken (Gallus Gallus)
  misc_feature (36): n=g or t
ataactgatagaggaatggagcacagctgctattcntgctatcagttgctgttctgcacgctcctgtccct

SEQ ID NO: 27330 - DNA, 71 bp, chicken (Gallus Gallus)
  misc_feature (36): n=c or t
ctcccatctttcagtttaaaataattccctcattcntttgctgtctgcccatgcaaaaagtcagtcgccct

SEQ ID NO: 27331 - DNA, 71 bp, chicken (Gallus Gallus)
  misc_feature (36): n=c or t
ctttcacctagcacttcccctctctttcagaagcancttgtctgtggaccagtgaaggtgacaaaacccgt

SEQ ID NO: 27332 - DNA, 71 bp, chicken (Gallus Gallus)
  misc_feature (36): n=c or t
catataatttctgagaactgtttggtagacttccantggctcaggaccagcaccacgtcagggcacactat

SEQ ID NO: 27333 - DNA, 71 bp, chicken (Gallus Gallus)
  misc_feature (36): n=a or g
cttcttacaaagctgttactcttgtagtaagtagcntctgcaaagttgaagacatgcaagaaggtaaaggc

SEQ ID NO: 27334 - DNA, 71 bp, chicken (Gallus Gallus)
  misc_feature (36): n=c or t
gagcagacatgtagaaaacaaagaggccagggctcngggacctcctggataaactgtcccctccccggcca

SEQ ID NO: 27335 - DNA, 71 bp, chicken (Gallus Gallus)
  misc_feature (36): n=a or g
tcaattcaacaaatccatctggtccttttgttacanacctatggttatatggactgctcttccacagatca

SEQ ID NO: 27336 - DNA, 71 bp, chicken (Gallus Gallus)
  misc_feature (36): n=a or g
aaataaaagagaactccttccaacatccaggcacantttagtcctttaacctttttatcctgctaggcaca

SEQ ID NO: 27337 - DNA, 71 bp, chicken (Gallus Gallus)
  misc_feature (36): n=a or g
tcagtgagactaaaggtcaactgaacagaaagttgnaggcaatgaaacccaaaaaagtctgattccttttc

SEQ ID NO: 27338 - DNA, 71 bp, chicken (Gallus Gallus)
  misc_feature (36): n=a or g
tgtagaaagccttcagtaaatactctaccttcctcnctgcaagtgctggaattccccagtccttccacggg

SEQ ID NO: 27339 - DNA, 71 bp, chicken (Gallus Gallus)
  misc_feature (36): n=a or c
caaagatgcagcaaacagtacagagaaatagtcccnaagggaaactcatcctgttcaaacatatgttactc

SEQ ID NO: 27340 - DNA, 71 bp, chicken (Gallus Gallus)
  misc_feature (36): n=a or c
gttcatactgctccccaagaaatcacattttagcanaggataattgacaagtttttctgtagtattctaga

SEQ ID NO: 27341 - DNA, 71 bp, chicken (Gallus Gallus)
  misc_feature (36): n=a or g
actttgctgagtagcttcctgcaacatcagggaacntacttacatgttatcattttaatggacaccacttt

SEQ ID NO: 27342 - DNA, 71 bp, chicken (Gallus Gallus)
  misc_feature (36): n=a or g
tttacttgctgctctgcagtgaagtagtccaatttngtgctaaacatgttaaacttgttccttcttgttgt

SEQ ID NO: 27343 - DNA, 71 bp, chicken (Gallus Gallus)
  misc_feature (36): n=c or t
ggtcatagctagctcaaatgaactcttcatcacagnattggatattacagctggaaattatgatcagttaa

SEQ ID NO: 27344 - DNA, 71 bp, chicken (Gallus Gallus)
  misc_feature (36): n=a or c
gtctgacagcaacaggagactggcaataaggccagnagtatgagttctaataaggagctggtcaggcataa

SEQ ID NO: 27345 - DNA, 71 bp, chicken (Gallus Gallus)
  misc_feature (36): n=a or g
tcagtgcaagtgaaacaaacagcacttcactagaangaacatacaggctttagagaagagaaagtctgcta

SEQ ID NO: 27346 - DNA, 71 bp, chicken (Gallus Gallus)
  misc_feature (36): n=c or g
cgaaaataaaattcagccttgcaacagttgcttcanggggatgtatcagctggtctaaaaaaggccctgtg

SEQ ID NO: 27347 - DNA, 71 bp, chicken (Gallus Gallus)
  misc_feature (36): n=c or t
gtaattttacaagatttagataagttggaatcactnggcaactcaatttgagagctgctttctccaaaaca

SEQ ID NO: 27348 - DNA, 71 bp, chicken (Gallus Gallus)
  misc_feature (36): n=a or g
tgtacggtgaatgactaattctggtaaggaatgccnttcctcttttcaaaaaaatgaaattcaacgtggtc

SEQ ID NO: 27349 - DNA, 71 bp, chicken (Gallus Gallus)
  misc_feature (36): n=c or t
tgtccctgtatgttatcctgcctgctgcttctctcncatgtagccatggattcctacactgtgttaattag

SEQ ID NO: 27350 - DNA, 71 bp, chicken (Gallus Gallus)
  misc_feature (36): n=c or g
aacatttccagccaaaaatgaaggaatgaagtttgnttttgccttgaattacccatgtgttagaatgtgta

SEQ ID NO: 27351 - DNA, 71 bp, chicken (Gallus Gallus)
  misc_feature (36): n=a or t
ctgcaagtctggtcacttgctatcagatctgcaaanttgataaatctattattcattgttagaatttttat

SEQ ID NO: 27352 - DNA, 71 bp, chicken (Gallus Gallus)
  misc_feature (36): n=a or g
ggaggaaggtggggagtggcagcagattaagggtgntccttttgtggaaagagttatgaaagggcttggga

SEQ ID NO: 27353 - DNA, 71 bp, chicken (Gallus Gallus)
  misc_feature (36): n=a or c
ataaaacatatcccttcaaaatttaaaaccaattcnatttccagcaggcattcatgtgttcctggccagga

SEQ ID NO: 27354 - DNA, 71 bp, chicken (Gallus Gallus)
  misc_feature (36): n=a or t
ttatctcttgtcagtcgtcacatgtatctggtagcngtcctgggaggctgtgggaaggagtaccttttggc

SEQ ID NO: 27355 - DNA, 71 bp, chicken (Gallus Gallus)
  misc_feature (36): n=a or c
tccctggggaatatgtgctgtatataatgctaaacntttttgcaattgctgaagttaaagattttgattta

SEQ ID NO: 27356 - DNA, 71 bp, chicken (Gallus Gallus)
  misc_feature (36): n=c or g
tttcataaaacatgataatgaaccatggtcactgtnaccgataattaagatgaaatttctcctacccctaa

SEQ ID NO: 27357 - DNA, 71 bp, chicken (Gallus Gallus)
  misc_feature (36): n=a or t
cctacatgagggaggtttcttgtctccattaactanaacaagcattctaaacttgggcagtgaaaatcctc

SEQ ID NO: 27358 - DNA, 71 bp, chicken (Gallus Gallus)
  misc_feature (36): n=a or g
gtatgggacttccacataaaagcagccagaactatntatgtgagaaacttcctcctagtatctaacctaaa

SEQ ID NO: 27359 - DNA, 71 bp, chicken (Gallus Gallus)
  misc_feature (36): n=c or t
attaaatgttatcaatagtgactgaaactgcagcantgtagtgaattcccaatgagttatcagggcactga

SEQ ID NO: 27360 - DNA, 71 bp, chicken (Gallus Gallus)
  misc_feature (36): n=a or g
aatagcctgaacctgtcctaagtatccctagccctntgtaggcagtttatgtagtctgttccatgcataca

SEQ ID NO: 27361 - DNA, 71 bp, chicken (Gallus Gallus)
  misc_feature (36): n=a or t
agtacttccactgcttcatgcgggacagtcttgagngggtgggatctgtggatactctggatcgatgacag

SEQ ID NO: 27362 - DNA, 71 bp, chicken (Gallus Gallus)
  misc_feature (36): n=c or t
tgtttggtaacacgttcctaaatgtgctgaaaaatngtctatttatggcctactggaagcgttgataaaac

SEQ ID NO: 27363 - DNA, 71 bp, chicken (Gallus Gallus)
  misc_feature (36): n=c or t
tttcacaaaaccaatgtcaaagagcccaccagtttnatgtttttgtttccctctttaaaaaaaaataatag

SEQ ID NO: 27364 - DNA, 71 bp, chicken (Gallus Gallus)
  misc_feature (36): n=g or t
gttttctgtgctgcaaagcagagcatgaaccaatgnaacaggaaattaatatgcacggaaaatcaataatg

SEQ ID NO: 27365 - DNA, 71 bp, chicken (Gallus Gallus)
  misc_feature (36): n=a or g
tttccatgggtttggttatggtgtctggcttctctntttcttactaaaccttgagctctgattaaacgctt

SEQ ID NO: 27366 - DNA, 71 bp, chicken (Gallus Gallus)
  misc_feature (36): n=g or t
aggtagtaccacctttctggtcttgctatttttttnctctcagacggatttaatagctcaaacttgtcttg

SEQ ID NO: 27367 - DNA, 71 bp, chicken (Gallus Gallus)
  misc_feature (36): n=c or t
ctgatgaagctacaggtcccattggaaaaacagaanagaaaggcagagtagaatagagtagcatagagtag

SEQ ID NO: 27368 - DNA, 71 bp, chicken (Gallus Gallus)
  misc_feature (36): n=c or t
tttttgttctctcttttagaaatgtctctaactagnttcctgactaggcatgggctctcctatcctctgtc

SEQ ID NO: 27369 - DNA, 71 bp, chicken (Gallus Gallus)
  misc_feature (36): n=a or c
atgacaactcctgcactgttattcctacggctgtancctgaggcttcagaaaaggctgtaacaggtggttg

SEQ ID NO: 27370 - DNA, 71 bp, chicken (Gallus Gallus)
  misc_feature (36): n=c or t
gacctctgggaattacactagtgcatggaggaaaangagtctgcaacagaaaactataagtgcacgtgtct

SEQ ID NO: 27371 - DNA, 71 bp, chicken (Gallus Gallus)
  misc_feature (36): n=a or t
ccccttgtcttgtcactatcagactgtgtaaaaaantcactcttcttcccatttataaactccctttaagt

SEQ ID NO: 27372 - DNA, 71 bp, chicken (Gallus Gallus)
  misc_feature (36): n=c or t
ccttttaccctacttacatacctactctttcctccngcttcttcccacatacgtcaggctcggatcacagt

SEQ ID NO: 27373 - DNA, 71 bp, chicken (Gallus Gallus)
  misc_feature (36): n=g or t
gcattggcctagagtggcatggagtgcagcacaatntctgtctggatagaaagtggtattaatacctaaga

SEQ ID NO: 27374 - DNA, 71 bp, chicken (Gallus Gallus)
  misc_feature (36): n=a or c
cctggcatacaaagtgcctcagttcagacccagacncagaacaaagtactttggtttgacttttctaatgt

SEQ ID NO: 27375 - DNA, 71 bp, chicken (Gallus Gallus)
  misc_feature (36): n=c or t
cctccactgtcacaaggaactccatccccttctccnatttaatgtagtttaaagatctagcaaccagtcca

SEQ ID NO: 27376 - DNA, 71 bp, chicken (Gallus Gallus)
  misc_feature (36): n=a or g
ctgagggtacgtttttaagtcaggtcagtatttccntactcatttattttgaatgatagttttgttcttaa

SEQ ID NO: 27377 - DNA, 71 bp, chicken (Gallus Gallus)
  misc_feature (36): n=a or g
aaactggcattcacagagcattagaaggctataaangctgtgcatacatagttttcttgacattaagtttt

SEQ ID NO: 27378 - DNA, 71 bp, chicken (Gallus Gallus)
  misc_feature (36): n=c or t
agtgtgttttgttcttgggtgcttatggacaatgtngtattttcagggaactcaggtggaagttggtacaa

SEQ ID NO: 27379 - DNA, 71 bp, chicken (Gallus Gallus)
  misc_feature (36): n=c or t
ctttaagtatcaaaagcatcaagttaatttattgcngttacactgtaggtgatagcaaagtcatcagtgaa

SEQ ID NO: 27380 - DNA, 71 bp, chicken (Gallus Gallus)
  misc_feature (36): n=a or g
tggaatatttttttcaaagcatatctgccaaggtcntaattttggactgagcaaagtaacaattccagcaa

SEQ ID NO: 27381 - DNA, 71 bp, chicken (Gallus Gallus)
  misc_feature (36): n=a or g
ggacacatggagaggtgtgaggtatcttgatgtcantagatgttttgcaattaatgcaggaatataagatt

SEQ ID NO: 27382 - DNA, 71 bp, chicken (Gallus Gallus)
  misc_feature (36): n=c or t
tattgcatgtcagtgtttggcccctttatggacttntaaagcccaaatattcaggagatctcgctggattt

SEQ ID NO: 27383 - DNA, 71 bp, chicken (Gallus Gallus)
  misc_feature (36): n=a or g
tggcactatgctccagtaggcaaaatctgggggcanagagcttcttcactgtctgtctacaattaacaatg

SEQ ID NO: 27384 - DNA, 71 bp, chicken (Gallus Gallus)
  misc_feature (36): n=a or g
ctggagaaatctcacacatctgcacatgtacccatncacatgctcttttattgtatcccaatgagggcctt

SEQ ID NO: 27385 - DNA, 71 bp, chicken (Gallus Gallus)
  misc_feature (36): n=a or g
ttctacagctggactgctgtccatatgccactgcanagatatccgcagagtcttgagtgaatggtaatcta

SEQ ID NO: 27386 - DNA, 71 bp, chicken (Gallus Gallus)
  misc_feature (36): n=c or t
tcagccttaatagtttcaaaaattttcacattacangtttattaaaaaaacccagcaaactcctttgaggt

SEQ ID NO: 27387 - DNA, 71 bp, chicken (Gallus Gallus)
  misc_feature (36): n=a or g
caaaattctcatccatggagaaaggtaggaaggctngggaggaaggagggagtggaagaaatgtctaacag

SEQ ID NO: 27388 - DNA, 71 bp, chicken (Gallus Gallus)
  misc_feature (36): n=g or t
ggtcagctgccttccatacacagaaagtttgacacncagtagtagacggaaaagacaactttagccagcag

SEQ ID NO: 27389 - DNA, 71 bp, chicken (Gallus Gallus)
  misc_feature (36): n=a or g
cagtttcacattcacaaaacgtggtccttgtgtgcnacttcaaacaataaaaaatctgttagaaggacaac

SEQ ID NO: 27390 - DNA, 71 bp, chicken (Gallus Gallus)
  misc_feature (36): n=c or t
aaagaggtttttgagtaatttaaggctcctctttanattctgaggatgagcctgatccttgagaccaagtt

SEQ ID NO: 27391 - DNA, 71 bp, chicken (Gallus Gallus)
  misc_feature (36): n=a or c
attattcttcttccactatatcccacagcaagacanaaacctatttagagaagacaggggggaaaacagaa

SEQ ID NO: 27392 - DNA, 71 bp, chicken (Gallus Gallus)
  misc_feature (36): n=a or g
gcaataaccattcacagaattctactgatttgtatnctaaacttttagtgattattcatattttttacaag

SEQ ID NO: 27393 - DNA, 71 bp, chicken (Gallus Gallus)
  misc_feature (36): n=a or t
atatttatgtgtatctattttcagggaaaacatacngacttcctccatctactccttcctttccttctcag

SEQ ID NO: 27394 - DNA, 71 bp, chicken (Gallus Gallus)
  misc_feature (36): n=g or t
atgccactttaatctctggggaatattattgcctangaagactgaagtggtaagggggagaaagaaaacaa

SEQ ID NO: 27395 - DNA, 71 bp, chicken (Gallus Gallus)
  misc_feature (36): n=a or t
aacagcatcttctgtcagaaacgttccattgaaaanattctgatggattcaacttaaaaagcttttcccga

SEQ ID NO: 27396 - DNA, 71 bp, chicken (Gallus Gallus)
  misc_feature (36): n=c or t
tttgaacataacacctttgaagtcttacagacttgngtacagacttgaagtcttacagtctgtgttggagg

SEQ ID NO: 27397 - DNA, 71 bp, chicken (Gallus Gallus)
  misc_feature (36): n=c or t
agtgtcaagatgatataagcatagggtttgaaacantttccttgaggcgcttttccctcagagaagtttct

SEQ ID NO: 27398 - DNA, 71 bp, chicken (Gallus Gallus)
  misc_feature (36): n=a or g
cctggggtgtcagcgttgatttcattaatcaagagngtatgctctgtttgctggtccctggggttttttat

SEQ ID NO: 27399 - DNA, 71 bp, chicken (Gallus Gallus)
  misc_feature (36): n=a or g
tgaaagtcattgacagagggcaaaatacatgccacnggctgatctcctaactggcacagctgtctaatgtt

SEQ ID NO: 27400 - DNA, 71 bp, chicken (Gallus Gallus)
  misc_feature (36): n=c or t
tgttggcctcatgaccacatcatgtgatggcttaantgatgaattcaaggtaattgaaagggttcaaatgg

SEQ ID NO: 27401 - DNA, 71 bp, chicken (Gallus Gallus)
  misc_feature (36): n=c or t
tgctgctcatactactggatcagcatcattgctagngaatcactcagcagcagcagtctccacaaaagatg

SEQ ID NO: 27402 - DNA, 71 bp, chicken (Gallus Gallus)
  misc_feature (36): n=a or g
tgtacacgtaatgagggaatgtataggacagctggnttaaatgtatacagaatgtaaaccctcagtggagt

SEQ ID NO: 27403 - DNA, 71 bp, chicken (Gallus Gallus)
  misc_feature (36): n=c or t
caaagcacagaaatggaccattcagcagagctacangggagaccaaaaagcacaacagaaaccccccacaa

SEQ ID NO: 27404 - DNA, 71 bp, chicken (Gallus Gallus)
  misc_feature (36): n=c or t
tgctctggattcaccaatcttctcagctccaacatnagtggttcaagactcgaagcagagccaatgaggga

SEQ ID NO: 27405 - DNA, 71 bp, chicken (Gallus Gallus)
  misc_feature (36): n=c or t
tgacaataaaataaaataatctgaatggacaaaacnctttgctgctgtcattccactttcagaggaaacat

SEQ ID NO: 27406 - DNA, 71 bp, chicken (Gallus Gallus)
  misc_feature (36): n=c or t
tgccttgagaggccagatacagtatcacagattctntttatttttacatccgaggctgggagcgaagccaa

SEQ ID NO: 27407 - DNA, 71 bp, chicken (Gallus Gallus)
  misc_feature (36): n=c or t
ctgactgcagtctgtgggaatgaaactgggaagatnaggggggaattgatgaattagtgactgcaaaggca

SEQ ID NO: 27408 - DNA, 71 bp, chicken (Gallus Gallus)
  misc_feature (36): n=a or g
gaactgaatggtgactagctgcaataaagcataacnaatggaaaaggtttgatgttttaaatggttgtcca

SEQ ID NO: 27409 - DNA, 71 bp, chicken (Gallus Gallus)
  misc_feature (36): n=a or g
tgatgtgcaaaaatgaagttatgatctgctacatcntgctgatggcagaaagagctttcctttcaggactc

SEQ ID NO: 27410 - DNA, 71 bp, chicken (Gallus Gallus)
  misc_feature (36): n=a or g
agaagttaagaatgtcaatctgttggttatgacaanctgttctgtaaacacatctcttcctttgctgtcct

SEQ ID NO: 27411 - DNA, 71 bp, chicken (Gallus Gallus)
  misc_feature (36): n=c or t
attttgtctattcctccaggagatttaacctggcanagaaagtagaaggacaaattacagtcagaggaaaa

SEQ ID NO: 27412 - DNA, 71 bp, chicken (Gallus Gallus)
  misc_feature (36): n=a or g
tgatcctgaaggtcttttccaaaataaatgatcctncgattcaattccacatacaagatatgaagctgtat

SEQ ID NO: 27413 - DNA, 71 bp, chicken (Gallus Gallus)
  misc_feature (36): n=a or c
caaagatttatcacagtctttgcatttgctagtganaattctgaacaaactatgcaggagcgaaaacttac

SEQ ID NO: 27414 - DNA, 71 bp, chicken (Gallus Gallus)
  misc_feature (36): n=a or g
attggtttgtctgaatatagctttacactgtgcatnaaagcacatgcttcttctgttcaaattttggtaag

SEQ ID NO: 27415 - DNA, 71 bp, chicken (Gallus Gallus)
  misc_feature (36): n=a or g
cacatcttgtactctctctgctgaaatttagagatncatttcagcttttcacaactggaatatttatttat

SEQ ID NO: 27416 - DNA, 71 bp, chicken (Gallus Gallus)
  misc_feature (36): n=g or t
tctgggcattgaacaaaggcatgtgaagacactcantggtcttacattctgcatccatttgatcctgtaac

SEQ ID NO: 27417 - DNA, 71 bp, chicken (Gallus Gallus)
  misc_feature (36): n=a or g
ctgtttcagtgctctgtcacccttactgtaaagaanttcttcagcgtgtttgtatggaacctcctatgttc

SEQ ID NO: 27418 - DNA, 71 bp, chicken (Gallus Gallus)
  misc_feature (36): n=g or t
tgacgcagctcccaggccccctccctcccccaggangtacccaatggcacttaagcctttccagcttcttt

SEQ ID NO: 27419 - DNA, 71 bp, chicken (Gallus Gallus)
  misc_feature (36): n=c or t
cctttaacgtgcaagaccatcctctggtcaaagcanatttcaccaaggagatggcatacagataaaatggg

SEQ ID NO: 27420 - DNA, 71 bp, chicken (Gallus Gallus)
  misc_feature (36): n=c or t
gttaacataaacacggcgaaacaaactatgaaaaanattctgggccctaaaagagcattaaattacaaagc

SEQ ID NO: 27421 - DNA, 71 bp, chicken (Gallus Gallus)
  misc_feature (36): n=g or t
attccacctcctttttgggaggaaagattagtcaancttttactgtgagtactctgaaaatcatactttag

SEQ ID NO: 27422 - DNA, 71 bp, chicken (Gallus Gallus)
  misc_feature (36): n=a or g
gaattcagtggtaaggttgtgatattttgtggaacntgtcatttttcttcaagacttagtcttgatggtat

SEQ ID NO: 27423 - DNA, 71 bp, chicken (Gallus Gallus)
  misc_feature (36): n=c or g
taccatctcagcaaatgcttcatgcagcaacacatnttgcttgcaaaacagcttttggtagctgacttctg

SEQ ID NO: 27424 - DNA, 71 bp, chicken (Gallus Gallus)
  misc_feature (36): n=c or t
ttccccatctgatagagcaccctttgtttagaatgnttccttcacctcttatttaatggtggaaaataata

SEQ ID NO: 27425 - DNA, 71 bp, chicken (Gallus Gallus)
  misc_feature (36): n=a or c
agcaggaagtaaaacataggaaaaggacttaaaganaggaaatacaaaagttgagacatattctgttttaa

SEQ ID NO: 27426 - DNA, 71 bp, chicken (Gallus Gallus)
  misc_feature (36): n=g or t
cagatatatcgaacgagtgttaaaatatccacttanaaatgcttgccaggcatctgagcagtacggtctgc

SEQ ID NO: 27427 - DNA, 71 bp, chicken (Gallus Gallus)
  misc_feature (36): n=a or g
actcagctctataaccattacttgattcaccagacnacattttacagctgacatctgctcttatattagca

SEQ ID NO: 27428 - DNA, 71 bp, chicken (Gallus Gallus)
  misc_feature (36): n=c or t
agtaggggctgttctgtatcaggcattgggttctcngtgtagcagcagcaggataaaacccaaagtagacc

SEQ ID NO: 27429 - DNA, 71 bp, chicken (Gallus Gallus)
  misc_feature (36): n=c or t
tcagtagaactcagctgcagctgtgtcctaatgccnctttctctccagtcacctcaagatacgatagtgtg

SEQ ID NO: 27430 - DNA, 71 bp, chicken (Gallus Gallus)
  misc_feature (36): n=a or g
taagggttggcagtggaggtggaggtatcttgctgnacatccctgtctatctgaggcctgctaaaggtaac

SEQ ID NO: 27431 - DNA, 71 bp, chicken (Gallus Gallus)
  misc_feature (36): n=a or c
acaacagtaaaaaggtaagtaaatacccacctacanaaacacagcgctgttttaacacagataacggtcta

SEQ ID NO: 27432 - DNA, 71 bp, chicken (Gallus Gallus)
  misc_feature (36): n=c or t
gtagaaggccctgtattatgtgtttacactatacangtcatacatgctcattcacaccatggtttgataaa

SEQ ID NO: 27433 - DNA, 71 bp, chicken (Gallus Gallus)
  misc_feature (36): n=c or t
actattttaatcagtccctggttgcttcttttagcnagctgtcttttcattgagggatccaagagctgcac

SEQ ID NO: 27434 - DNA, 71 bp, chicken (Gallus Gallus)
  misc_feature (36): n=c or t
ttcttcttcttatttcaggagatgcaagaagctaanattctggtagtcatacatcaaactgatacctcaat

SEQ ID NO: 27435 - DNA, 71 bp, chicken (Gallus Gallus)
  misc_feature (36): n=a or g
tttttttttttttttttttacagaaccagagagaangatataggagacaagtattgctgaaaggacaaatg

SEQ ID NO: 27436 - DNA, 71 bp, chicken (Gallus Gallus)
  misc_feature (36): n=a or c
tgcagtagtcagctgggtatgtgctaattaaactgncatcatgttatggtttactgtctgcttcatgtgag

SEQ ID NO: 27437 - DNA, 71 bp, chicken (Gallus Gallus)
  misc_feature (36): n=c or t
gaataagcataaaagagtcctgcagatgggataccngctctgaaagcaaagaacagtcttcaggtaactat

SEQ ID NO: 27438 - DNA, 71 bp, chicken (Gallus Gallus)
  misc_feature (36): n=c or t
tttcctccagggccgaagggcacaggaacccatccnctttcaagcgcaaagttcatcttacagaaaggctt

SEQ ID NO: 27439 - DNA, 71 bp, chicken (Gallus Gallus)
  misc_feature (36): n=a or g
cattaaagatgagcaataattagatacgcatgacanccaggaagcaatgtctcatgtttctgtcagaaatc

SEQ ID NO: 27440 - DNA, 71 bp, chicken (Gallus Gallus)
  misc_feature (36): n=a or g
attctggactactccaaaacttgcaagtgtgctcantagtgacattcagaattaaaaatacactttctacg

SEQ ID NO: 27441 - DNA, 71 bp, chicken (Gallus Gallus)
  misc_feature (36): n=a or c
gcataggaaccctcattatgtgtagtacaaacttanttcctaggacaaaattatatcaccctggaacatat

SEQ ID NO: 27442 - DNA, 71 bp, chicken (Gallus Gallus)
  misc_feature (36): n=c or g
agttccatggcatctcagtgttcaaatctttggggntaaatggcgtcatttgaaagctacagctgctgttg

SEQ ID NO: 27443 - DNA, 71 bp, chicken (Gallus Gallus)
  misc_feature (36): n=c or t
tgaagtgtgaataactaatctctcccgagagccctnccttgctgagcatgcttaaactttgcatgcttacc

SEQ ID NO: 27444 - DNA, 71 bp, chicken (Gallus Gallus)
  misc_feature (36): n=a or c
ttaaggaatgctgccttataagcatggaactctcanatcagtaagtcaggctgcctaagctttcatttcta

SEQ ID NO: 27445 - DNA, 71 bp, chicken (Gallus Gallus)
  misc_feature (36): n=a or g
agcaggagctttttccaagagtatttaatagctacnctacttttgctttacagggcagagcttaacatgac

SEQ ID NO: 27446 - DNA, 71 bp, chicken (Gallus Gallus)
  misc_feature (36): n=c or t
cctggtgggcgaggaggaaaagacctcagtcttttnccaaacaagaaaacaacatgaaaatacaaaacctt

SEQ ID NO: 27447 - DNA, 71 bp, chicken (Gallus Gallus)
  misc_feature (36): n=a or g
ctcctccctagcataatgctgaagaataacacagcntggatgagtatcctttcagtgtgagttctctgaag

SEQ ID NO: 27448 - DNA, 71 bp, chicken (Gallus Gallus)
  misc_feature (36): n=c or g
gaatagcttgtgccataagctgggatgtgtttaacntcgggatgcaggcactgctggggcacttatccagc

SEQ ID NO: 27449 - DNA, 71 bp, chicken (Gallus Gallus)
  misc_feature (36): n=a or g
tgagggggaaaaagactgaaaattctgcatagctcngaagagagtggatctacttgccttagctggtctcc

SEQ ID NO: 27450 - DNA, 71 bp, chicken (Gallus Gallus)
  misc_feature (36): n=a or c
cataggcagtaaagaggagaggaatattaggatttntatgtataagaattcccatctttgtcttctcatgc

SEQ ID NO: 27451 - DNA, 71 bp, chicken (Gallus Gallus)
  misc_feature (36): n=c or t
ggcactgaaggtactgcaaaatgtggtacagcagcngctaacgtgtccttacccaggcattaaatgcaaag

SEQ ID NO: 27452 - DNA, 71 bp, chicken (Gallus Gallus)
  misc_feature (36): n=c or g
gtttttggagctctgtagtactgtgtgtatgtcagncaatggccgcataatatttctccgggcgcaaaata

SEQ ID NO: 27453 - DNA, 71 bp, chicken (Gallus Gallus)
  misc_feature (36): n=g or t
cagtagttctctgcctcctggtacaggtttggttgnggcctgtgatcaggctgctgcgcagcaagtgagca

SEQ ID NO: 27454 - DNA, 71 bp, chicken (Gallus Gallus)
  misc_feature (36): n=g or t
ggccagtgatggcggtttgaggtgttgtgagaaaanccaccttttgttgcactgctagcgtatctgtgctc

SEQ ID NO: 27455 - DNA, 71 bp, chicken (Gallus Gallus)
  misc_feature (36): n=a or g
ctgagaacagaactaatttagagttgactttagacnactattttgcatattgtaattcattctgatgtaat

SEQ ID NO: 27456 - DNA, 71 bp, chicken (Gallus Gallus)
  misc_feature (36): n=c or t
agcctcctgaagccaattaagcacaccaggagagtntgagaagaaagaatttaatctggaaggtagaaatt

SEQ ID NO: 27457 - DNA, 71 bp, chicken (Gallus Gallus)
  misc_feature (36): n=c or g
ggcaactagctctctgaaaggtgcaaaaagtcaaantgtttgtgcatgcaacaaagaaaggcagagagttg

SEQ ID NO: 27458 - DNA, 71 bp, chicken (Gallus Gallus)
  misc_feature (36): n=c or t
gatataattggaaattttacaccgctgactcatganttaagactttttaattataaaacactagtaacttc

SEQ ID NO: 27459 - DNA, 71 bp, chicken (Gallus Gallus)
  misc_feature (36): n=a or g
tcatgacttatcagaagggtgtttgttactgccaanaagtaatcaaattcaaatattccactttctgaaag

SEQ ID NO: 27460 - DNA, 71 bp, chicken (Gallus Gallus)
  misc_feature (36): n=a or g
ttcacttcaggccctatgggtctaaaatattcacgnataaccctcttcaagaggttgtttacttctcagta

SEQ ID NO: 27461 - DNA, 71 bp, chicken (Gallus Gallus)
  misc_feature (36): n=c or t
ctttgctgaaaaggaggctgaaaagccccaagcagncagaaataggtcacagctgcactggatccatgcta

SEQ ID NO: 27462 - DNA, 71 bp, chicken (Gallus Gallus)
  misc_feature (36): n=a or g
gtaacttgctgctatatctgtctgcttactgattantcccgaacttctttcaaagctaagactgtagagtc

SEQ ID NO: 27463 - DNA, 71 bp, chicken (Gallus Gallus)
  misc_feature (36): n=c or g
gaaattgcactgtttttgatggctgcatctctatantctgctcagaacaaagcgcatacagctaagcaaaa

SEQ ID NO: 27464 - DNA, 71 bp, chicken (Gallus Gallus)
  misc_feature (36): n=a or g
accgctgtgcagtggatgtgcacttgcaaaatgtcncggaatggcttcaaattgaactgcactgggtaaat

SEQ ID NO: 27465 - DNA, 71 bp, chicken (Gallus Gallus)
  misc_feature (36): n=c or t
agacccccagcacagtgacagaggtggacatggacntggatagctaccaggttgctctggaagaagtcctc

SEQ ID NO: 27466 - DNA, 71 bp, chicken (Gallus Gallus)
  misc_feature (36): n=c or t
tttgtttgttgttttaatttcaaagattgtaatccnatctccaagttcagtcacactgtttgaagaggtct

SEQ ID NO: 27467 - DNA, 71 bp, chicken (Gallus Gallus)
  misc_feature (36): n=a or t
ctactgcaggttttgtattagaggtggtcacttaantttcccctgctcctcactcagccttctgctgtatc

SEQ ID NO: 27468 - DNA, 71 bp, chicken (Gallus Gallus)
  misc_feature (36): n=c or t
cctttcctttcatctaggcatgttggctttgaggantttttctttgtgtacttttccctatacactgacaa

SEQ ID NO: 27469 - DNA, 71 bp, chicken (Gallus Gallus)
  misc_feature (36): n=a or g
gctatgaattaatgtttcactcctctttttccccanaactgctgttctgtacttgtagattccatgtcaca

SEQ ID NO: 27470 - DNA, 71 bp, chicken (Gallus Gallus)
  misc_feature (36): n=a or g
ttacgtgagactctttgtctgacttagatagaaatnctgtgaaatttttgatctgggatagttttaaaagg

SEQ ID NO: 27471 - DNA, 71 bp, chicken (Gallus Gallus)
  misc_feature (36): n=a or g
tttaaattgcctttatactcagcccacacactcttntctgccaaatctcctgatacaaagtcttctaagtc

SEQ ID NO: 27472 - DNA, 71 bp, chicken (Gallus Gallus)
  misc_feature (36): n=a or g
ctgaatacctaaaagatgccttggagaaattttacngaaggacagaatctgccactcttagtcatagtatt

SEQ ID NO: 27473 - DNA, 71 bp, chicken (Gallus Gallus)
  misc_feature (36): n=a or g
tgactgtagagaccaggagattatagagctgctgancttttcaatttgaatcacctgatacttaacacatc

SEQ ID NO: 27474 - DNA, 71 bp, chicken (Gallus Gallus)
  misc_feature (36): n=c or t
ccaggatgtcatgcaagacagtgtcacacgctttgnacgaatccaggtagctaacgtctgttatggtactc

SEQ ID NO: 27475 - DNA, 71 bp, chicken (Gallus Gallus)
  misc_feature (36): n=a or g
cagcagaaggtagcttttgctataaactgaaatctnatcatgttaagctcttcaccatcgccaggacactg

SEQ ID NO: 27476 - DNA, 71 bp, chicken (Gallus Gallus)
  misc_feature (36): n=c or t
gttcttctaacagtttgtgtcacctttatcagattngccactgaaaaaaaaaaacaacaacaacaatgaaa

SEQ ID NO: 27477 - DNA, 71 bp, chicken (Gallus Gallus)
  misc_feature (36): n=a or g
ccttggagagcaggtgacacagcacctctgttttancctgaagcagcagagtgtaatcatgctttcttatt

SEQ ID NO: 27478 - DNA, 71 bp, chicken (Gallus Gallus)
  misc_feature (36): n=c or g
taagtatgccaacactgtctgcacaaagcagagtgnattcagcagctttttagaacacagtaaaggcaagc

SEQ ID NO: 27479 - DNA, 71 bp, chicken (Gallus Gallus)
  misc_feature (36): n=a or t
ggttgcatctcatatacagcacccagttctggtctnctcagtactaaagagacctggatgtactggaaaga

SEQ ID NO: 27480 - DNA, 71 bp, chicken (Gallus Gallus)
  misc_feature (36): n=g or t
gatttgtttcctttgttcttgaagtgttgatttctnttaaagatactcttcttttttttcttcctttttta

SEQ ID NO: 27481 - DNA, 71 bp, chicken (Gallus Gallus)
  misc_feature (36): n=a or g
catggctgctgaaccagaggatttttcactcccctncagattgctctcaattcctattttccaaccaagag

SEQ ID NO: 27482 - DNA, 71 bp, chicken (Gallus Gallus)
  misc_feature (36): n=a or g
tactgttttcatttttaaaaataattaagtagcacntgcatatttaagcacaaatgtacagatgtgggcat

SEQ ID NO: 27483 - DNA, 71 bp, chicken (Gallus Gallus)
  misc_feature (36): n=a or t
gtatgtcttcaggatggtcttcagcaaagctgttcngtcaaggagcatccaagccaggccatgcattattg

SEQ ID NO: 27484 - DNA, 71 bp, chicken (Gallus Gallus)
  misc_feature (36): n=a or t
atggtactactgcatactctagtataatactgcatngtataatgaaacactaaatttgttttcatatccaa

SEQ ID NO: 27485 - DNA, 71 bp, chicken (Gallus Gallus)
  misc_feature (36): n=c or t
acatgcccagtgtatcttatagaccaagcagcctgnatgagggagtagcagtcgagctgaacccttttagc

SEQ ID NO: 27486 - DNA, 71 bp, chicken (Gallus Gallus)
  misc_feature (36): n=a or g
tttgtttgaaagagcttcaaataacaggctctctantacaggattcagctttcttccagctcttccagtgc

SEQ ID NO: 27487 - DNA, 71 bp, chicken (Gallus Gallus)
  misc_feature (36): n=a or g
atttgcccaaagtaaaatagcttggaaagccaggcnccaggattttaaacattttttaatcgcctctctca

SEQ ID NO: 27488 - DNA, 71 bp, chicken (Gallus Gallus)
  misc_feature (36): n=g or t
ttgtatttgttttgataacctatttatatgtttctntaaaaatgacaggtattctctgaagctgcgctggg

SEQ ID NO: 27489 - DNA, 71 bp, chicken (Gallus Gallus)
  misc_feature (36): n=a or g
atgtgtatatgtgtacataaacgtgcacaaagaccncttgtatataataggggaatacagcaattatgtat

SEQ ID NO: 27490 - DNA, 71 bp, chicken (Gallus Gallus)
  misc_feature (36): n=a or g
attttttttcctcttcattctgagtagcccactttnaatgtttatatattactgaaatgtgtgtgactgaa

SEQ ID NO: 27491 - DNA, 71 bp, chicken (Gallus Gallus)
  misc_feature (36): n=c or t
caagttaccatggtgtagcaaaatatggtagcagtncagaagcagcactttaaccctgtggcaactatcag

SEQ ID NO: 27492 - DNA, 71 bp, chicken (Gallus Gallus)
  misc_feature (36): n=a or g
tccacgtgccttgaggtgtgaagtcagattttatangttgcacctactctgatgaaggtcagtgtgcacag

SEQ ID NO: 27493 - DNA, 71 bp, chicken (Gallus Gallus)
  misc_feature (36): n=a or g
gtggccaccatctaaaaccagagtcatttactcatnaggctgtgggtaggagatgcataagaagtcacagt

SEQ ID NO: 27494 - DNA, 71 bp, chicken (Gallus Gallus)
  misc_feature (36): n=c or t
agattacctgagtaatttggatcaaaatgcaaattnaaatttttcaccttatgactatctcttattatact

SEQ ID NO: 27495 - DNA, 71 bp, chicken (Gallus Gallus)
  misc_feature (36): n=g or t
agtaattagttcatcccaaagctaggaatgggttcngttctgtgttggtgtcttggtgtctgtaagctctg

SEQ ID NO: 27496 - DNA, 71 bp, chicken (Gallus Gallus)
  misc_feature (36): n=g or t
gtgaggagccagatgggtgctgctgggacaggggcngatcttcatccatcttctgtaagctaaatggtgtc

SEQ ID NO: 27497 - DNA, 71 bp, chicken (Gallus Gallus)
  misc_feature (36): n=a or g
acgttgtttttcaacaatgttttcctcttcaatacntctttgtatccttactagacattatttgtcttaat

SEQ ID NO: 27498 - DNA, 71 bp, chicken (Gallus Gallus)
  misc_feature (36): n=a or g
cagtgatccatctctcagtacatcacaggtttcatntagtaaggaaacggaatgaaacagagcaatataaa

SEQ ID NO: 27499 - DNA, 71 bp, chicken (Gallus Gallus)
  misc_feature (36): n=c or t
aaaaacactaacaccaccagaagccaaatgctgtgntgcgaagaaagagaaacaacactgactggggcact

SEQ ID NO: 27500 - DNA, 71 bp, chicken (Gallus Gallus)
  misc_feature (36): n=c or t
atcccatcaatgccaacagagatctgtggtactatncctatacatcagtgtccacagacaacaaagggacg

SEQ ID NO: 27501 - DNA, 71 bp, chicken (Gallus Gallus)
  misc_feature (36): n=a or g
cgagttgctgtccatgacactatccgttctcccatncacttttaagaggagtctctcagagctgccatatt

SEQ ID NO: 27502 - DNA, 71 bp, chicken (Gallus Gallus)
  misc_feature (36): n=c or t
aaccctggctcaaaccagctgtgtaatgctgtcttngagtcatagaaaccttagagttgaaagagacctct

SEQ ID NO: 27503 - DNA, 71 bp, chicken (Gallus Gallus)
  misc_feature (36): n=a or c
agtatgttttattaattaagcagttggagaaaaaancatttactttgggcctttggaagtaatattaaagt

SEQ ID NO: 27504 - DNA, 71 bp, chicken (Gallus Gallus)
  misc_feature (36): n=c or t
aggcttctcttaattttttttcccaagggttttccntctgtttagttatttaagaagtacaaataattttg

SEQ ID NO: 27505 - DNA, 71 bp, chicken (Gallus Gallus)
  misc_feature (36): n=a or t
aaaaagcaagttgccttgatgggctttgtaagcagngatatttctgtttttaagctagaaagcacatttga

SEQ ID NO: 27506 - DNA, 71 bp, chicken (Gallus Gallus)
  misc_feature (36): n=c or t
aaaattcacatgtaatgcaatatccaaaataccatngggctcttagagcaagcgtttttctgtagaaatgt

SEQ ID NO: 27507 - DNA, 71 bp, chicken (Gallus Gallus)
  misc_feature (36): n=a or g
caagatggctgctgtcatattcacttaaacatcccntgttgatgaacccttcctatgacaggagaaggaag

SEQ ID NO: 27508 - DNA, 71 bp, chicken (Gallus Gallus)
  misc_feature (36): n=a or c
gctgaggactgtggttgtcacaaagtcagaccaagnctagaataaactcagtggttagaagcttcttgttg

SEQ ID NO: 27509 - DNA, 71 bp, chicken (Gallus Gallus)
  misc_feature (36): n=a or g
catcttttctttaatattctgatagagtgagaaaantttcttgctcaagttccttctatatattttatacc

SEQ ID NO: 27510 - DNA, 71 bp, chicken (Gallus Gallus)
  misc_feature (36): n=a or g
tctctaaggctcaatatggctttactgttgtgaagnctttgactgattggttcagagatgaacagtgtatt

SEQ ID NO: 27511 - DNA, 71 bp, chicken (Gallus Gallus)
  misc_feature (36): n=c or t
atgaatctacacacaacagaactgctcaacaaagangctcattaatgctttccaggtaatgcatttggtta

SEQ ID NO: 27512 - DNA, 71 bp, chicken (Gallus Gallus)
  misc_feature (36): n=a or g
aagctatgaagtctccctgatgttctttaaactacntgtatgcatacatacatatacagacacacacacat

SEQ ID NO: 27513 - DNA, 71 bp, chicken (Gallus Gallus)
  misc_feature (36): n=c or g
actcatttcatttacattcttttaacagagttgcantgcatattgaaatggctggaagtggcttgaataga

SEQ ID NO: 27514 - DNA, 71 bp, chicken (Gallus Gallus)
  misc_feature (36): n=c or t
tgtatgatgtggggcaagccttgacaggagtaaagngcacaaattcaaagcaattgtgctgatgctctgca

SEQ ID NO: 27515 - DNA, 71 bp, chicken (Gallus Gallus)
  misc_feature (36): n=a or g
tatattaaatgtagttaagctttctgaaatactcantcagtttcatggaagtgcggcttatgtcttgacga

SEQ ID NO: 27516 - DNA, 71 bp, chicken (Gallus Gallus)
  misc_feature (36): n=a or g
cagctgaaggcaaacaacttgtttgctgcctttcantacaagcagaggaagcttactactggaggcccttc

SEQ ID NO: 27517 - DNA, 71 bp, chicken (Gallus Gallus)
  misc_feature (36): n=a or c
gataggacaaggagaaataatttcaaaataaaaganaggacatttagactggatataaggaaaaacttttt

SEQ ID NO: 27518 - DNA, 71 bp, chicken (Gallus Gallus)
  misc_feature (36): n=a or t
tctacattattggtgctcttccaggtatctacattngttcctgttttgctgtttcactgctatgttctcag

SEQ ID NO: 27519 - DNA, 71 bp, chicken (Gallus Gallus)
  misc_feature (36): n=a or g
ctcatgactttttaaataaaccaaatgaagaatgcnagtcttttgtactaaaaaatattacctgacccact

SEQ ID NO: 27520 - DNA, 71 bp, chicken (Gallus Gallus)
  misc_feature (36): n=g or t
tgtaattcgctgttgtgaggcaagttggatctgcantacatattacaaataattcacacttcattcaaggt

SEQ ID NO: 27521 - DNA, 71 bp, chicken (Gallus Gallus)
  misc_feature (36): n=c or t
gactagatgattttagtggtcttttccagctgtaanggttccatgattctttattatctttggaaaacaga

SEQ ID NO: 27522 - DNA, 71 bp, chicken (Gallus Gallus)
  misc_feature (36): n=a or t
agccatattggaaaggcttgaatgtaattctggttnaccagtctgagttggagtactatatagacacactt

SEQ ID NO: 27523 - DNA, 71 bp, chicken (Gallus Gallus)
  misc_feature (36): n=c or t
gaggaacatgagaacctttagccgtacacatcttangctgcactgaattctgctctgtattttgtttatat

SEQ ID NO: 27524 - DNA, 71 bp, chicken (Gallus Gallus)
  misc_feature (36): n=a or g
acttctgtgagtatctgtgtgagaacgaggcgtgtnagaacagaggacttcacagaggtgtgagacttgtg

SEQ ID NO: 27525 - DNA, 71 bp, chicken (Gallus Gallus)
  misc_feature (36): n=a or g
aattcaaaaagctaccaccatcaattcagatgcacngttcctgggaggatgcgctggagagtactctgggc

SEQ ID NO: 27526 - DNA, 71 bp, chicken (Gallus Gallus)
  misc_feature (36): n=a or g
tgaaactacctcatcttccctctttatttattgacntacttccatatagtaatgaaaaacagcagtagtaa

SEQ ID NO: 27527 - DNA, 71 bp, chicken (Gallus Gallus)
  misc_feature (36): n=c or t
acttgaacacaggagacctcagtaacacctgtcagnaaaatacttgtatgaaagacctatgcgaacttgtt

SEQ ID NO: 27528 - DNA, 71 bp, chicken (Gallus Gallus)
  misc_feature (36): n=a or g
aagactgagaagaaaaggtttccaagaccatgtctngcattagcagggaccataaatttgcaatggtagga

SEQ ID NO: 27529 - DNA, 71 bp, chicken (Gallus Gallus)
  misc_feature (36): n=a or g
aggaatgagtagtccaagatctataatcaatattanaaactaaaaagaaaaagtaataaatgcttctgcct

SEQ ID NO: 27530 - DNA, 71 bp, chicken (Gallus Gallus)
  misc_feature (36): n=a or g
atctctattattataaaagagctgcattttcccaanaaaacatgtatctgccttcttgctttttggtgcca

SEQ ID NO: 27531 - DNA, 71 bp, chicken (Gallus Gallus)
  misc_feature (36): n=g or t
ggggattaccagttgccatgcttgcagtcaaaaatnagttccttacttcctttttagggcacagaaaatta

SEQ ID NO: 27532 - DNA, 71 bp, chicken (Gallus Gallus)
  misc_feature (36): n=a or c
agactggaagcaaagaaagcagtccaaaagaaatantgctgtgacaggcaggaatcctgcacactttatca

SEQ ID NO: 27533 - DNA, 71 bp, chicken (Gallus Gallus)
  misc_feature (36): n=a or c
aagtatcctatggtagccttgtgaggatatttcagntaaccaagcacctctggtatgacacttacgttagt

SEQ ID NO: 27534 - DNA, 71 bp, chicken (Gallus Gallus)
  misc_feature (36): n=c or t
aatcacaaaatcactttcatattcatatcagaaacngatacaatgtcccttgtgtgtttaattgaaacttc

SEQ ID NO: 27535 - DNA, 71 bp, chicken (Gallus Gallus)
  misc_feature (36): n=a or g
aatcagtagcattttttctgtcacagtcactttacnaatagcatcagctgaatgtttaagttccagaaaat

SEQ ID NO: 27536 - DNA, 71 bp, chicken (Gallus Gallus)
  misc_feature (36): n=c or t
cagggctcagaaatagggctattcagaaaggagtgnctgtgcacatattttaagaactgatgccaaataca

SEQ ID NO: 27537 - DNA, 71 bp, chicken (Gallus Gallus)
  misc_feature (36): n=a or g
tctcccttagccaaaatatcgggatggaaagagctnaaggtgttgcagaaggatggaatcagtccctgagg

SEQ ID NO: 27538 - DNA, 71 bp, chicken (Gallus Gallus)
  misc_feature (36): n=c or g
tcccagtcaataaaacagctatggtttgtattagcncttgattcttgcatttcgtattagcatttatgtgc

SEQ ID NO: 27539 - DNA, 71 bp, chicken (Gallus Gallus)
  misc_feature (36): n=a or g
ttgctaattgctgaacatcttacacttcttgtctcncatccacagttatcttttttttcttttaagaggct

SEQ ID NO: 27540 - DNA, 71 bp, chicken (Gallus Gallus)
  misc_feature (36): n=c or t
tgggacatgcattgagctgtgcacacccacatcaangtgagatatcctatctgtttcagcctgttgttgaa

SEQ ID NO: 27541 - DNA, 71 bp, chicken (Gallus Gallus)
  misc_feature (36): n=c or t
tattttaacgagtaagcagcagccaggaatccaccnagattgtgtccaagcaaaatcattttttctagccc

SEQ ID NO: 27542 - DNA, 71 bp, chicken (Gallus Gallus)
  misc_feature (36): n=a or g
taaagctggcttttcaaactaggctgaaagattttntcttatttttttcacaaggaggtgatgataggttt

SEQ ID NO: 27543 - DNA, 71 bp, chicken (Gallus Gallus)
  misc_feature (36): n=g or t
gtggtggctagtagtatacaatgagtgggctcagangcacttatttccaaaaacatatctccatctgtctc

SEQ ID NO: 27544 - DNA, 71 bp, chicken (Gallus Gallus)
  misc_feature (36): n=a or c
tcacagtgggttacgatcagctgtctcctagcttanagacttacagcagctctgaaatgtgccaccagtca

SEQ ID NO: 27545 - DNA, 71 bp, chicken (Gallus Gallus)
  misc_feature (36): n=c or t
atgtagctactgttctgggggaatgttcagctcctngtcactaccttgttaatgagttataaatagttttg

SEQ ID NO: 27546 - DNA, 71 bp, chicken (Gallus Gallus)
  misc_feature (36): n=c or t
tgaccatgagtatgcttcttcatcttgtaaaatcantctcccctacaggcccttagcaaaggtatctcaga

SEQ ID NO: 27547 - DNA, 71 bp, chicken (Gallus Gallus)
  misc_feature (36): n=a or g
taggcaagtgctataaaatatgcgcctaagtagcgngtcctccccaaactactctagaaaaatgctcatgt

SEQ ID NO: 27548 - DNA, 71 bp, chicken (Gallus Gallus)
  misc_feature (36): n=a or g
aatatttcagtgcattttctctttctgtctttatcncagtattgtgtgcctttttatgtcccttcctcaag

SEQ ID NO: 27549 - DNA, 71 bp, chicken (Gallus Gallus)
  misc_feature (36): n=c or t
ggctttaaacatgccctgctgaaaggcagtattctntaaggacgattaaaattatgttttctgtgagcact

SEQ ID NO: 27550 - DNA, 71 bp, chicken (Gallus Gallus)
  misc_feature (36): n=a or t
aagagggataaaaataccccttgattctgtaaaagnttttctcagattaaaatgttgcctgtgatgatgta

SEQ ID NO: 27551 - DNA, 71 bp, chicken (Gallus Gallus)
  misc_feature (36): n=a or g
taacatggcaggtgagaattgctgcactgagcacanggaatttagcatgggcatggcctccaaatgggatc

SEQ ID NO: 27552 - DNA, 71 bp, chicken (Gallus Gallus)
  misc_feature (36): n=a or g
gtaaataagacataaagtaagtctcttctacctcantcatgttttccattttattttcttttaaagtgttc

SEQ ID NO: 27553 - DNA, 71 bp, chicken (Gallus Gallus)
  misc_feature (36): n=a or g
tgcttttagcatctttcatgttatagaaaaacactntagcaaaagtcagcatagaacaggtttgtcttcct

SEQ ID NO: 27554 - DNA, 71 bp, chicken (Gallus Gallus)
  misc_feature (36): n=c or t
gtgcagctgtgaagctcagtttcagcattgtggtcnagcatttctgctacacgtaacacctctgctgggtt

SEQ ID NO: 27555 - DNA, 71 bp, chicken (Gallus Gallus)
  misc_feature (36): n=g or t
tctaaacaccaataagagaagttcacaacaaatcanttggagctgttaactacatgtatcttgtgttatag

SEQ ID NO: 27556 - DNA, 71 bp, chicken (Gallus Gallus)
  misc_feature (36): n=c or t
atagggtttgtttgtataattggttggatgctatanggggcactgcaatttctcagtgtctcttatttgtt

SEQ ID NO: 27557 - DNA, 71 bp, chicken (Gallus Gallus)
  misc_feature (36): n=g or t
cctcgaggaaagcctgtgcttaaatgctgcatgtanggaaagctcaagaaacccaactgcacccataaata

SEQ ID NO: 27558 - DNA, 71 bp, chicken (Gallus Gallus)
  misc_feature (36): n=c or t
tatgttatctgtcaccagtgaggagctgcaactaanggaatctctgggaaagctaaatattctcatttgat

SEQ ID NO: 27559 - DNA, 71 bp, chicken (Gallus Gallus)
  misc_feature (36): n=a or c
atgatgcaatttgtacggcaaatatttagaaacccnaaaagcaaaaccatttctgaactatgatattaaga

SEQ ID NO: 27560 - DNA, 71 bp, chicken (Gallus Gallus)
  misc_feature (36): n=c or t
gagggcaaagatttccttgctaaggctgtccaatgntttacacagtacctttaattcttctatcacatttt

SEQ ID NO: 27561 - DNA, 71 bp, chicken (Gallus Gallus)
  misc_feature (36): n=a or g
gacgtatgatgtgcagctctgatcatagtttagccnctgctttttcattaacacctcaatatcaaaaagaa

SEQ ID NO: 27562 - DNA, 71 bp, chicken (Gallus Gallus)
  misc_feature (36): n=g or t
ttggtgcatctcataactgcatgaatccctctgtgnagaaaattaattttgaaacttaaagcgtaagaaaa

SEQ ID NO: 27563 - DNA, 71 bp, chicken (Gallus Gallus)
  misc_feature (36): n=c or t
ccaagcaactacttgagtttgatcactccaggcttntccattctgcccaaatttaggcagaataaaagaaa

SEQ ID NO: 27564 - DNA, 71 bp, chicken (Gallus Gallus)
  misc_feature (36): n=a or g
ctcctgagtattcagaccagagctcagtgtggaaancaccagctactactttgtgcttatacaacatctgg

SEQ ID NO: 27565 - DNA, 71 bp, chicken (Gallus Gallus)
  misc_feature (36): n=c or t
aaatatattttcacatctgcaaaggggtagtgcccngcctggctagatcgggaatgagagatgttcaggta

SEQ ID NO: 27566 - DNA, 71 bp, chicken (Gallus Gallus)
  misc_feature (36): n=a or g
tataatgtaattatattatatttgctgtaattgctnagatgcaagcatagcaagtatattcatcatgccag

SEQ ID NO: 27567 - DNA, 71 bp, chicken (Gallus Gallus)
  misc_feature (36): n=c or t
acagcgcaggtaatgaagttagtatagacgtgcttngtttttctgcagtgcatgtaagagaatagcactta

SEQ ID NO: 27568 - DNA, 71 bp, chicken (Gallus Gallus)
  misc_feature (36): n=a or c
ttctgacctttgtgaggaaataatgaatggtacgtngttaaaggccaaatgccatccgtacgtacttaagc

SEQ ID NO: 27569 - DNA, 71 bp, chicken (Gallus Gallus)
  misc_feature (36): n=g or t
gctaacatatatgtgctttaaatttcaaaatgaatngaaccagcagcaaagctggtgaggggtctgcagca

SEQ ID NO: 27570 - DNA, 71 bp, chicken (Gallus Gallus)
  misc_feature (36): n=a or g
gaactgaaatagccaaattaagtatatgttacaacntaaagtatttttgttttgtaatataagcagaactg

SEQ ID NO: 27571 - DNA, 71 bp, chicken (Gallus Gallus)
  misc_feature (36): n=a or g
acctctctgtcacttttcaacagaaacttgcaagcngagtatgaccgtttgaagcaacagcatgatcacaa

SEQ ID NO: 27572 - DNA, 71 bp, chicken (Gallus Gallus)
  misc_feature (36): n=c or t
atggcttgggaatcaggaaggtttccagccatgggntgatggactgtaaatgggcagtggttcgacagtga

SEQ ID NO: 27573 - DNA, 71 bp, chicken (Gallus Gallus)
  misc_feature (36): n=a or c
tcaaaggagacatttcaaaaacatcataaagctaantttcttacagcatacattcatctaattgaaaatta

SEQ ID NO: 27574 - DNA, 71 bp, chicken (Gallus Gallus)
  misc_feature (36): n=a or g
gcaccaaaacctcccatcctttgcaccagaagaacnagattagccaggaagaataatgttcaaagcagtgg

SEQ ID NO: 27575 - DNA, 71 bp, chicken (Gallus Gallus)
  misc_feature (36): n=c or t
ttctgctgctggcttcctctcatgtaacagttcctnccctgttttgtcccaccaggtgaaggagcttgttt

SEQ ID NO: 27576 - DNA, 71 bp, chicken (Gallus Gallus)
  misc_feature (36): n=c or t
atgtcagtttacagatttctgtgctcatctcctatngtagaaataagtttgtttgtctgaatcctcttgct

SEQ ID NO: 27577 - DNA, 71 bp, chicken (Gallus Gallus)
  misc_feature (36): n=c or t
caagatattttggaacaaatttatatgaaatgactnattgctaaattttatcttctgtaaggtgaaatgct

SEQ ID NO: 27578 - DNA, 71 bp, chicken (Gallus Gallus)
  misc_feature (36): n=a or c
agcattgaaagccttatcctgtggggcagagagagngatgagatacaagaataatcctcctgatgcattcc

SEQ ID NO: 27579 - DNA, 71 bp, chicken (Gallus Gallus)
  misc_feature (36): n=c or t
acccaggactcttaaaccatctcagaactccaattncccagctactcccagaccatagctaccagcctcct

SEQ ID NO: 27580 - DNA, 71 bp, chicken (Gallus Gallus)
  misc_feature (36): n=c or g
gagaagggctcgttaccgagggtgctctgtgtgcanggaagctgtggctcattaacactgagtgttgagtc

SEQ ID NO: 27581 - DNA, 71 bp, chicken (Gallus Gallus)
  misc_feature (36): n=a or g
tttcaacacaaaattggcaaaagagcatctattaantttcctttctgatttcagaatacaaaagctatatt

SEQ ID NO: 27582 - DNA, 71 bp, chicken (Gallus Gallus)
  misc_feature (36): n=c or t
cagagaaaaggtgaatctgaaggttgctttctttgngatgtctctaattccctaagccagccctctacttc

SEQ ID NO: 27583 - DNA, 71 bp, chicken (Gallus Gallus)
  misc_feature (36): n=a or t
caccaccaccactcctggtgggcaggttatctgagnagatctgcggtatgcctggtgagaactcaaactct

SEQ ID NO: 27584 - DNA, 71 bp, chicken (Gallus Gallus)
  misc_feature (36): n=a or g
aggaagcccatctcccaggcagcaaatgccacaggncagaagggtagctttctcatggaaagaagagaagc

SEQ ID NO: 27585 - DNA, 71 bp, chicken (Gallus Gallus)
  misc_feature (36): n=c or g
atctcaagattattgttccaggtaagacttctcagnaatataacagaaaatggaagtgagcaatacagagt

SEQ ID NO: 27586 - DNA, 71 bp, chicken (Gallus Gallus)
  misc_feature (36): n=c or t
ggctactgcagtcagtgaccacttcattacccagangaacatgctgattgatatcaactacgatctgtttg

SEQ ID NO: 27587 - DNA, 71 bp, chicken (Gallus Gallus)
  misc_feature (36): n=g or t
agactcattttaaacagtactttgcccattatttanctttaaacccatctgacaaggaggaaggcaagaga

SEQ ID NO: 27588 - DNA, 71 bp, chicken (Gallus Gallus)
  misc_feature (36): n=c or g
taaaacacaaaaaaattccaggcactgatttcatantcacaagggctgcattttcactctactatgacagc

SEQ ID NO: 27589 - DNA, 71 bp, chicken (Gallus Gallus)
  misc_feature (36): n=a or t
tcctgacatgctgttgaagagctgacttaaaatccnagcttcctctccttttccacttttcaaagacaaac

SEQ ID NO: 27590 - DNA, 71 bp, chicken (Gallus Gallus)
  misc_feature (36): n=a or c
ttaaccaccttgaagactcctttctccatgacagcnttgcatagcttggagctgcttctttatcacaatta

SEQ ID NO: 27591 - DNA, 71 bp, chicken (Gallus Gallus)
  misc_feature (36): n=c or t
agggaaaataatcacttgcaagtccaggacggctancggaacaccctacaaaataaggcttaggagtactt

SEQ ID NO: 27592 - DNA, 71 bp, chicken (Gallus Gallus)
  misc_feature (36): n=c or t
ctgctgtcataattctcctgctaacagataagaaanggtgaaatgacatcctgcccaaagagtctgaatgt

SEQ ID NO: 27593 - DNA, 71 bp, chicken (Gallus Gallus)
  misc_feature (36): n=a or g
cttgggcaacctgttcagtgcgtcaccaccctctgngtgaaggcatatatggtactgtggagccttaatga

SEQ ID NO: 27594 - DNA, 71 bp, chicken (Gallus Gallus)
  misc_feature (36): n=a or g
tattaaagctgatgaggcaaaggggaaaacaggttncaagatcatcccttgcaggttaagcacccaatttg

SEQ ID NO: 27595 - DNA, 71 bp, chicken (Gallus Gallus)
  misc_feature (36): n=c or t
tctaggaaattttggctaaatgtttattactgaatntgcaaagcaatacaacagtgatttatcttttggaa

SEQ ID NO: 27596 - DNA, 71 bp, chicken (Gallus Gallus)
  misc_feature (36): n=a or g
tgctcaggcacttaaggtcacagtacgacatccacngagttaaggcagatgaggtaacactaggtcagatg

SEQ ID NO: 27597 - DNA, 71 bp, chicken (Gallus Gallus)
  misc_feature (36): n=a or t
taaaatatgaaaattcacttgcagtgactcgtcatncaaaataagaagtcagcacggatagagcaaagtta

SEQ ID NO: 27598 - DNA, 71 bp, chicken (Gallus Gallus)
  misc_feature (36): n=a or g
atctgaacatgacaaaacttctttactctgagaatngtggagtactggaacaggctgcctggagtctcctt

SEQ ID NO: 27599 - DNA, 71 bp, chicken (Gallus Gallus)
  misc_feature (36): n=a or g
tcaactgaaggttaattcagtttgaggtttgtgggnaaaaaaatgtgatttgtgcattggttttcatgaaa

SEQ ID NO: 27600 - DNA, 71 bp, chicken (Gallus Gallus)
  misc_feature (36): n=g or t
atgaggctcccttgtccctatcaggctatgagatanaacagattttcttaagaaatgagtaaaatatattg

SEQ ID NO: 27601 - DNA, 71 bp, chicken (Gallus Gallus)
  misc_feature (36): n=a or c
gaagagtccttgcaactgcacctagtatgggaaaantgtgtttgtaaaaaccaaatccagatgggaaagtg

SEQ ID NO: 27602 - DNA, 71 bp, chicken (Gallus Gallus)
  misc_feature (36): n=a or g
ttgtacatctataccagttatggagtgaggaaaggnatgtgaagaaagtcaatcaaatgtggcaatatgaa

SEQ ID NO: 27603 - DNA, 71 bp, chicken (Gallus Gallus)
  misc_feature (36): n=g or t
acctctgcagagcaatcctactcaatcacactactncgattatgcccagcaatggcatcagttccacaaag

SEQ ID NO: 27604 - DNA, 71 bp, chicken (Gallus Gallus)
  misc_feature (36): n=g or t
catgtttatctggaatgggaaatttggactcactgntttttttataacaaatttaatagccctcatgctgc

SEQ ID NO: 27605 - DNA, 71 bp, chicken (Gallus Gallus)
  misc_feature (36): n=a or g
agatgagaatgggaacgtgatatgtcagagaggttncatttcacctactttgcctggaagagctcttacaa

SEQ ID NO: 27606 - DNA, 71 bp, chicken (Gallus Gallus)
  misc_feature (36): n=c or t
attctggactgatccttgcctattttctccagtttnccagctcagaggtgcctatggtgatagatatagcc

SEQ ID NO: 27607 - DNA, 71 bp, chicken (Gallus Gallus)
  misc_feature (36): n=a or g
atttctctctactgatgaaaaaaatgtcaccactancactttaaactgtcattctggctttacacatgaac

SEQ ID NO: 27608 - DNA, 71 bp, chicken (Gallus Gallus)
  misc_feature (36): n=c or t
gcctgccttcaatgcaaaaagaccaaaaactgcatngactgggaaagtgttctcctcagaccgaagtccag

SEQ ID NO: 27609 - DNA, 71 bp, chicken (Gallus Gallus)
  misc_feature (36): n=c or t
aaatagctgcccaaaaggtttgagtgccgtgacaanaattaaatctgtagtaattactttatttttattta

SEQ ID NO: 27610 - DNA, 71 bp, chicken (Gallus Gallus)
  misc_feature (36): n=a or g
tttcttcgggattttttttctttcattttttctaanctagttgtaatttatttaaccaaatagcttttcat

SEQ ID NO: 27611 - DNA, 71 bp, chicken (Gallus Gallus)
  misc_feature (36): n=a or g
actggggaattatagtagagttcacatgaaaccagncttcactaagtttggtgctgaggaaaagctaaaac

SEQ ID NO: 27612 - DNA, 71 bp, chicken (Gallus Gallus)
  misc_feature (36): n=c or t
ggcagttcacaagtaacatttgcttttaccatgttngttgtcctaagcttcgagaaagctttaccttaccc

SEQ ID NO: 27613 - DNA, 71 bp, chicken (Gallus Gallus)
  misc_feature (36): n=c or t
ttcaaatcctgacagagaataagccaagatccctgntcttataaactgccagcaaatgctgcttgaccttt

SEQ ID NO: 27614 - DNA, 71 bp, chicken (Gallus Gallus)
  misc_feature (36): n=c or t
gatcagtgagggtaatataggggaccagaaacttgngcagaggagagcagctttgatggaagttgtgcaaa

SEQ ID NO: 27615 - DNA, 71 bp, chicken (Gallus Gallus)
  misc_feature (36): n=c or t
taccactttcagtatggtatcaagttcacttggctncagtctttggcattggagaactcagtcagttgcga

SEQ ID NO: 27616 - DNA, 71 bp, chicken (Gallus Gallus)
  misc_feature (36): n=a or g
atggatcagtatactgcaactaaaatcacccaacangactactttggataaacaagcacaccccaaaacag

SEQ ID NO: 27617 - DNA, 71 bp, chicken (Gallus Gallus)
  misc_feature (36): n=c or g
atatcagataccaaacaaggttgttgtgctcagganactattcaatgcaactttttctaggtttgattcat

SEQ ID NO: 27618 - DNA, 71 bp, chicken (Gallus Gallus)
  misc_feature (36): n=a or g
ttttcctcttggtatctgtgtaaatggatatagagnataacttggccaaattagtgcctacagaaaatttt

SEQ ID NO: 27619 - DNA, 71 bp, chicken (Gallus Gallus)
  misc_feature (36): n=a or t
ctgggaagtgggtttaccaacactatgtgaggaagngaacagaaaaagccaaagggaagatgtagatcaaa

SEQ ID NO: 27620 - DNA, 71 bp, chicken (Gallus Gallus)
  misc_feature (36): n=a or g
ggcacgaggactttatggatggaacaggaagacatnctgtatgttgtcttcctcagactttttgttaatat

SEQ ID NO: 27621 - DNA, 71 bp, chicken (Gallus Gallus)
  misc_feature (36): n=c or t
ccactgacatttaatcttgccatttccaaatggttntcctgtagtactgctttttgcctgtgaaagatcac

SEQ ID NO: 27622 - DNA, 71 bp, chicken (Gallus Gallus)
  misc_feature (36): n=g or t
atgcatctttgaaatggcttcagagatggggactcnccctcttccccaggcagcctgtatcctaccccatt

SEQ ID NO: 27623 - DNA, 71 bp, chicken (Gallus Gallus)
  misc_feature (36): n=a or c
caaagaaacattaaaattcggtgttgcagagaatgnaaattaagacatatttcagaaaaaacagtaaatgc

SEQ ID NO: 27624 - DNA, 71 bp, chicken (Gallus Gallus)
  misc_feature (36): n=c or t
actccatcccatattcagctgcatcacgttaaaccnagaagctacctctgtgttttgagtacatcctaggt

SEQ ID NO: 27625 - DNA, 71 bp, chicken (Gallus Gallus)
  misc_feature (36): n=a or c
taagagtagaacctatatccaacacaggcaaacagngctgagtgggtcttggaaaacttagaaattcaatt

SEQ ID NO: 27626 - DNA, 71 bp, chicken (Gallus Gallus)
  misc_feature (36): n=c or t
atggactaatattgtgtaggataattaagaaacggnttgaccgaaaactcaagcgtggttatggaaaaaca

SEQ ID NO: 27627 - DNA, 71 bp, chicken (Gallus Gallus)
  misc_feature (36): n=c or t
aggtaagggaacaacctgttttttctcttgtgcagntcagctgtggtatgactaattttaataactcttaa

SEQ ID NO: 27628 - DNA, 71 bp, chicken (Gallus Gallus)
  misc_feature (36): n=c or g
ggagggacaagatgacatcatggcaaaaagtttcangttgtgatctctattgataccagttattgatactg

SEQ ID NO: 27629 - DNA, 71 bp, chicken (Gallus Gallus)
  misc_feature (36): n=a or g
taattgctcactggtgaggttctaagcataaaaaancaagcatgttttttcagcctatagtaagtcgctaa

SEQ ID NO: 27630 - DNA, 71 bp, chicken (Gallus Gallus)
  misc_feature (36): n=a or c
ggtcagaagtctagcaagttgattctctagcacagnataaaccaatatgcctctttgccttccaaggtgtt

SEQ ID NO: 27631 - DNA, 71 bp, chicken (Gallus Gallus)
  misc_feature (36): n=c or t
aaaaacgttctacaaatataactgatttgagcatgntaccaacataacttaaatgtttaataaagcacttt

SEQ ID NO: 27632 - DNA, 71 bp, chicken (Gallus Gallus)
  misc_feature (36): n=a or g
attgaggttagatgttttataataaatacttctccnagacagtggccaggcacaggaatgggctgcccagg

SEQ ID NO: 27633 - DNA, 71 bp, chicken (Gallus Gallus)
  misc_feature (36): n=c or g
tcacacttcgtatttccttggcaagctacttgaatntaaactctcacatgctggatgttgtgtgtggtcag

SEQ ID NO: 27634 - DNA, 71 bp, chicken (Gallus Gallus)
  misc_feature (36): n=a or g
gctatcaagagatatgcacagattcaggccttaacntaagcctaaccatgaagaaaaacattaataaaaaa

SEQ ID NO: 27635 - DNA, 71 bp, chicken (Gallus Gallus)
  misc_feature (36): n=c or t
caaaggatgcagctttgagacacaacctaccctcangtatggatgcagtgaggatcagaaccgtaacttct

SEQ ID NO: 27636 - DNA, 71 bp, chicken (Gallus Gallus)
  misc_feature (36): n=c or t
gtttgttttagtatttcaatttcaaaccgttctgcntctgttcctttgtgttgctcagagtgccttaagca

SEQ ID NO: 27637 - DNA, 71 bp, chicken (Gallus Gallus)
  misc_feature (36): n=a or g
atcatatcatctcctgttccacagaagtgctgctcnacatgcagttttttagttattgacgttttcttttc

SEQ ID NO: 27638 - DNA, 71 bp, chicken (Gallus Gallus)
  misc_feature (36): n=c or t
gttcatattaatatttttttctatgttgcaatcacngtggtgatggatattttacatttaaaagaaattct

SEQ ID NO: 27639 - DNA, 71 bp, chicken (Gallus Gallus)
  misc_feature (36): n=a or g
ggcacagcacactggaggaagatgcgttacctgatngtgttgctcttgctcataagaagaacaagacgtcg

SEQ ID NO: 27640 - DNA, 71 bp, chicken (Gallus Gallus)
  misc_feature (36): n=c or g
taactcaagctctttctagagtctcacaaatgatgncacatttaggagtgcaaatagttgcatggcattac

SEQ ID NO: 27641 - DNA, 71 bp, chicken (Gallus Gallus)
  misc_feature (36): n=c or g
ttgcaatgcagaaaaaactaggctgctgatcctttnagtagataacacatttgaagtacagaaacatgctt

SEQ ID NO: 27642 - DNA, 71 bp, chicken (Gallus Gallus)
  misc_feature (36): n=c or t
attccttcagtacggggaaactttttttgagatgtngtttgggctttagatgaatgcagaatggttgacag

SEQ ID NO: 27643 - DNA, 71 bp, chicken (Gallus Gallus)
  misc_feature (36): n=c or t
tgtaaaacaacaaataagctaatcatgcagctggangtcttgctcaataaaatcaaagatggtgaacaaaa

SEQ ID NO: 27644 - DNA, 71 bp, chicken (Gallus Gallus)
  misc_feature (36): n=a or t
aaagcacacgtcagagagcaggcggcacaggaggcncaagattccactaaagccactactgtaaggccgct

SEQ ID NO: 27645 - DNA, 71 bp, chicken (Gallus Gallus)
  misc_feature (36): n=c or t
tccaaagtatgcagggaatctgtccggggacaccanaccattctgctaggcaggaatctcctggaaatacc

SEQ ID NO: 27646 - DNA, 71 bp, chicken (Gallus Gallus)
  misc_feature (36): n=a or g
catagcgaagatacggctttcagggctgggtataantctgagagtgtgtgtaggagaagcagtgacacact

SEQ ID NO: 27647 - DNA, 71 bp, chicken (Gallus Gallus)
  misc_feature (36): n=a or g
cagattaaagtatctgtgtgaaactactgtgtctgnactgtattctagttgatgggaatttattttctgtg

SEQ ID NO: 27648 - DNA, 71 bp, chicken (Gallus Gallus)
  misc_feature (36): n=g or t
aagctccatctctacaaaactaagcttaaagtgcantaggctgcactatctgcttttatgatgtaatacaa

SEQ ID NO: 27649 - DNA, 71 bp, chicken (Gallus Gallus)
  misc_feature (36): n=c or g
gaggctccttggctctcacctgggtgtgtgtgcctntgtttgctattagagccctgagcgtcagtaccctc

SEQ ID NO: 27650 - DNA, 71 bp, chicken (Gallus Gallus)
  misc_feature (36): n=c or t
accgctgaggactgagatagctttaagctgacttgntggggtgccaggggtgatcagctgtatacgcttgg

SEQ ID NO: 27651 - DNA, 71 bp, chicken (Gallus Gallus)
  misc_feature (36): n=a or g
acctgcaagatatcttttctccgttgctggctccanattataatgaaaatgtatagtcaactagagcatat

SEQ ID NO: 27652 - DNA, 71 bp, chicken (Gallus Gallus)
  misc_feature (36): n=a or c
ctaaagtcacagagcgctgaattccctgctcatagnaggcttttgcatagtttgtctagtagtaccagatg

SEQ ID NO: 27653 - DNA, 71 bp, chicken (Gallus Gallus)
  misc_feature (36): n=c or t
catgcagtgtctgtgcccctatttgtaatcttctancagaaggaacctggaacaaaggccaacaaaggtgc

SEQ ID NO: 27654 - DNA, 71 bp, chicken (Gallus Gallus)
  misc_feature (36): n=a or g
gaatggcatcctatagtaggaatggatataggaaangcatcccttgaaaatcattgtccacctagaaattg

SEQ ID NO: 27655 - DNA, 71 bp, chicken (Gallus Gallus)
  misc_feature (36): n=a or t
acagatgcatcccatctcctctgtacagtaccaagnccacagacaaaatgtgtattttacaaggaccctgt

SEQ ID NO: 27656 - DNA, 71 bp, chicken (Gallus Gallus)
  misc_feature (36): n=c or g
agtaaatcatcaccaacgttcatttacaactacagntggctgtccactcctgattcagcattcctactgtt

SEQ ID NO: 27657 - DNA, 71 bp, chicken (Gallus Gallus)
  misc_feature (36): n=c or t
acagtgatgtagcattgtcaggccctgtagatcagnctcagctgagctggcacactaaacccctcttcagc

SEQ ID NO: 27658 - DNA, 71 bp, chicken (Gallus Gallus)
  misc_feature (36): n=a or c
gcttttccctgcaaacacaaagctatgcaaacactnagtgccttcttgtgtgcttgattggctctcagtaa

SEQ ID NO: 27659 - DNA, 71 bp, chicken (Gallus Gallus)
  misc_feature (36): n=a or g
tttacctttatgtaacttttgcctttcttagaaagngtttgagtggtaagagcgagcggctgacttgattt

SEQ ID NO: 27660 - DNA, 71 bp, chicken (Gallus Gallus)
  misc_feature (36): n=a or t
ttttttttttctcagcccattattgcagaaggaaanttgagcaaaaaattaaattccaagcatccatacat

SEQ ID NO: 27661 - DNA, 71 bp, chicken (Gallus Gallus)
  misc_feature (36): n=a or g
atcataattggccagcacagccaaatgatgaggttnacagaggcaattgagaatattaatcaaatcggtgg

SEQ ID NO: 27662 - DNA, 71 bp, chicken (Gallus Gallus)
  misc_feature (36): n=c or t
tgaaagattttacagatgggagaggcatgagactgntgttttaggcagccgatgtgaaacaggaaatgacc

SEQ ID NO: 27663 - DNA, 71 bp, chicken (Gallus Gallus)
  misc_feature (36): n=a or g
tgcatcttgggctaatgttgaaactgctgctgatgnatccaaagtgatctctgcctgctgggatgcagtca

SEQ ID NO: 27664 - DNA, 71 bp, chicken (Gallus Gallus)
  misc_feature (36): n=c or t
ttttgaaagaagttaataaaaaaaatcttgagatanttcttttcaagtaaattccttcttttttcattgtt

SEQ ID NO: 27665 - DNA, 71 bp, chicken (Gallus Gallus)
  misc_feature (36): n=c or t
tgtcttaacatgtcagcacggtttgtcatgtaacanactctctccttgatttttttggtaaagtatatgcc

SEQ ID NO: 27666 - DNA, 71 bp, chicken (Gallus Gallus)
  misc_feature (36): n=a or g
tttgtgagcaatgggcaaaaagatatttaagctgantgtgttatatggatgcatttataaggtaattcagg

SEQ ID NO: 27667 - DNA, 71 bp, chicken (Gallus Gallus)
  misc_feature (36): n=a or t
aagacagggtccaaagagtcagggaactgatgtttnggagaccgtctctaaccacaaaatctgccttaccc

SEQ ID NO: 27668 - DNA, 71 bp, chicken (Gallus Gallus)
  misc_feature (36): n=a or t
attccagcagaacaggcagcttttacattgtaaaanatcaagcagcaaaatgaatgctttacactgtctaa

SEQ ID NO: 27669 - DNA, 71 bp, chicken (Gallus Gallus)
  misc_feature (36): n=c or t
tcagtaacgggcgtttcagtgtgagcacctgcgatntggcttcctcctgttcagctgcattaatcaactgg

SEQ ID NO: 27670 - DNA, 71 bp, chicken (Gallus Gallus)
  misc_feature (36): n=a or t
aactgctagaaatttataaatacaaatagtgcttangttttcttcattcatgctccaacagattacaaact

SEQ ID NO: 27671 - DNA, 71 bp, chicken (Gallus Gallus)
  misc_feature (36): n=c or t
tgccatcggtggaaatcatgggtacccattgtgtcnaatgaaatatgtagccagacatacatgggcaggtg

SEQ ID NO: 27672 - DNA, 71 bp, chicken (Gallus Gallus)
  misc_feature (36): n=c or t
tagattgtgcaacctttttggcttctaaaaacaaangcgtaagaaaagaatctcaattaccttcagatgca

SEQ ID NO: 27673 - DNA, 71 bp, chicken (Gallus Gallus)
  misc_feature (36): n=a or g
aacagagatctgtctaacagcctgtgctgtccagantcaataaattaaatctctttgtaccagctttagaa

SEQ ID NO: 27674 - DNA, 71 bp, chicken (Gallus Gallus)
  misc_feature (36): n=a or c
aaagctgttgtgtgcctgtgagcagaattctttgcnatattttctaaaagcctttctaaaacctttcagtt

SEQ ID NO: 27675 - DNA, 71 bp, chicken (Gallus Gallus)
  misc_feature (36): n=c or t
ttgaatgtgctagtacttcccgcactgctttgtaangtatcgttggcaaactgcccttctaccttaacttt

SEQ ID NO: 27676 - DNA, 71 bp, chicken (Gallus Gallus)
  misc_feature (36): n=a or t
tataatcagtcctggacaacagatcaaaagtgtggnatagactaattaagaaaaatcttctctgcttcttt

SEQ ID NO: 27677 - DNA, 71 bp, chicken (Gallus Gallus)
  misc_feature (36): n=a or g
agggttggctttgagcattgttttatgacagcgttnttcctctctgtcttgcacacagtatttctgcactt

SEQ ID NO: 27678 - DNA, 71 bp, chicken (Gallus Gallus)
  misc_feature (36): n=c or t
ggtcactgcacggtgcttcagtgcctgttattctcnggtcctgtctgttccatgtaaattagtttagcaca

SEQ ID NO: 27679 - DNA, 71 bp, chicken (Gallus Gallus)
  misc_feature (36): n=c or g
ctgtctgacgtcttcacaatagggtgatgaactaanaagccaggtatctaaatggttcttatatttctatc

SEQ ID NO: 27680 - DNA, 71 bp, chicken (Gallus Gallus)
  misc_feature (36): n=a or g
tttcaacagatgtatcagcagccatctttaagtttnaagtgatctcctcagagctgtggaaatagggatac

SEQ ID NO: 27681 - DNA, 71 bp, chicken (Gallus Gallus)
  misc_feature (36): n=c or t
accctagagttattcctgaaggctagcagtagcctntggctacccgctctttcactcctctgatctgcaat

SEQ ID NO: 27682 - DNA, 71 bp, chicken (Gallus Gallus)
  misc_feature (36): n=a or g
agacttcacagctccatcagtaaagcatgggaaagngattaggccaattagtcttccctcaacttactcct

SEQ ID NO: 27683 - DNA, 71 bp, chicken (Gallus Gallus)
  misc_feature (36): n=a or g
tcaatcaacaaacagaatgggaagaagaggagtatncagtttatgccagaaaaacagagagatggcttcca

SEQ ID NO: 27684 - DNA, 71 bp, chicken (Gallus Gallus)
  misc_feature (36): n=a or c
gacattttccttagacataagtaatagaataaattnattcctcaaatgtttattttcagaactcaggagaa

SEQ ID NO: 27685 - DNA, 71 bp, chicken (Gallus Gallus)
  misc_feature (36): n=a or c
tccttgtagttcacatatacctttctgcagtcttanctaaactgccagaaataggacagtgcagcaatgct

SEQ ID NO: 27686 - DNA, 71 bp, chicken (Gallus Gallus)
  misc_feature (36): n=c or t
agcccctgaagacacgttctgaaggtctattggcangggtgagaatccagaagactaaatagggggtagaa

SEQ ID NO: 27687 - DNA, 71 bp, chicken (Gallus Gallus)
  misc_feature (36): n=c or t
tctttgtcagttttggaaaggaagctttttaaagangcaaataaactctgttgccagaatcctgatctcta

SEQ ID NO: 27688 - DNA, 71 bp, chicken (Gallus Gallus)
  misc_feature (36): n=a or c
aggggaaaacccaggacaaggcaaaagggaaaagcncggagagaacagagggatgctgcttttcctaaagg

SEQ ID NO: 27689 - DNA, 71 bp, chicken (Gallus Gallus)
  misc_feature (36): n=a or g
aaaatatggggatatgcttaactgttttctaacttngatcccagtatttatctttcacttttgcaatgaca

SEQ ID NO: 27690 - DNA, 71 bp, chicken (Gallus Gallus)
  misc_feature (36): n=a or g
gtctttaccaaagataggggaagcagcatcaaaccncatgcaggtttatttctgggaatatccagaccttg

SEQ ID NO: 27691 - DNA, 71 bp, chicken (Gallus Gallus)
  misc_feature (36): n=c or t
aatgtgcgtatacagttgtggatgaacaaacaggtngtcgctacctggacaccgttcctcagcgctctccc

SEQ ID NO: 27692 - DNA, 71 bp, chicken (Gallus Gallus)
  misc_feature (36): n=c or t
aacaatatagacctgtatatagactggaaaattcantggaagtcaatgctgatcctaggatgatgaaataa

SEQ ID NO: 27693 - DNA, 71 bp, chicken (Gallus Gallus)
  misc_feature (36): n=a or g
ttcggaccgcgttaatctttaaagctgtggttctgnggagagcggtttgcagctcttattcatgaaaattt

SEQ ID NO: 27694 - DNA, 71 bp, chicken (Gallus Gallus)
  misc_feature (36): n=a or g
acagggacatctaccttctgaaaaggtagagttgtncttgagcatgtggaaattggttagcaacgcatgag

SEQ ID NO: 27695 - DNA, 71 bp, chicken (Gallus Gallus)
  misc_feature (36): n=a or g
gctcagcggacagcctatgcaagacaaagtaacttnctgaagtaatcctttatagcctatgctatgctggg

SEQ ID NO: 27696 - DNA, 71 bp, chicken (Gallus Gallus)
  misc_feature (36): n=c or g
tttgtgttctgatacccttcgttatttaaatatgtntatgttaagccatgattccagaatctctgaataaa

SEQ ID NO: 27697 - DNA, 71 bp, chicken (Gallus Gallus)
  misc_feature (36): n=a or g
aatggcatgacaaaaacaagaaagataaacagtgangaaataagatggtgaattggagaatctgcttatgt

SEQ ID NO: 27698 - DNA, 71 bp, chicken (Gallus Gallus)
  misc_feature (36): n=a or t
ctcagctggtgatgctgaaattgatctttccaggtngcagcctttgcattatagctgccttcccagtgaag

SEQ ID NO: 27699 - DNA, 71 bp, chicken (Gallus Gallus)
  misc_feature (36): n=a or g
atcgtgtttgcatatgattcatgcatgagcaagctnccgctttgaagaagctctcagactgtttgagaagg

SEQ ID NO: 27700 - DNA, 71 bp, chicken (Gallus Gallus)
  misc_feature (36): n=a or g
ggtttcttgtagagtattggtcgtacattggttgcngcagcaaagactttgatcttgtgaatcactctaaa

SEQ ID NO: 27701 - DNA, 71 bp, chicken (Gallus Gallus)
  misc_feature (36): n=c or t
cagatttcggggctggctgcccaatgaacaacgcanccaacaacacagttttattcccttccccttccaga

SEQ ID NO: 27702 - DNA, 71 bp, chicken (Gallus Gallus)
  misc_feature (36): n=a or g
aggttgggcctcatctcagtacttttccagaccgtnatgctcgtaagaaggcattcagtgcctcccattga

SEQ ID NO: 27703 - DNA, 71 bp, chicken (Gallus Gallus)
  misc_feature (36): n=a or g
gctaatgacacaaccgcagtgttgatgcagtcaccnatttggtgatagaagatccctctggttaggaatat

SEQ ID NO: 27704 - DNA, 71 bp, chicken (Gallus Gallus)
  misc_feature (36): n=a or g
ggtgattattcaagtacagtagtctttgttgggttnggatgagaattactgggacttttggttgtgataat

SEQ ID NO: 27705 - DNA, 71 bp, chicken (Gallus Gallus)
  misc_feature (36): n=c or t
tctcagagtagcccagaaggaacaaaaactctgctntcatcaggcaccttatcgcataaactgttagaatt

SEQ ID NO: 27706 - DNA, 71 bp, chicken (Gallus Gallus)
  misc_feature (36): n=g or t
agtagtattacttctcataatggcaaatctttccanggagagaagatttgaggatttactgagggatttct

SEQ ID NO: 27707 - DNA, 71 bp, chicken (Gallus Gallus)
  misc_feature (36): n=a or t
cgccgtttggaaatgggatttacccaccttgtttgnctacacgctctgaagagaagagcaacaaagcgtgc

SEQ ID NO: 27708 - DNA, 71 bp, chicken (Gallus Gallus)
  misc_feature (36): n=c or t
ggaattcttgggagcacttttttttttttttttttnccataggaaatggatgattaagtatcaaaggatta

SEQ ID NO: 27709 - DNA, 71 bp, chicken (Gallus Gallus)
  misc_feature (36): n=c or t
agttcatttgtaatgagggagggaaggaacaggtgnctaagcacaaacagctcagtcaccatcctgttctc

SEQ ID NO: 27710 - DNA, 71 bp, chicken (Gallus Gallus)
  misc_feature (36): n=a or g
atattacccatgattatttagagatgtaaaacaaanaaaaagcatattcattatgggggtcaaaaaaaaaa

SEQ ID NO: 27711 - DNA, 71 bp, chicken (Gallus Gallus)
  misc_feature (36): n=a or g
taattcatacatttgagatattgtgaggcttcaaanttgaagggacgatctgtgtggaactgatatttgtt

SEQ ID NO: 27712 - DNA, 71 bp, chicken (Gallus Gallus)
  misc_feature (36): n=a or g
aggcgagaagctcgctgcctctgaggtaacacacgngattttaagctcgttcctcccttgcgtggaggatc

SEQ ID NO: 27713 - DNA, 71 bp, chicken (Gallus Gallus)
  misc_feature (36): n=a or g
ccctgctgctcttgtcaggatttcccttggaagcanagtttcaagccacagctggctctgctaagaatact

SEQ ID NO: 27714 - DNA, 71 bp, chicken (Gallus Gallus)
  misc_feature (36): n=a or c
ggaatctcctggtgcaaatcataatcaacagtaacntggcaccttgaagaagtgtagttagtccaacaagt

SEQ ID NO: 27715 - DNA, 71 bp, chicken (Gallus Gallus)
  misc_feature (36): n=a or g
atgttttatttgggggaaaaagaaaatggaatgtcnttatctcctgagcaggaacggattttggtagtaga

SEQ ID NO: 27716 - DNA, 71 bp, chicken (Gallus Gallus)
  misc_feature (36): n=c or t
cactgtgaaaatagtgcatttgctcagtgatcatantatcacaaggagaagagagatgtgagctcttaatg

SEQ ID NO: 27717 - DNA, 71 bp, chicken (Gallus Gallus)
  misc_feature (36): n=c or t
aatctcatgactgtatgtttattctttactaaaaanggtattttattccatgttcagatagactttcctgg

SEQ ID NO: 27718 - DNA, 71 bp, chicken (Gallus Gallus)
  misc_feature (36): n=c or t
aaggcccttactaaactaaggactctgaagaaggangcccaaagaaacctttgatggagaattggctgagg

SEQ ID NO: 27719 - DNA, 71 bp, chicken (Gallus Gallus)
  misc_feature (36): n=a or g
aaggatatttctagttgcacagtagtagcgcttganctctcttttgagtgtgaaaactttcatcagagatc

SEQ ID NO: 27720 - DNA, 71 bp, chicken (Gallus Gallus)
  misc_feature (36): n=c or t
gtagatacaagctaggatcttgctgagcacaaactnatgccattttcaaagcctcctcctgactttccttc

SEQ ID NO: 27721 - DNA, 71 bp, chicken (Gallus Gallus)
  misc_feature (36): n=a or g
acaaattatttttaacttgttttatattaacatcangaatgtaaagactttgtcagtgtcacaacacaaac

SEQ ID NO: 27722 - DNA, 71 bp, chicken (Gallus Gallus)
  misc_feature (36): n=c or g
tacagagcatccataaatggtccagctgctgagagncgaggtacagacagagaacttctccctaaatactt

SEQ ID NO: 27723 - DNA, 71 bp, chicken (Gallus Gallus)
  misc_feature (36): n=a or g
caatgaactactgacctcttaaagattcaattatgnttttcaggcacgtcacagaaaagaatataacagag

SEQ ID NO: 27724 - DNA, 71 bp, chicken (Gallus Gallus)
  misc_feature (36): n=a or g
attgattcttttaaacaaggaaaaagaaactagagnaaagctcagtaataaaactactgcatgctgctcat

SEQ ID NO: 27725 - DNA, 71 bp, chicken (Gallus Gallus)
  misc_feature (36): n=a or g
gctcccagggaatgacgagccctgtggttagcagcnttgcacacattaagcactgcccagccaaaacatga

SEQ ID NO: 27726 - DNA, 71 bp, chicken (Gallus Gallus)
  misc_feature (36): n=a or g
atgcatataaaataacttgcaagtaatagagtgcantgagacctttgaagtttttttggttaagaatactc

SEQ ID NO: 27727 - DNA, 71 bp, chicken (Gallus Gallus)
  misc_feature (36): n=a or g
ggaaataaaattttccaaatgttattaatttgtatnttttctcaattgtcctttgaaaaagtagtggtaaa

SEQ ID NO: 27728 - DNA, 71 bp, chicken (Gallus Gallus)
  misc_feature (36): n=a or c
actattggtttctctggcagtaactggaaaaacacngtgatgttacacatcttcctcttaaaaagacacca

SEQ ID NO: 27729 - DNA, 71 bp, chicken (Gallus Gallus)
  misc_feature (36): n=c or g
cacctctcagtcccctcctaacaaggagggtgttanattgaagctgtgcctctgcaatatgtccagcctcc

SEQ ID NO: 27730 - DNA, 71 bp, chicken (Gallus Gallus)
  misc_feature (36): n=c or t
tttcttccttaccaattttggatggcagtgaacagnctttatatatacacaactgggctagcctttagtca

SEQ ID NO: 27731 - DNA, 71 bp, chicken (Gallus Gallus)
  misc_feature (36): n=a or g
atagagctgcagagagagctggagatgaacagagantactgaaaacctggccctgagacaggaaatggaag

SEQ ID NO: 27732 - DNA, 71 bp, chicken (Gallus Gallus)
  misc_feature (36): n=a or g
aaaggaaattttgaagacacgagcaatttgactatnagaaaccctgcaagacaaaattactctttaactat

SEQ ID NO: 27733 - DNA, 71 bp, chicken (Gallus Gallus)
  misc_feature (36): n=c or t
tttcacaaagaaatattgtgacaaaatcccagggcnctttttttctttaacttgctatgtgcagagtggaa

SEQ ID NO: 27734 - DNA, 71 bp, chicken (Gallus Gallus)
  misc_feature (36): n=a or g
gtcttcagggtgatgttgatgtaagaagtgtaatanggatgatctggtggcaggtcctggaagttcaggat

SEQ ID NO: 27735 - DNA, 71 bp, chicken (Gallus Gallus)
  misc_feature (36): n=a or t
gttcaatatggagtagggttatccttctaagaatcncttctgtttcaagttcagaggttttagttgaagaa

SEQ ID NO: 27736 - DNA, 71 bp, chicken (Gallus Gallus)
  misc_feature (36): n=a or g
tgctttttttttttgaatgcagaaaggtagacagangttaagggaagggtaactaaataaggaatgagtat

SEQ ID NO: 27737 - DNA, 71 bp, chicken (Gallus Gallus)
  misc_feature (36): n=c or t
cgtgacaggtaccacagcgtcagtcacacgtccctncctgtgcctttctcaatggtactgagtattacgca

SEQ ID NO: 27738 - DNA, 71 bp, chicken (Gallus Gallus)
  misc_feature (36): n=a or g
ttgactgttcctcacagtaagaactacttaatgggncagacatagctaacactggggaaaccaaggaaagg

SEQ ID NO: 27739 - DNA, 71 bp, chicken (Gallus Gallus)
  misc_feature (36): n=c or t
gccaagtgtatgatcgtctttggcagacatcagagngaagcgcgccgtgccggtgtgtgtgtgcgtcctcc

SEQ ID NO: 27740 - DNA, 71 bp, chicken (Gallus Gallus)
  misc_feature (36): n=a or t
acggtgcaatggagcgctttttaaatactgctgttncgagcaaatattagctaaccaggttatggcattta

SEQ ID NO: 27741 - DNA, 71 bp, chicken (Gallus Gallus)
  misc_feature (36): n=c or t
cacgttacactttccctgtgtaacacagacctcagnatatcctgtgcactgaatgggagaatgttattgag

SEQ ID NO: 27742 - DNA, 71 bp, chicken (Gallus Gallus)
  misc_feature (36): n=c or t
tgctatcagtttgcagcttaaggaaaactcaagcanttgatgatcatccagcatggaaacagcaagacaga

SEQ ID NO: 27743 - DNA, 71 bp, chicken (Gallus Gallus)
  misc_feature (36): n=c or g
cataacaccttcttttaacagccacatttagcagcngataatctggataagattcatgacgaatgtgacaa

SEQ ID NO: 27744 - DNA, 71 bp, chicken (Gallus Gallus)
  misc_feature (36): n=a or c
caacttaacctggacagtgaatgacacagcttcagnctcctacacatatagaatagaggttagaaatgggt

SEQ ID NO: 27745 - DNA, 71 bp, chicken (Gallus Gallus)
  misc_feature (36): n=c or t
cgtagtagaagaaccacctttggatttaattcagtnacggaagtacaatggtctatggtataagcagagca

SEQ ID NO: 27746 - DNA, 71 bp, chicken (Gallus Gallus)
  misc_feature (36): n=a or c
ttgcttcttatttggcaatgtccttctacatattcntgtcatttgcaaggtttttctcttcttagcttaca

SEQ ID NO: 27747 - DNA, 71 bp, chicken (Gallus Gallus)
  misc_feature (36): n=a or g
cactgtagccaattcacctctttatctgcgttaccntatacaggtctttcctagcagacagactttttgat

SEQ ID NO: 27748 - DNA, 71 bp, chicken (Gallus Gallus)
  misc_feature (36): n=a or g
ttttaacaagaataagtgtctactggaacaaagaanagaaagaaagaagagacaccaataaaaacagaaat

SEQ ID NO: 27749 - DNA, 71 bp, chicken (Gallus Gallus)
  misc_feature (36): n=a or g
ttcatattttactgcccagcttttacaaagtgatgntgtcatttgatgaatacaatctctgacacgttcag

SEQ ID NO: 27750 - DNA, 71 bp, chicken (Gallus Gallus)
  misc_feature (36): n=c or t
tttctcacacttataaaggtggcagaaggaaacggngccctaaagcctttttcagggtctcttggaagcat

SEQ ID NO: 27751 - DNA, 71 bp, chicken (Gallus Gallus)
  misc_feature (36): n=c or g
aagtcatctcctttcagacatgctggcttcatacgntgaatctgtgaacccgctcatggatctctctgctt

SEQ ID NO: 27752 - DNA, 71 bp, chicken (Gallus Gallus)
  misc_feature (36): n=c or t
tcagagcaatgcatgttttcttcagcactgaatgcntccttacaccatctgcctataaatagaaatcatca

SEQ ID NO: 27753 - DNA, 71 bp, chicken (Gallus Gallus)
  misc_feature (36): n=c or t
aaatgtaggaactgtaggaacagccacgctggcttncaagatatacgtattaagatgactgtgagaacaag

SEQ ID NO: 27754 - DNA, 71 bp, chicken (Gallus Gallus)
  misc_feature (36): n=a or g
actattgctggttcctggctgactgcatacttcacnaaggttgtcatgaggtcatgattttctgacatctt

SEQ ID NO: 27755 - DNA, 71 bp, chicken (Gallus Gallus)
  misc_feature (36): n=a or g
ggttagtagctgggagctagtagggttagtagctgngagctagcatgattactaagattagaaaagattcc

SEQ ID NO: 27756 - DNA, 71 bp, chicken (Gallus Gallus)
  misc_feature (36): n=c or t
cttcatgtgagcttgctctccttgagcaaggtttcntccatccgagtgtgagcccctcagcacaaccttgc

SEQ ID NO: 27757 - DNA, 71 bp, chicken (Gallus Gallus)
  misc_feature (36): n=c or t
cattgtctagtttgtctccagctctccctctaatgnctccgagaggtcagttttggttttaagaagttctg

SEQ ID NO: 27758 - DNA, 71 bp, chicken (Gallus Gallus)
  misc_feature (36): n=a or g
ttttattttttgtttcctttctttctcaaacgttgngaataaaatacataatttttcagcctaaaggagat

SEQ ID NO: 27759 - DNA, 71 bp, chicken (Gallus Gallus)
  misc_feature (36): n=a or g
cttcatcttccagcccttatcatctaacatgggccngagtgcctgcgtcatgaaatacaaatggagatatt

SEQ ID NO: 27760 - DNA, 71 bp, chicken (Gallus Gallus)
  misc_feature (36): n=a or g
taccattctgtcatctccaaaccaaagctggatgcntttcagggaagacagagacacaggtggcaaagtct

SEQ ID NO: 27761 - DNA, 71 bp, chicken (Gallus Gallus)
  misc_feature (36): n=a or c
caaaagcatctaaatgacataaatttgccttaatcntagcattcatcagactttcttctattatatgctgc

SEQ ID NO: 27762 - DNA, 71 bp, chicken (Gallus Gallus)
  misc_feature (36): n=a or g
caggtcaaactatgagccaaggaaaatatctcctcntagaattctaaaagaaatagaaacagaaacaaatt

SEQ ID NO: 27763 - DNA, 71 bp, chicken (Gallus Gallus)
  misc_feature (36): n=a or g
ctgcctcgagtttctgtaacacagtacagcagcgcngttatgtaggcatgtataaagtacctacagcagcc

SEQ ID NO: 27764 - DNA, 71 bp, chicken (Gallus Gallus)
  misc_feature (36): n=g or t
actctaatagtatctttgatcgcacatttgtggagnttttttttttttgtctctgcactgaaagcttttca

SEQ ID NO: 27765 - DNA, 71 bp, chicken (Gallus Gallus)
  misc_feature (36): n=c or t
tgccttcatgcaaaataggtatcgatacgtaaacantactgtcctgttaatttacaacatataaaaataat

SEQ ID NO: 27766 - DNA, 71 bp, chicken (Gallus Gallus)
  misc_feature (36): n=g or t
gattagcatatttaagccatttgtgttacagaaacnaaggtgctgaactgttgaaaaagtcatttttgtcc

SEQ ID NO: 27767 - DNA, 71 bp, chicken (Gallus Gallus)
  misc_feature (36): n=a or g
ttacagttcaatacagacaataaaaggataagggcntaaatatgtcattttagacagaaagcagcactact

SEQ ID NO: 27768 - DNA, 71 bp, chicken (Gallus Gallus)
  misc_feature (36): n=c or t
caacatctgaagataactccatttctctaatcccgnccttccctccttctgtgtgtcctgcccccttattc

SEQ ID NO: 27769 - DNA, 71 bp, chicken (Gallus Gallus)
  misc_feature (36): n=a or c
ggagccgtggcttatgtgctttctaagcgtacagcnaaatcagctggctaccttatcccagaagtgctagc

SEQ ID NO: 27770 - DNA, 71 bp, chicken (Gallus Gallus)
  misc_feature (36): n=c or t
aaaaaaaaagtggtgttcttccagatttattctggntttggccagggattgaaagaaataatagacatgca

SEQ ID NO: 27771 - DNA, 71 bp, chicken (Gallus Gallus)
  misc_feature (36): n=c or g
ccctcatcatatcacacttccttctctctgacagcncactggctgaggtaatactgccaggaggcatcaaa

SEQ ID NO: 27772 - DNA, 71 bp, chicken (Gallus Gallus)
  misc_feature (36): n=a or c
tccccatgggcactgaagcaccacaaatgtcatagnttaaaacttgtgaagtttgtctgacttcaggtttt

SEQ ID NO: 27773 - DNA, 71 bp, chicken (Gallus Gallus)
  misc_feature (36): n=a or g
ccacagagcgacccctgaaatgctgtgcacacagcnacgcatttacaagcgctgggtggaatcccagctcc

SEQ ID NO: 27774 - DNA, 71 bp, chicken (Gallus Gallus)
  misc_feature (36): n=a or g
atcaggcagttattctatttgttcaaattgcacttnaattacaatcaaatattactgctagtacttagtac

SEQ ID NO: 27775 - DNA, 71 bp, chicken (Gallus Gallus)
  misc_feature (36): n=c or t
gagctcaacctcagcatcctgatggacctgattttngcctatggtaagcagcttgcttgtatcaccaccct

SEQ ID NO: 27776 - DNA, 71 bp, chicken (Gallus Gallus)
  misc_feature (36): n=a or t
gctttacaaagtgtttcttctccctctgctccgtangaaatgtaatcaagtctttgtgcatatactgcagc

SEQ ID NO: 27777 - DNA, 71 bp, chicken (Gallus Gallus)
  misc_feature (36): n=a or c
actcttctcataaagtcatcagctataaaactgtgntttcagttatgcctttcagtatgtggggcctagcc

SEQ ID NO: 27778 - DNA, 71 bp, chicken (Gallus Gallus)
  misc_feature (36): n=a or g
atatcttatggctgaagatattacagtacagctatngttcaatgcttagggcctcttgaggcggagagaag

SEQ ID NO: 27779 - DNA, 71 bp, chicken (Gallus Gallus)
  misc_feature (36): n=a or c
ctcatggaccatgggccagctaggctggtaggtgtntgaggaaacaccatcagcctcttgtgagccctctc

SEQ ID NO: 27780 - DNA, 71 bp, chicken (Gallus Gallus)
  misc_feature (36): n=a or t
cttaacactaaattcttagataacatatttcacagngtttctgcaaatgcaatggcatgccaggtatttac

SEQ ID NO: 27781 - DNA, 71 bp, chicken (Gallus Gallus)
  misc_feature (36): n=c or t
tcttcttattgtcttcacatttcaattactcccatngcatattgtttcagctttcttactacactcataat

SEQ ID NO: 27782 - DNA, 71 bp, chicken (Gallus Gallus)
  misc_feature (36): n=c or t
tttccgatgctcttacattaatgtcactaccactgntgtgctgttagcatttggtgaccatctggcagttg

SEQ ID NO: 27783 - DNA, 71 bp, chicken (Gallus Gallus)
  misc_feature (36): n=a or g
agtcagaggcatcagccaggctgggacaggggcagnagatccaaggaagcgtgtgcaaaggagagaacact

SEQ ID NO: 27784 - DNA, 71 bp, chicken (Gallus Gallus)
  misc_feature (36): n=c or t
atgaattgtgcaaggtatgaaaatgcagcaggaccnttagtcagaatatctgagtggggatgaacaaaacg

SEQ ID NO: 27785 - DNA, 71 bp, chicken (Gallus Gallus)
  misc_feature (36): n=a or c
aaacatcccaagctccacagtgtttagattggagtnttggtctggatctcaagatctactatgcaatattt

SEQ ID NO: 27786 - DNA, 71 bp, chicken (Gallus Gallus)
  misc_feature (36): n=a or t
ccctcctcttgctatcacttgtcctcttgctgattngatcttctacaagtacaggctttcatagagacttg

SEQ ID NO: 27787 - DNA, 71 bp, chicken (Gallus Gallus)
  misc_feature (36): n=c or t
attgccttctgtcatgaccttgtgctttctggtgcnttctgagcggctgaataatttaacacgggacacat

SEQ ID NO: 27788 - DNA, 71 bp, chicken (Gallus Gallus)
  misc_feature (36): n=g or t
gagtagctcccatgtgaaatcctgacaaaacctttncctttcaggtgcacatttagcactgcatgcagaga

SEQ ID NO: 27789 - DNA, 71 bp, chicken (Gallus Gallus)
  misc_feature (36): n=c or t
gatcacagacttcatcaagtttgacacaggtgggtngagcatcccctggcaagatgctgctttcttgggag

SEQ ID NO: 27790 - DNA, 71 bp, chicken (Gallus Gallus)
  misc_feature (36): n=c or t
gcttctgaatctgttcagctactgcattagaactgnatgtctcattccaaaatacacttatttctacagtg

SEQ ID NO: 27791 - DNA, 71 bp, chicken (Gallus Gallus)
  misc_feature (36): n=c or t
gcataataacctgaaatattccctagacatgaccgnaatttgtaactggtcaaggttggctgaattaatgg

SEQ ID NO: 27792 - DNA, 71 bp, chicken (Gallus Gallus)
  misc_feature (36): n=a or g
gttggccaaggctaacccatcatgccaagctttcancattttctttctctcccagcattttattaagagat

SEQ ID NO: 27793 - DNA, 71 bp, chicken (Gallus Gallus)
  misc_feature (36): n=c or t
ttagttttttcctattaacacaagtattttcaacangtatagctgctcttcagaacagggacatagtctca

SEQ ID NO: 27794 - DNA, 71 bp, chicken (Gallus Gallus)
  misc_feature (36): n=c or t
cccccagacttgagttacccataattagagaagcanatgatcccttcacagtgtcatcataaaagctgcag

SEQ ID NO: 27795 - DNA, 71 bp, chicken (Gallus Gallus)
  misc_feature (36): n=c or t
cacaatttcattttaatgaaaatgttcaaatgaccntcaccatgacaaagctctccttcacaacacctcat

SEQ ID NO: 27796 - DNA, 71 bp, chicken (Gallus Gallus)
  misc_feature (36): n=a or t
taagatttacttgaaactagagagtaaaaaaattantaataattacattttattccagataccagcaaaat

SEQ ID NO: 27797 - DNA, 71 bp, chicken (Gallus Gallus)
  misc_feature (36): n=a or g
cataggaaaacaaatttttaggaagtcatatggatnaatgctgacaatgacttacttgtgacagtagcgag

SEQ ID NO: 27798 - DNA, 71 bp, chicken (Gallus Gallus)
  misc_feature (36): n=c or t
ccagaagccgaaagcccagcagaagtttgtgcagtngggtgagtttcacaaagcccatacagtagtttatg

SEQ ID NO: 27799 - DNA, 71 bp, chicken (Gallus Gallus)
  misc_feature (36): n=c or t
ttattcaattgggctttcagggtctttgcaaacttnaagatggaacaataagttcttggatggcagatctc

SEQ ID NO: 27800 - DNA, 71 bp, chicken (Gallus Gallus)
  misc_feature (36): n=a or g
gtaactcacagcagtgatgtggagtggaaacgtgcncttatttgtgtggaattaaacaggacacaaatggc

SEQ ID NO: 27801 - DNA, 71 bp, chicken (Gallus Gallus)
  misc_feature (36): n=c or t
gtgttcatatgagctaatgaaaacctccagcacttnttgatgtgtgttgtggcatttggcaaatgcttttt

SEQ ID NO: 27802 - DNA, 71 bp, chicken (Gallus Gallus)
  misc_feature (36): n=a or g
tctgttccaaggtaaataccttaaccaccttctagnttctggtttaagtgaagctgttgaagcaggtacag

SEQ ID NO: 27803 - DNA, 71 bp, chicken (Gallus Gallus)
  misc_feature (36): n=c or t
agtcctttggtttgcttctgaactttgttctccacngtcttgtagacttgctgcctcacaaatggaagagc

SEQ ID NO: 27804 - DNA, 71 bp, chicken (Gallus Gallus)
  misc_feature (36): n=c or g
tttagaacagctgcagagcagtcctaaaccagcctntccttccatttcccagcaaggaaattcctaggtat

SEQ ID NO: 27805 - DNA, 71 bp, chicken (Gallus Gallus)
  misc_feature (36): n=g or t
taaactttctgtttctcctgtgctgactaacatatnctgtattaagctttaaaacaatgatgttgcttaca

SEQ ID NO: 27806 - DNA, 71 bp, chicken (Gallus Gallus)
  misc_feature (36): n=c or t
tctacaaccaagctttcaggtgatggtcctattccngggcattcatttcactgaaatgaaagtcaattgct

SEQ ID NO: 27807 - DNA, 71 bp, chicken (Gallus Gallus)
  misc_feature (36): n=a or c
agaacattacaacacagagaaagaattcttgactanaactagaaacagaaaggataaacctaaggcacaca

SEQ ID NO: 27808 - DNA, 71 bp, chicken (Gallus Gallus)
  misc_feature (36): n=c or t
ttccaatcaactgtgaaaagtaactcccaattacanggcaatattaatcttcaaactccagcttttgtgct

SEQ ID NO: 27809 - DNA, 71 bp, chicken (Gallus Gallus)
  misc_feature (36): n=c or t
caccattgtccaaggataggacgtgaaataagaatncacaaactgtctatttgttccagaatctgttttct

SEQ ID NO: 27810 - DNA, 71 bp, chicken (Gallus Gallus)
  misc_feature (36): n=c or t
ctcctgaacagctcatcatctaattccaggggacangcaaaaagctaaaagcacaagatagataaacagcc

SEQ ID NO: 27811 - DNA, 71 bp, chicken (Gallus Gallus)
  misc_feature (36): n=a or t
agtacatgtatatgttgaggaatgactgtgttattngggattgtatgaatggcaccgatgcaacagagaag

SEQ ID NO: 27812 - DNA, 71 bp, chicken (Gallus Gallus)
  misc_feature (36): n=c or t
accagaagacattcattggatttcatttttgtttanagaattgagaactttatttatgtaagttgtaagaa

SEQ ID NO: 27813 - DNA, 71 bp, chicken (Gallus Gallus)
  misc_feature (36): n=c or t
cagaggccatggtgatgtccagtgctaagaggagtngctatgagttgcagatgcatagcaagcagacagcc

SEQ ID NO: 27814 - DNA, 71 bp, chicken (Gallus Gallus)
  misc_feature (36): n=a or g
taggtagtttagctaccagtcatgtcattggtcatngtggccagtgccaaaaattgtcactgaataaacac

SEQ ID NO: 27815 - DNA, 71 bp, chicken (Gallus Gallus)
  misc_feature (36): n=a or g
ttagaatattagtattgaactgatgtagtgattttnaaaagcacattttagatttttttatttttatagta

SEQ ID NO: 27816 - DNA, 71 bp, chicken (Gallus Gallus)
  misc_feature (36): n=c or t
tatatatttgtatatagatgcagtaagaaaacacantgtgcttgtgtatatagatgcatacatagtgcatt

SEQ ID NO: 27817 - DNA, 71 bp, chicken (Gallus Gallus)
  misc_feature (36): n=a or g
aacatattagtgtgctgctcctatcatgcttaaaancaactgagctatattagctcccacagccaaaaagc

SEQ ID NO: 27818 - DNA, 71 bp, chicken (Gallus Gallus)
  misc_feature (36): n=a or g
ttttcacttaatgtttatattgtggttaatctaaangttggtagtaaaatgaggccatttgtctgaacaca

SEQ ID NO: 27819 - DNA, 71 bp, chicken (Gallus Gallus)
  misc_feature (36): n=a or t
ctccagccaggagaaaggtgtctgtttttcttctgnttacatcagggagattttcttacagaagacatttg

SEQ ID NO: 27820 - DNA, 71 bp, chicken (Gallus Gallus)
  misc_feature (36): n=c or t
ttactgctcaggatctgtatgagtgttttgttatcntccgtggatttgtcctgtagttttctgaagccata

SEQ ID NO: 27821 - DNA, 71 bp, chicken (Gallus Gallus)
  misc_feature (36): n=g or t
gatgggaaaaaatgaagcataatagatttttttcancctggaaaaggggaatgtgacaaaattctgtaatg

SEQ ID NO: 27822 - DNA, 71 bp, chicken (Gallus Gallus)
  misc_feature (36): n=a or g
tgcatataagacacctactttgaattcagctttcantaactctaacagcttcctcaaacacatcacttctt

SEQ ID NO: 27823 - DNA, 71 bp, chicken (Gallus Gallus)
  misc_feature (36): n=g or t
aggcacgttaactgaggacatataagcttccagatngtcacaaacatgctagtttagatctaatagttgaa

SEQ ID NO: 27824 - DNA, 71 bp, chicken (Gallus Gallus)
  misc_feature (36): n=c or g
ggagttgttaacgtggaataacgccagcaatgtgtntttggagcagtgctgtcagcaatgcccatccatct

SEQ ID NO: 27825 - DNA, 71 bp, chicken (Gallus Gallus)
  misc_feature (36): n=a or c
aatatacaaattcacctagagtcacctagagctacngttcctgaataccaacacaacgataaacatctgct

SEQ ID NO: 27826 - DNA, 71 bp, chicken (Gallus Gallus)
  misc_feature (36): n=a or c
gattcactcgtttctgtttcactgctgtgctaagtnaagtagtcgttcattctctttgattcaggatctgt

SEQ ID NO: 27827 - DNA, 71 bp, chicken (Gallus Gallus)
  misc_feature (36): n=a or g
actgttaggcaggctcacagggtaacctcagtcatncccatagtaaggttgagagttaatgatcataattt

SEQ ID NO: 27828 - DNA, 71 bp, chicken (Gallus Gallus)
  misc_feature (36): n=a or g
caaggcaagctggccattttctccaacagaggatgngggagagaaggctgacaaacaaaaagaacacaaaa

SEQ ID NO: 27829 - DNA, 71 bp, chicken (Gallus Gallus)
  misc_feature (36): n=a or g
aaaacaataaagagccactttttactcttgaatganataatcagaaaactcacagtatttcacgtgctctc

SEQ ID NO: 27830 - DNA, 71 bp, chicken (Gallus Gallus)
  misc_feature (36): n=c or t
cagtgattatggctaaacagtggcttttcactattnttatttcatagtgtattttccccgagtctcaccat

SEQ ID NO: 27831 - DNA, 71 bp, chicken (Gallus Gallus)
  misc_feature (36): n=c or g
cttgcagttggtcacatgctgctggccgggcacctngtcagcaacaacaccctgtggattggaagtgcctg

SEQ ID NO: 27832 - DNA, 71 bp, chicken (Gallus Gallus)
  misc_feature (36): n=g or t
ctgcgggtccaagcgcgtgatcttcaaaagggtctngatcatgatgtcccgaagcaacgcgttgctgtctg

SEQ ID NO: 27833 - DNA, 71 bp, chicken (Gallus Gallus)
  misc_feature (36): n=g or t
cagatagctgtaattgtgccaccaatctgtgcagcngcatggctagaacagaactttagtgcttagatgag

SEQ ID NO: 27834 - DNA, 71 bp, chicken (Gallus Gallus)
  misc_feature (36): n=a or c
tattaaatcaaagcaaagtcctcatacagccacccngatgctgtgctcacagggtcacgctatcccttcac

SEQ ID NO: 27835 - DNA, 71 bp, chicken (Gallus Gallus)
  misc_feature (36): n=a or g
agcttccagttgctttggagtgcaagaattgctgtngagctgaaactttcctactaaatacttcttttaat

SEQ ID NO: 27836 - DNA, 71 bp, chicken (Gallus Gallus)
  misc_feature (36): n=a or g
ctaccaccatgggggtatcttattctcaacatagcnttgctttcaataagaaaacagtgcaaacaggaaag

SEQ ID NO: 27837 - DNA, 71 bp, chicken (Gallus Gallus)
  misc_feature (36): n=c or t
caacatcactggtgctttatgccaagctgtctgtcncatgtgagagcaccttctctgcatttaaactacat

SEQ ID NO: 27838 - DNA, 71 bp, chicken (Gallus Gallus)
  misc_feature (36): n=a or t
taggtgagagtgagagaagacagggatgttcacttnagagtttcagagcatcagataatagaaattctgta

SEQ ID NO: 27839 - DNA, 71 bp, chicken (Gallus Gallus)
  misc_feature (36): n=a or g
taggacaaatgctagaaacaggtaactttatgtagngctggtacaacttaagaggctgcagggtacagttc

SEQ ID NO: 27840 - DNA, 71 bp, chicken (Gallus Gallus)
  misc_feature (36): n=c or t
cctagtcatcttcagctctttgactatttctacatncactgactcaggcaccaaacagtggaaaagtttac

SEQ ID NO: 27841 - DNA, 71 bp, chicken (Gallus Gallus)
  misc_feature (36): n=c or t
aggagtcagataatacagaaatgcctcctgtcattngtgatcctttctgattattttcagagcatatccca

SEQ ID NO: 27842 - DNA, 71 bp, chicken (Gallus Gallus)
  misc_feature (36): n=g or t
tgactttgtccattaaaacggcaaaataaaaactgnttttcctcatgtgggtttctccttaatgagatttg

SEQ ID NO: 27843 - DNA, 71 bp, chicken (Gallus Gallus)
  misc_feature (36): n=c or t
tttccctttaggagctggctccacaacagaagacangttccttctcaaaaaaaaccttttttccagtgctc

SEQ ID NO: 27844 - DNA, 71 bp, chicken (Gallus Gallus)
  misc_feature (36): n=c or t
tcattgtcttgctcctttctgatgaagaaagtaatnaattattagcagtatttttttgtgcttaatccatt

SEQ ID NO: 27845 - DNA, 71 bp, chicken (Gallus Gallus)
  misc_feature (36): n=c or t
agaatttggcacttctcttggccttgtttctgtgcncagattctgtgaaataggagtctcatcatttgctt

SEQ ID NO: 27846 - DNA, 71 bp, chicken (Gallus Gallus)
  misc_feature (36): n=c or t
ctttctctttctttctttactatgagaatggggcangatggtgagggattggagtaatttacatctgcctc

SEQ ID NO: 27847 - DNA, 71 bp, chicken (Gallus Gallus)
  misc_feature (36): n=c or t
gttgccacttgtaaatggcacattagtaacatattngtacaattaacaaagttaagcagatcagatgaaaa

SEQ ID NO: 27848 - DNA, 71 bp, chicken (Gallus Gallus)
  misc_feature (36): n=c or t
agagaccagccttattgatccaggacatggtattcnagccaccatgtctttctgcagagttgcagcaactt

SEQ ID NO: 27849 - DNA, 71 bp, chicken (Gallus Gallus)
  misc_feature (36): n=a or c
cgttattggtgttataaaacttcagattcttttgcnagaagactagaatgattctcattttgacttagatt

SEQ ID NO: 27850 - DNA, 71 bp, chicken (Gallus Gallus)
  misc_feature (36): n=a or g
tcccattttctgttgtgcaacttgaggaggatgcanccttccttgtgggaaggggttcattcagactaaat

SEQ ID NO: 27851 - DNA, 71 bp, chicken (Gallus Gallus)
  misc_feature (36): n=a or g
acttacgcagcgtggtgccgtcgcttcgtatgtgcntacctcctacaagtacccaagtgagctcaaaccag

SEQ ID NO: 27852 - DNA, 71 bp, chicken (Gallus Gallus)
  misc_feature (36): n=a or g
ataaaactgtctgcaaacaagatctgtggctcagcngattaagatgtcctgcttggggatttgcacaagtt

SEQ ID NO: 27853 - DNA, 71 bp, chicken (Gallus Gallus)
  misc_feature (36): n=c or t
gaaatgtttctttcagtaaatcttgcagaagaacangaatattctgtcttgccatgtgagcaaaaatcaca

SEQ ID NO: 27854 - DNA, 71 bp, chicken (Gallus Gallus)
  misc_feature (36): n=c or t
tactgttgggtttcacagacccacatccataagganaaaatggatttgcatattatgatggaatgtatatg

SEQ ID NO: 27855 - DNA, 71 bp, chicken (Gallus Gallus)
  misc_feature (36): n=a or g
acgcgtggaggaggatctcctcacaaacaggtactngatgacatgctctgggctgcagctttccttcagag

SEQ ID NO: 27856 - DNA, 71 bp, chicken (Gallus Gallus)
  misc_feature (36): n=c or t
taattcttggtcagcacactttttgcttgtaatganattgagtttactccagtcttagcatcactgctgtt

SEQ ID NO: 27857 - DNA, 71 bp, chicken (Gallus Gallus)
  misc_feature (36): n=a or g
agaatattacattgataagatttatccatcatcacnacactcaaaatagcattcttttccaaaggcaggtt

SEQ ID NO: 27858 - DNA, 71 bp, chicken (Gallus Gallus)
  misc_feature (36): n=c or t
aaaaaaaaccaacaacccaaacaaaaaaacccaaangtgtgtagttgtaagtgggagagagatttctaggc

SEQ ID NO: 27859 - DNA, 71 bp, chicken (Gallus Gallus)
  misc_feature (36): n=c or t
ttattgcttacaaatagagttgggattgttgaagtnttaagtgaaacttaaaagtgaaacaagaaaaggaa

SEQ ID NO: 27860 - DNA, 71 bp, chicken (Gallus Gallus)
  misc_feature (36): n=a or g
tcagtaccagactttctgccactgcagtgagatgcntttgtgaagagtagtccttgaacattcatggccca

SEQ ID NO: 27861 - DNA, 71 bp, chicken (Gallus Gallus)
  misc_feature (36): n=c or t
tttataacagttgtacttcttatgacaggcatgcantttatatgcactattgtctgtcactgttactttgg

SEQ ID NO: 27862 - DNA, 71 bp, chicken (Gallus Gallus)
  misc_feature (36): n=a or g
cgttatttgaatgcatgggtagaagagctgtgcagngggctgctggtgtgtcacctcacatggcagccctg

SEQ ID NO: 27863 - DNA, 71 bp, chicken (Gallus Gallus)
  misc_feature (36): n=c or t
tacacaagtaatttgtacttgctgttacatggcttngcatattgttgcaccattaataacaatgaataata

SEQ ID NO: 27864 - DNA, 71 bp, chicken (Gallus Gallus)
  misc_feature (36): n=c or t
tgacattttaaatattagtacctcatgaattccaantcaaaacattaatattgcaacatctttttctcaaa

SEQ ID NO: 27865 - DNA, 71 bp, chicken (Gallus Gallus)
  misc_feature (36): n=c or t
tccagctttaactacacgctctggaagtgaacaagnatatgcagtcatattaacattcattccactctgaa

SEQ ID NO: 27866 - DNA, 71 bp, chicken (Gallus Gallus)
  misc_feature (36): n=a or g
gtgtctgtgggcaggtggaggggcttgcaggtattntggaagataactagcatctcatctgaaaaacctgc

SEQ ID NO: 27867 - DNA, 71 bp, chicken (Gallus Gallus)
  misc_feature (36): n=a or t
agaaagtgaaccagatcaaagtgttccatacaaagncgatttctgctgccagtcctcaccaaccagaggta

SEQ ID NO: 27868 - DNA, 71 bp, chicken (Gallus Gallus)
  misc_feature (36): n=c or t
gctggcaagtcctatctcctctcataaccatgaccntgttaactgttcagtgaaaaggctcaccatcacct

SEQ ID NO: 27869 - DNA, 71 bp, chicken (Gallus Gallus)
  misc_feature (36): n=c or t
tatgaaatatgcaccttttagaagccacctcaattnaattatgtctttttttctcctgagaagatgaggga

SEQ ID NO: 27870 - DNA, 71 bp, chicken (Gallus Gallus)
  misc_feature (36): n=a or c
aagagcaattttcaccaacaataaaatatttcatgnaaaatttagacaataatttagacagacttgatcac

SEQ ID NO: 27871 - DNA, 71 bp, chicken (Gallus Gallus)
  misc_feature (36): n=c or t
gtagaagtcaaaaagagtaaaaaaaagtctctgtcnactacaaacttaaattcctgcagaaatcaccagtg

SEQ ID NO: 27872 - DNA, 71 bp, chicken (Gallus Gallus)
  misc_feature (36): n=a or g
tctgggaaaacatcatatgcaataactggatatccntgttttatcaggttttttgccattggatttcccat

SEQ ID NO: 27873 - DNA, 71 bp, chicken (Gallus Gallus)
  misc_feature (36): n=g or t
agcattaaggctgtcagtacatcagcacttgttagngagatgttgatattcctgtgttggaatactgggct

SEQ ID NO: 27874 - DNA, 71 bp, chicken (Gallus Gallus)
  misc_feature (36): n=c or t
ggcttgaaatgaggaaaccaaaatctctcaccatcntcatccacctcatcaatcatctcctgcagctcctc

SEQ ID NO: 27875 - DNA, 71 bp, chicken (Gallus Gallus)
  misc_feature (36): n=a or g
tactgctcaatgtcctaccttgaatatgacaattcntcagttgctatccattaacccagtagtttgctttg

SEQ ID NO: 27876 - DNA, 71 bp, chicken (Gallus Gallus)
  misc_feature (36): n=g or t
tgctgagtgtggtctggtgtgagataagtcaccctnggtgcagcaggcctaggaagaacttgtgtatacat

SEQ ID NO: 27877 - DNA, 71 bp, chicken (Gallus Gallus)
  misc_feature (36): n=c or t
tttgctcttaccttgcaaggtgaaagcacaaggtcnggttttgagttgtttgactgggcatgcctgcagcc

SEQ ID NO: 27878 - DNA, 71 bp, chicken (Gallus Gallus)
  misc_feature (36): n=c or t
caagggtacaggattcttggtatgaagcatagactntcatgcaggacaagaacaatggatactgccttgaa

SEQ ID NO: 27879 - DNA, 71 bp, chicken (Gallus Gallus)
  misc_feature (36): n=a or t
tatattttattgtcagaatgtaactttgtgctaggnctgctcattagagctagatcaagattggagacacc

SEQ ID NO: 27880 - DNA, 71 bp, chicken (Gallus Gallus)
  misc_feature (36): n=a or t
gccatgtgctgggagcagtgctgacctcatgaaagngagcatgtgtttcatagcttacctgtatctatcaa

SEQ ID NO: 27881 - DNA, 71 bp, chicken (Gallus Gallus)
  misc_feature (36): n=c or g
agcagaatggactttggcctgcagaaaatgacaggnttggtttcgttatgctattgataaacagagaaact

SEQ ID NO: 27882 - DNA, 71 bp, chicken (Gallus Gallus)
  misc_feature (36): n=c or t
agcctgaccaaagacagccatggtctccacagatcnaatcacagcagtctgggactggagacttaactgca

SEQ ID NO: 27883 - DNA, 71 bp, chicken (Gallus Gallus)
  misc_feature (36): n=a or g
gaacaagcaggctacatgagaatgagttcatctgtnttttattttcttcatcttcctttgaagaagaagaa

SEQ ID NO: 27884 - DNA, 71 bp, chicken (Gallus Gallus)
  misc_feature (36): n=c or t
ccaagcacacttattcgtgtctctgggctgcatttnccaatgctcctgccatcctcctttgtagacatttg

SEQ ID NO: 27885 - DNA, 71 bp, chicken (Gallus Gallus)
  misc_feature (36): n=c or t
gaggagtagcaaatgaattccccgttttgcttcgcnagcacatacagcttttgctttcttaaacagtcttt

SEQ ID NO: 27886 - DNA, 71 bp, chicken (Gallus Gallus)
  misc_feature (36): n=c or t
tactaatggaacgttgacatgttttaattacttcanttcagacataatataattaaaaagaaaggataaat

SEQ ID NO: 27887 - DNA, 71 bp, chicken (Gallus Gallus)
  misc_feature (36): n=c or t
gatatctacattcatttagtgcttgtctgtttctcntagtgcttcttggagccagctgtctatgagtcttg

SEQ ID NO: 27888 - DNA, 71 bp, chicken (Gallus Gallus)
  misc_feature (36): n=a or g
gttagttgtgacagatttgttcctgtactggctgtncatgaggaaaagatcaggcatagtccaatggtaac

SEQ ID NO: 27889 - DNA, 71 bp, chicken (Gallus Gallus)
  misc_feature (36): n=g or t
agttactctctatcattcagcgtgcaggtcaacgtncttgttgtgcaagtgttcttttctttcattttgtg

SEQ ID NO: 27890 - DNA, 71 bp, chicken (Gallus Gallus)
  misc_feature (36): n=a or g
aaagaactgttaagatataacttcttctattcttcncacttttatgtgtaattggattgtttctttctgat

SEQ ID NO: 27891 - DNA, 71 bp, chicken (Gallus Gallus)
  misc_feature (36): n=g or t
tccagtttcagacagtctgcactgtggagcattttntgctgacagagacactgctccaagttttggtactg

SEQ ID NO: 27892 - DNA, 71 bp, chicken (Gallus Gallus)
  misc_feature (36): n=a or c
tatgcagataaatgtaagagggcctacggactgttntagggaagaaaacattgttagcaatgcctccttcc

SEQ ID NO: 27893 - DNA, 71 bp, chicken (Gallus Gallus)
  misc_feature (36): n=a or g
gatgcaagctagatccaagatgagcatagatggggnggcggtgggaggggggaggataacatttctcccca

SEQ ID NO: 27894 - DNA, 71 bp, chicken (Gallus Gallus)
  misc_feature (36): n=c or g
tgcatcccttccacaatttgtttgtaaatcacattngaagacaagaaagtgtgaaaaattgatactgtgaa

SEQ ID NO: 27895 - DNA, 71 bp, chicken (Gallus Gallus)
  misc_feature (36): n=c or g
tgccactactttatttcagataactacacttaaaanaaagttaattgttcctatctatttggtataaatac

SEQ ID NO: 27896 - DNA, 71 bp, chicken (Gallus Gallus)
  misc_feature (36): n=a or c
tacaacatgctacagagttctagagcaaagccaaanaactttgagcattacaaagctcactacaaccaaaa

SEQ ID NO: 27897 - DNA, 71 bp, chicken (Gallus Gallus)
  misc_feature (36): n=g or t
agcgatagccttcaggtgattaccactttgggattnaaattatatggccgtggctttataccaaagctatg

SEQ ID NO: 27898 - DNA, 71 bp, chicken (Gallus Gallus)
  misc_feature (36): n=g or t
acagcataaataatttcaattaaaacatgtggatcntaaataaaccacttctggaggcttatcaagcaaaa

SEQ ID NO: 27899 - DNA, 71 bp, chicken (Gallus Gallus)
  misc_feature (36): n=a or t
tttatttcagactataattgattggttagttgaggnttttattaaatattttcagaactctgtctttatta

SEQ ID NO: 27900 - DNA, 71 bp, chicken (Gallus Gallus)
  misc_feature (36): n=a or t
gcactgttggcttttttttttttttttcctgagganaatcttgcttttttgaagtgaactaatataattat

SEQ ID NO: 27901 - DNA, 71 bp, chicken (Gallus Gallus)
  misc_feature (36): n=c or t
tctagcagaaaacctgttgtaatcagagttcttcanaacagaaagtagcttatgaagcatttttagatcag

SEQ ID NO: 27902 - DNA, 71 bp, chicken (Gallus Gallus)
  misc_feature (36): n=c or t
tcattataatggtaagagctaagttctatatgtaanatatttgtgtcctgagggaaaagacctcatttcat

SEQ ID NO: 27903 - DNA, 71 bp, chicken (Gallus Gallus)
  misc_feature (36): n=c or t
cagagcttgcggctgtggggaaaaatctccatgcantggggtgtggtgagcggcgtcggggcaggggctgc

SEQ ID NO: 27904 - DNA, 71 bp, chicken (Gallus Gallus)
  misc_feature (36): n=c or t
gttatcagctacttcggagtcagaaatcagaacagntgactgagcaaattatagctgaatacattcatatg

SEQ ID NO: 27905 - DNA, 71 bp, chicken (Gallus Gallus)
  misc_feature (36): n=c or t
atataggaaactagaagggctgatcacaagccttanactctagctgaggtcatgctggctactgtccctca

SEQ ID NO: 27906 - DNA, 71 bp, chicken (Gallus Gallus)
  misc_feature (36): n=c or g
atgtccccaccaggcatgtagattgaaacaatatcnaaagggtatggtttgagacccctgtgtcactgtgg

SEQ ID NO: 27907 - DNA, 71 bp, chicken (Gallus Gallus)
  misc_feature (36): n=a or g
gagatgagaaatttagatgcttacagtatgcagatntgtatgcattcacacgggagtcgttttattttggc

SEQ ID NO: 27908 - DNA, 71 bp, chicken (Gallus Gallus)
  misc_feature (36): n=a or g
tttaagaaatgttctcaactcaacaatttctgaccnagttacagaaaccttttcagtatagaaaccgtaag

SEQ ID NO: 27909 - DNA, 71 bp, chicken (Gallus Gallus)
  misc_feature (36): n=c or t
ctagccccaacctagaagttcaggtacatgataaangtgggagctctgacttccaccaaggcaaaaaaatt

SEQ ID NO: 27910 - DNA, 71 bp, chicken (Gallus Gallus)
  misc_feature (36): n=a or c
taaaatagacaactgaggttggaagtgcacagcagnaatatgcagggaggaaacgtacctaaaatctatgc

SEQ ID NO: 27911 - DNA, 71 bp, chicken (Gallus Gallus)
  misc_feature (36): n=g or t
cttgcttactaaccatgcagttgacaagatattttntagagatgcttaaaaaacattctaaatgcttaatt

SEQ ID NO: 27912 - DNA, 71 bp, chicken (Gallus Gallus)
  misc_feature (36): n=c or t
acgttctttctcagtatttccaatagaatatttgtnttccaagctgtaaaggtttcatattatcatgagtt

SEQ ID NO: 27913 - DNA, 71 bp, chicken (Gallus Gallus)
  misc_feature (36): n=c or t
gaaatcactgcatcttgccaaagtgagcaatgtctngtggaaaaaaaaaacgcaatagagagaaatgcagt

SEQ ID NO: 27914 - DNA, 71 bp, chicken (Gallus Gallus)
  misc_feature (36): n=a or g
gagcagtatggacattgaacttactgacagtggttnttgtggtatgcgttccccttttaaaaatagacgtg

SEQ ID NO: 27915 - DNA, 71 bp, chicken (Gallus Gallus)
  misc_feature (36): n=a or g
agtgctttgacaaccctactttacaagccacttgcncatagtctgacactcatcaatactcagtacattta

SEQ ID NO: 27916 - DNA, 71 bp, chicken (Gallus Gallus)
  misc_feature (36): n=a or t
caggctccagtgttgtcagaacaaattctgcaaacnagctttatgcaaataaacccaaatttagctggtct

SEQ ID NO: 27917 - DNA, 71 bp, chicken (Gallus Gallus)
  misc_feature (36): n=c or g
aaaaatttagcaaggaatttacagcttgacacaatnacatgtgcagtaataataataatataaatatcaaa

SEQ ID NO: 27918 - DNA, 71 bp, chicken (Gallus Gallus)
  misc_feature (36): n=a or g
agtaacgataaaaacattggcaaagcctacaagcangcttatgggactgtaactacctaaccttggaatgg

SEQ ID NO: 27919 - DNA, 71 bp, chicken (Gallus Gallus)
  misc_feature (36): n=c or t
gaacaacttcatctccaaaattagagctaagatgcnctaagaatcatgttttagtaccagaacagtaagtc

SEQ ID NO: 27920 - DNA, 71 bp, chicken (Gallus Gallus)
  misc_feature (36): n=g or t
ctgggatgacaaatgagcaaaagaactaacttgaangttctccttttggtgcactcccgcttagaaaagga

SEQ ID NO: 27921 - DNA, 71 bp, chicken (Gallus Gallus)
  misc_feature (36): n=c or t
tttaatgtctttgtcaagcagagatggctggtgaangttttcattggaataaaactacaaaagtcttaatt

SEQ ID NO: 27922 - DNA, 71 bp, chicken (Gallus Gallus)
  misc_feature (36): n=a or g
cttagactgtggaaattgatttggctccagggatantttgtcttgattgtttctgtgacaaaatttgtgga

SEQ ID NO: 27923 - DNA, 71 bp, chicken (Gallus Gallus)
  misc_feature (36): n=c or t
taaaaaagcctcactattaatatttcctccacctcntccatcttttctcaagcaatcattgctcattgaat

SEQ ID NO: 27924 - DNA, 71 bp, chicken (Gallus Gallus)
  misc_feature (36): n=c or t
ttatactggcagaactagaattgaaactgataaaantgaggtataaggagagacaagaagcaagtggggag

SEQ ID NO: 27925 - DNA, 71 bp, chicken (Gallus Gallus)
  misc_feature (36): n=c or t
agcccttgcaccattgctgccctgatgggagccagntggcattgctgaagccctgtgatgctgttttagtg

SEQ ID NO: 27926 - DNA, 71 bp, chicken (Gallus Gallus)
  misc_feature (36): n=a or g
atttattagaactacttttaaggccacccaggaacntcagataagaaatgctgttcagaatctgaggagaa

SEQ ID NO: 27927 - DNA, 71 bp, chicken (Gallus Gallus)
  misc_feature (36): n=c or t
ccaccaagtgttttttattggattttgatactttantgaatgatccattatctacagaatcataccttccc

SEQ ID NO: 27928 - DNA, 71 bp, chicken (Gallus Gallus)
  misc_feature (36): n=c or g
agaaaatggaccactatatacgggtttatatagtgngtaggaggtagggataccctgcctggaaagcattc

SEQ ID NO: 27929 - DNA, 71 bp, chicken (Gallus Gallus)
  misc_feature (36): n=c or t
tcaatgttgcagagcaagaaagaagccaagaattangctgaggtgagctgcacacccaggcaaagctgcag

SEQ ID NO: 27930 - DNA, 71 bp, chicken (Gallus Gallus)
  misc_feature (36): n=c or t
gaaccctggctctggcacatacaatagaagcacttngaaagacttgagacagctggaaaatatgtcaccta

SEQ ID NO: 27931 - DNA, 71 bp, chicken (Gallus Gallus)
  misc_feature (36): n=c or g
ctgtcactgtggcacaggcaacccgtggagcagganagatccagaactttcacctggtagcactcagctta

SEQ ID NO: 27932 - DNA, 71 bp, chicken (Gallus Gallus)
  misc_feature (36): n=g or t
ctgttgattgtatttagcttatgtggcaaggttttnataacaggtggtctggaggtggtctctgtgagatt

SEQ ID NO: 27933 - DNA, 71 bp, chicken (Gallus Gallus)
  misc_feature (36): n=c or t
gaggaggcagcatctcttgggataactagagtggcnaaaatgagatgggaggagttgcatgaaaatacagt

SEQ ID NO: 27934 - DNA, 71 bp, chicken (Gallus Gallus)
  misc_feature (36): n=a or g
gtctatcagacttctgtgctgctagaaaaatcttgnctgttctcttcttggaaaaggattgttctaattgc

SEQ ID NO: 27935 - DNA, 71 bp, chicken (Gallus Gallus)
  misc_feature (36): n=a or g
aagctccgtgccaaaataaatgttacttcaccatcnagcaggcagaagaatgaaaatctggatatgtgtga

SEQ ID NO: 27936 - DNA, 71 bp, chicken (Gallus Gallus)
  misc_feature (36): n=c or t
agcagcctctgagatccatagattaaaaatgctaanagtcattctgctgttgctgatgcagctcagaattt

SEQ ID NO: 27937 - DNA, 71 bp, chicken (Gallus Gallus)
  misc_feature (36): n=c or t
gcaagcatgtaagtcaggcattagaaatgtttctgncatcatggtctggctacccaataagagcaaaagac

SEQ ID NO: 27938 - DNA, 71 bp, chicken (Gallus Gallus)
  misc_feature (36): n=g or t
gcaaaagacctgtttgagccatgtaggaagtacccncctttcttcacctcaatctggaagttcttgtactg

SEQ ID NO: 27939 - DNA, 71 bp, chicken (Gallus Gallus)
  misc_feature (36): n=a or g
tcagcaacaagaaaactactaaatttgccaaaaacngatcccagtcctaaacacctcccagctgtttgtct

SEQ ID NO: 27940 - DNA, 71 bp, chicken (Gallus Gallus)
  misc_feature (36): n=c or t
ggacttaggggttctggttgactaaaagctcaacangagccagcagtgtgtgcttgctgttcagaaggcca

SEQ ID NO: 27941 - DNA, 71 bp, chicken (Gallus Gallus)
  misc_feature (36): n=c or g
gttcccaaatcttttgatccaggggtttggaaatantccttgctagggacttgatggcatccaactactac

SEQ ID NO: 27942 - DNA, 71 bp, chicken (Gallus Gallus)
  misc_feature (36): n=a or g
ctttgtgcattttgcagctatattgtatagtttatncaatacagaatacagaacttgacagttggaaacat

SEQ ID NO: 27943 - DNA, 71 bp, chicken (Gallus Gallus)
  misc_feature (36): n=a or g
tgctgatagagggcaagctaatgttgacgtgtaaancaaagccaggccacagtgagaggccagctccagca

SEQ ID NO: 27944 - DNA, 71 bp, chicken (Gallus Gallus)
  misc_feature (36): n=a or g
attaataaagaataaaactgcttcttctgtgttccngagagcatgagttcaggagaacaagaatgccagca

SEQ ID NO: 27945 - DNA, 71 bp, chicken (Gallus Gallus)
  misc_feature (36): n=c or t
gaaaaaaggagcatttcagtgattttctctacgggnttctcactctctctcttctataatatcttctgata

SEQ ID NO: 27946 - DNA, 71 bp, chicken (Gallus Gallus)
  misc_feature (36): n=c or t
gtgacaatgtggaatcagtgagtgcatatgaatacnaatgaaatgtatataaaatacgccttgagtattta

SEQ ID NO: 27947 - DNA, 71 bp, chicken (Gallus Gallus)
  misc_feature (36): n=c or t
tgttgacccacaacacaaaaattcatctcaagccanaatggagatttatcccacagtagcaatctgtatct

SEQ ID NO: 27948 - DNA, 71 bp, chicken (Gallus Gallus)
  misc_feature (36): n=a or g
atctcacattttcaaatctctctacaaacaatcagnagagtagagtgcccagcaggtagtagagggacttg

SEQ ID NO: 27949 - DNA, 71 bp, chicken (Gallus Gallus)
  misc_feature (36): n=a or g
tgagtaaggaatatctccctactccaaatctatgtntatatatatatatgttcttcctgttcgtacagtgt

SEQ ID NO: 27950 - DNA, 71 bp, chicken (Gallus Gallus)
  misc_feature (36): n=c or t
ataagtcttacgctggacaaaataaaataattatanggaagagaaaagatgttaaaataatgctccagttt

SEQ ID NO: 27951 - DNA, 71 bp, chicken (Gallus Gallus)
  misc_feature (36): n=a or g
agtgggaagatcttcctggggtgatcagacagtggnctatccaagtgataaaggctgcagggtaaggacaa

SEQ ID NO: 27952 - DNA, 71 bp, chicken (Gallus Gallus)
  misc_feature (36): n=a or g
agtgtagattgtccttgagatgtatctgatccttancaagccagttctagaaacaaacatggaaaaagtac

SEQ ID NO: 27953 - DNA, 71 bp, chicken (Gallus Gallus)
  misc_feature (36): n=g or t
gtgtggtagaagatgtcacattcacattgctcaacnctgagtattataggaggatcactataaaatctata

SEQ ID NO: 27954 - DNA, 71 bp, chicken (Gallus Gallus)
  misc_feature (36): n=c or t
ttgtgggcccatctatcaagcctgtccaggtccctntggatagcaacctttctctctagcgcgtcaactgc

SEQ ID NO: 27955 - DNA, 71 bp, chicken (Gallus Gallus)
  misc_feature (36): n=a or g
ctcaaagtcagtacaactacaggtgaggacagtacngcttgtttatttaaatgtataaattctgacacatc

SEQ ID NO: 27956 - DNA, 71 bp, chicken (Gallus Gallus)
  misc_feature (36): n=a or c
gtttgtatttgaaacttaagaattaaatacctgttncttccttttgctcctttgtttgtgttcataaggta

SEQ ID NO: 27957 - DNA, 71 bp, chicken (Gallus Gallus)
  misc_feature (36): n=a or g
tggtgagacaccgttgcacttccttgctttctttcntttctttgcatttacatgcacttctgggaaagcca

SEQ ID NO: 27958 - DNA, 71 bp, chicken (Gallus Gallus)
  misc_feature (36): n=a or g
acacaacatataaatctagcacatccagtgtcaatnttgcagaggcaatgctgagacgaaggcggaggttt

SEQ ID NO: 27959 - DNA, 71 bp, chicken (Gallus Gallus)
  misc_feature (36): n=g or t
ccgtgtgataaccaactttttttatacagttagacngtatatgttctcatgaggtatgaggtaaagctcat

SEQ ID NO: 27960 - DNA, 71 bp, chicken (Gallus Gallus)
  misc_feature (36): n=a or g
ggttctgatagtggttgaggactgaacataagcacntgacaaaacaacagcagttcagcttcaacgtacta

SEQ ID NO: 27961 - DNA, 71 bp, chicken (Gallus Gallus)
  misc_feature (36): n=c or t
cataaatcttctcccatattgtaactaaaattatanctgtaggtcatatatgagatcacaaaaacttttaa

SEQ ID NO: 27962 - DNA, 71 bp, chicken (Gallus Gallus)
  misc_feature (36): n=a or c
gtgtcattgccaccatattaccatcctccaaattantaacctgctttctcacaatttctctgaaaagatcc

SEQ ID NO: 27963 - DNA, 71 bp, chicken (Gallus Gallus)
  misc_feature (36): n=a or g
caaaagacaccagcccctgggcagagagaagcaccnaagtcaaacaaggagcgagcaaactcagtagtgga

SEQ ID NO: 27964 - DNA, 71 bp, chicken (Gallus Gallus)
  misc_feature (36): n=c or t
gtaaatattttaaaaactttgttgtataatgactcnggagctttcatataaaatgattctgctaatttctg

SEQ ID NO: 27965 - DNA, 71 bp, chicken (Gallus Gallus)
  misc_feature (36): n=a or g
ttgtaccttaaaaaaaaaaaaagaaaaaaaaaggantacacacccatattttactaaaggttgttcttaat

SEQ ID NO: 27966 - DNA, 71 bp, chicken (Gallus Gallus)
  misc_feature (36): n=c or t
tgagaacagagcattgattgaagtatattgtagtangtattacttctctatacagccagaaaatgcagact

SEQ ID NO: 27967 - DNA, 71 bp, chicken (Gallus Gallus)
  misc_feature (36): n=c or g
tcagacactccgccctagaagccagaatttattccntatagtggatgctaaagggctacaggcttttctga

SEQ ID NO: 27968 - DNA, 71 bp, chicken (Gallus Gallus)
  misc_feature (36): n=c or t
gagtaaaagtcctatcagagtgaataagcagtcttngttcttttagtttggtttgccagttgtggaacaag

SEQ ID NO: 27969 - DNA, 71 bp, chicken (Gallus Gallus)
  misc_feature (36): n=a or t
acacagtaaataatcttctcttatcataagcttgcnttttgttttgttttgtttctgtgttgttttggttt

SEQ ID NO: 27970 - DNA, 71 bp, chicken (Gallus Gallus)
  misc_feature (36): n=a or g
tccactgcttaaatggaagctataggtaagacaganccagatgcagatcagaggtacaatggaaaaagtca

SEQ ID NO: 27971 - DNA, 71 bp, chicken (Gallus Gallus)
  misc_feature (36): n=a or c
attgagataaattaaaacttttcaaattgtctaggncttatgaatgtcacccttgaatatgtaggtgacag

SEQ ID NO: 27972 - DNA, 71 bp, chicken (Gallus Gallus)
  misc_feature (36): n=a or g
accagttgtagatctctctgatgaaaacaactctcngccaaaatgcagctagtgagttgcataatgcacac

SEQ ID NO: 27973 - DNA, 71 bp, chicken (Gallus Gallus)
  misc_feature (36): n=g or t
tgtgttttccaagagacaatgcaacgttggctgttntgctcagcagcaacctacgctgggtttgccatgga

SEQ ID NO: 27974 - DNA, 71 bp, chicken (Gallus Gallus)
  misc_feature (36): n=c or t
catttcagtatagtgccttatcccttcaacccagtnctccactattctcaatatcagtggtctccttcaac

SEQ ID NO: 27975 - DNA, 71 bp, chicken (Gallus Gallus)
  misc_feature (36): n=c or g
cttatttccagcataaaaatcatccttaaggacaanttagaccaaatacttctcttccccatccagaattt

SEQ ID NO: 27976 - DNA, 71 bp, chicken (Gallus Gallus)
  misc_feature (36): n=c or t
gactacaggcaagcaaaacaacacagacttcagcanccccacctcagcattcttctttcttagaaatttaa

SEQ ID NO: 27977 - DNA, 71 bp, chicken (Gallus Gallus)
  misc_feature (36): n=c or t
tgtgcacgcttcacagctttaacagaacggctgccncgtgcttcagaatagctcttccatgtcagtttgca

SEQ ID NO: 27978 - DNA, 71 bp, chicken (Gallus Gallus)
  misc_feature (36): n=c or t
ctttcttgggatgccccagagatcatccctctcccngttaggtgtagggcaacatgaaagggactcgatat

SEQ ID NO: 27979 - DNA, 71 bp, chicken (Gallus Gallus)
  misc_feature (36): n=a or g
gagatctgagcccagttcccaactggactaggagcngccaatcatcctggaaatcccaacctgatcctccc

SEQ ID NO: 27980 - DNA, 71 bp, chicken (Gallus Gallus)
  misc_feature (36): n=g or t
aacagagttatagagatactgctgaaatactaaaanctgggatattgctgctgaccacagagagcaaatta

SEQ ID NO: 27981 - DNA, 71 bp, chicken (Gallus Gallus)
  misc_feature (36): n=c or t
ccatgtgatttcagtgaaatgactctgactttacanaagtgtgccaaggagaatttgaccctaactcccaa

SEQ ID NO: 27982 - DNA, 71 bp, chicken (Gallus Gallus)
  misc_feature (36): n=c or t
agactggagtaaataccatgaggagaaaagcagcanaggctgcaaacaggcaaaccctcacattaaatgca

SEQ ID NO: 27983 - DNA, 71 bp, chicken (Gallus Gallus)
  misc_feature (36): n=c or g
atgttaaacacagcagcttttgtccctctctctatncctcctttcttttgatgctccataatgagaccaaa

SEQ ID NO: 27984 - DNA, 71 bp, chicken (Gallus Gallus)
  misc_feature (36): n=a or c
taacatcttaactacgatggatgctaatggaaatantgtaagcagattttgatctgtgcttattgtcagaa

SEQ ID NO: 27985 - DNA, 71 bp, chicken (Gallus Gallus)
  misc_feature (36): n=g or t
gagtgtaaagacaagaataaactatttttgtgaaanatcttaaacacctgtgggaggctgcagatgcctgc

SEQ ID NO: 27986 - DNA, 71 bp, chicken (Gallus Gallus)
  misc_feature (36): n=c or t
accagactcagttggaggagatgtgaactaatggtntcctcaagcaatacgttcaccaaacaagttcaccc

SEQ ID NO: 27987 - DNA, 71 bp, chicken (Gallus Gallus)
  misc_feature (36): n=a or g
agagctgtaaagaagctgtagtaattttacaattcnttgtttccttcaatagaccaggtgaagaaacttca

SEQ ID NO: 27988 - DNA, 71 bp, chicken (Gallus Gallus)
  misc_feature (36): n=a or g
gctattgaattaatcaaatttaatcaacctatctcnacttgagaagaaaatctgtaatgcattttgagatg

SEQ ID NO: 27989 - DNA, 71 bp, chicken (Gallus Gallus)
  misc_feature (36): n=c or t
tgccatcagctttgtgtggacagaaatagttatcangtccacatttgctaatatcactgatcaaagttgtc

SEQ ID NO: 27990 - DNA, 71 bp, chicken (Gallus Gallus)
  misc_feature (36): n=c or t
caggatgtgtaagctgggatcctgtaacccttttcnctctgctgtcctcacaacagctggtaggaaagcgc

SEQ ID NO: 27991 - DNA, 71 bp, chicken (Gallus Gallus)
  misc_feature (36): n=a or g
gaagggaggaagcaggcaggcctgtctgagcctgcntgaacccaagcagcatgggaatatacccagccctg

SEQ ID NO: 27992 - DNA, 71 bp, chicken (Gallus Gallus)
  misc_feature (36): n=c or g
taaaaattttaaaacaaaatcacatctatataggantctaaaagtgctttgcagtgtgagatatccaaaga

SEQ ID NO: 27993 - DNA, 71 bp, chicken (Gallus Gallus)
  misc_feature (36): n=a or g
tgccacacgtcaatctggcacgaaacccccgggagnttcatcagcaccctcagtctgacacggcatccgat

SEQ ID NO: 27994 - DNA, 71 bp, chicken (Gallus Gallus)
  misc_feature (36): n=c or t
caccaggaagagagaaatcaggatttaacactgagngtgtcagcatgataggctgcaagttacagcagcct

SEQ ID NO: 27995 - DNA, 71 bp, chicken (Gallus Gallus)
  misc_feature (36): n=c or t
ctgcattccgacagacccacgcctacaggtcatagngaagcagtgttggctaagctgcccaaaggtatcag

SEQ ID NO: 27996 - DNA, 71 bp, chicken (Gallus Gallus)
  misc_feature (36): n=g or t
tttgtaaataaatattttccaatttgaaaatgccanttcaacagtgggaactggtatcaagttgtgtgttt

SEQ ID NO: 27997 - DNA, 71 bp, chicken (Gallus Gallus)
  misc_feature (36): n=c or t
gggatacgtatcaagtacagcgccttcccgaggacnttgcgcttattctctatggtggcagttagctcctg

SEQ ID NO: 27998 - DNA, 71 bp, chicken (Gallus Gallus)
  misc_feature (36): n=c or t
taaaacaaatgcatttgctgtatttatatcagtacngttttctcagtggcttcactaggaggcaagtaaac

SEQ ID NO: 27999 - DNA, 71 bp, chicken (Gallus Gallus)
  misc_feature (36): n=c or t
ctttgttttgtaactgttttcatcatcctttacagnagtgtcttttgtgaggtgtattgtgtcagtttctg

SEQ ID NO: 28000 - DNA, 71 bp, chicken (Gallus Gallus)
  misc_feature (36): n=a or g
agacccttccctattttcatagccctcctttggacnctcccttatagtttattgtccttcttgcatgacaa

SEQ ID NO: 28001 - DNA, 71 bp, chicken (Gallus Gallus)
  misc_feature (36): n=c or t
ttaagtggttcaggggagagacaatcgcctgtgtgntaggataatagacagctccatgtatttgcattctg

SEQ ID NO: 28002 - DNA, 71 bp, chicken (Gallus Gallus)
  misc_feature (36): n=a or c
aaggttgagattgctccattttacttttatgtcaangtaacaccacaattcctaaagcacttcactcaagg

SEQ ID NO: 28003 - DNA, 71 bp, chicken (Gallus Gallus)
  misc_feature (36): n=a or g
caaactgcaagggaaagatcacatgataatacacancgcgtttgttcagaaatttggctggaaaagaaact

SEQ ID NO: 28004 - DNA, 71 bp, chicken (Gallus Gallus)
  misc_feature (36): n=c or t
aagagaactctagttaacttgtgtggctgaagctangctttctttctagaactttgcagaggtgaagggca

SEQ ID NO: 28005 - DNA, 71 bp, chicken (Gallus Gallus)
  misc_feature (36): n=a or g
tgtcttcccaaggaaggagcatagctcgtgacctcngtgagagcatatgaggaaggagcccgctatgtttg

SEQ ID NO: 28006 - DNA, 71 bp, chicken (Gallus Gallus)
  misc_feature (36): n=c or g
ttttcaaaaatccgaatactagagtgttaatagtanatcctactttttcataattaaaatattcaatctca

SEQ ID NO: 28007 - DNA, 71 bp, chicken (Gallus Gallus)
  misc_feature (36): n=a or g
ctctaagcagaagcatacatttgcagtttgtagacnatccaaaacatggattatcaatgaaccacatctga

SEQ ID NO: 28008 - DNA, 71 bp, chicken (Gallus Gallus)
  misc_feature (36): n=g or t
gtcttaagcctgatctaagaagtctaccaagcactngcactggcactgaggaaaatcactggtggttggaa

SEQ ID NO: 28009 - DNA, 71 bp, chicken (Gallus Gallus)
  misc_feature (36): n=c or g
cctgagagtcttcaggcacagcaggacagggataanttgaggttaggaaagacttcagtcaggaccagaag

SEQ ID NO: 28010 - DNA, 71 bp, chicken (Gallus Gallus)
  misc_feature (36): n=a or c
catagaatcacagaatcgtttgagttggaagggacntttagagatcatctagtctgtctctcctgaatcat

SEQ ID NO: 28011 - DNA, 71 bp, chicken (Gallus Gallus)
  misc_feature (36): n=a or g
tcctgaatgccaccatttctctttctcgcgctacanatttgtattgttaacaggacttcattaacctctgt

SEQ ID NO: 28012 - DNA, 71 bp, chicken (Gallus Gallus)
  misc_feature (36): n=c or g
taagcatgattttcagcttgtctgccactgtgaagncttttgctgacacagaactgtgtaggtgcaaacat

SEQ ID NO: 28013 - DNA, 71 bp, chicken (Gallus Gallus)
  misc_feature (36): n=a or g
tagtttcagaaattttaattgaacttatttcttcantcttgtgagatcatggaactgtatatctttctctt

SEQ ID NO: 28014 - DNA, 71 bp, chicken (Gallus Gallus)
  misc_feature (36): n=a or g
gtttgaggtgaaagataaaacaaggaaacagtggtncaaaatcaattttagtttactgccttcattgaagt

SEQ ID NO: 28015 - DNA, 71 bp, chicken (Gallus Gallus)
  misc_feature (36): n=c or t
gcttgcttccaaattaaacacgcagatcattgtagntacatggaggcttgtaggaaggaaggacagacata

SEQ ID NO: 28016 - DNA, 71 bp, chicken (Gallus Gallus)
  misc_feature (36): n=c or t
aatgcatgccaagcattgctttctatatgactatcncttagcttcatttcagttttatgaatcttgtatac

SEQ ID NO: 28017 - DNA, 71 bp, chicken (Gallus Gallus)
  misc_feature (36): n=g or t
tacttcacttggtttattgtatcagacctaggttanctggcactctctctgcccttatctgagcagtgctt

SEQ ID NO: 28018 - DNA, 71 bp, chicken (Gallus Gallus)
  misc_feature (36): n=c or t
tgtttggtcaagtttttggatagcctccatttcagngcaggacttgaaggaactacaacgaagggctgagc

SEQ ID NO: 28019 - DNA, 71 bp, chicken (Gallus Gallus)
  misc_feature (36): n=c or g
gacacatctggggtaggagaattcctattcataatncttggtaccagcaatgctgagaacaggtcctgctg

SEQ ID NO: 28020 - DNA, 71 bp, chicken (Gallus Gallus)
  misc_feature (36): n=a or c
ttcaagtgctgtagcttcagttcatgaaagctgcgngtgggctctgctgccaatatgcacttttctctctt

SEQ ID NO: 28021 - DNA, 71 bp, chicken (Gallus Gallus)
  misc_feature (36): n=a or g
gatgttacactgagacacttaatgacatgagaaacntgctctgtgatccatttgttgtgaatgcatgcttg

SEQ ID NO: 28022 - DNA, 71 bp, chicken (Gallus Gallus)
  misc_feature (36): n=c or t
ctagagccacttcaaaaagtttcaagctttcaaggntggagttgctagagcaaagcttggattaatgcctt

SEQ ID NO: 28023 - DNA, 71 bp, chicken (Gallus Gallus)
  misc_feature (36): n=c or t
tgtgacatggaaggatatatgaagcaaaacagcgtnactgaattcctccacgaagaaaatattgtacccat

SEQ ID NO: 28024 - DNA, 71 bp, chicken (Gallus Gallus)
  misc_feature (36): n=c or t
gtaggggggtattctcatgtcccacatggtttgttngtagtggttggagggagtaaagctgactgaggagg

SEQ ID NO: 28025 - DNA, 71 bp, chicken (Gallus Gallus)
  misc_feature (36): n=a or c
tatcttcataaaaaccacccttaatacaaaccatanagggatttaaaaaagccagcatattctgcactgca

SEQ ID NO: 28026 - DNA, 71 bp, chicken (Gallus Gallus)
  misc_feature (36): n=g or t
tacaacatgggaaacacaaatgagaggcagcacatncattttgagcatgtgtggaaggaggcagaaggaac

SEQ ID NO: 28027 - DNA, 71 bp, chicken (Gallus Gallus)
  misc_feature (36): n=c or t
aaaagtctatcatttaggatcgcaacctgaagaacnttcagaattctattctcacagtgatagaaataact

SEQ ID NO: 28028 - DNA, 71 bp, chicken (Gallus Gallus)
  misc_feature (36): n=a or g
aaactgcacatttaataattttttagatgcttcatnactgctgaaccccaagcattctccactctcactgg

SEQ ID NO: 28029 - DNA, 71 bp, chicken (Gallus Gallus)
  misc_feature (36): n=a or g
attaccgtaaagtcggtttctcaccttttgatgaantgcaacaccaggcccaccagcaagagcgcgagcag

SEQ ID NO: 28030 - DNA, 71 bp, chicken (Gallus Gallus)
  misc_feature (36): n=a or g
acaaggggtgagggacataaactgggacacaggaanctccctgcagatatgaggagtaacttctttaatgt

SEQ ID NO: 28031 - DNA, 71 bp, chicken (Gallus Gallus)
  misc_feature (36): n=a or c
gcctgattacaatgggaaaaattcaagactacttancgaacctatttttagtcccataataactgccaaaa

SEQ ID NO: 28032 - DNA, 71 bp, chicken (Gallus Gallus)
  misc_feature (36): n=c or t
taacatttatctgtcacctgtgggagtgtaaatccnatggtgaccatcccatgtgttccctgttcctgctg

SEQ ID NO: 28033 - DNA, 71 bp, chicken (Gallus Gallus)
  misc_feature (36): n=c or t
aaccttagctctaatagcctatccaaggaattacangtaagtgctcagtttaagtgcatatgtgacctaat

SEQ ID NO: 28034 - DNA, 71 bp, chicken (Gallus Gallus)
  misc_feature (36): n=a or g
tgcttgatctataaaaagctggcacagggacatggnagatatgggatggggttgaaggcagggggttggca

SEQ ID NO: 28035 - DNA, 71 bp, chicken (Gallus Gallus)
  misc_feature (36): n=a or t
ctaagaaacctccctctcattctgcagacaacagangctgtcagttatagaactatcctatttttttttac

SEQ ID NO: 28036 - DNA, 71 bp, chicken (Gallus Gallus)
  misc_feature (36): n=c or t
aactatggatgcataacttggggagcctggtttctnagtgtacagagaatcttttattgttgtgcgtagtt

SEQ ID NO: 28037 - DNA, 71 bp, chicken (Gallus Gallus)
  misc_feature (36): n=g or t
ggtttttcacctgctcacaagaatggcagcaagganaaacaagatctgcagattgtggctaataccatgaa

SEQ ID NO: 28038 - DNA, 71 bp, chicken (Gallus Gallus)
  misc_feature (36): n=a or g
tgctggatcagtctacagctgccgaggggctcctgnggtgctttgtcagataagcttgcatccacctgaga

SEQ ID NO: 28039 - DNA, 71 bp, chicken (Gallus Gallus)
  misc_feature (36): n=c or t
ttgctcccacagtgaacaattcctattgcaagtgcntcgagaacttcagcattcagagattagcggaaaat

SEQ ID NO: 28040 - DNA, 71 bp, chicken (Gallus Gallus)
  misc_feature (36): n=c or t
ccactgaacagctttctagttactacagatagaaantggagtccagaagtaaataggcatcccaccagacc

SEQ ID NO: 28041 - DNA, 71 bp, chicken (Gallus Gallus)
  misc_feature (36): n=a or g
gcttgtttgttttttgctgttgacttagtagaaccnggattcatccctgaattttagtaagaggactgaaa

SEQ ID NO: 28042 - DNA, 71 bp, chicken (Gallus Gallus)
  misc_feature (36): n=c or t
tatatttgttaggacaccaacatgcatggatgccantgcaataggaattaacattcaaataattgcaaata

SEQ ID NO: 28043 - DNA, 71 bp, chicken (Gallus Gallus)
  misc_feature (36): n=c or t
agcggctaaaagctgatacataccacacaggaaagnttgaagcaggcaagacagcaatggtcaatataatc

SEQ ID NO: 28044 - DNA, 71 bp, chicken (Gallus Gallus)
  misc_feature (36): n=a or g
ttctctgtgttcatggtcaaaaggaaaagaagaacncacaagcatatagcaaccactttcaactgcattaa

SEQ ID NO: 28045 - DNA, 71 bp, chicken (Gallus Gallus)
  misc_feature (36): n=c or t
taaaaacccagatattcagttacaatgaatgatgancaattttgtggccaccaagtaaaataccacttcct

SEQ ID NO: 28046 - DNA, 71 bp, chicken (Gallus Gallus)
  misc_feature (36): n=c or t
gagtaatgaatattgccacaaaacaacaattccctntgcttttttttgcatcttctctgcaaattttctct

SEQ ID NO: 28047 - DNA, 71 bp, chicken (Gallus Gallus)
  misc_feature (36): n=c or t
ttgtgcttagtagcaaaggggaactagtattgtttngttatgtttgcttgcgagcttaactaagaagggga

SEQ ID NO: 28048 - DNA, 71 bp, chicken (Gallus Gallus)
  misc_feature (36): n=c or t
cagcattgtgtcttttcctttcagagccataagttnaaatcgtatcagaaaactcaaagagcaaataaata

SEQ ID NO: 28049 - DNA, 71 bp, chicken (Gallus Gallus)
  misc_feature (36): n=c or t
cttctcctcaaatagaaggcacttagaattagcacncttgtgttagattggtgaatatggctttattacta

SEQ ID NO: 28050 - DNA, 71 bp, chicken (Gallus Gallus)
  misc_feature (36): n=a or g
ccctttaaacacctcacataataggagttaagtttngagatgtctttgaactaaaacacgtgagaggcata

SEQ ID NO: 28051 - DNA, 71 bp, chicken (Gallus Gallus)
  misc_feature (36): n=a or g
ctgagctccaactgagggcaggttgccaaggggtcntgcaacaatgtgtctcacagcaaaacaatggacta

SEQ ID NO: 28052 - DNA, 71 bp, chicken (Gallus Gallus)
  misc_feature (36): n=c or t
gctatcctcttactgaatttgcagatttgtccttgnattttgaaagaaagtctttacattttcatagtaca

SEQ ID NO: 28053 - DNA, 71 bp, chicken (Gallus Gallus)
  misc_feature (36): n=a or g
agctgagagaaagtaaagaaagagttggctgttacntgacttctccctatgttaaatactgctgttctaaa

SEQ ID NO: 28054 - DNA, 71 bp, chicken (Gallus Gallus)
  misc_feature (36): n=a or c
caggtacaaagctttcaacacttgggaaacttcaantagcacaaaatgttacagaaaacctcttcagtgat

SEQ ID NO: 28055 - DNA, 71 bp, chicken (Gallus Gallus)
  misc_feature (36): n=c or t
gatgatccatacattttatgtgcctttaatatagangtaggtgaagaattctcataacatgttatcctcaa

SEQ ID NO: 28056 - DNA, 71 bp, chicken (Gallus Gallus)
  misc_feature (36): n=a or g
ttctttgattctctgaaatgaaagtctctgagacanggaaaagggcaggatttgcagcctttcctggtata

SEQ ID NO: 28057 - DNA, 71 bp, chicken (Gallus Gallus)
  misc_feature (36): n=c or t
tacctacacagggggaatcttcttgccagatttacncttgcaaatgacaagagactgtcccaagatttcca

SEQ ID NO: 28058 - DNA, 71 bp, chicken (Gallus Gallus)
  misc_feature (36): n=a or g
aggaggaggggccgctctctttacttttgctaaatnaacttctccatgaagctataagcccgctaaaataa

SEQ ID NO: 28059 - DNA, 71 bp, chicken (Gallus Gallus)
  misc_feature (36): n=c or t
ttacatttgagtggatctgaaaagaggagtggtgcnatgtggggcaaagcagaggttttctttttgtgggc

SEQ ID NO: 28060 - DNA, 71 bp, chicken (Gallus Gallus)
  misc_feature (36): n=c or t
catttacataacaaggaatgtgagggtacataaaanataacacattctgagactgtaagacattaagagag

SEQ ID NO: 28061 - DNA, 71 bp, chicken (Gallus Gallus)
  misc_feature (36): n=a or g
tgcagaggggcagcacagagtctaatgtgtgatgtncctggtctgctcgcgtcactttggggcagtcacag

SEQ ID NO: 28062 - DNA, 71 bp, chicken (Gallus Gallus)
  misc_feature (36): n=a or g
tcttgaatggttgtgttggtaaatacctgctgcacngcagccttctgatgcctgagaattatcctgtttgt

SEQ ID NO: 28063 - DNA, 71 bp, chicken (Gallus Gallus)
  misc_feature (36): n=c or t
tctctcactctggagttcagaattagggctgcaacntggggcagtactcggactgctctggtggtactggt

SEQ ID NO: 28064 - DNA, 71 bp, chicken (Gallus Gallus)
  misc_feature (36): n=a or g
gtatcaattctattacaaagtgacacaaaggacacntttcctaatccttttcagaatgctatgctagacac

SEQ ID NO: 28065 - DNA, 71 bp, chicken (Gallus Gallus)
  misc_feature (36): n=c or t
tgacatgctggggcaccttggcatgccctgcatctntgtgcagtgggaagcctctgtatcacattaggaaa

SEQ ID NO: 28066 - DNA, 71 bp, chicken (Gallus Gallus)
  misc_feature (36): n=c or t
aataagtgatttgggtggttctgagaacataagaangatggaagaaggagcaagaggcgagataagccaca

SEQ ID NO: 28067 - DNA, 71 bp, chicken (Gallus Gallus)
  misc_feature (36): n=c or t
tcagagaaacttctttacctcaaaagagagtttagntaaatgtgttatagcagctgcagaagaaaacgtta

SEQ ID NO: 28068 - DNA, 71 bp, chicken (Gallus Gallus)
  misc_feature (36): n=a or t
tagcataaacaaatcgaaatacatctgtgcatgcgnctcctgagcagttgcttcttagaaggtcaagctca

SEQ ID NO: 28069 - DNA, 71 bp, chicken (Gallus Gallus)
  misc_feature (36): n=a or g
aggccctgaaaatacctttcagggaatataacgccngagcacactactcacagtgtcacgcatttaaatag

SEQ ID NO: 28070 - DNA, 71 bp, chicken (Gallus Gallus)
  misc_feature (36): n=c or t
ctagctatctttgttattggaagcagtgtcaaaaangtagttactgaacatgaaggaagaaggcacacagc

SEQ ID NO: 28071 - DNA, 71 bp, chicken (Gallus Gallus)
  misc_feature (36): n=c or t
gtacgtcatactatcacgtaactgtgcaagtgctgnaccaagtgacctcctcatcttctgattcttctgca

SEQ ID NO: 28072 - DNA, 71 bp, chicken (Gallus Gallus)
  misc_feature (36): n=c or t
ctcctgcttcatcctgccaacctttcagtcatttcnatgaaacagaaatttgatctctacaacctacccat

SEQ ID NO: 28073 - DNA, 71 bp, chicken (Gallus Gallus)
  misc_feature (36): n=c or t
agcacgaagaataaaagaagcaaccctcagtaacanagtccatcctacaaatgctccagaaaatcactgcc

SEQ ID NO: 28074 - DNA, 71 bp, chicken (Gallus Gallus)
  misc_feature (36): n=c or g
caggtcttcagcactgattgggataaggatgcggancaatggaagaagacatgggacagataggagtgatt

SEQ ID NO: 28075 - DNA, 71 bp, chicken (Gallus Gallus)
  misc_feature (36): n=g or t
ggcccacaacatccacacctgacttagtgcaccaanctgcctgcaggaatttaatgaagtcaaaaaggatc

SEQ ID NO: 28076 - DNA, 71 bp, chicken (Gallus Gallus)
  misc_feature (36): n=c or t
tttataagaaaaacactcacgattaacctttgccangtgcagattttcttattttcactgtctcaaattaa

SEQ ID NO: 28077 - DNA, 71 bp, chicken (Gallus Gallus)
  misc_feature (36): n=a or t
acctacagtgatgtaaacctctacaaaagtataccnttttttttttttttttttttgtcatgaagaaaaca

SEQ ID NO: 28078 - DNA, 71 bp, chicken (Gallus Gallus)
  misc_feature (36): n=a or t
gactcgacacctgaaagtaaataattttcctttgtnagtgaagtatcccctatttgctgtattacttcagc

SEQ ID NO: 28079 - DNA, 71 bp, chicken (Gallus Gallus)
  misc_feature (36): n=a or g
ctactcaaactttatgaacaagtcttcaaaataatntaccagtgctaactggtaggagcttactacgaagg

SEQ ID NO: 28080 - DNA, 71 bp, chicken (Gallus Gallus)
  misc_feature (36): n=a or g
gacacagtactctaggtggcatctcacaagagcagngtagaggggtagagtcacttccctcgacctgttgg

SEQ ID NO: 28081 - DNA, 71 bp, chicken (Gallus Gallus)
  misc_feature (36): n=c or t
ataaacctttctttgtcttatggatattttttctcnctgaaataaaagtgggatagtgtgacattgctgtt

SEQ ID NO: 28082 - DNA, 71 bp, chicken (Gallus Gallus)
  misc_feature (36): n=a or t
aattactccatcttcatgaactgaagtgtaatgaancaagatgaaaaaagagagctcaggttttttatttt

SEQ ID NO: 28083 - DNA, 71 bp, chicken (Gallus Gallus)
  misc_feature (36): n=c or t
tgtaaggaaagagaataaaagctggctgtgcaattngttctgaagccagcattctatcccctttgtgctgt

SEQ ID NO: 28084 - DNA, 71 bp, chicken (Gallus Gallus)
  misc_feature (36): n=a or c
gacactgaggctgcctccagccatccctcttgaganatcttctcagttttccctggcttcagcttgtgcct

SEQ ID NO: 28085 - DNA, 71 bp, chicken (Gallus Gallus)
  misc_feature (36): n=a or g
acaggacacagaagagacaagcagggtccacagaanaggccagataccgatggagaacacgggctgcccag

SEQ ID NO: 28086 - DNA, 71 bp, chicken (Gallus Gallus)
  misc_feature (36): n=a or t
cctggattacagaaaacagatgacaacacaaaaaanatttagagtacctatactttaccttatacaaagaa

SEQ ID NO: 28087 - DNA, 71 bp, chicken (Gallus Gallus)
  misc_feature (36): n=c or g
gttccctcaggttctatcactgattagcagagaaangaggtgacaccactgcatatactgcatgtagctag

SEQ ID NO: 28088 - DNA, 71 bp, chicken (Gallus Gallus)
  misc_feature (36): n=a or c
aggaaaatctgtcaattcttgtagtgaataatgcanatacaatagttaagaaaagaatttcttaaaagaac

SEQ ID NO: 28089 - DNA, 71 bp, chicken (Gallus Gallus)
  misc_feature (36): n=a or g
gggcataggcagtactttgcagcactgtgtaccacnctccaagaagacacaggggatggtgaacacacact

SEQ ID NO: 28090 - DNA, 71 bp, chicken (Gallus Gallus)
  misc_feature (36): n=a or g
ccatgtgagtcataggaacatggagcatcccaaacnggaagggatggacagggatcacagagtccaaccct

SEQ ID NO: 28091 - DNA, 71 bp, chicken (Gallus Gallus)
  misc_feature (36): n=a or g
ctagtgcagctttcacacatgtttcttcaggctaangactgtaccagcatggctgcaccgcagccagaatc

SEQ ID NO: 28092 - DNA, 71 bp, chicken (Gallus Gallus)
  misc_feature (36): n=c or t
tagggaatgctactccccaacacttacagaactgcnatctcacctctttgtgggctgtctctctgtacaaa

SEQ ID NO: 28093 - DNA, 71 bp, chicken (Gallus Gallus)
  misc_feature (36): n=g or t
ttccaaaaaaaagatttccaaaaaattgatgccaanggcaccaatgcatatccgggagtagaaaagctaaa

SEQ ID NO: 28094 - DNA, 71 bp, chicken (Gallus Gallus)
  misc_feature (36): n=c or t
ttgctttagagatgtccgttcccaccgttctccttnatgctgggtaggaatgtttaagcccttcaaaggta

SEQ ID NO: 28095 - DNA, 71 bp, chicken (Gallus Gallus)
  misc_feature (36): n=a or g
agctctgaattttgagctgatggctgtgctttaaantacccccattcggatgtgttttaggtattccccct

SEQ ID NO: 28096 - DNA, 71 bp, chicken (Gallus Gallus)
  misc_feature (36): n=a or g
agttcactcaagtttccagaggagctacattaacangaatcaaatgcaaaagcttcttgttctcctgttcc

SEQ ID NO: 28097 - DNA, 71 bp, chicken (Gallus Gallus)
  misc_feature (36): n=a or g
ctcatcctgtaacaagagcaagggaagaaatgaagntttatgttaacgccagttgaaagtctttcccaaaa

SEQ ID NO: 28098 - DNA, 71 bp, chicken (Gallus Gallus)
  misc_feature (36): n=c or t
ttgcctgagctgtgctgtgggtgtatttgtaaactngtcttttaggtcattttggcccttctccaaatgta

SEQ ID NO: 28099 - DNA, 71 bp, chicken (Gallus Gallus)
  misc_feature (36): n=a or g
tgtttgaaattactacatcaatgcatttgtgattanaatttttttatctgtgtcttgcctgtgactgttac

SEQ ID NO: 28100 - DNA, 71 bp, chicken (Gallus Gallus)
  misc_feature (36): n=c or t
agttggcagaatgaattctggttattttagagcacngaccattagaggaaataaataaataacaaattatt

SEQ ID NO: 28101 - DNA, 71 bp, chicken (Gallus Gallus)
  misc_feature (36): n=c or g
tgggacgtggtaatgtctgacataaaagatctgttngagtagacagggcttcactgctctctttcaagctg

SEQ ID NO: 28102 - DNA, 71 bp, chicken (Gallus Gallus)
  misc_feature (36): n=c or t
aactgtcaacagagaaactgtgtcactgtaaagcantgactcagggccctgaaaattcccgtcttggaagg

SEQ ID NO: 28103 - DNA, 71 bp, chicken (Gallus Gallus)
  misc_feature (36): n=c or t
agaaaaataaaagcaacacagtgggctctccatgangtatttgacttaattaaacataaatcagctcaagc

SEQ ID NO: 28104 - DNA, 71 bp, chicken (Gallus Gallus)
  misc_feature (36): n=c or t
tttacatcacatgaatctgcacagggatgggtcagncagtgtcttactgaatgggaaaatgaaaggttctc

SEQ ID NO: 28105 - DNA, 71 bp, chicken (Gallus Gallus)
  misc_feature (36): n=a or t
ggatctctgcggctgaagagtctgaaaaaagaattntttaaagataaattagataaatattagataaagat

SEQ ID NO: 28106 - DNA, 71 bp, chicken (Gallus Gallus)
  misc_feature (36): n=c or t
agctcccaagcaaacaccgaacacttgaaaaatgangcacaattttcacagtgaaactgtatttttcacat

SEQ ID NO: 28107 - DNA, 71 bp, chicken (Gallus Gallus)
  misc_feature (36): n=c or g
tgggagacaacacatcatgggcattctaaacttctnacttatgcatagtgcttcagtggctttgccttagt

SEQ ID NO: 28108 - DNA, 71 bp, chicken (Gallus Gallus)
  misc_feature (36): n=c or t
ccttttgctcgcatatttgctgacaaattaatttcnttatgtgtaatttttaaggactgaagatattttta

SEQ ID NO: 28109 - DNA, 71 bp, chicken (Gallus Gallus)
  misc_feature (36): n=c or t
ttcatgaaggaaggttggtgtctgcactctcattgntcccaatcccctctgacatgattgtttttaatgta

SEQ ID NO: 28110 - DNA, 71 bp, chicken (Gallus Gallus)
  misc_feature (36): n=c or t
ctgatataactactgaactaacagatgcttgcaaangaaacagaccaaaatattctgtttatcaaggagat

SEQ ID NO: 28111 - DNA, 71 bp, chicken (Gallus Gallus)
  misc_feature (36): n=c or t
ttctggggagaccccaagttggagtagagcagctgnatctgctgtgtttgtccttgtggtgccttcagtct

SEQ ID NO: 28112 - DNA, 71 bp, chicken (Gallus Gallus)
  misc_feature (36): n=c or g
gcaagatgacacaaaccgaagcaatcttcccagctngctgcttgcggaatgctgaaagtggttcagtgtac

SEQ ID NO: 28113 - DNA, 71 bp, chicken (Gallus Gallus)
  misc_feature (36): n=c or t
gttgggcgagatggcactggggtgccttccctcggnctctgcagttctggcatgctttgattccatagtat

SEQ ID NO: 28114 - DNA, 71 bp, chicken (Gallus Gallus)
  misc_feature (36): n=a or g
aactgcattcctctgtgcctcagaggaagagcagancacacaaaaatttctgagatgttttctttcctgaa

SEQ ID NO: 28115 - DNA, 71 bp, chicken (Gallus Gallus)
  misc_feature (36): n=a or g
agtggttaatgcacagtcatttgatgtcctgtgagnaaaggcatgatacattataattttgaattacaatc

SEQ ID NO: 28116 - DNA, 71 bp, chicken (Gallus Gallus)
  misc_feature (36): n=c or t
atattaggcaatgtataatactcgtctgaatttttncccccccctttttttttttttttctaattgctaat

SEQ ID NO: 28117 - DNA, 71 bp, chicken (Gallus Gallus)
  misc_feature (36): n=a or g
ttgaaaattaaggtactgaattcccctcgatttcantgggagttagggattacttttgaaaaccataccac

SEQ ID NO: 28118 - DNA, 71 bp, chicken (Gallus Gallus)
  misc_feature (36): n=c or t
atgttctcagtttgcccagcagttaaatatcataanactgattacacattattatacacatatgggatttg

SEQ ID NO: 28119 - DNA, 71 bp, chicken (Gallus Gallus)
  misc_feature (36): n=g or t
ggtagaagttgccagaccaagcaaacatgttgtatnttgctcatctttctttgaaactgcttcattatcac

SEQ ID NO: 28120 - DNA, 71 bp, chicken (Gallus Gallus)
  misc_feature (36): n=a or g
tatgctcttatactattttatttgtccattatatgngtacatcacatggaataatcactcaaaaaggtcac

SEQ ID NO: 28121 - DNA, 71 bp, chicken (Gallus Gallus)
  misc_feature (36): n=c or t
gtaaaaacacagttggaaactactgatgtctgtacngagtctgtcttctgcccctgtgtttgccccagctt

SEQ ID NO: 28122 - DNA, 71 bp, chicken (Gallus Gallus)
  misc_feature (36): n=a or g
tgcctataacatgctacagaatctcaggcagcactngagacagcaagtttcttcagatgatccataaatac

SEQ ID NO: 28123 - DNA, 71 bp, chicken (Gallus Gallus)
  misc_feature (36): n=a or t
caagctcacctgcatgagtgattaataaaaaaaaanatcctccaatttttcattattcttaaggcttttct

SEQ ID NO: 28124 - DNA, 71 bp, chicken (Gallus Gallus)
  misc_feature (36): n=a or g
cagcaatatatacaatacagtcagcaatacactgantgaaatgtgaaagcaaactgttctctctttccaca

SEQ ID NO: 28125 - DNA, 71 bp, chicken (Gallus Gallus)
  misc_feature (36): n=a or g
tgaagactgtaggttagatatctacacaagagatgnacccttgaagtatcccttgtggtcaaagtaaagaa

SEQ ID NO: 28126 - DNA, 71 bp, chicken (Gallus Gallus)
  misc_feature (36): n=c or g
agtgtcttcattctaccagcacccagctgttgacanctttagatgctcctctgggaaactgcccacttttt

SEQ ID NO: 28127 - DNA, 71 bp, chicken (Gallus Gallus)
  misc_feature (36): n=c or t
ttgagggtgacgttgagattcacagttcctgatatncctctgagatccagcaaaacgttgtgcaagcacat

SEQ ID NO: 28128 - DNA, 71 bp, chicken (Gallus Gallus)
  misc_feature (36): n=a or g
atgaatttaaaatactttaaaaaaacactttaattnctctgaatgatcctcagaaaattcacagttgaaac

SEQ ID NO: 28129 - DNA, 71 bp, chicken (Gallus Gallus)
  misc_feature (36): n=c or t
ggtttcttaagtgttatctggctccagatgaagtangaatcagtgtttggaggagttctataagatcaaat

SEQ ID NO: 28130 - DNA, 71 bp, chicken (Gallus Gallus)
  misc_feature (36): n=c or t
gatacacagaataaaagatctcagcgctccttcttngcagaactgcattcatgtgtctcaccccattctgc

SEQ ID NO: 28131 - DNA, 71 bp, chicken (Gallus Gallus)
  misc_feature (36): n=c or t
aaagcaaactcatctgaaggaattatagttatgttnggaattcgaatttgtttgttatgggccactagaag

SEQ ID NO: 28132 - DNA, 71 bp, chicken (Gallus Gallus)
  misc_feature (36): n=a or g
gtaatgggttgcattttggtgtaaaggacaggagangtgttaaaatgttacagtgactgtatgctgttctt

SEQ ID NO: 28133 - DNA, 71 bp, chicken (Gallus Gallus)
  misc_feature (36): n=c or t
cagcacaatacattcctttggaaaagtatatactgnaccctaagccaatggaatttttccaattaacttta

SEQ ID NO: 28134 - DNA, 71 bp, chicken (Gallus Gallus)
  misc_feature (36): n=c or t
taagaatgccaggccaccagccaaaatgagagaganggtccaaaatccaaaggtgcaaattgcaagagccc

SEQ ID NO: 28135 - DNA, 71 bp, chicken (Gallus Gallus)
  misc_feature (36): n=c or t
ctttgttactcttctagagctgccaactcaactgtnagaatgataatcagggatgattttggtcatattgc

SEQ ID NO: 28136 - DNA, 71 bp, chicken (Gallus Gallus)
  misc_feature (36): n=c or t
gggagttatgctggttatgaatgagttgtgaagagntgaacaaggtgtttgctttagaaatttgattaagg

SEQ ID NO: 28137 - DNA, 71 bp, chicken (Gallus Gallus)
  misc_feature (36): n=a or g
ggctgatgaagcagacgataacccatcctgggcacnctgctcattcctgatgaggcatcgtgcatttattt

SEQ ID NO: 28138 - DNA, 71 bp, chicken (Gallus Gallus)
  misc_feature (36): n=a or g
tgggtgggtgggctttaacagagtaatacatcttcntgtaataaaacactgaagtccatttgatatctgta

SEQ ID NO: 28139 - DNA, 71 bp, chicken (Gallus Gallus)
  misc_feature (36): n=a or c
ttattacaggttctcacatctcacaagttttccttntactttcccatccacccttacaactttcccattca

SEQ ID NO: 28140 - DNA, 71 bp, chicken (Gallus Gallus)
  misc_feature (36): n=c or t
tatacctgttccatagcccacatcctaggaagctgncagcagacagtcctagaaagtaagtactgtacatg

SEQ ID NO: 28141 - DNA, 71 bp, chicken (Gallus Gallus)
  misc_feature (36): n=g or t
gggcaagctgggaaaaagaattacatttatctgaanttttgttttgtctctctttgccaaacaaagccttg

SEQ ID NO: 28142 - DNA, 71 bp, chicken (Gallus Gallus)
  misc_feature (36): n=a or c
ccaacctaatctccttctatgagcaagtgacccttncagtggatgaggaaaaggctgttatcacaatctat

SEQ ID NO: 28143 - DNA, 71 bp, chicken (Gallus Gallus)
  misc_feature (36): n=a or g
tcaagcctattttaggtctctcttctcctcctcccngtctttggaacagtagctttagaaagccacttcca

SEQ ID NO: 28144 - DNA, 71 bp, chicken (Gallus Gallus)
  misc_feature (36): n=c or g
gggagcatttagaagtcagaagagggaccagtaaanctgcagaaattatgagtggatttaccttgtgtcct

SEQ ID NO: 28145 - DNA, 71 bp, chicken (Gallus Gallus)
  misc_feature (36): n=g or t
ttgttcattagatcaagcaggtgaagctgttattcncataaaagtatgtggaagcccccccaaattgtctt

SEQ ID NO: 28146 - DNA, 71 bp, chicken (Gallus Gallus)
  misc_feature (36): n=c or t
agagagagaaatatctgtggcattcctgcttctgcngctcaaaataagatgcgcaaggaaaggttttgaca

SEQ ID NO: 28147 - DNA, 71 bp, chicken (Gallus Gallus)
  misc_feature (36): n=a or c
tggccctctgttagactctctccaggagattcttgncttttttgtaccatggagcccagaactgtacacaa

SEQ ID NO: 28148 - DNA, 71 bp, chicken (Gallus Gallus)
  misc_feature (36): n=g or t
ttctgaaggagaaatcttcccttaagttcctctgcnattctcttgtgaccgctgagtcagtgtaagaaact

SEQ ID NO: 28149 - DNA, 71 bp, chicken (Gallus Gallus)
  misc_feature (36): n=c or t
acgacaaaaaaatcccagtggaaattacaggttttncctttgtttgtccttgggaccttgtccacaaagac

SEQ ID NO: 28150 - DNA, 71 bp, chicken (Gallus Gallus)
  misc_feature (36): n=c or t
accaaagaaaagaaaaatcacagcaagagaaaactntcattcttgccagtctcatctcagaaccagtcaat

SEQ ID NO: 28151 - DNA, 71 bp, chicken (Gallus Gallus)
  misc_feature (36): n=a or t
ctacttgcttgatgattttggttaagtgcaatttgntgtatgcagaatgctgtttcatttaaggtcattct

SEQ ID NO: 28152 - DNA, 71 bp, chicken (Gallus Gallus)
  misc_feature (36): n=a or g
ttcagcaactactactttagaaagtgtgagctggcntcataacagtattttcaactgtatttctcaagtat

SEQ ID NO: 28153 - DNA, 71 bp, chicken (Gallus Gallus)
  misc_feature (36): n=a or g
actgttattcaaattctagccaccttgggagccccntcgccgtaactactgaagataaaacttgacgctac

SEQ ID NO: 28154 - DNA, 71 bp, chicken (Gallus Gallus)
  misc_feature (36): n=a or c
actactcctgatgtggttatttgccagataatgttntccttgaggtaaaaacaaacagacaaaacaaaaaa

SEQ ID NO: 28155 - DNA, 71 bp, chicken (Gallus Gallus)
  misc_feature (36): n=a or g
agtgttgctattctaaattcttcttccaaatccagncattgttataagaatgcatgtaaacatcatatact

SEQ ID NO: 28156 - DNA, 71 bp, chicken (Gallus Gallus)
  misc_feature (36): n=a or c
actacaggatgaattcaagattcttggataagattnttgaatagaagcttatccctgagatttgcatggac

SEQ ID NO: 28157 - DNA, 71 bp, chicken (Gallus Gallus)
  misc_feature (36): n=c or t
gaaacatggaagattccgagtatttgaagctttgangcttcaaacttttcaagatggctcttactaaaaat

SEQ ID NO: 28158 - DNA, 71 bp, chicken (Gallus Gallus)
  misc_feature (36): n=c or t
gcttacctgtaggaacactcagtagatttaacaggngggcaggcatattgcgtatgccattcaaacatgta

SEQ ID NO: 28159 - DNA, 71 bp, chicken (Gallus Gallus)
  misc_feature (36): n=c or t
tgttatttaatgcaatagttagggaaccacttttanttaagtttatttcaaacaaagctatatgatgcagc

SEQ ID NO: 28160 - DNA, 71 bp, chicken (Gallus Gallus)
  misc_feature (36): n=c or t
gaggttcaaaagcgaaagaacccagaaaagctctcncaggacacactctcaccttctggagaagcgctcag

SEQ ID NO: 28161 - DNA, 71 bp, chicken (Gallus Gallus)
  misc_feature (36): n=a or g
tgctgatactgctccagacaaataggattgctgctntcttgctgcagactcgggtttcatcagctacccac

SEQ ID NO: 28162 - DNA, 71 bp, chicken (Gallus Gallus)
  misc_feature (36): n=a or g
agcctttgagttcaatggtctggtcatttttccatntgctttgcagtatgctcatatgattccagccatct

SEQ ID NO: 28163 - DNA, 71 bp, chicken (Gallus Gallus)
  misc_feature (36): n=c or t
cagcgtgctactgctatcagctcacaacatacttcncttctatcaatgactattgaaaacatagtgaaact

SEQ ID NO: 28164 - DNA, 71 bp, chicken (Gallus Gallus)
  misc_feature (36): n=c or t
cttttgaaagttagggaagttgcagagggtttggcnttacttcatttaacaggctcacagaatctatttca

SEQ ID NO: 28165 - DNA, 71 bp, chicken (Gallus Gallus)
  misc_feature (36): n=c or t
tagcctttctctttaggtatcttctttgtctaacangcagtttcttttttaatcctcattttcttcagctt

SEQ ID NO: 28166 - DNA, 71 bp, chicken (Gallus Gallus)
  misc_feature (36): n=a or c
gacttaaggcaaaaaaaccatttaatggatgtgaanatcattcaaaaagaagtggaaaagccacctgctct

SEQ ID NO: 28167 - DNA, 71 bp, chicken (Gallus Gallus)
  misc_feature (36): n=a or c
gcttggcagagagaaagctgccttttaaagtcttanagcaagtccaaaaatgttctccagcatactgggaa

SEQ ID NO: 28168 - DNA, 71 bp, chicken (Gallus Gallus)
  misc_feature (36): n=a or g
ttcctgaaagcattgctcaggctttcttgctataanttcttgatgcaggaaaagaattttaaaaagcaatc

SEQ ID NO: 28169 - DNA, 71 bp, chicken (Gallus Gallus)
  misc_feature (36): n=a or g
aaaaatcacacatatctcaccttttctggctgtacntcaccagcactgttctggtgaactatgctgctggg

SEQ ID NO: 28170 - DNA, 71 bp, chicken (Gallus Gallus)
  misc_feature (36): n=a or g
gagcattgctaatgctgcttttccctgcatcttctntgttcctaacaccctcctgcagctgatgacaaagc

SEQ ID NO: 28171 - DNA, 71 bp, chicken (Gallus Gallus)
  misc_feature (36): n=a or g
tagactagtacacattcagactgtcaacggtttacnggctggtccggcccggttccgcgactagtggggca

SEQ ID NO: 28172 - DNA, 71 bp, chicken (Gallus Gallus)
  misc_feature (36): n=a or c
tcacgggaaggcagaagtactttaagttttgtctcnagtcacactaaaccctacatgcaaaatacgtgggg

SEQ ID NO: 28173 - DNA, 71 bp, chicken (Gallus Gallus)
  misc_feature (36): n=c or t
ctgctgtggatttaggcccacgtcaaacatcctctngaaatccttacctaagtgtgcgctggaaatgctga

SEQ ID NO: 28174 - DNA, 71 bp, chicken (Gallus Gallus)
  misc_feature (36): n=a or g
aaattaaaagcttctgctctacagctgctggaaagntggattgaacaccacttatcaagatgagcaagctc

SEQ ID NO: 28175 - DNA, 71 bp, chicken (Gallus Gallus)
  misc_feature (36): n=c or t
atatattatcatacacaggaaggattatagatggcnacaattaaaacttgaaataaaacataagaaaagtc

SEQ ID NO: 28176 - DNA, 71 bp, chicken (Gallus Gallus)
  misc_feature (36): n=a or g
tttgtttacagcagcaattaagaacctgcagcttgntatgccttgcacttgacagttctccctgcaaacat

SEQ ID NO: 28177 - DNA, 71 bp, chicken (Gallus Gallus)
  misc_feature (36): n=g or t
gaactcaagtcgcttcattgtgacaaatcaggaganagcttgcctgagaggaatttccagtgatgtaaaca

SEQ ID NO: 28178 - DNA, 71 bp, chicken (Gallus Gallus)
  misc_feature (36): n=c or t
caattccacctttctggaccaaacatcagatcacanggcataataaacagtcacatacattaaataagcac

SEQ ID NO: 28179 - DNA, 71 bp, chicken (Gallus Gallus)
  misc_feature (36): n=c or t
tcctcttctgctttctcttcccctcctcccctgccngttttcccaagataaagaagaactgtaaaagctta

SEQ ID NO: 28180 - DNA, 71 bp, chicken (Gallus Gallus)
  misc_feature (36): n=a or g
aaaatcagtgtaaaaccatgctagtagagtgaaatncacaccatttaagcacagtttactttttcaacagg

SEQ ID NO: 28181 - DNA, 71 bp, chicken (Gallus Gallus)
  misc_feature (36): n=a or c
gaaagagttttggaatttaaggggaacgtgaaacantccctccaccatcctgctgtaaaatttccttcctt

SEQ ID NO: 28182 - DNA, 71 bp, chicken (Gallus Gallus)
  misc_feature (36): n=c or t
gagctcgcacattagattttaaggggggcactgaanacaggagacagcagattaaaaagtaggcccacatc

SEQ ID NO: 28183 - DNA, 71 bp, chicken (Gallus Gallus)
  misc_feature (36): n=a or g
gtgaagatcatggggagagagcaaagaaagtcgtgnctaaaaagaacagcacaaaaaaaaaaacccataaa

SEQ ID NO: 28184 - DNA, 71 bp, chicken (Gallus Gallus)
  misc_feature (36): n=a or g
actggaaggtgccttttctgctggagctggaattgngcacaatgagaaagcaacaagaatcaaatacactg

SEQ ID NO: 28185 - DNA, 71 bp, chicken (Gallus Gallus)
  misc_feature (36): n=a or c
ctgggaatgtttaggatcttaactgacatatcaagntatttacattttaaaatcaggctttactaagttaa

SEQ ID NO: 28186 - DNA, 71 bp, chicken (Gallus Gallus)
  misc_feature (36): n=a or g
ggtgtgagcaagctgcagggtaaattcaaggtgacntagtgttcgtggctgcaaatgatgcgaaggaagtc

SEQ ID NO: 28187 - DNA, 71 bp, chicken (Gallus Gallus)
  misc_feature (36): n=c or t
cctttctctttgtcaactcttatgaccacgacacantcgttccttccaatgcggatgagtttgtttatgga

SEQ ID NO: 28188 - DNA, 71 bp, chicken (Gallus Gallus)
  misc_feature (36): n=a or g
tttagcttgacctatgaacttctttaccacaagganagtgttccttgcagtgataaatgctgttgatgcct

SEQ ID NO: 28189 - DNA, 71 bp, chicken (Gallus Gallus)
  misc_feature (36): n=a or g
tctaaaatattgttgtcaaagtacaccttgcccaancactggtgagacatgcatacatatataaaagaagc

SEQ ID NO: 28190 - DNA, 71 bp, chicken (Gallus Gallus)
  misc_feature (36): n=a or g
ccaatgtgtgtccttgaaagtattcacaagttcaangctatgtttatgtctagattgagggaggttcttca

SEQ ID NO: 28191 - DNA, 71 bp, chicken (Gallus Gallus)
  misc_feature (36): n=c or t
ttttaaggctaattttaattgcatatgtaacagtangacatcactgctctaagaaaactgatactggagtc

SEQ ID NO: 28192 - DNA, 71 bp, chicken (Gallus Gallus)
  misc_feature (36): n=c or t
taaaattctgtgattctgttgtatgctactacatgnttcttgatgctggttgcatgtaccagataagtatt

SEQ ID NO: 28193 - DNA, 71 bp, chicken (Gallus Gallus)
  misc_feature (36): n=c or t
gggggtcgttgcttttaatgtatttccctgctttcntaatgcctgcatttctgtggtttgcacgttgggat

SEQ ID NO: 28194 - DNA, 71 bp, chicken (Gallus Gallus)
  misc_feature (36): n=c or t
caaacgagcaattccttcatgcacagcacctgtaangaacatctagatccaatgcagaccaatccgaacat

SEQ ID NO: 28195 - DNA, 71 bp, chicken (Gallus Gallus)
  misc_feature (36): n=a or c
gtgtgactacctcatacacacctgatgtaaaacagnagcacagagaactctcacaatgcccacctttctgt

SEQ ID NO: 28196 - DNA, 71 bp, chicken (Gallus Gallus)
  misc_feature (36): n=a or t
aaaaaaaaaagtggtcgtaatatcgggcacactgcntaaataagagaacgccctccgaaccactgtatttt

SEQ ID NO: 28197 - DNA, 71 bp, chicken (Gallus Gallus)
  misc_feature (36): n=c or t
cctgatgaaaaaggccatacatgtaaacatttttanaattaatcaacagcattgtttctgagaaagaatat

SEQ ID NO: 28198 - DNA, 71 bp, chicken (Gallus Gallus)
  misc_feature (36): n=a or t
gaatgaaagaggtaaattcctgaatacagctgcaantacttctgggatagccaaacatcacttttctggcc

SEQ ID NO: 28199 - DNA, 71 bp, chicken (Gallus Gallus)
  misc_feature (36): n=c or t
gaattgatgaaaatgatggaataacaatctatggcnatgggaaaggagattggcttaagccgtcttaaaat

SEQ ID NO: 28200 - DNA, 71 bp, chicken (Gallus Gallus)
  misc_feature (36): n=c or t
ataaagctatgctattacaaagttgtgactatgcanatatacacatttctaccattctccataaacccggc

SEQ ID NO: 28201 - DNA, 71 bp, chicken (Gallus Gallus)
  misc_feature (36): n=c or t
caaaataacagactcttggattactccataacagangtgaaactggtatccaacactgaattttggccata

SEQ ID NO: 28202 - DNA, 71 bp, chicken (Gallus Gallus)
  misc_feature (36): n=a or g
ggctctgttactgacttttgtggctcttagatcacncacaattctgtattcatgttctttctgtttaatag

SEQ ID NO: 28203 - DNA, 71 bp, chicken (Gallus Gallus)
  misc_feature (36): n=a or g
cttccttcaagtcctgatgcttctgtctgtttcagntctctgttcactagaagtatcctttggatagagaa

SEQ ID NO: 28204 - DNA, 71 bp, chicken (Gallus Gallus)
  misc_feature (36): n=a or g
agatactgaggtatagaaatcgtgagtgggacaganaaggacaagtgggtgatccttggcaccttccccac

SEQ ID NO: 28205 - DNA, 71 bp, chicken (Gallus Gallus)
  misc_feature (36): n=c or t
acaaactgactgtgaggctgtttggagttatatagnacttctgacattgctctcccctctttgtttgcctg

SEQ ID NO: 28206 - DNA, 71 bp, chicken (Gallus Gallus)
  misc_feature (36): n=c or t
cgtgtttgtatggctttgcttgatgtcatgatggcnacaaccacaggtgcagcacttacacgttcaggttc

SEQ ID NO: 28207 - DNA, 71 bp, chicken (Gallus Gallus)
  misc_feature (36): n=g or t
agccttgctgtctgtgttactgacttgttggcatanctctgggctggtcccacacaccaggggcaggggtt

SEQ ID NO: 28208 - DNA, 71 bp, chicken (Gallus Gallus)
  misc_feature (36): n=a or g
gagagaaaatacatttctttctaggccatagttacncagttgaaggtctttcttagggtagtctgatgtgg

SEQ ID NO: 28209 - DNA, 71 bp, chicken (Gallus Gallus)
  misc_feature (36): n=a or c
ctttcacaagaacactccacgttgattatgcacacnttattttgcagtaacacgtgcaggagttctttgcc

SEQ ID NO: 28210 - DNA, 71 bp, chicken (Gallus Gallus)
  misc_feature (36): n=c or t
aagggtactgaaaaacaaggaagagtgaacttgagntgatagtggagcactggacatgtccctaatagttg

SEQ ID NO: 28211 - DNA, 71 bp, chicken (Gallus Gallus)
  misc_feature (36): n=a or c
gattccctgagtgtttcaggacttaggaactcaacnaacatgggcttgaattgtgcaaagaattcacaata

SEQ ID NO: 28212 - DNA, 71 bp, chicken (Gallus Gallus)
  misc_feature (36): n=c or g
tgttacagtctaattcttctttctagtatttagagntttcctctaagtatttatggacctgatctttattt

SEQ ID NO: 28213 - DNA, 71 bp, chicken (Gallus Gallus)
  misc_feature (36): n=a or g
gatgaggctgcatgtgtgcactttgttaagtgcctngggaatattaagtcttatctgaatataattacata

SEQ ID NO: 28214 - DNA, 71 bp, chicken (Gallus Gallus)
  misc_feature (36): n=g or t
attaaattcttccaagtcaagactgtttttctcgtnatgataactggtaactgatcttgtctttactttat

SEQ ID NO: 28215 - DNA, 71 bp, chicken (Gallus Gallus)
  misc_feature (36): n=g or t
ggtatctgctaatgtctggggcttctgttgctgtgntaagggacattaggatcatggctgccatctccagc

SEQ ID NO: 28216 - DNA, 71 bp, chicken (Gallus Gallus)
  misc_feature (36): n=c or g
tgctgggcagttgagccctccttgtgggatcctgtntctgaacattgctggagtgcctttgggtccagctg

SEQ ID NO: 28217 - DNA, 71 bp, chicken (Gallus Gallus)
  misc_feature (36): n=c or t
atagggaaaagcatcagaattagtttgacttttccnatgcacgccagccatgcacacacttaaagcagaga

SEQ ID NO: 28218 - DNA, 71 bp, chicken (Gallus Gallus)
  misc_feature (36): n=c or t
cctgggacttgctcttggctgtttcaggagtaactngtagtgcaggttcttggtccttgttatctgtagtg

SEQ ID NO: 28219 - DNA, 71 bp, chicken (Gallus Gallus)
  misc_feature (36): n=a or g
gaacaacacagaagaaaacaccaatatgttcatttngataaactacagcacaagatctcatttttcacaca

SEQ ID NO: 28220 - DNA, 71 bp, chicken (Gallus Gallus)
  misc_feature (36): n=c or t
tgtagaaagtggactttgtaacctaaggagatctgnccatactgagtgtgggaagaggaagggagtatgat

SEQ ID NO: 28221 - DNA, 71 bp, chicken (Gallus Gallus)
  misc_feature (36): n=a or g
gtgaattaatggaggagaaagctgtaaatgagatcnatgctaatgcacctatatttcctcagggtgttcta

SEQ ID NO: 28222 - DNA, 71 bp, chicken (Gallus Gallus)
  misc_feature (36): n=a or g
tgcattttagagagtagactggaatagaagcatgangtgcaaatacagttgtggtagttcaaaagttgcat

SEQ ID NO: 28223 - DNA, 71 bp, chicken (Gallus Gallus)
  misc_feature (36): n=c or t
aatccctctggaattgcccagagaactgcagactgngattgcagcccgctcagcatcacttttgcattctg

SEQ ID NO: 28224 - DNA, 71 bp, chicken (Gallus Gallus)
  misc_feature (36): n=c or t
attatggcaaagagaatgatgctgactcatcccaangagtttggaagtacttacttcagacccaaaatgca

SEQ ID NO: 28225 - DNA, 71 bp, chicken (Gallus Gallus)
  misc_feature (36): n=c or t
cagtttgacacctacgatgcatatgtcagaatagtnccatgagggaaaagtgctacatatttaacagtact

SEQ ID NO: 28226 - DNA, 71 bp, chicken (Gallus Gallus)
  misc_feature (36): n=a or t
ttagttgcacttgaaccaaatagtgtggtttatacncaaggtccatttagagtgtttaggcagaaggcaac

SEQ ID NO: 28227 - DNA, 71 bp, chicken (Gallus Gallus)
  misc_feature (36): n=a or g
tgttgtcatatgctcacctcgggtttagggaccagntcaatgttcttatcaataagaaaagtgaccaagga

SEQ ID NO: 28228 - DNA, 71 bp, chicken (Gallus Gallus)
  misc_feature (36): n=c or t
cccacagctactgaggagtaacacctggagaaggangtcctgtctttgtgaacaacgtgtctctggggaag

SEQ ID NO: 28229 - DNA, 71 bp, chicken (Gallus Gallus)
  misc_feature (36): n=g or t
aaagccagtgagtgcctattttagagctgggattgnagcttgtctccgagatgcataagactggtgctgga

SEQ ID NO: 28230 - DNA, 71 bp, chicken (Gallus Gallus)
  misc_feature (36): n=a or g
ccagccaggaggatgcccacaacaaaggacggtaangaggagcagagcagggctgtgggctgagccagggc

SEQ ID NO: 28231 - DNA, 71 bp, chicken (Gallus Gallus)
  misc_feature (36): n=c or g
ttgaagggatgtggtgctgaaaattggctttgcatnaggctgtttctggcttagcacctacgtgatgtgtc

SEQ ID NO: 28232 - DNA, 71 bp, chicken (Gallus Gallus)
  misc_feature (36): n=c or g
agccaggctgctcggagctgaatgaagttccatccngtcagcaagggtagctctaaatccttggcactgtg

SEQ ID NO: 28233 - DNA, 71 bp, chicken (Gallus Gallus)
  misc_feature (36): n=c or g
gcttcaaaacctgtctgacttgaatttattttatgnacctgacagaaaatacttccccacctcccatttct

SEQ ID NO: 28234 - DNA, 71 bp, chicken (Gallus Gallus)
  misc_feature (36): n=a or c
gtcagtgcgtgagtgcttaataatttgatagcatcngtacaggtagtaagatcacgaaatttgaatgaagg

SEQ ID NO: 28235 - DNA, 71 bp, chicken (Gallus Gallus)
  misc_feature (36): n=c or t
gagacaagaagatgccctgttgctgtgtctccttcncactaacagctggtgacccgacaccacattccaag

SEQ ID NO: 28236 - DNA, 71 bp, chicken (Gallus Gallus)
  misc_feature (36): n=c or t
cctgcatgcgtatcaccagaagttgaatcagttgangtccagttaatctatttctcatgacaatagctttt

SEQ ID NO: 28237 - DNA, 71 bp, chicken (Gallus Gallus)
  misc_feature (36): n=c or t
tttaatgtgtggttggttaagttccaaattaagtcncacttcctggtttaccatgtttgggaaatataggc

SEQ ID NO: 28238 - DNA, 71 bp, chicken (Gallus Gallus)
  misc_feature (36): n=c or t
aagattccctcggtatctgcagcactcccatggtgntggcagaagaggcagaggatttatagagatgtcta

SEQ ID NO: 28239 - DNA, 71 bp, chicken (Gallus Gallus)
  misc_feature (36): n=a or g
acagtgttcttgggtaatattagtctataaaaatancagtaaaaaatcgaaacaccagacagtggcatatc

SEQ ID NO: 28240 - DNA, 71 bp, chicken (Gallus Gallus)
  misc_feature (36): n=a or t
aaaaaataaatagaaagttgtaagaaaaaaagctcnaagtttgttcaaggtctagtttgggtctgctttca

SEQ ID NO: 28241 - DNA, 71 bp, chicken (Gallus Gallus)
  misc_feature (36): n=a or g
atatattttaatgtaaaagtttttctactccatcantgtgactttgcagctcattccaatctttcagtgac

SEQ ID NO: 28242 - DNA, 71 bp, chicken (Gallus Gallus)
  misc_feature (36): n=c or t
gctccaaggacttctggagtgctgctccatgaaagngctgacatgtaaaatgtgcaaacacttctctgagc

SEQ ID NO: 28243 - DNA, 71 bp, chicken (Gallus Gallus)
  misc_feature (36): n=c or t
atttatgacgtctggaggtcatacaaaatccttcancctgacaaaaacacctggtcaacagaaacagtatc

SEQ ID NO: 28244 - DNA, 71 bp, chicken (Gallus Gallus)
  misc_feature (36): n=g or t
catgcttctttcccaagttcccatggtttgtttatnctgccaataacttcctttgggtgggagaaagtgtg

SEQ ID NO: 28245 - DNA, 71 bp, chicken (Gallus Gallus)
  misc_feature (36): n=a or g
aagcagtctttctggattttattcttcagagcatanttctggagcagaaccacatgccaatcagaagatga

SEQ ID NO: 28246 - DNA, 71 bp, chicken (Gallus Gallus)
  misc_feature (36): n=c or t
tggactaatttatttgttatttgcctgtaaagaggnaaactgatttgtcagtattttacagtacgtggacg

SEQ ID NO: 28247 - DNA, 71 bp, chicken (Gallus Gallus)
  misc_feature (36): n=a or g
aaacagtcctgatgtatctggtaaggtctgagtacnttcaggtcactgataaagaaagtactgcagtgaat

SEQ ID NO: 28248 - DNA, 71 bp, chicken (Gallus Gallus)
  misc_feature (36): n=c or t
agtaaggcctttagtaccatcccttatctcatcttnctggagaagagatcaatttgtgagatgaacagcta

SEQ ID NO: 28249 - DNA, 71 bp, chicken (Gallus Gallus)
  misc_feature (36): n=c or t
tgacaagattggagactgtggttttaacatgatatngtaggaagcttgatgtgctatgttttattttagcg

SEQ ID NO: 28250 - DNA, 71 bp, chicken (Gallus Gallus)
  misc_feature (36): n=c or t
tatatatgctattatgggaagcatattactgtgtcngttgctgctgcttgtacagtgtcaaatctctgcta

SEQ ID NO: 28251 - DNA, 71 bp, chicken (Gallus Gallus)
  misc_feature (36): n=a or g
ctttattcaaaggtaacatctaaaatgataaagaantgacaacagtactcaactaacctgtgaacccaaaa

SEQ ID NO: 28252 - DNA, 71 bp, chicken (Gallus Gallus)
  misc_feature (36): n=c or t
ggaatcatagctttggcttctgggctcagaatcccnagctaacacgtacaaacaaaactgatacttgctta

SEQ ID NO: 28253 - DNA, 71 bp, chicken (Gallus Gallus)
  misc_feature (36): n=a or t
gcttaaccaactccttattaaaacaaatctaaatgntttctcttgaacatatttagcagcttccataaatc

SEQ ID NO: 28254 - DNA, 71 bp, chicken (Gallus Gallus)
  misc_feature (36): n=a or g
gaacaagatgaaaaccacaacggaaggatttaatancatggagagaggcagtttgggtagcagaggagagt

SEQ ID NO: 28255 - DNA, 71 bp, chicken (Gallus Gallus)
  misc_feature (36): n=c or t
caaaaaactttaaacctttcacttaacaccaaggtnctaatgtgtctatggaagtttcaagacagtaaaac

SEQ ID NO: 28256 - DNA, 71 bp, chicken (Gallus Gallus)
  misc_feature (36): n=g or t
ttagtagatttttgtatctttagtagtgaaagtagntaaaaaaattttgatgcaaaagaagaataaataaa

SEQ ID NO: 28257 - DNA, 71 bp, chicken (Gallus Gallus)
  misc_feature (36): n=c or t
tgtcagctgctgtacgtgctggtgtaggagtcagangaaagtgtagaacaaatactccagaattaaaaaca

SEQ ID NO: 28258 - DNA, 71 bp, chicken (Gallus Gallus)
  misc_feature (36): n=g or t
aaattgaaaaacataaaaatataaaatgtccttttncttctacagagctcatgataaataagtttcttttt

SEQ ID NO: 28259 - DNA, 71 bp, chicken (Gallus Gallus)
  misc_feature (36): n=a or g
atgcttcttagctaagtatttaatattgtcttgaangatgaagtgattgtcgtcttgttcatggtgtcttt

SEQ ID NO: 28260 - DNA, 71 bp, chicken (Gallus Gallus)
  misc_feature (36): n=a or g
tttttaaggaacttgctagaaataactcacactgtntggagtatttacctaccaccaactaagtgcccacc

SEQ ID NO: 28261 - DNA, 71 bp, chicken (Gallus Gallus)
  misc_feature (36): n=a or g
agtcctcttcacaagctgaggtggttgcaggatggngcaactgatgctgttttgctcaagtgctgctgctg

SEQ ID NO: 28262 - DNA, 71 bp, chicken (Gallus Gallus)
  misc_feature (36): n=c or t
gttccgatgtacctcacagtgatttacaattgatantatactgtgatactgttactcactgtacagctcca

SEQ ID NO: 28263 - DNA, 71 bp, chicken (Gallus Gallus)
  misc_feature (36): n=c or t
gcttcattttatataagcacctgcaagcttgctgtnccaaaaggctcaattgcaccacaaagctgaactct

SEQ ID NO: 28264 - DNA, 71 bp, chicken (Gallus Gallus)
  misc_feature (36): n=g or t
ctcctttggaccctctctaattaatctttatgtccntcttatgttttggcacccagatccacacccagtgc

SEQ ID NO: 28265 - DNA, 71 bp, chicken (Gallus Gallus)
  misc_feature (36): n=g or t
tttaggattaatacagtgcaagtaccatctagcttnaactcctgatgtggaaatagtatcaattgtctcag

SEQ ID NO: 28266 - DNA, 71 bp, chicken (Gallus Gallus)
  misc_feature (36): n=a or g
aatataagtgtttgaacctgtccaggtcaaagtccnaagcaagaaactcacacaggaatccatgtttcatg

SEQ ID NO: 28267 - DNA, 71 bp, chicken (Gallus Gallus)
  misc_feature (36): n=c or t
aacagggtgcctagagaggttctggatgccctgtcnctggaagtttttaaggtcctgggcaatctgactta

SEQ ID NO: 28268 - DNA, 71 bp, chicken (Gallus Gallus)
  misc_feature (36): n=g or t
cttgttctttgtattaaatgctgtacaggatgaaanatattcccaactaaacacaacagtggaatacttca

SEQ ID NO: 28269 - DNA, 71 bp, chicken (Gallus Gallus)
  misc_feature (36): n=a or g
agaaacaatagcaagaagagttgtatatgtattacntgagattgtgcccttatgcgtacatgcattttaca

SEQ ID NO: 28270 - DNA, 71 bp, chicken (Gallus Gallus)
  misc_feature (36): n=g or t
gggagagaagacagttgggacagccagccagcagcntggcttgcaaagagaaggagtagggaattggtggc

SEQ ID NO: 28271 - DNA, 71 bp, chicken (Gallus Gallus)
  misc_feature (36): n=c or g
tgtccccttccttctgccactgtcacttgcccaacntagcaagtttgcttttggaagcctttgtatcccat

SEQ ID NO: 28272 - DNA, 71 bp, chicken (Gallus Gallus)
  misc_feature (36): n=c or t
taattacaaaaaactgtacagaggctctttgggagncacatctggagacggcgttccatgcctataagcct

SEQ ID NO: 28273 - DNA, 71 bp, chicken (Gallus Gallus)
  misc_feature (36): n=c or t
tttgacaaagaagtggcattttgttttccatgagantggaatttgaatttactgcagaaggtccaaaggct

SEQ ID NO: 28274 - DNA, 71 bp, chicken (Gallus Gallus)
  misc_feature (36): n=c or t
ggaacagaagcagtccagcatcaccctggaaactanttcctgaggtaaagcaagaaacaaagtcttctaag

SEQ ID NO: 28275 - DNA, 71 bp, chicken (Gallus Gallus)
  misc_feature (36): n=c or t
aactcaagcatacacgcaagaagggaagttctgttnaacagtgtttagcctgaccacgataagtacagaaa

SEQ ID NO: 28276 - DNA, 71 bp, chicken (Gallus Gallus)
  misc_feature (36): n=c or t
aatccataaaaataagcatatgcttttgtttttatntaatagtgtgattactttgcaatcatcaaagtttt

SEQ ID NO: 28277 - DNA, 71 bp, chicken (Gallus Gallus)
  misc_feature (36): n=c or t
tccttttcccagaacggaccctaaaacaatcagctncagcacaaaccccacagaggatctacctaagagaa

SEQ ID NO: 28278 - DNA, 71 bp, chicken (Gallus Gallus)
  misc_feature (36): n=a or g
ctcatggtgttgttattgcttgtttggcctcaagancccacagatttgtatcccaagatataattaaagtc

SEQ ID NO: 28279 - DNA, 71 bp, chicken (Gallus Gallus)
  misc_feature (36): n=a or c
taggagctggcattagtgtaataaaagctacactanatgtgtttgtttcccactccgctgctctgctgacc

SEQ ID NO: 28280 - DNA, 71 bp, chicken (Gallus Gallus)
  misc_feature (36): n=c or t
ctaaaatagctatatggttccccagtcagaagttgntcgtatatgaccggtctgaagcttgaacagagaaa

SEQ ID NO: 28281 - DNA, 71 bp, chicken (Gallus Gallus)
  misc_feature (36): n=c or t
ggcattcaaggactgagctacacacagtgctctgtntgcttggtcttcagagaggtctgagtcatctggct

SEQ ID NO: 28282 - DNA, 71 bp, chicken (Gallus Gallus)
  misc_feature (36): n=a or c
aacagaatgagctttcttctaagtggttcttgttcntgtgacagaaataatataatgcagtaatcattttc

SEQ ID NO: 28283 - DNA, 71 bp, chicken (Gallus Gallus)
  misc_feature (36): n=c or t
ccctgtatgaacacactgcttttatgtggcgtatcngtacacagcacactgaagtaggtacttcattgatt

SEQ ID NO: 28284 - DNA, 71 bp, chicken (Gallus Gallus)
  misc_feature (36): n=a or g
gtcactgtttcttagtcaaagttaaacaaatgctgnagagtctaaacaaacactattaagaatctaacaac

SEQ ID NO: 28285 - DNA, 71 bp, chicken (Gallus Gallus)
  misc_feature (36): n=c or g
tgagcgtgcaaataggagtatatgctagaagagcanttgttgcctctgcaggtctgttaagtacgtacttg

SEQ ID NO: 28286 - DNA, 71 bp, chicken (Gallus Gallus)
  misc_feature (36): n=g or t
tttagtgctttcctttggttggtgctaggtgggaantctggggatttgtctctgaccacagtagctgtata

SEQ ID NO: 28287 - DNA, 71 bp, chicken (Gallus Gallus)
  misc_feature (36): n=a or g
cctttattttcctcaattttcctttatttccctccntattccactttattttccttcattccgtatttccc

SEQ ID NO: 28288 - DNA, 71 bp, chicken (Gallus Gallus)
  misc_feature (36): n=a or g
taatgccttcccaagtcacaggctgttaagtaggtncccagaacaattttcagacacattctctaatcatc

SEQ ID NO: 28289 - DNA, 71 bp, chicken (Gallus Gallus)
  misc_feature (36): n=c or t
ttttgcctagtgttttcttgttctctgacgagttangagcagaaatgcaaagccactcggtgcaactggaa

SEQ ID NO: 28290 - DNA, 71 bp, chicken (Gallus Gallus)
  misc_feature (36): n=c or t
cctgagctgaatgtgcccgctgtgttagtccttacnttgcagtgttaagctccatgctcattccaccacca

SEQ ID NO: 28291 - DNA, 71 bp, chicken (Gallus Gallus)
  misc_feature (36): n=a or t
tatggacttctcagagcttgaaagccattggttcanaggcagtgtgattagcatcgattataaaatagtct

SEQ ID NO: 28292 - DNA, 71 bp, chicken (Gallus Gallus)
  misc_feature (36): n=c or t
gtggtttattctgagcctttctctgttcctcagatngtatgaagcatttgtgagataagctgttgaaggac

SEQ ID NO: 28293 - DNA, 71 bp, chicken (Gallus Gallus)
  misc_feature (36): n=g or t
tctggcaatttatttccttgatttttttaccttctnctacattgactagcaatgctactttcctttcagct

SEQ ID NO: 28294 - DNA, 71 bp, chicken (Gallus Gallus)
  misc_feature (36): n=a or g
ggattgcctcctaggtaggaaagggttcatcttagngaatggtgagacttgaagaacctgttgtaacaggc

SEQ ID NO: 28295 - DNA, 71 bp, chicken (Gallus Gallus)
  misc_feature (36): n=c or t
aaagaagaattctcataggtaagtaaatgaggcacnggagtattttaaatcattggagaataaataaaatg

SEQ ID NO: 28296 - DNA, 71 bp, chicken (Gallus Gallus)
  misc_feature (36): n=c or t
ttttaattaaactggcttgattttcttatgtgggcngagctagcttattttcttcatctgtgtgctgtcat

SEQ ID NO: 28297 - DNA, 71 bp, chicken (Gallus Gallus)
  misc_feature (36): n=g or t
ccactcagctttttagtcttgtcggtatttatcttncgatcatatgaatgccgcttggaattctttgtttc

SEQ ID NO: 28298 - DNA, 71 bp, chicken (Gallus Gallus)
  misc_feature (36): n=c or g
caaatttattttatgtagctgtgctattaccctcangtaagcaagcagtaatctatttgtatttgtacagc

SEQ ID NO: 28299 - DNA, 71 bp, chicken (Gallus Gallus)
  misc_feature (36): n=a or g
ttattgcaaccagttactctgatttcttaatccacnagtaaaaccttcttgcactgagtttgtgggataat

SEQ ID NO: 28300 - DNA, 71 bp, chicken (Gallus Gallus)
  misc_feature (36): n=a or c
ggtgatgtcttggttgatgctatattagaagatacntgagaatgtcatctggtttccttggtacacatgct

SEQ ID NO: 28301 - DNA, 71 bp, chicken (Gallus Gallus)
  misc_feature (36): n=a or g
cctaacatttgctgcttgtggtcagtcatacagacntattacaattttacacatttgtctctaagcacaaa

SEQ ID NO: 28302 - DNA, 71 bp, chicken (Gallus Gallus)
  misc_feature (36): n=a or g
catgaagcccatggaaattaatagatctcatctgcntttgttttcagagttcttgtactgatcagggcaaa

SEQ ID NO: 28303 - DNA, 71 bp, chicken (Gallus Gallus)
  misc_feature (36): n=g or t
tatctggaaacaagataggtagttacacagtgcatnacaaggtaccttcttcttataagatgtgaggtaac

SEQ ID NO: 28304 - DNA, 71 bp, chicken (Gallus Gallus)
  misc_feature (36): n=g or t
ttcttttgagatagagtacagaaaaaggacttcatntatgggctcctcaaatagtgcctcctaccatttcc

SEQ ID NO: 28305 - DNA, 71 bp, chicken (Gallus Gallus)
  misc_feature (36): n=c or g
gatagcactttctgggataggcaatgaaagaaaggntttggctgcttctaatagattaatggacatcttag

SEQ ID NO: 28306 - DNA, 71 bp, chicken (Gallus Gallus)
  misc_feature (36): n=c or t
ctatacactctgttgcgggtagcttttggatacaantggagtcttaacttcaaaccaccggtgggatcaca

SEQ ID NO: 28307 - DNA, 71 bp, chicken (Gallus Gallus)
  misc_feature (36): n=c or t
tgcaagaggaaaggagtattgctgtgcaggggtggnataggttgtgctgctggaatatcgtgagatgcagt

SEQ ID NO: 28308 - DNA, 71 bp, chicken (Gallus Gallus)
  misc_feature (36): n=c or t
gctggattaacttcagatcttctgtcaattttatgnaactttattcataatgagcagatctgccacactag

SEQ ID NO: 28309 - DNA, 71 bp, chicken (Gallus Gallus)
  misc_feature (36): n=c or t
attcaggttggaaaagacctctgagatcatgtagtncaccactggcttcaaccagataacttgaaccttta

SEQ ID NO: 28310 - DNA, 71 bp, chicken (Gallus Gallus)
  misc_feature (36): n=a or t
taacagaactttacaaattcatgtattttttctaancatagtaaatattttattcattacgacagtcacat

SEQ ID NO: 28311 - DNA, 71 bp, chicken (Gallus Gallus)
  misc_feature (36): n=a or g
taatattttatcaaggctgaaaagctactggcagangttataggaacagcaaagcacagttttttaacgtc

SEQ ID NO: 28312 - DNA, 71 bp, chicken (Gallus Gallus)
  misc_feature (36): n=c or t
ctgccccatccatgaagacatggatatcgatagtanctgtacatcctccctgatgaactgctaaccactac

SEQ ID NO: 28313 - DNA, 71 bp, chicken (Gallus Gallus)
  misc_feature (36): n=a or t
gtgacttagatggtattccagattctgtttctgatngtcagaaagctgagtttttgtcttgtgtttgggaa

SEQ ID NO: 28314 - DNA, 71 bp, chicken (Gallus Gallus)
  misc_feature (36): n=a or g
ccctaggatttctatatagaagtctgcagttctaangaagatatttggctgtgcacttctagatattctgt

SEQ ID NO: 28315 - DNA, 71 bp, chicken (Gallus Gallus)
  misc_feature (36): n=a or t
ttccagtgaagactgctgcagtgtttcatatattgnttgtagcattccatttaatcatcgctatacgtttt

SEQ ID NO: 28316 - DNA, 71 bp, chicken (Gallus Gallus)
  misc_feature (36): n=c or t
caggaagtcagaaagtgttttgcactggtcctttangcttgggcagactctgatgttgattcatcatctct

SEQ ID NO: 28317 - DNA, 71 bp, chicken (Gallus Gallus)
  misc_feature (36): n=c or t
agtttaaccaattacccaagcaacgctcacaccagnagtgcagtttccccttgcttcctctctttagctcc

SEQ ID NO: 28318 - DNA, 71 bp, chicken (Gallus Gallus)
  misc_feature (36): n=a or t
ggtgatgggatttatttaaataaactttagagtgtntttataacctgcaatacatacacctctcgcaaaag

SEQ ID NO: 28319 - DNA, 71 bp, chicken (Gallus Gallus)
  misc_feature (36): n=a or g
tccaggggcagatcagagttttctccagtggatcancaaccatgagagcccgcaggaccacatgctggttt

SEQ ID NO: 28320 - DNA, 71 bp, chicken (Gallus Gallus)
  misc_feature (36): n=a or g
ttaatatcccacatgcaaaacattctgcttgtaaanctatctgatctgcttacagactccacagagaaggc

SEQ ID NO: 28321 - DNA, 71 bp, chicken (Gallus Gallus)
  misc_feature (36): n=a or g
agattcttgcatgtttcctcactgtgtgaacatacnacccaaaactgagttggggcacgagcgcatggctc

SEQ ID NO: 28322 - DNA, 71 bp, chicken (Gallus Gallus)
  misc_feature (36): n=c or t
agggagccaatgaatcagcacaccatgagtagctgngctgcttaaccatccagtatctttctctagcccta

SEQ ID NO: 28323 - DNA, 71 bp, chicken (Gallus Gallus)
  misc_feature (36): n=c or t
ttcagaatttataactatcaagctgaatctgaagangttagattaagtttggagacatttggaagtttgct

SEQ ID NO: 28324 - DNA, 71 bp, chicken (Gallus Gallus)
  misc_feature (36): n=c or g
tggtagcaccgctcatatcaaaggacaccattcctntattgttacccttttgactttaaagcaggacctgt

SEQ ID NO: 28325 - DNA, 71 bp, chicken (Gallus Gallus)
  misc_feature (36): n=c or t
gaagccttttattgagactataattaggggcagtanggattaggggtacactgtcctctggagggaggagt

SEQ ID NO: 28326 - DNA, 71 bp, chicken (Gallus Gallus)
  misc_feature (36): n=c or t
tcctcacaaagaccaggcgccagccaccttattacncccccatgcacaccacaagttagcattggaagaga

SEQ ID NO: 28327 - DNA, 71 bp, chicken (Gallus Gallus)
  misc_feature (36): n=c or t
aatatattacaaatatattacaaataaattatgaanatcaccagacttggacagaagtgaatatgaacttc

SEQ ID NO: 28328 - DNA, 71 bp, chicken (Gallus Gallus)
  misc_feature (36): n=a or c
acatctggggtgaagactgctgtttggtgtctctgncaacataaatggatttttccatgataaaggcaaat

SEQ ID NO: 28329 - DNA, 71 bp, chicken (Gallus Gallus)
  misc_feature (36): n=a or g
gctgtctacagtattcagcagacttcacttgaaacnttttattttggaggttttagttgacaaaataggtt

SEQ ID NO: 28330 - DNA, 71 bp, chicken (Gallus Gallus)
  misc_feature (36): n=c or t
ttcctgtctgcatatttcaaatacacagaaagaagntgtacatctgagtggtacacaccagcaaaatagca

SEQ ID NO: 28331 - DNA, 71 bp, chicken (Gallus Gallus)
  misc_feature (36): n=c or t
gtggatgcagatgagctgatcttgattccccaaggngtacagatattctttgtgactcctgatgggcaggt

SEQ ID NO: 28332 - DNA, 71 bp, chicken (Gallus Gallus)
  misc_feature (36): n=c or t
ctaatcacatgtattcacttgggcttttgtgcactnctccagcttaacttgcagtacaatttaaatctgaa

SEQ ID NO: 28333 - DNA, 71 bp, chicken (Gallus Gallus)
  misc_feature (36): n=a or g
catgtttgccatgcgtgagtctggggtcctgctacngtggtctttttggatgggctggtattgccagcctg

SEQ ID NO: 28334 - DNA, 71 bp, chicken (Gallus Gallus)
  misc_feature (36): n=a or g
aaaaggaaggtggtataatttgaagagtcaagaacntcataacattatggtcctgctcagagttggtgcag

SEQ ID NO: 28335 - DNA, 71 bp, chicken (Gallus Gallus)
  misc_feature (36): n=c or g
tggtactgcaggaaactgttcagatttggtcctctnatgtctgtggatcctgagggatctgtgcctaccaa

SEQ ID NO: 28336 - DNA, 71 bp, chicken (Gallus Gallus)
  misc_feature (36): n=a or g
agtcagtgggttcgcctctgctccctgcagttttcnaagtatgagtgaagcaccttgtatacaggcaggct

SEQ ID NO: 28337 - DNA, 71 bp, chicken (Gallus Gallus)
  misc_feature (36): n=c or t
ttctgacagtctcttgtacaaatcaaccaggaaaantaccctcaacaatcatgagacatatttctgtccca

SEQ ID NO: 28338 - DNA, 71 bp, chicken (Gallus Gallus)
  misc_feature (36): n=a or g
cttgtgccttctgaaaaaggacatcctctcaatctnagtaagactgttggtcagtctcctatagaaaaaac

SEQ ID NO: 28339 - DNA, 71 bp, chicken (Gallus Gallus)
  misc_feature (36): n=c or t
gtccttcatttattaaaaaataatgatccctgatangaaacccctatggtaacaggaactacgtgacagac

SEQ ID NO: 28340 - DNA, 71 bp, chicken (Gallus Gallus)
  misc_feature (36): n=c or t
aagaggaggaggaagacaggattgtgtttagctgtncccccccagagtctgcaatgcattccagaattgcc

SEQ ID NO: 28341 - DNA, 71 bp, chicken (Gallus Gallus)
  misc_feature (36): n=a or t
tgtaaaaactctgccataaaaacacttcttcctttnttagcagtacagtaaaagacaaaaatcacatttta

SEQ ID NO: 28342 - DNA, 71 bp, chicken (Gallus Gallus)
  misc_feature (36): n=c or t
ctcgtcttaatgagagacaagtacactagaaaatantgcctgctaacagtattcataagctgctcccaaga

SEQ ID NO: 28343 - DNA, 71 bp, chicken (Gallus Gallus)
  misc_feature (36): n=c or t
tgactgaattcttgcctctaaaagctatcatattantgtaatattgccaccatgcaggcagacttttggca

SEQ ID NO: 28344 - DNA, 71 bp, chicken (Gallus Gallus)
  misc_feature (36): n=a or g
cgatgagtcattgacagggcaatgcttggctgtgtntgcaacaagaagctgcgttttccccagccttccag

SEQ ID NO: 28345 - DNA, 71 bp, chicken (Gallus Gallus)
  misc_feature (36): n=a or g
gatggtgggcaaaattcagcagtcctggagttctcnaagagcaattgcttcaggattgactctcagtttgt

SEQ ID NO: 28346 - DNA, 71 bp, chicken (Gallus Gallus)
  misc_feature (36): n=c or t
acacaatattttcttagtctcactgtctggaacagnctacgtttctctgccttcaaacttatgtctcttga

SEQ ID NO: 28347 - DNA, 71 bp, chicken (Gallus Gallus)
  misc_feature (36): n=c or t
tagaaaagatggcagctctgtatctcagaaatgtcngcattcagatagatacttgttccagttctaccatc

SEQ ID NO: 28348 - DNA, 71 bp, chicken (Gallus Gallus)
  misc_feature (36): n=a or g
tggtgcatgaactcagcttgtaaatacatgtgaggncaagtagagcttgccatgttttaataatgagaatg

SEQ ID NO: 28349 - DNA, 71 bp, chicken (Gallus Gallus)
  misc_feature (36): n=a or t
taaatagcaggtgtagactgcagagtgaaaggacanaggaccattcccatctcctaagccattcccatatg

SEQ ID NO: 28350 - DNA, 71 bp, chicken (Gallus Gallus)
  misc_feature (36): n=a or g
tgtcactcattgacagatgatgatgtctttatatcngggctatgatttgtagtactgatctattcatgttc

SEQ ID NO: 28351 - DNA, 71 bp, chicken (Gallus Gallus)
  misc_feature (36): n=c or t
aatgcaatcagtcatcaaagccaacttaagtgctgngagaagggatgaaaacatctccctaaatataattt

SEQ ID NO: 28352 - DNA, 71 bp, chicken (Gallus Gallus)
  misc_feature (36): n=c or g
taaaatctggaagtgtatgaacaaaaatttattaantgcacatacacataattttttgtatttacaccaca

SEQ ID NO: 28353 - DNA, 71 bp, chicken (Gallus Gallus)
  misc_feature (36): n=c or t
ctgtgcattggattttggttgaggggaagggtgttnggttttactgcagataaaagtgaagtacaacactg

SEQ ID NO: 28354 - DNA, 71 bp, chicken (Gallus Gallus)
  misc_feature (36): n=c or t
ttactttaagaagaaaacaactgtatattgttgagnaacagtcagcacctgcataaacactgaaaactgca

SEQ ID NO: 28355 - DNA, 71 bp, chicken (Gallus Gallus)
  misc_feature (36): n=a or t
ttcccttcccttattcacagtaaagcttgaatctanctcgcattctcacactgtaaaaacgggtcccaagt

SEQ ID NO: 28356 - DNA, 71 bp, chicken (Gallus Gallus)
  misc_feature (36): n=c or g
agcacagcacaacactcagtgttacagcatgcagtntcacacatgtatatggtggcaccagtccttgagca

SEQ ID NO: 28357 - DNA, 71 bp, chicken (Gallus Gallus)
  misc_feature (36): n=c or t
gactgccaccacctctgacagctaaagaatttgagntccatttcctacttattaacatttccaaataagca

SEQ ID NO: 28358 - DNA, 71 bp, chicken (Gallus Gallus)
  misc_feature (36): n=c or t
atttctttaccatttgtgttctaacctattgtttangttctaatttctactaagcatttcaaaacatttta

SEQ ID NO: 28359 - DNA, 71 bp, chicken (Gallus Gallus)
  misc_feature (36): n=a or c
ataatttaacttattttaggaattaaaacagccacntgctacaatttaaaggcgttcttgcaaaatggaaa

SEQ ID NO: 28360 - DNA, 71 bp, chicken (Gallus Gallus)
  misc_feature (36): n=a or g
tctaaataggaacttggagagaagacttttgcaaanaaatctctttaacctagctgagagaagcacagcat

SEQ ID NO: 28361 - DNA, 71 bp, chicken (Gallus Gallus)
  misc_feature (36): n=c or t
tatgtctttacagatttgaatcagttttgattttcngaaacaaagttgagaggtgacgtttcatatactgg

SEQ ID NO: 28362 - DNA, 71 bp, chicken (Gallus Gallus)
  misc_feature (36): n=c or t
tgtattcacacactcactatgtaatctagggccaanaattgtttcttgaatacacagaacaaaacaacaac

SEQ ID NO: 28363 - DNA, 71 bp, chicken (Gallus Gallus)
  misc_feature (36): n=c or t
attgaaaagtgtcaatctagaaagtagcataatctntccatgccttgctcacgtccagtgtgtgtatccaa

SEQ ID NO: 28364 - DNA, 71 bp, chicken (Gallus Gallus)
  misc_feature (36): n=a or c
agaaaacaaagctcccaatagtgagaactacccagnggtatagagcttagtggagaactttaatgtcctca

SEQ ID NO: 28365 - DNA, 71 bp, chicken (Gallus Gallus)
  misc_feature (36): n=g or t
ccttgcacagtggcaatttatgaaaacctcatatcnatttttcaatttcaaatgggttttcctgcatgttt

SEQ ID NO: 28366 - DNA, 71 bp, chicken (Gallus Gallus)
  misc_feature (36): n=c or t
ggtaagagaactagcacagcagcctgtgcacattantgattatcagtcaggaacactttggaggtaagtga

SEQ ID NO: 28367 - DNA, 71 bp, chicken (Gallus Gallus)
  misc_feature (36): n=c or g
ttccccacaaaaagcataaagaacatgcacaagggncttctgatacacattgcatcactacagtaataaaa

SEQ ID NO: 28368 - DNA, 71 bp, chicken (Gallus Gallus)
  misc_feature (36): n=a or g
caggaccaacttcaaagttacaaacaaatccaaaantaaagcatgctctagaggagctgttaggtcacagc

SEQ ID NO: 28369 - DNA, 71 bp, chicken (Gallus Gallus)
  misc_feature (36): n=c or t
tctacactccaactaattcccaaagcagacctaagnttgtaggtcttgtccaggatccctcacccacaccc

SEQ ID NO: 28370 - DNA, 71 bp, chicken (Gallus Gallus)
  misc_feature (36): n=c or t
aatgaaacagtaagcatcactttcagagcatccctngtagatattaaattctaaacttgttctcatgtagc

SEQ ID NO: 28371 - DNA, 71 bp, chicken (Gallus Gallus)
  misc_feature (36): n=a or g
tgcatgtttgtagaatcgagaccttaattagctctnggttaatttcccttcttcctaattaaaaacacaga

SEQ ID NO: 28372 - DNA, 71 bp, chicken (Gallus Gallus)
  misc_feature (36): n=c or t
actgtaaacatcactctctagagtgaatgaaaacangttaagcaggaaaaatagggagattcacttcagaa

SEQ ID NO: 28373 - DNA, 71 bp, chicken (Gallus Gallus)
  misc_feature (36): n=c or t
tgcctctacgccatgaaaaagtcctgcctcctaccntcctggagtgcagaggaatgtcatagctttctttc

SEQ ID NO: 28374 - DNA, 71 bp, chicken (Gallus Gallus)
  misc_feature (36): n=g or t
agagtctaagtcacactagcaaagccctacagcttntcacataacttagaccaggaggggagatgcacatg

SEQ ID NO: 28375 - DNA, 71 bp, chicken (Gallus Gallus)
  misc_feature (36): n=a or t
gaataaatctaattgttgccttctcaatgaaataanatcaactctaaaatttttttgcagtacttttttta

SEQ ID NO: 28376 - DNA, 71 bp, chicken (Gallus Gallus)
  misc_feature (36): n=c or g
ttatcagtgtgagcaatatgagtggagtgacaggantgattctcctatttacagtcctgagctgtaattca

SEQ ID NO: 28377 - DNA, 71 bp, chicken (Gallus Gallus)
  misc_feature (36): n=c or g
aagcagcttagcttttcttttggtttaactgcacantggcaagttaagacagggtgggtggttttgctttt

SEQ ID NO: 28378 - DNA, 71 bp, chicken (Gallus Gallus)
  misc_feature (36): n=a or g
aagctacaggccaagtgacaagtatctactgctacngaatggtgaatctgtgaaattttgatggctgttca

SEQ ID NO: 28379 - DNA, 71 bp, chicken (Gallus Gallus)
  misc_feature (36): n=a or g
ataaatcacagcttcaggagctggagacaatctacngacttcctagggagccagtaaaaccttgagctgca

SEQ ID NO: 28380 - DNA, 71 bp, chicken (Gallus Gallus)
  misc_feature (36): n=c or t
gaccataaggtttaccaaatttagctgtttagtgantgtccgtatggaaaaggtcagtcatatagaagatg

SEQ ID NO: 28381 - DNA, 71 bp, chicken (Gallus Gallus)
  misc_feature (36): n=a or g
ttttaaaatgtggaaaagtgtttttcttcctgagcnttgctgtcactcggtgtgtgaacgataagctgcag

SEQ ID NO: 28382 - DNA, 71 bp, chicken (Gallus Gallus)
  misc_feature (36): n=a or t
acagtaacaggattacctcaatggcacgtgataccntatagtaacagtactaaaacttttgtgctctgtcc

SEQ ID NO: 28383 - DNA, 71 bp, chicken (Gallus Gallus)
  misc_feature (36): n=a or g
caccacttcaaaatgagctgaactcccttccattcntcatctctgcctcatccccagattgctctctactc

SEQ ID NO: 28384 - DNA, 71 bp, chicken (Gallus Gallus)
  misc_feature (36): n=g or t
aggttagatttattatgtaaaaagttcgctaccaanaacctcttaaattcaggagtatccacaaatacaac

SEQ ID NO: 28385 - DNA, 71 bp, chicken (Gallus Gallus)
  misc_feature (36): n=a or c
ggcaggaaggcagagggcctgatgctgagctacagnactccttcctgcaaaccagtatcttgcttctctgg

SEQ ID NO: 28386 - DNA, 71 bp, chicken (Gallus Gallus)
  misc_feature (36): n=c or t
agaatcagtggagagtatgcctggttgggcaagccnttggctgggtgctctaaaaatatttatatatttat

SEQ ID NO: 28387 - DNA, 71 bp, chicken (Gallus Gallus)
  misc_feature (36): n=a or t
acgcttttaaaaatgtgaagtatatgcattgcactnattgcatggctacctaatctgttatttggtgatgc

SEQ ID NO: 28388 - DNA, 71 bp, chicken (Gallus Gallus)
  misc_feature (36): n=c or t
agggattgaattgcagctggatgttgttgaaactgnacgagctctcttcttgacgttttttatattccagc

SEQ ID NO: 28389 - DNA, 71 bp, chicken (Gallus Gallus)
  misc_feature (36): n=a or g
ttatgcatggaaatcaaggagtcccaactggtgagntattcccactgatgcactgtcgtagtagcagtcag

SEQ ID NO: 28390 - DNA, 71 bp, chicken (Gallus Gallus)
  misc_feature (36): n=c or t
tccctaccacagctggcagcacttaaaagcatgaanttccctggagttgagtgctcctctcatctgtgggg

SEQ ID NO: 28391 - DNA, 71 bp, chicken (Gallus Gallus)
  misc_feature (36): n=c or t
aacgcacaaatgcacattttgatcaagggcttgcantggaaaggtcagaagaagtcacatcaaaagagcct

SEQ ID NO: 28392 - DNA, 71 bp, chicken (Gallus Gallus)
  misc_feature (36): n=a or t
tggtccaagagatctgaattcttttcattatatccnttagggagaatgaggtaaaacaaagatcaagggca

SEQ ID NO: 28393 - DNA, 71 bp, chicken (Gallus Gallus)
  misc_feature (36): n=a or c
gtgttgtgaatgtcaaacactatgtgaaatgttccnatttgttcttcatttctgtagattgagaagtttta

SEQ ID NO: 28394 - DNA, 71 bp, chicken (Gallus Gallus)
  misc_feature (36): n=a or g
gcatataataataaagtaaaattctttaggacaccnagtaatgaccttaactgcaagtctgaattctgatt

SEQ ID NO: 28395 - DNA, 71 bp, chicken (Gallus Gallus)
  misc_feature (36): n=c or t
aatttccctgctaatcccatagtctcaataagatgnggcaaggaattccacagactgaaatactcagaaag

SEQ ID NO: 28396 - DNA, 71 bp, chicken (Gallus Gallus)
  misc_feature (36): n=c or t
agtggagtgaaggggatgtaaaaatatccatttcancattatgggagctatcctttacaagaaaataaaaa

SEQ ID NO: 28397 - DNA, 71 bp, chicken (Gallus Gallus)
  misc_feature (36): n=a or g
gatggaagagatttgctcagccttttctcagaggtngaacagtatcacagacgcgagaactgcactggtgg

SEQ ID NO: 28398 - DNA, 71 bp, chicken (Gallus Gallus)
  misc_feature (36): n=g or t
tcatcccacctaaacaactctgcatcaaagttctanaagcatgtgctagaaaattacattgtttacctttt

SEQ ID NO: 28399 - DNA, 71 bp, chicken (Gallus Gallus)
  misc_feature (36): n=c or g
agctcctagctgcaatagcctgaaatagctttaatncagtgtgtcgcctttgtatggctgaaagctactgg

SEQ ID NO: 28400 - DNA, 71 bp, chicken (Gallus Gallus)
  misc_feature (36): n=c or t
acagcctatttattcattgcagtttaaattcatcangaagagggagaactatccagaagactgagtacttc

SEQ ID NO: 28401 - DNA, 71 bp, chicken (Gallus Gallus)
  misc_feature (36): n=c or g
acttgagtgaataattgaaagaacaggtttgtgcanttgctttcagttttatgtgtttttctattttaaaa

SEQ ID NO: 28402 - DNA, 71 bp, chicken (Gallus Gallus)
  misc_feature (36): n=c or t
ccagctccactaaagcatagtttgtatttgcttttngtagtaatgtttttgaattgcatttcttccaaaag

SEQ ID NO: 28403 - DNA, 71 bp, chicken (Gallus Gallus)
  misc_feature (36): n=a or g
aggtacttacacaaagtggaagaaagttactgaacnttgttgcacactgatcagccttatctgagttcaca

SEQ ID NO: 28404 - DNA, 71 bp, chicken (Gallus Gallus)
  misc_feature (36): n=c or t
cccagagtgagggatcactcaaacaacagctttcangctttcctttgtcttccttttcttgacttaagcct

SEQ ID NO: 28405 - DNA, 71 bp, chicken (Gallus Gallus)
  misc_feature (36): n=c or t
atggagtaacatctggttaaaacagaaaatagaagngctaggatgtgggtcaaatactactctgcaaaaat

SEQ ID NO: 28406 - DNA, 71 bp, chicken (Gallus Gallus)
  misc_feature (36): n=c or t
ttggccggggaggtatatctgctactaagtgctccngcttacctggagaagtgtgatgggtgggggtctgg

SEQ ID NO: 28407 - DNA, 71 bp, chicken (Gallus Gallus)
  misc_feature (36): n=a or g
agttcatattttagaagtcacagagagccaacaccnaatgctagaattacacaagcgtatatgttttctgg

SEQ ID NO: 28408 - DNA, 71 bp, chicken (Gallus Gallus)
  misc_feature (36): n=c or t
gacagaagtaccttttttctcccacttgttttccancagcacaatgccagccctttgcagctccatcctgc

SEQ ID NO: 28409 - DNA, 71 bp, chicken (Gallus Gallus)
  misc_feature (36): n=a or g
acagaatataaatacgttacagtattggtgcttacntgctcagcagttggtgagctacaaatctaaaatct

SEQ ID NO: 28410 - DNA, 71 bp, chicken (Gallus Gallus)
  misc_feature (36): n=c or t
ttttttttttgacttctgcttcctcacttgttcttncatttactgtgattctaaagcaaggagaggcaggt

SEQ ID NO: 28411 - DNA, 71 bp, chicken (Gallus Gallus)
  misc_feature (36): n=a or g
cgcttgcctattggaccaataattagaaaaataacntattacctatctgtcttgcttgcatacatctttcc

SEQ ID NO: 28412 - DNA, 71 bp, chicken (Gallus Gallus)
  misc_feature (36): n=a or t
acggctgtgctacacttgaaggataaaggatttatntgctctgctgcaggcatgccattgctgtggttcct

SEQ ID NO: 28413 - DNA, 71 bp, chicken (Gallus Gallus)
  misc_feature (36): n=c or t
aagatgtatgattctccttccaactttcaggtattntagatagcacattcaatgcaaaacaaatatgaaaa

SEQ ID NO: 28414 - DNA, 71 bp, chicken (Gallus Gallus)
  misc_feature (36): n=a or g
aggagaatggctctgcctcaaaaattccaacaaaantgcacatattttttttatttaatctgagggttctt

SEQ ID NO: 28415 - DNA, 71 bp, chicken (Gallus Gallus)
  misc_feature (36): n=c or g
agtattttagctaaaaaatttttactaaaaacatangattttcatatctttaaaagtattcttgtatatag

SEQ ID NO: 28416 - DNA, 71 bp, chicken (Gallus Gallus)
  misc_feature (36): n=c or t
aaaaagaaagcctaaaatttaagatcaacttgtagnctagacaactttcagatgctgcatacgtgcttaag

SEQ ID NO: 28417 - DNA, 71 bp, chicken (Gallus Gallus)
  misc_feature (36): n=c or t
actggttaccatttgccctcaaaaaatcaagcatanataaaatcagcatataattggatattgccatggtg

SEQ ID NO: 28418 - DNA, 71 bp, chicken (Gallus Gallus)
  misc_feature (36): n=a or g
caagccacctgttactgttgtacttccttttaaatnttgttctttacttttgcaaagtgtgctggttatgt

SEQ ID NO: 28419 - DNA, 71 bp, chicken (Gallus Gallus)
  misc_feature (36): n=a or g
gaagcgatgaaagattcttctttttacaacaaaaanatcaccctgtaaaggagagcaaagctgaggacctg

SEQ ID NO: 28420 - DNA, 71 bp, chicken (Gallus Gallus)
  misc_feature (36): n=a or g
tggtgaaatgctgagagatggagtactgtatagtgnagaccagactgtgaatcactcacggaaagaagcat

SEQ ID NO: 28421 - DNA, 71 bp, chicken (Gallus Gallus)
  misc_feature (36): n=a or c
cagtactccgagaagtgtgctttgactgtaatgacncaagagtcttctgagctctttgtgctgctctttca

SEQ ID NO: 28422 - DNA, 71 bp, chicken (Gallus Gallus)
  misc_feature (36): n=c or t
gtaggatagtacttttcatatagaccatcattaatnattttttgttttcactgctcagaagtactgaaaag

SEQ ID NO: 28423 - DNA, 71 bp, chicken (Gallus Gallus)
  misc_feature (36): n=a or c
taactgacacactcatcataactactcaaataaagnagcgtggggaggtagcatcaagcatgctctggagg

SEQ ID NO: 28424 - DNA, 71 bp, chicken (Gallus Gallus)
  misc_feature (36): n=a or g
gacccagttacaaaataaggatccaaaggaatttcngagaacaaatatctggattttaagagagcatttgg

SEQ ID NO: 28425 - DNA, 71 bp, chicken (Gallus Gallus)
  misc_feature (36): n=c or g
ttgttttcactgctacagccacagcttgcttgctgntgttcagacctggcacccattgatctaaatgggaa

SEQ ID NO: 28426 - DNA, 71 bp, chicken (Gallus Gallus)
  misc_feature (36): n=c or t
tacagtttgggatcaaaccctcacagacacctatgngcctctttttctctgattcagtaatctgcaatctg

SEQ ID NO: 28427 - DNA, 71 bp, chicken (Gallus Gallus)
  misc_feature (36): n=c or t
tattgtggtgcctaatagggataaggttccagaganctcaaagaaagaaacagagtggtgaacatgtgaga

SEQ ID NO: 28428 - DNA, 71 bp, chicken (Gallus Gallus)
  misc_feature (36): n=a or t
acatccaacatttaaaactggtaattcagggcatangaacacaggtctagctagaagtggcctaaatgcac

SEQ ID NO: 28429 - DNA, 71 bp, chicken (Gallus Gallus)
  misc_feature (36): n=a or g
cctcacttttcctgtaagtggaggacctacggaaanctcactgcaacagcaattgctacctgcacagcact

SEQ ID NO: 28430 - DNA, 71 bp, chicken (Gallus Gallus)
  misc_feature (36): n=a or g
gttcattactcctgttgtgtgacttggctgcctaantttctgctatttgatttttaaacagcagaataaca

SEQ ID NO: 28431 - DNA, 71 bp, chicken (Gallus Gallus)
  misc_feature (36): n=a or g
ataataattaaatttcactcctgcctgactgggcanacaggacaaaggcactgcccagagcatcactgtca

SEQ ID NO: 28432 - DNA, 71 bp, chicken (Gallus Gallus)
  misc_feature (36): n=g or t
caggcttctctgtgcctcttccttgtctctcagatnaagagttgtaaattccaaagatattcctaaattat

SEQ ID NO: 28433 - DNA, 71 bp, chicken (Gallus Gallus)
  misc_feature (36): n=a or g
tagtctttcaaatttagaaatagttgaaaggtactnaaatataacccacaacataatatcattgtttgttt

SEQ ID NO: 28434 - DNA, 71 bp, chicken (Gallus Gallus)
  misc_feature (36): n=a or t
cagccctgttgaaaagaacttgggggtactgatggntggcaaacatgacatgagccatcagtatgcaatcg

SEQ ID NO: 28435 - DNA, 71 bp, chicken (Gallus Gallus)
  misc_feature (36): n=c or t
cccagctatgtaatgcaggagactctaagatgtaangtactgaaccacgtttcgttttggtttgttttatt

SEQ ID NO: 28436 - DNA, 71 bp, chicken (Gallus Gallus)
  misc_feature (36): n=c or g
gttgagaagaagtagtgtggaccctttctaaataantgggcagtcctacagctaagatctcgagaggtcgg

SEQ ID NO: 28437 - DNA, 71 bp, chicken (Gallus Gallus)
  misc_feature (36): n=c or t
aattcatgtcttgattcttaacttacgcaggtcctngaccaagctaaaaagccaatggtggtggtaggaag

SEQ ID NO: 28438 - DNA, 71 bp, chicken (Gallus Gallus)
  misc_feature (36): n=c or t
tttcccagaaggagctgaggaagaaaggaacaactngttcctactttggcattgccacgccagcaagctcc

SEQ ID NO: 28439 - DNA, 71 bp, chicken (Gallus Gallus)
  misc_feature (36): n=a or c
aacaaagcactccagcagccttacaatcgtatctantgcagacagttataaaatgcatcagatctgcatat

SEQ ID NO: 28440 - DNA, 71 bp, chicken (Gallus Gallus)
  misc_feature (36): n=a or t
tttagaacaacctgaaaccttttgccttaaaatggntaacagtctgtgacatataagcatgtcacaaatgt

SEQ ID NO: 28441 - DNA, 71 bp, chicken (Gallus Gallus)
  misc_feature (36): n=a or g
gagacgttactctaaaggaaaaagtgtgatactggnatacatatgcacattctgtcatgcattttccccat

SEQ ID NO: 28442 - DNA, 71 bp, chicken (Gallus Gallus)
  misc_feature (36): n=a or g
gaccaaagaaggccaaccactggagagtatgatgtntttctccctccacagctggagttatgagaatttag

SEQ ID NO: 28443 - DNA, 71 bp, chicken (Gallus Gallus)
  misc_feature (36): n=a or c
aaagttggggaagcagggaaggagaaaaatacctcngttgtttttcctttttagagttctgaaaattaaaa

SEQ ID NO: 28444 - DNA, 71 bp, chicken (Gallus Gallus)
  misc_feature (36): n=a or g
gtggaaataaactggcagtcatttggttttgctggngaaaatgaacagggagttgagcatctgttccagca

SEQ ID NO: 28445 - DNA, 71 bp, chicken (Gallus Gallus)
  misc_feature (36): n=c or t
atgcagtgtgaccacatagtccagcagatcggaaangcctttttcattctgttcctccgcaagtggccagt

SEQ ID NO: 28446 - DNA, 71 bp, chicken (Gallus Gallus)
  misc_feature (36): n=c or t
ctcactttctaatgaagggaaagttggatgttatanggtgggtcatcctttgcttcccagtagctgtgatc

SEQ ID NO: 28447 - DNA, 71 bp, chicken (Gallus Gallus)
  misc_feature (36): n=a or g
tcagagtgttttgtgtgtgtggttagcagcacagcnttgcacttctggtatgtaatggaaacattgagatg

SEQ ID NO: 28448 - DNA, 71 bp, chicken (Gallus Gallus)
  misc_feature (36): n=c or t
gtaccatatctccatgcttagggatggtactccatnacctccctgggcagcctgtgccactgcctcactac

SEQ ID NO: 28449 - DNA, 71 bp, chicken (Gallus Gallus)
  misc_feature (36): n=c or g
ggaggtgaaaacctgcgctcaactctgtctttatcncatcactcatttcctcaagtctttaagtaaaatta

SEQ ID NO: 28450 - DNA, 71 bp, chicken (Gallus Gallus)
  misc_feature (36): n=g or t
ttattgtaaaagtctgttatgcttaatgtttcttantttaataataactttactctaataactctaataat

SEQ ID NO: 28451 - DNA, 71 bp, chicken (Gallus Gallus)
  misc_feature (36): n=a or c
gatttatcttcacagtagtgattatcacatctgtantgcatagtgaccactggaagattttttaagtgctg

SEQ ID NO: 28452 - DNA, 71 bp, chicken (Gallus Gallus)
  misc_feature (36): n=c or t
ctcaatgtttagttctcatccttaaagcacttacantgcgtgatttaaaaggaaaacagctcctgctctac

SEQ ID NO: 28453 - DNA, 71 bp, chicken (Gallus Gallus)
  misc_feature (36): n=c or t
agagtttttctagcatttccataagtgctgtcttangatggttgtttctggtggcggtgtatgaatgctta

SEQ ID NO: 28454 - DNA, 71 bp, chicken (Gallus Gallus)
  misc_feature (36): n=c or t
gaagctagtaattatcttgttcagtaatttttgttnataatatgatcgtggagtggatcaacattctcacc

SEQ ID NO: 28455 - DNA, 71 bp, chicken (Gallus Gallus)
  misc_feature (36): n=c or t
ttaaagagagaatgatttgtaggaatcgtggaacangagtaaaatattttatcttcttattactgacaggt

SEQ ID NO: 28456 - DNA, 71 bp, chicken (Gallus Gallus)
  misc_feature (36): n=c or t
gtgtcctaggacaacagcactacatccctatctgangcacagtatgttggaatcccaccttgttaatgaag

SEQ ID NO: 28457 - DNA, 71 bp, chicken (Gallus Gallus)
  misc_feature (36): n=c or g
cattattattgtaattaaatccagattcattgtctnagagctcctcttcctccttcttctcttcctcccct

SEQ ID NO: 28458 - DNA, 71 bp, chicken (Gallus Gallus)
  misc_feature (36): n=a or t
tcccactcattattttattgcagcctcacaaaaacnatggaagaattttctttgatgggcaatgtcactca

SEQ ID NO: 28459 - DNA, 71 bp, chicken (Gallus Gallus)
  misc_feature (36): n=a or g
gtaaggctaatggtttttaaagctaagaattagganattttgattcagtttgagcagtcgtgctgttactt

SEQ ID NO: 28460 - DNA, 71 bp, chicken (Gallus Gallus)
  misc_feature (36): n=a or g
tgagaactaatcgcctctctgaacctcacactgggncttcagattgacaggtacttttccatttactgaag

SEQ ID NO: 28461 - DNA, 71 bp, chicken (Gallus Gallus)
  misc_feature (36): n=g or t
gacatatatgagagactttcttcagcactggccccnagtatctatgagcatgaagatatcaaaaaggtaaa

SEQ ID NO: 28462 - DNA, 71 bp, chicken (Gallus Gallus)
  misc_feature (36): n=c or t
attacattatgatcttcattaattacaagctgattngtaatttcatgaataagttctgaatgaggatgaaa

SEQ ID NO: 28463 - DNA, 71 bp, chicken (Gallus Gallus)
  misc_feature (36): n=c or t
caggatctggatcctaaacgtttgcatgagcagtcntttcaactgatcaggtaaaaccagttagtagacaa

SEQ ID NO: 28464 - DNA, 71 bp, chicken (Gallus Gallus)
  misc_feature (36): n=a or g
tggccacttgtgtatcaatcaatgctgttgtttctnttcatataatctttagatggtgtgcagatgaacta

SEQ ID NO: 28465 - DNA, 71 bp, chicken (Gallus Gallus)
  misc_feature (36): n=a or g
ctgagtgctgtgaacctgacatactttgggacctgntgcttctcctcatttctgtgaaaccttgtaagtct

SEQ ID NO: 28466 - DNA, 71 bp, chicken (Gallus Gallus)
  misc_feature (36): n=c or t
atactcttttttattttctctctctccactcttagngtttcagaatggtgctcccattctgaaaaaatgaa

SEQ ID NO: 28467 - DNA, 71 bp, chicken (Gallus Gallus)
  misc_feature (36): n=a or c
tctatgattctatgaatgatctgtgttaaattttcntatatggaagtatatgcatgtctggatgtgggtgt

SEQ ID NO: 28468 - DNA, 71 bp, chicken (Gallus Gallus)
  misc_feature (36): n=c or t
agtatagtttagtgaatgttaaattgttgtgtactngtgttaagataaagtacaaatgacgttagttgtca

SEQ ID NO: 28469 - DNA, 71 bp, chicken (Gallus Gallus)
  misc_feature (36): n=c or t
agatcatttttaagatatctattaagatcatagatngtctattaagatctattaaaaaaaaaaaaaaagtg

SEQ ID NO: 28470 - DNA, 71 bp, chicken (Gallus Gallus)
  misc_feature (36): n=g or t
tgctcttcagtagtgagaatactttgtaaagaaaanatgggaaccaaacctatttctttattttttatact

SEQ ID NO: 28471 - DNA, 71 bp, chicken (Gallus Gallus)
  misc_feature (36): n=c or t
ataagcagctacaatacatataagccaaataattanatttatcatcaattattattgaaaatttagctatt

SEQ ID NO: 28472 - DNA, 71 bp, chicken (Gallus Gallus)
  misc_feature (36): n=c or t
ttgtttgaggccatgtgctaatctgattgaaagcanattcaggagtctgcatgatttgtgcagagcagact

SEQ ID NO: 28473 - DNA, 71 bp, chicken (Gallus Gallus)
  misc_feature (36): n=a or c
aatacatcgcgagagggatgagctgcagctactaanttaataaaaaatgttctgcaaaacacattacatag

SEQ ID NO: 28474 - DNA, 71 bp, chicken (Gallus Gallus)
  misc_feature (36): n=c or g
ccctctgatgctatttcatcaaatctcacacaaggnaagatcatccttctgcactccctcagatgcagaaa

SEQ ID NO: 28475 - DNA, 71 bp, chicken (Gallus Gallus)
  misc_feature (36): n=a or g
aagccattttccctagtcctatcacaatatgccccnctaatgagtctgttcctttcctttagatactgaaa

SEQ ID NO: 28476 - DNA, 71 bp, chicken (Gallus Gallus)
  misc_feature (36): n=a or g
aattgttttcccttaaataaaatgatgaacaaaacnaaaaccttgttttctgtctctactgtcagatatca

SEQ ID NO: 28477 - DNA, 71 bp, chicken (Gallus Gallus)
  misc_feature (36): n=c or t
ttgaagttaccagtaaacttactgcatcactgttangaagggcagcagcaagaggtggaggacgtaacttt

SEQ ID NO: 28478 - DNA, 71 bp, chicken (Gallus Gallus)
  misc_feature (36): n=a or g
ctccagacaggtatgtgtttaccctttgttttctcngggcatctgccagatcactgttcagatgagcaata

SEQ ID NO: 28479 - DNA, 71 bp, chicken (Gallus Gallus)
  misc_feature (36): n=c or t
atggaaaaactaatttgccaaaccctccaatctgtnggtatgtgttgaaataccatactgcacaagcaaac

SEQ ID NO: 28480 - DNA, 71 bp, chicken (Gallus Gallus)
  misc_feature (36): n=a or g
actgaacccaggtagattcagcctaacatctgatcntcatttcgtcctctcattgaaaccagttctgtggc

SEQ ID NO: 28481 - DNA, 71 bp, chicken (Gallus Gallus)
  misc_feature (36): n=c or t
ttcaaagcaaagtggtggcaaaatgcatgcagtcantgtagttcccaccatggtatttctctaaacattag

SEQ ID NO: 28482 - DNA, 71 bp, chicken (Gallus Gallus)
  misc_feature (36): n=a or g
cttaatcattattaaaatgaatgtcacagtcctagngcagtacatacaaatagaataacacatcttagggt

SEQ ID NO: 28483 - DNA, 71 bp, chicken (Gallus Gallus)
  misc_feature (36): n=c or t
tgtatgtacctcatggaggaaacctctcgtgacttncatgagtccacatcatttggatgacccacagaaag

SEQ ID NO: 28484 - DNA, 71 bp, chicken (Gallus Gallus)
  misc_feature (36): n=c or t
atccacctgaaatcttttgccagttcctgggtaaantcaatttcactatttttctcctctgaatcacagtt

SEQ ID NO: 28485 - DNA, 71 bp, chicken (Gallus Gallus)
  misc_feature (36): n=a or g
caccactactgtgagtttgaggaaatttagcttcantgaagtatttttaatgccaatcacgtctttcattc

SEQ ID NO: 28486 - DNA, 71 bp, chicken (Gallus Gallus)
  misc_feature (36): n=c or t
tgcagtggatcagggtctaacccccttgttaacctnccagccaagacctttacttcatatcttttgtagca

SEQ ID NO: 28487 - DNA, 71 bp, chicken (Gallus Gallus)
  misc_feature (36): n=c or t
ctataattcctttgctcagtgtacgatccctctcanggtatgctgcccttcctaactgattccacatcagc

SEQ ID NO: 28488 - DNA, 71 bp, chicken (Gallus Gallus)
  misc_feature (36): n=a or g
gcaacttcctagtcatgtgtgcccaattctaaaggnaaaacttgaagctattcaaacataagctcattctg

SEQ ID NO: 28489 - DNA, 71 bp, chicken (Gallus Gallus)
  misc_feature (36): n=a or g
cattgacaatgaggacatgtaactttgccacttggngtgctacgagaagtgttttggagccagctcaaaac

SEQ ID NO: 28490 - DNA, 71 bp, chicken (Gallus Gallus)
  misc_feature (36): n=a or c
catagatggcatctattaagagctctaaagttgatncttcttaaaaatatggaacatctttactataacag

SEQ ID NO: 28491 - DNA, 71 bp, chicken (Gallus Gallus)
  misc_feature (36): n=a or g
caaaaagcaattgttctctgatggataaaacttaanatattctctggtaaggaaatgaaatactcttttag

SEQ ID NO: 28492 - DNA, 71 bp, chicken (Gallus Gallus)
  misc_feature (36): n=a or g
tacgccacaccacagagacttgcaggagtgaacatnccctgcactcacgtcatttcttggtgctttctaag

SEQ ID NO: 28493 - DNA, 71 bp, chicken (Gallus Gallus)
  misc_feature (36): n=a or g
tcctttagcagtgagcaatacaaaatctaagctacncagtgcccacaaaaaagccacaatttgaccctcag

SEQ ID NO: 28494 - DNA, 71 bp, chicken (Gallus Gallus)
  misc_feature (36): n=c or t
tctctgctaagcctaccaaagacgcttctagactangaactacatatttctacttcccagggaaactgcat

SEQ ID NO: 28495 - DNA, 71 bp, chicken (Gallus Gallus)
  misc_feature (36): n=a or t
gctgttaggaccacttctccttccactcatggtcangtggagcacctgcaccctcatctgcaattacttaa

SEQ ID NO: 28496 - DNA, 71 bp, chicken (Gallus Gallus)
  misc_feature (36): n=a or g
aaactgtctacagtttgtttgttttttaactcacanggaaatgtgccaccttccaaaaagaagtggtgttt

SEQ ID NO: 28497 - DNA, 71 bp, chicken (Gallus Gallus)
  misc_feature (36): n=c or t
tatattttttctgatctttgaagggctgccaaagcnagcaaagttgaattcatttgggacgaaggagatgc

SEQ ID NO: 28498 - DNA, 71 bp, chicken (Gallus Gallus)
  misc_feature (36): n=a or c
acagggagctgaaatctgtaacttcctctcctcctngccagcagccaaagctagagccccttcccaccctt

SEQ ID NO: 28499 - DNA, 71 bp, chicken (Gallus Gallus)
  misc_feature (36): n=c or t
tagctgcagcttgctaacagcagtgactatgtaaanaggcttcacctggcgctgtgtttcagggcatcgtt

SEQ ID NO: 28500 - DNA, 71 bp, chicken (Gallus Gallus)
  misc_feature (36): n=a or c
accagcattaagtcaacagattgtatttgctcagangcaacaacccgtgagtcagagcacagctcctaatg

SEQ ID NO: 28501 - DNA, 71 bp, chicken (Gallus Gallus)
  misc_feature (36): n=g or t
acagatgcagcaaactaacatataggcagtgtgaanaaacaggagacctgaaaacaaatttgagagctact

SEQ ID NO: 28502 - DNA, 71 bp, chicken (Gallus Gallus)
  misc_feature (36): n=c or t
agtttttatttgaagagctatttgcaaaatgcaagnttcaaggactagcaaatcaataaacccataaagtc

SEQ ID NO: 28503 - DNA, 71 bp, chicken (Gallus Gallus)
  misc_feature (36): n=c or t
tgtttcagtggaaaggatgagggctgaaacctactnttctgacatggaaatgtgttgaaatgcattattgg

SEQ ID NO: 28504 - DNA, 71 bp, chicken (Gallus Gallus)
  misc_feature (36): n=g or t
cctcagctgttgatggctgtgtggtcggtggcaacncttctgctcagctgcagtttagaaacgaatttaga

SEQ ID NO: 28505 - DNA, 71 bp, chicken (Gallus Gallus)
  misc_feature (36): n=c or g
gcagcatacagtaagacaaaacctcattacataacntcaagagttcattgcttaccttgagaaacagacac

SEQ ID NO: 28506 - DNA, 71 bp, chicken (Gallus Gallus)
  misc_feature (36): n=a or g
tctccttggagtccatgtacaagtcattgcctacantcaccccaggatctccagcccctgctgatggaagg

SEQ ID NO: 28507 - DNA, 71 bp, chicken (Gallus Gallus)
  misc_feature (36): n=a or t
atctgtgatatgcaaagggaactcagttatgcttanagttaccaagaataataacttttggccacagggag

SEQ ID NO: 28508 - DNA, 71 bp, chicken (Gallus Gallus)
  misc_feature (36): n=a or c
ggccagctccctggcattattgttcagcatagaatnatagagtggtttgggttggaggggacctcaatgat

SEQ ID NO: 28509 - DNA, 71 bp, chicken (Gallus Gallus)
  misc_feature (36): n=c or t
ctggagatctctcgtggtatccatgcattattacangtgtaggcagtcgcagtataatatctctgcttttg

SEQ ID NO: 28510 - DNA, 71 bp, chicken (Gallus Gallus)
  misc_feature (36): n=a or t
aagtatttaattactgcactttaaaccgtctttgtnagcctgagtttttacttctatccttgttcctaatt

SEQ ID NO: 28511 - DNA, 71 bp, chicken (Gallus Gallus)
  misc_feature (36): n=g or t
atattcattgccttttggccatctcatgagcctaanttaaattgtggccaaaagagagatatggtgtccag

SEQ ID NO: 28512 - DNA, 71 bp, chicken (Gallus Gallus)
  misc_feature (36): n=c or t
atctgcatcactcttatgtacagcacattcatcctntgtagcattcataaaggttaggattgcctatgtta

SEQ ID NO: 28513 - DNA, 71 bp, chicken (Gallus Gallus)
  misc_feature (36): n=c or t
tataacaagcagcaggaaaatatgtagtacagcagncctgaaatgactctgagcacaactaagaagatgga

SEQ ID NO: 28514 - DNA, 71 bp, chicken (Gallus Gallus)
  misc_feature (36): n=c or t
caaagataaagaaatgtggagatgaaaggtaaacantgaaaaagtttgtacagatatctgatttctgtact

SEQ ID NO: 28515 - DNA, 71 bp, chicken (Gallus Gallus)
  misc_feature (36): n=a or g
tccaccttagtgtatttatattttcaatgttggctntagaactagatgatccttaaggtcccttccaaaca

SEQ ID NO: 28516 - DNA, 71 bp, chicken (Gallus Gallus)
  misc_feature (36): n=c or t
tccttgttacactgtttcgagttccctggaaaagangttacaccgaatcaccacatcagtcgcacacataa

SEQ ID NO: 28517 - DNA, 71 bp, chicken (Gallus Gallus)
  misc_feature (36): n=c or t
aaagatttcttctccatccaattctttactgagagngctggaatgggctgcccagagtggttatggatgcc

SEQ ID NO: 28518 - DNA, 71 bp, chicken (Gallus Gallus)
  misc_feature (36): n=a or c
aaagattgttttccaattgttttgctatattttttnttttccttttatgaatggaatcaaaatagttgccc

SEQ ID NO: 28519 - DNA, 71 bp, chicken (Gallus Gallus)
  misc_feature (36): n=a or g
caacattactcagtttccagacatctctggctgacngtggccttcactgcaggtgggaatttcagcacaca

SEQ ID NO: 28520 - DNA, 71 bp, chicken (Gallus Gallus)
  misc_feature (36): n=a or c
acgatgtgcttccataagaagctctgcacgatcccncaggcacccggctcactccatgcacgggatggacc

SEQ ID NO: 28521 - DNA, 71 bp, chicken (Gallus Gallus)
  misc_feature (36): n=a or g
ctgaaagttgtatctctataaaagtggcaaaccacntttttactttctttgacttcttggaaaaagtctct

SEQ ID NO: 28522 - DNA, 71 bp, chicken (Gallus Gallus)
  misc_feature (36): n=c or g
taaaaggactggccaaagtggttactgagataagtncatttgggcatgcgaggagtgtgaagtgaacccat

SEQ ID NO: 28523 - DNA, 71 bp, chicken (Gallus Gallus)
  misc_feature (36): n=a or g
caaacgaagatgacctgtgtaatgtgcagcatgtanatctgacagaaggcttaggagagcgaagactgcta

SEQ ID NO: 28524 - DNA, 71 bp, chicken (Gallus Gallus)
  misc_feature (36): n=a or g
ctcttattacagtgtttaatattgctaaattgtggntactggtacatatacgttcatgttgcatagtactc

SEQ ID NO: 28525 - DNA, 71 bp, chicken (Gallus Gallus)
  misc_feature (36): n=a or g
gcacacagatactgcaactaatgtcttctgtagatnacctggattttgatggatttctcagtagagagaga

SEQ ID NO: 28526 - DNA, 71 bp, chicken (Gallus Gallus)
  misc_feature (36): n=g or t
atgtgcacagaccccaacctgggtctcttcattagntgaagcaaatcaactgataaaatattgaagcaaca

SEQ ID NO: 28527 - DNA, 71 bp, chicken (Gallus Gallus)
  misc_feature (36): n=c or t
tgtgtttctctgtggtgtagagaagagattcttccntgcctcaataaaggcaaggaagaatgcccttgatc

SEQ ID NO: 28528 - DNA, 71 bp, chicken (Gallus Gallus)
  misc_feature (36): n=a or g
atgccagagggttctccaccaaagcatttggaagcnttctaataaacacttatcatgtgttgaaaagaaaa

SEQ ID NO: 28529 - DNA, 71 bp, chicken (Gallus Gallus)
  misc_feature (36): n=a or c
gttttatatatctctttatagcttaagtgatacccncgttcaggagcatagtatgttttattattcataga

SEQ ID NO: 28530 - DNA, 71 bp, chicken (Gallus Gallus)
  misc_feature (36): n=a or g
tggaaatcaaaaccatactggctttcaagatcaccnatgagttatttggaaatgcaagcctttttatttct

SEQ ID NO: 28531 - DNA, 71 bp, chicken (Gallus Gallus)
  misc_feature (36): n=c or t
acacaatctgtattttcagtgtactttcagatctcntgtatattagatacttgtgacttatggtactacat

SEQ ID NO: 28532 - DNA, 71 bp, chicken (Gallus Gallus)
  misc_feature (36): n=c or g
acagcacagttcctaaagatcttgggatacatcatntggggcactgggaggaagggccacttgatcagtga

SEQ ID NO: 28533 - DNA, 71 bp, chicken (Gallus Gallus)
  misc_feature (36): n=g or t
atccagcggaagatactgtcatctcaacactcgctngatatgagatacagtttatctttcattcccagttt

SEQ ID NO: 28534 - DNA, 71 bp, chicken (Gallus Gallus)
  misc_feature (36): n=c or t
acttatatcttcccacccatctaagcagctcccatntctatcttcagtttgttgggaaacagaagtatggt

SEQ ID NO: 28535 - DNA, 71 bp, chicken (Gallus Gallus)
  misc_feature (36): n=c or t
taaagaagctgaacaatgggcatttctggatctgcngttaaattgccttatgctttgagtactggagctat

SEQ ID NO: 28536 - DNA, 71 bp, chicken (Gallus Gallus)
  misc_feature (36): n=a or g
tatccccaggtgactaatcaaccataataaactgcnttatcgcttcctaaatggcccatgcaacaggcaag

SEQ ID NO: 28537 - DNA, 71 bp, chicken (Gallus Gallus)
  misc_feature (36): n=a or c
agttttcttccagctgttagttctgtcttctcaggntctcttatgcaaaagttagtatatctcctttgtta

SEQ ID NO: 28538 - DNA, 71 bp, chicken (Gallus Gallus)
  misc_feature (36): n=a or g
ttatggttataacaacattgtatcacataattaccnaaaagaaacacatgggaactccagcctgatgagat

SEQ ID NO: 28539 - DNA, 71 bp, chicken (Gallus Gallus)
  misc_feature (36): n=c or t
gtttgcaatgcacgctggaaacaaaaaaaggtttcnagagggatgacacaatagtgtattgattttccaag

SEQ ID NO: 28540 - DNA, 71 bp, chicken (Gallus Gallus)
  misc_feature (36): n=g or t
gaatgtattgatagtagagatccaggaaaaagaganagagagagagagagagagagagagagagagagact

SEQ ID NO: 28541 - DNA, 71 bp, chicken (Gallus Gallus)
  misc_feature (36): n=a or g
acagcagatctcatagcagctcagtacaaagctacngttttgagaaacagtgtatgccttaataatgtggg

SEQ ID NO: 28542 - DNA, 71 bp, chicken (Gallus Gallus)
  misc_feature (36): n=a or g
tccaaattctgagaagaatgaggcagatctgtgaantagttgggagagctgaattgcaacatctcttaatt

SEQ ID NO: 28543 - DNA, 71 bp, chicken (Gallus Gallus)
  misc_feature (36): n=a or g
tttcattcttttcctttgaagtttacttctattatntatattaaatttcaaaaatgatttaaaaaaaaaaa

SEQ ID NO: 28544 - DNA, 71 bp, chicken (Gallus Gallus)
  misc_feature (36): n=c or t
ctgaaaaaaaggcagcacatttcactgctgccaaangttcacactaacatcttttcataaatgaatctagt

SEQ ID NO: 28545 - DNA, 71 bp, chicken (Gallus Gallus)
  misc_feature (36): n=c or t
tgtattttcacagtccaaggatacacccatccctgncattctagacctcagaagaactgcttgcaaattag

SEQ ID NO: 28546 - DNA, 71 bp, chicken (Gallus Gallus)
  misc_feature (36): n=c or t
gtcgttcctgagcttatgtttttctttccagcacangccaagtcaaaatctctctaactttcctaggccca

SEQ ID NO: 28547 - DNA, 71 bp, chicken (Gallus Gallus)
  misc_feature (36): n=c or g
tccccactgacagaagaaggcatcgcgcaggtctcncagttaattgagtacctgcacaaaagtaagtgctt

SEQ ID NO: 28548 - DNA, 71 bp, chicken (Gallus Gallus)
  misc_feature (36): n=c or t
acaaagcccaccaaggaggtcttttttgtggatttngggaacacggagaccattgaagaagatcttctgct

SEQ ID NO: 28549 - DNA, 71 bp, chicken (Gallus Gallus)
  misc_feature (36): n=c or t
acctgttttacctcatccccagcccctgcctgtctncacacagcatccaggaaaacagtaagggctcagcc

SEQ ID NO: 28550 - DNA, 71 bp, chicken (Gallus Gallus)
  misc_feature (36): n=c or t
gtatcacagctttttgcaaacaagcctgggtctttnggaaactgttacaggcactggacagcaaaatatgc

SEQ ID NO: 28551 - DNA, 71 bp, chicken (Gallus Gallus)
  misc_feature (36): n=g or t
aaacagcttggatcattgccagtgagtctgaaagcntcacacattgtgagtgcttaaactgctcaagttgt

SEQ ID NO: 28552 - DNA, 71 bp, chicken (Gallus Gallus)
  misc_feature (36): n=a or c
actgtgcatagcacctgggagtgaagtcaaacaacnaccaccttgtagtgagggaactttcaccttggtgt

SEQ ID NO: 28553 - DNA, 71 bp, chicken (Gallus Gallus)
  misc_feature (36): n=c or g
cggctgagatgctgacatttgctgcagggctcatantgctgcaccgaactggggcacataatccacctctc

SEQ ID NO: 28554 - DNA, 71 bp, chicken (Gallus Gallus)
  misc_feature (36): n=a or g
taagtcacggtaagtgacttgtgcagcttcgtttcntgtactttgtgaacagaagtaagtggcattgggtt

SEQ ID NO: 28555 - DNA, 71 bp, chicken (Gallus Gallus)
  misc_feature (36): n=c or t
gttgcattcagatttcaagtgggagtggagaggaangtgtaatgaatactgcacagaaaaaatgtgatttt

SEQ ID NO: 28556 - DNA, 71 bp, chicken (Gallus Gallus)
  misc_feature (36): n=a or t
aggctgatgtgttacttccacaaaaacaaggtcacntataccttttctgcaaaatagaacaatacagggga

SEQ ID NO: 28557 - DNA, 71 bp, chicken (Gallus Gallus)
  misc_feature (36): n=a or t
tcctaatagggactactttctcctttataaatatangtcttttctttcctgtatacataaattgaaaatac

SEQ ID NO: 28558 - DNA, 71 bp, chicken (Gallus Gallus)
  misc_feature (36): n=c or t
ttcaaatccatagctacctggattacctgaagatanataatagaaaaccatgtaattttaaacttgctttg

SEQ ID NO: 28559 - DNA, 71 bp, chicken (Gallus Gallus)
  misc_feature (36): n=a or g
aagggacagaagagtggaacttgctgttgtatgatnatctccccttaacagctggtgtttctgatagtgct

SEQ ID NO: 28560 - DNA, 71 bp, chicken (Gallus Gallus)
  misc_feature (36): n=c or t
acttgttaatgatttagtttctggactgaaacttangaattgcagtggaagtttcagttaagtaattttca

SEQ ID NO: 28561 - DNA, 71 bp, chicken (Gallus Gallus)
  misc_feature (36): n=c or t
ggctggtgtttttctagtgtatgactttccagttcngtgaccacaaccctctgcttctttacaaaatacat

SEQ ID NO: 28562 - DNA, 71 bp, chicken (Gallus Gallus)
  misc_feature (36): n=c or t
tcatagctgttttgctggtttgtttgtgtttagctngagttctgatcctttctggttagcgtctttcactg

SEQ ID NO: 28563 - DNA, 71 bp, chicken (Gallus Gallus)
  misc_feature (36): n=a or g
atgaggtcaaaacttgatatttttttttcttctggngaactactgaaaaacaaggaggcagcttacagaat

SEQ ID NO: 28564 - DNA, 71 bp, chicken (Gallus Gallus)
  misc_feature (36): n=g or t
cttactgaacttgaatactgatggtgattaagactnctttcaaattctcacagtgtcctaaatgtatgtaa

SEQ ID NO: 28565 - DNA, 71 bp, chicken (Gallus Gallus)
  misc_feature (36): n=c or t
tcggagctttgcagtaaatcacactggcaacatacnctctcctccagactgtcttttgtttagtaacaaac

SEQ ID NO: 28566 - DNA, 71 bp, chicken (Gallus Gallus)
  misc_feature (36): n=c or t
atgtgaccctggagaggaaatgggttcaggacagcnaattgattttcaagcatctcttattccaagctcaa

SEQ ID NO: 28567 - DNA, 71 bp, chicken (Gallus Gallus)
  misc_feature (36): n=a or c
ctgctgcctggctggggaaggagccctcacctaccngagcacacagaagaatgagcatttatttcaaacag

SEQ ID NO: 28568 - DNA, 71 bp, chicken (Gallus Gallus)
  misc_feature (36): n=c or t
ttcctgtacagaataacacatcctaagcatgacttntgtgtttaaaatgcagactgagttgggctacagta

SEQ ID NO: 28569 - DNA, 71 bp, chicken (Gallus Gallus)
  misc_feature (36): n=c or t
acggagggtacgtacggcaccgagtggctctccctngggcggtttgcatttcaccctgcagcctggggacg

SEQ ID NO: 28570 - DNA, 71 bp, chicken (Gallus Gallus)
  misc_feature (36): n=a or g
ctgttcttttgattgaacagtcattgcagagcccanaggtagggatatgctgggctttatggacacaaact

SEQ ID NO: 28571 - DNA, 71 bp, chicken (Gallus Gallus)
  misc_feature (36): n=c or t
aacactcagcatagacagattgttgtaatttattanctgttgatagcaaatcagagcagcgagagctaaag

SEQ ID NO: 28572 - DNA, 71 bp, chicken (Gallus Gallus)
  misc_feature (36): n=c or t
taaaccatcacaactcaaggagaaaacagaattgangtgttacaaacttttttcctattactatccctctt

SEQ ID NO: 28573 - DNA, 71 bp, chicken (Gallus Gallus)
  misc_feature (36): n=c or t
ttataagacattctgcgttctgtatatcccttgttntcatagaatttcaagacacggaaatttatactcat

SEQ ID NO: 28574 - DNA, 71 bp, chicken (Gallus Gallus)
  misc_feature (36): n=g or t
atctgttcctccaagccactcttgaatataatgatncagtaatgtttagcatcaaataaaactttgctcat

SEQ ID NO: 28575 - DNA, 71 bp, chicken (Gallus Gallus)
  misc_feature (36): n=a or g
cacagtgagtgaatttaatcagtgctatcattgaanaggagtcctgaagcccgcacattgtatgggtctag

SEQ ID NO: 28576 - DNA, 71 bp, chicken (Gallus Gallus)
  misc_feature (36): n=a or g
tgttggcaaggaaatgccacgatttaaatgttacanctatgttcttagctgagttatctttggaagagatt

SEQ ID NO: 28577 - DNA, 71 bp, chicken (Gallus Gallus)
  misc_feature (36): n=c or t
acttctatgtagacttgcagggactatggaaataantggtaagctttccatcaatagagataatccatcat

SEQ ID NO: 28578 - DNA, 71 bp, chicken (Gallus Gallus)
  misc_feature (36): n=c or t
aaaagctcaggagggaatcatcccactttcttattncatggttaggggtatgagttgctttcttgcattta

SEQ ID NO: 28579 - DNA, 71 bp, chicken (Gallus Gallus)
  misc_feature (36): n=a or g
gtacgttatttgtgtgatctccacagtagcagacanaaggtctctgtcaactgaagaattcaacaggtcca

SEQ ID NO: 28580 - DNA, 71 bp, chicken (Gallus Gallus)
  misc_feature (36): n=c or t
gcaaagccaatgaacagtttctaaagctgagaacangggaatgaaaccaaggaattttaaattaactagaa

SEQ ID NO: 28581 - DNA, 71 bp, chicken (Gallus Gallus)
  misc_feature (36): n=a or c
ttttgtttgtttgtttgcaaggtaagaaggaatctngctatattgcagctttgctttctttatgctcaaat

SEQ ID NO: 28582 - DNA, 71 bp, chicken (Gallus Gallus)
  misc_feature (36): n=c or t
atgaaaaacacagcaaggtactaagaaaaaatgtcnattgtgggttgcaggtttttcttttggagtatttt

SEQ ID NO: 28583 - DNA, 71 bp, chicken (Gallus Gallus)
  misc_feature (36): n=a or g
tattcctatctctatatctagttatttactcagaancataccttcatacatatttgaaaagctgccctggt

SEQ ID NO: 28584 - DNA, 71 bp, chicken (Gallus Gallus)
  misc_feature (36): n=a or g
tatgaagctcagtagtgagctttaattatcaataancttctagtaatctgtacttacattcttggggtctc

SEQ ID NO: 28585 - DNA, 71 bp, chicken (Gallus Gallus)
  misc_feature (36): n=c or t
cctgcagtactctgaagtcagtatctggtttcagancttgccctgttgttagggtgttttttcatcatgtt

SEQ ID NO: 28586 - DNA, 71 bp, chicken (Gallus Gallus)
  misc_feature (36): n=c or t
ggcaccttcaacagtttcaccagtttgaatacgttnaaattttctggttttcattaagtgaaaagcaaccc

SEQ ID NO: 28587 - DNA, 71 bp, chicken (Gallus Gallus)
  misc_feature (36): n=a or g
agaggttgagaagttgtggttgaaggagtgaagatnagcgtgggaaaagtggggaggaaaggtgttgtttt

SEQ ID NO: 28588 - DNA, 71 bp, chicken (Gallus Gallus)
  misc_feature (36): n=c or t
agttatttgtcttagtttgacatgtaaaagttaaangtccatttaatgtttagtacccagatttactcttc

SEQ ID NO: 28589 - DNA, 71 bp, chicken (Gallus Gallus)
  misc_feature (36): n=c or t
ccacccacattttaactttacaggtccgatcctacngtcagtgaaataactgacagtttgcaattgattag

SEQ ID NO: 28590 - DNA, 71 bp, chicken (Gallus Gallus)
  misc_feature (36): n=a or g
ataaaaaggtaatcagattctgctttatattgttcngaaaaatgtttctgtcttctacaatcaatcaacct

SEQ ID NO: 28591 - DNA, 71 bp, chicken (Gallus Gallus)
  misc_feature (36): n=c or t
actttttttgaggagagattgaggaagaatttgaangtacagttctggctcttaagggagtgggctccaag

SEQ ID NO: 28592 - DNA, 71 bp, chicken (Gallus Gallus)
  misc_feature (36): n=a or g
aaaagtagcaaatggctttcatgaaaaactttaatngtcaaatttgtttcaatatccctgaaacaactctt

SEQ ID NO: 28593 - DNA, 71 bp, chicken (Gallus Gallus)
  misc_feature (36): n=a or g
tgcctttttacactttaaaccaatggcccttgtggnttacagctacattaaacaagtgcatacatacaaaa

SEQ ID NO: 28594 - DNA, 71 bp, chicken (Gallus Gallus)
  misc_feature (36): n=a or g
cttcaggagctagctctccataaaatgcataaaacntcaacatgttcacttagtagtgttttgggtttttt

SEQ ID NO: 28595 - DNA, 71 bp, chicken (Gallus Gallus)
  misc_feature (36): n=a or g
tggtagtatattaactgaaaatcagcaagggagatngaaggtcatttagaacagaaatgaacaaatatgta

SEQ ID NO: 28596 - DNA, 71 bp, chicken (Gallus Gallus)
  misc_feature (36): n=c or t
ggaaaataagtagaaaacagtacagaggaatcaagncttattttttgtgaggaaaaaagagtctttacctt

SEQ ID NO: 28597 - DNA, 71 bp, chicken (Gallus Gallus)
  misc_feature (36): n=a or g
tatcttgatgactgatccaatcgatattcaaaatangaagaagaagtgaaaccatatttgtattcaagatc

SEQ ID NO: 28598 - DNA, 71 bp, chicken (Gallus Gallus)
  misc_feature (36): n=a or g
atctctttgactgaaatctgtttaatccttttagancaatgtaatatgaaccttaagagtagtccatagta

SEQ ID NO: 28599 - DNA, 71 bp, chicken (Gallus Gallus)
  misc_feature (36): n=a or g
gtgcaatcttaattacttcactgaattttaaaaccntttgctgtttagttatcctcttaacttctaaaact

SEQ ID NO: 28600 - DNA, 71 bp, chicken (Gallus Gallus)
  misc_feature (36): n=c or t
tgtatacttaaacccacagtaagcatcaaactatgngattttatctaggaaggaaagttattagggttccc

SEQ ID NO: 28601 - DNA, 71 bp, chicken (Gallus Gallus)
  misc_feature (36): n=c or t
caacatatctgtttgctgactctgtaagcctcaganagaaaaacagcttttatactcctcctattgtgcat

SEQ ID NO: 28602 - DNA, 71 bp, chicken (Gallus Gallus)
  misc_feature (36): n=a or g
gagcctcattctgaggcagagttagctcagaggtantatcaacagttggcttcttttaatttttcttaatt

SEQ ID NO: 28603 - DNA, 71 bp, chicken (Gallus Gallus)
  misc_feature (36): n=c or t
aattctctatgctccaaatactaatgttagaatccnatgtaacttcttcataaaaggcttttctactggga

SEQ ID NO: 28604 - DNA, 71 bp, chicken (Gallus Gallus)
  misc_feature (36): n=c or t
aagtagtactttgttttgatgcattgtttctgccangtttttcctgctagctctgtcagaaatttaggtat

SEQ ID NO: 28605 - DNA, 71 bp, chicken (Gallus Gallus)
  misc_feature (36): n=c or t
attctattgaaaatatgcaagtaataggatagctgntgttttcagggacagatgctcggtgcaaacaacta

SEQ ID NO: 28606 - DNA, 71 bp, chicken (Gallus Gallus)
  misc_feature (36): n=c or t
atgctcaagtcaaacatactttatgtagtgtagcanaggaatttctagttttctggaatatttatttgtta

SEQ ID NO: 28607 - DNA, 71 bp, chicken (Gallus Gallus)
  misc_feature (36): n=g or t
ttgctatgatcttgggaggaagttagtattgcaaantgagagcactaaatctttcacttgatagaaatatc

SEQ ID NO: 28608 - DNA, 71 bp, chicken (Gallus Gallus)
  misc_feature (36): n=c or t
gaaaagaattgtttccttaaacagttttaaagttangtctctgttttcctgttgcaatatcattaacctac

SEQ ID NO: 28609 - DNA, 71 bp, chicken (Gallus Gallus)
  misc_feature (36): n=c or t
gaaggatttattggattaagtagtcattccagatgnacactgattgatagctttgagcagtttaactctca

SEQ ID NO: 28610 - DNA, 71 bp, chicken (Gallus Gallus)
  misc_feature (36): n=a or g
ttgctcagcaataaaactgggaaagttggccaggtngagctgctggctgagggatcagcaggtggtgaacg

SEQ ID NO: 28611 - DNA, 71 bp, chicken (Gallus Gallus)
  misc_feature (36): n=c or t
caaaacaactttctttaacttgtcctgcttatctantttttcctagaagtcctttatctcatgcatacagt

SEQ ID NO: 28612 - DNA, 71 bp, chicken (Gallus Gallus)
  misc_feature (36): n=a or g
aatagtacttgatgcaaagacagttttctataagangtatgaagctgttctatgttgttcagggtttcctt

SEQ ID NO: 28613 - DNA, 71 bp, chicken (Gallus Gallus)
  misc_feature (36): n=a or g
aaaccaacatggtatctatgtgcttagtatacccantgtagcattgttcaaaatgtaccagagaacaaaaa

SEQ ID NO: 28614 - DNA, 71 bp, chicken (Gallus Gallus)
  misc_feature (36): n=c or t
gcttggaagacagaacagcactcttcccccattttngaatcagtgtttttctgagcaggatctttattgat

SEQ ID NO: 28615 - DNA, 71 bp, chicken (Gallus Gallus)
  misc_feature (36): n=a or g
aagtctgagaggagcaatggggactccgtgtatacncacgttacagactagagtaagcaggtcattcaaat

SEQ ID NO: 28616 - DNA, 71 bp, chicken (Gallus Gallus)
  misc_feature (36): n=c or t
ctgcccttgaagacagatgtgaactttccacttcantgccgagagatggttttgtgaaaagagccccataa

SEQ ID NO: 28617 - DNA, 71 bp, chicken (Gallus Gallus)
  misc_feature (36): n=a or g
cttgctgaccatctttgtaaaagtagagtttactgnaagcaaatttggacaaaaaatcatagctaataatt

SEQ ID NO: 28618 - DNA, 71 bp, chicken (Gallus Gallus)
  misc_feature (36): n=g or t
tatcttattgcctttaggaattgcatattacttttncatcagcctagactctaagacacgtaactatgaga

SEQ ID NO: 28619 - DNA, 71 bp, chicken (Gallus Gallus)
  misc_feature (36): n=c or t
ctgaatttttgtcttgtctacttcagctgagtcaangatatgggtgtactgtgtggttgtacataagcatt

SEQ ID NO: 28620 - DNA, 71 bp, chicken (Gallus Gallus)
  misc_feature (36): n=c or t
tattctgaaccctggaagtgccacaagcatgtcttntaaactagcttatctttactattgttttggtctat

SEQ ID NO: 28621 - DNA, 71 bp, chicken (Gallus Gallus)
  misc_feature (36): n=c or t
gcacagactgagaaatttatttctctgacagataantctgttgcttatttttggttttggtatgacgtatg

SEQ ID NO: 28622 - DNA, 71 bp, chicken (Gallus Gallus)
  misc_feature (36): n=a or g
tcatactccagtagttcacatatgagaaactcagtnggaagatgctataaaactaaaaatcagttttgcag

SEQ ID NO: 28623 - DNA, 71 bp, chicken (Gallus Gallus)
  misc_feature (36): n=a or g
gaaatgtatgtggcagcacatagatacattcagtanaacttacttgcagccttttctcatattcagtttaa

SEQ ID NO: 28624 - DNA, 71 bp, chicken (Gallus Gallus)
  misc_feature (36): n=c or t
tcctacttctcttctgtgtcctaagatcaggagttncgtgctgatgctgaaatggaaatgtaaaggagtgt

SEQ ID NO: 28625 - DNA, 71 bp, chicken (Gallus Gallus)
  misc_feature (36): n=a or g
tcagctcataggctcttcagattggaagataggacngttatgaatttgaaaagaatggcttgcactgcaaa

SEQ ID NO: 28626 - DNA, 71 bp, chicken (Gallus Gallus)
  misc_feature (36): n=c or t
tattccctggaccaggcagcagggatgagaaagatnctcacttaaattgagagggataaggaaaaagctag

SEQ ID NO: 28627 - DNA, 71 bp, chicken (Gallus Gallus)
  misc_feature (36): n=a or c
ttgctttataatgttatttgtatgtcacacatctantgaattcatgctacctttttggaggaaggtcattg

SEQ ID NO: 28628 - DNA, 71 bp, chicken (Gallus Gallus)
  misc_feature (36): n=a or g
catgaggaaattcacagactatgaataagaaagagnaacttagaacaaagagtcagcaattgaacaagaag

SEQ ID NO: 28629 - DNA, 71 bp, chicken (Gallus Gallus)
  misc_feature (36): n=a or c
ctgcatgaagaaaatgattgaattcagctacaaaanggctgctgcatgaggagacaaaagcaggagttcaa

SEQ ID NO: 28630 - DNA, 71 bp, chicken (Gallus Gallus)
  misc_feature (36): n=c or t
ttcatgttggcaaacatcaagtaatacagtaaatanacctctgtgactgtatactcatccttgttcccaac

SEQ ID NO: 28631 - DNA, 71 bp, chicken (Gallus Gallus)
  misc_feature (36): n=a or g
gtctggcctaattatctgagtatcaggagtctagcntgatattagtgtgcaggaatgaattaggctcggca

SEQ ID NO: 28632 - DNA, 71 bp, chicken (Gallus Gallus)
  misc_feature (36): n=a or c
ttccaaaaatgaatgctaagaccatggtgctctganagtgtttttgaaagcaatgtggatgctaatttact

SEQ ID NO: 28633 - DNA, 71 bp, chicken (Gallus Gallus)
  misc_feature (36): n=c or t
cttactaaaatatcaatcttcagtgtctcacaagantgagttgacatgcttttaatttgctacttaatcta

SEQ ID NO: 28634 - DNA, 71 bp, chicken (Gallus Gallus)
  misc_feature (36): n=a or g
ttggcttatgtggcaaacagaggcaaggtcaaagcntactgatgtttgcaaaatattatcctcatctctag

SEQ ID NO: 28635 - DNA, 71 bp, chicken (Gallus Gallus)
  misc_feature (36): n=a or c
tctacagatcttatattcagttactgctgcaaacantaaagcttgaaatgttataagtatcttaagcaagt

SEQ ID NO: 28636 - DNA, 71 bp, chicken (Gallus Gallus)
  misc_feature (36): n=a or c
tgatgaagacatggtaatggcagcaatttccatgcnattttcataaaatacctaagcacttactgaacatc

SEQ ID NO: 28637 - DNA, 71 bp, chicken (Gallus Gallus)
  misc_feature (36): n=c or t
aggccttttaaaaggcttttaagatttgatgaggangtacattagttcatttggctttgatgaaactagag

SEQ ID NO: 28638 - DNA, 71 bp, chicken (Gallus Gallus)
  misc_feature (36): n=a or g
aaaacagctctagatccactatctgtatctcccagntctgttaataatgtccacagcgtgaagcagtgggg

SEQ ID NO: 28639 - DNA, 71 bp, chicken (Gallus Gallus)
  misc_feature (36): n=c or t
tgttctcaaacaagctgtgcagtagtgggtttttgntggctttttggttatgagggcatgatgagggcaag

SEQ ID NO: 28640 - DNA, 71 bp, chicken (Gallus Gallus)
  misc_feature (36): n=a or g
agccacaatctctttaccaaacatatggtaaccacncaacagagggcaaagaacaattacattctctatca

SEQ ID NO: 28641 - DNA, 71 bp, chicken (Gallus Gallus)
  misc_feature (36): n=c or t
ccaagggatttcataaggagaaaaattgtattatanagctccacactgatgtattcattttatgcatatct

SEQ ID NO: 28642 - DNA, 71 bp, chicken (Gallus Gallus)
  misc_feature (36): n=a or g
aagggcataacttgtccttggtctcgaagtgtaacntgacatttattcatgcctcaaaatgataatggcaa

SEQ ID NO: 28643 - DNA, 71 bp, chicken (Gallus Gallus)
  misc_feature (36): n=a or g
ataagtacaacagtttacctggtcatgtcatcaccngcacctcctgctgtacaaataacggttcttgcacc

SEQ ID NO: 28644 - DNA, 71 bp, chicken (Gallus Gallus)
  misc_feature (36): n=a or g
ggaaaccctacaatcacacaaccagaaatgccatgnttcttaacatgagttagtaaggcatttctatgaag

SEQ ID NO: 28645 - DNA, 71 bp, chicken (Gallus Gallus)
  misc_feature (36): n=a or g
gaaaaatttcagcatattttagttggtgctgaaatntggaattaatatcaaggctgattacattttaaaac

SEQ ID NO: 28646 - DNA, 71 bp, chicken (Gallus Gallus)
  misc_feature (36): n=a or g
caatgagtgattatagccatgggagtctgaaaagtnatacagtttatagggagaaataatattttatttta

SEQ ID NO: 28647 - DNA, 71 bp, chicken (Gallus Gallus)
  misc_feature (36): n=a or g
aacatttcttccatcctcaagctgtcacaaagaagncttagttgttatataggatttgctgttatttgtat

SEQ ID NO: 28648 - DNA, 71 bp, chicken (Gallus Gallus)
  misc_feature (36): n=c or t
atgatgtaagatatccacaattgaaagatatataantgttaagctactacatatgtgaaaaaaaataaaca

SEQ ID NO: 28649 - DNA, 71 bp, chicken (Gallus Gallus)
  misc_feature (36): n=a or g
aagaaacagtggaaagactgctccacatcagcatcnttagcatttatacagtcaaattatttcagacagtc

SEQ ID NO: 28650 - DNA, 71 bp, chicken (Gallus Gallus)
  misc_feature (36): n=a or c
ttgattgagtcaagctgctacatttttgctaatgcngtctaggctgctctttttcatgcaggtgcacgctc

SEQ ID NO: 28651 - DNA, 71 bp, chicken (Gallus Gallus)
  misc_feature (36): n=a or g
cttgtccttggaatgtgaggtccttcactaacatcnacaaagtcaccaaacctgatggaaaccaaagaaga

SEQ ID NO: 28652 - DNA, 71 bp, chicken (Gallus Gallus)
  misc_feature (36): n=c or t
agtttggtggctaatagctagctgggtgaatgcttngatggaaacttagggaaatgttatgtggaaactga

SEQ ID NO: 28653 - DNA, 71 bp, chicken (Gallus Gallus)
  misc_feature (36): n=a or g
tgactgccctaattgagggaatcatgttgctgtgcntaggcaacagtcactgctgtcattccttcccccac

SEQ ID NO: 28654 - DNA, 71 bp, chicken (Gallus Gallus)
  misc_feature (36): n=c or t
cacagcataaaaatacaacagcgaagaagcactcanttagtaacaccaatgctacataacagaccattcca

SEQ ID NO: 28655 - DNA, 71 bp, chicken (Gallus Gallus)
  misc_feature (36): n=c or t
tacctttgtcaaactgagggcctatagtgaagtagntgcaagatcctgtcagccctgccacccgtctggct

SEQ ID NO: 28656 - DNA, 71 bp, chicken (Gallus Gallus)
  misc_feature (36): n=a or g
tgttaaattcaagcaggaacttggtatttttgtgtntaactacaatacaaatgccaatctaaagttgctgc

SEQ ID NO: 28657 - DNA, 71 bp, chicken (Gallus Gallus)
  misc_feature (36): n=a or g
ggaactatttaccataattccaagtctcatttctgngaagtaacatcagcttagagtccattctttcatgt

SEQ ID NO: 28658 - DNA, 71 bp, chicken (Gallus Gallus)
  misc_feature (36): n=c or t
aatctcaaaatgtgtatgtttagtctcaactatttngtatttgtcttcaattgatttattgtgtgtaatgt

SEQ ID NO: 28659 - DNA, 71 bp, chicken (Gallus Gallus)
  misc_feature (36): n=c or t
acaggacaactactaaaaatcctttaatttatcacngctataaacctgaaggaatattgtgcaaataacaa

SEQ ID NO: 28660 - DNA, 71 bp, chicken (Gallus Gallus)
  misc_feature (36): n=a or c
gctccatttactttggttaccttccagagaaagaanatgatcctcaaaaaagctcttggaacactcagaga

SEQ ID NO: 28661 - DNA, 71 bp, chicken (Gallus Gallus)
  misc_feature (36): n=g or t
ccacgtaacatttaaatgctttgttgggcttatttngggggcttagatgggtctcaagaggtgcataaggc

SEQ ID NO: 28662 - DNA, 71 bp, chicken (Gallus Gallus)
  misc_feature (36): n=a or g
ctgctttacatagatggcttaggaacactgggaaanagaaatcttgcatggtatatggcatggaatttcac

SEQ ID NO: 28663 - DNA, 71 bp, chicken (Gallus Gallus)
  misc_feature (36): n=c or t
ctgcatcatcaagctaagcttcagtctgtgagtaangtggttatagtgtctggctcataatcaagtgtctg

SEQ ID NO: 28664 - DNA, 71 bp, chicken (Gallus Gallus)
  misc_feature (36): n=a or g
ttacagaagactgtaacactacttgtggtgtattangtgaatattaacccaagagtaatactagaccattt

SEQ ID NO: 28665 - DNA, 71 bp, chicken (Gallus Gallus)
  misc_feature (36): n=a or g
attagatatgcagcatagctttggcctattggaaantctcaaaaacatgagatatgaaataattctgtaaa

SEQ ID NO: 28666 - DNA, 71 bp, chicken (Gallus Gallus)
  misc_feature (36): n=c or t
tcatccaaacctagtcaacatgttgtgttagtcatncagtttcaaaggtatcctcagcagaaaccgaacaa

SEQ ID NO: 28667 - DNA, 71 bp, chicken (Gallus Gallus)
  misc_feature (36): n=c or t
gaactctcacctccatatttctcagtgtattagacntactggtattaaaataaactaagcctttatatgca

SEQ ID NO: 28668 - DNA, 71 bp, chicken (Gallus Gallus)
  misc_feature (36): n=a or g
tctcaaagctatcctgtggaggaacaactggaagtngataatttattaaaactgttcatactggcacattc

SEQ ID NO: 28669 - DNA, 71 bp, chicken (Gallus Gallus)
  misc_feature (36): n=c or t
tcctgagtcaagcttattgaaatcttgaaaatatgnggtatctgctgttttctgagtcacttctgttgctg

SEQ ID NO: 28670 - DNA, 71 bp, chicken (Gallus Gallus)
  misc_feature (36): n=g or t
ctaacaaggatcttaaaggtcaacacagttaggatnagagagaatctagctttgtacagtgattaccattt

SEQ ID NO: 28671 - DNA, 71 bp, chicken (Gallus Gallus)
  misc_feature (36): n=a or g
gttttaaatcatgtctttcagctgtttaaatgattnttttcactcatggtttttccactgaattcagtagc

SEQ ID NO: 28672 - DNA, 71 bp, chicken (Gallus Gallus)
  misc_feature (36): n=a or g
taataatttgagtcatcaattcgtcaaatgaacatnaaaaaatctattaaattgaggatgtaagggattca

SEQ ID NO: 28673 - DNA, 71 bp, chicken (Gallus Gallus)
  misc_feature (36): n=c or t
aaaaatttccatttggctaaacttttgacaaatttnatcaaggcatttcaagtgttctcctttaagatgat

SEQ ID NO: 28674 - DNA, 71 bp, chicken (Gallus Gallus)
  misc_feature (36): n=c or t
aggagtcctcagatgtgctgtaaagagtacttgcanactagctataaggacgtggttctcattagttccaa

SEQ ID NO: 28675 - DNA, 71 bp, chicken (Gallus Gallus)
  misc_feature (36): n=c or t
agcttttcttgtatgaaagcagtcattgaattcaanagcatgtcttaatcctttcatcaaaaggatctgaa

SEQ ID NO: 28676 - DNA, 71 bp, chicken (Gallus Gallus)
  misc_feature (36): n=c or t
tacactgcttcagtaacaactatgaagttttaaagnaatctgcacctaagatagcgagtggagagcataga

SEQ ID NO: 28677 - DNA, 71 bp, chicken (Gallus Gallus)
  misc_feature (36): n=a or c
ctgcaaccaaatacaagcttttgcctttttatcaangatgtgcctgttacagttaggtacttgaaatataa

SEQ ID NO: 28678 - DNA, 71 bp, chicken (Gallus Gallus)
  misc_feature (36): n=a or g
tgtaatattttactgttctgagcactgagtaatagncaaaaaatttgtaatacacaaagtaccagaggcaa

SEQ ID NO: 28679 - DNA, 71 bp, chicken (Gallus Gallus)
  misc_feature (36): n=a or g
gagaaaacttggccccttgctgagtttaaaagtgcntcaaggaagttttgttcacactcagcacagtccat

SEQ ID NO: 28680 - DNA, 71 bp, chicken (Gallus Gallus)
  misc_feature (36): n=a or g
ttaaaatggtggtggaagattatgccttgatgctgnttttcttaaccaaagagcttttggttgctgcatgt

SEQ ID NO: 28681 - DNA, 71 bp, chicken (Gallus Gallus)
  misc_feature (36): n=c or t
acttcaccaactctatttgtgtcaactatcgaatgncataccagtttgtcaactaaagagccacagaataa

SEQ ID NO: 28682 - DNA, 71 bp, chicken (Gallus Gallus)
  misc_feature (36): n=c or t
ataccttttaactatagaaatgcatgaagtatcctntgtgacttgaaaaattacactagtactagtttact

SEQ ID NO: 28683 - DNA, 71 bp, chicken (Gallus Gallus)
  misc_feature (36): n=a or g
agcagaggcaagaaaggactgcttgggatctgcccnagaaaggttagataagagagcatgcacaaggagag

SEQ ID NO: 28684 - DNA, 71 bp, chicken (Gallus Gallus)
  misc_feature (36): n=c or t
catagttgtaactgagaacatgtcagtaaatgtacngtgagggtattttgttctcatcttctggtctgttt

SEQ ID NO: 28685 - DNA, 71 bp, chicken (Gallus Gallus)
  misc_feature (36): n=a or g
ttcatacttcagattccagttccagtactaaagacnttcaggtgccaccaactgtaacttctatcgagaaa

SEQ ID NO: 28686 - DNA, 71 bp, chicken (Gallus Gallus)
  misc_feature (36): n=c or t
cgatgtcgtaagagaaaacttgactgcatacaaaancttgaatccgaaattgagaaactggtatgtatgaa

SEQ ID NO: 28687 - DNA, 71 bp, chicken (Gallus Gallus)
  misc_feature (36): n=a or g
aactgaatgtgtaggacagcaaggtactgctccccntctagagcattggctaaatctctgtcagatgttat

SEQ ID NO: 28688 - DNA, 71 bp, chicken (Gallus Gallus)
  misc_feature (36): n=a or g
ttttaaacaagtctactttctaggcaatgcttaagnaagtaaaaattgagtggaaaatacataatcttttt

SEQ ID NO: 28689 - DNA, 71 bp, chicken (Gallus Gallus)
  misc_feature (36): n=a or g
aagatccagcactgtcttctgtgagccttcccacanctgtgtcactgctgggtaatatttcaaagctttct

SEQ ID NO: 28690 - DNA, 71 bp, chicken (Gallus Gallus)
  misc_feature (36): n=c or t
tcagaccctaaaacaaaccaaaccttgactatagangagaagtttgggttttgatgcagacatgaaaatct

SEQ ID NO: 28691 - DNA, 71 bp, chicken (Gallus Gallus)
  misc_feature (36): n=a or g
tcagaagctgttacaaatactctacatctcattagnacttcatcgcttttgcttaggcaagagctttaagg

SEQ ID NO: 28692 - DNA, 71 bp, chicken (Gallus Gallus)
  misc_feature (36): n=a or g
agaggtgggacctctccagccttatgggtgcttacncacttgcagaaatttacttcatgagtgatcttaga

SEQ ID NO: 28693 - DNA, 71 bp, chicken (Gallus Gallus)
  misc_feature (36): n=g or t
aagatagcacacttcaagcaatcctcagaatctatncattagttgtaggttgtgaagacacctgaactcag

SEQ ID NO: 28694 - DNA, 71 bp, chicken (Gallus Gallus)
  misc_feature (36): n=a or g
acgcactggagaaatctgaaacataatcaactactncagataagccttaataccatgtctctggtgaacag

SEQ ID NO: 28695 - DNA, 71 bp, chicken (Gallus Gallus)
  misc_feature (36): n=g or t
acacagtgtcacttacaaaaagagagctcttctgtnctagttgccaaatatccacatgcatgcaaaggcag

SEQ ID NO: 28696 - DNA, 71 bp, chicken (Gallus Gallus)
  misc_feature (36): n=a or g
cgaactgtgaaataaagagagaacatgggaagaccncatcagttttcagcaagcagaaatttgtcctacag

SEQ ID NO: 28697 - DNA, 71 bp, chicken (Gallus Gallus)
  misc_feature (36): n=a or g
ggtgcacagttagactataacttgatgcagcgcagnggacctcctttatttaaatgatttactccagtgga

SEQ ID NO: 28698 - DNA, 71 bp, chicken (Gallus Gallus)
  misc_feature (36): n=g or t
aaacacagagcagccaacagaaaaggttgtagttgntttttgccagccagcatctaagcacaagagatgtc

SEQ ID NO: 28699 - DNA, 71 bp, chicken (Gallus Gallus)
  misc_feature (36): n=c or t
acatcagttgatgtgcaagaaatgcacctatcaacnaatgctggccaagatgtgtgcccaggacctgaccc

SEQ ID NO: 28700 - DNA, 71 bp, chicken (Gallus Gallus)
  misc_feature (36): n=a or g
cagcgtgcactgcaaaattcaaaatatagaaaattncagttctgtttcccaaccttaagacaaaacaattg

SEQ ID NO: 28701 - DNA, 71 bp, chicken (Gallus Gallus)
  misc_feature (36): n=c or t
ttgaggtgctgccaacctgggaggtgcagttgcagnactggttgtgctggaggagaaggatgcctgtttcc

SEQ ID NO: 28702 - DNA, 71 bp, chicken (Gallus Gallus)
  misc_feature (36): n=a or c
aaatggatctaatgaaaaagcaaaccagttcacccnagaaacataatctcatcttgtggcttgtccgcatt

SEQ ID NO: 28703 - DNA, 71 bp, chicken (Gallus Gallus)
  misc_feature (36): n=a or g
attttttgcctaaccttacattgtcattcagctaantgtgttgccttgagggcagcgcatttctgtccagt

SEQ ID NO: 28704 - DNA, 71 bp, chicken (Gallus Gallus)
  misc_feature (36): n=a or g
atactctcacgctcatctttaagcacactgagaccnagtgcacatctgagtgcctgtaaaaccaaggctta

SEQ ID NO: 28705 - DNA, 71 bp, chicken (Gallus Gallus)
  misc_feature (36): n=a or g
aaaaaatctatgctttgcaaacgtccacaattaacntgtagttttagatgcattgttacttaaaatctgaa

SEQ ID NO: 28706 - DNA, 71 bp, chicken (Gallus Gallus)
  misc_feature (36): n=c or t
aagaaaagcaaactgcagaggtgtgagggatgcaanggtgatatttagcagctcaaggattccattacaaa

SEQ ID NO: 28707 - DNA, 71 bp, chicken (Gallus Gallus)
  misc_feature (36): n=a or c
aaagctttgctgagcatgtgctccccttcttttgcnccaagtaaattcacaataatttgtttgccatataa

SEQ ID NO: 28708 - DNA, 71 bp, chicken (Gallus Gallus)
  misc_feature (36): n=a or g
cgtgtttgttgtgttttgctctctctgcatcaccgncctggtttgtaagtgaaacagcagaataaagcaca

SEQ ID NO: 28709 - DNA, 71 bp, chicken (Gallus Gallus)
  misc_feature (36): n=a or g
tagctcagcaccccatcataagagccacttgccagnctgtctcagcaagggataaaattactgaatatatt

SEQ ID NO: 28710 - DNA, 71 bp, chicken (Gallus Gallus)
  misc_feature (36): n=a or c
atcttatttgcccacatctgggagggtacatctcanatggatgcgagagccacacagtgatgccaacggtg

SEQ ID NO: 28711 - DNA, 71 bp, chicken (Gallus Gallus)
  misc_feature (36): n=a or g
ttcctgggtaaggactgctttatgcccatagcatcntccttaaaggtcatgctctgagattatttttcttt

SEQ ID NO: 28712 - DNA, 71 bp, chicken (Gallus Gallus)
  misc_feature (36): n=c or t
tccaattagatccacagagtggaagatatttaaatncatcattcatagacatgctcaactctacagctgta

SEQ ID NO: 28713 - DNA, 71 bp, chicken (Gallus Gallus)
  misc_feature (36): n=a or g
ttcctcttaatttaagaagtattagtactttagctntgtgcactttgaactggaaagggcattgtacacct

SEQ ID NO: 28714 - DNA, 71 bp, chicken (Gallus Gallus)
  misc_feature (36): n=a or g
atcagaaaccagttttaaccttttgttcactttacngcagagttcacgggctgcaattaatctggaatctg

SEQ ID NO: 28715 - DNA, 71 bp, chicken (Gallus Gallus)
  misc_feature (36): n=c or t
agtaaatgagaaaatcaccacagagcagccaaaagnctggcatagaatgaagcaggcaagcaccatcctac

SEQ ID NO: 28716 - DNA, 71 bp, chicken (Gallus Gallus)
  misc_feature (36): n=c or t
cctaatggtatccctttctctagctgctcctacttnagggacctcagtgggtctcaccaggctacaggagt

SEQ ID NO: 28717 - DNA, 71 bp, chicken (Gallus Gallus)
  misc_feature (36): n=a or g
aaatgcattgtcttccaaatatgttctgcattgagntgtttttggtcatacatctttctgaagtgatatct

SEQ ID NO: 28718 - DNA, 71 bp, chicken (Gallus Gallus)
  misc_feature (36): n=c or t
atagctgcttgattccatttttagcagttcagagtntttttaagctattggggaccatagagatctttttg

SEQ ID NO: 28719 - DNA, 71 bp, chicken (Gallus Gallus)
  misc_feature (36): n=g or t
tctacaactgttttggtgataatttttgacttaatnacctaatttagttgtaattttaaacagtataattt

SEQ ID NO: 28720 - DNA, 71 bp, chicken (Gallus Gallus)
  misc_feature (36): n=c or t
catacatgttactgtgtagtataacttcacagggtngttgattagcctacagggaaaatactctgaagtaa

SEQ ID NO: 28721 - DNA, 71 bp, chicken (Gallus Gallus)
  misc_feature (36): n=a or g
gtgttaattggaggtgaattaataggaaaatgtgtnttttcagcatggtacccgagcgcttttgcaaagga

SEQ ID NO: 28722 - DNA, 71 bp, chicken (Gallus Gallus)
  misc_feature (36): n=c or t
aacttcagtagcactcttgctgcagtgagaacccantaagttgcgaaaaggacatcagattctgattttta

SEQ ID NO: 28723 - DNA, 71 bp, chicken (Gallus Gallus)
  misc_feature (36): n=c or t
tttttgaacagaacatagtctgtagggtaggattanttctccagaggtgaatcatgctgtagtgaaggaga

SEQ ID NO: 28724 - DNA, 71 bp, chicken (Gallus Gallus)
  misc_feature (36): n=a or g
ctgagaactacggtaagaatcaaatgcatgaggacncatgcacatgggttgctccactgcctcctgctggc

SEQ ID NO: 28725 - DNA, 71 bp, chicken (Gallus Gallus)
  misc_feature (36): n=a or c
cattactttctgcaagggaatggtgaattaaaaacnctgtggctaaagcaaactcagtgtgtgagggagaa

SEQ ID NO: 28726 - DNA, 71 bp, chicken (Gallus Gallus)
  misc_feature (36): n=a or g
agaaagtcctgatacataaagaaatcattaaactcnggcaaaaactgcgtgagaggcatgccagacaggat

SEQ ID NO: 28727 - DNA, 71 bp, chicken (Gallus Gallus)
  misc_feature (36): n=a or g
ctgaggcctgaaaataggaagaaccatttaagaaantgagtcaaggtagtagttttcccatttcttcactt

SEQ ID NO: 28728 - DNA, 71 bp, chicken (Gallus Gallus)
  misc_feature (36): n=a or g
tggggtacacaatgtgaattaaggacagtcattaanaaagttccctctgaagtctccatttttccacaaaa

SEQ ID NO: 28729 - DNA, 71 bp, chicken (Gallus Gallus)
  misc_feature (36): n=c or t
ttaaggtttggatagatgttatgctgtaacaggcantcaaggtggcagcacgtaacaatagtattgaagag

SEQ ID NO: 28730 - DNA, 71 bp, chicken (Gallus Gallus)
  misc_feature (36): n=c or t
atctctacccatgtgattttggtggcaacagtaatntaaggaaatgctgtagctacatgccaatctaaccc

SEQ ID NO: 28731 - DNA, 71 bp, chicken (Gallus Gallus)
  misc_feature (36): n=a or g
ctgaagtgaaaatggaattggagttcagttttcagngaaaaaagaaagttatgcttactgatctccttttt

SEQ ID NO: 28732 - DNA, 71 bp, chicken (Gallus Gallus)
  misc_feature (36): n=a or g
atgggaagttcttctgagctattccccatctggatncatttatggctcctgacagttttgatcatgacttc

SEQ ID NO: 28733 - DNA, 71 bp, chicken (Gallus Gallus)
  misc_feature (36): n=c or t
tgaattcatatttctacaattcctgcattatggatntacccactccagttaacattaaccactgtaaaatt

SEQ ID NO: 28734 - DNA, 71 bp, chicken (Gallus Gallus)
  misc_feature (36): n=a or g
agcagaaagaccaaaagaagactttctgaaacacanattgtcctatcaaagatgctctttgaaatggagag

SEQ ID NO: 28735 - DNA, 71 bp, chicken (Gallus Gallus)
  misc_feature (36): n=c or t
ggaattgtttgttactgcaggctgacacacggccgnggagatcagcttttgagaattgatattttaaattg

SEQ ID NO: 28736 - DNA, 71 bp, chicken (Gallus Gallus)
  misc_feature (36): n=c or t
gctctgcgctcagcgttgcgccttgcatgaagcccngatctcggcatcaaacagtcccctctccaaacgtt

SEQ ID NO: 28737 - DNA, 71 bp, chicken (Gallus Gallus)
  misc_feature (36): n=a or g
taaaatgcaacaaacgagactttccttgaaagaacncaacagattatcatgagaagttttccacaacctga

SEQ ID NO: 28738 - DNA, 71 bp, chicken (Gallus Gallus)
  misc_feature (36): n=c or t
atttatctgactttgaggtcatatgactgcaaatgntgcaaacaacaaatgccttgttcctgcacacattc

SEQ ID NO: 28739 - DNA, 71 bp, chicken (Gallus Gallus)
  misc_feature (36): n=c or t
ttaaccacatccagctctgggaggacctggctatgngtaacccaggcatatcaggcttcaggatcttgctc

SEQ ID NO: 28740 - DNA, 71 bp, chicken (Gallus Gallus)
  misc_feature (36): n=a or g
ctaacctgctttggattgcaatagcctctatgatcnttgtaacacaaagagaagagcggacttcttttctc

SEQ ID NO: 28741 - DNA, 71 bp, chicken (Gallus Gallus)
  misc_feature (36): n=a or g
agatatttatagtccgacctgctactgctgtgctgnagaaatggaaatattgttaaattattctgatcaaa

SEQ ID NO: 28742 - DNA, 71 bp, chicken (Gallus Gallus)
  misc_feature (36): n=c or t
ataatgaggtaacattcagggtgtttacaaagagtntctccaatgcatgaggggcagcactggaaaaaaaa

SEQ ID NO: 28743 - DNA, 71 bp, chicken (Gallus Gallus)
  misc_feature (36): n=a or g
tgattggttcttgattcttgaatatgtccaagaagnagtgagagaaacacagcactgaaacacatgacagc

SEQ ID NO: 28744 - DNA, 71 bp, chicken (Gallus Gallus)
  misc_feature (36): n=c or t
agcctccctccccatcctgcactgacagcagatgcntgagccctgagaccaagcacgatctcatgagaatt

SEQ ID NO: 28745 - DNA, 71 bp, chicken (Gallus Gallus)
  misc_feature (36): n=a or g
ggcacaagaagagcctgccacaaccattcatacttnctaaagttcagtagggaaggagctggtcaagtctt

SEQ ID NO: 28746 - DNA, 71 bp, chicken (Gallus Gallus)
  misc_feature (36): n=a or g
atttgctggcactgctgacaataatacattgataantcagaaacacaggccctccaattctttccttatat

SEQ ID NO: 28747 - DNA, 71 bp, chicken (Gallus Gallus)
  misc_feature (36): n=a or g
gcataaagccaaaatgattctatgagggacggtgtncatatttttctgagtgaaatacccatcttgcctaa

SEQ ID NO: 28748 - DNA, 71 bp, chicken (Gallus Gallus)
  misc_feature (36): n=a or g
ttagtgaacggtcagcagaggacctggcacaattcncttaaaaatcaccttccctttggttgccactgatg

SEQ ID NO: 28749 - DNA, 71 bp, chicken (Gallus Gallus)
  misc_feature (36): n=c or t
tactgtacaaatgtctttttgtctttacatatttgngttaagaaaattgtgctacaccccaagaaatatca

SEQ ID NO: 28750 - DNA, 71 bp, chicken (Gallus Gallus)
  misc_feature (36): n=c or t
ttgtagatgcttatgaaactacttacgaaaaatcantgaaaatcaagttagctccagatggaacaggtcat

SEQ ID NO: 28751 - DNA, 71 bp, chicken (Gallus Gallus)
  misc_feature (36): n=a or g
tgccaggacaaaggagaattctgtattactttcctnttaaatgaatgccaccttaatagaggccgttgtta

SEQ ID NO: 28752 - DNA, 71 bp, chicken (Gallus Gallus)
  misc_feature (36): n=a or g
gggatcttgctgctctccattaataaaaaatagtanacacataaaagaagtacatgtacaagatggaagca

SEQ ID NO: 28753 - DNA, 71 bp, chicken (Gallus Gallus)
  misc_feature (36): n=g or t
ttccagcaacctgtctggcaaataagtagaacttcnaaggaattgagttcattctgatctgaccttgctta

SEQ ID NO: 28754 - DNA, 71 bp, chicken (Gallus Gallus)
  misc_feature (36): n=g or t
aggaacatgaccaccacagtgggatcaggtgtgtanctggtggaatttttctcctgagctggcctagttaa

SEQ ID NO: 28755 - DNA, 71 bp, chicken (Gallus Gallus)
  misc_feature (36): n=c or t
cctatcagagaaataagagaaactccgctcttacancttcctcctgtgaaaaaccttacaccttccttttt

SEQ ID NO: 28756 - DNA, 71 bp, chicken (Gallus Gallus)
  misc_feature (36): n=c or t
tgccttggatatctgtggggtgaagatttacactgnaaaaattctgggaaatgcctttgaagctcaaccat

SEQ ID NO: 28757 - DNA, 71 bp, chicken (Gallus Gallus)
  misc_feature (36): n=a or g
acttgccaatggactgtgttgtttgttcatgtatancacctttgcatagcacctcatctgctgttttagat

SEQ ID NO: 28758 - DNA, 71 bp, chicken (Gallus Gallus)
  misc_feature (36): n=c or t
gttaaactatagatgttcttagtacattaatgctgnagaatgcgatgtgtcacagaagtggagtgggaata

SEQ ID NO: 28759 - DNA, 71 bp, chicken (Gallus Gallus)
  misc_feature (36): n=c or t
gcacagcagaccaagaattatggtatgtttatctantggatgctttaaattcagaaaaggaatggaacaca

SEQ ID NO: 28760 - DNA, 71 bp, chicken (Gallus Gallus)
  misc_feature (36): n=c or t
gtaggttttgacaaaagaccaaaactgttatatatncaagattatgtactggctgaatctgaaggagaaaa

SEQ ID NO: 28761 - DNA, 71 bp, chicken (Gallus Gallus)
  misc_feature (36): n=c or t
gtcacaatattgggtaagatggaaatgctgaaccangtctcttgcactgtcaaaggcagtaaaataaaagc

SEQ ID NO: 28762 - DNA, 71 bp, chicken (Gallus Gallus)
  misc_feature (36): n=a or g
ggtgttactagatcaccgatctctacagatattctntacagtcttaaacagaatgtacaatacttcatagt

SEQ ID NO: 28763 - DNA, 71 bp, chicken (Gallus Gallus)
  misc_feature (36): n=c or t
ttggaacttagatcagtaatatcctaccacagtccngtgtgcagcaaacccaggtgttctcctggctctga

SEQ ID NO: 28764 - DNA, 71 bp, chicken (Gallus Gallus)
  misc_feature (36): n=c or t
tctttcacataggagaaagaggcatacatgggattngcacagtttttgtaatgggaacattttatttgcac

SEQ ID NO: 28765 - DNA, 71 bp, chicken (Gallus Gallus)
  misc_feature (36): n=c or t
agttgagtctacagttaccaaatcccaggtgggccngtgacattttggtacgaacccttcacaagtcaatt

SEQ ID NO: 28766 - DNA, 71 bp, chicken (Gallus Gallus)
  misc_feature (36): n=a or g
gcctaaaaacatgtgcctaaaacctactgcaaaatngaagcatgtaaatactcttcctgtggctctcttaa

SEQ ID NO: 28767 - DNA, 71 bp, chicken (Gallus Gallus)
  misc_feature (36): n=c or t
tcctctgacctaccttgatatctctaggaaggctgnccatcacttttctatatgactgctttttcctcagc

SEQ ID NO: 28768 - DNA, 71 bp, chicken (Gallus Gallus)
  misc_feature (36): n=a or g
agtcatacgcaatatttctattgctgaaatcatcanaatcagattagaaaaattgtaaatagccatgaacc

SEQ ID NO: 28769 - DNA, 71 bp, chicken (Gallus Gallus)
  misc_feature (36): n=c or t
attctggatttttgggagtcctttggtaatagactnggaatacatataattctgccttccaggacaatgtg

SEQ ID NO: 28770 - DNA, 71 bp, chicken (Gallus Gallus)
  misc_feature (36): n=a or g
attactgttatcctctgactgaggtggatacaacanttccctctcttttcttgtcagtttgatcacacttg

SEQ ID NO: 28771 - DNA, 71 bp, chicken (Gallus Gallus)
  misc_feature (36): n=a or g
catgatttgttctgctctctggattctcactgatcnttgcaggcaggtgtgctggcaatgctgtgcacctg

SEQ ID NO: 28772 - DNA, 71 bp, chicken (Gallus Gallus)
  misc_feature (36): n=a or g
aacgcagcctgtagacaggaaaaattcatccctagngaactaaacgtttataccctctcttgttcagatga

SEQ ID NO: 28773 - DNA, 71 bp, chicken (Gallus Gallus)
  misc_feature (36): n=c or t
tgcctagcgattatcttactcaaagattcttaaccntattcctgtccttactcccactaatttttaggcca

SEQ ID NO: 28774 - DNA, 71 bp, chicken (Gallus Gallus)
  misc_feature (36): n=a or c
gggtatccagctgcagcaatgcaactgaactggaanttttgagacagccaattaggagactaaagatcaaa

SEQ ID NO: 28775 - DNA, 71 bp, chicken (Gallus Gallus)
  misc_feature (36): n=c or t
atcagcaagcatagcagacgcccacgatgatggctnagtgtttgccagacaaagcatcagtgacccagcat

SEQ ID NO: 28776 - DNA, 71 bp, chicken (Gallus Gallus)
  misc_feature (36): n=a or g
cagcaggaccttgggcaagaacagcacagaaagagnaggacactcaatgagtcccaaatataacaccaacc

SEQ ID NO: 28777 - DNA, 71 bp, chicken (Gallus Gallus)
  misc_feature (36): n=c or t
gtgtattcagtacttaataaagtatccatctgctanttatgagtttttgtttgaaggattagtcagtatca

SEQ ID NO: 28778 - DNA, 71 bp, chicken (Gallus Gallus)
  misc_feature (36): n=c or t
ttcattttctttgactgtcatgtataattttttgcnaccacataagagtaatttgcaaagaagattaatgt

SEQ ID NO: 28779 - DNA, 71 bp, chicken (Gallus Gallus)
  misc_feature (36): n=c or t
atgcaagcccttctccaagctgagacagacacaaangcaacctgcctttcagaacttatctgccaggtagt

SEQ ID NO: 28780 - DNA, 71 bp, chicken (Gallus Gallus)
  misc_feature (36): n=a or g
aaatcaggaacttgagacagtgatgcaattccccantgtcaggaacagcccgggcacttcagaagatgcaa

SEQ ID NO: 28781 - DNA, 71 bp, chicken (Gallus Gallus)
  misc_feature (36): n=a or c
ctacatggaaggtatctgccagcacctcttcaaggngaggagccccactgtgccattcactctgtgcttcc

SEQ ID NO: 28782 - DNA, 71 bp, chicken (Gallus Gallus)
  misc_feature (36): n=a or g
ttttttattgtgatgaattacagcagttgccaaccnagctggttttctgctatggtctgtaccaggtgtac

SEQ ID NO: 28783 - DNA, 71 bp, chicken (Gallus Gallus)
  misc_feature (36): n=a or g
tgatagtctcatttagtattagtttatttagcgatnacttcctaactagagttcttagtcgagctactgaa

SEQ ID NO: 28784 - DNA, 71 bp, chicken (Gallus Gallus)
  misc_feature (36): n=g or t
gttagaacacttgtttgccttcagtgatccaggttngtattgcaggagatgtctagtggtactcatgtcat

SEQ ID NO: 28785 - DNA, 71 bp, chicken (Gallus Gallus)
  misc_feature (36): n=a or c
acttgccaatctagcaatctggaaagatcaatggtntaagagaggataagtgaagctgatgctgtttaaag

SEQ ID NO: 28786 - DNA, 71 bp, chicken (Gallus Gallus)
  misc_feature (36): n=g or t
tccgtgcctagatatctccaaagctgcaacttctanccacagactcagaggggagtttctacatgtaacct

SEQ ID NO: 28787 - DNA, 71 bp, chicken (Gallus Gallus)
  misc_feature (36): n=c or t
tttgtcagtggatcccacttaacaaaaaggtaacanaaaggaggaattcagtctttcttactgcactaggc

SEQ ID NO: 28788 - DNA, 71 bp, chicken (Gallus Gallus)
  misc_feature (36): n=a or g
ttctaaaatcagagactttcaatgtgaattataatntacgaagataaggttatcatgctatttattttctg

SEQ ID NO: 28789 - DNA, 71 bp, chicken (Gallus Gallus)
  misc_feature (36): n=c or t
cttgtctagagtcaatggtgttactggaacaaccanaattcagttgaataaggaaatttgcctagttactg

SEQ ID NO: 28790 - DNA, 71 bp, chicken (Gallus Gallus)
  misc_feature (36): n=a or g
agtgctgatggtgaaaagggtcttactcatcttctncatcatgtgtttccatttatagtacttgtctgaaa

SEQ ID NO: 28791 - DNA, 71 bp, chicken (Gallus Gallus)
  misc_feature (36): n=a or g
ccactgcagagtcagaggataaattctgaaggctgnctgacaaaaatcagttcactagcccaaaagataga

SEQ ID NO: 28792 - DNA, 71 bp, chicken (Gallus Gallus)
  misc_feature (36): n=c or t
ttgttgtttaacaacaaagtcagggtacagaataanatcacagttatccctaagacctgttttcatgtatg

SEQ ID NO: 28793 - DNA, 71 bp, chicken (Gallus Gallus)
  misc_feature (36): n=a or c
agtgcagttagaagcgcacacaactagggtgttctnggtttttcagactaagttacacaggggcaatttat

SEQ ID NO: 28794 - DNA, 71 bp, chicken (Gallus Gallus)
  misc_feature (36): n=a or g
agctgctttactgtctgttatagatactcgtttacnccatgttgtttcatagctgataatacactgtaaca

SEQ ID NO: 28795 - DNA, 71 bp, chicken (Gallus Gallus)
  misc_feature (36): n=c or t
ttccaactcgcaataagaaaacaactgtttgagaangaggaaactgcaacaacgtgaactcctctttccct

SEQ ID NO: 28796 - DNA, 71 bp, chicken (Gallus Gallus)
  misc_feature (36): n=a or g
taagcctggcctcctgtgctgtcacgtcagtgaagngattgagtgtgacgtcaagcaaaacaagaagagca

SEQ ID NO: 28797 - DNA, 71 bp, chicken (Gallus Gallus)
  misc_feature (36): n=c or t
cctctttattcccacccacccctagctcccacacgntcaaggttagctcagactgtttctataagtcaaag

SEQ ID NO: 28798 - DNA, 71 bp, chicken (Gallus Gallus)
  misc_feature (36): n=a or c
tattttcccagatacatgctctgtattttctctctntatatttctctacttaacatccactcgtgtccatt

SEQ ID NO: 28799 - DNA, 71 bp, chicken (Gallus Gallus)
  misc_feature (36): n=a or c
ggccttaaaatcctgcccaattgtgtcccataaatnactgtgctgtgttcccatttatagctcactgaatt

SEQ ID NO: 28800 - DNA, 71 bp, chicken (Gallus Gallus)
  misc_feature (36): n=c or t
agctgtatgtgtttattcaaagacagacataccttntgatatgtcagtacaaaacagtgtttgctgaaata

SEQ ID NO: 28801 - DNA, 71 bp, chicken (Gallus Gallus)
  misc_feature (36): n=a or g
atactatgcattggagtcacacactgctttgctatnggactgaaagagttcaaattttaaggtagttttca

SEQ ID NO: 28802 - DNA, 71 bp, chicken (Gallus Gallus)
  misc_feature (36): n=a or g
tcttaggttttctgtatctgctgtgtgaaaactganccacagcttttatataaaccaagtgcctgaacttt

SEQ ID NO: 28803 - DNA, 71 bp, chicken (Gallus Gallus)
  misc_feature (36): n=a or g
gtcgagcctttttgggccactcagcttctgcctacntgatagataagatttctccttcacataactcccct

SEQ ID NO: 28804 - DNA, 71 bp, chicken (Gallus Gallus)
  misc_feature (36): n=a or g
gcacaaagctattttatgtttatacaacctaaatanctggtacccaggtctgtctacatggctcaaatatt

SEQ ID NO: 28805 - DNA, 71 bp, chicken (Gallus Gallus)
  misc_feature (36): n=a or g
cacaaagcaaatctacaactctgtccacagcaaacngcattcttggcactgtgactcaaaagcccagttcg

SEQ ID NO: 28806 - DNA, 71 bp, chicken (Gallus Gallus)
  misc_feature (36): n=c or t
gaactaagcattgtgctgtgtctgtatcacatgggnactaaaatgaggatatctcatgcactttctctgta

SEQ ID NO: 28807 - DNA, 71 bp, chicken (Gallus Gallus)
  misc_feature (36): n=a or g
aaccttacaacaagctgtgaaccatgtgcttttagnttagattctagatttgaatttacctgaatctttgt

SEQ ID NO: 28808 - DNA, 71 bp, chicken (Gallus Gallus)
  misc_feature (36): n=g or t
gcaaaaacaggaggaaaaacaaagaactacccattngaataatactgggaaccatgcagaaaatgaagaaa

SEQ ID NO: 28809 - DNA, 71 bp, chicken (Gallus Gallus)
  misc_feature (36): n=a or g
tggctctacagaagactgcagccaagagcttgtccngatttcatctgagagagagcaatgtcctttgccta

SEQ ID NO: 28810 - DNA, 71 bp, chicken (Gallus Gallus)
  misc_feature (36): n=c or t
aaactgaggaggaagctgcgtgggacagaaccaaanggggcagggtgaaaggatagtgaaatatactgacc

SEQ ID NO: 28811 - DNA, 71 bp, chicken (Gallus Gallus)
  misc_feature (36): n=c or t
acatggtttgtacaactgaagaggggcttcgttgtnttcctgtagggtccagatttctcctgtttcctcaa

SEQ ID NO: 28812 - DNA, 71 bp, chicken (Gallus Gallus)
  misc_feature (36): n=a or c
gcctcccttggcttgcttgctgcaagatgttacccnagtattttatcctgcccattacagctctccatcag

SEQ ID NO: 28813 - DNA, 71 bp, chicken (Gallus Gallus)
  misc_feature (36): n=g or t
atcctgttgaatttttagttctgtcaggaaaacctntagtgatgatgaagccaggggatgtcattttgata

SEQ ID NO: 28814 - DNA, 71 bp, chicken (Gallus Gallus)
  misc_feature (36): n=c or t
ggaactctgcaacagctaatgaaagtttaatccctnggtactcagcgcatatgtatgcaatgaatgtttgc

SEQ ID NO: 28815 - DNA, 71 bp, chicken (Gallus Gallus)
  misc_feature (36): n=g or t
aatatccactcttcatccacagtctcaagatcgccntcactacattctgcaaatcttcaaggacaattcta

SEQ ID NO: 28816 - DNA, 71 bp, chicken (Gallus Gallus)
  misc_feature (36): n=c or t
caaagacccaaaccagacatttacacctgagttcantggaaaatagagggaagtgggcatttctaggacat

SEQ ID NO: 28817 - DNA, 71 bp, chicken (Gallus Gallus)
  misc_feature (36): n=c or t
ttttaggaggagggtggagcttgccatcccactcanagcagcagaaacatgttcataggcatgctgaagca

SEQ ID NO: 28818 - DNA, 71 bp, chicken (Gallus Gallus)
  misc_feature (36): n=c or t
actggaaaaacaagttgctgctgcatcatcagctcngtggtggtcaagcatggagtcaccgcataactgtg

SEQ ID NO: 28819 - DNA, 71 bp, chicken (Gallus Gallus)
  misc_feature (36): n=c or t
gcaagctcatgtactaccagctacgtattgctcccngcatgtggccctgtgatccacgtgcaagtagattg

SEQ ID NO: 28820 - DNA, 71 bp, chicken (Gallus Gallus)
  misc_feature (36): n=a or g
tcgtccttacccaaacaagctttgggtttagattcnctcaggatttgtagctctgtgaacaaacgatattg

SEQ ID NO: 28821 - DNA, 71 bp, chicken (Gallus Gallus)
  misc_feature (36): n=c or t
aaatctactgcacaccgaagaaaatgttggagtaangggagaagagcttgcacaacctcagcagcatgctg

SEQ ID NO: 28822 - DNA, 71 bp, chicken (Gallus Gallus)
  misc_feature (36): n=a or g
gtgtgtatgtgaaattctccgtgtcttgccttagtnctggagtatattatatcagttatgcttttgtactg

SEQ ID NO: 28823 - DNA, 71 bp, chicken (Gallus Gallus)
  misc_feature (36): n=a or g
agctataaaagcacttcactaaagttgttgtagccntagtcagatgtttgaaagccatggttcccattcaa

SEQ ID NO: 28824 - DNA, 71 bp, chicken (Gallus Gallus)
  misc_feature (36): n=a or g
ctgtaatagcatctcattagctaagcttcaatttcncatccattcatcccaacagtttattttctgaaagc

SEQ ID NO: 28825 - DNA, 71 bp, chicken (Gallus Gallus)
  misc_feature (36): n=g or t
gagcttctccgctgtttactgactgtccatgagcantcattttcaaaagggtgtgagaaaatggaaaagca

SEQ ID NO: 28826 - DNA, 71 bp, chicken (Gallus Gallus)
  misc_feature (36): n=c or t
aatttgtgatactccaatgagaaaatgtagctacanggcttctgtgctagaattgctttcagtgcctggac

SEQ ID NO: 28827 - DNA, 71 bp, chicken (Gallus Gallus)
  misc_feature (36): n=c or t
gagatcagtgtattgtcaccaggagaaaatgagggnacagagagatgaaatgacttgccctaagtgatcca

SEQ ID NO: 28828 - DNA, 71 bp, chicken (Gallus Gallus)
  misc_feature (36): n=c or t
gcctgcagacctcagttcaataggaagaggagctcngtgttcctgctgagcagtaacagcagtggatgcaa

SEQ ID NO: 28829 - DNA, 71 bp, chicken (Gallus Gallus)
  misc_feature (36): n=g or t
actgtgtgataatacattctaacatgaacgttgaanctacagtggttaatgtgtatgtccaaagacgactg

SEQ ID NO: 28830 - DNA, 71 bp, chicken (Gallus Gallus)
  misc_feature (36): n=a or g
tcttgcattcaatctgacaatttacagctcgcctcnatgtataaataggagtaagttctgagcagacccta

SEQ ID NO: 28831 - DNA, 71 bp, chicken (Gallus Gallus)
  misc_feature (36): n=c or t
tgaactactgtggtcttatgtagaagattcttttantgggaattacgtattttagtagctctgctgtattg

SEQ ID NO: 28832 - DNA, 71 bp, chicken (Gallus Gallus)
  misc_feature (36): n=c or t
cgtcaagtggggtttcgtaagtctcagttctcacantggcatggactacagcataatcaatagcataacag

SEQ ID NO: 28833 - DNA, 71 bp, chicken (Gallus Gallus)
  misc_feature (36): n=c or t
attaggcctcaggtaacagctggatctctcagggtncactgcctgcatcaccttatatgtgctcaaggtct

SEQ ID NO: 28834 - DNA, 71 bp, chicken (Gallus Gallus)
  misc_feature (36): n=c or t
gtttgtaaaatgttgataatgacattgctcttcctnaatggtcttgtctgtttattggagagtgcattgtc

SEQ ID NO: 28835 - DNA, 71 bp, chicken (Gallus Gallus)
  misc_feature (36): n=c or t
aacctggtgtcaaacttcctgtcaaacccggcattntcttgaagagctttaaaatttagccattacttatt

SEQ ID NO: 28836 - DNA, 71 bp, chicken (Gallus Gallus)
  misc_feature (36): n=a or c
aattctacgtaattcctgtatttactcctgatactntaccccaagcactgaacctgttagtcttacatcac

SEQ ID NO: 28837 - DNA, 71 bp, chicken (Gallus Gallus)
  misc_feature (36): n=c or t
aacctcttcaaggatcagaggtatagtggattgcangtaaacttaactgatgaaaggtctagtaggaaaat

SEQ ID NO: 28838 - DNA, 71 bp, chicken (Gallus Gallus)
  misc_feature (36): n=a or g
aaaatgaatcagtctcaagactctatattaaatccncagctgtacaaaaatgaaaacaacccaaactgttc

SEQ ID NO: 28839 - DNA, 71 bp, chicken (Gallus Gallus)
  misc_feature (36): n=c or t
gtcatttgagataggaagtagcaagaccccattganctgggctctaaattacattacttgtaacaacattt

SEQ ID NO: 28840 - DNA, 71 bp, chicken (Gallus Gallus)
  misc_feature (36): n=c or t
tgttaaatgggaatgtaattttttggcaaaatatgnagttcatccaacttttaggggatggtttactgaca

SEQ ID NO: 28841 - DNA, 71 bp, chicken (Gallus Gallus)
  misc_feature (36): n=c or t
ggcagtggtgctactaagtcacttagagtgcctttngtctgagtagggtactctagatgacttagggaaga

SEQ ID NO: 28842 - DNA, 71 bp, chicken (Gallus Gallus)
  misc_feature (36): n=a or c
ttgtgaaaagatatcattgtgtgccctgaagaacangttagataaatgtcttcctacagatggtttagtac

SEQ ID NO: 28843 - DNA, 71 bp, chicken (Gallus Gallus)
  misc_feature (36): n=c or t
acaacaaaacaagaattcaccatcattagtcacaangacattgaaaaagacttctgtttataatgaagaga

SEQ ID NO: 28844 - DNA, 71 bp, chicken (Gallus Gallus)
  misc_feature (36): n=a or c
gtggaatcactgatccttgtttatctgccagtcaancatagttatatcaagcagctcacttttacatgttg

SEQ ID NO: 28845 - DNA, 71 bp, chicken (Gallus Gallus)
  misc_feature (36): n=c or t
atttcctacattctgccattaaaagacatttcatanatccaggttgtatcccattctttaatgacatttat

SEQ ID NO: 28846 - DNA, 71 bp, chicken (Gallus Gallus)
  misc_feature (36): n=a or g
gtctgcttggaaagctgaagataatggcacttcacnctctcagactgttcaaatgaagaatactagtgtat

SEQ ID NO: 28847 - DNA, 71 bp, chicken (Gallus Gallus)
  misc_feature (36): n=a or c
ctagaactagtgcatattttctcctaagtacataantgcttgcagatcacaggcaaaagcatggtgatagt

SEQ ID NO: 28848 - DNA, 71 bp, chicken (Gallus Gallus)
  misc_feature (36): n=g or t
ctccactttctttgagaatctgctttgacattcagncagctacagcgctgtgaaaaagaacatgagctggg

SEQ ID NO: 28849 - DNA, 71 bp, chicken (Gallus Gallus)
  misc_feature (36): n=a or g
gacaggttttttttctgctagaggtcagatctccantcaccagctttttatggtatagaagtaatcagcat

SEQ ID NO: 28850 - DNA, 71 bp, chicken (Gallus Gallus)
  misc_feature (36): n=a or g
tcctctttttgtaaacactgaactgaagcaaaaggngttcactgtaaaaagcctgcttttgggtccttagt

SEQ ID NO: 28851 - DNA, 71 bp, chicken (Gallus Gallus)
  misc_feature (36): n=c or t
cttctggctttgcaaatcagtgcccttaagtactcnggcaagaaattcataatagcaatacaaaaatgaag

SEQ ID NO: 28852 - DNA, 71 bp, chicken (Gallus Gallus)
  misc_feature (36): n=g or t
tacttatctctactccatacaattttctttcttgtnccttccagttctgacagctcactgacaaatgacac

SEQ ID NO: 28853 - DNA, 71 bp, chicken (Gallus Gallus)
  misc_feature (36): n=a or g
aggcctattgtactcacattctttcaaatgagatcnggtctgtttattttcactcatctgcaggaaatggg

SEQ ID NO: 28854 - DNA, 71 bp, chicken (Gallus Gallus)
  misc_feature (36): n=a or c
tttcgtgaaattaattcatcaatggaaaattgtttngtatttgtgtttctgttagatattacaatttttca

SEQ ID NO: 28855 - DNA, 71 bp, chicken (Gallus Gallus)
  misc_feature (36): n=c or t
agtgacagcttctaggaaggcatattcgttgtttanagtcactagtatgttgtggcaattgtgaatgaata

SEQ ID NO: 28856 - DNA, 71 bp, chicken (Gallus Gallus)
  misc_feature (36): n=a or c
gagtgctgtgaaaatagtcttttcagccatatacangtggtcacacaaacaaaaaagaaactgtccaggtg

SEQ ID NO: 28857 - DNA, 71 bp, chicken (Gallus Gallus)
  misc_feature (36): n=a or g
cctgtttcctcaacttcaactattgactgcaaggangaccttcagcatcactgcaaggttataggtcatcc

SEQ ID NO: 28858 - DNA, 71 bp, chicken (Gallus Gallus)
  misc_feature (36): n=a or g
ttgtaggccaccgcttcaatcctgtttctctccagntagacatgggtcagattctccatgcccctaatggc

SEQ ID NO: 28859 - DNA, 71 bp, chicken (Gallus Gallus)
  misc_feature (36): n=c or t
aaccttaagaaattaagtcgctcctgtacttcttgnacatgactgtatctgcttcctggtcttacggtttg

SEQ ID NO: 28860 - DNA, 71 bp, chicken (Gallus Gallus)
  misc_feature (36): n=a or g
ttgtaaagatgtatatgtggcgtacttgctagttgnttgagaagaagatcaacccacactccatagtaaga

SEQ ID NO: 28861 - DNA, 71 bp, chicken (Gallus Gallus)
  misc_feature (36): n=a or g
cagctatcccacaaagtgccgtaacgggtttaaacntgtcaaaggtttgagagttttagcgtaagccttgg

SEQ ID NO: 28862 - DNA, 71 bp, chicken (Gallus Gallus)
  misc_feature (36): n=g or t
tggagaggggcaggtgtgtggggtaaggcactcggngcttcttaaaaggcagtaatagctcatgggagagc

SEQ ID NO: 28863 - DNA, 71 bp, chicken (Gallus Gallus)
  misc_feature (36): n=a or c
aaaggcgaacagcttctccttgtccttgctgggcanacaagtgctgccaggcctcccgttggctcggtgct

SEQ ID NO: 28864 - DNA, 71 bp, chicken (Gallus Gallus)
  misc_feature (36): n=c or t
caacattcaaatggtgctttggcccagcagagcttntggcagtgagctgatggcacgcctggtagctgcag

SEQ ID NO: 28865 - DNA, 71 bp, chicken (Gallus Gallus)
  misc_feature (36): n=a or g
tttcccacagcttgctctccaaaacacccaagctcnattgctggtgacattatttcagaaaccactcgcca

SEQ ID NO: 28866 - DNA, 71 bp, chicken (Gallus Gallus)
  misc_feature (36): n=a or g
tctgacttaggcaggagtggaaggcttttgacttcntgtgtggactgactgcctcaacttgggatgtggag

SEQ ID NO: 28867 - DNA, 71 bp, chicken (Gallus Gallus)
  misc_feature (36): n=c or t
agagttgtaaaatcatctctgtacagaggactgcanttcgatatagtgtcccttgtatagcttagaaaacc

SEQ ID NO: 28868 - DNA, 71 bp, chicken (Gallus Gallus)
  misc_feature (36): n=c or t
cctggtgttgtgatgagcagtgccgagtgagaagangtgtacaaacttaacagaatgtactttctgcagca

SEQ ID NO: 28869 - DNA, 71 bp, chicken (Gallus Gallus)
  misc_feature (36): n=a or g
gaagaatcctccaagttcacctccccaagttcttcnacaagtggttccagtcccttcgggaccaacctgct

SEQ ID NO: 28870 - DNA, 71 bp, chicken (Gallus Gallus)
  misc_feature (36): n=a or c
tttgtgctgacaggaaatttgagtaagatgaaacanaatacctcggatgtatagatattaagataaaaaaa

SEQ ID NO: 28871 - DNA, 71 bp, chicken (Gallus Gallus)
  misc_feature (36): n=c or t
cacagggagggtagtgtgacacttactaattagctnctctttgcagtgtttcattaagatactgttattat

SEQ ID NO: 28872 - DNA, 71 bp, chicken (Gallus Gallus)
  misc_feature (36): n=a or g
aaatattcagaacaattctacggagctattctcacngtatattaatcattacttgacatttccatagcagt

SEQ ID NO: 28873 - DNA, 71 bp, chicken (Gallus Gallus)
  misc_feature (36): n=c or t
gtatcttcccagctaacagggtggatcgcatcatcncaggcattcagagcaaaacagaagggataacagaa

SEQ ID NO: 28874 - DNA, 71 bp, chicken (Gallus Gallus)
  misc_feature (36): n=c or t
tgatggatttacagatgaaaaccatgttccgtgaantagtgttgttgactgtgtacatgttaaagatgatg

SEQ ID NO: 28875 - DNA, 71 bp, chicken (Gallus Gallus)
  misc_feature (36): n=c or t
ctgccagacgagctgcctaagtgtcctagacacacngccaaacttgataccaacatcttaatgctcacacc

SEQ ID NO: 28876 - DNA, 71 bp, chicken (Gallus Gallus)
  misc_feature (36): n=a or g
aaagggcagaaaaggcttatgtctgtactacctttntgagagcgttccaaaatatgccaggttatcaggta

SEQ ID NO: 28877 - DNA, 71 bp, chicken (Gallus Gallus)
  misc_feature (36): n=a or g
tatatatattaatagtacagatttttaatctagcantttctacaacctctctcttaaaagaaagtgcaaga

SEQ ID NO: 28878 - DNA, 71 bp, chicken (Gallus Gallus)
  misc_feature (36): n=c or t
gcccttgataactgtcagctcttctaactgctgttntcttcattcatttattctatcagtcctattttttc

SEQ ID NO: 28879 - DNA, 71 bp, chicken (Gallus Gallus)
  misc_feature (36): n=a or g
tgtgtattaattattggatacagaattcagcttaanaaatacagtatgcaattgaagatacaaaaatgtat

SEQ ID NO: 28880 - DNA, 71 bp, chicken (Gallus Gallus)
  misc_feature (36): n=c or t
gcagctagcaaataacaggaatctgcctcagagttngtaagttcaattttggacaatttagctcttcgtct

SEQ ID NO: 28881 - DNA, 71 bp, chicken (Gallus Gallus)
  misc_feature (36): n=a or g
tgtaatacataatgtgttggttcatcccggattcantaacatcttggtagctatttttcaatctaggaagc

SEQ ID NO: 28882 - DNA, 71 bp, chicken (Gallus Gallus)
  misc_feature (36): n=g or t
atggaataagtgcctttgcaaagtcctggctttgtntctctatcagtctacctttaaaatgctaagcaaaa

SEQ ID NO: 28883 - DNA, 71 bp, chicken (Gallus Gallus)
  misc_feature (36): n=a or c
aaattactgaaacacacagtccttctgtctggtagntatcatatgtatgcatagagaattttgtctactag

SEQ ID NO: 28884 - DNA, 71 bp, chicken (Gallus Gallus)
  misc_feature (36): n=a or c
aaaattccaaaatatttgacctaattttcatctacnttgaggttggtaccacactaagaaaagaaagaaaa

SEQ ID NO: 28885 - DNA, 71 bp, chicken (Gallus Gallus)
  misc_feature (36): n=a or g
taagtcagatctatctgactttaatatgaactgctnacaaacacattctgcttcaaatcccttctaacact

SEQ ID NO: 28886 - DNA, 71 bp, chicken (Gallus Gallus)
  misc_feature (36): n=g or t
cagttaatttgcttgcagtgtgctgaatccagctanagacccgagcaattgcattgtaattcatggatgag

SEQ ID NO: 28887 - DNA, 71 bp, chicken (Gallus Gallus)
  misc_feature (36): n=c or t
tataaatggaaaattgttctgagctgtattatcttngtcctgctgattctctgggttagttacctctgtgt

SEQ ID NO: 28888 - DNA, 71 bp, chicken (Gallus Gallus)
  misc_feature (36): n=g or t
gactgcattttatctaaaccagagcagagtgaatgngagcccacacatgcagaatcagggcctaagttctc

SEQ ID NO: 28889 - DNA, 71 bp, chicken (Gallus Gallus)
  misc_feature (36): n=c or t
atgagttgtaatggtgtgataatatcccagtgatangggttgccacatgatgtattttctagcagttgaaa

SEQ ID NO: 28890 - DNA, 71 bp, chicken (Gallus Gallus)
  misc_feature (36): n=a or g
aactcaataaccatacagttatcatgcaaaatagtntattttagaacccaacagagagaaaataaggaaca

SEQ ID NO: 28891 - DNA, 71 bp, chicken (Gallus Gallus)
  misc_feature (36): n=c or t
ggggctccttgagacaggcagacacttctctgcacngtgccttccggtaatgctgtacctttagcaggcgc

SEQ ID NO: 28892 - DNA, 71 bp, chicken (Gallus Gallus)
  misc_feature (36): n=a or g
atcttttccttcttggagtacctttgggtaagtgantacatctcagtattgttaggagttgctaagagttg

SEQ ID NO: 28893 - DNA, 71 bp, chicken (Gallus Gallus)
  misc_feature (36): n=c or t
tttagtatataagttaagtgaaatgattgtgttagntattgatggttataacaaatgcattattattcacc

SEQ ID NO: 28894 - DNA, 71 bp, chicken (Gallus Gallus)
  misc_feature (36): n=a or g
ccccattcaagggaagaaaactgaactgctgcctcngtactactgccattatcacagggtatagtcctgag

SEQ ID NO: 28895 - DNA, 71 bp, chicken (Gallus Gallus)
  misc_feature (36): n=c or t
aaaaagccacttacaaggatatgagaaaataaaaanttgacatgtgaagggcattcaggaatgaaagggag

SEQ ID NO: 28896 - DNA, 71 bp, chicken (Gallus Gallus)
  misc_feature (36): n=a or g
gagaaggactgtgggtggttctggtaaagcttttcnaaggacagtgttctctattccagtattgttactgt

SEQ ID NO: 28897 - DNA, 71 bp, chicken (Gallus Gallus)
  misc_feature (36): n=c or t
ttctgcatcaaaattagaagagagtaccaataaatncccaaattatcaccagagcactttcagtaagctgt

SEQ ID NO: 28898 - DNA, 71 bp, chicken (Gallus Gallus)
  misc_feature (36): n=a or c
ttcacggttggctccctgtaatgctattatggatanactgagacaaaagtctgagcaaagtttttcattat

SEQ ID NO: 28899 - DNA, 71 bp, chicken (Gallus Gallus)
  misc_feature (36): n=a or g
attttcttacaagaataccttgttttctatgtgtcntattcagaaacaaacttggatatattctctctgtt

SEQ ID NO: 28900 - DNA, 71 bp, chicken (Gallus Gallus)
  misc_feature (36): n=c or t
gttatttaataaactgatttggttttgaccaccttnatttctgaacaaatacttttgttccattttcccaa

SEQ ID NO: 28901 - DNA, 71 bp, chicken (Gallus Gallus)
  misc_feature (36): n=c or t
tcatagccctgtttgtcacaggtgtgaaatttctanttcttaaatttctgttcatctgtccttcccctcct

SEQ ID NO: 28902 - DNA, 71 bp, chicken (Gallus Gallus)
  misc_feature (36): n=a or g
aaatctttcagaactgccttttagaattaaattatnagaaggtaaaaggcttcacctcatgtataaccctt

SEQ ID NO: 28903 - DNA, 71 bp, chicken (Gallus Gallus)
  misc_feature (36): n=c or t
gattgactgaccatattgcttgggtttctacagctntcaatgttcccacactcactgctgattagcaacat

SEQ ID NO: 28904 - DNA, 71 bp, chicken (Gallus Gallus)
  misc_feature (36): n=a or g
aaaggatagacaaatccatgtgacaaccaagtaaantggggctgtaagcagttcatgttgagttctagcct

SEQ ID NO: 28905 - DNA, 71 bp, chicken (Gallus Gallus)
  misc_feature (36): n=a or g
cttagccttaattgctgcatgcttgatcaataacgnatgtgccttaccgtaatatatagtttgaagcttat

SEQ ID NO: 28906 - DNA, 71 bp, chicken (Gallus Gallus)
  misc_feature (36): n=a or g
gactgcataaaatggtagtgctactgctgtagcaangacttggcatacatgagggctgatccgaaagtaat

SEQ ID NO: 28907 - DNA, 71 bp, chicken (Gallus Gallus)
  misc_feature (36): n=g or t
cctacctttcctgcctggtaaattttccagctgacncactaggatttttgtaaggatcaaagtctgtggtg

SEQ ID NO: 28908 - DNA, 71 bp, chicken (Gallus Gallus)
  misc_feature (36): n=a or g
actgagtgcttagcagtctactgtgcaaagagcacnttgacaggcatttaagactcttgtctcattttgca

SEQ ID NO: 28909 - DNA, 71 bp, chicken (Gallus Gallus)
  misc_feature (36): n=a or g
acccgccttctgttcttgtgttttgagggctgtgcntattctccaaaacgtagggaacattgaaaagggta

SEQ ID NO: 28910 - DNA, 71 bp, chicken (Gallus Gallus)
  misc_feature (36): n=a or g
ggccccatgctcactgtggctgcatcagtgagactntgtcatcttcaagcaccagaagtggctccatagag

SEQ ID NO: 28911 - DNA, 71 bp, chicken (Gallus Gallus)
  misc_feature (36): n=c or t
ttgaaagtactatttgtgggaaatcgtatgcacacntcaattaagctgtgatataaatgcaatttaaaatg

SEQ ID NO: 28912 - DNA, 71 bp, chicken (Gallus Gallus)
  misc_feature (36): n=g or t
tggttgagtaatgacggctgtgaagcatttcctttntggaaacctcattttatgtcattacgaattttcaa

SEQ ID NO: 28913 - DNA, 71 bp, chicken (Gallus Gallus)
  misc_feature (36): n=g or t
tgttttatgtgtttctgtaggaatatgaactttaantgttgcagtatggaaggtgcatgctgaagattaaa

SEQ ID NO: 28914 - DNA, 71 bp, chicken (Gallus Gallus)
  misc_feature (36): n=a or g
cctagatttatgtgtacatttcagagctacccactnttgttttagtgttcatatgcaggttgttcacatca

SEQ ID NO: 28915 - DNA, 71 bp, chicken (Gallus Gallus)
  misc_feature (36): n=a or g
tattaacttcttccacaatgcatgtgaggaatagcntgattaaatctttttatgacaatttgttcaattta

SEQ ID NO: 28916 - DNA, 71 bp, chicken (Gallus Gallus)
  misc_feature (36): n=a or g
aagcttgtgttcagtaggttgagggaaatgtgaaantaaaagtaatggtatgaagaggtaagattcatgtt

SEQ ID NO: 28917 - DNA, 71 bp, chicken (Gallus Gallus)
  misc_feature (36): n=c or t
tcagtgcccggacaatttgtagttggcagtgatctnctaaaggcaggaaatgtaaaagcagtgttgttatg

SEQ ID NO: 28918 - DNA, 71 bp, chicken (Gallus Gallus)
  misc_feature (36): n=a or g
catggtagtctgtgtaaaacagatgaaaactaagantttgaaatataccattgtgattaaaatatatacca

SEQ ID NO: 28919 - DNA, 71 bp, chicken (Gallus Gallus)
  misc_feature (36): n=a or c
ccagtgcctgaaaacaggactttcacgtagtcttgnttgtctaaaatgtaatgctacctgcagggcttcaa

SEQ ID NO: 28920 - DNA, 71 bp, chicken (Gallus Gallus)
  misc_feature (36): n=a or g
tttccaacatctttccttcaatcatgcaaacagacngccttaataatattgttaaggtgattcttatgtct

SEQ ID NO: 28921 - DNA, 71 bp, chicken (Gallus Gallus)
  misc_feature (36): n=c or t
agccagtctccaagaaggttccttaatctcagttanttttcttttgtttacctctaagataagaaatagct

SEQ ID NO: 28922 - DNA, 71 bp, chicken (Gallus Gallus)
  misc_feature (36): n=c or t
cattctgttgtatatctatactagcaaacagttcangaagatacaacttttgtgatgactgaaagtatgac

SEQ ID NO: 28923 - DNA, 71 bp, chicken (Gallus Gallus)
  misc_feature (36): n=c or t
aacataagtatgtagtctcaatagcacatgctgagntgttcatgatgtattttttgcatctcttggacatg

SEQ ID NO: 28924 - DNA, 71 bp, chicken (Gallus Gallus)
  misc_feature (36): n=c or t
acagtcatgggaagttaaactgctgttttctaatcngctctcatacaatagctggacaacttgacacttac

SEQ ID NO: 28925 - DNA, 71 bp, chicken (Gallus Gallus)
  misc_feature (36): n=g or t
tttgtagaagtatacaggttgtcaaagaaagaaganaactccatgtgttttaatgatgtacagcaatgata

SEQ ID NO: 28926 - DNA, 71 bp, chicken (Gallus Gallus)
  misc_feature (36): n=a or g
tatagaagtagaatctaattgaaagaatgctttggnttcctactcatttctatttagctgtaatacaaacg

SEQ ID NO: 28927 - DNA, 71 bp, chicken (Gallus Gallus)
  misc_feature (36): n=a or g
taaagtgatttgggaagcattagaaggtgaaaactnctactctactgatttgtacaaatgctatagaaaag

SEQ ID NO: 28928 - DNA, 71 bp, chicken (Gallus Gallus)
  misc_feature (36): n=c or t
tatagaaaaagatttcctcacagagttaggatgtcnatagctgacctgaacagtaaattttttgtgttctt

SEQ ID NO: 28929 - DNA, 71 bp, chicken (Gallus Gallus)
  misc_feature (36): n=c or t
ttagggctggcctctgcctcacttgatattcctaantgtggaaataaatcctgaggatagaggttagaatt

SEQ ID NO: 28930 - DNA, 71 bp, chicken (Gallus Gallus)
  misc_feature (36): n=a or g
atgttgcttgtaaaagtcttggagactggcatgacntagctgattttagtaaaaaggataaagcatataaa

SEQ ID NO: 28931 - DNA, 71 bp, chicken (Gallus Gallus)
  misc_feature (36): n=c or t
ggggttgatgtcttggtgtctgaggttatctggtgnacagtaaacgttctgctctgacatgaaggaataac

SEQ ID NO: 28932 - DNA, 71 bp, chicken (Gallus Gallus)
  misc_feature (36): n=c or t
gaaggggtgaatgacgtggcacttaagctgctccgngattattcagcagatgacaccagaaaagtagaact

SEQ ID NO: 28933 - DNA, 71 bp, chicken (Gallus Gallus)
  misc_feature (36): n=a or c
aaaccaagctcatgtgcttcatgaagtttcagcttntttgtattttgttatagaaaagcacctgctttcac

SEQ ID NO: 28934 - DNA, 71 bp, chicken (Gallus Gallus)
  misc_feature (36): n=a or g
tgccatttagacatcatttgtatatgcatgttatantaacttagtgtctttttcaataaatattagccttt

SEQ ID NO: 28935 - DNA, 71 bp, chicken (Gallus Gallus)
  misc_feature (36): n=c or t
ctgccattgagagcattttagtcaattgaacccagntgtcaaagagcatatttcatccctatacttcagca

SEQ ID NO: 28936 - DNA, 71 bp, chicken (Gallus Gallus)
  misc_feature (36): n=c or t
cgtactttcttcttgggatgcttgtgataccagttngcagactagatcaggatgtttccatgcaagcacgc

SEQ ID NO: 28937 - DNA, 71 bp, chicken (Gallus Gallus)
  misc_feature (36): n=c or t
tttccctttgtcttcagtcacccacagtcctcaagngcattccagcaaatgccaactggaatgaaagccgg

SEQ ID NO: 28938 - DNA, 71 bp, chicken (Gallus Gallus)
  misc_feature (36): n=a or c
gtcatgactgagtaattttcaactcatacagacagntacaactgggaccgctacaatagcaaaggcaggag

SEQ ID NO: 28939 - DNA, 71 bp, chicken (Gallus Gallus)
  misc_feature (36): n=a or c
tcatccccaaaccatcttgatccacctcctctccancctctggttcctccttcatgttgtatgcaatcttt

SEQ ID NO: 28940 - DNA, 71 bp, chicken (Gallus Gallus)
  misc_feature (36): n=a or g
cagtcagtgcaattcagaggtactatctccctttcnaatgtcacaccccaatgaaaaatctgggaactgga

SEQ ID NO: 28941 - DNA, 71 bp, chicken (Gallus Gallus)
  misc_feature (36): n=a or g
aacaattaaaaccagtagcatgtttcagtgacaacnttactgaccacacctaacaaggaaaaagaactctg

SEQ ID NO: 28942 - DNA, 71 bp, chicken (Gallus Gallus)
  misc_feature (36): n=a or g
tttattatgaaagagttcactgtctttcttcatacntgtttagtgctacgtacttgctgcaagctagtttg

SEQ ID NO: 28943 - DNA, 71 bp, chicken (Gallus Gallus)
  misc_feature (36): n=c or t
cctagcatgagagcaaagaaaagttaaaactagganatttaaaagataaacagttactgcagttcctgaat

SEQ ID NO: 28944 - DNA, 71 bp, chicken (Gallus Gallus)
  misc_feature (36): n=a or g
atttttcagcaaatgtagaatcagattccagcctcnctgcatcagttctcagttccgttattcatgggtac

SEQ ID NO: 28945 - DNA, 71 bp, chicken (Gallus Gallus)
  misc_feature (36): n=c or t
aaactataaagccagagtaaagctgtctggcataanctcctctgacatgccaatggtatgtttgtcaggtg

SEQ ID NO: 28946 - DNA, 71 bp, chicken (Gallus Gallus)
  misc_feature (36): n=a or c
cagacgtattaattgtgaaccatttaaagctcaganagactaaacagttcttatttatgctgtaatagagt

SEQ ID NO: 28947 - DNA, 71 bp, chicken (Gallus Gallus)
  misc_feature (36): n=g or t
cagtaagcttgttttcacagtatctaggtgaacaangtcaaaccaaagcatgaaatgagataataccaatc

SEQ ID NO: 28948 - DNA, 71 bp, chicken (Gallus Gallus)
  misc_feature (36): n=c or t
ctattttttttccagaattgtctaagaaatggttantacaaattattgtaagctaccattttttttttctt

SEQ ID NO: 28949 - DNA, 71 bp, chicken (Gallus Gallus)
  misc_feature (36): n=a or g
taataggccatcactcttctttccataaccactcancaggtcttcaaggctatatactgtgctcagaagca

SEQ ID NO: 28950 - DNA, 71 bp, chicken (Gallus Gallus)
  misc_feature (36): n=a or g
aatagaggagatttactcttctactccacaatttcncagtacattttgtacagtgggcacaacttacaaag

SEQ ID NO: 28951 - DNA, 71 bp, chicken (Gallus Gallus)
  misc_feature (36): n=g or t
gattatttcttgctgtcttaaaccagaaggatgatncatcaagcctaggcatgtggagcatcgtctgggaa

SEQ ID NO: 28952 - DNA, 71 bp, chicken (Gallus Gallus)
  misc_feature (36): n=a or g
taaagtagcacaatctttcaaaaagagtaaatatgntatgcttggcaaaattaccattttaatgatgctca

SEQ ID NO: 28953 - DNA, 71 bp, chicken (Gallus Gallus)
  misc_feature (36): n=c or t
tagtgtctaggatatatatagcatttctctataagnaaacgcactgtgactgaacttctatccctacaatt

SEQ ID NO: 28954 - DNA, 71 bp, chicken (Gallus Gallus)
  misc_feature (36): n=a or c
ttctgcatactttgttccatgaagtgcaaaaagganaaggaaaaggaaatctatttcaaacaggtaggtaa

SEQ ID NO: 28955 - DNA, 71 bp, chicken (Gallus Gallus)
  misc_feature (36): n=c or t
gtgacaatttgtaatatcaaaacaaggattgcacantgggatggaaacaaagggaagatgctggtcactgc

SEQ ID NO: 28956 - DNA, 71 bp, chicken (Gallus Gallus)
  misc_feature (36): n=g or t
gacaaaaatagatatgagagacataattaagtgcanatgcagtattgttctctacctcacaaatgtgttat

SEQ ID NO: 28957 - DNA, 71 bp, chicken (Gallus Gallus)
  misc_feature (36): n=a or g
gtctaatagataacatcagtgggatctggcattgcngtcttacagttatataaacaatagcaatggaatca

SEQ ID NO: 28958 - DNA, 71 bp, chicken (Gallus Gallus)
  misc_feature (36): n=c or t
ggaaggctttgcgtgtcatccttcccataacatatntcatcataactgtatataattgtgccaacagggct

SEQ ID NO: 28959 - DNA, 71 bp, chicken (Gallus Gallus)
  misc_feature (36): n=c or t
aaaaacagtctgatgtttttcatcagacataatagnttttgatggactgtcacaaagtatttacctgatta

SEQ ID NO: 28960 - DNA, 71 bp, chicken (Gallus Gallus)
  misc_feature (36): n=c or t
ttatttcccagttggttgcaatggtgggagcactgncattttagaccctacttctcaagtccttcagttca

SEQ ID NO: 28961 - DNA, 71 bp, chicken (Gallus Gallus)
  misc_feature (36): n=c or t
gattgcattgaatggttatttagaaatttgataaanactggattacactgttggtggtaatccagaaatac

SEQ ID NO: 28962 - DNA, 71 bp, chicken (Gallus Gallus)
  misc_feature (36): n=a or g
agagtccatgtagatccttaggttaccaatacattnatggaaatctgaattcctgaaatataaacagttca

SEQ ID NO: 28963 - DNA, 71 bp, chicken (Gallus Gallus)
  misc_feature (36): n=c or t
aactctaggaacactgaaatcctgactgaagttatntactttttaaaatctacaagcaaatcatataagaa

SEQ ID NO: 28964 - DNA, 71 bp, chicken (Gallus Gallus)
  misc_feature (36): n=a or g
ttcaatctttttgacgacagaaaatacttccagagnttttattctccatgtggtctactagttgacctctt

SEQ ID NO: 28965 - DNA, 71 bp, chicken (Gallus Gallus)
  misc_feature (36): n=a or c
taaaaattgatatagataattcaacaaataagcaanaaattccaggtcattttatttaaggtgtataatat

SEQ ID NO: 28966 - DNA, 71 bp, chicken (Gallus Gallus)
  misc_feature (36): n=a or g
aatttttctgaattactctgaaagaagaattttcangaaaatattgatgcttgcacagaacattaaagaag

SEQ ID NO: 28967 - DNA, 71 bp, chicken (Gallus Gallus)
  misc_feature (36): n=c or t
caggagagagacgaatcagattgtggatcagccttnacctcttcagacgtaaacaaagatttccatttcta

SEQ ID NO: 28968 - DNA, 71 bp, chicken (Gallus Gallus)
  misc_feature (36): n=c or t
ccagactacaagctgttgaaagcgcagactaaaacncattgtgttttagagttatccacacttaattcact

SEQ ID NO: 28969 - DNA, 71 bp, chicken (Gallus Gallus)
  misc_feature (36): n=a or c
gcctgacttagatcccagatgtaaggctagcagtgngctaatgcactctaaggagttaagtaactgtttat

SEQ ID NO: 28970 - DNA, 71 bp, chicken (Gallus Gallus)
  misc_feature (36): n=a or g
tttacttagatgttatttgtgtttaagagctctccnttagatattcgtactcaaaggaagggctattttgg

SEQ ID NO: 28971 - DNA, 71 bp, chicken (Gallus Gallus)
  misc_feature (36): n=c or t
agcaaaatttattagttttccttgacttccttaaantatcaacagacaatactgcagggattaacataact

SEQ ID NO: 28972 - DNA, 71 bp, chicken (Gallus Gallus)
  misc_feature (36): n=c or t
aaacaattatgtgacacagacttgctgctgtttcantgctcctctcctatttgcattaatttaatcaaaat

SEQ ID NO: 28973 - DNA, 71 bp, chicken (Gallus Gallus)
  misc_feature (36): n=c or t
aaatgtgtacagtggactcctccttctccttttganctgcattagtcaaaatatgctcgagttaaagtttt

SEQ ID NO: 28974 - DNA, 71 bp, chicken (Gallus Gallus)
  misc_feature (36): n=a or g
tccaggaatcttgatgcttgtctgcattagccagcngcagtgtttccatgaaggcagcaggcacgctccat

SEQ ID NO: 28975 - DNA, 71 bp, chicken (Gallus Gallus)
  misc_feature (36): n=c or t
catacttgcttaaacacccttctgcatgtgttagtnttaccatgctaaattataagttaaacattttggtg

SEQ ID NO: 28976 - DNA, 71 bp, chicken (Gallus Gallus)
  misc_feature (36): n=a or c
atacactcttaaaaaagtaggtttactacacatcanggctctatacaattgtgtggacttttattacatag

SEQ ID NO: 28977 - DNA, 71 bp, chicken (Gallus Gallus)
  misc_feature (36): n=c or t
tatgtttggaaaatggatagtcaaatacagttatangcatcatattttgtcactaactatgaaatgacata

SEQ ID NO: 28978 - DNA, 71 bp, chicken (Gallus Gallus)
  misc_feature (36): n=a or g
tctatcaatatgtcaactcagtatataagctcttcngaaatactcactacctttccagggaaatcttccaa

SEQ ID NO: 28979 - DNA, 71 bp, chicken (Gallus Gallus)
  misc_feature (36): n=a or g
taatcttaataatatttatgatccttctgtaagctnaagtatgctgtgtatgttgaggcaataaaacaaac

SEQ ID NO: 28980 - DNA, 71 bp, chicken (Gallus Gallus)
  misc_feature (36): n=a or c
ttccaactgttctgactgttgtctcttggcttcccnttttactcctcagtaaaaaagcctagctcagtctt

SEQ ID NO: 28981 - DNA, 71 bp, chicken (Gallus Gallus)
  misc_feature (36): n=a or c
gtttgtcaacttttcataggtagttttgcttctccncttgcttacacaacaaatttgggatagcctttgtg

SEQ ID NO: 28982 - DNA, 71 bp, chicken (Gallus Gallus)
  misc_feature (36): n=a or g
aacctgtgcattctttctgtactctgatattaagcnttaggaatgagagttttgtgtttagctacacaagt

SEQ ID NO: 28983 - DNA, 71 bp, chicken (Gallus Gallus)
  misc_feature (36): n=a or c
ttacattgtattatactatattatattgattttacnatgactatcctccgtactgttctcatattactttt

SEQ ID NO: 28984 - DNA, 71 bp, chicken (Gallus Gallus)
  misc_feature (36): n=c or t
tcactcttaaccatctgtgaaatctgaccatttctnacaatgaaaattataacgtgtcagcttctcactct

SEQ ID NO: 28985 - DNA, 71 bp, chicken (Gallus Gallus)
  misc_feature (36): n=c or t
acttcagtgagaatctttctaccttttcaattcaanggacttcaattttctaacttctaggaaattttatg

SEQ ID NO: 28986 - DNA, 71 bp, chicken (Gallus Gallus)
  misc_feature (36): n=a or c
taaaaatcttagacttgaagaaaaatacagggtaanaaactgtgttagacaaaagaaaaatgaagacactc

SEQ ID NO: 28987 - DNA, 71 bp, chicken (Gallus Gallus)
  misc_feature (36): n=a or g
attttgtgtcactttctggacaataaagctcttcanctaactcttaagatacttgtaacaaacatttaagg

SEQ ID NO: 28988 - DNA, 71 bp, chicken (Gallus Gallus)
  misc_feature (36): n=a or g
gtcatcaatgggaaaagagaaattcattgaaaaatnttatccaagccctgaccttatctccactcccaggt

SEQ ID NO: 28989 - DNA, 71 bp, chicken (Gallus Gallus)
  misc_feature (36): n=c or t
tattaagtaaacttttgtgagattgttgctatatgnagtaacacagactctagaaacttcacagtatgttt

SEQ ID NO: 28990 - DNA, 71 bp, chicken (Gallus Gallus)
  misc_feature (36): n=c or t
aaaattgatacctgagatcccaggatctgtggaganagatggaagcaaatcctttgaaagacctttatatg

SEQ ID NO: 28991 - DNA, 71 bp, chicken (Gallus Gallus)
  misc_feature (36): n=c or t
gcatccaacaacagttttgaagttatatttgttttnttattatttaatacagcaaaaatttaggaaatata

SEQ ID NO: 28992 - DNA, 71 bp, chicken (Gallus Gallus)
  misc_feature (36): n=c or t
aagtgaagtgcatcagtgacctcaaacaaagattantgaaggctctgtctccacgatatttctgagttctg

SEQ ID NO: 28993 - DNA, 71 bp, chicken (Gallus Gallus)
  misc_feature (36): n=a or g
attttgctgaatggacagtttttctcttcatattcntgttgtacagacctactggtctcagtcataaagct

SEQ ID NO: 28994 - DNA, 71 bp, chicken (Gallus Gallus)
  misc_feature (36): n=c or t
ccctactagagttttccaaggtagggttacaacatngtaccagaagaggcatcctttcctccttctctaag

SEQ ID NO: 28995 - DNA, 71 bp, chicken (Gallus Gallus)
  misc_feature (36): n=c or t
cacctgcttgcaaatcctaattgcagttctaaatgnaatttacgtaggttgttaagaaccttgcttaactt

SEQ ID NO: 28996 - DNA, 71 bp, chicken (Gallus Gallus)
  misc_feature (36): n=a or g
atagtcacagagacagctggtatccttacagcaagngactgcactacatctgttgttccaccacagggtta

SEQ ID NO: 28997 - DNA, 71 bp, chicken (Gallus Gallus)
  misc_feature (36): n=c or t
acaaagtatgagattcaactgcaatgagaaatactnagattttggaaaatgtcagcatattcacaaccctg

SEQ ID NO: 28998 - DNA, 71 bp, chicken (Gallus Gallus)
  misc_feature (36): n=c or t
ggacctgaaagcaaggaaagtgtctaaaaatcattngggagaatgttagtcatcacaggtcaaaaccatgc

SEQ ID NO: 28999 - DNA, 71 bp, chicken (Gallus Gallus)
  misc_feature (36): n=a or g
cccagcaggtgccttctgcaggtactgtgagtccangcaatgccaagaagcagtcataaagttaacaccgt

SEQ ID NO: 29000 - DNA, 71 bp, chicken (Gallus Gallus)
  misc_feature (36): n=c or t
tgttgttcaataatcaagatgcttctaatttcctcntggttaaccaaaacatgattttaagtacaacccat

SEQ ID NO: 29001 - DNA, 71 bp, chicken (Gallus Gallus)
  misc_feature (36): n=c or t
atgactttaaaccatttgttaaagcaaagatagatntgaggctactaggacagcctgtacaagttggtact

SEQ ID NO: 29002 - DNA, 71 bp, chicken (Gallus Gallus)
  misc_feature (36): n=c or t
caacccaggccattcaatgactttttcagcgacacngaaattacctgcccatactctactcaacaaagctg

SEQ ID NO: 29003 - DNA, 71 bp, chicken (Gallus Gallus)
  misc_feature (36): n=a or c
gaggaggtcataacattttaagataagctgtccccnacctccctctgccaaaataacagatctctcttgga

SEQ ID NO: 29004 - DNA, 71 bp, chicken (Gallus Gallus)
  misc_feature (36): n=a or g
gtgaagtgcttatgtggaagaggtgagttatggggnaaaaagccacaaaccagaagggagaaaatgtgaag

SEQ ID NO: 29005 - DNA, 71 bp, chicken (Gallus Gallus)
  misc_feature (36): n=a or g
gaacactttctctgacatgctcccacatcacaaagngagaaaaaagaatcagtgaagaagctcacaggtac

SEQ ID NO: 29006 - DNA, 71 bp, chicken (Gallus Gallus)
  misc_feature (36): n=c or t
gaatttaagctacaggaacgggaagaaaagaaatcntccaatattcttcaattttcaagaattgcacttca

SEQ ID NO: 29007 - DNA, 71 bp, chicken (Gallus Gallus)
  misc_feature (36): n=a or g
ggaggcctctgttacaatggtcattacagtgactcnattctcacctttgatccagaggaaaacaagtggaa

SEQ ID NO: 29008 - DNA, 71 bp, chicken (Gallus Gallus)
  misc_feature (36): n=c or t
tgaacaaatattttgtatttgtagtggaatattctnagtgtggtgaaatgaagtaatccaagatgaatact

SEQ ID NO: 29009 - DNA, 71 bp, chicken (Gallus Gallus)
  misc_feature (36): n=g or t
aatcactcttcattggagaactggaaataagcacancaaagtacatctacagttgaggtacaatgtttgat

SEQ ID NO: 29010 - DNA, 71 bp, chicken (Gallus Gallus)
  misc_feature (36): n=c or t
agaggaacaagtcctttcgaacactgtaagtaagcnctctcttttgaggctcttttgaaaggaaattaagc

SEQ ID NO: 29011 - DNA, 71 bp, chicken (Gallus Gallus)
  misc_feature (36): n=c or t
tcacttgcaaaaatattgagagagagttatacactnggtgattacatggaatttcttgagagcatgtcttg

SEQ ID NO: 29012 - DNA, 71 bp, chicken (Gallus Gallus)
  misc_feature (36): n=a or g
ttttcaaactgcttcttgacaaaagtgataaaacanaagtctgcaagtaatttcaccttcatgttgcaaca

SEQ ID NO: 29013 - DNA, 71 bp, chicken (Gallus Gallus)
  misc_feature (36): n=a or c
tccattctgtgcaaagttgtgatgggtggagggganagaagggaagagcacaatcagtgtttaatcagtaa

SEQ ID NO: 29014 - DNA, 71 bp, chicken (Gallus Gallus)
  misc_feature (36): n=c or t
aggaccaacagtgagagagaaggtcagccagcttcncagaactgctgggctgagactgtgatctctgcgta

SEQ ID NO: 29015 - DNA, 71 bp, chicken (Gallus Gallus)
  misc_feature (36): n=c or t
acaaatctgctcacaatcacagctggagtggcttanagtggagacaggtcgtgctgggatctttcactttg

SEQ ID NO: 29016 - DNA, 71 bp, chicken (Gallus Gallus)
  misc_feature (36): n=c or t
tgaccttgctatcctcctctttccactgtagacagngctcagaacaggccacccgcattaacttgcccctt

SEQ ID NO: 29017 - DNA, 71 bp, chicken (Gallus Gallus)
  misc_feature (36): n=a or g
tgtgacctagaaatagatctgaaaagtcagtagatnctatagatattactcaaaaagcaaaaatcttgtca

SEQ ID NO: 29018 - DNA, 71 bp, chicken (Gallus Gallus)
  misc_feature (36): n=a or g
atatttcacagattagatgaaactcctatttcctangtgaaatctctaatcatcagcacctcttccttgct

SEQ ID NO: 29019 - DNA, 71 bp, chicken (Gallus Gallus)
  misc_feature (36): n=a or c
ttgacaaataaggatgataccagtgttggtagctangtacctaatgaagtagtgccactcacccatagggg

SEQ ID NO: 29020 - DNA, 71 bp, chicken (Gallus Gallus)
  misc_feature (36): n=a or g
cacactttcctttgagtgttacccagtatctaccancttttatctgagggatctcctgaggtagaaccaac

SEQ ID NO: 29021 - DNA, 71 bp, chicken (Gallus Gallus)
  misc_feature (36): n=c or t
acgtgaaaccctttgatttcactggtaaagcactantgcagcaagcaaagagaggatgtcagtagagaact

SEQ ID NO: 29022 - DNA, 71 bp, chicken (Gallus Gallus)
  misc_feature (36): n=c or t
tcttggactcaattatcagagcaccagaaatagggntttgaccacagactgcattaaacagctaagatcca

SEQ ID NO: 29023 - DNA, 71 bp, chicken (Gallus Gallus)
  misc_feature (36): n=c or t
atggagttgaggataaagacatactgttgacccttnctgtggttgtgtaaaattatctggtgagcagcaga

SEQ ID NO: 29024 - DNA, 71 bp, chicken (Gallus Gallus)
  misc_feature (36): n=g or t
tagaaaggcagatatctgagaggaaatactgctacntggcatgaaatacagtgttttaacaacattagtac

SEQ ID NO: 29025 - DNA, 71 bp, chicken (Gallus Gallus)
  misc_feature (36): n=g or t
tttcaaatgtgtaatttatgaaatagaagtggctgnttgaattatacaaagttcccacattaaagttgtat

SEQ ID NO: 29026 - DNA, 71 bp, chicken (Gallus Gallus)
  misc_feature (36): n=c or t
tgaaattaagttgtagtttgcagtgctaccatcttncttgatgctggtctgtgtggattctaattatgggc

SEQ ID NO: 29027 - DNA, 71 bp, chicken (Gallus Gallus)
  misc_feature (36): n=a or g
cagcttgcacagttgttagaagactattggacactngtaagatatgcaaggggaaaggtcatctgtatttt

SEQ ID NO: 29028 - DNA, 71 bp, chicken (Gallus Gallus)
  misc_feature (36): n=a or g
ttattgtgaagacaatatagtgtcaatatcctgaangtaaaaatagctacccctgacgttctctgcttttc

SEQ ID NO: 29029 - DNA, 71 bp, chicken (Gallus Gallus)
  misc_feature (36): n=c or t
gtgggtgagctctccgttgtggagatgtgtgtatcntcctcttagcaaagaagtgatgaattacctgtggt

SEQ ID NO: 29030 - DNA, 71 bp, chicken (Gallus Gallus)
  misc_feature (36): n=a or g
agtataaaagggtaccacagaagaggttttgagatncttttgaagctgttggcactgtgagactgtacctg

SEQ ID NO: 29031 - DNA, 71 bp, chicken (Gallus Gallus)
  misc_feature (36): n=a or g
gtctagttactctgtctgtcttatatttgcttgtgnaaggatcatcttgccttgtcacttagttcttgtgt

SEQ ID NO: 29032 - DNA, 71 bp, chicken (Gallus Gallus)
  misc_feature (36): n=c or t
atttcagaagtttattcaaccatggaacttgcatangtttagcccaaagttagctctttttaaactttgag

SEQ ID NO: 29033 - DNA, 71 bp, chicken (Gallus Gallus)
  misc_feature (36): n=a or c
ggctctaaagtacgttacgtgcttcatggtaactgnctatatgaatgcacttagcttttggtaaaaaaaac

SEQ ID NO: 29034 - DNA, 71 bp, chicken (Gallus Gallus)
  misc_feature (36): n=c or t
tgattgccaggaattctccatccctctttttctccnttctgtctcagttcagtgtagaagtgctttcttct

SEQ ID NO: 29035 - DNA, 71 bp, chicken (Gallus Gallus)
  misc_feature (36): n=a or g
tcatcttctaggttctatgcaagttaacaaaagacnaagacactaaataacatagctcctttagaaactct

SEQ ID NO: 29036 - DNA, 71 bp, chicken (Gallus Gallus)
  misc_feature (36): n=a or g
ttcctcctcttagatacgaacagacaaaacacactnaggtgaaactatgggaacttctaaggagaaatgac

SEQ ID NO: 29037 - DNA, 71 bp, chicken (Gallus Gallus)
  misc_feature (36): n=a or g
acgtggcagacattttcctttcatgtccgagccaanaatgcagtgagaaaagttcaaatcttgatgagaat

SEQ ID NO: 29038 - DNA, 71 bp, chicken (Gallus Gallus)
  misc_feature (36): n=a or g
ctgctggaagctgcggtgtgcaccacccccaggagngcacccaggagcgcccacgctgtctgtgctgcagg

SEQ ID NO: 29039 - DNA, 71 bp, chicken (Gallus Gallus)
  misc_feature (36): n=a or g
ggttaatggtaacacaaacactttgcaggcgaatcntggaacatggaaataatgatagtctggaggcattt

SEQ ID NO: 29040 - DNA, 71 bp, chicken (Gallus Gallus)
  misc_feature (36): n=a or c
ttaatgttaatggagatttcagacagctctgaacanttcttccctcaacttccacctctccaaaccagggc

SEQ ID NO: 29041 - DNA, 71 bp, chicken (Gallus Gallus)
  misc_feature (36): n=c or t
cattttaagatgctttagagatccctatcttccttncagtattcccttccaagaaacaaaccaactcaatc

SEQ ID NO: 29042 - DNA, 71 bp, chicken (Gallus Gallus)
  misc_feature (36): n=a or c
gacccttaatatggacccaagtgttccttctgctgntaattgacctaatggatttcatatttgtaactagg

SEQ ID NO: 29043 - DNA, 71 bp, chicken (Gallus Gallus)
  misc_feature (36): n=a or g
ggttaactggcacaacaaacagacacaattcaaganggctgggaagtctgcgattcttatacacgtaagaa

SEQ ID NO: 29044 - DNA, 71 bp, chicken (Gallus Gallus)
  misc_feature (36): n=a or g
aaaaggaggcttagtgttaagacatcatagcatgangcaggaagggatgctcttgctgcacttacaatttt

SEQ ID NO: 29045 - DNA, 71 bp, chicken (Gallus Gallus)
  misc_feature (36): n=c or t
ggtcagccctgtgggctatgtccttagcaccagcancctgacagcatagggcactcctgggagctcatcag

SEQ ID NO: 29046 - DNA, 71 bp, chicken (Gallus Gallus)
  misc_feature (36): n=c or t
aacatttagtgttaccactagggcatattcaagatngcagtaaataacaggccaagaccctgtaggcaaag

SEQ ID NO: 29047 - DNA, 71 bp, chicken (Gallus Gallus)
  misc_feature (36): n=a or g
atgccttgccagtgttgtattacctaccagcaaacntcagtaaactgttgcagaaaaggttaattattcca

SEQ ID NO: 29048 - DNA, 71 bp, chicken (Gallus Gallus)
  misc_feature (36): n=c or t
atgttaaggaattcagtagctaagacttatcctacngaaataagagaatgtgggagaagaaatgctgaagt

SEQ ID NO: 29049 - DNA, 71 bp, chicken (Gallus Gallus)
  misc_feature (36): n=a or g
cattggaaggttttccttatcctactgctgatgttnttattgcctcagaaggacttcaggttggatattag

SEQ ID NO: 29050 - DNA, 71 bp, chicken (Gallus Gallus)
  misc_feature (36): n=g or t
tgcttcgattcacccagatggatgtcctttggaaancactgtggatgataagtattatataagtatttgct

SEQ ID NO: 29051 - DNA, 71 bp, chicken (Gallus Gallus)
  misc_feature (36): n=a or c
tcagaacaaactaaccacagaagaaacatggctgcnaaggaagattttattataataaatcgtacatttga

SEQ ID NO: 29052 - DNA, 71 bp, chicken (Gallus Gallus)
  misc_feature (36): n=g or t
gcagaaggagctgaagaaccatcagaggcaaaccanatttgaccttgagaccctcacttcactcctgttaa

SEQ ID NO: 29053 - DNA, 71 bp, chicken (Gallus Gallus)
  misc_feature (36): n=g or t
gatataaggacaccacaggccttaaccctgccctgnctgcttggtgaatttgccaggctcaaaggaaaagt

SEQ ID NO: 29054 - DNA, 71 bp, chicken (Gallus Gallus)
  misc_feature (36): n=c or t
aaagttttcaaaccaacagtgcagaccaattataantgaccaagcagtaaaacatttaatagagggaaatg

SEQ ID NO: 29055 - DNA, 71 bp, chicken (Gallus Gallus)
  misc_feature (36): n=c or t
gtcacagagagaatcggtatttgatgtaatcatcgngttgctgacacctaaaagagctcccacctctgccc

SEQ ID NO: 29056 - DNA, 71 bp, chicken (Gallus Gallus)
  misc_feature (36): n=c or t
cttagcagataggtgcatgtaacacaaccaagatantagcttaaggatatgagtttgatggtaagactatt

SEQ ID NO: 29057 - DNA, 71 bp, chicken (Gallus Gallus)
  misc_feature (36): n=a or g
aagataattttgtagtgcttatgatgagttgagccntgtacctgctcaagtggaaaatccagaatgcatgt

SEQ ID NO: 29058 - DNA, 71 bp, chicken (Gallus Gallus)
  misc_feature (36): n=g or t
tagtaaatttgagactaagatgcagacacttttcanaacttgccctttgctgatgtctgaaggtagaattt

SEQ ID NO: 29059 - DNA, 71 bp, chicken (Gallus Gallus)
  misc_feature (36): n=c or t
caagatatgcagacagaaacttgccttcaaaatctntctattgagcctctccttcaatttaattattttac

SEQ ID NO: 29060 - DNA, 71 bp, chicken (Gallus Gallus)
  misc_feature (36): n=c or t
acagtctatgtaactcactgaatttaagatttatantgagaaaaaaaatccaagaccccttgtacagtttg

SEQ ID NO: 29061 - DNA, 71 bp, chicken (Gallus Gallus)
  misc_feature (36): n=g or t
agggtggtcttcatgagttgatctgccttttttccnatgatgaccgctcatgtgagagactagagagacag

SEQ ID NO: 29062 - DNA, 71 bp, chicken (Gallus Gallus)
  misc_feature (36): n=a or g
ctcattatatgcctccttttgaattccttccattcnatttggaagaatttgtaccacataaaacaatattt

SEQ ID NO: 29063 - DNA, 71 bp, chicken (Gallus Gallus)
  misc_feature (36): n=c or t
tcactgtttgctaattcaaaatcttatgtgaatgtnctcccagctgaatgctgtgtggaagggccatgcac

SEQ ID NO: 29064 - DNA, 71 bp, chicken (Gallus Gallus)
  misc_feature (36): n=g or t
tgataaaacctgtctgccgtcatctttccaaagaanttggattgcatgtgactgcaccccctgctgtgcta

SEQ ID NO: 29065 - DNA, 71 bp, chicken (Gallus Gallus)
  misc_feature (36): n=c or t
tggaccactgagtgatgagatgtgtcagactccccnataagggcagtggctgcactgaagtagacccaatt

SEQ ID NO: 29066 - DNA, 71 bp, chicken (Gallus Gallus)
  misc_feature (36): n=a or g
taattgattgctgcttcaaagaattaataaaaagcnctgcactcagagagcagttatagctatgaatgaac

SEQ ID NO: 29067 - DNA, 71 bp, chicken (Gallus Gallus)
  misc_feature (36): n=c or t
tcactgctaaaaatgttcaaagagtgtgtcaaatgngtaataatgtacaggggtattttatgacaatgtgt

SEQ ID NO: 29068 - DNA, 71 bp, chicken (Gallus Gallus)
  misc_feature (36): n=a or c
tccttttgcctcggaaaaggggttgcctctgccaantccatcccatgcaattaccatgtggtgcttgcggt

SEQ ID NO: 29069 - DNA, 71 bp, chicken (Gallus Gallus)
  misc_feature (36): n=c or t
aaaggatatccaaatagtattgttggctgcagacanggtcaagcagcatttggaaagaggaggttctcagg

SEQ ID NO: 29070 - DNA, 71 bp, chicken (Gallus Gallus)
  misc_feature (36): n=a or g
ctccttgggtggaaaaatttagcttttcaggagtcntggcatgcttacatagagtcaattttcctttaaac

SEQ ID NO: 29071 - DNA, 71 bp, chicken (Gallus Gallus)
  misc_feature (36): n=a or c
tcaggcaaaaccagtgggtgtagttgagtacaattnattggaaataactgttagaaaaatcttcaaacacc

SEQ ID NO: 29072 - DNA, 71 bp, chicken (Gallus Gallus)
  misc_feature (36): n=a or g
tccaaaaatgaaaagagtgggaaacaacagaaatcnctgggatggctcagctcattctcattgttatatga

SEQ ID NO: 29073 - DNA, 71 bp, chicken (Gallus Gallus)
  misc_feature (36): n=c or t
gctttgaacaacaaaatttataaaacttttttcacnagtaaattgccagaggggtcaagggggtatgtggg

SEQ ID NO: 29074 - DNA, 71 bp, chicken (Gallus Gallus)
  misc_feature (36): n=c or t
cattggcctaaaaacatccagagagctttccctgangctttcaagtgatccttcagctttagtgtctgagg

SEQ ID NO: 29075 - DNA, 71 bp, chicken (Gallus Gallus)
  misc_feature (36): n=c or t
agttaaataatacttgcatgggccagaggagtgccngatgccactttctggctttgctttggaggtagggg

SEQ ID NO: 29076 - DNA, 71 bp, chicken (Gallus Gallus)
  misc_feature (36): n=a or g
tcctagacctgcaaaggttaagaaaactgttaaaangggaattagtgagcagaaagctttgtacgtatcta

SEQ ID NO: 29077 - DNA, 71 bp, chicken (Gallus Gallus)
  misc_feature (36): n=c or t
tcataacgtgatcatatctgtaatttttgctttttntatggtattatataattgtgaacatagtcattttt

SEQ ID NO: 29078 - DNA, 71 bp, chicken (Gallus Gallus)
  misc_feature (36): n=c or t
aggctgctgtatctaattggtgcttttgtcactatntgaacaaacatttgcccaaataaaactcatcctgc

SEQ ID NO: 29079 - DNA, 71 bp, chicken (Gallus Gallus)
  misc_feature (36): n=a or g
cttataaacctgtaggtggccatttctagaaaactntactgttccctctgtttcaatgtccactatgagat

SEQ ID NO: 29080 - DNA, 71 bp, chicken (Gallus Gallus)
  misc_feature (36): n=c or t
tcagatctgagaaatagaaactcagattatgagatntgaattttaagacctcaagttttaaagagtaaata

SEQ ID NO: 29081 - DNA, 71 bp, chicken (Gallus Gallus)
  misc_feature (36): n=c or t
acaatgctgagcaatgaggtgcacatagcagggcanggagtgccttggagtcttactcagcaaatctttct

SEQ ID NO: 29082 - DNA, 71 bp, chicken (Gallus Gallus)
  misc_feature (36): n=a or g
aaaggatgggatgccttcttgccaggaaagtctcanaaagtggtggctgaattagtacaacagagtaatga

SEQ ID NO: 29083 - DNA, 71 bp, chicken (Gallus Gallus)
  misc_feature (36): n=g or t
atgaacagctgcagatcatttgcacatttaaggcanctcagttccacttctcacaggttgacagaaaagag

SEQ ID NO: 29084 - DNA, 71 bp, chicken (Gallus Gallus)
  misc_feature (36): n=a or g
ggccctgcattccagcttaactttaagccccattantatgttatgagctctcttcacggcagcagaagttg

SEQ ID NO: 29085 - DNA, 71 bp, chicken (Gallus Gallus)
  misc_feature (36): n=c or t
ggagaaggcagtgagcgagcaaattagatggatagntgtggtcttgaaaggctacaatattgccttcttga

SEQ ID NO: 29086 - DNA, 71 bp, chicken (Gallus Gallus)
  misc_feature (36): n=c or t
atgtgaaaaataattatctgaatagtctcacaaaangttccccagaaaacactttttacatataagaaaaa

SEQ ID NO: 29087 - DNA, 71 bp, chicken (Gallus Gallus)
  misc_feature (36): n=c or t
cagaacaatctctaacaggacagaaagagttacttnattatttggtgttccctgtactcatacatgcactt

SEQ ID NO: 29088 - DNA, 71 bp, chicken (Gallus Gallus)
  misc_feature (36): n=c or t
agaaaaccatagttggcagtactgtagctttcttgnatcattttggtagaagctgtcaaaacaatattttg

SEQ ID NO: 29089 - DNA, 71 bp, chicken (Gallus Gallus)
  misc_feature (36): n=a or c
ttgacataccacgtagcaaatgtagggacatccctnagtaggtggcttacctctttgccttccatgtgttc

SEQ ID NO: 29090 - DNA, 71 bp, chicken (Gallus Gallus)
  misc_feature (36): n=a or g
aaatgagagtcaaagagccaatgcacagtgtaaganccatcggtctatacagatcagcttacagaggagag

SEQ ID NO: 29091 - DNA, 71 bp, chicken (Gallus Gallus)
  misc_feature (36): n=a or g
tgtcaaaaggagaagaaaatctgagatagcataaanaaaagctttatcagcattagcttgtggatagttct

SEQ ID NO: 29092 - DNA, 71 bp, chicken (Gallus Gallus)
  misc_feature (36): n=a or g
gctctcgcacttattaatttgcttgctaattttctncttgatcactgtgattatactctttttggttccta

SEQ ID NO: 29093 - DNA, 71 bp, chicken (Gallus Gallus)
  misc_feature (36): n=a or g
atgaattctgaattttagtaaatatctgattgctantgaactcaagctgtaaaccaagcagataaatcttt

SEQ ID NO: 29094 - DNA, 71 bp, chicken (Gallus Gallus)
  misc_feature (36): n=g or t
tttgggctttattgcactttatctacaatatctacntggggagtctgggtgaaaactgaccgatctgttta

SEQ ID NO: 29095 - DNA, 71 bp, chicken (Gallus Gallus)
  misc_feature (36): n=a or g
cctgacagcagcttgcagagactagattgtctcatngtcttagatgtggaaaagcacaggctttcattcaa

SEQ ID NO: 29096 - DNA, 71 bp, chicken (Gallus Gallus)
  misc_feature (36): n=c or t
attgtaaatagaaatcagactacgtgatttttaatnatattgtctctatagccttcagaccttgacttcta

SEQ ID NO: 29097 - DNA, 71 bp, chicken (Gallus Gallus)
  misc_feature (36): n=c or t
ccaaacatactatttcattccagagttatctctgtnaaatacaagcttatgagtcatttacttgccatatt

SEQ ID NO: 29098 - DNA, 71 bp, chicken (Gallus Gallus)
  misc_feature (36): n=c or t
acctatttactactgctgacatcactgacaacatgnagtctagtccttttaagctgtaattatcttcattt

SEQ ID NO: 29099 - DNA, 71 bp, chicken (Gallus Gallus)
  misc_feature (36): n=c or t
ttggttgccgtaaaaaacaatccaaaactacttccntcttttgtcccatactcaggatttgactaagtcag

SEQ ID NO: 29100 - DNA, 71 bp, chicken (Gallus Gallus)
  misc_feature (36): n=a or g
agctgtaattatacgcagcatctatcaaatcttgcncagcaaaggaagcatctattcaatcttgtgcggta

SEQ ID NO: 29101 - DNA, 71 bp, chicken (Gallus Gallus)
  misc_feature (36): n=c or t
tttcccacactagattcagctatgatttacctaacnatgtccaaggttatccaaaaaatgggagtcgggaa

SEQ ID NO: 29102 - DNA, 71 bp, chicken (Gallus Gallus)
  misc_feature (36): n=c or t
gaaatgaattcgtgtgggcttgtaatggatgatatngatcttccctttatgggaaatgatgcataaaaaga

SEQ ID NO: 29103 - DNA, 71 bp, chicken (Gallus Gallus)
  misc_feature (36): n=a or c
aagtaactattaccaaagcacccctgagatgaccanacaaaaaactcctgggtacactgtcactgaatata

SEQ ID NO: 29104 - DNA, 71 bp, chicken (Gallus Gallus)
  misc_feature (36): n=g or t
tgcggtgacctgaaataaatcagagccacaccactnctgtttaaagaaattccgctaaagaacagtggaat

SEQ ID NO: 29105 - DNA, 71 bp, chicken (Gallus Gallus)
  misc_feature (36): n=c or t
agatatattaatatgttcaaccactatataattgcntacaaattcacaagtggtacctaaaataactgcaa

SEQ ID NO: 29106 - DNA, 71 bp, chicken (Gallus Gallus)
  misc_feature (36): n=c or t
aatacaattcatgttacacagatttgggacagctgntaaactacattgtaacccacacaataaccaacact

SEQ ID NO: 29107 - DNA, 71 bp, chicken (Gallus Gallus)
  misc_feature (36): n=g or t
aacactactttaactcctatatagaaagaaaactgngggaaggtctggagaaatttctcaacattatcttt

SEQ ID NO: 29108 - DNA, 71 bp, chicken (Gallus Gallus)
  misc_feature (36): n=c or t
ggagacagaaatactgaattattactgagcaattcntatattttggagatgaagtaccagtgtcttatgtt

SEQ ID NO: 29109 - DNA, 71 bp, chicken (Gallus Gallus)
  misc_feature (36): n=a or g
tgagatgatcccactcaaaagaccctatgctaatangtaacagggatacagccaagaaactaggtattacc

SEQ ID NO: 29110 - DNA, 71 bp, chicken (Gallus Gallus)
  misc_feature (36): n=a or g
aattgagaaagacccagcaagaattagttggcaaangggaaaaaccgtcagcaaatacaagcaaagaagga

SEQ ID NO: 29111 - DNA, 71 bp, chicken (Gallus Gallus)
  misc_feature (36): n=a or g
gagagcagcatctctgcccaaaccaggatatcctcngaggccacatttctgagattcttacgtgatggcaa

SEQ ID NO: 29112 - DNA, 71 bp, chicken (Gallus Gallus)
  misc_feature (36): n=c or t
agaggaattatgtttgaatggttgaggtttgataanttaggctctaaaacagattatgaagtccagagaaa

SEQ ID NO: 29113 - DNA, 71 bp, chicken (Gallus Gallus)
  misc_feature (36): n=c or t
ggtctgcctatacatctgagttttttcttaatgaangatattcttctctgtaacctattttgatggttgat

SEQ ID NO: 29114 - DNA, 71 bp, chicken (Gallus Gallus)
  misc_feature (36): n=a or g
agataagcccagatgagaaaccatcttctgtgttcnctctgtggatagaggatcatctgtgctgctaaaaa

SEQ ID NO: 29115 - DNA, 71 bp, chicken (Gallus Gallus)
  misc_feature (36): n=c or t
aaagctacttctcggaatactccttcttaaattatnatcttcactattctgcagttgactggcacttctgt

SEQ ID NO: 29116 - DNA, 71 bp, chicken (Gallus Gallus)
  misc_feature (36): n=a or g
atttgtcctagacccagtgctggagagagacaggcngttatctccttatctaatccttccttagtgctaca

SEQ ID NO: 29117 - DNA, 71 bp, chicken (Gallus Gallus)
  misc_feature (36): n=a or g
tggtcagtctgggattttacattgagaagagagaantgagtggtagctggagcacgttggccctgcaggac

SEQ ID NO: 29118 - DNA, 71 bp, chicken (Gallus Gallus)
  misc_feature (36): n=a or c
tggtaagtcctatcactgtgcccaattgcatcctgngctgtgaagaatgtctatttgctttagatttctaa

SEQ ID NO: 29119 - DNA, 71 bp, chicken (Gallus Gallus)
  misc_feature (36): n=a or g
cttgttgactaagttaatagcttactgctaacatcnctgtctgggactcatcagagagagagtaggtcagg

SEQ ID NO: 29120 - DNA, 71 bp, chicken (Gallus Gallus)
  misc_feature (36): n=a or g
ctagaggtaaaacagaactttctgaagtagtgtaanttgaaggcataatgcagattgcagattgaatactc

SEQ ID NO: 29121 - DNA, 71 bp, chicken (Gallus Gallus)
  misc_feature (36): n=a or g
aaattgcttgtaactctgaagtgattgcacctgcanaatcctgcaatcaattccatatggaagctgtaggc

SEQ ID NO: 29122 - DNA, 71 bp, chicken (Gallus Gallus)
  misc_feature (36): n=g or t
gaaattacacattccaggcactgtttgttcatagangtaatgagagatgcgtcttttcaatggctttgaag

SEQ ID NO: 29123 - DNA, 71 bp, chicken (Gallus Gallus)
  misc_feature (36): n=a or g
actctgcagggcaaaatactttttcagggaaatgtntagaagagaatcttcatccagtcttctgaatcacg

SEQ ID NO: 29124 - DNA, 71 bp, chicken (Gallus Gallus)
  misc_feature (36): n=a or c
gtaaacagctttattccattaaagttggtgatcatncttgagggaatttatgtttgtgcacttggaatgct

SEQ ID NO: 29125 - DNA, 71 bp, chicken (Gallus Gallus)
  misc_feature (36): n=g or t
gatgaatggtatagagagacatagaaatagatgaanaaattatgtcatcatacggaaatatgtgcaatgga

SEQ ID NO: 29126 - DNA, 71 bp, chicken (Gallus Gallus)
  misc_feature (36): n=a or g
gaaataaatatatagtcccagcctgcttcctctcanaaactggcagctagaatataaatactgagagagat

SEQ ID NO: 29127 - DNA, 71 bp, chicken (Gallus Gallus)
  misc_feature (36): n=c or t
aaaatagattgaagaactgacatctacttctaacanaaaaacactggattgcacagaatcatgcaaaatag

SEQ ID NO: 29128 - DNA, 71 bp, chicken (Gallus Gallus)
  misc_feature (36): n=c or t
ttcatgtacatatatctggagttaaatttctctcanctaatataaaacattatggaattaccatgcagatt

SEQ ID NO: 29129 - DNA, 71 bp, chicken (Gallus Gallus)
  misc_feature (36): n=a or c
tatcttgagtggcaaaattacctgaagattcagaantgaagggaaaagcttcatggtagaattaacttcaa

SEQ ID NO: 29130 - DNA, 71 bp, chicken (Gallus Gallus)
  misc_feature (36): n=c or t
acaaagtgagtggaatttgggctgtagagatcttangtatgggagatgacaatttcaatgtgtgcaaggag

SEQ ID NO: 29131 - DNA, 71 bp, chicken (Gallus Gallus)
  misc_feature (36): n=c or t
agtatctccaattacaaaaggactccttggaaaganctgatgttatagaggtgtagcatttcacctcattc

SEQ ID NO: 29132 - DNA, 71 bp, chicken (Gallus Gallus)
  misc_feature (36): n=a or g
aaaaaaaagagagaaagattatcatatttgcccatntattcattcttcaaattatgaagtcagaaatgttt

SEQ ID NO: 29133 - DNA, 71 bp, chicken (Gallus Gallus)
  misc_feature (36): n=a or g
cttgttaatggatacggaagtattgtgtatgcaaanggggataaagcatggttaataaattggtaaactac

SEQ ID NO: 29134 - DNA, 71 bp, chicken (Gallus Gallus)
  misc_feature (36): n=c or t
cagctatcttaagatacttatgtctgggtttagtangaaagtagtctttaacataaaaggtggttgtctgc

SEQ ID NO: 29135 - DNA, 71 bp, chicken (Gallus Gallus)
  misc_feature (36): n=c or t
aaattatagctgtgttctgggctgtgcgagagtccngttgttgcctgtgtaaaactcagagcccaaaaaac

SEQ ID NO: 29136 - DNA, 71 bp, chicken (Gallus Gallus)
  misc_feature (36): n=a or c
gcctgacggaagatagagaggtgtgtatccaaaagnggattctaactcaaataatcattcctcaacaaatc

SEQ ID NO: 29137 - DNA, 71 bp, chicken (Gallus Gallus)
  misc_feature (36): n=a or g
cttacatttgctgaaatgtctgtgaagtaagtggtntgttagagaaataatttgttgtaggttttttgttg

SEQ ID NO: 29138 - DNA, 71 bp, chicken (Gallus Gallus)
  misc_feature (36): n=a or g
ttctctaaatgcttcttcaaagggctgatgaagggnaaaatatactgtgaatgttataaccgacctaacta

SEQ ID NO: 29139 - DNA, 71 bp, chicken (Gallus Gallus)
  misc_feature (36): n=a or g
gtttgtgtgatagtttagtggctttttctaagatgnagaaaatatgacttctttggcactcaagaataggt

SEQ ID NO: 29140 - DNA, 71 bp, chicken (Gallus Gallus)
  misc_feature (36): n=c or t
gacctacccacttacaattagagtgagcaattaaanttgtatttgtttgcatacatcagatctgtcacacg

SEQ ID NO: 29141 - DNA, 71 bp, chicken (Gallus Gallus)
  misc_feature (36): n=a or c
acaatggggaactatattaactaacaacacataagnaattgggctaaatgtcgtctcttttcaagctttgt

SEQ ID NO: 29142 - DNA, 71 bp, chicken (Gallus Gallus)
  misc_feature (36): n=c or t
atgtgctgatgtttaaagttgatcctgcttttcaanttacatatctgaatttagtgtacagttcttttcac

SEQ ID NO: 29143 - DNA, 71 bp, chicken (Gallus Gallus)
  misc_feature (36): n=a or c
gttattaaacgttctgagttaacaaagtcatagacnaaaattgcaaatactgtagctgcttaaaatgcatt

SEQ ID NO: 29144 - DNA, 71 bp, chicken (Gallus Gallus)
  misc_feature (36): n=a or g
ggtgactggggaagatgagactagctttcctaattngatttcctagggatgcttctattaaccaaagtcat

SEQ ID NO: 29145 - DNA, 71 bp, chicken (Gallus Gallus)
  misc_feature (36): n=g or t
ctttgtttaattctcaccacaaattactagtgacancaagatacactcactcagactcagagatccaattt

SEQ ID NO: 29146 - DNA, 71 bp, chicken (Gallus Gallus)
  misc_feature (36): n=a or c
agtttcagttgaagcttattcaattatatttctccncatgcatttccttacaattttaaagtactttaact

SEQ ID NO: 29147 - DNA, 71 bp, chicken (Gallus Gallus)
  misc_feature (36): n=c or t
ctcttggaccaattgcaacagctagaatttagcccngttcaatgtcacatgattagacacagcccattgat

SEQ ID NO: 29148 - DNA, 71 bp, chicken (Gallus Gallus)
  misc_feature (36): n=c or t
ctgtttgagagtgaaacaggtgtttaatagaggacnggtggaaaaatgttctgaatctccattcagaatac

SEQ ID NO: 29149 - DNA, 71 bp, chicken (Gallus Gallus)
  misc_feature (36): n=c or t
gagattatgtcactatttataacatgatgaatgctnattctctaagactgcatgtttttgggtcaggaaat

SEQ ID NO: 29150 - DNA, 71 bp, chicken (Gallus Gallus)
  misc_feature (36): n=a or g
ttctgaaagaatactaaagcagattatggaatcaanactgtagagaaggcattgcactgtgtagttttaca

SEQ ID NO: 29151 - DNA, 71 bp, chicken (Gallus Gallus)
  misc_feature (36): n=c or t
acaaaagaagaagtgacaatattagaagtattattnatgacttgggaggaagaaagctttctttcttgttg

SEQ ID NO: 29152 - DNA, 71 bp, chicken (Gallus Gallus)
  misc_feature (36): n=c or t
aaaaaaatcaatatgttctgagatagtatgcagcancataccttatttgaagagcttgttggtagtgcaga

SEQ ID NO: 29153 - DNA, 71 bp, chicken (Gallus Gallus)
  misc_feature (36): n=c or t
tgtgaagcatgtaaaacctttagtgaagcattctgngattctctttgagaatctctggctgatgtgagtat

SEQ ID NO: 29154 - DNA, 71 bp, chicken (Gallus Gallus)
  misc_feature (36): n=c or t
cactaaataaattccagtggtctcacagaaatcagnaaaactgaatgtgtactgagggaaaaagaaggaac

SEQ ID NO: 29155 - DNA, 71 bp, chicken (Gallus Gallus)
  misc_feature (36): n=c or t
agaaaactcttcctgccacatcggactagtcaagcntgcaggaacttgaatttctgtgccacattccttat

SEQ ID NO: 29156 - DNA, 71 bp, chicken (Gallus Gallus)
  misc_feature (36): n=a or g
tttggcctactgtactttcaaaatctcaaactgttngagttcttatcactaccttcagatacaagttcaat

SEQ ID NO: 29157 - DNA, 71 bp, chicken (Gallus Gallus)
  misc_feature (36): n=g or t
ttcagtatgcaatacaatggaaggttttataatatncagagcagtgcagtacagaaatatcaacaagatat

SEQ ID NO: 29158 - DNA, 71 bp, chicken (Gallus Gallus)
  misc_feature (36): n=c or t
gtaagtcagtgttgctcacagtttgtttcacaaggncaaaaactttagttcgggaagcattcctttgaaca

SEQ ID NO: 29159 - DNA, 71 bp, chicken (Gallus Gallus)
  misc_feature (36): n=a or g
cagacgattgaagaacgtcagcagaaccatgcaaancacaggagggagtgttcaggtgatagagctgggag

SEQ ID NO: 29160 - DNA, 71 bp, chicken (Gallus Gallus)
  misc_feature (36): n=c or t
gagttcagtgctagaaatctgagttgacgactctanagggaaaatagggttgttgaatcacggtgctgtac

SEQ ID NO: 29161 - DNA, 71 bp, chicken (Gallus Gallus)
  misc_feature (36): n=c or t
acttttggagcagccctgctacttaagagttttganaataacttgttgcatgtaatttctagcacttcaca

SEQ ID NO: 29162 - DNA, 71 bp, chicken (Gallus Gallus)
  misc_feature (36): n=a or c
gatcatctgtgtcaagtaagacagcttattaacagntttgtttgtggaaaaaagatatgctctgaaactta

SEQ ID NO: 29163 - DNA, 71 bp, chicken (Gallus Gallus)
  misc_feature (36): n=c or t
ttagctctattggatatgtaactacacaaccaattncactgtacaaaagctgataatctagatgagtaagt

SEQ ID NO: 29164 - DNA, 71 bp, chicken (Gallus Gallus)
  misc_feature (36): n=a or g
atgattcaactctctttgaaacttcactgatttcantactatgggattctgcgttatactatgtgttgtgg

SEQ ID NO: 29165 - DNA, 71 bp, chicken (Gallus Gallus)
  misc_feature (36): n=c or t
ctaatttttgttcagcaaattatgaatgtttgtaantagaaagtactgcctgattcttcaacccatctcag

SEQ ID NO: 29166 - DNA, 71 bp, chicken (Gallus Gallus)
  misc_feature (36): n=c or t
tttcctgtttacaggcccagcattttaaaatatctnttcttgcctagctctgcacataattttgcctaaac

SEQ ID NO: 29167 - DNA, 71 bp, chicken (Gallus Gallus)
  misc_feature (36): n=c or t
ctgactgaaagttacttctctctattgtagtgtagnttccacatacgtaaactagcataatataatttacc

SEQ ID NO: 29168 - DNA, 71 bp, chicken (Gallus Gallus)
  misc_feature (36): n=a or c
agatgtttttgatcagagcagtgaggcttctcttcngtgtctgttgagtgaactgaactacatagcttatg

SEQ ID NO: 29169 - DNA, 71 bp, chicken (Gallus Gallus)
  misc_feature (36): n=a or g
gattaggctaacatatgaaggttgatgaaaaaggtntgtaggtttcttccagataatatttgcctcatttg

SEQ ID NO: 29170 - DNA, 71 bp, chicken (Gallus Gallus)
  misc_feature (36): n=g or t
gacatttctgccagcctgttcgtatgaaatgaaatnttcccttctgctcaatgttaagaatatgtttatag

SEQ ID NO: 29171 - DNA, 71 bp, chicken (Gallus Gallus)
  misc_feature (36): n=c or t
ggatttttgttataatttaagtaggagttcaaaatntgtcctttaggagtgttatttaattattttttcta

SEQ ID NO: 29172 - DNA, 71 bp, chicken (Gallus Gallus)
  misc_feature (36): n=t or c
actgtgtttaggtatttacatcataacccaaaaaanactaggtatagaattttccttagtcaatgctggtg

SEQ ID NO: 29173 - DNA, 71 bp, chicken (Gallus Gallus)
  misc_feature (36): n=c or t
tcagtgaagtacagggcattaccagcttctttcttncatgttgcttaccatttatgtgaaatgcagtttga

SEQ ID NO: 29174 - DNA, 71 bp, chicken (Gallus Gallus)
  misc_feature (36): n=a or g
tttgacttcagaaaatagcactgtactcaaaattgnaaaatgcaccactggaagaggtaaataggtgatta

SEQ ID NO: 29175 - DNA, 71 bp, chicken (Gallus Gallus)
  misc_feature (36): n=c or t
atgttaaaaaaatgtttggttcaagattcaggcttntttttagggcgaaaaattccattaataaatataat

SEQ ID NO: 29176 - DNA, 71 bp, chicken (Gallus Gallus)
  misc_feature (36): n=a or g
tgctttcatcaaacttaaacattcttaagcacaacntgcaaaatagactgggtagctgacaagcacagttt

SEQ ID NO: 29177 - DNA, 71 bp, chicken (Gallus Gallus)
  misc_feature (36): n=c or t
cctgagatagattgcatctgttactcaacaactcanctctttacttcttcagttccatagcccaagactat

SEQ ID NO: 29178 - DNA, 71 bp, chicken (Gallus Gallus)
  misc_feature (36): n=a or g
aaacaccagcaaatagagtgaatgttttatttggangcttgcttcatgaagtctccttctagtggtattag

SEQ ID NO: 29179 - DNA, 71 bp, chicken (Gallus Gallus)
  misc_feature (36): n=a or g
aggcacaaattctgcagttattgggcctttgagtantggcacatgcagagataaaatctacctaaatgaac

SEQ ID NO: 29180 - DNA, 71 bp, chicken (Gallus Gallus)
  misc_feature (36): n=c or t
gtttttcttcatttggcttgtgagagtttttcagantcaaaacaacccgtatcctgcccctgtggaaaata

SEQ ID NO: 29181 - DNA, 71 bp, chicken (Gallus Gallus)
  misc_feature (36): n=c or t
tcaaaggggaattataaacaagtatttagataacantgctccattgttatcaataaaggatgctttctcaa

SEQ ID NO: 29182 - DNA, 71 bp, chicken (Gallus Gallus)
  misc_feature (36): n=c or t
tttagcccaactacttctcaacctgaaaaaaaatanatgacacactctgcttctcctgaaacctttgtact

SEQ ID NO: 29183 - DNA, 71 bp, chicken (Gallus Gallus)
  misc_feature (36): n=c or t
agctttgtatgatgtaagtcaaattctgaactcagntgtacacattttgatatgcagaattattaccttat

SEQ ID NO: 29184 - DNA, 71 bp, chicken (Gallus Gallus)
  misc_feature (36): n=a or g
agtatttttatatgtaggaaaccagtttagtcaatnaaagcattatgctttttgcagggttgtagtgattg

SEQ ID NO: 29185 - DNA, 71 bp, chicken (Gallus Gallus)
  misc_feature (36): n=a or g
gtggctcagaaggaaactggtatgaacttgataagnaaaataatagcattcacacaacaacagtcgagatc

SEQ ID NO: 29186 - DNA, 71 bp, chicken (Gallus Gallus)
  misc_feature (36): n=a or g
agtaggtgccaagcataattgcagaatacctcatgngtggttgctccactggggcttccttatacgtgaag

SEQ ID NO: 29187 - DNA, 71 bp, chicken (Gallus Gallus)
  misc_feature (36): n=a or g
ccagccataacatgccattattttttcagtcacgancagtagttacaggcaggttctgtgagctatttcca

SEQ ID NO: 29188 - DNA, 71 bp, chicken (Gallus Gallus)
  misc_feature (36): n=a or g
aagcgggagggattttcaatattacccttttattcnttaatccattgtatgcagtacagttacatataaag

SEQ ID NO: 29189 - DNA, 71 bp, chicken (Gallus Gallus)
  misc_feature (36): n=c or t
ggtttttatggtctctgtatttttgccaaagacaanaatttgtcttttccctgatgtcttcctgtcatagt

SEQ ID NO: 29190 - DNA, 71 bp, chicken (Gallus Gallus)
  misc_feature (36): n=a or c
cgcgtccaacggcaattataccaaaactatcacttnacgagaggcttcggccaaagcgtttaaccctcacg

SEQ ID NO: 29191 - DNA, 71 bp, chicken (Gallus Gallus)
  misc_feature (36): n=a or g
ctgatgacaagcatgttcatgtagttaatcatgcanctaagaacctgtcccacagaaaacaaagctgcatt

SEQ ID NO: 29192 - DNA, 71 bp, chicken (Gallus Gallus)
  misc_feature (36): n=a or g
aatgacattcaggtggtgaatttttcactttttcanctaatggcttatgtaacactccctgtagaaagctg

SEQ ID NO: 29193 - DNA, 71 bp, chicken (Gallus Gallus)
  misc_feature (36): n=a or g
agaaaacggagtgtttgtggagattacaggacaacnattttcttagaaaggattaagaaaatcctcaggag

SEQ ID NO: 29194 - DNA, 71 bp, chicken (Gallus Gallus)
  misc_feature (36): n=c or t
gcccacctttctctgccacagaaggcccactacttntgcctctgatttgtggtcagagttggctaatgtca

SEQ ID NO: 29195 - DNA, 71 bp, chicken (Gallus Gallus)
  misc_feature (36): n=g or t
ttacaggatatgaacaaattcaatacatagaaaagncatgtactgtattattggattggctctgcccataa

SEQ ID NO: 29196 - DNA, 71 bp, chicken (Gallus Gallus)
  misc_feature (36): n=c or t
gaatacttccattctcaaggaacatctctctcaaanagacatatattatgtaatcttttgccaaactgctt

SEQ ID NO: 29197 - DNA, 71 bp, chicken (Gallus Gallus)
  misc_feature (36): n=c or t
aaggtcaattctctcaatttcatgttatgttcctanatgattcatatgtagaaagaactgtagaaagaaaa

SEQ ID NO: 29198 - DNA, 71 bp, chicken (Gallus Gallus)
  misc_feature (36): n=c or t
gagtggatagagggggacgcttgcaaaaggcagttnatccctcgtgcctttccctcatatcaaagaatgag

SEQ ID NO: 29199 - DNA, 71 bp, chicken (Gallus Gallus)
  misc_feature (36): n=c or t
attgtattttgtttatcttggctattttagttaaanggataaatcttttgtgacttggctctttttgtaga

SEQ ID NO: 29200 - DNA, 71 bp, chicken (Gallus Gallus)
  misc_feature (36): n=a or g
aactagtggaacagggaggagaagattattcctctnaaagtagtatatggaaactgataagtgaaacacta

SEQ ID NO: 29201 - DNA, 71 bp, chicken (Gallus Gallus)
  misc_feature (36): n=a or g
cagaacgatatactgactactgccaactgaaatgtngaattgcaatggaagtaatatgtacgactttcatt

SEQ ID NO: 29202 - DNA, 71 bp, chicken (Gallus Gallus)
  misc_feature (36): n=c or t
ctatagttctttcaagcagcataggccactctttcntctaagggtcacaaattccaaattttgcaaatggc

SEQ ID NO: 29203 - DNA, 71 bp, chicken (Gallus Gallus)
  misc_feature (36): n=a or g
tttagtgtggtactccatctgggcaagtatcaggcngctgggcagtggcaggaaaacccaccttgggtgac

SEQ ID NO: 29204 - DNA, 71 bp, chicken (Gallus Gallus)
  misc_feature (36): n=a or g
gatcctatgaaataggtaagcctggaataaaatatntttgatcggctggtttgaaattcaccccacatttg

SEQ ID NO: 29205 - DNA, 71 bp, chicken (Gallus Gallus)
  misc_feature (36): n=g or t
tcccccacacactatccaatgcatgtttgatgtttngcaaaatgaagaaaagccctagcgctatggctgta

SEQ ID NO: 29206 - DNA, 71 bp, chicken (Gallus Gallus)
  misc_feature (36): n=a or g
tctactgctgtctgcactatcctttggagcattcancattgcagctttggcacagacataaacaaccacaa

SEQ ID NO: 29207 - DNA, 71 bp, chicken (Gallus Gallus)
  misc_feature (36): n=c or t
tatttctggtaaggatagacagtatctttaatcagntgctacaagttgaaggaaataaataccgtgtttat

SEQ ID NO: 29208 - DNA, 71 bp, chicken (Gallus Gallus)
  misc_feature (36): n=c or t
cttcttgacaagtctgcctctaggggatgaggaaangtagtaggatgaaaatctctgtggcctagcacaat

SEQ ID NO: 29209 - DNA, 71 bp, chicken (Gallus Gallus)
  misc_feature (36): n=a or g
gcatctaacacagccctctgcaaccaggtaaacttnctactgcaaatacattgaccctacctaccttcaga

SEQ ID NO: 29210 - DNA, 71 bp, chicken (Gallus Gallus)
  misc_feature (36): n=c or t
ttacatgatgaccctgaaatcccttatattatttanttcatttgaatgtgggagagatcagttgtactagc

SEQ ID NO: 29211 - DNA, 71 bp, chicken (Gallus Gallus)
  misc_feature (36): n=a or g
tccttcacagcaatatcaagtagaatgatagagagnatcttctcaggagcagtaacaaggtaattatttta

SEQ ID NO: 29212 - DNA, 71 bp, chicken (Gallus Gallus)
  misc_feature (36): n=c or t
ttcatttccacttcaaagtttgcagtcgatgagagngaaagcgagttatttgcaccacattctgctctgat

SEQ ID NO: 29213 - DNA, 71 bp, chicken (Gallus Gallus)
  misc_feature (36): n=a or g
actggatagctatgctatagggatgagagaagttcnttccatttgtgggtgaggtcataaccatcagctac

SEQ ID NO: 29214 - DNA, 71 bp, chicken (Gallus Gallus)
  misc_feature (36): n=a or c
agggcatctgaagctgttgctaaccacagggctacngtaattctctgtgagcttcagtaatgcatcatttc

SEQ ID NO: 29215 - DNA, 71 bp, chicken (Gallus Gallus)
  misc_feature (36): n=c or t
aagtcacgaggttctgctttttatgcctgtttcccngaggagaaatgccagtttctcttggaaactgagag

SEQ ID NO: 29216 - DNA, 71 bp, chicken (Gallus Gallus)
  misc_feature (36): n=c or t
aatctgccacaagtggtaaagaagagcagactactngctgcttctcatggcccagaagaccagtgacacac

SEQ ID NO: 29217 - DNA, 71 bp, chicken (Gallus Gallus)
  misc_feature (36): n=c or t
tgaagccttttggagtacatacaatggttaaagtantggtcattctgaagcacaaggaggctgtggatgcc

SEQ ID NO: 29218 - DNA, 71 bp, chicken (Gallus Gallus)
  misc_feature (36): n=c or t
acaaagctgtctaaaaattaaagcagagattctcangtgactttacaaactgggattcaatcgttaccatt

SEQ ID NO: 29219 - DNA, 71 bp, chicken (Gallus Gallus)
  misc_feature (36): n=c or t
tttgagcagggcttacttccacccttcttgacaagntttcctctatctttgtctgcaagctggtaaaaagt

SEQ ID NO: 29220 - DNA, 71 bp, chicken (Gallus Gallus)
  misc_feature (36): n=a or c
ttataaaatggagcaagaaatacctggtccagggantactgaaatgtcctaaaacactctagctacatggc

SEQ ID NO: 29221 - DNA, 71 bp, chicken (Gallus Gallus)
  misc_feature (36): n=c or t
caatgacatgtgaactgcaatcctctttaggagttnattgacagctggtacatcatgtaaccctcttagag

SEQ ID NO: 29222 - DNA, 71 bp, chicken (Gallus Gallus)
  misc_feature (36): n=c or t
ttggattttgcaaccttcacaggacatatgtttgtnggaatctgccttgttgttctggtctcctttccctt

SEQ ID NO: 29223 - DNA, 71 bp, chicken (Gallus Gallus)
  misc_feature (36): n=c or t
gagcacaagatgcccatctgaccttttaaacacaanacatcgctgtctatattatggttacaattatgtcc

SEQ ID NO: 29224 - DNA, 71 bp, chicken (Gallus Gallus)
  misc_feature (36): n=a or g
cattaacccccattaaaaagaattcatagtttccanatgacagaaaatcaatggcacctgaaatagacaca

SEQ ID NO: 29225 - DNA, 71 bp, chicken (Gallus Gallus)
  misc_feature (36): n=g or t
aagttaattaagggccttgctgaaaaatgtaggttngaatccctgtttacatgaatattcaatttacacaa

SEQ ID NO: 29226 - DNA, 71 bp, chicken (Gallus Gallus)
  misc_feature (36): n=a or c
tacattaaacgtgctaagtgctaaagcttccactgntcctaattagagggttttttcccctgcctgttttt

SEQ ID NO: 29227 - DNA, 71 bp, chicken (Gallus Gallus)
  misc_feature (36): n=c or t
aaaagaaaaataaaatgacctaggtaattctgttanttaaggtcttgtcttcctcgtgatgtcatgcactt

SEQ ID NO: 29228 - DNA, 71 bp, chicken (Gallus Gallus)
  misc_feature (36): n=c or t
ggggagcctgaattcaatctcattttgaattaccangcaaatcatatgctcagcagccatttccagaggct

SEQ ID NO: 29229 - DNA, 71 bp, chicken (Gallus Gallus)
  misc_feature (36): n=c or t
agggacataactggttttcagcgctctgattttaanctgctgtcacactttggcaaagccctcagaatcca

SEQ ID NO: 29230 - DNA, 71 bp, chicken (Gallus Gallus)
  misc_feature (36): n=a or g
tgagataattgccttatcttccttggacagcttcancacagtctcaggagaaaaagcaatcagatctagac

SEQ ID NO: 29231 - DNA, 71 bp, chicken (Gallus Gallus)
  misc_feature (36): n=c or t
caatttgctaaatacattggggtcttccttacaaangtgcaaacatgagttgcacaaaacaacctccagaa

SEQ ID NO: 29232 - DNA, 71 bp, chicken (Gallus Gallus)
  misc_feature (36): n=g or t
ttacggtactattaatacacagaactcaaataaagnattaagcaaccagtaatctcatggaaataatccca

SEQ ID NO: 29233 - DNA, 71 bp, chicken (Gallus Gallus)
  misc_feature (36): n=a or g
ctatttatgagaagcaggagtaaacagatgtatganttgctatttcaactcacaccaaatatctcttagtc

SEQ ID NO: 29234 - DNA, 71 bp, chicken (Gallus Gallus)
  misc_feature (36): n=c or t
atatttatttccatggaagcctcttcaaaatccagnagtattttttgttattggctgtgaaggagtttttc

SEQ ID NO: 29235 - DNA, 71 bp, chicken (Gallus Gallus)
  misc_feature (36): n=a or c
gtgtaagtgtctatggatcctttcaacttacatacntcatgtgtattaggccactgtcttattgtatgtga

SEQ ID NO: 29236 - DNA, 71 bp, chicken (Gallus Gallus)
  misc_feature (36): n=a or c
catagcccagcatgagtgatgtgtgtttcttacctntcttataggtacactctgcattccattttctgtgc

SEQ ID NO: 29237 - DNA, 71 bp, chicken (Gallus Gallus)
  misc_feature (36): n=g or t
ctcccctaatccagttttgcatttcttcatcagcanctggaatcccacatctctctgctgagcctagaaca

SEQ ID NO: 29238 - DNA, 71 bp, chicken (Gallus Gallus)
  misc_feature (36): n=c or t
ttgtgattgtgattgtgtcttcaatagcagaccaanttaaaatttactgtaccttttcacctctttaatgg

SEQ ID NO: 29239 - DNA, 71 bp, chicken (Gallus Gallus)
  misc_feature (36): n=c or t
gtgaatcggaattcaattcttaattaaaatttttcnttttcctcatgctggaaatcactgcctattccaca

SEQ ID NO: 29240 - DNA, 71 bp, chicken (Gallus Gallus)
  misc_feature (36): n=c or t
aacagtttcatcttccctggcattaaaagatacagngttgactggacaggggccatcagaaacctttccaa

SEQ ID NO: 29241 - DNA, 71 bp, chicken (Gallus Gallus)
  misc_feature (36): n=a or g
ctaatgaaatgatgaataaattgcttggtttggggnataactggttacatctagtgcagaaagagaggtca

SEQ ID NO: 29242 - DNA, 71 bp, chicken (Gallus Gallus)
  misc_feature (36): n=c or t
cgtgcagtaaaattcaaattatttgcccctcacccntggagaatagtcacacattgggatattgcagtcta

SEQ ID NO: 29243 - DNA, 71 bp, chicken (Gallus Gallus)
  misc_feature (36): n=a or g
ccagaaaaacctgaaaatgaaatggtgcaaataaancagaaaagtaaaaaactgctaacaagtatcaagaa

SEQ ID NO: 29244 - DNA, 71 bp, chicken (Gallus Gallus)
  misc_feature (36): n=c or t
cttccagtttaaaacttgtcctgttgctaacagaantgtcatcatgtacttgactcaccctaatgaaacaa

SEQ ID NO: 29245 - DNA, 71 bp, chicken (Gallus Gallus)
  misc_feature (36): n=c or t
aacacatcactcatttccagatatttcagatcttgnactaggtaataagatgagcatgccatttaagtaat

SEQ ID NO: 29246 - DNA, 71 bp, chicken (Gallus Gallus)
  misc_feature (36): n=a or c
caacccctaacattaaccctggtgcaacactgccanatctcacctgatatgacaaagagagacacctcttt

SEQ ID NO: 29247 - DNA, 71 bp, chicken (Gallus Gallus)
  misc_feature (36): n=a or g
gttactctttcctagcaaaaatcaatacagggccangcagcactgggaaagaatccaagacatctttcata

SEQ ID NO: 29248 - DNA, 71 bp, chicken (Gallus Gallus)
  misc_feature (36): n=a or c
ttcaacttcatctcatcaagctcattctggtacttngttattttcacatgtagtacctatgaagacagatt

SEQ ID NO: 29249 - DNA, 71 bp, chicken (Gallus Gallus)
  misc_feature (36): n=a or g
gaaaacagtccttttcatcatgaactcactgacctntgctttcttccctacagctttactcaagtctagtc

SEQ ID NO: 29250 - DNA, 71 bp, chicken (Gallus Gallus)
  misc_feature (36): n=a or g
gacctttcttgtgctggtgagcctgaaaacatcacnttttgcagatggtactctgtcatctgtcctaatgt

SEQ ID NO: 29251 - DNA, 71 bp, chicken (Gallus Gallus)
  misc_feature (36): n=a or g
atctgtccttcaggtgtttgttgggacttatcccancatcctgcactgtatctatactgtccaaaggaaga

SEQ ID NO: 29252 - DNA, 71 bp, chicken (Gallus Gallus)
  misc_feature (36): n=c or t
ggcaggcttttaaagtcacaacttgagactaaattngtatttttggaagtatgaatatacctctcatttaa

SEQ ID NO: 29253 - DNA, 71 bp, chicken (Gallus Gallus)
  misc_feature (36): n=a or c
cacttgaaacggaaagggaatgcttaagagtgaaantcccaagtgatataaccaaatactttctcaggaaa

SEQ ID NO: 29254 - DNA, 71 bp, chicken (Gallus Gallus)
  misc_feature (36): n=a or g
tccacgctctggcattaaacgcaaacccagagactnaggcagaagagcttcaataatttgtttagttaggt

SEQ ID NO: 29255 - DNA, 71 bp, chicken (Gallus Gallus)
  misc_feature (36): n=c or t
gcaaacaattttgtttatgatgctctgacaacttgnggaatctgttcatatacaaggcatttattctgaat

SEQ ID NO: 29256 - DNA, 71 bp, chicken (Gallus Gallus)
  misc_feature (36): n=a or g
actgatatcaaagagaaaggaactaagcattccacnaagtcagcctggggagaattacttgtatctgacat

SEQ ID NO: 29257 - DNA, 71 bp, chicken (Gallus Gallus)
  misc_feature (36): n=c or t
gttaaatcatgatctacagagttatggaaaccatanaacagccccagtgtgaaacaaataatgaagaagtc

SEQ ID NO: 29258 - DNA, 71 bp, chicken (Gallus Gallus)
  misc_feature (36): n=c or t
ggagtgacaaccttggaagaggactaacctctcccnctatcatgtcattttagcctcagtctcaaattggt

SEQ ID NO: 29259 - DNA, 71 bp, chicken (Gallus Gallus)
  misc_feature (36): n=c or t
atattttgaagcaatttatccacatctatcaactangttctaactgtagcacagctttgtagaggctcaga

SEQ ID NO: 29260 - DNA, 71 bp, chicken (Gallus Gallus)
  misc_feature (36): n=c or t
gcttgatcataaactgaatcatgaaggcgaacaagntcttcatactctggtccttcaaccttattgttaaa

SEQ ID NO: 29261 - DNA, 71 bp, chicken (Gallus Gallus)
  misc_feature (36): n=c or t
cgttatattagaaaggctagcaaaaactgattgacntgacttgataaaagtggtagcacaactgtattctc

SEQ ID NO: 29262 - DNA, 71 bp, chicken (Gallus Gallus)
  misc_feature (36): n=c or t
tctgcagaaatctctgcaagaactggttacagaagngcgttacacacggaagcagctctccacatctgtct

SEQ ID NO: 29263 - DNA, 71 bp, chicken (Gallus Gallus)
  misc_feature (36): n=c or t
ggaggtgaagaggagtctgattcaggaagtaagcanatgagaagactgagcaaaatggagcctgagagtca

SEQ ID NO: 29264 - DNA, 71 bp, chicken (Gallus Gallus)
  misc_feature (36): n=c or t
gatactggaagcatccagtcagggaggtaatctcanccggacttcatcagatgtcttcacaggaagtgcta

SEQ ID NO: 29265 - DNA, 71 bp, chicken (Gallus Gallus)
  misc_feature (36): n=c or t
atgtgtttatggtggcagtacttgaaatgtatcacngcactgtaagaagttgtggtgcagtagggttttga

SEQ ID NO: 29266 - DNA, 71 bp, chicken (Gallus Gallus)
  misc_feature (36): n=a or g
tgtagaactagtctgggtgacacaagtgtcctccantgcagaggagctagttcagaaatgagtaaatatcc

SEQ ID NO: 29267 - DNA, 71 bp, chicken (Gallus Gallus)
  misc_feature (36): n=g or t
agttgccactacatttgtgtagctaagcaagaggangaaggatttcttcctgaaggacaggtggctgctgc

SEQ ID NO: 29268 - DNA, 71 bp, chicken (Gallus Gallus)
  misc_feature (36): n=a or g
tctacaaatatatcaggcttagtataattatgcatncttagataatagtaagattagagcccaaagtaatg

SEQ ID NO: 29269 - DNA, 71 bp, chicken (Gallus Gallus)
  misc_feature (36): n=c or t
gggattaagttccaaatatggaaagcaaactgagcngtgcattgctttcaggacatacactcttagcatta

SEQ ID NO: 29270 - DNA, 71 bp, chicken (Gallus Gallus)
  misc_feature (36): n=c or t
atgggaggacagaattgactgcaaatatatagatcnttaaactaacagctcttcctatcatttattaaata

SEQ ID NO: 29271 - DNA, 71 bp, chicken (Gallus Gallus)
  misc_feature (36): n=c or t
ccgcagatagctcagagggacggcatcttaagaatngtgccagtgttaaaagcccatgcaaaaggtggaga

SEQ ID NO: 29272 - DNA, 71 bp, chicken (Gallus Gallus)
  misc_feature (36): n=c or t
gtttgctaaaagagggaagtcagtaagtgctaacgnatttacgtaattctctgaactttagatttaggaac

SEQ ID NO: 29273 - DNA, 71 bp, chicken (Gallus Gallus)
  misc_feature (36): n=a or g
tttctttagaataattgcatttaatttgggggcttngtgcatcagttaacgctactcatttgtcaaaaaaa

SEQ ID NO: 29274 - DNA, 71 bp, chicken (Gallus Gallus)
  misc_feature (36): n=c or t
acaatgtagtggaaccagctactcactcccctttcngctcgcctgtactttagtgagatggctttaacctt

SEQ ID NO: 29275 - DNA, 71 bp, chicken (Gallus Gallus)
  misc_feature (36): n=c or t
aaggctttgtccctattggtaattttggaagttaancatctcctagtagcactcaagcagacagcaatggt

SEQ ID NO: 29276 - DNA, 71 bp, chicken (Gallus Gallus)
  misc_feature (36): n=a or g
ccatatttagtgtttaacccaaagatataattactnagccttttcaatatttcagatgtttaattgagtca

SEQ ID NO: 29277 - DNA, 71 bp, chicken (Gallus Gallus)
  misc_feature (36): n=c or t
agttgcagccaaattgctaatggaactgtgtcttcnggttgggcttgctggaaagcacagtgtcagggatt

SEQ ID NO: 29278 - DNA, 71 bp, chicken (Gallus Gallus)
  misc_feature (36): n=c or t
ttttcacttacataaggaaaaacgttttagcagttntagttctccatgaatattcccctcccactgtttat

SEQ ID NO: 29279 - DNA, 71 bp, chicken (Gallus Gallus)
  misc_feature (36): n=c or t
aacaaaaaaaacaccacatccatacttacttcagantgaggattcacaaaaaaggagagaccatttgggcc

SEQ ID NO: 29280 - DNA, 71 bp, chicken (Gallus Gallus)
  misc_feature (36): n=a or c
agggccacgtacagtacagtacagtatattccctgnctgcttctttagccaaataaattttgttgatgagt

SEQ ID NO: 29281 - DNA, 71 bp, chicken (Gallus Gallus)
  misc_feature (36): n=a or g
cttctgcacccaagaacttaccttttcgtatctctntgatgcagctttttctcactttatgcaatcaagat

SEQ ID NO: 29282 - DNA, 71 bp, chicken (Gallus Gallus)
  misc_feature (36): n=c or t
gtctgggttctctgactgatcccttacccaagacantaaatcaataaagacttgaaagcgctgctttccat

SEQ ID NO: 29283 - DNA, 71 bp, chicken (Gallus Gallus)
  misc_feature (36): n=g or t
cttggtatttcaattattaaactttgtgtgacaccntcttagaaagagatcattttggtatgtattttctc

SEQ ID NO: 29284 - DNA, 71 bp, chicken (Gallus Gallus)
  misc_feature (36): n=a or c
ggataccttaactagagaattcagatgaaatttcanggttagtcagatgttactgaaagtaagttttattt

SEQ ID NO: 29285 - DNA, 71 bp, chicken (Gallus Gallus)
  misc_feature (36): n=c or t
ttttctttcccacttcatcattaacatgttaatccngtctttttacatacagatttttgctagctatattg

SEQ ID NO: 29286 - DNA, 71 bp, chicken (Gallus Gallus)
  misc_feature (36): n=c or t
tctcacttatttcatcatagcccatgcagcctttcncattcataactgtgtttgtttgtcagctctttgtt

SEQ ID NO: 29287 - DNA, 71 bp, chicken (Gallus Gallus)
  misc_feature (36): n=c or t
agtgaaaagctgggtgtttctgtaagtgtcttgatngtacttcattgcaccttcctttgaagtgtgtggct

SEQ ID NO: 29288 - DNA, 71 bp, chicken (Gallus Gallus)
  misc_feature (36): n=a or g
tttcatttcgatcaatacttccaccctgttaggccntatcacccatcctctcaaccgtagtaagcagagcg

SEQ ID NO: 29289 - DNA, 71 bp, chicken (Gallus Gallus)
  misc_feature (36): n=c or t
gtacgtgccgtttgttattctatcgagaagcgtcanatctcaaatgattttaacggctcgatttttttttc

SEQ ID NO: 29290 - DNA, 71 bp, chicken (Gallus Gallus)
  misc_feature (36): n=c or t
tcatccagcaaacaaaaagtgactcagcttcaaaangctggggagggagagcagtgtagtagtgaaagatt

SEQ ID NO: 29291 - DNA, 71 bp, chicken (Gallus Gallus)
  misc_feature (36): n=g or t
caggggatctgcattctgtaagagtcatccaaatanatgcgtagatatatacacttatatgtaggtggtga

SEQ ID NO: 29292 - DNA, 71 bp, chicken (Gallus Gallus)
  misc_feature (36): n=c or t
ccttcaaaaacttatctcaggcttgctacggagggncaaaggacaaacactgatcaaactgctagagaaac

SEQ ID NO: 29293 - DNA, 71 bp, chicken (Gallus Gallus)
  misc_feature (36): n=c or t
cagtgctgggtaaaaatccacacgcagctaagatancgtctgactcttaacgggaaataatcagtccttag

SEQ ID NO: 29294 - DNA, 71 bp, chicken (Gallus Gallus)
  misc_feature (36): n=c or t
gtggaatcaaattggaaagctgttaataaaactagngaccgtggtgcaatggagcacttgaatgatcaaac

SEQ ID NO: 29295 - DNA, 71 bp, chicken (Gallus Gallus)
  misc_feature (36): n=a or g
ctgctgttactgtgatcctatgaaagtgcaggtatntgcttaactgctgctagtggtcttactgcaatgca

SEQ ID NO: 29296 - DNA, 71 bp, chicken (Gallus Gallus)
  misc_feature (36): n=c or t
gctctctcagggatgccaggcttgtttcacagctcngtacttcaggggcttgactcagggctttacagaat

SEQ ID NO: 29297 - DNA, 71 bp, chicken (Gallus Gallus)
  misc_feature (36): n=a or g
aaacacagtctgatagatggctggaaggtagtcagnagtagctcaccatcgttaatatattcaacctttta

SEQ ID NO: 29298 - DNA, 71 bp, chicken (Gallus Gallus)
  misc_feature (36): n=a or g
cagactgacattttagaatcaaatccaagaaatgtntattaaagaactggagggacaagctctaatcttgt

SEQ ID NO: 29299 - DNA, 71 bp, chicken (Gallus Gallus)
  misc_feature (36): n=g or t
catgtacctccagtacctcagacaggaagctgcatnaaacttaatgcttggggaagtaaagaggcacacac

SEQ ID NO: 29300 - DNA, 71 bp, chicken (Gallus Gallus)
  misc_feature (36): n=a or c
caacaaaagggtccccaaagaaacggctcctaccantgtttattcaaaaatactgaagcattgacaaccag

SEQ ID NO: 29301 - DNA, 71 bp, chicken (Gallus Gallus)
  misc_feature (36): n=a or g
gtgcatgcatatatcagatgggtaaatccagtgtcngaaatgttgcataacattcagttttaaagcctata

SEQ ID NO: 29302 - DNA, 71 bp, chicken (Gallus Gallus)
  misc_feature (36): n=a or g
atgctgagattcagttttctccttcaagttctcctntaaagatggtgtgtctaatgtctgtaagtagaaag

SEQ ID NO: 29303 - DNA, 71 bp, chicken (Gallus Gallus)
  misc_feature (36): n=a or g
aatggagaagtactccttagaaaggtgaatgccaantaaacttcatggtgcacaatgaaaaatttgctttt

SEQ ID NO: 29304 - DNA, 71 bp, chicken (Gallus Gallus)
  misc_feature (36): n=g or t
cccaactattttgtagttctcattgagtgtattttngatagtcattgttcctgtttggatcaagaacaaaa

SEQ ID NO: 29305 - DNA, 71 bp, chicken (Gallus Gallus)
  misc_feature (36): n=a or g
ctctgtggacaatgaggacacttccaaggagtcacngtgaccacaaggacctgtgtgtctaaggtcaggcc

SEQ ID NO: 29306 - DNA, 71 bp, chicken (Gallus Gallus)
  misc_feature (36): n=a or g
gggactgcagtgtaggatacacatatattggctctnctgacaccccgcttcttgagggatattccggtgta

SEQ ID NO: 29307 - DNA, 71 bp, chicken (Gallus Gallus)
  misc_feature (36): n=c or t
caaccactgccttgtctccattaaatgctccttttnccctctgggttttgaacggagaatggaaatttcac

SEQ ID NO: 29308 - DNA, 71 bp, chicken (Gallus Gallus)
  misc_feature (36): n=a or g
cgttgagttgaggaggagtaggaaagcagccagatnggctgagtctgagagatggcagtcagctggtgaca

SEQ ID NO: 29309 - DNA, 71 bp, chicken (Gallus Gallus)
  misc_feature (36): n=c or t
cacctgctaaagagtgtagttctgttctgacactcngactgccctgagatattgccctcaaagcagaaagt

SEQ ID NO: 29310 - DNA, 71 bp, chicken (Gallus Gallus)
  misc_feature (36): n=a or g
agtatgttcagtggtggtatgaaattgttcctgtcntgctcctcttgtagcaattgctaagggtgtgtgtg

SEQ ID NO: 29311 - DNA, 71 bp, chicken (Gallus Gallus)
  misc_feature (36): n=a or c
aaccaaaacaaatatcacagttagacattagagaanaacttgtaacagtacaaacaaggcttggaatagat

SEQ ID NO: 29312 - DNA, 71 bp, chicken (Gallus Gallus)
  misc_feature (36): n=a or g
aggcagagaattcattaagggtctgagttcagtatnttggaaatactggtagtttttatacagatgataag

SEQ ID NO: 29313 - DNA, 71 bp, chicken (Gallus Gallus)
  misc_feature (36): n=g or t
atactgcatgcagttctatctgtaatttatcaccanctctcctgatgcatctggaactgctctccaactcc

SEQ ID NO: 29314 - DNA, 71 bp, chicken (Gallus Gallus)
  misc_feature (36): n=a or c
cttatgtcattctcttttacctaacctagcaaagcntttcaagttgtacttctcacccatttccctcccag

SEQ ID NO: 29315 - DNA, 71 bp, chicken (Gallus Gallus)
  misc_feature (36): n=g or t
gtcattgaattgtaatcaatctccaacttgttaggngtttattttcttagaatactcacaagagcatattt

SEQ ID NO: 29316 - DNA, 71 bp, chicken (Gallus Gallus)
  misc_feature (36): n=c or t
attttcttcaccctcgataacaaccttgacattcancatgcttcttttgagagacaaagctgtagcttgtc

SEQ ID NO: 29317 - DNA, 71 bp, chicken (Gallus Gallus)
  misc_feature (36): n=g or t
tacaggacataaataatctttaaagtctttatccanttagctttatttttagctagaatcataaaatcact

SEQ ID NO: 29318 - DNA, 71 bp, chicken (Gallus Gallus)
  misc_feature (36): n=a or g
taaaaggatatagctgtatgttctatccatgcatcncaacttaatttgtgggtaatatgttgcgctatttg

SEQ ID NO: 29319 - DNA, 71 bp, chicken (Gallus Gallus)
  misc_feature (36): n=a or c
ctcctttcatggctcaagggattatcacattatgtnctcaagggtcatttttgaagactgatggaagagga

SEQ ID NO: 29320 - DNA, 71 bp, chicken (Gallus Gallus)
  misc_feature (36): n=a or g
tgtttttaggcaggaccaattgcattttccatcctntaacttcccaccagcttgctaagtatgggagtgtc

SEQ ID NO: 29321 - DNA, 71 bp, chicken (Gallus Gallus)
  misc_feature (36): n=c or t
gactatctttatgccagctttaagctttcaaacatnatccatcattctgtcactttgccagagagggcaaa

SEQ ID NO: 29322 - DNA, 71 bp, chicken (Gallus Gallus)
  misc_feature (36): n=a or g
aggcaggtctgctgtccctccaagaaagaagtcctntacaaacccttttagccctggattggaggatagca

SEQ ID NO: 29323 - DNA, 71 bp, chicken (Gallus Gallus)
  misc_feature (36): n=a or c
caagctacaaagaatgtgataaaacttacagaaaanctgctgtggattgataggctggtgaattaaggctg

SEQ ID NO: 29324 - DNA, 71 bp, chicken (Gallus Gallus)
  misc_feature (36): n=c or t
acttcatggacagagaggctcctaacagaacctgangcagttctactcagttccttccagcctggcctctt

SEQ ID NO: 29325 - DNA, 71 bp, chicken (Gallus Gallus)
  misc_feature (36): n=c or t
agggggatcaattgtgggctgaatgaaaataacatntgaaatccttgagtcagatttcaaaatcaggacaa

SEQ ID NO: 29326 - DNA, 71 bp, chicken (Gallus Gallus)
  misc_feature (36): n=c or t
taaagctgggcttacccttatcattaagccacaccntcagccagctctttctccaggtcttttctgtaggt

SEQ ID NO: 29327 - DNA, 71 bp, chicken (Gallus Gallus)
  misc_feature (36): n=a or g
acaggcaagtttttaaatgtcctacgagagatggtnttgcatcataaaactgaactcctattttgataatg

SEQ ID NO: 29328 - DNA, 71 bp, chicken (Gallus Gallus)
  misc_feature (36): n=a or g
gccctgcacaccagtgcactgatgtgaaagggcccngtctgtgttcccaggatgatgaagctgagagcaga

SEQ ID NO: 29329 - DNA, 71 bp, chicken (Gallus Gallus)
  misc_feature (36): n=a or g
cagggatttgaagagagtaacatacctgcttaattntaaggcagttgcatgcagacaaacttattatcctc

SEQ ID NO: 29330 - DNA, 71 bp, chicken (Gallus Gallus)
  misc_feature (36): n=a or g
agtgaagcttctgaagtaacaatgcaatggggtgcnatggaacttaaaatcacacttctctttgaaagtgt

SEQ ID NO: 29331 - DNA, 71 bp, chicken (Gallus Gallus)
  misc_feature (36): n=c or t
catcatgctgcctgaccagacgcagaaaagcaatanaaatctgtatcacttctcagaaattcagcattatt

SEQ ID NO: 29332 - DNA, 71 bp, chicken (Gallus Gallus)
  misc_feature (36): n=a or g
ttttgctggaggtgagatatgggtctcaaacaagcntacccggaacactgagctccatggtgcaagcaata

SEQ ID NO: 29333 - DNA, 71 bp, chicken (Gallus Gallus)
  misc_feature (36): n=c or t
aggcagtcttgcccaattttcccgcgctgagaatangcagattacattttccgaactaaacaagatgctag

SEQ ID NO: 29334 - DNA, 71 bp, chicken (Gallus Gallus)
  misc_feature (36): n=c or t
atagatatgcaacgtgtgctccatgtgaacgcacangacagcatatgctacaggctgaatcccatgcatgc

SEQ ID NO: 29335 - DNA, 71 bp, chicken (Gallus Gallus)
  misc_feature (36): n=a or g
gctaaatgctggtcagaggcatcaagactgataccntatttgtctgatttgctttaagactttttccattt

SEQ ID NO: 29336 - DNA, 71 bp, chicken (Gallus Gallus)
  misc_feature (36): n=a or g
cagccataggcttgcaggtattgttgcataatgcangagatgagaatatttcaactgagtaacagaacgta

SEQ ID NO: 29337 - DNA, 71 bp, chicken (Gallus Gallus)
  misc_feature (36): n=c or t
attgagtaaaagaataattgataagtgatttttttncctttctattctctatgctggattttgttgtgctg

SEQ ID NO: 29338 - DNA, 71 bp, chicken (Gallus Gallus)
  misc_feature (36): n=c or t
gcttgcagcaggttggttgcatgggaacgcagtccnaaggcaatccaggggtaagtacacagcacatggat

SEQ ID NO: 29339 - DNA, 71 bp, chicken (Gallus Gallus)
  misc_feature (36): n=a or g
ggagtcagacttttcctattcttggaagaaaatttnccctcacagatttaacatctctttggttgttatga

SEQ ID NO: 29340 - DNA, 71 bp, chicken (Gallus Gallus)
  misc_feature (36): n=c or t
agtaatacactccttgtcttgaatttttctaaaccngtatctattcagctataaatgctgaagatgtcagt

SEQ ID NO: 29341 - DNA, 71 bp, chicken (Gallus Gallus)
  misc_feature (36): n=g or t
gcttacaggaacatatggcatttataccactgtttngcagctgtgctcagagaggaagggcacacacagca

SEQ ID NO: 29342 - DNA, 71 bp, chicken (Gallus Gallus)
  misc_feature (36): n=a or c
aaaggaaaacaacttttgcagaaaccatcatccccnaaatcctgaaagagcaaacaggacagagagaagag

SEQ ID NO: 29343 - DNA, 71 bp, chicken (Gallus Gallus)
  misc_feature (36): n=g or t
agcagatgagttcctggggagggaacaaaggcattnaaacttcagcaacatattgtttaacttagaagagc

SEQ ID NO: 29344 - DNA, 71 bp, chicken (Gallus Gallus)
  misc_feature (36): n=a or g
aacagagcctcaccgcctccagtcttagtggttttntaacaggacgctagaagtgagtgttgcatggaagc

SEQ ID NO: 29345 - DNA, 71 bp, chicken (Gallus Gallus)
  misc_feature (36): n=c or t
tgatatggagagtacaggatttcctactgtacctgnctgaccatattccacctggattacttaccacgtta

SEQ ID NO: 29346 - DNA, 71 bp, chicken (Gallus Gallus)
  misc_feature (36): n=a or g
aggagagaggaagtagtggaaatcagatatatcggnatggctgaacttccctaagtctggccagtaaaaat

SEQ ID NO: 29347 - DNA, 71 bp, chicken (Gallus Gallus)
  misc_feature (36): n=g or t
atcgttttatggacttgttcttagcacagcctattncatatctaaacgtggtacatcttaggcatttttct

SEQ ID NO: 29348 - DNA, 71 bp, chicken (Gallus Gallus)
  misc_feature (36): n=c or t
aacacattgcctcagttttgggttcagtttccagtntcctggcactgtttgaatccctggtgcagctgctc

SEQ ID NO: 29349 - DNA, 71 bp, chicken (Gallus Gallus)
  misc_feature (36): n=a or g
aaagaagaaaatgccaatcccaaacccaacaatccntccttctctaaaatcttatgtgactttttgtgtgt

SEQ ID NO: 29350 - DNA, 71 bp, chicken (Gallus Gallus)
  misc_feature (36): n=c or t
aagatgactggcatgctaagctccctaaatacatcnagtctttcacacaatgacttgtttgtagtgtgtat

SEQ ID NO: 29351 - DNA, 71 bp, chicken (Gallus Gallus)
  misc_feature (36): n=a or g
gcttatatattcatttacaagttccatgatattgangtttaagatattttctaagttcctgattgactttt

SEQ ID NO: 29352 - DNA, 71 bp, chicken (Gallus Gallus)
  misc_feature (36): n=a or g
tttgtgcatgaattaagtcaggaatttgtgggtctncttattgccagtgactccctgaataatatctctct

SEQ ID NO: 29353 - DNA, 71 bp, chicken (Gallus Gallus)
  misc_feature (36): n=a or g
ttataaacctcatatgacagaccaaaagaagatganttagcaaaggtagctgtgttcattttcatcaattt

SEQ ID NO: 29354 - DNA, 71 bp, chicken (Gallus Gallus)
  misc_feature (36): n=a or g
tgtgtgtttcaatttgatgagaaataaaaagggganggttttcatgctgctgtgtgtgactattctcctca

SEQ ID NO: 29355 - DNA, 71 bp, chicken (Gallus Gallus)
  misc_feature (36): n=c or t
gtaaagcatgtacactttgtaaatttgtatctaganttttaaaggtatctggtgaatgcattttaaggctc

SEQ ID NO: 29356 - DNA, 71 bp, chicken (Gallus Gallus)
  misc_feature (36): n=c or t
aggcaaatatgtgttatttatcattcctttgtagtnaaacatgtcaaagtcttttgaatcttgtgctgaaa

SEQ ID NO: 29357 - DNA, 71 bp, chicken (Gallus Gallus)
  misc_feature (36): n=a or c
tagaagaacatgagaattcagttttgcagaaagganatgctgaaagagatcgtaatgttagtacagaggga

SEQ ID NO: 29358 - DNA, 71 bp, chicken (Gallus Gallus)
  misc_feature (36): n=a or g
ctaggaagaatatttatctgtttatcttatttggcntttattagctctctaaaaattcaacagaaggcctt

SEQ ID NO: 29359 - DNA, 71 bp, chicken (Gallus Gallus)
  misc_feature (36): n=c or t
ggaaaagtgatttttaaatggtgacagtaagtaaangtatggaaaagatttgctattcagaaaaaaagggt

SEQ ID NO: 29360 - DNA, 71 bp, chicken (Gallus Gallus)
  misc_feature (36): n=c or t
agatatctaacaataaacactggttagattctcaangctacataggtgtataaattttattgaaattatcc

SEQ ID NO: 29361 - DNA, 71 bp, chicken (Gallus Gallus)
  misc_feature (36): n=g or t
cccatagctcactttgtggaaatgctgcctgtcctntcagctccatgacacagtgaaaggggggtttccat

SEQ ID NO: 29362 - DNA, 71 bp, chicken (Gallus Gallus)
  misc_feature (36): n=a or g
ttcattgtgcctttatttctatagcacccccaaaanttgattgctctcaaaattagcacaccttcctttac

SEQ ID NO: 29363 - DNA, 71 bp, chicken (Gallus Gallus)
  misc_feature (36): n=a or g
ccatggtctgaatgcttccccaagtgctaatgtctntcttatcttcaaggcatgctgaaaagggactgacg

SEQ ID NO: 29364 - DNA, 71 bp, chicken (Gallus Gallus)
  misc_feature (36): n=c or t
gtttgaaatcatgcccacttctgctatgttgttctncctctaatagaaagcttaggttgtcctaggttgat

SEQ ID NO: 29365 - DNA, 71 bp, chicken (Gallus Gallus)
  misc_feature (36): n=a or g
ctttgtcccgtgacaatggtactgtaggtttacttncagaacaagcatggtgagctgcaagggttgggcag

SEQ ID NO: 29366 - DNA, 71 bp, chicken (Gallus Gallus)
  misc_feature (36): n=a or g
ttgctgaaacttccattttgtcccagtagatggtanatgctaaagatcaagagacataatcaagagcacaa

SEQ ID NO: 29367 - DNA, 71 bp, chicken (Gallus Gallus)
  misc_feature (36): n=c or t
atagagtcattttatcctatatcaggtagaaaaatntttggaaattaactgttttttcccttttaaattct

SEQ ID NO: 29368 - DNA, 71 bp, chicken (Gallus Gallus)
  misc_feature (36): n=c or t
tatctatcactagaagggaggacataggaccacagnctattcagtgtcagaagcaatattagacaaagaat

SEQ ID NO: 29369 - DNA, 71 bp, chicken (Gallus Gallus)
  misc_feature (36): n=c or t
atctggaaagagtatattggagattacagccaaganagaacattgctgagtcatggaatttattcatcacc

SEQ ID NO: 29370 - DNA, 71 bp, chicken (Gallus Gallus)
  misc_feature (36): n=a or g
tagcctttccagttgcctttaaagccaagatgtacntgccaaaagctcctctgtgcccttgaattctcaaa

SEQ ID NO: 29371 - DNA, 71 bp, chicken (Gallus Gallus)
  misc_feature (36): n=t or c
ctcttaagtatgtagaatggtagccactgcctcgcntcttccctgcggacaaaaggacattactaaaatct

SEQ ID NO: 29372 - DNA, 71 bp, chicken (Gallus Gallus)
  misc_feature (36): n=a or g
cttattaccattaaacactgttgcataatcagacantattcaaagttgacttgcattgtttggtattttgt

SEQ ID NO: 29373 - DNA, 71 bp, chicken (Gallus Gallus)
  misc_feature (36): n=c or t
ctcatgataagaagaggctttatatgtagcttcttngagcttttatgaaaattctacttcattgggaacat

SEQ ID NO: 29374 - DNA, 71 bp, chicken (Gallus Gallus)
  misc_feature (36): n=c or t
ggtgacaaatatccatgctttcatatttaatttctnagagcagaattagtcagtgaaatatgtatatggtg

SEQ ID NO: 29375 - DNA, 71 bp, chicken (Gallus Gallus)
  misc_feature (36): n=a or c
attacctggctatcagaggcacaaagcactcatgcngagtcaagataaaaattgggatatagcttttatca

SEQ ID NO: 29376 - DNA, 71 bp, chicken (Gallus Gallus)
  misc_feature (36): n=a or c
gcatttgttcaggttttcttatccttaaaatcaaanccatctactctgcctgatactgatccctttcaggc

SEQ ID NO: 29377 - DNA, 71 bp, chicken (Gallus Gallus)
  misc_feature (36): n=c or t
acttaagatcccctaaaggataccagtaaccatttntcacttctgaaggacagaattctcatctaagccag

SEQ ID NO: 29378 - DNA, 71 bp, chicken (Gallus Gallus)
  misc_feature (36): n=a or g
tattaactgaatttcttacaaaatagagagttgacngatcccagttctatgaagtgaggaatccagtgagt

SEQ ID NO: 29379 - DNA, 71 bp, chicken (Gallus Gallus)
  misc_feature (36): n=c or t
aaaactattttttcaaaggaagggattacattaacngtgatcataaaagactttagctaatttgtctattt

SEQ ID NO: 29380 - DNA, 71 bp, chicken (Gallus Gallus)
  misc_feature (36): n=c or t
actatcacgattatgaatgcacaaatagcacaatgnaccttcaacctagtagcatttgaatgaactaactt

SEQ ID NO: 29381 - DNA, 71 bp, chicken (Gallus Gallus)
  misc_feature (36): n=a or g
agcattttctagcaatttttcgtatataattagttnccatattttcttctgcatgtcttcgcctatagcct

SEQ ID NO: 29382 - DNA, 71 bp, chicken (Gallus Gallus)
  misc_feature (36): n=c or t
tttcccaaactgtgtccacataagatgttttcatangagaacaaaatagtccttttgtctatgccctttca

SEQ ID NO: 29383 - DNA, 71 bp, chicken (Gallus Gallus)
  misc_feature (36): n=c or t
agggggcctggtccttactgcagcttttgcttacgngtcattggtgccaaggccctatgatcagctctgtg

SEQ ID NO: 29384 - DNA, 71 bp, chicken (Gallus Gallus)
  misc_feature (36): n=a or g
ccttcacctgagaaggccttcaaatagaaagcttcnagtcctcaaaactcagatattcggattaaggaaat

SEQ ID NO: 29385 - DNA, 71 bp, chicken (Gallus Gallus)
  misc_feature (36): n=a or g
cattttcagtgttacaagccttatctgtgcagtaantatacactgctttgtgcaaaaagcccagatcttgc

SEQ ID NO: 29386 - DNA, 71 bp, chicken (Gallus Gallus)
  misc_feature (36): n=a or g
atcattaaggaaagttccattaatatttagcatgtntgaacgtgctacatttctatacaacaaaagtgagg

SEQ ID NO: 29387 - DNA, 71 bp, chicken (Gallus Gallus)
  misc_feature (36): n=c or t
tggtgctgaaaggccttgtccaggcctgcaggcacngtagggactgatattattttctctatatcaccagc

SEQ ID NO: 29388 - DNA, 71 bp, chicken (Gallus Gallus)
  misc_feature (36): n=a or g
cttacacccgcacaggtgcacataagcacatatatncacacagatatcatcagcataatgcaggaaaagaa

SEQ ID NO: 29389 - DNA, 71 bp, chicken (Gallus Gallus)
  misc_feature (36): n=g or t
tttcttgttgacattgttaactatgtagtgccactngtttacctacgttgcacaaacttttgcttgctttc

SEQ ID NO: 29390 - DNA, 71 bp, chicken (Gallus Gallus)
  misc_feature (36): n=a or g
tacatttttctaagcatctgatggaagattcctccngaatgagagaaaacaactttgaactgccgtattgt

SEQ ID NO: 29391 - DNA, 71 bp, chicken (Gallus Gallus)
  misc_feature (36): n=a or g
ttgatctagatttctttctcaatcctgatttctcantggtatatgtagaaatacttggcctggtaacatat

SEQ ID NO: 29392 - DNA, 71 bp, chicken (Gallus Gallus)
  misc_feature (36): n=c or t
aggttcagaaaattagactttggaattttcctgacngtggagtatattttcaagtcaagcactgtaataaa

SEQ ID NO: 29393 - DNA, 71 bp, chicken (Gallus Gallus)
  misc_feature (36): n=c or t
aaaagttattaccttcaagagcaaatgtacaacagngataataactgtgtatatgctacaggaaaacagaa

SEQ ID NO: 29394 - DNA, 71 bp, chicken (Gallus Gallus)
  misc_feature (36): n=c or t
tgcaaagctttcatctccacacctactattcagaanggaaacaaagcacttcgtaaatatttaagacagct

SEQ ID NO: 29395 - DNA, 71 bp, chicken (Gallus Gallus)
  misc_feature (36): n=a or g
ttctttaatatgtgatggttagagcaaaaaatgaancactgttaaaccatgactttggtacaaagtggcat

SEQ ID NO: 29396 - DNA, 71 bp, chicken (Gallus Gallus)
  misc_feature (36): n=a or c
tccctcctacacgtctcctctactctgagcatcccncaggccaggaatccttattcctgaacacagccaag

SEQ ID NO: 29397 - DNA, 71 bp, chicken (Gallus Gallus)
  misc_feature (36): n=a or g
gcttgttatgataggagtcactaaactgctagagcntgttgattggcaaaagcaatcatttttcacattaa

SEQ ID NO: 29398 - DNA, 71 bp, chicken (Gallus Gallus)
  misc_feature (36): n=g or t
gacttaactaaggatctgtaaaaagcactgtaaatncactcagctctacaaagaaggtatggaactatctg

SEQ ID NO: 29399 - DNA, 71 bp, chicken (Gallus Gallus)
  misc_feature (36): n=c or t
atcaagtaaaaaggtaatttcaaatggtattcttgnagaggtaatatatttaaagttgatttagtttgtaa

SEQ ID NO: 29400 - DNA, 71 bp, chicken (Gallus Gallus)
  misc_feature (36): n=a or c
gcatcaagtaatgttgccttaaaagtaatctagggnagaaatggtatcctataacttctcaacaacaattc

SEQ ID NO: 29401 - DNA, 71 bp, chicken (Gallus Gallus)
  misc_feature (36): n=g or t
gataccactctacaccccaaaactccataagataancttattcacaattctggtaggaacagctcttgaca

SEQ ID NO: 29402 - DNA, 71 bp, chicken (Gallus Gallus)
  misc_feature (36): n=a or g
tgcttgctaagtctgttgggtctctggaagatctcnaaggtctcttggttttgcagtaaccaagtagctcc

SEQ ID NO: 29403 - DNA, 71 bp, chicken (Gallus Gallus)
  misc_feature (36): n=a or g
agtgcagctctgacttggaaatgtaagctttccttntggacaggatattttgactttcaaatggcaagctg

SEQ ID NO: 29404 - DNA, 71 bp, chicken (Gallus Gallus)
  misc_feature (36): n=a or g
attacatgcaagccaaatatttgattttactgtcantatggagttagcaaagcagtggcaatcactgaagt

SEQ ID NO: 29405 - DNA, 71 bp, chicken (Gallus Gallus)
  misc_feature (36): n=g or t
tgtctatgatgctctttcttagctaccacgacactngataagcttcctatttaaactcattctctttttgc

SEQ ID NO: 29406 - DNA, 71 bp, chicken (Gallus Gallus)
  misc_feature (36): n=a or g
aaataagcatatactcttttcataactgcagcatgncgtaaaacactttcactttgtttatttttccttct

SEQ ID NO: 29407 - DNA, 71 bp, chicken (Gallus Gallus)
  misc_feature (36): n=c or t
accatttctttacccttaactgtatcagtttgttantacttcacaaggtaaaagctttgggtggtcataat

SEQ ID NO: 29408 - DNA, 71 bp, chicken (Gallus Gallus)
  misc_feature (36): n=c or t
gactcctgattaagtggagtcaggcatctcttcagnagattctcggcagaggtgtagtagtttgtacagat

SEQ ID NO: 29409 - DNA, 71 bp, chicken (Gallus Gallus)
  misc_feature (36): n=c or t
tccctgtaaggttcaaaccagtatgttcttatatgnaacttcttaggtctggcccatgcctaccaatttct

SEQ ID NO: 29410 - DNA, 71 bp, chicken (Gallus Gallus)
  misc_feature (36): n=a or g
aaacactatcacaaattaaatcaaaactatgatacntctgtttgttgtggtttctgttttctttgcagtga

SEQ ID NO: 29411 - DNA, 71 bp, chicken (Gallus Gallus)
  misc_feature (36): n=c or t
ccattcctgccactcaaggcagggcctggaagtccnactctcttgtttttacttcattcattgcaagtcag

SEQ ID NO: 29412 - DNA, 71 bp, chicken (Gallus Gallus)
  misc_feature (36): n=a or c
tcaacttgtttttaaaatttcacgctgaaaacctcncctgctgtattctctcccctcaagacagacactgt

SEQ ID NO: 29413 - DNA, 71 bp, chicken (Gallus Gallus)
  misc_feature (36): n=g or t
gtttacatagatttcacagcttggtcagtttatttnttctttcatccatatacagggtgaaaattcctcac

SEQ ID NO: 29414 - DNA, 71 bp, chicken (Gallus Gallus)
  misc_feature (36): n=c or t
aatagttctttcattctaattccctgcggtgctacnggtgacataggtaaaaatcagatgagttaagtgca

SEQ ID NO: 29415 - DNA, 71 bp, chicken (Gallus Gallus)
  misc_feature (36): n=a or g
ctctcatatttgtgactgagtgaaaaatttgtgggnactactcaggctggaacgtaatgtttacttacttt

SEQ ID NO: 29416 - DNA, 71 bp, chicken (Gallus Gallus)
  misc_feature (36): n=a or g
attccctattactagttttctcaagaacttagagancatatccatgtaaatgtattttgttatattgttct

SEQ ID NO: 29417 - DNA, 71 bp, chicken (Gallus Gallus)
  misc_feature (36): n=c or t
tgggctaaggagctctctcaatatagctgaacatcnaccaacattatattgacataataattatgtatgtg

SEQ ID NO: 29418 - DNA, 71 bp, chicken (Gallus Gallus)
  misc_feature (36): n=a or g
tttaactgacttcaaaaatgttgttcttttcctgcnttttacacttttgtcatggtatattgacagtgagt

SEQ ID NO: 29419 - DNA, 71 bp, chicken (Gallus Gallus)
  misc_feature (36): n=a or g
acttaaaccttgttatcattgtgctatttttctacnttgcgaggtgaggcaggggagtattttaattgaaa

SEQ ID NO: 29420 - DNA, 71 bp, chicken (Gallus Gallus)
  misc_feature (36): n=a or c
gaactaaatatgctaaagcactagggtgtttactanggtattcgatcagtgcatttcatcactcctatgaa

SEQ ID NO: 29421 - DNA, 71 bp, chicken (Gallus Gallus)
  misc_feature (36): n=a or g
acaatattcttcccatctacacaaaggaaatatatntgaatggctacctacttttaaacaagaaaaaaaag

SEQ ID NO: 29422 - DNA, 71 bp, chicken (Gallus Gallus)
  misc_feature (36): n=c or t
aagagagttggtttttgaagtaaaactgttctttanctaataaagctttgcaatattgggtagcattttag

SEQ ID NO: 29423 - DNA, 71 bp, chicken (Gallus Gallus)
  misc_feature (36): n=c or t
acagagcatcatatgtgtaaaagaatatcttaatangaagatgacctctaagccctcagtaaggactggaa

SEQ ID NO: 29424 - DNA, 71 bp, chicken (Gallus Gallus)
  misc_feature (36): n=c or t
gtccatacagtctttctagtaaaatacaattaaganattattaagaagttttagataataagcaacagtgt

SEQ ID NO: 29425 - DNA, 71 bp, chicken (Gallus Gallus)
  misc_feature (36): n=a or c
taatgtctagtaaagtttaatactggcttatacttnagttccattctgagtatgggaaatgtcctaaggaa

SEQ ID NO: 29426 - DNA, 71 bp, chicken (Gallus Gallus)
  misc_feature (36): n=c or t
taatgagtccatctagaagatgctagtattactggnaaggacagatgaataatgagtggtgttctccaggg

SEQ ID NO: 29427 - DNA, 71 bp, chicken (Gallus Gallus)
  misc_feature (36): n=a or g
gttctgtatagattaagtggctgatatgcagctgantggtgttgaacgaataaaaacaccctagggaagtg

SEQ ID NO: 29428 - DNA, 71 bp, chicken (Gallus Gallus)
  misc_feature (36): n=g or t
tgtctttcttaaagtgcagggatcttgttaggcagngtagtagttgggtttgatttaataactggtctaaa

SEQ ID NO: 29429 - DNA, 71 bp, chicken (Gallus Gallus)
  misc_feature (36): n=a or g
acatatggaaagcttaattcagcatcagggctaccntaatcagtaatttctacatgagtagaacatctttt

SEQ ID NO: 29430 - DNA, 71 bp, chicken (Gallus Gallus)
  misc_feature (36): n=a or g
tcactgtagtatccctgccctggttggcataccagntttcatgtgggtttctgagagcctcttctaagctc

SEQ ID NO: 29431 - DNA, 71 bp, chicken (Gallus Gallus)
  misc_feature (36): n=c or t
ttttgcaccaaaaacatgttgtaaaatcaaaacttnagtggattttaagggattcctttttcgtgagataa

SEQ ID NO: 29432 - DNA, 71 bp, chicken (Gallus Gallus)
  misc_feature (36): n=c or t
gaagttcatttgggagatggttttaggcttgaagangaagttggctggttctcattcatgtgatcaaagtt

SEQ ID NO: 29433 - DNA, 71 bp, chicken (Gallus Gallus)
  misc_feature (36): n=c or t
cttcccactcagagatgcaagagatagcagtcttcntcacaacttcattctagtggatgtgaaagtgctgc

SEQ ID NO: 29434 - DNA, 71 bp, chicken (Gallus Gallus)
  misc_feature (36): n=a or g
gaggtaaatcccagtgtgggaaactttgttccagcnctagggtgccatctctaattttaacattgcatgaa

SEQ ID NO: 29435 - DNA, 71 bp, chicken (Gallus Gallus)
  misc_feature (36): n=c or t
cttgaggagatggtatcctgcagacgaacaacatanattacagaattcaacactgaacacatgagagtggt

SEQ ID NO: 29436 - DNA, 71 bp, chicken (Gallus Gallus)
  misc_feature (36): n=c or t
tcttccagcacatagcgtctccttaaaacagggatnaaatgtggtgggtagggattaaatgtagtaagttt

SEQ ID NO: 29437 - DNA, 71 bp, chicken (Gallus Gallus)
  misc_feature (36): n=c or t
gtcacttcaaggaggtacagaactgcatgcatattnccacctgaaaaggcatagaaccaacctgcttatgt

SEQ ID NO: 29438 - DNA, 71 bp, chicken (Gallus Gallus)
  misc_feature (36): n=c or t
actaactgaaagccgactatatgcctgattcccttnttcatgctctctttatctgcacacaggttcgattc

SEQ ID NO: 29439 - DNA, 71 bp, chicken (Gallus Gallus)
  misc_feature (36): n=c or t
ctcaagaggtaaaatcataggaagtgaaaattactnggagatatgataagccatgtcatatcatactgata

SEQ ID NO: 29440 - DNA, 71 bp, chicken (Gallus Gallus)
  misc_feature (36): n=a or g
gaatgtggttaaaatcaatttaagttctgttttacngttgctagatggaagcatttcttactgcctgcaat

SEQ ID NO: 29441 - DNA, 71 bp, chicken (Gallus Gallus)
  misc_feature (36): n=a or g
acacttgggattctccatgttgtttgccttgaaacncatattgtagaagtaaacttttcatttattatagt

SEQ ID NO: 29442 - DNA, 71 bp, chicken (Gallus Gallus)
  misc_feature (36): n=c or t
tcttctggaagcaccaggatggctacaaagcaagtnatttctaaagtctttatttcttccatgctgggatt

SEQ ID NO: 29443 - DNA, 71 bp, chicken (Gallus Gallus)
  misc_feature (36): n=a or g
tcacatgtctggcagccacagaggtttaatatctgncaagataacagtttgctgccaacaaaatcagtaat

SEQ ID NO: 29444 - DNA, 71 bp, chicken (Gallus Gallus)
  misc_feature (36): n=c or t
caacaaaccctgtagaatcacattccgtcttacctnctgggaccccctctctgacctgtgatttaaacaca

SEQ ID NO: 29445 - DNA, 71 bp, chicken (Gallus Gallus)
  misc_feature (36): n=a or g
ttagttgaggaaaagtgcaggaaggtgctgaagtgnagcaacctaactttcttttatcatagactgtagag

SEQ ID NO: 29446 - DNA, 71 bp, chicken (Gallus Gallus)
  misc_feature (36): n=a or c
acagcagtgtgcaagcagggaagtcttagggttacntgagtatttgtaactgtttagctggaagctactgc

SEQ ID NO: 29447 - DNA, 71 bp, chicken (Gallus Gallus)
  misc_feature (36): n=a or g
tgtttaccatctgtgttactctctctctttgttacnaacactaatggagcattgagacataaaagcatggg

SEQ ID NO: 29448 - DNA, 71 bp, chicken (Gallus Gallus)
  misc_feature (36): n=a or g
tcatgctggtaaggaatccatttgtacattagaacntattcaaaatatactacattcattctcagtacctt

SEQ ID NO: 29449 - DNA, 71 bp, chicken (Gallus Gallus)
  misc_feature (36): n=a or g
gctgtttcctaaggatggtgatttaccattctaatncaaatctgttgttagtactatcccagttttctaaa

SEQ ID NO: 29450 - DNA, 71 bp, chicken (Gallus Gallus)
  misc_feature (36): n=a or c
cagcttttgtagtttgcaattacacagcacacatgntcagcctcagtttgtgcatcatgaaagttactgtg

SEQ ID NO: 29451 - DNA, 71 bp, chicken (Gallus Gallus)
  misc_feature (36): n=a or g
gcagagccagtccctacgtgacagtggaaatctacntgtctttctatctattctacataagaacactgaat

SEQ ID NO: 29452 - DNA, 71 bp, chicken (Gallus Gallus)
  misc_feature (36): n=c or t
gggtggtggaattaacaaagacaagatttaaggcantgatttcaggagtgcctgagcataagacattaagc

SEQ ID NO: 29453 - DNA, 71 bp, chicken (Gallus Gallus)
  misc_feature (36): n=c or t
cagaattcaaaaccagcatttgaagtttggggaaantgtcttaattaggattactataaatgatagcaatt

SEQ ID NO: 29454 - DNA, 71 bp, chicken (Gallus Gallus)
  misc_feature (36): n=c or t
ggcaggacaactgttccatggaatacatcagccatngctttctcctttccagatttaaatgactaaagtaa

SEQ ID NO: 29455 - DNA, 71 bp, chicken (Gallus Gallus)
  misc_feature (36): n=a or g
tagatatatccaagtccaagtccaagtccaacaaanatttcatctacttcaagcagtccatcaggctttga

SEQ ID NO: 29456 - DNA, 71 bp, chicken (Gallus Gallus)
  misc_feature (36): n=c or t
ttgaaagccccaaatgtgggcatggcaatgggcaangcagcgacacattaagagccttcttgccactggaa

SEQ ID NO: 29457 - DNA, 71 bp, chicken (Gallus Gallus)
  misc_feature (36): n=a or g
tctacttataaagcaagtaagtaggaaacttgatgnctttgttctgccttcctcaaaaaagcttatcgaag

SEQ ID NO: 29458 - DNA, 71 bp, chicken (Gallus Gallus)
  misc_feature (36): n=c or t
aatcaacctcccccttcatactgcttccccccaaanatcgcagctcctctaaaattgttaacgtgaagaat

SEQ ID NO: 29459 - DNA, 71 bp, chicken (Gallus Gallus)
  misc_feature (36): n=a or g
ggcaccggtgctcagtgatattccggccaaatgtanacacttattgtcttcagcgcacacctacgcgtgtg

SEQ ID NO: 29460 - DNA, 71 bp, chicken (Gallus Gallus)
  misc_feature (36): n=a or g
tcttacacagaaagcataaacctaaagttccccacnttggtgacactcctcttcacctgctcacagtagat

SEQ ID NO: 29461 - DNA, 71 bp, chicken (Gallus Gallus)
  misc_feature (36): n=c or t
ctggaatgggagcgtaagtcccaaggctattctgcntcactgtgagacatttgagaagctcacctcgaatt

SEQ ID NO: 29462 - DNA, 71 bp, chicken (Gallus Gallus)
  misc_feature (36): n=c or t
aatgagcttttatgtgagcttttatgtcatgccttnggtgtgccatggggcagaagtccaaaggcagcgtc

SEQ ID NO: 29463 - DNA, 71 bp, chicken (Gallus Gallus)
  misc_feature (36): n=c or t
tattattaagatgaattgcacattacaaaaagtgtngtgggatgtaattttgcaaatatgtaacattccag

SEQ ID NO: 29464 - DNA, 71 bp, chicken (Gallus Gallus)
  misc_feature (36): n=a or g
taattaaacattctgtactacatctatattaaaagnaaaaaagtagttacttttctcactgtgtgctctgg

SEQ ID NO: 29465 - DNA, 71 bp, chicken (Gallus Gallus)
  misc_feature (36): n=g or t
ccagctttaagacactgagatacttctcatccaganaagcaaaaagggctggggactcctttgatggaaaa

SEQ ID NO: 29466 - DNA, 71 bp, chicken (Gallus Gallus)
  misc_feature (36): n=c or t
acttggcacttcctgaactacagatcttccttttcncaccacacatccttcaaccccatttcaagtgcagt

SEQ ID NO: 29467 - DNA, 71 bp, chicken (Gallus Gallus)
  misc_feature (36): n=a or g
ggatgaagacctagaaggagatatgctcaggactcnagaatctttctgtactgctatctcccattggtctg

SEQ ID NO: 29468 - DNA, 71 bp, chicken (Gallus Gallus)
  misc_feature (36): n=c or t
gcagaactgtacattcctatatctcttgtataatanacagcctctgttgtgtttcataagccatagagtcg

SEQ ID NO: 29469 - DNA, 71 bp, chicken (Gallus Gallus)
  misc_feature (36): n=c or t
ttttaaattgtttaatgcagaggaaccaatggatcncactcaatggatcccactcctggacatccatacct

SEQ ID NO: 29470 - DNA, 71 bp, chicken (Gallus Gallus)
  misc_feature (36): n=a or g
caaagttagatgtttatttcaccactggaagagacntctgagatctaatttcttgctgtaattgtttaaac

SEQ ID NO: 29471 - DNA, 71 bp, chicken (Gallus Gallus)
  misc_feature (36): n=a or c
gtcccgtgggattacatgctatgattatatacattnaagtgttcaagagctttaaatacactccagatgct

SEQ ID NO: 29472 - DNA, 71 bp, chicken (Gallus Gallus)
  misc_feature (36): n=c or t
taaaaagctttagcaggaaaacagtaaaggcagtangttccaaagatgcacgagtactttaaacaaaggct

SEQ ID NO: 29473 - DNA, 71 bp, chicken (Gallus Gallus)
  misc_feature (36): n=a or g
tgtcacagtggatatgctggaaaacatgactttgcntctagccaggagacgtttctctttaccaagttctc

SEQ ID NO: 29474 - DNA, 71 bp, chicken (Gallus Gallus)
  misc_feature (36): n=g or t
ggttgtgggcttggaatactgagtcgtcctgatatntgtactgtagaaatctgcttgagttaatttaccaa

SEQ ID NO: 29475 - DNA, 71 bp, chicken (Gallus Gallus)
  misc_feature (36): n=c or t
aacaacagaggaagggacagacttggccccctcatnttatgatgctggaatttcttacaagaggaactgtg

SEQ ID NO: 29476 - DNA, 71 bp, chicken (Gallus Gallus)
  misc_feature (36): n=c or t
acagagcgtccataagattctttaaaggtactgtangcaagaccatgcattcctttgtgccagagagaata

SEQ ID NO: 29477 - DNA, 71 bp, chicken (Gallus Gallus)
  misc_feature (36): n=g or t
gtagccctccaaatcatgaggaagaatataactctnggacgttttggactaaagtgcatcagttatgaata

SEQ ID NO: 29478 - DNA, 71 bp, chicken (Gallus Gallus)
  misc_feature (36): n=g or t
aacaactaaaggtatactgccctttcctttaactgnatatagaggaatgggcatgaggtgcaacatcctca

SEQ ID NO: 29479 - DNA, 71 bp, chicken (Gallus Gallus)
  misc_feature (36): n=c or t
aaaaataaaatcataaaaaaccagcactttgacagngtcaaatagagaggtaattagagagtgttatttta

SEQ ID NO: 29480 - DNA, 71 bp, chicken (Gallus Gallus)
  misc_feature (36): n=a or g
tgactggtgtggaaatacagacattagctgctattnctcagctagggtgaaattacatcttataattcaag

SEQ ID NO: 29481 - DNA, 71 bp, chicken (Gallus Gallus)
  misc_feature (36): n=a or g
tacaatgttaaccactgacacagttcccaaacttcnactacttattaagaaatattctgcacagacttttc

SEQ ID NO: 29482 - DNA, 71 bp, chicken (Gallus Gallus)
  misc_feature (36): n=c or t
cacataagctatattgcatgagttcctattttacanataaaacaaatcagtacttctgatagtagtccaca

SEQ ID NO: 29483 - DNA, 71 bp, chicken (Gallus Gallus)
  misc_feature (36): n=c or t
caagtttttggcagtaataccttgatacagtttctnaactccttttgttttgaaggtatcagcctgctgca

SEQ ID NO: 29484 - DNA, 71 bp, chicken (Gallus Gallus)
  misc_feature (36): n=c or t
gagagagggttgaaccaagggtcaacatgtcatatntagtcagcctgagttcagtgagtatttaagcttca

SEQ ID NO: 29485 - DNA, 71 bp, chicken (Gallus Gallus)
  misc_feature (36): n=c or t
ttttgccataaggacaaatggcatggcagagagcanatccatttagttacagtcctttatccccattcata

SEQ ID NO: 29486 - DNA, 71 bp, chicken (Gallus Gallus)
  misc_feature (36): n=c or t
tggtgttaaggcttagcacactaaagcttcaatatngtcatcttcctctagcagtgcctgctctaacagtt

SEQ ID NO: 29487 - DNA, 71 bp, chicken (Gallus Gallus)
  misc_feature (36): n=a or g
ttggggcacttatttagtatttgagcattttttaanatctagctactcgcaaatagaagtatatatgtagg

SEQ ID NO: 29488 - DNA, 71 bp, chicken (Gallus Gallus)
  misc_feature (36): n=a or g
taggaataacagcttttctgttacgtaccaaaaacntattgcctgcgtttattgctcctggacatcctgaa

SEQ ID NO: 29489 - DNA, 71 bp, chicken (Gallus Gallus)
  misc_feature (36): n=c or t
gatttgtagcaccagaaagttgtagggttaaggcangtgtgacactgttaaaagaataccaaaggtggtct

SEQ ID NO: 29490 - DNA, 71 bp, chicken (Gallus Gallus)
  misc_feature (36): n=c or t
aatgcaaggggtaactcaaatcaaatcctctgcgangttctctagaggcatctctctgaactgcttgcaac

SEQ ID NO: 29491 - DNA, 71 bp, chicken (Gallus Gallus)
  misc_feature (36): n=a or g
ggggtctttgcatctgtcagtgtttttggtcatgangttcatgctgaactgttcttttagcttgtctacat

SEQ ID NO: 29492 - DNA, 71 bp, chicken (Gallus Gallus)
  misc_feature (36): n=c or t
agccataccttcccaaaatgttgacatctgtaagantgttcttaaaagctgctcccaatttcaagacggcc

SEQ ID NO: 29493 - DNA, 71 bp, chicken (Gallus Gallus)
  misc_feature (36): n=a or g
atcacaagctatagctttgccactgttgcatctctngctgtcttactgtagtattcaattaattttttaga

SEQ ID NO: 29494 - DNA, 71 bp, chicken (Gallus Gallus)
  misc_feature (36): n=c or t
ttattttctttagctcatcccacagagggactttcntgctttttttgtctaagagtgaaaaactgtccttg

SEQ ID NO: 29495 - DNA, 71 bp, chicken (Gallus Gallus)
  misc_feature (36): n=a or g
tgatcccattctaaaagaacagaaaccctgcagggnagttgctgggtagagatatctcagcagggcaatgg

SEQ ID NO: 29496 - DNA, 71 bp, chicken (Gallus Gallus)
  misc_feature (36): n=a or g
tgaactgggaagagcaggtgtgaatatcatcaaatnttatatcagcatcaaaattaaaacagtataactgc

SEQ ID NO: 29497 - DNA, 71 bp, chicken (Gallus Gallus)
  misc_feature (36): n=c or t
gagcaacctcttgtttttattgattcatatgcacangtgcaaaatttagcctgtatatcctgtatcctgct

SEQ ID NO: 29498 - DNA, 71 bp, chicken (Gallus Gallus)
  misc_feature (36): n=c or t
acgagcatactcttaacatggaggtaggaagagctnagcgcatccccatggtgaactgccttctacatact

SEQ ID NO: 29499 - DNA, 71 bp, chicken (Gallus Gallus)
  misc_feature (36): n=c or t
gaatacgtttttcatcagaggatgccactcacaccnggtgcttgcagaaaaaaaagattattagaatgctt

SEQ ID NO: 29500 - DNA, 71 bp, chicken (Gallus Gallus)
  misc_feature (36): n=a or g
tgatttaataagcacggttgctgagttctgttattngagaatggtaatttagaaataacacttttcttaac

SEQ ID NO: 29501 - DNA, 71 bp, chicken (Gallus Gallus)
  misc_feature (36): n=a or g
gtgatctaggaaattgtttattgccttggaaatgcngagtgagaaagatcttacagtagagagatgccttc

SEQ ID NO: 29502 - DNA, 71 bp, chicken (Gallus Gallus)
  misc_feature (36): n=a or g
tgatagcaaaagttgatagcaaatatggcaaatganaaagattctataagaatcttccatctgaactgcaa

SEQ ID NO: 29503 - DNA, 71 bp, chicken (Gallus Gallus)
  misc_feature (36): n=c or t
aacctgaaaaacactaaagagaatgttgtatgcttntgacacttgagttctccccagcctagtctaaagat

SEQ ID NO: 29504 - DNA, 71 bp, chicken (Gallus Gallus)
  misc_feature (36): n=a or g
tagaaactcactgacaagccaccctttctgtatgantaaccctaatttgctttttaaaagtagtgattatt

SEQ ID NO: 29505 - DNA, 71 bp, chicken (Gallus Gallus)
  misc_feature (36): n=a or g
gacaagagtaaatctaaattctgagtgcttcataangatttcagggatttaagagattgcagcttgagaaa

SEQ ID NO: 29506 - DNA, 71 bp, chicken (Gallus Gallus)
  misc_feature (36): n=g or t
agtgtatgaaggagggagtaaacattgtggaagaanatctgttagaatgggatctctctacttctagagta

SEQ ID NO: 29507 - DNA, 71 bp, chicken (Gallus Gallus)
  misc_feature (36): n=c or t
tgtttgcagtcactggggagtgtaatatatgaatcnggatataaactgatctagcaatcagtgcattcagg

SEQ ID NO: 29508 - DNA, 71 bp, chicken (Gallus Gallus)
  misc_feature (36): n=a or g
ttaaggactttacatgtaatagtgcaagtgatgttntcctcctaaatgttgaagtcaaagacagtgtgatc

SEQ ID NO: 29509 - DNA, 71 bp, chicken (Gallus Gallus)
  misc_feature (36): n=a or g
tctgatgcattttatatccaagatagtatgatgggncattgctttctaatttacaaatcttttctactgaa

SEQ ID NO: 29510 - DNA, 71 bp, chicken (Gallus Gallus)
  misc_feature (36): n=a or g
tctaaccactagtgctttttatagaaagttaaaacntactagttacattttgtaactaattattttgttag

SEQ ID NO: 29511 - DNA, 71 bp, chicken (Gallus Gallus)
  misc_feature (36): n=c or t
tgagtttgtatttaggctcagaaggcaaataaaacnagtgaaaagaggttgagcccatgggatcttcaagg

SEQ ID NO: 29512 - DNA, 71 bp, chicken (Gallus Gallus)
  misc_feature (36): n=c or t
tacgatgctcttctcctaagtggccggcctctggcncagacagattttgactagattttgcagtaataaaa

SEQ ID NO: 29513 - DNA, 71 bp, chicken (Gallus Gallus)
  misc_feature (36): n=c or t
ttctgccttgcttatttgtttgactcagatgttctntagttgtctcaaataccaatacaagttttcccact

SEQ ID NO: 29514 - DNA, 71 bp, chicken (Gallus Gallus)
  misc_feature (36): n=a or g
aatatttccagattgaagtggtcagattttgatgantttagggaattagcgacactgagctgagaaactaa

SEQ ID NO: 29515 - DNA, 71 bp, chicken (Gallus Gallus)
  misc_feature (36): n=a or g
ctattcagttactgtttactctaaaatatacagcanccttgggagcagggccaagatactcagtgagaata

SEQ ID NO: 29516 - DNA, 71 bp, chicken (Gallus Gallus)
  misc_feature (36): n=a or g
tcctccagaaagggttggagtcctgataaagtaaangacctacatgctgcaagttatgcattgattttttt

SEQ ID NO: 29517 - DNA, 71 bp, chicken (Gallus Gallus)
  misc_feature (36): n=a or c
ctgttcaaatatgacccagaagagaaagagcatcanatttgaaagggctacgcgcttttgtttaatgacaa

SEQ ID NO: 29518 - DNA, 71 bp, chicken (Gallus Gallus)
  misc_feature (36): n=c or t
aaacaactgggaccgtattaaacaatcctgctaaanacagaaaaaccttttcacaaagttctcagggatgc

SEQ ID NO: 29519 - DNA, 71 bp, chicken (Gallus Gallus)
  misc_feature (36): n=a or g
taccacctagggttacacaggactttctaaatatgnagagaaagatattgtaatatttgcaaaatgtaaac

SEQ ID NO: 29520 - DNA, 71 bp, chicken (Gallus Gallus)
  misc_feature (36): n=a or g
gagtgttcagtgtcacctttccatctaaatataacntagaaagagttaccataaaaagagactacttttaa

SEQ ID NO: 29521 - DNA, 71 bp, chicken (Gallus Gallus)
  misc_feature (36): n=c or t
acctatttctggatgtgatcttgtataaatagcctnacagtgataagcactcactttagacgaaactcttc

SEQ ID NO: 29522 - DNA, 71 bp, chicken (Gallus Gallus)
  misc_feature (36): n=c or t
cagtggctgctcaaacacaggttataatcataatcnttcaatactttaccattttattttatctgatttac

SEQ ID NO: 29523 - DNA, 71 bp, chicken (Gallus Gallus)
  misc_feature (36): n=a or g
agtatctccaaaaagagtgtggtggaggggtaaganctgacatatgcacatgtgtacactgatacacggga

SEQ ID NO: 29524 - DNA, 71 bp, chicken (Gallus Gallus)
  misc_feature (36): n=a or g
atttctgcctattcctcacccatccttctctattcntacttgctcccattcagatatctcaatcagatttg

SEQ ID NO: 29525 - DNA, 71 bp, chicken (Gallus Gallus)
  misc_feature (36): n=a or g
ttgctttttcttcactgtaaggatttgtctactcancatagacatttgcaggctaactaaatggtattagt

SEQ ID NO: 29526 - DNA, 71 bp, chicken (Gallus Gallus)
  misc_feature (36): n=c or t
ggctggagtagtgggacaggctctggctgccaacanttgcctcatgagtagatgtttccaactccagtacc

SEQ ID NO: 29527 - DNA, 71 bp, chicken (Gallus Gallus)
  misc_feature (36): n=c or t
aataagagtgtggattcagcaaaatatactgacacnacaagaaacatatcagctttgcatagaaaaaaaac

SEQ ID NO: 29528 - DNA, 71 bp, chicken (Gallus Gallus)
  misc_feature (36): n=c or t
gtcactgtaaaactggacatagacatttgatcaacnggttccttagacactatttttgcactgacaagtag

SEQ ID NO: 29529 - DNA, 71 bp, chicken (Gallus Gallus)
  misc_feature (36): n=c or t
taaaatgtcaagaaggttttaaggtgattaaagcanttcagtaacaagggaaatgatcaactgatgtcact

SEQ ID NO: 29530 - DNA, 71 bp, chicken (Gallus Gallus)
  misc_feature (36): n=a or c
tggcagggaaacaagaggatccgcatagaagcaagntaagcaagcaggatttgtaattctcatggtgacat

SEQ ID NO: 29531 - DNA, 71 bp, chicken (Gallus Gallus)
  misc_feature (36): n=a or g
gcctaacagatctgcagatgagcataggcaagatancatattcaaattctgcaaaatacgagttttatgaa

SEQ ID NO: 29532 - DNA, 71 bp, chicken (Gallus Gallus)
  misc_feature (36): n=a or g
acagggttcaaacagtatgctaatcaggaaatacangggaaaagattaatccattttaaactagaacttat

SEQ ID NO: 29533 - DNA, 71 bp, chicken (Gallus Gallus)
  misc_feature (36): n=a or g
ataccgaacacatactgagtgaatatctgtacccanggagtacaacaagcaaacctcaataacagactcag

SEQ ID NO: 29534 - DNA, 71 bp, chicken (Gallus Gallus)
  misc_feature (36): n=c or t
gtataaatgtcagttaaactaatctcttcctctctnctccccatttgcacaattcctgttagtttagcttt

SEQ ID NO: 29535 - DNA, 71 bp, chicken (Gallus Gallus)
  misc_feature (36): n=a or g
aatctagcatatatactacatgggcatacatgcatncttatatataaacagtgtggtttgaccattcaata

SEQ ID NO: 29536 - DNA, 71 bp, chicken (Gallus Gallus)
  misc_feature (36): n=c or t
atgaaactatatttatcatatggttgatggttgatnggttatggcaatggttgtaacattatagaaaacct

SEQ ID NO: 29537 - DNA, 71 bp, chicken (Gallus Gallus)
  misc_feature (36): n=c or t
aatgaaaacctgccctcttctcctggatatgcatcntgtgatgagcacatggagcttggtaagcaacacgg

SEQ ID NO: 29538 - DNA, 71 bp, chicken (Gallus Gallus)
  misc_feature (36): n=c or t
tgtgtactgttgtgttcactactatgttcacatcangtgcctatggaaaattcaggcatctacttctggac

SEQ ID NO: 29539 - DNA, 71 bp, chicken (Gallus Gallus)
  misc_feature (36): n=a or g
ggagaatgcaaattaaggtttccatagaaatagtantttaccagaactgtgaatttgaagtgatgcatata

SEQ ID NO: 29540 - DNA, 71 bp, chicken (Gallus Gallus)
  misc_feature (36): n=a or g
ctggaacacagtgagtcatccattcagtgtactgcnaaacaggcaattctcactctgagatgcattagcag

SEQ ID NO: 29541 - DNA, 71 bp, chicken (Gallus Gallus)
  misc_feature (36): n=a or g
ttgtactgaactcttacctgaaagagtactctgtcnaatgagctgtcccctttatgcatttttatgctgaa

SEQ ID NO: 29542 - DNA, 71 bp, chicken (Gallus Gallus)
  misc_feature (36): n=a or g
tcatttgagtttgaatagcttacttttaacactgtnttagagtgaagtgtagtacacaaacagtacttctt

SEQ ID NO: 29543 - DNA, 71 bp, chicken (Gallus Gallus)
  misc_feature (36): n=a or g
ctcttatgtcctaagatctcattggactttccaganggtcatctgattcatgactcaggtttatttattga

SEQ ID NO: 29544 - DNA, 71 bp, chicken (Gallus Gallus)
  misc_feature (36): n=a or g
aaatataggaaaatatatccactgttgtttctactnagacaagaactttgcatctttatattctacagctc

SEQ ID NO: 29545 - DNA, 71 bp, chicken (Gallus Gallus)
  misc_feature (36): n=g or t
cagtaaggagagagactgggaccaaatctctacacngacttcagtaaaagtattgtttcctaaccccctgt

SEQ ID NO: 29546 - DNA, 71 bp, chicken (Gallus Gallus)
  misc_feature (36): n=c or t
gctctttgtgtatgattcattttcagcactaaactngtgtagacgcctatttgaggtctggagcttacttc

SEQ ID NO: 29547 - DNA, 71 bp, chicken (Gallus Gallus)
  misc_feature (36): n=a or g
actgcacaggcaattttccttctgtacttgcattcntaaatgtatcttcctggatgtctttgctatgctct

SEQ ID NO: 29548 - DNA, 71 bp, chicken (Gallus Gallus)
  misc_feature (36): n=c or t
tatgagttctgtgcataaaaggcaccttgtgtctantgagagctgaaatatgaattttctgtgtatcccaa

SEQ ID NO: 29549 - DNA, 71 bp, chicken (Gallus Gallus)
  misc_feature (36): n=g or t
acagcctttccaggctgctccataaaaatgtacatnccttgtaactcctgtgccatatctgtgaatttcct

SEQ ID NO: 29550 - DNA, 71 bp, chicken (Gallus Gallus)
  misc_feature (36): n=g or t
cagaaaacaaagagatgcaagatttaagaagtgttntagcctgcaaaatggggatagaataggttatatta

SEQ ID NO: 29551 - DNA, 71 bp, chicken (Gallus Gallus)
  misc_feature (36): n=c or t
aattgcatctatcctggtatatttgctattaactcngcagaaatcaatgaagttgtgctgagataccattc

SEQ ID NO: 29552 - DNA, 71 bp, chicken (Gallus Gallus)
  misc_feature (36): n=c or t
tgctgttattgcagactttcatttacctttcatatnctacctttgtttcagtatcagctttcccacatcta

SEQ ID NO: 29553 - DNA, 71 bp, chicken (Gallus Gallus)
  misc_feature (36): n=a or c
agagttttgcaagaggtactgtaataagtcttaaantaattttcaatcagggaaaaacataagttttttat

SEQ ID NO: 29554 - DNA, 71 bp, chicken (Gallus Gallus)
  misc_feature (36): n=a or c
tagatgtacttagactggataaaggaaggaagattnggttgagaagccttgaaaaagatatagcctggttt

SEQ ID NO: 29555 - DNA, 71 bp, chicken (Gallus Gallus)
  misc_feature (36): n=a or g
cctatacatagtctaagtttaatttttaatctaatntatattttgttcaagcatttttgatgactgtgaca

SEQ ID NO: 29556 - DNA, 71 bp, chicken (Gallus Gallus)
  misc_feature (36): n=a or g
tttgtctaagcttgtcactttcagtgatattcatgncatcggaagagaaataagcacttctagaatcttat

SEQ ID NO: 29557 - DNA, 71 bp, chicken (Gallus Gallus)
  misc_feature (36): n=g or t
ttccctgtagaaattttgatactctgaatagaatgnggaaaatatctttattgtgaagaccctttgaaatg

SEQ ID NO: 29558 - DNA, 71 bp, chicken (Gallus Gallus)
  misc_feature (36): n=c or t
gcaaaaccttgctccttaatgtcctgaattatgccncaaattccttctgtaagttcacctgacatctctca

SEQ ID NO: 29559 - DNA, 71 bp, chicken (Gallus Gallus)
  misc_feature (36): n=a or g
aaacttggcattgtggtggctcattgtagtaatacntaggaaagattagtacagtaccacatacacaagta

SEQ ID NO: 29560 - DNA, 71 bp, chicken (Gallus Gallus)
  misc_feature (36): n=g or t
cgaaataatgcctgatacatgcttaaagcttcttgnttgagactctgtttacattcagtaaagataaataa

SEQ ID NO: 29561 - DNA, 71 bp, chicken (Gallus Gallus)
  misc_feature (36): n=a or g
cattaataagaactgctcaacttcagcacctattancacaaataacatgatggtactatttcctttgacag

SEQ ID NO: 29562 - DNA, 71 bp, chicken (Gallus Gallus)
  misc_feature (36): n=a or g
gatcatcaaagggcataagcatatgtgctaatttcngacaatttatgacatgtacagattctcaaggcagt

SEQ ID NO: 29563 - DNA, 71 bp, chicken (Gallus Gallus)
  misc_feature (36): n=c or t
tgtctcctgccttcagctaaatgtctccttcctctnctcctgaagctccagggaaacagtgaacctagctt

SEQ ID NO: 29564 - DNA, 71 bp, chicken (Gallus Gallus)
  misc_feature (36): n=g or t
gttaaaagtaggtttgatagtgtgcagtgtggctgnattcaggctctgtgccatcagctgcccagccaaat

SEQ ID NO: 29565 - DNA, 71 bp, chicken (Gallus Gallus)
  misc_feature (36): n=a or g
tatattaaatttattattacttgttatttgttattnatttgtggaaacatggctgatccagtagtagggct

SEQ ID NO: 29566 - DNA, 71 bp, chicken (Gallus Gallus)
  misc_feature (36): n=c or t
gttattctaaccaaatacacctattctgaatgatanacataataaagtagtcctagttttcttgtaggcca

SEQ ID NO: 29567 - DNA, 71 bp, chicken (Gallus Gallus)
  misc_feature (36): n=a or c
gtttcagaaaaaaatctgtatctcttaaacgagatnaaagctactcttctgctaaaggtaactcttccttg

SEQ ID NO: 29568 - DNA, 71 bp, chicken (Gallus Gallus)
  misc_feature (36): n=a or g
ctatggttcaaaaaagggagagctgcccactcctcntttatacactgagtttgtaggattccatgatacac

SEQ ID NO: 29569 - DNA, 71 bp, chicken (Gallus Gallus)
  misc_feature (36): n=g or t
gctgattgtggcaatagtgactgactgttgttgggntctgaatgatgtcatagatatgaagccaatgggat

SEQ ID NO: 29570 - DNA, 71 bp, chicken (Gallus Gallus)
  misc_feature (36): n=a or g
gtgttctactgtctatgttttctctcagtggtatanaaatgaaaacggttagaacattatttttgaagtat

SEQ ID NO: 29571 - DNA, 71 bp, chicken (Gallus Gallus)
  misc_feature (36): n=a or g
tcagaattttaatttgaagaacacaccttatgtgcntacagtattattgtctcttttcaacaatgttttta

SEQ ID NO: 29572 - DNA, 71 bp, chicken (Gallus Gallus)
  misc_feature (36): n=c or t
tactggtcaccactttctgggcctggttattcagcnagctttcattcttgctccatatctcaatgtacatt

SEQ ID NO: 29573 - DNA, 71 bp, chicken (Gallus Gallus)
  misc_feature (36): n=g or t
aactcctaagattatgtggtaatggagatactctgnagataaggaaaaaatgctaaagctaacaacgcact

SEQ ID NO: 29574 - DNA, 71 bp, chicken (Gallus Gallus)
  misc_feature (36): n=a or g
gccagcacagctcaccatgacatttaaaattgcaantaatgacaaattatgttaccaggcatccaatatgt

SEQ ID NO: 29575 - DNA, 71 bp, chicken (Gallus Gallus)
  misc_feature (36): n=a or c
aggtcagatagtctgtgaaccaagcataactccagngctacctgtgttctggctttgctatccatgacagt

SEQ ID NO: 29576 - DNA, 71 bp, chicken (Gallus Gallus)
  misc_feature (36): n=g or t
tacctgttcaatcaacacttcagaaagccatttagntggtcaaatgcatgctttcatctcagggggagttg

SEQ ID NO: 29577 - DNA, 71 bp, chicken (Gallus Gallus)
  misc_feature (36): n=a or g
atatctgcaaaaaaaagggcacaggtcctttctacntatcactgtcctacttattccttaaaataactcct

SEQ ID NO: 29578 - DNA, 71 bp, chicken (Gallus Gallus)
  misc_feature (36): n=a or g
ttcactcttttcacttttcacctgttacccgcatcngaactttttacagcttgtgtactgaggagatgctg

SEQ ID NO: 29579 - DNA, 71 bp, chicken (Gallus Gallus)
  misc_feature (36): n=a or g
tcacctcctagaggtgtgactgtgtttttccccctntttccaacctcctcctttggctttgctgttacacc

SEQ ID NO: 29580 - DNA, 71 bp, chicken (Gallus Gallus)
  misc_feature (36): n=a or g
gtcagtaacaggattttgatggtgacagtagactcnatcatcctttcagaggaccattcaattctttactc

SEQ ID NO: 29581 - DNA, 71 bp, chicken (Gallus Gallus)
  misc_feature (36): n=c or t
aatgtttcttatgtttcctcataaatttacatgtanacttgaaaaatgttgataacaatcatttggtatct

SEQ ID NO: 29582 - DNA, 71 bp, chicken (Gallus Gallus)
  misc_feature (36): n=a or c
ctatatcatatttcaagcactttagtaaggacagangtttctttgaattttgatttctcaggaaaaagtaa

SEQ ID NO: 29583 - DNA, 71 bp, chicken (Gallus Gallus)
  misc_feature (36): n=a or g
tatttattcacctttcttaaatatgcttccccagangtgccatgcacttggctgaaggcctgtggttggtc

SEQ ID NO: 29584 - DNA, 71 bp, chicken (Gallus Gallus)
  misc_feature (36): n=g or t
tttggtatcaaaatagtacttgttaatctggtttgnaaatcactgctgtgaatgataaatatctcttccaa

SEQ ID NO: 29585 - DNA, 71 bp, chicken (Gallus Gallus)
  misc_feature (36): n=a or g
atacaccactacgaatgacagaaaagaagttttctntctctgaagcctgttgcgggcgtaaaataagctga

SEQ ID NO: 29586 - DNA, 71 bp, chicken (Gallus Gallus)
  misc_feature (36): n=c or t
atggaaagatagagattaaatttatctggtaattangaaatagtgtttgtggaaaataacttatgtcattt

SEQ ID NO: 29587 - DNA, 71 bp, chicken (Gallus Gallus)
  misc_feature (36): n=c or t
aatccttaagattaaatgcaccattaaattaaccanaagtgttctaatatttttgactaaaatacatatga

SEQ ID NO: 29588 - DNA, 71 bp, chicken (Gallus Gallus)
  misc_feature (36): n=c or t
ttagtagtcaagaaatagtgacattttagtattacngcaatatatgttttgtcaaaacattttctccatcc

SEQ ID NO: 29589 - DNA, 71 bp, chicken (Gallus Gallus)
  misc_feature (36): n=a or g
aattcattttgggggtacatagcagaacaacaaacntttaccacaactatattcaattttcttgctttaca

SEQ ID NO: 29590 - DNA, 71 bp, chicken (Gallus Gallus)
  misc_feature (36): n=c or t
ctccattagacatctctaatcaaatagtagtgatantgccatattacaactcatgacttaaagaagtaaga

SEQ ID NO: 29591 - DNA, 71 bp, chicken (Gallus Gallus)
  misc_feature (36): n=a or g
aagtgtttgtctttaaacctctactataggattcantgtatttagttttagatatttattagctaactgct

SEQ ID NO: 29592 - DNA, 71 bp, chicken (Gallus Gallus)
  misc_feature (36): n=c or t
tatataataaaactgtagtatcattcaggtttgagngaagatcgtctttaggatatcaccaaaaccaggca

SEQ ID NO: 29593 - DNA, 71 bp, chicken (Gallus Gallus)
  misc_feature (36): n=g or t
gttcagtagggtgtatctttagacagaaagaaaacngaaccctttttcttcagtgataagtagatttaggt

SEQ ID NO: 29594 - DNA, 71 bp, chicken (Gallus Gallus)
  misc_feature (36): n=c or t
taggagaccaaaccctctgcaaaaatgagagcagangacattttagacccataagcaggaacagcgactac

SEQ ID NO: 29595 - DNA, 71 bp, chicken (Gallus Gallus)
  misc_feature (36): n=a or g
attttgagattatctatttagatttgggttaatganattatttaagttttatttagcatgctaagttgtaa

SEQ ID NO: 29596 - DNA, 71 bp, chicken (Gallus Gallus)
  misc_feature (36): n=a or g
gatgatcaaggaaataaaactagtgagatgactggntcctgaacattcaaggttaaactaacttcagagga

SEQ ID NO: 29597 - DNA, 71 bp, chicken (Gallus Gallus)
  misc_feature (36): n=c or t
gatatatttgagctcacctgtgttatcttgaaaagngttttttgtgttgcattaaactaaaatatgactgt

SEQ ID NO: 29598 - DNA, 71 bp, chicken (Gallus Gallus)
  misc_feature (36): n=a or c
gtgtatatttttaatgtatgaataatagcaaaatgnaggaaaataataaactactaccatgaagtgaaaaa

SEQ ID NO: 29599 - DNA, 71 bp, chicken (Gallus Gallus)
  misc_feature (36): n=a or g
gttgacttcttagtcttatgtaacagttccacaaancagatgatacaaaagaagcacagtgtatttctcag

SEQ ID NO: 29600 - DNA, 71 bp, chicken (Gallus Gallus)
  misc_feature (36): n=c or t
gttactccagttaattgcaatcacagtcaaagctcnagaaagaactatggtttccagtttgtgctctgtct

SEQ ID NO: 29601 - DNA, 71 bp, chicken (Gallus Gallus)
  misc_feature (36): n=g or t
ttgcactgcaaattaaaatttgagactttaatttcnttattcagttcagcagttattaacccccacctctc

SEQ ID NO: 29602 - DNA, 71 bp, chicken (Gallus Gallus)
  misc_feature (36): n=a or g
ttgtgaaagcaaatccttaaagctcagtgttgactnggagttaggtactaacagttttatgattaactatt

SEQ ID NO: 29603 - DNA, 71 bp, chicken (Gallus Gallus)
  misc_feature (36): n=c or t
atctccactgcatttgtatgtatatttacagtatgntattttgtatactattatatgacatatgtaatctt

SEQ ID NO: 29604 - DNA, 71 bp, chicken (Gallus Gallus)
  misc_feature (36): n=a or g
tgcaagatttatgagaatacattaattgcatttacnatgttgcatggacagaatctttagtgttccccctc

SEQ ID NO: 29605 - DNA, 71 bp, chicken (Gallus Gallus)
  misc_feature (36): n=c or t
gaaaaaaaattaaatatacgacattcactttcacanaatcagtgccaccttccctctgatgctcactgcac

SEQ ID NO: 29606 - DNA, 71 bp, chicken (Gallus Gallus)
  misc_feature (36): n=c or t
ttttctgctagatgaaaatttgcatagcatgtaatnatagattgcagagtaccgcatgattataatctgag

SEQ ID NO: 29607 - DNA, 71 bp, chicken (Gallus Gallus)
  misc_feature (36): n=a or c
atcccaataattaataatagtctcattggattcttnaatagagaactcatagtaagtgtagtagatgtaac

SEQ ID NO: 29608 - DNA, 71 bp, chicken (Gallus Gallus)
  misc_feature (36): n=c or t
taaaaatatttttgtttggaaatcaagatataactnttgtaatagattgccttcagttgttagaagttgtg

SEQ ID NO: 29609 - DNA, 71 bp, chicken (Gallus Gallus)
  misc_feature (36): n=g or t
tataatcaattcaccagatttttgtgtatctagatntttttcagaggaactgtgcagaactaattaggata

SEQ ID NO: 29610 - DNA, 71 bp, chicken (Gallus Gallus)
  misc_feature (36): n=c or t
tggagttctgccaacatttcccactgttgaatctgncatcaccctcaatcccttcacctgttagacaagca

SEQ ID NO: 29611 - DNA, 71 bp, chicken (Gallus Gallus)
  misc_feature (36): n=a or c
tatgttttatccatgagactactgataaaccaggtnctacagatttcaagatactattaattagaatatag

SEQ ID NO: 29612 - DNA, 71 bp, chicken (Gallus Gallus)
  misc_feature (36): n=a or g
atctacagtgcacacatagcagcgccatttcaaacnaattcttaactattcttttcaagatgtaacaagag

SEQ ID NO: 29613 - DNA, 71 bp, chicken (Gallus Gallus)
  misc_feature (36): n=a or g
actaggaagttactaggaagaaaatttcgactatcncgtggttttagcacttcatcaccataacaaaggta

SEQ ID NO: 29614 - DNA, 71 bp, chicken (Gallus Gallus)
  misc_feature (36): n=a or g
tattaatagtaatgtacactgaacagttgcagcctnttatctagcttagaaaatcaatcactgaggctgag

SEQ ID NO: 29615 - DNA, 71 bp, chicken (Gallus Gallus)
  misc_feature (36): n=a or g
aacactctccagtgctcctgctcctgcatgtggccnactcttaacaagaacaaaagtacttccacaatttg

SEQ ID NO: 29616 - DNA, 71 bp, chicken (Gallus Gallus)
  misc_feature (36): n=a or c
ggagcgcaggatgaagtgttctagtattgtgaatantatcttttctctactcatctctttcatgctggcct

SEQ ID NO: 29617 - DNA, 71 bp, chicken (Gallus Gallus)
  misc_feature (36): n=a or c
aataaacagagttttaaatgcaagtaatccctgagnttttattttagttctctgttattgtgctggggacc

SEQ ID NO: 29618 - DNA, 71 bp, chicken (Gallus Gallus)
  misc_feature (36): n=a or g
agaatctgatatcacactttaaaccagatatctatngatgatcagatgaatagatctctgtgaactaaccg

SEQ ID NO: 29619 - DNA, 71 bp, chicken (Gallus Gallus)
  misc_feature (36): n=a or g
aagacttcttttcacaacacttacccattttctcantcatggcagtccagtcttttggcttgcctgagcta

SEQ ID NO: 29620 - DNA, 71 bp, chicken (Gallus Gallus)
  misc_feature (36): n=a or g
caaatttcagcttctgcaaagactccatcattctcnatagatctttgcaaataaagaagttgaccccgaca

SEQ ID NO: 29621 - DNA, 71 bp, chicken (Gallus Gallus)
  misc_feature (36): n=c or t
gtttattcttaaattactcagacttttttgtgtgtntgacagtgttctcttgaagaaagaatgaaatgaaa

SEQ ID NO: 29622 - DNA, 71 bp, chicken (Gallus Gallus)
  misc_feature (36): n=a or g
taaagaagattgttctataacactttagaaccatcnttatggatcactaaaatactctatttggtaattga

SEQ ID NO: 29623 - DNA, 71 bp, chicken (Gallus Gallus)
  misc_feature (36): n=a or c
agcatgcctactctcctaaatgaaagaagtccatgnaacatgatgatgtctgattatctgcactatgtaat

SEQ ID NO: 29624 - DNA, 71 bp, chicken (Gallus Gallus)
  misc_feature (36): n=g or t
tattgtttatatttgtttggcacccaacaactgacngttactgatgctcattatctgctcctctggaaagt

SEQ ID NO: 29625 - DNA, 71 bp, chicken (Gallus Gallus)
  misc_feature (36): n=g or t
tggaccaaagacgcttcattttttttataagagtgnagaaaattaagctattgtttgtctgttgtggttca

SEQ ID NO: 29626 - DNA, 71 bp, chicken (Gallus Gallus)
  misc_feature (36): n=g or t
agattttccttaatggacaaaatttcagggaaatcnctctgaatacgttggaatctcccatctttcaatgc

SEQ ID NO: 29627 - DNA, 71 bp, chicken (Gallus Gallus)
  misc_feature (36): n=a or g
acccagaaacatctgggcattacatacttggtatangatgctggatattgctgaattgttttctatgttag

SEQ ID NO: 29628 - DNA, 71 bp, chicken (Gallus Gallus)
  misc_feature (36): n=a or c
atgtacaaatgtatatttcctacttccaattaactnatctccactcaaattaattaaggatttaaaggatt

SEQ ID NO: 29629 - DNA, 71 bp, chicken (Gallus Gallus)
  misc_feature (36): n=c or t
aactcatgtcttgtcataactcaaatgttcaaatanatattaatacattattgtagaccgtatgatcagcg

SEQ ID NO: 29630 - DNA, 71 bp, chicken (Gallus Gallus)
  misc_feature (36): n=a or g
tagtctattttatttactaactgagacataaccttncgtgttctattcacagattctttgtggttcttcag

SEQ ID NO: 29631 - DNA, 71 bp, chicken (Gallus Gallus)
  misc_feature (36): n=c or t
tatctatccactgtaaaggaaaccaaagagaataantggcaatgtgcactgattttatgacgtatgtatgt

SEQ ID NO: 29632 - DNA, 71 bp, chicken (Gallus Gallus)
  misc_feature (36): n=c or t
gaaaacatacaccactgaaatacatgccatggcaangagtctttttcctgtagtaaaacacataaatgaag

SEQ ID NO: 29633 - DNA, 71 bp, chicken (Gallus Gallus)
  misc_feature (36): n=c or t
atcgttcagcatttctatccttacttccatttattntgaagatcattaggaggcaaccacaccatcttttc

SEQ ID NO: 29634 - DNA, 71 bp, chicken (Gallus Gallus)
  misc_feature (36): n=c or t
atgctactgtgaagtcccagtactgcaggctgatcngtatggaattggacagatatagaaactacagcaat

SEQ ID NO: 29635 - DNA, 71 bp, chicken (Gallus Gallus)
  misc_feature (36): n=a or g
tggagtatataacatttggagactctagctaagtgncaagttttccaaatagtaatctcatctccccctac

SEQ ID NO: 29636 - DNA, 71 bp, chicken (Gallus Gallus)
  misc_feature (36): n=c or t
tcacagaaaatatcactagtcactcaaacacagaangcatgtcctgctgccttcacagtagtataggttac

SEQ ID NO: 29637 - DNA, 71 bp, chicken (Gallus Gallus)
  misc_feature (36): n=a or g
catatacatgaaatagtaaacttttaaaagaaatgnatattaatcacacttttgcagagctaaataagtaa

SEQ ID NO: 29638 - DNA, 71 bp, chicken (Gallus Gallus)
  misc_feature (36): n=a or g
agagtctgagagtcaaatgcttatgttttaatatgnacagtatcacttccattgtttacagtttttcaatg

SEQ ID NO: 29639 - DNA, 71 bp, chicken (Gallus Gallus)
  misc_feature (36): n=a or g
agataaatgtgctaagaattaactggtgaattatgnttatcccaagataatgctcctagcagaattctata

SEQ ID NO: 29640 - DNA, 71 bp, chicken (Gallus Gallus)
  misc_feature (36): n=a or g
accttacttagagataagaaacaaacttccagaganatacacagtctaggcaacataatcaatttcctgaa

SEQ ID NO: 29641 - DNA, 71 bp, chicken (Gallus Gallus)
  misc_feature (36): n=a or g
tgtgccagctgtctcaaaaatatatttgtaccctgnataagcctgaatggtagaatctgtttgttattttc

SEQ ID NO: 29642 - DNA, 71 bp, chicken (Gallus Gallus)
  misc_feature (36): n=a or g
ggtatggcagacaagtgaatgacattttctttaccntgggctactagagacagaagaaaggatctctgccc

SEQ ID NO: 29643 - DNA, 71 bp, chicken (Gallus Gallus)
  misc_feature (36): n=a or g
ctccacttacaccaaagtcatccaaatgtcaaaagnttgttgaataagaagactatgcatttatttatttg

SEQ ID NO: 29644 - DNA, 71 bp, chicken (Gallus Gallus)
  misc_feature (36): n=c or t
tgtaaaaagtgaaaagcaatagtaacaaacagtaanaaaatattagagaagaaaatatactgacttcatgg

SEQ ID NO: 29645 - DNA, 71 bp, chicken (Gallus Gallus)
  misc_feature (36): n=a or g
tgcacaaacttgtaagtttttcataaatagcacaancaacaattctagtcttattcttctatctagtgaat

SEQ ID NO: 29646 - DNA, 71 bp, chicken (Gallus Gallus)
  misc_feature (36): n=a or g
agtgtaatttcacaactgtatcagcaaggagacagntttacattggtaagaatttagctcacttttgctca

SEQ ID NO: 29647 - DNA, 71 bp, chicken (Gallus Gallus)
  misc_feature (36): n=a or g
aagggctctgaacaactcaccagttgtcagacagangaatgccagcttgagaattggatgaaacaagttat

SEQ ID NO: 29648 - DNA, 71 bp, chicken (Gallus Gallus)
  misc_feature (36): n=c or t
gaaacaagcatatgtacaaaggaaagtaatatgacngtcactgtatgtaatgttttctcttatataaagaa

SEQ ID NO: 29649 - DNA, 71 bp, chicken (Gallus Gallus)
  misc_feature (36): n=a or c
ataagatagaaataattgtataaatattgcgtgagnagaatatgcaacactttctagtctgacacaattat

SEQ ID NO: 29650 - DNA, 71 bp, chicken (Gallus Gallus)
  misc_feature (36): n=c or t
gactggaaactttgtcctgaatgggatgggatcatncatctgccagcctgacttgatgtctcaggagatct

SEQ ID NO: 29651 - DNA, 71 bp, chicken (Gallus Gallus)
  misc_feature (36): n=g or t
ctctcgttttcatcacaaggccagagaataataacntaattatactctatatgctaagatcattttcattc

SEQ ID NO: 29652 - DNA, 71 bp, chicken (Gallus Gallus)
  misc_feature (36): n=c or t
ctttctgccaagtggtcagcgtctgtgcctcctgtntgctgcacacctgcagaatatttattaatgcactg

SEQ ID NO: 29653 - DNA, 71 bp, chicken (Gallus Gallus)
  misc_feature (36): n=g or t
gcatataagcagcatgtgaacagagcactgtttagnctagagctgatacagttccaaattcatgactcttg

SEQ ID NO: 29654 - DNA, 71 bp, chicken (Gallus Gallus)
  misc_feature (36): n=a or g
ttgatcaccataacaagcgtgattacttttaatatncagtcttacttggacacccttgtgaagcattgtga

SEQ ID NO: 29655 - DNA, 71 bp, chicken (Gallus Gallus)
  misc_feature (36): n=a or g
atttttttactcatgaagcagatctgatgggtctgntgtcctaccctcatgggatactttgggacacaaac

SEQ ID NO: 29656 - DNA, 71 bp, chicken (Gallus Gallus)
  misc_feature (36): n=c or t
tattttattgttaataatgtttcatctattcagcantgtcacagtttgcttatgtctagcaattgctcttc

SEQ ID NO: 29657 - DNA, 71 bp, chicken (Gallus Gallus)
  misc_feature (36): n=a or c
ttaagtgaacacaagcactggagcacaaaagcacanaattcctccagagcaaactagccttcagcaatctg

SEQ ID NO: 29658 - DNA, 71 bp, chicken (Gallus Gallus)
  misc_feature (36): n=a or c
taagttttattaatgcatacatcaatgagaacctgntaatctgtgtctactggaagaatgatttcacagga

SEQ ID NO: 29659 - DNA, 71 bp, chicken (Gallus Gallus)
  misc_feature (36): n=a or g
tactattcatttattcatccagcacattgtcaagtnatcaaattgtttataaactggtatttgtggttttt

SEQ ID NO: 29660 - DNA, 71 bp, chicken (Gallus Gallus)
  misc_feature (36): n=c or t
atttttgcttttatttggctcctcagcccctccctntacctcagaaacttgaagtcctcctcgaagataaa

SEQ ID NO: 29661 - DNA, 71 bp, chicken (Gallus Gallus)
  misc_feature (36): n=a or g
aaacatgtaattagaaagctattaattttagcaacncagaaccactgaatatttctgcacttaggcattct

SEQ ID NO: 29662 - DNA, 71 bp, chicken (Gallus Gallus)
  misc_feature (36): n=c or t
ttttatcatttattctgtaacatgcatgcaaaagantgttaagaaaattacctgaagcagtagaatatcat

SEQ ID NO: 29663 - DNA, 71 bp, chicken (Gallus Gallus)
  misc_feature (36): n=a or c
aaactcattcttatatgaagagggttcattatgctnccagcctagaatatcctgtttataattgcattcag

SEQ ID NO: 29664 - DNA, 71 bp, chicken (Gallus Gallus)
  misc_feature (36): n=a or g
ccatgccccagcctgctccttcagcccaaggcagcnctcagatagcaagatgcccaaggctgaggatagat

SEQ ID NO: 29665 - DNA, 71 bp, chicken (Gallus Gallus)
  misc_feature (36): n=a or g
tgggagaacaacattgtgatactgaactcagcactntctcagtgtaaatgatgtctgatatattatttgag

SEQ ID NO: 29666 - DNA, 71 bp, chicken (Gallus Gallus)
  misc_feature (36): n=c or t
gtggtgtgtgtttgtgtatgattatacaaacagaanagaacagaataattcatctgggaggtgcttgcata

SEQ ID NO: 29667 - DNA, 71 bp, chicken (Gallus Gallus)
  misc_feature (36): n=c or t
ctgtttgtctttaggaagaaggatctcttcaagganctctttaagaacctcttgtcttgaatagacctacg

SEQ ID NO: 29668 - DNA, 71 bp, chicken (Gallus Gallus)
  misc_feature (36): n=c or t
ggaaaacagagaatggcaaagtagctagagaaaaantgttttactaaaatgctttcatatgtgcaactgtt

SEQ ID NO: 29669 - DNA, 71 bp, chicken (Gallus Gallus)
  misc_feature (36): n=a or g
atgatgacaaatctgattggagtatggagtgtactngaccaaatgtatagatgttatagttctttagatat

SEQ ID NO: 29670 - DNA, 71 bp, chicken (Gallus Gallus)
  misc_feature (36): n=a or c
tttgaacacataagtgtgcatatttgtaaatccttnatttattcctacccattgttctgcagtcaattctg

SEQ ID NO: 29671 - DNA, 71 bp, chicken (Gallus Gallus)
  misc_feature (36): n=c or t
caacaagaaaagaacagatatttgcatcatttattntgcttagagtattgaaatatcctagtttccatgtg

SEQ ID NO: 29672 - DNA, 71 bp, chicken (Gallus Gallus)
  misc_feature (36): n=a or g
tgtattcaaagtaactacactagcaaacagctatcnagctgttttcaaattaagctaactggcaactaact

SEQ ID NO: 29673 - DNA, 71 bp, chicken (Gallus Gallus)
  misc_feature (36): n=c or t
ccaggattttaggtttctttaggggagaaaattctncatcattctggactatagaatggcttaagagtgaa

SEQ ID NO: 29674 - DNA, 71 bp, chicken (Gallus Gallus)
  misc_feature (36): n=c or t
gctgctcattgcaatatctgtgatttagttttgacntggaacagcaatgcagtattatcagtacatagtca

SEQ ID NO: 29675 - DNA, 71 bp, chicken (Gallus Gallus)
  misc_feature (36): n=c or t
atttttttccaaagggactaagctaacccatttttnagactctagaatcaaaaaagagtgtagtttaaaat

SEQ ID NO: 29676 - DNA, 71 bp, chicken (Gallus Gallus)
  misc_feature (36): n=c or t
agttaatctttacggccatataaaaaagcattttcnacatatataataaagttgttagaaccacagaatca

SEQ ID NO: 29677 - DNA, 71 bp, chicken (Gallus Gallus)
  misc_feature (36): n=g or t
gtaaatatctcaatgccttgtttttaaattactgantataacaggagtgcacatattaatgaacattagat

SEQ ID NO: 29678 - DNA, 71 bp, chicken (Gallus Gallus)
  misc_feature (36): n=c or t
tttctatacatatgttaaatatcatggtggaggaanagatttttaacactttaaatttttaacaatattat

SEQ ID NO: 29679 - DNA, 71 bp, chicken (Gallus Gallus)
  misc_feature (36): n=a or g
aaaatgttccttgctcattatttcatcctaaatgtnacatattaaaataagctagatttctgtccatcagt

SEQ ID NO: 29680 - DNA, 71 bp, chicken (Gallus Gallus)
  misc_feature (36): n=c or t
ctttacttaaaactgtattgtaaagaccctgctggncaattcagataatcattcttgctacttgtactgtt

SEQ ID NO: 29681 - DNA, 71 bp, chicken (Gallus Gallus)
  misc_feature (36): n=a or g
tgtttgagtaatgtaaaagttattttgtccctttcnatagatttgcaacatgcagaatatctgtgtttttt

SEQ ID NO: 29682 - DNA, 71 bp, chicken (Gallus Gallus)
  misc_feature (36): n=c or t
cagaactgtgacatcagcaatattgcttcagtaaanagtatgagtgaagtactctaaaaacctttaactag

SEQ ID NO: 29683 - DNA, 71 bp, chicken (Gallus Gallus)
  misc_feature (36): n=c or t
aaaaaataacataacaatagccaagtacataaacantccacaatatattttgaagaatacatctaactttc

SEQ ID NO: 29684 - DNA, 71 bp, chicken (Gallus Gallus)
  misc_feature (36): n=a or g
tctgatcactagcccatgacagtgcggcttgggacnacagcggttgccggcagtaacagaccacaggtttg

SEQ ID NO: 29685 - DNA, 71 bp, chicken (Gallus Gallus)
  misc_feature (36): n=c or t
cccagttattctgctgagttgtatgaaaccttgctnactctggagaaaatcttgctattaaagattaaatt

SEQ ID NO: 29686 - DNA, 71 bp, chicken (Gallus Gallus)
  misc_feature (36): n=c or t
ggtcaggtagatgcaaagctccttttatttgaggantctaacgtagacatcaattgagggaataaatttgg

SEQ ID NO: 29687 - DNA, 71 bp, chicken (Gallus Gallus)
  misc_feature (36): n=c or t
agatattctgattaaatcactaccattatataattnatgtttttacatctttacatattaagtagttcaat

SEQ ID NO: 29688 - DNA, 71 bp, chicken (Gallus Gallus)
  misc_feature (36): n=a or g
ccaaaaacaaaaggttggaagaaatttaaaggccangaagctatatttcctctcgttttccagactcctat

SEQ ID NO: 29689 - DNA, 71 bp, chicken (Gallus Gallus)
  misc_feature (36): n=a or g
ttaatcatccaaaaaataccatgaaaattctgaaangttactaaggacatctgaaatgtaattacattaac

SEQ ID NO: 29690 - DNA, 71 bp, chicken (Gallus Gallus)
  misc_feature (36): n=a or g
aaaagaaagccagatggacttgcagatgcaaatgcnagagagagagacaatttgtcttacggatgtttggt

SEQ ID NO: 29691 - DNA, 71 bp, chicken (Gallus Gallus)
  misc_feature (36): n=c or t
atctgatcatgtatgcatactgcaattaatggaagnaaataggaatgtcagaaagacaacctttctcaact

SEQ ID NO: 29692 - DNA, 71 bp, chicken (Gallus Gallus)
  misc_feature (36): n=a or c
agtgatatattaaattgtctagaaagcaaatactgnctttgctcaaggaagcctgctctacatgctgacac

SEQ ID NO: 29693 - DNA, 71 bp, chicken (Gallus Gallus)
  misc_feature (36): n=c or t
agaaagcaaatactgcctttgctcaaggaagcctgntctacatgctgacactgccaaacatgacattagaa

SEQ ID NO: 29694 - DNA, 71 bp, chicken (Gallus Gallus)
  misc_feature (36): n=a or g
aagcagcaacatagatttcagcagaatgactaggcnctgcaagcaccatagttgctgtgaagtcaaggtgt

SEQ ID NO: 29695 - DNA, 71 bp, chicken (Gallus Gallus)
  misc_feature (36): n=g or t
aatgcatgcaatttagcctaaaaaagaataaacttntattagaaatagtcccaggcttatatggaagaaaa

SEQ ID NO: 29696 - DNA, 71 bp, chicken (Gallus Gallus)
  misc_feature (36): n=a or g
cttctttaaacttctttcctaattatttatcccacnttgtttaacagggtagttcattacaggcacttttt

SEQ ID NO: 29697 - DNA, 71 bp, chicken (Gallus Gallus)
  misc_feature (36): n=a or g
attgaaagtcctgttgacatctatgattttctcacnagagctttcctttgacaatcattatatttaaagga

SEQ ID NO: 29698 - DNA, 71 bp, chicken (Gallus Gallus)
  misc_feature (36): n=a or g
gtgacagctccgtggtttctactgccaatttgctantgaccagtgataaatgtggtcctatcttctttctg

SEQ ID NO: 29699 - DNA, 71 bp, chicken (Gallus Gallus)
  misc_feature (36): n=a or g
ctgatttgctgggatccatcgtgacattctcttctngtggatattttctgccatatccagaagatttctgc

SEQ ID NO: 29700 - DNA, 71 bp, chicken (Gallus Gallus)
  misc_feature (36): n=a or g
caaggacatccaaagctaaattttgaggcagaaccnagttttagagcagataagactgcacagaacaagga

SEQ ID NO: 29701 - DNA, 71 bp, chicken (Gallus Gallus)
  misc_feature (36): n=c or t
ggcccagcaaacagctgatagactggcagtgtacantgaaagagtgcagcccagagcctgggaaaggtcct

SEQ ID NO: 29702 - DNA, 71 bp, chicken (Gallus Gallus)
  misc_feature (36): n=a or g
ttgtacaatagtagggcacagagtagctttcttttngagtagttatgttgtcttgtagtcttttgagcttc

SEQ ID NO: 29703 - DNA, 71 bp, chicken (Gallus Gallus)
  misc_feature (36): n=a or g
ttacttgattttcatttggaagtactaatagcatancatgttctcactgatggaagtgtcacatgtagggt

SEQ ID NO: 29704 - DNA, 71 bp, chicken (Gallus Gallus)
  misc_feature (36): n=g or t
agctagcaggagtttgtgagatgtatcggtgacagngtcacagaatgatagatagaacctcataatcagca

SEQ ID NO: 29705 - DNA, 71 bp, chicken (Gallus Gallus)
  misc_feature (36): n=c or t
tatttccatggtaaggttctcccttcatgctgaggnactcacaatttaccagaagtctgttctgttgttgt

SEQ ID NO: 29706 - DNA, 71 bp, chicken (Gallus Gallus)
  misc_feature (36): n=a or c
gctctacaatcttgacagcagagacaaggaaatagnaggagcacacctcactgcacatcctagaaaacatg

SEQ ID NO: 29707 - DNA, 71 bp, chicken (Gallus Gallus)
  misc_feature (36): n=c or t
atctgagaacagcagtggtggatatgggaggagcangaagggaatagactgcagaccatggtcatgtccat

SEQ ID NO: 29708 - DNA, 71 bp, chicken (Gallus Gallus)
  misc_feature (36): n=a or g
gtctagacacagcatagaatatgtctctggctctgnaataagaaaaactccactcatcctcatttacagtt

SEQ ID NO: 29709 - DNA, 71 bp, chicken (Gallus Gallus)
  misc_feature (36): n=a or g
aacatttgccatgtaatatctactgtgtttctatantttccctgatgctccactgctgtagcattttctat

SEQ ID NO: 29710 - DNA, 71 bp, chicken (Gallus Gallus)
  misc_feature (36): n=a or c
gggtctaagcctgtattttaggaaagacctttttgnaccacactattcctagcccaagatggagggatggg

SEQ ID NO: 29711 - DNA, 71 bp, chicken (Gallus Gallus)
  misc_feature (36): n=a or g
aaagtgtctacaatgtcatcaattggtctacatgcnctgggaaagaatcttataatccatcaagctttatt

SEQ ID NO: 29712 - DNA, 71 bp, chicken (Gallus Gallus)
  misc_feature (36): n=a or g
gcattcactcaggcttaccttatgagctgtagcccntttactgtgaggtgtatatcaaaatttcaagacaa

SEQ ID NO: 29713 - DNA, 71 bp, chicken (Gallus Gallus)
  misc_feature (36): n=g or t
agttaactggaagaaattatatgacctctttagatnaggtaagagtggattacctaaggccagacaggagc

SEQ ID NO: 29714 - DNA, 71 bp, chicken (Gallus Gallus)
  misc_feature (36): n=c or t
tctgaagcagcgaacctcggcgatcaacgtgtatgnataccatacatacacaacatatcatgatatcagta

SEQ ID NO: 29715 - DNA, 71 bp, chicken (Gallus Gallus)
  misc_feature (36): n=c or t
gaatctgtgagaggagtttctcttacctgctgtatnttctgctcatgtatcactgtaatcagtttcttgat

SEQ ID NO: 29716 - DNA, 71 bp, chicken (Gallus Gallus)
  misc_feature (36): n=g or t
agagcctgccttgacaacttgaagactgctattttnaagcccctgaatcactcctcgtatcttgtacatcc

SEQ ID NO: 29717 - DNA, 71 bp, chicken (Gallus Gallus)
  misc_feature (36): n=c or t
agtagatcaattgccattctcatttgggacaacagntgaaatcctaatgagaatagtaacacttgtaatta

SEQ ID NO: 29718 - DNA, 71 bp, chicken (Gallus Gallus)
  misc_feature (36): n=a or c
gaaagactgaatccctgattgtaagaaaagaaactnatttgaccaaagacagatgtatgctattacagtca

SEQ ID NO: 29719 - DNA, 71 bp, chicken (Gallus Gallus)
  misc_feature (36): n=g or t
atcccatctgatgcacatcagcagccccagaatcancagtcagaagcacttttccaaaaaaatatgtcttc

SEQ ID NO: 29720 - DNA, 71 bp, chicken (Gallus Gallus)
  misc_feature (36): n=c or t
acaggcctaattaagtacttcacgaataagagaagngctcagataactacagctgtcttgacccttttctt

SEQ ID NO: 29721 - DNA, 71 bp, chicken (Gallus Gallus)
  misc_feature (36): n=c or t
taataaatatgtctcctttaccctgcctgccaaccntcctgatgcactgaaaacaatgctttcctttttca

SEQ ID NO: 29722 - DNA, 71 bp, chicken (Gallus Gallus)
  misc_feature (36): n=a or g
atatagtagttttgttcttccattgacctactcatntaactttcacttgaatttaaagtcaatcaataatt

SEQ ID NO: 29723 - DNA, 71 bp, chicken (Gallus Gallus)
  misc_feature (36): n=a or g
tcctgctgcatgcaaccgtccatcaactactgtganatagaagtcttactgtcagttcaggagtaggaaat

SEQ ID NO: 29724 - DNA, 71 bp, chicken (Gallus Gallus)
  misc_feature (36): n=a or g
atgtctgcttgatactcctaagcagttaaacatcantgatgacctcaaacagcagaaactgtttcatacca

SEQ ID NO: 29725 - DNA, 71 bp, chicken (Gallus Gallus)
  misc_feature (36): n=a or c
aatgacatataaaacgttgctccacgttagcgcttnggaaatagtaataatgacagaggtctcccaaggaa

SEQ ID NO: 29726 - DNA, 71 bp, chicken (Gallus Gallus)
  misc_feature (36): n=c or t
agatttgaagagcctgggaattctgaagagcttctnttcaataaaataattacaatctcatctaaacggtg

SEQ ID NO: 29727 - DNA, 71 bp, chicken (Gallus Gallus)
  misc_feature (36): n=a or g
gagttattttatggagtagatgtagatgcattcagnattacagaaagaataaattgtctgcccttatacaa

SEQ ID NO: 29728 - DNA, 71 bp, chicken (Gallus Gallus)
  misc_feature (36): n=g or t
tttattggactttgtatgttaaagccatcattcacngacagtagttgcttcttgttctgggttcaaagggc

SEQ ID NO: 29729 - DNA, 71 bp, chicken (Gallus Gallus)
  misc_feature (36): n=c or t
gttcttcctgaaaataacaccaaagtttctttacancctgcatagtgacaaatcctcttctactaagtcat

SEQ ID NO: 29730 - DNA, 71 bp, chicken (Gallus Gallus)
  misc_feature (36): n=c or t
atatttagcatcattaacatgtaccaagagatcttnagtatgttattccttttgaaagcaactactggcct

SEQ ID NO: 29731 - DNA, 71 bp, chicken (Gallus Gallus)
  misc_feature (36): n=c or t
atatctaaaaattctgcaacaagttttacccaaaanaaagcaatcttaaatgtgaggagggattttttttc

SEQ ID NO: 29732 - DNA, 71 bp, chicken (Gallus Gallus)
  misc_feature (36): n=a or c
gtaactccaaaaaacattcgtttcttctcatggatnagatcattctgaatgtcttggactacacataggca

SEQ ID NO: 29733 - DNA, 71 bp, chicken (Gallus Gallus)
  misc_feature (36): n=g or t
ttagttgtgacaactgattttcttccagctaggtcncagtgaataatttgtcttacttttgcttatcatcg

SEQ ID NO: 29734 - DNA, 71 bp, chicken (Gallus Gallus)
  misc_feature (36): n=a or g
cttaagactaaagataaactgtctccaaacaatttncagatgaatcaagatactgaaaatatgtaagatac

SEQ ID NO: 29735 - DNA, 71 bp, chicken (Gallus Gallus)
  misc_feature (36): n=a or g
agatgaagccaaatgttagccatttaagcgttttcntttgtggtttcacgaggagttagatgaattatgta

SEQ ID NO: 29736 - DNA, 71 bp, chicken (Gallus Gallus)
  misc_feature (36): n=c or t
aggattccccttttttacagtagaattattttcctncttctcagcacctgacaacatgtaatcttgatctc

SEQ ID NO: 29737 - DNA, 71 bp, chicken (Gallus Gallus)
  misc_feature (36): n=c or t
cagggaatgacttcataaaatatatatttgaaaatnatgggacttcaatattgttttgcttaatgtgacag

SEQ ID NO: 29738 - DNA, 71 bp, chicken (Gallus Gallus)
  misc_feature (36): n=g or t
atattcagttccatttctaaagttagatgtaacaantatagtattacacttttctactgcttccttgctaa

SEQ ID NO: 29739 - DNA, 71 bp, chicken (Gallus Gallus)
  misc_feature (36): n=c or t
ttagcaggagtggtgctgagaggtctttggaggggncttacgattagggatctcatgattgtcaagtatcc

SEQ ID NO: 29740 - DNA, 71 bp, chicken (Gallus Gallus)
  misc_feature (36): n=a or g
catttgccacaaaatggctccagttcaataggaganaggtaattttaaagttagtgaaaaatgagtgtgca

SEQ ID NO: 29741 - DNA, 71 bp, chicken (Gallus Gallus)
  misc_feature (36): n=a or g
ccctctgcgtgcacaggtccaaaaaacaaattttcnaagaagtaatagctaacaggcaaatctggcttcct

SEQ ID NO: 29742 - DNA, 71 bp, chicken (Gallus Gallus)
  misc_feature (36): n=a or g
gcttttgggcttttattacacgtcttgtaagtattntaagcactttcagctgctgctttaattcttttcct

SEQ ID NO: 29743 - DNA, 71 bp, chicken (Gallus Gallus)
  misc_feature (36): n=c or t
gagctcagtgtctctcccttataagaagagccatantggagacagaaagtgagacagaaacctctcttctg

SEQ ID NO: 29744 - DNA, 71 bp, chicken (Gallus Gallus)
  misc_feature (36): n=a or g
aatgctgataggaatccaaatatttcctccaagtcngtacattatttggatgttgttccatctggagttaa

SEQ ID NO: 29745 - DNA, 71 bp, chicken (Gallus Gallus)
  misc_feature (36): n=a or g
agcagcagttgtttccctgtatcaaaattctaatgnagcagtaactggtcagaattatttcagaatcaata

SEQ ID NO: 29746 - DNA, 71 bp, chicken (Gallus Gallus)
  misc_feature (36): n=a or c
tgtaggtttcttttgaaacagctctcatgacttgtngaaaacaaaaactggaatattcagtgtaatttttt

SEQ ID NO: 29747 - DNA, 71 bp, chicken (Gallus Gallus)
  misc_feature (36): n=a or g
gaacagaaggggcctttaaaactcctccaaagcaanagttactaggctctaagccagtgcgcctagaagat

SEQ ID NO: 29748 - DNA, 71 bp, chicken (Gallus Gallus)
  misc_feature (36): n=a or g
atagtatgcactttgaagttctgacttctgcttgtntaatctcacctgttttgagatggagctatacctgc

SEQ ID NO: 29749 - DNA, 71 bp, chicken (Gallus Gallus)
  misc_feature (36): n=c or t
agtataataactgtgtattaactagttctaatagcntaatttagcacctccaaattagaaggcagatttag

SEQ ID NO: 29750 - DNA, 71 bp, chicken (Gallus Gallus)
  misc_feature (36): n=a or g
aatgagttatttatctatacttgaaagacttgtacnaagtggaagctctgtgtgaggctgtagacaaagca

SEQ ID NO: 29751 - DNA, 71 bp, chicken (Gallus Gallus)
  misc_feature (36): n=a or g
ttgaacatataggtctaaaataaatcatggcaaccnaagaagtctgtgatctgagcagtactggagaagta

SEQ ID NO: 29752 - DNA, 71 bp, chicken (Gallus Gallus)
  misc_feature (36): n=a or g
aacgaaggctggagagcaccagcttgttaaatcccnagtcttttaaaactacatatacaccttacaactga

SEQ ID NO: 29753 - DNA, 71 bp, chicken (Gallus Gallus)
  misc_feature (36): n=c or t
cagacttctgataccatgtagacagaatatgaaggncagtacaagttcataccggaaagttataagcagcc

SEQ ID NO: 29754 - DNA, 71 bp, chicken (Gallus Gallus)
  misc_feature (36): n=c or t
cagaaatagactggttttaaacaaataacatattcnccagcactgctggcagcctaaggttcctcagacac

SEQ ID NO: 29755 - DNA, 71 bp, chicken (Gallus Gallus)
  misc_feature (36): n=a or g
tttttttctttaagtgggactttcagatttctggcnttcaaggtaattgatgtagggagggaccaactgtc

SEQ ID NO: 29756 - DNA, 71 bp, chicken (Gallus Gallus)
  misc_feature (36): n=c or t
atgcctattaattctgcaaacagtttgaatgcacancatttctaaactcaacactcaaattcacacatcat

SEQ ID NO: 29757 - DNA, 71 bp, chicken (Gallus Gallus)
  misc_feature (36): n=c or t
atgcttacacaaacagaaatctgcctgtaaatatgnaagtgagaggaattattcaacaggatacagttctc

SEQ ID NO: 29758 - DNA, 71 bp, chicken (Gallus Gallus)
  misc_feature (36): n=c or t
gagtacttcagaatatctgatgccagttgcttacantggaggtgttgggcttcagtaattcaaaattgggg

SEQ ID NO: 29759 - DNA, 71 bp, chicken (Gallus Gallus)
  misc_feature (36): n=c or t
cgcaggcgctctgtctctcccagatcggccactagngatgacccaggaaagactccctggcaatgccgcca

SEQ ID NO: 29760 - DNA, 71 bp, chicken (Gallus Gallus)
  misc_feature (36): n=a or c
tcactgcacagcatcagtcagaatggtttgtccatnacgagtattaattgtctgtaagatacgtttcagca

SEQ ID NO: 29761 - DNA, 71 bp, chicken (Gallus Gallus)
  misc_feature (36): n=c or t
tagaaaaacagctgccgaagagtttggctagattangtatatgttgacaacagggagagcctgatttctag

SEQ ID NO: 29762 - DNA, 71 bp, chicken (Gallus Gallus)
  misc_feature (36): n=a or g
gtgcatccagaccgtatatagtaatgtgccttccanataaatcagagcatcagtaatgcaagaaactgtat

SEQ ID NO: 29763 - DNA, 71 bp, chicken (Gallus Gallus)
  misc_feature (36): n=a or g
gagctgaagacaaatgattacaacgagcagtctganctaatcatccgtaggtggataggggaaaatattta

SEQ ID NO: 29764 - DNA, 71 bp, chicken (Gallus Gallus)
  misc_feature (36): n=g or t
ttgatattttatgctgtgttagtcttcagcatggtnttcaagcaacagccccttccctaagcatttaaaca

SEQ ID NO: 29765 - DNA, 71 bp, chicken (Gallus Gallus)
  misc_feature (36): n=c or t
agattgctaaatgcttgcaaattggaaaatagaacncagtaaattatctgtcatttagggaatccagtgaa

SEQ ID NO: 29766 - DNA, 71 bp, chicken (Gallus Gallus)
  misc_feature (36): n=c or t
acaccagctacaatgaaagccaatgaagccagctcnagttggaaacagaacttactattcccctcactccc

SEQ ID NO: 29767 - DNA, 71 bp, chicken (Gallus Gallus)
  misc_feature (36): n=c or t
tttcctttactgttgtgcagggtatagctgtgctgnaagacaaatatttgagtcttcagagtgcaaatgta

SEQ ID NO: 29768 - DNA, 71 bp, chicken (Gallus Gallus)
  misc_feature (36): n=g or t
ttttacgtatcagcctggttgtctttttcaattaanagtgattgctggaatgcgtgtgatgttacagaata

SEQ ID NO: 29769 - DNA, 71 bp, chicken (Gallus Gallus)
  misc_feature (36): n=g or t
gttgccagctcatgtgtaatgtgaggaagactgagnaaggaggaaaaactaaaaagaactaactgcccagg

SEQ ID NO: 29770 - DNA, 71 bp, chicken (Gallus Gallus)
  misc_feature (36): n=a or g
catctgctgatgtcatctgtttgatagcatcagcancattggtcccataatgtatgtattcttgttgcttt

SEQ ID NO: 29771 - DNA, 71 bp, chicken (Gallus Gallus)
  misc_feature (36): n=a or g
aaaaatggttttctgcagtgttgctgctggtgaccnagacatcattttggcatcagtggtcaaaacaggca

SEQ ID NO: 29772 - DNA, 71 bp, chicken (Gallus Gallus)
  misc_feature (36): n=a or g
ttttccctgcccaaacatgaaaagaaggatttaacnggcatatgctaaaagtaattgtcagcaagtatttg

SEQ ID NO: 29773 - DNA, 71 bp, chicken (Gallus Gallus)
  misc_feature (36): n=c or t
cttctcagtaaatgcatcagtatgagtatttccaangccattcttagtatcttagcttccccaaaggttca

SEQ ID NO: 29774 - DNA, 71 bp, chicken (Gallus Gallus)
  misc_feature (36): n=a or c
ggcaccgagagctaaaacatagttggtaattccaanttctgcagctgtaactatccagtagcatgaagaga

SEQ ID NO: 29775 - DNA, 71 bp, chicken (Gallus Gallus)
  misc_feature (36): n=c or t
atgtaagtgtgtggttcctcagtgctgccacagccncattggacttctcctacaggagcagtcactaacct

SEQ ID NO: 29776 - DNA, 71 bp, chicken (Gallus Gallus)
  misc_feature (36): n=a or g
actgaacgtgcctatttctccccactagaagacaanacaagtggattagattttgacaattaaacattaga

SEQ ID NO: 29777 - DNA, 71 bp, chicken (Gallus Gallus)
  misc_feature (36): n=g or t
gtcaaaagagagccagtgtgatacttttacctcaangaatcatttttcctattcttactccccaccgggca

SEQ ID NO: 29778 - DNA, 71 bp, chicken (Gallus Gallus)
  misc_feature (36): n=c or t
agtatagttggggatttgacggtcatttaaatgtcngaagttagggagcatgaatagaagaatgagggctt

SEQ ID NO: 29779 - DNA, 71 bp, chicken (Gallus Gallus)
  misc_feature (36): n=a or g
agagactagaaaaaagccctttagtgcttaagagcnatgactagcagtccataatggccacagctgtatag

SEQ ID NO: 29780 - DNA, 71 bp, chicken (Gallus Gallus)
  misc_feature (36): n=a or g
tctaattcctccttgttctgtatggtctgctttccntttttccaatttctaccaaggcattatgtaatgtc

SEQ ID NO: 29781 - DNA, 71 bp, chicken (Gallus Gallus)
  misc_feature (36): n=a or g
gcccctaatgcagtgcatgcacttcaggtcacttgntgcactgaggaagcccctccaaattggtcatacct

SEQ ID NO: 29782 - DNA, 71 bp, chicken (Gallus Gallus)
  misc_feature (36): n=a or g
tgcatctagaggaaaaatctactcagttctactccntattaatgcaaggaaaggttacagggagaagtatg

SEQ ID NO: 29783 - DNA, 71 bp, chicken (Gallus Gallus)
  misc_feature (36): n=a or c
ggagtcaagtacagttttcatgaataaaaatttttnactaatcttgttctgacaaacttccaaagcccttt

SEQ ID NO: 29784 - DNA, 71 bp, chicken (Gallus Gallus)
  misc_feature (36): n=a or g
ctgtagtttctgattgccatataactacaaatactnagattgtctcttcattttagctatgcaagtaattt

SEQ ID NO: 29785 - DNA, 71 bp, chicken (Gallus Gallus)
  misc_feature (36): n=g or t
aaacctgaattaggttctacttttcagctagccttncttattgcacgagtgtgttcttgcacttacaacca

SEQ ID NO: 29786 - DNA, 71 bp, chicken (Gallus Gallus)
  misc_feature (36): n=a or g
cttgaacacttgaatttagtgtccattctattaatnctaattcactgtggcagtacttttcagtatgttta

SEQ ID NO: 29787 - DNA, 71 bp, chicken (Gallus Gallus)
  misc_feature (36): n=g or t
tgggacaagtctgctttcccagtctggaaaagcatngaagtttgcagtccttttgaaaattaggcttgtct

SEQ ID NO: 29788 - DNA, 71 bp, chicken (Gallus Gallus)
  misc_feature (36): n=g or t
ggaagctgttagggcagatcgttctgatataactgngtcctgctacagcaaacgctatatgatttgtgtta

SEQ ID NO: 29789 - DNA, 71 bp, chicken (Gallus Gallus)
  misc_feature (36): n=a or c
ttccagtgcttttatgggcatatccgtgttaacatntctctgatattaagttttgagcagatggatgccat

SEQ ID NO: 29790 - DNA, 71 bp, chicken (Gallus Gallus)
  misc_feature (36): n=a or g
tgattgttaaatttgctaaacaaggcaacggattgnatgttatgatctgaacaccagttagtaaattgagg

SEQ ID NO: 29791 - DNA, 71 bp, chicken (Gallus Gallus)
  misc_feature (36): n=c or t
agaagaaggcaatctttacaatcagaaagcactttntggcatttcccagcatgaggttttgtaggctgttg

SEQ ID NO: 29792 - DNA, 71 bp, chicken (Gallus Gallus)
  misc_feature (36): n=c or t
gctggatcatacttttttattaattgtgttttaagnctaacctgaaaatgacagaacactattctaccttt

SEQ ID NO: 29793 - DNA, 71 bp, chicken (Gallus Gallus)
  misc_feature (36): n=a or g
tattcttaagtgttagaaaatttgtacgaaagtcgnagtctcgtggctgtgcatggaaaagcatttttctg

SEQ ID NO: 29794 - DNA, 71 bp, chicken (Gallus Gallus)
  misc_feature (36): n=a or g
atgtctactttcattaattacagctgggatgggaancagacagcttgtcttctattaactgaaataagcaa

SEQ ID NO: 29795 - DNA, 71 bp, chicken (Gallus Gallus)
  misc_feature (36): n=a or g
ctgagattactctaaagtgcagaacatgctaatacngaatgataatgcacaaaatctattttgcctactca

SEQ ID NO: 29796 - DNA, 71 bp, chicken (Gallus Gallus)
  misc_feature (36): n=a or g
aggactagtatttgtttttacagagtcatgttattntttttcaacattcttttccagcatttattattgag

SEQ ID NO: 29797 - DNA, 71 bp, chicken (Gallus Gallus)
  misc_feature (36): n=c or t
ttcatcaccaacagtggaagacatttcaaattgaancaaggaagtttacttgttcacatatttctcagtgt

SEQ ID NO: 29798 - DNA, 71 bp, chicken (Gallus Gallus)
  misc_feature (36): n=a or g
gactgagatatctcaaactgtttaatattagtttgncagcagcagttctaaagtaatatgttttagagtaa

SEQ ID NO: 29799 - DNA, 71 bp, chicken (Gallus Gallus)
  misc_feature (36): n=c or t
atttctaatagaatgtcataattaaaattttgctgnctagtaacatttagaatacagtgtattgatatatt

SEQ ID NO: 29800 - DNA, 71 bp, chicken (Gallus Gallus)
  misc_feature (36): n=a or c
gagtgaaatcaagctgaagttcaacataaagcaganccgccatcagaattattgtcagtcctgtaagattt

SEQ ID NO: 29801 - DNA, 71 bp, chicken (Gallus Gallus)
  misc_feature (36): n=a or g
agtgtggcatttctctggaatacatgaactcctcanaatcaaaatatgttctatcaaaattattcaaaata

SEQ ID NO: 29802 - DNA, 71 bp, chicken (Gallus Gallus)
  misc_feature (36): n=a or g
taagtacagtaatgttaatttaggtatagaagtagnttttaacaatttttatgggcaattcaaagactaat

SEQ ID NO: 29803 - DNA, 71 bp, chicken (Gallus Gallus)
  misc_feature (36): n=a or c
acagggctcagccagaaaagcatacaggtagctccnttttacatgcagcaagcccttctatacctttctct

SEQ ID NO: 29804 - DNA, 71 bp, chicken (Gallus Gallus)
  misc_feature (36): n=c or t
ccattctttcctgtcagagtgcctattccttttacncagaatgacatggggagtactggagactactggaa

SEQ ID NO: 29805 - DNA, 71 bp, chicken (Gallus Gallus)
  misc_feature (36): n=a or g
aacataaattcaaagtaaatagatcttaaactgtcntctcccctctattttcatatttgtgtaatgttaca

SEQ ID NO: 29806 - DNA, 71 bp, chicken (Gallus Gallus)
  misc_feature (36): n=c or t
aaattaatgagcaaaatcttctaaaattaaacaaantgtacttaagcttttctggatctcagttgtgtagt

SEQ ID NO: 29807 - DNA, 71 bp, chicken (Gallus Gallus)
  misc_feature (36): n=a or g
aatgcgtagcatccatatacattgttattcagtccnagggcctatgttcaacaaatatttacaaaaggtca

SEQ ID NO: 29808 - DNA, 71 bp, chicken (Gallus Gallus)
  misc_feature (36): n=a or g
agcctagtaatacagatcagctggcatatgtgctantaatgagataattcaaagagaatcttttgaatacg

SEQ ID NO: 29809 - DNA, 71 bp, chicken (Gallus Gallus)
  misc_feature (36): n=g or t
tttcaggattttttgggacaaatgttctgtacactnggagaaatagttggatcacaggggagcagactgga

SEQ ID NO: 29810 - DNA, 71 bp, chicken (Gallus Gallus)
  misc_feature (36): n=g or t
aaaacaatctgattggtcaccaaatgctcattcagngatctttttgagccctacaaagaatgtttatatgt

SEQ ID NO: 29811 - DNA, 71 bp, chicken (Gallus Gallus)
  misc_feature (36): n=a or g
taattaagttgaaatctgcagttatgacagtttacnggcatttcacccttaaggtgggacagatttgtatt

SEQ ID NO: 29812 - DNA, 71 bp, chicken (Gallus Gallus)
  misc_feature (36): n=c or t
ttgggcattttctaaccaagatattcctccctctancttcaaaaaagcatctttgatagaatcataataaa

SEQ ID NO: 29813 - DNA, 71 bp, chicken (Gallus Gallus)
  misc_feature (36): n=c or t
ctatttcttcattaccttcagtaacagatgaaccanaaccagaagagactatagacccacttctcatttga

SEQ ID NO: 29814 - DNA, 71 bp, chicken (Gallus Gallus)
  misc_feature (36): n=a or g
aagtgaataaccttgagaccaaagttaagggataangattgatttgtatcagaccacttatggctaggcag

SEQ ID NO: 29815 - DNA, 71 bp, chicken (Gallus Gallus)
  misc_feature (36): n=c or t
gaagctaatttcaaaatgggcaatatgtaaccttantgactttacttagcataccctctttttggtcagac

SEQ ID NO: 29816 - DNA, 71 bp, chicken (Gallus Gallus)
  misc_feature (36): n=c or t
aaaagttcacaatgcaagtacaaaaaaactgatacngatatcaaacttaaatttgaagtttaaagtgtaat

SEQ ID NO: 29817 - DNA, 71 bp, chicken (Gallus Gallus)
  misc_feature (36): n=c or t
attaaaccaagatagcatcttactcaatgttgaacngttgttttcagacatctagtaaaaaacaggcaagg

SEQ ID NO: 29818 - DNA, 71 bp, chicken (Gallus Gallus)
  misc_feature (36): n=c or t
caatatttagatagctatcattaatgaattacctcnccagggactgacctctcatgaagtctttgcaatct

SEQ ID NO: 29819 - DNA, 71 bp, chicken (Gallus Gallus)
  misc_feature (36): n=a or g
ttgaaacacatactgttcttcacataatacagaacnagcagtaagtactgttgacatttccagctggattg

SEQ ID NO: 29820 - DNA, 71 bp, chicken (Gallus Gallus)
  misc_feature (36): n=c or t
attatcaataacatccccatcaaatgtaagaaaaanatttaccagttgttataggcctgtaataggagaaa

SEQ ID NO: 29821 - DNA, 71 bp, chicken (Gallus Gallus)
  misc_feature (36): n=a or g
tagtaattcagagttctggaagtaatctttgagatnttaactgtactacatttaaatttgcattgatgaaa

SEQ ID NO: 29822 - DNA, 71 bp, chicken (Gallus Gallus)
  misc_feature (36): n=c or t
cttggccaagagccctatagtgctggacccacatgncagcccatatccctgaccaacttcagccagcatct

SEQ ID NO: 29823 - DNA, 71 bp, chicken (Gallus Gallus)
  misc_feature (36): n=c or t
ataagcaaactcttcaaacaaataagctccactatnttatctacaaagacaaagctagcctgtatctctta

SEQ ID NO: 29824 - DNA, 71 bp, chicken (Gallus Gallus)
  misc_feature (36): n=c or t
gaagagtgaaatatgatttctgtctgaataacttgntcagaattgctgcttgtagctatcaggtggggaga

SEQ ID NO: 29825 - DNA, 71 bp, chicken (Gallus Gallus)
  misc_feature (36): n=a or g
gctagtggttttgatggacattcacgacaaagaagnggctccaagaaactcagcctacccaatgggtggat

SEQ ID NO: 29826 - DNA, 71 bp, chicken (Gallus Gallus)
  misc_feature (36): n=a or c
tcggtgaaattgccgtttaaggtagtcagattaagntatctttctattcaactcagcatatgtgtgttaaa

SEQ ID NO: 29827 - DNA, 71 bp, chicken (Gallus Gallus)
  misc_feature (36): n=a or g
atgcaaaagtaacaacgtggagtactcactaagagnttcttccatgaagtcttgcttttcacagatggagt

SEQ ID NO: 29828 - DNA, 71 bp, chicken (Gallus Gallus)
  misc_feature (36): n=g or t
tggctttgcataactatttactagtacttcagaatnagtataaactataactaaaatttcagtgtaaaaaa

SEQ ID NO: 29829 - DNA, 71 bp, chicken (Gallus Gallus)
  misc_feature (36): n=c or t
tcaatgagagatgaagatttctactgacaccgtatntaatcaatgtttacctttcctaagaaaaccaaaat

SEQ ID NO: 29830 - DNA, 71 bp, chicken (Gallus Gallus)
  misc_feature (36): n=a or g
gggtgcaagcaaagaggacatagaaatctcaggganaacactgctataaaatataagtacttgtatgtgac

SEQ ID NO: 29831 - DNA, 71 bp, chicken (Gallus Gallus)
  misc_feature (36): n=a or g
ctactcatcctttctttatgagtttaacttttgacngtgcactttccttgacagatcaagtagttcctcaa

SEQ ID NO: 29832 - DNA, 71 bp, chicken (Gallus Gallus)
  misc_feature (36): n=c or t
ctgtttcccaccacactgctatttacctttatctcnatctattctgttttgttatgagttggtgctgtgaa

SEQ ID NO: 29833 - DNA, 71 bp, chicken (Gallus Gallus)
  misc_feature (36): n=c or t
aatgtgtgcatactgcccacaaacatgcagtatttnatttttactctatcaacaatctcagatgcatattt

SEQ ID NO: 29834 - DNA, 71 bp, chicken (Gallus Gallus)
  misc_feature (36): n=a or g
aaacctcattttgctagtaagactagtaaggttcangctgaaatatgtctatatcgctagtgagcacatat

SEQ ID NO: 29835 - DNA, 71 bp, chicken (Gallus Gallus)
  misc_feature (36): n=a or g
attaatacatacagtaacataaatcatgatatgcantagtcagagtcatccatttgtgcttaacagctcca

SEQ ID NO: 29836 - DNA, 71 bp, chicken (Gallus Gallus)
  misc_feature (36): n=a or g
ctctttggtctgcttccactgactcttcccagtcanctggtgctcttgtggcctctggaaaacagttgatt

SEQ ID NO: 29837 - DNA, 71 bp, chicken (Gallus Gallus)
  misc_feature (36): n=c or t
ttttctgtatttgtcgcatttctattccttgatttngagtaaacaaactgaaaccttaaagaattagtact

SEQ ID NO: 29838 - DNA, 71 bp, chicken (Gallus Gallus)
  misc_feature (36): n=g or t
tttttacagtcctgacatgattctctaaagcatacntcagtaaaaccatgagattggatgatttggcatgc

SEQ ID NO: 29839 - DNA, 71 bp, chicken (Gallus Gallus)
  misc_feature (36): n=c or t
aaacaatggtgtgtgactattactggtgcaaccatntctaaagaattctcaacagaaaaagtcatgtatat

SEQ ID NO: 29840 - DNA, 71 bp, chicken (Gallus Gallus)
  misc_feature (36): n=g or t
tctgattttttaaatgatcatgatcagagtttaacntgagggagaaaaaatgagataagaccatatttcag

SEQ ID NO: 29841 - DNA, 71 bp, chicken (Gallus Gallus)
  misc_feature (36): n=c or t
taactgagataatgaatagaatcactttcataaagntttaaaaggaattttttggacatgactggtactcc

SEQ ID NO: 29842 - DNA, 71 bp, chicken (Gallus Gallus)
  misc_feature (36): n=a or c
tctttgcctcaagattcagaagacaaagttagttgnaacattatccttcaatattggctatctgtctaagc

SEQ ID NO: 29843 - DNA, 71 bp, chicken (Gallus Gallus)
  misc_feature (36): n=c or t
tacacggtgacataatctagaggagtaaagaaaggnacagtgtgaaaatcttgcagtaaatactctgcagc

SEQ ID NO: 29844 - DNA, 71 bp, chicken (Gallus Gallus)
  misc_feature (36): n=a or g
catgttactagcacatgctgctttagaaacagttantattagctatgtatacattaatttatttgcctttg

SEQ ID NO: 29845 - DNA, 71 bp, chicken (Gallus Gallus)
  misc_feature (36): n=a or g
acaatgggattaaaaattggatgttaagtgcaaatntgaggctttttatgagaggaggctaagatatattt

SEQ ID NO: 29846 - DNA, 71 bp, chicken (Gallus Gallus)
  misc_feature (36): n=c or t
taagacgagcactgccctgcagtctggtaactgtcnctgtttcaaggcacccctgaaactatgttctggtg

SEQ ID NO: 29847 - DNA, 71 bp, chicken (Gallus Gallus)
  misc_feature (36): n=a or c
atagtctctgaaataaatctaacctaaaaggattgnagaaatgttggaaacatcaaagacacttttatcca

SEQ ID NO: 29848 - DNA, 71 bp, chicken (Gallus Gallus)
  misc_feature (36): n=c or t
tctgtagacttctattaataacttaaatctctgtcntttgtcttcattcaagtaactcttcaaaactcatt

SEQ ID NO: 29849 - DNA, 71 bp, chicken (Gallus Gallus)
  misc_feature (36): n=c or t
taattactattcctgctaatgtattactattttaangttcctgtttctgtagcctctattctgttgctttt

SEQ ID NO: 29850 - DNA, 71 bp, chicken (Gallus Gallus)
  misc_feature (36): n=c or t
tccagaataaatagagccaagagataatgtagcaanggggatgatcagtggtctagaatttaaggtttttt

SEQ ID NO: 29851 - DNA, 71 bp, chicken (Gallus Gallus)
  misc_feature (36): n=c or t
tatgcaaaccttgatcttctctgattatatctcagnaccagctgtttaggagatctctcgtacaggtatag

SEQ ID NO: 29852 - DNA, 71 bp, chicken (Gallus Gallus)
  misc_feature (36): n=c or t
tcatactgattataataattcttctgggatcaccancctttcctcctgtagctcctatgcagctcttttaa

SEQ ID NO: 29853 - DNA, 71 bp, chicken (Gallus Gallus)
  misc_feature (36): n=c or t
gttcagtatacagcctttaaagaaatctgcatcagncttgccttggctaggtatttgtatttggatgattt

SEQ ID NO: 29854 - DNA, 71 bp, chicken (Gallus Gallus)
  misc_feature (36): n=a or c
caattcttagccaccacagcaaataccttcttaacnctagacaaagtgtgtataaatcatttatctcatct

SEQ ID NO: 29855 - DNA, 71 bp, chicken (Gallus Gallus)
  misc_feature (36): n=c or t
cttcttccttctagcattctattctgaattgctcanggatcagagagatgtaaaagtcccttatgactacg

SEQ ID NO: 29856 - DNA, 71 bp, chicken (Gallus Gallus)
  misc_feature (36): n=g or t
actttctagccatggactgaaaggtggttaagcctnttttagcttctgacctttcctgctgactatatcat

SEQ ID NO: 29857 - DNA, 71 bp, chicken (Gallus Gallus)
  misc_feature (36): n=a or c
tcttctgagtgaacagtttaataccccttttgtaanataaaggtctgctgctctattttatccagtagatt

SEQ ID NO: 29858 - DNA, 71 bp, chicken (Gallus Gallus)
  misc_feature (36): n=a or g
cccaacttgtcttcagatatagacatctctctagtngagatatgtgaagttatttgacagagatcatacac

SEQ ID NO: 29859 - DNA, 71 bp, chicken (Gallus Gallus)
  misc_feature (36): n=c or t
aaaacaatagatttatttcaatgtgtgatattgtgnagaaaggtataggttataaagacagctgtgctctc

SEQ ID NO: 29860 - DNA, 71 bp, chicken (Gallus Gallus)
  misc_feature (36): n=a or g
cgatgacaatatatgtaagagtctgaatgacaactnaactcttcaaactgagtaaggcagaaatgataaaa

SEQ ID NO: 29861 - DNA, 71 bp, chicken (Gallus Gallus)
  misc_feature (36): n=a or g
aacaagtatatacatgagcccaatgactaacaaaangatgtatacccctttcatctaaatcactgattaag

SEQ ID NO: 29862 - DNA, 71 bp, chicken (Gallus Gallus)
  misc_feature (36): n=c or t
ttctgatctgcctgatttaggagaatgaattgaaangttccgcagccaagatacagttttataaatattta

SEQ ID NO: 29863 - DNA, 71 bp, chicken (Gallus Gallus)
  misc_feature (36): n=a or g
cagtggagaaaactcaatcctgtactactgtctgtntgcttagatataccaaattcaatgttgcctatgtt

SEQ ID NO: 29864 - DNA, 71 bp, chicken (Gallus Gallus)
  misc_feature (36): n=a or c
tcagtgttttaagttgctgtgtttcagtataaatgncaccatttaaagatttttatattccttctttaaaa

SEQ ID NO: 29865 - DNA, 71 bp, chicken (Gallus Gallus)
  misc_feature (36): n=c or t
ggaagaaagccctgaaaaaaggcatcagagtgatangaatcttagaaactgaggaagttaagctgttcact

SEQ ID NO: 29866 - DNA, 71 bp, chicken (Gallus Gallus)
  misc_feature (36): n=c or t
ttattttattggtgtccattgttgtaaacttcatcntgtcctcatgcctgtcaagttccatgggatgactt

SEQ ID NO: 29867 - DNA, 71 bp, chicken (Gallus Gallus)
  misc_feature (36): n=c or t
cagcacaggctaccacagacatgcattgctggctangtcatgcaacaaccagttagctccaaagctccttg

SEQ ID NO: 29868 - DNA, 71 bp, chicken (Gallus Gallus)
  misc_feature (36): n=g or t
accagtaaagttactaaagaataaacatcagaacanggaaatgacgagtgagccactgtttcagagagctc

SEQ ID NO: 29869 - DNA, 71 bp, chicken (Gallus Gallus)
  misc_feature (36): n=a or g
gctggcacagttgggaaaaacaagcaggcttttagnctcctaagcccttcttcaggtctgaaaacataagc

SEQ ID NO: 29870 - DNA, 71 bp, chicken (Gallus Gallus)
  misc_feature (36): n=a or c
acaacttgacccctattgtgcttcttaaatcatttntttatgtcttctgctaagaaataggtccaatgtat

SEQ ID NO: 29871 - DNA, 71 bp, chicken (Gallus Gallus)
  misc_feature (36): n=a or g
caaccgcagttcggaaatccaataaacaatatacantaaagttctatagagtatgtgcttgaccagtattt

SEQ ID NO: 29872 - DNA, 71 bp, chicken (Gallus Gallus)
  misc_feature (36): n=a or c
tagacatgcatgacctctcaactagccttactttanaggcaatacagagaattttatttcttatactgtct

SEQ ID NO: 29873 - DNA, 71 bp, chicken (Gallus Gallus)
  misc_feature (36): n=c or t
tatccagtacctttaggaatgtcaggcaagtagtgngagacagaacaatttccagctgatctaagacacac

SEQ ID NO: 29874 - DNA, 71 bp, chicken (Gallus Gallus)
  misc_feature (36): n=a or g
tatcaattaagctgatttagaagaagagatcagtanatagagagctaaagtacattttttaaacttaaata

SEQ ID NO: 29875 - DNA, 71 bp, chicken (Gallus Gallus)
  misc_feature (36): n=c or t
ccctgtgtgaagcattactcctttcgctcctatcgnatggaattctgctcatttcagtttaatacatttga

SEQ ID NO: 29876 - DNA, 71 bp, chicken (Gallus Gallus)
  misc_feature (36): n=c or t
ttccagcagaatctttccatggcttactaatgttgntcaggagggatatgactataatgggttaatgaagt

SEQ ID NO: 29877 - DNA, 71 bp, chicken (Gallus Gallus)
  misc_feature (36): n=a or g
aagatcacaaactggccaactatacctcttgtacantttccagtggtgaataaatttttagactatgtcat

SEQ ID NO: 29878 - DNA, 71 bp, chicken (Gallus Gallus)
  misc_feature (36): n=c or t
gggaagagcatctggggactgtacaagatttattangtgatgttccaagaaagaaacaaaggaaataaaag

SEQ ID NO: 29879 - DNA, 71 bp, chicken (Gallus Gallus)
  misc_feature (36): n=a or g
atgtaaacaataaactgttataagcaatatggatcnttcagatctgaatccatgcctccgatgctgaaaat

SEQ ID NO: 29880 - DNA, 71 bp, chicken (Gallus Gallus)
  misc_feature (36): n=a or g
agttagtttccccttcattcatctggtagtttcctngcaatctctacaggatcaagtggacagacaatgta

SEQ ID NO: 29881 - DNA, 71 bp, chicken (Gallus Gallus)
  misc_feature (36): n=c or t
cagaacatccttgctcttgatctcaacagccaaaancagagtaataaaacaggcttgtttgtcttagcata

SEQ ID NO: 29882 - DNA, 71 bp, chicken (Gallus Gallus)
  misc_feature (36): n=a or g
ttacccagataataaactgacgcagagaaaaaaatntcttggtcgaagtaaacattcaagaggatatagga

SEQ ID NO: 29883 - DNA, 71 bp, chicken (Gallus Gallus)
  misc_feature (36): n=a or g
aagcaagcataattactcctagatagtttttaagtntagctttaacttgcaaacactagcatgccaatttc

SEQ ID NO: 29884 - DNA, 71 bp, chicken (Gallus Gallus)
  misc_feature (36): n=a or c
tatttgattaaattgcctggagcacattgtaggtanttctatatcatttcctttcaaattgtaggactcag

SEQ ID NO: 29885 - DNA, 71 bp, chicken (Gallus Gallus)
  misc_feature (36): n=a or g
aacagagtcatcagctgtacacatctctcactggtnaggatgccattccaaattactgttaagacactgga

SEQ ID NO: 29886 - DNA, 71 bp, chicken (Gallus Gallus)
  misc_feature (36): n=a or g
atgtcataatggattgttaagcagagtttgatttcntcatatttcaatattggatttgaaagagcagttat

SEQ ID NO: 29887 - DNA, 71 bp, chicken (Gallus Gallus)
  misc_feature (36): n=c or t
gtggtatggagaaagccaaaagactcctacaatcangtaacttagttttcatatcatggaaggatgtgtat

SEQ ID NO: 29888 - DNA, 71 bp, chicken (Gallus Gallus)
  misc_feature (36): n=g or t
atattggtctttttgaagtcacacttgttttccctnttcaaagcattggtttggagatatgcgtgcatgtc

SEQ ID NO: 29889 - DNA, 71 bp, chicken (Gallus Gallus)
  misc_feature (36): n=a or g
caataggcttagattctgacaattttattcagaatntaactttcaagtgctcaaatctcttcctgttgaga

SEQ ID NO: 29890 - DNA, 71 bp, chicken (Gallus Gallus)
  misc_feature (36): n=c or t
tactaaactgaaccacatttaggaacctaactgaanatggaagcctgactaaatgatccttgtgaatgcag

SEQ ID NO: 29891 - DNA, 71 bp, chicken (Gallus Gallus)
  misc_feature (36): n=a or c
gtccaccttagctgtgtgccaggttaaaacacaacncagtctgtcctgatgttgattaaatgtaactcttc

SEQ ID NO: 29892 - DNA, 71 bp, chicken (Gallus Gallus)
  misc_feature (36): n=a or c
acaaatgactaaactgtgctatgttagccctaaggnccatcattctaacattctacagaaagtaaaaggag

SEQ ID NO: 29893 - DNA, 71 bp, chicken (Gallus Gallus)
  misc_feature (36): n=c or t
actgtgaaagtacacattttttctgctttttttttncccatcaaatttctactttcctgtttaggatctca

SEQ ID NO: 29894 - DNA, 71 bp, chicken (Gallus Gallus)
  misc_feature (36): n=a or c
acaattccgtatgcctattcctcctgatacatctancataacctccaactgtatgtaccacatatcttaat

SEQ ID NO: 29895 - DNA, 71 bp, chicken (Gallus Gallus)
  misc_feature (36): n=a or g
aatgcaacaaaaactatccttgtgtaaactaatgtnatattttagttgggaaaagtatagcctcagtttat

SEQ ID NO: 29896 - DNA, 71 bp, chicken (Gallus Gallus)
  misc_feature (36): n=c or t
atccttatcagacagagaggagaacgaggcaaatangttggtgctgtctgtgtttgagtgctgagtgtgct

SEQ ID NO: 29897 - DNA, 71 bp, chicken (Gallus Gallus)
  misc_feature (36): n=c or t
gtacaaagtaaaaacagtactaaactgcttcattgngctattattttcagctcaaacagcctttgctcatc

SEQ ID NO: 29898 - DNA, 71 bp, chicken (Gallus Gallus)
  misc_feature (36): n=c or t
aaatactagcaatatatctgaatccctttggtttcntttatctcaggcttttgtttagaaggatattctgt

SEQ ID NO: 29899 - DNA, 71 bp, chicken (Gallus Gallus)
  misc_feature (36): n=a or g
gaaaatggaaaatagtccagaacacatactctactntataaaaagctctgctacaagtgaacattagaaag

SEQ ID NO: 29900 - DNA, 71 bp, chicken (Gallus Gallus)
  misc_feature (36): n=a or g
agtacatttcgagtcttgaatggatttttttatatncatgtaatgcttttttacatttggataaatgtact

SEQ ID NO: 29901 - DNA, 71 bp, chicken (Gallus Gallus)
  misc_feature (36): n=c or t
aactgcaaaaaagttggacaaaatgtgagttattancagatttttacaacagggtgaatggtgtgtttgtg

SEQ ID NO: 29902 - DNA, 71 bp, chicken (Gallus Gallus)
  misc_feature (36): n=c or t
atcttgtattggatttcctgtattctgccatactgntctatttctctatattactacagtgtagagataag

SEQ ID NO: 29903 - DNA, 71 bp, chicken (Gallus Gallus)
  misc_feature (36): n=a or g
ttctatgttctctcattttagttcctatctttcaanctgagcttttgacacagtagatgtaattatgagtc

SEQ ID NO: 29904 - DNA, 71 bp, chicken (Gallus Gallus)
  misc_feature (36): n=c or t
ttttgcttgatggttgtgatgaacaacaaaatgtcnggatggagacaagtaacaagtggtgtacctcaagg

SEQ ID NO: 29905 - DNA, 71 bp, chicken (Gallus Gallus)
  misc_feature (36): n=a or g
tgtctagttcaactgcctgatgtctttatccaaacnattcttgaacattcacagggcatcaaccaaatctc

SEQ ID NO: 29906 - DNA, 71 bp, chicken (Gallus Gallus)
  misc_feature (36): n=a or g
ggactattgttccttatgcattcccattcttcgacnatctgtgctgaacgtagctatgggaaacccagaat

SEQ ID NO: 29907 - DNA, 71 bp, chicken (Gallus Gallus)
  misc_feature (36): n=a or g
gaacctctctgatggactgtctggtatgaaaattcntagagttttagaggtgaatatgtgggagagcacag

SEQ ID NO: 29908 - DNA, 71 bp, chicken (Gallus Gallus)
  misc_feature (36): n=a or g
gaaattgtttctttaattttcgcccttcacttgacngatctttgatgaatgataaataagactacagtata

SEQ ID NO: 29909 - DNA, 71 bp, chicken (Gallus Gallus)
  misc_feature (36): n=a or g
aggaaatgtccttcaatataacagtcttctctttcngtgttcgatcttccttttctcaaactgcttcatta

SEQ ID NO: 29910 - DNA, 71 bp, chicken (Gallus Gallus)
  misc_feature (36): n=c or t
tgcattgagaaaaggccagaagagttggtcaaatanggggagcagaacttttagcaaccattctttgagca

SEQ ID NO: 29911 - DNA, 71 bp, chicken (Gallus Gallus)
  misc_feature (36): n=a or g
taagaaggaaaaaaagaagcatgcattttctctgantaattgaatgactcacagtatttaattggctcaat

SEQ ID NO: 29912 - DNA, 71 bp, chicken (Gallus Gallus)
  misc_feature (36): n=c or t
atgaaccgacttgtttttcatcactgactccctttnttattaccccttgtgttattggaaaggagaccttg

SEQ ID NO: 29913 - DNA, 71 bp, chicken (Gallus Gallus)
  misc_feature (36): n=a or c
cattataatcattcatcagtgtaacaagtgagttgncatcagccccacagttgcaaggaaaataaatgaag

SEQ ID NO: 29914 - DNA, 71 bp, chicken (Gallus Gallus)
  misc_feature (36): n=c or t
tctagatggagtttaaaaagacaaattagtatattnagctaccagaatagtttaatgaaggaagtgggtgg

SEQ ID NO: 29915 - DNA, 71 bp, chicken (Gallus Gallus)
  misc_feature (36): n=c or t
acatgtactttatcaaagtagcaaatatgtaaactncgacacaagccccctgaatttcacacagtgttgaa

SEQ ID NO: 29916 - DNA, 71 bp, chicken (Gallus Gallus)
  misc_feature (36): n=a or g
acgatacaaaaattgaaatgaaagtgattgattgtntcataggttttatcacaagctacataatgagtcaa

SEQ ID NO: 29917 - DNA, 71 bp, chicken (Gallus Gallus)
  misc_feature (36): n=c or t
tgaaaacatagatttagtaagaaggggcattttaanactgttagtgtatttccacatacgtttccattatt

SEQ ID NO: 29918 - DNA, 71 bp, chicken (Gallus Gallus)
  misc_feature (36): n=a or g
cgtctgaaacagaaatcagggaggtcactgaaatcncagcttagatcttacatctgaaactttaagatatg

SEQ ID NO: 29919 - DNA, 71 bp, chicken (Gallus Gallus)
  misc_feature (36): n=c or t
ctgtcagcattcttcagtgaatccttgttaccttcntttttcttactctgaagtaggagagtgttatgata

SEQ ID NO: 29920 - DNA, 71 bp, chicken (Gallus Gallus)
  misc_feature (36): n=a or g
ttactgagttagaacactgaactattttcactctgnactcttagtttcaggagatgcagtgttctgaaata

SEQ ID NO: 29921 - DNA, 71 bp, chicken (Gallus Gallus)
  misc_feature (36): n=c or t
gtgacaataatggggcatttttaaatttggtagttnaaaatagtaaagaaattttcagaatacttatatac

SEQ ID NO: 29922 - DNA, 71 bp, chicken (Gallus Gallus)
  misc_feature (36): n=a or g
ataaaaccacgacaacagacaattagaaatagaacngaattactcgtgctgaatagaacaacattgaatcc

SEQ ID NO: 29923 - DNA, 71 bp, chicken (Gallus Gallus)
  misc_feature (36): n=a or g
gaatggttttggagggatgaacatataagaaataanaaaggcaaaaattgggtacaataacagcatcagat

SEQ ID NO: 29924 - DNA, 71 bp, chicken (Gallus Gallus)
  misc_feature (36): n=a or g
aaacaggaggcctgaccacaaaggaaaaccattganttaccaaagcaaggcatttgcaaatggaataaaat

SEQ ID NO: 29925 - DNA, 71 bp, chicken (Gallus Gallus)
  misc_feature (36): n=g or t
ctctcgccgtttagaaactaatagctttgggtgctncataaaatattctgaagttgattgaaatttctgaa

SEQ ID NO: 29926 - DNA, 71 bp, chicken (Gallus Gallus)
  misc_feature (36): n=a or g
tctatttctttcttcttattatttttttcttcagtngaggaacctaaaaggactggtcactgaaaatattg

SEQ ID NO: 29927 - DNA, 71 bp, chicken (Gallus Gallus)
  misc_feature (36): n=c or t
ttcgttttttgtgtgtgtgtggtgacgctatgggtngcttttgtgatttctacaattaccctcttcttttt

SEQ ID NO: 29928 - DNA, 71 bp, chicken (Gallus Gallus)
  misc_feature (36): n=a or g
tgttaggacaggtcatgcccactttagttacttctntaaatctgctcagaaaggaatgtgcacttaaaaag

SEQ ID NO: 29929 - DNA, 71 bp, chicken (Gallus Gallus)
  misc_feature (36): n=a or c
atgcctatgtatcactgtgctatatgccacttctgnctttcttaactgtttgttacatgttcagacagaac

SEQ ID NO: 29930 - DNA, 71 bp, chicken (Gallus Gallus)
  misc_feature (36): n=c or t
ggctactcaccacagaataaaaagcagtatcctatnagatcatccctagttttataattgtactgtagatg

SEQ ID NO: 29931 - DNA, 71 bp, chicken (Gallus Gallus)
  misc_feature (36): n=c or t
ctgtacttgtgatttgccacaataagatattgattnaatataccatataagcacatacagaaatccctcct

SEQ ID NO: 29932 - DNA, 71 bp, chicken (Gallus Gallus)
  misc_feature (36): n=a or g
cttcagtagtgtacaatgtgatctctatcttacctnagcctcaaagcattcagtagtggtaaagtcaaaat

SEQ ID NO: 29933 - DNA, 71 bp, chicken (Gallus Gallus)
  misc_feature (36): n=a or g
agacgaggaaaagcctgaatgtctaacaactggganaatggagaaaaagataccattatacttatcacttt

SEQ ID NO: 29934 - DNA, 71 bp, chicken (Gallus Gallus)
  misc_feature (36): n=g or t
cactgaatagaatgtgagaaattatgccagattctncttccaggatgagctatggggaaaaataaatggta

SEQ ID NO: 29935 - DNA, 71 bp, chicken (Gallus Gallus)
  misc_feature (36): n=a or g
gtcacggagaatcctagtttgcctgcatttttactntgtcgagacactgataactgaagtatgggccatga

SEQ ID NO: 29936 - DNA, 71 bp, chicken (Gallus Gallus)
  misc_feature (36): n=c or t
tgctttgggctatcccacttacaatcaggaaagaantggtgaactagtttaaccttgtgtttcatggtatt

SEQ ID NO: 29937 - DNA, 71 bp, chicken (Gallus Gallus)
  misc_feature (36): n=c or t
tctgttgagaatttgaatacttatctcagtatgttnaattctcagtcttaacacctctaactataaatgac

SEQ ID NO: 29938 - DNA, 71 bp, chicken (Gallus Gallus)
  misc_feature (36): n=c or t
aggttttgctggagcaatattaagatgttctcatanatttctaacagttctctatgtacagctctttatgt

SEQ ID NO: 29939 - DNA, 71 bp, chicken (Gallus Gallus)
  misc_feature (36): n=a or g
tgtggatactgtaagatgatttctgtggatgtatangtgttctaagtagcaattacttcaactttgtttcc

SEQ ID NO: 29940 - DNA, 71 bp, chicken (Gallus Gallus)
  misc_feature (36): n=a or g
atcaatttgtcacaaagaacagaaacaggtgaaaangaagatcatcaattcctactgtgtatggggctgga

SEQ ID NO: 29941 - DNA, 71 bp, chicken (Gallus Gallus)
  misc_feature (36): n=c or t
tttttcttaaataattatatctgagttcccggagtngctggtttatgctctgtatcaacccatacaagatg

SEQ ID NO: 29942 - DNA, 71 bp, chicken (Gallus Gallus)
  misc_feature (36): n=c or t
tgaaggttccagcacaaggctgacattcatatcagntgcctttgaccattctcacttgtctccagtacttc

SEQ ID NO: 29943 - DNA, 71 bp, chicken (Gallus Gallus)
  misc_feature (36): n=g or t
tcgatataatctccaatggctgtgtagcaataaggnagtcttattgcctttggtctttgtagtaagcttaa

SEQ ID NO: 29944 - DNA, 71 bp, chicken (Gallus Gallus)
  misc_feature (36): n=a or g
aaaaagtaacacattcagtttgctgtgcaactttcntgtttgttaaagtgaacaaagttctgcatactaag

SEQ ID NO: 29945 - DNA, 71 bp, chicken (Gallus Gallus)
  misc_feature (36): n=a or g
tggggaaaacaacttagcattcaaattacagtgccntgtattttatccgtaagagttttcttttgaatcct

SEQ ID NO: 29946 - DNA, 71 bp, chicken (Gallus Gallus)
  misc_feature (36): n=a or g
tgctcacaaggttgtgttctttcagtgataatttgnatgttatttatttccttgtcatctctggagtcatc

SEQ ID NO: 29947 - DNA, 71 bp, chicken (Gallus Gallus)
  misc_feature (36): n=a or c
tgaattgaagctctgtggttttatgtggacattccnccaatggacacttttgccttgaagtcttcatagac

SEQ ID NO: 29948 - DNA, 71 bp, chicken (Gallus Gallus)
  misc_feature (36): n=c or t
acagggtaacattcatttgacctattttagtttttngctttaatatgaaacaaatagcattttaaaagatt

SEQ ID NO: 29949 - DNA, 71 bp, chicken (Gallus Gallus)
  misc_feature (36): n=a or g
aaacagagctgaacagcattcagaggaacaatattntatcaaattgtagtgtctaccttactcttattttt

SEQ ID NO: 29950 - DNA, 71 bp, chicken (Gallus Gallus)
  misc_feature (36): n=c or t
cgaaggaagaaagagtaaagcagtgagttggctaanaagaacaggcacttcactgctaatagaatctgttg

SEQ ID NO: 29951 - DNA, 71 bp, chicken (Gallus Gallus)
  misc_feature (36): n=a or g
tggtaaaagttcatgcaaatttccaagaagaaagancaatcctacctctttgtttctttacaggatactgt

SEQ ID NO: 29952 - DNA, 71 bp, chicken (Gallus Gallus)
  misc_feature (36): n=c or t
gaaaattgtttataatattaatagtgcattacaaangtaagttaatgatctcagaagagatctacaccagc

SEQ ID NO: 29953 - DNA, 71 bp, chicken (Gallus Gallus)
  misc_feature (36): n=c or t
tgtcatctacaatattaaaattttaggacgtgagtntggttgtctccatctaacacttatcctgagcaatt

SEQ ID NO: 29954 - DNA, 71 bp, chicken (Gallus Gallus)
  misc_feature (36): n=c or t
gagacattttattttcctgcagcatattctgtttgnatttgaactactacctagtaacattctgaagtgca

SEQ ID NO: 29955 - DNA, 71 bp, chicken (Gallus Gallus)
  misc_feature (36): n=g or t
gcaacatcccatgtccaataacgccttcagcagcanaaggtacattttggcaggactctgcacagacagtg

SEQ ID NO: 29956 - DNA, 71 bp, chicken (Gallus Gallus)
  misc_feature (36): n=g or t
tctcaaaaataaaacacaatatgccaaaataaaatntattggtatggagtagcatacttcaaactcccacc

SEQ ID NO: 29957 - DNA, 71 bp, chicken (Gallus Gallus)
  misc_feature (36): n=a or g
aaagacaactcctctgctagagatacaggatacacntttatgggcagacttgtcattaagatagaactagg

SEQ ID NO: 29958 - DNA, 71 bp, chicken (Gallus Gallus)
  misc_feature (36): n=g or t
gattttgagggctaaatgcataatatgcagtaaggnggtgctatgtggtgtaactagtggggtctaaaagt

SEQ ID NO: 29959 - DNA, 71 bp, chicken (Gallus Gallus)
  misc_feature (36): n=a or g
attatttgaaaatgattttcttggatgatatagatngaaactgaactaacgtgtgcatgtttggctggtgg

SEQ ID NO: 29960 - DNA, 71 bp, chicken (Gallus Gallus)
  misc_feature (36): n=a or g
agagaaattctaaaggcagtgtcaccagaactgcanttaaaagcataataggctgagctatctaatctcaa

SEQ ID NO: 29961 - DNA, 71 bp, chicken (Gallus Gallus)
  misc_feature (36): n=a or g
tgttcaatttattctggagtttcttatgctattagntgggttgtgtaaaagagtaatgttattttcagctt

SEQ ID NO: 29962 - DNA, 71 bp, chicken (Gallus Gallus)
  misc_feature (36): n=g or t
agtgagtactgaaattataggggcattgtgattttncagtgtcattccaagtaatatttgctgtcatatgc

SEQ ID NO: 29963 - DNA, 71 bp, chicken (Gallus Gallus)
  misc_feature (36): n=a or g
tgttatgtgaataaggcaaaactgtagcaaacagcnaaagctaaatatattctaccaaagcaatttattca

SEQ ID NO: 29964 - DNA, 71 bp, chicken (Gallus Gallus)
  misc_feature (36): n=a or g
gagagtgcataggaaacagtcaagatcaaaggaaangacaaccgtacaaaattggtccaatcaaccacctg

SEQ ID NO: 29965 - DNA, 71 bp, chicken (Gallus Gallus)
  misc_feature (36): n=c or t
tacggtgtaagaagctcattaatagtactggcactntttcactttcttcatgtacagattgtttactttca

SEQ ID NO: 29966 - DNA, 71 bp, chicken (Gallus Gallus)
  misc_feature (36): n=c or t
taatgataatcttttcagaatcctgaaactctcacngagttctccccagtttgctgtttctgatttcaaac

SEQ ID NO: 29967 - DNA, 71 bp, chicken (Gallus Gallus)
  misc_feature (36): n=a or g
gtcccaggtttctgcatatgaatttggcagttactntgacattgaacactgaaagtgtgaggattagatta

SEQ ID NO: 29968 - DNA, 71 bp, chicken (Gallus Gallus)
  misc_feature (36): n=a or g
tttatattattggttaatatttactaggtaatctcntcctatgttcttcctgtgctctcctctttccttca

SEQ ID NO: 29969 - DNA, 71 bp, chicken (Gallus Gallus)
  misc_feature (36): n=a or g
atacaaattaaatctgcattgcataaagttagatantatgtttgtcattggatgcatttttaaaccaaagc

SEQ ID NO: 29970 - DNA, 71 bp, chicken (Gallus Gallus)
  misc_feature (36): n=a or g
tgtgaacatgctattctccaagctaatgatagaccnataaaagagaaatttgttaatgcactcaaaggtat

SEQ ID NO: 29971 - DNA, 71 bp, chicken (Gallus Gallus)
  misc_feature (36): n=a or g
aattggcaagttttgtagttgagcactttactgtgngtttctctcagggatgatctgtactcctgtttcaa

SEQ ID NO: 29972 - DNA, 71 bp, chicken (Gallus Gallus)
  misc_feature (36): n=c or t
agctccagagataatagaatgctggacaatgtatgnaacaccggagtaattaatatcaacattaagtaaat

SEQ ID NO: 29973 - DNA, 71 bp, chicken (Gallus Gallus)
  misc_feature (36): n=c or t
tttttcaaatgattcattttacatggtaacctcacnagtgcataccacttctttaagaattgataggagat

SEQ ID NO: 29974 - DNA, 71 bp, chicken (Gallus Gallus)
  misc_feature (36): n=a or g
tctcaacagtggcagagtttgctatcttcctggtgnccattttctgttactcatactcttttctgctactc

SEQ ID NO: 29975 - DNA, 71 bp, chicken (Gallus Gallus)
  misc_feature (36): n=a or g
agtgaaaataccactgctacccttcaagagtgtggnaaaaaattgcctgcaaaattggtcatatttcaaac

SEQ ID NO: 29976 - DNA, 71 bp, chicken (Gallus Gallus)
  misc_feature (36): n=a or g
gaacaaaggagcattaatactgtgttttgtaaatanctctaatttaccttatggctataatatatacatac

SEQ ID NO: 29977 - DNA, 71 bp, chicken (Gallus Gallus)
  misc_feature (36): n=a or g
gcaaaacccaatgaactttgatatattaatacagcntttagtatttaatcctatactgttatgaaaactaa

SEQ ID NO: 29978 - DNA, 71 bp, chicken (Gallus Gallus)
  misc_feature (36): n=a or g
tgccatcctgcagggtgggctgggggtctgcgtgcntctttgttgctggggtccagatgctgcagaggggc

SEQ ID NO: 29979 - DNA, 71 bp, chicken (Gallus Gallus)
  misc_feature (36): n=g or t
tactctatttccccttttgataaccattctgtcctnagtatctgtacaacaactttgaacttcatctttgg

SEQ ID NO: 29980 - DNA, 71 bp, chicken (Gallus Gallus)
  misc_feature (36): n=c or t
taggtcacagagtaataaaaactcttatgctatttnagggaccatttagtctgtctgtactcatcactgca

SEQ ID NO: 29981 - DNA, 71 bp, chicken (Gallus Gallus)
  misc_feature (36): n=a or g
ggggggcgtaacatcggaccatgtgctagcacacanctgctttccttctagtccttggcgtaggaagcttg

SEQ ID NO: 29982 - DNA, 71 bp, chicken (Gallus Gallus)
  misc_feature (36): n=c or t
cagctagtgagctgaatggtaattgtagtgaatgancagagatgaagtacttagacttcctccctagctct

SEQ ID NO: 29983 - DNA, 71 bp, chicken (Gallus Gallus)
  misc_feature (36): n=a or c
tcaaggtctcccctacagataaagaaatagaaagtntatgcaagtcccgcaaaaaaataatttccaggacc

SEQ ID NO: 29984 - DNA, 71 bp, chicken (Gallus Gallus)
  misc_feature (36): n=a or g
tacaatgcttacaatctcagtagctctgttctgacngtagggatatcctctgatatggaaaacacacttca

SEQ ID NO: 29985 - DNA, 71 bp, chicken (Gallus Gallus)
  misc_feature (36): n=c or t
ttttgcaatctgctggttgcaactgggctgttaaanttcttgaatttatttcatcttacacaaatactgct

SEQ ID NO: 29986 - DNA, 71 bp, chicken (Gallus Gallus)
  misc_feature (36): n=c or t
tacaaacactaaggtgagatcatctctttttcctgngaccagaaagaacaatacccctgcaagaaggatca

SEQ ID NO: 29987 - DNA, 71 bp, chicken (Gallus Gallus)
  misc_feature (36): n=g or t
tgttccactcctttattgcaacccatctgcaatttnctgcagtcgttttgtcctttgatcttaatgtgact

SEQ ID NO: 29988 - DNA, 71 bp, chicken (Gallus Gallus)
  misc_feature (36): n=a or g
aaggtgtatttaaatgaactaatagcccactttgcntgggtgaaattgaagaaattgaacctaactagttt

SEQ ID NO: 29989 - DNA, 71 bp, chicken (Gallus Gallus)
  misc_feature (36): n=a or c
taacacaaaatggatctagaaatgtcttgtggagtncatccatctgtttcaagcaatttccaggggatgat

SEQ ID NO: 29990 - DNA, 71 bp, chicken (Gallus Gallus)
  misc_feature (36): n=c or t
ctttgttattgattggcactgatggcactgtgtgangttgtcctgaagtgggaagtatcatcagagagaac

SEQ ID NO: 29991 - DNA, 71 bp, chicken (Gallus Gallus)
  misc_feature (36): n=a or g
gcagctagacactgaactcttagccatctaagtgtnaatgaaagactcaaatctgaaagtgttacaaaatt

SEQ ID NO: 29992 - DNA, 71 bp, chicken (Gallus Gallus)
  misc_feature (36): n=a or g
aagtatgtttcaccactcttccctttctgtagaaangtagattaatgatgataatacatgatgtacatctg

SEQ ID NO: 29993 - DNA, 71 bp, chicken (Gallus Gallus)
  misc_feature (36): n=a or g
tacttgtcatcctaccattcatgatgaaatctttanatcaatcacgttgagccacatgagaaaaactgttg

SEQ ID NO: 29994 - DNA, 71 bp, chicken (Gallus Gallus)
  misc_feature (36): n=a or g
ttaaatttaagggaaatactgggtatttggggtaanatgactttagcctcttatatctaaactgtctgctc

SEQ ID NO: 29995 - DNA, 71 bp, chicken (Gallus Gallus)
  misc_feature (36): n=a or g
tccagagcagtaacaataatcaattaggtggcaganggatgctcaatagaaaaatcagtaaatgagcggat

SEQ ID NO: 29996 - DNA, 71 bp, chicken (Gallus Gallus)
  misc_feature (36): n=c or t
attactcacgcaactgtcaattcacacacaatgcantgcagtgaatacgtattcacaaaaactatgaaatt

SEQ ID NO: 29997 - DNA, 71 bp, chicken (Gallus Gallus)
  misc_feature (36): n=a or g
catcccttcattaaggtaccatccttcaccactctntgtagcagtgggtctgatcagtatgattaagcatg

SEQ ID NO: 29998 - DNA, 71 bp, chicken (Gallus Gallus)
  misc_feature (36): n=a or g
aagaagcactaacaaaccagttgtttccttttgtantatatatcagcttatcagactaaatgtgaagtctt

SEQ ID NO: 29999 - DNA, 71 bp, chicken (Gallus Gallus)
  misc_feature (36): n=c or t
gaccatagagggtaaataactacctttatctatagntaggattcagcttactctgctatgaggcaccaggg

SEQ ID NO: 30000 - DNA, 71 bp, chicken (Gallus Gallus)
  misc_feature (36): n=c or t
tccaatgtccttcctcctgtccttcatgttgccttnataaaccaactcctctaacagctggcttcaaacac

SEQ ID NO: 30001 - DNA, 71 bp, chicken (Gallus Gallus)
  misc_feature (36): n=g or t
gggaatgattctgaaagttgcatttttgaagtcttnggaactaaaattcagtcgtagagtcatggactcac

SEQ ID NO: 30002 - DNA, 71 bp, chicken (Gallus Gallus)
  misc_feature (36): n=c or t
agaggaaaggacctgtaggaagacaaaagagcatanacccactaaaaaaagcatcctaacttcaataaacc

SEQ ID NO: 30003 - DNA, 71 bp, chicken (Gallus Gallus)
  misc_feature (36): n=a or g
ttttacagagacctggttgattttagttttcatttntaatctggttttcaaaagggaccctgtcttggatc

SEQ ID NO: 30004 - DNA, 71 bp, chicken (Gallus Gallus)
  misc_feature (36): n=c or t
atctcttatatttaggatgaatatacagccctgggngttatgctttttgacatctaaagaagcaagccttt

SEQ ID NO: 30005 - DNA, 71 bp, chicken (Gallus Gallus)
  misc_feature (36): n=c or t
tgtgaagttttgaccggagaatgtaggaaatatctnaggttggaataccgataaaacagcattcacttaga

SEQ ID NO: 30006 - DNA, 71 bp, chicken (Gallus Gallus)
  misc_feature (36): n=c or t
ttatcttgaccttttaatctatattagtgaaagttnggtagattactaaaatgtgactgcagatttttgtt

SEQ ID NO: 30007 - DNA, 71 bp, chicken (Gallus Gallus)
  misc_feature (36): n=a or g
actgaaggttgaatgaagatgtcccatttcagtgcntactgaaaaaataagagtcctaacaacaggaaatg

SEQ ID NO: 30008 - DNA, 71 bp, chicken (Gallus Gallus)
  misc_feature (36): n=c or t
acaaaagcaacttatcagagagttgtgctaaaaccntgtggtgggataccctgcagttcaggctcagatta

SEQ ID NO: 30009 - DNA, 71 bp, chicken (Gallus Gallus)
  misc_feature (36): n=a or g
atgtagaatgtacaaaatatgtgattaagtgtacancattacaccaagaaacatgtagtatgtagattttt

SEQ ID NO: 30010 - DNA, 71 bp, chicken (Gallus Gallus)
  misc_feature (36): n=c or t
aatcaaaatccacatttaagcctcttgtgactcagncaaggttgtctgttctgtaactctgcagatcagcc

SEQ ID NO: 30011 - DNA, 71 bp, chicken (Gallus Gallus)
  misc_feature (36): n=c or t
aaggttttcttaaggcgctgcttcagataagactangagtttgtagaccagtgctccacacacatacaaaa

SEQ ID NO: 30012 - DNA, 71 bp, chicken (Gallus Gallus)
  misc_feature (36): n=a or g
attatctgatgactgcaaaaattctgtactgcagtnttaacatttaacatttccctgctaaatttaggaca

SEQ ID NO: 30013 - DNA, 71 bp, chicken (Gallus Gallus)
  misc_feature (36): n=a or g
aatgcctgcagctgagagtctgtcacctgccctgtnggatgtcaacaatccctttcagagcacccaacctt

SEQ ID NO: 30014 - DNA, 71 bp, chicken (Gallus Gallus)
  misc_feature (36): n=c or t
atatatataaatgaaacttgtgcaaagcctcttcangctgcaagcaaacactctctaagcttggataaaat

SEQ ID NO: 30015 - DNA, 71 bp, chicken (Gallus Gallus)
  misc_feature (36): n=a or g
cattccaatgctatagttttggcttcattaaggtgngcctgtcagtaaggctagctttagacaaaggaagc

SEQ ID NO: 30016 - DNA, 71 bp, chicken (Gallus Gallus)
  misc_feature (36): n=c or t
agtcagtcagttgaaatgatctgagctttgtaaaantggtagtttcaagactggtacaacaacaaggtaga

SEQ ID NO: 30017 - DNA, 71 bp, chicken (Gallus Gallus)
  misc_feature (36): n=c or t
actagtttcagaatctggcctgcaaactctcactgnagactatatttggcactgattgcttcagcctggga

SEQ ID NO: 30018 - DNA, 71 bp, chicken (Gallus Gallus)
  misc_feature (36): n=a or g
gcataaaaatagagatgtgattaccatagcagtggnggatgttctaaatatggttttcaagaagaaactgt

SEQ ID NO: 30019 - DNA, 71 bp, chicken (Gallus Gallus)
  misc_feature (36): n=c or t
gaagcagcaaagtaaggaggaatttcaaattctgangtgaatattggtgcctgttcaagcagaacgtaccc

SEQ ID NO: 30020 - DNA, 71 bp, chicken (Gallus Gallus)
  misc_feature (36): n=a or g
agagcctcatagatggggtattctgctttcctgtanagggggaaagctctgcacctcatttgcaggtggga

SEQ ID NO: 30021 - DNA, 71 bp, chicken (Gallus Gallus)
  misc_feature (36): n=a or g
atgctattcataaaaattaatgtcacgtaaggcatntttttccttgcttatcatttttcacctgggtacac

SEQ ID NO: 30022 - DNA, 71 bp, chicken (Gallus Gallus)
  misc_feature (36): n=a or g
gccttgaagaaatgggacccaaggctggggatgcancactgcagcttcatccaaagctcaagcatcacaca

SEQ ID NO: 30023 - DNA, 71 bp, chicken (Gallus Gallus)
  misc_feature (36): n=c or t
cacttccacagcgagtcaaagaaatgaccttcaganattcctcaaactagcactgcttataaaggagttgc

SEQ ID NO: 30024 - DNA, 71 bp, chicken (Gallus Gallus)
  misc_feature (36): n=a or g
cataacttctgtttttatcctgttgcataacttagnacataacaattaccgataagtacaactaaaccccc

SEQ ID NO: 30025 - DNA, 71 bp, chicken (Gallus Gallus)
  misc_feature (36): n=c or t
ttatatccttgaatttgttatataataatgagactngtttgtctcctagcctgtgtaactgaaatggtggt

SEQ ID NO: 30026 - DNA, 71 bp, chicken (Gallus Gallus)
  misc_feature (36): n=a or g
aatcatctgaaacattttcctatgaagttaaaatanattgtttttagtatcacacaatcgtagaaatgcag

SEQ ID NO: 30027 - DNA, 71 bp, chicken (Gallus Gallus)
  misc_feature (36): n=a or g
ctctaagtgaaaatgggacagaattctaactgtacntgctgtcatagctttctcttgttttctgctcacat

SEQ ID NO: 30028 - DNA, 71 bp, chicken (Gallus Gallus)
  misc_feature (36): n=a or c
aggaattcagtactgaaacaagtttactctgacaantacatcctcatccaggatctaatgccattgccagt

SEQ ID NO: 30029 - DNA, 71 bp, chicken (Gallus Gallus)
  misc_feature (36): n=c or t
aagtccaaatggtatgctttctaatccagcagacantggcaagtacctcacaaggtgccacttgtgccatc

SEQ ID NO: 30030 - DNA, 71 bp, chicken (Gallus Gallus)
  misc_feature (36): n=c or t
cctacaactcaaaatcctagtgtgagaatactcaanatctttgaggaacaggacacattcattagcatact

SEQ ID NO: 30031 - DNA, 71 bp, chicken (Gallus Gallus)
  misc_feature (36): n=a or g
ttctttggtatcagcacctacaattttgctgatcancaattcttgggaactagcatcagtggaactttttc

SEQ ID NO: 30032 - DNA, 71 bp, chicken (Gallus Gallus)
  misc_feature (36): n=g or t
acatgaatattctgaataaacaaaatccttcattcncagatttttcacaatagtacaacaatacagatgct

SEQ ID NO: 30033 - DNA, 71 bp, chicken (Gallus Gallus)
  misc_feature (36): n=g or t
tttgagaatgctggggaagctctttagcaaaaccanagagaaagaatatgcaagaagataatgctggaaaa

SEQ ID NO: 30034 - DNA, 71 bp, chicken (Gallus Gallus)
  misc_feature (36): n=c or t
gaatgtttctggagttctaaatctccatcagagtgncataaaacaaaagcctcaggccttcctagttatat

SEQ ID NO: 30035 - DNA, 71 bp, chicken (Gallus Gallus)
  misc_feature (36): n=a or g
ctctgagaagcagaaatgttgctcgtttgcctctcntgtgtagattttcaccctcccttagattctcctcg

SEQ ID NO: 30036 - DNA, 71 bp, chicken (Gallus Gallus)
  misc_feature (36): n=a or g
ctgctgtagaggttgggccccaaatgcttgagaacnccaatagtctgcagtcccaaccaaaacaaacaaac

SEQ ID NO: 30037 - DNA, 71 bp, chicken (Gallus Gallus)
  misc_feature (36): n=g or t
ttcttagacccttggcagtcttcctccaaccaaatngtgcataaccctataaagaaagagcagtctttgtt

SEQ ID NO: 30038 - DNA, 71 bp, chicken (Gallus Gallus)
  misc_feature (36): n=a or g
atatataaatatatttcaatatttctgaaattcatnactataaagcagagtagtggaaatgtgagtgtggc

SEQ ID NO: 30039 - DNA, 71 bp, chicken (Gallus Gallus)
  misc_feature (36): n=a or c
aaaaatctaaattaacttctgcaattctagtcttcnccctctgaaagttactgctaactctgcaggatttg

SEQ ID NO: 30040 - DNA, 71 bp, chicken (Gallus Gallus)
  misc_feature (36): n=c or t
gtgggccaaggactatgtggcaaatttctgctctgnattttattcattaattcactcccagtgagcccctg

SEQ ID NO: 30041 - DNA, 71 bp, chicken (Gallus Gallus)
  misc_feature (36): n=a or g
tcttgatgtagttgaactacttacagttttataagnttgactaaacacaggctaaaggctttcacaaatgc

SEQ ID NO: 30042 - DNA, 71 bp, chicken (Gallus Gallus)
  misc_feature (36): n=a or g
tgggttgaggagatggtgttgttgggcaacaagacntgcaggcctcaacaaagcccctaaaattgaagggt

SEQ ID NO: 30043 - DNA, 71 bp, chicken (Gallus Gallus)
  misc_feature (36): n=a or c
ctcccatttatgacaaatagtaataaaattgttggntgtgacttacagaagcttctccaaatttggcatca

SEQ ID NO: 30044 - DNA, 71 bp, chicken (Gallus Gallus)
  misc_feature (36): n=a or g
cagcatccaccagcagtgctctcctgcttgaggtanaagccgggaaaaaataggtgcaggtttaaggcctc

SEQ ID NO: 30045 - DNA, 71 bp, chicken (Gallus Gallus)
  misc_feature (36): n=g or t
tttagcaagaattattctccttacccattttaaatntatcactgtcacaggtacggaagatatttccctat

SEQ ID NO: 30046 - DNA, 71 bp, chicken (Gallus Gallus)
  misc_feature (36): n=c or t
tgactcagaaggggaactagaaaaggtacaactccngaatcaatcaccatctgtatctgctcgttgccacc

SEQ ID NO: 30047 - DNA, 71 bp, chicken (Gallus Gallus)
  misc_feature (36): n=c or t
atttcttacctgactctaaagccagatgatgctctngggacaggggatgactgtgtcgaagtcctcatgtc

SEQ ID NO: 30048 - DNA, 71 bp, chicken (Gallus Gallus)
  misc_feature (36): n=c or t
acagctggcacaaacttgctacaaaaccacttcaanggttgaaaggaaaaggtagaactttcaaacatcct

SEQ ID NO: 30049 - DNA, 71 bp, chicken (Gallus Gallus)
  misc_feature (36): n=c or t
ttttttccccaccagtttaaacaatagtagtttcantttttgtcttatgcttgctcaacactgtgatattt

SEQ ID NO: 30050 - DNA, 71 bp, chicken (Gallus Gallus)
  misc_feature (36): n=a or g
tttcttaggcatctgtgctagaaaacaaaagggccncggtgcagctgcaggtgggtagcgtgtcacagctc

SEQ ID NO: 30051 - DNA, 71 bp, chicken (Gallus Gallus)
  misc_feature (36): n=a or g
attagtcctaatttgtgtagatatctatttaccttnagtcactgagtcattactttgcctttgttgctgct

SEQ ID NO: 30052 - DNA, 71 bp, chicken (Gallus Gallus)
  misc_feature (36): n=c or t
aatctttgcactttgtgtaacatattgccatttaangaacagagggcagaggatagctgaagcaaaccaat

SEQ ID NO: 30053 - DNA, 71 bp, chicken (Gallus Gallus)
  misc_feature (36): n=c or t
gatgatgtgcagtcattatctacaactggccttttnatgggaaggtatgggatttagtatgcatatcaaag

SEQ ID NO: 30054 - DNA, 71 bp, chicken (Gallus Gallus)
  misc_feature (36): n=c or t
cttggtttaaatgttcctcataggcttttcgtccanagcaaaatcaaaatcttcctctggaaaatttcagt

SEQ ID NO: 30055 - DNA, 71 bp, chicken (Gallus Gallus)
  misc_feature (36): n=c or t
tatatttaaggttatctctctggagatgttcttttngtagatccccagctgatagcatgaatgtttgtatg

SEQ ID NO: 30056 - DNA, 71 bp, chicken (Gallus Gallus)
  misc_feature (36): n=c or t
cagtgaaattacttgcagctaaaggggtcagttatncgtgacacagagtctatagaaacctagcacagaat

SEQ ID NO: 30057 - DNA, 71 bp, chicken (Gallus Gallus)
  misc_feature (36): n=a or g
tttacttgaaagacttttatctaaactttccaattnctctcaagttaaattttaggtagcgttctctcatc

SEQ ID NO: 30058 - DNA, 71 bp, chicken (Gallus Gallus)
  misc_feature (36): n=c or t
atcttcagatcatgcttccatcatctgcaggcactncttgatctccacagatattcccatcctccccagac

SEQ ID NO: 30059 - DNA, 71 bp, chicken (Gallus Gallus)
  misc_feature (36): n=a or g
tggccgttggccaatgataagacagcttacaaagantatgtgtgctctactacagctgaagagcaaatact

SEQ ID NO: 30060 - DNA, 71 bp, chicken (Gallus Gallus)
  misc_feature (36): n=a or g
aagactcaggaattaaggagtattcttgtactgccnctttagctgtaatcagagaatctctttgaaatcct

SEQ ID NO: 30061 - DNA, 71 bp, chicken (Gallus Gallus)
  misc_feature (36): n=g or t
taatgagctaccaattattactataatatacaattnctcgaaacagactaattaaatgttcagtcttgttg

SEQ ID NO: 30062 - DNA, 71 bp, chicken (Gallus Gallus)
  misc_feature (36): n=a or g
cttgcgtacagtgcaagatgatacctgtctccctgntacacacatagactacaattttatttatgccaagt

SEQ ID NO: 30063 - DNA, 71 bp, chicken (Gallus Gallus)
  misc_feature (36): n=c or t
ctatgtcatggggaatggtgccgtttcccctccttncctgtgaggtgaagcgaaaagctttgttagtaata

SEQ ID NO: 30064 - DNA, 71 bp, chicken (Gallus Gallus)
  misc_feature (36): n=a or g
tgcacattagtttattgtaagtgagcttgagggagntgagaaaaaagcccagtgggactgagtagactgct

SEQ ID NO: 30065 - DNA, 71 bp, chicken (Gallus Gallus)
  misc_feature (36): n=c or t
ggcagatactatttgagaaagtaacaaaatagtcangctctgctgcaacaccgcgtcagatattactgccg

SEQ ID NO: 30066 - DNA, 71 bp, chicken (Gallus Gallus)
  misc_feature (36): n=c or t
aattgcattacagcaatggtactactgaaaagatcncgaacacctattttcaaagcagacagacctttcac

SEQ ID NO: 30067 - DNA, 71 bp, chicken (Gallus Gallus)
  misc_feature (36): n=c or t
taaaccctcggaaatccattattttggatcaggtcnctagaacagcatagagtgatgaaataaataggaat

SEQ ID NO: 30068 - DNA, 71 bp, chicken (Gallus Gallus)
  misc_feature (36): n=c or t
ccctacaacagcatcaccaaaatgaaagctatctcnctgcaatgggctgaagtctacagtgtatcagacac

SEQ ID NO: 30069 - DNA, 71 bp, chicken (Gallus Gallus)
  misc_feature (36): n=a or g
actgttggtttgaatggtctttgtgtggagtggganaacttacaaactggagccatcaacccgcacttggc

SEQ ID NO: 30070 - DNA, 71 bp, chicken (Gallus Gallus)
  misc_feature (36): n=c or t
taacaaaaaccttttgcacgcattggcctgcaggcncataatttgcatctcaggacacctctcacatttga

SEQ ID NO: 30071 - DNA, 71 bp, chicken (Gallus Gallus)
  misc_feature (36): n=c or t
gggaaagaaatccactttacatttcatttcttccantgttcaaggtaaaaattggacgtatcagctgagaa

SEQ ID NO: 30072 - DNA, 71 bp, chicken (Gallus Gallus)
  misc_feature (36): n=a or g
actaaaatagacacttttcaagcaaacatgctgatnatgggtatgcaccaataaagatttcaatgaaatgt

SEQ ID NO: 30073 - DNA, 71 bp, chicken (Gallus Gallus)
  misc_feature (36): n=c or t
gtagaggcacaaataaatcccaaagaaaatgaatcntcactcagaatcctttcttcggtgctcactcaatt

SEQ ID NO: 30074 - DNA, 71 bp, chicken (Gallus Gallus)
  misc_feature (36): n=c or t
acacgattctgtcaggttgctcacagaagttcctgnataaggactagaataactgggctgaataaatctaa

SEQ ID NO: 30075 - DNA, 71 bp, chicken (Gallus Gallus)
  misc_feature (36): n=a or g
catctaaagggcatttatggcagaggaaggactcancattttcctgtcatttgtgctccacacagacctct

SEQ ID NO: 30076 - DNA, 71 bp, chicken (Gallus Gallus)
  misc_feature (36): n=g or t
attattttaaatacaatagcaggaatgctccatttnacagggctgaggtcagaggaagggctgtggggcca

SEQ ID NO: 30077 - DNA, 71 bp, chicken (Gallus Gallus)
  misc_feature (36): n=c or t
accaagcatgcagaccactataaagtctacaatctntgcagtaagtatgtttagttgctgactattgaaag

SEQ ID NO: 30078 - DNA, 71 bp, chicken (Gallus Gallus)
  misc_feature (36): n=a or g
gtagttgctctgtgactactgtattgtgcagagaanatcccttgtctcactgaagcgtgctcagagcagtg

SEQ ID NO: 30079 - DNA, 71 bp, chicken (Gallus Gallus)
  misc_feature (36): n=a or g
tttcctggcacttctttttgtgatcttgctgaagancacctctgagattcctctcccctgtgtcacttact

SEQ ID NO: 30080 - DNA, 71 bp, chicken (Gallus Gallus)
  misc_feature (36): n=a or g
gattttcaaattcagttaaataattagtaacagacnaaaattcagataataatttttttattgaagatgca

SEQ ID NO: 30081 - DNA, 71 bp, chicken (Gallus Gallus)
  misc_feature (36): n=c or t
tggcctaatgacttggagtagcatcagaagtggggntcatctgcacagttgtttttagcatgttatctatt

SEQ ID NO: 30082 - DNA, 71 bp, chicken (Gallus Gallus)
  misc_feature (36): n=a or g
agctcttcattgtttagctgatggtatttctggatngaaagaacctgcacctttattatcaatgatgagac

SEQ ID NO: 30083 - DNA, 71 bp, chicken (Gallus Gallus)
  misc_feature (36): n=a or g
cggggtgaaggcctagcctcacagagctcagtgacnctgttatcactgaccagcagacccaatttcccact

SEQ ID NO: 30084 - DNA, 71 bp, chicken (Gallus Gallus)
  misc_feature (36): n=a or g
ttgacaaatgatctttataatattctgcatctgtanaatgccccacattttcatggttgagatcctttggt

SEQ ID NO: 30085 - DNA, 71 bp, chicken (Gallus Gallus)
  misc_feature (36): n=a or g
tcaggaaaatatttgtcttaggtctctgcaaatgantgacttggaattcagtgacattgtcctcttcaaag

SEQ ID NO: 30086 - DNA, 71 bp, chicken (Gallus Gallus)
  misc_feature (36): n=c or t
ttttttttttttcttacagatttggagttctaaaanagattaaatccaacattcacatttacaaaagaatt

SEQ ID NO: 30087 - DNA, 71 bp, chicken (Gallus Gallus)
  misc_feature (36): n=c or t
tcacgtaggctgtaaccaactcaagttgggggcttnagggaaaatgttagcgtacaaggttggatatgagg

SEQ ID NO: 30088 - DNA, 71 bp, chicken (Gallus Gallus)
  misc_feature (36): n=c or t
tgaaatgcatagcactattgctagtctactattgcngctttaatctatgaaacttcaagctttaattttag

SEQ ID NO: 30089 - DNA, 71 bp, chicken (Gallus Gallus)
  misc_feature (36): n=c or t
tctttctttcctgtctcctgatacagggaatcctgnatagctcagctcaggcaaataaccctctggcacac

SEQ ID NO: 30090 - DNA, 71 bp, chicken (Gallus Gallus)
  misc_feature (36): n=a or g
gttgtggccctgattagagagtgaactcatgaaccnaaggttgaaaattatcatacctaaccagaacaagc

SEQ ID NO: 30091 - DNA, 71 bp, chicken (Gallus Gallus)
  misc_feature (36): n=c or t
tcctggtggaagagaggttgtaataaaagcctttgngagcccaggtaagataaggctcaggtgcaaatatg

SEQ ID NO: 30092 - DNA, 71 bp, chicken (Gallus Gallus)
  misc_feature (36): n=a or g
agctgtgtttttcaaggaagaccagtgccacccctnctattagggttgtgcttgtaaaaagctgtcatatc

SEQ ID NO: 30093 - DNA, 71 bp, chicken (Gallus Gallus)
  misc_feature (36): n=g or t
gggtcagcattaaatgttttcagaggttttcttgtncttccctatgtacattgctgcttactggtttaacc

SEQ ID NO: 30094 - DNA, 71 bp, chicken (Gallus Gallus)
  misc_feature (36): n=a or g
tggttcctcaacgcctggataagaaaagcactcagnctctgcaaagtaccacttcagatggggctaatgct

SEQ ID NO: 30095 - DNA, 71 bp, chicken (Gallus Gallus)
  misc_feature (36): n=a or c
acaggcttatctacagggttgtagctttctcttgtnatccggtatggtgtggtgcttttgggagatgctca

SEQ ID NO: 30096 - DNA, 71 bp, chicken (Gallus Gallus)
  misc_feature (36): n=g or t
tttagactgtagtggtaccagctttgttgcagtcangtagaatgctactgaaagccacgggacagatccct

SEQ ID NO: 30097 - DNA, 71 bp, chicken (Gallus Gallus)
  misc_feature (36): n=c or t
tcatggtgatgttatgtacaacatgtcctcctcatnctcaatggggcaaagggagcaaagtctgaaaagtt

SEQ ID NO: 30098 - DNA, 71 bp, chicken (Gallus Gallus)
  misc_feature (36): n=c or t
ccagaggttttgtttgaactcaggtgaaagaacagngcaagtacattgtgcctgacacaagagtagctgga

SEQ ID NO: 30099 - DNA, 71 bp, chicken (Gallus Gallus)
  misc_feature (36): n=a or g
ggcattgccagcctagtggaacagcccacgctttgnggacaggctaccctcctccaagggctgagcctaag

SEQ ID NO: 30100 - DNA, 71 bp, chicken (Gallus Gallus)
  misc_feature (36): n=c or t
caatctgttattcattcctccatctccatccacaanatacatctctccactctcctctacaaagatctctg

SEQ ID NO: 30101 - DNA, 71 bp, chicken (Gallus Gallus)
  misc_feature (36): n=c or t
ttaggccagcttatgtccaacttgtacatctgttgntctccatctcccttccaagaagagaagtaatcaaa

SEQ ID NO: 30102 - DNA, 71 bp, chicken (Gallus Gallus)
  misc_feature (36): n=c or t
atacatacatagttaacaaagcattttctccatggngagtgttgggaaacttattccccattattgaaaac

SEQ ID NO: 30103 - DNA, 71 bp, chicken (Gallus Gallus)
  misc_feature (36): n=g or t
gttttctaaaatttacactgtgtcatagttgcatangtgcactggtttaaagaattaagcaaggcaagatc

SEQ ID NO: 30104 - DNA, 71 bp, chicken (Gallus Gallus)
  misc_feature (36): n=a or g
aagaaaactaataaaaaattatgtagacctgaaagngatcttttcctagaaaaggagttgcagcacagaca

SEQ ID NO: 30105 - DNA, 71 bp, chicken (Gallus Gallus)
  misc_feature (36): n=a or g
taggtgcctgtgttaagttcctcaaattaagaaggnttaatgcaaaccatagagccaagtcaaggatcctt

SEQ ID NO: 30106 - DNA, 71 bp, chicken (Gallus Gallus)
  misc_feature (36): n=a or g
agttttagaacaggctacagctacacctcatgcagntggtagttcagcccatttcttagtctgcttctatg

SEQ ID NO: 30107 - DNA, 71 bp, chicken (Gallus Gallus)
  misc_feature (36): n=c or t
tgataatcctacaggggcttttgcagcattctctcnctatgatggttaaaggtcaacttacttgaaacctc

SEQ ID NO: 30108 - DNA, 71 bp, chicken (Gallus Gallus)
  misc_feature (36): n=a or c
actgtactatatagattgaataagcacataaaaaancaaaaccttttctagagaattttcattgtaggaga

SEQ ID NO: 30109 - DNA, 71 bp, chicken (Gallus Gallus)
  misc_feature (36): n=a or g
ttcggtgctgttcaggacaatgtgtgcaccaatacntttaggactgtatgaacaccctggaagaaaagact

SEQ ID NO: 30110 - DNA, 71 bp, chicken (Gallus Gallus)
  misc_feature (36): n=a or g
tttgaaacagtgtgaggttcatttgatgaagtggtnccctaaagaaggagtgtttagatgagtgatgggag

SEQ ID NO: 30111 - DNA, 71 bp, chicken (Gallus Gallus)
  misc_feature (36): n=a or c
tggcatgtaatggtttctcctaccaatagtgaaagnggctacttacttctatacaagcacagatacatatt

SEQ ID NO: 30112 - DNA, 71 bp, chicken (Gallus Gallus)
  misc_feature (36): n=c or t
ccatttacaatcaatgttagcctcagcaataacttntgcacttgagcttaccctagatcagcattctattt

SEQ ID NO: 30113 - DNA, 71 bp, chicken (Gallus Gallus)
  misc_feature (36): n=c or t
agctaaaaaatccaaagcctttgtagaagaaacagntaaatgacttcttcctgccttgctacactagctca

SEQ ID NO: 30114 - DNA, 71 bp, chicken (Gallus Gallus)
  misc_feature (36): n=c or t
catgtttcctcacattcttgattatcatcccttggncaagaaatttggtgttcccctctgcttgttctaag

SEQ ID NO: 30115 - DNA, 71 bp, chicken (Gallus Gallus)
  misc_feature (36): n=c or t
ttttgtcctcccaagtgtgcttgcacacctcaactnctgttttaaaccatcatttcacagacttactaaaa

SEQ ID NO: 30116 - DNA, 71 bp, chicken (Gallus Gallus)
  misc_feature (36): n=a or c
ggacaggatcactcttctgttctatcatctaaactnaataaagctcttaggacaagagatgttatcttcag

SEQ ID NO: 30117 - DNA, 71 bp, chicken (Gallus Gallus)
  misc_feature (36): n=c or t
tgttcatgctttccaaaacaccaaggaaaagagttngactcacatcacagcatgtcttttacttttcagcc

SEQ ID NO: 30118 - DNA, 71 bp, chicken (Gallus Gallus)
  misc_feature (36): n=c or t
gtagtaatgcagcttaatctcacttgtgctgatagnagctgatgaattaatgtacaaggtgtgcaaacact

SEQ ID NO: 30119 - DNA, 71 bp, chicken (Gallus Gallus)
  misc_feature (36): n=a or g
cttaaaaataagaatgtgttatctctgctgcagggncacagaaatgtgcaacagataagtattttacttat

SEQ ID NO: 30120 - DNA, 71 bp, chicken (Gallus Gallus)
  misc_feature (36): n=c or t
agttgaatgccaacttaagaggggaaaaaaatcacngctccttaaaatttaaaatctgctggaaatattct

SEQ ID NO: 30121 - DNA, 71 bp, chicken (Gallus Gallus)
  misc_feature (36): n=g or t
ctatgtgcattactaggatgcgtacaagatgtatanagatcaatatatatgatcgatcagtaagctcaaga

SEQ ID NO: 30122 - DNA, 71 bp, chicken (Gallus Gallus)
  misc_feature (36): n=a or g
aatctaaaatcagattatttccttctttctccccantggttggtgaagagaagtccagatgattatcttaa

SEQ ID NO: 30123 - DNA, 71 bp, chicken (Gallus Gallus)
  misc_feature (36): n=a or g
ttttctttgtgttaaagaccttctttcaaaagaagngacaagaaaattcattagtgttccaggatggttct

SEQ ID NO: 30124 - DNA, 71 bp, chicken (Gallus Gallus)
  misc_feature (36): n=a or c
cattcatgttcatgcagtcaaataattgatccttgnacaatttctgaattagtctattccctgcttaatgc

SEQ ID NO: 30125 - DNA, 71 bp, chicken (Gallus Gallus)
  misc_feature (36): n=a or g
aagtttttctctcatttcagacttcagtagtaaacntagacagatataaattctgatggttttataaatca

SEQ ID NO: 30126 - DNA, 71 bp, chicken (Gallus Gallus)
  misc_feature (36): n=a or g
tagagacacttgctctgactttcttagtctattganatgtcattctagtatggtttctgagattaaattct

SEQ ID NO: 30127 - DNA, 71 bp, chicken (Gallus Gallus)
  misc_feature (36): n=a or g
gataactgggtggctcccacactcctgaggcatacntacattttacttcatttgatctgtcttctactgat

SEQ ID NO: 30128 - DNA, 71 bp, chicken (Gallus Gallus)
  misc_feature (36): n=a or c
tggttcaaatatttgaacttcccctgtagaaaaatncacatttttctcagaattttgccagttaagaacat

SEQ ID NO: 30129 - DNA, 71 bp, chicken (Gallus Gallus)
  misc_feature (36): n=a or g
ggtgtttcttttgctttcatacaaaacaaataaganaaaagagttaagatttacagagcctcatttttttt

SEQ ID NO: 30130 - DNA, 71 bp, chicken (Gallus Gallus)
  misc_feature (36): n=a or g
gacggaccataagcagaagttaaatggcttagaganctaccacatttgcattttgagtctacagtggactg

SEQ ID NO: 30131 - DNA, 71 bp, chicken (Gallus Gallus)
  misc_feature (36): n=c or t
ctctatacagaaacactaggcagtgaaaaaataganatttctgcagcatggtttatctgtcatctttgatg

SEQ ID NO: 30132 - DNA, 71 bp, chicken (Gallus Gallus)
  misc_feature (36): n=a or g
cctcacagataactacatgtaaaccttcttagcatngcttggaagagtggagtaatgccaaaagccctaca

SEQ ID NO: 30133 - DNA, 71 bp, chicken (Gallus Gallus)
  misc_feature (36): n=a or c
atttttaaataaattgctgagactttaatctccttngcgtaatttaccttccctgatcacagcccttgtga

SEQ ID NO: 30134 - DNA, 71 bp, chicken (Gallus Gallus)
  misc_feature (36): n=a or g
cagtttgttctaccaacaaatacgtatgccattttnagagtgatacaataagcctaccaaagatacaacag

SEQ ID NO: 30135 - DNA, 71 bp, chicken (Gallus Gallus)
  misc_feature (36): n=c or t
aaaacaaacgctgcgggtgaagcacaaagcacttgnagaggtataaccacttctccacacgcaacgttccg

SEQ ID NO: 30136 - DNA, 71 bp, chicken (Gallus Gallus)
  misc_feature (36): n=c or t
ttcagcaagaagagggactatgaaatttatgcatcnattggtgtgatggctctacaaagaaaacataatct

SEQ ID NO: 30137 - DNA, 71 bp, chicken (Gallus Gallus)
  misc_feature (36): n=c or t
gtcagctctgatttttgttatatacccattccactngaaattgtctacaagcacccaggatgaacagagtc

SEQ ID NO: 30138 - DNA, 71 bp, chicken (Gallus Gallus)
  misc_feature (36): n=g or t
cctttttgatttcagcagcttagatgttcagtaaancaagaaatccaacgaaattaatgttttcattgtaa

SEQ ID NO: 30139 - DNA, 71 bp, chicken (Gallus Gallus)
  misc_feature (36): n=c or t
gagctcaaagctgggcacaaagtctttggaaagggngcatttctgtgcatccctccaggttcattattcca

SEQ ID NO: 30140 - DNA, 71 bp, chicken (Gallus Gallus)
  misc_feature (36): n=c or t
tgaactttgggggaagctcagaagccaggtgcaganctactcaggatatctcacaacgtgtgctaggacat

SEQ ID NO: 30141 - DNA, 71 bp, chicken (Gallus Gallus)
  misc_feature (36): n=c or t
tctctgcttgtttcaccatgtcttttcctccttaanatagtttgcaggtgtaccgcagcctggggaacttg

SEQ ID NO: 30142 - DNA, 71 bp, chicken (Gallus Gallus)
  misc_feature (36): n=a or g
acataatccagttaatacagaattcagttcagtagnacttaactcaaatttaggctgaatttggaatgtta

SEQ ID NO: 30143 - DNA, 71 bp, chicken (Gallus Gallus)
  misc_feature (36): n=c or t
acctgtgtgcgagcaaaggtccttttaatgaatctncagagtgctaaatagtatgtcattgtaagacagaa

SEQ ID NO: 30144 - DNA, 71 bp, chicken (Gallus Gallus)
  misc_feature (36): n=c or t
atttctaatgttactctgctgcacctggtataattntgtcctaagcaggttggtctgcatagcacagctga

SEQ ID NO: 30145 - DNA, 71 bp, chicken (Gallus Gallus)
  misc_feature (36): n=a or g
gtaggacaagaagtgtcctctgttgcagaatgaatntgacattacataaatctaaagaaacaagatatgac

SEQ ID NO: 30146 - DNA, 71 bp, chicken (Gallus Gallus)
  misc_feature (36): n=c or t
catgtgtttatctgaaacctcaactgtcaagagatnctgcaacttctctgtgggatctattccagtacctt

SEQ ID NO: 30147 - DNA, 71 bp, chicken (Gallus Gallus)
  misc_feature (36): n=c or t
caaatggagaaaagaatctaggcaccttttcactgnagtttggtggattctgaagcaaaatctatgtttgg

SEQ ID NO: 30148 - DNA, 71 bp, chicken (Gallus Gallus)
  misc_feature (36): n=c or t
caagtggctgaagtcctccagaactgcagagctccngtaaccaaccccatgtttgctctaccaaagcaccc

SEQ ID NO: 30149 - DNA, 71 bp, chicken (Gallus Gallus)
  misc_feature (36): n=a or g
cactacaagaagtagtacatgtagatggaggttagnataggggaaggactccatgggggctggcatccttc

SEQ ID NO: 30150 - DNA, 71 bp, chicken (Gallus Gallus)
  misc_feature (36): n=a or g
tctgactttagagagttggcagccattgcactgagnagtgataaacctattacacgctcagtagatatccc

SEQ ID NO: 30151 - DNA, 71 bp, chicken (Gallus Gallus)
  misc_feature (36): n=a or g
tgctatcaaacacacctgtctgtagccttctgctangaacctaaggagtaggaagagttgtggatgttctt

SEQ ID NO: 30152 - DNA, 71 bp, chicken (Gallus Gallus)
  misc_feature (36): n=a or g
ttctcttctgagcagaagaacagggcatgtctacanaacctgagatgagtgataacgcagatctctacgtc

SEQ ID NO: 30153 - DNA, 71 bp, chicken (Gallus Gallus)
  misc_feature (36): n=c or t
tggagtttgctacaaattcgtggcagtctgcacgantgctcattgtattctaaacacagattgaaatgaga

SEQ ID NO: 30154 - DNA, 71 bp, chicken (Gallus Gallus)
  misc_feature (36): n=a or g
tacactgagctgatgggtagaggggaatatatttgnattttcattttctatacgtttcaactctttacaag

SEQ ID NO: 30155 - DNA, 71 bp, chicken (Gallus Gallus)
  misc_feature (36): n=c or t
tttcttcatcttgtatattaagcagctgtaaagtcntataccttgacatcattttctgttgtcactaatgc

SEQ ID NO: 30156 - DNA, 71 bp, chicken (Gallus Gallus)
  misc_feature (36): n=c or t
agattacacaagacttatgatacgaggtgtgaccangaactctcaacaatatttccacttcaaaagtgagc

SEQ ID NO: 30157 - DNA, 71 bp, chicken (Gallus Gallus)
  misc_feature (36): n=g or t
ataaatcagtaaagttctttgtgaagttagagtctnccatatcagtttggcagacattctgattaagggat

SEQ ID NO: 30158 - DNA, 71 bp, chicken (Gallus Gallus)
  misc_feature (36): n=a or g
tttcttagttaagtttattctttctccccccctccnaagagtttttctagtaaaagccaatttacaatgga

SEQ ID NO: 30159 - DNA, 71 bp, chicken (Gallus Gallus)
  misc_feature (36): n=c or t
ggatactttttttaatcaatcaatccaatcaatcantggtatttatttttctagggacaaccctttaccaa

SEQ ID NO: 30160 - DNA, 71 bp, chicken (Gallus Gallus)
  misc_feature (36): n=c or t
gttaatcagcaccctgaatgataataaacaccttgntattaaatggattgctgatggttttagtatattac

SEQ ID NO: 30161 - DNA, 71 bp, chicken (Gallus Gallus)
  misc_feature (36): n=c or t
ctttcaaatctcaaaaccaaaagatttgttgcacanattaaaagggaagaaggaggaaaagattacaggga

SEQ ID NO: 30162 - DNA, 71 bp, chicken (Gallus Gallus)
  misc_feature (36): n=c or t
aaaacactagcagatgaagccagtccttgcacagangctgagatagaagaggtatataattgaaagcacgg

SEQ ID NO: 30163 - DNA, 71 bp, chicken (Gallus Gallus)
  misc_feature (36): n=c or t
tctcttgcttatgaccaaaagattggaaagaatgtntgctcaagtgactgacacatggcaatttaaggtct

SEQ ID NO: 30164 - DNA, 71 bp, chicken (Gallus Gallus)
  misc_feature (36): n=a or g
ttctgcaactgtttgtataaatatacactcttctgngatttaggtaagaccaaatattgttctgttttgat

SEQ ID NO: 30165 - DNA, 71 bp, chicken (Gallus Gallus)
  misc_feature (36): n=a or g
aaaaaatcaccaagaataaaaccacacattttaacnaggtaactctcctgtagccaagcaaaaaaataccc

SEQ ID NO: 30166 - DNA, 71 bp, chicken (Gallus Gallus)
  misc_feature (36): n=g or t
gagaaatgcatgaggcatgataacttccctcctacntccagcaatgtaacaagacaacatactaaaaaaat

SEQ ID NO: 30167 - DNA, 71 bp, chicken (Gallus Gallus)
  misc_feature (36): n=a or c
gactacggagctacattttaccagtgttctcgtttncagctatctatcaacgtgcaacaacgttttgcacc

SEQ ID NO: 30168 - DNA, 71 bp, chicken (Gallus Gallus)
  misc_feature (36): n=a or g
tgaagcactccgtgtttccactcctactatagtcantctgggctcctgtgctcttccatgcagctcccaga

SEQ ID NO: 30169 - DNA, 71 bp, chicken (Gallus Gallus)
  misc_feature (36): n=c or t
gatgactgtgtgagcctctaggttcctgtaacaatnagcagtctaggctctttctcagttgcgttgctctg

SEQ ID NO: 30170 - DNA, 71 bp, chicken (Gallus Gallus)
  misc_feature (36): n=a or g
tgagcaagaggagttccagtgatgctggaaagggancagatgaaagcaagataaatatgtccctaaaagca

SEQ ID NO: 30171 - DNA, 71 bp, chicken (Gallus Gallus)
  misc_feature (36): n=a or g
taaagaaggaatcacttacaccttaccaaggatcanggctcacagaatacaccaaaggtggctgccagact

SEQ ID NO: 30172 - DNA, 71 bp, chicken (Gallus Gallus)
  misc_feature (36): n=c or t
tctctcacttgttcgccgtcctgtcctttatatgcnatgttgtgtcctgttttcacattgctccctctttc

SEQ ID NO: 30173 - DNA, 71 bp, chicken (Gallus Gallus)
  misc_feature (36): n=g or t
cctagcgtaaccatttatcactaattgtctctcccnagtggaaagaaaacttaagaaaatttgagctcatg

SEQ ID NO: 30174 - DNA, 71 bp, chicken (Gallus Gallus)
  misc_feature (36): n=a or g
ctgctttgttctcagaatactggtaagacaaaaganaacgttttctccagaagtgcagagtagcacttagc

SEQ ID NO: 30175 - DNA, 71 bp, chicken (Gallus Gallus)
  misc_feature (36): n=a or g
tataaacttgtgcttggtgctgtagtatgctttggnggcttcattcatccccatgttggtgaacattggcc

SEQ ID NO: 30176 - DNA, 71 bp, chicken (Gallus Gallus)
  misc_feature (36): n=g or t
gaactaatctccactgagggcaactcccatgacagnagcaatattcagttacgtaagcaacctagtatttt

SEQ ID NO: 30177 - DNA, 71 bp, chicken (Gallus Gallus)
  misc_feature (36): n=c or t
gtcagcaaatgttattgtaggagttggtaggagtgnggtattcataccaagtgtgccaatccctataaaag

SEQ ID NO: 30178 - DNA, 71 bp, chicken (Gallus Gallus)
  misc_feature (36): n=g or t
agtattcaaacatgtatgagtgttgtagcagtattnttcaaattactttgactgtccctgaatgtgtagca

SEQ ID NO: 30179 - DNA, 71 bp, chicken (Gallus Gallus)
  misc_feature (36): n=c or t
cgctcagcaaatgtgtgtcgtcacattatttatttntgctgtgtagaaatggggctgttggagaaatggct

SEQ ID NO: 30180 - DNA, 71 bp, chicken (Gallus Gallus)
  misc_feature (36): n=c or t
agcatggaaaaaattgagtgaatgtgttctctgtangtagtttcatcaaagtcatttctccttcagtgtag

SEQ ID NO: 30181 - DNA, 71 bp, chicken (Gallus Gallus)
  misc_feature (36): n=a or g
tgcattgtgtaaggaaaaaggcatttattaaatggnagcattaagaaaaagcagaaagaaattaatcctac

SEQ ID NO: 30182 - DNA, 71 bp, chicken (Gallus Gallus)
  misc_feature (36): n=a or c
cagtgcggttgtagggatctgaaactgtttgtgaanttggtgtttcagaagggccaggaggccaaaggact

SEQ ID NO: 30183 - DNA, 71 bp, chicken (Gallus Gallus)
  misc_feature (36): n=c or t
cttattttcctatttccccaaattgcagtcacagtntaggagtgtggtttgaactcaaatgctggactgtc

SEQ ID NO: 30184 - DNA, 71 bp, chicken (Gallus Gallus)
  misc_feature (36): n=g or t
gaacatcttttcattagaagcctcccagagggctanccatttttggtcttgatcaaatgtgtttgattctt

SEQ ID NO: 30185 - DNA, 71 bp, chicken (Gallus Gallus)
  misc_feature (36): n=g or t
catctgaaattctttactaggaggaatatgatgttnacagtggagattttgttctcctcactaatggatca

SEQ ID NO: 30186 - DNA, 71 bp, chicken (Gallus Gallus)
  misc_feature (36): n=a or g
ccctctgcagcctctacttttagactggggttttcngtggaatttgggggaagcagagagcaggaagggga

SEQ ID NO: 30187 - DNA, 71 bp, chicken (Gallus Gallus)
  misc_feature (36): n=a or g
ggaaggaacaagactggtctttttcagctgaagctnaagcacctagaaatggccattttttttacccttag

SEQ ID NO: 30188 - DNA, 71 bp, chicken (Gallus Gallus)
  misc_feature (36): n=c or t
agtcgtttaggtggcgatcatccaccacagcaaggntctcaatacgttacacaggacaactaataaatggt

SEQ ID NO: 30189 - DNA, 71 bp, chicken (Gallus Gallus)
  misc_feature (36): n=c or t
tttgtctgtgtagttctgccacaggcctcttcctcnttccagtacagaacaattcataacagctcatcgtc

SEQ ID NO: 30190 - DNA, 71 bp, chicken (Gallus Gallus)
  misc_feature (36): n=a or g
ggttcttgtgccagcttcacaatagcactacctgcngccaacctcaatcgagacatatcaggtttactgaa

SEQ ID NO: 30191 - DNA, 71 bp, chicken (Gallus Gallus)
  misc_feature (36): n=g or t
gctttcctcctacagagatcttgaattaccggctgngtttgatatggaggagaaaccaatggctgtggtca

SEQ ID NO: 30192 - DNA, 71 bp, chicken (Gallus Gallus)
  misc_feature (36): n=a or c
agagctttgatctacaggcactatcttcaaaaggcnaaaggacgctcttattctatgtaaatgattaactt

SEQ ID NO: 30193 - DNA, 71 bp, chicken (Gallus Gallus)
  misc_feature (36): n=c or t
cattagtacctaaagctaacggacacatctaatcangtcttgatttctttttgtaagcttttcaatttctg

SEQ ID NO: 30194 - DNA, 71 bp, chicken (Gallus Gallus)
  misc_feature (36): n=c or t
tgcattttattccctttcacttttctccactttccnattagtcagtttttaattctcaggtctggcagtcc

SEQ ID NO: 30195 - DNA, 71 bp, chicken (Gallus Gallus)
  misc_feature (36): n=c or t
ctttgttttttatgacacaccttgtgtttattcctnctctttgttgggagtgagttttggcaacccttacg

SEQ ID NO: 30196 - DNA, 71 bp, chicken (Gallus Gallus)
  misc_feature (36): n=a or g
ttctgagtttacgaagaatcctcctttcagaaaagncaatgtaactcttgccctcttatacaggtcactag

SEQ ID NO: 30197 - DNA, 71 bp, chicken (Gallus Gallus)
  misc_feature (36): n=c or t
acggtatagcagggatggtgtttccattgattatgnaattaggagaaggaattttcagtgtggcagctctc

SEQ ID NO: 30198 - DNA, 71 bp, chicken (Gallus Gallus)
  misc_feature (36): n=a or g
atagaaaattaagttttctcacagggtaaattatcnttcccttttggattaacactatggcagcaaatcta

SEQ ID NO: 30199 - DNA, 71 bp, chicken (Gallus Gallus)
  misc_feature (36): n=c or t
aagccattgagtctttgcaattcatgacgttctatnactgtcagcactcatcattttgtcaggtatttcca

SEQ ID NO: 30200 - DNA, 71 bp, chicken (Gallus Gallus)
  misc_feature (36): n=g or t
ctatttctgccaaagatttccaaagtgaaaaggacngaaacagatgtttacttaaaaggtactgacatctg

SEQ ID NO: 30201 - DNA, 71 bp, chicken (Gallus Gallus)
  misc_feature (36): n=a or g
tgctcttctgccccaggagcagcctactctgggacntactcctgcttcactcacaagcaaacagagatggg

SEQ ID NO: 30202 - DNA, 71 bp, chicken (Gallus Gallus)
  misc_feature (36): n=a or g
gtgctagggctgacaatactactgcacaatcagtcnaatagcaaataaaagaccttcttcacattttgcag

SEQ ID NO: 30203 - DNA, 71 bp, chicken (Gallus Gallus)
  misc_feature (36): n=g or t
taatgaattatttaggtgcctggagtgcatgcttcnagaaggggcagctctgcatcaattagcagatgctt

SEQ ID NO: 30204 - DNA, 71 bp, chicken (Gallus Gallus)
  misc_feature (36): n=c or t
agtctatttaaaagcaaatgacaagggcaagtttgntctcctcataaatccctctaattgcttccaaagca

SEQ ID NO: 30205 - DNA, 71 bp, chicken (Gallus Gallus)
  misc_feature (36): n=g or t
acacccatgtccaatgtgagcagtgctgagtgctcngtgggcaggtgacaccatctcccagctcctgaggg

SEQ ID NO: 30206 - DNA, 71 bp, chicken (Gallus Gallus)
  misc_feature (36): n=c or t
ctagtctgtcctccccaggttctcctgtcccttcanttgctccccccgaatgtcttctggatagcagttca

SEQ ID NO: 30207 - DNA, 71 bp, chicken (Gallus Gallus)
  misc_feature (36): n=c or t
tgaaagtctgaagatggagtttaagtatttgcatgnggacaaatatttccactattgcttctcactaactt

SEQ ID NO: 30208 - DNA, 71 bp, chicken (Gallus Gallus)
  misc_feature (36): n=c or t
tagataaaggatgtatgaagatcttaaaattaaaanaacaacaaaaaaccgaccagaagagttctaatgta

SEQ ID NO: 30209 - DNA, 71 bp, chicken (Gallus Gallus)
  misc_feature (36): n=a or g
ttggttatttctcattccaagtgcagcgaaaggcanggctgctgatcagcgctcttttcaatattgtctgt

SEQ ID NO: 30210 - DNA, 71 bp, chicken (Gallus Gallus)
  misc_feature (36): n=c or t
tcttagggatattttgtaatctaagcttgaaaagcntgataattcttagagctggctagtgaatttctgag

SEQ ID NO: 30211 - DNA, 71 bp, chicken (Gallus Gallus)
  misc_feature (36): n=c or t
ccactcaaatgatgttcaaagagcacagtctgaggngatgcctggccttggcaaaaccaaagctgatgaaa

SEQ ID NO: 30212 - DNA, 71 bp, chicken (Gallus Gallus)
  misc_feature (36): n=c or t
caaggtcctgctgtctgttggtcttcagcctgcccnggtgctggttctcatctgtggttaggaaaggggct

SEQ ID NO: 30213 - DNA, 71 bp, chicken (Gallus Gallus)
  misc_feature (36): n=a or g
accatgaaacatagtagcatattgaccatggtttgnaggtcaggcccattaagcattctcagactgagaac

SEQ ID NO: 30214 - DNA, 71 bp, chicken (Gallus Gallus)
  misc_feature (36): n=g or t
tcaaagaagcctactaatggtttaaagatcattctncaatctctaggtacatacctcaccatcctagggga

SEQ ID NO: 30215 - DNA, 71 bp, chicken (Gallus Gallus)
  misc_feature (36): n=c or t
agagcataaaggtccttcaaattactgtttgatagngtgggctgactattaacatccagcactgccaccgg

SEQ ID NO: 30216 - DNA, 71 bp, chicken (Gallus Gallus)
  misc_feature (36): n=a or g
aagccagaaggaagaggacacaatgagttgctaacngtaatatattgttgaggtctttggcttgctaggac

SEQ ID NO: 30217 - DNA, 71 bp, chicken (Gallus Gallus)
  misc_feature (36): n=c or t
ttggcttttctaatctgacatgctgtgacaaagacnactgtgtcatactgacaccatagagataactcaag

SEQ ID NO: 30218 - DNA, 71 bp, chicken (Gallus Gallus)
  misc_feature (36): n=a or g
tatttgatgaagtgattatccttttccctacttaanctctctttgggtgttaacaggagaagagcaaatac

SEQ ID NO: 30219 - DNA, 71 bp, chicken (Gallus Gallus)
  misc_feature (36): n=a or g
tcatgtgctgacagccccttctgacactttcttatnatctcactttgcaagacacctccagcaatggagaa

SEQ ID NO: 30220 - DNA, 71 bp, chicken (Gallus Gallus)
  misc_feature (36): n=a or g
aagattttcaatacagatttttgaggttaatgaggnaaggaaagaagttgaggacaaagcagagaaaaaat

SEQ ID NO: 30221 - DNA, 71 bp, chicken (Gallus Gallus)
  misc_feature (36): n=c or t
acagcacaacttcagtttctatcacaatatctgttnggagcaaaattccaggtaagacattcagcaatagt

SEQ ID NO: 30222 - DNA, 71 bp, chicken (Gallus Gallus)
  misc_feature (36): n=a or g
atgcttcaagaaatttctaatgctagggacagtaangtgagggctgcaggtggtgggcaggtgagtgttct

SEQ ID NO: 30223 - DNA, 71 bp, chicken (Gallus Gallus)
  misc_feature (36): n=c or t
agaaatcccaaatccaaagatgtcttttctgggagnttcttttgcttaatagtcagtgagaaacatcacag

SEQ ID NO: 30224 - DNA, 71 bp, chicken (Gallus Gallus)
  misc_feature (36): n=a or g
gaaggcctctgagatggtttggacttcagtctcagncacataggaatggcggagcttttagaatgtacacc

SEQ ID NO: 30225 - DNA, 71 bp, chicken (Gallus Gallus)
  misc_feature (36): n=a or g
aatgtgtttttgatggtattaataagaaatcttttntttgcaccagcaagaggacatttcaacctgtaaag

SEQ ID NO: 30226 - DNA, 71 bp, chicken (Gallus Gallus)
  misc_feature (36): n=a or g
tcctggctttgattatcactgcaaatctgccgtgcntgcccagtgagctcaccctgtacctgagctgctgt

SEQ ID NO: 30227 - DNA, 71 bp, chicken (Gallus Gallus)
  misc_feature (36): n=c or t
catagaagagtcataagagctttgttctttactgtncccaaaaaataaaggctattaaaaataaagaagag

SEQ ID NO: 30228 - DNA, 71 bp, chicken (Gallus Gallus)
  misc_feature (36): n=c or t
agattttcctcaaaccactcatcctatgtgatgtcnttgcagggctcctgcggtgggcagatgaataaaga

SEQ ID NO: 30229 - DNA, 71 bp, chicken (Gallus Gallus)
  misc_feature (36): n=c or t
gattctcagaacacttccttgcctcttccccatgcntattggaagaattctcaggtggttgattctcacct

SEQ ID NO: 30230 - DNA, 71 bp, chicken (Gallus Gallus)
  misc_feature (36): n=a or g
gtttaaatgtctttgcagtagaagtagaacctggcnttttaccctcatccatgcattaagctgcaatccaa

SEQ ID NO: 30231 - DNA, 71 bp, chicken (Gallus Gallus)
  misc_feature (36): n=c or t
attctgtctccaccatactttgttccccagagtttngccttttggaagattttttaatgtagtggaagagt

SEQ ID NO: 30232 - DNA, 71 bp, chicken (Gallus Gallus)
  misc_feature (36): n=a or c
aaaaatgtttctcagtggacttgctcttctacctanaaattatcctagaattgcaatatcttaaatgtcag

SEQ ID NO: 30233 - DNA, 71 bp, chicken (Gallus Gallus)
  misc_feature (36): n=a or g
tttcacaggggagcatcctgcttaaaagagaataangaaagtggatgaaatacagcacatccagactccaa

SEQ ID NO: 30234 - DNA, 71 bp, chicken (Gallus Gallus)
  misc_feature (36): n=c or t
tgttttgctaccttgttaatcctacttggctcattntgtaggattagctccagagctgccagcagtttggg

SEQ ID NO: 30235 - DNA, 71 bp, chicken (Gallus Gallus)
  misc_feature (36): n=c or t
attgatccagaagttcacttgaaataacaggaacangaaccgtatgtcttggaagttgatgaagtaatcct

SEQ ID NO: 30236 - DNA, 71 bp, chicken (Gallus Gallus)
  misc_feature (36): n=c or t
ggaacttgataaagaacttaaaccctctagtaccangctattaggatggctgaggatatatttacatcaca

SEQ ID NO: 30237 - DNA, 71 bp, chicken (Gallus Gallus)
  misc_feature (36): n=c or t
gtaacagtagggaaacaccagaagaaaatcaaatgnatagatctgaacaaggtgagatggattttagttga

SEQ ID NO: 30238 - DNA, 71 bp, chicken (Gallus Gallus)
  misc_feature (36): n=c or t
aaacaaacaacaaatttcagaattcaatgaaacagnctcctcactcccagcagaaggtacactttgtactt

SEQ ID NO: 30239 - DNA, 71 bp, chicken (Gallus Gallus)
  misc_feature (36): n=a or g
gccatacagtttcatatgggagacataaatcatccnaattactcctatggacaagcgtataccaaattcag

SEQ ID NO: 30240 - DNA, 71 bp, chicken (Gallus Gallus)
  misc_feature (36): n=a or g
taagtattatcctaattctcatttggacttatcccntagtttggctactaaaacagtagaggggtgactta

SEQ ID NO: 30241 - DNA, 71 bp, chicken (Gallus Gallus)
  misc_feature (36): n=a or g
tatactcgagtgttattcctattggtaggcatagcnctactcatatttgtcagctcttaacaaaattattg

SEQ ID NO: 30242 - DNA, 71 bp, chicken (Gallus Gallus)
  misc_feature (36): n=c or t
tgtgaagtaaacctaagtacctttgaatttggtcanctgtcagttattcctaaaagttacggcacagcttt

SEQ ID NO: 30243 - DNA, 71 bp, chicken (Gallus Gallus)
  misc_feature (36): n=a or g
tgggaaagagccagacagggctgatgtggctttgantgtcagatatgggtaagaagtgagttcccactaaa

SEQ ID NO: 30244 - DNA, 71 bp, chicken (Gallus Gallus)
  misc_feature (36): n=c or t
tttctgagtccagcaaagctcatcactaggaagctngctttcaaaagatgggatttggtgcctgttgttaa

SEQ ID NO: 30245 - DNA, 71 bp, chicken (Gallus Gallus)
  misc_feature (36): n=c or t
tcacagcaattgacttcagtctgtaaatggtaatanaaatgaggctccatttttccaacgacagcttggtg

SEQ ID NO: 30246 - DNA, 71 bp, chicken (Gallus Gallus)
  misc_feature (36): n=c or t
ctcaaatgtgcaaagaccttcattcttattcttatnattatcttagtttctgaatctctgataaagctgaa

SEQ ID NO: 30247 - DNA, 71 bp, chicken (Gallus Gallus)
  misc_feature (36): n=a or g
tgtatgccacgctccaagcctgtatctccaataacnaccacatgctcactgaaaacaccctcaagcacagt

SEQ ID NO: 30248 - DNA, 71 bp, chicken (Gallus Gallus)
  misc_feature (36): n=c or t
gcatatatccttccacttctctgttgtgctcaattnatcaaatctagaaaggaaacatgtcacacatgtgg

SEQ ID NO: 30249 - DNA, 71 bp, chicken (Gallus Gallus)
  misc_feature (36): n=c or t
gcttgagtaatggtgacgccccactcttcacatcancattgttctatgggttctgaggttccgcagtgcat

SEQ ID NO: 30250 - DNA, 71 bp, chicken (Gallus Gallus)
  misc_feature (36): n=c or t
gctggcagatgtgggtttttggcttttttctttttncatcaagtagacttgtaaaccttatgtacaagata

SEQ ID NO: 30251 - DNA, 71 bp, chicken (Gallus Gallus)
  misc_feature (36): n=g or t
tcaagagccagaattctctctctgatccaaagaaanaaggtgttatttattaagtccttaacatgacccgc

SEQ ID NO: 30252 - DNA, 71 bp, chicken (Gallus Gallus)
  misc_feature (36): n=a or g
gaaatgcctcattttggttaataccgtgttctgagngagagatggttctttgtatttgttggtcctttgag

SEQ ID NO: 30253 - DNA, 71 bp, chicken (Gallus Gallus)
  misc_feature (36): n=c or t
cagtttctattttcatgaggattacagtagtctacntagacagctgaacagagggaatggcagatttatct

SEQ ID NO: 30254 - DNA, 71 bp, chicken (Gallus Gallus)
  misc_feature (36): n=c or t
agagtaagagtaaaatatacttgaaagtaaacagangacaatttttggataccaaaaacacataacttttg

SEQ ID NO: 30255 - DNA, 71 bp, chicken (Gallus Gallus)
  misc_feature (36): n=a or g
ttcaatctactctgaaagccacatcattcagcagcntcttatgaggaaaggagcacatatttgagttttta

SEQ ID NO: 30256 - DNA, 71 bp, chicken (Gallus Gallus)
  misc_feature (36): n=c or t
tcctagattattaaactaaccattagtccatgccanatgcctacattcattcacaatgtcatacatggcca

SEQ ID NO: 30257 - DNA, 71 bp, chicken (Gallus Gallus)
  misc_feature (36): n=c or t
ttggttagtgaatcttagtaataagcaaatcagcangtatgttgccaaattaaaatagaaagctatcaaca

SEQ ID NO: 30258 - DNA, 71 bp, chicken (Gallus Gallus)
  misc_feature (36): n=a or g
gaagctatttttcttccccatgcacttcttaacacngtctgtaagtgaaaaggatcagcaagaaggtagag

SEQ ID NO: 30259 - DNA, 71 bp, chicken (Gallus Gallus)
  misc_feature (36): n=a or g
ctcttttctttgagtgccagctgtcctaggatttangtaactaaactatttgattgataacaaataacagc

SEQ ID NO: 30260 - DNA, 71 bp, chicken (Gallus Gallus)
  misc_feature (36): n=a or g
aactgcataattcccaatgtcacagttgttccttcnctatgattttatacaaacagatcacaatataatgt

SEQ ID NO: 30261 - DNA, 71 bp, chicken (Gallus Gallus)
  misc_feature (36): n=a or g
acaaaaaagaaatcatatctcattgacgcaagactnagtaatcacaaaccagataagaatattaatttgtt

SEQ ID NO: 30262 - DNA, 71 bp, chicken (Gallus Gallus)
  misc_feature (36): n=c or t
ggtcaacattcaccattacgttaaaaatatatgctntcataatttggtaattacaggaacaaatgtaaagt

SEQ ID NO: 30263 - DNA, 71 bp, chicken (Gallus Gallus)
  misc_feature (36): n=a or c
aaaagacaacccttttccaaaactttttatttccancagctctgatgtggaacctgtccctgcttcaaaag

SEQ ID NO: 30264 - DNA, 71 bp, chicken (Gallus Gallus)
  misc_feature (36): n=a or g
tttcacaaccctaaaccccaggagcgcacgaaagcnatagaaatgccccagtaaataactcagtccctcag

SEQ ID NO: 30265 - DNA, 71 bp, chicken (Gallus Gallus)
  misc_feature (36): n=a or g
agctccttgcccctgactgacagaaaccacaactcngggcaaattgccagtctgcaaagcattgcagcaca

SEQ ID NO: 30266 - DNA, 71 bp, chicken (Gallus Gallus)
  misc_feature (36): n=c or t
acagagaatgagtgagaattgctagctatcaccccnggaaaatttgaattttctgctacataaggacatgc

SEQ ID NO: 30267 - DNA, 71 bp, chicken (Gallus Gallus)
  misc_feature (36): n=c or t
agtcatctgattcttaaacagcatcaaaatccaaanaaactgatctttaaattgaacttgtaactccttta

SEQ ID NO: 30268 - DNA, 71 bp, chicken (Gallus Gallus)
  misc_feature (36): n=c or t
atgtggagtctgtattaaaaccattattggtttcantgaatgttgatctgagaaagcattcagatagcctg

SEQ ID NO: 30269 - DNA, 71 bp, chicken (Gallus Gallus)
  misc_feature (36): n=a or g
tcccctaaaattccactggtccaggttccacagtcngtactgacactttttcaacagcttctcctcaaata

SEQ ID NO: 30270 - DNA, 71 bp, chicken (Gallus Gallus)
  misc_feature (36): n=g or t
ttagatatctgaaattaacacgtacaaaagtgaacncatgtctctgagttcagattggtgaaggacagcaa

SEQ ID NO: 30271 - DNA, 71 bp, chicken (Gallus Gallus)
  misc_feature (36): n=a or g
gtgttgaaagctttaggaacttcagtcaaaatgagnctgacaacaagctgtccgcttctctgccctgcaca

SEQ ID NO: 30272 - DNA, 71 bp, chicken (Gallus Gallus)
  misc_feature (36): n=a or g
aacttcatacaacagctgagagctgaggtgcagtcnatccctgtctacaatacctctgcttagggttgctg

SEQ ID NO: 30273 - DNA, 71 bp, chicken (Gallus Gallus)
  misc_feature (36): n=a or g
tacactgagtaagagctgactgccagttactgtccnttactggatctctcacataactagctaacgtcctt

SEQ ID NO: 30274 - DNA, 71 bp, chicken (Gallus Gallus)
  misc_feature (36): n=a or g
gaaggcgtgcatgaattggtgaaaccactacaaatntgcaccagttgttgctcacagaagcaagatcatac

SEQ ID NO: 30275 - DNA, 71 bp, chicken (Gallus Gallus)
  misc_feature (36): n=c or t
atttattgttcacataagaacttctagcaattccancctgtctctcctctatgaaattctgactgaaataa

SEQ ID NO: 30276 - DNA, 71 bp, chicken (Gallus Gallus)
  misc_feature (36): n=c or t
tttgtctgcatatgaggtttacagtacgtggctttngtcattgtcaaaggcttgcacagaacagccttgtt

SEQ ID NO: 30277 - DNA, 71 bp, chicken (Gallus Gallus)
  misc_feature (36): n=c or t
ggtccttaaaactaagtgaaaaaaaataaacgcttnatggatgcttaggaatccaaaataattcaatctaa

SEQ ID NO: 30278 - DNA, 71 bp, chicken (Gallus Gallus)
  misc_feature (36): n=a or g
tagaatctcataacagaaagtttcacagaacaactnaaaaactgtcaccagccatttcaagaaaggcatga

SEQ ID NO: 30279 - DNA, 71 bp, chicken (Gallus Gallus)
  misc_feature (36): n=c or t
aggcgtatgcaaaaaggtgcttttgcaaaactatgncaaaggcataagacagtgacttttttctacatctt

SEQ ID NO: 30280 - DNA, 71 bp, chicken (Gallus Gallus)
  misc_feature (36): n=g or t
tgacaagaattcttaattgagagtttgagataaaanagaatacagatccaaattctgagaaatagattgaa

SEQ ID NO: 30281 - DNA, 71 bp, chicken (Gallus Gallus)
  misc_feature (36): n=c or t
caccctgcacaaaagcctgaataaatgggttttaangttaatctgaagaatcactattcatttgctgatcg

SEQ ID NO: 30282 - DNA, 71 bp, chicken (Gallus Gallus)
  misc_feature (36): n=c or t
atgaatagatttggtttctgcgtgcttccagctccncatgtagctattagatctgaggggggaagagaact

SEQ ID NO: 30283 - DNA, 71 bp, chicken (Gallus Gallus)
  misc_feature (36): n=a or g
ggaatgttaagggtctgttggctgtgtgcatgaggntgcagcatgagtagggttgtctccttgacagagcc

SEQ ID NO: 30284 - DNA, 71 bp, chicken (Gallus Gallus)
  misc_feature (36): n=a or g
gcctggctgccagaaaaaaaatcaatttgtatgcantgaccacctcgtatctcctaaattcacaaaagttc

SEQ ID NO: 30285 - DNA, 71 bp, chicken (Gallus Gallus)
  misc_feature (36): n=a or c
ggacatggagttccagaaacaagatagcaactactnagaaatgctgtggaaaacattactcacgtaataac

SEQ ID NO: 30286 - DNA, 71 bp, chicken (Gallus Gallus)
  misc_feature (36): n=c or t
tacaaaggcgccttctcccgggctcccccaaaccancatgacaaaatcaccgtctgcaagagccccgcgcc

SEQ ID NO: 30287 - DNA, 71 bp, chicken (Gallus Gallus)
  misc_feature (36): n=a or g
agcaagaactgtgtcagagttgttccaggagaagcntacttggtggttctgaagagatcctaaagcagagt

SEQ ID NO: 30288 - DNA, 71 bp, chicken (Gallus Gallus)
  misc_feature (36): n=c or t
aggagcattaatcaggcttaaaattcaaaaagaaanatgttttctagaatcagcccaaaatacatacactg

SEQ ID NO: 30289 - DNA, 71 bp, chicken (Gallus Gallus)
  misc_feature (36): n=a or g
cagaatgttttctcttgcccatcccaagagcctcanattacaaaggacttcatttcctttcccaccattga

SEQ ID NO: 30290 - DNA, 71 bp, chicken (Gallus Gallus)
  misc_feature (36): n=c or t
cctagatccaggatatgtcaaataacagaaaagccnaaatgttaaatatcttttgtaagaattagtgtctt

SEQ ID NO: 30291 - DNA, 71 bp, chicken (Gallus Gallus)
  misc_feature (36): n=c or t
ttgcaaattaattttaggtatgtgtagaagggtttntgtgagtcagagcctttgtatactgactaatgtaa

SEQ ID NO: 30292 - DNA, 71 bp, chicken (Gallus Gallus)
  misc_feature (36): n=g or t
tctcgttacatgttctctgactgagttatttgtggncctaaccaagctattaagttagtgccatatttgga

SEQ ID NO: 30293 - DNA, 71 bp, chicken (Gallus Gallus)
  misc_feature (36): n=a or g
aacactttgtacactgcattatcaaagttctcagtnagctgatctgggcatcttcatttagttttttgctt

SEQ ID NO: 30294 - DNA, 71 bp, chicken (Gallus Gallus)
  misc_feature (36): n=a or g
acagacagaagccagcagcagttcatgttgaaaatnaaggtccacctgagcagacagcactatttatcctg

SEQ ID NO: 30295 - DNA, 71 bp, chicken (Gallus Gallus)
  misc_feature (36): n=a or g
aaaatgttttctccagaaaatctcatctaccaaggnaaaattaaatgtctccctttgttgcaagcatttat

SEQ ID NO: 30296 - DNA, 71 bp, chicken (Gallus Gallus)
  misc_feature (36): n=g or t
tggtacctccttctgccaactcataggcaactgtangaagaaaggtcaggtcttgaactgctgaatctgta

SEQ ID NO: 30297 - DNA, 71 bp, chicken (Gallus Gallus)
  misc_feature (36): n=c or t
cctgtgtgcaggaagtctacttgctcattgcttccncattgcactttgccatggtgttagaaaaatctgta

SEQ ID NO: 30298 - DNA, 71 bp, chicken (Gallus Gallus)
  misc_feature (36): n=a or g
aaagagcatgttggacacagcttggtgtacatgaantagacttccaaggttatttgtgaattttactctaa

SEQ ID NO: 30299 - DNA, 71 bp, chicken (Gallus Gallus)
  misc_feature (36): n=c or t
gagagcagagccagcacacagcttggttccttgtgncccgatgagcccacctatgagtgggcagctcgctc

SEQ ID NO: 30300 - DNA, 71 bp, chicken (Gallus Gallus)
  misc_feature (36): n=c or t
tattaattcacagtgactactacattttcacaattntttctgactcacagaatttgggtttaacccaagtg

SEQ ID NO: 30301 - DNA, 71 bp, chicken (Gallus Gallus)
  misc_feature (36): n=a or c
cacaacgaatgtgctatgtgacagtgctaacacagntccctctgctttcacccccaagctgacaggagaaa

SEQ ID NO: 30302 - DNA, 71 bp, chicken (Gallus Gallus)
  misc_feature (36): n=a or g
aaggtgactagagggacagaacaaagaaagttcatncctaaacactgaatattgctcaatatgtcagggca

SEQ ID NO: 30303 - DNA, 71 bp, chicken (Gallus Gallus)
  misc_feature (36): n=g or t
caagcagaagaaagactgcatcagacctctggcttntctttaggcaccatctccttgttgacagtcattat

SEQ ID NO: 30304 - DNA, 71 bp, chicken (Gallus Gallus)
  misc_feature (36): n=c or t
catagtttatttaaaatagcattaagaagtttgatnagccccttatactctagagattccattatctttcc

SEQ ID NO: 30305 - DNA, 71 bp, chicken (Gallus Gallus)
  misc_feature (36): n=a or g
ctgtcaagtactgtgaccaacttgaggcagaatgtntacactgaaacctggcagtttgggaagctcgttat

SEQ ID NO: 30306 - DNA, 71 bp, chicken (Gallus Gallus)
  misc_feature (36): n=c or t
acagcataaatgattaccccagttttaaaaatgcgntattattttacaaggcagtctcactatgtccaact

SEQ ID NO: 30307 - DNA, 71 bp, chicken (Gallus Gallus)
  misc_feature (36): n=a or g
gtaagaaatgtgagatatctttgacctttcacatgntcttccaaagcattcttcatgtttcttaaggtgaa

SEQ ID NO: 30308 - DNA, 71 bp, chicken (Gallus Gallus)
  misc_feature (36): n=g or t
atagaagtgcttttagacagctgaacaacaaagaangtgcacaatgcattttatgcacaaattgcaaagga

SEQ ID NO: 30309 - DNA, 71 bp, chicken (Gallus Gallus)
  misc_feature (36): n=a or g
ctaagcgctatcatgaagtggagaatacattttatnccattcggagcaggaaaggaaagaaataagagttt

SEQ ID NO: 30310 - DNA, 71 bp, chicken (Gallus Gallus)
  misc_feature (36): n=g or t
aaaaatcatacaaagctgttacactaaacaatgttntgttatcacaatttatgcgaaaattcatactatag

SEQ ID NO: 30311 - DNA, 71 bp, chicken (Gallus Gallus)
  misc_feature (36): n=a or g
gaccaacaacacatggtaagaggaggacttttcctntgttctatatttaacaaacgaccagaatagggaaa

SEQ ID NO: 30312 - DNA, 71 bp, chicken (Gallus Gallus)
  misc_feature (36): n=a or g
caaagaatctgactaagaagccccaacaagttaaanacagtagtatctgaaataaagtgaatcccccaaga

SEQ ID NO: 30313 - DNA, 71 bp, chicken (Gallus Gallus)
  misc_feature (36): n=a or g
gagaaactttacaaattgagcatgccctgttggacncaaaagtgtatttagaagttactggttttggaagg

SEQ ID NO: 30314 - DNA, 71 bp, chicken (Gallus Gallus)
  misc_feature (36): n=c or t
ttgtctcataaagaatttcaagttttatccaagatnaaggaagtcatcagaaggcaaacgttattttttgc

SEQ ID NO: 30315 - DNA, 71 bp, chicken (Gallus Gallus)
  misc_feature (36): n=c or t
cagaccaccagatcagtatcatttagttgttacctntgatcagtgtggctctgagcatgatgcttgtgcct

SEQ ID NO: 30316 - DNA, 71 bp, chicken (Gallus Gallus)
  misc_feature (36): n=c or t
atagcttcaaatatacctagagcttttcccactagnacaattcagcaataaaagttactaatcagtggata

SEQ ID NO: 30317 - DNA, 71 bp, chicken (Gallus Gallus)
  misc_feature (36): n=c or t
cgtatgactttttgtgaagttgaaggtaagaatttntcaggctcaatttaccatgcagtagagtgtgagaa

SEQ ID NO: 30318 - DNA, 71 bp, chicken (Gallus Gallus)
  misc_feature (36): n=a or g
atgtaagtgatgagggtcaggtaagaggaagggccnagaaggtcactgagtatttctgccatcaaatcttc

SEQ ID NO: 30319 - DNA, 71 bp, chicken (Gallus Gallus)
  misc_feature (36): n=c or t
tcacccacaagtgatcatatgctttacattcttctntatgagaaaatttcagcaaatgtgtaagagtcctg

SEQ ID NO: 30320 - DNA, 71 bp, chicken (Gallus Gallus)
  misc_feature (36): n=c or t
actcagtatatgacccaagcccacagacaagcaggntatggtagcaaatgacattgctatgccctcccatc

SEQ ID NO: 30321 - DNA, 71 bp, chicken (Gallus Gallus)
  misc_feature (36): n=a or g
tcgtaacctcaaagattgcattagcacactgcacantgcccagtgacagcactgtagatagcaatgctgtg

SEQ ID NO: 30322 - DNA, 71 bp, chicken (Gallus Gallus)
  misc_feature (36): n=c or t
ctttacaagttaaataaataagcacttgctagcacngccaaactgttctctagaaggggagtagcaagatg

SEQ ID NO: 30323 - DNA, 71 bp, chicken (Gallus Gallus)
  misc_feature (36): n=a or g
gtggtccaggctgggacaaaacaatgttctaccccngtaaattaaatgatgcataggcacagcctcagcag

SEQ ID NO: 30324 - DNA, 71 bp, chicken (Gallus Gallus)
  misc_feature (36): n=a or g
ttcacgtttcttaatttgcagtcctcaaatcttgtnctgcttgtctaatacttcttttctccaaatcttcc

SEQ ID NO: 30325 - DNA, 71 bp, chicken (Gallus Gallus)
  misc_feature (36): n=a or g
aaaacattgcactgatgagtgaagatagattcctcnaagaaccacaaactgtacagattatcaatctgcaa

SEQ ID NO: 30326 - DNA, 71 bp, chicken (Gallus Gallus)
  misc_feature (36): n=a or c
aaatattttctgttttcatgaacaaaatgtcatttntccataaagtgcacagattaacagcaaacagaaaa

SEQ ID NO: 30327 - DNA, 71 bp, chicken (Gallus Gallus)
  misc_feature (36): n=c or t
agcagggcttgttccctaactgggacttgtggctanacaaaggaatagtaacagcttacacccatggcagg

SEQ ID NO: 30328 - DNA, 71 bp, chicken (Gallus Gallus)
  misc_feature (36): n=a or c
tttgttgctcagcttgtagaaacctttgtgttatcntgcttggagacagactgcagcagaaatgaaacaaa

SEQ ID NO: 30329 - DNA, 71 bp, chicken (Gallus Gallus)
  misc_feature (36): n=a or c
atcctctcaagaaacaagtaaattcccttgttcttncttctctctgaataggattgcagaaagaatagtaa

SEQ ID NO: 30330 - DNA, 71 bp, chicken (Gallus Gallus)
  misc_feature (36): n=a or g
gtgcctgaaattggccattagaatgctttagcacancagcaggagcatcccatgtggcttgctgtaagaaa

SEQ ID NO: 30331 - DNA, 71 bp, chicken (Gallus Gallus)
  misc_feature (36): n=a or g
tatctgccatgttctgctccctctgtgagcaatgcntgatgctaactgagcagcggtgaaacaggaccata

SEQ ID NO: 30332 - DNA, 71 bp, chicken (Gallus Gallus)
  misc_feature (36): n=c or t
gcttgtactcctatgtagaattgatgaacaaggaanggtgagtagagtgcctagaaaagggatacttaggg

SEQ ID NO: 30333 - DNA, 71 bp, chicken (Gallus Gallus)
  misc_feature (36): n=c or t
aaacccaggtgtggtgttcctgatgtagagcaatangtcttcacaccagggaatccaaaatggaagaaaaa

SEQ ID NO: 30334 - DNA, 71 bp, chicken (Gallus Gallus)
  misc_feature (36): n=c or t
tctgagaaacgatgcaccctaggcagaaagcagacngctctcgtatgaggatggaaaggagtgtaagaatg

SEQ ID NO: 30335 - DNA, 71 bp, chicken (Gallus Gallus)
  misc_feature (36): n=a or c
gtccaactttaagacctttgaaaaaactgcaagagntcatcttttctggatattccattgcttcatacctg

SEQ ID NO: 30336 - DNA, 71 bp, chicken (Gallus Gallus)
  misc_feature (36): n=c or t
aattataattctaagttaagttcaactgtttcttangtgtccccataaatccagtgtgtgccataatgggc

SEQ ID NO: 30337 - DNA, 71 bp, chicken (Gallus Gallus)
  misc_feature (36): n=g or t
tcaaggtagtctgggaatcggttctgatgggacggnatgttactttggctgatactgtcacctagttataa

SEQ ID NO: 30338 - DNA, 71 bp, chicken (Gallus Gallus)
  misc_feature (36): n=c or t
ttaatgacatcttcagtgaactgaatacatacatantgcttttgagtaaaacaagatttcattttctgata

SEQ ID NO: 30339 - DNA, 71 bp, chicken (Gallus Gallus)
  misc_feature (36): n=c or t
tactcacccagaaaacccaacatgtttaccttcagnatgcagacagttctccaagttctgttctacccctc

SEQ ID NO: 30340 - DNA, 71 bp, chicken (Gallus Gallus)
  misc_feature (36): n=a or g
gaaatcattagagcttcaagttcatatcacaactcngagtcttacttaggcaaatactaaatttttactta

SEQ ID NO: 30341 - DNA, 71 bp, chicken (Gallus Gallus)
  misc_feature (36): n=a or c
atttagtatgttattaaagggatggaaaaaaacatncaacagtgagatttgaagtattacatcttactaat

SEQ ID NO: 30342 - DNA, 71 bp, chicken (Gallus Gallus)
  misc_feature (36): n=a or c
ggccagagctttcctcaggaggtgatctaagccccnaaattctcattgttttgccagtatacacagcttgt

SEQ ID NO: 30343 - DNA, 71 bp, chicken (Gallus Gallus)
  misc_feature (36): n=g or t
caatgaacaggagaactgcataaataaaccccaccngaggtgcaaggacatctgtggcaaatcattttgaa

SEQ ID NO: 30344 - DNA, 71 bp, chicken (Gallus Gallus)
  misc_feature (36): n=a or g
tgagttgcaaaacctctttcaactgacgcagaacanaaatctcaatccaatggtgactgagttggctcagc

SEQ ID NO: 30345 - DNA, 71 bp, chicken (Gallus Gallus)
  misc_feature (36): n=c or t
gtcagaacttgtgcaaacacaggtagtgttaatggnggattgcagttgtgacttaaccctgcaagcagctt

SEQ ID NO: 30346 - DNA, 71 bp, chicken (Gallus Gallus)
  misc_feature (36): n=a or g
actaaaaagatctaaatgattatcactgctttgaanaaaaaaagaagcatgtctccagaggctagcccatc

SEQ ID NO: 30347 - DNA, 71 bp, chicken (Gallus Gallus)
  misc_feature (36): n=a or g
tctggtttctgtgtcagccactttgcagaaatgaangcagtaggggtggtctgtgattggaaatcagcatg

SEQ ID NO: 30348 - DNA, 71 bp, chicken (Gallus Gallus)
  misc_feature (36): n=a or g
agcagaaatttaagatagatccataactataaaatntaatgacataataaatgtcttaaggctgttctaaa

SEQ ID NO: 30349 - DNA, 71 bp, chicken (Gallus Gallus)
  misc_feature (36): n=c or t
atttctcatacaaaatgcagagtttaatattttggnctttgaatgcctggctaaatcaaaagcaattggca

SEQ ID NO: 30350 - DNA, 71 bp, chicken (Gallus Gallus)
  misc_feature (36): n=a or g
gataactaaaaaagctctaacaggtgaaactgtacnaaatactaaatgaacattatttgtattccaaatca

SEQ ID NO: 30351 - DNA, 71 bp, chicken (Gallus Gallus)
  misc_feature (36): n=c or t
gatggagatcatacaaacatgtcagtggtcagatgntgtattttgcaccggatctgattctgaatgagtaa

SEQ ID NO: 30352 - DNA, 71 bp, chicken (Gallus Gallus)
  misc_feature (36): n=g or t
ttcacttcattagtcttctactaccttttcataatnttctataagaatttcaacgacgatattctgaaact

SEQ ID NO: 30353 - DNA, 71 bp, chicken (Gallus Gallus)
  misc_feature (36): n=c or t
tataaattctcactggtagtgatttccttgtcaagnagctctattgcctgcacacgtctgagaaatatcat

SEQ ID NO: 30354 - DNA, 71 bp, chicken (Gallus Gallus)
  misc_feature (36): n=c or t
tagtgagatttttcacatttcataaacagaaaattngcccaatggtttcaaaagataatcttttcagagag

SEQ ID NO: 30355 - DNA, 71 bp, chicken (Gallus Gallus)
  misc_feature (36): n=c or t
cttaaatgggaaaattattcatgtgtaaagctgctnaactgagtcattaatatgtattctggtaaacatgc

SEQ ID NO: 30356 - DNA, 71 bp, chicken (Gallus Gallus)
  misc_feature (36): n=a or g
tgagtgtcagcagttgcccaagctgatacctgatcnaaacggtttggatgcaaatatggggccagatagaa

SEQ ID NO: 30357 - DNA, 71 bp, chicken (Gallus Gallus)
  misc_feature (36): n=a or g
cggggagaaaggaagattttcctgaagcacaaagantaactaaaataagggtcttatttgtccttgtaact

SEQ ID NO: 30358 - DNA, 71 bp, chicken (Gallus Gallus)
  misc_feature (36): n=c or t
gaagggaattaaccacttatttagagaccaagagangtaaactgttgtgccctgtctcacccaactttcct

SEQ ID NO: 30359 - DNA, 71 bp, chicken (Gallus Gallus)
  misc_feature (36): n=g or t
ttaatttagcaagaattctgatgctgtgtaaaatanattgttcagatacctttgttatgtactttagattt

SEQ ID NO: 30360 - DNA, 71 bp, chicken (Gallus Gallus)
  misc_feature (36): n=a or g
ttaaccttttccagaagagatagtagagcaatactntaaggaacttaaatctatgagaaatagaaaaatag

SEQ ID NO: 30361 - DNA, 71 bp, chicken (Gallus Gallus)
  misc_feature (36): n=a or g
gctgtttagaacttcattatattaaatgccagatgnctgttgaacatcaacagcataataaaaaataaaaa

SEQ ID NO: 30362 - DNA, 71 bp, chicken (Gallus Gallus)
  misc_feature (36): n=a or c
cactgtttagcattatctgtgggtcatgtctttccncctcaaaattcatgtaacgtaactaaaaaaaaaaa

SEQ ID NO: 30363 - DNA, 71 bp, chicken (Gallus Gallus)
  misc_feature (36): n=a or c
agagcagagacataggagacacagaattatcttcantacactttgtacttgaatgcctcgtcactaggtaa

SEQ ID NO: 30364 - DNA, 71 bp, chicken (Gallus Gallus)
  misc_feature (36): n=g or t
tgagcggttcctaaaataaactgtagtatcttaaancatataatagatagtacttaaaatgttttaaatag

SEQ ID NO: 30365 - DNA, 71 bp, chicken (Gallus Gallus)
  misc_feature (36): n=c or t
gttgtatggaccatatatccctagcctgttgctaangctcaccatcgcacagtcttctctcctacaccaca

SEQ ID NO: 30366 - DNA, 71 bp, chicken (Gallus Gallus)
  misc_feature (36): n=g or t
aggtatcacacagatgcagagaagtttgtgccaggnataggtcaatgcatttttgagttcaatagacaagc

SEQ ID NO: 30367 - DNA, 71 bp, chicken (Gallus Gallus)
  misc_feature (36): n=a or g
agaggtagtgtgaaagggcatggaagagcattattntctgtcatatgggatttagaaacacatatttgtat

SEQ ID NO: 30368 - DNA, 71 bp, chicken (Gallus Gallus)
  misc_feature (36): n=a or g
agaatggtgtcctgggccaatacagtaaaaaagaangtattacatttagagcagctttcagctagtcagca

SEQ ID NO: 30369 - DNA, 71 bp, chicken (Gallus Gallus)
  misc_feature (36): n=a or g
tttcagatcttgtttgtggccttaacctgttctttntaagacaagaatggtctgcataagagcagatggcc

SEQ ID NO: 30370 - DNA, 71 bp, chicken (Gallus Gallus)
  misc_feature (36): n=a or g
ctgtcttgttatattttatctagtagagctgtgtcnaaacatatgtcaacatagctgtatcagtaatacta

SEQ ID NO: 30371 - DNA, 71 bp, chicken (Gallus Gallus)
  misc_feature (36): n=c or t
cctatcctctctatcctcccagatttgttagtccanagcccacctctgatctcttcctttctctgcgtctc

SEQ ID NO: 30372 - DNA, 71 bp, chicken (Gallus Gallus)
  misc_feature (36): n=a or g
ctcatagcctgttaataaagttactaagattttaantattctaattcaatctcagaagaaagtgttttaca

SEQ ID NO: 30373 - DNA, 71 bp, chicken (Gallus Gallus)
  misc_feature (36): n=g or t
attgttattaatattgaagaagtgtaataggcaaantaaatctcatgaaaatgcgatttaagattgtcatc

SEQ ID NO: 30374 - DNA, 71 bp, chicken (Gallus Gallus)
  misc_feature (36): n=c or t
ggatctaataagagagcctgtgagcttttttctttnctaggtttcaaataattagttggttgcaatgatat

SEQ ID NO: 30375 - DNA, 71 bp, chicken (Gallus Gallus)
  misc_feature (36): n=a or g
ttaaatcttctactgatccttcctctgaggaaagcntcaataataaaatacatactatacagcccacactg

SEQ ID NO: 30376 - DNA, 71 bp, chicken (Gallus Gallus)
  misc_feature (36): n=a or g
aatttctggaatgctatgtggctttcctccctctcntgtacaatacactctgtggataggcaacatggcta

SEQ ID NO: 30377 - DNA, 71 bp, chicken (Gallus Gallus)
  misc_feature (36): n=a or g
tgttatgatgtaggtagtatgctaacacaaaaaggnaactagaattaatactgaagttacagagattttat

SEQ ID NO: 30378 - DNA, 71 bp, chicken (Gallus Gallus)
  misc_feature (36): n=c or t
gaagcaagtttttgtgcaaggggaaaacattcttanctccatccccatttcagtctctttctccatctcta

SEQ ID NO: 30379 - DNA, 71 bp, chicken (Gallus Gallus)
  misc_feature (36): n=g or t
aataagaaacaatattgtttaagatcatttcaagtnacattatatttctttcattagtcatactgcttcca

SEQ ID NO: 30380 - DNA, 71 bp, chicken (Gallus Gallus)
  misc_feature (36): n=g or t
gatttattttgtttgcttgtgacatttttgttctgntttgctttagaataaaaggtcattttcaaataaag

SEQ ID NO: 30381 - DNA, 71 bp, chicken (Gallus Gallus)
  misc_feature (36): n=c or t
tgattatgagccatgcttgaagccactcttgtaacnaaagtagtatttgaatatctgaatctacagtgaaa

SEQ ID NO: 30382 - DNA, 71 bp, chicken (Gallus Gallus)
  misc_feature (36): n=a or c
ttgacctgacaggaatggctgctacttacactttcnaaaggatcttttccaattgagaattactatgtttg

SEQ ID NO: 30383 - DNA, 71 bp, chicken (Gallus Gallus)
  misc_feature (36): n=a or c
tgaactaagaaatgccatctagtagaggttctgatnccttctaacagtaaaagatttgctcttacacattg

SEQ ID NO: 30384 - DNA, 71 bp, chicken (Gallus Gallus)
  misc_feature (36): n=c or t
tatattcacagatactgacgcagttgcctcacccantgactgcatgattataggtacacatggaccttgca

SEQ ID NO: 30385 - DNA, 71 bp, chicken (Gallus Gallus)
  misc_feature (36): n=g or t
ttaatgacttacaaaaactgtatatttctctggaanatactatatacactgcaaacatgaggtcagttttt

SEQ ID NO: 30386 - DNA, 71 bp, chicken (Gallus Gallus)
  misc_feature (36): n=a or g
gaaggtggcaaagcataaactgaagctaatgccacntgtctctcatttggtgtataagcagcaaagtcata

SEQ ID NO: 30387 - DNA, 71 bp, chicken (Gallus Gallus)
  misc_feature (36): n=c or t
cagactgcagtagcccaacctgatataagagtattnggggagacagggatgaaacaacctttaaaaaaaac

SEQ ID NO: 30388 - DNA, 71 bp, chicken (Gallus Gallus)
  misc_feature (36): n=a or g
tcatctatttatgtagttgtaaagttggtggtagangggttaaattattcagcctgtggcaatttgtagat

SEQ ID NO: 30389 - DNA, 71 bp, chicken (Gallus Gallus)
  misc_feature (36): n=c or t
ttcatactatttagatttgtgtcttcaagtgactcngaagctaatcttgggtaaggaatcagtactgagtc

SEQ ID NO: 30390 - DNA, 71 bp, chicken (Gallus Gallus)
  misc_feature (36): n=a or g
tcttgtcctctgcggcaacagtcatggcaaacatcnttaaggatgtgaggtctctcctttaattaagaact

SEQ ID NO: 30391 - DNA, 71 bp, chicken (Gallus Gallus)
  misc_feature (36): n=a or g
ggtaaatgagataatgtaacttacttgacttggcancaggctaccaaatgaccaagtcaccattttacaga

SEQ ID NO: 30392 - DNA, 71 bp, chicken (Gallus Gallus)
  misc_feature (36): n=a or c
tagctctacactaaccacagcatatggcagcagaanaggaaccaaataagatatgtaagggggattagaga

SEQ ID NO: 30393 - DNA, 71 bp, chicken (Gallus Gallus)
  misc_feature (36): n=c or t
agttcactgcaagttcaggtgctagagaacagcaangctggggagcctggaagcaggaaaatgattgggtt

SEQ ID NO: 30394 - DNA, 71 bp, chicken (Gallus Gallus)
  misc_feature (36): n=a or g
accctggtaatgcacatgggcaggaagaggcactcnttttcttggacagcattaatatactacagtgtgag

SEQ ID NO: 30395 - DNA, 71 bp, chicken (Gallus Gallus)
  misc_feature (36): n=a or g
cttttttttccactccgttgcctttgctaggacatnttggattaaattatgttattggaaggaaacttagg

SEQ ID NO: 30396 - DNA, 71 bp, chicken (Gallus Gallus)
  misc_feature (36): n=c or t
caaagaaaacttgtagtgcttttggtgtcagaaaantggttgaaacatgaccctggttatatcctacgaaa

SEQ ID NO: 30397 - DNA, 71 bp, chicken (Gallus Gallus)
  misc_feature (36): n=a or g
atgattgacttcccttccccttcccccaggcacaanctgcatggctgtgcttcatgggctgcctgcttagt

SEQ ID NO: 30398 - DNA, 71 bp, chicken (Gallus Gallus)
  misc_feature (36): n=a or g
aggagttggtaaaacttcagtcagttacaaaccctnccctcagcagtacagaatgcatctttcttggctta

SEQ ID NO: 30399 - DNA, 71 bp, chicken (Gallus Gallus)
  misc_feature (36): n=c or t
agaggtacctggccatgtgcattctgagcaaagcangctggatctgggttaggctctgcttttcatgcttt

SEQ ID NO: 30400 - DNA, 71 bp, chicken (Gallus Gallus)
  misc_feature (36): n=c or t
agagctctcgacagcagcagagaacaaaacaagagnggcactgttagctttatcaggaaaaacagagggtg

SEQ ID NO: 30401 - DNA, 71 bp, chicken (Gallus Gallus)
  misc_feature (36): n=c or t
ctgatgttttgaaacaaagaaaatacagttgtatgnatggaaacctttctcatgttaactcgtttaagctc

SEQ ID NO: 30402 - DNA, 71 bp, chicken (Gallus Gallus)
  misc_feature (36): n=c or t
cccttactgtttgttgcaaagagatcaagatttganattgtgatgcatgctacatcacctcaggataggta

SEQ ID NO: 30403 - DNA, 71 bp, chicken (Gallus Gallus)
  misc_feature (36): n=a or c
tattaattgcttcttatgtgggaaacaccacagtanagtttgagaatgatttggaggcacacacagttgca

SEQ ID NO: 30404 - DNA, 71 bp, chicken (Gallus Gallus)
  misc_feature (36): n=c or t
gtggactgagctattctgacctttgtagctggctcnatttcagctttctgaaggttggacataaaaaacag

SEQ ID NO: 30405 - DNA, 71 bp, chicken (Gallus Gallus)
  misc_feature (36): n=a or g
taagatcagactttatttgcttgctccgaagggctntgtgtttgcctgagttttggtaggttttgttttga

SEQ ID NO: 30406 - DNA, 71 bp, chicken (Gallus Gallus)
  misc_feature (36): n=c or t
gggttgctgctgttataggtgcatggcttgtttctntgggcttaacccagagtgaagataacagaggtaag

SEQ ID NO: 30407 - DNA, 71 bp, chicken (Gallus Gallus)
  misc_feature (36): n=a or g
gaatacatagactaagaaccactggatttgggaaantttgtggagatcaataatttgccatgttttaaaaa

SEQ ID NO: 30408 - DNA, 71 bp, chicken (Gallus Gallus)
  misc_feature (36): n=a or g
agcatttaatctgcaccatatctgccctgagtccanctttctccaactggccaagtataatacaataaaaa

SEQ ID NO: 30409 - DNA, 71 bp, chicken (Gallus Gallus)
  misc_feature (36): n=c or t
tgtaggcagaggcaaccactgtatcaagtacactangcagccagatgacctttttaagtactgctttcagt

SEQ ID NO: 30410 - DNA, 71 bp, chicken (Gallus Gallus)
  misc_feature (36): n=a or g
aatattttctacctgcaaatgtaccttgtgaggaancatcatagaagagtgcagtcaacaaagcaaatatt

SEQ ID NO: 30411 - DNA, 71 bp, chicken (Gallus Gallus)
  misc_feature (36): n=g or t
aggtagtttactcgtggagatactcaagtataccanactcagtgattgcaaaatatcctatctatatacaa

SEQ ID NO: 30412 - DNA, 71 bp, chicken (Gallus Gallus)
  misc_feature (36): n=a or g
tcagtactggaaccttatgtgaagcagtctctatcnacttacctcatggagaagtcagagctttcatgttt

SEQ ID NO: 30413 - DNA, 71 bp, chicken (Gallus Gallus)
  misc_feature (36): n=a or g
ctaggtaaatagacaagaataagatatactactgcntatcaaacatttttcaagtcttactcaaaaaactg

SEQ ID NO: 30414 - DNA, 71 bp, chicken (Gallus Gallus)
  misc_feature (36): n=c or t
tatgagtgggcatctagttccacttggcatcacttnggtttcaggaactgctgcaggtcctctgaatatct

SEQ ID NO: 30415 - DNA, 71 bp, chicken (Gallus Gallus)
  misc_feature (36): n=c or t
caaagggattttaaatgaattcttgagaaatcacgngtaggcctttctccctctgtttgttctttccctca

SEQ ID NO: 30416 - DNA, 71 bp, chicken (Gallus Gallus)
  misc_feature (36): n=c or t
gattctgatgatcagatgggtttttgagttccctgntgtctccatcattagtaaagaaaactttttgaagt

SEQ ID NO: 30417 - DNA, 71 bp, chicken (Gallus Gallus)
  misc_feature (36): n=a or g
aacaccagttgccttctagataattcaaagctgacnattagagccttataaccaaaaagaccacacaaagc

SEQ ID NO: 30418 - DNA, 71 bp, chicken (Gallus Gallus)
  misc_feature (36): n=a or c
cactgagcccccaggataataaataagacttttccntccctgcactgacatcatagatagcttaacataat

SEQ ID NO: 30419 - DNA, 71 bp, chicken (Gallus Gallus)
  misc_feature (36): n=a or g
ctctgctgaagggtttattgaggctcactaagtgtncccattttaccagtgctttaatcaccaattagtac

SEQ ID NO: 30420 - DNA, 71 bp, chicken (Gallus Gallus)
  misc_feature (36): n=c or t
agaaacagactggtttattcacaggagtgtttttantcaatcctcctctcctttatcctcgtacaaacttg

SEQ ID NO: 30421 - DNA, 71 bp, chicken (Gallus Gallus)
  misc_feature (36): n=c or t
catggagggcacatgttcaagaaatgaccagtggtngtgccaggaaaaatcccagccctgaaaacaaagat

SEQ ID NO: 30422 - DNA, 71 bp, chicken (Gallus Gallus)
  misc_feature (36): n=a or g
atgagagatcagccaggattgtcctaatgggtcctncagcctctgctacccacctattgtgttacaatctg

SEQ ID NO: 30423 - DNA, 71 bp, chicken (Gallus Gallus)
  misc_feature (36): n=a or g
cccatagatcctgtatcacacctgtctttcccaaanatgtttcagctatcccgcagtatcttgaatgaaag

SEQ ID NO: 30424 - DNA, 71 bp, chicken (Gallus Gallus)
  misc_feature (36): n=c or t
tcatgaacttcttccttgctcacttttatcccaaantgcctcttcagaattgagcccagaaagcctgatat

SEQ ID NO: 30425 - DNA, 71 bp, chicken (Gallus Gallus)
  misc_feature (36): n=c or t
ctcccttgtttaacacagctaaggagaaaatgcttngcatggagagtgatgtcacatgctgtcaccttctc

SEQ ID NO: 30426 - DNA, 71 bp, chicken (Gallus Gallus)
  misc_feature (36): n=c or t
cactgagctgccttttctcctctgagatttctgaangtatctgcttctcatgcccttgggaacgcaccgtc

SEQ ID NO: 30427 - DNA, 71 bp, chicken (Gallus Gallus)
  misc_feature (36): n=a or g
aaaaaaactgtgaaagaaatgcaaggagtgatctcntgaaaaaggagttagtgcagtcctccttctggttg

SEQ ID NO: 30428 - DNA, 71 bp, chicken (Gallus Gallus)
  misc_feature (36): n=a or g
gactggaaccctgagtagaacaggctgtcagatggncagaagtgcttcatgggagtcactttccgttcccg

SEQ ID NO: 30429 - DNA, 71 bp, chicken (Gallus Gallus)
  misc_feature (36): n=a or g
ccagtactgctagctacactgggtaaaggcaataancaatcaatcttctcagttaagaaaagactgagatg

SEQ ID NO: 30430 - DNA, 71 bp, chicken (Gallus Gallus)
  misc_feature (36): n=c or t
aattcataaaatattacttttagctctctatcttanggttatattcacaggtattttggcctacctatttg

SEQ ID NO: 30431 - DNA, 71 bp, chicken (Gallus Gallus)
  misc_feature (36): n=c or t
atctatcagcatccactgttatcttaagccaaatcnctttcatcaaaattctgccttggctagctccaagg

SEQ ID NO: 30432 - DNA, 71 bp, chicken (Gallus Gallus)
  misc_feature (36): n=a or g
tgattgaaaccatgtaagaatatgtttgtttttccnttgttatgaaatctttccttgaatgtcctcatgga

SEQ ID NO: 30433 - DNA, 71 bp, chicken (Gallus Gallus)
  misc_feature (36): n=g or t
gattttcctttggccaccgaatacgcaaaacagcantatctttctcttttgtgaatgatgttgaatttctc

SEQ ID NO: 30434 - DNA, 71 bp, chicken (Gallus Gallus)
  misc_feature (36): n=a or g
taattctaatgcaaaaataaggttataagaataagngaaaatagcagaaatggtcttttttgctcttacga

SEQ ID NO: 30435 - DNA, 71 bp, chicken (Gallus Gallus)
  misc_feature (36): n=g or t
tctgcacacaattcttctttctatctgaaggttcanggagtagatgcctgaggatcctggagagtcagact

SEQ ID NO: 30436 - DNA, 71 bp, chicken (Gallus Gallus)
  misc_feature (36): n=c or t
agacctttccacaaaaggactgctttcaaactgaangcccattggaatggaaggaggcaagatatatgtgc

SEQ ID NO: 30437 - DNA, 71 bp, chicken (Gallus Gallus)
  misc_feature (36): n=c or t
aactggtcctactaatggtagacctcagcatacttntttggtgacctggggtacgtttctaaaatctgcgt

SEQ ID NO: 30438 - DNA, 71 bp, chicken (Gallus Gallus)
  misc_feature (36): n=a or g
aagatctgacagggcccagaactgtggctgtagatnaaagtttggtcttagcggtcatgacgtaaaatgcc

SEQ ID NO: 30439 - DNA, 71 bp, chicken (Gallus Gallus)
  misc_feature (36): n=c or t
agcaccccctactctgtgaatatgccatccctgcanatgtgcaaaacagatgatctaaataacttcctaac

SEQ ID NO: 30440 - DNA, 71 bp, chicken (Gallus Gallus)
  misc_feature (36): n=c or t
ccaaaagaaatctaatggcgtctacaaaatgtctcntgagaaagagcatgaaaaagagtaggcatcaattg

SEQ ID NO: 30441 - DNA, 71 bp, chicken (Gallus Gallus)
  misc_feature (36): n=c or t
ttctacatcagactcaatgcccttccaggatccccnagtatataccaaatgccatttcaaagtacaagtgg

SEQ ID NO: 30442 - DNA, 71 bp, chicken (Gallus Gallus)
  misc_feature (36): n=a or g
gtgggatagaaataataagtatatttatagcttacntttgcctttcccctcctatatactcttctgattga

SEQ ID NO: 30443 - DNA, 71 bp, chicken (Gallus Gallus)
  misc_feature (36): n=a or g
tgttcaatcaaccattcaagctgttgttgcaaatcngtgttcaaattactgtcacactttgttatgttgct

SEQ ID NO: 30444 - DNA, 71 bp, chicken (Gallus Gallus)
  misc_feature (36): n=c or t
gtgcaccgttgtatgtgtaaaacattgagactccantgttctgatcagccaagagaacgtgggagctattt

SEQ ID NO: 30445 - DNA, 71 bp, chicken (Gallus Gallus)
  misc_feature (36): n=c or t
tcagcctggttgggggtattggtctgtagcagcatnttaccactaaatgatacaacaaagtaaattttcaa

SEQ ID NO: 30446 - DNA, 71 bp, chicken (Gallus Gallus)
  misc_feature (36): n=g or t
gtggaaaaaatgagggtgggatgtattagttttttngtgcttggtatcttgaggctgagatgaagcacttt

SEQ ID NO: 30447 - DNA, 71 bp, chicken (Gallus Gallus)
  misc_feature (36): n=a or g
ggaaatgttgacagattccctgccctcacagtactntcgttatctattgcactgcacattaaacacacata

SEQ ID NO: 30448 - DNA, 71 bp, chicken (Gallus Gallus)
  misc_feature (36): n=a or c
ggcatgaacctaaggaccagaaaacacagccccagnctgtacctcaccatggcctcacagacagatggaga

SEQ ID NO: 30449 - DNA, 71 bp, chicken (Gallus Gallus)
  misc_feature (36): n=a or g
acagacagatgcaaaaagaactaagcaactatgcantggtaccacaatgattcaccagtgaaattgtggag

SEQ ID NO: 30450 - DNA, 71 bp, chicken (Gallus Gallus)
  misc_feature (36): n=c or t
caaaccctgattgaaatgttttaacctgcaaaatantgtattattctaaagtccatggtgattttttttga

SEQ ID NO: 30451 - DNA, 71 bp, chicken (Gallus Gallus)
  misc_feature (36): n=a or g
cttggtatacacccaacatcaaggtaccttgacccnaactggtgcccatgtcattatgaaagattaatgaa

SEQ ID NO: 30452 - DNA, 71 bp, chicken (Gallus Gallus)
  misc_feature (36): n=a or g
gtctgttgatgctcatagcagcatcagtaaggaccnaagtttgttaaggaacattaaatggtattggacca

SEQ ID NO: 30453 - DNA, 71 bp, chicken (Gallus Gallus)
  misc_feature (36): n=a or c
tggaccccaaatgagatatgaaaaatggtaccttgnccacaaaatgaagcataccaggcattagctaaagt

SEQ ID NO: 30454 - DNA, 71 bp, chicken (Gallus Gallus)
  misc_feature (36): n=c or t
ttctgatagaataatgcacaaaagctaaaaccctgntatagcttaattgaattgcagcctcccatcaatcc

SEQ ID NO: 30455 - DNA, 71 bp, chicken (Gallus Gallus)
  misc_feature (36): n=c or t
tcccttgcaggccagatgacactgaggacgcagcangttcaggactccaagatgggctttgtaatcaacgc

SEQ ID NO: 30456 - DNA, 71 bp, chicken (Gallus Gallus)
  misc_feature (36): n=c or t
agtaataatgctgataatgaaaggacagagggaganatattaattccctttgccactccactgggagagga

SEQ ID NO: 30457 - DNA, 71 bp, chicken (Gallus Gallus)
  misc_feature (36): n=c or t
tcacctatcagcaccgtgagccacagaactgcctcngttagccgaacagaagatgatgcccctaccttcca

SEQ ID NO: 30458 - DNA, 71 bp, chicken (Gallus Gallus)
  misc_feature (36): n=g or t
tatgtatctactctgcttttatgttatttctagatntacagcactcctgtgaatgttctgccaataaattg

SEQ ID NO: 30459 - DNA, 71 bp, chicken (Gallus Gallus)
  misc_feature (36): n=c or t
tttcctttgaaaatagcatacattttaacaaaaccnctatgaccaatatttcatatcttaacatcattgac

SEQ ID NO: 30460 - DNA, 71 bp, chicken (Gallus Gallus)
  misc_feature (36): n=g or t
cttctttgagggatagagggttcattattccagttnttggtttgcatcagcagctagtcactgctctttaa

SEQ ID NO: 30461 - DNA, 71 bp, chicken (Gallus Gallus)
  misc_feature (36): n=c or t
aatatcataagaggcaacagagacttggcaaagggnttcagctttattgcgttagatcccatttcgcttca

SEQ ID NO: 30462 - DNA, 71 bp, chicken (Gallus Gallus)
  misc_feature (36): n=a or c
taaaatcattaacatagaaaatactgtgccattcantaccgctcaaaagctttaactttgcctgtgattaa

SEQ ID NO: 30463 - DNA, 71 bp, chicken (Gallus Gallus)
  misc_feature (36): n=c or t
ataaaaaggcttagatcccatgccaatatataatancaagtgtgtttttatgagcagtgcagccttttctg

SEQ ID NO: 30464 - DNA, 71 bp, chicken (Gallus Gallus)
  misc_feature (36): n=a or g
tcaactgtctgatagggagacatgaggaaaatgganccaaaacattctcccaaatattggaacaggttttc

SEQ ID NO: 30465 - DNA, 71 bp, chicken (Gallus Gallus)
  misc_feature (36): n=a or c
acctttgctagcagcatgactaaggacaagggttcntctttgacacagttttttggaaaagaggtatcaac

SEQ ID NO: 30466 - DNA, 71 bp, chicken (Gallus Gallus)
  misc_feature (36): n=a or c
tacagcactgtgcaggaaggtcaaatgctagtcagnatatgtaagaataagagaccctcatgggcataaca

SEQ ID NO: 30467 - DNA, 71 bp, chicken (Gallus Gallus)
  misc_feature (36): n=a or g
gagacatcactgtcagtcccgcagtgcttctctgantaggactccccatatgatacaaactacttatctcc

SEQ ID NO: 30468 - DNA, 71 bp, chicken (Gallus Gallus)
  misc_feature (36): n=a or g
caaaaagaattcaaaccttcagagagactgtggaantctgcataggagaaaaacactatgagtactctgaa

SEQ ID NO: 30469 - DNA, 71 bp, chicken (Gallus Gallus)
  misc_feature (36): n=g or t
agatagctgcatagtttttatatgggagggagaatnatcataattggtaaagctcctactggctactaaaa

SEQ ID NO: 30470 - DNA, 71 bp, chicken (Gallus Gallus)
  misc_feature (36): n=a or g
atccacacttgaaaaggaatcaagggggtgcctgantttcctcaggtctgcccacaaacagtagtggctct

SEQ ID NO: 30471 - DNA, 71 bp, chicken (Gallus Gallus)
  misc_feature (36): n=a or g
gacatgaattttagtgagattaaaggaattcttgcntgacttgagaaatctagatgcaaataaagtgagac

SEQ ID NO: 30472 - DNA, 71 bp, chicken (Gallus Gallus)
  misc_feature (36): n=g or t
tatgttctatataacccatagacagaaatgcctatnctgtaaagtatagaactatacaggaatgttgataa

SEQ ID NO: 30473 - DNA, 71 bp, chicken (Gallus Gallus)
  misc_feature (36): n=a or c
gttcattttgtatccttataactgctcataaccccntggatttgtatgagaggtgtttgtgctcctttctg

SEQ ID NO: 30474 - DNA, 71 bp, chicken (Gallus Gallus)
  misc_feature (36): n=a or g
tgacaagaaccactgcaaccagctttcctgcccacnctccttaaccctgctctcagctcaaagcagcagag

SEQ ID NO: 30475 - DNA, 71 bp, chicken (Gallus Gallus)
  misc_feature (36): n=c or t
taaaagtgaggaaacgtgatttacccatataaaagntttgttgacgcggtgcccttctgtgaaccacttta

SEQ ID NO: 30476 - DNA, 71 bp, chicken (Gallus Gallus)
  misc_feature (36): n=a or c
taattattgctgatgcctcccttaggcggctggccngagcacactcaggatatgggcacagttggacccaa

SEQ ID NO: 30477 - DNA, 71 bp, chicken (Gallus Gallus)
  misc_feature (36): n=a or c
acttggaggagtttatacttacatcagaggctcccntgatttaggcttaatgaagatagcgatgggatata

SEQ ID NO: 30478 - DNA, 71 bp, chicken (Gallus Gallus)
  misc_feature (36): n=a or c
agtgttcttaagcacttattcagtgagacacaaaancctggccaactacaaatgtcacaccatctgtacta

SEQ ID NO: 30479 - DNA, 71 bp, chicken (Gallus Gallus)
  misc_feature (36): n=a or g
atgacaccagaatagcgatgcatgtcctgaatgtgnagaacatgagagcatacaggggggatcatttaaga

SEQ ID NO: 30480 - DNA, 71 bp, chicken (Gallus Gallus)
  misc_feature (36): n=a or g
tgctggaatgtcttcaaagcttacatttatcatgcngatgtcagactgctcttatcacaaccttctgtgca

SEQ ID NO: 30481 - DNA, 71 bp, chicken (Gallus Gallus)
  misc_feature (36): n=a or g
acagaatttgatcgagatacctacatgtaaaacttnaatgtctaatttatattgggaaaaacaggcaatta

SEQ ID NO: 30482 - DNA, 71 bp, chicken (Gallus Gallus)
  misc_feature (36): n=a or c
tatgcatcttgaccaaactatttattgcaaagtgcngcttttgtacttctttttggtgaaaaagaaccaat

SEQ ID NO: 30483 - DNA, 71 bp, chicken (Gallus Gallus)
  misc_feature (36): n=g or t
cccatcgcccttccaaagtctggttctcagattttnattcctctatgaatggcttccaattaacaaaagcc

SEQ ID NO: 30484 - DNA, 71 bp, chicken (Gallus Gallus)
  misc_feature (36): n=g or t
tactttttaagcttctcaatttgatgatcacttaangtttccccccattatatttgcaaaaagtatttctt

SEQ ID NO: 30485 - DNA, 71 bp, chicken (Gallus Gallus)
  misc_feature (36): n=c or t
agatttgtttaatgtggctaaatccaagaaaactancctgtcaatgacaggataatgaggggtcattcctt

SEQ ID NO: 30486 - DNA, 71 bp, chicken (Gallus Gallus)
  misc_feature (36): n=a or g
tgtgtgggaatgacactggtaggcacagaataaagnaaaaattgctgaaagcggggatggaaaatattaaa

SEQ ID NO: 30487 - DNA, 71 bp, chicken (Gallus Gallus)
  misc_feature (36): n=c or t
catttgaaccaaggctaggctgctcaaaggaaatgnagggaactagatatgcaagtctcttaacacaatta

SEQ ID NO: 30488 - DNA, 71 bp, chicken (Gallus Gallus)
  misc_feature (36): n=a or g
gccatcacctggaaagccttaatctctctctacacngcacggtatgaaaatattgtttcgtgacagtgatg

SEQ ID NO: 30489 - DNA, 71 bp, chicken (Gallus Gallus)
  misc_feature (36): n=a or g
taaagttgcatctctcccgcgtttccacattggatnaattcacccatgaaaaacaagtcattggtggacac

SEQ ID NO: 30490 - DNA, 71 bp, chicken (Gallus Gallus)
  misc_feature (36): n=c or t
agcatcctctgtgcagaaggcctttattccaatcanagaccatgtgggaactccgagatttaggagctact

SEQ ID NO: 30491 - DNA, 71 bp, chicken (Gallus Gallus)
  misc_feature (36): n=c or t
aatgattcactgtgcatgtaacaaaatacaatctgnagaaagatatataattttagtttctcagatcaaag

SEQ ID NO: 30492 - DNA, 71 bp, chicken (Gallus Gallus)
  misc_feature (36): n=c or t
acaaagcacctcatacactatcatcagtttcccacngtgaaactgtgctcagagtaacattatagcaaaat

SEQ ID NO: 30493 - DNA, 71 bp, chicken (Gallus Gallus)
  misc_feature (36): n=a or g
actacaggcttcaaaacatgaatgtaattaagtaanaggacaaaaccatatctgcgcgttatcagtccatc

SEQ ID NO: 30494 - DNA, 71 bp, chicken (Gallus Gallus)
  misc_feature (36): n=a or c
tatgaagctgcattctgaaaatacataccctgttanaagatctcttgtaacaccatcaacacataagctat

SEQ ID NO: 30495 - DNA, 71 bp, chicken (Gallus Gallus)
  misc_feature (36): n=a or c
attgacttaatcctctcatcatttagcctctcagtncactctcctgtgaaactaagagcaacaaacatcag

SEQ ID NO: 30496 - DNA, 71 bp, chicken (Gallus Gallus)
  misc_feature (36): n=c or t
tccttaaaatgccagttaccctgtgttgcagttttnagagtgagaaatcctgaagttatattacagcctgt

SEQ ID NO: 30497 - DNA, 71 bp, chicken (Gallus Gallus)
  misc_feature (36): n=a or g
ttctcaatgaatttataataaaccggaggtctccgnggagctgaagggggactgtattcaacaatccgtac

SEQ ID NO: 30498 - DNA, 71 bp, chicken (Gallus Gallus)
  misc_feature (36): n=a or g
tgaaattgacataactttcaagtttcaagacacccnttggaataaggtcagcctctgttacacacaccgta

SEQ ID NO: 30499 - DNA, 71 bp, chicken (Gallus Gallus)
  misc_feature (36): n=c or t
tgcccagagtgtaaatattgcaagttcatatttttnacaatgtcttcgaaagcgtatagggtggaggagtt

SEQ ID NO: 30500 - DNA, 71 bp, chicken (Gallus Gallus)
  misc_feature (36): n=c or t
ttttaatagcatcatgaaggacagcataaacttcangaaacatttgacaggcaagaacaaacgtgcagtat

SEQ ID NO: 30501 - DNA, 71 bp, chicken (Gallus Gallus)
  misc_feature (36): n=a or g
tctaacttccttcttcaatttaggatatttcccacnaggtatttagagctccctaagtaaataaaactcat

SEQ ID NO: 30502 - DNA, 71 bp, chicken (Gallus Gallus)
  misc_feature (36): n=c or t
gttgtgagcaccactgctttttcgggaaagaaatgngagccctggagttgctttttcctatgttaattcgt

SEQ ID NO: 30503 - DNA, 71 bp, chicken (Gallus Gallus)
  misc_feature (36): n=c or t
taggataaaaggatcagtatagaaaaagacctcagnctgcaaccaattagaataattgcacattgaacttg

SEQ ID NO: 30504 - DNA, 71 bp, chicken (Gallus Gallus)
  misc_feature (36): n=a or g
gttttgtagggaagtaagcaaacatgaacactaacngtgtttggcagcagatttaaatgctatttaaatgc

SEQ ID NO: 30505 - DNA, 71 bp, chicken (Gallus Gallus)
  misc_feature (36): n=c or t
cctaccattaaaaaaatgcattagggctacccacantgaatgtgtgctcctctgtttgccttgactgatga

SEQ ID NO: 30506 - DNA, 71 bp, chicken (Gallus Gallus)
  misc_feature (36): n=g or t
aggagacgtccagaaagaacaaagttcataataaanctgtagcgtgtgaccaaagagaaaaaggcatcctc

SEQ ID NO: 30507 - DNA, 71 bp, chicken (Gallus Gallus)
  misc_feature (36): n=a or g
gaccagacagtacactgtacaattgcttaagagagncaactgtgacaatgttccttgctctcaagattgca

SEQ ID NO: 30508 - DNA, 71 bp, chicken (Gallus Gallus)
  misc_feature (36): n=c or t
gatattcttgaatgatcagtaagataatgagtatgnactgtgagtactgaggaaataggggagatgagtgt

SEQ ID NO: 30509 - DNA, 71 bp, chicken (Gallus Gallus)
  misc_feature (36): n=c or t
gacatctcgagcatgaatgatttcgacttaccaaangtagaaggaaagataacttaatgttatgattgtgc

SEQ ID NO: 30510 - DNA, 71 bp, chicken (Gallus Gallus)
  misc_feature (36): n=a or g
aatgtttaaaatttgttgttcaagtgattccggtgnaagataatcattctgaaaagtcaagaactttggtt

SEQ ID NO: 30511 - DNA, 71 bp, chicken (Gallus Gallus)
  misc_feature (36): n=a or g
taaatatcttgaagtttgctgtgaatttattagagntagaacttcacaaagaagcttgaaaatccaactgc

SEQ ID NO: 30512 - DNA, 71 bp, chicken (Gallus Gallus)
  misc_feature (36): n=a or g
gattgtaaactaaccaatgaactgcatcctttaccngctttatttctaggaacagtgtgttttgttctgga

SEQ ID NO: 30513 - DNA, 71 bp, chicken (Gallus Gallus)
  misc_feature (36): n=g or t
catagctggcacagatactgaaaatcttggtgcttnctagagctgtgtcaacctttggcatcaaggatcct

SEQ ID NO: 30514 - DNA, 71 bp, chicken (Gallus Gallus)
  misc_feature (36): n=a or c
ttcttagtcttcctggtgaagcatgatgaccttaancacctctcaaactcactgcttttgagggcagatta

SEQ ID NO: 30515 - DNA, 71 bp, chicken (Gallus Gallus)
  misc_feature (36): n=a or g
gattgcaacagcatcaccctgtcatcttgctctgcngatgcagtttttattcctctattataaagtacata

SEQ ID NO: 30516 - DNA, 71 bp, chicken (Gallus Gallus)
  misc_feature (36): n=c or t
gcatacacatacaatttacatgtgcacaaattatgnacttatattcatggacaagcacacaggaaaacaca

SEQ ID NO: 30517 - DNA, 71 bp, chicken (Gallus Gallus)
  misc_feature (36): n=c or t
tacattaagaatcatcattttttctccacccttccnctccctcccccactgcacagtctatatcaatatac

SEQ ID NO: 30518 - DNA, 71 bp, chicken (Gallus Gallus)
  misc_feature (36): n=c or t
tgaccagttacaagccttcagagatatttgtctatnagaatgtcaataatcatagtctttaattttcttaa

SEQ ID NO: 30519 - DNA, 71 bp, chicken (Gallus Gallus)
  misc_feature (36): n=c or t
actaatttctctttatttctagcggcatcattaganacctgtaaagcagacttccctttggatatcttttt

SEQ ID NO: 30520 - DNA, 71 bp, chicken (Gallus Gallus)
  misc_feature (36): n=g or t
acctgctagcaaaaatcaagcccatatccccattgnaaaaagaagtcaggaatagtttttctatcatccac

SEQ ID NO: 30521 - DNA, 71 bp, chicken (Gallus Gallus)
  misc_feature (36): n=c or t
gggattcatagggatagcaatcaaagcaagaactcnatgcttgaatagagagcaaagttattgggaaatta

SEQ ID NO: 30522 - DNA, 71 bp, chicken (Gallus Gallus)
  misc_feature (36): n=c or t
ttgttgttgttagctattaattcaaccatcctatantttctacacctgggcaaaaatcagcttgtatataa

SEQ ID NO: 30523 - DNA, 71 bp, chicken (Gallus Gallus)
  misc_feature (36): n=c or t
atcagtcatctctgtatcacactatctcagtgtttngttttttcaatccatgatagaactgcagacttata

SEQ ID NO: 30524 - DNA, 71 bp, chicken (Gallus Gallus)
  misc_feature (36): n=c or t
atcccgtgactactagagttcagttccttctatcangatagagcttcaatgtggctttcagctgggccagt

SEQ ID NO: 30525 - DNA, 71 bp, chicken (Gallus Gallus)
  misc_feature (36): n=a or g
ggcagataaagtactcaaggagatgcatcatctcanttttcaaagtaatctgtagctagcacttaaatcct

SEQ ID NO: 30526 - DNA, 71 bp, chicken (Gallus Gallus)
  misc_feature (36): n=c or t
agcaaactgcaagtaacgtgggtccctggaaaatcntgaatgacaatagatagttgtgtacaaaaagggaa

SEQ ID NO: 30527 - DNA, 71 bp, chicken (Gallus Gallus)
  misc_feature (36): n=a or g
attcactgacaaatggatataatgaaacaagttgtncttcccagtttggagctgagatggcttcatttggg

SEQ ID NO: 30528 - DNA, 71 bp, chicken (Gallus Gallus)
  misc_feature (36): n=a or c
agagaaataagttttgtgtccccctttgtatctgcnattatctctggcatgccaagctagttccaactgca

SEQ ID NO: 30529 - DNA, 71 bp, chicken (Gallus Gallus)
  misc_feature (36): n=g or t
ctaattcacccaattataagctgatgactgcttggntggggaaatggggcaatgaaaggtttccttcaagc

SEQ ID NO: 30530 - DNA, 71 bp, chicken (Gallus Gallus)
  misc_feature (36): n=c or t
cctcaaattacaaagtatatggattcttcaggaaanatatacacctccacatgcagagtatatcagataaa

SEQ ID NO: 30531 - DNA, 71 bp, chicken (Gallus Gallus)
  misc_feature (36): n=c or t
ctgggttgaaaacactttgacaatttgccccagcancacattgaaaacaaaatcaatgctaggagctgtga

SEQ ID NO: 30532 - DNA, 71 bp, chicken (Gallus Gallus)
  misc_feature (36): n=a or g
gcttctcaatattcaaatatacaataagtccagaanctaacagagcaggaaaagctatctctgagaaaatt

SEQ ID NO: 30533 - DNA, 71 bp, chicken (Gallus Gallus)
  misc_feature (36): n=a or g
tattacctcaatacctctggaaatttaacctttacnttatgtttggttagctagttattatagattaatga

SEQ ID NO: 30534 - DNA, 71 bp, chicken (Gallus Gallus)
  misc_feature (36): n=a or g
ttgtttctggagaggcaaaatgacagaacctcaggntatataaaggattgggtttgactctcctgtgacag

SEQ ID NO: 30535 - DNA, 71 bp, chicken (Gallus Gallus)
  misc_feature (36): n=c or t
accagatcctacagacgttgctgcatgtcttattcnataccctgtggtctggatcaaggatttacatgttc

SEQ ID NO: 30536 - DNA, 71 bp, chicken (Gallus Gallus)
  misc_feature (36): n=a or g
tatattgctcttgtatgttaaacaatagtcaggcantggtgagatgcaattgattatgtgaaacgttagaa

SEQ ID NO: 30537 - DNA, 71 bp, chicken (Gallus Gallus)
  misc_feature (36): n=c or t
aaccaaagctatctaaaattcaaacccagctgtttncagtctcatagttctgaaatgagtatgggagaaaa

SEQ ID NO: 30538 - DNA, 71 bp, chicken (Gallus Gallus)
  misc_feature (36): n=c or t
aaagcctttacattatgaactcaatctgctacctanagaagagcttccaggtccctttttggttttttcat

SEQ ID NO: 30539 - DNA, 71 bp, chicken (Gallus Gallus)
  misc_feature (36): n=a or g
tttggttgtaatttaaagattgctccataaaactcncactcagctttcttccagccacagtgattgtttaa

SEQ ID NO: 30540 - DNA, 71 bp, chicken (Gallus Gallus)
  misc_feature (36): n=a or g
gtattcagcaaatcttagctccgagactgaaggccntcagtacctggcatttcatgtcctgctattcaaca

SEQ ID NO: 30541 - DNA, 71 bp, chicken (Gallus Gallus)
  misc_feature (36): n=a or g
aaagtcacataaagtagttttagtaacatggtgtgnattcagagtattttgttgagtggaaagttgggttt

SEQ ID NO: 30542 - DNA, 71 bp, chicken (Gallus Gallus)
  misc_feature (36): n=a or g
aatttttttttaaaggcatctggcctactctatggngtcatgccttttgcattattcaggccacagaatag

SEQ ID NO: 30543 - DNA, 71 bp, chicken (Gallus Gallus)
  misc_feature (36): n=c or t
aaaaagataaagacagctcagagatacataaaactngggtttatacattgacattaggtatcgtggcgtct

SEQ ID NO: 30544 - DNA, 71 bp, chicken (Gallus Gallus)
  misc_feature (36): n=c or t
caggagcattctttaaagctgttcatttccagttcnccttcacatgtctgcaaatggggaataggcactgt

SEQ ID NO: 30545 - DNA, 71 bp, chicken (Gallus Gallus)
  misc_feature (36): n=a or g
gctgagagggtgccagctccttctagctgtactcantattcctgtagggcagcacaatgacgttctttttc

SEQ ID NO: 30546 - DNA, 71 bp, chicken (Gallus Gallus)
  misc_feature (36): n=a or g
agacaggacaacatttcaaatgctctcttggaacangcagtttcccacccagctgtaatgataacagcaag

SEQ ID NO: 30547 - DNA, 71 bp, chicken (Gallus Gallus)
  misc_feature (36): n=c or t
cagaagaccttattaacattcttgaatgaaggatcntgcactaaatggtgattcagtgtgaataatcagag

SEQ ID NO: 30548 - DNA, 71 bp, chicken (Gallus Gallus)
  misc_feature (36): n=c or t
tgttccattctggaggtcactgtgctaccagccacncaggagcacagataaaattctgtgcatggttgaac

SEQ ID NO: 30549 - DNA, 71 bp, chicken (Gallus Gallus)
  misc_feature (36): n=a or g
gaaacatgcacgtgttcttcaactgcaaaacacacntgtcactcaaagaaggaatgcaggtatcctcatct

SEQ ID NO: 30550 - DNA, 71 bp, chicken (Gallus Gallus)
  misc_feature (36): n=a or g
ctgcagtctgatctgaattgagactgacgcttagcngtgcttctgatagagtgtgaagttgtccaaacact

SEQ ID NO: 30551 - DNA, 71 bp, chicken (Gallus Gallus)
  misc_feature (36): n=c or t
tatcatcatctgcaagttctttgtttggtgcagaangctcagttgaaagccttgggggctattgacaggag

SEQ ID NO: 30552 - DNA, 71 bp, chicken (Gallus Gallus)
  misc_feature (36): n=a or g
gagctgtcacacagccttggaaatctgtccccagcnagcaagcctgagttgtgttttcctaaaaaaaacaa

SEQ ID NO: 30553 - DNA, 71 bp, chicken (Gallus Gallus)
  misc_feature (36): n=c or t
tgaggagcagcctatggaggagaccaacagccaganctccacctggcacagctggttaagcctgacctcct

SEQ ID NO: 30554 - DNA, 71 bp, chicken (Gallus Gallus)
  misc_feature (36): n=a or g
tcagagctgcaccttactttcaacagtaaatatatntatgcatatatatgaagtatcactgtaggaagtag

SEQ ID NO: 30555 - DNA, 71 bp, chicken (Gallus Gallus)
  misc_feature (36): n=a or c
gcataatgtcaggatgtacatagaagaacaggatgnccaggatggatccacatggaagtgcattgttaggt

SEQ ID NO: 30556 - DNA, 71 bp, chicken (Gallus Gallus)
  misc_feature (36): n=c or t
agtttgagtgagcagctccctgtggcagaagattangtgaatgcagatgctgctcttaacgctgagacaaa

SEQ ID NO: 30557 - DNA, 71 bp, chicken (Gallus Gallus)
  misc_feature (36): n=a or c
tccagcagcagagaagatccacgtgtcctacctaangctgcttaactaactacagcccgaagacaggatag

SEQ ID NO: 30558 - DNA, 71 bp, chicken (Gallus Gallus)
  misc_feature (36): n=a or g
gaacctttctgtgaccacaaaggctggaagcaaatnttgagactgggtagctccttctcagaagtttctct

SEQ ID NO: 30559 - DNA, 71 bp, chicken (Gallus Gallus)
  misc_feature (36): n=a or c
ccatagtataaaggatagccatgaaatatggaagangaaatgagaggagaggcactcattctttttatata

SEQ ID NO: 30560 - DNA, 71 bp, chicken (Gallus Gallus)
  misc_feature (36): n=c or t
ctcagcacacatctgtcctgctaacatcctcgccantgtgcagcaaggcataaaatgagtttccaaggcaa

SEQ ID NO: 30561 - DNA, 71 bp, chicken (Gallus Gallus)
  misc_feature (36): n=a or g
cagtcagcctcctttgaaaggactagagggctcaantaggactgtgtgtgacccacaatgaagaaaaggca

SEQ ID NO: 30562 - DNA, 71 bp, chicken (Gallus Gallus)
  misc_feature (36): n=a or g
tcgcgggccagctgggcaaggcgtacctggaggagnaaacatacaatgactgaactgctgactccagagag

SEQ ID NO: 30563 - DNA, 71 bp, chicken (Gallus Gallus)
  misc_feature (36): n=c or t
gccctttcttctccagcagacaaaattagccagcancttcttctcctgggttctactaaagtgattctagg

SEQ ID NO: 30564 - DNA, 71 bp, chicken (Gallus Gallus)
  misc_feature (36): n=a or g
aaacagttccaattgcaggaacaccattgattggtngctgtgaaatgcaatgctctttcactccccatttg

SEQ ID NO: 30565 - DNA, 71 bp, chicken (Gallus Gallus)
  misc_feature (36): n=c or t
gaccctcccatcacagagagcccttttattcacccnacagaatgccctcacacggacagacacagctctgt

SEQ ID NO: 30566 - DNA, 71 bp, chicken (Gallus Gallus)
  misc_feature (36): n=g or t
ccctgccctcatgtctctgaattcccccagggttgnacaaacaccacccaaacaggcacagaaggagatgt

SEQ ID NO: 30567 - DNA, 71 bp, chicken (Gallus Gallus)
  misc_feature (36): n=c or t
ggctgttcccacccttcaggtgagcagatcagacanccactggatttttaacttgaagtgaaggcaaacaa

SEQ ID NO: 30568 - DNA, 71 bp, chicken (Gallus Gallus)
  misc_feature (36): n=a or g
tttttttgacatttcttgtttctatcacctctcatngcctctcagtcctcttcatctgtggtgtgatggtg

SEQ ID NO: 30569 - DNA, 71 bp, chicken (Gallus Gallus)
  misc_feature (36): n=c or t
agagaatgtgaggctgcaatcatccaaggcgctcancactctttgttgtaggtagatttgtattccatctc

SEQ ID NO: 30570 - DNA, 71 bp, chicken (Gallus Gallus)
  misc_feature (36): n=a or g
gtgcttaaattgaaactcagctcttcgttcacttcnactgacaagattgtattatgattttgttatcggtt

SEQ ID NO: 30571 - DNA, 71 bp, chicken (Gallus Gallus)
  misc_feature (36): n=c or t
gaaagcgcttaatttttgttaagctcttaccagtcngattaaacagctttttgctagttaacttgcaatga

SEQ ID NO: 30572 - DNA, 71 bp, chicken (Gallus Gallus)
  misc_feature (36): n=a or g
tcaggcacacttggtggtaggttctcccctgatggnagaagaaccctgatggttctggaaaacctcatcca

SEQ ID NO: 30573 - DNA, 71 bp, chicken (Gallus Gallus)
  misc_feature (36): n=g or t
cataaatccccctaccttgtttttattgctaaggangcttattgcagtgccagctagggcacaaatgagtg

SEQ ID NO: 30574 - DNA, 71 bp, chicken (Gallus Gallus)
  misc_feature (36): n=c or t
cacaaggatggaagacataaaaaaatcattcacttncagccaaggaagatgactctgctttgcttcggtga

SEQ ID NO: 30575 - DNA, 71 bp, chicken (Gallus Gallus)
  misc_feature (36): n=a or g
ggccacctctctcctctaagctaaaggtgcttcctngctctggttggagctcttgtttccaaacctactgt

SEQ ID NO: 30576 - DNA, 71 bp, chicken (Gallus Gallus)
  misc_feature (36): n=a or g
cagccctgggccctttctgcatctccttcaacacancacgtgaaatcagctccatctctggccgggtatta

SEQ ID NO: 30577 - DNA, 71 bp, chicken (Gallus Gallus)
  misc_feature (36): n=c or t
acctccctgcacagctttctcagcactcagaagggngtgagaagccctgaggggacccataagaagtcaca

SEQ ID NO: 30578 - DNA, 71 bp, chicken (Gallus Gallus)
  misc_feature (36): n=a or g
aggttctcactcaagctctcctcatggtccagcacnaacttgaggatggtggccagctcgacctgtgggac

SEQ ID NO: 30579 - DNA, 71 bp, chicken (Gallus Gallus)
  misc_feature (36): n=c or t
tacgctgcttcgtggccccaaagcttcctcaggacnctccctccaggagaagcgttcacaccgcttccttc

SEQ ID NO: 30580 - DNA, 71 bp, chicken (Gallus Gallus)
  misc_feature (36): n=a or g
aaatgggagaggagcctgggtgcctctggtgtgatnctgtctgtccagctgccatctgtgtctactgattt

SEQ ID NO: 30581 - DNA, 71 bp, chicken (Gallus Gallus)
  misc_feature (36): n=a or g
gtgacagctactctcacccttgcagcgtggctctgnctgaagaggatgagcctggctctaaggtaggcggc

SEQ ID NO: 30582 - DNA, 71 bp, chicken (Gallus Gallus)
  misc_feature (36): n=a or g
tggtgattatgggaagtggagtcctattggtaattntgggagatagatgaccattatagacattatgggag

SEQ ID NO: 30583 - DNA, 71 bp, chicken (Gallus Gallus)
  misc_feature (36): n=a or g
atggagacattaccagtgaaggggcacttcttgtcnatgtaggtgccctcgatagcctacaagagaagcga

SEQ ID NO: 30584 - DNA, 71 bp, chicken (Gallus Gallus)
  misc_feature (36): n=a or g
ctgctggtcagccccggtggctcactctgaaatgtnaacagcatctgaagttacgtgccatccaacggccc

SEQ ID NO: 30585 - DNA, 71 bp, chicken (Gallus Gallus)
  misc_feature (36): n=g or t
cgcggggggcgccgatgcgcagccccttcaatgtgnggtcccacacggctccatccctccctgctgggacg

SEQ ID NO: 30586 - DNA, 71 bp, chicken (Gallus Gallus)
  misc_feature (36): n=a or g
cattactgttttcagggctacagctgagagcactgntgtgtgtggttgaaacaaatgatccttctgtagct

SEQ ID NO: 30587 - DNA, 71 bp, chicken (Gallus Gallus)
  misc_feature (36): n=g or t
actgtctgcaaccccaacatttccccctttgtggtntattaacaaattattggttcaggaccaaaaacagt

SEQ ID NO: 30588 - DNA, 71 bp, chicken (Gallus Gallus)
  misc_feature (36): n=c or t
agcacagcctgtttgcagtcgtgctgcggtcccggnggctgcaggtaggtgatggatgaggggcccggggg

SEQ ID NO: 30589 - DNA, 71 bp, chicken (Gallus Gallus)
  misc_feature (36): n=c or t
cctgtctctttactatccagaaacctcactgcatcntgacatcatccctgcatcccgacagcatccttcca

SEQ ID NO: 30590 - DNA, 71 bp, chicken (Gallus Gallus)
  misc_feature (36): n=c or t
agccgcgtgtggttaggatttcattttagcactgangtgaaacaagccaagaatgcatttgtgcagacagg

SEQ ID NO: 30591 - DNA, 71 bp, chicken (Gallus Gallus)
  misc_feature (36): n=c or t
acaagctgcaacgaccacttctgcactctaattctnatgcaccgaacccaagattctgaggtttcaatacg

SEQ ID NO: 30592 - DNA, 71 bp, chicken (Gallus Gallus)
  misc_feature (36): n=a or c
gatatatgctataaattgtagtatgtagaacattangtttatctccaggttttcttttgctatatgttaaa

SEQ ID NO: 30593 - DNA, 71 bp, chicken (Gallus Gallus)
  misc_feature (36): n=c or t
attagttatataacacttgcttgactctcccacatngcatttgcagacttggctgctaggaaaaccatatc

SEQ ID NO: 30594 - DNA, 71 bp, chicken (Gallus Gallus)
  misc_feature (36): n=a or g
ttcacccattgtcctattgactcattggcccgttgncccattggaccatgccatcagcctggagcacggat

SEQ ID NO: 30595 - DNA, 71 bp, chicken (Gallus Gallus)
  misc_feature (36): n=c or t
agtctttaacacataggatgtatagaataaacctancctcctttttcctgtatgcacccagcaatacacac

SEQ ID NO: 30596 - DNA, 71 bp, chicken (Gallus Gallus)
  misc_feature (36): n=a or g
agagcatggtggtctctgcttaccggtgtcccaaangatatcagctcatgtcaccgctgccaatgtcccca

SEQ ID NO: 30597 - DNA, 71 bp, chicken (Gallus Gallus)
  misc_feature (36): n=c or t
atacacatactcacattcacaggctaactcatgtangttcttgaaatgtattggcacaacaccatgaaaga

SEQ ID NO: 30598 - DNA, 71 bp, chicken (Gallus Gallus)
  misc_feature (36): n=a or c
caggctctgcgtccccaagatgggtctccaagttgngtccccaaactccacatccccaagccctgtgaccc

SEQ ID NO: 30599 - DNA, 71 bp, chicken (Gallus Gallus)
  misc_feature (36): n=a or c
tgtgttagttaagacagaatttaaggtggcaaaggntgtatgaccacctcgaaagatgcagctgttacaag

SEQ ID NO: 30600 - DNA, 71 bp, chicken (Gallus Gallus)
  misc_feature (36): n=a or g
agcatacataaaggatatgagacgacacagaacgcnaggacaggtttggattcagggaaggggtgcaggta

SEQ ID NO: 30601 - DNA, 71 bp, chicken (Gallus Gallus)
  misc_feature (36): n=c or t
aggaaggatgctttaagtgcatattaagcatagcangagggatgcagatgtcttcaagcccttatcccttc

SEQ ID NO: 30602 - DNA, 71 bp, chicken (Gallus Gallus)
  misc_feature (36): n=g or t
catgcacatagtcagagctctgtgctcacagggacngtggagatctcgtcccagctgtaacagactgctca

SEQ ID NO: 30603 - DNA, 71 bp, chicken (Gallus Gallus)
  misc_feature (36): n=a or g
gttcaagatcaatcaataagcagtgccacgtactcnccccacctttttctgttgtgctaaatccaacggtt

SEQ ID NO: 30604 - DNA, 71 bp, chicken (Gallus Gallus)
  misc_feature (36): n=a or g
aagggggtgttacattggttattaaaccactgcagnaacaccacatagggaaaggtgtgatttgtgttagt

SEQ ID NO: 30605 - DNA, 71 bp, chicken (Gallus Gallus)
  misc_feature (36): n=a or g
ctgtcacatgtcacccatcccatggctctggtctgnccccagtgctgcgggggtgtgtgggacactctgcc

SEQ ID NO: 30606 - DNA, 71 bp, chicken (Gallus Gallus)
  misc_feature (36): n=c or t
tataaatctggattcttggcatggaaacgtctcacncacagctgataaaacattcagacccgatgtgatct

SEQ ID NO: 30607 - DNA, 71 bp, chicken (Gallus Gallus)
  misc_feature (36): n=c or t
cacattttaactcgtatctttatcccttcagtaaangttcctcgagtgttctgggtacaggaaaggaaaag

SEQ ID NO: 30608 - DNA, 71 bp, chicken (Gallus Gallus)
  misc_feature (36): n=c or t
catgccataaaacaccgccagtgggtgttgtgcacnctcatcctgaaggcagttttgcgagtgcacctctc

SEQ ID NO: 30609 - DNA, 71 bp, chicken (Gallus Gallus)
  misc_feature (36): n=c or t
aagactgaggaaccccaaaaatatcctccccccagntcactgttatccacacggtgattttcacatttctc

SEQ ID NO: 30610 - DNA, 71 bp, chicken (Gallus Gallus)
  misc_feature (36): n=a or g
aagagaaagatagaaatacaagcacatgtgggtaangctttttatatgttattcctacataataatcatca

SEQ ID NO: 30611 - DNA, 71 bp, chicken (Gallus Gallus)
  misc_feature (36): n=c or t
actgtttaactgccccaccttcaaagtgaagccttngcttcaaactttttaatctcaatacagtcaacaga

SEQ ID NO: 30612 - DNA, 71 bp, chicken (Gallus Gallus)
  misc_feature (36): n=a or g
attgaacttggtgacaaaatatagatcgttttgtgntcttttgtatgactgaaaccattagatctgccaat

SEQ ID NO: 30613 - DNA, 71 bp, chicken (Gallus Gallus)
  misc_feature (36): n=a or g
aggattattaacttgtactaggaaagaatgcttaanttgtagttttaatgttatactctctaccatgaaaa

SEQ ID NO: 30614 - DNA, 71 bp, chicken (Gallus Gallus)
  misc_feature (36): n=a or c
aaggtgaaacttattcagaaattcatccattcctgnatattgattcctgggatgtctggctggaaaaaaaa

SEQ ID NO: 30615 - DNA, 71 bp, chicken (Gallus Gallus)
  misc_feature (36): n=a or g
gtgtttagtaaagagccattgaggctgctgtttgtncaatcaggtgtactgtgttctctgggtcatttgta

SEQ ID NO: 30616 - DNA, 71 bp, chicken (Gallus Gallus)
  misc_feature (36): n=a or c
tactgtttggaaaggggcagtttcacaaaaatgagnatagttgatctagagaactgagtggtcacatcctg

SEQ ID NO: 30617 - DNA, 71 bp, chicken (Gallus Gallus)
  misc_feature (36): n=c or t
gcataaatgcatgtgaagaatgctgtcctgctaacncgtggatctgtgcagctgcgccattccagagcctt

SEQ ID NO: 30618 - DNA, 71 bp, chicken (Gallus Gallus)
  misc_feature (36): n=a or g
tggcaaagggaaaaattgtggtacactctacagcantgaacttttaaagagaatttcctaagacttctcaa

SEQ ID NO: 30619 - DNA, 71 bp, chicken (Gallus Gallus)
  misc_feature (36): n=c or t
ctatcaaactgaagacctcctccgataaacaggagntatctccaagtcaaatgcaaatgtaaacacagaga

SEQ ID NO: 30620 - DNA, 71 bp, chicken (Gallus Gallus)
  misc_feature (36): n=a or g
catttgagggtgcttggcatcactgtcatctgtcanttggtagagcagtgtgaaggttctaaaaaacaaat

SEQ ID NO: 30621 - DNA, 71 bp, chicken (Gallus Gallus)
  misc_feature (36): n=c or t
tgtttccagcacagtaatggggtatctttgtgtggngctgtaaagctgttggaattctagcacaaaacacc

SEQ ID NO: 30622 - DNA, 71 bp, chicken (Gallus Gallus)
  misc_feature (36): n=c or t
catcttcctgctgttcttccaaaacctcttaactantttttcagttgtcagttgaatgctttcttctatca

SEQ ID NO: 30623 - DNA, 71 bp, chicken (Gallus Gallus)
  misc_feature (36): n=c or t
actatgtctcttcagttccagctgctctgtttttcntttcagagctcttttaaagctgctggagtaggact

SEQ ID NO: 30624 - DNA, 71 bp, chicken (Gallus Gallus)
  misc_feature (36): n=g or t
ccctgtggaagactcttctcttcctgaacaaagctngaatctgatcccagaggccagaaacttccatgcct

SEQ ID NO: 30625 - DNA, 71 bp, chicken (Gallus Gallus)
  misc_feature (36): n=c or t
tcccgcctcctcaatgcaaccagcaccttcctcctncctccaggttcaaacaacagagaacaaactctgaa

SEQ ID NO: 30626 - DNA, 71 bp, chicken (Gallus Gallus)
  misc_feature (36): n=a or c
actggtaaagcatagcttcatttctccacagggggnaagtgccaacatatgggcaaaacagtattccaatt

SEQ ID NO: 30627 - DNA, 71 bp, chicken (Gallus Gallus)
  misc_feature (36): n=c or t
tgttttttcttctggagccactcgtgcaacagacanggttccttcctcccaacccaaaggatgttgaaaac

SEQ ID NO: 30628 - DNA, 71 bp, chicken (Gallus Gallus)
  misc_feature (36): n=c or t
acacagtttccaagcttagtctttcatgtcccaaangacaaattaaaccaccttccaaatctttgccctct

SEQ ID NO: 30629 - DNA, 71 bp, chicken (Gallus Gallus)
  misc_feature (36): n=c or t
atttaacagtggccaacaacacccactgaggatcantcgttttcttctcaaacacaccgatttttccatat

SEQ ID NO: 30630 - DNA, 71 bp, chicken (Gallus Gallus)
  misc_feature (36): n=a or g
gtgaattccacaggttaaaagagagagatcccttcnttttttagctgctttggcaattattcaaaacagta

SEQ ID NO: 30631 - DNA, 71 bp, chicken (Gallus Gallus)
  misc_feature (36): n=a or g
gtttaagataaatgttccagttcaggcaaatatccnaagggacagaggagacaggtcttgaatttgcgttt

SEQ ID NO: 30632 - DNA, 71 bp, chicken (Gallus Gallus)
  misc_feature (36): n=a or g
tacgctgtctacagttgatgacagatagaattacangattatagaattcttcagaggagtgatatgattgc

SEQ ID NO: 30633 - DNA, 71 bp, chicken (Gallus Gallus)
  misc_feature (36): n=a or g
atatgcatgaaggagattcaggacacaggccaaagnatagaagggaaatgactgtggtggataatagattt

SEQ ID NO: 30634 - DNA, 71 bp, chicken (Gallus Gallus)
  misc_feature (36): n=a or g
agagcctttgtatgaatctctgtgaaaaacacatcnattaggtgacatttatcttataaactcctccagag

SEQ ID NO: 30635 - DNA, 71 bp, chicken (Gallus Gallus)
  misc_feature (36): n=c or t
ttttatatacaccacatggtacaagacataatcacnttgtgactcagcatactggaccaggtgtacattct

SEQ ID NO: 30636 - DNA, 71 bp, chicken (Gallus Gallus)
  misc_feature (36): n=c or t
gaacttgggcaattttgctgcagccccctgagctgngaaaagggctaaatatccctcctgtcagcactgac

SEQ ID NO: 30637 - DNA, 71 bp, chicken (Gallus Gallus)
  misc_feature (36): n=c or t
ctcctcttgttcagtttgggcacgttgtctcagtgntgagtctttaaattcaatcatactcagacatgtcc

SEQ ID NO: 30638 - DNA, 71 bp, chicken (Gallus Gallus)
  misc_feature (36): n=a or g
gctttgctgataatctttcggtgttcaaaaggagtnaaactaaaaaataagcaggtaaccaaataaccagt

SEQ ID NO: 30639 - DNA, 71 bp, chicken (Gallus Gallus)
  misc_feature (36): n=a or g
tatttcagaaatgcaaattcaaggatatgattaacntttatgatgcacgccttgtactataaaagaagtag

SEQ ID NO: 30640 - DNA, 71 bp, chicken (Gallus Gallus)
  misc_feature (36): n=c or t
tttgctttcagaagtgctacattgggttgtgtgagnatccatatggggacttcaggccagtcaccagaatt

SEQ ID NO: 30641 - DNA, 71 bp, chicken (Gallus Gallus)
  misc_feature (36): n=c or t
attaatagggactgttaataaaaggctagcatgcanatatattccagagcaagagttcatctaatggaaga

SEQ ID NO: 30642 - DNA, 71 bp, chicken (Gallus Gallus)
  misc_feature (36): n=c or t
ctgtagacatcagcagagcagatttcaagccgaganctgcagagacctctttcccattgtaaatgctaagc

SEQ ID NO: 30643 - DNA, 71 bp, chicken (Gallus Gallus)
  misc_feature (36): n=a or c
agcataactctgaaggaagcttacacataaaaatantaatcagaatgagctacaaggagacgaaagaagtg

SEQ ID NO: 30644 - DNA, 71 bp, chicken (Gallus Gallus)
  misc_feature (36): n=c or t
tagatccatattacacctgttatagcatacattcangatcttcataattgatatagttttctgaatagtaa

SEQ ID NO: 30645 - DNA, 71 bp, chicken (Gallus Gallus)
  misc_feature (36): n=c or t
gtgaggtctgatttacacccttgttccatcttagantgtagtaagggattatttggttttgacatctatag

SEQ ID NO: 30646 - DNA, 71 bp, chicken (Gallus Gallus)
  misc_feature (36): n=a or g
tgtatagttttcttgttattctgcatgagtttgagncatcattttacttggtgaatgatggacttggtaca

SEQ ID NO: 30647 - DNA, 71 bp, chicken (Gallus Gallus)
  misc_feature (36): n=a or g
ccatacagttagaatcagcctttttattttcacatncaatctgtccctttaaaattctgttttttgtaaca

SEQ ID NO: 30648 - DNA, 71 bp, chicken (Gallus Gallus)
  misc_feature (36): n=g or t
atgggaactgcaaggtacatttggtggaaataatcngggaaataatctgttgagtctatgcaatgaaaata

SEQ ID NO: 30649 - DNA, 71 bp, chicken (Gallus Gallus)
  misc_feature (36): n=a or g
gtgaagaaagcaagatgacttccttatccatagatntgtatactctgcggactttatgatacaattaaagg

SEQ ID NO: 30650 - DNA, 71 bp, chicken (Gallus Gallus)
  misc_feature (36): n=a or g
caaataatacctcttccttaactatgaaattaatanggactgtagcactgaagaaatctgctgtgttctgg

SEQ ID NO: 30651 - DNA, 71 bp, chicken (Gallus Gallus)
  misc_feature (36): n=c or t
aagacagtataaaattgttccaggttagcattttcnggggaagaggagttaatctgacaaacctcctaatc

SEQ ID NO: 30652 - DNA, 71 bp, chicken (Gallus Gallus)
  misc_feature (36): n=c or t
atggtgtcctggaatttcatgaggaaatataaatanaaatccactctgttctgatatggctacacctcaac

SEQ ID NO: 30653 - DNA, 71 bp, chicken (Gallus Gallus)
  misc_feature (36): n=c or t
agtctggtttgtttctctcccatatattggtcatcntagagacagcttccaataggcagtataattaagga

SEQ ID NO: 30654 - DNA, 71 bp, chicken (Gallus Gallus)
  misc_feature (36): n=c or t
tattctaaaacagtaggagaaatcatcatagcttcngataaacaggattgcataattttaagtctaaaata

SEQ ID NO: 30655 - DNA, 71 bp, chicken (Gallus Gallus)
  misc_feature (36): n=c or t
taaaggtgtcaaaatgcctcaaatgtagacagattnaggggaggtgaatccatttccaagggggttatcca

SEQ ID NO: 30656 - DNA, 71 bp, chicken (Gallus Gallus)
  misc_feature (36): n=g or t
aaaagctgccattagaggtgagacataaattagacngatataggatgctctattcccacctctggcatgta

SEQ ID NO: 30657 - DNA, 71 bp, chicken (Gallus Gallus)
  misc_feature (36): n=a or g
gatgtttctaaagctgttctccagtggtctgactcncagtttggcagtgcacacaggcccaaacagcatgg

SEQ ID NO: 30658 - DNA, 71 bp, chicken (Gallus Gallus)
  misc_feature (36): n=c or t
tattactcttcaggcttcacatagcattcatttctntgaatgaaaacaaatgactccttgcaagaggcagg

SEQ ID NO: 30659 - DNA, 71 bp, chicken (Gallus Gallus)
  misc_feature (36): n=a or g
tatggaccagaattttcactgccaaaattgaaggtngtttgctttaatcagagctgattttttacacagtc

SEQ ID NO: 30660 - DNA, 71 bp, chicken (Gallus Gallus)
  misc_feature (36): n=c or t
tacaccactgcccaatccattatactattctgcctnctgttaccagtgctacaagcggctcatccatttaa

SEQ ID NO: 30661 - DNA, 71 bp, chicken (Gallus Gallus)
  misc_feature (36): n=c or t
aaaatcaaaatacatactggaattccatgcaattgnggtttatctatcaaactgtgcagctcattctttga

SEQ ID NO: 30662 - DNA, 71 bp, chicken (Gallus Gallus)
  misc_feature (36): n=a or g
cattagaaataacttctccaaggtcaccacatgcangcaatcacaaatgcaggtctgaaatagcaaaaggt

SEQ ID NO: 30663 - DNA, 71 bp, chicken (Gallus Gallus)
  misc_feature (36): n=a or g
ataaaaaatttgtgagcagtgttcagtgcaacagtntgtgtttcttcttgaatgtcagtacagcctttgaa

SEQ ID NO: 30664 - DNA, 71 bp, chicken (Gallus Gallus)
  misc_feature (36): n=c or t
aagttctcacttcaaagacttttccaataatcatcnagcctctcctgtagttactgaactggtagaataga

SEQ ID NO: 30665 - DNA, 71 bp, chicken (Gallus Gallus)
  misc_feature (36): n=a or g
gtgtagaaatagcggacattgcaaagtcgggcacgntgtgagtgctgctcagggtctgaagagagttaagt

SEQ ID NO: 30666 - DNA, 71 bp, chicken (Gallus Gallus)
  misc_feature (36): n=a or c
gcctgtgaaatatatttcattccttccaactgtttntagccttttagccccgctgaaaatccctccaacaa

SEQ ID NO: 30667 - DNA, 71 bp, chicken (Gallus Gallus)
  misc_feature (36): n=a or g
caggatccctcagagattttaggatcatgctgaaanatcccacagcatgcattcaagtcatttggctatgg

SEQ ID NO: 30668 - DNA, 71 bp, chicken (Gallus Gallus)
  misc_feature (36): n=a or g
ccaaacatttttatgagcagtataaatgcttaagcnctccagatttccatagctgcttttggcttttgtat

SEQ ID NO: 30669 - DNA, 71 bp, chicken (Gallus Gallus)
  misc_feature (36): n=c or t
attaacagcgtggacttcttaagtattacttttaantgttcagagactgacatggagctggcaataacctg

SEQ ID NO: 30670 - DNA, 71 bp, chicken (Gallus Gallus)
  misc_feature (36): n=c or t
ttttaggaccattagtgggttctgtacctttgtagntcttaccacctgcaaaacaaaacgaacgtcatgcc

SEQ ID NO: 30671 - DNA, 71 bp, chicken (Gallus Gallus)
  misc_feature (36): n=a or g
acagaaaattgccccccgcagatcaagaggtctganctatttggcagcgagttactgtggagggcagaaag

SEQ ID NO: 30672 - DNA, 71 bp, chicken (Gallus Gallus)
  misc_feature (36): n=a or g
gtttacatagaagaagctatgctgaaataatatgantaaaacctgaagtacatgaagtagtgtacagatgt

SEQ ID NO: 30673 - DNA, 71 bp, chicken (Gallus Gallus)
  misc_feature (36): n=c or t
ttctgacactggcagaccagcacaggaacagggcanggtttcccagctgataacagtttgtggttcagaga

SEQ ID NO: 30674 - DNA, 71 bp, chicken (Gallus Gallus)
  misc_feature (36): n=a or g
ttacaacttcaccaaaggaataggtgacagcctgcntcaaatctggtacctgtggagactgtgggctgctt

SEQ ID NO: 30675 - DNA, 71 bp, chicken (Gallus Gallus)
  misc_feature (36): n=c or t
atcaagtaacagcatttatttgtatgttaattgctnttcagacctataacctttctgttcggtagttctgt

SEQ ID NO: 30676 - DNA, 71 bp, chicken (Gallus Gallus)
  misc_feature (36): n=c or t
taaagcaacatgatagaagacttcatattaacagtngattaatattttctatttgcagcatataaagaaca

SEQ ID NO: 30677 - DNA, 71 bp, chicken (Gallus Gallus)
  misc_feature (36): n=a or c
atgcattaggtatgcagcagaagaaactaaacttgnatgtaaagtgtgagacaaactctaacagtgcaaat

SEQ ID NO: 30678 - DNA, 71 bp, chicken (Gallus Gallus)
  misc_feature (36): n=a or g
aattacaggcactgatgctttgggttatctataacnatttggaactgtggagaacttaatgctataaatca

SEQ ID NO: 30679 - DNA, 71 bp, chicken (Gallus Gallus)
  misc_feature (36): n=c or t
tgggtgcagcagaagggtaaagctgagaagagatangatgattagggactacatgttataatatttgtaaa

SEQ ID NO: 30680 - DNA, 71 bp, chicken (Gallus Gallus)
  misc_feature (36): n=a or g
cttttggaagtgccacagttgtgtgctggcggagtnagctggagtgctttgaatctgcccagccaacctct

SEQ ID NO: 30681 - DNA, 71 bp, chicken (Gallus Gallus)
  misc_feature (36): n=a or g
ctgattttgaacatgtattagagcagaactatagcnacatcattaaatggagggagacagtctatctagat

SEQ ID NO: 30682 - DNA, 71 bp, chicken (Gallus Gallus)
  misc_feature (36): n=a or g
aaaaaagataaaggatagagcttcccaatttttttnctttgaatgactttctgagaaatactttctcatgc

SEQ ID NO: 30683 - DNA, 71 bp, chicken (Gallus Gallus)
  misc_feature (36): n=a or g
aagtaactttttgtctgcctttgcctcttgtcatcntaaaagccattctggacagaacaatggaaaaaaat

SEQ ID NO: 30684 - DNA, 71 bp, chicken (Gallus Gallus)
  misc_feature (36): n=c or t
agccatctctctggctttatattgtatcactttctnaaatcagtgagggctttggagtctattccttgaaa

SEQ ID NO: 30685 - DNA, 71 bp, chicken (Gallus Gallus)
  misc_feature (36): n=c or t
acgtggaacattttaaataggaaagccccaagtagncagcttcttcttgcttccagtctcgtgcttattct

SEQ ID NO: 30686 - DNA, 71 bp, chicken (Gallus Gallus)
  misc_feature (36): n=a or g
gaatggaatgacttgcgtgttattatgacaacaggngatatgtcattggtgctgtttataaggaaatgccc

SEQ ID NO: 30687 - DNA, 71 bp, chicken (Gallus Gallus)
  misc_feature (36): n=a or c
tatgggtcccttcaaactcagggtattttatggttntttgtgtcatatttaattattatcctgaaagtacc

SEQ ID NO: 30688 - DNA, 71 bp, chicken (Gallus Gallus)
  misc_feature (36): n=a or c
aattttatctgctcatttattactgaattaaatagnagtttcatgggagaaatccctgtcgcacttacaac

SEQ ID NO: 30689 - DNA, 71 bp, chicken (Gallus Gallus)
  misc_feature (36): n=a or g
aaactactctgccgagcatcaaaagaaggaaagtangaacataaggtgccaagaataagaaaaatacaaag

SEQ ID NO: 30690 - DNA, 71 bp, chicken (Gallus Gallus)
  misc_feature (36): n=g or t
tgcttctcaaatgtcttaaatgtttcacttgcacancaaatctttgtctgagacagtaatactcctctcac

SEQ ID NO: 30691 - DNA, 71 bp, chicken (Gallus Gallus)
  misc_feature (36): n=a or g
attatttgcttttttgtcaacttagaagataatgantttattctggcatagaacactgaatttggaggaaa

SEQ ID NO: 30692 - DNA, 71 bp, chicken (Gallus Gallus)
  misc_feature (36): n=c or t
ataactgttatcacctttaaattgtggtagatcctngatgacaggaacatacagattttagcataaagaga

SEQ ID NO: 30693 - DNA, 71 bp, chicken (Gallus Gallus)
  misc_feature (36): n=a or g
ccaaagcataacgtcctattccacagttctgccccntgcaccaggttctgtctccatcttgttgcatagca

SEQ ID NO: 30694 - DNA, 71 bp, chicken (Gallus Gallus)
  misc_feature (36): n=c or t
tgtaccttaatctctgttttgaggatgtttgtaggncagttttctacaatagtccccggtgcactgagtgt

SEQ ID NO: 30695 - DNA, 71 bp, chicken (Gallus Gallus)
  misc_feature (36): n=a or g
aaatctgtaattattgtttagtgaagagacactccncttttctattttgaaaactggtttttaagtactgt

SEQ ID NO: 30696 - DNA, 71 bp, chicken (Gallus Gallus)
  misc_feature (36): n=a or g
atgtacattgcagcataattctgaagctcccttacnctacctatttagcctccctgacctctagtctcttt

SEQ ID NO: 30697 - DNA, 71 bp, chicken (Gallus Gallus)
  misc_feature (36): n=c or t
ccaggggctgtaaagttgatatgcatatgagtttgncacacacatcctggattactgtgattctatttctc

SEQ ID NO: 30698 - DNA, 71 bp, chicken (Gallus Gallus)
  misc_feature (36): n=c or t
ttcacctttattcttgttcccatttctcctttcacnacactctcctccacttagccagttttctttccctg

SEQ ID NO: 30699 - DNA, 71 bp, chicken (Gallus Gallus)
  misc_feature (36): n=a or g
ctcaaccaactcccatacagactggtagtgcaggcngaaaggatatgtctgcatctatgctgataaatcct

SEQ ID NO: 30700 - DNA, 71 bp, chicken (Gallus Gallus)
  misc_feature (36): n=c or t
ctatgggaacagaaaatgtagagtgattttacagtncatgtttgctcaaatcactcatgagttaacacagc

SEQ ID NO: 30701 - DNA, 71 bp, chicken (Gallus Gallus)
  misc_feature (36): n=c or t
cacaaattgacaacaggcttttgagaacttgttcangcagtgaatattgttgctgtgtaattcagtagcag

SEQ ID NO: 30702 - DNA, 71 bp, chicken (Gallus Gallus)
  misc_feature (36): n=a or g
acattcttcagccccacagctaaagctcttcttgangctccaggatattgcagtagtgttctttcttttcc

SEQ ID NO: 30703 - DNA, 71 bp, chicken (Gallus Gallus)
  misc_feature (36): n=c or t
gcaaaagaggcaatgtgttcacaaatactatagacnacataaatcttgcaagcacaaaccatgtcatttca

SEQ ID NO: 30704 - DNA, 71 bp, chicken (Gallus Gallus)
  misc_feature (36): n=a or g
tcatcccatccacattatcagcatcttacagaactnggcctctgacaagccatgctgtcccagtaggcagt

SEQ ID NO: 30705 - DNA, 71 bp, chicken (Gallus Gallus)
  misc_feature (36): n=g or t
ggtactcctggtacagtaagcatgactatttttggnatatgttcatatttcaagattaacaggggaatttt

SEQ ID NO: 30706 - DNA, 71 bp, chicken (Gallus Gallus)
  misc_feature (36): n=a or g
catctcatgacagtttatcagacatcagtactcacnaaagttttcttccacacatttgtccagtgtgaggt

SEQ ID NO: 30707 - DNA, 71 bp, chicken (Gallus Gallus)
  misc_feature (36): n=a or g
gcagtagcagccaagctgtccctctctctgcattcntgtgttatatgtgcagatgctctattactgaaggt

SEQ ID NO: 30708 - DNA, 71 bp, chicken (Gallus Gallus)
  misc_feature (36): n=g or t
gggatttctgtagaatcccattttttggtattaatnttggtgctgacaaatgggacactccttctaccatc

SEQ ID NO: 30709 - DNA, 71 bp, chicken (Gallus Gallus)
  misc_feature (36): n=c or t
tgcattccttcagcaaactcatgctacttgtattancattccttcccgctcttctctccagatttaaatat

SEQ ID NO: 30710 - DNA, 71 bp, chicken (Gallus Gallus)
  misc_feature (36): n=c or t
cccaacctcttccttttccatcttttccacttcctnctctttccttccccaagatctgcaaaaatcaacca

SEQ ID NO: 30711 - DNA, 71 bp, chicken (Gallus Gallus)
  misc_feature (36): n=c or t
aacgtgtcagtgactaatggagtattttccataaangtatctcccttcttgctggtaccgcccaagatgac

SEQ ID NO: 30712 - DNA, 71 bp, chicken (Gallus Gallus)
  misc_feature (36): n=c or t
gtggttcggaaataggtctgaattattttattgccnggttcttgtcatcactttgataggcattagttact

SEQ ID NO: 30713 - DNA, 71 bp, chicken (Gallus Gallus)
  misc_feature (36): n=c or t
ctctggggaattctgacagtgtaatgcttcagaaangctgtgtacctagagattgattagaactggggctg

SEQ ID NO: 30714 - DNA, 71 bp, chicken (Gallus Gallus)
  misc_feature (36): n=c or t
ctttttgaagctacacttattaggagtatcattttnattgcttaaatgattaaatatacgtatatttatta

SEQ ID NO: 30715 - DNA, 71 bp, chicken (Gallus Gallus)
  misc_feature (36): n=a or g
gatgaggaaggcaccctcatgttccagaaaccctcncagcactgggcttttctttggactccagtttgagg

SEQ ID NO: 30716 - DNA, 71 bp, chicken (Gallus Gallus)
  misc_feature (36): n=a or g
ctgctaatataacgctttgcagacaaaaatacaganattgtttcctcctagtatgcctgatggcaagcctc

SEQ ID NO: 30717 - DNA, 71 bp, chicken (Gallus Gallus)
  misc_feature (36): n=a or g
aagaccaaacaagcacaactgaaatctctatacacnctctaatgatacagaaagaaggcatccagattaga

SEQ ID NO: 30718 - DNA, 71 bp, chicken (Gallus Gallus)
  misc_feature (36): n=c or t
ggttgtctgcaaagaatagggacagtgtaattttcntggaatgtagcttctcctttcttaaagggccaagt

SEQ ID NO: 30719 - DNA, 71 bp, chicken (Gallus Gallus)
  misc_feature (36): n=c or t
ttttaatttttgtaaaatcatatggttttctctcanaagaaagtaaaagctatattagaaggttactttct

SEQ ID NO: 30720 - DNA, 71 bp, chicken (Gallus Gallus)
  misc_feature (36): n=g or t
taaacagagggagcttggaaatgaaacttttggggnctaatcccttctctcatttgtttcttgttggtttt

SEQ ID NO: 30721 - DNA, 71 bp, chicken (Gallus Gallus)
  misc_feature (36): n=a or g
gcattagtgcatagatgcatcagatctgatttcatntgatagcttggagctttgtgatccactgaatgtgt

SEQ ID NO: 30722 - DNA, 71 bp, chicken (Gallus Gallus)
  misc_feature (36): n=c or t
aatgtggagcctgtgtcccagcaaactgtcccatcntgcccctatggccaatcctagctgatgtgaatggg

SEQ ID NO: 30723 - DNA, 71 bp, chicken (Gallus Gallus)
  misc_feature (36): n=c or t
aagcaggaagcagagcccaacaaacattactaaatngtgctaaaagatgagaaagttgactttgctcctaa

SEQ ID NO: 30724 - DNA, 71 bp, chicken (Gallus Gallus)
  misc_feature (36): n=c or t
ggggacacctgagaccagaggatccatggctgggcnttgctccatgtatttactccttctgtcagagccat

SEQ ID NO: 30725 - DNA, 71 bp, chicken (Gallus Gallus)
  misc_feature (36): n=a or g
tttccccctatctagtttgttaatactggaaaggcnattggacagtggggcctcctcattcttggcactat

SEQ ID NO: 30726 - DNA, 71 bp, chicken (Gallus Gallus)
  misc_feature (36): n=c or t
gaccaatatgcttaaggctatccaagttggccccangacagttataatgtgtaaggtttaaacaaattttc

SEQ ID NO: 30727 - DNA, 71 bp, chicken (Gallus Gallus)
  misc_feature (36): n=c or t
ttacatggtaatagtgaattttccatattggatcanaccactagtccatcaacttgtatgtcctgactgta

SEQ ID NO: 30728 - DNA, 71 bp, chicken (Gallus Gallus)
  misc_feature (36): n=c or t
ttactgtgaaaccattccccgtatttaggcagttanaaagattgttgtctcaaacagactgagtttatcca

SEQ ID NO: 30729 - DNA, 71 bp, chicken (Gallus Gallus)
  misc_feature (36): n=c or t
tatgttgaagtagtgacaagagaaaggcaaagaganaaatgtaaagacaatggctatttcagtatttccaa

SEQ ID NO: 30730 - DNA, 71 bp, chicken (Gallus Gallus)
  misc_feature (36): n=c or t
aaaacttgactttcttttgtaagcaataaaatcaanctaggtctgaagatttggtttgatatgcccaggca

SEQ ID NO: 30731 - DNA, 71 bp, chicken (Gallus Gallus)
  misc_feature (36): n=a or g
cgatagtcaagccaactgctaggatttgtaaaatanattattcttgtcatggttattgaggaacaattatt

SEQ ID NO: 30732 - DNA, 71 bp, chicken (Gallus Gallus)
  misc_feature (36): n=a or g
gtaattcatccctaatactttggaactacagaaaancaaggttatttgttttgcatacatgccaagaatca

SEQ ID NO: 30733 - DNA, 71 bp, chicken (Gallus Gallus)
  misc_feature (36): n=a or g
aatactgggagtttagtggtcataaagcagcacagnctctccgttctttgagtttcagtcaactttccaaa

SEQ ID NO: 30734 - DNA, 71 bp, chicken (Gallus Gallus)
  misc_feature (36): n=g or t
aaggctggctatgaaaagtgagatattcattagagnctgcatttgcaacagagtcatgactgttttctcct

SEQ ID NO: 30735 - DNA, 71 bp, chicken (Gallus Gallus)
  misc_feature (36): n=a or g
gaaaataaccacagtgacaagggaaggccaccccanaagacagccaccagagaccagtatattagatatga

SEQ ID NO: 30736 - DNA, 71 bp, chicken (Gallus Gallus)
  misc_feature (36): n=c or t
agggacttttgaactctacacacatattctgttaanatttccagactatcgtaggagttccaaaacaactg

SEQ ID NO: 30737 - DNA, 71 bp, chicken (Gallus Gallus)
  misc_feature (36): n=a or g
gtcatcagctaagctggcctgttagcccataatggnagcaggtccaaagtggctgcaattctcctgtctcc

SEQ ID NO: 30738 - DNA, 71 bp, chicken (Gallus Gallus)
  misc_feature (36): n=c or t
atgaaacttgttaaagccaaggtgaactgtggcacnacatccaaatgcagaaaaagacaatcacatttttc

SEQ ID NO: 30739 - DNA, 71 bp, chicken (Gallus Gallus)
  misc_feature (36): n=c or t
ttgcctagtctgtaagaccgtattgcttgaaacaanccggccttctccttggtcctttagctccatgcttc

SEQ ID NO: 30740 - DNA, 71 bp, chicken (Gallus Gallus)
  misc_feature (36): n=g or t
cctctcagagcacaacagagtttccgaagaataaanaaggccagctctcaggcttcctgaagatttaataa

SEQ ID NO: 30741 - DNA, 71 bp, chicken (Gallus Gallus)
  misc_feature (36): n=c or t
ctggctgatgctgtaggtgagttcctcccaagaacnactaacctgaacttctaacattcaaatatttttac

SEQ ID NO: 30742 - DNA, 71 bp, chicken (Gallus Gallus)
  misc_feature (36): n=g or t
ttcattttgtgcttggaaattagataccagaagggngtggaagtggtactgaatatgagagaactcatatg

SEQ ID NO: 30743 - DNA, 71 bp, chicken (Gallus Gallus)
  misc_feature (36): n=c or t
tttctgaacgaactctgatacacatctgaatgcatnacatacagctcctctagggtgctgaacaaaaagat

SEQ ID NO: 30744 - DNA, 71 bp, chicken (Gallus Gallus)
  misc_feature (36): n=c or t
cggtgtaagtcatttcacttaaaactgaaagatagnatgagagatggaggaagcatttaaagtaccttgtg

SEQ ID NO: 30745 - DNA, 71 bp, chicken (Gallus Gallus)
  misc_feature (36): n=a or g
tttcctttagctcagcttttaacactttttcacatntaaaactgaatctactgaggagattttatttcaac

SEQ ID NO: 30746 - DNA, 71 bp, chicken (Gallus Gallus)
  misc_feature (36): n=c or t
cccaccaccattgcaagaaaagtttcatttgctgangcatttgggtttgatcttgtgtctgttaaagagtt

SEQ ID NO: 30747 - DNA, 71 bp, chicken (Gallus Gallus)
  misc_feature (36): n=a or g
gtatcaattaagtagcaattatgtatgaagtggggnaaaaaagtgatgatataaataagtaatgcacacga

SEQ ID NO: 30748 - DNA, 71 bp, chicken (Gallus Gallus)
  misc_feature (36): n=a or g
gaaataattctgtatctcaagttctcttgtaatctnttaccacctgtgaaaaaaaatagatgccaaaaagc

SEQ ID NO: 30749 - DNA, 71 bp, chicken (Gallus Gallus)
  misc_feature (36): n=c or t
agggagacatacttatgaatacaaataaagaactcngcaaagaagaagataattcttaagggaaatattta

SEQ ID NO: 30750 - DNA, 71 bp, chicken (Gallus Gallus)
  misc_feature (36): n=a or c
attgcagctgctgacatcggagagcaactgaacaantgaaaaagaactaattctgtgcccaccaagagttt

SEQ ID NO: 30751 - DNA, 71 bp, chicken (Gallus Gallus)
  misc_feature (36): n=a or g
atttctccactataggaataatgcataaggacatcnctaattaggctctgtatttcagtgctaaaaataga

SEQ ID NO: 30752 - DNA, 71 bp, chicken (Gallus Gallus)
  misc_feature (36): n=c or t
aatgctgtttgtgctcctccagactcataggcaganagaatcttgaaatgaagattatatttttttaatct

SEQ ID NO: 30753 - DNA, 71 bp, chicken (Gallus Gallus)
  misc_feature (36): n=a or g
acttattttcagggtcgagagtaagtttcctgcagngttctccttgtgaaaaggtgtatcttgctatttag

SEQ ID NO: 30754 - DNA, 71 bp, chicken (Gallus Gallus)
  misc_feature (36): n=g or t
agaggtaaggatctcagaggtgacagattcctgggnagaagagggagggtgacagttggagttccttgagc

SEQ ID NO: 30755 - DNA, 71 bp, chicken (Gallus Gallus)
  misc_feature (36): n=a or g
ggttggctgtctttgaggagaggggccatggggganataaagaactgcaagcctggagagtgcactgtaag

SEQ ID NO: 30756 - DNA, 71 bp, chicken (Gallus Gallus)
  misc_feature (36): n=a or g
aaaaattaatcttagttacataaaagcactgtcaantatacataaaataatacatacgacatctaaaaaat

SEQ ID NO: 30757 - DNA, 71 bp, chicken (Gallus Gallus)
  misc_feature (36): n=c or t
actctggggacaataacactggcagtggtgttggtnatactgcaccaaattgacattcatcattcagacta

SEQ ID NO: 30758 - DNA, 71 bp, chicken (Gallus Gallus)
  misc_feature (36): n=a or g
tgtagcattcatgcctacacagaggccaagatcccngttagctggagaggacttgcagcactttggctgtc

SEQ ID NO: 30759 - DNA, 71 bp, chicken (Gallus Gallus)
  misc_feature (36): n=c or t
ttcagacaatttgaaatggttattccaacagaagantctgttattacagagatgacatcaactttaagaga

SEQ ID NO: 30760 - DNA, 71 bp, chicken (Gallus Gallus)
  misc_feature (36): n=c or t
tctgggggactcagagcaccccagcagacatttagntgaactcttgtaagcagagggagacaatgttaaag

SEQ ID NO: 30761 - DNA, 71 bp, chicken (Gallus Gallus)
  misc_feature (36): n=a or g
accagggagctggacagcgtttaaaaaaaagaaagngctatttgtgtaaccaatatgataaatttcaaaaa

SEQ ID NO: 30762 - DNA, 71 bp, chicken (Gallus Gallus)
  misc_feature (36): n=g or t
ggttgtcatcctaaaaatgttaggagacaagcatgnggatcttgtacaaatagtgactatacatggacata

SEQ ID NO: 30763 - DNA, 71 bp, chicken (Gallus Gallus)
  misc_feature (36): n=a or g
catgagcactgttcagggtatacttgggcactcccnaaatgagtttttattggtttcttactgaatcttaa

SEQ ID NO: 30764 - DNA, 71 bp, chicken (Gallus Gallus)
  misc_feature (36): n=c or t
ttgtttaattaacaatgcccccatttataatcagcnaacttgagcataatgatcacagttacggttgtttt

SEQ ID NO: 30765 - DNA, 71 bp, chicken (Gallus Gallus)
  misc_feature (36): n=a or g
agtggtgaacaccctgtgggaccaggtgtccctttnggctgtcctcaggatccttctctgtgcctgccgtg

SEQ ID NO: 30766 - DNA, 71 bp, chicken (Gallus Gallus)
  misc_feature (36): n=c or t
acagtggctgcaaacctggggcatggggctgcaagnacaagacatggggctgcaagcacaattcaaggggt

SEQ ID NO: 30767 - DNA, 71 bp, chicken (Gallus Gallus)
  misc_feature (36): n=a or g
atggtttatattttgagagaatgcatatgttgccantgagggactattgatgtagaccatatttccggagg

SEQ ID NO: 30768 - DNA, 71 bp, chicken (Gallus Gallus)
  misc_feature (36): n=a or g
cagtattgcaacagccttattagaattgggaaaatntatgacaaataatggagaacctttgcataagctgg

SEQ ID NO: 30769 - DNA, 71 bp, chicken (Gallus Gallus)
  misc_feature (36): n=a or g
atcattttattccagcactgattttgctattatccnctaaatgtctatattcaaagtttgtcagggaactt

SEQ ID NO: 30770 - DNA, 71 bp, chicken (Gallus Gallus)
  misc_feature (36): n=a or g
aattaggcagggagtttgagaatgccaatgattccnaaagtcactgatgcaattatagattttcattatgt

SEQ ID NO: 30771 - DNA, 71 bp, chicken (Gallus Gallus)
  misc_feature (36): n=a or g
cttctaaatgggatatgacacatagcttatatcacncctggtcagagaaatggacagagcactgcaaactt

SEQ ID NO: 30772 - DNA, 71 bp, chicken (Gallus Gallus)
  misc_feature (36): n=a or c
gaagggatgtgtgtgagagaagcagagggagtaagnaaatgtatcctgtgaagagttaccagcttttaata

SEQ ID NO: 30773 - DNA, 71 bp, chicken (Gallus Gallus)
  misc_feature (36): n=a or c
tttgctattaaagtgtcagaataatggaaactgaanagtagcattattcatcagtacttaaagtagaaatg

SEQ ID NO: 30774 - DNA, 71 bp, chicken (Gallus Gallus)
  misc_feature (36): n=c or t
aggtattttcaaagttaggtctgttttcagtatttngagaaccttagaaattccttccaaacaaaaccaga

SEQ ID NO: 30775 - DNA, 71 bp, chicken (Gallus Gallus)
  misc_feature (36): n=a or c
ctttaatggctattgtggatctattcagcctattcnatttcagcatctgcttgctgttgagatcacaagac

SEQ ID NO: 30776 - DNA, 71 bp, chicken (Gallus Gallus)
  misc_feature (36): n=a or g
tcttatatttaatctggatagccctatggtaaaacnaagtagtagagaatcaggcatagattttctgactc

SEQ ID NO: 30777 - DNA, 71 bp, chicken (Gallus Gallus)
  misc_feature (36): n=c or t
aagcacttttaagtcagagagcagagaaggtgaaanagctcatcaaggatgaaggagtatcccatctaata

SEQ ID NO: 30778 - DNA, 71 bp, chicken (Gallus Gallus)
  misc_feature (36): n=g or t
actggaggacaagatggctcagtcacgttactgttntggtggctggcttcaggatcagaggactggccttc

SEQ ID NO: 30779 - DNA, 71 bp, chicken (Gallus Gallus)
  misc_feature (36): n=c or t
aaagcccttcaaaaagggcatgagttggtaacttanacagtttatgttacaaaaaagatttctgatgatat

SEQ ID NO: 30780 - DNA, 71 bp, chicken (Gallus Gallus)
  misc_feature (36): n=c or t
agtgggcaatcaggggatgtatttcacctgatttcntaactactcaaaggtagtggagaagtagagtcagt

SEQ ID NO: 30781 - DNA, 71 bp, chicken (Gallus Gallus)
  misc_feature (36): n=a or g
accttcccttaagactacaaaaccagtgaaacaggntaggcacaatcccaaaaatataagtggaattacaa

SEQ ID NO: 30782 - DNA, 71 bp, chicken (Gallus Gallus)
  misc_feature (36): n=a or g
atcaaatcattatctgagtgaagaccagaattatantctaacatctttatagcagatctatttctttctcc

SEQ ID NO: 30783 - DNA, 71 bp, chicken (Gallus Gallus)
  misc_feature (36): n=a or g
ccagtgactatatccatgtggtacattctgtccagnatgcttggtggactgttaatcatctcacatgatta

SEQ ID NO: 30784 - DNA, 71 bp, chicken (Gallus Gallus)
  misc_feature (36): n=c or t
tacatttgtacctaaaccagtacaattaaccccacntacataaaaagcgtgcattgcatccctatgaaaac

SEQ ID NO: 30785 - DNA, 71 bp, chicken (Gallus Gallus)
  misc_feature (36): n=a or g
ctgttgagtggcattgttgcacagatgaagtcaagntggtttcataaggacaaagatttattagagtgact

SEQ ID NO: 30786 - DNA, 71 bp, chicken (Gallus Gallus)
  misc_feature (36): n=c or t
gtgattcagataatcaaggataaaacacatttgaancattgcttaaggccttagtttgagataaaccctca

SEQ ID NO: 30787 - DNA, 71 bp, chicken (Gallus Gallus)
  misc_feature (36): n=a or g
taggacacaactagactgcaaggtcaatatgtggtntgtgtgtttgtaccttgacagatgtcagcatgtat

SEQ ID NO: 30788 - DNA, 71 bp, chicken (Gallus Gallus)
  misc_feature (36): n=c or t
attgatagtgctgaggaagtcacatttctcactatnttaatattacaaacagtatttacaggtctagatga

SEQ ID NO: 30789 - DNA, 71 bp, chicken (Gallus Gallus)
  misc_feature (36): n=c or t
gacagttcataagccagtcaaattctgttcctgtantgtctactaatttccatttgtcagtgtgcagtact

SEQ ID NO: 30790 - DNA, 71 bp, chicken (Gallus Gallus)
  misc_feature (36): n=a or c
taacagaggaattgcgtgcgctgcagtgtaatgatncagcatgttatagttggtcactaaaatgttagggt

SEQ ID NO: 30791 - DNA, 71 bp, chicken (Gallus Gallus)
  misc_feature (36): n=g or t
tgttgtgtctttacacagcctcaagtgcactgaaantctcctccctggatctgtaatggaaacaatacttc

SEQ ID NO: 30792 - DNA, 71 bp, chicken (Gallus Gallus)
  misc_feature (36): n=a or g
tcttagcagaaattgctggtatctgttatgttatcntgaggaatctcattgtcttcaaatcatctgtacat

SEQ ID NO: 30793 - DNA, 71 bp, chicken (Gallus Gallus)
  misc_feature (36): n=a or g
agtgactctgcgaagctactaagcctaactccagcngaaccacttatgtgtccctgtacagttaagaggaa

SEQ ID NO: 30794 - DNA, 71 bp, chicken (Gallus Gallus)
  misc_feature (36): n=a or g
catattgttgcacaattcatagagtgaagtgggcantagatagggaaccacagaaattggagattctacat

SEQ ID NO: 30795 - DNA, 71 bp, chicken (Gallus Gallus)
  misc_feature (36): n=a or g
tctgaagaagagttatctacctaggaaaagtgaagnaggacagaattaatttgttgtggaagaacagagtt

SEQ ID NO: 30796 - DNA, 71 bp, chicken (Gallus Gallus)
  misc_feature (36): n=a or g
gctggtcagtgagcgcgatgtagccagactgcagcntctatatgactagtgaatttcaagctcttgctgtt

SEQ ID NO: 30797 - DNA, 71 bp, chicken (Gallus Gallus)
  misc_feature (36): n=a or g
agctgttagctaacaccagcacactcagagtgtagngcagaagttgatgctgtgggcccactgattgatcg

SEQ ID NO: 30798 - DNA, 71 bp, chicken (Gallus Gallus)
  misc_feature (36): n=c or t
cttcttgaaagctgttgacagcattgtgtagcccantacagacaaatatgcttacatttggttagtcaggc

SEQ ID NO: 30799 - DNA, 71 bp, chicken (Gallus Gallus)
  misc_feature (36): n=a or g
aatgtgtctcagagagcaggaagaatacagtctagnagtagtaatgcataacttagtttgggtactgaata

SEQ ID NO: 30800 - DNA, 71 bp, chicken (Gallus Gallus)
  misc_feature (36): n=c or t
tttattaaaatatttcaaatagaaatgggtatcagnctgtttacatgtgggtacctttcatagtatgtttg

SEQ ID NO: 30801 - DNA, 71 bp, chicken (Gallus Gallus)
  misc_feature (36): n=a or g
tggtgaggggggaaggaatagccatcaggcaaaggngactggagacaaggagctcagttaaactgagttga

SEQ ID NO: 30802 - DNA, 71 bp, chicken (Gallus Gallus)
  misc_feature (36): n=c or t
ctgcctgaagtagagtcatttcttcttttaagtcancatttacaaaacaatgtatatctgtctgttttgtg

SEQ ID NO: 30803 - DNA, 71 bp, chicken (Gallus Gallus)
  misc_feature (36): n=a or g
tgaatttctttttgaaaatctgcatgccagcactcntgtgtgacactgcagcaccatgaggggaagcttct

SEQ ID NO: 30804 - DNA, 71 bp, chicken (Gallus Gallus)
  misc_feature (36): n=c or t
ttgcagcaatggtccagtccttcctctacgtttctntgcttggctttcatcctggctgtaaggtaaaatga

SEQ ID NO: 30805 - DNA, 71 bp, chicken (Gallus Gallus)
  misc_feature (36): n=c or t
gttacaactttatcacgcccatgagcctcaagcaangtagaagagcagcacatcataacgaaaccatatat

SEQ ID NO: 30806 - DNA, 71 bp, chicken (Gallus Gallus)
  misc_feature (36): n=a or g
gatttgcttattcttttagccaaagaagcatgaggnggaggatggaactacagacactgcaacctcatcat

SEQ ID NO: 30807 - DNA, 71 bp, chicken (Gallus Gallus)
  misc_feature (36): n=a or g
cggaagcagcacttggtgcgagccaaggagcagagnaggcgacgggagttcatgatgcgtagcaggctgga

SEQ ID NO: 30808 - DNA, 71 bp, chicken (Gallus Gallus)
  misc_feature (36): n=a or c
ccctgagaaaatcagcacgtcagttattctagtganaagatttggacagggccaaatatgtttccacatgg

SEQ ID NO: 30809 - DNA, 71 bp, chicken (Gallus Gallus)
  misc_feature (36): n=a or c
gtctgtgacttccccagcttctcagctatcaccttnaaagtcaaacagtaccaataaacagtattttctgt

SEQ ID NO: 30810 - DNA, 71 bp, chicken (Gallus Gallus)
  misc_feature (36): n=c or t
catgctaaacgttgtggtacttctgccattagtagnctgaaaaaagcttgtgctttgtgacaccaggtgtc

SEQ ID NO: 30811 - DNA, 71 bp, chicken (Gallus Gallus)
  misc_feature (36): n=a or g
gaaactagattctggctgagttcctccaaccacacnaagcattatgctttgccctagtaaaaccattaaac

SEQ ID NO: 30812 - DNA, 71 bp, chicken (Gallus Gallus)
  misc_feature (36): n=a or g
tttttaggcagaagcaggctctaaaaacctttcaanccttgctttgcatgtggaaatggaagaaaaaataa

SEQ ID NO: 30813 - DNA, 71 bp, chicken (Gallus Gallus)
  misc_feature (36): n=c or t
tattccatgaccttacaaaagcctacagcacaaaangatcacaagtaaaatgacaaacaaatcaataaata

SEQ ID NO: 30814 - DNA, 71 bp, chicken (Gallus Gallus)
  misc_feature (36): n=a or c
ttccacaaagagccaagacggtggtttaccattccncaaatattccatatgctttagcattcaaatccctc

SEQ ID NO: 30815 - DNA, 71 bp, chicken (Gallus Gallus)
  misc_feature (36): n=c or t
ccacagacattttctatcctaacctctttttaagtngtagatgctgagtacccaagactacacctaggaat

SEQ ID NO: 30816 - DNA, 71 bp, chicken (Gallus Gallus)
  misc_feature (36): n=c or t
agcagtgttgtgtcagccatctgtctgaatgtcttnctctcctgagatctagctgaagcagttgcactgtg

SEQ ID NO: 30817 - DNA, 71 bp, chicken (Gallus Gallus)
  misc_feature (36): n=g or t
tggaaaataaatgtcttgggaagcactgaatttccncgttgtatttcacacttggggaaactaagagctag

SEQ ID NO: 30818 - DNA, 71 bp, chicken (Gallus Gallus)
  misc_feature (36): n=a or g
tagaaaaaatcccctaattaaaatgtgagttaagangtgggtaagttaagtgaagctaagaggaactggag

SEQ ID NO: 30819 - DNA, 71 bp, chicken (Gallus Gallus)
  misc_feature (36): n=g or t
gactgcaaaggtgatatttctgcaaaatattacttntgcccattataaaagtttacaagtgttccatgagc

SEQ ID NO: 30820 - DNA, 71 bp, chicken (Gallus Gallus)
  misc_feature (36): n=g or t
gctgtgtatgcctccatgaccagatgacggtgtggngcattaatctactcattttaaaacaactcaatcag

SEQ ID NO: 30821 - DNA, 71 bp, chicken (Gallus Gallus)
  misc_feature (36): n=c or t
aggatctttcaggtaacaacaactgacaaagtgtangttgagtgactgctaagcagaaacatgtctgtatt

SEQ ID NO: 30822 - DNA, 71 bp, chicken (Gallus Gallus)
  misc_feature (36): n=a or g
agaatgaaggactgctccccttcccccatatgtgantggctagagtacttacctgaagcaccagacacaaa

SEQ ID NO: 30823 - DNA, 71 bp, chicken (Gallus Gallus)
  misc_feature (36): n=a or g
actcctggggaaacccggagcttaaaatataagtcncagaaacagctacagtcttgacactggtatttaaa

SEQ ID NO: 30824 - DNA, 71 bp, chicken (Gallus Gallus)
  misc_feature (36): n=a or c
taaggtcagctaaacagcgtgggagagatcagcagntttgggacccaaccagaagggctctgctgttcagt

SEQ ID NO: 30825 - DNA, 71 bp, chicken (Gallus Gallus)
  misc_feature (36): n=c or t
acagcacaattcggctagaatagaaaagaagtcaantggaaagcaggacttgtcaaggctgctatgagaac

SEQ ID NO: 30826 - DNA, 71 bp, chicken (Gallus Gallus)
  misc_feature (36): n=c or t
ttctgaattcagtcagtgtatttagttgtttacagnataatattacatctcttagctcttcaagaaagaaa

SEQ ID NO: 30827 - DNA, 71 bp, chicken (Gallus Gallus)
  misc_feature (36): n=c or t
atactttttgtgattaattgtaaccctaatgaaganggacactaacagaaaaacatgggagaagcaacaag

SEQ ID NO: 30828 - DNA, 71 bp, chicken (Gallus Gallus)
  misc_feature (36): n=a or g
atattcaagtccagccttgatggatgtctataccanccatgggcacttgtcacttgaacaaatcgaagctt

SEQ ID NO: 30829 - DNA, 71 bp, chicken (Gallus Gallus)
  misc_feature (36): n=a or g
agaaggggccttcctgtgtcagaatgataaataccntttctagggacaagatgagtagaaacgttagccct

SEQ ID NO: 30830 - DNA, 71 bp, chicken (Gallus Gallus)
  misc_feature (36): n=a or c
ttctcagtttgtttgcctaagccattcaatcggaancatttctgcaccagtagtgaataattcactattcc

SEQ ID NO: 30831 - DNA, 71 bp, chicken (Gallus Gallus)
  misc_feature (36): n=c or t
ttagtccattgttgttcttaggggagaacagctgcnatcatctcatccaggtgtctactcctctcttttat

SEQ ID NO: 30832 - DNA, 71 bp, chicken (Gallus Gallus)
  misc_feature (36): n=g or t
tacaagtgtcagatttgcagaggtagttcaatcatntgtactacgctgtgctgaagaaatcacttagcaca

SEQ ID NO: 30833 - DNA, 71 bp, chicken (Gallus Gallus)
  misc_feature (36): n=c or t
gcttttgaatatctccactgtggtctgacaacctcnatggtaaaagtattttcctatgttccaaatgaact

SEQ ID NO: 30834 - DNA, 71 bp, chicken (Gallus Gallus)
  misc_feature (36): n=c or t
agattttacaatgcatgcacagtttataaacttgantgggtgaaaattacaaatgcttccaaatcctggct

SEQ ID NO: 30835 - DNA, 71 bp, chicken (Gallus Gallus)
  misc_feature (36): n=c or t
tggcaatactgagtgcaaataccagattaagttcanggttggtgtaacacaagcacatgctatatacaagc

SEQ ID NO: 30836 - DNA, 71 bp, chicken (Gallus Gallus)
  misc_feature (36): n=c or t
tattagaaattgagtgcaaattgcaacttcccccancactgcaatgttatctggcatagcaattctaaatc

SEQ ID NO: 30837 - DNA, 71 bp, chicken (Gallus Gallus)
  misc_feature (36): n=c or t
atgaagtaagttagtttgaaacctgttgctgtgaangtgcgtcaaaagacttcatgttctactgacataaa

SEQ ID NO: 30838 - DNA, 71 bp, chicken (Gallus Gallus)
  misc_feature (36): n=c or t
attcatttaacataaactaagaggaagacttgaaanctgctctctcagttcttgaacaagtggtatatgag

SEQ ID NO: 30839 - DNA, 71 bp, chicken (Gallus Gallus)
  misc_feature (36): n=g or t
aatactgcacgggtatccttactaacagcagttttncagtacaacagtgttagcaagagctctgtccacag

SEQ ID NO: 30840 - DNA, 71 bp, chicken (Gallus Gallus)
  misc_feature (36): n=c or t
ttactggggaaacaggtgagaattcactgggacatnggtacacactgaaaccgtaagtgtgatattaggtt

SEQ ID NO: 30841 - DNA, 71 bp, chicken (Gallus Gallus)
  misc_feature (36): n=c or t
aagtaatgacatctagagctcgttctcagtcagccntgtccaagatattggcacgtaaactattgtctatt

SEQ ID NO: 30842 - DNA, 71 bp, chicken (Gallus Gallus)
  misc_feature (36): n=a or g
agcaagccattttccccctggtttgggaaccacacnacatgcaggcaagtgtcaagtaaccatcttttccc

SEQ ID NO: 30843 - DNA, 71 bp, chicken (Gallus Gallus)
  misc_feature (36): n=a or g
gagatagctggcatttttttccaaccattgtttagnatgtgcactttataacagaaagttaataacaagct

SEQ ID NO: 30844 - DNA, 71 bp, chicken (Gallus Gallus)
  misc_feature (36): n=a or g
tcttgctgtttaaaaggtttacatttcaactatagnggaagaaaaacgacttctaaagcagtcaattcagt

SEQ ID NO: 30845 - DNA, 71 bp, chicken (Gallus Gallus)
  misc_feature (36): n=a or g
ctcccatttctcttaaggcctcgcacatggagcatncttgtgtggaaatttagatggccaaaactgtataa

SEQ ID NO: 30846 - DNA, 71 bp, chicken (Gallus Gallus)
  misc_feature (36): n=c or t
tatagcaagttaggctgagcctccacttgtgagagngaaattgacatgtaaagcagaacaactacatttgt

SEQ ID NO: 30847 - DNA, 71 bp, chicken (Gallus Gallus)
  misc_feature (36): n=a or g
cctccaatgttttgaagagatgtagatccaaagacnatcattttccctggggtaccgaaaacctgctcacc

SEQ ID NO: 30848 - DNA, 71 bp, chicken (Gallus Gallus)
  misc_feature (36): n=a or g
acaaaattaagacagcaagaaggaagggatgagtanggggatggtcctgtagcatggcagtacttgataca

SEQ ID NO: 30849 - DNA, 71 bp, chicken (Gallus Gallus)
  misc_feature (36): n=a or g
tgcagcacctagacagctgagatctgctttgtgccnagcacttccacgcaacgtaataataggcagttctt

SEQ ID NO: 30850 - DNA, 71 bp, chicken (Gallus Gallus)
  misc_feature (36): n=c or t
gaaatgaaggaatagtttgttcttctaacccgttcnaagtacaaaaacctgtgctgccttttattatttga

SEQ ID NO: 30851 - DNA, 71 bp, chicken (Gallus Gallus)
  misc_feature (36): n=a or c
ctctatgaacagcagttttttgtcagttctttgacnattaggtaaaagcaaagctgatatctctttattat

SEQ ID NO: 30852 - DNA, 71 bp, chicken (Gallus Gallus)
  misc_feature (36): n=a or g
ggagaggtattattcccaacccacctaactttgttntcagtgcagaactatctgccttcataatgctgctg

SEQ ID NO: 30853 - DNA, 71 bp, chicken (Gallus Gallus)
  misc_feature (36): n=c or t
actttcttaggcttaacacttgaatagttttagttnaaataccacagtcagctttgagaagtgcaaaataa

SEQ ID NO: 30854 - DNA, 71 bp, chicken (Gallus Gallus)
  misc_feature (36): n=c or t
aggacttcagaagctgagactgggcacaaactctcnctggggagcactgggatggggcccggcattcggca

SEQ ID NO: 30855 - DNA, 71 bp, chicken (Gallus Gallus)
  misc_feature (36): n=a or g
gctcctaattgctttactaattttctacatgatttntattctgtagattttctggatattcagatttcctc

SEQ ID NO: 30856 - DNA, 71 bp, chicken (Gallus Gallus)
  misc_feature (36): n=a or c
tttccttatgcattaaaactgatctctactgctttngggacagaatggtttctggaacaggtggtggtttt

SEQ ID NO: 30857 - DNA, 71 bp, chicken (Gallus Gallus)
  misc_feature (36): n=g or t
cctcagaacaacttgaatttggaaagcctggaagtntgacaatgaaactgtaatactggtttgtgtataat

SEQ ID NO: 30858 - DNA, 71 bp, chicken (Gallus Gallus)
  misc_feature (36): n=a or g
ataaataaacttttggtgtaatggatgtgtgatagntagatttgactttgcaacttaattactggctagga

SEQ ID NO: 30859 - DNA, 71 bp, chicken (Gallus Gallus)
  misc_feature (36): n=c or t
caagatagtttcttgatgaatatattacactcattncactttcctcaacttccttctgtgtgtgtgtgtgc

SEQ ID NO: 30860 - DNA, 71 bp, chicken (Gallus Gallus)
  misc_feature (36): n=a or g
cctgtcttggaaacactatggggcatctgggtactngaataacacgtacatttaaatttagacaagaaact

SEQ ID NO: 30861 - DNA, 71 bp, chicken (Gallus Gallus)
  misc_feature (36): n=a or g
ttccactccccggcagagcttgcaacagcagcatgncaacttctggcagttttgggtgaggaatttgatca

SEQ ID NO: 30862 - DNA, 71 bp, chicken (Gallus Gallus)
  misc_feature (36): n=c or t
atacaaacttgagaagagtagaatgttatctctcantttagattgagttaccacagatttctggaagactg

SEQ ID NO: 30863 - DNA, 71 bp, chicken (Gallus Gallus)
  misc_feature (36): n=g or t
caaggactgtcagatttgcctttggagtatttccanatcttgtgaaccaaacactttaagcaatccccaaa

SEQ ID NO: 30864 - DNA, 71 bp, chicken (Gallus Gallus)
  misc_feature (36): n=g or t
ataatttgcagtacccaattttgttaaatgagagcnttttcaattaagtattctatttagatttgcaatat

SEQ ID NO: 30865 - DNA, 71 bp, chicken (Gallus Gallus)
  misc_feature (36): n=c or t
tacagtcctgtatgtcacagagatcttcaaatatanggtctctctggtctctcttgctgtttatacttttt

SEQ ID NO: 30866 - DNA, 71 bp, chicken (Gallus Gallus)
  misc_feature (36): n=c or t
tttgcatgttatcagacttttgcacaatttgaaggnagcacagcactcactacaacttatagaacagctaa

SEQ ID NO: 30867 - DNA, 71 bp, chicken (Gallus Gallus)
  misc_feature (36): n=a or c
atcaatgcttctagagcccagcactaccagctcatnaaattctagcatatttccaaatgtttcaccctcag

SEQ ID NO: 30868 - DNA, 71 bp, chicken (Gallus Gallus)
  misc_feature (36): n=c or t
gattgtcagatgatatccagatgattaaaaagaagntgaatctgcatcctattctcctttctcccactata

SEQ ID NO: 30869 - DNA, 71 bp, chicken (Gallus Gallus)
  misc_feature (36): n=a or g
ttaataaaagaaagaaattgcaatacactgcatgtnaaagctctgacaatactggtaatataaagggtttc

SEQ ID NO: 30870 - DNA, 71 bp, chicken (Gallus Gallus)
  misc_feature (36): n=a or g
agcttagatgctgtgtgtgaatacgtcagtgctatnaatattatatagaaggctgtctaaagatcttcctt

SEQ ID NO: 30871 - DNA, 71 bp, chicken (Gallus Gallus)
  misc_feature (36): n=c or t
cctgttctcagtgctgtgggtcatgctttgaatcancaaggggctgcgattttcagcaaagtttgtaagga

SEQ ID NO: 30872 - DNA, 71 bp, chicken (Gallus Gallus)
  misc_feature (36): n=a or g
ggggaattcctgaaggactggcacaccatcttatcncccgaacaccacgggagcctcaccgtggagcaaag

SEQ ID NO: 30873 - DNA, 71 bp, chicken (Gallus Gallus)
  misc_feature (36): n=c or t
tctttcctaagcatctactattaacagaagttactncttaggcataaaatgggaacagatggataatcttt

SEQ ID NO: 30874 - DNA, 71 bp, chicken (Gallus Gallus)
  misc_feature (36): n=g or t
atctcgaaaaaaggcacagttacatcacaacttcanctaggaatggtaaccaaggcttaaattaagttctc

SEQ ID NO: 30875 - DNA, 71 bp, chicken (Gallus Gallus)
  misc_feature (36): n=g or t
ttgacagattcatgacaaaatgtgagtgcatgccanatacattttgtcaggaaagccaggagcctcggcag

SEQ ID NO: 30876 - DNA, 71 bp, chicken (Gallus Gallus)
  misc_feature (36): n=a or g
ccttaatgtttctatgatgctatagataggactggntttgggtctgaaactgggtgcttgacctttgttct

SEQ ID NO: 30877 - DNA, 71 bp, chicken (Gallus Gallus)
  misc_feature (36): n=c or t
tggacctgatttatttaaccaaaccccacagagcanagaaccttttgtatttggtcaaactcgtgctccca

SEQ ID NO: 30878 - DNA, 71 bp, chicken (Gallus Gallus)
  misc_feature (36): n=g or t
agcagcagagaagtagatgtctattgctatcagcancagatctgtatgacatgatgcagaaaacaaattag

SEQ ID NO: 30879 - DNA, 71 bp, chicken (Gallus Gallus)
  misc_feature (36): n=a or g
atattatcttgccttatagaaggaggaaaggttcantggaacagtatcaaaggatatggatactacaattc

SEQ ID NO: 30880 - DNA, 71 bp, chicken (Gallus Gallus)
  misc_feature (36): n=a or g
gcccacagcagtttgctaagggctttatccagtcanactgtgaatgcctctgagaccagagatgacataga

SEQ ID NO: 30881 - DNA, 71 bp, chicken (Gallus Gallus)
  misc_feature (36): n=a or c
agggaagtgtcctcagatgataataatttagtgacntaatgcttgtaatttgctaagaaaactcagtttaa

SEQ ID NO: 30882 - DNA, 71 bp, chicken (Gallus Gallus)
  misc_feature (36): n=c or t
cccacttttttggatcccaacaaagaaatctagcanacctgaagtctccaagtatgtcacaaaacactttc

SEQ ID NO: 30883 - DNA, 71 bp, chicken (Gallus Gallus)
  misc_feature (36): n=c or t
atgttttccatgtatgtaacatgcacttatgaaccnaagcatcatagtggaattgaagaaagttacaggtc

SEQ ID NO: 30884 - DNA, 71 bp, chicken (Gallus Gallus)
  misc_feature (36): n=c or t
agacccactgtagaagtttaagtatagagaatttcncatggataccacagtagtaaatgattatttcacag

SEQ ID NO: 30885 - DNA, 71 bp, chicken (Gallus Gallus)
  misc_feature (36): n=c or t
tcaaaatgttaaaagaagctagggaaaatgaaagangaagcaatttgcttaaggacatactcaggagataa

SEQ ID NO: 30886 - DNA, 71 bp, chicken (Gallus Gallus)
  misc_feature (36): n=a or g
actaaatgtaccaattttcagatgacatattctctngaaataaaggccccttcctcttcctcacatttaag

SEQ ID NO: 30887 - DNA, 71 bp, chicken (Gallus Gallus)
  misc_feature (36): n=a or c
attgccctttgataaatacactgcctgcagagcacntgcatataccaataatatgagtaataaaaccacga

SEQ ID NO: 30888 - DNA, 71 bp, chicken (Gallus Gallus)
  misc_feature (36): n=a or g
ctgagattagtaataacactgaagtcattctgtttnggaaaactcttatacctcaatcttttttcattagt

SEQ ID NO: 30889 - DNA, 71 bp, chicken (Gallus Gallus)
  misc_feature (36): n=c or t
aattgttgagcctatgtgggtgcacagttagtgtcnagtgtactcaaagattgctaataaacacttttcaa

SEQ ID NO: 30890 - DNA, 71 bp, chicken (Gallus Gallus)
  misc_feature (36): n=c or t
gagaccatgcctactttagacctaatacacatcagnattttgacttttcagaagcctgacagcaggcatca

SEQ ID NO: 30891 - DNA, 71 bp, chicken (Gallus Gallus)
  misc_feature (36): n=c or t
atttgttctgatgatacttttcccattatttactangcatctttctaatcacaacagtagttgggccatgt

SEQ ID NO: 30892 - DNA, 71 bp, chicken (Gallus Gallus)
  misc_feature (36): n=a or g
agcactcgatgcatatcagtatagataggtgagctnccagaccttatgttccctgtctatgtctctcatga

SEQ ID NO: 30893 - DNA, 71 bp, chicken (Gallus Gallus)
  misc_feature (36): n=g or t
attccacatttgagtgtattgttaccatccaaaccnattttcataactatgttttcctcttaattcctttc

SEQ ID NO: 30894 - DNA, 71 bp, chicken (Gallus Gallus)
  misc_feature (36): n=c or t
cagagcagcaaacatttctaagcacaataaagtgcnagataccagatggaacacctgtcccttactcttgt

SEQ ID NO: 30895 - DNA, 71 bp, chicken (Gallus Gallus)
  misc_feature (36): n=a or g
aaattgtgcctttgtgcaggaggaattccatgatcnggatcctcctctgaaagaacagtatttttttctta

SEQ ID NO: 30896 - DNA, 71 bp, chicken (Gallus Gallus)
  misc_feature (36): n=a or g
tacgtatgaaccattaaaggaagaaaaggaagagangaaaagacttccgcatgtttgcccaattctcaaga

SEQ ID NO: 30897 - DNA, 71 bp, chicken (Gallus Gallus)
  misc_feature (36): n=a or c
gtttcagtttgcttctgtagagccgcagggaagatntttgaagtgcagagtcaggggaggaacttaactca

SEQ ID NO: 30898 - DNA, 71 bp, chicken (Gallus Gallus)
  misc_feature (36): n=a or c
agacagaggcaatgcaaaacagcacccataaggaancctggttcctaggtatgttatcagtgtgtaatatg

SEQ ID NO: 30899 - DNA, 71 bp, chicken (Gallus Gallus)
  misc_feature (36): n=g or t
aactctttaatctagcatgaataccacttgcaaaanaaacttacttttacatgtttgatcttttatttgaa

SEQ ID NO: 30900 - DNA, 71 bp, chicken (Gallus Gallus)
  misc_feature (36): n=c or t
actgcattccagtgtcttcagttggttgtgaccgantttcttccaacaatgccatgtacgtgtctacagat

SEQ ID NO: 30901 - DNA, 71 bp, chicken (Gallus Gallus)
  misc_feature (36): n=a or g
ttttttattactactatttccttattttttggtcantgtcatgtataatattgtatttgtgtttctacatt

SEQ ID NO: 30902 - DNA, 71 bp, chicken (Gallus Gallus)
  misc_feature (36): n=g or t
cacatggcaccgctagaaggtggattttctatttcntgaagaccgagtgatgactaacttgtattttctgt

SEQ ID NO: 30903 - DNA, 71 bp, chicken (Gallus Gallus)
  misc_feature (36): n=g or t
tttgtcagtgcatctaaacaatctatctcaagttanctgcactgaagatctaattatctttcctattgaag

SEQ ID NO: 30904 - DNA, 71 bp, chicken (Gallus Gallus)
  misc_feature (36): n=c or t
cctgccctgatccctcttcttcttaattaggttttntacatctcaaagcacggtacattgttattaaataa

SEQ ID NO: 30905 - DNA, 71 bp, chicken (Gallus Gallus)
  misc_feature (36): n=c or t
tctgtctttcaggaatactcctgacgtacctacccntttgagtgttttctctgctttgagtgctcacgtgc

SEQ ID NO: 30906 - DNA, 71 bp, chicken (Gallus Gallus)
  misc_feature (36): n=c or t
acctcttgagaatacaacctttaaaaaaggattcangaggcaaatgatgacagaggcatacatgactgcta

SEQ ID NO: 30907 - DNA, 71 bp, chicken (Gallus Gallus)
  misc_feature (36): n=a or c
gctcttttatgctctgatttgccacacaatcaaaangatgaaaggccatgaagaaatgtaattcccaaagt

SEQ ID NO: 30908 - DNA, 71 bp, chicken (Gallus Gallus)
  misc_feature (36): n=a or g
ggttagcatactcactcccttaatgctaaaaggaanaacacatgctccagtgggataaaattccccaggcc

SEQ ID NO: 30909 - DNA, 71 bp, chicken (Gallus Gallus)
  misc_feature (36): n=c or t
agaaacagcagaaagcagtagattctgcaaactcancatgcatctacagctgcattcagggctcacacaac

SEQ ID NO: 30910 - DNA, 71 bp, chicken (Gallus Gallus)
  misc_feature (36): n=c or t
ccaaacaggctcaggactgaatttcctcaacacctnctgttgtcaaaacaggcagacaaggcgggtgtttg

SEQ ID NO: 30911 - DNA, 71 bp, chicken (Gallus Gallus)
  misc_feature (36): n=c or t
gagaatgtaacaactgtagggcagatgcccctgctncaggatgatgtagcataaaccatcaagttcctcac

SEQ ID NO: 30912 - DNA, 71 bp, chicken (Gallus Gallus)
  misc_feature (36): n=a or c
gagaatacaaaagaggcaaaatttgcagatgatatnattactaatgatttatatcagttgctttaatgaaa

SEQ ID NO: 30913 - DNA, 71 bp, chicken (Gallus Gallus)
  misc_feature (36): n=a or g
ttttccccaaataatactttgtatgtcaatggatgncatgaacgtaactgatggtgtgatactgaaaggca

SEQ ID NO: 30914 - DNA, 71 bp, chicken (Gallus Gallus)
  misc_feature (36): n=c or t
tagtgatgttttgtcagcggaagaatcttttcaaangccctgatgtatgaaaaagttatcttaactgattg

SEQ ID NO: 30915 - DNA, 71 bp, chicken (Gallus Gallus)
  misc_feature (36): n=c or t
gtcagcagagcactcatgtctccataactccactgnctgcttttaaactcctcaaggctcatctgcctgca

SEQ ID NO: 30916 - DNA, 71 bp, chicken (Gallus Gallus)
  misc_feature (36): n=a or g
agaaatcttttgggggaaggctgagttgtaaactanaagttgggttgaggttttagtaaaggtgtcttaat

SEQ ID NO: 30917 - DNA, 71 bp, chicken (Gallus Gallus)
  misc_feature (36): n=a or g
aataaggaagacattctaggcaagatttttctcccncttcagacttggaacctgtcatacttgcattagct

SEQ ID NO: 30918 - DNA, 71 bp, chicken (Gallus Gallus)
  misc_feature (36): n=a or g
cttaaattaaaattgtatttgtcctacagtgagcanggttgtaataagacagattaaagtaatgtccaaaa

SEQ ID NO: 30919 - DNA, 71 bp, chicken (Gallus Gallus)
  misc_feature (36): n=c or t
acatttatgtgtatcagtgatgttaagttgtacacntagttttcaaattttccatcttccaggcttcctgg

SEQ ID NO: 30920 - DNA, 71 bp, chicken (Gallus Gallus)
  misc_feature (36): n=g or t
ttgcctattgctctccctggatagatacatatgaanagaagaagaaaacttttactgtttctgaacctacc

SEQ ID NO: 30921 - DNA, 71 bp, chicken (Gallus Gallus)
  misc_feature (36): n=a or g
aaaacagtgggatattcttcagggaatattagactnacttatgttcatgagaaaagtcaaaacatgaaaag

SEQ ID NO: 30922 - DNA, 71 bp, chicken (Gallus Gallus)
  misc_feature (36): n=a or g
gtgaggattatactaatgcttctctaaaggaaagcngttcttagtagcagttaattactgtaggtatacta

SEQ ID NO: 30923 - DNA, 71 bp, chicken (Gallus Gallus)
  misc_feature (36): n=c or t
tggatgttgaaggttttttttccccgttatttttgncttttagtgttggtaagagactagcaatcatagca

SEQ ID NO: 30924 - DNA, 71 bp, chicken (Gallus Gallus)
  misc_feature (36): n=c or t
tggtatatcaagatctgctgagttttgtccataatntcttgtttgaaggtactatgcagaggaatttggcc

SEQ ID NO: 30925 - DNA, 71 bp, chicken (Gallus Gallus)
  misc_feature (36): n=c or t
tgcaatattcctgggacaggtttacattttgtccantaagttttccttcgtctatcaagccagaaggttaa

SEQ ID NO: 30926 - DNA, 71 bp, chicken (Gallus Gallus)
  misc_feature (36): n=c or t
gcaagttacacccaggactgcatgagccacagtganctcaaaggcggtttcactgggctccagataggagt

SEQ ID NO: 30927 - DNA, 71 bp, chicken (Gallus Gallus)
  misc_feature (36): n=g or t
ttgaggtttaatatttaacataatagtaaatgtacntccatttagaggctaggaaggtgttctagtacctt

SEQ ID NO: 30928 - DNA, 71 bp, chicken (Gallus Gallus)
  misc_feature (36): n=a or g
attttcatggtttttcaggctcaggacttagccatnagtaggaagtatggagggagaatggaattatagca

SEQ ID NO: 30929 - DNA, 71 bp, chicken (Gallus Gallus)
  misc_feature (36): n=a or c
acgttacgcaacattgcctggctgtgttatactganctctgtttagtaagataacttccatgttgcctctt

SEQ ID NO: 30930 - DNA, 71 bp, chicken (Gallus Gallus)
  misc_feature (36): n=g or t
aagtgggtttaagctatgttatataaactagcatcnatgtccattcagctatttgggtactgcaacttcta

SEQ ID NO: 30931 - DNA, 71 bp, chicken (Gallus Gallus)
  misc_feature (36): n=a or g
caactgggagttagctgctggtctgggctcagtggngctttgcaacccagacatccctttgaaaatctttg

SEQ ID NO: 30932 - DNA, 71 bp, chicken (Gallus Gallus)
  misc_feature (36): n=a or g
aagagggggatgtaagaaggatcagggaagaaaccncatttggagtttgaaaacaagatttcccaaggtta

SEQ ID NO: 30933 - DNA, 71 bp, chicken (Gallus Gallus)
  misc_feature (36): n=a or g
aacttagcttctaaaggacacaaactttgaagtgcntctgcattatcttcagttatcttttgggatgtttc

SEQ ID NO: 30934 - DNA, 71 bp, chicken (Gallus Gallus)
  misc_feature (36): n=c or t
ttccatcattttgtccctcttgttgccattgagttnggacatacctcattttctgccccagtatgtccttg

SEQ ID NO: 30935 - DNA, 71 bp, chicken (Gallus Gallus)
  misc_feature (36): n=a or g
ccaatcatagcaggctgaaagaggaaacatgttcgngtttatcaagggatcgcaacagttactgtacctaa

SEQ ID NO: 30936 - DNA, 71 bp, chicken (Gallus Gallus)
  misc_feature (36): n=c or t
tgggtaataagggccttatagaaaaggttttagcangcagtggaggctagcgttggtgattgatttttcag

SEQ ID NO: 30937 - DNA, 71 bp, chicken (Gallus Gallus)
  misc_feature (36): n=a or g
gggtcacaccaccagagcagtggtgtatttaaagtntgtggatgtcagttccctagctggtactcttcctc

SEQ ID NO: 30938 - DNA, 71 bp, chicken (Gallus Gallus)
  misc_feature (36): n=c or t
tggcagatcactcactgccaccacacaggtgagctnggatctctgagggaacacatggcactgctcaagcc

SEQ ID NO: 30939 - DNA, 71 bp, chicken (Gallus Gallus)
  misc_feature (36): n=a or g
agcagcattccagcctacatgacagcagaaattccncatggtgctggaataacaggatgcaaaacatcctc

SEQ ID NO: 30940 - DNA, 71 bp, chicken (Gallus Gallus)
  misc_feature (36): n=a or g
caacaccccacggtcaggatagccacgggataacantgcttcaacaccgagcaagaagaaaaggcttcaaa

SEQ ID NO: 30941 - DNA, 71 bp, chicken (Gallus Gallus)
  misc_feature (36): n=a or g
agttatggcatttatagcatagctgtagcttctcanatggagataacagatcttctgtactcacacaagaa

SEQ ID NO: 30942 - DNA, 71 bp, chicken (Gallus Gallus)
  misc_feature (36): n=c or t
aaaatgtaagcattgaagttcctttgcctgaatttncaccctcctttccactcttctcaagcctttttcct

SEQ ID NO: 30943 - DNA, 71 bp, chicken (Gallus Gallus)
  misc_feature (36): n=c or t
atcccaagaggaatgaaagttcaaacctctctctgntcctcctccctcctactttcacacagcacattctt

SEQ ID NO: 30944 - DNA, 71 bp, chicken (Gallus Gallus)
  misc_feature (36): n=c or t
cgaggcgtgattaaaacctcccataggtagcagcantgctttctgcatgctaatacatttcttctgttagc

SEQ ID NO: 30945 - DNA, 71 bp, chicken (Gallus Gallus)
  misc_feature (36): n=a or g
ataattttaacactgccattatgagttttataaacnacaccactatcaacacattcatactggcacactac

SEQ ID NO: 30946 - DNA, 71 bp, chicken (Gallus Gallus)
  misc_feature (36): n=a or g
attgattttgcagataacactttaactaagtttctnaaacagtcaaataatacaactttccaatcaaaagc

SEQ ID NO: 30947 - DNA, 71 bp, chicken (Gallus Gallus)
  misc_feature (36): n=a or g
tttaaaaaaaattgttattacttgggatttgaactnccatactacttttaatctttgatttcagtagtgca

SEQ ID NO: 30948 - DNA, 71 bp, chicken (Gallus Gallus)
  misc_feature (36): n=c or t
ccttcctccctcaccaaaatcacacttctctacganacctgaaaactgctaaaataaaacttaacaaagaa

SEQ ID NO: 30949 - DNA, 71 bp, chicken (Gallus Gallus)
  misc_feature (36): n=c or t
taaaagaaaatgtgtatattcaatcatacatgcccngattgagccgagctctagttcccaacaaagctctt

SEQ ID NO: 30950 - DNA, 71 bp, chicken (Gallus Gallus)
  misc_feature (36): n=a or g
cctgccaacttcttcagtattatctgaccttcttcntatttttgaagtttcagtgagaaagcctcttagct

SEQ ID NO: 30951 - DNA, 71 bp, chicken (Gallus Gallus)
  misc_feature (36): n=a or c
gttaaaatagatgctcagtttccatttttttgatgnatctgcacgtttttcacgtctgtctcttaaggttt

SEQ ID NO: 30952 - DNA, 71 bp, chicken (Gallus Gallus)
  misc_feature (36): n=c or t
tgccttcttaacattgttgaatattaagagggggcncttcttggaagaaagggtttgaccccttaccacgt

SEQ ID NO: 30953 - DNA, 71 bp, chicken (Gallus Gallus)
  misc_feature (36): n=g or t
caaggcctctgagaaggagaacctgaccaatggtantgatctgtagcacagatttctttacttcacccagt

SEQ ID NO: 30954 - DNA, 71 bp, chicken (Gallus Gallus)
  misc_feature (36): n=g or t
gtccttagaatatcaaacagaggtatgaactggganagtgatgaccaataaagccccttctgcgtggattg

SEQ ID NO: 30955 - DNA, 71 bp, chicken (Gallus Gallus)
  misc_feature (36): n=c or t
gtgttccagtattttccctctgtacactttgacccnctttcatgggcacatgcatcccacttacaggtccc

SEQ ID NO: 30956 - DNA, 71 bp, chicken (Gallus Gallus)
  misc_feature (36): n=a or g
aaagagaaaatgacagcatatttggtcttccaaagnttttaaagctttttaatggcgtggtaaatatttat

SEQ ID NO: 30957 - DNA, 71 bp, chicken (Gallus Gallus)
  misc_feature (36): n=g or t
tggcagagaaggaggtcctcacatcttgccatgaanggaaagtggattatcataccatttcagccaaggtg

SEQ ID NO: 30958 - DNA, 71 bp, chicken (Gallus Gallus)
  misc_feature (36): n=c or t
attgtaggtgactgaatttagccaactgctttgaanagattcatcttggcaggtaatggagtttaattgtc

SEQ ID NO: 30959 - DNA, 71 bp, chicken (Gallus Gallus)
  misc_feature (36): n=a or g
gaccattgacagctatattatgacttgggcaaaggnacagagctgcagaggtggcattggaggactgcatg

SEQ ID NO: 30960 - DNA, 71 bp, chicken (Gallus Gallus)
  misc_feature (36): n=c or t
ttttcaccgtgataaaaaattcactaaaattctatnttcccactaaaataagcattggattaatggtaaac

SEQ ID NO: 30961 - DNA, 71 bp, chicken (Gallus Gallus)
  misc_feature (36): n=c or t
agctgtactggtggcacaagtagggaaagccagccngtgaattgctggtttcaggaacgttttacctttca

SEQ ID NO: 30962 - DNA, 71 bp, chicken (Gallus Gallus)
  misc_feature (36): n=g or t
ctaatacagactatcctgtttctgtcagtttgcagnatttcttgagacacaaaggattagaaaggttcaac

SEQ ID NO: 30963 - DNA, 71 bp, chicken (Gallus Gallus)
  misc_feature (36): n=c or t
ctcatccccttcctttctctctctggtcagaaatgnccacaaaactgcccacaggaaagtgctatgaaaat

SEQ ID NO: 30964 - DNA, 71 bp, chicken (Gallus Gallus)
  misc_feature (36): n=c or t
acttggcttcttttgccaattgtattttctttactngacaaggctcacaaaatgcaccaaggacattccta

SEQ ID NO: 30965 - DNA, 71 bp, chicken (Gallus Gallus)
  misc_feature (36): n=a or g
cttgggtgggctttccttgtttttgtttggcagganctttgcaatacgtattacaggtgtgctcaaaacaa

SEQ ID NO: 30966 - DNA, 71 bp, chicken (Gallus Gallus)
  misc_feature (36): n=g or t
gaaataatttgacctgaaaacctaaaagtggaattnggccccaacacagatgcatgccaaatgcctgatcc

SEQ ID NO: 30967 - DNA, 71 bp, chicken (Gallus Gallus)
  misc_feature (36): n=a or g
agggcaagactagttcacagagaaggaactaagtcntgtaagaagcttagagatttgctcagctacacaag

SEQ ID NO: 30968 - DNA, 71 bp, chicken (Gallus Gallus)
  misc_feature (36): n=c or t
tgattttcgagctgctcaagagatcaaagctccacnggttttcttgtcagtttattgcatacattaattac

SEQ ID NO: 30969 - DNA, 71 bp, chicken (Gallus Gallus)
  misc_feature (36): n=a or g
atgaccagaaaatgcttcctttgagagtacactgangaatactgctctgctacttttaccaatggctctag

SEQ ID NO: 30970 - DNA, 71 bp, chicken (Gallus Gallus)
  misc_feature (36): n=c or t
ataaacaaggaatgcatcatttcagcataaggctanttattccaatgctgacatctcagattctgtataaa

SEQ ID NO: 30971 - DNA, 71 bp, chicken (Gallus Gallus)
  misc_feature (36): n=c or t
tggattagcctgttggaaatgtggtaattttccagngtgtgctagaagcagattgctggggagagtgacag

SEQ ID NO: 30972 - DNA, 71 bp, chicken (Gallus Gallus)
  misc_feature (36): n=a or g
ttctgtatgcattcttcctgtcataagatcaaaccngagtactcagttttgtttgtcttcagatcttaagt

SEQ ID NO: 30973 - DNA, 71 bp, chicken (Gallus Gallus)
  misc_feature (36): n=a or c
ttgataggattcttcattggaccagggcactttctntggtctgtgttacagtttgctcaaagaggaagccc

SEQ ID NO: 30974 - DNA, 71 bp, chicken (Gallus Gallus)
  misc_feature (36): n=a or g
gactaggcctcggggtgagcaggcctctgggttcantcacacatgttccttagcacaggacacaagaactt

SEQ ID NO: 30975 - DNA, 71 bp, chicken (Gallus Gallus)
  misc_feature (36): n=c or t
aacgatacgggaattttggagcccaggtgcttgcanaccctcaccaataaagcattttatttcacttcaat

SEQ ID NO: 30976 - DNA, 71 bp, chicken (Gallus Gallus)
  misc_feature (36): n=c or t
attctgaatggttgtttataaaacgccaggcaaatntcttgtgaaagatgttttcagagagggatataata

SEQ ID NO: 30977 - DNA, 71 bp, chicken (Gallus Gallus)
  misc_feature (36): n=g or t
catgaagtgtggcctttctaatccataatgccatgngtctcccctttaatttcaggtttctttattctctg

SEQ ID NO: 30978 - DNA, 71 bp, chicken (Gallus Gallus)
  misc_feature (36): n=a or g
caaaagaaacttactcgttctcccaaaagctgctangctgttgtgtaaggcaccactgttggattgcacca

SEQ ID NO: 30979 - DNA, 71 bp, chicken (Gallus Gallus)
  misc_feature (36): n=c or t
attctgctgttctcacagtaaagatctttgttcctntcaaaataacattgcctgtgattttttaattttaa

SEQ ID NO: 30980 - DNA, 71 bp, chicken (Gallus Gallus)
  misc_feature (36): n=c or t
ccagctctttcctctcagatggattctttccccacngcagtcctgatgtgtactacaagctcaccagcata

SEQ ID NO: 30981 - DNA, 71 bp, chicken (Gallus Gallus)
  misc_feature (36): n=a or g
gaaatttgcctgttctctggaagttaatggaagggntgaaacattccactaaaaacaaaagatcattactg

SEQ ID NO: 30982 - DNA, 71 bp, chicken (Gallus Gallus)
  misc_feature (36): n=a or g
tatgaaaataagaaagtgcaagaaagggcagagacngttgtgtgctaaagaacaaagtggcactccaagga

SEQ ID NO: 30983 - DNA, 71 bp, chicken (Gallus Gallus)
  misc_feature (36): n=a or c
agaatcactacaagatgcaggccaatgtacttatgnagatcattgatcaatcctcttcagtaatgccagtg

SEQ ID NO: 30984 - DNA, 71 bp, chicken (Gallus Gallus)
  misc_feature (36): n=c or t
aaacatgaaaaagaaagttgtacaatcgatgacagntatatcatgttatcaaatttaactagaactccccg

SEQ ID NO: 30985 - DNA, 71 bp, chicken (Gallus Gallus)
  misc_feature (36): n=g or t
aagtccctatcagctgattcactgtgtagtcagttnttccttgagatccagacttgaaataacagtttgta

SEQ ID NO: 30986 - DNA, 71 bp, chicken (Gallus Gallus)
  misc_feature (36): n=c or t
aactgaagtattgtaaaagtaacagtgcaattagtnaggatgaaagaggtgaacccttggcatggctgaat

SEQ ID NO: 30987 - DNA, 71 bp, chicken (Gallus Gallus)
  misc_feature (36): n=a or g
ttacaaatgccaataattctgttattcctgatgcancgcaagacctaaataacacaatctattttcacaca

SEQ ID NO: 30988 - DNA, 71 bp, chicken (Gallus Gallus)
  misc_feature (36): n=a or c
acttcatcgttgacctttcatttgaactactcttgnacctatagttgaacctataggtctcttagtattgc

SEQ ID NO: 30989 - DNA, 71 bp, chicken (Gallus Gallus)
  misc_feature (36): n=a or g
tagaacacctcaacaaaagcactacagaaatctgtnaagcccctaggtagtttgtaaactgctgcatgcac

SEQ ID NO: 30990 - DNA, 71 bp, chicken (Gallus Gallus)
  misc_feature (36): n=a or g
aaaaatataatgaagattaatcagtttgattaagtntatgaaatgacattcaacccccaaaacttttataa

SEQ ID NO: 30991 - DNA, 71 bp, chicken (Gallus Gallus)
  misc_feature (36): n=c or t
atttccattcctctagggatacatgccatgaacttntgggacatgtgcctctacttgctgatcctaagttt

SEQ ID NO: 30992 - DNA, 71 bp, chicken (Gallus Gallus)
  misc_feature (36): n=c or t
ttacatgtgtacttgaacaatttagttttaggtttnctgtcatactgtttctgaatcggctgttggaatac

SEQ ID NO: 30993 - DNA, 71 bp, chicken (Gallus Gallus)
  misc_feature (36): n=c or t
atagtgctttgtgttcctgatatgattgctctctcngtaagattaggtactaccataaaaacacagcacag

SEQ ID NO: 30994 - DNA, 71 bp, chicken (Gallus Gallus)
  misc_feature (36): n=a or g
accttattcactattagttcttctgagctgactgangccgtttgaaatgatctctgaaacaatataccttg

SEQ ID NO: 30995 - DNA, 71 bp, chicken (Gallus Gallus)
  misc_feature (36): n=c or t
ggagagagagaggaaatggtgttaatgtgatccaanactgacatgtcattaccttccagtgcaatttgaag

SEQ ID NO: 30996 - DNA, 71 bp, chicken (Gallus Gallus)
  misc_feature (36): n=a or g
tcatgtggggaagaacttcctgaatttcaataaaancaatgaaaacaacccaatttatgataaaggtttgg

SEQ ID NO: 30997 - DNA, 71 bp, chicken (Gallus Gallus)
  misc_feature (36): n=c or t
aagtttataaaatacagactacacataagatttccngaaggaaactctcagaatctgggattcatttgaaa

SEQ ID NO: 30998 - DNA, 71 bp, chicken (Gallus Gallus)
  misc_feature (36): n=a or g
agtgtggcaaaaagagacaaaattgttacaaattantctcaagaatagaaacaattcctgcctgtttgact

SEQ ID NO: 30999 - DNA, 71 bp, chicken (Gallus Gallus)
  misc_feature (36): n=g or t
gttgattttaagactggaatagtttactagtcagtnctactgtcttatattcaagaagctgcctctggctg

SEQ ID NO: 31000 - DNA, 71 bp, chicken (Gallus Gallus)
  misc_feature (36): n=c or t
gcaataaaatttacaagcaaattgtaagcctttagnaataggtatggaaatctatcatactcagtccttac

SEQ ID NO: 31001 - DNA, 71 bp, chicken (Gallus Gallus)
  misc_feature (36): n=a or c
gtcagtaacgtgtcggggctgcggggtaaggccagngatgtctgcatagcagtattggaaatgctgagttt

SEQ ID NO: 31002 - DNA, 71 bp, chicken (Gallus Gallus)
  misc_feature (36): n=a or g
ccctgcattttcatgtccttagtgatacatgccttntatatgacagtgcaaaggattatttaatgttgtca

SEQ ID NO: 31003 - DNA, 71 bp, chicken (Gallus Gallus)
  misc_feature (36): n=c or t
gttgcaggaaggtctaagtgtcttgaagccttcagncaaagcatggtgtatgtgaggccagccatgcctgt

SEQ ID NO: 31004 - DNA, 71 bp, chicken (Gallus Gallus)
  misc_feature (36): n=c or t
ttggccttggaatattctgctctcctctagtaacangtgaagtcttcccatctctcttataactcctgctt

SEQ ID NO: 31005 - DNA, 71 bp, chicken (Gallus Gallus)
  misc_feature (36): n=c or t
atctcccaattacgtttcttattttcatccctcacntttagtctgtttatctgtgaatccaagctccccac

SEQ ID NO: 31006 - DNA, 71 bp, chicken (Gallus Gallus)
  misc_feature (36): n=c or t
agataggcctattgcttcttaatacaatgagttgcntactaaatgcaagtgctggttctagaacagtagga

SEQ ID NO: 31007 - DNA, 71 bp, chicken (Gallus Gallus)
  misc_feature (36): n=g or t
gatctgcagtggtgctgtaatacctccttcatacangaatagagcctggagtgataccatgctgcagctgg

SEQ ID NO: 31008 - DNA, 71 bp, chicken (Gallus Gallus)
  misc_feature (36): n=c or t
gacttctctagtgtttttccttcagctccgatctanctcactgcttagaggtggggacattttctctgcca

SEQ ID NO: 31009 - DNA, 71 bp, chicken (Gallus Gallus)
  misc_feature (36): n=a or g
tatagtaggttttatgaattattcaggcactgtgcntgtattttgccaacatctgatggcagaaagccttc

SEQ ID NO: 31010 - DNA, 71 bp, chicken (Gallus Gallus)
  misc_feature (36): n=c or t
cacaaacagttggaaagccttgtatagattacagcntcaggacctctcttcacaacttaaacactttcttt

SEQ ID NO: 31011 - DNA, 71 bp, chicken (Gallus Gallus)
  misc_feature (36): n=a or g
ttttgactctcccatgccaacaaaaaagtgaatctntgcaacaaattaaccactaaccattaattttctaa

SEQ ID NO: 31012 - DNA, 71 bp, chicken (Gallus Gallus)
  misc_feature (36): n=a or g
catatctgcttcatactgatgatacttcagtttatntttgtctgtaggggttggcagattttctggtattg

SEQ ID NO: 31013 - DNA, 71 bp, chicken (Gallus Gallus)
  misc_feature (36): n=c or t
tgacataaaccggggtacttctgatgtcattgcctntgttagatcctgctgctatcctcaagaacacgtga

SEQ ID NO: 31014 - DNA, 71 bp, chicken (Gallus Gallus)
  misc_feature (36): n=a or g
aatgtctgaacccgctgaagtcagtttgtgttttcnggtcacagggggagcattggttcccagcagcaaag

SEQ ID NO: 31015 - DNA, 71 bp, chicken (Gallus Gallus)
  misc_feature (36): n=c or t
ggaaaagggagacaattaaaatctcttaccctgtcnctgccctcctcccatttctgtcttgggaattacat

SEQ ID NO: 31016 - DNA, 71 bp, chicken (Gallus Gallus)
  misc_feature (36): n=c or t
tagttgtgtcctgcagcagatgaacccatacagctnttcaggctattcttctgtctaagtcttcatgtgaa

SEQ ID NO: 31017 - DNA, 71 bp, chicken (Gallus Gallus)
  misc_feature (36): n=c or t
tgtgtaatacactgtagatgtgaactctgaaaaacnaattatccccataatttattgaacagcagcaccga

SEQ ID NO: 31018 - DNA, 71 bp, chicken (Gallus Gallus)
  misc_feature (36): n=c or t
tgggtagctaatgcaaagttacggggattttgttangtatggagaattttgagagatgcttgtgatacaag

SEQ ID NO: 31019 - DNA, 71 bp, chicken (Gallus Gallus)
  misc_feature (36): n=a or g
gtactttctcatgctttcataatttgtctccaagtntgtttacactaagtttgcctttagcttttgaataa

SEQ ID NO: 31020 - DNA, 71 bp, chicken (Gallus Gallus)
  misc_feature (36): n=c or t
catagaaaaagaggatccactgctagggttttgtgnggttgtggtcctgtctttgaagttgaaaatatgga

SEQ ID NO: 31021 - DNA, 71 bp, chicken (Gallus Gallus)
  misc_feature (36): n=a or g
gacttctaataggtgctaaattttaatcattaattntttttctgatgctttgtatttcattctagacttct

SEQ ID NO: 31022 - DNA, 71 bp, chicken (Gallus Gallus)
  misc_feature (36): n=a or c
taagtaaataaatagtactaaacctttgctttgctngtctatagaaattgcatgctggaggacagtataat

SEQ ID NO: 31023 - DNA, 71 bp, chicken (Gallus Gallus)
  misc_feature (36): n=a or g
aggcgtgactggaaaacaaaagccaatgaggagctntaacaggagcatggaacaatccagtttttactggt

SEQ ID NO: 31024 - DNA, 71 bp, chicken (Gallus Gallus)
  misc_feature (36): n=a or g
tgagaaatcaccatcattgaaccatttaaacctccngtgaacatatctttaacataaaatgtgaagaagga

SEQ ID NO: 31025 - DNA, 71 bp, chicken (Gallus Gallus)
  misc_feature (36): n=g or t
ttttccataggggccagggtactgaaggaaaagaanaaattcacatgcttggaaagaggaaatatacagtt

SEQ ID NO: 31026 - DNA, 71 bp, chicken (Gallus Gallus)
  misc_feature (36): n=a or g
agaatttgtaatgaagacattttctgtaggtaatgncctctgactttgtcaccgtagagggtatgtgtggt

SEQ ID NO: 31027 - DNA, 71 bp, chicken (Gallus Gallus)
  misc_feature (36): n=c or t
tcataggtaggccttctttcccttctggcaccattnacagatagctaaaccatcttccttctgtttttgga

SEQ ID NO: 31028 - DNA, 71 bp, chicken (Gallus Gallus)
  misc_feature (36): n=a or g
tggtgtggtaactcctgcctgttgccagacaccagncttgaaggatggctaggatcctctatccagacaga

SEQ ID NO: 31029 - DNA, 71 bp, chicken (Gallus Gallus)
  misc_feature (36): n=a or c
ccacaaatgatctcttcctgtaagtctgctgactgntgggtattaagcactgctgttcatctacacgcaag

SEQ ID NO: 31030 - DNA, 71 bp, chicken (Gallus Gallus)
  misc_feature (36): n=a or g
gtataagtactatacataatactatgtactgcagtntattagtaaattaggttttgtttatagttatagcc

SEQ ID NO: 31031 - DNA, 71 bp, chicken (Gallus Gallus)
  misc_feature (36): n=c or t
ctaaaggcagagactggaaatactggaaaacctgcncggccatcgtcagagtcttcaagtagcacgtcatc

SEQ ID NO: 31032 - DNA, 71 bp, chicken (Gallus Gallus)
  misc_feature (36): n=a or g
ttttttctcccctttctcacaccacatttactcacnttacagtaaaagctgtttgttactttgcaaaataa

SEQ ID NO: 31033 - DNA, 71 bp, chicken (Gallus Gallus)
  misc_feature (36): n=a or c
actatacaagctgtcctttaggccaaaatgatgcanccaagaatatcagagtaaacaaatgtcagatatcc

SEQ ID NO: 31034 - DNA, 71 bp, chicken (Gallus Gallus)
  misc_feature (36): n=a or g
gcagagctgccagttactttgtgtggtgcttccacntgaatgagtgattgttagggacttgcagacgtctc

SEQ ID NO: 31035 - DNA, 71 bp, chicken (Gallus Gallus)
  misc_feature (36): n=c or t
tttcctgaattcacagaattggatttagtggcatcnctatttccaattgtcctgggaacttttcctttcct

SEQ ID NO: 31036 - DNA, 71 bp, chicken (Gallus Gallus)
  misc_feature (36): n=a or g
tgcatgtaagagcacatgttgagcatcatggagaanatagaagtgattttcatgagttctttagctccttg

SEQ ID NO: 31037 - DNA, 71 bp, chicken (Gallus Gallus)
  misc_feature (36): n=a or g
cctctaccatcatatgtgtatctcattcaaataacntgtgtgttgttttccactattctgtactgttgtcc

SEQ ID NO: 31038 - DNA, 71 bp, chicken (Gallus Gallus)
  misc_feature (36): n=a or g
gatgaagagaggtactcagagctgaaggacaagcantaaactccctggcaaaactggactcgggttcaact

SEQ ID NO: 31039 - DNA, 71 bp, chicken (Gallus Gallus)
  misc_feature (36): n=a or g
atccattaggtgcaattgtaaactgatggagaaggnagctttagaacattactcttctcctgtttttgatg

SEQ ID NO: 31040 - DNA, 71 bp, chicken (Gallus Gallus)
  misc_feature (36): n=a or g
agacagctgagaagatcctcatgttcactccagatnctaaattcaggggacgaggagacaaagcttgagag

SEQ ID NO: 31041 - DNA, 71 bp, chicken (Gallus Gallus)
  misc_feature (36): n=c or t
gtcccacgcttgctctacctgctctatcactcttgnactatctattcgactcactcctgtgcagtcccatt

SEQ ID NO: 31042 - DNA, 71 bp, chicken (Gallus Gallus)
  misc_feature (36): n=a or g
tgaagtgcactatttgctcttcagttctcaggtacngctatttaactaggtaggaagaactggcagattat

SEQ ID NO: 31043 - DNA, 71 bp, chicken (Gallus Gallus)
  misc_feature (36): n=a or g
acaaactagagcaggtctccttgcttggtctcactngacagggaagaatcacaccagaagctacggaggtc

SEQ ID NO: 31044 - DNA, 71 bp, chicken (Gallus Gallus)
  misc_feature (36): n=c or t
atatgtggctgcttcccttcatctactctggagccngtttcagctactgattatttactagtctatatttt

SEQ ID NO: 31045 - DNA, 71 bp, chicken (Gallus Gallus)
  misc_feature (36): n=a or g
cctagagaagatttcttgttagggctcactagagtnttttctagaaaaggctttttctcactgtcaggctt

SEQ ID NO: 31046 - DNA, 71 bp, chicken (Gallus Gallus)
  misc_feature (36): n=c or t
gaattagatgctataaaattaagtatagaaattganctaggcatgtatgtctgattccttgaatggtataa

SEQ ID NO: 31047 - DNA, 71 bp, chicken (Gallus Gallus)
  misc_feature (36): n=c or t
ggaatgtttcaccttctctctgaatattatgtctcngtttctccaactatatttctctgtgattatggttt

SEQ ID NO: 31048 - DNA, 71 bp, chicken (Gallus Gallus)
  misc_feature (36): n=a or g
aaggatgtttgggatctagtcccttgtaaattttcnaagggaaatgagcatctagttgctctctgaaattc

SEQ ID NO: 31049 - DNA, 71 bp, chicken (Gallus Gallus)
  misc_feature (36): n=c or t
ttgattaaagccaagtaaagcccaaggtatttgganacacagcaagcaaaggacttgtgaaaagttacaga

SEQ ID NO: 31050 - DNA, 71 bp, chicken (Gallus Gallus)
  misc_feature (36): n=a or g
agaaataactaaaaaattctgttccatacctctctnatagctgtacaaaactcactctgcagcaccttctt

SEQ ID NO: 31051 - DNA, 71 bp, chicken (Gallus Gallus)
  misc_feature (36): n=c or t
tgcaagggccggagtattatttctccacatcacagngcaatggaacatggaagaataaacagagtagctct

SEQ ID NO: 31052 - DNA, 71 bp, chicken (Gallus Gallus)
  misc_feature (36): n=c or t
gcaatttctacctttgtctctgcatatgccaaaacnaaatgtaaaaaatctttcctttcaaaagaaaaaga

SEQ ID NO: 31053 - DNA, 71 bp, chicken (Gallus Gallus)
  misc_feature (36): n=a or c
agcagtatacctggtgccctggacaaaaatcttcancagctctgttcacccacactcctggaatccacatc

SEQ ID NO: 31054 - DNA, 71 bp, chicken (Gallus Gallus)
  misc_feature (36): n=a or g
gcaactattattatgcatcatgattgtacttaagcngcaaaacaaatgatccttataacaaactgtctctc

SEQ ID NO: 31055 - DNA, 71 bp, chicken (Gallus Gallus)
  misc_feature (36): n=c or t
agctttacaaattacttctgtcatgtttgctttganaaattaacaaccgcgacaaaagctcacaataactt

SEQ ID NO: 31056 - DNA, 71 bp, chicken (Gallus Gallus)
  misc_feature (36): n=a or g
tttatcgcagcaaataaccacagcagtgaaaaattntatggaaaaaagctatatgttgttagaaatctgaa

SEQ ID NO: 31057 - DNA, 71 bp, chicken (Gallus Gallus)
  misc_feature (36): n=a or g
tttaaaatgacatcaaggagcagcggaaggaggtantactgccacaggcaaaggtgaaaagtaccagtgaa

SEQ ID NO: 31058 - DNA, 71 bp, chicken (Gallus Gallus)
  misc_feature (36): n=c or t
tggggttagggatacaagcatgattaccaacagatntgtggtgtcagagaatcaaaatccaactgagcatg

SEQ ID NO: 31059 - DNA, 71 bp, chicken (Gallus Gallus)
  misc_feature (36): n=a or c
agaacaactccaggttatgacaagcccagcggaagnaattttacctccagttttcaggtagtaaaacagta

SEQ ID NO: 31060 - DNA, 71 bp, chicken (Gallus Gallus)
  misc_feature (36): n=g or t
ttgtatagaggacattattgaatagatctggaaaanaaataaataacccccaactgtgttcagaaggtgtg

SEQ ID NO: 31061 - DNA, 71 bp, chicken (Gallus Gallus)
  misc_feature (36): n=a or g
ttcagcaagagctgttgaacacgttgctttaataantgaccactcctgttcagcacagaaaaaaaaagggt

SEQ ID NO: 31062 - DNA, 71 bp, chicken (Gallus Gallus)
  misc_feature (36): n=a or g
caagttatgacttgcacagatgggccctcccaagtnagcaggagagggtgcaaatcctgcaattcacttcc

SEQ ID NO: 31063 - DNA, 71 bp, chicken (Gallus Gallus)
  misc_feature (36): n=c or t
tagaacttgagaccaggtgttttcaagcatccatcntccaccagagaactggacagacttctatttgaagt

SEQ ID NO: 31064 - DNA, 71 bp, chicken (Gallus Gallus)
  misc_feature (36): n=a or g
gagtccatgaggaaattccctgccagaaatgtttcntctcatgacatttaactttgctgtgaactgtgctg

SEQ ID NO: 31065 - DNA, 71 bp, chicken (Gallus Gallus)
  misc_feature (36): n=c or t
ctttgattgcatccatcagtgtggattagaacttcnactttgtagcagaaagtaagctgtgcctgagaaac

SEQ ID NO: 31066 - DNA, 71 bp, chicken (Gallus Gallus)
  misc_feature (36): n=a or g
cgcttgtgatgatgtgctccttaccttactctatcntgaaatgcaaggtttagtctgctggggtagcagct

SEQ ID NO: 31067 - DNA, 71 bp, chicken (Gallus Gallus)
  misc_feature (36): n=a or g
tggcagtcttagaaagtatttgcacagtctgaagtntgtcttagaaaatacagatagaaatgtcaaaattc

SEQ ID NO: 31068 - DNA, 71 bp, chicken (Gallus Gallus)
  misc_feature (36): n=a or g
gttgaatggaaaaaacttttttctgattgggtatgnataatggaaaaagtccaacctctttgtggtttgaa

SEQ ID NO: 31069 - DNA, 71 bp, chicken (Gallus Gallus)
  misc_feature (36): n=a or g
atttagtgtctatatttgtatcaatcttctgttaanaaacattttcccgtaattcaactccttttattaaa

SEQ ID NO: 31070 - DNA, 71 bp, chicken (Gallus Gallus)
  misc_feature (36): n=c or t
tttctggattttcacttgtatcatagaaatgcatcngtaatcatgtaacacccacaaattctccgaagaac

SEQ ID NO: 31071 - DNA, 71 bp, chicken (Gallus Gallus)
  misc_feature (36): n=a or g
gtaaacagaaacaactgttattttaactctgcttcncttatgtaattactgaatttgtattgcgatgtatt

SEQ ID NO: 31072 - DNA, 71 bp, chicken (Gallus Gallus)
  misc_feature (36): n=g or t
agaaatcttcaccttttattggtagaacagatggtncataagaagtgcaaattatgtacattaatcatgca

SEQ ID NO: 31073 - DNA, 71 bp, chicken (Gallus Gallus)
  misc_feature (36): n=a or g
aaacatgttccactgagaaatgtgaatgacttgacntgaagcttttgcattataattagtctaagaatact

SEQ ID NO: 31074 - DNA, 71 bp, chicken (Gallus Gallus)
  misc_feature (36): n=a or c
ttataacattcatgctgaattttctatcaaaaaacnccccaaaattaatttttgataaaatgatgtacagt

SEQ ID NO: 31075 - DNA, 71 bp, chicken (Gallus Gallus)
  misc_feature (36): n=c or t
tttaaattacatccaaagcctttagactttcagttngaaatgttatctttgaaaatttcctcagggtacac

SEQ ID NO: 31076 - DNA, 71 bp, chicken (Gallus Gallus)
  misc_feature (36): n=c or t
attattattattatttcccttgctttaccaagttcntgaggttaccagttcagtttaatcatagaatcata

SEQ ID NO: 31077 - DNA, 71 bp, chicken (Gallus Gallus)
  misc_feature (36): n=c or t
agtagttactctgaggtttactgatacttataaaangataaacaatgtcagtgtcatgaatcgtgcattaa

SEQ ID NO: 31078 - DNA, 71 bp, chicken (Gallus Gallus)
  misc_feature (36): n=c or t
acaacctacatgggttttttgaggaggcttggtgangtagggtactctacagggagacattaaattttata

SEQ ID NO: 31079 - DNA, 71 bp, chicken (Gallus Gallus)
  misc_feature (36): n=a or g
aatttctcactgcagtcataatgtctttgaataacnccattaagaaaaattggagtatactttcttataaa

SEQ ID NO: 31080 - DNA, 71 bp, chicken (Gallus Gallus)
  misc_feature (36): n=a or c
cccaaacagcgtaaatttcatcttcaacatacaaanagacgtgtcaggttttagcatgctttactataaat

SEQ ID NO: 31081 - DNA, 71 bp, chicken (Gallus Gallus)
  misc_feature (36): n=a or c
agcaacaagtaggtgatttgtgattcaaggagtacngactacagagatgtaatcagaccttaaggactgtt

SEQ ID NO: 31082 - DNA, 71 bp, chicken (Gallus Gallus)
  misc_feature (36): n=a or g
aaggaaaggaagagaagaaaaccatttacctttacnaagaaccatttacctataaaaagtgacgcaattct

SEQ ID NO: 31083 - DNA, 71 bp, chicken (Gallus Gallus)
  misc_feature (36): n=c or t
caggatgaagtccctataatctataatgggaatctntaagagatctcctacattctttgaacattcagaag

SEQ ID NO: 31084 - DNA, 71 bp, chicken (Gallus Gallus)
  misc_feature (36): n=c or t
taacagcttattaggaaccatacaatgcattctctnctgaaaaatgtgtattggaagactagtgggttttt

SEQ ID NO: 31085 - DNA, 71 bp, chicken (Gallus Gallus)
  misc_feature (36): n=a or g
atcttatagtatatacttcatggtgttaaatacttncttttattaaatctattacagactctgatgatatg

SEQ ID NO: 31086 - DNA, 71 bp, chicken (Gallus Gallus)
  misc_feature (36): n=c or t
ctgaagatagaacccaaaccaagaatgaaaaaatcngtgtgttccagctatgaggaaactcagtctgatac

SEQ ID NO: 31087 - DNA, 71 bp, chicken (Gallus Gallus)
  misc_feature (36): n=c or t
ggtgactagacatgtaatttctataactgccaaagntctgttgtatatttgacagatacatagaaatatta

SEQ ID NO: 31088 - DNA, 71 bp, chicken (Gallus Gallus)
  misc_feature (36): n=c or t
agcacatcagttgaataccggtgttcattcagatgncacacattgaaatttgaaaggatttgctgtgacac

SEQ ID NO: 31089 - DNA, 71 bp, chicken (Gallus Gallus)
  misc_feature (36): n=a or c
catatgagtccatctaataccttcaagcttgcatcnttcattgcaaagttttttctattgcatataaagag

SEQ ID NO: 31090 - DNA, 71 bp, chicken (Gallus Gallus)
  misc_feature (36): n=c or t
atttatagcaaaagcattagttttaattagtagatngcacgtttcttgctattatcccccaaatatatttc

SEQ ID NO: 31091 - DNA, 71 bp, chicken (Gallus Gallus)
  misc_feature (36): n=c or t
cagatgaactcagggctaattaaagcttgctcaaantgaatttgtacacgtgtattaggacagcctctagt

SEQ ID NO: 31092 - DNA, 71 bp, chicken (Gallus Gallus)
  misc_feature (36): n=a or g
tgatcccgtgaaaagttagattctggatttcaaatngacacatgttcatagtattaagatttgagtatctt

SEQ ID NO: 31093 - DNA, 71 bp, chicken (Gallus Gallus)
  misc_feature (36): n=a or g
aaacaaggcaagataaatgcacattaaaggcctccngattcctggcgtttcggtagcctgaacttttacac

SEQ ID NO: 31094 - DNA, 71 bp, chicken (Gallus Gallus)
  misc_feature (36): n=a or c
tgcgacctctagtatgtaagctgccaaatctaatcnctgctcacttccctaatccatgtttcacaaactac

SEQ ID NO: 31095 - DNA, 71 bp, chicken (Gallus Gallus)
  misc_feature (36): n=c or t
taaatggaatgactattgcaaataggaagatctgtncaaagccaactttctatgtagctgccaaattctgt

SEQ ID NO: 31096 - DNA, 71 bp, chicken (Gallus Gallus)
  misc_feature (36): n=c or t
gacaatgtttataaattatgattgattataaagaanatgtttaaaaagtatgacaacgtttttgtttatgt

SEQ ID NO: 31097 - DNA, 71 bp, chicken (Gallus Gallus)
  misc_feature (36): n=c or t
aaatgtgcataggaaagaaacacagttaaggccttnaagtaacagtatagtctaaatgaattgtttaaagt

SEQ ID NO: 31098 - DNA, 71 bp, chicken (Gallus Gallus)
  misc_feature (36): n=a or c
gaaaaagtgctcactgattccataaggggtttactntattgcagtgatggctctttgatttgatggaacca

SEQ ID NO: 31099 - DNA, 71 bp, chicken (Gallus Gallus)
  misc_feature (36): n=a or g
cttccctctatttaattataggagtttgaaaagaanaaaaggactaataaagcatgtcttcgaaagagacg

SEQ ID NO: 31100 - DNA, 71 bp, chicken (Gallus Gallus)
  misc_feature (36): n=a or g
gacttttttatacacagaaggctttcttaacagtgntaacttttaatcaaagcagtattgagaatttacaa

SEQ ID NO: 31101 - DNA, 71 bp, chicken (Gallus Gallus)
  misc_feature (36): n=a or g
caaactaagccccaccttgacatttgtacatcgatngtaatcaaggctaatcagagttgtccctgtagcac

SEQ ID NO: 31102 - DNA, 71 bp, chicken (Gallus Gallus)
  misc_feature (36): n=c or t
tattatcacaagctcaagtatttgactattgagttntttttggggggggaggggaggaaggaataaatatt

SEQ ID NO: 31103 - DNA, 71 bp, chicken (Gallus Gallus)
  misc_feature (36): n=c or t
gaaaagggtaacaagaaatactaatgtttcttgatntcaatcaggctcagatgtaaacagctcagtcctac

SEQ ID NO: 31104 - DNA, 71 bp, chicken (Gallus Gallus)
  misc_feature (36): n=a or g
caagcactctgatgtgaaagtgacgcatgtacaccngcttctcttaacataataaaaagtactgaagtaaa

SEQ ID NO: 31105 - DNA, 71 bp, chicken (Gallus Gallus)
  misc_feature (36): n=a or g
tgatgttcctcaagcagagcttgaatcacttctgcncatgttgtgcgctttgtcaggccacatacaatctt

SEQ ID NO: 31106 - DNA, 71 bp, chicken (Gallus Gallus)
  misc_feature (36): n=c or t
cagcagcgtatagacaaaacaaaaacatgtatttangttgcagagagtcaaaatattcaataacttaagcc

SEQ ID NO: 31107 - DNA, 71 bp, chicken (Gallus Gallus)
  misc_feature (36): n=c or t
cacagagaccaaaatattctgcattgtaatatctcnattcaacagatggagcatttgtctgtatctgagac

SEQ ID NO: 31108 - DNA, 71 bp, chicken (Gallus Gallus)
  misc_feature (36): n=c or t
gggagaaaccttatcaagtattacctatctataacnagtgcagctttgaatgttacagagagaccagaaga

SEQ ID NO: 31109 - DNA, 71 bp, chicken (Gallus Gallus)
  misc_feature (36): n=a or c
gaaatgagacaaaaaacagggaatctgacattgcanatgagctgcaaagctatcatctagggctgcgttaa

SEQ ID NO: 31110 - DNA, 71 bp, chicken (Gallus Gallus)
  misc_feature (36): n=g or t
ccagcaaaagccctattgttaaaatttatactgctnaagcatttgctgaaacaatggttttagttagggta

SEQ ID NO: 31111 - DNA, 71 bp, chicken (Gallus Gallus)
  misc_feature (36): n=a or g
agttcattctgacaaaaatctgaggtacaatagagntgacagagatgccatacttcagtagtgaatcactg

SEQ ID NO: 31112 - DNA, 71 bp, chicken (Gallus Gallus)
  misc_feature (36): n=a or c
atatcgtggaaaaatatgtaaagtttactggaaagnagaaattgtccatataagtaatgtttcttttaaat

SEQ ID NO: 31113 - DNA, 71 bp, chicken (Gallus Gallus)
  misc_feature (36): n=c or t
acttaagagtctttcaagggagaagtacatacttantgtttctttggaatgttgtggaagagctatttgct

SEQ ID NO: 31114 - DNA, 71 bp, chicken (Gallus Gallus)
  misc_feature (36): n=c or t
atgaattttggcattttcctctacagataacaaatnctacttaccttgaagcactggcaaaaaccattaag

SEQ ID NO: 31115 - DNA, 71 bp, chicken (Gallus Gallus)
  misc_feature (36): n=a or g
ctatatagccacaagtacaaaatctgaatatctatngaatgtgctgtgaaataaatacaccatgctgagtc

SEQ ID NO: 31116 - DNA, 71 bp, chicken (Gallus Gallus)
  misc_feature (36): n=g or t
ccaagagaacctgtgaaaataaatccgaaggaaacncataacaaagctgtccactgaaaagagtcaagttc

SEQ ID NO: 31117 - DNA, 71 bp, chicken (Gallus Gallus)
  misc_feature (36): n=c or t
aagagagtgctttttatagcagagttgataatcagnaaggtagagaactacactttatcacatagtgcaga

SEQ ID NO: 31118 - DNA, 71 bp, chicken (Gallus Gallus)
  misc_feature (36): n=a or c
tcttcactgcatgtgtatttatgagcaccaagatcncctcttctctgcactttatgccagcttgaaacaag

SEQ ID NO: 31119 - DNA, 71 bp, chicken (Gallus Gallus)
  misc_feature (36): n=c or t
agtctcaagcaagatatttttttgttgatgttgaanagtgtgctttccccttctgcagatagcattcaggg

SEQ ID NO: 31120 - DNA, 71 bp, chicken (Gallus Gallus)
  misc_feature (36): n=a or c
tttgagatatatataagtatcagctcataaataaantaggtcatataaatatgtagcatcagtgttttcca

SEQ ID NO: 31121 - DNA, 71 bp, chicken (Gallus Gallus)
  misc_feature (36): n=c or t
tgcttgggaaggtggtggaagtccctgctgtcccanagaggggctctggccccgtggcggatgtgctcagg

SEQ ID NO: 31122 - DNA, 71 bp, chicken (Gallus Gallus)
  misc_feature (36): n=c or t
tatgaatgactttggtagaacaatgacaagtataantgaaaactcaaagagcaatataagaagctcaatta

SEQ ID NO: 31123 - DNA, 71 bp, chicken (Gallus Gallus)
  misc_feature (36): n=a or g
cttacagtggatgtgatagagaactagaaatcacanaaaacatgatgagggtgaattaaaactgcctgctt

SEQ ID NO: 31124 - DNA, 71 bp, chicken (Gallus Gallus)
  misc_feature (36): n=c or t
tactggatatttgcaaattcattgccaaagtaatcnggctttacaaaaagctaccagcaacattcaaatag

SEQ ID NO: 31125 - DNA, 71 bp, chicken (Gallus Gallus)
  misc_feature (36): n=a or c
gagtccataaaatccagggctctgaaatacttttgnaaaagtgaagcacactattcaatttatttgtaagg

SEQ ID NO: 31126 - DNA, 71 bp, chicken (Gallus Gallus)
  misc_feature (36): n=a or g
actgtggactatgaacagtaaagctcccaatccccntttaacagaatgacttatatttcttctaggcgcct

SEQ ID NO: 31127 - DNA, 71 bp, chicken (Gallus Gallus)
  misc_feature (36): n=g or t
taacatcaggctacctggtagtggttaaacagatcnctttctaaataattacagtagaaaaccccatgccc

SEQ ID NO: 31128 - DNA, 71 bp, chicken (Gallus Gallus)
  misc_feature (36): n=a or g
cattcttctagtgcccaaattcacaacaagaaacantaatagtttttacaatagttgtgtatggaatacac

SEQ ID NO: 31129 - DNA, 71 bp, chicken (Gallus Gallus)
  misc_feature (36): n=a or g
actttaagacccagaagtgtaaatgaagctaccttntgttctattttacagctatagcccatgatttgctc

SEQ ID NO: 31130 - DNA, 71 bp, chicken (Gallus Gallus)
  misc_feature (36): n=g or t
tgatcctagtagcttagttaatgaatgtattcaacngtgaaagttccctaggatgcacttttctaattata

SEQ ID NO: 31131 - DNA, 71 bp, chicken (Gallus Gallus)
  misc_feature (36): n=c or t
atctctcagcttggggttgattagttacagctctcngttgggtaagagaataccctttgtggttaggaaag

SEQ ID NO: 31132 - DNA, 71 bp, chicken (Gallus Gallus)
  misc_feature (36): n=c or t
ttattcatcatagtttatggtcatatttcagagttntgtcatgtgctttgtgcttcccgcatactctaaat

SEQ ID NO: 31133 - DNA, 71 bp, chicken (Gallus Gallus)
  misc_feature (36): n=a or g
tgtggtgattaaagccttggattttagtaacaaatnaaaactatcaaacaattttagcacagcttagatta

SEQ ID NO: 31134 - DNA, 71 bp, chicken (Gallus Gallus)
  misc_feature (36): n=c or t
tctgaagtaaaaacctctaatacagataaatgattnataaccattatctagaaagagtcaggatgaaaaga

SEQ ID NO: 31135 - DNA, 71 bp, chicken (Gallus Gallus)
  misc_feature (36): n=a or g
tgctcacagttgcaccaggtcaaaaaaatactaaancatggctttaactttgaagctgagtttcctactaa

SEQ ID NO: 31136 - DNA, 71 bp, chicken (Gallus Gallus)
  misc_feature (36): n=a or g
aaccagaatgggttctgaaccaggctctaaaattcntggttcatttgtatgtgatacgtttggattgctca

SEQ ID NO: 31137 - DNA, 71 bp, chicken (Gallus Gallus)
  misc_feature (36): n=a or g
cagctttcattttaaagtgtgacctcctgaaatctnttttcatatttcgtatcataggatttcctgctggt

SEQ ID NO: 31138 - DNA, 71 bp, chicken (Gallus Gallus)
  misc_feature (36): n=a or c
ttcttgctagttctgtgtctagctccatccccacancagcagaaaaatctctttccaaacagtcacttcct

SEQ ID NO: 31139 - DNA, 71 bp, chicken (Gallus Gallus)
  misc_feature (36): n=c or t
gtggggagattagtcactctgctgattgtagcactnctctgaactgtgattttgcaaacttttatgtaaag

SEQ ID NO: 31140 - DNA, 71 bp, chicken (Gallus Gallus)
  misc_feature (36): n=g or t
agatccagtacatgtggacctaaagtgatctgtagngatgtgcaggtgagcagccaggcaaacactcattt

SEQ ID NO: 31141 - DNA, 71 bp, chicken (Gallus Gallus)
  misc_feature (36): n=a or g
ataagtattcccaaagcagagaagcagcgtaattcntatgcttgacctattccaggtaacagttaaaccta

SEQ ID NO: 31142 - DNA, 71 bp, chicken (Gallus Gallus)
  misc_feature (36): n=a or c
gaggcatacactattttaaattctgtgggggttatnccttgctttccttaatcattcatgtctttggaaaa

SEQ ID NO: 31143 - DNA, 71 bp, chicken (Gallus Gallus)
  misc_feature (36): n=c or t
ctacagactttaacactctgatttatgagcacagtncctgttttctcaccattaataaaattattattttc

SEQ ID NO: 31144 - DNA, 71 bp, chicken (Gallus Gallus)
  misc_feature (36): n=c or t
cacagatttgtcctcactgcaagatgctattagtcntccatcaggtgaaaatctggaacatgcaaatgtat

SEQ ID NO: 31145 - DNA, 71 bp, chicken (Gallus Gallus)
  misc_feature (36): n=c or t
ggtacttcatgtaataatatgcacttgaagtatgcngtgagctgcttttaagcctgtcttagtgtcacctc

SEQ ID NO: 31146 - DNA, 71 bp, chicken (Gallus Gallus)
  misc_feature (36): n=a or g
gaagaatgttgtcactgtatgcacttagaaaataantacttaaaagagaggatcatagaaactgtatttac

SEQ ID NO: 31147 - DNA, 71 bp, chicken (Gallus Gallus)
  misc_feature (36): n=a or g
ataccctgacttaacaaatgttaaaaggcaatctanctcatttttccagggttcccagacctcttactgac

SEQ ID NO: 31148 - DNA, 71 bp, chicken (Gallus Gallus)
  misc_feature (36): n=g or t
aataaaaaaaaactaattgagcacaaacctagaaanaaccaatcatataaaccaagtttacctacattcca

SEQ ID NO: 31149 - DNA, 71 bp, chicken (Gallus Gallus)
  misc_feature (36): n=a or g
ttttggagagatcaatagtatggcactctgataganctattatttaattcttactgaggactagcacagta

SEQ ID NO: 31150 - DNA, 71 bp, chicken (Gallus Gallus)
  misc_feature (36): n=c or t
taggctgggctagaagccttagagctgtagcagaangctctatgagggctcagtagacaaaaagatgaaaa

SEQ ID NO: 31151 - DNA, 71 bp, chicken (Gallus Gallus)
  misc_feature (36): n=a or g
ctggacatacagtcttacaccttcacaagtctgtangcaaccagttactagaactacatatgggagaggac

SEQ ID NO: 31152 - DNA, 71 bp, chicken (Gallus Gallus)
  misc_feature (36): n=c or t
tttttcatttgtggttaaacctgtatctaaatagcngagttttgttgttcttgtagcagaacaaaattaaa

SEQ ID NO: 31153 - DNA, 71 bp, chicken (Gallus Gallus)
  misc_feature (36): n=c or t
tcacactttgttgtccttgctggaattgacacaatntgataaaactcaagcactaggaaaaatcactaaat

SEQ ID NO: 31154 - DNA, 71 bp, chicken (Gallus Gallus)
  misc_feature (36): n=c or t
cctttctggcatttttggaaatcatcatctagaggnatcactagcatgacatatcctttactgttgtgtca

SEQ ID NO: 31155 - DNA, 71 bp, chicken (Gallus Gallus)
  misc_feature (36): n=a or g
gccgcataggtctctctctgaagtgtagctagctgnagagcatctgtttctaatgtcccagatggttcttc

SEQ ID NO: 31156 - DNA, 71 bp, chicken (Gallus Gallus)
  misc_feature (36): n=c or t
ctaattcttcaaagcagcagttgaattaacataagntttatgtgggtgttatgtattcatctgcacatttt

SEQ ID NO: 31157 - DNA, 71 bp, chicken (Gallus Gallus)
  misc_feature (36): n=a or c
cctcctttaagtatcagtttcccagccttttcaaantcctccttctgcagttcctaacagcagttttctta

SEQ ID NO: 31158 - DNA, 71 bp, chicken (Gallus Gallus)
  misc_feature (36): n=c or t
caaatatgaatcagttctttaatgcaacagggagcngaccagtatctataaaaaatggatgtgccgttctg

SEQ ID NO: 31159 - DNA, 71 bp, chicken (Gallus Gallus)
  misc_feature (36): n=a or g
ataaactattgactcagggttgcacatatgggttcntgagaatactcttgaacatttttttcttgacaata

SEQ ID NO: 31160 - DNA, 71 bp, chicken (Gallus Gallus)
  misc_feature (36): n=c or t
atctgagcaattagcatgtggatcaaattaaatganttacgcatacaaatgtagaggaatttactagtaca

SEQ ID NO: 31161 - DNA, 71 bp, chicken (Gallus Gallus)
  misc_feature (36): n=a or c
ttatgattattaatgaaatcactacaaaatactttnattatctatgacaatattgaacttctccttcttct

SEQ ID NO: 31162 - DNA, 71 bp, chicken (Gallus Gallus)
  misc_feature (36): n=c or t
cacagtgaagaagtataacactgtacatggtatagnagtctttgagaagctccttagccatcacagaaaaa

SEQ ID NO: 31163 - DNA, 71 bp, chicken (Gallus Gallus)
  misc_feature (36): n=a or g
gagtcaagtatttaaacaagtgaaggatatttggcntataagctctcatgttgtcaaatttcagtaactgc

SEQ ID NO: 31164 - DNA, 71 bp, chicken (Gallus Gallus)
  misc_feature (36): n=a or g
ttttgctttacatccaaagtcttcacaacagctccngatacatgagcataaccctgctatgcacatgcact

SEQ ID NO: 31165 - DNA, 71 bp, chicken (Gallus Gallus)
  misc_feature (36): n=a or g
tcctctgatttctgttgtcatgctttcaagctaccnaaagggagtttagagatttagatttgtgccctgaa

SEQ ID NO: 31166 - DNA, 71 bp, chicken (Gallus Gallus)
  misc_feature (36): n=a or c
aatctggaatttgatctgtgataaattactttcccnccaggccctctcacattagcttaatccacatttgt

SEQ ID NO: 31167 - DNA, 71 bp, chicken (Gallus Gallus)
  misc_feature (36): n=a or c
aaggccacataacaaatagctataccttctgcagtnaaatgtatcctactggtaatttttatgttgttcca

SEQ ID NO: 31168 - DNA, 71 bp, chicken (Gallus Gallus)
  misc_feature (36): n=a or g
ctgtcagttctcattaactagtattcatgttacacnatttctctaacaagtatttagctgagtgcacctaa

SEQ ID NO: 31169 - DNA, 71 bp, chicken (Gallus Gallus)
  misc_feature (36): n=a or g
gttaatttattgtgcgataaacgtaaatattgcagngttttaaaaccttggaagtattcatcaggaatatt

SEQ ID NO: 31170 - DNA, 71 bp, chicken (Gallus Gallus)
  misc_feature (36): n=g or t
tacttttgcagtataaacagaactacatattgatgnaaatacaggatggtgaaggctcaaaacatttttgg

SEQ ID NO: 31171 - DNA, 71 bp, chicken (Gallus Gallus)
  misc_feature (36): n=c or t
acggaagaaaaatatatctgagagtgcagtttaaangagaaatacacgaactcaacacttttttacacgca

SEQ ID NO: 31172 - DNA, 71 bp, chicken (Gallus Gallus)
  misc_feature (36): n=a or g
ttgacaaactatccttcttggtctgatttattctgncaactacttaatcaatataaaagaaagtatgatta

SEQ ID NO: 31173 - DNA, 71 bp, chicken (Gallus Gallus)
  misc_feature (36): n=a or g
aataggctgttaaagcacaaccattctgtaactggnacagctattgtaggcaacagcagtatttctttaag

SEQ ID NO: 31174 - DNA, 71 bp, chicken (Gallus Gallus)
  misc_feature (36): n=a or c
tatggaacaagtataatttttgctctccaccatatntcctcaacatgtttatccaaacaccttatgacaat

SEQ ID NO: 31175 - DNA, 71 bp, chicken (Gallus Gallus)
  misc_feature (36): n=c or t
ggaccttgaggtcctgctccttgctttaaaatgggncctggctttggaaaacaatcagagctttagaaatg

SEQ ID NO: 31176 - DNA, 71 bp, chicken (Gallus Gallus)
  misc_feature (36): n=c or t
tgctttaggatttccccttctaacccagagcactgnatacctcatacacgttaacgtgccttaatttaaca

SEQ ID NO: 31177 - DNA, 71 bp, chicken (Gallus Gallus)
  misc_feature (36): n=c or t
aaagtttgaggataatttgtttgcccccgtgaaccnttaaaaaatcctgtaggagatccaaactgatcaca

SEQ ID NO: 31178 - DNA, 71 bp, chicken (Gallus Gallus)
  misc_feature (36): n=c or t
atagagttctgcattcattcctgtcttcaagttggnactcaccaatgacccctttaaaatagcaatttgac

SEQ ID NO: 31179 - DNA, 71 bp, chicken (Gallus Gallus)
  misc_feature (36): n=a or c
gaaacagtgttttggtttcagaggatgcattattgnataaactgtttatggttcacatggtgaacaaagtg

SEQ ID NO: 31180 - DNA, 71 bp, chicken (Gallus Gallus)
  misc_feature (36): n=c or t
aaatgggtccaatatggtattccataaatctaaaangacccatctttagccaaaacatctcataattcttg

SEQ ID NO: 31181 - DNA, 71 bp, chicken (Gallus Gallus)
  misc_feature (36): n=a or g
cagctcagtgctcagcagtacccagaaatgcaaatnaaatacattatgaattactggaaaaggaacagagg

SEQ ID NO: 31182 - DNA, 71 bp, chicken (Gallus Gallus)
  misc_feature (36): n=c or t
gattatcctggataataaatacaggttttaacttcnaagaaggaatccttagcaattactttcattttaca

SEQ ID NO: 31183 - DNA, 71 bp, chicken (Gallus Gallus)
  misc_feature (36): n=c or t
catagggaagtacaagatagaaagcctatgactacntcaaagataaaatacttcatgacaccatgcttgtg

SEQ ID NO: 31184 - DNA, 71 bp, chicken (Gallus Gallus)
  misc_feature (36): n=a or g
tatttgaatattgttataggcaagtgaaagaataantcaatatacttgtatatatttaactgtgaattgca

SEQ ID NO: 31185 - DNA, 71 bp, chicken (Gallus Gallus)
  misc_feature (36): n=c or t
ctgttcaaatccaataaacctatcggtgtatacttnacctttcctttcaggtaccacattttgtttcataa

SEQ ID NO: 31186 - DNA, 71 bp, chicken (Gallus Gallus)
  misc_feature (36): n=a or g
gttgaagtaacttccttaggtcatgcaaaaaatctntggcttgatgcaggaaatgagctcagatcttgcaa

SEQ ID NO: 31187 - DNA, 71 bp, chicken (Gallus Gallus)
  misc_feature (36): n=a or g
agaggcgatgccttcagcccaaggcactgagaggantcgagctggtggctagcaggaactgtatttggaca

SEQ ID NO: 31188 - DNA, 71 bp, chicken (Gallus Gallus)
  misc_feature (36): n=c or t
cagcatagtcagcagcacatttcatagaagttgaangttgctttacaggaagccgagctctgtatttttct

SEQ ID NO: 31189 - DNA, 71 bp, chicken (Gallus Gallus)
  misc_feature (36): n=a or c
gctcccaccatcgtattgtgcagacaaaagaagttnaaaagctgccagatatgatagctcccttaacataa

SEQ ID NO: 31190 - DNA, 71 bp, chicken (Gallus Gallus)
  misc_feature (36): n=c or t
agttgagagttcgtgcacctgtgaagccaatggcantagtaaaagccaggcaaagcatgaacaagctgtaa

SEQ ID NO: 31191 - DNA, 71 bp, chicken (Gallus Gallus)
  misc_feature (36): n=c or t
tttccacagctgtagtgcaagctcctggcagatgtngatttagaaaactagaggctttagctagcattcac

SEQ ID NO: 31192 - DNA, 71 bp, chicken (Gallus Gallus)
  misc_feature (36): n=a or g
ccaatgtcagctgtattttgaatatacaggcaacanttatttaatgttccaggacctgctcactgcttctg

SEQ ID NO: 31193 - DNA, 71 bp, chicken (Gallus Gallus)
  misc_feature (36): n=a or g
tcaagcccagccacaacttcccactggcacataacnagttatttcttttgcctgaaaagcactccaaattc

SEQ ID NO: 31194 - DNA, 71 bp, chicken (Gallus Gallus)
  misc_feature (36): n=g or t
tgccttccctcctgctgtttggtgagtgcactaccntcctggctaaggcagcttttgcagtgtatccaatg

SEQ ID NO: 31195 - DNA, 71 bp, chicken (Gallus Gallus)
  misc_feature (36): n=a or g
agagtttccgttagatcagctcatctgaatcatctntaatttctctttgtctctcaacaagtatgtgatca

SEQ ID NO: 31196 - DNA, 71 bp, chicken (Gallus Gallus)
  misc_feature (36): n=a or g
tgagaacccttgaagacctagtcctctggtacattnactttatcatctgaaaactcagagatcatcataaa

SEQ ID NO: 31197 - DNA, 71 bp, chicken (Gallus Gallus)
  misc_feature (36): n=a or g
agtttcacttctaaagagactaaaatgtgtagaacntagcaagaagttgtttgctttacccaagactaaaa

SEQ ID NO: 31198 - DNA, 71 bp, chicken (Gallus Gallus)
  misc_feature (36): n=c or t
ataacgggatgtatgggtacacatcagctgtctctntttcccaaggtttgttttccagtacactacaaaac

SEQ ID NO: 31199 - DNA, 71 bp, chicken (Gallus Gallus)
  misc_feature (36): n=c or t
aatagacattaatggcccctacattctgaataccangggagtaccacacagtggttttctggatgcctccg

SEQ ID NO: 31200 - DNA, 71 bp, chicken (Gallus Gallus)
  misc_feature (36): n=a or g
gaggagcaaaaagatgtactatttgaagatgacacnttttatttatattacactttcagatcaaataaaga

SEQ ID NO: 31201 - DNA, 71 bp, chicken (Gallus Gallus)
  misc_feature (36): n=c or t
gttcacaagttaatcatttccccgaatgccagaagncagggcagatcaggatgtacattgtgttggtagag

SEQ ID NO: 31202 - DNA, 71 bp, chicken (Gallus Gallus)
  misc_feature (36): n=a or g
tgaagcagaattaatgttcagctggaaagacagacnagagaacatcctgtttgagtttagtttacgttcac

SEQ ID NO: 31203 - DNA, 71 bp, chicken (Gallus Gallus)
  misc_feature (36): n=g or t
ctatggaacaagtagatagtaccaagattcctgagntcaaagctatatttaacagtcatttgcattatttg

SEQ ID NO: 31204 - DNA, 71 bp, chicken (Gallus Gallus)
  misc_feature (36): n=c or t
gtggcccagctgtctctggatgcgttcagtagctgnctataagcgagtcccgctacgaagtaagtgatgat

SEQ ID NO: 31205 - DNA, 71 bp, chicken (Gallus Gallus)
  misc_feature (36): n=g or t
ttgttagcacagtattactacatttgtctgttcttncctgtcaaacctgacaatttatcacccgcagtcac

SEQ ID NO: 31206 - DNA, 71 bp, chicken (Gallus Gallus)
  misc_feature (36): n=g or t
atgtggccctgccatgtgataggtagatgttccttntgacttgtctcttagtcacttccctggggtgtgca

SEQ ID NO: 31207 - DNA, 71 bp, chicken (Gallus Gallus)
  misc_feature (36): n=c or t
cacagtttaaagcttatgaaaaattagtagatgatnctccctgttcagcaagacctgtgttaaaactacat

SEQ ID NO: 31208 - DNA, 71 bp, chicken (Gallus Gallus)
  misc_feature (36): n=a or g
tcatagaggaaagagtgtgagaattgtttgtccccngaactcatcaaatttccaagggctgttattttggt

SEQ ID NO: 31209 - DNA, 71 bp, chicken (Gallus Gallus)
  misc_feature (36): n=a or g
aattcgagaaacgacttcaggctgcaacccgcaaancgatgcaggcttcccgtgagaggagcccgactcac

SEQ ID NO: 31210 - DNA, 71 bp, chicken (Gallus Gallus)
  misc_feature (36): n=c or t
tgcctgccctccttggcttgatccatcctagcaagntcccctcttagcctgcttctgacccatgagaagaa

SEQ ID NO: 31211 - DNA, 71 bp, chicken (Gallus Gallus)
  misc_feature (36): n=a or g
tcctccttgcatttttgttgtcagttttcaggatgntgtaaggaagggcagctagtggggctgaggtgaag

SEQ ID NO: 31212 - DNA, 71 bp, chicken (Gallus Gallus)
  misc_feature (36): n=c or t
aattcatttcaggaggctcaaaaatataatcactgnactatgataaagaagatgaaatatattgtggattt

SEQ ID NO: 31213 - DNA, 71 bp, chicken (Gallus Gallus)
  misc_feature (36): n=a or g
ggaggctaattcataggcacctggcatgaaactggnctcctgctttttgggaaatagcacattgctgcctg

SEQ ID NO: 31214 - DNA, 71 bp, chicken (Gallus Gallus)
  misc_feature (36): n=a or g
gtatcaaataaattctcagctgagttttcaagtgcncatttggtcactgcaattgcattctgagtcttgca

SEQ ID NO: 31215 - DNA, 71 bp, chicken (Gallus Gallus)
  misc_feature (36): n=c or t
gctagcacacacttctgccacaagatcagacactantgcttttccgcttggccagctcgtggcacaaatgc

SEQ ID NO: 31216 - DNA, 71 bp, chicken (Gallus Gallus)
  misc_feature (36): n=g or t
tccctaataagcacaaacgtacttaatgccagctcntgctatcatctggagtacaaagcctgctgcttcca

SEQ ID NO: 31217 - DNA, 71 bp, chicken (Gallus Gallus)
  misc_feature (36): n=g or t
tcaggggaagccaagagcaactgctcactgatattngctataacaccattacagttcattacaaaatccaa

SEQ ID NO: 31218 - DNA, 71 bp, chicken (Gallus Gallus)
  misc_feature (36): n=c or t
cactttcacttcagtggctgagcttctcacatctanatcacacgttcatcctgcagtgggatccaggcaag

SEQ ID NO: 31219 - DNA, 71 bp, chicken (Gallus Gallus)
  misc_feature (36): n=a or g
accacttccctccacactagttttcacaacactgcnttcagtgctgcctcagatgaaggtgggagaagaac

SEQ ID NO: 31220 - DNA, 71 bp, chicken (Gallus Gallus)
  misc_feature (36): n=a or g
aagaagtttcttttgtcttcatagtacttgtttccntatttgtcaactcctaccagcgtaccagtcttcaa

SEQ ID NO: 31221 - DNA, 71 bp, chicken (Gallus Gallus)
  misc_feature (36): n=c or t
tcaacacagccgtaacgatgaagcacacattatganagtaaagagcacagagataaggtagttttgtgcac

SEQ ID NO: 31222 - DNA, 71 bp, chicken (Gallus Gallus)
  misc_feature (36): n=c or t
tcctgatgctaaattggctgccattgatatgacaantggagtgaaatactggggaaatactgattgacaag

SEQ ID NO: 31223 - DNA, 71 bp, chicken (Gallus Gallus)
  misc_feature (36): n=a or g
tcttttgtgtatttgtaacacagcttgattcttctntttcttcagcattggaatgtccagaggaggaccac

SEQ ID NO: 31224 - DNA, 71 bp, chicken (Gallus Gallus)
  misc_feature (36): n=a or g
ctacatgcgtgtgttggttttatttgtcttccccangtgttatgaagagtaatgtacttgagaagcccttt

SEQ ID NO: 31225 - DNA, 71 bp, chicken (Gallus Gallus)
  misc_feature (36): n=c or t
tcttcagcatccagtgagtggggagcagcttctacngtttataagatacatttgctttcatagagtagatg

SEQ ID NO: 31226 - DNA, 71 bp, chicken (Gallus Gallus)
  misc_feature (36): n=c or t
agcagtgcaataaaatgggattgtaaaaccactganggtgataaagtgcatttggctgttaagacctttaa

SEQ ID NO: 31227 - DNA, 71 bp, chicken (Gallus Gallus)
  misc_feature (36): n=c or t
atatgtaaagcatattggtaggcttgtggttcttangatgttgcatgtctgccttttctttcctctcatac

SEQ ID NO: 31228 - DNA, 71 bp, chicken (Gallus Gallus)
  misc_feature (36): n=g or t
ctctctaggcaataagccttgggcacctttagcaancagtgagtttagcttcctaacaaacacaaaaccat

SEQ ID NO: 31229 - DNA, 71 bp, chicken (Gallus Gallus)
  misc_feature (36): n=a or g
ctgacaataaggaatgataacgggttctttttggantaattcaggaagaacccacaaaatcacaggggagc

SEQ ID NO: 31230 - DNA, 71 bp, chicken (Gallus Gallus)
  misc_feature (36): n=a or g
aggaaagtgctgaaagcaatgtatttgtgagggaancgaaaacatctccgctaagggaactcttgattcta

SEQ ID NO: 31231 - DNA, 71 bp, chicken (Gallus Gallus)
  misc_feature (36): n=a or g
atcagtgtgagtggacagagaccaaatgcactggtnagcccatagggtgacctactcgctgttagagcaat

SEQ ID NO: 31232 - DNA, 71 bp, chicken (Gallus Gallus)
  misc_feature (36): n=c or t
ctaaaatcataacacttgcagagaccagtgcccttngttagtgtgacgggctaaataaatcccaccattgg

SEQ ID NO: 31233 - DNA, 71 bp, chicken (Gallus Gallus)
  misc_feature (36): n=a or g
tctgctctttctcttcacctcagagtgtctcagagngaatgtatgcccagaactcctgtgactttctgcag

SEQ ID NO: 31234 - DNA, 71 bp, chicken (Gallus Gallus)
  misc_feature (36): n=c or t
agggtatattacacgtaataaaaccattgtcagaanagtgtaaggaatagtatgtggttcagtatttagct

SEQ ID NO: 31235 - DNA, 71 bp, chicken (Gallus Gallus)
  misc_feature (36): n=c or t
catatatattttttctaggtagcctatcagactggnaactacacattagccagaggagcattttcaccgat

SEQ ID NO: 31236 - DNA, 71 bp, chicken (Gallus Gallus)
  misc_feature (36): n=c or t
ctaaatctgggtgagcagaagagcttcttttcatgntctttattccagttagtgcttagaagtctggtgga

SEQ ID NO: 31237 - DNA, 71 bp, chicken (Gallus Gallus)
  misc_feature (36): n=a or c
catgtgataacgggagatcacaaatacagtcttaangtgattctgctgtccttttaggaaattggtagtgg

SEQ ID NO: 31238 - DNA, 71 bp, chicken (Gallus Gallus)
  misc_feature (36): n=c or t
tgcatttcagttcctcaaaggtgtttttcttttccnggaagccccaaatccttatgttattgagagctgag

SEQ ID NO: 31239 - DNA, 71 bp, chicken (Gallus Gallus)
  misc_feature (36): n=a or c
aacttctgagacaaaacttagcagaactgcaaaaanatgtgagggcatgggtgtattgggaacaaactgaa

SEQ ID NO: 31240 - DNA, 71 bp, chicken (Gallus Gallus)
  misc_feature (36): n=a or g
tttttaaaagtcaattctatccattcagctaaagancagactcctgtcaacagtctacatttctttccaga

SEQ ID NO: 31241 - DNA, 71 bp, chicken (Gallus Gallus)
  misc_feature (36): n=a or g
ataagggggaggaaactgaagaggacatgagataangagatgaggtaatgagcaaatgcttctgttttaac

SEQ ID NO: 31242 - DNA, 71 bp, chicken (Gallus Gallus)
  misc_feature (36): n=a or g
gtgaaaagccacactggggaaaaagatccgctgagncttttctcataagattagctcaacactgtaagata

SEQ ID NO: 31243 - DNA, 71 bp, chicken (Gallus Gallus)
  misc_feature (36): n=a or g
tggaaaaataggtatgaagagcaggtccaggttccnttggttttgctaaaagtgattgttcactggctgct

SEQ ID NO: 31244 - DNA, 71 bp, chicken (Gallus Gallus)
  misc_feature (36): n=a or g
cctctagtgatcattaatgctaaagtggcaagaacnttttcaagtgagcagagcttttggtctgcaacagc

SEQ ID NO: 31245 - DNA, 71 bp, chicken (Gallus Gallus)
  misc_feature (36): n=c or t
aaatgtatggtgcttaaagggagggaatacgaccanatggaaatggctttcttatccaagtggaaacagtt

SEQ ID NO: 31246 - DNA, 71 bp, chicken (Gallus Gallus)
  misc_feature (36): n=g or t
attacatatattacaagtttccttgtttttagctanggtgaataaagtcaagagaacaggggcagttgcag

SEQ ID NO: 31247 - DNA, 71 bp, chicken (Gallus Gallus)
  misc_feature (36): n=c or t
aataagtgcgctacatgctctgccttctgggagccngttgctctgacaatcccttcgtgagctgtgatctc

SEQ ID NO: 31248 - DNA, 71 bp, chicken (Gallus Gallus)
  misc_feature (36): n=c or t
ttctctctttccctctcccacttgtcttcctccccnatttactgataccatccctgaggaaaggctgtact

SEQ ID NO: 31249 - DNA, 71 bp, chicken (Gallus Gallus)
  misc_feature (36): n=a or g
ttacagaggtccaagtggaaaacgccagcatttcancatgcagccagccaactctgttgcacaactcacta

SEQ ID NO: 31250 - DNA, 71 bp, chicken (Gallus Gallus)
  misc_feature (36): n=c or t
acactgcttcctccatcagtggcaactttgctttcnccttgcttgccccttggtagccaagtgttcccagg

SEQ ID NO: 31251 - DNA, 71 bp, chicken (Gallus Gallus)
  misc_feature (36): n=a or g
gaagtaaacttaaatattgtttcaaatttcacaggnaagctctttcagagtatcttttaaaatgtgaacgc

SEQ ID NO: 31252 - DNA, 71 bp, chicken (Gallus Gallus)
  misc_feature (36): n=g or t
gctgtcttaatctgttcaatttttcttgcattactngatgccaagctttgtagttctgcacttcggtcaat

SEQ ID NO: 31253 - DNA, 71 bp, chicken (Gallus Gallus)
  misc_feature (36): n=c or t
tccactgactgagaatgatgtatttacagtctcttngtatttaaagagaatttgcgttgagaatttgaact

SEQ ID NO: 31254 - DNA, 71 bp, chicken (Gallus Gallus)
  misc_feature (36): n=a or c
tcgggagaggttcttgctatgttaaacaagtgaagncatataacaaatatcttggtaatcaggccagcata

SEQ ID NO: 31255 - DNA, 71 bp, chicken (Gallus Gallus)
  misc_feature (36): n=c or t
tttcacttacatgcttgtcactgtcactcagttctngcgtagagacaattgttctttgagcttgtagtcag

SEQ ID NO: 31256 - DNA, 71 bp, chicken (Gallus Gallus)
  misc_feature (36): n=a or c
aaatacatcacaagcatatttccatactacaagtanaagatgtcttttcctctacttcactctcttttttt

SEQ ID NO: 31257 - DNA, 71 bp, chicken (Gallus Gallus)
  misc_feature (36): n=c or t
tttttgagaatcccaagagactgtaaatatgcatgntgcatgatggttgctgatactactgaaacgccaca

SEQ ID NO: 31258 - DNA, 71 bp, chicken (Gallus Gallus)
  misc_feature (36): n=a or g
aactcttttttgattactgctactcagtcagaggancattgagaagtgaatggtagctctaccaatggcca

SEQ ID NO: 31259 - DNA, 71 bp, chicken (Gallus Gallus)
  misc_feature (36): n=c or t
cacgaataaggtggaggagttacattatattactantgcttgatgcaacacctttaagagatagatggcaa

SEQ ID NO: 31260 - DNA, 71 bp, chicken (Gallus Gallus)
  misc_feature (36): n=a or c
aaacaaacggaatccctcaattctcccaagatctantgcttaacattcccttcttcgacttccacaccttt

SEQ ID NO: 31261 - DNA, 71 bp, chicken (Gallus Gallus)
  misc_feature (36): n=g or t
tatcagctgatactgtactaacactttgacttaaanctgtgattcctctagtaacttttaaacttgtaacc

SEQ ID NO: 31262 - DNA, 71 bp, chicken (Gallus Gallus)
  misc_feature (36): n=a or g
tagtaattagttggctgtaacattgacttctgaaangattgcctaaagtaatcatcacagtgctctcttcc

SEQ ID NO: 31263 - DNA, 71 bp, chicken (Gallus Gallus)
  misc_feature (36): n=a or c
tgaatatgtgtacttaaagaaacattttggagctantttgtctttcaacgttaccatagcttaaagcccag

SEQ ID NO: 31264 - DNA, 71 bp, chicken (Gallus Gallus)
  misc_feature (36): n=a or g
acaaactagagtaatggaccagttatatgggtaacnagtggagaaggttatcgttagatggagtcagtgtc

SEQ ID NO: 31265 - DNA, 71 bp, chicken (Gallus Gallus)
  misc_feature (36): n=a or g
tcgtggggtatttaggttcatttgcaagctctgggnataagttctgcacgcacttgaaaaagcttcaatta

SEQ ID NO: 31266 - DNA, 71 bp, chicken (Gallus Gallus)
  misc_feature (36): n=a or c
actctttagctgttctatctgtccatgaatgctatncctactgcagggagtgcagagaccgtggactcatc

SEQ ID NO: 31267 - DNA, 71 bp, chicken (Gallus Gallus)
  misc_feature (36): n=a or g
cattttcaaatctaatgtctgcaagatggccctcanagcttttcaaaagattcatgtcactactataagaa

SEQ ID NO: 31268 - DNA, 71 bp, chicken (Gallus Gallus)
  misc_feature (36): n=a or g
tatttcttaagaagaataatctcaagtctcattgcntacaaagaaaatcgtccttttaaaataacttttac

SEQ ID NO: 31269 - DNA, 71 bp, chicken (Gallus Gallus)
  misc_feature (36): n=c or t
gcatcacaaagctggtgatgctaagagacccaatanctttggcaaagttcataatattagtacatactgtc

SEQ ID NO: 31270 - DNA, 71 bp, chicken (Gallus Gallus)
  misc_feature (36): n=c or t
tcagcaagtttctggtcttaatcaacagcctttaangagaggagatgtattttaagtatcaccataactga

SEQ ID NO: 31271 - DNA, 71 bp, chicken (Gallus Gallus)
  misc_feature (36): n=c or t
tcttttagagcatgcaacaggcctccactttgaaanatgacctactccttctattacttttacagagtgat

SEQ ID NO: 31272 - DNA, 71 bp, chicken (Gallus Gallus)
  misc_feature (36): n=a or g
aaatagtccatttcagtatttctgaggagaacacgntcgtaaaagtggagcatcgaccacatcttgtccct

SEQ ID NO: 31273 - DNA, 71 bp, chicken (Gallus Gallus)
  misc_feature (36): n=a or c
aacaaagcaataattgcagaggaatagatttatttnccctgcctatctcatggccatcacaagcatcacga

SEQ ID NO: 31274 - DNA, 71 bp, chicken (Gallus Gallus)
  misc_feature (36): n=a or g
cataatcacagtggcatcaatgtacacagaggtgtnaaggcaacatatttctacagctataagtaggtagg

SEQ ID NO: 31275 - DNA, 71 bp, chicken (Gallus Gallus)
  misc_feature (36): n=a or c
gcgcttggcaagtctttccttaagtgttcatgatanagcatcaaagaatggaaaaaatgctcccaggagac

SEQ ID NO: 31276 - DNA, 71 bp, chicken (Gallus Gallus)
  misc_feature (36): n=g or t
tctactgttactttctccaagtaacttatgaggatnagagtgtcatccttactcagtggtgactggcaggt

SEQ ID NO: 31277 - DNA, 71 bp, chicken (Gallus Gallus)
  misc_feature (36): n=a or g
tgctttctagctgagtgtttcacctgatcccagccngtaaccgaggattcagagtgtgcaggaagtggggt

SEQ ID NO: 31278 - DNA, 71 bp, chicken (Gallus Gallus)
  misc_feature (36): n=a or c
gtacatctgagcatggctcactaatgaatccatggnttttggtcattccaaagtggcagtactaacgtaca

SEQ ID NO: 31279 - DNA, 71 bp, chicken (Gallus Gallus)
  misc_feature (36): n=a or g
cagtaaaaaatgtcttttacgtaaaatgctagcctnggtcatggtggttgaaaggagagagaaaggcaact

SEQ ID NO: 31280 - DNA, 71 bp, chicken (Gallus Gallus)
  misc_feature (36): n=c or t
gaaacacggaacatgactcatcttagctacaatttnccttactttgcaacagcatagctgggagcaaatga

SEQ ID NO: 31281 - DNA, 71 bp, chicken (Gallus Gallus)
  misc_feature (36): n=a or g
gtctactccgttgagtttagctatgatgagaacacngtctacagcataggcgaggatggcaaggtaagctc

SEQ ID NO: 31282 - DNA, 71 bp, chicken (Gallus Gallus)
  misc_feature (36): n=c or t
tatcacagtgagccagagtacaagccaacaacatcncagaagcataaggaatcataccttgagctggaagg

SEQ ID NO: 31283 - DNA, 71 bp, chicken (Gallus Gallus)
  misc_feature (36): n=c or t
gaagctagaacagtcaatagtctattcatgctttcnttcctcttctctatgtgagacaactctaagaaaac

SEQ ID NO: 31284 - DNA, 71 bp, chicken (Gallus Gallus)
  misc_feature (36): n=c or t
ttgagagaaaagcaaaggctcacaaaacaggcacgntgatgtctaataaattattcaggagtagaaacaga

SEQ ID NO: 31285 - DNA, 71 bp, chicken (Gallus Gallus)
  misc_feature (36): n=c or t
ggacaggacctggagccccgctggaccttggaaatncagaacatcagcaggttacctactgggaacatttt

SEQ ID NO: 31286 - DNA, 71 bp, chicken (Gallus Gallus)
  misc_feature (36): n=c or t
tctgttccagtacactcattattcaggtccagctantgcaaagtaattgctggggattatttaacctgtgc

SEQ ID NO: 31287 - DNA, 71 bp, chicken (Gallus Gallus)
  misc_feature (36): n=g or t
cttctggactcatagctcatccctcaaaatgaacanggaagagaaagtggccctgccctttgtagtagaaa

SEQ ID NO: 31288 - DNA, 71 bp, chicken (Gallus Gallus)
  misc_feature (36): n=c or t
actttagatgaggcactagtccccaggtcttgctcnttcctcatcagattaatcatgacatctcttcatca

SEQ ID NO: 31289 - DNA, 71 bp, chicken (Gallus Gallus)
  misc_feature (36): n=a or g
cacctgcctaactcaaaacactttgtatgtaaatancagaaataaatccaggtgaagaatatcttgattcc

SEQ ID NO: 31290 - DNA, 71 bp, chicken (Gallus Gallus)
  misc_feature (36): n=a or c
gcaaattgacttcctttgacttgttagactagttanattacagctggtggccatcggagacctttgcatca

SEQ ID NO: 31291 - DNA, 71 bp, chicken (Gallus Gallus)
  misc_feature (36): n=a or g
ttcataagaggccatatgctgcagagcctgtgcgtngtaggctgagtgcctggttttgcacagagtatggt

SEQ ID NO: 31292 - DNA, 71 bp, chicken (Gallus Gallus)
  misc_feature (36): n=g or t
ctgagaaagtcagacctgattatctatgatgcagangcaggagctgtaaactcttgctgcagccagatttt

SEQ ID NO: 31293 - DNA, 71 bp, chicken (Gallus Gallus)
  misc_feature (36): n=c or t
agtcccatttgtgcccttcttggtctctgctgtttntctgagctgaactcatccatcaagccaagctgaat

SEQ ID NO: 31294 - DNA, 71 bp, chicken (Gallus Gallus)
  misc_feature (36): n=a or c
tgcttatatcctcaagccccaaagaagaacagttangtctaaagttcaaagactgggaatttctctttcct

SEQ ID NO: 31295 - DNA, 71 bp, chicken (Gallus Gallus)
  misc_feature (36): n=a or g
catatcattactaatttttaagaatgattttaaggntgattaaattaaattacacagcactgtgataacac

SEQ ID NO: 31296 - DNA, 71 bp, chicken (Gallus Gallus)
  misc_feature (36): n=a or g
tttataagtcatatggagttcaggtaatagtttaantggtttacttatgacccttgtgctcccttggcctg

SEQ ID NO: 31297 - DNA, 71 bp, chicken (Gallus Gallus)
  misc_feature (36): n=a or c
gatcttataaaatgtctgcagtgttgtagaaacaancgcttcctctttgtagtagaagaaggggaggtttt

SEQ ID NO: 31298 - DNA, 71 bp, chicken (Gallus Gallus)
  misc_feature (36): n=c or t
tgaaggagagtgtacagaccctgatcctagagaggngacttcagaagacataaggtatgttgcataggggt

SEQ ID NO: 31299 - DNA, 71 bp, chicken (Gallus Gallus)
  misc_feature (36): n=c or t
tgttatctatgaggctcgactacaatctctggagangtgctacaggtactgtgattatatatattaagaat

SEQ ID NO: 31300 - DNA, 71 bp, chicken (Gallus Gallus)
  misc_feature (36): n=c or t
agcatagtttggtgtaaggaaggccacttttaatanagtcaagcaaatagaatggcccatatccacactgt

SEQ ID NO: 31301 - DNA, 71 bp, chicken (Gallus Gallus)
  misc_feature (36): n=a or g
ataatctctcaaaatcaacaggccattacggtctgntgtaactcaatgagtactttgagacagaaatcctg

SEQ ID NO: 31302 - DNA, 71 bp, chicken (Gallus Gallus)
  misc_feature (36): n=g or t
cagtaagaccttccttgcagttctttttatctgtgngaataatcaagctgtcttaatctatagatgctctt

SEQ ID NO: 31303 - DNA, 71 bp, chicken (Gallus Gallus)
  misc_feature (36): n=a or c
cagcccttgctctgtgactcactgatcatttctggnagaatacagtattgccctgctccttttattgtagt

SEQ ID NO: 31304 - DNA, 71 bp, chicken (Gallus Gallus)
  misc_feature (36): n=a or g
gctgcaagcatttaggcaaggcttagatgaaaactnaggccacttttctcctgcttattgcccaacaaaat

SEQ ID NO: 31305 - DNA, 71 bp, chicken (Gallus Gallus)
  misc_feature (36): n=a or g
gggcccggacagagttgaaccagagcaatccgtccntatggagcattccctagagaaaaacgcttatctga

SEQ ID NO: 31306 - DNA, 71 bp, chicken (Gallus Gallus)
  misc_feature (36): n=c or t
agtgcaatgcattgaacccacctgtgatatttcagnggtggggtttgacacaggaactcagtcacaaggac

SEQ ID NO: 31307 - DNA, 71 bp, chicken (Gallus Gallus)
  misc_feature (36): n=c or t
tgcagacatggtagggcttccagctgtttctgatantgctgttctttttaaagcagccaagtacatcgcag

SEQ ID NO: 31308 - DNA, 71 bp, chicken (Gallus Gallus)
  misc_feature (36): n=a or g
cagtgggtcggtgccacagattttgtaggctgtgangtggcagagaaattgggagttctccttatctctgc

SEQ ID NO: 31309 - DNA, 71 bp, chicken (Gallus Gallus)
  misc_feature (36): n=a or g
aggtgtccatatacaatcttctcagataaggtcagnggacggtcaagcctggggagacaaaggaattttgc

SEQ ID NO: 31310 - DNA, 71 bp, chicken (Gallus Gallus)
  misc_feature (36): n=c or t
tatgagcaattagcaccaatatctcccctgataccnttgtgatgctttgatgggtacgtgtgacactgagg

SEQ ID NO: 31311 - DNA, 71 bp, chicken (Gallus Gallus)
  misc_feature (36): n=a or g
gtactcacacgtggctgtccgagcagcctgatgctncaggtttggctgaaatggcccattctggatgtttg

SEQ ID NO: 31312 - DNA, 71 bp, chicken (Gallus Gallus)
  misc_feature (36): n=a or g
aggggtattctgctccatccccagggaaggaggacnggctttgactcacctgcagtctggccaggatgctg

SEQ ID NO: 31313 - DNA, 71 bp, chicken (Gallus Gallus)
  misc_feature (36): n=c or t
agatcaaggacataacttctgcatctgttcattttngaatttgtctgtgaagaggcacaactttttgttct

SEQ ID NO: 31314 - DNA, 71 bp, chicken (Gallus Gallus)
  misc_feature (36): n=c or t
ttggctgtgagaagtactttcatttgtctaccccangagggcagcataattcctttgagacttatgttctg

SEQ ID NO: 31315 - DNA, 71 bp, chicken (Gallus Gallus)
  misc_feature (36): n=g or t
gaaactttctcaacttgtgattatcagtagagccantgcattcatttgctgtcttatcatgtttaaagaga

SEQ ID NO: 31316 - DNA, 71 bp, chicken (Gallus Gallus)
  misc_feature (36): n=a or c
attatctctgagactgcacatgatcacattggcatncacagccctgaatcctgaattatatagtgagaccc

SEQ ID NO: 31317 - DNA, 71 bp, chicken (Gallus Gallus)
  misc_feature (36): n=c or t
aatgaatgacatgccaacccagattaagaagatgcnttccatctctgccatcttcttcacgagttaggaaa

SEQ ID NO: 31318 - DNA, 71 bp, chicken (Gallus Gallus)
  misc_feature (36): n=c or t
ctatcaggtctgatcactgattctgattttgatatnttaacctattccagatggttttccagtttctcctc

SEQ ID NO: 31319 - DNA, 71 bp, chicken (Gallus Gallus)
  misc_feature (36): n=a or g
caggaccgctgcccggccatgggaccacatggcacnggaggtaggcagcataggagaaaagtgtggcaggg

SEQ ID NO: 31320 - DNA, 71 bp, chicken (Gallus Gallus)
  misc_feature (36): n=c or t
ttacacaggagaagaggacaagtgcactctgtgatnggtaccatattgcaatgaatattgtaggcttgaga

SEQ ID NO: 31321 - DNA, 71 bp, chicken (Gallus Gallus)
  misc_feature (36): n=g or t
gctcagttaaacattaagaatagagtttgcgtaacncagaatacgtaatttgtgtttcacttaaccactac

SEQ ID NO: 31322 - DNA, 71 bp, chicken (Gallus Gallus)
  misc_feature (36): n=c or t
aattatgtgcgtgtgtatgtgtatccccaaaactgntactttttctcaagtccttcaacactttatcccaa

SEQ ID NO: 31323 - DNA, 71 bp, chicken (Gallus Gallus)
  misc_feature (36): n=a or g
ggctgaggcttcatcctcgcacctcttgcatccctngcagtcatgagaagttgctgtctacacccaggatc

SEQ ID NO: 31324 - DNA, 71 bp, chicken (Gallus Gallus)
  misc_feature (36): n=c or t
gctttcacacttcctcccagttcctttctaaacttnagcctcttcatctcctttttgattcattttatgtt

SEQ ID NO: 31325 - DNA, 71 bp, chicken (Gallus Gallus)
  misc_feature (36): n=c or t
aaacctctgctttccaataacaggttggggttgtgnggaccttaaatgctcttaaaatcacccctgcgtca

SEQ ID NO: 31326 - DNA, 71 bp, chicken (Gallus Gallus)
  misc_feature (36): n=c or t
cagagaacaataacaacttttgtttccccagatgangaagtgagcttgtgaaatatcaaaggcagcatggg

SEQ ID NO: 31327 - DNA, 71 bp, chicken (Gallus Gallus)
  misc_feature (36): n=a or g
ctacccagccttccctgacaccaattaatctgaagntggaaaggttctagggaagaaaaagcacacagctg

SEQ ID NO: 31328 - DNA, 71 bp, chicken (Gallus Gallus)
  misc_feature (36): n=c or t
aaggatgccatgatgttatcggtgactgcaagctanaaggatgttagcaggaagtttctgtcagggtcaaa

SEQ ID NO: 31329 - DNA, 71 bp, chicken (Gallus Gallus)
  misc_feature (36): n=a or g
gcacagaagaggatttaggcattgaagaggataggngaagagcacgatggagagccattacctgctttgtt

SEQ ID NO: 31330 - DNA, 71 bp, chicken (Gallus Gallus)
  misc_feature (36): n=c or t
aaaacaactcttcctaaagctaaatggtatctactnctcttcagctcgtcccttccttgcctgcggccttg

SEQ ID NO: 31331 - DNA, 71 bp, chicken (Gallus Gallus)
  misc_feature (36): n=c or t
tccattaatgcagccaaccctaacactgatgaccanggttttatattcttcctcaggcatagtaaccagta

SEQ ID NO: 31332 - DNA, 71 bp, chicken (Gallus Gallus)
  misc_feature (36): n=c or t
aggaaatgcaccttgagcaaactgtgagctggaaantgagtccatggcccttcagtctccacctctgccct

SEQ ID NO: 31333 - DNA, 71 bp, chicken (Gallus Gallus)
  misc_feature (36): n=c or t
cttattttttgcattcctgctactattatttttggncagctgatatcttatcagcttgttaaaatagaagt

SEQ ID NO: 31334 - DNA, 71 bp, chicken (Gallus Gallus)
  misc_feature (36): n=a or g
agtcattgttgctcgtgtgtcagcagatggactcgnagaaggaaaaatcccccaggggagggatgagggag

SEQ ID NO: 31335 - DNA, 71 bp, chicken (Gallus Gallus)
  misc_feature (36): n=a or g
ttttatgtgctgtggcactcttgccagctaggcacntctagaagccattaatataatgtttggaggctgag

SEQ ID NO: 31336 - DNA, 71 bp, chicken (Gallus Gallus)
  misc_feature (36): n=c or t
gaaagcttggctttttctttctgttttcagatacantgatatttccaactactgctgtgacctcttggctg

SEQ ID NO: 31337 - DNA, 71 bp, chicken (Gallus Gallus)
  misc_feature (36): n=a or g
ggtcatgcaggaggaaaaacattagaaagacaaacnaagtattgaaattgattacctgtgaattctcattt

SEQ ID NO: 31338 - DNA, 71 bp, chicken (Gallus Gallus)
  misc_feature (36): n=c or t
agtgtcttttggccaaagggatttgtgactcaatgngtttagacaacatgatcccaactggactgggctcc

SEQ ID NO: 31339 - DNA, 71 bp, chicken (Gallus Gallus)
  misc_feature (36): n=c or t
gtgatgtatgggaggggtggtggtgcactttttttnctgcaaaaaggctcaaaaataggtttggcagctga

SEQ ID NO: 31340 - DNA, 71 bp, chicken (Gallus Gallus)
  misc_feature (36): n=a or c
actagcttctccctgctattgtgcagcagacactgntgcatgtcccatcttgacagcagagataagctatc

SEQ ID NO: 31341 - DNA, 71 bp, chicken (Gallus Gallus)
  misc_feature (36): n=a or c
ccctaggaagtgaggcacggctcttactggatcccntatatatgtgttggccttgggaatgccgggtgtgg

SEQ ID NO: 31342 - DNA, 71 bp, chicken (Gallus Gallus)
  misc_feature (36): n=g or t
tgttggtttattcctaattatcttttgcattgtatncatattatcctgaacactatctccatattctcatt

SEQ ID NO: 31343 - DNA, 71 bp, chicken (Gallus Gallus)
  misc_feature (36): n=a or g
agacaagtacagctgacaaaagtgaggttgtaaatngcacttctgatgtctgataggagatctgtagaatc

SEQ ID NO: 31344 - DNA, 71 bp, chicken (Gallus Gallus)
  misc_feature (36): n=a or g
atgtgccagtaatgtatgcactggtgtcaggtcctnggattgattcctgatccattacaaaataatacagc

SEQ ID NO: 31345 - DNA, 71 bp, chicken (Gallus Gallus)
  misc_feature (36): n=a or c
aagccttcatatccatgtcttggtccctaccacaanagagcaagatcagaagacctgttatcagcagcgac

SEQ ID NO: 31346 - DNA, 71 bp, chicken (Gallus Gallus)
  misc_feature (36): n=g or t
tgctgccataaataacaaatcacagaagtccaaatngttcttttgctgtgtgtgtagtatacatacataaa

SEQ ID NO: 31347 - DNA, 71 bp, chicken (Gallus Gallus)
  misc_feature (36): n=c or t
tgaggttgaatctaggttttctgtcctgcaactagngtgtttttgccgcagtgttgttcagtattttactc

SEQ ID NO: 31348 - DNA, 71 bp, chicken (Gallus Gallus)
  misc_feature (36): n=a or g
gatggtcacgccatatgcaaatggtaagagagactntttgtgctagtgatgagctgaaaggttagaaggaa

SEQ ID NO: 31349 - DNA, 71 bp, chicken (Gallus Gallus)
  misc_feature (36): n=c or t
aagcgtgctgcagtggtggtgcagtgatctagcttngctctcagacaaatctggcaacatttgtattgaat

SEQ ID NO: 31350 - DNA, 71 bp, chicken (Gallus Gallus)
  misc_feature (36): n=g or t
tagtagtatgtgcacatccctctaaaaattgatctncctagtcacgtgttcctttataagatggtattctt

SEQ ID NO: 31351 - DNA, 71 bp, chicken (Gallus Gallus)
  misc_feature (36): n=a or c
atgctccatgcatagcacagctctgtgacccacagntcaaacattcccctggtgctgccatctcctcatcc

SEQ ID NO: 31352 - DNA, 71 bp, chicken (Gallus Gallus)
  misc_feature (36): n=a or c
agactgtagctggtatcagaataatatatgcaattntcttctctactaagtctgatgttatttaaatatct

SEQ ID NO: 31353 - DNA, 71 bp, chicken (Gallus Gallus)
  misc_feature (36): n=c or t
tatcttttagctgtcaggttagcaatggtctccatncacctgtcatggactacaagcacgctgaggcatac

SEQ ID NO: 31354 - DNA, 71 bp, chicken (Gallus Gallus)
  misc_feature (36): n=c or t
ccctcagagacacaggatggcagggactattcacantgacaaacagaagcctggtaagacagccagtggta

SEQ ID NO: 31355 - DNA, 71 bp, chicken (Gallus Gallus)
  misc_feature (36): n=a or g
gcagccatcgagttctctctcagccctcagtaaganagaagtaagccaagctaggttcctttcttatccag

SEQ ID NO: 31356 - DNA, 71 bp, chicken (Gallus Gallus)
  misc_feature (36): n=a or g
gaatgtttaagtatgccagatatcatcaaaatagcnttataggcatgtgttaaaatgcacaagcttaagca

SEQ ID NO: 31357 - DNA, 71 bp, chicken (Gallus Gallus)
  misc_feature (36): n=a or g
atggtttggaaggaccagtatgtttattgatagaantagcccaagcagtggaactaattcaaacagagata

SEQ ID NO: 31358 - DNA, 71 bp, chicken (Gallus Gallus)
  misc_feature (36): n=c or t
agatcatacagtgcaaccagactagggaaatcttcntcctctgccttcagaccattcagctcctcctatct

SEQ ID NO: 31359 - DNA, 71 bp, chicken (Gallus Gallus)
  misc_feature (36): n=c or t
agcttgctattgaacaaaatacaagattatgggagntggaagggaaagggaactagggattatcatagaaa

SEQ ID NO: 31360 - DNA, 71 bp, chicken (Gallus Gallus)
  misc_feature (36): n=c or t
cttgaacagttggctgttgaaatccactgcaaacanacctttggtctgggtacgactccactgctggaagc

SEQ ID NO: 31361 - DNA, 71 bp, chicken (Gallus Gallus)
  misc_feature (36): n=c or t
tgaagcaagagaaggcattgggtcctaattttcctntcacagaagctttacaggatgacgaagaagttatt

SEQ ID NO: 31362 - DNA, 71 bp, chicken (Gallus Gallus)
  misc_feature (36): n=a or g
tgcatcatactagccatgccacttcctacatcttcntgatacaattaggacatgttttcaaaaacaaatgt

SEQ ID NO: 31363 - DNA, 71 bp, chicken (Gallus Gallus)
  misc_feature (36): n=a or g
agaactggttaaggagcccctctagtgaagacaggngacagaagcacgtagaaggtaacaaggacatgttg

SEQ ID NO: 31364 - DNA, 71 bp, chicken (Gallus Gallus)
  misc_feature (36): n=c or t
ctgcaggagtgctctgaaagcgatttcctataagangaaatctcttgcatgaaaaggtgaagagacagttt

SEQ ID NO: 31365 - DNA, 71 bp, chicken (Gallus Gallus)
  misc_feature (36): n=c or t
tacaggtgttgtgcaggtctgttttcttaattatcnagggatagtggagtcaagaactatgcaaaatggtg

SEQ ID NO: 31366 - DNA, 71 bp, chicken (Gallus Gallus)
  misc_feature (36): n=a or g
tatcacaagatcaaaatgtctggatatattgttttntctactatcttcttacagggaggacatgtatatta

SEQ ID NO: 31367 - DNA, 71 bp, chicken (Gallus Gallus)
  misc_feature (36): n=a or g
gtaggtgaaaagctggagtaaagctgagtttggagngttcattgtgaaaacaggtctgaaaacaagtatca

SEQ ID NO: 31368 - DNA, 71 bp, chicken (Gallus Gallus)
  misc_feature (36): n=c or t
ccttttatagcatggttagtaataatcaagctggcntgaggttgctgtgttactgacttctgatctgtaca

SEQ ID NO: 31369 - DNA, 71 bp, chicken (Gallus Gallus)
  misc_feature (36): n=a or g
tttgatttgaaaccagcaggagcggagagtcctctncagcttctggcactaggtgtctctgattaaacaca

SEQ ID NO: 31370 - DNA, 71 bp, chicken (Gallus Gallus)
  misc_feature (36): n=c or t
aaagattattaggtccaattgcctgagttttatcantgattttttccttccttacttgagtacatatctcc

SEQ ID NO: 31371 - DNA, 71 bp, chicken (Gallus Gallus)
  misc_feature (36): n=a or g
gtggtagaaagacacagcccactgccagcttgaaanctggtttggttggagtggaaattctccctgctgct

SEQ ID NO: 31372 - DNA, 71 bp, chicken (Gallus Gallus)
  misc_feature (36): n=c or t
gcagctatttctttgaatgaaatgcactgctaaatnatcttagtgagctttaagatagtattttagtcaaa

SEQ ID NO: 31373 - DNA, 71 bp, chicken (Gallus Gallus)
  misc_feature (36): n=a or g
accaggaatgcaaaattaatgaggctagaaagaganggagaataagcaggaacgatcataaccctgtcaat

SEQ ID NO: 31374 - DNA, 71 bp, chicken (Gallus Gallus)
  misc_feature (36): n=a or g
ggatcgtagaatcacaggtaatttggatcagatagnatcctttgccacaaggtctcattactggctcttgt

SEQ ID NO: 31375 - DNA, 71 bp, chicken (Gallus Gallus)
  misc_feature (36): n=c or t
aggatttgtgtcaaatattaatgctgtaggacatanagtaatgcagattgctatctgcttactttggggtc

SEQ ID NO: 31376 - DNA, 71 bp, chicken (Gallus Gallus)
  misc_feature (36): n=c or t
cagttattcttcctcccattactgaccgtgttaaanctacagcatcagctggtcactaagtatcctctgta

SEQ ID NO: 31377 - DNA, 71 bp, chicken (Gallus Gallus)
  misc_feature (36): n=c or t
tgatttcctctctactgtcagctactgaggggagtncatggcacccctgcacatggctgtcccacctcaga

SEQ ID NO: 31378 - DNA, 71 bp, chicken (Gallus Gallus)
  misc_feature (36): n=a or g
aaggtgtgcttacaaatgtcctccactcggtcaganagatcctgttcatgttccacttctctcatcacaac

SEQ ID NO: 31379 - DNA, 71 bp, chicken (Gallus Gallus)
  misc_feature (36): n=a or g
cagctcgccagtgccagacacagtgctggaaacctnaggttgctttggccattaattgcccggatgattaa

SEQ ID NO: 31380 - DNA, 71 bp, chicken (Gallus Gallus)
  misc_feature (36): n=g or t
atttcctgtctgtttgctaaagcattagaacacttnggagagaggtgttggatgaaatgctgcactccctc

SEQ ID NO: 31381 - DNA, 71 bp, chicken (Gallus Gallus)
  misc_feature (36): n=a or g
gtgaaacactcaagtattgcagtgatgagagttgcntgagcatttaagacaaagaaatggatggtctttat

SEQ ID NO: 31382 - DNA, 71 bp, chicken (Gallus Gallus)
  misc_feature (36): n=a or g
tatctttaaaaaaccactcaggacaccacaaacacngtaatttaacctgttcctcaagcagagcactgagc

SEQ ID NO: 31383 - DNA, 71 bp, chicken (Gallus Gallus)
  misc_feature (36): n=a or g
agaacattatcagaagataaccaagtacaacagagnaccaagatggggatcaacctcacccagctagtgat

SEQ ID NO: 31384 - DNA, 71 bp, chicken (Gallus Gallus)
  misc_feature (36): n=g or t
tggaggacatatcagctaataaactgaggagcacanacagaaaactcaaggttgctttggaaatgccagaa

SEQ ID NO: 31385 - DNA, 71 bp, chicken (Gallus Gallus)
  misc_feature (36): n=c or t
caggccacttgtccgtgttgctgcacagttgccagntgagcattggtagtgtaaaagtcaagttaaatgaa

SEQ ID NO: 31386 - DNA, 71 bp, chicken (Gallus Gallus)
  misc_feature (36): n=c or t
agtaattaaactgcagctcttaaaactgctagtctncagtttattaatgagaatcagtgactaaaaggcga

SEQ ID NO: 31387 - DNA, 71 bp, chicken (Gallus Gallus)
  misc_feature (36): n=c or t
gccttgatcatttcaaatgttactgtaccaacacanggaattcaaacagtacagattcttgtattttagtc

SEQ ID NO: 31388 - DNA, 71 bp, chicken (Gallus Gallus)
  misc_feature (36): n=a or c
atagagggtcttcagtgaagatttgcaaaccactcntttacagttcctacatacaaatgagaaacttagaa

SEQ ID NO: 31389 - DNA, 71 bp, chicken (Gallus Gallus)
  misc_feature (36): n=c or t
cactgacttaaggaagataagcccactgaaatgaanggttttactgttgttattgtgattactgatatagt

SEQ ID NO: 31390 - DNA, 71 bp, chicken (Gallus Gallus)
  misc_feature (36): n=g or t
cggtaggatgtgatgttaaaggttttcccaacaatntttttatgtccttagacttctgcatccactctgac

SEQ ID NO: 31391 - DNA, 71 bp, chicken (Gallus Gallus)
  misc_feature (36): n=a or c
ccactctgaaggaggtggtgaaagtgtaaagccaanatgtgtgctttttactctggctcacatcattgtgc

SEQ ID NO: 31392 - DNA, 71 bp, chicken (Gallus Gallus)
  misc_feature (36): n=a or g
cagaagccaataattagtataacgataaggtcatcngggaaccacctaaagggaggcacacaacaggctct

SEQ ID NO: 31393 - DNA, 71 bp, chicken (Gallus Gallus)
  misc_feature (36): n=c or t
tctcccttcgagtagggaacgggctgatatgtgcanactcacaagaccctacaaagatcctcacccagaca

SEQ ID NO: 31394 - DNA, 71 bp, chicken (Gallus Gallus)
  misc_feature (36): n=c or t
tttaaatggtgccagtattaaccatcttcattactngctccatgctgtgcttgtgttgcaatcaggcttac

SEQ ID NO: 31395 - DNA, 71 bp, chicken (Gallus Gallus)
  misc_feature (36): n=a or g
aggaaagagaggagcacacagacctttcacagtctnttgcccagagcacctacagtattctccaagtggcc

SEQ ID NO: 31396 - DNA, 71 bp, chicken (Gallus Gallus)
  misc_feature (36): n=a or g
ataggacagaccctatgcactgagctctgttacatngctcttgacaggagtcatccagttggagttacttt

SEQ ID NO: 31397 - DNA, 71 bp, chicken (Gallus Gallus)
  misc_feature (36): n=c or t
agtgataattcagctgtaaaactagagcaggtatangtctgcttgctggggttgttctttggactgactgg

SEQ ID NO: 31398 - DNA, 71 bp, chicken (Gallus Gallus)
  misc_feature (36): n=a or g
ttcttcacccaaggtggcaacttgatgtgtcaaccnaggggagcggtagctggaggattgattcaggacct

SEQ ID NO: 31399 - DNA, 71 bp, chicken (Gallus Gallus)
  misc_feature (36): n=a or g
aagaggtgcttcaagacctggacttgtaaccaagantggtctagtcatttttggtaatgacgggaagatgg

SEQ ID NO: 31400 - DNA, 71 bp, chicken (Gallus Gallus)
  misc_feature (36): n=c or t
tgtgctgtccaggatgcagtcgtcggaatccttcgnttccatttgatctcaggttacggagcacggaacgt

SEQ ID NO: 31401 - DNA, 71 bp, chicken (Gallus Gallus)
  misc_feature (36): n=g or t
ttggtgttatctggtgatgggcgtgcacaggaaatnaataacctgaacatcaacctcctgtgcatgaaaca

SEQ ID NO: 31402 - DNA, 71 bp, chicken (Gallus Gallus)
  misc_feature (36): n=a or g
gggacagatgtgaaaatagtgtggaacttttagacntatgagtacttctgaagatggcttgaatatgctat

SEQ ID NO: 31403 - DNA, 71 bp, chicken (Gallus Gallus)
  misc_feature (36): n=a or g
agccttaatcattttggtttggattggtaaaaaagnatggatctaggaggagatttgagaccgttagactg

SEQ ID NO: 31404 - DNA, 71 bp, chicken (Gallus Gallus)
  misc_feature (36): n=a or g
aagtacagcatgtcacatgaatatattgctgattangcctccatggctattgtgttataaaagcgtacagc

SEQ ID NO: 31405 - DNA, 71 bp, chicken (Gallus Gallus)
  misc_feature (36): n=c or t
atcctcctctgctctgcagagtttcctaggaagtgnctgctcctgtctctttatcacagcttatctcctat

SEQ ID NO: 31406 - DNA, 71 bp, chicken (Gallus Gallus)
  misc_feature (36): n=c or t
cacagccagtggaaatttccttcgctcttattttgnaacagtattctctttcagtagtttcctctctgcca

SEQ ID NO: 31407 - DNA, 71 bp, chicken (Gallus Gallus)
  misc_feature (36): n=c or t
agggaaatgaagtgaaagagcagatgtatcatcttnctgataggcagtcagaggggaggagttggaaggca

SEQ ID NO: 31408 - DNA, 71 bp, chicken (Gallus Gallus)
  misc_feature (36): n=a or g
ttcaatagattttttcctgttagcaaattaaaactngtgctctagaggccaacaaaaagcagtctcgtagt

SEQ ID NO: 31409 - DNA, 71 bp, chicken (Gallus Gallus)
  misc_feature (36): n=c or t
agaagtctaaaatttctgcactgtagaggatgccanttcaatttgttcaacaattcaaaagatgttgggga

SEQ ID NO: 31410 - DNA, 71 bp, chicken (Gallus Gallus)
  misc_feature (36): n=a or g
tgcatttggtaggtgcacttcaggtttgcttaccantgagaaatgagcaatatcaaagatgttcttgaaca

SEQ ID NO: 31411 - DNA, 71 bp, chicken (Gallus Gallus)
  misc_feature (36): n=a or c
gcgagatcttcttattaatgagcatagggtaagtanaattattgggattacaataattttatgactgaaga

SEQ ID NO: 31412 - DNA, 71 bp, chicken (Gallus Gallus)
  misc_feature (36): n=a or g
aagcaaaggactgtgtgaagcctagcacgtaactgngcaaagctcggagaaaacttgtgtgatctatacac

SEQ ID NO: 31413 - DNA, 71 bp, chicken (Gallus Gallus)
  misc_feature (36): n=a or g
ccatagcaaatgctcaatttaaatgcaaagcaactncttaggaagtgcagcattgctaagtcacagctgga

SEQ ID NO: 31414 - DNA, 71 bp, chicken (Gallus Gallus)
  misc_feature (36): n=c or t
gcctacatcagctcttgactgtgtgctttccacacngctactgctatggcttgtctgggaagaccttgctg

SEQ ID NO: 31415 - DNA, 71 bp, chicken (Gallus Gallus)
  misc_feature (36): n=c or t
tgctcccaacctgagatctcatcctcgttgtcctcngggaagtgctggctgctgcgctgctcccaggcagg

SEQ ID NO: 31416 - DNA, 71 bp, chicken (Gallus Gallus)
  misc_feature (36): n=a or g
tgttcatgttcagccgactgtgcattatgacccacngatctttgaattaggaagtccttaaatctagtcac

SEQ ID NO: 31417 - DNA, 71 bp, chicken (Gallus Gallus)
  misc_feature (36): n=c or t
cttcaagaaaaggtacacactggcttaattacatgntatgctcatcaataaaaggtcaaaacaattgaatc

SEQ ID NO: 31418 - DNA, 71 bp, chicken (Gallus Gallus)
  misc_feature (36): n=a or g
gaaatgctgaaatcaccaacagagtcctggttttcnagattcaggtgacaaaacaatatttagatagcgct

SEQ ID NO: 31419 - DNA, 71 bp, chicken (Gallus Gallus)
  misc_feature (36): n=c or t
actaaaggacaccccctgccttagtcgcatgcatcnatgttgaatcttcctttgggatttgttcaagagca

SEQ ID NO: 31420 - DNA, 71 bp, chicken (Gallus Gallus)
  misc_feature (36): n=g or t
cccaaacactagcactgccatttccaccctagctcnttcaaagccaaattaggtaaaattctgtgggaaat

SEQ ID NO: 31421 - DNA, 71 bp, chicken (Gallus Gallus)
  misc_feature (36): n=a or g
gtggggtcagctcctgggagcctctctgtctgccangggcagaacacagaagggaaatcttcaaaaccata

SEQ ID NO: 31422 - DNA, 71 bp, chicken (Gallus Gallus)
  misc_feature (36): n=a or g
cacttttgggcttctgggtcttgtggaaagatgtgngggattttttgtggctttggatgctgaatcatgag

SEQ ID NO: 31423 - DNA, 71 bp, chicken (Gallus Gallus)
  misc_feature (36): n=c or t
aaacattccaagtatttccctatgtttttcctgagntgactctgaggtgtttttttctcacgagaataatg

SEQ ID NO: 31424 - DNA, 71 bp, chicken (Gallus Gallus)
  misc_feature (36): n=a or c
accactgctatcaaaattaactaaagaaaggttgtntttgaaacctccttgttcatcctgagtgacaagca

SEQ ID NO: 31425 - DNA, 71 bp, chicken (Gallus Gallus)
  misc_feature (36): n=a or g
tgttttcttcctttagcctttaatcttgatagtatnttgtttaaaatctataataattcctggacttcttc

SEQ ID NO: 31426 - DNA, 71 bp, chicken (Gallus Gallus)
  misc_feature (36): n=c or t
cccatttccattctgctttcatagctcccatataangtgcaataataccatcttgtaaggatgttatgatt

SEQ ID NO: 31427 - DNA, 71 bp, chicken (Gallus Gallus)
  misc_feature (36): n=c or t
gaatctgtatcacctttttgtacacaggaacacagntcctagaaaccttttagagatatcagataagattt

SEQ ID NO: 31428 - DNA, 71 bp, chicken (Gallus Gallus)
  misc_feature (36): n=a or g
attcatgtctgctgggtatttttcacgctagttttnattaaggtgttagcaatttagtcattgaaggcaca

SEQ ID NO: 31429 - DNA, 71 bp, chicken (Gallus Gallus)
  misc_feature (36): n=g or t
acagttaagagaagaaggggttaatttttcatgggngcattcttctactcttgtcagaaattatccagttg

SEQ ID NO: 31430 - DNA, 71 bp, chicken (Gallus Gallus)
  misc_feature (36): n=a or g
ttcataactaaaataaaataatttagaattaggttngtttcacttttgtttaactaaagtttaatgcaatt

SEQ ID NO: 31431 - DNA, 71 bp, chicken (Gallus Gallus)
  misc_feature (36): n=c or t
agaacacaaacatttaaataaagattgagaacaggngctgtttgcaagttcccatatttcttcttagtctt

SEQ ID NO: 31432 - DNA, 71 bp, chicken (Gallus Gallus)
  misc_feature (36): n=c or t
tattaattctacttatacaatttaatttcagtctanacagttaaatcataaagctcttgggactgtaaaga

SEQ ID NO: 31433 - DNA, 71 bp, chicken (Gallus Gallus)
  misc_feature (36): n=a or g
atagctgtgagaatacaaaagttatctcaattaagnaactattttagtttttctctgattacgtgaaatta

SEQ ID NO: 31434 - DNA, 71 bp, chicken (Gallus Gallus)
  misc_feature (36): n=c or t
tgagaaaggcatcataggatgaaggatgcgatctcnagtatgagataccttttcaatattgtcaagtctga

SEQ ID NO: 31435 - DNA, 71 bp, chicken (Gallus Gallus)
  misc_feature (36): n=a or g
tgagaattactacaattaccctgctgttaagagttngatagcagaaaaggcctgttataattgataaatct

SEQ ID NO: 31436 - DNA, 71 bp, chicken (Gallus Gallus)
  misc_feature (36): n=a or g
gttttcaactgagagccactctgaagtccatattgnaggttgcttttctttagtccttttgctcctgcctt

SEQ ID NO: 31437 - DNA, 71 bp, chicken (Gallus Gallus)
  misc_feature (36): n=a or g
atatttgctattgtacagaaacacgctattagcaantgataagctgggatgggcttcacaggtgtgtaaat

SEQ ID NO: 31438 - DNA, 71 bp, chicken (Gallus Gallus)
  misc_feature (36): n=a or g
taaaaacaattcttggttagtatttttaaaataatngtagtggaaattaagtccctcgttggtttgtgcaa

SEQ ID NO: 31439 - DNA, 71 bp, chicken (Gallus Gallus)
  misc_feature (36): n=c or t
atttctgtaccttcagggtactgtatgatggatttnttttatttaacagaatagctaggatttttattagt

SEQ ID NO: 31440 - DNA, 71 bp, chicken (Gallus Gallus)
  misc_feature (36): n=c or t
gcagaattatatcacagttctgcattatatcatagnttctgcatttgccacatactctgtttaacataggt

SEQ ID NO: 31441 - DNA, 71 bp, chicken (Gallus Gallus)
  misc_feature (36): n=c or t
agcaaagaaatcacagctttgacatgcctgctctcntatgtcacagttttattcattttctagctgtccat

SEQ ID NO: 31442 - DNA, 71 bp, chicken (Gallus Gallus)
  misc_feature (36): n=c or t
ctttacagatattattcacagcaattcaaaaaccancaagtgattgtgaagcccacatctcattttaaaaa

SEQ ID NO: 31443 - DNA, 71 bp, chicken (Gallus Gallus)
  misc_feature (36): n=a or g
atgaacctaatggaaaggaaaatgtgagaatcaggncaaaacctttccagataagctccataaaggtcaag

SEQ ID NO: 31444 - DNA, 71 bp, chicken (Gallus Gallus)
  misc_feature (36): n=a or c
ctgtgtttattaaaagtagctaaaagatctgaaaanccttcctaccatgttaagatcaatgcaccaacgtg

SEQ ID NO: 31445 - DNA, 71 bp, chicken (Gallus Gallus)
  misc_feature (36): n=a or g
acaaaacttctattctggtccaaggagttgacaatntcttctttggctcccattacacatgctgagctttc

SEQ ID NO: 31446 - DNA, 71 bp, chicken (Gallus Gallus)
  misc_feature (36): n=c or t
aagccaaggcagctttcagacagcgacaaggcattngttgctaccacggctttccccatgctctgtaatca

SEQ ID NO: 31447 - DNA, 71 bp, chicken (Gallus Gallus)
  misc_feature (36): n=c or t
taaatatctccctctagtcccttaccaacaaccatngctttttctgaactcctgtaatggatagaatacca

SEQ ID NO: 31448 - DNA, 71 bp, chicken (Gallus Gallus)
  misc_feature (36): n=a or g
acaggcacagacaaaacagggattttccaccatgcngagaagtgactggaaatgctggaaatccgtttgtt

SEQ ID NO: 31449 - DNA, 71 bp, chicken (Gallus Gallus)
  misc_feature (36): n=a or g
aagtaagttttcagtataaaagcgtaagttaaaaanaggacagtcttttctgacagtgttagcatcataca

SEQ ID NO: 31450 - DNA, 71 bp, chicken (Gallus Gallus)
  misc_feature (36): n=g or t
acaattcaggcagaaaaatgtcctcgaaaggaaacngctctcagtatatgctccgcctttccctgggtaag

SEQ ID NO: 31451 - DNA, 71 bp, chicken (Gallus Gallus)
  misc_feature (36): n=a or g
caacaatactagttatgaaatttcatcatctgtgcngtgtggttcactgtgagtaggggaacaagaagaat

SEQ ID NO: 31452 - DNA, 71 bp, chicken (Gallus Gallus)
  misc_feature (36): n=a or g
gtgcaattgggttcccatcttactccagatttgaantcataaaactggaatatgagttgttttctgaacat

SEQ ID NO: 31453 - DNA, 71 bp, chicken (Gallus Gallus)
  misc_feature (36): n=a or c
cacagattggtcagagttatcccctatgtgcccagngctgcaataaagaaatatctgcttgatacaagtca

SEQ ID NO: 31454 - DNA, 71 bp, chicken (Gallus Gallus)
  misc_feature (36): n=a or g
caagccttgggcccactccttaaggaaagtaaagcncggtcattaatcataggagggtacggggggaagag

SEQ ID NO: 31455 - DNA, 71 bp, chicken (Gallus Gallus)
  misc_feature (36): n=a or g
actagagtagacaggagaaagggagattagcccccntatttaattgaactatcctcattataatactaaaa

SEQ ID NO: 31456 - DNA, 71 bp, chicken (Gallus Gallus)
  misc_feature (36): n=a or g
aagcaggtctacgtgagaccaaagtttaaaacagtnggatagcaccagtctttgtgataacagagctgcta

SEQ ID NO: 31457 - DNA, 71 bp, chicken (Gallus Gallus)
  misc_feature (36): n=a or g
tagatctttgacttctctctcactgagaaagagatnaaagaaattgaagccctgaacaaaaacgttcgtta

SEQ ID NO: 31458 - DNA, 71 bp, chicken (Gallus Gallus)
  misc_feature (36): n=c or t
cacaggtggcgtgaccatccagaatatcccttcaangatgaatactgaaaacaaggcatccaggcagcttc

SEQ ID NO: 31459 - DNA, 71 bp, chicken (Gallus Gallus)
  misc_feature (36): n=c or t
ttgcactgtaggcaaagcattttaagaattagccanagtttaatttacaccatggctccaggtacaatatc

SEQ ID NO: 31460 - DNA, 71 bp, chicken (Gallus Gallus)
  misc_feature (36): n=c or t
tttgtcattttcttaatgctgcttcaaaaagcttcngagcttcactccggaccatcactatattttccctt

SEQ ID NO: 31461 - DNA, 71 bp, chicken (Gallus Gallus)
  misc_feature (36): n=a or g
ggtagtgggaggtgtccagaggagagctgctaaganggggctatgcatgcaggtttttaaaaggcttgtgc

SEQ ID NO: 31462 - DNA, 71 bp, chicken (Gallus Gallus)
  misc_feature (36): n=c or t
tcctgcagaatacacaatctgcacatgcataatgtnagtgcattagatccagcagcactggaacgggctgc

SEQ ID NO: 31463 - DNA, 71 bp, chicken (Gallus Gallus)
  misc_feature (36): n=a or g
caaatagttactccaacacaaaatacttttgaaccnaagtactttccagtgcttagcaatgcttgggcttg

SEQ ID NO: 31464 - DNA, 71 bp, chicken (Gallus Gallus)
  misc_feature (36): n=c or t
aaagtgagggaaaaagctggcttggaaatcatatgnatttttccaacagggctttagttctgaggatacat

SEQ ID NO: 31465 - DNA, 71 bp, chicken (Gallus Gallus)
  misc_feature (36): n=c or t
cgatatgtgccaaatcgctgagacttcggtgcctanggtactcagaagtgcacgacacccagtgttgctac

SEQ ID NO: 31466 - DNA, 71 bp, chicken (Gallus Gallus)
  misc_feature (36): n=a or g
actaattcctgtgcagcctatctccaaaccaaacantatgcaagatttctgggatgaaagccttctctgtt

SEQ ID NO: 31467 - DNA, 71 bp, chicken (Gallus Gallus)
  misc_feature (36): n=g or t
cccagtctgcacaggcccagcagtaggcattagaangtgtctactggatgagaaattctcatcccataata

SEQ ID NO: 31468 - DNA, 71 bp, chicken (Gallus Gallus)
  misc_feature (36): n=a or g
cccgcctccgggaactgattgttcagttggtaaggngaagggaaatcaggaatataaatcaactgcaggta

SEQ ID NO: 31469 - DNA, 71 bp, chicken (Gallus Gallus)
  misc_feature (36): n=c or t
gcatcagtgtaagtaggacagaatttgctctgctanttctaccccctcctttaggtatgttgctaaagagg

SEQ ID NO: 31470 - DNA, 71 bp, chicken (Gallus Gallus)
  misc_feature (36): n=c or t
caatgtgtggcagggatgctcagtttcatgcactcngaagagagaattcctgttttttgcaacaaaaataa

SEQ ID NO: 31471 - DNA, 71 bp, chicken (Gallus Gallus)
  misc_feature (36): n=a or g
ccagcctcattgcagataacaggatcctgtgttacnttggtagctttataaccagtccaaaatctgacttt

SEQ ID NO: 31472 - DNA, 71 bp, chicken (Gallus Gallus)
  misc_feature (36): n=a or g
gtatccaaagttaatgctgaagccattgttgtcccngtgttatgttctatgatatttcttgttaatgcaga

SEQ ID NO: 31473 - DNA, 71 bp, chicken (Gallus Gallus)
  misc_feature (36): n=a or g
tgtattggtacttttctggagtttttctgcatctantatcatctggctataggatgccaccaggatggtat

SEQ ID NO: 31474 - DNA, 71 bp, chicken (Gallus Gallus)
  misc_feature (36): n=c or t
cctgctgtagcatttcacaacatccagtgaaaaggntctcattccctgctaagggactcactttttttttt

SEQ ID NO: 31475 - DNA, 71 bp, chicken (Gallus Gallus)
  misc_feature (36): n=a or g
gacttttatctggtactacagacatgaagattcatnttagtttcacaatcaactttttaataaaatacatt

SEQ ID NO: 31476 - DNA, 71 bp, chicken (Gallus Gallus)
  misc_feature (36): n=a or g
aggaggtgggacactcaaaggtctgtggaatccacnggccacggaaatttaccttaattgcttccagcaag

SEQ ID NO: 31477 - DNA, 71 bp, chicken (Gallus Gallus)
  misc_feature (36): n=c or t
agacagtgaagtagaggaaagtgtatcaaactattnccaaacattcacagtttaggtctttttataccgtt

SEQ ID NO: 31478 - DNA, 71 bp, chicken (Gallus Gallus)
  misc_feature (36): n=a or g
tttcatgagagtatgtgcccttgctaatctatcatntataaaacaatgatgtaatttgctgtagtctcaca

SEQ ID NO: 31479 - DNA, 71 bp, chicken (Gallus Gallus)
  misc_feature (36): n=a or c
agggaagccatcaccctgcaaccagctctttcctgngctgactgggactaaaggagcacacagtctcctta

SEQ ID NO: 31480 - DNA, 71 bp, chicken (Gallus Gallus)
  misc_feature (36): n=c or t
taggaggatactttccctttggaggatatacacaangtccacataagagacctaacacgctgtactaccca

SEQ ID NO: 31481 - DNA, 71 bp, chicken (Gallus Gallus)
  misc_feature (36): n=a or g
aggacacaaagtaaaaactttgagttcaagtttctnttcctttatgctccaattaagccaataggattgga

SEQ ID NO: 31482 - DNA, 71 bp, chicken (Gallus Gallus)
  misc_feature (36): n=a or g
atgcagaaaggtaaaatcatgcactctacagtaacntcctagaagtgtctagcaagaagtgatcctgagat

SEQ ID NO: 31483 - DNA, 71 bp, chicken (Gallus Gallus)
  misc_feature (36): n=a or g
gttgtttttccctagaaagattactttgatttccanatctgtcagtgtacatgtaaagtctcaagtgagcc

SEQ ID NO: 31484 - DNA, 71 bp, chicken (Gallus Gallus)
  misc_feature (36): n=c or t
agcactaaggtcttctgttcttaactatttcccttnttccaacacgacaatttcctttgctcaagtgtaca

SEQ ID NO: 31485 - DNA, 71 bp, chicken (Gallus Gallus)
  misc_feature (36): n=a or c
gcagacaaagcatgggagaatgcaggtgttattttntacaatttccacttgagtgtctgaggcacaggagg

SEQ ID NO: 31486 - DNA, 71 bp, chicken (Gallus Gallus)
  misc_feature (36): n=a or g
ctgtacacagtacttccattgggtctaaatagtagncatggataaggacagtaaatacaaggggtaaagaa

SEQ ID NO: 31487 - DNA, 71 bp, chicken (Gallus Gallus)
  misc_feature (36): n=a or g
ttaataaaagagacattgaagcaagtatccacagcntcaggaaggtaggaagtattttcagaaagtatatc

SEQ ID NO: 31488 - DNA, 71 bp, chicken (Gallus Gallus)
  misc_feature (36): n=a or g
gtactgcatccatccaatagtaggctcagaagtgcnagtaccttctgtcagttggagtttgtactctcttc

SEQ ID NO: 31489 - DNA, 71 bp, chicken (Gallus Gallus)
  misc_feature (36): n=a or g
gttcctcatgtaaataaagcagaaaggaaagactcntgctgagaatgaaacaaggaaacccaaaagaggat

SEQ ID NO: 31490 - DNA, 71 bp, chicken (Gallus Gallus)
  misc_feature (36): n=c or t
ataccaggccatggcttcacataccaggaattatgngttctgtaaaaatgaatactttcctgtgcttatga

SEQ ID NO: 31491 - DNA, 71 bp, chicken (Gallus Gallus)
  misc_feature (36): n=a or c
ggtgcacttagcacagaggagttaagatagttgctnttcagtaaatggtcatttgatttgtcaccagggag

SEQ ID NO: 31492 - DNA, 71 bp, chicken (Gallus Gallus)
  misc_feature (36): n=a or g
gtataggtatgcgctgctacatgtggtgcagatcantcaggctgctttttcagaccagatttcaaatgttg

SEQ ID NO: 31493 - DNA, 71 bp, chicken (Gallus Gallus)
  misc_feature (36): n=a or g
gtgggatttacctttgaatcattatgaagcatcacnaaagtggtttccaagaaagctatttcattgtatgt

SEQ ID NO: 31494 - DNA, 71 bp, chicken (Gallus Gallus)
  misc_feature (36): n=a or g
ttgggataggataaaaactggctgaaagacacgagnaaactgcagagagataaagccaaaaagggaaatat

SEQ ID NO: 31495 - DNA, 71 bp, chicken (Gallus Gallus)
  misc_feature (36): n=c or t
ggataatatttcaatttctacttcagtattcgcttngttgacaaaccttttattgctttctttatgtactt

SEQ ID NO: 31496 - DNA, 71 bp, chicken (Gallus Gallus)
  misc_feature (36): n=c or t
tgaagtcttcagttctccaagcctctaatcattttnctcttatttttcccaaacctcatatttctcttttt

SEQ ID NO: 31497 - DNA, 71 bp, chicken (Gallus Gallus)
  misc_feature (36): n=a or g
tgacactttgcgttggtggcaaagaagagcaattcnttcagaaggtgaaacacagaaatgtccaaagcaag

SEQ ID NO: 31498 - DNA, 71 bp, chicken (Gallus Gallus)
  misc_feature (36): n=c or t
cattaaaaaatatcagtacagaccaagtcctgttcnaagattcttagaaacttgatccttcaaacacaata

SEQ ID NO: 31499 - DNA, 71 bp, chicken (Gallus Gallus)
  misc_feature (36): n=c or t
cagaaactgaattcagttcacatataactatatccnacagcactggcttttgtgaagtgaaatcagtgtaa

SEQ ID NO: 31500 - DNA, 71 bp, chicken (Gallus Gallus)
  misc_feature (36): n=c or t
tgaacttttttattgaatatccgtggaaaacagccnttcacagttgaactgagcagagaacaatttcttga

SEQ ID NO: 31501 - DNA, 71 bp, chicken (Gallus Gallus)
  misc_feature (36): n=c or t
ttcccctactgtaggagagcaagaatagatgcaggncaggctgaaattccagaggatatccataaggggaa

SEQ ID NO: 31502 - DNA, 71 bp, chicken (Gallus Gallus)
  misc_feature (36): n=a or g
ttttaaaaccaaaatacaaggatactgaacaagagnatgtactttaaatacaaatagtagtttggattaca

SEQ ID NO: 31503 - DNA, 71 bp, chicken (Gallus Gallus)
  misc_feature (36): n=a or g
tcactgatgtgtgagggtagaagactgaaaaagcgnaaaacaaccacaaagaagaatacactcaatccagt

SEQ ID NO: 31504 - DNA, 71 bp, chicken (Gallus Gallus)
  misc_feature (36): n=a or c
atggggtcctgcaacactccctgtgagaagtttcantgacaaggaacagcattttgtgtgaagttcctggt

SEQ ID NO: 31505 - DNA, 71 bp, chicken (Gallus Gallus)
  misc_feature (36): n=a or g
agaaaatgagataattcacaggcaattgagaaccancatgcacagggaagattcctttaagaccaactcat

SEQ ID NO: 31506 - DNA, 71 bp, chicken (Gallus Gallus)
  misc_feature (36): n=a or g
tacatcaacaaaatttcctgacttttataattgcancttttataatggctggtcggcttttatttccaaag

SEQ ID NO: 31507 - DNA, 71 bp, chicken (Gallus Gallus)
  misc_feature (36): n=c or t
aagtaggtatgacagtaccttactttcactgttggncacctgtgttcttctacattgtgaccacacaaaat

SEQ ID NO: 31508 - DNA, 71 bp, chicken (Gallus Gallus)
  misc_feature (36): n=a or g
acagtcttgcagcaggatgagtgatacctatgtacntgtgaaatgcaggcaagctgctgcaccccttcttc

SEQ ID NO: 31509 - DNA, 71 bp, chicken (Gallus Gallus)
  misc_feature (36): n=a or g
aaccaaaagcagcaactacaagaaaagagaaggtgntcttaaacatttttcacactccagtaaacatctgg

SEQ ID NO: 31510 - DNA, 71 bp, chicken (Gallus Gallus)
  misc_feature (36): n=a or g
gatacaatagcaccttgatacagagcaaatccccanacataattagattagagcatcctgaaatgtctttg

SEQ ID NO: 31511 - DNA, 71 bp, chicken (Gallus Gallus)
  misc_feature (36): n=c or t
ttccaagcagctgcttacaatgcaacttagtggttntgcaccaatagttttagctcacctacaaaaatact

SEQ ID NO: 31512 - DNA, 71 bp, chicken (Gallus Gallus)
  misc_feature (36): n=a or g
aaagttaataaaacactggactaagagactagactnagaactccagcgcgtgggttatgtgtttgttctga

SEQ ID NO: 31513 - DNA, 71 bp, chicken (Gallus Gallus)
  misc_feature (36): n=c or t
ttctctttgcatcctcatgaattaaaatggtaaatnatatgaatcaattgtagcacacaggacaacctttt

SEQ ID NO: 31514 - DNA, 71 bp, chicken (Gallus Gallus)
  misc_feature (36): n=a or c
cagtaatagccattcagaatactaggttactgcctnagtggatgtatatgacatgcaaaatagacagcata

SEQ ID NO: 31515 - DNA, 71 bp, chicken (Gallus Gallus)
  misc_feature (36): n=c or t
gaaactgcttgtagacacaaggtttcttcacagcantttctagcagaagtggatcatggattatgaaataa

SEQ ID NO: 31516 - DNA, 71 bp, chicken (Gallus Gallus)
  misc_feature (36): n=a or g
acagggatgtaagagatgctatgtgaagttaaaacngtgaggacgcagataaccatgcgaaacaagcaaag

SEQ ID NO: 31517 - DNA, 71 bp, chicken (Gallus Gallus)
  misc_feature (36): n=c or t
atcctatcactatcattggagaatgggatcccattncattcaccagcatttatgcccccatgtggtgacca

SEQ ID NO: 31518 - DNA, 71 bp, chicken (Gallus Gallus)
  misc_feature (36): n=c or t
aatttctactgttcagtttaaaagacaactgtgttngtgatgacttcctcagcagtatttatacccagcag

SEQ ID NO: 31519 - DNA, 71 bp, chicken (Gallus Gallus)
  misc_feature (36): n=c or t
tatcatggctcttcctgccccaagacacaaagtcanggaggctgtagcacatgactgaaaagaatcaatag

SEQ ID NO: 31520 - DNA, 71 bp, chicken (Gallus Gallus)
  misc_feature (36): n=c or t
gggcagcttgtttctaaggaacagtgatttggtgcngatttagctaaattatgtctgtgaagtagtttgag

SEQ ID NO: 31521 - DNA, 71 bp, chicken (Gallus Gallus)
  misc_feature (36): n=a or g
tttagttattcatgcacacagcttttgaattgttcnagctcttggtagctttcatagatcaaagaattata

SEQ ID NO: 31522 - DNA, 71 bp, chicken (Gallus Gallus)
  misc_feature (36): n=c or t
catcacatccaaggtgatgtccagtgcaggtcagcngtccaacctagaaaacaattgctgagtaatccata

SEQ ID NO: 31523 - DNA, 71 bp, chicken (Gallus Gallus)
  misc_feature (36): n=a or g
ttgcagatctgtatgctgggattatttgcttggcancatttacagaactttgtcctcatgcatgttcaggg

SEQ ID NO: 31524 - DNA, 71 bp, chicken (Gallus Gallus)
  misc_feature (36): n=c or t
tcaacactgtgagtaagactgactttttcttttccntgtgtgtaaaagctatctactgaatagccagtgag

SEQ ID NO: 31525 - DNA, 71 bp, chicken (Gallus Gallus)
  misc_feature (36): n=c or t
tccagagcaggcacagacatgctctaagtgcctttnagtcctcctaaactcctaggtaaatctgcgtctgt

SEQ ID NO: 31526 - DNA, 71 bp, chicken (Gallus Gallus)
  misc_feature (36): n=g or t
tgttgggtgtggggactgtgctttcttcagtgaatntaaggtcttggaaacacatggagctggaagcaatg

SEQ ID NO: 31527 - DNA, 71 bp, chicken (Gallus Gallus)
  misc_feature (36): n=a or g
ttcacagcagtgccatgggtgggcattacagcaacntaacagggaatctggatgttttccatttcaaagct

SEQ ID NO: 31528 - DNA, 71 bp, chicken (Gallus Gallus)
  misc_feature (36): n=c or t
cagagctcacccgttctgaggtctcctttgtaacancccaccaacatcaatgccttcattgcagagcacct

SEQ ID NO: 31529 - DNA, 71 bp, chicken (Gallus Gallus)
  misc_feature (36): n=c or t
tgaaaatcttgttgtaaaccttcagcttctgctttntgtaagcagactcatttagctgtggctctggcttc

SEQ ID NO: 31530 - DNA, 71 bp, chicken (Gallus Gallus)
  misc_feature (36): n=a or g
tctctgtggtagtgctgggcagctgcttcaagttcngcatttcctagggaagctgatagcaaaagacattt

SEQ ID NO: 31531 - DNA, 71 bp, chicken (Gallus Gallus)
  misc_feature (36): n=a or g
ctctgctttgctttgtgcgctcgttacctgctgcanctcatcataaaagaaaagcttgcactgaagtgcgt

SEQ ID NO: 31532 - DNA, 71 bp, chicken (Gallus Gallus)
  misc_feature (36): n=a or g
tctttccctttgcttgaaaactgataatttcattgngttaagaagtcagaagtaatttttctggttcactt

SEQ ID NO: 31533 - DNA, 71 bp, chicken (Gallus Gallus)
  misc_feature (36): n=g or t
atttgttcctctctctgtcatgttgaaggtatacantacctagcttttcctgctgcagatccccagtttgt

SEQ ID NO: 31534 - DNA, 71 bp, chicken (Gallus Gallus)
  misc_feature (36): n=c or t
cagagaagccacagaggtgagaaaccatttcactgnccccgctgtgagaaaagcttcagcgaccgctcctc

SEQ ID NO: 31535 - DNA, 71 bp, chicken (Gallus Gallus)
  misc_feature (36): n=a or g
gtgtgtgttatacttagcgtgtgtgatgggtccctnctggtagtcaggaggctgcagttctgtagtccttt

SEQ ID NO: 31536 - DNA, 71 bp, chicken (Gallus Gallus)
  misc_feature (36): n=c or t
tttatctccctaggtccagctttggccccgccttcngcacgttaacaagagaagcaaaagaacaagaacgc

SEQ ID NO: 31537 - DNA, 71 bp, chicken (Gallus Gallus)
  misc_feature (36): n=c or t
ctcaaggttccccactatgttctgttccttggattncatacagatctccctctgtgtcattcaacacattt

SEQ ID NO: 31538 - DNA, 71 bp, chicken (Gallus Gallus)
  misc_feature (36): n=a or g
actccaagtcaggcttacagcacctggacatgccantgacaagcaagcctccatgcccatggactgttcct

SEQ ID NO: 31539 - DNA, 71 bp, chicken (Gallus Gallus)
  misc_feature (36): n=a or g
atggcctgatttttctcaaagttagcaggagcccantggctaatctactcttcccaaattccactccaaca

SEQ ID NO: 31540 - DNA, 71 bp, chicken (Gallus Gallus)
  misc_feature (36): n=c or t
ggggagtttttaggtttggggcctaccgttcaaaangaattctcccagatgattttgctgttacctgcttc

SEQ ID NO: 31541 - DNA, 71 bp, chicken (Gallus Gallus)
  misc_feature (36): n=a or g
tggaaacaattctaaccccatgaaaactgactgccnctgccttacttaaagacaaagagaaaagaattgca

SEQ ID NO: 31542 - DNA, 71 bp, chicken (Gallus Gallus)
  misc_feature (36): n=c or t
gcagctcgctccgaggtgcctaacccggccatcccntctgggtatcggaacagccctcaggaatgcctggg

SEQ ID NO: 31543 - DNA, 71 bp, chicken (Gallus Gallus)
  misc_feature (36): n=g or t
tgtggccaaaacccattggtagtgtttgttttattntttttaactttatccttgcccaacatctctgtttt

SEQ ID NO: 31544 - DNA, 71 bp, chicken (Gallus Gallus)
  misc_feature (36): n=c or t
ctaattttcatgtgtggaaatcctcatctatgcatncctgccttgctgtgtggcttagggcatcctgcttg

SEQ ID NO: 31545 - DNA, 71 bp, chicken (Gallus Gallus)
  misc_feature (36): n=c or t
tatgcctgggcttttgaaagcctgtcaacaaagtcngtttccaactgatgttgaagttacattcagcaggg

SEQ ID NO: 31546 - DNA, 71 bp, chicken (Gallus Gallus)
  misc_feature (36): n=c or t
tgaaattctgaattttaatgacattcttggacaaanggcactataaaattatatgtaacactggtggtaca

SEQ ID NO: 31547 - DNA, 71 bp, chicken (Gallus Gallus)
  misc_feature (36): n=a or g
agctgaggtgctcagtttctgtctagactcaaaaantccctgaggtatacctgtctaatagaagggctgga

SEQ ID NO: 31548 - DNA, 71 bp, chicken (Gallus Gallus)
  misc_feature (36): n=c or t
gagtcagtaacatctagttccttgttttatcagtgngcagatcatgatttcatcatgcaggaaagtgggag

SEQ ID NO: 31549 - DNA, 71 bp, chicken (Gallus Gallus)
  misc_feature (36): n=c or t
tacttggcaattctcttcagctctcagactgttccnttcattcaggaacttgtggtaattacatatgctgt

SEQ ID NO: 31550 - DNA, 71 bp, chicken (Gallus Gallus)
  misc_feature (36): n=a or g
cttcggtgcacgctctcccagcctatgcctttttcnaaaagttctcttcccagatattttctagttttgca

SEQ ID NO: 31551 - DNA, 71 bp, chicken (Gallus Gallus)
  misc_feature (36): n=a or g
cttccatgtgatatttcagtctgctgaatccatccntatcttagagttggaatcatttgttggtatcattg

SEQ ID NO: 31552 - DNA, 71 bp, chicken (Gallus Gallus)
  misc_feature (36): n=a or g
atatgtgatacagttttctggtttcatacaaaagtntattagctgctgtttccttttatccgttgtaatag

SEQ ID NO: 31553 - DNA, 71 bp, chicken (Gallus Gallus)
  misc_feature (36): n=g or t
gagttttcatgtggtttataaagatttactatgcanaaattttacagacaaaatgaggcatattcttctgt

SEQ ID NO: 31554 - DNA, 71 bp, chicken (Gallus Gallus)
  misc_feature (36): n=a or g
tcctctgatatcttacatccaggtgtcagcagccanggacatgcagtttcctagcgcaacagtcccacagt

SEQ ID NO: 31555 - DNA, 71 bp, chicken (Gallus Gallus)
  misc_feature (36): n=a or g
ctctggggtgttcctaagtactccagggttggctgnagtcataaaaaactgatagcgtgcagaagaaaatg

SEQ ID NO: 31556 - DNA, 71 bp, chicken (Gallus Gallus)
  misc_feature (36): n=g or t
aactgtaaacctgagctgctcggtgagtacatatgntttctggaaagttcttctcgatggcgtgatgcaga

SEQ ID NO: 31557 - DNA, 71 bp, chicken (Gallus Gallus)
  misc_feature (36): n=a or g
cactcccgtgaaaggcagaaagaggtgggtagtttntttgtttgcttggttctctttgcagatcgtcctcc

SEQ ID NO: 31558 - DNA, 71 bp, chicken (Gallus Gallus)
  misc_feature (36): n=a or c
gcacggtggcaagtggctcctctcaggttgtcaccnttcccacagccaccaggctccactgctggcactgc

SEQ ID NO: 31559 - DNA, 71 bp, chicken (Gallus Gallus)
  misc_feature (36): n=c or t
atctttggcttaattaaaggccctcaaatctgcagngatgtccataaaagcagaagcccttacagacacag

SEQ ID NO: 31560 - DNA, 71 bp, chicken (Gallus Gallus)
  misc_feature (36): n=a or g
ttttagttgctcttttaagtgtccctgcaggtcctntgtcccatctgccagccccgtgcagatctcttgta

SEQ ID NO: 31561 - DNA, 71 bp, chicken (Gallus Gallus)
  misc_feature (36): n=c or t
aaatcctaatcagctgtctcctcagcattcaagcancagatctttttttcaaagaacagaatgcacaaagg

SEQ ID NO: 31562 - DNA, 71 bp, chicken (Gallus Gallus)
  misc_feature (36): n=a or g
aaatgagacaacgttttaagcattttttagatgaantaaaaacaacaataagccctcaagataagaaatga

SEQ ID NO: 31563 - DNA, 71 bp, chicken (Gallus Gallus)
  misc_feature (36): n=a or c
tgtatgcatcatcaagctggtctgaaaatgcaatgngatactattgctatcacagatgcatttttgcgatc

SEQ ID NO: 31564 - DNA, 71 bp, chicken (Gallus Gallus)
  misc_feature (36): n=a or g
aacaagttgggaagccaaaagtattgaaaactgctngatgccaggctgggaaaataatattcccattagca

SEQ ID NO: 31565 - DNA, 71 bp, chicken (Gallus Gallus)
  misc_feature (36): n=a or g
ttatttgggacctgggatgtcttattattgccagcntgtggctgagtgggaaggtatgatctagtattgtt

SEQ ID NO: 31566 - DNA, 71 bp, chicken (Gallus Gallus)
  misc_feature (36): n=c or t
atttttagttgactgactcagatggacttctgctgntagaacatcaaaaaagccttacccggtgtgtgtat

SEQ ID NO: 31567 - DNA, 71 bp, chicken (Gallus Gallus)
  misc_feature (36): n=a or g
gtactgttggtgtgggaatgagccacttatcttatncagtcacgtcgtgttttcccgatggattagcatga

SEQ ID NO: 31568 - DNA, 71 bp, chicken (Gallus Gallus)
  misc_feature (36): n=a or g
agatgtatgaacagtgttagctgtgtggaatggagngagcccactgaagtggggcgctctgcacaaggcag

SEQ ID NO: 31569 - DNA, 71 bp, chicken (Gallus Gallus)
  misc_feature (36): n=c or t
tccaatctctggggaacagtctcatggtgtctgttncaggttactatagacatctaacttagatgagaatc

SEQ ID NO: 31570 - DNA, 71 bp, chicken (Gallus Gallus)
  misc_feature (36): n=a or g
actatttattgcagtgtgggtgtgttacttgtgatngaagcttgaagatttacacctttatgttgtttcca

SEQ ID NO: 31571 - DNA, 71 bp, chicken (Gallus Gallus)
  misc_feature (36): n=c or t
gctcgacgggctcagccctgagcggtgacggccagngcattgacataaccatgggggcccacgtcgacgtc

SEQ ID NO: 31572 - DNA, 71 bp, chicken (Gallus Gallus)
  misc_feature (36): n=c or t
cgcgtgctgatgtttctgaagcatcgcagcaagcantgggctttcaccattgtattgtggtcgggatgcac

SEQ ID NO: 31573 - DNA, 71 bp, chicken (Gallus Gallus)
  misc_feature (36): n=a or c
cacatggctccagaataaatagttgggaggtacagntgtgctggagttgtgtgactgggtggtatttgcat

SEQ ID NO: 31574 - DNA, 71 bp, chicken (Gallus Gallus)
  misc_feature (36): n=c or t
agggtaataatactatcttcgtcagcagcaaattcnaccctcggcatctttagaatcctcagctaacttca

SEQ ID NO: 31575 - DNA, 71 bp, chicken (Gallus Gallus)
  misc_feature (36): n=c or t
ttatataggttggaaaatgttctgaacagttaaganagtgaagagttaaatctggagcccagtaaccttca

SEQ ID NO: 31576 - DNA, 71 bp, chicken (Gallus Gallus)
  misc_feature (36): n=c or t
cttcagaagttacagctctgacaactgatacggacntataaagatatgaaaacctcagttctcagcttctg

SEQ ID NO: 31577 - DNA, 71 bp, chicken (Gallus Gallus)
  misc_feature (36): n=a or c
agttagcttgagtggggaatactgaaccctagtctnagacttcagatgcaatatacataaaacgctcagat

SEQ ID NO: 31578 - DNA, 71 bp, chicken (Gallus Gallus)
  misc_feature (36): n=c or t
attgctacagtatctgggttagggagaaagattggnagcaataacactgaggtaaaagaggactgaaaatc

SEQ ID NO: 31579 - DNA, 71 bp, chicken (Gallus Gallus)
  misc_feature (36): n=a or g
tctgcagctgactttaaagatcatagacctgcaccnaactccttaccactagaagggatggtgtctttgaa

SEQ ID NO: 31580 - DNA, 71 bp, chicken (Gallus Gallus)
  misc_feature (36): n=c or t
ttaatatttggggaaaggcagattttcccttccccnatgcacacccttttctcagattacaaagtgcataa

SEQ ID NO: 31581 - DNA, 71 bp, chicken (Gallus Gallus)
  misc_feature (36): n=a or g
gatgttgatgactccagtatcttttgtatctgaatntgtcttcttgagggctagccttgagggttagtggg

SEQ ID NO: 31582 - DNA, 71 bp, chicken (Gallus Gallus)
  misc_feature (36): n=g or t
ggagcagccgtggcgttagacttggttctccatagnctggcagatgagtgagaagctaagggtttccctta

SEQ ID NO: 31583 - DNA, 71 bp, chicken (Gallus Gallus)
  misc_feature (36): n=a or g
catccagaacagctgatcactggaaaggaagatgcngctaataactatgctcgtggacactacaccgttgg

SEQ ID NO: 31584 - DNA, 71 bp, chicken (Gallus Gallus)
  misc_feature (36): n=a or g
aacaatagaacaggactgagaactgcttttaagagntagaaaactttcctcgaatcttttggtatttaatg

SEQ ID NO: 31585 - DNA, 71 bp, chicken (Gallus Gallus)
  misc_feature (36): n=c or t
gctacaacatcttgatcttgtttaggtgtctctagnaatctagttttcactgctagcacttctccaactgc

SEQ ID NO: 31586 - DNA, 71 bp, chicken (Gallus Gallus)
  misc_feature (36): n=c or t
agctctagaattcttgcctgaagatggtttccatgngaacaaagtaaatataaactgtccaggatcactgg

SEQ ID NO: 31587 - DNA, 71 bp, chicken (Gallus Gallus)
  misc_feature (36): n=g or t
aggtccattgaaatgtgatcccagggccatacacancagggagacatgctggtcaacaaccatctgaactt

SEQ ID NO: 31588 - DNA, 71 bp, chicken (Gallus Gallus)
  misc_feature (36): n=c or t
tggtgcagatacaagaaagagaatgaacacagccancactttgagctgacaggtttgagtgcccttctcag

SEQ ID NO: 31589 - DNA, 71 bp, chicken (Gallus Gallus)
  misc_feature (36): n=a or g
gaaataaaacagcccttaacaccagcattgcagttnctatctggcttatttgagattgatctatagttttc

SEQ ID NO: 31590 - DNA, 71 bp, chicken (Gallus Gallus)
  misc_feature (36): n=c or t
aaaccaaacaatctcccttccagtaccctcctcccnctcctttcagacattcacgtatttccaagttatgg

SEQ ID NO: 31591 - DNA, 71 bp, chicken (Gallus Gallus)
  misc_feature (36): n=g or t
gcagcatactacagaagcaggctcccaaagctgctncttctgcattgaaactaatgccaacagatcccacc

SEQ ID NO: 31592 - DNA, 71 bp, chicken (Gallus Gallus)
  misc_feature (36): n=c or t
tgagatgaggtttacattccttgctccaccacgttnttatttggtttaaaatggattaatggctgattaca

SEQ ID NO: 31593 - DNA, 71 bp, chicken (Gallus Gallus)
  misc_feature (36): n=a or c
ttgaactagttctgagaaataattcctcagatgcanatagtcataatactaggctaattcttaggattacc

SEQ ID NO: 31594 - DNA, 71 bp, chicken (Gallus Gallus)
  misc_feature (36): n=a or g
ctttgttaggcgttgagttcctgctctgaggaatantaatactacaatatctatgtaaaggggctgcaaga

SEQ ID NO: 31595 - DNA, 71 bp, chicken (Gallus Gallus)
  misc_feature (36): n=a or g
aggtctctgatttagttatgatgactttggactatntctttgggataagagaggtagtttctggtcactca

SEQ ID NO: 31596 - DNA, 71 bp, chicken (Gallus Gallus)
  misc_feature (36): n=c or t
tgagtccagatggacatatagagggaaggtatttgntcatggtaaaagacagctctgctccagtggtaaat

SEQ ID NO: 31597 - DNA, 71 bp, chicken (Gallus Gallus)
  misc_feature (36): n=c or t
caaggaacagcaaagaattcaggcttttcatgatcntgtgagatctcagttagttccaggcaacctgatct

SEQ ID NO: 31598 - DNA, 71 bp, chicken (Gallus Gallus)
  misc_feature (36): n=a or g
gaagaagacaacgctgttgagagaatttttgcatantttggtgatgtttctgacagagttttaaaagtttc

SEQ ID NO: 31599 - DNA, 71 bp, chicken (Gallus Gallus)
  misc_feature (36): n=c or t
caataaaacataaccttgcttggaagacatgagccnatgtttcctgagtcaccttgtagacttttggggac

SEQ ID NO: 31600 - DNA, 71 bp, chicken (Gallus Gallus)
  misc_feature (36): n=c or t
aatggctcagtactctttcagcatcagagagagccnctggtatagctagtaacatgctctaagtttatgat

SEQ ID NO: 31601 - DNA, 71 bp, chicken (Gallus Gallus)
  misc_feature (36): n=a or g
taaattcttctctttatagtcccatctcattcatgncattcaacaatagcacaaaatacaacttggtcatt

SEQ ID NO: 31602 - DNA, 71 bp, chicken (Gallus Gallus)
  misc_feature (36): n=g or t
aatctccttaagtttttagccataagaatttcaaancagtttaaaagtcaacaatgcaaccaatacaatta

SEQ ID NO: 31603 - DNA, 71 bp, chicken (Gallus Gallus)
  misc_feature (36): n=c or t
tcagaactattcagaagtgggatgcaacacattacngagacggatatggtctggaagctggaatcattttt

SEQ ID NO: 31604 - DNA, 71 bp, chicken (Gallus Gallus)
  misc_feature (36): n=a or c
taaccatttttttgttacatactttgaccggtgatnattgattccaaaatagcaaataatgaattctttca

SEQ ID NO: 31605 - DNA, 71 bp, chicken (Gallus Gallus)
  misc_feature (36): n=c or t
ctatgtttcatacacactatgcaatttactaatacnattattaaggactgaagcttttacatacagttacg

SEQ ID NO: 31606 - DNA, 71 bp, chicken (Gallus Gallus)
  misc_feature (36): n=c or t
tccatatatagacttgaaagactagaggtggcagcntgggttttggcttagggaattaaacaagtagggac

SEQ ID NO: 31607 - DNA, 71 bp, chicken (Gallus Gallus)
  misc_feature (36): n=c or t
actgttgaattcagaaaagcttatacctctgaaaanaaaaatactttcagtacatatcaacataaatttaa

SEQ ID NO: 31608 - DNA, 71 bp, chicken (Gallus Gallus)
  misc_feature (36): n=a or g
tattagcccagcatacaggaggatttcaactagtcngatataaaatgccacaataaagtaaatttaaagac

SEQ ID NO: 31609 - DNA, 71 bp, chicken (Gallus Gallus)
  misc_feature (36): n=c or t
cctgcagtggggctgttagctggaggagtaggatgnatgctagaagcacagcacttctggggctccccaaa

SEQ ID NO: 31610 - DNA, 71 bp, chicken (Gallus Gallus)
  misc_feature (36): n=a or g
cttttgttagctgcagtaagacacagtattaaaccnctataaagcttacaatacttaaaccttgcgttgcc

SEQ ID NO: 31611 - DNA, 71 bp, chicken (Gallus Gallus)
  misc_feature (36): n=c or t
ccattacaggtttatatactgcagctgaagaactcntttaaagcctaatgtatggtaatacagtttaattg

SEQ ID NO: 31612 - DNA, 71 bp, chicken (Gallus Gallus)
  misc_feature (36): n=a or c
ctcccagtgagctacaggtaaatattcatagtcagntctctgtaagttttgtcatatattcatctctacat

SEQ ID NO: 31613 - DNA, 71 bp, chicken (Gallus Gallus)
  misc_feature (36): n=c or t
gtttcaggtttagctttataccatcaatgcagacanctgcaactcaaatgtaggaagccccacaaattatc

SEQ ID NO: 31614 - DNA, 71 bp, chicken (Gallus Gallus)
  misc_feature (36): n=a or g
tgaacagatagagaagatacctgacagatggggccntcttcctttgcagatatattcaacaaattatatct

SEQ ID NO: 31615 - DNA, 71 bp, chicken (Gallus Gallus)
  misc_feature (36): n=a or c
catttttatgatgttccactttcatagaagtggaancttttctctttgtagttcagtacttcttaggggtt

SEQ ID NO: 31616 - DNA, 71 bp, chicken (Gallus Gallus)
  misc_feature (36): n=a or g
ttgcctcaaaagaacttttcctactttatccagaanggtctgagctaaggtagatgtccgcagatttttgt

SEQ ID NO: 31617 - DNA, 71 bp, chicken (Gallus Gallus)
  misc_feature (36): n=a or g
aaatccattctgaaggtgaaaggtttcagatgtatnctgttaccaaccattattagagtcttttttaagtc

SEQ ID NO: 31618 - DNA, 71 bp, chicken (Gallus Gallus)
  misc_feature (36): n=a or g
ataatcccattctgttaatttgtatctatgtcctgntagtgatggtagcagtaaataaatagggaactttt

SEQ ID NO: 31619 - DNA, 71 bp, chicken (Gallus Gallus)
  misc_feature (36): n=a or g
tcccgattctgaagtgttgaatagttagagaacagnggataactgtcagtgaactgcgcaaatcatctcgg

SEQ ID NO: 31620 - DNA, 71 bp, chicken (Gallus Gallus)
  misc_feature (36): n=a or g
ttgattaagtaagtttgattggatttttttgagacnctcatcttcacagcaactgtccggtagaaatgctg

SEQ ID NO: 31621 - DNA, 71 bp, chicken (Gallus Gallus)
  misc_feature (36): n=c or t
ccttggcttgatcttccttagacccttcctcacctngcttcttcaggacttggtgaaaaattcagtcttat

SEQ ID NO: 31622 - DNA, 71 bp, chicken (Gallus Gallus)
  misc_feature (36): n=g or t
ttgttgctctttgttatttaggcataattgtcttcnctgcttgagaacatatgtaggaaaaatgaaggtca

SEQ ID NO: 31623 - DNA, 71 bp, chicken (Gallus Gallus)
  misc_feature (36): n=a or c
ggtgaccgaacaaggaaggtctggagttcaaattantattaacttgatactgctttttgcaatatatgact

SEQ ID NO: 31624 - DNA, 71 bp, chicken (Gallus Gallus)
  misc_feature (36): n=c or t
tgtatttggttacttatacattattgagttaacttngggtgaatactcagtctttttccctatctgctgat

SEQ ID NO: 31625 - DNA, 71 bp, chicken (Gallus Gallus)
  misc_feature (36): n=a or g
caatagctatgatgtcaaataatacagagttttccntgttccaataggaattgctacaaaatcaaggtgag

SEQ ID NO: 31626 - DNA, 71 bp, chicken (Gallus Gallus)
  misc_feature (36): n=a or g
gcgtgactgagtttagcattggatattcaggatccncagaccttaagcatgcctatgttcaagctgttctg

SEQ ID NO: 31627 - DNA, 71 bp, chicken (Gallus Gallus)
  misc_feature (36): n=c or t
caccaattttgggagcaaacatgagtgagagtcatntgggaccctctgcagcactaacagtcacagtcctc

SEQ ID NO: 31628 - DNA, 71 bp, chicken (Gallus Gallus)
  misc_feature (36): n=c or t
accatgttttttcttaacaatatggaatttagaacntaaaattattttacatgattcagtaaaatgctaaa

SEQ ID NO: 31629 - DNA, 71 bp, chicken (Gallus Gallus)
  misc_feature (36): n=a or g
gctttataaagattggctgataaaggaaaatatacnagtcaaggcatagcacaggtatttacaatgagaaa

SEQ ID NO: 31630 - DNA, 71 bp, chicken (Gallus Gallus)
  misc_feature (36): n=c or t
aactactcatacaggtatttaattcagaaacttttnacttcagtttggaaacatccaatgtacatgattta

SEQ ID NO: 31631 - DNA, 71 bp, chicken (Gallus Gallus)
  misc_feature (36): n=c or t
tcataaacccaatatagaactatagatctgctgtanagaaatctgcctccataacaggtttgagtcagtta

SEQ ID NO: 31632 - DNA, 71 bp, chicken (Gallus Gallus)
  misc_feature (36): n=c or t
ctatatctgaagagaaacaggtttgttgagcagaangcattaatgcaaattcagagaattgtttaggctgg

SEQ ID NO: 31633 - DNA, 71 bp, chicken (Gallus Gallus)
  misc_feature (36): n=a or g
accgagagaaacatctatgtgttgttaaaagagacntgctgtgaattctgacgcagtctcttaagatgatt

SEQ ID NO: 31634 - DNA, 71 bp, chicken (Gallus Gallus)
  misc_feature (36): n=c or t
gattccctctaaatctataccctagagtgaaacacnctaacaagtgtttcaaagagctacaagaaatctca

SEQ ID NO: 31635 - DNA, 71 bp, chicken (Gallus Gallus)
  misc_feature (36): n=a or g
aagacactgctgaaaaagtaaaagttgccagtgacncaaaaagaaaggtttgttaaaaaatagttcccctt

SEQ ID NO: 31636 - DNA, 71 bp, chicken (Gallus Gallus)
  misc_feature (36): n=c or t
aaatctaattacattgaatctcttggtaagaaaaangtgtaggttaatcatctttggtcattttatcttca

SEQ ID NO: 31637 - DNA, 71 bp, chicken (Gallus Gallus)
  misc_feature (36): n=c or t
tgattgcagagctgggtgaatttttccagtgttgcngctgaaacagtaggacacaaccatgaaaatggtat

SEQ ID NO: 31638 - DNA, 71 bp, chicken (Gallus Gallus)
  misc_feature (36): n=a or c
ggtaataaaaactgtatacttcacaaaaaccttaanaactctacttatgctttcagaaatgaacatttctt

SEQ ID NO: 31639 - DNA, 71 bp, chicken (Gallus Gallus)
  misc_feature (36): n=c or t
tatttcagtagggcaaggagaaagccttttagagcngcacagtctctagacagtattagcagatattctga

SEQ ID NO: 31640 - DNA, 71 bp, chicken (Gallus Gallus)
  misc_feature (36): n=a or g
agatgagagaatcctgatggatttatgagaatctcntgtatcagactgaccaatttcacatttggaattat

SEQ ID NO: 31641 - DNA, 71 bp, chicken (Gallus Gallus)
  misc_feature (36): n=a or g
ttctttaacatttgccttgtgcaattggaaataggnctttcaaagaaattacagaagttcaatttttttat

SEQ ID NO: 31642 - DNA, 71 bp, chicken (Gallus Gallus)
  misc_feature (36): n=a or g
tgtgggacgacctttgaagctgtgattttattttcngcaattagctgtactcatcttccagtgttactact

SEQ ID NO: 31643 - DNA, 71 bp, chicken (Gallus Gallus)
  misc_feature (36): n=a or g
ccaacacactgcttttataagctgtgaacagcaggnataaaccttggttttttacatcgtacttgttcagg

SEQ ID NO: 31644 - DNA, 71 bp, chicken (Gallus Gallus)
  misc_feature (36): n=c or t
ggagtttgagtactcttgtaaaagaattgcattaangtaagatagtattgaaagacagttatggtatttca

SEQ ID NO: 31645 - DNA, 71 bp, chicken (Gallus Gallus)
  misc_feature (36): n=c or t
agtttctttgtagctgtttggatagatggttggttnccatcgcaggacttaaagcaatgagtagtgggaaa

SEQ ID NO: 31646 - DNA, 71 bp, chicken (Gallus Gallus)
  misc_feature (36): n=c or t
gatagttgtgcattgtaactgcctcctttttgtctnaaactgtctcaaacagcaaataatgttttagtcat

SEQ ID NO: 31647 - DNA, 71 bp, chicken (Gallus Gallus)
  misc_feature (36): n=a or g
atggttagaagaacgtgcaaattttttactgagtanacagtagatttcaggtattgctcctgcttccgaat

SEQ ID NO: 31648 - DNA, 71 bp, chicken (Gallus Gallus)
  misc_feature (36): n=a or g
tctccctcttccaaataaaattaaggtccccatacnttgtcaattaccagatttttatcaatatagatcag

SEQ ID NO: 31649 - DNA, 71 bp, chicken (Gallus Gallus)
  misc_feature (36): n=c or t
accccttgagcagttacagatattctagttttggangtaacatacagaggcttcttcctgtctttctaagt

SEQ ID NO: 31650 - DNA, 71 bp, chicken (Gallus Gallus)
  misc_feature (36): n=a or g
aagacacagcaaaggatttggagccaaacgctgtgngtttcttctgggtttagtaaacttgttagcaacga

SEQ ID NO: 31651 - DNA, 71 bp, chicken (Gallus Gallus)
  misc_feature (36): n=a or g
agcacttgcttctgtgatatttgaaatataactgcngattgttcacagctctgtcctctgggggtaaatgc

SEQ ID NO: 31652 - DNA, 71 bp, chicken (Gallus Gallus)
  misc_feature (36): n=a or g
ttgccgaaggtgctattttacagcccactggccacngcagtcactgtaactttctagtctggattataata

SEQ ID NO: 31653 - DNA, 71 bp, chicken (Gallus Gallus)
  misc_feature (36): n=g or t
ttgcagactgacggatggcatgaagtgcagacaagnttctgcacctttcccacttcctaactgtgagattg

SEQ ID NO: 31654 - DNA, 71 bp, chicken (Gallus Gallus)
  misc_feature (36): n=a or g
aatattcctctaatatacctctctaacacataaacncatagattgtgatctgaattcacaaacttacatca

SEQ ID NO: 31655 - DNA, 71 bp, chicken (Gallus Gallus)
  misc_feature (36): n=c or t
acattgtgaaggactttgaatgttgtagatgagtgnctatgctcagaacatacggtggagaaatactcaaa

SEQ ID NO: 31656 - DNA, 71 bp, chicken (Gallus Gallus)
  misc_feature (36): n=g or t
ttttccactgagaccagagcctgatgatttctcttnttcccttaaagtacatccagaatatttaacacact

SEQ ID NO: 31657 - DNA, 71 bp, chicken (Gallus Gallus)
  misc_feature (36): n=g or t
ccaggacatcacatcctaaaaatatgtatgacaganctgcagtttacactatatttctttcgtcagttgga

SEQ ID NO: 31658 - DNA, 71 bp, chicken (Gallus Gallus)
  misc_feature (36): n=c or t
agtagagattttcagcaaaaatacaaacctcagatngaccttaaaatgcagcagcagtgatgttgctggga

SEQ ID NO: 31659 - DNA, 71 bp, chicken (Gallus Gallus)
  misc_feature (36): n=a or g
tgatatcttccaccaaatgtcccaagatgttgtatnttgctctcataataaaagcgatttataagggagta

SEQ ID NO: 31660 - DNA, 71 bp, chicken (Gallus Gallus)
  misc_feature (36): n=a or g
cagtctcaagtaactgacagttaattcacatgtgcngtgtttatctccgtggtatgctgtgtgacaacttg

SEQ ID NO: 31661 - DNA, 71 bp, chicken (Gallus Gallus)
  misc_feature (36): n=a or g
cagaggaattctgacatgtgcagtagttggattctntgtgttatcaaataggttacagttaaccccattta

SEQ ID NO: 31662 - DNA, 71 bp, chicken (Gallus Gallus)
  misc_feature (36): n=a or g
ctacaagtcctgaatactaataggagtgatagaaangcatttttttccaggttctcagctgttctgaggag

SEQ ID NO: 31663 - DNA, 71 bp, chicken (Gallus Gallus)
  misc_feature (36): n=a or g
cttgtttgtgctgttattattgtcagcgtgggtacnacttgatgttggtggaggagcagcacaaggcacag

SEQ ID NO: 31664 - DNA, 71 bp, chicken (Gallus Gallus)
  misc_feature (36): n=c or t
gattggtatggcgagatgctcatgatgcagaagtgnagattggattagtctctaattagaagtgagatgca

SEQ ID NO: 31665 - DNA, 71 bp, chicken (Gallus Gallus)
  misc_feature (36): n=a or g
agcactttcttcaggtacttgtaaagcccttcatgngagtgaagcagcgtcaagctctgttttgctgttct

SEQ ID NO: 31666 - DNA, 71 bp, chicken (Gallus Gallus)
  misc_feature (36): n=a or g
tatagtttaagctaagaatcttctctttcatttttntggtgcgttgtgttggacaagctatagagacactg

SEQ ID NO: 31667 - DNA, 71 bp, chicken (Gallus Gallus)
  misc_feature (36): n=c or t
atgcatgcaatggctgatcagaataaggataggaanataccaggtacagtacttcaggagactatctctat

SEQ ID NO: 31668 - DNA, 71 bp, chicken (Gallus Gallus)
  misc_feature (36): n=c or t
agtttgcagactagaggaaaatgcggagtgtcttcngtgtgatgcatggtaggggacagaggcagaagaat

SEQ ID NO: 31669 - DNA, 71 bp, chicken (Gallus Gallus)
  misc_feature (36): n=a or g
aataatccctttcagggctgacatctctaccacctnttggaattggaattttcctgggaggaataataatg

SEQ ID NO: 31670 - DNA, 71 bp, chicken (Gallus Gallus)
  misc_feature (36): n=c or t
tcatcagacataggaagcactctccttccaaagctnagttttctgttgttaagagtgttcagataggtgaa

SEQ ID NO: 31671 - DNA, 71 bp, chicken (Gallus Gallus)
  misc_feature (36): n=c or t
ttcagccgacggtgagcctgctcacccaaccttccngcatccccacatgaatttggtgaagtgtcttacac

SEQ ID NO: 31672 - DNA, 71 bp, chicken (Gallus Gallus)
  misc_feature (36): n=a or g
ggttgtgcaggacatgtatcaggacagcactagccnctggaaaagggtcactgaacacagacgtacagcag

SEQ ID NO: 31673 - DNA, 71 bp, chicken (Gallus Gallus)
  misc_feature (36): n=a or g
tgttagtgagatagtctaaatcagaaacctctacantgctctgagtactctgaggcgttagcgaagagctt

SEQ ID NO: 31674 - DNA, 71 bp, chicken (Gallus Gallus)
  misc_feature (36): n=c or t
ggtctccctgaatcagcacttgggaggaatctctcngccgttaatggtttgcatctttttgcatcaaaggg

SEQ ID NO: 31675 - DNA, 71 bp, chicken (Gallus Gallus)
  misc_feature (36): n=a or g
tgcctgtgcaggaagtctggggtccttgagatggantgggttgtggaatatgtcatagaggatcaaaaatt

SEQ ID NO: 31676 - DNA, 71 bp, chicken (Gallus Gallus)
  misc_feature (36): n=c or t
aagagttctctggtgccaatggaaagtctcagcccnagaagccaaagtcatctctggcacatgtgtgtagg

SEQ ID NO: 31677 - DNA, 71 bp, chicken (Gallus Gallus)
  misc_feature (36): n=c or t
agccagttttggtgaatgtgttggctccactcatanggactatgtctcttttgtgttcttgctcattttgc

SEQ ID NO: 31678 - DNA, 71 bp, chicken (Gallus Gallus)
  misc_feature (36): n=a or g
taaggatgactggggagtggagctgatctgcattcntttttcaaggctggttcattatgtagacaggccca

SEQ ID NO: 31679 - DNA, 71 bp, chicken (Gallus Gallus)
  misc_feature (36): n=c or t
ggtcttggtgaacctcagttctgtcaggactcactnaaggcagatctgaggacaaaaggcttttgtccctg

SEQ ID NO: 31680 - DNA, 71 bp, chicken (Gallus Gallus)
  misc_feature (36): n=c or t
gtaaataacagtgtttcctgtctgttaagagacatnaaatgcggagttgggtagagtggatgggagtactc

SEQ ID NO: 31681 - DNA, 71 bp, chicken (Gallus Gallus)
  misc_feature (36): n=a or g
caccatcaggtagctgaagtttgtacatcttacatngaaacaacttttactcacctttaagaagttctctc

SEQ ID NO: 31682 - DNA, 71 bp, chicken (Gallus Gallus)
  misc_feature (36): n=a or g
tggcagggcttaggtcattcattctataaagcagcncagtattggctaaatttttggagttatagtttagg

SEQ ID NO: 31683 - DNA, 71 bp, chicken (Gallus Gallus)
  misc_feature (36): n=c or t
agagaaattccattccaggagaaaaatgagctaaanaagaggtctatatggaggtggtaactgttgttggt

SEQ ID NO: 31684 - DNA, 71 bp, chicken (Gallus Gallus)
  misc_feature (36): n=c or t
ctcgccgaggtcccatccagacgtgtccgagcgagngggtcgggttattctttgaactttgtggcgagcag

SEQ ID NO: 31685 - DNA, 71 bp, chicken (Gallus Gallus)
  misc_feature (36): n=a or g
gctaagtagcatttccctttcgctgaggcgctttcngaaggcgactctgtggcttgtgtgttcaggtctgg

SEQ ID NO: 31686 - DNA, 71 bp, chicken (Gallus Gallus)
  misc_feature (36): n=c or t
gagatgaaatatgtttcagtgtaaaagcaaaacatntcacaagagaagtagatttgtgcaccttctttctg

SEQ ID NO: 31687 - DNA, 71 bp, chicken (Gallus Gallus)
  misc_feature (36): n=c or t
ttttccaagttattcacaaattctcatgaaaacttntaggtagtcctttgtttgctgatacctaagttatt

SEQ ID NO: 31688 - DNA, 71 bp, chicken (Gallus Gallus)
  misc_feature (36): n=c or t
ttttaaacagctttttttaggggaaagggggagcantattaaggacaacacgtgttgaggcttctgggttt

SEQ ID NO: 31689 - DNA, 71 bp, chicken (Gallus Gallus)
  misc_feature (36): n=a or g
agcctgctcatctgtaatgtgacagaatgttaactngaagattttgtagtcaaacactcagttcttctctg

SEQ ID NO: 31690 - DNA, 71 bp, chicken (Gallus Gallus)
  misc_feature (36): n=a or g
tatacattcaacaatattgcagaaatgcagtatggnagagaaagaagcagtggctgagaggctggccagtg

SEQ ID NO: 31691 - DNA, 71 bp, chicken (Gallus Gallus)
  misc_feature (36): n=c or t
aaactgtgtataacttttaggccatatattcattgngctgagcacttacagctttgggatgaagaattagt

SEQ ID NO: 31692 - DNA, 71 bp, chicken (Gallus Gallus)
  misc_feature (36): n=a or g
tcttttttccagatagcagtttagtgctaagaatcnaaacatacagagtcaatttgtattgattttgttta

SEQ ID NO: 31693 - DNA, 71 bp, chicken (Gallus Gallus)
  misc_feature (36): n=g or t
gattagtttaatctgctgatgaagacggtttgagcngaccttgctgagtctgcactgaggctgactggggt

SEQ ID NO: 31694 - DNA, 71 bp, chicken (Gallus Gallus)
  misc_feature (36): n=a or g
agagagccaaatagagacactttacttaatatcagnagctccttactcatttctgagtttatggaatatcc

SEQ ID NO: 31695 - DNA, 71 bp, chicken (Gallus Gallus)
  misc_feature (36): n=a or c
tttctccagccagtttacaactttcttgaaccacantacctaaaagcacacacagccttaacactgaggtc

SEQ ID NO: 31696 - DNA, 71 bp, chicken (Gallus Gallus)
  misc_feature (36): n=c or t
tggttgtatcaatccccattacactggtgcaatacnagaaatgggaggtgatttcacaagtttagactgaa

SEQ ID NO: 31697 - DNA, 71 bp, chicken (Gallus Gallus)
  misc_feature (36): n=c or t
gccacataacttgccttttccagaggagcatcttangctgaaagactggtcttagtcatgccattgcacaa

SEQ ID NO: 31698 - DNA, 71 bp, chicken (Gallus Gallus)
  misc_feature (36): n=c or t
tggctcaggtgtctctgggtgcctaatccacagggnatgtaaatcgttcgtgcttcttagacccagagtgt

SEQ ID NO: 31699 - DNA, 71 bp, chicken (Gallus Gallus)
  misc_feature (36): n=a or c
ctcagttttcagcctcaggtaccactccaagactcncacttttcatcattccacttcataacttgttcatg

SEQ ID NO: 31700 - DNA, 71 bp, chicken (Gallus Gallus)
  misc_feature (36): n=g or t
ggaaaaaataaaaaggaatataagaaagttgcatantggagaggtttagactcaaagttcaagaagcagct

SEQ ID NO: 31701 - DNA, 71 bp, chicken (Gallus Gallus)
  misc_feature (36): n=a or g
tattttttcagttcacgttatctcatgtttcagaangttctcttgtcctaactgatgacgagcgtgacaga

SEQ ID NO: 31702 - DNA, 71 bp, chicken (Gallus Gallus)
  misc_feature (36): n=a or c
ctggcagtgatgtgaggttttcaatggaatttgggncaaagaatattcaggaattgtggtgggaatgttgc

SEQ ID NO: 31703 - DNA, 71 bp, chicken (Gallus Gallus)
  misc_feature (36): n=c or t
atcagtctaaaatctaacacatctttgagaatcaantgacaagctgagaacttgggcaccttactttccct

SEQ ID NO: 31704 - DNA, 71 bp, chicken (Gallus Gallus)
  misc_feature (36): n=c or t
gtcactgaagagaaaatgatccagagaaggaagatnatgtgctaggttcgcctgagcccctggtgataata

SEQ ID NO: 31705 - DNA, 71 bp, chicken (Gallus Gallus)
  misc_feature (36): n=c or t
tgactgggcattttctaggtcctttttttcagtccntgaggtctttaagctatctctcttgaagcagagca

SEQ ID NO: 31706 - DNA, 71 bp, chicken (Gallus Gallus)
  misc_feature (36): n=c or t
cctggagtccttcagtgttgtggatctcctgtgtanttgtgctctgcttctctatctgctaagtgagcatt

SEQ ID NO: 31707 - DNA, 71 bp, chicken (Gallus Gallus)
  misc_feature (36): n=a or g
cacttaatcaaagtggaaccttaaattagagggaancattttttaactctaatacagcgtaaaactgtatt

SEQ ID NO: 31708 - DNA, 71 bp, chicken (Gallus Gallus)
  misc_feature (36): n=c or t
cacagtaccttttgctgtgtagcgtgttaaacaatntaagacaatgagagtggaaagtgctcagaagggag

SEQ ID NO: 31709 - DNA, 71 bp, chicken (Gallus Gallus)
  misc_feature (36): n=a or g
caaataaagtctctgaggttaatgttagtgctaacncagtggcagacagctctcttatctatattgtttat

SEQ ID NO: 31710 - DNA, 71 bp, chicken (Gallus Gallus)
  misc_feature (36): n=a or c
tttggatgggtgccattacaaatgtatagggaaatntggctttaggagatttttaccactgctacagggaa

SEQ ID NO: 31711 - DNA, 71 bp, chicken (Gallus Gallus)
  misc_feature (36): n=c or t
tctgctgctgacctggcgctccaggatctggagctnatagtgatacttgaaggagtcgtggagacgactgg

SEQ ID NO: 31712 - DNA, 71 bp, chicken (Gallus Gallus)
  misc_feature (36): n=c or t
aatgcaaggaagaaaggcccagagaaggtttaaccnctccctcataatcctttccccctgagctgattggg

SEQ ID NO: 31713 - DNA, 71 bp, chicken (Gallus Gallus)
  misc_feature (36): n=c or t
tcacaggacagaagcagtcatcagttttgcagcccngtgacatgtgtgatgtaagcttgatctgtgaagaa

SEQ ID NO: 31714 - DNA, 71 bp, chicken (Gallus Gallus)
  misc_feature (36): n=c or t
actcgttggccaaaaattggttttaatgaaaagctnacagacctgtttttgaaacgtattttctgcatcaa

SEQ ID NO: 31715 - DNA, 71 bp, chicken (Gallus Gallus)
  misc_feature (36): n=c or t
tcagggctttggaaactacatccttttttccacccngatggtcttttgcctgttttacctagacctctagg

SEQ ID NO: 31716 - DNA, 71 bp, chicken (Gallus Gallus)
  misc_feature (36): n=c or t
tctggaccttaacttacaccctcttgtttgctcctnctgcacaatcatctttctgttactgagagtccctt

SEQ ID NO: 31717 - DNA, 71 bp, chicken (Gallus Gallus)
  misc_feature (36): n=c or t
taaggcaaaaggggactgcttgatcatttagcctgntcccctgtgtatgaactttcatctggatgctttcc

SEQ ID NO: 31718 - DNA, 71 bp, chicken (Gallus Gallus)
  misc_feature (36): n=c or t
gcttgttcatgaatgcgtatacacttgggtttctgnatatgatgtgatgtatctggtgccagctgactagc

SEQ ID NO: 31719 - DNA, 71 bp, chicken (Gallus Gallus)
  misc_feature (36): n=c or t
ctctccttgtaacctactatgctgtctgcctcttcntggaatctactacaacacctggctcttcttagaaa

SEQ ID NO: 31720 - DNA, 71 bp, chicken (Gallus Gallus)
  misc_feature (36): n=a or c
attcatttacaaagtcagtctgccacgatgttctanttacaaactacagtcaatgaatataaggtacgtct

SEQ ID NO: 31721 - DNA, 71 bp, chicken (Gallus Gallus)
  misc_feature (36): n=a or g
tagctgcggggttcagctgagatccagagtgcttcncagatcactgagctcacccttagtatgtagcatgt

SEQ ID NO: 31722 - DNA, 71 bp, chicken (Gallus Gallus)
  misc_feature (36): n=g or t
tatctgtaaaggataaaacttaaaggcatcaagagnaacatgaatgagtgggattctcagagcaaaatgaa

SEQ ID NO: 31723 - DNA, 71 bp, chicken (Gallus Gallus)
  misc_feature (36): n=a or c
acctagactctgatatctgttgattctaaggacagnctatgaaattaagcagaccagagaccactatagaa

SEQ ID NO: 31724 - DNA, 71 bp, chicken (Gallus Gallus)
  misc_feature (36): n=a or g
tcaaatcctaaagatcaagaaccaaaatacagccanaattaggactgaggcacagcttctacctgcagaca

SEQ ID NO: 31725 - DNA, 71 bp, chicken (Gallus Gallus)
  misc_feature (36): n=g or t
gtgctaacgtcacactgcaaaaaacctagttgccancactgtctggcttttgattagaaggaacgctgacc

SEQ ID NO: 31726 - DNA, 71 bp, chicken (Gallus Gallus)
  misc_feature (36): n=c or t
aacaatgagtgtttggacagacagaaaagccattgntgaaagcctcagctttgtactgagcaccatctctc

SEQ ID NO: 31727 - DNA, 71 bp, chicken (Gallus Gallus)
  misc_feature (36): n=a or g
acactcaggtgaggtccctgctctgaaacaaagagngtgagttcttatctgcatttctctcactcttttcg

SEQ ID NO: 31728 - DNA, 71 bp, chicken (Gallus Gallus)
  misc_feature (36): n=c or t
ctgaattggtctcttttcctcatacaaaggcaaatntaagtttaatgcctcggagcaaagaggttggtggc

SEQ ID NO: 31729 - DNA, 71 bp, chicken (Gallus Gallus)
  misc_feature (36): n=c or t
aatgatccagtgcctctcaaaagtgtatcctaaaanaaagttgatgtactgttttgctttggggtatggtt

SEQ ID NO: 31730 - DNA, 71 bp, chicken (Gallus Gallus)
  misc_feature (36): n=c or t
aagagatgtagtaaacataggctagccataaaatantgtttcaagcaggatttttcatccaaaatcttcaa

SEQ ID NO: 31731 - DNA, 71 bp, chicken (Gallus Gallus)
  misc_feature (36): n=c or t
ttaactctaatagagcatttgtagtttacaaactantgaaatacttttttataactaaaagctaggaagct

SEQ ID NO: 31732 - DNA, 71 bp, chicken (Gallus Gallus)
  misc_feature (36): n=c or t
cacacagacacagaatcttaaaagtcatactggaangtatgtaaaataaatgtcagttgtgtaagcctatg

SEQ ID NO: 31733 - DNA, 71 bp, chicken (Gallus Gallus)
  misc_feature (36): n=g or t
agaacagctgccatcatttctgagagggagcacgtngtcagacttgacagtcaaagatttctgtctctgct

SEQ ID NO: 31734 - DNA, 71 bp, chicken (Gallus Gallus)
  misc_feature (36): n=g or t
atatatatttgccatcagtgaagcttgattgtaganatatgacacataaatccatgctgtcaaactccttt

SEQ ID NO: 31735 - DNA, 71 bp, chicken (Gallus Gallus)
  misc_feature (36): n=a or g
ccttctgttgaagatccatgctaacagcaaataacntaactcctgggcttccaccactggcttgcagtgaa

SEQ ID NO: 31736 - DNA, 71 bp, chicken (Gallus Gallus)
  misc_feature (36): n=a or g
gtaagggctcacaatcgctttgcagatcacgctatnggaacgctgggtcttcactatggaaagcaattcac

SEQ ID NO: 31737 - DNA, 71 bp, chicken (Gallus Gallus)
  misc_feature (36): n=a or g
tctggagcaggtatacatagcaggtatacatatacntagaccaaatagtaagtataattttgttaaaaatg

SEQ ID NO: 31738 - DNA, 71 bp, chicken (Gallus Gallus)
  misc_feature (36): n=c or t
ggtaaaatatagatgttaagattactttgcccattntgggggaagatagggactataggttacatcatctc

SEQ ID NO: 31739 - DNA, 71 bp, chicken (Gallus Gallus)
  misc_feature (36): n=c or t
acgtgaattcagccatcgtttagcttaagcaaagcnctacataaatagctgcaaactttaccaggcagatg

SEQ ID NO: 31740 - DNA, 71 bp, chicken (Gallus Gallus)
  misc_feature (36): n=c or t
gttctgcgtgctgctccgctcacttcagggcacggnacaaaaataacaggctgcagagccgggtctgccgt

SEQ ID NO: 31741 - DNA, 71 bp, chicken (Gallus Gallus)
  misc_feature (36): n=c or t
ttatcgtctggatgggtgtgctttatccttgtgctngacagtggccgagctggcagcagagacctggcaca

SEQ ID NO: 31742 - DNA, 71 bp, chicken (Gallus Gallus)
  misc_feature (36): n=a or g
agatgttgacatgattgaagatgtgagcagaacttngtgataaaagctagaattcttgagttgttggctag

SEQ ID NO: 31743 - DNA, 71 bp, chicken (Gallus Gallus)
  misc_feature (36): n=a or g
ccttcagaagtataaaggcagataatgtcttctacnttgtcaaaaagtgtattgctttttacttatcagtg

SEQ ID NO: 31744 - DNA, 71 bp, chicken (Gallus Gallus)
  misc_feature (36): n=g or t
gagatgtgggatatggatgttaaccgctttacaccngggaaagattatgcaattgaactgcaggtaactaa

SEQ ID NO: 31745 - DNA, 71 bp, chicken (Gallus Gallus)
  misc_feature (36): n=c or t
cctctatcctggatagttctgtgcatatggttatgngtgtgcatgactgcttgtctgtacgatctgggtgg

SEQ ID NO: 31746 - DNA, 71 bp, chicken (Gallus Gallus)
  misc_feature (36): n=c or t
ccctcttctgattagttaaaactatggtgtttatgnaccagatggtgtaaaagaaacttgacaattaaatt

SEQ ID NO: 31747 - DNA, 71 bp, chicken (Gallus Gallus)
  misc_feature (36): n=c or t
gtccacaagaagactggttaaatagctgacgtgtcnaaaatgacatcatagccaaagctaagattttctta

SEQ ID NO: 31748 - DNA, 71 bp, chicken (Gallus Gallus)
  misc_feature (36): n=a or g
actgcaatttcagtattgagctttctctccttttcntgaaaatatatacactctatacatcattcagcttc

SEQ ID NO: 31749 - DNA, 71 bp, chicken (Gallus Gallus)
  misc_feature (36): n=a or g
acctcaaactgaggccaattcattgacatccctggnccttgattagctctgaaccaccgcaggtcttcaac

SEQ ID NO: 31750 - DNA, 71 bp, chicken (Gallus Gallus)
  misc_feature (36): n=a or c
cagaaatgctcatttataattccttacagttagtcntcgttacagttaaaatatagaggtaataaggtctt

SEQ ID NO: 31751 - DNA, 71 bp, chicken (Gallus Gallus)
  misc_feature (36): n=a or g
aatgaactcttactgtgaaacatgtagaactgttcnttgaatggtgagattttaatgttctgagccctgtt

SEQ ID NO: 31752 - DNA, 71 bp, chicken (Gallus Gallus)
  misc_feature (36): n=a or c
gagtgtttctaagagttaatgaccgtattcctgctnaattataaaacacagaatgcctgcggtaggattaa

SEQ ID NO: 31753 - DNA, 71 bp, chicken (Gallus Gallus)
  misc_feature (36): n=c or t
ttagaagtacgcagttgttttagttttgaaataccngttgtgctgtgtagtgctcaatgatttgtaagaat

SEQ ID NO: 31754 - DNA, 71 bp, chicken (Gallus Gallus)
  misc_feature (36): n=c or t
ttttctttggctgaattttacagcataatatcctanatcatgaataacctgaagcgattctttttcttcct

SEQ ID NO: 31755 - DNA, 71 bp, chicken (Gallus Gallus)
  misc_feature (36): n=a or g
actcagctcctactcagagcatgaggagttataggngtagcactacggtaaaaaggtatcttggctttgct

SEQ ID NO: 31756 - DNA, 71 bp, chicken (Gallus Gallus)
  misc_feature (36): n=a or g
tgttaaaatatattaattacagtctgtggcacatanatgcgggtttaattgtattttaatggaatgctcga

SEQ ID NO: 31757 - DNA, 71 bp, chicken (Gallus Gallus)
  misc_feature (36): n=c or t
cttcatagcaagtctaccaatatgactcccagactncaacaactataatttggcatcagcaagaaagcaga

SEQ ID NO: 31758 - DNA, 71 bp, chicken (Gallus Gallus)
  misc_feature (36): n=g or t
gcatttgcgtgcaccacacctgaccttgtctacacntactgccctgatggtgtaaaggtctggaacgtagg

SEQ ID NO: 31759 - DNA, 71 bp, chicken (Gallus Gallus)
  misc_feature (36): n=a or g
aattctacctagacaaagaagttctttggcaacagntgcagggatctttaaagacaagcaattgcgaatca

SEQ ID NO: 31760 - DNA, 71 bp, chicken (Gallus Gallus)
  misc_feature (36): n=c or t
aatgaggtaaagggactggagagatgaactctggcngaggagagcctttctggaaagcagattcttagcac

SEQ ID NO: 31761 - DNA, 71 bp, chicken (Gallus Gallus)
  misc_feature (36): n=c or t
gcaggagacaatggggcatctacaatagaaaactgngttgaggttgtcctcataaccttttgttgtgaatc

SEQ ID NO: 31762 - DNA, 71 bp, chicken (Gallus Gallus)
  misc_feature (36): n=c or t
cctgtcatacacagcagcatgcagaattgtgcaagntgacaaatacagtgcaccataactgcaaacttaaa

SEQ ID NO: 31763 - DNA, 71 bp, chicken (Gallus Gallus)
  misc_feature (36): n=c or t
gttggtctaaaattaaaatattgcttacggactacnttcttctggaaactctttctacattgtttgcctat

SEQ ID NO: 31764 - DNA, 71 bp, chicken (Gallus Gallus)
  misc_feature (36): n=a or g
gaggacttatttctgcaactataaatttactttgangcaaattttatttgcttacacaatcttatttttgc

SEQ ID NO: 31765 - DNA, 71 bp, chicken (Gallus Gallus)
  misc_feature (36): n=g or t
cctactgaagaagtaaccatcttcaagtaataaaancacattttaaaaacgtttagggaaatgtacttagt

SEQ ID NO: 31766 - DNA, 71 bp, chicken (Gallus Gallus)
  misc_feature (36): n=g or t
tttagattcatttttggacagtgataatgaggaaantcctaataagtgtgattgctgactaaagggatgcc

SEQ ID NO: 31767 - DNA, 71 bp, chicken (Gallus Gallus)
  misc_feature (36): n=a or g
atagataaataagaagttcacactccctgggaaatnctgccttagaagcttcaagtaatgatctgaattag

SEQ ID NO: 31768 - DNA, 71 bp, chicken (Gallus Gallus)
  misc_feature (36): n=a or g
attgagtttaaccatacacaaaaatcacagtggttntcagctgtgaacagagaacaatgatttgtcacaaa

SEQ ID NO: 31769 - DNA, 71 bp, chicken (Gallus Gallus)
  misc_feature (36): n=a or g
aaagaggtgaaaataacctttttgtgaaagctagcncatgattaaaacaaaaactttggttccttcaaatt

SEQ ID NO: 31770 - DNA, 71 bp, chicken (Gallus Gallus)
  misc_feature (36): n=a or g
ttttgtaggctgaaaggcaagacctacataatggancaggcatcaaaattatattgaatttatgccaagaa

SEQ ID NO: 31771 - DNA, 71 bp, chicken (Gallus Gallus)
  misc_feature (36): n=c or t
gaaatagtagaacagtagaatagactgtcctgtaanttctgaatgagttgcacatggttaggcagatacaa

SEQ ID NO: 31772 - DNA, 71 bp, chicken (Gallus Gallus)
  misc_feature (36): n=c or t
cctagaagcatcagtattttctacaagaaagccctntgtgcacacactatttccttttttgttcttccatg

SEQ ID NO: 31773 - DNA, 71 bp, chicken (Gallus Gallus)
  misc_feature (36): n=c or t
ccaattccatctaaatggcactaataacatgccagnactaacacaggaatcccaaactgtgctcagatgag

SEQ ID NO: 31774 - DNA, 71 bp, chicken (Gallus Gallus)
  misc_feature (36): n=a or g
gctatactgatgggatttccagagttaacgctagcntgtcactctaagtgaaaacttacctagtaagtggg

SEQ ID NO: 31775 - DNA, 71 bp, chicken (Gallus Gallus)
  misc_feature (36): n=a or g
gatttctataaaaatgtatcaaaatgctcgacaganactgtatttttgttatactaactactagagacatg

SEQ ID NO: 31776 - DNA, 71 bp, chicken (Gallus Gallus)
  misc_feature (36): n=a or g
gaccttaaaatcaattgaatcctttaatatttgtancgctgtggtatctctaacggcctacgtggttaagg

SEQ ID NO: 31777 - DNA, 71 bp, chicken (Gallus Gallus)
  misc_feature (36): n=a or g
gaaagtaaatcctgtcttttcagcttatgtacttanccgatagtcttcataaaggcagcacgctgaaccat

SEQ ID NO: 31778 - DNA, 71 bp, chicken (Gallus Gallus)
  misc_feature (36): n=a or c
ttgcaccactccatttgtggtgtgcaaaaaagctgncctgtcccatttacccatttacccagccttacaga

SEQ ID NO: 31779 - DNA, 71 bp, chicken (Gallus Gallus)
  misc_feature (36): n=a or g
tgtgagaatccaaccagcattgcagccaaggcaccnaagcaaaagatcatgagcttttttggtcccttttt

SEQ ID NO: 31780 - DNA, 71 bp, chicken (Gallus Gallus)
  misc_feature (36): n=c or t
gttcttctacttagataacattttccataagtattnatgaacagaggatttaaagcactcaggctgtaggt

SEQ ID NO: 31781 - DNA, 71 bp, chicken (Gallus Gallus)
  misc_feature (36): n=c or t
tggagaatgcaaaggaaatgggagaccaagtggaantgcatgcagtgtgacagagggatctacttaaatgt

SEQ ID NO: 31782 - DNA, 71 bp, chicken (Gallus Gallus)
  misc_feature (36): n=c or t
atttctatgccccagaaaacttgttttatttgcccntccgctatcatctatttgcataagtcacctcttcc

SEQ ID NO: 31783 - DNA, 71 bp, chicken (Gallus Gallus)
  misc_feature (36): n=a or c
aactaggttaaatgtcataactaaaaacaatgcctnggattgattaagggccaaatcaacatctctggact

SEQ ID NO: 31784 - DNA, 71 bp, chicken (Gallus Gallus)
  misc_feature (36): n=a or c
ctttttctgcacagcagctccacaatctcatgctanattatttatgcttcaacacttgtgcatccttttca

SEQ ID NO: 31785 - DNA, 71 bp, chicken (Gallus Gallus)
  misc_feature (36): n=a or c
tcagctgcacgcctgcttttctcaggcataaatttncttgggaataaaggcagaacataaaagcatctcta

SEQ ID NO: 31786 - DNA, 71 bp, chicken (Gallus Gallus)
  misc_feature (36): n=a or g
tgagtcctctcaggacatggcctaattaaacacaangcactgcaaataaacccggaaactgctgctagaaa

SEQ ID NO: 31787 - DNA, 71 bp, chicken (Gallus Gallus)
  misc_feature (36): n=a or g
cctgacaaactgtccattggcataaagcgctttccnggtgccacacaattaaagcctatgccttccagata

SEQ ID NO: 31788 - DNA, 71 bp, chicken (Gallus Gallus)
  misc_feature (36): n=c or t
accctgccctctgagtgtcagcctgcattgatgctnttatatgtgtgaggggaagcacatttgcaagtcct

SEQ ID NO: 31789 - DNA, 71 bp, chicken (Gallus Gallus)
  misc_feature (36): n=c or t
gtacatcagagggtttagcatcggcaaatccgtagnggaatgggcaaaacatagtacatttatttttcctg

SEQ ID NO: 31790 - DNA, 71 bp, chicken (Gallus Gallus)
  misc_feature (36): n=c or t
ggacaccaaagtccatggatgtgaacagccacatcngccatccctacgtaatacaggagatgagaagagac

SEQ ID NO: 31791 - DNA, 71 bp, chicken (Gallus Gallus)
  misc_feature (36): n=a or g
aatgttagtagtcactagatcttgctaatacttaancagtagagaagactgtgggctaatgcctgagccca

SEQ ID NO: 31792 - DNA, 71 bp, chicken (Gallus Gallus)
  misc_feature (36): n=c or t
caaaactattttatctgctaatggaaagtaggtcancattacatcaccagtttctataagagtaaacatag

SEQ ID NO: 31793 - DNA, 71 bp, chicken (Gallus Gallus)
  misc_feature (36): n=c or t
atgctgctgactgcactgtgctgtagtcagatctcncaaaaccctcccttccctccagaaaaaatggtagg

SEQ ID NO: 31794 - DNA, 71 bp, chicken (Gallus Gallus)
  misc_feature (36): n=g or t
gcagcagttcttgcaaagtccttgttttgctttcantcaccctatttccatgcagggatctcaggacacaa

SEQ ID NO: 31795 - DNA, 71 bp, chicken (Gallus Gallus)
  misc_feature (36): n=c or t
gtacttacataaagaacagtggaatgtcggatgtangtaaatatttagtgaattaaacaaaacgtgccttc

SEQ ID NO: 31796 - DNA, 71 bp, chicken (Gallus Gallus)
  misc_feature (36): n=c or t
aataatgatgagagaaaatgatttcagacactgtantttaaactgttagcaatatgttttaccatcacccc

SEQ ID NO: 31797 - DNA, 71 bp, chicken (Gallus Gallus)
  misc_feature (36): n=a or g
atccttcccaacccctctatgagtgcagaaaagacnaaaataaaggacaaggctggagttttggtggcttt

SEQ ID NO: 31798 - DNA, 71 bp, chicken (Gallus Gallus)
  misc_feature (36): n=c or t
attatatgattaaatgggctgtattgtaatggatgngtctgcgttagaatcactgggttttgcagtagtaa

SEQ ID NO: 31799 - DNA, 71 bp, chicken (Gallus Gallus)
  misc_feature (36): n=c or t
agtcccacccttaaaatcagaccattatcctgttcnatattctgactgaggaaagaaagttttcattgcat

SEQ ID NO: 31800 - DNA, 71 bp, chicken (Gallus Gallus)
  misc_feature (36): n=a or g
gtgtattctttggtctctcaatggttttggtgcagnctttgatcaaagagggacatcttattcatccataa

SEQ ID NO: 31801 - DNA, 71 bp, chicken (Gallus Gallus)
  misc_feature (36): n=a or g
agtagttaaaaaaaatatcccgtaatgctttatgcncaaaacttacagagctatggaaagaaaagccacta

SEQ ID NO: 31802 - DNA, 71 bp, chicken (Gallus Gallus)
  misc_feature (36): n=c or t
ataattcacaatgcaaaacgttttgattatggtctntgcaaatatgacaatataatgtgagccaatataat

SEQ ID NO: 31803 - DNA, 71 bp, chicken (Gallus Gallus)
  misc_feature (36): n=a or g
aactcatttcagtttttccttagaaattataaaacntaatgagactacaaacttcaaagtaaggcctatta

SEQ ID NO: 31804 - DNA, 71 bp, chicken (Gallus Gallus)
  misc_feature (36): n=a or g
tgtatcaacacatatttttcatacagcgttaaggcngtcaagtttgaagagtttctttatcagcaatattt

SEQ ID NO: 31805 - DNA, 71 bp, chicken (Gallus Gallus)
  misc_feature (36): n=a or g
tgacctagggggagccaagttacaagatgaactctnaccaagttagaagaggaaataagtgaagattggtc

SEQ ID NO: 31806 - DNA, 71 bp, chicken (Gallus Gallus)
  misc_feature (36): n=a or c
attatcaccttttgcagtggccaactctttctaccngggcccctgacccgcttccaaattctgcttatctt

SEQ ID NO: 31807 - DNA, 71 bp, chicken (Gallus Gallus)
  misc_feature (36): n=a or g
gaagagatgccttacttgttttcctgcatttctacnacttgtaccccctccttctgactcttattaatatg

SEQ ID NO: 31808 - DNA, 71 bp, chicken (Gallus Gallus)
  misc_feature (36): n=a or g
acagctgtgatctctgtatatcatctccattcctgnaactacatggatttttatttctcaagggcttgaaa

SEQ ID NO: 31809 - DNA, 71 bp, chicken (Gallus Gallus)
  misc_feature (36): n=a or g
tcagtaagacagaacacagagagcaatgccaatggnaagtaggtactggcccctacagatgtgtctgcgag

SEQ ID NO: 31810 - DNA, 71 bp, chicken (Gallus Gallus)
  misc_feature (36): n=c or t
taatactactgagctccaaagtgaactgggtatagnaattaaggaaaactacaaatgattctttatctaaa

SEQ ID NO: 31811 - DNA, 71 bp, chicken (Gallus Gallus)
  misc_feature (36): n=c or t
tgcagacctgaagttttcggaagcctgaagtctcanttttgccaaaggctgtgtgggtgcagcagggagtc

SEQ ID NO: 31812 - DNA, 71 bp, chicken (Gallus Gallus)
  misc_feature (36): n=c or t
tgccaagagctggaatatttgcagccaagttcatcngaatttcccttgtcccctttttcctggtgtcagat

SEQ ID NO: 31813 - DNA, 71 bp, chicken (Gallus Gallus)
  misc_feature (36): n=a or g
agccacctagttatcttgtgggacaaatccataacntggtctcatcgggtgtgaccacataggtggtcatt

SEQ ID NO: 31814 - DNA, 71 bp, chicken (Gallus Gallus)
  misc_feature (36): n=c or t
atctgggccagattaaaggcccaggcattgcagacnggctctgacatcagactccagcagtcatgtgatga

SEQ ID NO: 31815 - DNA, 71 bp, chicken (Gallus Gallus)
  misc_feature (36): n=a or g
ttttctaattcactctctgcaggcatatatcaggcntctaccaggttgccagaaagcagagctgtgctctc

SEQ ID NO: 31816 - DNA, 71 bp, chicken (Gallus Gallus)
  misc_feature (36): n=c or t
ttttccaccatggaaattaagctgtggatagtccanagaattatgtacatatcagctataacaatagcttt

SEQ ID NO: 31817 - DNA, 71 bp, chicken (Gallus Gallus)
  misc_feature (36): n=c or t
tggctactactaggtaacaagctattcttgcacccntcaggtgtctgatggatggtctctgtcctacccaa

SEQ ID NO: 31818 - DNA, 71 bp, chicken (Gallus Gallus)
  misc_feature (36): n=a or c
aaggagaaaatacgtaaaagcagcaaatcaccaaantaaatgaagggatacattacaaaaaaaataatcac

SEQ ID NO: 31819 - DNA, 71 bp, chicken (Gallus Gallus)
  misc_feature (36): n=g or t
ggaagagcccgttgcccagaggggagcatcgttgcntccttcaggacgctgccagactcacctgcctcggg

SEQ ID NO: 31820 - DNA, 71 bp, chicken (Gallus Gallus)
  misc_feature (36): n=a or g
ggcaacagcaataaaagccagcaatgggagcatccntgacttaaatcaacaacatggtatggcagagcttg

SEQ ID NO: 31821 - DNA, 71 bp, chicken (Gallus Gallus)
  misc_feature (36): n=c or t
ttttctgcttctccagttttccaagtgcttagactnctcagaagcagttggagtctgctgaagccttgtcc

SEQ ID NO: 31822 - DNA, 71 bp, chicken (Gallus Gallus)
  misc_feature (36): n=g or t
agactgaggaaagtgcattagaaatgcaacgaagtnatctgaaatttggtgggcagtaaatcaatgcaata

SEQ ID NO: 31823 - DNA, 71 bp, chicken (Gallus Gallus)
  misc_feature (36): n=c or t
cagggcatgctagcattctgaccatggaatagctangaggactagaccaggacatcagcttttagcttctt

SEQ ID NO: 31824 - DNA, 71 bp, chicken (Gallus Gallus)
  misc_feature (36): n=c or t
aaatttaaatcacttttactgattgcattttatatnctctaaggctggtcaaagtcagggcagagatcatg

SEQ ID NO: 31825 - DNA, 71 bp, chicken (Gallus Gallus)
  misc_feature (36): n=a or g
ctcacatgtgaatttcatgtgaaagaatgtcatgcncctgtcctggctgatcttgtgagtctgttgaatga

SEQ ID NO: 31826 - DNA, 71 bp, chicken (Gallus Gallus)
  misc_feature (36): n=g or t
ctatcccctggaggaattaaagctctcagtgagaantcactggactagtcctttgtgtaaccatagtgttg

SEQ ID NO: 31827 - DNA, 71 bp, chicken (Gallus Gallus)
  misc_feature (36): n=a or g
cttgtaggtctgtgatttgtttgtctcctgagttangtatctgccctcatcttcactgccaaaacggacag

SEQ ID NO: 31828 - DNA, 71 bp, chicken (Gallus Gallus)
  misc_feature (36): n=c or t
tagaactagtcccagaagaggtagcttaggccaggngaggtattcacaggcacatcataaattgtgaaacc

SEQ ID NO: 31829 - DNA, 71 bp, chicken (Gallus Gallus)
  misc_feature (36): n=a or g
tctccacaaatttttatggcagaaaatgcaatcagntactgtgtgtaaaaatggtacgacagaactgcttt

SEQ ID NO: 31830 - DNA, 71 bp, chicken (Gallus Gallus)
  misc_feature (36): n=g or t
agttaaaagaagatattatgcctgtataagtggtanccaaactaaggttgcctaaataattctagttttta

SEQ ID NO: 31831 - DNA, 71 bp, chicken (Gallus Gallus)
  misc_feature (36): n=g or t
cattgtattaagtttctccatcctataaactgaagncaattaactttgcaaatgttttgacattttattaa

SEQ ID NO: 31832 - DNA, 71 bp, chicken (Gallus Gallus)
  misc_feature (36): n=g or t
atcatttgaatgaattgactagttggtattacaggnaatacacaaattcataccaagcatgtttaaaataa

SEQ ID NO: 31833 - DNA, 71 bp, chicken (Gallus Gallus)
  misc_feature (36): n=a or g
tgtaaactacatgcaagcgtttttatgtgaaggcanaagaaaaatgaatgtttctgtacattagaaaaata

SEQ ID NO: 31834 - DNA, 71 bp, chicken (Gallus Gallus)
  misc_feature (36): n=c or t
ctgtaaaacgaatgtttcgtttgtacatggaacaangtttaagataagtagttactctgtgatcatagttc

SEQ ID NO: 31835 - DNA, 71 bp, chicken (Gallus Gallus)
  misc_feature (36): n=a or g
agctcgcagttttcaattgacagcaagaatgtgtgngtttcacaaatgagattgtttcaaccgtatctggg

SEQ ID NO: 31836 - DNA, 71 bp, chicken (Gallus Gallus)
  misc_feature (36): n=c or t
atgcactgaagatgctctgcaggcaatgactacttntggcaagttaagatttactattaccttactattac

SEQ ID NO: 31837 - DNA, 71 bp, chicken (Gallus Gallus)
  misc_feature (36): n=c or t
acagttgtattctattaaaagtggtgtgtttaaaangaaacaactattctctagttattgatatttcactg

SEQ ID NO: 31838 - DNA, 71 bp, chicken (Gallus Gallus)
  misc_feature (36): n=c or t
atgaatagatgttcctttgcacaaatttggaaagcncgtttgaatagataatgaatgaaatgctatactta

SEQ ID NO: 31839 - DNA, 71 bp, chicken (Gallus Gallus)
  misc_feature (36): n=a or g
ataaaggctgaacttgagatctgtaaacttctcagnttaatatttcatgtgtgtgtattctgttcatgaca

SEQ ID NO: 31840 - DNA, 71 bp, chicken (Gallus Gallus)
  misc_feature (36): n=a or g
gtttcactggtgttcactgcaagcagtactgatcantctgggacttaatttcacctttgcttactgctgct

SEQ ID NO: 31841 - DNA, 71 bp, chicken (Gallus Gallus)
  misc_feature (36): n=a or c
agtgtcttattaatggaaagtgattaacacagtaanctccgttttcatatgatagagttatttagtgcatg

SEQ ID NO: 31842 - DNA, 71 bp, chicken (Gallus Gallus)
  misc_feature (36): n=a or g
ggtttacttatgaatagtagggagtgtgggatgacntgggcagatgcctggagcagtgggcacctgcagtg

SEQ ID NO: 31843 - DNA, 71 bp, chicken (Gallus Gallus)
  misc_feature (36): n=a or g
aaagaggaaggaaagatgaacaaagaggagtatgcntttcagtgaacatacaacctaagtgtaagtgatca

SEQ ID NO: 31844 - DNA, 71 bp, chicken (Gallus Gallus)
  misc_feature (36): n=c or t
ataaactgaattgaggaatgaaatggttctagtaanaggcatcactaaaaatgctaaagctgtcatatttc

SEQ ID NO: 31845 - DNA, 71 bp, chicken (Gallus Gallus)
  misc_feature (36): n=a or g
aaaaaacagaagccatgttatctgggcaaggcttcntggaatattattaacaagaattatgatctcaaagg

SEQ ID NO: 31846 - DNA, 71 bp, chicken (Gallus Gallus)
  misc_feature (36): n=c or t
gtgaaattagtgacacatctagtctctgaatgatcngatgccaaatgactcagctctgacctatttctatt

SEQ ID NO: 31847 - DNA, 71 bp, chicken (Gallus Gallus)
  misc_feature (36): n=a or g
atccaacatactatcaagaatgtggaacgtgtggtnacactttaacagtcttgttctttgtcactgtctag

SEQ ID NO: 31848 - DNA, 71 bp, chicken (Gallus Gallus)
  misc_feature (36): n=a or g
ctgcccgaatctgtaccccccttttctgagaagccntgggctccccctggcacccacatacactacatggc

SEQ ID NO: 31849 - DNA, 71 bp, chicken (Gallus Gallus)
  misc_feature (36): n=a or c
attagatttgaaaggaaattattccagctgcagtcnctggaaacagcctatcttggtatatatattttttt

SEQ ID NO: 31850 - DNA, 71 bp, chicken (Gallus Gallus)
  misc_feature (36): n=a or c
ttggattatctactgctacagaagtgaaatggtttntctctatacaccttttatagataccacagcataag

SEQ ID NO: 31851 - DNA, 71 bp, chicken (Gallus Gallus)
  misc_feature (36): n=a or g
ggccaacctaaacaccagcattttgtctgaactgcnagggtgtgagccaggtatctgtggagttagaggct

SEQ ID NO: 31852 - DNA, 71 bp, chicken (Gallus Gallus)
  misc_feature (36): n=a or g
aagtaaaatacagtctctggaatattcactgaaagnaaatgcttttggagtgacacagatctccaaaataa

SEQ ID NO: 31853 - DNA, 71 bp, chicken (Gallus Gallus)
  misc_feature (36): n=c or t
tccagttcatctacaactcccaggaacttggtgcanaatgtgaacagaagagactcaagcttaaaattttc

SEQ ID NO: 31854 - DNA, 71 bp, chicken (Gallus Gallus)
  misc_feature (36): n=c or t
cagaatcactgacctatttcccaccctcccactcanctagatggaaaactaacaacacaccaacagtagaa

SEQ ID NO: 31855 - DNA, 71 bp, chicken (Gallus Gallus)
  misc_feature (36): n=c or t
ccaggaacagttatgtaaagatgtaaggaccgatanactgatcttgtaagcaggtaccacccatgtcactc

SEQ ID NO: 31856 - DNA, 71 bp, chicken (Gallus Gallus)
  misc_feature (36): n=c or t
agactgtttttgtacatatgagatgtggtagaagcntgaggaaagagtgagtcagggaaggttatagtaca

SEQ ID NO: 31857 - DNA, 71 bp, chicken (Gallus Gallus)
  misc_feature (36): n=a or c
gagagacccttgccagagggagaataccagcgccangtatggctcctctttgagtacccagaaagctctgg

SEQ ID NO: 31858 - DNA, 71 bp, chicken (Gallus Gallus)
  misc_feature (36): n=a or g
gctaagttctcttatacgcagatgatcataacgcanttttccctgtccaaaattgtatacaaaatttctag

SEQ ID NO: 31859 - DNA, 71 bp, chicken (Gallus Gallus)
  misc_feature (36): n=a or g
tttgtttgagaataggctatattggcatcacagtgngtttaaatctttaaatactcagtctactcagtttt

SEQ ID NO: 31860 - DNA, 71 bp, chicken (Gallus Gallus)
  misc_feature (36): n=g or t
agtaatctgatgtaaacgttgcaagaaatgggaggnacatgggagatacagaacaacccattctctcattc

SEQ ID NO: 31861 - DNA, 71 bp, chicken (Gallus Gallus)
  misc_feature (36): n=c or t
aagcatttaccataggctcaactttaagcattattnagcaggtatttttggtgtactgatctttgaaatta

SEQ ID NO: 31862 - DNA, 71 bp, chicken (Gallus Gallus)
  misc_feature (36): n=a or c
caaaaagttttctcctaatttgttgaggaagtcagncatttttgaaagggatttaataataggaatgttgt

SEQ ID NO: 31863 - DNA, 71 bp, chicken (Gallus Gallus)
  misc_feature (36): n=a or g
agctcctgaaggtttttgatatgttgctgaactggngggcatgactagtcggatagctttttttttttttt

SEQ ID NO: 31864 - DNA, 71 bp, chicken (Gallus Gallus)
  misc_feature (36): n=a or g
cctgtatccccttcccatgccccctccaaccttggnaataaaagccactcttgaactagcaaacataacag

SEQ ID NO: 31865 - DNA, 71 bp, chicken (Gallus Gallus)
  misc_feature (36): n=c or t
tctctgagttacttgtccctatcaataaaggaagtntctgggagtaactgaagcattcaggagtgccagga

SEQ ID NO: 31866 - DNA, 71 bp, chicken (Gallus Gallus)
  misc_feature (36): n=c or t
gggttaggctagacatatcttagtgatgattatgtngttttgctccattgtagcaatatttaaaattgact

SEQ ID NO: 31867 - DNA, 71 bp, chicken (Gallus Gallus)
  misc_feature (36): n=c or t
gaaatgcaggaaccatctcttgttatttcacagtgnatcctcttcatccatttttcttttaatggtcaagt

SEQ ID NO: 31868 - DNA, 71 bp, chicken (Gallus Gallus)
  misc_feature (36): n=a or g
gtaaatccttctataatagtcatgtctgtccttaanttgattctggatagactttaagcactagacaaact

SEQ ID NO: 31869 - DNA, 71 bp, chicken (Gallus Gallus)
  misc_feature (36): n=a or g
actcacttcactgactgacatgcttgcagccctagnggattgttcaaaacatttggagtatcaggaagata

SEQ ID NO: 31870 - DNA, 71 bp, chicken (Gallus Gallus)
  misc_feature (36): n=c or t
taaactgagttttgaacattacagtccagaagaacngatttcagtgatacacgaaagatcagttctaaatc

SEQ ID NO: 31871 - DNA, 71 bp, chicken (Gallus Gallus)
  misc_feature (36): n=a or g
tgactttatagatcaattcaaatgaagttaattganagattcataaggacttcggtgttatactgaactgg

SEQ ID NO: 31872 - DNA, 71 bp, chicken (Gallus Gallus)
  misc_feature (36): n=c or t
tgcaagggaccttgcaattcctctgcctcttgcgangactctgcagtttctccaactcctgcaatgaactc

SEQ ID NO: 31873 - DNA, 71 bp, chicken (Gallus Gallus)
  misc_feature (36): n=a or g
ctgtgattaatgtttccagaacatttagcagatttnggaaggagctgtaccgtcatgcaaaggcttaacca

SEQ ID NO: 31874 - DNA, 71 bp, chicken (Gallus Gallus)
  misc_feature (36): n=a or g
taacaccacattggagttagatagttttcttcttgnatttcggatgacactccttgtaacagataagcatc

SEQ ID NO: 31875 - DNA, 71 bp, chicken (Gallus Gallus)
  misc_feature (36): n=a or g
ttcctaaagtaccaacagtaatagagtatatactcnaatcatagaagtgaactcattttagagaattttct

SEQ ID NO: 31876 - DNA, 71 bp, chicken (Gallus Gallus)
  misc_feature (36): n=c or t
ggccagactttcaagagctctcatctcccaaaaggntttacgattctcagtgggtgatatagtctgttaaa

SEQ ID NO: 31877 - DNA, 71 bp, chicken (Gallus Gallus)
  misc_feature (36): n=c or t
tcctcctcatcacccctttcctcttgcagtatctcntatttcccatcatccatgcaatgaccatgccctga

SEQ ID NO: 31878 - DNA, 71 bp, chicken (Gallus Gallus)
  misc_feature (36): n=c or t
caaatctggcagactcaaaattcacaacagatagcncagatacctgaggctgagtcaacactactctgaag

SEQ ID NO: 31879 - DNA, 71 bp, chicken (Gallus Gallus)
  misc_feature (36): n=c or t
gagttttcatccagcaactgtggaagtttcttcctnacctcaataagcatcagtgtggtttctgtccctta

SEQ ID NO: 31880 - DNA, 71 bp, chicken (Gallus Gallus)
  misc_feature (36): n=a or g
ttgtcctcatgttctgtaatacctcaacaagaaacntaacaatttagtttgtcctaacccctcagaaggta

SEQ ID NO: 31881 - DNA, 71 bp, chicken (Gallus Gallus)
  misc_feature (36): n=c or t
caggtgctcatggcacagcaataattaacagtactnagtgcaagttatggaggcatggaatattctagtga

SEQ ID NO: 31882 - DNA, 71 bp, chicken (Gallus Gallus)
  misc_feature (36): n=c or t
gtcattccatttcttttaaatgcctccttgctaccnggaagactagataaataaaataactatgagtccat

SEQ ID NO: 31883 - DNA, 71 bp, chicken (Gallus Gallus)
  misc_feature (36): n=a or g
agtttgcctgacaccacttctgcctgtaacggatcnttcaaagctgagattagcaattaaaaatagttacc

SEQ ID NO: 31884 - DNA, 71 bp, chicken (Gallus Gallus)
  misc_feature (36): n=c or t
tcctcctccgtgtttcatttttatgagactgttttncatatcttggattcggacagaagcagagcgagtgc

SEQ ID NO: 31885 - DNA, 71 bp, chicken (Gallus Gallus)
  misc_feature (36): n=a or c
acagtacttgttgatagttgaagagtcagaaagaanaaccttactgatttctccagtatcaggagaacatt

SEQ ID NO: 31886 - DNA, 71 bp, chicken (Gallus Gallus)
  misc_feature (36): n=c or t
gaggagtggagttgagcagtcatgaggaaaccatgngtttcctactcaattcatggcagattggaactggt

SEQ ID NO: 31887 - DNA, 71 bp, chicken (Gallus Gallus)
  misc_feature (36): n=c or t
ttcttataacaggtgtcattaataattgcttgacanaattttatagcaattacaatgatggcagaaggtgg

SEQ ID NO: 31888 - DNA, 71 bp, chicken (Gallus Gallus)
  misc_feature (36): n=c or t
gccctatgtaaaaccagcataacagctatagagccnggcctacttttttacttcagtaaagtcttccatta

SEQ ID NO: 31889 - DNA, 71 bp, chicken (Gallus Gallus)
  misc_feature (36): n=a or g
gtagttgatctgttttgaagtactgagggtaagggngattggtgagaattaactggaatttggggatcaga

SEQ ID NO: 31890 - DNA, 71 bp, chicken (Gallus Gallus)
  misc_feature (36): n=c or t
tgttgttatatgaacctaagtttcagcaagtagagntcagatgttttcaacaatgaacttagagaaacaca

SEQ ID NO: 31891 - DNA, 71 bp, chicken (Gallus Gallus)
  misc_feature (36): n=a or g
aaggaaagagatgagagatactaggctagagcaagnccaagggcatggacaagctcaccttgcactcaaat

SEQ ID NO: 31892 - DNA, 71 bp, chicken (Gallus Gallus)
  misc_feature (36): n=a or c
tttttatttgaaaggtctgttttctattaccatgcntacaacagaaatggtacatctggtttaaggtcctt

SEQ ID NO: 31893 - DNA, 71 bp, chicken (Gallus Gallus)
  misc_feature (36): n=c or t
acattcatgagtaaatccagcaggcagagaaacaanggttagagaatcagggtgtataatcaatgagtcta

SEQ ID NO: 31894 - DNA, 71 bp, chicken (Gallus Gallus)
  misc_feature (36): n=c or t
acctcatatctgagtatgtgcttcacttttatcacngctgtgccataaacctagttcttgttcaacttata

SEQ ID NO: 31895 - DNA, 71 bp, chicken (Gallus Gallus)
  misc_feature (36): n=g or t
atttcagaggggaaaagccaattgaaggtaaggcantttggtccatcagagatgtagttttattttccagt

SEQ ID NO: 31896 - DNA, 71 bp, chicken (Gallus Gallus)
  misc_feature (36): n=c or t
aaatctaaaaaagcatctgctgtttacatataaagnagctgtttattatgcaattgcaatgactacttagg

SEQ ID NO: 31897 - DNA, 71 bp, chicken (Gallus Gallus)
  misc_feature (36): n=a or g
caacagacccagagtgtcagctactgaggagacccntatgagtggactcgtatgagtggactctagctact

SEQ ID NO: 31898 - DNA, 71 bp, chicken (Gallus Gallus)
  misc_feature (36): n=c or t
tgtcatctctttgagggaacccatccagagcacatngcatttttgcctgctttgatgacgctgttctaagt

SEQ ID NO: 31899 - DNA, 71 bp, chicken (Gallus Gallus)
  misc_feature (36): n=a or g
ttggagccttcttctctcttacaagactcctttgtnggacttaagcttatcagggaccattaagaataagt

SEQ ID NO: 31900 - DNA, 71 bp, chicken (Gallus Gallus)
  misc_feature (36): n=a or g
gtctaggaaatacagtttttatccgtccagtcccantacagataaagctcaagcattaaggcagcacagca

SEQ ID NO: 31901 - DNA, 71 bp, chicken (Gallus Gallus)
  misc_feature (36): n=c or t
gcttgtttgtcccaagaattgctactatagcacatntatcttactaaagtctttaaactataggcataatg

SEQ ID NO: 31902 - DNA, 71 bp, chicken (Gallus Gallus)
  misc_feature (36): n=a or g
ttaaaatgctctgcaattacagcctaaatgttcctnttcttggaagattcactcagtggatattcttgtgc

SEQ ID NO: 31903 - DNA, 71 bp, chicken (Gallus Gallus)
  misc_feature (36): n=c or t
cacccatcaacaagcattagcaagcttgacaatatngctacaaccggcctgattctgtgactagtggggca

SEQ ID NO: 31904 - DNA, 71 bp, chicken (Gallus Gallus)
  misc_feature (36): n=a or g
taaagcacctggagcagaacttcccacttccctganaatatccttttgcactagtcactgatgccttatat

SEQ ID NO: 31905 - DNA, 71 bp, chicken (Gallus Gallus)
  misc_feature (36): n=g or t
aatacactgtaatgtactcctccatggctactattncatttacaggattgtgatttactatttttcccaaa

SEQ ID NO: 31906 - DNA, 71 bp, chicken (Gallus Gallus)
  misc_feature (36): n=c or t
cacagcagattatctggaatattcactgcttagtgnaataccagcggtttcctaactcaggttcttgaagc

SEQ ID NO: 31907 - DNA, 71 bp, chicken (Gallus Gallus)
  misc_feature (36): n=a or g
tttatttgctggggaagaatgtgttagttaaactanaccagtacctgttcataataggacatatactcttc

SEQ ID NO: 31908 - DNA, 71 bp, chicken (Gallus Gallus)
  misc_feature (36): n=a or g
ccagcgttgtcttgaatatggggtcttgatctgtgngtgattcaggcatatgatctaagtcattttaatca

SEQ ID NO: 31909 - DNA, 71 bp, chicken (Gallus Gallus)
  misc_feature (36): n=c or t
gtcaggccttttatagttttcctgacagacagaagnccccagtaatcctgagctaacttccttcacctagt

SEQ ID NO: 31910 - DNA, 71 bp, chicken (Gallus Gallus)
  misc_feature (36): n=a or g
gacctgaagtgtaacgcgcttcactgtgcctgaatncacactcaagaataaagagatctcaaaaggaaagg

SEQ ID NO: 31911 - DNA, 71 bp, chicken (Gallus Gallus)
  misc_feature (36): n=a or g
ccctggctccccacgaaaccattagataactcgcgnaaacactgaaagtacatgccacactccatgaattg

SEQ ID NO: 31912 - DNA, 71 bp, chicken (Gallus Gallus)
  misc_feature (36): n=a or g
ttcctgggctagcaaacgtcccagtccttagctgcntgtgtagctgagatttctccttctttatggtggag

SEQ ID NO: 31913 - DNA, 71 bp, chicken (Gallus Gallus)
  misc_feature (36): n=c or t
aaagtttattatcacaacaatgctaaacagctcatncatctcaggtctgcctgctcccaaagcaattcctt

SEQ ID NO: 31914 - DNA, 71 bp, chicken (Gallus Gallus)
  misc_feature (36): n=a or g
cagggacagttgtccagcagtgtgtgctattagacnttgtgagctgtgccagctgatgcaggtgggtgctg

SEQ ID NO: 31915 - DNA, 71 bp, chicken (Gallus Gallus)
  misc_feature (36): n=a or g
ggcctctgctctctctacgtatctactgtttgatcnatcatttgctctatgctaacatttacctgtgctgc

SEQ ID NO: 31916 - DNA, 71 bp, chicken (Gallus Gallus)
  misc_feature (36): n=c or t
aatgtttgatattcaggctgttccaccttaaaaatngtagacagctttagtctatttttagtaaatcagtg

SEQ ID NO: 31917 - DNA, 71 bp, chicken (Gallus Gallus)
  misc_feature (36): n=a or g
tgttccaagtgagaaggttaagagaaatctgctaanagccagttgattatggctttgtatagtctgtctag

SEQ ID NO: 31918 - DNA, 71 bp, chicken (Gallus Gallus)
  misc_feature (36): n=a or c
tattgaatgccaaaagaaagagagcatactcaggcnctgacttccttcctgtctgcacgtcatggaaaaga

SEQ ID NO: 31919 - DNA, 71 bp, chicken (Gallus Gallus)
  misc_feature (36): n=a or g
atgttgtttttagtgaaatggaatgaaataaatttntagttaagtaggtcattgcacatctgggaaatcca

SEQ ID NO: 31920 - DNA, 71 bp, chicken (Gallus Gallus)
  misc_feature (36): n=c or t
ttttaatgttaacaacactccctttccctgcccaangatctctttgaaaataccagtctgaacactgtcat

SEQ ID NO: 31921 - DNA, 71 bp, chicken (Gallus Gallus)
  misc_feature (36): n=c or t
cttttatccctgtactgcaacactagggagcccttncccatttccccactggctgaggtagtcggggttca

SEQ ID NO: 31922 - DNA, 71 bp, chicken (Gallus Gallus)
  misc_feature (36): n=a or g
gaggaagatgcggagattctctgcttgtacactgangtccttatctgtgattccctgaacacattgtttag

SEQ ID NO: 31923 - DNA, 71 bp, chicken (Gallus Gallus)
  misc_feature (36): n=c or t
ttcaacctcactactgagcccattcaagggacttangcagtggtggcacagaaggcttttgggaagacaat

SEQ ID NO: 31924 - DNA, 71 bp, chicken (Gallus Gallus)
  misc_feature (36): n=c or t
tccgaataatgatgctgttaagtttgcagttcctcnctgatttcacttcagctgtaccagactttccttca

SEQ ID NO: 31925 - DNA, 71 bp, chicken (Gallus Gallus)
  misc_feature (36): n=a or g
aaagatgcaaacatgagcatgctgtgcctgtgcttnatgctgtttttcaaagccaaataagaatgcatttg

SEQ ID NO: 31926 - DNA, 71 bp, chicken (Gallus Gallus)
  misc_feature (36): n=g or t
tggaggaagagtctgagaatatgatgtttattaganctgattgtgaacagcaattaactgttggaaccacc

SEQ ID NO: 31927 - DNA, 71 bp, chicken (Gallus Gallus)
  misc_feature (36): n=a or g
tctagattgagcccattgaatatatagccttgtagntcttgaatggggtgcaagttgtatatctgtgagga

SEQ ID NO: 31928 - DNA, 71 bp, chicken (Gallus Gallus)
  misc_feature (36): n=c or t
gatgtgcaatagtttcttgcccttttcccagcttcnatttacttttatatagcctggaatgatgaagatga

SEQ ID NO: 31929 - DNA, 71 bp, chicken (Gallus Gallus)
  misc_feature (36): n=a or g
agtggtgtgggatgtcagacttactgagggaaggtntgacacaggtctgcataagggagggaagcagttga

SEQ ID NO: 31930 - DNA, 71 bp, chicken (Gallus Gallus)
  misc_feature (36): n=a or g
tacaagaacagagggtatatcaggaggacatagggncatatcttttgacaactggcccctcacatacctat

SEQ ID NO: 31931 - DNA, 71 bp, chicken (Gallus Gallus)
  misc_feature (36): n=a or g
atttcttcaaaggggcagcatttagcacacaggtgnctccaaaccgaacacagaatacactgcaattcata

SEQ ID NO: 31932 - DNA, 71 bp, chicken (Gallus Gallus)
  misc_feature (36): n=c or t
ctgctactgtttcactctccactagctacatccccngacagctgtgtcaagatgagacaacaggttcataa

SEQ ID NO: 31933 - DNA, 71 bp, chicken (Gallus Gallus)
  misc_feature (36): n=a or c
tccccagacagctcctttttgaatgccatctgtaanttgtgattcggagacaagagaatcagatatgaata

SEQ ID NO: 31934 - DNA, 71 bp, chicken (Gallus Gallus)
  misc_feature (36): n=a or g
ctcctcaactgcttagtaggtattttttctttggcngcatacattaagtcattaagtgactctataaacac

SEQ ID NO: 31935 - DNA, 71 bp, chicken (Gallus Gallus)
  misc_feature (36): n=a or g
gacaaacttgcttgacaatacaacagcctttgggancaaaccctgaggaccacagtgcagtaggtgtgatc

SEQ ID NO: 31936 - DNA, 71 bp, chicken (Gallus Gallus)
  misc_feature (36): n=c or t
caagcaggagatacagactctgggcaggggcatcangtatgcctcttgttaaaatgcttttaaccacagaa

SEQ ID NO: 31937 - DNA, 71 bp, chicken (Gallus Gallus)
  misc_feature (36): n=a or g
tctcttacaagcattaacttggagaagaaagctcantggaaggaagaagctactcagagtacgtctgctaa

SEQ ID NO: 31938 - DNA, 71 bp, chicken (Gallus Gallus)
  misc_feature (36): n=c or t
aggttaggaagttggattttaactttagcataattnatgtggaagaagtaattcagtgctttgtgtgggta

SEQ ID NO: 31939 - DNA, 71 bp, chicken (Gallus Gallus)
  misc_feature (36): n=c or t
ttaggtgaaggtttaccactcaaaaggtccacttcngcaaagataagtctggttcttccctttttcccacc

SEQ ID NO: 31940 - DNA, 71 bp, chicken (Gallus Gallus)
  misc_feature (36): n=c or t
tctgaagccaggggtattgatggactgtttgtagantttgcaacacagacatacagctttcctctagagcc

SEQ ID NO: 31941 - DNA, 71 bp, chicken (Gallus Gallus)
  misc_feature (36): n=c or t
acggacacatttcactagcaccgtgtgtttgctttnctcaataaccacagttttctgcactgatcactttt

SEQ ID NO: 31942 - DNA, 71 bp, chicken (Gallus Gallus)
  misc_feature (36): n=c or t
tttacaggtttatttgacctggtaataaaatgtctnacttctacattgatggccacccccacttcctttcc

SEQ ID NO: 31943 - DNA, 71 bp, chicken (Gallus Gallus)
  misc_feature (36): n=c or t
ctgtagttgctgacagcatgataaaaagagatcagngctctgctgtaatccatcataggcaaatcgaggtg

SEQ ID NO: 31944 - DNA, 71 bp, chicken (Gallus Gallus)
  misc_feature (36): n=c or t
ttgctttgctctgccccagctcttgctttggcaagntgtgttaccagcagctttcagacattcagatacac

SEQ ID NO: 31945 - DNA, 71 bp, chicken (Gallus Gallus)
  misc_feature (36): n=a or c
cgctcagcattgctgtcgttggccaagatcatcccngtattcttcataagctgagctgccagaaggcaaaa

SEQ ID NO: 31946 - DNA, 71 bp, chicken (Gallus Gallus)
  misc_feature (36): n=a or g
cccaataagaattaatacaaacttcaactcttttgnaacacttgacacttatttaggtgccctaaactgga

SEQ ID NO: 31947 - DNA, 71 bp, chicken (Gallus Gallus)
  misc_feature (36): n=a or g
agaataaatgcaaggaggtaagaagctctttaatcntgggacagaaagcacaataaggaccaaaaaaagaa

SEQ ID NO: 31948 - DNA, 71 bp, chicken (Gallus Gallus)
  misc_feature (36): n=c or t
ggctttacctctaacactcccttccaaccaggctcngagtcccccaggacccagtctgagcaaggtatacc

SEQ ID NO: 31949 - DNA, 71 bp, chicken (Gallus Gallus)
  misc_feature (36): n=g or t
ggctgcacacaaggcagtagcacatccttcaggccntggtgatggcacgggatgaggcatgaggctgttcc

SEQ ID NO: 31950 - DNA, 71 bp, chicken (Gallus Gallus)
  misc_feature (36): n=g or t
caatgattatagagatggtgatcgtgacgtagagcngggggtccactcctgcaagacaaaggggacaaggg

SEQ ID NO: 31951 - DNA, 71 bp, chicken (Gallus Gallus)
  misc_feature (36): n=a or g
ggcacacctcaccagcatcttgcacagcagtggcantgcatacccataactactagaaatgccttcagcat

SEQ ID NO: 31952 - DNA, 71 bp, chicken (Gallus Gallus)
  misc_feature (36): n=a or g
atcacatcttgcatcagtttgagactactgctcagntgagggctctattgcttcagctccttctctcaagg

SEQ ID NO: 31953 - DNA, 71 bp, chicken (Gallus Gallus)
  misc_feature (36): n=a or g
acagatagctgatggtatcccagacagcagacaagnaagaatgccatcttggaagaggaatacagtgctat

SEQ ID NO: 31954 - DNA, 71 bp, chicken (Gallus Gallus)
  misc_feature (36): n=a or g
ttcttgaaatatgaagctgatactggaggaaatacncaagagctttaaatgccagaactgctccaaaagta

SEQ ID NO: 31955 - DNA, 71 bp, chicken (Gallus Gallus)
  misc_feature (36): n=a or g
ttttctttctccttgcagctgtaagttggcccaggngaatggctggggtgtgatggtgagtcaccgatctg

SEQ ID NO: 31956 - DNA, 71 bp, chicken (Gallus Gallus)
  misc_feature (36): n=c or t
gttccaaagggcagcaagagaactgccaaatgaagnctccttccctcagtgtgcttttctaatgctaggaa

SEQ ID NO: 31957 - DNA, 71 bp, chicken (Gallus Gallus)
  misc_feature (36): n=c or t
caagcttgagtctctttaccaattataattagaggngtcattacctctggcaaagaaatatttctaagaga

SEQ ID NO: 31958 - DNA, 71 bp, chicken (Gallus Gallus)
  misc_feature (36): n=a or g
cactggcattctgagtggccagagagaattctaagngcaaaggcaatgaattcctacttacctgagaaagt

SEQ ID NO: 31959 - DNA, 71 bp, chicken (Gallus Gallus)
  misc_feature (36): n=a or g
cattctgcaggaatggatacaagtgattctttcctntcagacattattgatgcctatgccataatgtggca

SEQ ID NO: 31960 - DNA, 71 bp, chicken (Gallus Gallus)
  misc_feature (36): n=a or g
gttcgatacagtggtattttctaaaagattattgtncttggtattaaccaacctttgagaaaatttattat

SEQ ID NO: 31961 - DNA, 71 bp, chicken (Gallus Gallus)
  misc_feature (36): n=a or g
ttccaaggcaggtttgaaactgactgcagtcctttnactggagaagtctcaagggagaccatatcactctc

SEQ ID NO: 31962 - DNA, 71 bp, chicken (Gallus Gallus)
  misc_feature (36): n=c or t
aattcatcacagtctagggtctgacccactgaattntgaattaaatttttatgtattcatgaactatttat

SEQ ID NO: 31963 - DNA, 71 bp, chicken (Gallus Gallus)
  misc_feature (36): n=c or t
tgttttaaactgcacttgtcttgattgctgttattnataacaataacaatgaaatcgtatacaagctatgt

SEQ ID NO: 31964 - DNA, 71 bp, chicken (Gallus Gallus)
  misc_feature (36): n=a or c
atttgtctgccttccttagaagccacttttacttcnctgcaggatctgtgagtccccactccttcaagctg

SEQ ID NO: 31965 - DNA, 71 bp, chicken (Gallus Gallus)
  misc_feature (36): n=c or t
agttggattttgggaaaactgaagtgagattaatangtattctgacctgaggcttttctaatccatgattc

SEQ ID NO: 31966 - DNA, 71 bp, chicken (Gallus Gallus)
  misc_feature (36): n=a or g
atggcactggagaattgtctgatttttatttagtgnagaagagctagcaggtgcttgtggtctgtccaaac

SEQ ID NO: 31967 - DNA, 71 bp, chicken (Gallus Gallus)
  misc_feature (36): n=a or g
gagcacaacaatattagagggcaactgcttggggangtcagatggaaagaaatctagaaaagggcagaaga

SEQ ID NO: 31968 - DNA, 71 bp, chicken (Gallus Gallus)
  misc_feature (36): n=c or t
tgcaacaactcaattctgatcctttcaattagagtngttcagctgctgttttaacaaagacagaagaaaaa

SEQ ID NO: 31969 - DNA, 71 bp, chicken (Gallus Gallus)
  misc_feature (36): n=a or g
gcaaatcatagaatcgcttaggttagcttgagaccnctaaggtcattaagtccaagcattagatcactggg

SEQ ID NO: 31970 - DNA, 71 bp, chicken (Gallus Gallus)
  misc_feature (36): n=a or g
gtaactaagtcagatagcatttcagtgatatctgcnttgtaacctggaagcacagttacactttccaagaa

SEQ ID NO: 31971 - DNA, 71 bp, chicken (Gallus Gallus)
  misc_feature (36): n=a or g
gcttcacagctttcctgaaagatgaggaactgtccnttgtttggtgcaaacctgccagactgcctactttt

SEQ ID NO: 31972 - DNA, 71 bp, chicken (Gallus Gallus)
  misc_feature (36): n=g or t
gctgttctggtctggtcccgtgaccagaggaggagntattaagtagcactgaggaggaatgttgatttact

SEQ ID NO: 31973 - DNA, 71 bp, chicken (Gallus Gallus)
  misc_feature (36): n=c or t
tcctctgccactgtctactccatgtctcaatgcgtnctgtaggcaaagaagaaattccgctttctagatca

SEQ ID NO: 31974 - DNA, 71 bp, chicken (Gallus Gallus)
  misc_feature (36): n=c or t
cactgacacaattctttctcgcttacagaacagctntgagacacccatcatctatgtaagtaaaaaaaata

SEQ ID NO: 31975 - DNA, 71 bp, chicken (Gallus Gallus)
  misc_feature (36): n=a or g
ataaggcaatccccaagactaatgcaatacaccttntttgccaggtttttcagagaagccagttagtggca

SEQ ID NO: 31976 - DNA, 71 bp, chicken (Gallus Gallus)
  misc_feature (36): n=a or c
acaatgcagacattagaactgaaataccagtgatanagcagagtatctcttaaattatattttcctgatag

SEQ ID NO: 31977 - DNA, 71 bp, chicken (Gallus Gallus)
  misc_feature (36): n=a or c
acgttccttgcaaataaaagtgatttcaactaccanaaccaatctattgaagtgtttgtttgtttaccttt

SEQ ID NO: 31978 - DNA, 71 bp, chicken (Gallus Gallus)
  misc_feature (36): n=a or g
tgatagtttgggaggatgctgagtcttaaaccttcngtatagttcataagaaacagtggtttaattatgtc

SEQ ID NO: 31979 - DNA, 71 bp, chicken (Gallus Gallus)
  misc_feature (36): n=a or g
agtcttcaacaacagcatattgcttttaacataagnggccacaagtatgtatttctcttcatccaccgagg

SEQ ID NO: 31980 - DNA, 71 bp, chicken (Gallus Gallus)
  misc_feature (36): n=c or t
ttggaaacgctctgctgagagggaactgtgcactcngggtgctttcagggtgtgctgaggaaggaaacctg

SEQ ID NO: 31981 - DNA, 71 bp, chicken (Gallus Gallus)
  misc_feature (36): n=a or g
tttcttctactgcagcagtgcagctgatttgcagantataggcaaggtgttagtatttagaccttttataa

SEQ ID NO: 31982 - DNA, 71 bp, chicken (Gallus Gallus)
  misc_feature (36): n=c or t
gtttcagactcccttggctctgatactctcctcttnacctcactcttgccagaaggctcacttggctaaca

SEQ ID NO: 31983 - DNA, 71 bp, chicken (Gallus Gallus)
  misc_feature (36): n=c or t
gtgtaaaggatgagaagtaggaaaaagtcactgcanactcagcactagccaggtttctgttcaataaactt

SEQ ID NO: 31984 - DNA, 71 bp, chicken (Gallus Gallus)
  misc_feature (36): n=a or c
gcaacaaaccaggaggcactgccatgcatctggacnagagcattgaaatacagtgaacacttcaacagagg

SEQ ID NO: 31985 - DNA, 71 bp, chicken (Gallus Gallus)
  misc_feature (36): n=c or t
tagacatttggcatagaaatcttccatctgtgctantggtatttggcaaagcatttcatggggaagtgctt

SEQ ID NO: 31986 - DNA, 71 bp, chicken (Gallus Gallus)
  misc_feature (36): n=g or t
gaggtgattgggcaacagggaagttggggtgactgnggcactgggtactgggtgagcagaagggggagctg

SEQ ID NO: 31987 - DNA, 71 bp, chicken (Gallus Gallus)
  misc_feature (36): n=a or c
aaagaaaaatataactagaggaaaaagacaccaaangaaaagacttaggagaaaattaagaggtagaatag

SEQ ID NO: 31988 - DNA, 71 bp, chicken (Gallus Gallus)
  misc_feature (36): n=g or t
atcatgccagtgttcagtaatttgaccatatagatnatcatgtttgagtatgttgaagtgtttccacttaa

SEQ ID NO: 31989 - DNA, 71 bp, chicken (Gallus Gallus)
  misc_feature (36): n=c or t
tgatgaatgcaaatgccaatccctcccttgatgaangttcagaccaataaatgcacttctgtcctggcttg

SEQ ID NO: 31990 - DNA, 71 bp, chicken (Gallus Gallus)
  misc_feature (36): n=g or t
acaagcattagtttgaatacttctctgcctacagangggcaggcagctgaacagattgtagttaccttgcc

SEQ ID NO: 31991 - DNA, 71 bp, chicken (Gallus Gallus)
  misc_feature (36): n=a or g
tgatgtacttggaggtgtaccacaaaaaaatgtcanaagataagaatgaaggtccttggcaaattcacaga

SEQ ID NO: 31992 - DNA, 71 bp, chicken (Gallus Gallus)
  misc_feature (36): n=c or t
aagaagcacccacaaaacagtttggttgtggcactnacccatcttgaagcgtcccatgtagtagatctggg

SEQ ID NO: 31993 - DNA, 71 bp, chicken (Gallus Gallus)
  misc_feature (36): n=g or t
tgcaacacatttaagaaccttaccactgagccagtnctagcaatcacatctctccctctgaaagtcaacag

SEQ ID NO: 31994 - DNA, 71 bp, chicken (Gallus Gallus)
  misc_feature (36): n=a or g
tcaccttcccccttgagaacgtggagcgtggctgangaaaactgtctcatgtctcaaaggcaaccagttcc

SEQ ID NO: 31995 - DNA, 71 bp, chicken (Gallus Gallus)
  misc_feature (36): n=a or g
cttgaccacaaatccagggccaaacagtagttcacnggtacagcaatttgctgtcagtcactgacctcttg

SEQ ID NO: 31996 - DNA, 71 bp, chicken (Gallus Gallus)
  misc_feature (36): n=a or g
gaagacctgtgaggtttttgcctgccttggtaatantccctgttttctgtcacaggttctacctcaattgt

SEQ ID NO: 31997 - DNA, 71 bp, chicken (Gallus Gallus)
  misc_feature (36): n=a or g
gcagaaatgagagcacaagccttggtgaaagcagcntgagagacactagaagagaaattctctgcagacct

SEQ ID NO: 31998 - DNA, 71 bp, chicken (Gallus Gallus)
  misc_feature (36): n=c or t
tggattttggaataaacttagttcagtacagttccnctgatacttcccttctcaaagagattataactcaa

SEQ ID NO: 31999 - DNA, 71 bp, chicken (Gallus Gallus)
  misc_feature (36): n=a or g
ttcccaatcacaactacctattcaattaaaaacaantaacacttagcggaaagtacaattaagtttaaact

SEQ ID NO: 32000 - DNA, 71 bp, chicken (Gallus Gallus)
  misc_feature (36): n=c or t
agtatttatccagctaaagaaagatgctgagatcangcaccacattctgcttaggcagtgcagtgttgcct

SEQ ID NO: 32001 - DNA, 71 bp, chicken (Gallus Gallus)
  misc_feature (36): n=c or t
gcagcaacaataccctaaaaaattagaataaatccnaccaatgtattccttacaacatttgaaaacaggac

SEQ ID NO: 32002 - DNA, 71 bp, chicken (Gallus Gallus)
  misc_feature (36): n=c or t
gtctcctaattagagaaagtaacagtaggggtattngtctggtggaaagtttcctggcatttttctttttt

SEQ ID NO: 32003 - DNA, 71 bp, chicken (Gallus Gallus)
  misc_feature (36): n=c or t
taagaggttagactcttttatgtttctctcttttangacagtcaataatatgcccttctccttccctacca

SEQ ID NO: 32004 - DNA, 71 bp, chicken (Gallus Gallus)
  misc_feature (36): n=a or g
tgtgtcagctgtaaaactcacctgtgctgcttggangctttcccaagccttgtgagtgtgttcaggtcaac

SEQ ID NO: 32005 - DNA, 71 bp, chicken (Gallus Gallus)
  misc_feature (36): n=c or t
caaaaagggcttagctgactagacctggtgaaatantcagttagttctgatccttgaggtcgcacaagaga

SEQ ID NO: 32006 - DNA, 71 bp, chicken (Gallus Gallus)
  misc_feature (36): n=a or g
aattcctacacccacagcttcaaagacaatgctacnttgctcaggcatttaatactggggaatttgtggtg

SEQ ID NO: 32007 - DNA, 71 bp, chicken (Gallus Gallus)
  misc_feature (36): n=c or t
tttgccagttttaaatggtgcatttcagttgcttcngatgcgcctctggctgcagtcgtcttcagtcagtg

SEQ ID NO: 32008 - DNA, 71 bp, chicken (Gallus Gallus)
  misc_feature (36): n=c or t
tgttaatgtagaagtagtctgagatgaaggactcantggaggcagcactgacctgtaccctaaaaaaaaag

SEQ ID NO: 32009 - DNA, 71 bp, chicken (Gallus Gallus)
  misc_feature (36): n=a or c
tctttttcgctctgatggttatcaattctattctgncaatgaacagccatttaatatgccaactacccacc

SEQ ID NO: 32010 - DNA, 71 bp, chicken (Gallus Gallus)
  misc_feature (36): n=a or g
atagacattttctcaatctcaggtatcaggaaagcntaaaccagctctgctacaatctcttctgactgtag

SEQ ID NO: 32011 - DNA, 71 bp, chicken (Gallus Gallus)
  misc_feature (36): n=a or g
aagcttacatggattctgtaaggtaggtaggtgatnttgcaggtgctcttcagtggctgaagtgaactgat

SEQ ID NO: 32012 - DNA, 71 bp, chicken (Gallus Gallus)
  misc_feature (36): n=a or g
cagagccaaaagggaagcagtgggattgcacccctngcttcagcacacataaccgagcttcccaaatattg

SEQ ID NO: 32013 - DNA, 71 bp, chicken (Gallus Gallus)
  misc_feature (36): n=a or g
ccagcacttttatctttcagtcatatgaggcatacngcttctggagcagtgaacattcttctaactgttca

SEQ ID NO: 32014 - DNA, 71 bp, chicken (Gallus Gallus)
  misc_feature (36): n=g or t
aacccgctacctgcaaatgagggtaatccagaatanctgcagcctgagactgggcatgtgtttgttaatcc

SEQ ID NO: 32015 - DNA, 71 bp, chicken (Gallus Gallus)
  misc_feature (36): n=a or g
ttctaaatcatatgggaaaaaggagaggaactctcntctcgtacagtgcaagagattcgcactgaagagct

SEQ ID NO: 32016 - DNA, 71 bp, chicken (Gallus Gallus)
  misc_feature (36): n=c or t
acacagctgaatgtttttcttcccctcgaatactangtatataatttaattccgtctctgtaaatttcaga

SEQ ID NO: 32017 - DNA, 71 bp, chicken (Gallus Gallus)
  misc_feature (36): n=g or t
gctgattcattcagagacattttactgcaagactgngaggattcagacatggatattttgacgttgaaacc

SEQ ID NO: 32018 - DNA, 71 bp, chicken (Gallus Gallus)
  misc_feature (36): n=c or t
aacaaagatctgctgctggttttgtcctatctctgnagtaactcattgcatttgtccctgcagtatcacgg

SEQ ID NO: 32019 - DNA, 71 bp, chicken (Gallus Gallus)
  misc_feature (36): n=c or t
catgcagatggaggaggaataaaagcaaggaggganctagtctcagccccaaccattctcccactggctag

SEQ ID NO: 32020 - DNA, 71 bp, chicken (Gallus Gallus)
  misc_feature (36): n=g or t
ggaaaagacgtctcccacagacttccctcatcttgntttcatacttccatcttaaaaacttccctcttaaa

SEQ ID NO: 32021 - DNA, 71 bp, chicken (Gallus Gallus)
  misc_feature (36): n=c or t
gagaaggagacatcaattctgattgtgtggcattanaccatgacaaggtgtaggatgtttcttcctgaccc

SEQ ID NO: 32022 - DNA, 71 bp, chicken (Gallus Gallus)
  misc_feature (36): n=a or c
ttggagcatgtatgcagttccccatttttgcaagcnctttggttctgctgtatgtattttaataccagcat

SEQ ID NO: 32023 - DNA, 71 bp, chicken (Gallus Gallus)
  misc_feature (36): n=a or g
ctgtctgggctataggtggtagccacagacagagtngatctggtgagaaatagggaaactctggggataga

SEQ ID NO: 32024 - DNA, 71 bp, chicken (Gallus Gallus)
  misc_feature (36): n=a or g
ccccgttttgttccaactcattactaacctgtgtcntggctgatgtaaaagggggctggcgtgttgggttt

SEQ ID NO: 32025 - DNA, 71 bp, chicken (Gallus Gallus)
  misc_feature (36): n=c or t
cttcctggtgttgatttgattttgttacacatatanaaaccattcaagctaaatgcttctgctagctcaat

SEQ ID NO: 32026 - DNA, 71 bp, chicken (Gallus Gallus)
  misc_feature (36): n=a or g
acagaaaagcaaagactctttggtcgtactgatgcngtcagcaggtagcactcagcatctcaggacacgct

SEQ ID NO: 32027 - DNA, 71 bp, chicken (Gallus Gallus)
  misc_feature (36): n=a or c
cactcccgcaacattaagctcaactctttgcatctnatttatcaccttctcatctgccctgagactgtgta

SEQ ID NO: 32028 - DNA, 71 bp, chicken (Gallus Gallus)
  misc_feature (36): n=c or t
aaaaaaagaattttagctttccagtccttgattttngctttgtttaaaaatctcagaggccattttgataa

SEQ ID NO: 32029 - DNA, 71 bp, chicken (Gallus Gallus)
  misc_feature (36): n=a or g
cttggacttggcattaacctcagtgtgtgcgaggcngttgttggtaatgacatctctactctgtgctccct

SEQ ID NO: 32030 - DNA, 71 bp, chicken (Gallus Gallus)
  misc_feature (36): n=c or t
aatggggtggtctgggagaaaacagctgacctaggngtgtaggcatgtgatctgctgtgatgatgttgtct

SEQ ID NO: 32031 - DNA, 71 bp, chicken (Gallus Gallus)
  misc_feature (36): n=c or t
acatttttcaagatagggactgcatttggccatctnctttcttttgtgcaaccaggctagagcctggctga

SEQ ID NO: 32032 - DNA, 71 bp, chicken (Gallus Gallus)
  misc_feature (36): n=c or t
tcttgacaaccaaccacaagattcacagtgcctcanatgagatgttccgtgctgactttatgggtgtgctg

SEQ ID NO: 32033 - DNA, 71 bp, chicken (Gallus Gallus)
  misc_feature (36): n=c or t
ttttcctttgtctccaattccaggctaattctgtgnatgctgtgtgcaaagcatggagctatcaagtgctg

SEQ ID NO: 32034 - DNA, 71 bp, chicken (Gallus Gallus)
  misc_feature (36): n=g or t
aaggatgcactgaagtcttgacttgcaattctgcanttgaccatggttgcagatgcccatagcttctaaca

SEQ ID NO: 32035 - DNA, 71 bp, chicken (Gallus Gallus)
  misc_feature (36): n=c or t
atagttgtgaggaggaaattgcagacagggtagagnggaacgcttgttaattgtcgattttctgggcattc

SEQ ID NO: 32036 - DNA, 71 bp, chicken (Gallus Gallus)
  misc_feature (36): n=a or g
taatacactgcaagatgtcactgcactccagaagcngttcattactcagacaataagaatattacttatct

SEQ ID NO: 32037 - DNA, 71 bp, chicken (Gallus Gallus)
  misc_feature (36): n=a or c
ttttcacaaaaatgtagtcaatagatgcttgcttgnatatgacttgtactactgaggtgcaaagaaatgta

SEQ ID NO: 32038 - DNA, 71 bp, chicken (Gallus Gallus)
  misc_feature (36): n=c or t
ttgtctggagcagcatggagtttggcctttctacangaaggtacaatatgtctgctttcttgtcgcaactt

SEQ ID NO: 32039 - DNA, 71 bp, chicken (Gallus Gallus)
  misc_feature (36): n=g or t
ccagtgaagaatctacatcatctccataagtatagnaacagatgatgtttatgtctcttgcagctcacctg

SEQ ID NO: 32040 - DNA, 71 bp, chicken (Gallus Gallus)
  misc_feature (36): n=a or g
agtgaaggtattttacatagctcacatacttggtcnaggaagtgttgctacatccaattcagtggagacaa

SEQ ID NO: 32041 - DNA, 71 bp, chicken (Gallus Gallus)
  misc_feature (36): n=c or t
ataggccgttagccaattctttcccactgaacttcngtaaagaatggattgagacttgaacttgtgctgtg

SEQ ID NO: 32042 - DNA, 71 bp, chicken (Gallus Gallus)
  misc_feature (36): n=a or g
gcatccctttgtcatcaaactggtgtctagggcatncagcaactcttcaggactgtcagtaggtctccatt

SEQ ID NO: 32043 - DNA, 71 bp, chicken (Gallus Gallus)
  misc_feature (36): n=a or g
atagggatgattgggtccagcttgaaccctcccttntttccctgataaacacaggagcaacctccagaatg

SEQ ID NO: 32044 - DNA, 71 bp, chicken (Gallus Gallus)
  misc_feature (36): n=c or t
cagcagctctttcccagtgccatcaccacctgcagnagggaccaggggctttgtctcggggctgcagcaaa

SEQ ID NO: 32045 - DNA, 71 bp, chicken (Gallus Gallus)
  misc_feature (36): n=c or t
tcccactaatgtctcccagtctcctactgcatcccnttctgacaggacatacaaaagggttttcagctaca

SEQ ID NO: 32046 - DNA, 71 bp, chicken (Gallus Gallus)
  misc_feature (36): n=c or t
tacaggtgtgcaaagtctgtagaccatctttgcaantgaggctgacaccttggctgtgcctgtactgcctc

SEQ ID NO: 32047 - DNA, 71 bp, chicken (Gallus Gallus)
  misc_feature (36): n=a or g
ccatggagtctcttcagtcccatgacagaaactcanttacttgggaaggcctttaaggcaccaggagcaca

SEQ ID NO: 32048 - DNA, 71 bp, chicken (Gallus Gallus)
  misc_feature (36): n=a or g
cttactgtacccccattcttctagtcttccacccancattttcttatattttagtatgaaacacactagct

SEQ ID NO: 32049 - DNA, 71 bp, chicken (Gallus Gallus)
  misc_feature (36): n=c or t
ggatgaatggagccatgatactcaatatttattcanattaaatggattttaacaatagtgatttgactgtg

SEQ ID NO: 32050 - DNA, 71 bp, chicken (Gallus Gallus)
  misc_feature (36): n=a or g
gcttcaatgcagtacagaaaagcgtttggcaaaagnggcctgctatccatctcagagcactcagaggcaat

SEQ ID NO: 32051 - DNA, 71 bp, chicken (Gallus Gallus)
  misc_feature (36): n=a or g
ctggcgctgtgcccaggatgctcggacgtgctgggngcaccagggggcgacggagaccgcgctgagtttcg

SEQ ID NO: 32052 - DNA, 71 bp, chicken (Gallus Gallus)
  misc_feature (36): n=a or g
tctgtttcccaggcagctccttggagccccatcagnaattttcctgggcccttgctaagccagctgctgta

SEQ ID NO: 32053 - DNA, 71 bp, chicken (Gallus Gallus)
  misc_feature (36): n=c or t
gtaaaaccttgtcagaaccaagccacttcattcagngcagaccactccatcatccatggtcacctcatcaa

SEQ ID NO: 32054 - DNA, 71 bp, chicken (Gallus Gallus)
  misc_feature (36): n=c or t
atgtcacttgctgttacccagtgtagtgatgccatngcagggctaggtgctctcagcaaacgtcaggcagt

SEQ ID NO: 32055 - DNA, 71 bp, chicken (Gallus Gallus)
  misc_feature (36): n=a or c
ttgggtgtggtgtgtctcttccatctttctgctaantccagtcaggattagggctttacctaaagacaaat

SEQ ID NO: 32056 - DNA, 71 bp, chicken (Gallus Gallus)
  misc_feature (36): n=a or c
ttttgctgttttggagtaagactatgtgaccatatncctcttcatgagtattatgtgaattatccatgtct

SEQ ID NO: 32057 - DNA, 71 bp, chicken (Gallus Gallus)
  misc_feature (36): n=c or t
tttataatctccagatataaacctgggagcactccnggctttggcagtccgacactatctgtaaatcactg

SEQ ID NO: 32058 - DNA, 71 bp, chicken (Gallus Gallus)
  misc_feature (36): n=a or c
tcagtagtcctggtctttccccagtcgtttaagagnacgttgaacaccacaggtcttaatgcaaactgttg

SEQ ID NO: 32059 - DNA, 71 bp, chicken (Gallus Gallus)
  misc_feature (36): n=a or g
gaacattttaagctgtataagtatcttatgtaagtntgacgtattataagtatattgtataggctgcattg

SEQ ID NO: 32060 - DNA, 71 bp, chicken (Gallus Gallus)
  misc_feature (36): n=c or t
tagatcttgcctgagaagaacaatggggtaactagngaaagccagttttctccaaattcacttttgggggc

SEQ ID NO: 32061 - DNA, 71 bp, chicken (Gallus Gallus)
  misc_feature (36): n=c or t
acttggtaaaatggcttccaaaatccatgtgttttnctctgcattccactttctcatgtcagatcaatata

SEQ ID NO: 32062 - DNA, 71 bp, chicken (Gallus Gallus)
  misc_feature (36): n=a or g
ttttttgttttccttttctggcataagtgcctgtgnttttgatcccactgctcccccccaaaataataata

SEQ ID NO: 32063 - DNA, 71 bp, chicken (Gallus Gallus)
  misc_feature (36): n=c or t
tttgcagttaaaatgggcctctctgggtgtcctatncaataaatgctataagcatctagcttgctgccttg

SEQ ID NO: 32064 - DNA, 71 bp, chicken (Gallus Gallus)
  misc_feature (36): n=a or c
catctgaagttttggagtacacttttgtcttggcanaggaactttttcaataagagttttcaaaactcttt

SEQ ID NO: 32065 - DNA, 71 bp, chicken (Gallus Gallus)
  misc_feature (36): n=a or g
tacggtacagatagtgttattgacatgagcctaggntagtcttaaactccatttccaagtggttctgctca

SEQ ID NO: 32066 - DNA, 71 bp, chicken (Gallus Gallus)
  misc_feature (36): n=c or t
attatcctcatacagtcacattatcatagcttcccntgagagccaggatgctactgtgtgttctgcacagc

SEQ ID NO: 32067 - DNA, 71 bp, chicken (Gallus Gallus)
  misc_feature (36): n=g or t
ttagacagagcatctctccagagacccctgtggggntcaccattcatttactgcaaagcatcataattctg

SEQ ID NO: 32068 - DNA, 71 bp, chicken (Gallus Gallus)
  misc_feature (36): n=g or t
aatacaataaaacacacatctaattggaagtgtcantgcttttgtgggatccatttgccacatttgccata

SEQ ID NO: 32069 - DNA, 71 bp, chicken (Gallus Gallus)
  misc_feature (36): n=a or g
atattcagttaaatgtagaaattgagtatcatagtngaactgcatgtaaatttgcccagcctgcactgcta

SEQ ID NO: 32070 - DNA, 71 bp, chicken (Gallus Gallus)
  misc_feature (36): n=c or t
gaacagctgctgtgaagttataaggctctgcatacncaacagagctctccacctgctcccaaaggggaata

SEQ ID NO: 32071 - DNA, 71 bp, chicken (Gallus Gallus)
  misc_feature (36): n=c or t
agaaataggagccacagtgagcaggaaaggtagttnagaacatcagctgacagactaagaacaataacaga

SEQ ID NO: 32072 - DNA, 71 bp, chicken (Gallus Gallus)
  misc_feature (36): n=c or t
ttcttatggttctaacaatcctgattcttttttaanagagaaaaactgtctggtcttctgatatgaattgt

SEQ ID NO: 32073 - DNA, 71 bp, chicken (Gallus Gallus)
  misc_feature (36): n=c or t
agctggaaacgcacaacagcaattcagataacagantgagaaaaataacggaagtaatgaaagtaacggaa

SEQ ID NO: 32074 - DNA, 71 bp, chicken (Gallus Gallus)
  misc_feature (36): n=c or t
agaagtccaagagagttgcgacttcagtgcacagantatcttcccccatactctccttttgcacattaaac

SEQ ID NO: 32075 - DNA, 71 bp, chicken (Gallus Gallus)
  misc_feature (36): n=a or c
catcatctgccaaagaaagtaagctgtaaacaacancagaaacaacagtgaaaagatatttaacggactta

SEQ ID NO: 32076 - DNA, 71 bp, chicken (Gallus Gallus)
  misc_feature (36): n=c or t
agtcacttacggttctggatagtgatcttccgttgncggtagtcaacacccagcacaggctcattttgccc

SEQ ID NO: 32077 - DNA, 71 bp, chicken (Gallus Gallus)
  misc_feature (36): n=a or g
cgctccttcaactccagcagttcggaaccgcggtgngtgcagtcataaatatgcatttttgaccgggctct

SEQ ID NO: 32078 - DNA, 71 bp, chicken (Gallus Gallus)
  misc_feature (36): n=a or g
cagtttctacagccttcatcaccacaggacctggangcaccagatcaaatattccctgttcttaaaccatg

SEQ ID NO: 32079 - DNA, 71 bp, chicken (Gallus Gallus)
  misc_feature (36): n=a or c
taaaaaccttgcttgggagaataaatggaatctttngcatgagaaccctgtgtcatgttgctggcatgcga

SEQ ID NO: 32080 - DNA, 71 bp, chicken (Gallus Gallus)
  misc_feature (36): n=c or t
ctcgtccagtgccagaacagggcagaagaatctccntaaaaaagctgtgggtgacatggaagggcacagga

SEQ ID NO: 32081 - DNA, 71 bp, chicken (Gallus Gallus)
  misc_feature (36): n=c or t
atagagccacgagcaaagtactgacaagcagtcaangaattcagctgccggttggctgtgcaggactttgg

SEQ ID NO: 32082 - DNA, 71 bp, chicken (Gallus Gallus)
  misc_feature (36): n=a or c
aaagaacaatgatgaaatgagccagtaacacagatntctggagaaaataattctggtactgcagggcaaca

SEQ ID NO: 32083 - DNA, 71 bp, chicken (Gallus Gallus)
  misc_feature (36): n=c or t
ctgtgaaagttgattgataagctgctgtgctcacangtgatactctggagaacctgctcatgtaccacgtt

SEQ ID NO: 32084 - DNA, 71 bp, chicken (Gallus Gallus)
  misc_feature (36): n=c or t
ctgaattacaacagcactgccacttgccttccagcntgcctacggttacagccatgtagctgaactggcag

SEQ ID NO: 32085 - DNA, 71 bp, chicken (Gallus Gallus)
  misc_feature (36): n=c or t
gtgtttccagagatatgtccaggatctatcttgttnttcagtgatagtttatacttatatttcttgttccc

SEQ ID NO: 32086 - DNA, 71 bp, chicken (Gallus Gallus)
  misc_feature (36): n=a or g
tggttgttgttttagccactcaaagccaggctgagngttctttacatttactgcttcttctctggcagtgt

SEQ ID NO: 32087 - DNA, 71 bp, chicken (Gallus Gallus)
  misc_feature (36): n=c or t
actatgatgttttagtatcccatgacaacgaaggcnccttcttaactgaaatttctggacatttgaggaag

SEQ ID NO: 32088 - DNA, 71 bp, chicken (Gallus Gallus)
  misc_feature (36): n=a or c
gtgttctgtttggttatagtagacagcaaatcattnttttacactgaacagcaatattatggatatgtgaa

SEQ ID NO: 32089 - DNA, 71 bp, chicken (Gallus Gallus)
  misc_feature (36): n=c or t
tttcgtgttcagtttagcttatgagatctaagctancttttactaaagtatttccaaacgttccttggcca

SEQ ID NO: 32090 - DNA, 71 bp, chicken (Gallus Gallus)
  misc_feature (36): n=a or c
aggagtctttccacttatgtctgtgcctttctggtncctttcagactataattctggtgaaaaatcacgag

SEQ ID NO: 32091 - DNA, 71 bp, chicken (Gallus Gallus)
  misc_feature (36): n=a or g
ctctttaaacaaaatactcccgtgtgtgtgaatggnagctctttccactatgacatgttagtgcaatgaat

SEQ ID NO: 32092 - DNA, 71 bp, chicken (Gallus Gallus)
  misc_feature (36): n=g or t
acagtttctcctccggtgtgtaggagtcgtggcagngcttcttcacaatgggaacgtaagaaggcacaaca

SEQ ID NO: 32093 - DNA, 71 bp, chicken (Gallus Gallus)
  misc_feature (36): n=g or t
ttgtcagaagacacatcctgtaccacatatgcaatngtagctacaaatagaaagtaggacatattttccac

SEQ ID NO: 32094 - DNA, 71 bp, chicken (Gallus Gallus)
  misc_feature (36): n=c or t
tcaattaccctatttttgttctgtgtgtaccatagngtatattgtgtaaactccttaaaggtaatgtgaag

SEQ ID NO: 32095 - DNA, 71 bp, chicken (Gallus Gallus)
  misc_feature (36): n=a or c
gagaagtaaaaatgtccatgtcagtatgtcttaacncctcagggcagcaagaagtgctgaagcatcctctg

SEQ ID NO: 32096 - DNA, 71 bp, chicken (Gallus Gallus)
  misc_feature (36): n=a or g
tctctgactcgtctttcaggctgttaccaataatgnctaattgtcagaatcctgtgcatcactgcatcatt

SEQ ID NO: 32097 - DNA, 71 bp, chicken (Gallus Gallus)
  misc_feature (36): n=c or t
ttttatgcagagaacaagcctttggattgatttagncatgagatactaccaagaaaccaaaaagctaaagg

SEQ ID NO: 32098 - DNA, 71 bp, chicken (Gallus Gallus)
  misc_feature (36): n=c or t
gcctcaggagttgatgtcatttacacattacctgantctgatgagcgaacttgccagcggccaagcacaac

SEQ ID NO: 32099 - DNA, 71 bp, chicken (Gallus Gallus)
  misc_feature (36): n=c or t
gaaagaataagatatttattttgaaagcacaggtanatgcacagcttgtgacagtttaattgcagtcaata

SEQ ID NO: 32100 - DNA, 71 bp, chicken (Gallus Gallus)
  misc_feature (36): n=c or t
caccaggctttgtgtttttcttcagtgtctgaatgntagatggatgctaatcgtcactacaggatcctctt

SEQ ID NO: 32101 - DNA, 71 bp, chicken (Gallus Gallus)
  misc_feature (36): n=a or g
ctcacagcgtacctgaatgcttagactgcaggaaangaagaaatctctcaatgaatagatgtcctccatct

SEQ ID NO: 32102 - DNA, 71 bp, chicken (Gallus Gallus)
  misc_feature (36): n=c or t
ggacccgtggtctaaactcataaccaagtttcccanggcatattgtgaatttcactgcatttatgcctagc

SEQ ID NO: 32103 - DNA, 71 bp, chicken (Gallus Gallus)
  misc_feature (36): n=a or g
gatcctgcagtgaggacctgtacctgtttctgtaangtgttttaatttttctagctgggatagcttggaca

SEQ ID NO: 32104 - DNA, 71 bp, chicken (Gallus Gallus)
  misc_feature (36): n=a or g
tttcctgatgtctaatccaggatttatccccgtacnttgttccaaagcctttttattgctttcctgtcccc

SEQ ID NO: 32105 - DNA, 71 bp, chicken (Gallus Gallus)
  misc_feature (36): n=a or g
aactgcaggatgtaagtagtcccattaggagtggcnctgaagcctggcttcctgtggctttctcctttctg

SEQ ID NO: 32106 - DNA, 71 bp, chicken (Gallus Gallus)
  misc_feature (36): n=c or t
taacagaatatcttaaaagtcaactattctcagtanctttctattaagttcccctgtacattgattttata

SEQ ID NO: 32107 - DNA, 71 bp, chicken (Gallus Gallus)
  misc_feature (36): n=a or c
ttcttcaaatcagctaagcacgtgcttaataaagcntgtttgttatgtttaggggttcagagcaaagcatt

SEQ ID NO: 32108 - DNA, 71 bp, chicken (Gallus Gallus)
  misc_feature (36): n=a or g
attaagtgataagtactgattaatatctttgaagantaagtgcataaaacttaagtgatctccaattcttg

SEQ ID NO: 32109 - DNA, 71 bp, chicken (Gallus Gallus)
  misc_feature (36): n=a or c
gaagatggtctgatattaagtggcattttcagtcantgtccttaacaaaggatatgaaattattttccttt

SEQ ID NO: 32110 - DNA, 71 bp, chicken (Gallus Gallus)
  misc_feature (36): n=c or t
aaaatccacgtgcaaactcagagaatagcaaggctnttcttaaacagctaatcttaaacacagctaatctt

SEQ ID NO: 32111 - DNA, 71 bp, chicken (Gallus Gallus)
  misc_feature (36): n=g or t
cactgagtacatgcacttcagattttgtattgtgtnatttttctcttaggcagaggacttgcttgcagaaa

SEQ ID NO: 32112 - DNA, 71 bp, chicken (Gallus Gallus)
  misc_feature (36): n=a or g
ctgttggctcagtgtattcagtgttggcactatacntgacagctcccatccagacctgtgtgcataataca

SEQ ID NO: 32113 - DNA, 71 bp, chicken (Gallus Gallus)
  misc_feature (36): n=a or g
tcacacaaatcacacttgaactgtttctgtacttcntgaagagctaagtgcatttttaatccatgcttata

SEQ ID NO: 32114 - DNA, 71 bp, chicken (Gallus Gallus)
  misc_feature (36): n=a or g
ggtagcctgctgtggtaaaggtggtgaaagaagacngcatgcttggttagtgtagactgacctggtgactg

SEQ ID NO: 32115 - DNA, 71 bp, chicken (Gallus Gallus)
  misc_feature (36): n=c or t
cggatcagattaagcagtttcacttctgtggcctcntgtctcatcaaatgtgacagactatgcttggtcaa

SEQ ID NO: 32116 - DNA, 71 bp, chicken (Gallus Gallus)
  misc_feature (36): n=a or g
tcatggttgtacaagcagaggtaagtctgcaatatnctggagaaacatcagtttttcacagtaaaaattgt

SEQ ID NO: 32117 - DNA, 71 bp, chicken (Gallus Gallus)
  misc_feature (36): n=a or g
tccaaggtctactgagtcaacagaaaggcctcaacncagctctatgaagacaaagagaagattagtagtct

SEQ ID NO: 32118 - DNA, 71 bp, chicken (Gallus Gallus)
  misc_feature (36): n=a or g
cacttgggctggcttttcctggagtgggtccagtcnggcaaggcttcctgaaaccttttccatgctttctg

SEQ ID NO: 32119 - DNA, 71 bp, chicken (Gallus Gallus)
  misc_feature (36): n=c or t
ctttgtttcaactccattcattcctcttcattcttnctgtggacacttgggcagctgatcctgacggatgt

SEQ ID NO: 32120 - DNA, 71 bp, chicken (Gallus Gallus)
  misc_feature (36): n=c or t
attattctattttctcctacacgcttgtgtaactantcaataatctttattcttgtcatgtaggattgttt

SEQ ID NO: 32121 - DNA, 71 bp, chicken (Gallus Gallus)
  misc_feature (36): n=c or t
tgacagcactcttgagatgggctctgttctgggcantgtgagctgctggcccacatgtccatgactcagca

SEQ ID NO: 32122 - DNA, 71 bp, chicken (Gallus Gallus)
  misc_feature (36): n=a or g
gaacatgagatctcatagatgagcagctgcacagtntagtcctatccgcttacaagcagtaaagacagaaa

SEQ ID NO: 32123 - DNA, 71 bp, chicken (Gallus Gallus)
  misc_feature (36): n=a or g
aatgatccaaaggaatttttgttcagttatttagantggcttcctccaccatagtgtctcttatgtttttt

SEQ ID NO: 32124 - DNA, 71 bp, chicken (Gallus Gallus)
  misc_feature (36): n=a or g
ccggaagactactcggatgtcggttaaaaaagcagngtagcaagaagattctctcagcaggaagtccaccc

SEQ ID NO: 32125 - DNA, 71 bp, chicken (Gallus Gallus)
  misc_feature (36): n=c or t
cttttgtttctaaatgtccccgacacatgaacatanacagttgttgagtttctttatatagtaggaggtga

SEQ ID NO: 32126 - DNA, 71 bp, chicken (Gallus Gallus)
  misc_feature (36): n=a or g
aagtaaagtggaactcagtggtccttgatgctgatngaagaggtagattaacagatacggatacatcagca

SEQ ID NO: 32127 - DNA, 71 bp, chicken (Gallus Gallus)
  misc_feature (36): n=c or t
gagcgtgaccatgtgcccagagacacaaacacagangaagggacacatgtgatcctgcccaaactgcactc

SEQ ID NO: 32128 - DNA, 71 bp, chicken (Gallus Gallus)
  misc_feature (36): n=a or g
tctggaagctgaatttagtaccagtggtcagcagcntactcctgatgtgagatctactttacagccagagg

SEQ ID NO: 32129 - DNA, 71 bp, chicken (Gallus Gallus)
  misc_feature (36): n=c or t
gcgtgtctttgatttccaggacttttggggaagttnctgtctaaaagctcgcatgaagtaagtcagagctc

SEQ ID NO: 32130 - DNA, 71 bp, chicken (Gallus Gallus)
  misc_feature (36): n=c or t
tcagttctgcagactacaatacagggtaggctgtcntttaagactgtaaataaaaaccatggtctctctgt

SEQ ID NO: 32131 - DNA, 71 bp, chicken (Gallus Gallus)
  misc_feature (36): n=c or t
tgtatgtaggaatgagaggaggcttttggtttctantgaggttcaacatctcaacagcagtgctgctgcca

SEQ ID NO: 32132 - DNA, 71 bp, chicken (Gallus Gallus)
  misc_feature (36): n=c or t
aaagatctgtcttaagctagttcattgctatcaaanaagaatcagagctgagatacaaaaaggacttggta

SEQ ID NO: 32133 - DNA, 71 bp, chicken (Gallus Gallus)
  misc_feature (36): n=a or g
agaagtgataggcacggaattcacaccagcctcacntatctccttatcagtgcatctatatttcaccagtg

SEQ ID NO: 32134 - DNA, 71 bp, chicken (Gallus Gallus)
  misc_feature (36): n=c or t
gagttttgcagcctgtggaagaaggtatgttgcagnactggatgttgtccttgaattcacagacagtatgt

SEQ ID NO: 32135 - DNA, 71 bp, chicken (Gallus Gallus)
  misc_feature (36): n=a or g
acaagtgttctctgattgacaaaagcatgatggacncaaccaccatcactgtgcactgtaagtcattgcat

SEQ ID NO: 32136 - DNA, 71 bp, chicken (Gallus Gallus)
  misc_feature (36): n=a or g
tatctatgccagataaaatgtcttcaggatgttttnagttttatatgtcattcatgtctgcatatttctac

SEQ ID NO: 32137 - DNA, 71 bp, chicken (Gallus Gallus)
  misc_feature (36): n=c or t
atgctacagcagaactgaccaaaagtacaaggggangtgaacgggaacatagtacaggcatcaactagaaa

SEQ ID NO: 32138 - DNA, 71 bp, chicken (Gallus Gallus)
  misc_feature (36): n=a or g
cagaatgaatttcaagtcaactactcaatctagatnaccttagtaaaaggcaaaatatagaaaatgtactg

SEQ ID NO: 32139 - DNA, 71 bp, chicken (Gallus Gallus)
  misc_feature (36): n=c or t
cttccttgtctgcatctttgtatgttttgctgtttngcaaatgcatcatttcatagacaaaccgcatacaa

SEQ ID NO: 32140 - DNA, 71 bp, chicken (Gallus Gallus)
  misc_feature (36): n=c or t
caaggtctgttcctgggcatacacctgtaagctttnagaaatgaaagactgcttaaaacaaaatcggaaca

SEQ ID NO: 32141 - DNA, 71 bp, chicken (Gallus Gallus)
  misc_feature (36): n=c or t
gttctacttagtctgcaagttttaataactattttntctcttttctggcctcatggccttcattactcctc

SEQ ID NO: 32142 - DNA, 71 bp, chicken (Gallus Gallus)
  misc_feature (36): n=c or t
ccacatactagtttttctattaaacaggaaagtgtnttttggtgtcccagtgaaatgtaatgggcgagtgc

SEQ ID NO: 32143 - DNA, 71 bp, chicken (Gallus Gallus)
  misc_feature (36): n=c or t
tctgcgccctcaccaatgtgcacaaatatgccatangataccagattaaaacagccttggaaatctggcag

SEQ ID NO: 32144 - DNA, 71 bp, chicken (Gallus Gallus)
  misc_feature (36): n=a or g
tgtacattaagttgtatgtaaacgcagttaatgggncacggtgcagagacccctgagctagcacacaaaga

SEQ ID NO: 32145 - DNA, 71 bp, chicken (Gallus Gallus)
  misc_feature (36): n=c or t
ggccagtggcacagagcagatgcattaatcacatgngatttcttcagccagatctttaggacttgcaaatc

SEQ ID NO: 32146 - DNA, 71 bp, chicken (Gallus Gallus)
  misc_feature (36): n=a or g
tcagctataagcaagtctcacttcttgagcagtgcnagttggttcagttatgagaggtagatgctgagatg

SEQ ID NO: 32147 - DNA, 71 bp, chicken (Gallus Gallus)
  misc_feature (36): n=g or t
tattcaattggattcaaaagtctgaatgtgtagatngatttaatatggtaaatttcactccatggaaaata

SEQ ID NO: 32148 - DNA, 71 bp, chicken (Gallus Gallus)
  misc_feature (36): n=c or t
gctccgtgtaatgtagcatcctgagaacctattacncacatagtatgaatagcctataatggatttcaata

SEQ ID NO: 32149 - DNA, 71 bp, chicken (Gallus Gallus)
  misc_feature (36): n=a or g
tgtaagacctctcatgcactctgcacagtcctgcangccaatgatatgaaacagcagcatttcattccact

SEQ ID NO: 32150 - DNA, 71 bp, chicken (Gallus Gallus)
  misc_feature (36): n=a or g
ttaaaatatgttacttttattaactgcatcactctnctgaaagatacctttggctctaaattgctggtgaa

SEQ ID NO: 32151 - DNA, 71 bp, chicken (Gallus Gallus)
  misc_feature (36): n=a or g
tgaggcagaaaataagcgtttttgaccattcccaanccatctgtcacttcataaaggttgcttttctaggt

SEQ ID NO: 32152 - DNA, 71 bp, chicken (Gallus Gallus)
  misc_feature (36): n=a or g
agttcagcttaggaagctgtaagagagtcgatgagnagaaagcctgccttcccaaggacagctgtttgaca

SEQ ID NO: 32153 - DNA, 71 bp, chicken (Gallus Gallus)
  misc_feature (36): n=g or t
tcacaattagtgacagttcttcactgtatgtcagcntgcagcagagctacgctctgaaaacgcgtggcaat

SEQ ID NO: 32154 - DNA, 71 bp, chicken (Gallus Gallus)
  misc_feature (36): n=c or t
ctttcacatcccttccaaactttctggtccctgcangtcctcatgaactccacaagtctagctataaaaat

SEQ ID NO: 32155 - DNA, 71 bp, chicken (Gallus Gallus)
  misc_feature (36): n=c or t
ttttttttttgaccactagattattagcttttcttntataccaagagctaatattgaccaaacactgaagc

SEQ ID NO: 32156 - DNA, 71 bp, chicken (Gallus Gallus)
  misc_feature (36): n=a or g
tcccaaccagcagtaatgtagatggcctttgctgcnccctgacagctgtgttacgaaacagcagtccttga

SEQ ID NO: 32157 - DNA, 71 bp, chicken (Gallus Gallus)
  misc_feature (36): n=a or g
tgctttatgaagcaagcactttctggatgatctgcnatgtctctgaaaatgtttcaaattttggtggctgc

SEQ ID NO: 32158 - DNA, 71 bp, chicken (Gallus Gallus)
  misc_feature (36): n=c or t
taaatacagatattttaaaaatgccgggaaacttanccaatatgaggctttacattcttaatgctacacaa

SEQ ID NO: 32159 - DNA, 71 bp, chicken (Gallus Gallus)
  misc_feature (36): n=a or g
ccttacacaattttatggttaccttattcattctcngtatttgttcttccatcacctgtgaaagttcattt

SEQ ID NO: 32160 - DNA, 71 bp, chicken (Gallus Gallus)
  misc_feature (36): n=g or t
tgtactattgccataagaagtattattctaaagtanttaaactagtattttctgctgatccagaaaagtag

SEQ ID NO: 32161 - DNA, 71 bp, chicken (Gallus Gallus)
  misc_feature (36): n=a or g
tgcagcatttcctcatagctgctatctggacagtanctggagcacacctcttgaagtgctgggaatcagaa

SEQ ID NO: 32162 - DNA, 71 bp, chicken (Gallus Gallus)
  misc_feature (36): n=a or c
ggaactaaatcacggcgcggttattcttttattgcntgggagcccgtgtgcgcggtgtggttttatggcag

SEQ ID NO: 32163 - DNA, 71 bp, chicken (Gallus Gallus)
  misc_feature (36): n=a or g
atactctctgccttttggcttaccctacactaaacnttattagtgtcccacagtcagctacatctttctga

SEQ ID NO: 32164 - DNA, 71 bp, chicken (Gallus Gallus)
  misc_feature (36): n=a or g
gtcagcagtaaaagcccagacacatccaagaaaacnttttttataggatctatcaacgtaaacttgttgcg

SEQ ID NO: 32165 - DNA, 71 bp, chicken (Gallus Gallus)
  misc_feature (36): n=a or g
cttttcagatttcatgttaaattgacattcagctcngagtagaaaatttaattaaccatcactcactggaa

SEQ ID NO: 32166 - DNA, 71 bp, chicken (Gallus Gallus)
  misc_feature (36): n=c or t
gagcacctgatatttttactgtaatcaagctatcantctccacaaagtacatgtgcatgttccagtaatat

SEQ ID NO: 32167 - DNA, 71 bp, chicken (Gallus Gallus)
  misc_feature (36): n=a or g
gagtgaataaataatttagtgatagtcaaattgcanttttagctggaaaacacttctagaatacagaaagt

SEQ ID NO: 32168 - DNA, 71 bp, chicken (Gallus Gallus)
  misc_feature (36): n=c or t
ggagtaaacttagcagtcattttccatttactctangctgaaaataatataaacttgttccagtctgggca

SEQ ID NO: 32169 - DNA, 71 bp, chicken (Gallus Gallus)
  misc_feature (36): n=a or g
agggtatggcactgactttctttagccaggacaganttatctgtaaggatggacatggtacttttagacaa

SEQ ID NO: 32170 - DNA, 71 bp, chicken (Gallus Gallus)
  misc_feature (36): n=a or g
gatgagccctcagtgtaaaatttctgctgctccagntagctgcagggtagatgacagcatacatgccccag

SEQ ID NO: 32171 - DNA, 71 bp, chicken (Gallus Gallus)
  misc_feature (36): n=a or c
tctgactcacccctggcaccatctgagcacttcttnctgtctctggtttccattatccctgggatggcatt

SEQ ID NO: 32172 - DNA, 71 bp, chicken (Gallus Gallus)
  misc_feature (36): n=a or g
tgtgtggccctactggttgcctttgctacaccaacngcaatcacctgatcccaaacctagttcaggggcta

SEQ ID NO: 32173 - DNA, 71 bp, chicken (Gallus Gallus)
  misc_feature (36): n=c or t
taaagagtcacctattttgcataaagtgaatggagntttttctcctcaaaaatatatagatgctatggatc

SEQ ID NO: 32174 - DNA, 71 bp, chicken (Gallus Gallus)
  misc_feature (36): n=a or g
aagatgccttctcccctgccttcagagctgtaaatnggttgagcttgctaggcaagacaatatgctattga

SEQ ID NO: 32175 - DNA, 71 bp, chicken (Gallus Gallus)
  misc_feature (36): n=a or g
tagtagttctatcaaatgatatttcattgtttgcanttttaccctgattattaaaggaagttcatccatca

SEQ ID NO: 32176 - DNA, 71 bp, chicken (Gallus Gallus)
  misc_feature (36): n=a or g
ctggtgtatgtgcatgtttatttgcactcattttcntagtcaaaaacattcttggcaaaggtaatttgagt

SEQ ID NO: 32177 - DNA, 71 bp, chicken (Gallus Gallus)
  misc_feature (36): n=a or g
caatctgccacgtccttctgtgttctcatttacttntctctttgtttcgctgctatcttttggtgcgtttt

SEQ ID NO: 32178 - DNA, 71 bp, chicken (Gallus Gallus)
  misc_feature (36): n=c or t
tacaaaacccatgagcatgactggcattcagaaggnactgctaagaacaattgtgtggattttccagcctt

SEQ ID NO: 32179 - DNA, 71 bp, chicken (Gallus Gallus)
  misc_feature (36): n=a or g
agttcctagaagactactcctcacttttccttaaanaagaaagggtcttcacagacacccaagttataaaa

SEQ ID NO: 32180 - DNA, 71 bp, chicken (Gallus Gallus)
  misc_feature (36): n=g or t
tacgtgcaaatgcaagatagcattttagttgtttgntttttttatacactaacctattagtaatgtcagta

SEQ ID NO: 32181 - DNA, 71 bp, chicken (Gallus Gallus)
  misc_feature (36): n=c or t
aagccgctggggagtataaaatctgtcagttctttngcaaagcaggcaaagatgtttaatatgcatatttt

SEQ ID NO: 32182 - DNA, 71 bp, chicken (Gallus Gallus)
  misc_feature (36): n=a or g
caggaatgttttaaactgacattttctcagtcttcngaatagcttccattctgcttcagcacaaggaaatg

SEQ ID NO: 32183 - DNA, 71 bp, chicken (Gallus Gallus)
  misc_feature (36): n=a or g
cagcaacagcggggccagagaagacacttttttggnggccctttaggggaaagagaggagatatgttaaaa

SEQ ID NO: 32184 - DNA, 71 bp, chicken (Gallus Gallus)
  misc_feature (36): n=g or t
ttaaatacacaaaggcatctgatagctgagaggctntgcaattctgaaaaattgtataccttttctacaag

SEQ ID NO: 32185 - DNA, 71 bp, chicken (Gallus Gallus)
  misc_feature (36): n=a or g
tttgtcactaccttcagtttccttcagccttggcanagcgtgatgaaacttcctggtggatgctaaacaca

SEQ ID NO: 32186 - DNA, 71 bp, chicken (Gallus Gallus)
  misc_feature (36): n=a or g
aaagaaacctcactaatgtcactgggagcaactctngagaaagacaatcctcaaaatgaatactgtcacaa

SEQ ID NO: 32187 - DNA, 71 bp, chicken (Gallus Gallus)
  misc_feature (36): n=a or g
ttctagctgaatgttagtagtatagagaaggcagtnaagccatcataatgcaactagtttaactcaaatct

SEQ ID NO: 32188 - DNA, 71 bp, chicken (Gallus Gallus)
  misc_feature (36): n=a or g
agagtgtctaaacaccaaagtagtttctagaaagcnttatttgaactttttcagtcttaaaatctaattca

SEQ ID NO: 32189 - DNA, 71 bp, chicken (Gallus Gallus)
  misc_feature (36): n=a or c
agcttctaaatattgtttctctttttggtgctttcngtttctgtggctcattctttaggtaatacctctgc

SEQ ID NO: 32190 - DNA, 71 bp, chicken (Gallus Gallus)
  misc_feature (36): n=c or t
aataactcatttctattatccacatggaagtggccntttggaagatggttgaactgcttctggcttgtaaa

SEQ ID NO: 32191 - DNA, 71 bp, chicken (Gallus Gallus)
  misc_feature (36): n=a or g
ctattcccttcccctggcactgagaattcttgtacntatttctggccagcagcctgggcttgcaaagtgtt

SEQ ID NO: 32192 - DNA, 71 bp, chicken (Gallus Gallus)
  misc_feature (36): n=a or g
taggattgcttggagaaatgctaaatccttcagcantcagttcatacttgctggcaggagcaggtctcctg

SEQ ID NO: 32193 - DNA, 71 bp, chicken (Gallus Gallus)
  misc_feature (36): n=a or g
aaagcagtattgtgtcctagaacaaacaaatcttcnggggttgtaaatcctcttatcctagtggttttctg

SEQ ID NO: 32194 - DNA, 71 bp, chicken (Gallus Gallus)
  misc_feature (36): n=c or t
acattattccacaaacaacaagcactgtcttattangaccttaggatactgttcccaggtaacaagcaata

SEQ ID NO: 32195 - DNA, 71 bp, chicken (Gallus Gallus)
  misc_feature (36): n=c or t
tgctggattgcagttttcagatggggttaatagagngctaggacacaaactttggtatagaaaaaacacat

SEQ ID NO: 32196 - DNA, 71 bp, chicken (Gallus Gallus)
  misc_feature (36): n=c or t
gtgacttacccctctctgccaggttgcaggtttcanggaatgatagtgctttcctctagtctgaggaaagc

SEQ ID NO: 32197 - DNA, 71 bp, chicken (Gallus Gallus)
  misc_feature (36): n=a or c
aacatgatgtatggaacttaaaatggccacagaacnaaatcctaaaaagccaagaaagatgttatttatat

SEQ ID NO: 32198 - DNA, 71 bp, chicken (Gallus Gallus)
  misc_feature (36): n=a or g
gaaagacaaaacaaattctgtaatgagttccctgtntttgtcactttgttcaactcagtaaaccatactgt

SEQ ID NO: 32199 - DNA, 71 bp, chicken (Gallus Gallus)
  misc_feature (36): n=c or t
aataatgaagaactgatggcctggcagtccttctgngctttagggcagtatttttgtgcctcttttacaag

SEQ ID NO: 32200 - DNA, 71 bp, chicken (Gallus Gallus)
  misc_feature (36): n=g or t
aggatgcagttttatttgccgaggggtaataagtantcaaaattcagcctactgagatatatgcatcaatt

SEQ ID NO: 32201 - DNA, 71 bp, chicken (Gallus Gallus)
  misc_feature (36): n=a or g
cttatttcatgactgtcacatcattactgttttaangaaacagtatctaaaactgactgtccaacttgcaa

SEQ ID NO: 32202 - DNA, 71 bp, chicken (Gallus Gallus)
  misc_feature (36): n=a or c
attttgattagaaatacaaaaattcataatcttgtntcaacttttatcagagaaattcatgctgccctatg

SEQ ID NO: 32203 - DNA, 71 bp, chicken (Gallus Gallus)
  misc_feature (36): n=c or t
taagcacacattagcagttgctcatctctacttgantgttaaaaatccaatgcagacagaagtggctgcta

SEQ ID NO: 32204 - DNA, 71 bp, chicken (Gallus Gallus)
  misc_feature (36): n=c or t
tctctgtttacaatagcatcctatccttaggtcacnaaactgtttcctctcccttttcctctcaccaagat

SEQ ID NO: 32205 - DNA, 71 bp, chicken (Gallus Gallus)
  misc_feature (36): n=a or g
ttcctaacaaaaattcaggacaactttattttaaangtgctgttgcaagactatcctcttccaaacaataa

SEQ ID NO: 32206 - DNA, 71 bp, chicken (Gallus Gallus)
  misc_feature (36): n=c or t
gaacaccttgatagctaatttatctccttaccatanttttctgcttgaaagatttattgaagatcacagaa

SEQ ID NO: 32207 - DNA, 71 bp, chicken (Gallus Gallus)
  misc_feature (36): n=c or t
ggatcctaccactccacctaccattcttcaactagngttaggagagttgctaataaagtagacatacatga

SEQ ID NO: 32208 - DNA, 71 bp, chicken (Gallus Gallus)
  misc_feature (36): n=g or t
ggctagaactagcacccttggaatttaaacctactntcactaaaatatcagtaaacaaatggcaccccctg

SEQ ID NO: 32209 - DNA, 71 bp, chicken (Gallus Gallus)
  misc_feature (36): n=a or c
caattaaacgaatttgacaatgtccttgtaataccnactatctagacttttccactgtggtaaattcctgt

SEQ ID NO: 32210 - DNA, 71 bp, chicken (Gallus Gallus)
  misc_feature (36): n=a or c
gtgcagtccgactctgcaattcatcttcttaatggnaaacacatggaaaactttgatatgtttcttcaatt

SEQ ID NO: 32211 - DNA, 71 bp, chicken (Gallus Gallus)
  misc_feature (36): n=c or t
tttgagattactatttcaagcagaaatccatagacnaaggagtactcatgggaaggggctaaaagcatcac

SEQ ID NO: 32212 - DNA, 71 bp, chicken (Gallus Gallus)
  misc_feature (36): n=c or t
aagccaggagcttaaacacattgaagcttctgcaanactctttttcttaatttaatacatcatccaaagag

SEQ ID NO: 32213 - DNA, 71 bp, chicken (Gallus Gallus)
  misc_feature (36): n=c or t
catatatttttgaggctctgcattaaaagagactantcaatatagccaaacgttaacttaatgttttccaa

SEQ ID NO: 32214 - DNA, 71 bp, chicken (Gallus Gallus)
  misc_feature (36): n=a or g
agttgtgtatagctactgctgtgtaaacaagaatgnggaaaactataggcatggaaatttggaaatgagat

SEQ ID NO: 32215 - DNA, 71 bp, chicken (Gallus Gallus)
  misc_feature (36): n=a or g
tacaggcatgaaagctgtgaatatatatttcctgcngcacagcaccatgcagctagcaatccatacctaaa

SEQ ID NO: 32216 - DNA, 71 bp, chicken (Gallus Gallus)
  misc_feature (36): n=a or g
agtgcaagccaagaaagttatgcgcttaagatcccntctctctggacatatgatagagctgtatttatagg

SEQ ID NO: 32217 - DNA, 71 bp, chicken (Gallus Gallus)
  misc_feature (36): n=g or t
caaacatgaaacaatttgtgtaaatcatacctgtanaatttcagtcctgtcctgcaactggttagggcaga

SEQ ID NO: 32218 - DNA, 71 bp, chicken (Gallus Gallus)
  misc_feature (36): n=c or t
atgaaaaagtcaatgtccaagcagctgatcataganagatatcatccagcgtaggaatcagatccatattc

SEQ ID NO: 32219 - DNA, 71 bp, chicken (Gallus Gallus)
  misc_feature (36): n=c or t
agaacagtacacattgcccttctttggtggatattntgctgaaataaatggacaacacagtgatttccaca

SEQ ID NO: 32220 - DNA, 71 bp, chicken (Gallus Gallus)
  misc_feature (36): n=c or t
agcaggccataaacagcctgccaaaatctaactcangacaagtcagaagaaatcatagtccttaaactgtg

SEQ ID NO: 32221 - DNA, 71 bp, chicken (Gallus Gallus)
  misc_feature (36): n=c or t
tatattaactcaagttggtctgggaaacaaattgtnggattctggtgactggctcagattcatacagtact

SEQ ID NO: 32222 - DNA, 71 bp, chicken (Gallus Gallus)
  misc_feature (36): n=c or t
tcttatatatgaatctaggccagaatggttgatttntttgtgtaaaatgatgtgaagtttccaagtattaa

SEQ ID NO: 32223 - DNA, 71 bp, chicken (Gallus Gallus)
  misc_feature (36): n=a or g
catgtagatatttcaaaaaatgctcatctgatgaangttgctaccaagaatacacaatacttgattctctt

SEQ ID NO: 32224 - DNA, 71 bp, chicken (Gallus Gallus)
  misc_feature (36): n=c or t
cagggattctcagagaagtagagtcccatataaaanaaccagaatctagcctcaaaaggataattaacctt

SEQ ID NO: 32225 - DNA, 71 bp, chicken (Gallus Gallus)
  misc_feature (36): n=a or g
ctgcatctctgagtttaaactcatatgagcagcacnggcttttgttgcagtgtgagaatatatatggcata

SEQ ID NO: 32226 - DNA, 71 bp, chicken (Gallus Gallus)
  misc_feature (36): n=g or t
taagatggagacattctcccatcagcttttgcagtntgatatgactctgttccttcacaccgtttcagcca

SEQ ID NO: 32227 - DNA, 71 bp, chicken (Gallus Gallus)
  misc_feature (36): n=c or t
cttctgcaggggcgacagcaagaccacacagctttnatgactgttagcgacactttgaagcaggtggaatg

SEQ ID NO: 32228 - DNA, 71 bp, chicken (Gallus Gallus)
  misc_feature (36): n=c or t
aaccaggtcctttagctgccttaaggaaagtcacantgaaggaagctaatgggcattactttggcagtaag

SEQ ID NO: 32229 - DNA, 71 bp, chicken (Gallus Gallus)
  misc_feature (36): n=c or t
ctaaggcagtagatcccagagagttctagatttctnccagataactacaacaaaggacactagaaatccaa

SEQ ID NO: 32230 - DNA, 71 bp, chicken (Gallus Gallus)
  misc_feature (36): n=a or g
tttttaagatgctaaactaagatttagaagctccancaatcttctgaggaggtgggatgggagcgtcagga

SEQ ID NO: 32231 - DNA, 71 bp, chicken (Gallus Gallus)
  misc_feature (36): n=g or t
tttcatatccatttaattcgatgataaaaatacctntgtatcaattaatcatttcttacctgtgttcccat

SEQ ID NO: 32232 - DNA, 71 bp, chicken (Gallus Gallus)
  misc_feature (36): n=c or t
tgctcacactctcatcatcactaaattcacctgatngataaggtcttcctcccatgctagaatttccatcc

SEQ ID NO: 32233 - DNA, 71 bp, chicken (Gallus Gallus)
  misc_feature (36): n=c or t
tagtgtaatctttttgccttacccctgtaagtcagnagtgcttcatccaggaactctgcagctggatggaa

SEQ ID NO: 32234 - DNA, 71 bp, chicken (Gallus Gallus)
  misc_feature (36): n=a or g
caccacaactattcctgaaaaaataactttcagtcncattcatttgaagaagagtacattgcactgcattc

SEQ ID NO: 32235 - DNA, 71 bp, chicken (Gallus Gallus)
  misc_feature (36): n=a or g
tcacagacagacatttttccatttgtgtgtcattcntgtcaatcttggtttctatcacaggtctctgcagt

SEQ ID NO: 32236 - DNA, 71 bp, chicken (Gallus Gallus)
  misc_feature (36): n=c or t
gggctcagtccttagagatgccactggattttcccngaaaacttatatctttttctccatacttctggata

SEQ ID NO: 32237 - DNA, 71 bp, chicken (Gallus Gallus)
  misc_feature (36): n=c or t
ccttctgaatgatgacttcccagtgccaaactctcnctagtgcatgggcacttactgtccttactggtgga

SEQ ID NO: 32238 - DNA, 71 bp, chicken (Gallus Gallus)
  misc_feature (36): n=a or g
cttagagtaattgctgctggagttggggaaattgcnacaggggtgaatttggcctcgagtacgtaagctct

SEQ ID NO: 32239 - DNA, 71 bp, chicken (Gallus Gallus)
  misc_feature (36): n=g or t
ttgtggaactgtgtcagagattgcagaggactctgnatgtctgtggacagcttgaatctgctcaccagcgt

SEQ ID NO: 32240 - DNA, 71 bp, chicken (Gallus Gallus)
  misc_feature (36): n=a or g
aacaataaatcttggttagattctaaattaagtggntttgcatctgtgtagatgagatgaagagattctct

SEQ ID NO: 32241 - DNA, 71 bp, chicken (Gallus Gallus)
  misc_feature (36): n=c or t
catttccaaaatcagtatttaaatatgcctccttcngtgaccactttggagatgtttgatgggctttggcc

SEQ ID NO: 32242 - DNA, 71 bp, chicken (Gallus Gallus)
  misc_feature (36): n=c or t
gagatgagggatctgctgcttctgtaatgttcttcngtaaggtatagaaaaggagaccaacactcatctga

SEQ ID NO: 32243 - DNA, 71 bp, chicken (Gallus Gallus)
  misc_feature (36): n=a or g
aactgtttaagagaatcatttggaggaggagcaggnataacagaagccttttcccttgagtaagcttgact

SEQ ID NO: 32244 - DNA, 71 bp, chicken (Gallus Gallus)
  misc_feature (36): n=a or g
atgataccagcatgctttggtgtccttttccgtgcntattccacagcatctgtgattgctctgtaacgatc

SEQ ID NO: 32245 - DNA, 71 bp, chicken (Gallus Gallus)
  misc_feature (36): n=c or t
agagcacagggcatggtccctgcagtgggattgtcnggctctcagtgtatgaagactgatatccttcctaa

SEQ ID NO: 32246 - DNA, 71 bp, chicken (Gallus Gallus)
  misc_feature (36): n=a or g
gttaagctcacatcactttgataaatcacataatgncattttgttaagctgtcagacaactagatcagtgt

SEQ ID NO: 32247 - DNA, 71 bp, chicken (Gallus Gallus)
  misc_feature (36): n=g or t
tagcgagggtcagtggcgcaggtcagcaggaatggngacagactgtttgtgatttgcagaaccaggtgctc

SEQ ID NO: 32248 - DNA, 71 bp, chicken (Gallus Gallus)
  misc_feature (36): n=a or g
gcttcttgctgcaggaaatactttgcaacaagctgntgtggaaaataactcactgaggggagaaaaaaatt

SEQ ID NO: 32249 - DNA, 71 bp, chicken (Gallus Gallus)
  misc_feature (36): n=c or t
atctgatctgtgatttccttagggcaatatatcatngaaaagatgaatactaaagtaaaaaatcagaattg

SEQ ID NO: 32250 - DNA, 71 bp, chicken (Gallus Gallus)
  misc_feature (36): n=c or t
attaattcaaacttaacatcagtgattaatgagtgnaatgatgaaaaatgaaatcgtataagtgctcaaaa

SEQ ID NO: 32251 - DNA, 71 bp, chicken (Gallus Gallus)
  misc_feature (36): n=a or g
gacatttctcccgttattttaattctcatgcatggnaagtgttagatatcaacccccttctcctcctagtt

SEQ ID NO: 32252 - DNA, 71 bp, chicken (Gallus Gallus)
  misc_feature (36): n=a or c
aataataaaaccactatttgcaggggagtcagtagntgtgacatacatggcttttaaatagaaacagtggg

SEQ ID NO: 32253 - DNA, 71 bp, chicken (Gallus Gallus)
  misc_feature (36): n=c or t
tacagttgtagaggtatgactgttccagtagcattngtatgtgtaaatagcattttacagttatgaccacc

SEQ ID NO: 32254 - DNA, 71 bp, chicken (Gallus Gallus)
  misc_feature (36): n=c or t
agatgatcccagggaagttatagggttctcagtccnatgaaagcagtgaagatgcttctagatgcaagtcc

SEQ ID NO: 32255 - DNA, 71 bp, chicken (Gallus Gallus)
  misc_feature (36): n=c or t
gcattaagctgtgttaatgttcgagtgtatttgttnagtctttgttaactttctgaaactggagatgctcc

SEQ ID NO: 32256 - DNA, 71 bp, chicken (Gallus Gallus)
  misc_feature (36): n=c or t
gcctcttgaagagaactacaaatcagcctcatttcntcctcctgagaatcgttagatcatttgttacaaga

SEQ ID NO: 32257 - DNA, 71 bp, chicken (Gallus Gallus)
  misc_feature (36): n=c or t
ttatcttgagtcacctaagactccttgagatccctncaagctgtacaattcatggacaaatactaattctt

SEQ ID NO: 32258 - DNA, 71 bp, chicken (Gallus Gallus)
  misc_feature (36): n=c or t
ctcagtaaagtcattaaggggaaaaactcaagatcnttagacctacagaaccaaagggtttgtcttcagtt

SEQ ID NO: 32259 - DNA, 71 bp, chicken (Gallus Gallus)
  misc_feature (36): n=g or t
gtgacatctagtggatatggctctaaataccagcanctcaaaggcattgaaagcctcttgaaatacgtcag

SEQ ID NO: 32260 - DNA, 71 bp, chicken (Gallus Gallus)
  misc_feature (36): n=c or t
ttttggataaggtaagcaatataattatactctgcnctctgaatgactttgatgttttgatctttccagaa

SEQ ID NO: 32261 - DNA, 71 bp, chicken (Gallus Gallus)
  misc_feature (36): n=a or g
tcttttttaaatctaaactcaatttctgttaatacnttatctccttttcagatgatagctatctgcctcta

SEQ ID NO: 32262 - DNA, 71 bp, chicken (Gallus Gallus)
  misc_feature (36): n=a or g
tcttccagaatagactttattttgattttgactccngattctgtttttacatgacaaaatcaccatgtact

SEQ ID NO: 32263 - DNA, 71 bp, chicken (Gallus Gallus)
  misc_feature (36): n=c or t
cagcactcagcagcagcccaccagcagcctttcagngcttcaggttgaattgccactcaggtatagctgct

SEQ ID NO: 32264 - DNA, 71 bp, chicken (Gallus Gallus)
  misc_feature (36): n=a or c
atctctgctggctgtaacaaagtctttgacaacatncaagatatttcaaactgagaaaagcacaatatatt

SEQ ID NO: 32265 - DNA, 71 bp, chicken (Gallus Gallus)
  misc_feature (36): n=c or t
atacttgataatattacaagattacgtaatccaagngtctagagttaaagactaaaaccaaggggcactct

SEQ ID NO: 32266 - DNA, 71 bp, chicken (Gallus Gallus)
  misc_feature (36): n=a or g
ttctaagagaatttctgattttttagtgattgatcncattcttttgatttccttcttctttcactttctct

SEQ ID NO: 32267 - DNA, 71 bp, chicken (Gallus Gallus)
  misc_feature (36): n=c or t
cctacacagagtggttagagcatcaaatgtacatantctggcagtagtggggaagctgttaattaacagag

SEQ ID NO: 32268 - DNA, 71 bp, chicken (Gallus Gallus)
  misc_feature (36): n=c or t
gtcattccctgactggtctgctcacattcagagccntggagtcattgctcagcctctcaggtacacgtagc

SEQ ID NO: 32269 - DNA, 71 bp, chicken (Gallus Gallus)
  misc_feature (36): n=c or t
atggaacaggtagacaagaaatgaagcctgagtgangagtaattcagttatgtttagctgtgatttcataa

SEQ ID NO: 32270 - DNA, 71 bp, chicken (Gallus Gallus)
  misc_feature (36): n=a or g
gattgtatagggaccccttaacttacttcattacanattgacaacatcattgccagcgtattttgtttaac

SEQ ID NO: 32271 - DNA, 71 bp, chicken (Gallus Gallus)
  misc_feature (36): n=a or c
ctcttcataattctttcttgtaaaatggaactatgntatagttcagtggtagctatactcgtaatcagaat

SEQ ID NO: 32272 - DNA, 71 bp, chicken (Gallus Gallus)
  misc_feature (36): n=c or t
acactccaattcaaattattagggaaggggacatgntagaacttcatactacatttttcttgtaattcatt

SEQ ID NO: 32273 - DNA, 71 bp, chicken (Gallus Gallus)
  misc_feature (36): n=a or g
aaaagcatcataatcctcccactatgtaactgtacngcaaaggaaagagaccatggatggcacatgtatga

SEQ ID NO: 32274 - DNA, 71 bp, chicken (Gallus Gallus)
  misc_feature (36): n=g or t
cattccttgaaagaagtagcagtatttacaggtcancttattagtaacaagcaacatggaatgcctggtgt

SEQ ID NO: 32275 - DNA, 71 bp, chicken (Gallus Gallus)
  misc_feature (36): n=g or t
taaaaggggagaacacaaaccagcatttattaattngaacacttttaacctaagtatacagtgtcaatgct

SEQ ID NO: 32276 - DNA, 71 bp, chicken (Gallus Gallus)
  misc_feature (36): n=a or c
gcatggaagcctgccaagactggcacaaaattagtnatgttatcttcttcccaatagtggtagccaccaca

SEQ ID NO: 32277 - DNA, 71 bp, chicken (Gallus Gallus)
  misc_feature (36): n=c or t
tgtgcttgtgcagatcatatttggcttcagcttganagactgatgaagaatagcagttcttctctgagcat

SEQ ID NO: 32278 - DNA, 71 bp, chicken (Gallus Gallus)
  misc_feature (36): n=a or g
tccacagggagtaacagagactttggccaaacaacnaaggaaagtgagcacaagttgctctaggttagatg

SEQ ID NO: 32279 - DNA, 71 bp, chicken (Gallus Gallus)
  misc_feature (36): n=c or t
ctgagttcttaacaatatatttcccggatctatagnttcattatgtacattagatgtggaagttatatcgc

SEQ ID NO: 32280 - DNA, 71 bp, chicken (Gallus Gallus)
  misc_feature (36): n=a or c
caagttttcaggagaaaatattgacatttggtttgnaaagtaaatggtgtaacaggttcattaacatgatt

SEQ ID NO: 32281 - DNA, 71 bp, chicken (Gallus Gallus)
  misc_feature (36): n=g or t
taatcacatgcatctaaagaactttaatctgtcacngcaagcttatcctaaattttacaaaccatttccag

SEQ ID NO: 32282 - DNA, 71 bp, chicken (Gallus Gallus)
  misc_feature (36): n=c or t
aaagacttggagaaatcccaataatgtcttactcangtctttgctatagtctactgtgatgttgtcctttt

SEQ ID NO: 32283 - DNA, 71 bp, chicken (Gallus Gallus)
  misc_feature (36): n=c or t
agctgtgcttgtgttagtgctctcacagaggttacnggtgtttaaaacttcccataggcaggagctttaac

SEQ ID NO: 32284 - DNA, 71 bp, chicken (Gallus Gallus)
  misc_feature (36): n=c or t
caagggctgctctgaaagatgaagtagactcaattngtggagtttgacaagcgtctattctgaaaaaagaa

SEQ ID NO: 32285 - DNA, 71 bp, chicken (Gallus Gallus)
  misc_feature (36): n=g or t
gctcaaacctatgccattccctgaagtttccagagntagaagaatggtacactaactcactatcatactgt

SEQ ID NO: 32286 - DNA, 71 bp, chicken (Gallus Gallus)
  misc_feature (36): n=g or t
caaggcaataaagacataacattctgataagttttngttcaaggagtgtcactgaagaaaaccatacatta

SEQ ID NO: 32287 - DNA, 71 bp, chicken (Gallus Gallus)
  misc_feature (36): n=t or c
accgtgaaagcatttttccttccactggtgtaaggngattttcattagtcacattttactgaggagaacct

SEQ ID NO: 32288 - DNA, 71 bp, chicken (Gallus Gallus)
  misc_feature (36): n=c or t
ggttgcacactaaagcttctcttctgtttttggatnttgtaaacgtgttcttaaatttaatagaaacaaaa

SEQ ID NO: 32289 - DNA, 71 bp, chicken (Gallus Gallus)
  misc_feature (36): n=a or g
atctgcttctttccaaacattgctttaaaatctttncaagcatgttaaactttttgaaaggttatttttaa

SEQ ID NO: 32290 - DNA, 71 bp, chicken (Gallus Gallus)
  misc_feature (36): n=c or t
ctgtgtatgtgtacagatgtaccacgtcctttcccnagaaacgtggtagtgtgctcttcaccagtgggtga

SEQ ID NO: 32291 - DNA, 71 bp, chicken (Gallus Gallus)
  misc_feature (36): n=a or g
ccatgataacatcaaaagagacatctaaatcaagantttaagttagtactgatttggagactgtttggacc

SEQ ID NO: 32292 - DNA, 71 bp, chicken (Gallus Gallus)
  misc_feature (36): n=a or g
gtgaaatagatgtctgtctaacctctgtggattttntatgggatgaaaggagtaactttattaataagtca

SEQ ID NO: 32293 - DNA, 71 bp, chicken (Gallus Gallus)
  misc_feature (36): n=a or c
ttgatagacaaggataaaaatggattctatccatanaggtaacaagctgcagcaagaggtaacacaaaggt

SEQ ID NO: 32294 - DNA, 71 bp, chicken (Gallus Gallus)
  misc_feature (36): n=a or g
aaattcagacttttggcttaaggatctagctatcanttactactgttacgtgagaaatactgtacatgatt

SEQ ID NO: 32295 - DNA, 71 bp, chicken (Gallus Gallus)
  misc_feature (36): n=c or t
tggtagcagtaagtaaagtataagttgaaccctaangagatttttcagggaaaaaaaaaagattagttgtg

SEQ ID NO: 32296 - DNA, 71 bp, chicken (Gallus Gallus)
  misc_feature (36): n=a or g
tgctgcctgcaatcagtttgtactttcattaacaantgaccataagggaaaactagggtatagtgaataaa

SEQ ID NO: 32297 - DNA, 71 bp, chicken (Gallus Gallus)
  misc_feature (36): n=c or t
tgcttctctaagctgtgctttattatccagctttcnaagcatttgcaagatcggcactaaacacagaaaca

SEQ ID NO: 32298 - DNA, 71 bp, chicken (Gallus Gallus)
  misc_feature (36): n=c or t
cacacctgtatggcatataggaatgggtagctatantttagaggaattatatttcaagtacatattattag

SEQ ID NO: 32299 - DNA, 71 bp, chicken (Gallus Gallus)
  misc_feature (36): n=a or g
tgcaaagggcttatggaaatgatctcttcaccagtnttttctggaagaatggtgattgtgtgagattgcat

SEQ ID NO: 32300 - DNA, 71 bp, chicken (Gallus Gallus)
  misc_feature (36): n=g or t
atcatgtcaatgcatacgttaaagggttaattaaanttatgtgaactttaagacagaatttgctcaagttc

SEQ ID NO: 32301 - DNA, 71 bp, chicken (Gallus Gallus)
  misc_feature (36): n=c or t
gggcattgtataggatttgacagtgctgatatatantggaacattgtgagcacaggggacagaggttaaag

SEQ ID NO: 32302 - DNA, 71 bp, chicken (Gallus Gallus)
  misc_feature (36): n=a or g
tggaagataacgttctgtttctttgaaatttgatgnaagggacattatgctttggaaagaatgaatgtatc

SEQ ID NO: 32303 - DNA, 71 bp, chicken (Gallus Gallus)
  misc_feature (36): n=g or t
gttgtttctatttgacttaggtaggaacatactttnagaagcagaaatacttgcagtttcattcagatact

SEQ ID NO: 32304 - DNA, 71 bp, chicken (Gallus Gallus)
  misc_feature (36): n=g or t
ttactgctgtccgttgctgtctttcccccatctggnactttcaattttgtcactgcttaacaactccaaat

SEQ ID NO: 32305 - DNA, 71 bp, chicken (Gallus Gallus)
  misc_feature (36): n=c or t
ctgtgggagggtgatgctgtggcctttttgtctgtntgctaaggtattctctggaggaaaacttagagatg

SEQ ID NO: 32306 - DNA, 71 bp, chicken (Gallus Gallus)
  misc_feature (36): n=c or t
gcatataaaatgactggatgcctctatgttagacantgcaaagcccagttctgcctggcacagaggtctaa

SEQ ID NO: 32307 - DNA, 71 bp, chicken (Gallus Gallus)
  misc_feature (36): n=c or t
aatcacttacagtatctgtagtttcacttaatcttngcagaaattgcagttgaacagttttcaagcagaaa

SEQ ID NO: 32308 - DNA, 71 bp, chicken (Gallus Gallus)
  misc_feature (36): n=a or g
tgcaagagcttcattttagcaaaatcacagataatnataacttccatctttggatagactgttcataaaca

SEQ ID NO: 32309 - DNA, 71 bp, chicken (Gallus Gallus)
  misc_feature (36): n=c or t
gtttacaggccacagtcttctgacatttgaaaaccnaggtaaaaaagtgagggccaggaacaaaacatgac

SEQ ID NO: 32310 - DNA, 71 bp, chicken (Gallus Gallus)
  misc_feature (36): n=a or g
tagtaaaaaatctgtgtgcctaatactgtgtgctgnacgtgaccttattaacttcaattctgcatcccgat

SEQ ID NO: 32311 - DNA, 71 bp, chicken (Gallus Gallus)
  misc_feature (36): n=a or c
cggcggagttgtgccacatctcacacacattcctcncttctctgtactaggctggcagctgaatcaggctc

SEQ ID NO: 32312 - DNA, 71 bp, chicken (Gallus Gallus)
  misc_feature (36): n=c or t
cacatgcattggcagtcctctgttcatgcagataanggtttcaatctggacctcattctacccaggaagcc

SEQ ID NO: 32313 - DNA, 71 bp, chicken (Gallus Gallus)
  misc_feature (36): n=a or g
ctgagttttctgtagataataaagtctttcagttgngtttatatctataataaatatatgcagtgcctcag

SEQ ID NO: 32314 - DNA, 71 bp, chicken (Gallus Gallus)
  misc_feature (36): n=g or t
gttagtctcttgcttgctgagttgaacagaacaacntttcctaatcttctatcataagataaggtcatctg

SEQ ID NO: 32315 - DNA, 71 bp, chicken (Gallus Gallus)
  misc_feature (36): n=a or g
tacttcagtaacacagttcatctaattcaaaactcnatccagagattgtgaggtgttatcctgaatggtag

SEQ ID NO: 32316 - DNA, 71 bp, chicken (Gallus Gallus)
  misc_feature (36): n=c or t
aatccaaaatttaggttttatttccctgttgatacngtttctctttcgttttcaataggtttgtcaacttc

SEQ ID NO: 32317 - DNA, 71 bp, chicken (Gallus Gallus)
  misc_feature (36): n=c or t
agcagatcaattaacacacgattacctgttttacanggttcttttatggatcattagtttttttaagaata

SEQ ID NO: 32318 - DNA, 71 bp, chicken (Gallus Gallus)
  misc_feature (36): n=c or t
taagcaattattaacttgccacattgtgactgctantgaatgaagaatcataataaactttgttataccac

SEQ ID NO: 32319 - DNA, 71 bp, chicken (Gallus Gallus)
  misc_feature (36): n=a or c
aagctaaattcctcctgacatatcatcttttgcctnagcattacgtaaaatgtcttatcattttcatagct

SEQ ID NO: 32320 - DNA, 71 bp, chicken (Gallus Gallus)
  misc_feature (36): n=c or t
ttggaccaactgaaaataaggattgcatagattttngccataccagctttcaagtggtgcaactgatgttt

SEQ ID NO: 32321 - DNA, 71 bp, chicken (Gallus Gallus)
  misc_feature (36): n=a or g
accttgttttgttgttatagactctgtcctcttccngcagagtatttcagtgtatcagtgtataaatagcc

SEQ ID NO: 32322 - DNA, 71 bp, chicken (Gallus Gallus)
  misc_feature (36): n=a or g
cctttctggtgcaatttggtcctgaatgctgaaggngagttagtgagtgttaaggtttttttgtcttaaga

SEQ ID NO: 32323 - DNA, 71 bp, chicken (Gallus Gallus)
  misc_feature (36): n=a or g
aaacaacaaaaaagctacgctctttccctgagctanacaaatcagaatacatttacttttcaaatagaaac

SEQ ID NO: 32324 - DNA, 71 bp, chicken (Gallus Gallus)
  misc_feature (36): n=a or g
cagagcccaaaggtagggatatgctgggctttatgnacacaaactatatgattacaaaacaagttgactat

SEQ ID NO: 32325 - DNA, 71 bp, chicken (Gallus Gallus)
  misc_feature (36): n=a or g
aggccacctagtccaggccacctataaattggagcnagacagtatggaagggaatatatatgctatgagaa

SEQ ID NO: 32326 - DNA, 71 bp, chicken (Gallus Gallus)
  misc_feature (36): n=a or g
attttctatgtcattatgtaggcataacagttactntttacatttaatgttcatatctatattgcttggat

SEQ ID NO: 32327 - DNA, 71 bp, chicken (Gallus Gallus)
  misc_feature (36): n=g or t
taagagtaaaagtgtaagcagcctccacgtgcttanaaagttcctgcatcctgcaggactgtagatcctga

SEQ ID NO: 32328 - DNA, 71 bp, chicken (Gallus Gallus)
  misc_feature (36): n=a or g
tgaaggctttaaagaatgtatcagtgttgctctggnttcatcatctcctctaatgtgaatatttgacaaaa

SEQ ID NO: 32329 - DNA, 71 bp, chicken (Gallus Gallus)
  misc_feature (36): n=c or t
tttgacatgcatggcagggatttacagaattattcncctgggaagtaaggaagtggaaatacagattgctt

SEQ ID NO: 32330 - DNA, 71 bp, chicken (Gallus Gallus)
  misc_feature (36): n=c or t
ctggttgatgtggtgcataagttgaggagtttatanatgtctaaatatgattccctgaattcagtggatat

SEQ ID NO: 32331 - DNA, 71 bp, chicken (Gallus Gallus)
  misc_feature (36): n=a or c
tagattgccataaagaataacaaaagtattggattntgatttcctctcagagctttacaatttacaattac

SEQ ID NO: 32332 - DNA, 71 bp, chicken (Gallus Gallus)
  misc_feature (36): n=a or c
agactagagaagtccagttactcaagtgttgggaanaaaagagatgagaatgaccttccttgtaggttggt

SEQ ID NO: 32333 - DNA, 71 bp, chicken (Gallus Gallus)
  misc_feature (36): n=c or t
gacacaccatgtagtttagtattccctacccatganaagttcaattatatgagagaaatcctttctcctcc

SEQ ID NO: 32334 - DNA, 71 bp, chicken (Gallus Gallus)
  misc_feature (36): n=c or t
ggtgtcctacttacctaacaggaaatctcggctttnagtagcaatgtccagaggtcagatggaatgcctca

SEQ ID NO: 32335 - DNA, 71 bp, chicken (Gallus Gallus)
  misc_feature (36): n=a or g
gaccctaccttatcacatattgacaaaatatcatcntcaaactctcctgggacattatagaaattgcctat

SEQ ID NO: 32336 - DNA, 71 bp, chicken (Gallus Gallus)
  misc_feature (36): n=c or t
tcctactgccacataggacacataggaggtgcagancagtttttttttgtttgttttttcatagttaggct

SEQ ID NO: 32337 - DNA, 71 bp, chicken (Gallus Gallus)
  misc_feature (36): n=g or t
aattctgtccatgacaaattttcctcttgaagaggnatctccttttgaagtacatttagaattccagaatc

SEQ ID NO: 32338 - DNA, 71 bp, chicken (Gallus Gallus)
  misc_feature (36): n=c or t
tatgaggctgtaactgatttgactctttaaaagcangtgaagacatttataggatcccacttttatcagcc

SEQ ID NO: 32339 - DNA, 71 bp, chicken (Gallus Gallus)
  misc_feature (36): n=a or g
aattccagaggcagaattgcgtggtttggctgcatnttggttcccttcatggtggtgctgctcatgctttg

SEQ ID NO: 32340 - DNA, 71 bp, chicken (Gallus Gallus)
  misc_feature (36): n=a or c
gaattactgatgtttactggtttattgaaaataccnaatttcactttacatgcaaatcttctctaatccct

SEQ ID NO: 32341 - DNA, 71 bp, chicken (Gallus Gallus)
  misc_feature (36): n=a or g
gttctgctttattagttatgtatgacaagccaaatnatagtttcttctccctatccctgacattattgccc

SEQ ID NO: 32342 - DNA, 71 bp, chicken (Gallus Gallus)
  misc_feature (36): n=c or t
ccatggagaaaaccagattccagacactaaatcccnttgcagtggatagccagtaatctgttgtcttcttt

SEQ ID NO: 32343 - DNA, 71 bp, chicken (Gallus Gallus)
  misc_feature (36): n=a or g
cttttttctttccttgcaattagacagaatgatacnttgcttcagcaaatcctatgggaaggactgcttca

SEQ ID NO: 32344 - DNA, 71 bp, chicken (Gallus Gallus)
  misc_feature (36): n=g or t
ctcatcacactggatatagctgttttactatgtttncttgcccttttgtacttacagaaatactacttcaa

SEQ ID NO: 32345 - DNA, 71 bp, chicken (Gallus Gallus)
  misc_feature (36): n=a or g
ggttggttggtttttagggttttgtggagacagaantgctaattggaccaaagacagcccttacactttgg

SEQ ID NO: 32346 - DNA, 71 bp, chicken (Gallus Gallus)
  misc_feature (36): n=c or t
gaactagaaattggaatttgtaatgctagaggatantcataattatgtgctcagcagaagcatctctttta

SEQ ID NO: 32347 - DNA, 71 bp, chicken (Gallus Gallus)
  misc_feature (36): n=a or g
tccaaaacagaaataagcccacagaatgggtagaancattcaccatctaggatgatcctgcctatcacaaa

SEQ ID NO: 32348 - DNA, 71 bp, chicken (Gallus Gallus)
  misc_feature (36): n=a or g
atcagccacagtgtgctggatctcagtatttaatgngggtaatggtgatttgcaggcagctggaaaaagga

SEQ ID NO: 32349 - DNA, 71 bp, chicken (Gallus Gallus)
  misc_feature (36): n=a or c
gtaatgttcctttttccaaacaaggccactgcagcntgagcgcatgagtagctacataggtaaaatactga

SEQ ID NO: 32350 - DNA, 71 bp, chicken (Gallus Gallus)
  misc_feature (36): n=a or g
tctcctttttctctattgggtagtcaaggcatcacnttttgttgtcctcttccaaggcatacccttttgaa

SEQ ID NO: 32351 - DNA, 71 bp, chicken (Gallus Gallus)
  misc_feature (36): n=a or g
ttcagctaataaaaacagatgcattctggaaagaancatgaagggttttctatgatgcatgtattttgtag

SEQ ID NO: 32352 - DNA, 71 bp, chicken (Gallus Gallus)
  misc_feature (36): n=g or t
aaagttagggtttatgtgaagtactcagtacaattntaggcgaagagatcactgttcatagaatcataaaa

SEQ ID NO: 32353 - DNA, 71 bp, chicken (Gallus Gallus)
  misc_feature (36): n=a or g
aaagcagacagacataaacaagaaccttccttaagntgctcatttctaatcttcataatcacgaaacattt

SEQ ID NO: 32354 - DNA, 71 bp, chicken (Gallus Gallus)
  misc_feature (36): n=a or g
atgaatcatttgcaaaggaattgtcagcttcttagnactgacagcaaatctgaatcagtactttcagttgt

SEQ ID NO: 32355 - DNA, 71 bp, chicken (Gallus Gallus)
  misc_feature (36): n=a or g
ttcctaggagcagttactgacctgaagtggttttantgctttttaaatgccaatcctaaacaacacattct

SEQ ID NO: 32356 - DNA, 71 bp, chicken (Gallus Gallus)
  misc_feature (36): n=c or t
agagcacagctctcctggtactgctttttttaactncaagctgtacttggtacaggctgttcattgtacac

SEQ ID NO: 32357 - DNA, 71 bp, chicken (Gallus Gallus)
  misc_feature (36): n=a or c
ctctctttcgtattaactcttatctatcatttatcntgaatcattctcatttgatttttgaaagaaaaacc

SEQ ID NO: 32358 - DNA, 71 bp, chicken (Gallus Gallus)
  misc_feature (36): n=c or t
ttttggaaagtaaaaagtttcagagtttagcaggtntaacagtgaaacatattcataagcagaaactagca

SEQ ID NO: 32359 - DNA, 71 bp, chicken (Gallus Gallus)
  misc_feature (36): n=g or t
ttaaggcagaggccagatattttattcataagccanatgcatggtagttacattatactctaccttaaatt

SEQ ID NO: 32360 - DNA, 71 bp, chicken (Gallus Gallus)
  misc_feature (36): n=c or t
agtgtgttaagaaaacatgtagttctggtgtcactntatctattgagagagcaagctgtgttttctatttc

SEQ ID NO: 32361 - DNA, 71 bp, chicken (Gallus Gallus)
  misc_feature (36): n=c or t
tgacactaagaactcctaccagaagtcctgctgtcnttgaggaccttttccttggagaaagcccttttaat

SEQ ID NO: 32362 - DNA, 71 bp, chicken (Gallus Gallus)
  misc_feature (36): n=g or t
aaaaacagtgagaaaaagggctaaaatgaccatttngggctcttggtggtttaggggtgtttttagggttt

SEQ ID NO: 32363 - DNA, 71 bp, chicken (Gallus Gallus)
  misc_feature (36): n=c or t
ggatttcacagtgacagtaaaattacttcagttcanatttagtagagaccacaggtacataaaagacactc

SEQ ID NO: 32364 - DNA, 71 bp, chicken (Gallus Gallus)
  misc_feature (36): n=c or t
gatttcttgatgatagcagcagctgtttattatagncgtgttgggagagaggactgcctgtccctctgcta

SEQ ID NO: 32365 - DNA, 71 bp, chicken (Gallus Gallus)
  misc_feature (36): n=a or g
tctctctcatgttgtttcctgtttttgtatcattcngacaatgccttgaatacatccaattgctaattata

SEQ ID NO: 32366 - DNA, 71 bp, chicken (Gallus Gallus)
  misc_feature (36): n=a or g
gtcaggttatgagacacttacaaactgagccataangttcagagtggatttccaaagtaaagcacagaaat

SEQ ID NO: 32367 - DNA, 71 bp, chicken (Gallus Gallus)
  misc_feature (36): n=c or t
gcacagttcatctcagggctctatatagtctctganatacatcaagtaaaaactctttttttgacacttca

SEQ ID NO: 32368 - DNA, 71 bp, chicken (Gallus Gallus)
  misc_feature (36): n=c or t
agtttataatcatcatgtggtgattgtatctctatnactttccagacaaagcaagatggaaaggcactaac

SEQ ID NO: 32369 - DNA, 71 bp, chicken (Gallus Gallus)
  misc_feature (36): n=a or c
atcagaaagtacttactcattgaagccaaacactgncactttttgagtagctcaagacagttctttatgaa

SEQ ID NO: 32370 - DNA, 71 bp, chicken (Gallus Gallus)
  misc_feature (36): n=a or g
ttttttttccatttcttactagtacacgcctcccangccaggtgtagactacaggcaatcctagaacaagt

SEQ ID NO: 32371 - DNA, 71 bp, chicken (Gallus Gallus)
  misc_feature (36): n=c or t
gtggaaagacccacagctttaatggcaataactaanatttaagtgatgcaagtttcaatgcatcctagctc

SEQ ID NO: 32372 - DNA, 71 bp, chicken (Gallus Gallus)
  misc_feature (36): n=c or t
taagctacagaacacaagttcttttatcagtctccngagggtcggtaatatggaaatacaaagcactgaaa

SEQ ID NO: 32373 - DNA, 71 bp, chicken (Gallus Gallus)
  misc_feature (36): n=c or t
atttggtttagactccaaacaatcatttagttcatngatatagtgctgacactgctttcacattcatttct

SEQ ID NO: 32374 - DNA, 71 bp, chicken (Gallus Gallus)
  misc_feature (36): n=g or t
aaagactaggaaagtagagaagagataggaaaaagnaatcaccacctatattaagcttcaaataaatcaga

SEQ ID NO: 32375 - DNA, 71 bp, chicken (Gallus Gallus)
  misc_feature (36): n=c or t
ccactccagcacgcatatacagtcacacatgttccngaacacatgacatatgagttgaactccacattctg

SEQ ID NO: 32376 - DNA, 71 bp, chicken (Gallus Gallus)
  misc_feature (36): n=a or g
tgaactaagagagaaagtccagtcagaacaacaggngatgaacatacagctgtgtggtttctggaaaagga

SEQ ID NO: 32377 - DNA, 71 bp, chicken (Gallus Gallus)
  misc_feature (36): n=c or t
aactaagtgctaaatctgtagtaacatggttagttncatttgttagaagttattgacttagactgagggaa

SEQ ID NO: 32378 - DNA, 71 bp, chicken (Gallus Gallus)
  misc_feature (36): n=a or g
cctcttcctagaaaaacagcaagttaaaatgagaanattctcagctgttagtaaattgctttacttcatgc

SEQ ID NO: 32379 - DNA, 71 bp, chicken (Gallus Gallus)
  misc_feature (36): n=a or c
acaattttactgctgagtaccatgataaccacatanaaatgaacacagagtccagtgcttccttgtattgt

SEQ ID NO: 32380 - DNA, 71 bp, chicken (Gallus Gallus)
  misc_feature (36): n=a or g
ggctactcagaggaagtggcaaatgtatcattttcnagactgcagtagaaactaaatctatattttcacag

SEQ ID NO: 32381 - DNA, 71 bp, chicken (Gallus Gallus)
  misc_feature (36): n=g or t
agtcttgtaaaaagtccatatgacttctttattctnctgatgctatcaagtgcaagaaatgagtttccttt

SEQ ID NO: 32382 - DNA, 71 bp, chicken (Gallus Gallus)
  misc_feature (36): n=c or t
tatatcatgctgacttctgactattccatctctagngccaaattactttagaacatgatcatctcatttag

SEQ ID NO: 32383 - DNA, 71 bp, chicken (Gallus Gallus)
  misc_feature (36): n=c or t
ataaaggttagaagacaacaaaagaacaagcactangctagtcaaatggagatgatgtttaacagtaaata

SEQ ID NO: 32384 - DNA, 71 bp, chicken (Gallus Gallus)
  misc_feature (36): n=a or c
caaaggcttccttcaataacataaatagtgataaantaatggagttgacagtgttgacttggttcagtatc

SEQ ID NO: 32385 - DNA, 71 bp, chicken (Gallus Gallus)
  misc_feature (36): n=a or g
aaaaggagcaggaaactggttcactgtttctcaatntgtagcagaggggtcatggaaaaagttacagatgg

SEQ ID NO: 32386 - DNA, 71 bp, chicken (Gallus Gallus)
  misc_feature (36): n=c or t
tgtccatctccctgatagcaaaggactacaatttcnagcatgtggcacagcctaatttcagatgtcagcct

SEQ ID NO: 32387 - DNA, 71 bp, chicken (Gallus Gallus)
  misc_feature (36): n=c or t
attatatacacagcttcttcaccagaacaggtaaanagggacaaattaagaagtgagaaatagaaatcaaa

SEQ ID NO: 32388 - DNA, 71 bp, chicken (Gallus Gallus)
  misc_feature (36): n=a or c
taatcatgcaggtaataaaaatgcagaggttaaaanagtagttgaccatataaataaacatctaaccttat

SEQ ID NO: 32389 - DNA, 71 bp, chicken (Gallus Gallus)
  misc_feature (36): n=a or c
aagacaaagtcttagtttgggtactgaactggctantgatgtcatctaggttctaccatatagctaaatcc

SEQ ID NO: 32390 - DNA, 71 bp, chicken (Gallus Gallus)
  misc_feature (36): n=c or t
tccactcactctgctatgagagtgacagaacactantatactaccttttcgcacaaaacaatgtccagcaa

SEQ ID NO: 32391 - DNA, 71 bp, chicken (Gallus Gallus)
  misc_feature (36): n=g or t
tctgtgaaattttcattaaattcctggggtaatcantcagatatttggggaaagaacagggtcattgcaga

SEQ ID NO: 32392 - DNA, 71 bp, chicken (Gallus Gallus)
  misc_feature (36): n=c or t
cccttgttccagactactgtaatcctgatttgtaancctttttattctgttatgttctttccaccatgaag

SEQ ID NO: 32393 - DNA, 71 bp, chicken (Gallus Gallus)
  misc_feature (36): n=c or t
gaagaagaagccttaaaacattaaacagtttaaaanagtatgcagctctgtactcaaccaatcctgttgat

SEQ ID NO: 32394 - DNA, 71 bp, chicken (Gallus Gallus)
  misc_feature (36): n=a or c
tcatgtcagcagatgctcagcaactcatggagctantcgtaaacatcaacctgttgtggtcagcacctttt

SEQ ID NO: 32395 - DNA, 71 bp, chicken (Gallus Gallus)
  misc_feature (36): n=c or t
tcttgaatgattgtgctgtgtataggtctgctggantgcatcaataccttcttacagccaataattcatcc

SEQ ID NO: 32396 - DNA, 71 bp, chicken (Gallus Gallus)
  misc_feature (36): n=c or t
ctattttaaattatttatgctgcagtaattccatgncagcatacacagcagtttagcttccttaaaagtat

SEQ ID NO: 32397 - DNA, 71 bp, chicken (Gallus Gallus)
  misc_feature (36): n=c or t
agcttggaaagcagaaactggggtaaaaatgtccangatgaatgtcatttagatctgctgggcaacaagac

SEQ ID NO: 32398 - DNA, 71 bp, chicken (Gallus Gallus)
  misc_feature (36): n=c or t
acagagtgcctgaatccaaaacaccaattttcaaangttcagtttgaatggcttccttgttctttaggtgc

SEQ ID NO: 32399 - DNA, 71 bp, chicken (Gallus Gallus)
  misc_feature (36): n=a or g
aaggcaagtgatgtattttggaattgggcatccacntaaataatgaaggaagtaatgtcaggatttctgag

SEQ ID NO: 32400 - DNA, 71 bp, chicken (Gallus Gallus)
  misc_feature (36): n=c or t
ctcacttctctaagaatcacatgcagagagctattnggtatgttcacatgttcatacagatttcatgaagt

SEQ ID NO: 32401 - DNA, 71 bp, chicken (Gallus Gallus)
  misc_feature (36): n=a or c
aatcattttctttgttagtcatcctttgttctcagncaccaaaaaactttggcttttctagaaatgtttcc

SEQ ID NO: 32402 - DNA, 71 bp, chicken (Gallus Gallus)
  misc_feature (36): n=a or g
agagctctgtgtataggtactggcaccgcatgtagntacagaatctggacctctgttcagtcttctaattt

SEQ ID NO: 32403 - DNA, 71 bp, chicken (Gallus Gallus)
  misc_feature (36): n=a or g
caaaacaaagcccctgaaagataaacaagtgcggcncgggaataagtctttccattaataaacacttacca

SEQ ID NO: 32404 - DNA, 71 bp, chicken (Gallus Gallus)
  misc_feature (36): n=c or t
ctccttttttactcctttttactaggatttagcatngtatgagaaatagtggaaggttaaagttgtgttga

SEQ ID NO: 32405 - DNA, 71 bp, chicken (Gallus Gallus)
  misc_feature (36): n=a or g
gtctggagcggagtgcctaatcttttggtcttcctntatgtctgtatgtattttgatatttaagtaatgtc

SEQ ID NO: 32406 - DNA, 71 bp, chicken (Gallus Gallus)
  misc_feature (36): n=c or t
tctgccacgggggttatggaatactgcttgtaacgnatcttccatgcttgatgtagcattctttggagcat

SEQ ID NO: 32407 - DNA, 71 bp, chicken (Gallus Gallus)
  misc_feature (36): n=a or g
tacaatgacatttctgtgacaaagtcaacttgggangagttggaacgggactcttttggtggttatagaaa

SEQ ID NO: 32408 - DNA, 71 bp, chicken (Gallus Gallus)
  misc_feature (36): n=a or g
ggatctcggtttatctgtggaccattgactaattcnatttaaatacataaaagttggttatcctcaggaaa

SEQ ID NO: 32409 - DNA, 71 bp, chicken (Gallus Gallus)
  misc_feature (36): n=g or t
tggtcccagactccttcaggtctgggccctgattcntcctattcagctcaacatgaaaaccttgagccttt

SEQ ID NO: 32410 - DNA, 71 bp, chicken (Gallus Gallus)
  misc_feature (36): n=c or t
aaaagctgctttattagcacagcaacagaattaaanactaacacgttgacagtaacattagaaataagttt

SEQ ID NO: 32411 - DNA, 71 bp, chicken (Gallus Gallus)
  misc_feature (36): n=g or t
ttgacatgcaattctacaaaaagaaatacgaggagntttttgtgttcattgtcagagtagatatggggtat

SEQ ID NO: 32412 - DNA, 71 bp, chicken (Gallus Gallus)
  misc_feature (36): n=g or t
actgtagtgaccttgaagagaaagagcttggaattnggtccttctgctagtgttggatatccgtcgaagca

SEQ ID NO: 32413 - DNA, 71 bp, chicken (Gallus Gallus)
  misc_feature (36): n=g or t
tcaaaagtgcagagtgctgagaatctgtttttaatnataaacatatgaaggcaagtccatagaattcggct

SEQ ID NO: 32414 - DNA, 71 bp, chicken (Gallus Gallus)
  misc_feature (36): n=a or g
atcactgtttttctgactgttctcttaaatgctgtnactgtgatcacttttgagtattgacactgtttgaa

SEQ ID NO: 32415 - DNA, 71 bp, chicken (Gallus Gallus)
  misc_feature (36): n=c or t
ctcatgctgctgctaggaaaatacctttcctgaaantgccctgtttattttcctgcccttacaacatatcc

SEQ ID NO: 32416 - DNA, 71 bp, chicken (Gallus Gallus)
  misc_feature (36): n=c or t
ttttttcttttcccagatgggtggattttggttctngcatttcccaggtcatagatgcttgagatttttca

SEQ ID NO: 32417 - DNA, 71 bp, chicken (Gallus Gallus)
  misc_feature (36): n=a or c
aaaaagtaacaaaacccataacttatggttcaaacnaggctttgggaaaatactctctattgggatggtgg

SEQ ID NO: 32418 - DNA, 71 bp, chicken (Gallus Gallus)
  misc_feature (36): n=a or g
caacgcacagctctgaacagtgtaatctgcactctncgatcttttcattggaaactggctgcactggattt

SEQ ID NO: 32419 - DNA, 71 bp, chicken (Gallus Gallus)
  misc_feature (36): n=a or g
aaattgggaaaaacacttccagaatttcacacatanaagttgctatgggctgctgcaaacagtggaatatg

SEQ ID NO: 32420 - DNA, 71 bp, chicken (Gallus Gallus)
  misc_feature (36): n=a or g
ctgctatcaattattttttagcaatttataaagggngtgaagaaaagacatgcactagtacatgtaacctc

SEQ ID NO: 32421 - DNA, 71 bp, chicken (Gallus Gallus)
  misc_feature (36): n=g or t
gtagcatgtgccaccggatggtgaattcttattatnataattaagaaaaagctgtcctcttgagcttacct

SEQ ID NO: 32422 - DNA, 71 bp, chicken (Gallus Gallus)
  misc_feature (36): n=c or t
ttctcctttcattttgaaccacattccttttagctncagaaaaatacatctcaaactagaaatggatcata

SEQ ID NO: 32423 - DNA, 71 bp, chicken (Gallus Gallus)
  misc_feature (36): n=a or g
actaaacaagtggagcatgtagtgaaagagcatagnatttaacattcacttagatattttgtatgatccca

SEQ ID NO: 32424 - DNA, 71 bp, chicken (Gallus Gallus)
  misc_feature (36): n=a or g
aagctgatcaagtcttaaagttgtgcacagttctgngatgggacatatactaaggatgaagccagagtatc

SEQ ID NO: 32425 - DNA, 71 bp, chicken (Gallus Gallus)
  misc_feature (36): n=a or g
atatatatcacatatagagtaaatataaagctatanttatttctgtgtccaaggtgcatttttaatagtgc

SEQ ID NO: 32426 - DNA, 71 bp, chicken (Gallus Gallus)
  misc_feature (36): n=c or t
tccgttgtctaggatgctatttcttacctagaggtntgtagacaagttcacaagattttaaaagttcatgc

SEQ ID NO: 32427 - DNA, 71 bp, chicken (Gallus Gallus)
  misc_feature (36): n=c or t
acaaaaaacatatttgcatttgaaccttgctacatnatgtattcatagaggatatttcaaatcttaattca

SEQ ID NO: 32428 - DNA, 71 bp, chicken (Gallus Gallus)
  misc_feature (36): n=a or c
agaagaacacaagctgaaagcattcaaaactgtttnattaccactgccacatgatcacgctgatttactct

SEQ ID NO: 32429 - DNA, 71 bp, chicken (Gallus Gallus)
  misc_feature (36): n=c or t
acacatggtagaataactgttcaaggtagatatttngtctattggtttccatcctaggtttagtttcataa

SEQ ID NO: 32430 - DNA, 71 bp, chicken (Gallus Gallus)
  misc_feature (36): n=c or t
aggacctccatattctctgctgtcctttttttatangaccataagacactctgggaaaattctggcttgca

SEQ ID NO: 32431 - DNA, 71 bp, chicken (Gallus Gallus)
  misc_feature (36): n=g or t
ggccacccctcacacagcctttaactctacacaccnagtattactggttcctaaattggaaagtgtgtcac

SEQ ID NO: 32432 - DNA, 71 bp, chicken (Gallus Gallus)
  misc_feature (36): n=c or t
cttttcttttccccagcataatatttatccaaagcnattttgtttcctgttacagtcaacaagctatcaca

SEQ ID NO: 32433 - DNA, 71 bp, chicken (Gallus Gallus)
  misc_feature (36): n=a or g
ttaaaaaaactccttaaattaagtagatagtctacngtgttggcaattgtaaagcataaaaaacttcctgt

SEQ ID NO: 32434 - DNA, 71 bp, chicken (Gallus Gallus)
  misc_feature (36): n=g or t
gttgtagttgaggttggccgtcacaaagtagagcgngaccaccagcaggtgggcagagcaggtggagaagg

SEQ ID NO: 32435 - DNA, 71 bp, chicken (Gallus Gallus)
  misc_feature (36): n=a or g
ttaattttgaagacagcaaaaaattctacttttacntactcaaaaatgaatagcttgtccttacagacatt

SEQ ID NO: 32436 - DNA, 71 bp, chicken (Gallus Gallus)
  misc_feature (36): n=g or t
aaaatttgcatctgaattctcagtaggataagcatncagatatgtttctctacatcccatttcttttccta

SEQ ID NO: 32437 - DNA, 71 bp, chicken (Gallus Gallus)
  misc_feature (36): n=a or g
tcatcacccagtcaggtcgtaatcgaccgaactctnaagtcagcatgcacccagcccttccacgggcactc

SEQ ID NO: 32438 - DNA, 71 bp, chicken (Gallus Gallus)
  misc_feature (36): n=a or g
caactcaagatgccagcactactactactataagcnctggtcccatattaatgagtgtggactgaacaccc

SEQ ID NO: 32439 - DNA, 71 bp, chicken (Gallus Gallus)
  misc_feature (36): n=c or t
cctcacatcaagaacacagttcagagcattccagcngcttacaactattgctgcaaactgacagtccagac

SEQ ID NO: 32440 - DNA, 71 bp, chicken (Gallus Gallus)
  misc_feature (36): n=a or g
caggaaaattacatcatctgatattgtcacttccanatggttttaagctttctttaatttagccttatgtt

SEQ ID NO: 32441 - DNA, 71 bp, chicken (Gallus Gallus)
  misc_feature (36): n=c or t
ttgctttgtcaatcccacaacccatctaaagacatntctgttactgcccagaatatcaatgtaatagcttg

SEQ ID NO: 32442 - DNA, 71 bp, chicken (Gallus Gallus)
  misc_feature (36): n=c or t
gcgtggggacagggaaggggggctgtgtgtcgtccnccactccgtaattaccacttttcgttattcctctc

SEQ ID NO: 32443 - DNA, 71 bp, chicken (Gallus Gallus)
  misc_feature (36): n=g or t
ataaaaggtctgttcaccaattttccaaaacagttntgttggacactgcaattacagtctcgagcacatct

SEQ ID NO: 32444 - DNA, 71 bp, chicken (Gallus Gallus)
  misc_feature (36): n=c or t
aaatgtacatacaggagttttggctcaatagatacngaaatatcaaattagttaaatttgctcgctgaatt

SEQ ID NO: 32445 - DNA, 71 bp, chicken (Gallus Gallus)
  misc_feature (36): n=a or g
gtacaggtagaagcagacattttgggtgggccacangttaggcacaggcgctgaatgttcgaggttagttg

SEQ ID NO: 32446 - DNA, 71 bp, chicken (Gallus Gallus)
  misc_feature (36): n=c or t
tggcataatgtcactgcagcaggggttttacatttntctccagtcaccagagaaatgggtatcagagggca

SEQ ID NO: 32447 - DNA, 71 bp, chicken (Gallus Gallus)
  misc_feature (36): n=c or t
cctgttctttcagtattaattcttgtatatcacctncagtgttagcttgaaggtggttaggaattacaact

SEQ ID NO: 32448 - DNA, 71 bp, chicken (Gallus Gallus)
  misc_feature (36): n=a or g
ataatatcacaaatatgttgcttgtatgatgcatcnttttcccccatctccctcaatctaaatattctctg

SEQ ID NO: 32449 - DNA, 71 bp, chicken (Gallus Gallus)
  misc_feature (36): n=a or g
attaggaaatgcttttactaagaggcctggcacttnacaacattgactcataatatagaggagaaaaaaag

SEQ ID NO: 32450 - DNA, 71 bp, chicken (Gallus Gallus)
  misc_feature (36): n=a or g
agtattggatacaagtacacaagcaaattagcttcntttacagcagtgaagctgcatctattttagaaaac

SEQ ID NO: 32451 - DNA, 71 bp, chicken (Gallus Gallus)
  misc_feature (36): n=c or t
acaaaaacttataaacaggtgaacagacagcatagntatgcttcaagctttattcttcgaaaaggaatata

SEQ ID NO: 32452 - DNA, 71 bp, chicken (Gallus Gallus)
  misc_feature (36): n=a or c
ggataagctgttatttagacatccagaagctgctanaggtatagcaaggttacaggactgagaacggaaac

SEQ ID NO: 32453 - DNA, 71 bp, chicken (Gallus Gallus)
  misc_feature (36): n=c or t
taaacaaagtaaattgtttcggcattcccacaaaangttgatatttataaaatccaccggaggtaatttaa

SEQ ID NO: 32454 - DNA, 71 bp, chicken (Gallus Gallus)
  misc_feature (36): n=a or g
tattccctgaaattcaccccagtcagcatcaagtanttttgatgaaagtatggtaagacaaacgtttcatt

SEQ ID NO: 32455 - DNA, 71 bp, chicken (Gallus Gallus)
  misc_feature (36): n=a or g
aataattctctatatgccgagttttaagctgcaacncaaaagcctccgaaagtacacaaggcaggactcct

SEQ ID NO: 32456 - DNA, 71 bp, chicken (Gallus Gallus)
  misc_feature (36): n=g or t
gaggacaatacatatagaggaatagaaaagtaaaancttgtctgctagttatgttcacaaacatcaagaat

SEQ ID NO: 32457 - DNA, 71 bp, chicken (Gallus Gallus)
  misc_feature (36): n=a or g
cacaggtattggacaaacacatgatcaggtttcccngttttgagagtgatttagaaaagcacaaaaacatt

SEQ ID NO: 32458 - DNA, 71 bp, chicken (Gallus Gallus)
  misc_feature (36): n=a or g
cagtgctaagacctgtgtcatgctggtaaaggtcanagactcctgaagactgttgcaacttagatgagcca

SEQ ID NO: 32459 - DNA, 71 bp, chicken (Gallus Gallus)
  misc_feature (36): n=a or g
gaggataattattccttacttagcattacaaaaacnaagtgctgttccgtgtgtctgggcatgctgtgcac

SEQ ID NO: 32460 - DNA, 71 bp, chicken (Gallus Gallus)
  misc_feature (36): n=a or g
taattagtgtgagaatttttattctggccagagtanttaacttcatcattcgttggaaagaattctgtatt

SEQ ID NO: 32461 - DNA, 71 bp, chicken (Gallus Gallus)
  misc_feature (36): n=a or c
tttaagatttggagcaaaggggaattttggtgaaancacctatagagagaattacatatttgttgctggaa

SEQ ID NO: 32462 - DNA, 71 bp, chicken (Gallus Gallus)
  misc_feature (36): n=c or t
cttcaccccccgatgtcactttaatctgtttcttanaatcgagaaagcttcttgtcagtgtctaaaattcc

SEQ ID NO: 32463 - DNA, 71 bp, chicken (Gallus Gallus)
  misc_feature (36): n=a or g
tctgtagagcaggcagcttaggaaagagaaaactcnagaagaaaagagcaaaaagagtttaggtaagaaat

SEQ ID NO: 32464 - DNA, 71 bp, chicken (Gallus Gallus)
  misc_feature (36): n=c or t
ttacttttagctgtcccttatttaagatgtctaatntgaggaatacattgaccccaacaggtattagtaac

SEQ ID NO: 32465 - DNA, 71 bp, chicken (Gallus Gallus)
  misc_feature (36): n=c or t
acagaagttttaaacactgagggtgaaaattgttcngagtatttggcaagtgggcaaagataacaaaatat

SEQ ID NO: 32466 - DNA, 71 bp, chicken (Gallus Gallus)
  misc_feature (36): n=a or g
atttctgatctactatttctgatagtagacaaatgnttttcttcatcagttttcaaagttgtgctgctttt

SEQ ID NO: 32467 - DNA, 71 bp, chicken (Gallus Gallus)
  misc_feature (36): n=a or g
gccattccagaggtgactggaagtgctccatgagcnccttctggcttacagagtgatatccaatatctcat

SEQ ID NO: 32468 - DNA, 71 bp, chicken (Gallus Gallus)
  misc_feature (36): n=c or t
caaagtaaagattcccatcgtcctggtggctttctntgatgtccagcagagcagatcccttgtacatatgg

SEQ ID NO: 32469 - DNA, 71 bp, chicken (Gallus Gallus)
  misc_feature (36): n=c or t
gatttgattccccaatcacttttgcatttttatgcnttgagttggagatggcagattttagaagctgaatt

SEQ ID NO: 32470 - DNA, 71 bp, chicken (Gallus Gallus)
  misc_feature (36): n=c or t
tgtgcttttgtatcactcgttggcacctatgacatnggaaattctatgagtaacattttttttgcctttct

SEQ ID NO: 32471 - DNA, 71 bp, chicken (Gallus Gallus)
  misc_feature (36): n=c or t
tactgaagaggcatgactcaacctctgcaaccccangtgcagaactgtggaattgcctcataggttgtgtt

SEQ ID NO: 32472 - DNA, 71 bp, chicken (Gallus Gallus)
  misc_feature (36): n=g or t
ctctctgaaccacagcacagcacatccccaacaacntttgttaagtgaacatcagcaacacagtttggtct

SEQ ID NO: 32473 - DNA, 71 bp, chicken (Gallus Gallus)
  misc_feature (36): n=c or t
ttgcagcagagtttcacatcctgattctgtctcctnttcagccagcactgtggttttaatggatgtttttt

SEQ ID NO: 32474 - DNA, 71 bp, chicken (Gallus Gallus)
  misc_feature (36): n=c or t
ttactttctaaaaatacagtgctttgcaatttatgncatgcatgtgtgtttaaatgtagttcctgcccccc

SEQ ID NO: 32475 - DNA, 71 bp, chicken (Gallus Gallus)
  misc_feature (36): n=a or g
gcacaaatatagatgtgccccagctgtccttgagcngcacactacttgagtgtcaccaggacgaacgccat

SEQ ID NO: 32476 - DNA, 71 bp, chicken (Gallus Gallus)
  misc_feature (36): n=c or t
ttttcctctactaaactatttctgttgtaaagtccncattgtgaacctgtctaaatgcaacgcaagtgggt

SEQ ID NO: 32477 - DNA, 71 bp, chicken (Gallus Gallus)
  misc_feature (36): n=c or t
gtatctcagttagcatcattgagagcaagcgtttanggtatctgtgaattcttttgctataaattgttttc

SEQ ID NO: 32478 - DNA, 71 bp, chicken (Gallus Gallus)
  misc_feature (36): n=a or g
actccttgtatttctttagaactcattcattaaagnattttgccccttatttagctccttgctggtcttac

SEQ ID NO: 32479 - DNA, 71 bp, chicken (Gallus Gallus)
  misc_feature (36): n=a or g
attgctgtttatctccaacaaagggcacttatctcngtgcagcactggatgctgctgtcacattttctgtt

SEQ ID NO: 32480 - DNA, 71 bp, chicken (Gallus Gallus)
  misc_feature (36): n=a or g
tgtctcagatgaaaaagcaaattcccaccagatgcntgtgttatctcatacatataactcttactccaacc

SEQ ID NO: 32481 - DNA, 71 bp, chicken (Gallus Gallus)
  misc_feature (36): n=a or g
caccaagatgcattacagtgttccattttccgctcnttttaggtcaagtggaagcttcttttttcagtttt

SEQ ID NO: 32482 - DNA, 71 bp, chicken (Gallus Gallus)
  misc_feature (36): n=a or g
taaagagagagagctaaactcacttgcaggcatagngacgcactacttttgtccaacaacatgaagacacg

SEQ ID NO: 32483 - DNA, 71 bp, chicken (Gallus Gallus)
  misc_feature (36): n=a or g
agagatgtgtgaactaaacatgtcttcatatccaancgttcagcattggctaatagggtcaacagaagcag

SEQ ID NO: 32484 - DNA, 71 bp, chicken (Gallus Gallus)
  misc_feature (36): n=a or g
aactaacgggagatgttaaggcttggtccagccacnttgtggtcattaggaggagggagctacacaaatgt

SEQ ID NO: 32485 - DNA, 71 bp, chicken (Gallus Gallus)
  misc_feature (36): n=a or c
gaatgagtctggctcaggacagaagagtatactacncaaaacagtcttctataaacaagcacgtacaggag

SEQ ID NO: 32486 - DNA, 71 bp, chicken (Gallus Gallus)
  misc_feature (36): n=c or t
gaataaaaccccagatactgtcacagcccatcagtngggtacacttcagatgtaccattccatgaaaatca

SEQ ID NO: 32487 - DNA, 71 bp, chicken (Gallus Gallus)
  misc_feature (36): n=c or t
tgctctatcagaaatattcattgcttcttatgttgnttttttgacactgactttgtggaaactgtctttca

SEQ ID NO: 32488 - DNA, 71 bp, chicken (Gallus Gallus)
  misc_feature (36): n=c or t
accaagagaacaagatacccgaagtccttttgttcntcccttggatactgctgctagcagcctcgcatgaa

SEQ ID NO: 32489 - DNA, 71 bp, chicken (Gallus Gallus)
  misc_feature (36): n=g or t
gccagattgtaaataaagtacagcctttctttgtantgttcatatatttaaggttacctttaggcaaagac

SEQ ID NO: 32490 - DNA, 71 bp, chicken (Gallus Gallus)
  misc_feature (36): n=a or g
ctgcttttaattaccagataggatttacaaatcagnaacgtaacataagcacacagcttttttttatcctt

SEQ ID NO: 32491 - DNA, 71 bp, chicken (Gallus Gallus)
  misc_feature (36): n=c or t
atgggtatgttttgagagttcaggtttgtgtatttncagctacatatcacttatactttcaaatcttgaag

SEQ ID NO: 32492 - DNA, 71 bp, chicken (Gallus Gallus)
  misc_feature (36): n=g or t
gctgtttgtgctccagaaaaggcagacactacactntgctttgtagcatatggcataaatttagctgacat

SEQ ID NO: 32493 - DNA, 71 bp, chicken (Gallus Gallus)
  misc_feature (36): n=c or t
ccaagattatgacttcctctttgatggctgtgttantcttgattaaccgattttggtgggggtattgtagt

SEQ ID NO: 32494 - DNA, 71 bp, chicken (Gallus Gallus)
  misc_feature (36): n=g or t
aaatgggaatgatgcttgcacgtatcagctgggatnttgttcgtttgcatctcataattatcagtcttcca

SEQ ID NO: 32495 - DNA, 71 bp, chicken (Gallus Gallus)
  misc_feature (36): n=c or t
agaaatctagaataaggattctgtaaaaggtggaanaaagtttggtttctttgtcaggcaccatgtactgc

SEQ ID NO: 32496 - DNA, 71 bp, chicken (Gallus Gallus)
  misc_feature (36): n=c or t
cagtagcacatgcaggcatgcataactacatgggtncaggatgcatttctcagggattctttttttctttc

SEQ ID NO: 32497 - DNA, 71 bp, chicken (Gallus Gallus)
  misc_feature (36): n=c or t
actgaagtatattctaacctacttgagaaggttttnttctcagaaggataactgctaatcactaaaaactt

SEQ ID NO: 32498 - DNA, 71 bp, chicken (Gallus Gallus)
  misc_feature (36): n=c or t
tacaatttaatttcttagagcttgaatgcttacatnatccaaaatgcattgagatttgttttgatatgatt

SEQ ID NO: 32499 - DNA, 71 bp, chicken (Gallus Gallus)
  misc_feature (36): n=g or t
gatcccatcgacctacaagagatttgcagcctaaanagggggaagaggagcctacagattcctagagcaca

SEQ ID NO: 32500 - DNA, 71 bp, chicken (Gallus Gallus)
  misc_feature (36): n=a or g
ttatagtgatgtgattaacatgcatcatctcatcanttgcaccataaaatgaaatggaaacatggctttct

SEQ ID NO: 32501 - DNA, 71 bp, chicken (Gallus Gallus)
  misc_feature (36): n=a or c
atctttgtcacttaaggaaatgaacaggtttaagtngacgtgtaaaggaaatactgagatgggaaagctaa

SEQ ID NO: 32502 - DNA, 71 bp, chicken (Gallus Gallus)
  misc_feature (36): n=c or t
gccatgctcaatttgtatacctgtttttaaggaaangttgctaagcacctatataagaaaattgaaaacca

SEQ ID NO: 32503 - DNA, 71 bp, chicken (Gallus Gallus)
  misc_feature (36): n=c or t
aagtttattttcaattaagaagtggatatgagcctngcacagagggacatttaatttcctgctctggggag

SEQ ID NO: 32504 - DNA, 71 bp, chicken (Gallus Gallus)
  misc_feature (36): n=a or g
cagagagttttggtctctgtggaacgactagaagtnccaatctgatcagaatttgatctctccataaatgg

SEQ ID NO: 32505 - DNA, 71 bp, chicken (Gallus Gallus)
  misc_feature (36): n=a or g
aaggggctgttcacaatgcaggttttcagctggtgntataagtttgatctgaatcaagagacgctgcacaa

SEQ ID NO: 32506 - DNA, 71 bp, chicken (Gallus Gallus)
  misc_feature (36): n=a or g
ctttgccaccgtcagaggtttgcaatttctccatcncagttttgagataaaagagtaatttcagtttgtct

SEQ ID NO: 32507 - DNA, 71 bp, chicken (Gallus Gallus)
  misc_feature (36): n=c or t
agtattgctacagaaatgtgccaacgtcctgtatangtatccattctgctttccactcctgttcaggaaaa

SEQ ID NO: 32508 - DNA, 71 bp, chicken (Gallus Gallus)
  misc_feature (36): n=g or t
tgggtaacaattcttagagcttctttatgttcaagngactctttcttcctctcgtctcttgttttggaaat

SEQ ID NO: 32509 - DNA, 71 bp, chicken (Gallus Gallus)
  misc_feature (36): n=c or t
catatacattgcaggggtgataagcttgggatattntgaattctgggggaggccttcataatttctttaaa

SEQ ID NO: 32510 - DNA, 71 bp, chicken (Gallus Gallus)
  misc_feature (36): n=a or g
ttctgtaaccagtgtgaagctgtatgtcaaggtatnactaggctgagctaatcaagattgtgttgtataga

SEQ ID NO: 32511 - DNA, 71 bp, chicken (Gallus Gallus)
  misc_feature (36): n=g or t
tatttgtgtatgtttgaatttatatggcttttattnggggaaaaaaagcctcatagaatatagattcctgg

SEQ ID NO: 32512 - DNA, 71 bp, chicken (Gallus Gallus)
  misc_feature (36): n=a or g
gtggcgcaatgtttaactagtagcagcattttgacnctcctgatccaggcctgctagaaccatccatgttg

SEQ ID NO: 32513 - DNA, 71 bp, chicken (Gallus Gallus)
  misc_feature (36): n=c or t
acagatctcacagcagtgccgacatgcagtctgaangatctacttgtgtttccaagtataaaccaattagc

SEQ ID NO: 32514 - DNA, 71 bp, chicken (Gallus Gallus)
  misc_feature (36): n=c or t
tcttctcattgcctggtctggtttccttttctgtcncaggacagaattacacagtccttttcttcctctag

SEQ ID NO: 32515 - DNA, 71 bp, chicken (Gallus Gallus)
  misc_feature (36): n=g or t
acaacaattattaatgtaattaagcttagttatctntgtagattagcagaatggtgcatttagtacagcat

SEQ ID NO: 32516 - DNA, 71 bp, chicken (Gallus Gallus)
  misc_feature (36): n=c or t
attgcatttagagaaattccaatggaagtgttgcanaactgggactgattgggtgtatttgtggtcttgga

SEQ ID NO: 32517 - DNA, 71 bp, chicken (Gallus Gallus)
  misc_feature (36): n=a or g
agcacttcttgtacagtcttttctgaatatgtaggnaaaccttgcagagcctttaaagctgcagaacgtta

SEQ ID NO: 32518 - DNA, 71 bp, chicken (Gallus Gallus)
  misc_feature (36): n=c or t
ctggagctctgaagcattggccttgatttggatccngagaagttaccgcacagaagtgtcatgttcgttaa

SEQ ID NO: 32519 - DNA, 71 bp, chicken (Gallus Gallus)
  misc_feature (36): n=a or g
atgaaaaaatagaaaaacagagcaacctctttggtntgattgtctcccagtgtacagacatctttgcatct

SEQ ID NO: 32520 - DNA, 71 bp, chicken (Gallus Gallus)
  misc_feature (36): n=a or g
aaatgtttttgttgttaccttcttaagactcacacntttcttggttatttccttatttaaaaatcatcatc

SEQ ID NO: 32521 - DNA, 71 bp, chicken (Gallus Gallus)
  misc_feature (36): n=a or g
attattcctataaactgaggtgtgtcttacgggtcnagtaaggaggaatgatgaatctgattgggttggca

SEQ ID NO: 32522 - DNA, 71 bp, chicken (Gallus Gallus)
  misc_feature (36): n=a or g
actggcagtttgagggtagcgatcatgggaagtagnaagttggcctgtaacacttttttactggtaaagat

SEQ ID NO: 32523 - DNA, 71 bp, chicken (Gallus Gallus)
  misc_feature (36): n=c or t
ttagtgtggggcataggtttgcatacagggttttcnactgtaattctcaccctgtggaatagattttttta

SEQ ID NO: 32524 - DNA, 71 bp, chicken (Gallus Gallus)
  misc_feature (36): n=g or t
tcatagcccagaatttgagcttgatccagtctgctnctttagtggcactgtatcagggactcaatggaatg

SEQ ID NO: 32525 - DNA, 71 bp, chicken (Gallus Gallus)
  misc_feature (36): n=g or t
tcgttctttcctgttcctcctggcttaggctcgggnctatcaagcatactaccaccctcatcaccaggatt

SEQ ID NO: 32526 - DNA, 71 bp, chicken (Gallus Gallus)
  misc_feature (36): n=c or t
agtgtacacatatgcaattaggacagaactgcaggnttttatgtcaaaatattagtgaacagacaaaacaa

SEQ ID NO: 32527 - DNA, 71 bp, chicken (Gallus Gallus)
  misc_feature (36): n=a or g
ataagatcgatagcaatgtgtactgggcttattctntataagacacaggtagcaaaagtaatattagaaaa

SEQ ID NO: 32528 - DNA, 71 bp, chicken (Gallus Gallus)
  misc_feature (36): n=c or t
cctgttatgctatttccaagcctgcattaacgctgngtgttttcattatgttccagagagatggcagacaa

SEQ ID NO: 32529 - DNA, 71 bp, chicken (Gallus Gallus)
  misc_feature (36): n=a or g
ataggtatgcacaatttcatagcaaatgcaaatacntactttaaatgtgatgtaaagacagtggatcgcat

SEQ ID NO: 32530 - DNA, 71 bp, chicken (Gallus Gallus)
  misc_feature (36): n=c or t
gtttccttcttatttttttaagccagacccagagantgaaaagtttcagactaatggctaccttaaggtaa

SEQ ID NO: 32531 - DNA, 71 bp, chicken (Gallus Gallus)
  misc_feature (36): n=a or g
gtccaaccattaggacagaagcaacacttccttacnaacaatttttgttagagacttcgttgcaatcttca

SEQ ID NO: 32532 - DNA, 71 bp, chicken (Gallus Gallus)
  misc_feature (36): n=a or c
aaaccgaattcagaggaggatggggttgcagccagnctgctcatgaggatgggggggcccaacacaggtgg

SEQ ID NO: 32533 - DNA, 71 bp, chicken (Gallus Gallus)
  misc_feature (36): n=g or t
ggctgatagggttccagtaaatgaatattactttgncagcttcatcactacgaatttgctttcagagagag

SEQ ID NO: 32534 - DNA, 71 bp, chicken (Gallus Gallus)
  misc_feature (36): n=c or t
aaatgccaggcacagggcatttgttttggcaactantaatgaataaggaattaagacctcatgtcagattg

SEQ ID NO: 32535 - DNA, 71 bp, chicken (Gallus Gallus)
  misc_feature (36): n=c or t
acagaacttgtcagttatatattacagctggaaaanagtcagtgtcttttatttagaaacaagagttactg

SEQ ID NO: 32536 - DNA, 71 bp, chicken (Gallus Gallus)
  misc_feature (36): n=a or g
tgtcagcagcgatactgtactagaaagcacactgcntagacaggaatccccatccaccttgctccatgcag

SEQ ID NO: 32537 - DNA, 71 bp, chicken (Gallus Gallus)
  misc_feature (36): n=c or t
cgttctgaatagcactggaaagcccattggggtacngaaaacatgagaaatgaggtcatcggcatgttttg

SEQ ID NO: 32538 - DNA, 71 bp, chicken (Gallus Gallus)
  misc_feature (36): n=c or t
gcctgggtgaggacaaacgaactcttgttcactagngaccatgtcctgtgactctatcagatggagcacca

SEQ ID NO: 32539 - DNA, 71 bp, chicken (Gallus Gallus)
  misc_feature (36): n=c or t
tcttagaaatttagctaacttcagctaatctgtgcntcagagaagtgcattaaaaaccagtcttgtcacca

SEQ ID NO: 32540 - DNA, 71 bp, chicken (Gallus Gallus)
  misc_feature (36): n=c or t
tatctggcaagtttgaggagcacgtcacaggacagntgcttctctggcgacttctggcccaggttctgact

SEQ ID NO: 32541 - DNA, 71 bp, chicken (Gallus Gallus)
  misc_feature (36): n=c or t
accagcacgttttcctgtaaacaagtaaagattacngtttgacataaactgaatagatttataaagcttta

SEQ ID NO: 32542 - DNA, 71 bp, chicken (Gallus Gallus)
  misc_feature (36): n=c or t
gaaaggaaatgcagctagtattgaaactgcaatctngatgggtttacagtcatttttacgaggcagtatta

SEQ ID NO: 32543 - DNA, 71 bp, chicken (Gallus Gallus)
  misc_feature (36): n=c or t
ctctctgttagcagtttgcacatattcaccaactantgctgaacgctcagctttacaccaagtgaggtacc

SEQ ID NO: 32544 - DNA, 71 bp, chicken (Gallus Gallus)
  misc_feature (36): n=a or c
acagctgtgctctgatctttgtaggtacttttaaanaagtaagtatcaccaagctcatggctccacaagct

SEQ ID NO: 32545 - DNA, 71 bp, chicken (Gallus Gallus)
  misc_feature (36): n=c or t
agaagctgacgctatgctgaggccaggcacaatcanactgaattagcaaacatctgcacatggtgctgccc

SEQ ID NO: 32546 - DNA, 71 bp, chicken (Gallus Gallus)
  misc_feature (36): n=a or g
agtttacataatactgaatccttatactttgcttangtcagaattaccaattttaaaatgagacaattaat

SEQ ID NO: 32547 - DNA, 71 bp, chicken (Gallus Gallus)
  misc_feature (36): n=a or c
atcattagcagacatattcaggtaaattaatggtgntaactgaacacatcactgctttcggatgattttct

SEQ ID NO: 32548 - DNA, 71 bp, chicken (Gallus Gallus)
  misc_feature (36): n=c or t
taaaagttggatcccaactcatgagcgtggtgaggntttgtgggttggtccctcaacagacatcaggaaaa

SEQ ID NO: 32549 - DNA, 71 bp, chicken (Gallus Gallus)
  misc_feature (36): n=a or g
tggtttagaagcacgtgaggggctgagcatctctcnaagcagctccatccctattttgctttgcaaagcct

SEQ ID NO: 32550 - DNA, 71 bp, chicken (Gallus Gallus)
  misc_feature (36): n=a or g
tattctaaattacaatactattaccctacctccaantgaaagagcagtacatgctgtaagcccagagtttt

SEQ ID NO: 32551 - DNA, 71 bp, chicken (Gallus Gallus)
  misc_feature (36): n=c or t
agtgcaataattaatcttttctgtcaaagtgtcatnggattttgctggatttaagaacaacaaaatgtttc

SEQ ID NO: 32552 - DNA, 71 bp, chicken (Gallus Gallus)
  misc_feature (36): n=c or t
tgctgaagaacgtggtaaaagacggcagatttcagntgtagactcacagtgcctatagaaataataaatca

SEQ ID NO: 32553 - DNA, 71 bp, chicken (Gallus Gallus)
  misc_feature (36): n=c or t
catttgtcacatcgctctcaccgtgcggccagcgcncagctaagcacgtctaaaaactttgcgactgactc

SEQ ID NO: 32554 - DNA, 71 bp, chicken (Gallus Gallus)
  misc_feature (36): n=c or t
cgtttattttggtcttacagtggtgtctcagacacngattcttcatagggttgaaaagttcacgtaggtct

SEQ ID NO: 32555 - DNA, 71 bp, chicken (Gallus Gallus)
  misc_feature (36): n=a or g
ggcgctatgagtgcaataccttaagagtgatgatgnggtgaaagagcctggcttacctttaatattgacct

SEQ ID NO: 32556 - DNA, 71 bp, chicken (Gallus Gallus)
  misc_feature (36): n=a or c
gcatttacttactggtgttcctccagcacatctggncgaggatggtgtggccgctttgtggtcctcactac

SEQ ID NO: 32557 - DNA, 71 bp, chicken (Gallus Gallus)
  misc_feature (36): n=g or t
tgcttgcttctagtaagtggcacaaaggggaagcancatacactgagcctccatgaccacgacaagaactg

SEQ ID NO: 32558 - DNA, 71 bp, chicken (Gallus Gallus)
  misc_feature (36): n=c or t
cccagaaagagaggagtaggaatatcacataacttnattaaatatagatgttgattcctttatttggccac

SEQ ID NO: 32559 - DNA, 71 bp, chicken (Gallus Gallus)
  misc_feature (36): n=a or c
tttcctttattgtttctgggcttatgctatgcctcnaggagctgctgtctcataactttccaccatctgct

SEQ ID NO: 32560 - DNA, 71 bp, chicken (Gallus Gallus)
  misc_feature (36): n=a or g
tctgcctactgctcttcctatcaactgcccgctacnagcaattgatgagaggaagggcacagattacagga

SEQ ID NO: 32561 - DNA, 71 bp, chicken (Gallus Gallus)
  misc_feature (36): n=c or t
gctggaaaggtgtgggaataggggaggcactgcccnacatgggccactgtgctcagcagcatccaactcag

SEQ ID NO: 32562 - DNA, 71 bp, chicken (Gallus Gallus)
  misc_feature (36): n=a or g
gtcaaccatcctgaaggcagccagacccatgcacanaccaacaaagatgtattttccagacactgccaggc

SEQ ID NO: 32563 - DNA, 71 bp, chicken (Gallus Gallus)
  misc_feature (36): n=a or g
tcaacaaaggtaaccttgatctgataggagccctcngcactatatcagcagtgcctatctttcatctttgt

SEQ ID NO: 32564 - DNA, 71 bp, chicken (Gallus Gallus)
  misc_feature (36): n=c or t
aagcgtgagatgaaccttaccagtgacattgagaangatttctacttccgatacccctgtgagtattcagg

SEQ ID NO: 32565 - DNA, 71 bp, chicken (Gallus Gallus)
  misc_feature (36): n=g or t
ttccttggctgtgccccctgtgggatgagctttggntgtctctcagtatagcagttcagcatccctaagta

SEQ ID NO: 32566 - DNA, 71 bp, chicken (Gallus Gallus)
  misc_feature (36): n=a or c
ctgcagaaatgctgcaggtgcggtgtgtggttgtangtgtaggtttgtgagggtggtggataaatctgggg

SEQ ID NO: 32567 - DNA, 71 bp, chicken (Gallus Gallus)
  misc_feature (36): n=c or t
acctcgggaagggatctaattcctaaagcaccaggngagatcgactctcccctcccaaaatacgtttccta

SEQ ID NO: 32568 - DNA, 71 bp, chicken (Gallus Gallus)
  misc_feature (36): n=a or g
ttttcagcatcctctgtgttctgctcttgcagcacnctgtctagcatggatgcgttgatgcggaagtcccg

SEQ ID NO: 32569 - DNA, 71 bp, chicken (Gallus Gallus)
  misc_feature (36): n=g or t
cttccatcctgcgtcctgagacaggctatgaaccantttctagacatttacctagtctgcactcccaacat

SEQ ID NO: 32570 - DNA, 71 bp, chicken (Gallus Gallus)
  misc_feature (36): n=a or g
cagtcccagctgatacactgagcagcacgggacacncagcagttcccagcctggggctgtgctaggcttgt

SEQ ID NO: 32571 - DNA, 71 bp, chicken (Gallus Gallus)
  misc_feature (36): n=a or g
aagcagcagtccaggaggcagcatgggaagggagtngagtgaatacagcttttgctagaagcagatctctc

SEQ ID NO: 32572 - DNA, 71 bp, chicken (Gallus Gallus)
  misc_feature (36): n=a or g
gctaaggaggtgaaaaacacaaaacaaacacaaaanaagagttctctgagtgggactgcatatcagttcac

SEQ ID NO: 32573 - DNA, 71 bp, chicken (Gallus Gallus)
  misc_feature (36): n=c or t
ctcagggaattgggtcacactcctcaacctctgaancagaccatgaaacatacgcctcagagctgatgact

SEQ ID NO: 32574 - DNA, 71 bp, chicken (Gallus Gallus)
  misc_feature (36): n=c or t
acataattcatcaaaatgttggtctgtgtaatttcnaccttgcaacgtgtggcttgttaaattctctgcaa

SEQ ID NO: 32575 - DNA, 71 bp, chicken (Gallus Gallus)
  misc_feature (36): n=a or g
caaggtggtgctgccctcccctgccatcgccctgcngctgcagtgcctccagtgactgtgctctgggtgtg

SEQ ID NO: 32576 - DNA, 71 bp, chicken (Gallus Gallus)
  misc_feature (36): n=g or t
ccgtatttcaccacctcagcttgggggctgctgctnagaggctggggctgaacatacgtctttctcctggc

SEQ ID NO: 32577 - DNA, 71 bp, chicken (Gallus Gallus)
  misc_feature (36): n=c or t
tggcagtagtatttttctaaatcctgcattggcttncagagtgtctgagagtaattctggctagattcttg

SEQ ID NO: 32578 - DNA, 71 bp, chicken (Gallus Gallus)
  misc_feature (36): n=g or t
acacctctataacaaaacccctcagggttggaactngcttgtttttctgtttagtttgcacatctgggggc

SEQ ID NO: 32579 - DNA, 71 bp, chicken (Gallus Gallus)
  misc_feature (36): n=a or g
ggagattatcgtgatgcccagggaagaagatgagcntacatctaaggagagatttctttgaacagcagtga

SEQ ID NO: 32580 - DNA, 71 bp, chicken (Gallus Gallus)
  misc_feature (36): n=a or g
ttgcatattttttgcatatgttaattccaagagttnaaaatctgtaggtaaataaacgcatgtgtggcatc

SEQ ID NO: 32581 - DNA, 71 bp, chicken (Gallus Gallus)
  misc_feature (36): n=g or t
tttcctaagcaaagagactgcttcattgtgagaggntaatatgatgatgttacacggggaatagcagagtg

SEQ ID NO: 32582 - DNA, 71 bp, chicken (Gallus Gallus)
  misc_feature (36): n=a or g
ataaagggtggaggaaataaacttctcttgtttatntacaacgtgttttgagaagaacaggaaatatacag

SEQ ID NO: 32583 - DNA, 71 bp, chicken (Gallus Gallus)
  misc_feature (36): n=c or t
tgtgtgtgagttctatggaaagtgtaaaggaaaaangggtttgctagaaaaatacttgggaacagtgcttc

SEQ ID NO: 32584 - DNA, 71 bp, chicken (Gallus Gallus)
  misc_feature (36): n=a or g
ccaaggatgttactgaggtgggcaggtggggtttanagaactgggaagttcatctcctactttgcaaaagt

SEQ ID NO: 32585 - DNA, 71 bp, chicken (Gallus Gallus)
  misc_feature (36): n=a or g
atcttgcaaatgccttccacctctgattatagctgnaagactgaaagactgagtcaaatcagagtacccag

SEQ ID NO: 32586 - DNA, 71 bp, chicken (Gallus Gallus)
  misc_feature (36): n=c or t
aagccttctcttggaccacaggttctgctccacccnattgctcacaatccaaagccaaaaagacataaaga

SEQ ID NO: 32587 - DNA, 71 bp, chicken (Gallus Gallus)
  misc_feature (36): n=a or g
aaaccatagaaaataaacgatacaaggtgagctgtngagagggacaagggtcctgtttccatgaaaataaa

SEQ ID NO: 32588 - DNA, 71 bp, chicken (Gallus Gallus)
  misc_feature (36): n=g or t
attcagatatgctttccatctaaccctatggctttngggccattttggaaggactctcagtactgcttggc

SEQ ID NO: 32589 - DNA, 71 bp, chicken (Gallus Gallus)
  misc_feature (36): n=a or g
tccagggggctccctcccagggtcaggactaggcantgaaagactgtggctaaagggactcagatttcaag

SEQ ID NO: 32590 - DNA, 71 bp, chicken (Gallus Gallus)
  misc_feature (36): n=c or t
aagggaaatttgtgtgcctctacagcaatcattgtntaaatatttcacagccataggtccattactcagac

SEQ ID NO: 32591 - DNA, 71 bp, chicken (Gallus Gallus)
  misc_feature (36): n=c or t
ttctcatgcactgatggctcctaccttggcacccangatagttccttactgtgtcgtttttcaggcataga

SEQ ID NO: 32592 - DNA, 71 bp, chicken (Gallus Gallus)
  misc_feature (36): n=a or g
agggctgaacatctcccgagcctcatcatcttcacnagaatttattttaaagggccatgaaggtccattct

SEQ ID NO: 32593 - DNA, 71 bp, chicken (Gallus Gallus)
  misc_feature (36): n=c or t
tattgtatgttagagctgtaaatatcccttggtcangtgtctgtgtcttcttcaaaatatcatatctccgc

SEQ ID NO: 32594 - DNA, 71 bp, chicken (Gallus Gallus)
  misc_feature (36): n=g or t
gtgcatacatttaggttggagtatacgtgctgacangcaagcatgtgtaaaatgcatgcagtgtggatagg

SEQ ID NO: 32595 - DNA, 71 bp, chicken (Gallus Gallus)
  misc_feature (36): n=c or t
ttgtatgattctttgaaatgggaagaagaattgagntgccatacaagaagagttacatgactttgagagtt

SEQ ID NO: 32596 - DNA, 71 bp, chicken (Gallus Gallus)
  misc_feature (36): n=c or t
tgttgacaatgtcataatttccctatgaatagtatnataacatagtcatggaagcatagctaattgaagtc

SEQ ID NO: 32597 - DNA, 71 bp, chicken (Gallus Gallus)
  misc_feature (36): n=c or t
aggacaatcctctcagcacaaacagtaacaagcagnggtctcagtgtgctgagtctgaccagtggttttga

SEQ ID NO: 32598 - DNA, 71 bp, chicken (Gallus Gallus)
  misc_feature (36): n=a or g
agccaagagaaaggtgtaattcattgctgagattcntactaattagtttttcaggagttcccagggtaatt

SEQ ID NO: 32599 - DNA, 71 bp, chicken (Gallus Gallus)
  misc_feature (36): n=g or t
tttactgagtggaaaactctgcctccagggtgcccngaggtgtgatatttttacggcgctttctgaattct

SEQ ID NO: 32600 - DNA, 71 bp, chicken (Gallus Gallus)
  misc_feature (36): n=a or g
cacctagcactccctccattttcaggatcagtgacngtaagcaactatgattccagaatttattgcattag

SEQ ID NO: 32601 - DNA, 71 bp, chicken (Gallus Gallus)
  misc_feature (36): n=c or t
ttttccccccccagaagataatttagcatgactttncacagaacaatttgcacgggattacccacaataca

SEQ ID NO: 32602 - DNA, 71 bp, chicken (Gallus Gallus)
  misc_feature (36): n=c or t
gttccaaaaggcagagaagttagctgattttttcanttctctgtaattcaagaccacatatatttctcctt

SEQ ID NO: 32603 - DNA, 71 bp, chicken (Gallus Gallus)
  misc_feature (36): n=a or g
tttgaaattctcagcgttttttatcctgaggtctcngaactattcattctactgggcatcaagaccaagca

SEQ ID NO: 32604 - DNA, 71 bp, chicken (Gallus Gallus)
  misc_feature (36): n=a or g
tttgtccagactgtaacatcctggtcccatgggctnggcactgattcgggcactgtgtgcctacctctaaa

SEQ ID NO: 32605 - DNA, 71 bp, chicken (Gallus Gallus)
  misc_feature (36): n=c or t
ttacaacatcactgagtcagggtgtgttcacatacnaacttcatacttctacagtatgtacagacccaaca

SEQ ID NO: 32606 - DNA, 71 bp, chicken (Gallus Gallus)
  misc_feature (36): n=c or t
cattcttgccaattctaaagcacgttgtgccactantggatcagttcctaagaagagaccagctggtcctt

SEQ ID NO: 32607 - DNA, 71 bp, chicken (Gallus Gallus)
  misc_feature (36): n=a or g
gggaataacctagaaggtctttcagggagatcatcntgagagcacaactggtaacagcccaaagatcttgt

SEQ ID NO: 32608 - DNA, 71 bp, chicken (Gallus Gallus)
  misc_feature (36): n=c or t
acatccataaatatcagcctaaagaaaacttaaagngtaacattcttgaggaaaagagctgtcttgtaaag

SEQ ID NO: 32609 - DNA, 71 bp, chicken (Gallus Gallus)
  misc_feature (36): n=c or t
tgaatcaccgctgttgttttctctgagagattaagnagatatttctttctccccttcaagtttttatgctg

SEQ ID NO: 32610 - DNA, 71 bp, chicken (Gallus Gallus)
  misc_feature (36): n=a or g
ggctggccctgagggctatccctgaattacaagagntgctgtcagaccaagggcctggagcagcagcacta

SEQ ID NO: 32611 - DNA, 71 bp, chicken (Gallus Gallus)
  misc_feature (36): n=a or g
tccagaccaactaagcaacttcctaccgaaacaaantgtgtcatcgttttacctttggctctgtacaagat

SEQ ID NO: 32612 - DNA, 71 bp, chicken (Gallus Gallus)
  misc_feature (36): n=c or t
tccttttggagctattaatgcaatgcaagtggtcangtccaccaattagagtttacatggcacttgctaaa

SEQ ID NO: 32613 - DNA, 71 bp, chicken (Gallus Gallus)
  misc_feature (36): n=g or t
ggttttgtaaccagaagaagaatgtgtttattggtnttttggggtgtacgggaataagaagattggtgtcc

SEQ ID NO: 32614 - DNA, 71 bp, chicken (Gallus Gallus)
  misc_feature (36): n=a or g
caaacacaattttaaggctgggaaaaggtgctgtanaactgggactgtagtctagcagacaaccttaagca

SEQ ID NO: 32615 - DNA, 71 bp, chicken (Gallus Gallus)
  misc_feature (36): n=g or t
gcaaaaagccttcacagaaaaagacttggggaagangagagcaattttagaaaacagccttgtgtgagaac

SEQ ID NO: 32616 - DNA, 71 bp, chicken (Gallus Gallus)
  misc_feature (36): n=c or t
gtgagaactgctggaatcagcttcagactgctgctntgcaactggtgttagaggggataacaccaaaacgg

SEQ ID NO: 32617 - DNA, 71 bp, chicken (Gallus Gallus)
  misc_feature (36): n=a or g
attattttctttagcatcgctaaacaaaccactacnatatgccaaacactgtttctctgtggaaagtatga

SEQ ID NO: 32618 - DNA, 71 bp, chicken (Gallus Gallus)
  misc_feature (36): n=c or t
ccttaccccaggactcttctactcctgatggggctngctgctttaagaacccaccttcctcctcctcttcg

SEQ ID NO: 32619 - DNA, 71 bp, chicken (Gallus Gallus)
  misc_feature (36): n=a or g
cttttccacgaaaaaacccacacaggatcttgttcntactttgttccctcccaagcacccccagtttgcct

SEQ ID NO: 32620 - DNA, 71 bp, chicken (Gallus Gallus)
  misc_feature (36): n=a or g
cagaactctgctggagagctgtaacgtaaggcaagnggctggatttgattaacgtgatgaaattacacaag

SEQ ID NO: 32621 - DNA, 71 bp, chicken (Gallus Gallus)
  misc_feature (36): n=a or g
aaaccatccagattttccatttccaaactgtgtgcngtcaaatgctggagctgataggaatttctccattc

SEQ ID NO: 32622 - DNA, 71 bp, chicken (Gallus Gallus)
  misc_feature (36): n=a or g
tgcatagctgtaaagttcagagctgctttacgaganaaaaatcagtctgcctgcttggaattttcacttgt

SEQ ID NO: 32623 - DNA, 71 bp, chicken (Gallus Gallus)
  misc_feature (36): n=c or t
tacacttaatgcatttcaagttgaatgccagcctgntttttcaatcattagtcaatcctgtgaattgctgt

SEQ ID NO: 32624 - DNA, 71 bp, chicken (Gallus Gallus)
  misc_feature (36): n=c or t
gaacacttgaagctttaaataatactttataataangtcaataacacttaaaactttcctgtttctaccat

SEQ ID NO: 32625 - DNA, 71 bp, chicken (Gallus Gallus)
  misc_feature (36): n=c or t
aacctcctttcaggcataaagcgggtgccaaagatnatgtctcctagtaatgggtctcagtctgatatcca

SEQ ID NO: 32626 - DNA, 71 bp, chicken (Gallus Gallus)
  misc_feature (36): n=c or t
tgttagatgagaactgatgatgcttgaaaagattcngtgaggcaaaataagtgcataaacttgtatacagg

SEQ ID NO: 32627 - DNA, 71 bp, chicken (Gallus Gallus)
  misc_feature (36): n=a or g
ctttcattcctctgtagcttaggcctctatcactanggagcaactgacgttccctttggtactctgataga

SEQ ID NO: 32628 - DNA, 71 bp, chicken (Gallus Gallus)
  misc_feature (36): n=a or g
atttagcaagatttcgttcccttactctttgcaaancctacaaattagttcctcaatgggcttttgttcta

SEQ ID NO: 32629 - DNA, 71 bp, chicken (Gallus Gallus)
  misc_feature (36): n=c or t
ggtctgggttgttcgtgcatagtaactttatgcagngtgactcttgaaactgtagcatagcacccatccta

SEQ ID NO: 32630 - DNA, 71 bp, chicken (Gallus Gallus)
  misc_feature (36): n=a or g
actttggttccaaagccacttaagtgcttctgaaanatctctttgcctattattgattgcagtggattgct

SEQ ID NO: 32631 - DNA, 71 bp, chicken (Gallus Gallus)
  misc_feature (36): n=c or t
ggctgaaggtggtgtacccatcaaccccaagcaaangtctttttgttaatgttcttggaaatggagcatat

SEQ ID NO: 32632 - DNA, 71 bp, chicken (Gallus Gallus)
  misc_feature (36): n=a or g
cacggagggtaaattgaaattatgcctcgtttttgnagctgtagctgttgaatcagggtctgttatggagg

SEQ ID NO: 32633 - DNA, 71 bp, chicken (Gallus Gallus)
  misc_feature (36): n=a or g
gtttattcctttagaaaactcctgaagaccaaaccntctctgtgtaaagacgtggaattcttagcagcatc

SEQ ID NO: 32634 - DNA, 71 bp, chicken (Gallus Gallus)
  misc_feature (36): n=a or g
ttgcaatccaagtgtttctcagcccgaaagaggacnctgagatctgggctatgggaactggagcacggcac

SEQ ID NO: 32635 - DNA, 71 bp, chicken (Gallus Gallus)
  misc_feature (36): n=a or g
aacatctttcccacacgcaggatcacccagggtcanatcgtctcccggtgtaaactggcagaaatccattg

SEQ ID NO: 32636 - DNA, 71 bp, chicken (Gallus Gallus)
  misc_feature (36): n=g or t
agaactgtatggccctttgagggccaggatttaagntttagcctgcatcgagcataaatacactgggggtg

SEQ ID NO: 32637 - DNA, 71 bp, chicken (Gallus Gallus)
  misc_feature (36): n=g or t
ttttgggctagtatattgttccataaacaatgtgtnaagtagaaaattcttcaacagatgactgtgaaggg

SEQ ID NO: 32638 - DNA, 71 bp, chicken (Gallus Gallus)
  misc_feature (36): n=a or g
agcagtctgagaaagtgggggagaacttcctctttngagatttgaagcccttccctggagctgcaggacag

SEQ ID NO: 32639 - DNA, 71 bp, chicken (Gallus Gallus)
  misc_feature (36): n=c or t
gtagatctacctccaaccccttgtttcatcttgganaagtcatttagcttctctatggagtgattaaaaaa

SEQ ID NO: 32640 - DNA, 71 bp, chicken (Gallus Gallus)
  misc_feature (36): n=a or g
ggctatatatttatgagtgcatgcaattactataantacagataagtacagcactgggcaatgctatgcca

SEQ ID NO: 32641 - DNA, 71 bp, chicken (Gallus Gallus)
  misc_feature (36): n=a or g
aaatggaaatgaaaacacagcttgggagactagcanagataaagcgaggacaagaccaattagtggcagtt

SEQ ID NO: 32642 - DNA, 71 bp, chicken (Gallus Gallus)
  misc_feature (36): n=c or t
gtgtggagttggtgctggagagccagagggccagantcaagctggaatagaaaggaattggttggtgttaa

SEQ ID NO: 32643 - DNA, 71 bp, chicken (Gallus Gallus)
  misc_feature (36): n=c or t
ttctgtgataattgcagtggtgccatcaaggcgctngtcagttgctggcaactgaaataagccatgtgctg

SEQ ID NO: 32644 - DNA, 71 bp, chicken (Gallus Gallus)
  misc_feature (36): n=c or t
tctattaggaatggttttcctgacttcattaaaagngaactatagctgacctatattgtaatatttagctt

SEQ ID NO: 32645 - DNA, 71 bp, chicken (Gallus Gallus)
  misc_feature (36): n=a or g
cactcatctccagtgttagcctccgtgaatgcagcntggctcacctgcttgttctcatccagctttcttct

SEQ ID NO: 32646 - DNA, 71 bp, chicken (Gallus Gallus)
  misc_feature (36): n=a or g
ctgctgtgcagagatgaaatctgtctaatgtaagcnaagaaagtgctgtgttttcctatgagcgctcctta

SEQ ID NO: 32647 - DNA, 71 bp, chicken (Gallus Gallus)
  misc_feature (36): n=c or t
ttttttccgctcgattcaaaataacttctgagatanagaaagaaaagaatgtaggtttactccccgcttgt

SEQ ID NO: 32648 - DNA, 71 bp, chicken (Gallus Gallus)
  misc_feature (36): n=a or g
accatggctgaattgagttctttcgctaaaatgtcnaatctacttcactaaacaaaagctcatttggagag

SEQ ID NO: 32649 - DNA, 71 bp, chicken (Gallus Gallus)
  misc_feature (36): n=c or t
gtcagatgaggcactcagtggtaaatttctgctgcngggagccttcaacagagacagcagtttgagccact

SEQ ID NO: 32650 - DNA, 71 bp, chicken (Gallus Gallus)
  misc_feature (36): n=c or t
tttgcttttgcaggttggtggactgtctcaaataangccacaatgtaaaatgtctgggtcaaatattgagt

SEQ ID NO: 32651 - DNA, 71 bp, chicken (Gallus Gallus)
  misc_feature (36): n=a or g
ctccaaaattgcattgtgatatcagctgcccctgcntatcttcaagcccgggtgcaggtacacgtcaaagc

SEQ ID NO: 32652 - DNA, 71 bp, chicken (Gallus Gallus)
  misc_feature (36): n=g or t
tccccatggctcactgtgtccctttttgtcaaagcngagccacgctgacagagggtgatgtgtgggggagg

SEQ ID NO: 32653 - DNA, 71 bp, chicken (Gallus Gallus)
  misc_feature (36): n=a or g
caaaagcagtatctgcctgctcccgactccagcacntttagctgattacaaggacaccattaatggtgtta

SEQ ID NO: 32654 - DNA, 71 bp, chicken (Gallus Gallus)
  misc_feature (36): n=a or g
aatctcttagcatatacaacaagccatttgatgcanttgactcctgtgaaagtttgtaaataattttttaa

SEQ ID NO: 32655 - DNA, 71 bp, chicken (Gallus Gallus)
  misc_feature (36): n=g or t
tgaagttcacgcataactttacaaatatcagttggnagactctcctaccaaccataacaggtatgacagac

SEQ ID NO: 32656 - DNA, 71 bp, chicken (Gallus Gallus)
  misc_feature (36): n=c or t
ttccctttctaggatctattgcacctgacttcctgnaccttttctccctcgccttcttctagctcttagta

SEQ ID NO: 32657 - DNA, 71 bp, chicken (Gallus Gallus)
  misc_feature (36): n=g or t
gagaacattctggcaactcactaaaagagaaagaancctgggcagaatctccatgctgcatttattatgag

SEQ ID NO: 32658 - DNA, 71 bp, chicken (Gallus Gallus)
  misc_feature (36): n=a or g
tgacatggtgatcagacctttaggaaatcgattganagagcaaaattcaattcatttacaattttgtagtt

SEQ ID NO: 32659 - DNA, 71 bp, chicken (Gallus Gallus)
  misc_feature (36): n=a or g
gtggtaccaccgaacaataattacagaatgttcctnatagtaaatcatttgtcacaatcagagctcactac

SEQ ID NO: 32660 - DNA, 71 bp, chicken (Gallus Gallus)
  misc_feature (36): n=a or g
aagggcagaagaatttcctttctccctgaccttgcngtctaactaagaactactggtgagattattcctag

SEQ ID NO: 32661 - DNA, 71 bp, chicken (Gallus Gallus)
  misc_feature (36): n=c or t
aaaatattacatattgcagcactattttttttatgntaacatttgaattttttatccccagcatttttcaa

SEQ ID NO: 32662 - DNA, 71 bp, chicken (Gallus Gallus)
  misc_feature (36): n=c or t
ttttttctagccaactgaaattgtctctcaaaaagnatttcaggagttcaaatttgcagagttgaatatat

SEQ ID NO: 32663 - DNA, 71 bp, chicken (Gallus Gallus)
  misc_feature (36): n=a or g
ctgagagcagattagcccagatggagacattttcancacggttctgtctgaccaatcagcgacagctggga

SEQ ID NO: 32664 - DNA, 71 bp, chicken (Gallus Gallus)
  misc_feature (36): n=a or g
tgtactgcgttcccagcctcccctcaaccccagagnttaaaatctagttttctatattttgcaatgaatgg

SEQ ID NO: 32665 - DNA, 71 bp, chicken (Gallus Gallus)
  misc_feature (36): n=c or t
ggtattcgcctgttggcatcagttaaagatgtgccnggtctggcaatatagcaatgtgtatattagatatg

SEQ ID NO: 32666 - DNA, 71 bp, chicken (Gallus Gallus)
  misc_feature (36): n=a or g
cttgccataattccttttcttatgtgaagttttgcnaaacaacagcactgcatgttcagatctccccccac

SEQ ID NO: 32667 - DNA, 71 bp, chicken (Gallus Gallus)
  misc_feature (36): n=c or t
gtcaccacctcaccacctcatctatttttgccgtantggagagggcacaattacctgaatgcaatttgtgg

SEQ ID NO: 32668 - DNA, 71 bp, chicken (Gallus Gallus)
  misc_feature (36): n=c or t
ctttagaaggagaatgggactatcttccagacaaangctatagtttcatttgaagttggaaaatatatcaa

SEQ ID NO: 32669 - DNA, 71 bp, chicken (Gallus Gallus)
  misc_feature (36): n=a or g
aatgcaaaagcagtatggtacagggggagtcacgcnctgggttaaattcagagtggagaaagaaaacagcc

SEQ ID NO: 32670 - DNA, 71 bp, chicken (Gallus Gallus)
  misc_feature (36): n=a or g
agattttctgcatttgttctcctccttctagctcantgtatattggatcagtttacccagtttctctaact

SEQ ID NO: 32671 - DNA, 71 bp, chicken (Gallus Gallus)
  misc_feature (36): n=c or t
ccttgtggtttgttgacgagcccagtccaatgcaangtgagctcatgcaggaactcacactggtaacagag

SEQ ID NO: 32672 - DNA, 71 bp, chicken (Gallus Gallus)
  misc_feature (36): n=a or c
catttaaaatatgttaggggtgacacaatactttcncctggtgcaggcatatatcactggaaggatgttct

SEQ ID NO: 32673 - DNA, 71 bp, chicken (Gallus Gallus)
  misc_feature (36): n=g or t
gacgtcattttctctataacggtgaatacttctgcnggtcagatattggagttcaaactttaccctccgcc

SEQ ID NO: 32674 - DNA, 71 bp, chicken (Gallus Gallus)
  misc_feature (36): n=a or g
agtgatagacatgaggcgacaatcgcaggggctctnctgaacttcctgatattaaggcagctaaagcgctg

SEQ ID NO: 32675 - DNA, 71 bp, chicken (Gallus Gallus)
  misc_feature (36): n=a or g
aggcagagatccctgtgtggggataatggcattgcntggctgtgaaggcattcactgagagaggggaaaaa

SEQ ID NO: 32676 - DNA, 71 bp, chicken (Gallus Gallus)
  misc_feature (36): n=c or t
gcatttgcgagactcttggctctcagcttcatcccnaagacttctgcagtagtacaggtaatgccactgct

SEQ ID NO: 32677 - DNA, 71 bp, chicken (Gallus Gallus)
  misc_feature (36): n=a or g
gctcaaacctgttctaagggaaatgcttctgtgctnttatcatggactacctaccccacaaatacaagttg

SEQ ID NO: 32678 - DNA, 71 bp, chicken (Gallus Gallus)
  misc_feature (36): n=a or g
gtacagactcagcctggcaaattatgagttttcctnaatagctcatggcaaaaggaagatacagggataca

SEQ ID NO: 32679 - DNA, 71 bp, chicken (Gallus Gallus)
  misc_feature (36): n=a or c
ggtagtcctatgcctctataattctagggagcagcnttttcagcatgatgaatggaaacttattgaaaaga

SEQ ID NO: 32680 - DNA, 71 bp, chicken (Gallus Gallus)
  misc_feature (36): n=a or g
agaatgttttcatatagagtatggaataaaaatgantctctggaaggtctttgaaaagataatgtgtcatg

SEQ ID NO: 32681 - DNA, 71 bp, chicken (Gallus Gallus)
  misc_feature (36): n=g or t
cctcacctttgttgatgttacattggtcgcggcagntcttagaacttgatgcgagttgtaagcaggtgact

SEQ ID NO: 32682 - DNA, 71 bp, chicken (Gallus Gallus)
  misc_feature (36): n=a or g
catccgtttcctaccaaggttgcaggaaaggagcantatcagagctttgctttttggttattttgtaacac

SEQ ID NO: 32683 - DNA, 71 bp, chicken (Gallus Gallus)
  misc_feature (36): n=g or t
caatcttagttttaacatttcacataaaaatcaggntttaatcaaaatgatctgaaaagtaatacaataaa

SEQ ID NO: 32684 - DNA, 71 bp, chicken (Gallus Gallus)
  misc_feature (36): n=a or g
ctgcccctgctcttctccattattacctataagagncgggagccattatgcagcccttccttctttgtggt

SEQ ID NO: 32685 - DNA, 71 bp, chicken (Gallus Gallus)
  misc_feature (36): n=a or g
tacagaaactacccggagctattgaaccctgcacanctattttctgttatctgcctttgtgaatgtttgtg

SEQ ID NO: 32686 - DNA, 71 bp, chicken (Gallus Gallus)
  misc_feature (36): n=a or g
agctgtccgtcttgattcagttcccatgcttacttnggttagagttagggtgagggtcaggagaagtgtta

SEQ ID NO: 32687 - DNA, 71 bp, chicken (Gallus Gallus)
  misc_feature (36): n=a or g
tggcctgcaaagacctgtggccttgtctaacagganggtgcatgcataaaacagtgattcactacaaaaca

SEQ ID NO: 32688 - DNA, 71 bp, chicken (Gallus Gallus)
  misc_feature (36): n=a or g
cgatgcctgcactgcagaacgttaactgttacaccncagcgggatactggtattagtagtagacctgtatt

SEQ ID NO: 32689 - DNA, 71 bp, chicken (Gallus Gallus)
  misc_feature (36): n=g or t
aaactgttttctgaagcaacctgatctttgatgggntcctgcgttgttgttaagctgcttgaggttacaag

SEQ ID NO: 32690 - DNA, 71 bp, chicken (Gallus Gallus)
  misc_feature (36): n=c or t
aagctgtcggagaggtctgtaagtctgggcagcctngtcttgcttggatttggaggatgctagaagacctg

SEQ ID NO: 32691 - DNA, 71 bp, chicken (Gallus Gallus)
  misc_feature (36): n=a or c
aggggacgtaatctgtccattacaacccatgggagngggtaggaaagccccagcagcgaccagaacaccat

SEQ ID NO: 32692 - DNA, 71 bp, chicken (Gallus Gallus)
  misc_feature (36): n=a or c
taataaggctgtatcccagctaagtgagaagcaatnttgccattgctggcgtgcagccctgacttgctggc

SEQ ID NO: 32693 - DNA, 71 bp, chicken (Gallus Gallus)
  misc_feature (36): n=a or g
gtgaccccatgtaaggaaatacagaaagaggtctcnttattcctaaatgcctcatgctccaagctctggag

SEQ ID NO: 32694 - DNA, 71 bp, chicken (Gallus Gallus)
  misc_feature (36): n=c or t
ctgatgtttgatctcattaatggaatcagttatagnttactgactaacagaactcagtaattatttaggtt

SEQ ID NO: 32695 - DNA, 71 bp, chicken (Gallus Gallus)
  misc_feature (36): n=c or t
aaccaccagcctcgctctgggagctctgacagacangccacttaagggtgtgcttttctcctttaggaaat

SEQ ID NO: 32696 - DNA, 71 bp, chicken (Gallus Gallus)
  misc_feature (36): n=c or t
tttgaaaagtcagaatccttttgtaagaccagtggnacacggctgattagaattgcaggcagcattttcag

SEQ ID NO: 32697 - DNA, 71 bp, chicken (Gallus Gallus)
  misc_feature (36): n=g or t
tgcagcattatttactaaaggcaaaacgcagagatnctcttttgcatgcaaaggaaacgtattgaatgaca

SEQ ID NO: 32698 - DNA, 71 bp, chicken (Gallus Gallus)
  misc_feature (36): n=a or c
actgcataccctttggggtaaatcagaagtaattcnaccagtgatgtgcaaacctcaaggtgaacatcacc

SEQ ID NO: 32699 - DNA, 71 bp, chicken (Gallus Gallus)
  misc_feature (36): n=a or g
ctcactcctttttctttattaagtgaaaacgcttcnctgcaacttttgtgtcgcagatacataatcctata

SEQ ID NO: 32700 - DNA, 71 bp, chicken (Gallus Gallus)
  misc_feature (36): n=a or g
tttaagatgaaaccagtgttcactagtttgtcggcngcagaatcctgggaccatctatgcaaacattggac

SEQ ID NO: 32701 - DNA, 71 bp, chicken (Gallus Gallus)
  misc_feature (36): n=a or g
caccggagccttcaaagaaatggaacgacaaaaacnacacagtaacaactttaaatttgttgctttttcgg

SEQ ID NO: 32702 - DNA, 71 bp, chicken (Gallus Gallus)
  misc_feature (36): n=a or g
tccctctcccacagctctgagttcagagtaaaggcnccctgggaggtgggaagaacagaggagagggaaaa

SEQ ID NO: 32703 - DNA, 71 bp, chicken (Gallus Gallus)
  misc_feature (36): n=a or g
catccctgcaacatttgtgctgacgtgacagagtcnatggtcttcgttttcccatcctcacaaattttggg

SEQ ID NO: 32704 - DNA, 71 bp, chicken (Gallus Gallus)
  misc_feature (36): n=g or t
aaatttattctgtataatattatctgcatcattttngtaaccaactttatgattgttttcttctaaaacat

SEQ ID NO: 32705 - DNA, 71 bp, chicken (Gallus Gallus)
  misc_feature (36): n=c or t
gaccccactacaagctcagtgtgccatttccacagntttacttcgcagataacccatttcccatgtaagat

SEQ ID NO: 32706 - DNA, 71 bp, chicken (Gallus Gallus)
  misc_feature (36): n=a or g
ggttgcaaagaaaaacttacaggtgatctttgctcntgtagcattgtcccactgaatctagaggcagtcag

SEQ ID NO: 32707 - DNA, 71 bp, chicken (Gallus Gallus)
  misc_feature (36): n=g or t
catgcgtgcccgtgttggtgagcattctgtgcaagngtgtgtgttttagttaacccagttgcaagaacagc

SEQ ID NO: 32708 - DNA, 71 bp, chicken (Gallus Gallus)
  misc_feature (36): n=a or g
taattcacgagagagaagaatcttttaccatctttntatttcttgcataaactgggacagtgtcattgaag

SEQ ID NO: 32709 - DNA, 71 bp, chicken (Gallus Gallus)
  misc_feature (36): n=a or g
acgatgaacttgtggtggaagagactgagtaaattnaatccagagctcttattactttttgtattaccaac

SEQ ID NO: 32710 - DNA, 71 bp, chicken (Gallus Gallus)
  misc_feature (36): n=c or t
caagaattaagtaaaaaactgaagggtactgtacanatttgttggtaagctctatcttagtctggttaagc

SEQ ID NO: 32711 - DNA, 71 bp, chicken (Gallus Gallus)
  misc_feature (36): n=a or g
atcctggtgggacagcttggtctcctccaggaaganaactcagctgtggaagggaacagaaattggcttct

SEQ ID NO: 32712 - DNA, 71 bp, chicken (Gallus Gallus)
  misc_feature (36): n=c or t
aggctcagccctgacttacagacttctctctgccangtacagcttcaatcagctcttcttattgaaaaata

SEQ ID NO: 32713 - DNA, 71 bp, chicken (Gallus Gallus)
  misc_feature (36): n=c or t
ggtaacgtttgtcagtatttgtggacaggaagaaanattaaaatatgcgggaagttttgaagatttccagt

SEQ ID NO: 32714 - DNA, 71 bp, chicken (Gallus Gallus)
  misc_feature (36): n=a or c
aaggagctcaatcttgctgcctttactctgttcctnctctgcccttctttgtgaagtgatattagagtagt

SEQ ID NO: 32715 - DNA, 71 bp, chicken (Gallus Gallus)
  misc_feature (36): n=a or g
gagtgcaacctgtgtggcacagcgtgctatgctggntgtcccatcttcactggagacatgaaagggtaatg

SEQ ID NO: 32716 - DNA, 71 bp, chicken (Gallus Gallus)
  misc_feature (36): n=c or t
gtgcttttaaaatcaagactctcagcaactcatgtngtgaaagtctgaaacagggaggcctgtctctgcac

SEQ ID NO: 32717 - DNA, 71 bp, chicken (Gallus Gallus)
  misc_feature (36): n=c or t
cctgtttaggcattaaatatttcctgaggacattanggtgaccagctcctcttaatgcccagagcatgtgg

SEQ ID NO: 32718 - DNA, 71 bp, chicken (Gallus Gallus)
  misc_feature (36): n=g or t
cagagccctcactgagtccagtcccacggccctctntgctgggaggtgatgattccctctgggattgcacc

SEQ ID NO: 32719 - DNA, 71 bp, chicken (Gallus Gallus)
  misc_feature (36): n=c or t
gtgactcgtccaagaaaaagtaattctaggtcctgntgcaacaagcctgcacacatcactttatccccagt

SEQ ID NO: 32720 - DNA, 71 bp, chicken (Gallus Gallus)
  misc_feature (36): n=a or g
agccatcctcttctgcccctgtgtaggggaaaggantgcatggcttggcctggtctatagaactgagctgt

SEQ ID NO: 32721 - DNA, 71 bp, chicken (Gallus Gallus)
  misc_feature (36): n=a or c
ggactctcacttgagttacaaaggcaaaccatgagnaatgcgggcttagaattgccagctagctgcctcat

SEQ ID NO: 32722 - DNA, 71 bp, chicken (Gallus Gallus)
  misc_feature (36): n=c or t
agcatacactgcaaaggaggtgtatgccttgcagcnctttcatttcagctagatttcttaaaactcatgct

SEQ ID NO: 32723 - DNA, 71 bp, chicken (Gallus Gallus)
  misc_feature (36): n=c or t
ccacccgaccaggtgggaacagatacaaacacctancatctccctacacacactgagccaaatcccatcac

SEQ ID NO: 32724 - DNA, 71 bp, chicken (Gallus Gallus)
  misc_feature (36): n=c or t
gtcagcccttgtctttcatctctgtggaagaggcanggaaagggagagaacgttacaggtgtgcaggttgg

SEQ ID NO: 32725 - DNA, 71 bp, chicken (Gallus Gallus)
  misc_feature (36): n=a or g
ctagaaaggaggcaactgccaaaatcatacctcttnaaaacgtgccttgctaaataacattcagcaatctt

SEQ ID NO: 32726 - DNA, 71 bp, chicken (Gallus Gallus)
  misc_feature (36): n=c or t
attcctcattgtttcacgctgcttctgctcctcccnagttttggtgagcaccattcctctaagaggagaat

SEQ ID NO: 32727 - DNA, 71 bp, chicken (Gallus Gallus)
  misc_feature (36): n=c or t
cttccctgggtgtacaagtgaggtgggggtgggttntaaataccaggattcattttcaagacgtttggcac

SEQ ID NO: 32728 - DNA, 71 bp, chicken (Gallus Gallus)
  misc_feature (36): n=c or t
ccacagcaaggctcagtgcagagaacacatttgcanttctctgtgtgaaactgggtttctgctcacatctg

SEQ ID NO: 32729 - DNA, 71 bp, chicken (Gallus Gallus)
  misc_feature (36): n=a or g
tgtgtgggagcacaaagacgggctgcagcagcctanagcaagaaatcccattccttccccattgtcagttg

SEQ ID NO: 32730 - DNA, 71 bp, chicken (Gallus Gallus)
  misc_feature (36): n=c or t
tccccccagcccccaaataccttcaatctataatgnctgaaaggctctttccctggaccttgcacggttta

SEQ ID NO: 32731 - DNA, 71 bp, chicken (Gallus Gallus)
  misc_feature (36): n=c or t
actgcggttcaattttaccagctgcacaataggtgngtttaacgaacttcatcgctgcctggctctcagct

SEQ ID NO: 32732 - DNA, 71 bp, chicken (Gallus Gallus)
  misc_feature (36): n=a or g
gcaaatgtcagagaatattgaactgctaatgacttngggttcttccactttctgggtcctggaagtgaacc

SEQ ID NO: 32733 - DNA, 71 bp, chicken (Gallus Gallus)
  misc_feature (36): n=c or t
aaacaaaagccagtaatttgaacgtagtaggatttnagaacaaaaacttcccagcaacactcccagctcac

SEQ ID NO: 32734 - DNA, 71 bp, chicken (Gallus Gallus)
  misc_feature (36): n=a or g
gactctttaccttttcccctaaaaacaaaatctggngtcttttactagatgaacaccatacataggagtaa

SEQ ID NO: 32735 - DNA, 71 bp, chicken (Gallus Gallus)
  misc_feature (36): n=c or t
ggtgacaaagggatgcttctgtggaccgttatctgntgccaccagaacgctgcacccttgccaggagctgc

SEQ ID NO: 32736 - DNA, 71 bp, chicken (Gallus Gallus)
  misc_feature (36): n=c or t
gcctcctgtgcattgggcttcagagcctgcaggtgnggtccagagtcagagaacttaaagcaagtgaaaga

SEQ ID NO: 32737 - DNA, 71 bp, chicken (Gallus Gallus)
  misc_feature (36): n=c or t
tttccaggttgcagattgtgaggtttgtacatcatnccatagagtgtaaaccccgtggagctctcaaagga

SEQ ID NO: 32738 - DNA, 71 bp, chicken (Gallus Gallus)
  misc_feature (36): n=a or g
aagagttcacaaaataggcagaattacagatgtctnaaagaatttttatatcacggatgaaaccgaacacc

SEQ ID NO: 32739 - DNA, 71 bp, chicken (Gallus Gallus)
  misc_feature (36): n=a or c
atgctagcatgaacaacatcttcaataaagcagaanagaaaatgagagtatgctgagggacaatattcccc

SEQ ID NO: 32740 - DNA, 71 bp, chicken (Gallus Gallus)
  misc_feature (36): n=c or t
ggccagtgagagagcagacaaatgcacttgtttgtntggactgttctgcacgagtctgactttccctcgac

SEQ ID NO: 32741 - DNA, 71 bp, chicken (Gallus Gallus)
  misc_feature (36): n=g or t
aatctgtcaaagccttaaggcataattctgcacagngatgagaataatcatattaatgaataatcataatt

SEQ ID NO: 32742 - DNA, 71 bp, chicken (Gallus Gallus)
  misc_feature (36): n=a or g
agtctcagaaaatcagcttgtagtcatcccccaccnatacattgcaaatacccatttctgaggactgaaag

SEQ ID NO: 32743 - DNA, 71 bp, chicken (Gallus Gallus)
  misc_feature (36): n=c or t
aatttattcaaaatatttactggtaagatatcaccngattagcatgaattaagagtgaattgaaatttcat

SEQ ID NO: 32744 - DNA, 71 bp, chicken (Gallus Gallus)
  misc_feature (36): n=g or t
gttatgtcccatttctaatgactaccaaagagcagncaaattctttccgcagctgtggaacagcaccaaca

SEQ ID NO: 32745 - DNA, 71 bp, chicken (Gallus Gallus)
  misc_feature (36): n=a or g
actctctactgaaataaattactactttttagaggngaaataatagcagatgttttgctacatatcggttt

SEQ ID NO: 32746 - DNA, 71 bp, chicken (Gallus Gallus)
  misc_feature (36): n=a or g
tcatatagtgttgtatgaacattagatacacctatncatgagtgatgcatatacctgaatatgtatgatat

SEQ ID NO: 32747 - DNA, 71 bp, chicken (Gallus Gallus)
  misc_feature (36): n=a or c
tacagtgtttgccaatgagttccaccagaattcttnccagccacgagagaagggagaatccatggagaagt

SEQ ID NO: 32748 - DNA, 71 bp, chicken (Gallus Gallus)
  misc_feature (36): n=a or g
cctggagtcagcccagaagcagaggcacctgtcctntaagctgtgggctgctcagatcacattttccatct

SEQ ID NO: 32749 - DNA, 71 bp, chicken (Gallus Gallus)
  misc_feature (36): n=g or t
gtagcactgaactgtgtattccatcttctgtatttnctgtttgggtttaatttgtaaaacttggagtgcag

SEQ ID NO: 32750 - DNA, 71 bp, chicken (Gallus Gallus)
  misc_feature (36): n=a or g
catgttctcctctttcgtaacctttttcagtaactncctagacgtatacagaattagttattatttgaata

SEQ ID NO: 32751 - DNA, 71 bp, chicken (Gallus Gallus)
  misc_feature (36): n=a or c
tcctgaactgcctcaaaacgtcagtgagatgatgcnccataaggtgctttcaactttgaaatctaatctcg

SEQ ID NO: 32752 - DNA, 71 bp, chicken (Gallus Gallus)
  misc_feature (36): n=a or g
agagtcctccaaaaccattttttcccaagagttctnattacagcctggtcctgcaggtcactgtgttggca

SEQ ID NO: 32753 - DNA, 71 bp, chicken (Gallus Gallus)
  misc_feature (36): n=c or t
tgaatagtagctgaaggtatggcgtggaatcacttnaatttttaggaagtaaataatatttggaagcaaat

SEQ ID NO: 32754 - DNA, 71 bp, chicken (Gallus Gallus)
  misc_feature (36): n=a or g
ctgcatgcttgctggctctatagtttcaaagcctgngagaggctctgactgatatactgcaactgggtagt

SEQ ID NO: 32755 - DNA, 71 bp, chicken (Gallus Gallus)
  misc_feature (36): n=a or g
ggaggcgatttatagctcgtgtgttgggaaacagcnttcgtgcaaatcatttttcttagataagtgggaaa

SEQ ID NO: 32756 - DNA, 71 bp, chicken (Gallus Gallus)
  misc_feature (36): n=a or g
tgcctttttccgtgaagtcagtcctgagttcatgcntctcctagaatgaccacttgttctaatgcgtattt

SEQ ID NO: 32757 - DNA, 71 bp, chicken (Gallus Gallus)
  misc_feature (36): n=c or t
tatgtgtgtgtctaatagcttttgaattcactggcnaatttcaaccaaatttagcaaaagggtgaagatct

SEQ ID NO: 32758 - DNA, 71 bp, chicken (Gallus Gallus)
  misc_feature (36): n=c or t
tttatggaccctgacaagtttgcatagtctctcagnttcagtaaatcctgctggactaaaactgtgggtac

SEQ ID NO: 32759 - DNA, 71 bp, chicken (Gallus Gallus)
  misc_feature (36): n=c or t
aggcgatgccagcgttctgcacacaaatcctgcaangagcggcggtgaccaaacagctcatgtgcaaactt

SEQ ID NO: 32760 - DNA, 71 bp, chicken (Gallus Gallus)
  misc_feature (36): n=a or g
gggacacagggcacgtcctgaagtgcagatggcccncagtgtgggtgcagtcccagcacacaaagggaccg

SEQ ID NO: 32761 - DNA, 71 bp, chicken (Gallus Gallus)
  misc_feature (36): n=a or g
tgggctctgagctcctggaaagagcagattttgggnaagggaaggagctgagctggaatatggggctggtg

SEQ ID NO: 32762 - DNA, 71 bp, chicken (Gallus Gallus)
  misc_feature (36): n=a or g
taagatgagttcatcttcccagggtttgtttgagtncaccaggagataaaaggaggtgaggaacccagccc

SEQ ID NO: 32763 - DNA, 71 bp, chicken (Gallus Gallus)
  misc_feature (36): n=c or t
ttaacattgttgagcctgggtaagggatctcaaaantgggactttggaccttgagaaagtttccttgaaca

SEQ ID NO: 32764 - DNA, 71 bp, chicken (Gallus Gallus)
  misc_feature (36): n=c or t
tgggaggcagacggcaatgcggagaatgtccctttntgtcattgctgggtcactttccctgctggggacag

SEQ ID NO: 32765 - DNA, 71 bp, chicken (Gallus Gallus)
  misc_feature (36): n=g or t
ctgctctgggatgtggaggattctggttccatgggnctctggcttgtcactgagacccttctgggactgtg

SEQ ID NO: 32766 - DNA, 71 bp, chicken (Gallus Gallus)
  misc_feature (36): n=a or g
agctgcacctagggccaccagaaggagtagacagtnaaaaatgggtgtattaaaagttgcagaaggaaagg

SEQ ID NO: 32767 - DNA, 71 bp, chicken (Gallus Gallus)
  misc_feature (36): n=a or g
gtgcattaagctatttaactgcctggaaatccagcntgatgaacatccaaaggtatcttattattagctcg

SEQ ID NO: 32768 - DNA, 71 bp, chicken (Gallus Gallus)
  misc_feature (36): n=a or g
tccttcagatcccactgatagcgggatgggacacangtaggtggtatctcatttttctggatggccaacct

SEQ ID NO: 32769 - DNA, 71 bp, chicken (Gallus Gallus)
  misc_feature (36): n=c or t
gtaaatgttcatgtatttaaaagatacctgacagcnatcattcatacataaatgattaatatgtcatgctc

SEQ ID NO: 32770 - DNA, 71 bp, chicken (Gallus Gallus)
  misc_feature (36): n=a or g
tctaataggaatggaactgtctgaactcatggtatnggattgctcttggttctttgccttgttcactcttg

SEQ ID NO: 32771 - DNA, 71 bp, chicken (Gallus Gallus)
  misc_feature (36): n=a or g
gggtgtaacaaaatgcctcagctgggcacagcaagnggataaactgcgtggtccatagaggaagccaagaa

SEQ ID NO: 32772 - DNA, 71 bp, chicken (Gallus Gallus)
  misc_feature (36): n=a or g
tgcagcgtggcacatcacctcctgtgtactacatcngaaaggtaaaggtgcagcaggataaaatcctgagt

SEQ ID NO: 32773 - DNA, 71 bp, chicken (Gallus Gallus)
  misc_feature (36): n=a or g
attcttcccctgtgcgctgggagtagctgaactgcntggatataccaggcgtgagatgccttcctctgcgg

SEQ ID NO: 32774 - DNA, 71 bp, chicken (Gallus Gallus)
  misc_feature (36): n=g or t
tcctttgctgtgtgttaggtgttgtgtgaaataatnagttcttgtagattcttctggcagtgtcagaaaca

SEQ ID NO: 32775 - DNA, 71 bp, chicken (Gallus Gallus)
  misc_feature (36): n=a or g
tgtcatgcattggacacagccgctccgtgagctacngaaggactaagctaggatacaaggaatgtaaacag

SEQ ID NO: 32776 - DNA, 71 bp, chicken (Gallus Gallus)
  misc_feature (36): n=c or t
gagctgatagcagagatgcacagcgccgtgaccccnctgctcatgaaggagcaaagcttacctaaaaagaa

SEQ ID NO: 32777 - DNA, 71 bp, chicken (Gallus Gallus)
  misc_feature (36): n=a or g
tggagctgcacctgtacatgacatcggcgctgggcnggagcgacgtgaaggcagtggggctgcagctggcc

SEQ ID NO: 32778 - DNA, 71 bp, chicken (Gallus Gallus)
  misc_feature (36): n=a or g
ggggggtggctctgcacgctgaccccaggaactccngccctactgctgtgtgccctttgggtggaaaaaga

SEQ ID NO: 32779 - DNA, 71 bp, chicken (Gallus Gallus)
  misc_feature (36): n=a or g
aactggaatctcagaactcagcatagcacagcagcnggcagtgatgctgcacctctccccatgcagcgact

SEQ ID NO: 32780 - DNA, 71 bp, chicken (Gallus Gallus)
  misc_feature (36): n=c or t
tttttcttgatgcagtgtctgcccttgttccgaatngctgcattgtgtgttccctttaaaaacaagggcga

SEQ ID NO: 32781 - DNA, 71 bp, chicken (Gallus Gallus)
  misc_feature (36): n=g or t
acgctgaaggagcgtgctctcagatgaactgcaacnagtaagcctcccccgtgcaaaaaatagagccaaaa

SEQ ID NO: 32782 - DNA, 71 bp, chicken (Gallus Gallus)
  misc_feature (36): n=a or g
ggagataactgttctgtgagcagggtgaagctttcntgcctgctgtagtccatccaatattagatggtttt

SEQ ID NO: 32783 - DNA, 71 bp, chicken (Gallus Gallus)
  misc_feature (36): n=a or g
cggtctcttgatgcaatggacaggttaaaacctgtnccttttatctggctgtttgcttactctcgtcccca

SEQ ID NO: 32784 - DNA, 71 bp, chicken (Gallus Gallus)
  misc_feature (36): n=c or t
ttctcactgtcccatggcacatctcaagcatcccangtttgcatcagtaccaggaagaaatgtggttcccc

SEQ ID NO: 32785 - DNA, 71 bp, chicken (Gallus Gallus)
  misc_feature (36): n=c or t
acctgcacagcactcaggttggtgttcaccccgctnggtgtcccctactgatatacaggagcacccaaggt

SEQ ID NO: 32786 - DNA, 71 bp, chicken (Gallus Gallus)
  misc_feature (36): n=c or t
tgtcgatagctgtgtgtgagcggctgaggatgcagngctgtgctgcagagcagtggcgttctgctgtgggc

SEQ ID NO: 32787 - DNA, 71 bp, chicken (Gallus Gallus)
  misc_feature (36): n=a or c
cggatgcttcaaggatcccaaaaagcccatctcagntaatgcacgttgtttattctcactgctgaaagaaa

SEQ ID NO: 32788 - DNA, 71 bp, chicken (Gallus Gallus)
  misc_feature (36): n=a or g
gcctcctgccatcattaggcctgatagcaattagtngtgcctgatggctgcagcgtaggtgccctacaagt

SEQ ID NO: 32789 - DNA, 71 bp, chicken (Gallus Gallus)
  misc_feature (36): n=a or g
ctctgctggtggtggcccatggcacggctcagggantgcatagtgtcacacacaggatttatgtgtatcta

SEQ ID NO: 32790 - DNA, 71 bp, chicken (Gallus Gallus)
  misc_feature (36): n=a or g
tgcagcctgtactgagctctctgctctttgatgggnatctttgaagtcaccctgagatgctgcaattagca

SEQ ID NO: 32791 - DNA, 71 bp, chicken (Gallus Gallus)
  misc_feature (36): n=c or t
agccacagaaacttataatcctcactcattttcagncaaaaccatttccatggaaggacgaagttcacaat

SEQ ID NO: 32792 - DNA, 71 bp, chicken (Gallus Gallus)
  misc_feature (36): n=a or g
tcccgtagacccaagacgtttggattcccaacttgnctaaaggaacagtgccccgatgctggtcccatacc

SEQ ID NO: 32793 - DNA, 71 bp, chicken (Gallus Gallus)
  misc_feature (36): n=c or t
tagggaagggctttctgaaaccctgcatggggaagngagtccgctttgcccagggagggggtttgggaacc

SEQ ID NO: 32794 - DNA, 71 bp, chicken (Gallus Gallus)
  misc_feature (36): n=c or t
ggacccctgagtaccctctcagtttcacatccgccngtgtttaaaaacgagcaggaattgggcaagtggtg

SEQ ID NO: 32795 - DNA, 71 bp, chicken (Gallus Gallus)
  misc_feature (36): n=a or g
cactgaagtttttacagctggcgagagacggcagcngggaaggctgcagggcagtcccgtcagcagattcc

SEQ ID NO: 32796 - DNA, 71 bp, chicken (Gallus Gallus)
  misc_feature (36): n=t or c
gccctatgcaggagagtaacctcaatgccctcactnccatggctgtctgagcagacatctcctaaaacatc

SEQ ID NO: 32797 - DNA, 71 bp, chicken (Gallus Gallus)
  misc_feature (36): n=c or t
cgctcagcttctgcttggctttcattgtatttcctngttatttccaaaagctttttggtcagatcaccaac

SEQ ID NO: 32798 - DNA, 71 bp, chicken (Gallus Gallus)
  misc_feature (36): n=c or t
aaaccattcaggagccatcacaattaaaggtccttngccacgcagtttccacgtgaagctgcctccgctcg

SEQ ID NO: 32799 - DNA, 71 bp, chicken (Gallus Gallus)
  misc_feature (36): n=g or t
gctcctcctggatgctgccaaaggtagatgggttgngagtgtcccgcgaatgggattcagttctggagggg

SEQ ID NO: 32800 - DNA, 71 bp, chicken (Gallus Gallus)
  misc_feature (36): n=a or g
attagtcctcagtaccagcatacacttccagcagcncagatttaaagccatgctgatctcagtagcacaac

SEQ ID NO: 32801 - DNA, 71 bp, chicken (Gallus Gallus)
  misc_feature (36): n=g or t
taaacgaagaatgggaaagttcctgtcagtacagcngggaaagcagtcagcccaatgccagccccaggacc

SEQ ID NO: 32802 - DNA, 71 bp, chicken (Gallus Gallus)
  misc_feature (36): n=c or t
ggcgtgtcattgctgagacattctgacatctaagcngacaaacaggacgagtcagcaccgttctgcccagc

SEQ ID NO: 32803 - DNA, 71 bp, chicken (Gallus Gallus)
  misc_feature (36): n=g or t
tgtgagcacacaaacgatctttgctgtgctcttgcngctgagatggccaaaaaatctgcacgtaaactggt

SEQ ID NO: 32804 - DNA, 71 bp, chicken (Gallus Gallus)
  misc_feature (36): n=c or t
gtcagtggtggcaaaaggggcctgaaataatgaacngtttgccatcgtttggtgagtcaagcttttgcctg

SEQ ID NO: 32805 - DNA, 71 bp, chicken (Gallus Gallus)
  misc_feature (36): n=c or t
atgggaccctgccgttctcacccggcattttaccangaaagccacaagaaatgggtcatgtccatgctgtg

SEQ ID NO: 32806 - DNA, 71 bp, chicken (Gallus Gallus)
  misc_feature (36): n=a or g
tcttccaggaagtcaaaggaggagagcccgtcctcncttctgcagatctgagcgccgaaaggggcaaagga

SEQ ID NO: 32807 - DNA, 71 bp, chicken (Gallus Gallus)
  misc_feature (36): n=a or g
ctttccttgctccttctccagcaggctgcatgcccnatgctgatgcatgtgattgctgtcctgtgagctcc

SEQ ID NO: 32808 - DNA, 71 bp, chicken (Gallus Gallus)
  misc_feature (36): n=g or t
agcccatgggcgctgcctttccggttcttccagaanaacaaaccccctgggggtttatcacccatcacgag

SEQ ID NO: 32809 - DNA, 71 bp, chicken (Gallus Gallus)
  misc_feature (36): n=a or g
gaaatctctgccctagaaagcagcatgcagcctccntctcccttgagcagcagaacactttggcatcccca

SEQ ID NO: 32810 - DNA, 71 bp, chicken (Gallus Gallus)
  misc_feature (36): n=a or g
tctgaggtggcagcgtcactgaagacgctcagcatntcgaggaagtcttcaaaggacatgctgtcatcccc

SEQ ID NO: 32811 - DNA, 71 bp, chicken (Gallus Gallus)
  misc_feature (36): n=a or g
gctccacggtgtgtgtgcctctggtgcgttgtaggntcattcacagaacacttggactgtctcttgagtca

SEQ ID NO: 32812 - DNA, 71 bp, chicken (Gallus Gallus)
  misc_feature (36): n=a or c
gcataaaggggatttgggtgggctgatggtggctancgtctgtgtgactgcagcaccagggctcgcacagt

SEQ ID NO: 32813 - DNA, 71 bp, chicken (Gallus Gallus)
  misc_feature (36): n=a or g
gggatcaatgtcacctggggaaaaaagaagcaggcntgattatctgagaataactgcagtcataaacagtg

SEQ ID NO: 32814 - DNA, 71 bp, chicken (Gallus Gallus)
  misc_feature (36): n=a or g
aagacagagctgctgctttattttatgcagtaccanaacaatggggctctgagttggctgcagtctggcag

SEQ ID NO: 32815 - DNA, 71 bp, chicken (Gallus Gallus)
  misc_feature (36): n=a or g
tcagaaaggtttttccttgcagttaagatttatccnggctcagaaatgatctgggtggatttctgagccag

SEQ ID NO: 32816 - DNA, 71 bp, chicken (Gallus Gallus)
  misc_feature (36): n=a or g
gaaagatgctccttaccttttctggtcaggttaacnttttgattctcaaacatttgtacagactctcccac

SEQ ID NO: 32817 - DNA, 71 bp, chicken (Gallus Gallus)
  misc_feature (36): n=a or g
tcaactcacagcctcttcaacgtgagaaatgaaagngggagaaaagaagagctcaaggtgacgatggggaa

SEQ ID NO: 32818 - DNA, 71 bp, chicken (Gallus Gallus)
  misc_feature (36): n=g or t
ttcatcagcattacctggtccaaggaataattaacntgtgagatggaaagatgtgggtcagccagaaactg

SEQ ID NO: 32819 - DNA, 71 bp, chicken (Gallus Gallus)
  misc_feature (36): n=a or g
accagcagacataggagcagggcgtaaagagaatgngccagagaattgccagtcccaaattaacagctccg

SEQ ID NO: 32820 - DNA, 71 bp, chicken (Gallus Gallus)
  misc_feature (36): n=a or g
gcatcacgaagcatttggcatgaggtgttctgcttngatgagccactgggatttcctcagcaaggaaacct

SEQ ID NO: 32821 - DNA, 71 bp, chicken (Gallus Gallus)
  misc_feature (36): n=c or t
tgaatttgaagtaaagtttgacattgtagaagaagnttgaaattaaatataatatatgcgtaactcccatg

SEQ ID NO: 32822 - DNA, 71 bp, chicken (Gallus Gallus)
  misc_feature (36): n=a or g
cagagggtttcgcaatacccatcactctcagacacntccagcactgctcaccctcctcatcccactgtgtt

SEQ ID NO: 32823 - DNA, 71 bp, chicken (Gallus Gallus)
  misc_feature (36): n=c or t
tctcaagccacctggtactatggtacacaagaagcnagtacagttatgctagcacatcaagcatacttcct

SEQ ID NO: 32824 - DNA, 71 bp, chicken (Gallus Gallus)
  misc_feature (36): n=g or t
cttcacccaaatcactccttgggaccaggatttcanatccccaggataacacccatggtgacttgtggaac

SEQ ID NO: 32825 - DNA, 71 bp, chicken (Gallus Gallus)
  misc_feature (36): n=c or t
ttccttctcttgctccccagctgctgaccaagcttnggagtacagcatggggctcacgttcctcaccaggg

SEQ ID NO: 32826 - DNA, 71 bp, chicken (Gallus Gallus)
  misc_feature (36): n=a or g
gggatgatgatgctgaacatgttggcctcgatgaancctaggaaagtgccgccctccccggggctggggct

SEQ ID NO: 32827 - DNA, 71 bp, chicken (Gallus Gallus)
  misc_feature (36): n=a or c
gcagctccggtgggacgagcaggggacctgccaggnaatgcagagctctgggctcctttgctaacaaagcc

SEQ ID NO: 32828 - DNA, 71 bp, chicken (Gallus Gallus)
  misc_feature (36): n=g or t
tccaggagaaagtcaaattacagcaagcctgttttngggaaagaagcactcattatcagcttgatcccgct

SEQ ID NO: 32829 - DNA, 71 bp, chicken (Gallus Gallus)
  misc_feature (36): n=a or g
ccatttggggaacacatcccagataaggatggatcnttgcctctacctttctgaagactacaaaaaaaaat

SEQ ID NO: 32830 - DNA, 71 bp, chicken (Gallus Gallus)
  misc_feature (36): n=a or c
cagacaaaaaaacaacataccaaggagtgcaaagangtgccaaaataacacctgagtattaaaatggcatc

SEQ ID NO: 32831 - DNA, 71 bp, chicken (Gallus Gallus)
  misc_feature (36): n=c or t
tctctttctaaactgctgtatgtccggaatatctcngctgagctttgttgaatacacctgggagcagcttc

SEQ ID NO: 32832 - DNA, 71 bp, chicken (Gallus Gallus)
  misc_feature (36): n=c or t
atgtttcttttcttacaggttttaggtggaaaaaanattcaagggtttccttcactcacttctgtgaaata

SEQ ID NO: 32833 - DNA, 71 bp, chicken (Gallus Gallus)
  misc_feature (36): n=c or t
cccagagtgtccattcccaaaatcctaccagtatangaaaatgcatgattaaagtcgtgtgcatttattaa

SEQ ID NO: 32834 - DNA, 71 bp, chicken (Gallus Gallus)
  misc_feature (36): n=g or t
gtcccaagagccgtgtttgtgaagcaggacaatggnggcagcgcctcggtcatacccgtgtcagctgtccg

SEQ ID NO: 32835 - DNA, 71 bp, chicken (Gallus Gallus)
  misc_feature (36): n=a or g
gagaagaagtggtaggtaaaatccgaagccttcacnctgattcactgaagaagctggcacttaaatgtgaa

SEQ ID NO: 32836 - DNA, 71 bp, chicken (Gallus Gallus)
  misc_feature (36): n=g or t
ggtatcaaaaaacagccccattttgattaagtactnaataacaaaagaggaactaaggttctgatgcttcc

SEQ ID NO: 32837 - DNA, 71 bp, chicken (Gallus Gallus)
  misc_feature (36): n=g or t
ggagaaacacatttataaatatgatggcttttcatntaaatgttttggtgctcaagttgagcaaacttgct

SEQ ID NO: 32838 - DNA, 71 bp, chicken (Gallus Gallus)
  misc_feature (36): n=a or c
tcttggggaaaattgaggtttggcaaagtttccatngaaagtttgctgtgacagccatgggactttcccag

SEQ ID NO: 32839 - DNA, 71 bp, chicken (Gallus Gallus)
  misc_feature (36): n=c or t
tgtgttccaagtagaataatgaaaggtgcgtgctgnattgttttttcttcacttatcctcccagttgtgtg

SEQ ID NO: 32840 - DNA, 71 bp, chicken (Gallus Gallus)
  misc_feature (36): n=c or t
ggcttaaataggtcctttagtcctcgtaaggtaagngtgtgttgtgtaatatgttttcatacagtgaggat

SEQ ID NO: 32841 - DNA, 71 bp, chicken (Gallus Gallus)
  misc_feature (36): n=c or t
ctcgagcagatgtgatgagttttctttaatgtgttnatctctgtctgaccctgaatttttcagttttagtt

SEQ ID NO: 32842 - DNA, 71 bp, chicken (Gallus Gallus)
  misc_feature (36): n=c or t
cttctgtaaaaacatgatcgttcttcactaggaaangttctttgcactgtccagtgtgatgaagcagttaa

SEQ ID NO: 32843 - DNA, 71 bp, chicken (Gallus Gallus)
  misc_feature (36): n=c or t
agtgaagccaaataagatgcttacagggcagcaaangtcatagcaatgccctgggcttatggcttccagag

SEQ ID NO: 32844 - DNA, 71 bp, chicken (Gallus Gallus)
  misc_feature (36): n=c or t
ctgtagcttacacagaagcaatctctaagtcagcantgctacaatagtattcaaagccttgtgataatgga

SEQ ID NO: 32845 - DNA, 71 bp, chicken (Gallus Gallus)
  misc_feature (36): n=c or t
gccagaggagcaaacgtggcactctcttccctctanaaagaacgatgagactctatgtagacaccaagaac

SEQ ID NO: 32846 - DNA, 71 bp, chicken (Gallus Gallus)
  misc_feature (36): n=c or t
aaggcctacatccccatttagtactctgtggtgttngcactatctttcagcatctccacttgcaacctgtg

SEQ ID NO: 32847 - DNA, 71 bp, chicken (Gallus Gallus)
  misc_feature (36): n=c or t
ctgtggcataatgcactcagaggtgagatgagtaangtggaaagaaacctgaaaggaaacagagggtgtca

SEQ ID NO: 32848 - DNA, 71 bp, chicken (Gallus Gallus)
  misc_feature (36): n=a or g
ggcaaagtgttacagtgcatacagtaagaagtcaangagaaaatcgtaatacaacagctattagaaaacaa

SEQ ID NO: 32849 - DNA, 71 bp, chicken (Gallus Gallus)
  misc_feature (36): n=a or g
tgactaacagtaccgttcagcacgctgttttcaccnaagaagaaaaggtttatggccatctgaaatggcaa

SEQ ID NO: 32850 - DNA, 71 bp, chicken (Gallus Gallus)
  misc_feature (36): n=a or g
tcccaagaagagaagtaatcatcctctcctgaaacnttataagcagtactgacaaaaagcattttccactc

SEQ ID NO: 32851 - DNA, 71 bp, chicken (Gallus Gallus)
  misc_feature (36): n=a or g
tcttggggaaacaatatttcagaaacaccagctacntgcagggacagcccttcaaatgcacttgaaagcac

SEQ ID NO: 32852 - DNA, 71 bp, chicken (Gallus Gallus)
  misc_feature (36): n=g or t
tgtatttctggaacataggaaccagagccagacctncaatctgtcttcattccatcaggactagtctttta

SEQ ID NO: 32853 - DNA, 71 bp, chicken (Gallus Gallus)
  misc_feature (36): n=c or t
tggtggtatttttccatattcagtctttcctcctanaagattttcagctgttctaaccctattccttcagc

SEQ ID NO: 32854 - DNA, 71 bp, chicken (Gallus Gallus)
  misc_feature (36): n=a or g
gcctacatctccttcataaagaagagttttctggtnaagtgttcttttcacaacctcttaacctaaagcaa

SEQ ID NO: 32855 - DNA, 71 bp, chicken (Gallus Gallus)
  misc_feature (36): n=a or g
aaaaacactgggttttcagacaccgagatcaacacntttatcttcagctccacttgagctatgattcagat

SEQ ID NO: 32856 - DNA, 71 bp, chicken (Gallus Gallus)
  misc_feature (36): n=a or c
agtaattactattgccctccacaagatacatacaancaaccagcacttcagttgtcacatttctgggtcta

SEQ ID NO: 32857 - DNA, 71 bp, chicken (Gallus Gallus)
  misc_feature (36): n=a or g
gacatgggaacctctgggatacatgggaaagtatgntatgggggagaggaaaggaactgagcgtttcttaa

SEQ ID NO: 32858 - DNA, 71 bp, chicken (Gallus Gallus)
  misc_feature (36): n=a or c
ggaacaacagtttctaacagaggctgcacaaccagnagcatattgaacacaaatccatatgaagttgaagg

SEQ ID NO: 32859 - DNA, 71 bp, chicken (Gallus Gallus)
  misc_feature (36): n=c or t
cagtcttgtcttcaagatattacagcaggagatgangaaaattctaaggatttaattcagccaactatttc

SEQ ID NO: 32860 - DNA, 71 bp, chicken (Gallus Gallus)
  misc_feature (36): n=c or t
ccattggaaacctggcaagaattttgattccatgtngtagagagacattgtggaggaactgctgaagctag

SEQ ID NO: 32861 - DNA, 71 bp, chicken (Gallus Gallus)
  misc_feature (36): n=a or g
caccagtatcccagaaacactacttaggattttatngagcttacatttgtttttctcttatgttcagtcca

SEQ ID NO: 32862 - DNA, 71 bp, chicken (Gallus Gallus)
  misc_feature (36): n=a or g
tttaactcttcaacaggaaaactgatatttgagccnctctgaaatcttctcatacctttgatatacattac

SEQ ID NO: 32863 - DNA, 71 bp, chicken (Gallus Gallus)
  misc_feature (36): n=a or c
tgtctcaccataggatttttggtgttgtgctccccncccctcaaagctgcaaggcctaaacaaggagggta

SEQ ID NO: 32864 - DNA, 71 bp, chicken (Gallus Gallus)
  misc_feature (36): n=a or g
tgcaacttaatcatctgctggcctcctactgttaanaggacccaaagcacagttccctctgtcaaaaaact

SEQ ID NO: 32865 - DNA, 71 bp, chicken (Gallus Gallus)
  misc_feature (36): n=a or g
gtttaaagatccttcatgacaatcaagattcttctnaaaagttatgtgcttacacagcgtttagaaagact

SEQ ID NO: 32866 - DNA, 71 bp, chicken (Gallus Gallus)
  misc_feature (36): n=c or t
cactagatagtactgacttcatgagagaaaaactgnagtttgcacacattcaagcttttgcactgctatac

SEQ ID NO: 32867 - DNA, 71 bp, chicken (Gallus Gallus)
  misc_feature (36): n=a or g
aaaatcaagactaaagtttctttatggaattcagtntaagtatgaagctgaaatgatcctctctcatgtgg

SEQ ID NO: 32868 - DNA, 71 bp, chicken (Gallus Gallus)
  misc_feature (36): n=c or t
ccggagtcctgagcttgccatcggttctctacaacnaatcttagtgcaaattattccttagaagagcatga

SEQ ID NO: 32869 - DNA, 71 bp, chicken (Gallus Gallus)
  misc_feature (36): n=a or g
ggcaaactgaagaaaacacaaaggcagtgcagagangtgaaattaagaagcgtaagtccaaggaagaatca

SEQ ID NO: 32870 - DNA, 71 bp, chicken (Gallus Gallus)
  misc_feature (36): n=c or t
aaaaacagtgacaaatgtttgagaaaataagttctntctgccaagatcccatactcctgttttgctaagca

SEQ ID NO: 32871 - DNA, 71 bp, chicken (Gallus Gallus)
  misc_feature (36): n=a or g
tgtgtgacactactccttcagaggtttcaacctagnggaaaaatattcagtttggtattttaaatgacttt

SEQ ID NO: 32872 - DNA, 71 bp, chicken (Gallus Gallus)
  misc_feature (36): n=a or c
tattccagtctattccaggctgcctctactgcttcntaagtaggatgcaggaggctatgcagcaattagct

SEQ ID NO: 32873 - DNA, 71 bp, chicken (Gallus Gallus)
  misc_feature (36): n=c or t
tcttaaatataaagttacatcttctgagaatgttanaataaaacatgacttaacaggattttctcagcatc

SEQ ID NO: 32874 - DNA, 71 bp, chicken (Gallus Gallus)
  misc_feature (36): n=c or t
atatgaagatgatgtaagtacctggaacatgctttntccattttaaatttgactctagtgcagtcgttata

SEQ ID NO: 32875 - DNA, 71 bp, chicken (Gallus Gallus)
  misc_feature (36): n=c or t
gcatgaaagactttgctaagaagagtttccgtctcntaatggatatcaacttgaaagctccagttatagtt

SEQ ID NO: 32876 - DNA, 71 bp, chicken (Gallus Gallus)
  misc_feature (36): n=c or t
aaagtacaaaacttgcaaatcacagagtaaagtttnagctctatatctgtttttctactggatcagtttca

SEQ ID NO: 32877 - DNA, 71 bp, chicken (Gallus Gallus)
  misc_feature (36): n=c or t
aagttacagctctgttctatcactgaggctctctanctgcgcagctaagtaatttgtgaactttatcagtt

SEQ ID NO: 32878 - DNA, 71 bp, chicken (Gallus Gallus)
  misc_feature (36): n=c or t
tgagacttgctaaacatattctccatcctgtgttcntcttgtattgcatactcttcctaaatcctgtccag

SEQ ID NO: 32879 - DNA, 71 bp, chicken (Gallus Gallus)
  misc_feature (36): n=a or c
tgtccccattcctaaaagctatgaaccctaaaaacnaatttagtcccatcctacaagtgacaggtttaact

SEQ ID NO: 32880 - DNA, 71 bp, chicken (Gallus Gallus)
  misc_feature (36): n=a or g
ggaaagacactagtttctcattagtgttagtatggnaagctaacttaagctttaagcctcacttttgacct

SEQ ID NO: 32881 - DNA, 71 bp, chicken (Gallus Gallus)
  misc_feature (36): n=c or t
cttatttttcatgtaaaggtccactactgctacctnggtaagactgctttgtaaaaatgtagtttagcaga

SEQ ID NO: 32882 - DNA, 71 bp, chicken (Gallus Gallus)
  misc_feature (36): n=a or g
tgagaaatacctccacctgtagtgtgttgggatganagtacaattctggtttatctgagctgttttttttc

SEQ ID NO: 32883 - DNA, 71 bp, chicken (Gallus Gallus)
  misc_feature (36): n=a or g
caaggtaattttcgggaaggttgctttgcgtgtcancaaatctctttaagacatagaaaaataaaggatgt

SEQ ID NO: 32884 - DNA, 71 bp, chicken (Gallus Gallus)
  misc_feature (36): n=c or t
actcttttttttaactcagtaggtcattatggatcncctaatatgacaagtatgtatttttaggtgtattt

SEQ ID NO: 32885 - DNA, 71 bp, chicken (Gallus Gallus)
  misc_feature (36): n=a or g
cctgtgaatctgtgtctaaaaggctaaaccataganaaaaatgctgctgaagtttttgctataatattcta

SEQ ID NO: 32886 - DNA, 71 bp, chicken (Gallus Gallus)
  misc_feature (36): n=a or g
tggaggggttaggggagaggagacggggacagaganggttgagagctcctggcatcatgttggctgaagag

SEQ ID NO: 32887 - DNA, 71 bp, chicken (Gallus Gallus)
  misc_feature (36): n=c or t
gaagccatgaaatccaatgttagaacagaaattgangtctgaattcagtctatcgaaatgaatggtcagag

SEQ ID NO: 32888 - DNA, 71 bp, chicken (Gallus Gallus)
  misc_feature (36): n=a or c
taagggttgcaaaaggtgatgacttcttatggtacncccctatcaaggcccattgcatttctcacttagga

SEQ ID NO: 32889 - DNA, 71 bp, chicken (Gallus Gallus)
  misc_feature (36): n=g or t
tgtttccttttttttagcatgcttttgtgtttttgnattataagctgagggttgtaagattgcttctaagg

SEQ ID NO: 32890 - DNA, 71 bp, chicken (Gallus Gallus)
  misc_feature (36): n=a or g
tatgtggggtagacagggggctgtgttctatggagnagttatagaaacacatttatgtgtaagtaaacaaa

SEQ ID NO: 32891 - DNA, 71 bp, chicken (Gallus Gallus)
  misc_feature (36): n=a or g
gagctcatctgaggaaataagcaagcaagaaagcangcttaaaaattaggcaggcaaaagctgtatttagg

SEQ ID NO: 32892 - DNA, 71 bp, chicken (Gallus Gallus)
  misc_feature (36): n=c or t
gatttgcttcctttcacatgaagaatccttcagagntttgaaggggtttgataccaagctaatgtacagaa

SEQ ID NO: 32893 - DNA, 71 bp, chicken (Gallus Gallus)
  misc_feature (36): n=a or g
tgtatatgcaaggtaaccaacagaagtctatctacncatttatttctaacgtcacatggacagacttaggt

SEQ ID NO: 32894 - DNA, 71 bp, chicken (Gallus Gallus)
  misc_feature (36): n=c or t
cttattagattatgcaaataatgaggaaaagacagnagactagtttgttatttctgaaaggagaatatact

SEQ ID NO: 32895 - DNA, 71 bp, chicken (Gallus Gallus)
  misc_feature (36): n=a or g
gcatattgctctttgcagagtactgtccttaaatgnaagagcctaatatgcaacacagtggttttgtgtag

SEQ ID NO: 32896 - DNA, 71 bp, chicken (Gallus Gallus)
  misc_feature (36): n=c or t
aattatttccgtggattgtgcaggtaaagctgctcngaagtctctcctttgaatgaaataatggcttgaaa

SEQ ID NO: 32897 - DNA, 71 bp, chicken (Gallus Gallus)
  misc_feature (36): n=c or t
cagtcccacgtgtggatgataccagggacagagtancctgcaaacagcaaaaatcattcatttgtgcttct

SEQ ID NO: 32898 - DNA, 71 bp, chicken (Gallus Gallus)
  misc_feature (36): n=c or t
gtgcctggttgtatccctgattcattttacagttgncacagtgtttcagtttcacctgtagaagggcagca

SEQ ID NO: 32899 - DNA, 71 bp, chicken (Gallus Gallus)
  misc_feature (36): n=a or c
catccttgaaaatcaggctagtaaagtgtacatctncccaccataaatccagatttgaaggtatttactca

SEQ ID NO: 32900 - DNA, 71 bp, chicken (Gallus Gallus)
  misc_feature (36): n=a or g
attttggctttgcagtaacaagaaaaatacgtagcntgagtttatttaaaacgactttccatagacatggt

SEQ ID NO: 32901 - DNA, 71 bp, chicken (Gallus Gallus)
  misc_feature (36): n=c or t
aattactactactttgtccatctgcattatgagaanatcttttgtataagcatttgaagtgcaaagttgga

SEQ ID NO: 32902 - DNA, 71 bp, chicken (Gallus Gallus)
  misc_feature (36): n=a or g
taatagggcacatcattttatccgtctgagggattntgagcactgccaaggggaaagcagcgtgcctctag

SEQ ID NO: 32903 - DNA, 71 bp, chicken (Gallus Gallus)
  misc_feature (36): n=a or g
tagcagcacaaagtcatcatattagaggctcagaanaaatacacagcgtctgtcagagagcagcagaggca

SEQ ID NO: 32904 - DNA, 71 bp, chicken (Gallus Gallus)
  misc_feature (36): n=a or g
ggatgtccagacagtgtcagttgtcatagaaacacnggtgatactgcaggtaggggaccccttaggatcaa

SEQ ID NO: 32905 - DNA, 71 bp, chicken (Gallus Gallus)
  misc_feature (36): n=a or g
tgaaacaaatctaaatgatacagacaagaatctccnagagcaatcagatctaacatgcagatattatcaac

SEQ ID NO: 32906 - DNA, 71 bp, chicken (Gallus Gallus)
  misc_feature (36): n=c or t
atcgtgcctacctaaagagaaaccagctccatgtgnactccatgtgcagtgtccggcacagagccaggtaa

SEQ ID NO: 32907 - DNA, 71 bp, chicken (Gallus Gallus)
  misc_feature (36): n=a or g
tatattaatataagttattatttgaatgtatcccantgactctcaaattgcactttttccgttgtggctct

SEQ ID NO: 32908 - DNA, 71 bp, chicken (Gallus Gallus)
  misc_feature (36): n=c or t
agacggttttgaaaccgtcacaacatgcctttgtgngaattgacataagcagagaagcagaatagctgttc

SEQ ID NO: 32909 - DNA, 71 bp, chicken (Gallus Gallus)
  misc_feature (36): n=a or g
atgctttactttgaaacaattaatatttctctaacnctaagagtactagtttgttgcagttagaaattttc

SEQ ID NO: 32910 - DNA, 71 bp, chicken (Gallus Gallus)
  misc_feature (36): n=c or t
tcaaacttgcggtttaattatgattagggctctttnaatgtaagctaagaactattacttcagtcagacag

SEQ ID NO: 32911 - DNA, 71 bp, chicken (Gallus Gallus)
  misc_feature (36): n=c or t
tccataggagcttttgctatgggatgtgttaacttntgtctttggcagatcatgtgacttagcaaggtatg

SEQ ID NO: 32912 - DNA, 71 bp, chicken (Gallus Gallus)
  misc_feature (36): n=c or t
agaaacaaatctgacagaggatgcagccaatgctgnggaatcttcaactcaaatgtcctctgggggcacct

SEQ ID NO: 32913 - DNA, 71 bp, chicken (Gallus Gallus)
  misc_feature (36): n=g or t
tatcctgttatcccttagaaggttctttgagaagtntcttccttttcattgctccactgacctgttcatat

SEQ ID NO: 32914 - DNA, 71 bp, chicken (Gallus Gallus)
  misc_feature (36): n=c or t
acagatgtcacactccatttatagaagttcatttantcattaattgagagtgtctcttcaattataactat

SEQ ID NO: 32915 - DNA, 71 bp, chicken (Gallus Gallus)
  misc_feature (36): n=a or g
ctaatctcttctgtaagaagtataaatgaggaaaancagtgcttataaggaatggtttatttggggtcttc

SEQ ID NO: 32916 - DNA, 71 bp, chicken (Gallus Gallus)
  misc_feature (36): n=c or t
ttgcaccttaacacaggaattacagtgaacattcanttcgctgtctgcagttcaggcaagtattaggaatg

SEQ ID NO: 32917 - DNA, 71 bp, chicken (Gallus Gallus)
  misc_feature (36): n=c or t
tgagagttgtggatgatgtgctatgaggttctactntgagatggctatcaggctttgcactctttcttccc

SEQ ID NO: 32918 - DNA, 71 bp, chicken (Gallus Gallus)
  misc_feature (36): n=a or c
cagacagtatccttcctaggagagatctgagagccncaagtgtatgtgcggtgtatgtgacctgttttttg

SEQ ID NO: 32919 - DNA, 71 bp, chicken (Gallus Gallus)
  misc_feature (36): n=a or g
aatgcctgggctgtccgcttgtgccatgctatcccncattttcagctgtagggatggtggggcattgttgc

SEQ ID NO: 32920 - DNA, 71 bp, chicken (Gallus Gallus)
  misc_feature (36): n=a or c
aacctcacaaggcagcttcttattgggcactctgtnctgcacagattactttctttaagtagtcacatacc

SEQ ID NO: 32921 - DNA, 71 bp, chicken (Gallus Gallus)
  misc_feature (36): n=a or g
gttagtcaaccttatctgatatcaaatgtctcaatntagtttgtttaaataacatatttcagcatagtaag

SEQ ID NO: 32922 - DNA, 71 bp, chicken (Gallus Gallus)
  misc_feature (36): n=a or g
ccctactgccgagcaccggactgcttcgagagcccnagcacacccccccagtccggctcgcctttaacgcc

SEQ ID NO: 32923 - DNA, 71 bp, chicken (Gallus Gallus)
  misc_feature (36): n=a or g
aaaagagaacaaatttgctactgaacatctgaagtntgatttttccaagatcaggtgcaggtcggtacatt

SEQ ID NO: 32924 - DNA, 71 bp, chicken (Gallus Gallus)
  misc_feature (36): n=c or t
catcataactgcaaagagacttgctgttttctatcngagactttgaaacagtatacagacatctttgcttg

SEQ ID NO: 32925 - DNA, 71 bp, chicken (Gallus Gallus)
  misc_feature (36): n=c or t
tagcttcagtgtaagagcatttttgttcagagtganttttttccctctcgcccacctaagatcacatttat

SEQ ID NO: 32926 - DNA, 71 bp, chicken (Gallus Gallus)
  misc_feature (36): n=a or g
aggataaaatgaagggaattgcccactaacactgtntaggtgggactcttaggcaaggagctgcacttgtt

SEQ ID NO: 32927 - DNA, 71 bp, chicken (Gallus Gallus)
  misc_feature (36): n=c or t
cttactgtgtcctgagttacgtggttagttaaaagntagcacttaaaacattataacatccttctagtatg

SEQ ID NO: 32928 - DNA, 71 bp, chicken (Gallus Gallus)
  misc_feature (36): n=a or g
gacaacctgtctgtgcatgtctacacaacctgccanattactgtacttacattatttagttttatgtcagg

SEQ ID NO: 32929 - DNA, 71 bp, chicken (Gallus Gallus)
  misc_feature (36): n=g or t
ttgatgaattttcttttcttagcaaagaaggtgaanggagtagacccaggaggcggaggcagtggcggcat

SEQ ID NO: 32930 - DNA, 71 bp, chicken (Gallus Gallus)
  misc_feature (36): n=c or t
aaggctctcagattatacaggaccaatttgcacccnggagagattttaatgccagtgaaaaacgctagatg

SEQ ID NO: 32931 - DNA, 71 bp, chicken (Gallus Gallus)
  misc_feature (36): n=a or g
tttaaccagttcagcttacgttgaaaaagtctcacntataacttctgcccaccaactgcaaatttcagtta

SEQ ID NO: 32932 - DNA, 71 bp, chicken (Gallus Gallus)
  misc_feature (36): n=g or t
tgagaagttttttggtgagtattgtcttctgttctngagaaattattcccttaattaaaagtcaaggtcta

SEQ ID NO: 32933 - DNA, 71 bp, chicken (Gallus Gallus)
  misc_feature (36): n=a or g
tacagatgcaatggggttttctatcaaaagctcacngtacctaattgactgtaaatgaatctgcagtagct

SEQ ID NO: 32934 - DNA, 71 bp, chicken (Gallus Gallus)
  misc_feature (36): n=a or g
gaaatgtgtagatttctcatccttctcaggtggganagtagaaataaatatgagatagctatttaccagct

SEQ ID NO: 32935 - DNA, 71 bp, chicken (Gallus Gallus)
  misc_feature (36): n=c or t
ggcagagggcattggccaccttctagaattacatgnaaccagttagaacagcacctctaaatcatttatat

SEQ ID NO: 32936 - DNA, 71 bp, chicken (Gallus Gallus)
  misc_feature (36): n=a or c
aactgctgctggagcaaaaataatcaaagggacccnggcatcactgagctgcctgagttttaagcattatt

SEQ ID NO: 32937 - DNA, 71 bp, chicken (Gallus Gallus)
  misc_feature (36): n=a or c
atggaatcatctttgcagccaattacctgggctctncacagctgctctctgagcgcaacccttccaaaaac

SEQ ID NO: 32938 - DNA, 71 bp, chicken (Gallus Gallus)
  misc_feature (36): n=a or g
tgacaagatatttctcttgtagcaaacaagggaacnttcagttggacaaataatcatttaagtaggaattg

SEQ ID NO: 32939 - DNA, 71 bp, chicken (Gallus Gallus)
  misc_feature (36): n=c or t
aatataccagctatacaagaacctggctccctaaantctggattggcatttaaagtatcaggtgataaaga

SEQ ID NO: 32940 - DNA, 71 bp, chicken (Gallus Gallus)
  misc_feature (36): n=g or t
tactgattttaacagaaccttgctgccaatctcatnagattttcagcagttctttgtgatcatgattggta

SEQ ID NO: 32941 - DNA, 71 bp, chicken (Gallus Gallus)
  misc_feature (36): n=a or g
agtacagatgacaacagcaatttttgtttagatgcnatcggttaaattaacattgacatttattgtgcatg

SEQ ID NO: 32942 - DNA, 71 bp, chicken (Gallus Gallus)
  misc_feature (36): n=c or t
ccaagtttctatagtccaatcatcagtactaagaangacacccacaggaaatttccgcagctctccatgtg

SEQ ID NO: 32943 - DNA, 71 bp, chicken (Gallus Gallus)
  misc_feature (36): n=c or t
catcagacaccatctcagcagacaaaggttaaattncatctgcatattcagtcatctcctttgactggaga

SEQ ID NO: 32944 - DNA, 71 bp, chicken (Gallus Gallus)
  misc_feature (36): n=a or g
cgcagctccactggcttcaggaattttagtccgtgnggcccacacattaccaaggggctaagaagtgtttc

SEQ ID NO: 32945 - DNA, 71 bp, chicken (Gallus Gallus)
  misc_feature (36): n=a or g
taccggctgagaagcagttgttttaaatcctgaagnatctattctaagatttggctgaggctgagcttgag

SEQ ID NO: 32946 - DNA, 71 bp, chicken (Gallus Gallus)
  misc_feature (36): n=a or g
tgccaagtcatctaataaacatgtactaaagaaatnaaatccactttggtatgacagaacacttatggtat

SEQ ID NO: 32947 - DNA, 71 bp, chicken (Gallus Gallus)
  misc_feature (36): n=c or t
ccagaataaaacccaactgtctccaggatctcattncctaacatgtagcatataaacaaaaatatacacag

SEQ ID NO: 32948 - DNA, 71 bp, chicken (Gallus Gallus)
  misc_feature (36): n=g or t
gtcagagctatattgaggttaggaaaacacaactgnaatcaaactactagaaaaaggaactgatctacagg

SEQ ID NO: 32949 - DNA, 71 bp, chicken (Gallus Gallus)
  misc_feature (36): n=c or t
ctgctgctgaccatagtgtaaacaaaactgataaanagagaattctgatatgaagtcaagaagcttcctaa

SEQ ID NO: 32950 - DNA, 71 bp, chicken (Gallus Gallus)
  misc_feature (36): n=c or t
ggatctggggctctttatgtagacaacccagtctgngaattacactgaaccaccctactgctgcccaacct

SEQ ID NO: 32951 - DNA, 71 bp, chicken (Gallus Gallus)
  misc_feature (36): n=a or g
cagaacatctggcagcggataccacatgattgcagntgacctcttgccaggctgaaagaggtctgacccca

SEQ ID NO: 32952 - DNA, 71 bp, chicken (Gallus Gallus)
  misc_feature (36): n=c or t
ctacagtcatcacattgcttataccatcctaaggtncaaatttcactcatttctgttagcagaaattctct

SEQ ID NO: 32953 - DNA, 71 bp, chicken (Gallus Gallus)
  misc_feature (36): n=c or t
gtgggatatgatagttgaaagagaattaagaagaantaattagcagtgggccttctgagcagttttttttg

SEQ ID NO: 32954 - DNA, 71 bp, chicken (Gallus Gallus)
  misc_feature (36): n=a or g
gaggacacatatgtctgtgtttgcagctcagtgctngctgaagcacagttccccgtgagcaccaggttcaa

SEQ ID NO: 32955 - DNA, 71 bp, chicken (Gallus Gallus)
  misc_feature (36): n=c or t
tataaaaagggaaattttcaacagttgtttctagcncaaagtttccttacaattaataaaatcattctctt

SEQ ID NO: 32956 - DNA, 71 bp, chicken (Gallus Gallus)
  misc_feature (36): n=a or c
cttatttttttagatcttccatactgttactgtcanataatctgtacaacagttgccatggaagacttcca

SEQ ID NO: 32957 - DNA, 71 bp, chicken (Gallus Gallus)
  misc_feature (36): n=c or t
tcttgaagcttactgttgtaagacatccacaggtanggaatggtgcatttttgactttatggttgatgagg

SEQ ID NO: 32958 - DNA, 71 bp, chicken (Gallus Gallus)
  misc_feature (36): n=c or t
ttcagagataaatgtccagaagggatttgttgcccnagatctatcagaaaacatatttaagatattctgtg

SEQ ID NO: 32959 - DNA, 71 bp, chicken (Gallus Gallus)
  misc_feature (36): n=a or g
aaatctcagttcattcataatgcaattcaaatcctncattgcttaccttttgtcatttcctactctcctgt

SEQ ID NO: 32960 - DNA, 71 bp, chicken (Gallus Gallus)
  misc_feature (36): n=c or t
ataattttggaatagaatgttagtagctgttgtaanggtgcttctgtattctcatgtttcctcttgcagta

SEQ ID NO: 32961 - DNA, 71 bp, chicken (Gallus Gallus)
  misc_feature (36): n=c or t
aggaagtgaacagaaggctgacattctgtgtatgtnattttattgagtttattcagtctgtttgatatttt

SEQ ID NO: 32962 - DNA, 71 bp, chicken (Gallus Gallus)
  misc_feature (36): n=a or g
tgatttattatagtctcttgcttcttctttgtctcntttatatactaaagctacagaatgagaactgtctt

SEQ ID NO: 32963 - DNA, 71 bp, chicken (Gallus Gallus)
  misc_feature (36): n=c or t
tcctccagacagaagctgacagtgtgcccagttatnaatggagaagatcaccttcgccttttgaattttca

SEQ ID NO: 32964 - DNA, 71 bp, chicken (Gallus Gallus)
  misc_feature (36): n=c or t
ctaaatatattgttctaggcaatcgtgtctctgttncttagccttaatatttttctgcatgtcatacacat

SEQ ID NO: 32965 - DNA, 71 bp, chicken (Gallus Gallus)
  misc_feature (36): n=c or t
tgatcacactgtctatctgcttttctcctttaatgnctaacctactctctcccctctcatttctgaatctg

SEQ ID NO: 32966 - DNA, 71 bp, chicken (Gallus Gallus)
  misc_feature (36): n=a or g
agcagaagtgcaatatcaaatcaagaaatttgaaanctaagaatcaacttttaattcccttttaattgaat

SEQ ID NO: 32967 - DNA, 71 bp, chicken (Gallus Gallus)
  misc_feature (36): n=a or g
ttttcgtttggtttatggtatatgtgaacttcaaanctatgcttgcagatagttaccttttagtatttaca

SEQ ID NO: 32968 - DNA, 71 bp, chicken (Gallus Gallus)
  misc_feature (36): n=c or t
gttggaaaatcagagacaagcatgcacagaatcttnggagtggcctgaaatgttttttaattggacaattt

SEQ ID NO: 32969 - DNA, 71 bp, chicken (Gallus Gallus)
  misc_feature (36): n=g or t
gtttgtaaatgttactgattgctgtgaatatgacangtcttgactgttctttagaatagcatggaaaagat

SEQ ID NO: 32970 - DNA, 71 bp, chicken (Gallus Gallus)
  misc_feature (36): n=c or t
cagtattttggctcaaaatcaatggtcctctgacangtgttggcaagaacagcactgaggtgacaaggaat

SEQ ID NO: 32971 - DNA, 71 bp, chicken (Gallus Gallus)
  misc_feature (36): n=a or g
cattggaaagaacaaccactgttttgagctatgacntcttactggcacttcaaaacattgtttcagtgtta

SEQ ID NO: 32972 - DNA, 71 bp, chicken (Gallus Gallus)
  misc_feature (36): n=a or g
tggtgttcatctgcaaaacgaggagccagtgttagnaacagactcagtccacaaatggctgaactctttat

SEQ ID NO: 32973 - DNA, 71 bp, chicken (Gallus Gallus)
  misc_feature (36): n=a or g
caataaaggcatgccaaaggatagcaaatgttttangagaggaaatgcatcttgaaaggaaatatcatccg

SEQ ID NO: 32974 - DNA, 71 bp, chicken (Gallus Gallus)
  misc_feature (36): n=a or g
tgatgtggaagggaaagtttatacattagaggttgnacaagtctgaatgttagtgagaacacaaatataga

SEQ ID NO: 32975 - DNA, 71 bp, chicken (Gallus Gallus)
  misc_feature (36): n=c or t
gttgtgcagcagccttctgaaaacacttgcgtttgnttttggattaaagcaacaaagtttaaagttcccac

SEQ ID NO: 32976 - DNA, 71 bp, chicken (Gallus Gallus)
  misc_feature (36): n=g or t
ttgggctaagaaatcaggtatctagtttctttatcntcagcttattgacttctttggtgacacacaggaga

SEQ ID NO: 32977 - DNA, 71 bp, chicken (Gallus Gallus)
  misc_feature (36): n=a or g
cacatgagcaagcaatgggattctttttttgttacnggctgtattaattcattgtttactacatgtggtta

SEQ ID NO: 32978 - DNA, 71 bp, chicken (Gallus Gallus)
  misc_feature (36): n=a or g
catgtctcttttgtaacctgatcttgttctacattncatcttttggcatttacttgtagagcatatttaat

SEQ ID NO: 32979 - DNA, 71 bp, chicken (Gallus Gallus)
  misc_feature (36): n=a or c
atgccaatatatccagtaatttctgattataacaanttctagcaattattgtagctggcatcgtggagcac

SEQ ID NO: 32980 - DNA, 71 bp, chicken (Gallus Gallus)
  misc_feature (36): n=c or t
acaaattgttgtacctgcacaccgaaatgctatatnttttttccctggatatgtacaagagacagtacctg

SEQ ID NO: 32981 - DNA, 71 bp, chicken (Gallus Gallus)
  misc_feature (36): n=a or g
agactttggtttaagcatagtatttttggacttctnttcagttacaattcaaagaatttcattcaggaaag

SEQ ID NO: 32982 - DNA, 71 bp, chicken (Gallus Gallus)
  misc_feature (36): n=c or t
caaatccagctattccaccccatacaaagcaaatgnatattttaaactgttaagatggcataagtgagcat

SEQ ID NO: 32983 - DNA, 71 bp, chicken (Gallus Gallus)
  misc_feature (36): n=a or g
tttctttgtagatagtacattaaagctatttcacangacaccattgatcactctttgaggattgtttcttc

SEQ ID NO: 32984 - DNA, 71 bp, chicken (Gallus Gallus)
  misc_feature (36): n=a or c
ggactggagcattttggaaattgtagttcttccttngcagctgcccccatttcatcagttcttttgcatga

SEQ ID NO: 32985 - DNA, 71 bp, chicken (Gallus Gallus)
  misc_feature (36): n=c or t
ccgttatgacctttaaatagtaacaataacaacagntactttgagaagtctgcatgttacaaggtctaaca

SEQ ID NO: 32986 - DNA, 71 bp, chicken (Gallus Gallus)
  misc_feature (36): n=c or t
tttttccacataactggatgaagtgcattacaaagnccaggcttcctgccatcaaaacaacagcacactga

SEQ ID NO: 32987 - DNA, 71 bp, chicken (Gallus Gallus)
  misc_feature (36): n=a or c
ctccttaatcaaaacattttcctatcagacaatcangtattcaaggtgtaagaaaaagaggcagtatcatc

SEQ ID NO: 32988 - DNA, 71 bp, chicken (Gallus Gallus)
  misc_feature (36): n=a or g
tgggtttgcatttctaaaatggtgacttttcttcancaagagttcttagtaacttcttgagtgtggtagac

SEQ ID NO: 32989 - DNA, 71 bp, chicken (Gallus Gallus)
  misc_feature (36): n=c or t
tgccacattctggcctgtgaaagtccatgctattcngttgaccactgaatgaaaagtaataatttgtgtgt

SEQ ID NO: 32990 - DNA, 71 bp, chicken (Gallus Gallus)
  misc_feature (36): n=c or t
tgtacctccttgctctggatgctggaaaaatcctgncttctagctctgtggtctgtattgttgcatatctg

SEQ ID NO: 32991 - DNA, 71 bp, chicken (Gallus Gallus)
  misc_feature (36): n=g or t
cagctcagcttgagttgtggagcaatgacaatgtantgatattttctgtgagactgttcatgaggggagct

SEQ ID NO: 32992 - DNA, 71 bp, chicken (Gallus Gallus)
  misc_feature (36): n=a or g
catttcagagttgatagcttcaagaactttatagcntcagaaggaggctgagatgctgatgccttcctctt

SEQ ID NO: 32993 - DNA, 71 bp, chicken (Gallus Gallus)
  misc_feature (36): n=a or g
tcttttaaatggaagaatatgtatcctgcgtacaantaggaagattgccctgttttatgttgtgcaaaagg

SEQ ID NO: 32994 - DNA, 71 bp, chicken (Gallus Gallus)
  misc_feature (36): n=c or t
acatttacctttatccacagttgagagcagttcgtnttccttaaggatagatttagatcttttctttcttg

SEQ ID NO: 32995 - DNA, 71 bp, chicken (Gallus Gallus)
  misc_feature (36): n=a or g
gtttgtctgctagtaaagtgcttgtgattacactgngaatcattcagtactcattgccacaggaagaaccc

SEQ ID NO: 32996 - DNA, 71 bp, chicken (Gallus Gallus)
  misc_feature (36): n=c or t
attttcagagctacacttaacttgataacctccaanacaagtgtagcacaagtttagtaaaaacagcttaa

SEQ ID NO: 32997 - DNA, 71 bp, chicken (Gallus Gallus)
  misc_feature (36): n=a or c
tacttgtttgcgtgtaatattataagcacattcacntacatcatgccattcagtagcatcctccacaggat

SEQ ID NO: 32998 - DNA, 71 bp, chicken (Gallus Gallus)
  misc_feature (36): n=a or g
agcaaccagttcagcttctctctgcttgagatcccngtgcaattattaggagaaatttgatttcaacacgt

SEQ ID NO: 32999 - DNA, 71 bp, chicken (Gallus Gallus)
  misc_feature (36): n=c or t
gtcagaacgacattctgggattgcttttgaccttcntccctctgatcactttcaaacactatgaacaagaa

SEQ ID NO: 33000 - DNA, 71 bp, chicken (Gallus Gallus)
  misc_feature (36): n=a or g
tgcaaggcagcaggtctgccaatacaaccaccaagnacaggagctgagaaagagtggatggggctatccaa

SEQ ID NO: 33001 - DNA, 71 bp, chicken (Gallus Gallus)
  misc_feature (36): n=a or c
atcaacatatgtattcataccaaagatacaggtccnaatgttgatctaatacagaaaattggattttacaa

SEQ ID NO: 33002 - DNA, 71 bp, chicken (Gallus Gallus)
  misc_feature (36): n=c or t
agtcatagcctaagaagtatcagcaacttgaattcnctttatggaaagctgtttaaaaactgtaccttcgt

SEQ ID NO: 33003 - DNA, 71 bp, chicken (Gallus Gallus)
  misc_feature (36): n=c or t
gaagcctgataccttcattttgtatcctggttaaancaagttcaacacaaagttcacatggagactgtaac

SEQ ID NO: 33004 - DNA, 71 bp, chicken (Gallus Gallus)
  misc_feature (36): n=c or t
aaaaactctgaaaaccaggtactgcaaaggacacangctgtaggaaactatgaagtcaaagaatagtactt

SEQ ID NO: 33005 - DNA, 71 bp, chicken (Gallus Gallus)
  misc_feature (36): n=a or c
ctccagcctagaaacctggcagctcagagctgccancttgagtaatgtttaaccccataaaactttattgg

SEQ ID NO: 33006 - DNA, 71 bp, chicken (Gallus Gallus)
  misc_feature (36): n=a or g
acggacatagaaaattatgcacattatgccatgcanaaggtagctccatacagctctcactagtgtggaac

SEQ ID NO: 33007 - DNA, 71 bp, chicken (Gallus Gallus)
  misc_feature (36): n=a or g
ttgtattaccattccaagatctttgaggatggcagnttaccttgcacatctactgcttagtttaatttcta

SEQ ID NO: 33008 - DNA, 71 bp, chicken (Gallus Gallus)
  misc_feature (36): n=c or t
ttagaaaaacaattacatacaatttgaaacatcatnagacttttgcacgaaagcagttaccattagcaatt

SEQ ID NO: 33009 - DNA, 71 bp, chicken (Gallus Gallus)
  misc_feature (36): n=c or t
attaatgctttgtctctatcacgttcctgtcacctnccatctttctatgattactaagattttgtaaaact

SEQ ID NO: 33010 - DNA, 71 bp, chicken (Gallus Gallus)
  misc_feature (36): n=a or g
ttgaatttctagggttccacaaagaacagagagacnaaagtgttatgacttctactggcagtgttctcttt

SEQ ID NO: 33011 - DNA, 71 bp, chicken (Gallus Gallus)
  misc_feature (36): n=a or c
ctgtataattgtcttgtaactttaagtttcgaatgnagtggccagtaagaggacatgctggaatcatctct

SEQ ID NO: 33012 - DNA, 71 bp, chicken (Gallus Gallus)
  misc_feature (36): n=a or c
agaatagaatccattcactgtataagcactaaagancacttatgaattcccagcagatttacagtgatgtg

SEQ ID NO: 33013 - DNA, 71 bp, chicken (Gallus Gallus)
  misc_feature (36): n=c or t
catctcagatgtacaattgcttggtttacagagtcngagttatgtagatctctatcaatcccctgaatgat

SEQ ID NO: 33014 - DNA, 71 bp, chicken (Gallus Gallus)
  misc_feature (36): n=a or c
aatcctataccctttcctgtctgaaatactcactcntgtgagaagttacaattaaaaaagaaaaaaaagta

SEQ ID NO: 33015 - DNA, 71 bp, chicken (Gallus Gallus)
  misc_feature (36): n=g or t
aggagggcaactgagctactgcctctgtgaacatcntgatgtaacagtagatgctgattgagtagttctgg

SEQ ID NO: 33016 - DNA, 71 bp, chicken (Gallus Gallus)
  misc_feature (36): n=a or g
gttatcaaaaagaattaaaagcccctgaccaaaccnagcaaaagctgtagttgacttcatggctgttcagc

SEQ ID NO: 33017 - DNA, 71 bp, chicken (Gallus Gallus)
  misc_feature (36): n=c or t
tcactgaacacgtaattcaaatttaagaagctacgngggctttaagaaactgatttaaaatttctgatagt

SEQ ID NO: 33018 - DNA, 71 bp, chicken (Gallus Gallus)
  misc_feature (36): n=c or t
tcattgactactggtccatttaactacaaaacaccnttcctactctctggaagcttatgttcaaattgaaa

SEQ ID NO: 33019 - DNA, 71 bp, chicken (Gallus Gallus)
  misc_feature (36): n=g or t
tgagacagccaatagaaagggttacacacttacacngcatctagcaatttagcaatccacgtcatgaataa

SEQ ID NO: 33020 - DNA, 71 bp, chicken (Gallus Gallus)
  misc_feature (36): n=a or g
ctttgagaaggcagctgagatggtaactgtacgtgngtttggaatgaagcaagaaactactaagtgaccaa

SEQ ID NO: 33021 - DNA, 71 bp, chicken (Gallus Gallus)
  misc_feature (36): n=g or t
tatcaaattcaatctgaaactagttaatacagttgntacatgatacgttaacattcaggcttttcttaaca

SEQ ID NO: 33022 - DNA, 71 bp, chicken (Gallus Gallus)
  misc_feature (36): n=g or t
tttgttgcagaactggtctgggagcagctttttctntcactatgaatatatctcaaaaattggtcgccctg

SEQ ID NO: 33023 - DNA, 71 bp, chicken (Gallus Gallus)
  misc_feature (36): n=a or g
ctttttcagctttttctgtttctagtgattgatgantgtcatcactccccatcctctctaatatctccttt

SEQ ID NO: 33024 - DNA, 71 bp, chicken (Gallus Gallus)
  misc_feature (36): n=a or g
tgacgtgggaggttttcagttatgcttcaggttgcnaaattccagaactgcacatccatttctaattgcaa

SEQ ID NO: 33025 - DNA, 71 bp, chicken (Gallus Gallus)
  misc_feature (36): n=c or t
atgaggaggtattatatctgttgcttgtagttgctnttgcctacaactatttattaggccgtttgtatttt

SEQ ID NO: 33026 - DNA, 71 bp, chicken (Gallus Gallus)
  misc_feature (36): n=a or c
ctcaatcgtaggaaatgaaatgacttgtcacaaaancaggattggaatatctgaattcactgtaatatttg

SEQ ID NO: 33027 - DNA, 71 bp, chicken (Gallus Gallus)
  misc_feature (36): n=a or g
ttttgtattgttctatatgtatcaaaaggtggtcanaaagttatcagtaagccctgctgttctatacattt

SEQ ID NO: 33028 - DNA, 71 bp, chicken (Gallus Gallus)
  misc_feature (36): n=c or t
agactagcaggaggatattttcttccccttggtggncattcaggatgggttactgtttttggaggccctgc

SEQ ID NO: 33029 - DNA, 71 bp, chicken (Gallus Gallus)
  misc_feature (36): n=a or g
aatgtagtggtgttaaaactttaggttggagtgttntcatgtaacctggaagtgactgccgtgctttggct

SEQ ID NO: 33030 - DNA, 71 bp, chicken (Gallus Gallus)
  misc_feature (36): n=a or g
tcctattggagtggatgaatttaatcggctaatganaaagtatttgcagcaagttgtacataacttccgtc

SEQ ID NO: 33031 - DNA, 71 bp, chicken (Gallus Gallus)
  misc_feature (36): n=a or g
ccccacagcaccctctgtacctgtcatctctgcacngtggtgttgggtccttttttagtgctgaggtgcag

SEQ ID NO: 33032 - DNA, 71 bp, chicken (Gallus Gallus)
  misc_feature (36): n=a or g
agcaaaagcagaggagagaaaccatggattgcaggnaatatataccattttgtcatgaggcagaaacatca

SEQ ID NO: 33033 - DNA, 71 bp, chicken (Gallus Gallus)
  misc_feature (36): n=a or g
tgctacagtcattgcactgtgtctttgaaaactgcnatcaaggtcctgctgcacatttgtacctttttttg

SEQ ID NO: 33034 - DNA, 71 bp, chicken (Gallus Gallus)
  misc_feature (36): n=a or g
aactcctcatgtagttgttcctatgactttctctgnaggtcctgccttgtatttgttgctatcatccagtg

SEQ ID NO: 33035 - DNA, 71 bp, chicken (Gallus Gallus)
  misc_feature (36): n=a or g
caaggtttaaaaaggaggatcctaattcactgtggnttagttgaaagtctttttatgggagataatcagtt

SEQ ID NO: 33036 - DNA, 71 bp, chicken (Gallus Gallus)
  misc_feature (36): n=c or t
tctaattaggcttgttcataatggcctgagtacacnggcaatgggaaatgcagctcaggttctaacaaaac

SEQ ID NO: 33037 - DNA, 71 bp, chicken (Gallus Gallus)
  misc_feature (36): n=a or g
agaaatgctttcaagcctaaaatcttactctgtccnaagcagataaaaagcttcttggctgtagtcactgg

SEQ ID NO: 33038 - DNA, 71 bp, chicken (Gallus Gallus)
  misc_feature (36): n=a or g
ttcccacaatctctgtgggattatctgttgctaccnggtgcttttcagtgacacaaaccactgccagaata

SEQ ID NO: 33039 - DNA, 71 bp, chicken (Gallus Gallus)
  misc_feature (36): n=a or g
ttttattttgcactatatctcttggcaacagacaanaacaactttttaaagaacagtatcttagcacctaa

SEQ ID NO: 33040 - DNA, 71 bp, chicken (Gallus Gallus)
  misc_feature (36): n=a or g
ggaattttgcatggtgtcccaaatgcttggagagcnaggagatttataaataaaatggtttttattacact

SEQ ID NO: 33041 - DNA, 71 bp, chicken (Gallus Gallus)
  misc_feature (36): n=c or t
atggctggaagggaaaacaagccctcccactgcccnccaagagacacaaaaccgcgctgagccgtgcttag

SEQ ID NO: 33042 - DNA, 71 bp, chicken (Gallus Gallus)
  misc_feature (36): n=c or t
tctttgttgttttgtttgcaaacatacagacatacnggggttattatgggtgagataaaggtgatgttgaa

SEQ ID NO: 33043 - DNA, 71 bp, chicken (Gallus Gallus)
  misc_feature (36): n=a or g
aagtgcagacactgacactttccttgtggacagacngacagcagtgctctgtgccgacacccggtgtcaaa

SEQ ID NO: 33044 - DNA, 71 bp, chicken (Gallus Gallus)
  misc_feature (36): n=a or g
cacagttctgcctttgctatggaaactgcttgctcnctggtcacgtctttgtaaatacacggaatggaaat

SEQ ID NO: 33045 - DNA, 71 bp, chicken (Gallus Gallus)
  misc_feature (36): n=a or g
gggtaaatattctgatggtttcccctctcagatgcnttggtattaggttcagaaggaattctccaggtatg

SEQ ID NO: 33046 - DNA, 71 bp, chicken (Gallus Gallus)
  misc_feature (36): n=a or g
tctgaaacagctgaatttgggcccttcctgacaacncatcaaatatttcatgcagttctaatgacagacgt

SEQ ID NO: 33047 - DNA, 71 bp, chicken (Gallus Gallus)
  misc_feature (36): n=c or t
tttcttttcacgaatggcaagaaagaatggcacaanggggccggggcccaacacttggtcaatgctcattg

SEQ ID NO: 33048 - DNA, 71 bp, chicken (Gallus Gallus)
  misc_feature (36): n=g or t
gttgtgctcactgccagtgttctcctagctgtattngcatggtgagatgtacaacacaatgatattttgca

SEQ ID NO: 33049 - DNA, 71 bp, chicken (Gallus Gallus)
  misc_feature (36): n=c or t
attcatttctgagtataaatcagagggttgattcanttccagtcttttttttttttctttcatgttagtat

SEQ ID NO: 33050 - DNA, 71 bp, chicken (Gallus Gallus)
  misc_feature (36): n=g or t
tcctatgcttgttggctcatgatggtgactagtatncttagtagagtaagcaggtacagcatctcgtctgg

SEQ ID NO: 33051 - DNA, 71 bp, chicken (Gallus Gallus)
  misc_feature (36): n=a or g
tgcttttttttaactccttatttccaactgttaatnctttaactgcttctgtggtgaatacctgtctgcct

SEQ ID NO: 33052 - DNA, 71 bp, chicken (Gallus Gallus)
  misc_feature (36): n=a or g
aatttggctgcagtagaacagtgcacagattagganaggaatgttattatcggtgttcactatagaagggc

SEQ ID NO: 33053 - DNA, 71 bp, chicken (Gallus Gallus)
  misc_feature (36): n=c or t
taatgaggatccatgattcgtgcaagaccgaagtcnccaatcttcagcaccaagtcttcggtattaatgaa

SEQ ID NO: 33054 - DNA, 71 bp, chicken (Gallus Gallus)
  misc_feature (36): n=a or g
tgagagcagcctcagtgtgtgagattcacttggcanagcaagagctcttccacatactgggaccttttttt

SEQ ID NO: 33055 - DNA, 71 bp, chicken (Gallus Gallus)
  misc_feature (36): n=c or t
agctttaaattgggttacgtaaattatttgtagttntgacagcaggtttctcttccgtccacaaggacgga

SEQ ID NO: 33056 - DNA, 71 bp, chicken (Gallus Gallus)
  misc_feature (36): n=a or g
ggtagcacagactctgttttgctgcttcctgacccntgagcgaccttgctacggaccagctcattttcagc

SEQ ID NO: 33057 - DNA, 71 bp, chicken (Gallus Gallus)
  misc_feature (36): n=c or t
ggagaaataacatgttagggagaaacagaagcattngaggtgatgcagtcataatcaacccagctggcaat

SEQ ID NO: 33058 - DNA, 71 bp, chicken (Gallus Gallus)
  misc_feature (36): n=c or t
gatggccacacaacgcactcatctgcacacgttcanttgtccttgctgcatagcttccttgctgtggccta

SEQ ID NO: 33059 - DNA, 71 bp, chicken (Gallus Gallus)
  misc_feature (36): n=a or c
cagaggacagtaataaatccccctattttctatcgnatacacttgcctatcttttccttccaagcatgctt

SEQ ID NO: 33060 - DNA, 71 bp, chicken (Gallus Gallus)
  misc_feature (36): n=a or g
ttctacttctgcaagagtacccagctgctgcctctntttaaatgaaagatacacaaagacagcagagctta

SEQ ID NO: 33061 - DNA, 71 bp, chicken (Gallus Gallus)
  misc_feature (36): n=c or t
ttgaaactcaagtcactacattcaattttatttagnataagtcaaagcctttcagaaatgcagggtggttt

SEQ ID NO: 33062 - DNA, 71 bp, chicken (Gallus Gallus)
  misc_feature (36): n=a or c
ttcagagaccccctggtttgctagcaaacatctcanatgacagtgcacaggatcatgactaaggtactggg

SEQ ID NO: 33063 - DNA, 71 bp, chicken (Gallus Gallus)
  misc_feature (36): n=a or g
cgtatatatttacagaattgcacgtggccttgtaangttgaatgacttaattttgtaggtggttttagtaa

SEQ ID NO: 33064 - DNA, 71 bp, chicken (Gallus Gallus)
  misc_feature (36): n=a or g
atctcttggagctacttgtatcttttattttaagcntacagtgtactgtagttttgtagcaaaatattact

SEQ ID NO: 33065 - DNA, 71 bp, chicken (Gallus Gallus)
  misc_feature (36): n=c or t
caccaaaacaactgctgcctctagagctatttgctntattttgctctttctaatctcaggcatgaattttt

SEQ ID NO: 33066 - DNA, 71 bp, chicken (Gallus Gallus)
  misc_feature (36): n=a or g
atcaagatgtgctccattaaaatatattgatggaanggctgttggctcctcatggctgagctggaggctgt

SEQ ID NO: 33067 - DNA, 71 bp, chicken (Gallus Gallus)
  misc_feature (36): n=g or t
tgctgggttgcagtcacacaggtaatggacgcgtgntttttctctaccagagtgtgtcataacatctgtag

SEQ ID NO: 33068 - DNA, 71 bp, chicken (Gallus Gallus)
  misc_feature (36): n=c or t
agtaactaaaaaattattctaatacagacctctcanggggtatgagtatattgaaaaagtgattaaataag

SEQ ID NO: 33069 - DNA, 71 bp, chicken (Gallus Gallus)
  misc_feature (36): n=c or t
ttttgcatttctggttcaaatataatttaatcaaanttatagttagaactatagttagaactcacctaaat

SEQ ID NO: 33070 - DNA, 71 bp, chicken (Gallus Gallus)
  misc_feature (36): n=c or t
gtaaagtctttccagcaggacaggtattccaaaatnaatttcacaatatgtccctcttttcctttgtgaac

SEQ ID NO: 33071 - DNA, 71 bp, chicken (Gallus Gallus)
  misc_feature (36): n=a or g
tctgacatataatggtgttgctcctgaatatcagtnaaagcctatttaatacaggaacaattgtactcttc

SEQ ID NO: 33072 - DNA, 71 bp, chicken (Gallus Gallus)
  misc_feature (36): n=a or g
gtgcagaggaaaggaggagtactaagcagcatgatnctattaagctctaaatgtcaattggaccaaatgag

SEQ ID NO: 33073 - DNA, 71 bp, chicken (Gallus Gallus)
  misc_feature (36): n=a or g
tgtttcatcatgtgactacctgaaagattaatgctntctgacctcagaactgcctgcaattgcacagcatg

SEQ ID NO: 33074 - DNA, 71 bp, chicken (Gallus Gallus)
  misc_feature (36): n=c or t
tatctctctgaagattactcttctttaaatgataanatcctaactggaaaaacacacttattactgcattt

SEQ ID NO: 33075 - DNA, 71 bp, chicken (Gallus Gallus)
  misc_feature (36): n=a or g
ctacagttggagaggtcagatgaaaatcaatgccancttacaaaaacatcttcaaatttgttcctggaatc

SEQ ID NO: 33076 - DNA, 71 bp, chicken (Gallus Gallus)
  misc_feature (36): n=a or g
tgaaaatatcttcactaagatgagctgaatgtaccnggttgcttctgatttcacaacattgttaaactcat

SEQ ID NO: 33077 - DNA, 71 bp, chicken (Gallus Gallus)
  misc_feature (36): n=c or t
aatgattgaaaattgaggttacgttattttgacaanactgcaaacatatccaaccagtagttaaatatatg

SEQ ID NO: 33078 - DNA, 71 bp, chicken (Gallus Gallus)
  misc_feature (36): n=c or t
gactctgacatcattattttgtttgctaatcatatngagaaatgaaacaatttcaaagcacagtatgttca

SEQ ID NO: 33079 - DNA, 71 bp, chicken (Gallus Gallus)
  misc_feature (36): n=c or t
tttccacacaaagtttccatccagctttcctaatgngtaagaaaattggctccaaaattttgaaggcagtt

SEQ ID NO: 33080 - DNA, 71 bp, chicken (Gallus Gallus)
  misc_feature (36): n=c or t
gagaagtgatactccttcccaatattgtctatttancaggagcttcctcattatagggaaccagtattcct

SEQ ID NO: 33081 - DNA, 71 bp, chicken (Gallus Gallus)
  misc_feature (36): n=g or t
gcaagaaacaaaacccagagctttcagccaaatttnactcacacctgagtttatttgatggttcgagtgga

SEQ ID NO: 33082 - DNA, 71 bp, chicken (Gallus Gallus)
  misc_feature (36): n=a or g
tgcagtagagttagtcaatttagaggagaagcacanttagaaataaggtattagttaactcttacaaagca

SEQ ID NO: 33083 - DNA, 71 bp, chicken (Gallus Gallus)
  misc_feature (36): n=a or c
gggctattgccccctgcagaaatgttaaaggtgaangagaagacttcagaaggtatgggatgtcatcaggt

SEQ ID NO: 33084 - DNA, 71 bp, chicken (Gallus Gallus)
  misc_feature (36): n=a or g
agaaagtagctttggcccctgttataaggcaattanaaaacaaagtgaaagggagattccaatatttaagc

SEQ ID NO: 33085 - DNA, 71 bp, chicken (Gallus Gallus)
  misc_feature (36): n=c or t
tgtttatgtcagtctgagccattgcctgaaggaagngtgatgtgacgtgacacctggtaacacactccaaa

SEQ ID NO: 33086 - DNA, 71 bp, chicken (Gallus Gallus)
  misc_feature (36): n=g or t
caaatgtgatctgtaatagttccgtctcctatactntcttgttatttgtagccttcttctgtctacagcag

SEQ ID NO: 33087 - DNA, 71 bp, chicken (Gallus Gallus)
  misc_feature (36): n=c or t
tcacttccatatccttcatgtaagttttttaattgnggctcacctggtttgtaggctgctgcatgactagt

SEQ ID NO: 33088 - DNA, 71 bp, chicken (Gallus Gallus)
  misc_feature (36): n=c or t
cccctctcccccaccattgcccatgtctgtgcatangcttacagatgctctctcacagactacaaaagcag

SEQ ID NO: 33089 - DNA, 71 bp, chicken (Gallus Gallus)
  misc_feature (36): n=a or c
aacgtgtgtttgcaggagttctgcacaacagacagnagatctgactgtagatatgagctgaaatcaaaggt

SEQ ID NO: 33090 - DNA, 71 bp, chicken (Gallus Gallus)
  misc_feature (36): n=a or g
gactttggaccgtaaacccagtctgtttcctcctcntgcattttcacataggtgatagtgattctgttcag

SEQ ID NO: 33091 - DNA, 71 bp, chicken (Gallus Gallus)
  misc_feature (36): n=c or t
aggaaaacttgtgctttaatagaatgctgtaatctntaacttaaaaattgtatgcttacctgatcaaactg

SEQ ID NO: 33092 - DNA, 71 bp, chicken (Gallus Gallus)
  misc_feature (36): n=a or g
tatggagttgatctagactaatcactgctgacctangttacagcacattgcctcttattttaagaaaacta

SEQ ID NO: 33093 - DNA, 71 bp, chicken (Gallus Gallus)
  misc_feature (36): n=a or g
attattgttcttgtttttaattaatccatagttcantcactgcatgtttagtcaagtaaaattggtgaaca

SEQ ID NO: 33094 - DNA, 71 bp, chicken (Gallus Gallus)
  misc_feature (36): n=a or g
gcaaatgcattaatccagtgtttagagtaccaaccntacaaagctgtcaaatcaggcacttcaaacaatat

SEQ ID NO: 33095 - DNA, 71 bp, chicken (Gallus Gallus)
  misc_feature (36): n=a or g
agccactcactttctaaagtaggaagtttcagtaantaaaccaatcaaataagtcacgtcaccttacaaca

SEQ ID NO: 33096 - DNA, 71 bp, chicken (Gallus Gallus)
  misc_feature (36): n=c or t
atagtatgtaattgttaatgcttaaggaatacagancaagtcttattttttacaagcattttctcttttta

SEQ ID NO: 33097 - DNA, 71 bp, chicken (Gallus Gallus)
  misc_feature (36): n=a or c
acttgattgtatcacatattccaacatttgtggagntgaaaaaaactagtgtaaaaataatactgatgaaa

SEQ ID NO: 33098 - DNA, 71 bp, chicken (Gallus Gallus)
  misc_feature (36): n=c or t
atctacagacagacactgaaatgggacatggataancaaagccaaagaagaaatgggaaaatgggataaat

SEQ ID NO: 33099 - DNA, 71 bp, chicken (Gallus Gallus)
  misc_feature (36): n=c or t
tgagggacagctgatgctgctcaaaattttgaactncaatttgcagctttgtagtcctgggaagctgctaa

SEQ ID NO: 33100 - DNA, 71 bp, chicken (Gallus Gallus)
  misc_feature (36): n=a or g
aagcaagtagagaggatctctgttctacttctcctntgaggacagtaatataaaagttatctattcttctt

SEQ ID NO: 33101 - DNA, 71 bp, chicken (Gallus Gallus)
  misc_feature (36): n=a or g
tccttcagaagaaagttctgaaagttcttaccatcncatttttgtgtcacttcattaaacttgtgtccagc

SEQ ID NO: 33102 - DNA, 71 bp, chicken (Gallus Gallus)
  misc_feature (36): n=c or t
ggaaagaaaacgaaactttgtaaatattttaaaccntacgtcctacaacatcccaaacttcttaccaataa

SEQ ID NO: 33103 - DNA, 71 bp, chicken (Gallus Gallus)
  misc_feature (36): n=a or g
caacaagagctgactcagcttctcagtgcacacaanaaatctgacttgtgtgatacaacatcagacgaact

SEQ ID NO: 33104 - DNA, 71 bp, chicken (Gallus Gallus)
  misc_feature (36): n=c or t
aaactctgcagtgcttctccctgaaagaataaatanataaaactgctcatgccacagatttgatggaattt

SEQ ID NO: 33105 - DNA, 71 bp, chicken (Gallus Gallus)
  misc_feature (36): n=c or t
ggctgagccaaatttcaatcacataaaaggaaaatntcagaaatgatgctagactccaagagtaaacaaaa

SEQ ID NO: 33106 - DNA, 71 bp, chicken (Gallus Gallus)
  misc_feature (36): n=a or g
tttgcaaatcttaaactggccctttatcgaggaacntattctcagaactgtgatttggcttcttcagtctc

SEQ ID NO: 33107 - DNA, 71 bp, chicken (Gallus Gallus)
  misc_feature (36): n=a or g
ccttcatacagatacagcttaatttaaatgtagaanggcatttggactatagggagagcttgacatatttt

SEQ ID NO: 33108 - DNA, 71 bp, chicken (Gallus Gallus)
  misc_feature (36): n=c or t
gggaatcttctctatttccgtgtcattctatccacnctgcagcatttacactctgaattctttggttcttg

SEQ ID NO: 33109 - DNA, 71 bp, chicken (Gallus Gallus)
  misc_feature (36): n=c or t
taatgcaccagtatgaagctggaataaccggtaganggaaaaatatttcagtatattggtatgaaacaagc

SEQ ID NO: 33110 - DNA, 71 bp, chicken (Gallus Gallus)
  misc_feature (36): n=c or t
cactatggcaactatctaaaaaggctggatgggttngatcgcaaaggaatttatcacaggctcaacactta

SEQ ID NO: 33111 - DNA, 71 bp, chicken (Gallus Gallus)
  misc_feature (36): n=a or c
tgatcatttgaacttcctgatcatttccataaaaanctagaagttagtcacagactcaccaacaaaaacac

SEQ ID NO: 33112 - DNA, 71 bp, chicken (Gallus Gallus)
  misc_feature (36): n=a or g
ggtactcacacctcttctcccccttcccaattcatntcctgggagtctttaatgcttcaaattcatctttt

SEQ ID NO: 33113 - DNA, 71 bp, chicken (Gallus Gallus)
  misc_feature (36): n=c or t
tgataacttttgaccccaaaattaaggaaaacgtanaacagcagagtagttaacgtgttggttggaggaaa

SEQ ID NO: 33114 - DNA, 71 bp, chicken (Gallus Gallus)
  misc_feature (36): n=a or c
gctttgagtgttctctagctgagagtgcttaaaaantcaaatctttgttgaagttcacaaagcagtgtaaa

SEQ ID NO: 33115 - DNA, 71 bp, chicken (Gallus Gallus)
  misc_feature (36): n=c or t
gtaggaggtggcatacaagcagaggatttgtgctantgcagtcagtgagctgtctcggtgttggccagtat

SEQ ID NO: 33116 - DNA, 71 bp, chicken (Gallus Gallus)
  misc_feature (36): n=a or g
gccatctactttaagcagctcagataacgtttgtgncacaaatttgagtggttctgctgatctatactttg

SEQ ID NO: 33117 - DNA, 71 bp, chicken (Gallus Gallus)
  misc_feature (36): n=c or t
ttgactgcacaaaaggaaactatttttggaaagcangaaaggattttgagtaactccgatagggcactgca

SEQ ID NO: 33118 - DNA, 71 bp, chicken (Gallus Gallus)
  misc_feature (36): n=c or t
gagcaaataagagcttcatcatgctcttagatactngcattaatatggaacttgttaagtgacattcctgg

SEQ ID NO: 33119 - DNA, 71 bp, chicken (Gallus Gallus)
  misc_feature (36): n=a or g
aaaactgtactcctttttctgcagtaagaaagtccngttcttcagtggatttcagttttagaatgagaatc

SEQ ID NO: 33120 - DNA, 71 bp, chicken (Gallus Gallus)
  misc_feature (36): n=c or t
tcaaggttgtaactgtgacaacattcccatacatanagcaccatgtaactcatcctcattggttttcatgg

SEQ ID NO: 33121 - DNA, 71 bp, chicken (Gallus Gallus)
  misc_feature (36): n=a or g
caaacatctcaagccagctgttatctctacaatctnactgtctctctttaaagcaagtacctcccttttgg

SEQ ID NO: 33122 - DNA, 71 bp, chicken (Gallus Gallus)
  misc_feature (36): n=c or t
actgtttcctcgcacatatgggcatgactgactcanggaaagttgtacgaatcatgaaattctacagcaca

SEQ ID NO: 33123 - DNA, 71 bp, chicken (Gallus Gallus)
  misc_feature (36): n=c or t
ttgatgggtttgtgcagggatccagagggagactangaacgtgttcctttttgaaccccgtagtggatttt

SEQ ID NO: 33124 - DNA, 71 bp, chicken (Gallus Gallus)
  misc_feature (36): n=a or g
tggcacattccagattatgcaaggattcccagaacnctgcagactctggttgaaaattatatctgcagagc

SEQ ID NO: 33125 - DNA, 71 bp, chicken (Gallus Gallus)
  misc_feature (36): n=c or t
accttattcagttgtttcagtctctggaatagatanggtatcggagaactaagagttattgcttaccgaag

SEQ ID NO: 33126 - DNA, 71 bp, chicken (Gallus Gallus)
  misc_feature (36): n=c or t
ttgagagatgtacaggactcataggagataacaagnggcatcagcttagggtcatagactgcttttgcaga

SEQ ID NO: 33127 - DNA, 71 bp, chicken (Gallus Gallus)
  misc_feature (36): n=c or t
ttcatgttttatattcaatgttgaaaatactttacnggaagtttttatcatgttttgtgacatattttttt

SEQ ID NO: 33128 - DNA, 71 bp, chicken (Gallus Gallus)
  misc_feature (36): n=c or t
ttaatattctaacagtacagctatatgttagatagnggaaaatagagaacccatgtttgttttcagcatgg

SEQ ID NO: 33129 - DNA, 71 bp, chicken (Gallus Gallus)
  misc_feature (36): n=a or c
actgtattgaagcatcaaaatcccatgaagtgaatnccagtgctacaagagcacatatagaaagaacacac

SEQ ID NO: 33130 - DNA, 71 bp, chicken (Gallus Gallus)
  misc_feature (36): n=c or t
tagtttactgttgtctgttcacctaagaaaagttanacagatgcatataaacttttttcagcatctctatg

SEQ ID NO: 33131 - DNA, 71 bp, chicken (Gallus Gallus)
  misc_feature (36): n=c or t
ctttctgttctcctacatagcctgaagttctacttngttaatgtttgtgagtcatttctgttacagaagtt

SEQ ID NO: 33132 - DNA, 71 bp, chicken (Gallus Gallus)
  misc_feature (36): n=c or t
ggccgcctgaagaaggaagggctgaaggcgctcagnttgctgctcgtggaaggaaacagcaaggtggtgag

SEQ ID NO: 33133 - DNA, 71 bp, chicken (Gallus Gallus)
  misc_feature (36): n=g or t
ttctaaaaaaaagtctgactttacaagtttatttantatgaggagcttgattatcggtgtagttcaacata

SEQ ID NO: 33134 - DNA, 71 bp, chicken (Gallus Gallus)
  misc_feature (36): n=c or t
atgaaaggcacattgttagctgcttaggtgaagagngtgataaatacagcctcttggtgttttctttcagc

SEQ ID NO: 33135 - DNA, 71 bp, chicken (Gallus Gallus)
  misc_feature (36): n=a or g
tttgatgtacgtgcgttcctgaaagcgtgttgcaanatactggggcaaactttgcccactgcctggtgaag

SEQ ID NO: 33136 - DNA, 71 bp, chicken (Gallus Gallus)
  misc_feature (36): n=c or t
tagaaaccaaaaacaaactgtcaaaatcagtctaanaaagtgcattgtttgtatgtactgacttgctccag

SEQ ID NO: 33137 - DNA, 71 bp, chicken (Gallus Gallus)
  misc_feature (36): n=a or g
caattttcctagtagagtatctggatatgaaatagncattaatgagtgaacatactttcttcatttgccaa

SEQ ID NO: 33138 - DNA, 71 bp, chicken (Gallus Gallus)
  misc_feature (36): n=a or c
tcatctcacccacatagttatcgattcttgtactcntcaggggaagtcacactcggtaatgccacagcatt

SEQ ID NO: 33139 - DNA, 71 bp, chicken (Gallus Gallus)
  misc_feature (36): n=a or g
ggaaattccagagaacagaaggattcagagaaattnatcatgaaacatatgccttcatttttaaggaagaa

SEQ ID NO: 33140 - DNA, 71 bp, chicken (Gallus Gallus)
  misc_feature (36): n=c or t
ccagaatcctttgtagactacacaggtcgtgcatcncttgtttacctagttcaaaagagagctttctgaaa

SEQ ID NO: 33141 - DNA, 71 bp, chicken (Gallus Gallus)
  misc_feature (36): n=c or t
accaataagatgaaatatctagtactaaaatatgantggaaatcagtgagcgtgcaggtcagtgtgaaaaa

SEQ ID NO: 33142 - DNA, 71 bp, chicken (Gallus Gallus)
  misc_feature (36): n=g or t
aaacccttcatttcctagactttgaagtttgagacngagggagggtacaggatggagatggaatcatttta

SEQ ID NO: 33143 - DNA, 71 bp, chicken (Gallus Gallus)
  misc_feature (36): n=a or g
gttttgtatccttagtttagtatttgttgtcatgcntgtttgtccagaacagaagttgttgcacctaattt

SEQ ID NO: 33144 - DNA, 71 bp, chicken (Gallus Gallus)
  misc_feature (36): n=a or g
acaactcgcctcattaatgttatacgtggcattacntgactaatatctatatataactttccctttttcac

SEQ ID NO: 33145 - DNA, 71 bp, chicken (Gallus Gallus)
  misc_feature (36): n=a or g
aaaggtgtcagtcagtcttactgacagcaaataggntggttttgtaagtgtcattttaaagggactgatgt

SEQ ID NO: 33146 - DNA, 71 bp, chicken (Gallus Gallus)
  misc_feature (36): n=c or t
actgggccaatggttctgttcatcagaggaaactanactgctttatcttacagtttttttggaattgaaag

SEQ ID NO: 33147 - DNA, 71 bp, chicken (Gallus Gallus)
  misc_feature (36): n=c or t
ctgagcgtggccgccttgtccttcaacctgtggttnacaaagctctcctgcaaggacttcaggctggtgag

SEQ ID NO: 33148 - DNA, 71 bp, chicken (Gallus Gallus)
  misc_feature (36): n=a or g
gtctcttcctgaggtaggagaacaatgtgaatgtanggttgaaaatgtagtgacagcaattattgacttcc

SEQ ID NO: 33149 - DNA, 71 bp, chicken (Gallus Gallus)
  misc_feature (36): n=a or g
actgttatttgtaggaggatgaatagagaagagtanaagatatattggtacgataggctgttattgactgt

SEQ ID NO: 33150 - DNA, 71 bp, chicken (Gallus Gallus)
  misc_feature (36): n=c or t
ctgggttgattctgaacccagattgcattttttcanggtggctgatgggctaggaaggagtttgcagttgc

SEQ ID NO: 33151 - DNA, 71 bp, chicken (Gallus Gallus)
  misc_feature (36): n=c or t
ttttaaactttttgtacaaagcgtaataacactgtntgtgctggtggaactcatcatttattttgcatatt

SEQ ID NO: 33152 - DNA, 71 bp, chicken (Gallus Gallus)
  misc_feature (36): n=a or g
taaccttacaatgacaggtacattcaaagacaccgnggcttttagtaattgattacttaaaataaatacac

SEQ ID NO: 33153 - DNA, 71 bp, chicken (Gallus Gallus)
  misc_feature (36): n=c or t
cgtagccagtcttctcaggagatgctccgcaggtanctgaaatgaaagtggcactgctggtcacgccccag

SEQ ID NO: 33154 - DNA, 71 bp, chicken (Gallus Gallus)
  misc_feature (36): n=c or t
tctctcttataatggtaaaaatactaattttctaanatgcctttagagcccttacaagtgttcaaagcaca

SEQ ID NO: 33155 - DNA, 71 bp, chicken (Gallus Gallus)
  misc_feature (36): n=a or g
atggacttggctgcccagtcatgcaaaagatgcccngcagttcccctaagtgggaatatcctgactagaga

SEQ ID NO: 33156 - DNA, 71 bp, chicken (Gallus Gallus)
  misc_feature (36): n=a or g
gacataaaacctgagtatcagtatatgccaagaccngggcttcgaccagctcccaatagcgttgatgttga

SEQ ID NO: 33157 - DNA, 71 bp, chicken (Gallus Gallus)
  misc_feature (36): n=c or t
actaacatgacacctttggaaatctcattgaaatgncctaacaaaataacaccatagacagcaccgtaact

SEQ ID NO: 33158 - DNA, 71 bp, chicken (Gallus Gallus)
  misc_feature (36): n=a or g
cgttctgctgtaaatgccattctcattgcttcgtcntgtagtttcataaaaagtgtatgttcatcaagcta

SEQ ID NO: 33159 - DNA, 71 bp, chicken (Gallus Gallus)
  misc_feature (36): n=a or g
aactagagattccccatatccttattattatttacngctacctatattgcacactcatactcacagaggtc

SEQ ID NO: 33160 - DNA, 71 bp, chicken (Gallus Gallus)
  misc_feature (36): n=c or t
ttattcaagcaaaaattagagttcttttctcagttnttttcataattttgcaccttgctacttttgctgtc

SEQ ID NO: 33161 - DNA, 71 bp, chicken (Gallus Gallus)
  misc_feature (36): n=a or g
atcaaacccattcacatcacagcatgctctgaaacntgcttcaagtcaatgagtaaatatacttctccatg

SEQ ID NO: 33162 - DNA, 71 bp, chicken (Gallus Gallus)
  misc_feature (36): n=a or g
aggaagcttatggaatacaagaataggaagagcatnagatccctcccctaaaacttttgtgaactccattt

SEQ ID NO: 33163 - DNA, 71 bp, chicken (Gallus Gallus)
  misc_feature (36): n=a or g
ggagctagttctactaaaataatttgtgtgtagttnaaagcaaatgtaacagctcatttcagcagaaagca

SEQ ID NO: 33164 - DNA, 71 bp, chicken (Gallus Gallus)
  misc_feature (36): n=c or t
acttcatgttttaagaattagaagtaaaactcagantttgacgaaagaagcagtgctactgattttaaaga

SEQ ID NO: 33165 - DNA, 71 bp, chicken (Gallus Gallus)
  misc_feature (36): n=c or t
cttcctgcaatgaggggcaacgctggagcctcccangcagggcagtccaggagcctccctagccctaacat

SEQ ID NO: 33166 - DNA, 71 bp, chicken (Gallus Gallus)
  misc_feature (36): n=a or g
ggcaaatcccagagcttgcaaagctttgaccaaatngtacaggtgaatttagcagtacactgtgtgtgaca

SEQ ID NO: 33167 - DNA, 71 bp, chicken (Gallus Gallus)
  misc_feature (36): n=c or t
attcagttagctgctattgtatttgtcaaaggtctncatatttccgtaccagattagtgatctagattcag

SEQ ID NO: 33168 - DNA, 71 bp, chicken (Gallus Gallus)
  misc_feature (36): n=a or g
tttacagtaggattcaaactctgagatacttttgcntattgctctcactcacttaaatagtgagaaattta

SEQ ID NO: 33169 - DNA, 71 bp, chicken (Gallus Gallus)
  misc_feature (36): n=a or g
gttcttccttaaccccacaatgcttcgttctgaccntcactatgaaggtaagagcactgcatcctgggaat

SEQ ID NO: 33170 - DNA, 71 bp, chicken (Gallus Gallus)
  misc_feature (36): n=a or g
gaaatggttgctttgtttgtcagtcagagaacaatncaactgtcagcatttgaattattatagaaccattt

SEQ ID NO: 33171 - DNA, 71 bp, chicken (Gallus Gallus)
  misc_feature (36): n=c or t
gtttccaggactgattctgtttaacttcttgtgaancctcgtgcaattaatatctgacatatagctaatta

SEQ ID NO: 33172 - DNA, 71 bp, chicken (Gallus Gallus)
  misc_feature (36): n=c or t
ctccatatgcaagaacattgctttattcaaattttngttacttgacaacgttaagtgtttgtaatttgact

SEQ ID NO: 33173 - DNA, 71 bp, chicken (Gallus Gallus)
  misc_feature (36): n=c or t
ttcttgcttctcttcctcttcatcagctatagcctntgtaacattgcttcttttcccctaatctttttcat

SEQ ID NO: 33174 - DNA, 71 bp, chicken (Gallus Gallus)
  misc_feature (36): n=a or g
atgaaatgttctttacaatactgtatgtttattgantgtgaatttatgagactattttctgttataggtaa

SEQ ID NO: 33175 - DNA, 71 bp, chicken (Gallus Gallus)
  misc_feature (36): n=c or t
aaaggatgagataagagtagctccttgaagagttanactctttaaaggtatgacatttccccatacattca

SEQ ID NO: 33176 - DNA, 71 bp, chicken (Gallus Gallus)
  misc_feature (36): n=a or g
ccagcaaggtaagaagcaaactcctaaaacagtctnggagttgcatttaatgcagtagtgttatgaatatt

SEQ ID NO: 33177 - DNA, 71 bp, chicken (Gallus Gallus)
  misc_feature (36): n=c or t
tgccagatgatttttctgatcacaggtcatgtattnggggacttcactaattgctgaatttgccagattgt

SEQ ID NO: 33178 - DNA, 71 bp, chicken (Gallus Gallus)
  misc_feature (36): n=a or g
tgttaagagctataaataacgaatgtctcagcagtnatttaatcctttgtcaatcaaagcattcactacta

SEQ ID NO: 33179 - DNA, 71 bp, chicken (Gallus Gallus)
  misc_feature (36): n=c or t
acatccccagtttgccaggggagatgtatttattanctaagtacagtgtcactcggtagatatcctgctga

SEQ ID NO: 33180 - DNA, 71 bp, chicken (Gallus Gallus)
  misc_feature (36): n=c or t
ttggatcattgtgtagtacaaaggtttgctggcatnaatccacagaggcctagttttatgctgtgtcttat

SEQ ID NO: 33181 - DNA, 71 bp, chicken (Gallus Gallus)
  misc_feature (36): n=c or t
ccatccctggagggctatggtatacacttgtgctgncttttcccttgctctccacatacatctggtgtttt

SEQ ID NO: 33182 - DNA, 71 bp, chicken (Gallus Gallus)
  misc_feature (36): n=a or c
aaaactaagcccagggcttcttgcaattacttgtcntccacactactaaccacacaagagcagactgagga

SEQ ID NO: 33183 - DNA, 71 bp, chicken (Gallus Gallus)
  misc_feature (36): n=c or t
atctttagtacctgtcctcagttatccagacagtancttgtttcctcttgtttccagatttaactatcctg

SEQ ID NO: 33184 - DNA, 71 bp, chicken (Gallus Gallus)
  misc_feature (36): n=a or g
ttttgagctatagagagaataagaactaactgttangcattagaatctgagaatttttccctctaagtcac

SEQ ID NO: 33185 - DNA, 71 bp, chicken (Gallus Gallus)
  misc_feature (36): n=a or g
cactgagattttttgaagtgaagggtttttgtttcngaatttgtaatctcttgaacagactttataatgac

SEQ ID NO: 33186 - DNA, 71 bp, chicken (Gallus Gallus)
  misc_feature (36): n=a or g
agatttatattcagttttcatgttaaacttgtttcncgtgtactgattctgaagctgatctggagaacaga

SEQ ID NO: 33187 - DNA, 71 bp, chicken (Gallus Gallus)
  misc_feature (36): n=c or t
cctcttctcatcactttgtttatacacattctgtangtggcagtccatcaaggaacgttaaatatgaagac

SEQ ID NO: 33188 - DNA, 71 bp, chicken (Gallus Gallus)
  misc_feature (36): n=g or t
tttagtttaaaaggggagctcttggcaaagcagaantcagatactccttcagctgtctagcacagtaagga

SEQ ID NO: 33189 - DNA, 71 bp, chicken (Gallus Gallus)
  misc_feature (36): n=a or g
agattcagagtggcattgagtgtagacatgaagtangaacagggaaacacaaagtcagaagaactggctac

SEQ ID NO: 33190 - DNA, 71 bp, chicken (Gallus Gallus)
  misc_feature (36): n=c or t
gtgctgcaccttgtgcttgtatctgagtctaaactnaacctaattaaacctagttccaaaaaaatagggta

SEQ ID NO: 33191 - DNA, 71 bp, chicken (Gallus Gallus)
  misc_feature (36): n=c or t
tagtaattactttgaatacaagcagtaaggctccgntactgtctatgctagttgataatataaaaagctta

SEQ ID NO: 33192 - DNA, 71 bp, chicken (Gallus Gallus)
  misc_feature (36): n=a or g
gacaagttcatagcctgaggtagaaagtctgcatcntaccattctgttatatcttaccagaatagtcttaa

SEQ ID NO: 33193 - DNA, 71 bp, chicken (Gallus Gallus)
  misc_feature (36): n=c or t
gtgatccaccttattatcctattacttttccagtcncctcccactcctagtctgacctgcatcttctgtag

SEQ ID NO: 33194 - DNA, 71 bp, chicken (Gallus Gallus)
  misc_feature (36): n=a or g
aaaaataaggattgttttagtaagactgtgaaggancatggatacagattcatgaaaatagggacaacagc

SEQ ID NO: 33195 - DNA, 71 bp, chicken (Gallus Gallus)
  misc_feature (36): n=c or t
acaagttatcgttacaaatagaactatttgcacaanattgattttcacagtttgcactgtttctttctgca

SEQ ID NO: 33196 - DNA, 71 bp, chicken (Gallus Gallus)
  misc_feature (36): n=c or t
aagaacttgcatgttgaattatctcctttacaaacnccacaagcatccaatacagctttggaaccaagtcc

SEQ ID NO: 33197 - DNA, 71 bp, chicken (Gallus Gallus)
  misc_feature (36): n=c or t
agtcacagtcaataagctggaactgaaagagagagnatggcaggtatgtggcaaatgggtgggagcaggct

SEQ ID NO: 33198 - DNA, 71 bp, chicken (Gallus Gallus)
  misc_feature (36): n=c or t
tagctgcaagctatttggtgcctattcctggaacanggatgtatttttttggttcagaagtattctgtgca

SEQ ID NO: 33199 - DNA, 71 bp, chicken (Gallus Gallus)
  misc_feature (36): n=c or t
tctaatgtatcagttatgctccctgcagcaaccttncaggttcccagcctcttcagaagtgcacaggaaaa

SEQ ID NO: 33200 - DNA, 71 bp, chicken (Gallus Gallus)
  misc_feature (36): n=a or g
gttcactggtatgcctaactttagtctaaagcatcncttcccgaggtaggaaaggcgttatgatttttcag

SEQ ID NO: 33201 - DNA, 71 bp, chicken (Gallus Gallus)
  misc_feature (36): n=a or g
tttcccatctgtgcctggggtatgtttagtatgtgntggtatcattcggtatctgaccgggtgttttggtt

SEQ ID NO: 33202 - DNA, 71 bp, chicken (Gallus Gallus)
  misc_feature (36): n=a or g
agagttgaccttctatccagtagaattcatgcaacngtgttttccaaagttaatttacaattatgtcctaa

SEQ ID NO: 33203 - DNA, 71 bp, chicken (Gallus Gallus)
  misc_feature (36): n=c or t
tgcctacttaatcaaagtcttataaatataaacctnctctgccttatgttggcatatccctttcagaaggg

SEQ ID NO: 33204 - DNA, 71 bp, chicken (Gallus Gallus)
  misc_feature (36): n=a or g
ggacttcctaaaaggagcaaacctacttagatagcngcccatgatcagtaatgcgtagtgtccctgaaggg

SEQ ID NO: 33205 - DNA, 71 bp, chicken (Gallus Gallus)
  misc_feature (36): n=c or t
caattagtaacctcgctgctgacagcggtggcatantgttgttgagaataaagagtttgcactacttgggg

SEQ ID NO: 33206 - DNA, 71 bp, chicken (Gallus Gallus)
  misc_feature (36): n=a or g
ggtttactgaatgtgatctgccagttttttccccantgtttcagctggagtagatacacctgattacaaac

SEQ ID NO: 33207 - DNA, 71 bp, chicken (Gallus Gallus)
  misc_feature (36): n=a or c
cttccgttcttaaatgggatttttcagtgtctgaantctcagctttagtagattcatcagtgagagttacc

SEQ ID NO: 33208 - DNA, 71 bp, chicken (Gallus Gallus)
  misc_feature (36): n=c or t
atattttacattttgaaacgagtattttctttcagnagatgctaatacatattaggacatctgtttatttt

SEQ ID NO: 33209 - DNA, 71 bp, chicken (Gallus Gallus)
  misc_feature (36): n=c or t
gttaatgctgtaactccataaaaggttggaaatacncacgaatgtgaaaatattaataaccaaggagtgaa

SEQ ID NO: 33210 - DNA, 71 bp, chicken (Gallus Gallus)
  misc_feature (36): n=a or c
ttgttataatatagttgtgccactaattcccactangaactgcaaattgctcccatcccacccttccatcc

SEQ ID NO: 33211 - DNA, 71 bp, chicken (Gallus Gallus)
  misc_feature (36): n=c or t
gcagattctgcatgctgcactacaggctttatactncaccccagagatcatcgctgtttggttctggaaga

SEQ ID NO: 33212 - DNA, 71 bp, chicken (Gallus Gallus)
  misc_feature (36): n=c or t
ctagcaaggaaaggacctgggaggttcatcaccttnatctcccatcagtgctttagttgtatgtgtagggg

SEQ ID NO: 33213 - DNA, 71 bp, chicken (Gallus Gallus)
  misc_feature (36): n=c or t
catgcagtatatgcttgttatctaagctctgtgagntttggaacgtctcctgtgacatctttggggatatg

SEQ ID NO: 33214 - DNA, 71 bp, chicken (Gallus Gallus)
  misc_feature (36): n=c or t
tttaacttgaaccacagagagatgatggttctgtanctgtggcccatgcctgtggcccatttaacttgcta

SEQ ID NO: 33215 - DNA, 71 bp, chicken (Gallus Gallus)
  misc_feature (36): n=a or g
tcagataatataaacttgagtgtcatcagcctcctnttcctgctttgaacttgattactgttgattctaac

SEQ ID NO: 33216 - DNA, 71 bp, chicken (Gallus Gallus)
  misc_feature (36): n=a or g
ctccttctgcagagaggaaagttagcatgggagganagcacatcactccaggtcacagcagtgcaacaaaa

SEQ ID NO: 33217 - DNA, 71 bp, chicken (Gallus Gallus)
  misc_feature (36): n=c or t
tacttaggagtgacaatgctcacagacagcacctgngcatggcccaaatgtttgcccacacgttagttctg

SEQ ID NO: 33218 - DNA, 71 bp, chicken (Gallus Gallus)
  misc_feature (36): n=a or g
gcatacagagagcaaaaagtatggggaaagagatgnaaatcaaagggtatctggaagagaagtagggaaca

SEQ ID NO: 33219 - DNA, 71 bp, chicken (Gallus Gallus)
  misc_feature (36): n=c or t
ttcctgttaagtgcagacaaataattgccacttagnaagtccctattaaattcagcccaaattcagtccca

SEQ ID NO: 33220 - DNA, 71 bp, chicken (Gallus Gallus)
  misc_feature (36): n=a or g
ctgtgcagctgcaagaagggacaggagaggccagtnagagcaatatgatggagaagctgggatattccttc

SEQ ID NO: 33221 - DNA, 71 bp, chicken (Gallus Gallus)
  misc_feature (36): n=c or t
tcctgcaaaggagaaatgcacagctgccataaatantaaatctgtgtaagaattagtcctaaggtgcttgt

SEQ ID NO: 33222 - DNA, 71 bp, chicken (Gallus Gallus)
  misc_feature (36): n=a or g
attcaacagtgactaaaataacagagtagagaaacngttaatctgttctgtaaggccatctggggcatcga

SEQ ID NO: 33223 - DNA, 71 bp, chicken (Gallus Gallus)
  misc_feature (36): n=a or g
tgggaaggaaaatctctcagaattcaaatatgtganccttgaactctgcacaaggcattatatttatggca

SEQ ID NO: 33224 - DNA, 71 bp, chicken (Gallus Gallus)
  misc_feature (36): n=a or g
cgcgctgatggcgttccccaaactgaattgaaacgncacagggaagtatgctccagcctaaatgatctcat

SEQ ID NO: 33225 - DNA, 71 bp, chicken (Gallus Gallus)
  misc_feature (36): n=a or g
tgtggttgcatgcttttagtgctgcagtgtggtggngaacgaggtgtaaaacagctaggccaggtttcacg

SEQ ID NO: 33226 - DNA, 71 bp, chicken (Gallus Gallus)
  misc_feature (36): n=a or g
tgcatctctcctaatatacccatatctggggcacanagggcagtgctgaagcacatgtggggtttttcttg

SEQ ID NO: 33227 - DNA, 71 bp, chicken (Gallus Gallus)
  misc_feature (36): n=a or c
ctaagagcttatcattatcataagatatgcatgctntgtgggctcaaaatacctcttcaatgcaaaaacaa

SEQ ID NO: 33228 - DNA, 71 bp, chicken (Gallus Gallus)
  misc_feature (36): n=a or g
aggaaggggaaaaactggggtcttgagggcatttcnttttcagaatggctaaggagcatttattactcaaa

SEQ ID NO: 33229 - DNA, 71 bp, chicken (Gallus Gallus)
  misc_feature (36): n=a or g
aatttatccttaattcatcgatgagcatccacatcntagcaacattggaattaaacacacaataccgattt

SEQ ID NO: 33230 - DNA, 71 bp, chicken (Gallus Gallus)
  misc_feature (36): n=c or t
agctttcttgttacaatttacaatagcaactacagntgacatttcacgatgctttactttttttttttttt

SEQ ID NO: 33231 - DNA, 71 bp, chicken (Gallus Gallus)
  misc_feature (36): n=c or t
gcactattgagcatggttcagccacaaagagaatgnatgcattgacctatggctcatgcttctcctagaat

SEQ ID NO: 33232 - DNA, 71 bp, chicken (Gallus Gallus)
  misc_feature (36): n=a or g
catctagggacaaggaaagacataatcggctatagnacagcttggacatcagtgtgaaggagacgagcaag

SEQ ID NO: 33233 - DNA, 71 bp, chicken (Gallus Gallus)
  misc_feature (36): n=c or t
gatcagaatggctttgctggggagaaccaaactccntacagatttgaggttgatcagaaacaaaacatttt

SEQ ID NO: 33234 - DNA, 71 bp, chicken (Gallus Gallus)
  misc_feature (36): n=a or g
tgacccaatttcataaatacttcttccctcacgatntgttgttttgaactggttaatcacattctccattg

SEQ ID NO: 33235 - DNA, 71 bp, chicken (Gallus Gallus)
  misc_feature (36): n=g or t
tcctaaaatcagtcagcaataatgcactatggatcnaataaatacccagggctggaacagaatcacctctc

SEQ ID NO: 33236 - DNA, 71 bp, chicken (Gallus Gallus)
  misc_feature (36): n=a or g
tccaagggatggaacacctgaaagaccagtgagggnaccacaggatttacctgaggcgcggagccacgccg

SEQ ID NO: 33237 - DNA, 71 bp, chicken (Gallus Gallus)
  misc_feature (36): n=c or t
tcttggcatgttctgctttgatccagaggtctaaangcttaaatataaatacttgtgtagtgagtagagta

SEQ ID NO: 33238 - DNA, 71 bp, chicken (Gallus Gallus)
  misc_feature (36): n=a or g
agttaaggggagcattagaaactgagatctgccacnctcctaatctcatcatgagaggcttaggtaattgt

SEQ ID NO: 33239 - DNA, 71 bp, chicken (Gallus Gallus)
  misc_feature (36): n=a or g
ccaaacaaataagctgaaggagccttctgagtcagntcggttagttcagcaccgtctctgacagtggcttt

SEQ ID NO: 33240 - DNA, 71 bp, chicken (Gallus Gallus)
  misc_feature (36): n=c or t
tgatttcctcatcaggttatacaagcagatacaatngatgggaacctgaccctacagaccattgtatctga

SEQ ID NO: 33241 - DNA, 71 bp, chicken (Gallus Gallus)
  misc_feature (36): n=a or g
ctccatttcaatttcgggagaatgcttctttgcctntggagttatatggagcagaaaaaataggctgaact

SEQ ID NO: 33242 - DNA, 71 bp, chicken (Gallus Gallus)
  misc_feature (36): n=g or t
agtcctgaaaccacccccagcagaagttttcacagngggagagtcctgtaaggattttgcactcaaacctg

SEQ ID NO: 33243 - DNA, 71 bp, chicken (Gallus Gallus)
  misc_feature (36): n=a or g
aattccagaaatgtttgattgtaagaaacttggtcntatctcaaatgtctggtagatcggagagtggaaca

SEQ ID NO: 33244 - DNA, 71 bp, chicken (Gallus Gallus)
  misc_feature (36): n=a or g
atctgaactcagctgttgcaagctgctgtgcgatanagcatcttctgggtgaaatgattttacccggacag

SEQ ID NO: 33245 - DNA, 71 bp, chicken (Gallus Gallus)
  misc_feature (36): n=c or t
tctagaccgtgagctgctcagggcagagactgcctnttgatgtatttattcagggtctatgttcatgagta

SEQ ID NO: 33246 - DNA, 71 bp, chicken (Gallus Gallus)
  misc_feature (36): n=a or c
atggctccatagtttcctgggaggcaaatcctctgngtatgttcaagaggaatgtaaaatacgaagttctc

SEQ ID NO: 33247 - DNA, 71 bp, chicken (Gallus Gallus)
  misc_feature (36): n=a or g
agctgagttcaagtctgtcatatcaaacaacagtancaggcagttgcgttgtgaaatattgttgctctaca

SEQ ID NO: 33248 - DNA, 71 bp, chicken (Gallus Gallus)
  misc_feature (36): n=a or g
tgactttcctacacaaactgtttgatagtaagcctncaaacaattcacatttatcatcactatttaataaa

SEQ ID NO: 33249 - DNA, 71 bp, chicken (Gallus Gallus)
  misc_feature (36): n=a or g
ttgaaaggatcttaggcttgaagtgatactttttgnatgtcttatgagattcctgaagccatcaaatcaag

SEQ ID NO: 33250 - DNA, 71 bp, chicken (Gallus Gallus)
  misc_feature (36): n=a or g
aataagtagtcttcataatgttaaactgattgattngaataaaaagggaatgctattcttgtaacagcaga

SEQ ID NO: 33251 - DNA, 71 bp, chicken (Gallus Gallus)
  misc_feature (36): n=a or g
ataagcctgtgaaattgaaatgttcctatagtagantttgcagaactgaatgtatttaagaactactacct

SEQ ID NO: 33252 - DNA, 71 bp, chicken (Gallus Gallus)
  misc_feature (36): n=a or g
attgatctcacttctctctagacaatactttattcngttttgtggttaatgaagaattcatggttttgttg

SEQ ID NO: 33253 - DNA, 71 bp, chicken (Gallus Gallus)
  misc_feature (36): n=c or t
ccttctctatccttcctcaccatttttatcagttancttgatgaaagcctctccagcgctgttcctggcag

SEQ ID NO: 33254 - DNA, 71 bp, chicken (Gallus Gallus)
  misc_feature (36): n=a or g
agtgccatttaaaaccttcgtgtaaaccctccttgncaccaaagggctctggctgggatggttcggcattc

SEQ ID NO: 33255 - DNA, 71 bp, chicken (Gallus Gallus)
  misc_feature (36): n=a or g
ggccagggccgaaagaacacttttccttccaaggtngaaaacgctctataaaaaggtttaaaaaccttttt

SEQ ID NO: 33256 - DNA, 71 bp, chicken (Gallus Gallus)
  misc_feature (36): n=a or g
aggaatctaaaactagagatagctgttaaggaaagngagaagcagaaaacggcccaaggctgaacctcagt

SEQ ID NO: 33257 - DNA, 71 bp, chicken (Gallus Gallus)
  misc_feature (36): n=c or t
aagggcaggaacccagtgctcacagctggggacacngttctcagcttgttatggccacttgagcccaaagc

SEQ ID NO: 33258 - DNA, 71 bp, chicken (Gallus Gallus)
  misc_feature (36): n=a or g
aaaagaagagatgcagatcagtttttttccgagagngtttgaaacctgcctacatatgggtttctgaccct

SEQ ID NO: 33259 - DNA, 71 bp, chicken (Gallus Gallus)
  misc_feature (36): n=c or t
atggtacagatccagcccccagtccctctggaagantaattagagggaagcggaacagactcggtcacttc

SEQ ID NO: 33260 - DNA, 71 bp, chicken (Gallus Gallus)
  misc_feature (36): n=a or c
agagatggaaaaatcaggaggaaaggcctatcacangtgaaatattataagttccatagtgtgctacagcc

SEQ ID NO: 33261 - DNA, 71 bp, chicken (Gallus Gallus)
  misc_feature (36): n=a or g
caatctagtaatgcagtactttctgtggaagcagangataggaagaacttcatctcaaagtaatgatgaca

SEQ ID NO: 33262 - DNA, 71 bp, chicken (Gallus Gallus)
  misc_feature (36): n=g or t
ttttgaagagcaaggacagtgtctttctgtgccttnctggcctttctggcagcataggccagccatgtagt

SEQ ID NO: 33263 - DNA, 71 bp, chicken (Gallus Gallus)
  misc_feature (36): n=c or t
atgtgataaatggatcttttctgtggaaagaatagnatgcattagcccatgcaagtgcagtttctctgtcc

SEQ ID NO: 33264 - DNA, 71 bp, chicken (Gallus Gallus)
  misc_feature (36): n=a or g
gattctgaaatgcattttgtgcactgttacttagangaatccatgggtaatggaatctgcaagaactgtga

SEQ ID NO: 33265 - DNA, 71 bp, chicken (Gallus Gallus)
  misc_feature (36): n=a or g
tttctgccctgtgggaaatcatctctgcatgtttgntcttctgcataatggagattctccaacatggatca

SEQ ID NO: 33266 - DNA, 71 bp, chicken (Gallus Gallus)
  misc_feature (36): n=c or t
ttaacttctcattttgttgaagaatggtcacagaangattcagcatttcaagaccatttgttgttgatatt

SEQ ID NO: 33267 - DNA, 71 bp, chicken (Gallus Gallus)
  misc_feature (36): n=a or g
aaaaatagcacttcacattgttgtctgtactcaggnatagaacataaacctccagcaagtgcagctgacat

SEQ ID NO: 33268 - DNA, 71 bp, chicken (Gallus Gallus)
  misc_feature (36): n=c or t
aaatatttcagtaataagaaagagtataaatgctcnatctgacaagtttgttgcctaatgcaagtctagaa

SEQ ID NO: 33269 - DNA, 71 bp, chicken (Gallus Gallus)
  misc_feature (36): n=c or t
gtgtagtaaaaaatcttgtgcagagaccttccaagnaaattacaggttggccaaagggaaaaattgttata

SEQ ID NO: 33270 - DNA, 71 bp, chicken (Gallus Gallus)
  misc_feature (36): n=a or g
gtagcaaagatctagtctgagataatcaagtatctntgaagttaatgggtgtattgactaggccatttagg

SEQ ID NO: 33271 - DNA, 71 bp, chicken (Gallus Gallus)
  misc_feature (36): n=c or t
ttgtgtggtgcaggtagtgtctacgtgaaagtttcnaggttcaccctgagtgttttttccccttcttccac

SEQ ID NO: 33272 - DNA, 71 bp, chicken (Gallus Gallus)
  misc_feature (36): n=a or g
agtacttattcctctatgttcatcttaactgcaaantgttcttagaagcctagacttggcaggttgcaagt

SEQ ID NO: 33273 - DNA, 71 bp, chicken (Gallus Gallus)
  misc_feature (36): n=a or g
tgtcaaggattctgagtttcagtttctagattaatntgaattactatccttatggtacaggataaatctaa

SEQ ID NO: 33274 - DNA, 71 bp, chicken (Gallus Gallus)
  misc_feature (36): n=g or t
tgcatgccaaagtcatgggcaagctctgctggcacngtcatctcagtctgctgcactgtgtgttgtgctcg

SEQ ID NO: 33275 - DNA, 71 bp, chicken (Gallus Gallus)
  misc_feature (36): n=a or g
ggtgggatctggtaaccataccactgatgggaactntttttctcttacccttcaatgtaataaggaactaa

SEQ ID NO: 33276 - DNA, 71 bp, chicken (Gallus Gallus)
  misc_feature (36): n=a or g
tgctctcttgattaatttctggttaactcgtttgtntatttctctgttattactggaagcctttgtcaatc

SEQ ID NO: 33277 - DNA, 71 bp, chicken (Gallus Gallus)
  misc_feature (36): n=a or c
tctaaaccttcattggggctaagaggcaaatcaaantggcacagttcttattgctgtgtcttacattcaaa

SEQ ID NO: 33278 - DNA, 71 bp, chicken (Gallus Gallus)
  misc_feature (36): n=a or g
acaaaacaaccaacagcttttggtctttcaagcttnctatttagttagctatctgtaattaaccttacctg

SEQ ID NO: 33279 - DNA, 71 bp, chicken (Gallus Gallus)
  misc_feature (36): n=a or c
aagggtggatatattttgagcattttgatgtgatgngatttcatcgctctttattttcttctatacatgtg

SEQ ID NO: 33280 - DNA, 71 bp, chicken (Gallus Gallus)
  misc_feature (36): n=a or g
caaaattgactacagcaaaagagaggatgggaaagnaagaatccacaagagaacaagtctggtattagcag

SEQ ID NO: 33281 - DNA, 71 bp, chicken (Gallus Gallus)
  misc_feature (36): n=a or g
gaggggcaataaagagtggttaagtcaaacttgggnattttattccaccttcccatagaggaatagcctac

SEQ ID NO: 33282 - DNA, 71 bp, chicken (Gallus Gallus)
  misc_feature (36): n=a or g
actttgcctgaagacctcgctgtgctatagggactncagctgagatgcagtttagaatagctccctgcact

SEQ ID NO: 33283 - DNA, 71 bp, chicken (Gallus Gallus)
  misc_feature (36): n=a or g
ctatgatagaataacaacattatcccttcgggctcntgttaatactttggctaaatcctttaagtagatta

SEQ ID NO: 33284 - DNA, 71 bp, chicken (Gallus Gallus)
  misc_feature (36): n=a or g
caagcttacgaaatgcacttgctgtttacatgcatncccaagtgagagaaggcaaatatcatttttccttt

SEQ ID NO: 33285 - DNA, 71 bp, chicken (Gallus Gallus)
  misc_feature (36): n=c or t
tgtggtgaggctcttgttctcggctccatgccacanacagaatggccagccttgctgctctgagatcttgc

SEQ ID NO: 33286 - DNA, 71 bp, chicken (Gallus Gallus)
  misc_feature (36): n=c or t
ttttgcacttacccaaactcatttactagattctgnatttgcttcactgttgtttccccagagtcattgta

SEQ ID NO: 33287 - DNA, 71 bp, chicken (Gallus Gallus)
  misc_feature (36): n=a or g
tacctgtaaaagcatcatctctggactaattttaancacatctttctgacttttaaattcttgaatggtca

SEQ ID NO: 33288 - DNA, 71 bp, chicken (Gallus Gallus)
  misc_feature (36): n=c or t
gcttaaagtgcttctctgaagtccttggtttatagngcatgcaaaaattacacctgaaagaggagtgtttc

SEQ ID NO: 33289 - DNA, 71 bp, chicken (Gallus Gallus)
  misc_feature (36): n=g or t
gtgccacggtgtctgagcatctaatgactacaaggngtaaggatctctgttgtacttctcatccagaaccc

SEQ ID NO: 33290 - DNA, 71 bp, chicken (Gallus Gallus)
  misc_feature (36): n=g or t
gctacgtcctttttggatttgttgtttggtcctggngtagggtcatgtaaaaatgccaagggcatctcagc

SEQ ID NO: 33291 - DNA, 71 bp, chicken (Gallus Gallus)
  misc_feature (36): n=a or g
ctttcatctcatgtgtactgctgaggtaaaacaatngaggcagttggtttccctttgcatttcttttaata

SEQ ID NO: 33292 - DNA, 71 bp, chicken (Gallus Gallus)
  misc_feature (36): n=a or g
aaatagtcatgcaacttgtttgaaattaactgaaancagtcactgcacgctcacaaaagcattacaagagc

SEQ ID NO: 33293 - DNA, 71 bp, chicken (Gallus Gallus)
  misc_feature (36): n=a or c
ttatctcatctggggagtaaatgtaactaaaataanatatttcaattaacttttatgcttggggtctttat

SEQ ID NO: 33294 - DNA, 71 bp, chicken (Gallus Gallus)
  misc_feature (36): n=a or g
tgagcaggatacctaataggtgtgaggggcaaattnctggtccaaagaccataagactcaaggtgaaaaga

SEQ ID NO: 33295 - DNA, 71 bp, chicken (Gallus Gallus)
  misc_feature (36): n=c or t
ctcctcactttcttttccatctgaaggcatcttctnggatggtgacttgtggctcatttgtaatcttctgt

SEQ ID NO: 33296 - DNA, 71 bp, chicken (Gallus Gallus)
  misc_feature (36): n=a or c
gatcagtgcagggaatcagacacctccagccatcanataacccctgcttcagtgtctcatgtaagatccct

SEQ ID NO: 33297 - DNA, 71 bp, chicken (Gallus Gallus)
  misc_feature (36): n=a or c
agtctgtgcagccacctccaggtactgccagtcaantatagcagagagaaacatgtacaaattctggtggg

SEQ ID NO: 33298 - DNA, 71 bp, chicken (Gallus Gallus)
  misc_feature (36): n=c or t
acaaagtttaaggaagctgaggaaacacaggaaganagttttgtccaagggaggtgtcagattccaaaaca

SEQ ID NO: 33299 - DNA, 71 bp, chicken (Gallus Gallus)
  misc_feature (36): n=c or t
gcatcttcctcctgctgcaacccaacccatgacagnggcccatggggagcaatgctcctctgcagccatgc

SEQ ID NO: 33300 - DNA, 71 bp, chicken (Gallus Gallus)
  misc_feature (36): n=c or t
tcacaattacctgtggatgtttcttgcttaatccantttacagtttcaccttttacacctctcgaggtcac

SEQ ID NO: 33301 - DNA, 71 bp, chicken (Gallus Gallus)
  misc_feature (36): n=a or g
cctctcagaacaaactgatctcttgagagaaatagntttatgttgctgacggtgttttgattttgaacttc

SEQ ID NO: 33302 - DNA, 71 bp, chicken (Gallus Gallus)
  misc_feature (36): n=c or t
agtgatgttgtctttctccagccttttatctttgangagtgaaagcacgtcacatacatgttcagtgttga

SEQ ID NO: 33303 - DNA, 71 bp, chicken (Gallus Gallus)
  misc_feature (36): n=a or g
taattcctgcatgtgtaatctggaagggatcaacanaaggcagaattatatccacctagtgtttaaagcta

SEQ ID NO: 33304 - DNA, 71 bp, chicken (Gallus Gallus)
  misc_feature (36): n=a or g
gcatcccatcgggtgagccattgctgcctggggacncggtcctgtgccagcccttctctgacctgctgcca

SEQ ID NO: 33305 - DNA, 71 bp, chicken (Gallus Gallus)
  misc_feature (36): n=c or t
aaatggggaaagttcctgtgcaagcctcagatgtcnagagacactggagacactcagttatctcggccaca

SEQ ID NO: 33306 - DNA, 71 bp, chicken (Gallus Gallus)
  misc_feature (36): n=c or t
agtggataaaggtgaggcttaagctgtattatttcnctgtatgaagttcttaatgttgagagtgttttcat

SEQ ID NO: 33307 - DNA, 71 bp, chicken (Gallus Gallus)
  misc_feature (36): n=c or t
agtggaagcagaaagacatgggcttagtgattctgntacctgctccacttggttattactgtatgccttct

SEQ ID NO: 33308 - DNA, 71 bp, chicken (Gallus Gallus)
  misc_feature (36): n=c or t
tcccatggagtgctgggaattgctgagccagcaacngggaggacgtagctggcttctgtcccatgcaaaaa

SEQ ID NO: 33309 - DNA, 71 bp, chicken (Gallus Gallus)
  misc_feature (36): n=a or g
gcatgggctgtgtccatagtggggagcaggaacacnttcactgttggagtcccagggggtgggagagcaag

SEQ ID NO: 33310 - DNA, 71 bp, chicken (Gallus Gallus)
  misc_feature (36): n=c or t
ggaaggtaaatatccagatgtaaaatatagatgttntgtaagtgaaaatgctggtgtattttgcagagctc

SEQ ID NO: 33311 - DNA, 71 bp, chicken (Gallus Gallus)
  misc_feature (36): n=c or t
agagactgacaaccaggttaaaggatttcccatgtncatttgtccattgaatggattcaccttttctcttg

SEQ ID NO: 33312 - DNA, 71 bp, chicken (Gallus Gallus)
  misc_feature (36): n=c or t
tgtatatgaatgtatttgtcactcagtaaacacttncttttactatgctcaccagtctgaaagagcagcaa

SEQ ID NO: 33313 - DNA, 71 bp, chicken (Gallus Gallus)
  misc_feature (36): n=c or t
aacatagtttggtaatggctcacatattggtgtaanatataacaaaaagttatgtgctttctggttgcaag

SEQ ID NO: 33314 - DNA, 71 bp, chicken (Gallus Gallus)
  misc_feature (36): n=a or g
atccagattgacgacaatgagtatgcatgccttaangccatcatcttctttgatccaggtatgtgactttc

SEQ ID NO: 33315 - DNA, 71 bp, chicken (Gallus Gallus)
  misc_feature (36): n=g or t
ttgatcaaaaatatgcatatttactatcccatgcanagcccactaagttcaaattaccatcactttgattg

SEQ ID NO: 33316 - DNA, 71 bp, chicken (Gallus Gallus)
  misc_feature (36): n=g or t
tctgaacacagctagctgaggtttctgcagttattntttccctccttcccttatatctgctttctgtggac

SEQ ID NO: 33317 - DNA, 71 bp, chicken (Gallus Gallus)
  misc_feature (36): n=c or t
atagaatgatagaattttacatttggggctaagctnatttttaccctttgactttggcatcatcagagacc

SEQ ID NO: 33318 - DNA, 71 bp, chicken (Gallus Gallus)
  misc_feature (36): n=a or g
cactctgagcatcaaaacccagctgagaggagttgngagcagtcagtgggtcataggatcgttaagattgg

SEQ ID NO: 33319 - DNA, 71 bp, chicken (Gallus Gallus)
  misc_feature (36): n=g or t
cttgtttttggagatttctctcccactcacaatgcncatctctccctacaattctactctactgttaaagg

SEQ ID NO: 33320 - DNA, 71 bp, chicken (Gallus Gallus)
  misc_feature (36): n=a or g
ctggccagatttattctgggtttgctgtaagtgagngagaagggatattgcttatgtacctcaatcgtaga

SEQ ID NO: 33321 - DNA, 71 bp, chicken (Gallus Gallus)
  misc_feature (36): n=g or t
cctccctcgagacataggcgggcagaaaggagctgnacgcgaacaggccgatatctgccgcaaaaccttgc

SEQ ID NO: 33322 - DNA, 71 bp, chicken (Gallus Gallus)
  misc_feature (36): n=a or c
ggtggtttcgtgatagtctcataacacacttgacantggggtcaagaggagtgtagactggtgaaatgatt

SEQ ID NO: 33323 - DNA, 71 bp, chicken (Gallus Gallus)
  misc_feature (36): n=a or g
gatgggttttctgagctgttcaagcagctctgagtnatacagggttggatgaatatttccttgcactaaac

SEQ ID NO: 33324 - DNA, 71 bp, chicken (Gallus Gallus)
  misc_feature (36): n=g or t
tcttgtctcctggacaaaaccctctccatggcattngttggggtggagggaggtggcggagaaacgcagct

SEQ ID NO: 33325 - DNA, 71 bp, chicken (Gallus Gallus)
  misc_feature (36): n=c or t
tcttctcctcaagccactttttcaggaccatctgancattgcaattcctctctaaaattttggtgacacgt

SEQ ID NO: 33326 - DNA, 71 bp, chicken (Gallus Gallus)
  misc_feature (36): n=a or c
tcatgcaaacctcgtgggagagagctgcagcaagtnctcctgatttaagagctattactgatgctgctatt

SEQ ID NO: 33327 - DNA, 71 bp, chicken (Gallus Gallus)
  misc_feature (36): n=c or t
ggctgcgcacactaactaatttgttattggagtgtngctctaagttgcatactccagttcattactggtgg

SEQ ID NO: 33328 - DNA, 71 bp, chicken (Gallus Gallus)
  misc_feature (36): n=a or g
aaactactggaaaatatttattggacaagaatctgncacatttatatgatttaaaacaggattaaccatta

SEQ ID NO: 33329 - DNA, 71 bp, chicken (Gallus Gallus)
  misc_feature (36): n=a or g
tcacaaatgaagctccaaaaggcctggaaaactacncagctttgttgcctaaaactccattggcatccctt

SEQ ID NO: 33330 - DNA, 71 bp, chicken (Gallus Gallus)
  misc_feature (36): n=c or t
ctgctttcctcttccaagaagagcattgctaggaantgcaggcactgctacatgtcactctcctccaagca

SEQ ID NO: 33331 - DNA, 71 bp, chicken (Gallus Gallus)
  misc_feature (36): n=a or g
gacaaagccagtgtgtagcaaagcctaacagaaccntccaccttcactgttggtatttattcagctttgtg

SEQ ID NO: 33332 - DNA, 71 bp, chicken (Gallus Gallus)
  misc_feature (36): n=a or g
agctcccgctgagttttgctgactcaagagaccttngctagaatttaaataagcaactttggaggatccga

SEQ ID NO: 33333 - DNA, 71 bp, chicken (Gallus Gallus)
  misc_feature (36): n=a or c
catctgaagcagagaagggcacagctctgatcaganaagaaatgtatgcaccatttgctgaactcccttct

SEQ ID NO: 33334 - DNA, 71 bp, chicken (Gallus Gallus)
  misc_feature (36): n=a or g
ccctaagccttctccaggttgaacagcccaaatgcnctaacagcagagggcactgtcagaaggtacaaccc

SEQ ID NO: 33335 - DNA, 71 bp, chicken (Gallus Gallus)
  misc_feature (36): n=a or g
aaagccaggaatatttaagtgcataaagctgagctnagcaacccctgaggtttgccagagctgtcccttcc

SEQ ID NO: 33336 - DNA, 71 bp, chicken (Gallus Gallus)
  misc_feature (36): n=a or g
aatttcttttctcttttaaaggatataaccccccanagctcacgtagcaaacctttcaacccaaactcgca

SEQ ID NO: 33337 - DNA, 71 bp, chicken (Gallus Gallus)
  misc_feature (36): n=a or g
gaggtgtcagagcagctatccgagaattacccccanaacaacgaaaacgatcccattgctcctggaaaggg

SEQ ID NO: 33338 - DNA, 71 bp, chicken (Gallus Gallus)
  misc_feature (36): n=a or g
aaattcacttagcatgcggattatttgtatgagctntttttgttgctgttaacacaacactgtggaaatgg

SEQ ID NO: 33339 - DNA, 71 bp, chicken (Gallus Gallus)
  misc_feature (36): n=a or g
gcaagctgggcttgcacacgtgcctgcctggtcagnttgtcagaagggctctgctactacaggggaaaagg

SEQ ID NO: 33340 - DNA, 71 bp, chicken (Gallus Gallus)
  misc_feature (36): n=c or t
catgtttaaaataatttatgcagtttggagctcctnccagctctatctcagcaacatggagctgcacgcca

SEQ ID NO: 33341 - DNA, 71 bp, chicken (Gallus Gallus)
  misc_feature (36): n=c or t
cgatggactcctatgaattcacattaatctgcaaancccagtgactatagggtttatctgaaacttctggg

SEQ ID NO: 33342 - DNA, 71 bp, chicken (Gallus Gallus)
  misc_feature (36): n=a or g
tgcaggggcaccgagcgctgggtagaggatgtgcanccatgtgtgattcccatctgctccgaccctccggg

SEQ ID NO: 33343 - DNA, 71 bp, chicken (Gallus Gallus)
  misc_feature (36): n=a or c
gctggtcagcagagagctttgcatgcaaagagccanttgagctgcccaggctcaatgcccagagccccacg

SEQ ID NO: 33344 - DNA, 71 bp, chicken (Gallus Gallus)
  misc_feature (36): n=a or g
aggcaatgattacatatgagaactttggcaagcgcntaatcattaaattcccttcttttttcccagtgtgt

SEQ ID NO: 33345 - DNA, 71 bp, chicken (Gallus Gallus)
  misc_feature (36): n=c or t
gcttggtgatttgggacccagggaatgctgtgcttnctcagctaagggactgggtttggaccacttaacac

SEQ ID NO: 33346 - DNA, 71 bp, chicken (Gallus Gallus)
  misc_feature (36): n=a or g
gctgcaaagagttttatgatggggccatcacttgangattcgcatagggcaggtgcgatggtgagagcata

SEQ ID NO: 33347 - DNA, 71 bp, chicken (Gallus Gallus)
  misc_feature (36): n=c or t
tgcctggaagtatttctaaaggaaaccttctgccanggaacaccttgagctgaaagccagcttggctgtca

SEQ ID NO: 33348 - DNA, 71 bp, chicken (Gallus Gallus)
  misc_feature (36): n=a or g
ggtgaataaaagcctcaggcagaacccattaaagtngtttcaatctgcagactccaggctgcccagaagtt

SEQ ID NO: 33349 - DNA, 71 bp, chicken (Gallus Gallus)
  misc_feature (36): n=c or t
ccccttttgctgcactggaaagtgttgcaaagggangctccttccaatgaatccttcagtagaggcagtta

SEQ ID NO: 33350 - DNA, 71 bp, chicken (Gallus Gallus)
  misc_feature (36): n=a or g
agaaggccttgagatacagcgtgtgacggcggaggngctgttgggcaagttgagtacctatggtgatgata

SEQ ID NO: 33351 - DNA, 71 bp, chicken (Gallus Gallus)
  misc_feature (36): n=a or g
attcagcagctcctatacaaacctttaggccttcantgaagtactctggcttagatcttcctgtaggatct

SEQ ID NO: 33352 - DNA, 71 bp, chicken (Gallus Gallus)
  misc_feature (36): n=c or t
tcgaatgtggggcaggctgtgactgagacagcttcntgtgcttctgctccatttggtccctgctttccatc

SEQ ID NO: 33353 - DNA, 71 bp, chicken (Gallus Gallus)
  misc_feature (36): n=c or t
cgtcctaggacaccctgtgcaaaagttgtccactgntcgactccaaacaacgcaagactgagccaggggaa

SEQ ID NO: 33354 - DNA, 71 bp, chicken (Gallus Gallus)
  misc_feature (36): n=a or g
caggaattaaggacccagaagcagaagattgtctcngagcgagagcgactgcaagcggagctggatcacct

SEQ ID NO: 33355 - DNA, 71 bp, chicken (Gallus Gallus)
  misc_feature (36): n=a or g
ccaccacccaacagcgcagcagaaagctgtacaacngaggggatgagcatcctcccctgggactgagccag

SEQ ID NO: 33356 - DNA, 71 bp, chicken (Gallus Gallus)
  misc_feature (36): n=c or t
acctccagcagaaaggcaggacaagggagtcatttnatctttcacaaagcaaactcatcatctgagatcag

SEQ ID NO: 33357 - DNA, 71 bp, chicken (Gallus Gallus)
  misc_feature (36): n=a or g
acgatgagcagggagatgggcgagacgcagaggccntgacctcaccctgaggagcgggagaggcagcagca

SEQ ID NO: 33358 - DNA, 71 bp, chicken (Gallus Gallus)
  misc_feature (36): n=a or g
gcagcgctgctgcattgccctgcatggcgctgcacngccaaggcacgcttaaggcatccctgcagcccagc

SEQ ID NO: 33359 - DNA, 71 bp, chicken (Gallus Gallus)
  misc_feature (36): n=a or g
ggggagatgttcagccaagggaagcgcaggaaaacnctccaagattttggaagagcccacgttagtacaat

SEQ ID NO: 33360 - DNA, 71 bp, chicken (Gallus Gallus)
  misc_feature (36): n=a or g
cagtcgcagtggcctggctgcccaccagcgccgatnacgatgcgaaatgagcagggaaacctttgtgctcc

SEQ ID NO: 33361 - DNA, 71 bp, chicken (Gallus Gallus)
  misc_feature (36): n=a or g
tacgttcccttgaagagacctggcttgatgaggtcntcagggctgctcggagggaggtagatgcgtcggta

SEQ ID NO: 33362 - DNA, 71 bp, chicken (Gallus Gallus)
  misc_feature (36): n=g or t
ttttgaggtcaccagcagaaagagttcatgaagacnaaccaagtacagtagcaatcctagagagataaagc

SEQ ID NO: 33363 - DNA, 71 bp, chicken (Gallus Gallus)
  misc_feature (36): n=c or t
tgtgccaagcagagactgtggggcaccatatccaangaccctacagacatcagtgccaccctgggtaaggc

SEQ ID NO: 33364 - DNA, 71 bp, chicken (Gallus Gallus)
  misc_feature (36): n=g or t
gcactttggggagtggtttattaaagcacgggcttntctttctgttctctgaccaagggctgcacatagaa

SEQ ID NO: 33365 - DNA, 71 bp, chicken (Gallus Gallus)
  misc_feature (36): n=a or g
ttggaggaggaggttggacttccataagagaaatgnccccattggtgtgatgggcagccctgggacacgct

SEQ ID NO: 33366 - DNA, 71 bp, chicken (Gallus Gallus)
  misc_feature (36): n=c or t
ctcagaagaagcacagcacgcccctagccaacccantgcagttctgagcaggattattccaagtacagcgt

SEQ ID NO: 33367 - DNA, 71 bp, chicken (Gallus Gallus)
  misc_feature (36): n=a or g
gagtcaggctggtcacatcacctacagaggaaaacnagaggaaaaggttgatagcggacacctgatgatca

SEQ ID NO: 33368 - DNA, 71 bp, chicken (Gallus Gallus)
  misc_feature (36): n=a or g
aggggtttggaaccaatcgtttctgcaggtttgagngggttttatacatgcatgaggcaaataagcaagaa

SEQ ID NO: 33369 - DNA, 71 bp, chicken (Gallus Gallus)
  misc_feature (36): n=c or t
agagctggggacagaagggacaccctgggtgctgcngggccacctggtacagctgccctgactcccgcccc

SEQ ID NO: 33370 - DNA, 71 bp, chicken (Gallus Gallus)
  misc_feature (36): n=c or t
acgcagcaggtatcctgaaagcagcacaactgtaanagcaaatccctgtaaaccttgcttgttttagcaca

SEQ ID NO: 33371 - DNA, 71 bp, chicken (Gallus Gallus)
  misc_feature (36): n=c or t
taaaagactttagaacttcctggcaacaaaaggtgngtcgaaatattggctgcgaaggataatttaagtca

SEQ ID NO: 33372 - DNA, 71 bp, chicken (Gallus Gallus)
  misc_feature (36): n=c or t
cctgaagtaccaccatgtcacaggagagtgcatggngtgctcaggacattcctgttcctctccagttatga

SEQ ID NO: 33373 - DNA, 71 bp, chicken (Gallus Gallus)
  misc_feature (36): n=c or t
acttgtccaggttcctttccatcctattcactctcnggccttctattcaaaaagctgttacaaatacagcc

SEQ ID NO: 33374 - DNA, 71 bp, chicken (Gallus Gallus)
  misc_feature (36): n=g or t
gctgttcaataaactgaagtaaaggtggcatttttnggggaagaagaaataaattgtctgcagggtgtttt

SEQ ID NO: 33375 - DNA, 71 bp, chicken (Gallus Gallus)
  misc_feature (36): n=c or t
aaggaaacagccaggtcctgtagtattcagctgcanaggaagtctgtgtgctttacctgtcatgttacttt

SEQ ID NO: 33376 - DNA, 71 bp, chicken (Gallus Gallus)
  misc_feature (36): n=a or g
cagttcataattcctgcaaggtgttcagtgatacanacagaaacgtactgatgtaccaacctggcgtctgc

SEQ ID NO: 33377 - DNA, 71 bp, chicken (Gallus Gallus)
  misc_feature (36): n=c or t
ggttataggagttgcacccatcttgtgcggatcacngtgcagctgatcaggtggctggctttgtttagacg

SEQ ID NO: 33378 - DNA, 71 bp, chicken (Gallus Gallus)
  misc_feature (36): n=g or t
aagtacagctcctgtcctatcaaggcaggggttggntctgccgtgtgaaactattgagtacccaacaacat

SEQ ID NO: 33379 - DNA, 71 bp, chicken (Gallus Gallus)
  misc_feature (36): n=a or g
tttgcatagaaagattcaggtggtttcattatgcantcaatctctcatagcctttgagcgttccttcagct

SEQ ID NO: 33380 - DNA, 71 bp, chicken (Gallus Gallus)
  misc_feature (36): n=a or g
atcggctcctaagaacaccatagaaaagaggaattncttccagaattccccaattattggtgagtttaggg

SEQ ID NO: 33381 - DNA, 71 bp, chicken (Gallus Gallus)
  misc_feature (36): n=c or t
ctgagtcaggtattcctgtgagtaatcgctgtcccngttcccttagattttatgtagttggaggatttatg

SEQ ID NO: 33382 - DNA, 71 bp, chicken (Gallus Gallus)
  misc_feature (36): n=g or t
atgtgaacggataattcaagctatgtaagcaaatcntccttttaagctgtttgtaattggtaaatcagtgc

SEQ ID NO: 33383 - DNA, 71 bp, chicken (Gallus Gallus)
  misc_feature (36): n=c or t
gcacattccggggagggttgaattttccctgaaatnctggtgctggtcgttcctgaagtcagggcttccaa

SEQ ID NO: 33384 - DNA, 71 bp, chicken (Gallus Gallus)
  misc_feature (36): n=a or g
agtgatggggcaaagaacaaagcctgcgtggttccncattgcaaaatagttcaaagtttgtaacccaaact

SEQ ID NO: 33385 - DNA, 71 bp, chicken (Gallus Gallus)
  misc_feature (36): n=c or t
agggaagcaagcaggagagcaagaactgtgcaaacngaatgcatttccttggatttgtttttgcttgggta

SEQ ID NO: 33386 - DNA, 71 bp, chicken (Gallus Gallus)
  misc_feature (36): n=a or g
cttaaaaacatgtcccggagatggctttatttctgnctggctttctgctgcttgctccgtccaatctggca

SEQ ID NO: 33387 - DNA, 71 bp, chicken (Gallus Gallus)
  misc_feature (36): n=a or g
tggggtgagagaggtgctcaggtgcctcatctatgngattgtttagcaaatggggcacttggagggctctg

SEQ ID NO: 33388 - DNA, 71 bp, chicken (Gallus Gallus)
  misc_feature (36): n=g or t
taccctgaaaagaacaaatccattacagcttgtacngaagcctgagtgaccatggcaaagtctccaccgtg

SEQ ID NO: 33389 - DNA, 71 bp, chicken (Gallus Gallus)
  misc_feature (36): n=a or g
ttctttatttattaccacgttggtttgaaggctganctgggttaatagtgtcctcttctgtgctattgaga

SEQ ID NO: 33390 - DNA, 71 bp, chicken (Gallus Gallus)
  misc_feature (36): n=a or g
tctcctcccagcttcatcttgcgatgtgtctgaatntctcaaggggcttgttctgtctgtcctctgattgt

SEQ ID NO: 33391 - DNA, 71 bp, chicken (Gallus Gallus)
  misc_feature (36): n=a or g
aggttcccctgggtggtgggtctgtgcctgggtcantgttgctttgtcagaacagagcaggagtgtgacat

SEQ ID NO: 33392 - DNA, 71 bp, chicken (Gallus Gallus)
  misc_feature (36): n=a or g
tcgacgatcttgagctggtagagcatcttgcagacnatgatgatgcaggtccagacggtggagaggcacga

SEQ ID NO: 33393 - DNA, 71 bp, chicken (Gallus Gallus)
  misc_feature (36): n=a or g
gggggcgggaagaccccctgcacgaagggtgcttgntaggcatagaggcacaggaggtgggcagcagcgta

SEQ ID NO: 33394 - DNA, 71 bp, chicken (Gallus Gallus)
  misc_feature (36): n=g or t
gcctcgctgcaaggtcccaggagagcagggacaaanttcctgtgctggcatcgcccacacagctcgaagag

SEQ ID NO: 33395 - DNA, 71 bp, chicken (Gallus Gallus)
  misc_feature (36): n=a or g
acactgaactcttcctcaggtgcccttctgatgtcnacagagatggagcggtacaggtttgaggaggggat

SEQ ID NO: 33396 - DNA, 71 bp, chicken (Gallus Gallus)
  misc_feature (36): n=c or t
ggttttagaactgggttagcgtggaatcacttcccngcttgcagctcgcgcagcttgctcggggcaaggca

SEQ ID NO: 33397 - DNA, 71 bp, chicken (Gallus Gallus)
  misc_feature (36): n=a or g
agtgggtggaatgggaacaagccttgtcgaaacacnaaggtttggaagtctcacgctccttttgaagactc

SEQ ID NO: 33398 - DNA, 71 bp, chicken (Gallus Gallus)
  misc_feature (36): n=c or t
ctgtttacctcccgacctgccatcgctgtctgcctngcagctcctccttccttggcaagcctctgagatgt

SEQ ID NO: 33399 - DNA, 71 bp, chicken (Gallus Gallus)
  misc_feature (36): n=a or c
taacgctgccgttagagaagtgatcataacacgccnagaaggaagatcaaagctgactctcacggccgaaa

SEQ ID NO: 33400 - DNA, 71 bp, chicken (Gallus Gallus)
  misc_feature (36): n=a or g
tctttgtggggtgtaacagagcagccccctgcagcnagagtcctgcgagggcataggtgacaaccgcacct

SEQ ID NO: 33401 - DNA, 71 bp, chicken (Gallus Gallus)
  misc_feature (36): n=c or t
gctgctgggtctgtaacagcacacggtggtggtggnggtgacatccatgtgctgagatgtgcggccgtgca

SEQ ID NO: 33402 - DNA, 71 bp, chicken (Gallus Gallus)
  misc_feature (36): n=c or t
tgctgctcgaactcatccatcactgcagacaccttntgaaggtccatggagctcagagctttgtccaaagc

SEQ ID NO: 33403 - DNA, 71 bp, chicken (Gallus Gallus)
  misc_feature (36): n=a or g
tacaagcactgctgctgtttccagatgaaggcagcntgtttcaagtagacagactggggcctgatttggtt

SEQ ID NO: 33404 - DNA, 71 bp, chicken (Gallus Gallus)
  misc_feature (36): n=a or g
ttcaggaaaagacattctactttcagtttttaagcntggagaacagccagacatttaaaatgagtccagtc

SEQ ID NO: 33405 - DNA, 71 bp, chicken (Gallus Gallus)
  misc_feature (36): n=c or t
tgcaccttttgcatcagcattccagggccagacatnactctggcttggaaccagcactggctaaagtacac

SEQ ID NO: 33406 - DNA, 71 bp, chicken (Gallus Gallus)
  misc_feature (36): n=c or t
atgccttccaagaagctggctcacatccccgtctangcactgggcttcgagagcctcccgggctcactgct

SEQ ID NO: 33407 - DNA, 71 bp, chicken (Gallus Gallus)
  misc_feature (36): n=c or t
ttcaccgccatgttccgccgcaaggccttcctgcantggtacacgggagaggggatggacgagatggagtt

SEQ ID NO: 33408 - DNA, 71 bp, chicken (Gallus Gallus)
  misc_feature (36): n=a or g
aggctcggcgtgacatggctgcggccctgctgggcnctcgtttgagtgctgacccaacacggctcccgttg

SEQ ID NO: 33409 - DNA, 71 bp, chicken (Gallus Gallus)
  misc_feature (36): n=a or g
gctcggattaaatcatgccatctgctcttagggaanaagagaggttagattcgaatgtgcagagagttgga

SEQ ID NO: 33410 - DNA, 71 bp, chicken (Gallus Gallus)
  misc_feature (36): n=a or g
gaagtctgatgtgttaggagcaggtttgatgtggcnagtttccttaaaggtacccaaaccatttcagattc

SEQ ID NO: 33411 - DNA, 71 bp, chicken (Gallus Gallus)
  misc_feature (36): n=c or t
agctggactgcatctgctcagaggggcctctgttcntactgccctggtgtgtgtttgttctctcatatatg

SEQ ID NO: 33412 - DNA, 71 bp, chicken (Gallus Gallus)
  misc_feature (36): n=a or g
ctgtgcgaggtctgcacacatagccctggggaagcntccacgagtccctcccagcccaaactgaaggttgg

SEQ ID NO: 33413 - DNA, 71 bp, chicken (Gallus Gallus)
  misc_feature (36): n=a or g
ggactctgtccgctgacatctcaggagatttattcntgcactggaaattgcagatgacagtttctctgagt

SEQ ID NO: 33414 - DNA, 71 bp, chicken (Gallus Gallus)
  misc_feature (36): n=g or t
ttctagaaaaaaatcccgctgccagtgccattactngtgctgccatgtagctaggttaaatatttatttca

SEQ ID NO: 33415 - DNA, 71 bp, chicken (Gallus Gallus)
  misc_feature (36): n=a or c
gtgtacttggccaggtagcactgtggtctatttccncaagaaaccctgctggtgctactgtctgatttgtg

SEQ ID NO: 33416 - DNA, 71 bp, chicken (Gallus Gallus)
  misc_feature (36): n=a or g
aatgggggttcagcctatggttgtgaacttggagtnacagtggtgaattgttgggtgaggtgtgaagcact

SEQ ID NO: 33417 - DNA, 71 bp, chicken (Gallus Gallus)
  misc_feature (36): n=a or g
gagagagagtcccatttttgtttgggctctttcctnttttcccttttcagaaatagaagattaggaggtgt

SEQ ID NO: 33418 - DNA, 71 bp, chicken (Gallus Gallus)
  misc_feature (36): n=g or t
gtctggccaggtacgttctggtggagccaggcaggntttgtagtttgtgtattcaatgttgtgctgttttc

SEQ ID NO: 33419 - DNA, 71 bp, chicken (Gallus Gallus)
  misc_feature (36): n=a or g
cccacaattagcaggagggcaagcagcagagtaacnctttcagtcctggtggtcccaagaagcacatttag

SEQ ID NO: 33420 - DNA, 71 bp, chicken (Gallus Gallus)
  misc_feature (36): n=g or t
tcactgctgggaagtaaggtttcagtgcaccacttngcaggcgtggggtgttgctgtgctcgaggtggagt

SEQ ID NO: 33421 - DNA, 71 bp, chicken (Gallus Gallus)
  misc_feature (36): n=g or t
ttctgcaatggcagatcaagcagatgagatgatgangagatgttgtagctcaggacttggaaatctttgtg

SEQ ID NO: 33422 - DNA, 71 bp, chicken (Gallus Gallus)
  misc_feature (36): n=c or t
gacccattctgctgctcctagcacaagaaaggcagntcagaggaaaggtatcccagaagccagcatgaaga

SEQ ID NO: 33423 - DNA, 71 bp, chicken (Gallus Gallus)
  misc_feature (36): n=a or g
ttagctccttttaagcagagtcctggtaaaaccgcngtgtgaattgtggcgatgatgctaactggatatcg

SEQ ID NO: 33424 - DNA, 71 bp, chicken (Gallus Gallus)
  misc_feature (36): n=a or c
acacctgtgttaatttaatatggttcttcagtggangacgtttgagagcaagaaggcaccagttctgtctc

SEQ ID NO: 33425 - DNA, 71 bp, chicken (Gallus Gallus)
  misc_feature (36): n=a or c
tgaagaagtcttatcatgaatctaggaccagagagnagagaaaaagggaggctggcttataggcatgtatt

SEQ ID NO: 33426 - DNA, 71 bp, chicken (Gallus Gallus)
  misc_feature (36): n=a or g
gtacttctaagcaaactgctgcttccaaagatcagnaggcagaggcgatgtgcacagggcgacaggtgttt

SEQ ID NO: 33427 - DNA, 71 bp, chicken (Gallus Gallus)
  misc_feature (36): n=c or t
gttctcttcccccacagaaatacagcaactgcttantttcacaagcaatagataagcccttgtgaccagca

SEQ ID NO: 33428 - DNA, 71 bp, chicken (Gallus Gallus)
  misc_feature (36): n=a or g
gggatttcaaacactttctcctaatgatgtacatcnaagtggtaaaatacatctcctcttgcccagattgc

SEQ ID NO: 33429 - DNA, 71 bp, chicken (Gallus Gallus)
  misc_feature (36): n=g or t
attttctcattaggcaaatgatttgttggacttgtngggggggaatgatataacacctgtaatccccactg

SEQ ID NO: 33430 - DNA, 71 bp, chicken (Gallus Gallus)
  misc_feature (36): n=g or t
tttattccaggttctaacagcttggctgttgtaggnaacagatacacagatttgtcatttacagtaacacg

SEQ ID NO: 33431 - DNA, 71 bp, chicken (Gallus Gallus)
  misc_feature (36): n=a or c
ggtcttgatggcagtttgctaccacgacaagagcgncgttgcagcctacatcctctgctcccctcaagcat

SEQ ID NO: 33432 - DNA, 71 bp, chicken (Gallus Gallus)
  misc_feature (36): n=c or t
ctgaactgcattctaagacttagagatctgtatttncatctctgttctagtagggattggcttgggcagat

SEQ ID NO: 33433 - DNA, 71 bp, chicken (Gallus Gallus)
  misc_feature (36): n=a or g
ttattgagcaaaatggcaaccatgtagaagcatgcnctggcaactcttggaagcagagacatcaagcacaa

SEQ ID NO: 33434 - DNA, 71 bp, chicken (Gallus Gallus)
  misc_feature (36): n=c or t
tacgttcaggactcaaaatattcccttaatataaangtgcagaacttacacagctgtgcgctctgcccaga

SEQ ID NO: 33435 - DNA, 71 bp, chicken (Gallus Gallus)
  misc_feature (36): n=a or g
acttcatcttcaattgtttcttgggcacccaaagcnaatattgttccatctcactacgattcattaaacaa

SEQ ID NO: 33436 - DNA, 71 bp, chicken (Gallus Gallus)
  misc_feature (36): n=a or g
tatttatcactgctgacctgtacagtacactctggntaggcagtctggtactgcatatgtaccgcaatgaa

SEQ ID NO: 33437 - DNA, 71 bp, chicken (Gallus Gallus)
  misc_feature (36): n=c or t
agccttggaaaattgctaaaatggaggtgaagggangaaatcagtctatgaggaattgatactatcttaga

SEQ ID NO: 33438 - DNA, 71 bp, chicken (Gallus Gallus)
  misc_feature (36): n=c or t
acctttaaaaatatgaagaaatactttgcgctttgnacctcttacttgaacataaacagaacccttccttg

SEQ ID NO: 33439 - DNA, 71 bp, chicken (Gallus Gallus)
  misc_feature (36): n=c or t
gcttaggacattgtaccaagtgtgacaagggtgtanatatgtccatgatttcaggcaccacatcttcgtgt

SEQ ID NO: 33440 - DNA, 71 bp, chicken (Gallus Gallus)
  misc_feature (36): n=c or t
ttgggcttcagaatggaaacacccacttacataaancctggacagttgcaagtaacttctctctgcttttt

SEQ ID NO: 33441 - DNA, 71 bp, chicken (Gallus Gallus)
  misc_feature (36): n=a or g
tccacagtaggtactggatcagaagccgcatttgcnctggaaaccttggcatgttgctctgataaatgtgt

SEQ ID NO: 33442 - DNA, 71 bp, chicken (Gallus Gallus)
  misc_feature (36): n=a or g
aagacaatttgctttacaaataaaaaggaggctgcntgcatttcctgctacacttcttgcatctgatcaga

SEQ ID NO: 33443 - DNA, 71 bp, chicken (Gallus Gallus)
  misc_feature (36): n=a or g
aggccctggatgttgcttgtgtgaggcagtgccaangatggaacagtagacaaatccacctcatctctgtg

SEQ ID NO: 33444 - DNA, 71 bp, chicken (Gallus Gallus)
  misc_feature (36): n=c or t
cagacaatcaaatctaaacagactacaagggcttangaggtgtgtagaaagatgttctcttaaaaagactt

SEQ ID NO: 33445 - DNA, 71 bp, chicken (Gallus Gallus)
  misc_feature (36): n=a or g
tatattctctggcacgtcacatgtccctaccagatngttgtattaaatggtctataggaaaaaagaggtat

SEQ ID NO: 33446 - DNA, 71 bp, chicken (Gallus Gallus)
  misc_feature (36): n=g or t
atatgcatttattccattgtatgcaccaggcagggntattccatgtattaacaagacaaataatacaacgt

SEQ ID NO: 33447 - DNA, 71 bp, chicken (Gallus Gallus)
  misc_feature (36): n=a or g
tgtcattttctttaaattgtgctcaaaactactganaatgattcttgtttcctaagtatagagatttttgt

SEQ ID NO: 33448 - DNA, 71 bp, chicken (Gallus Gallus)
  misc_feature (36): n=a or g
caaatacagcaaatccagcacaggccctacaagccntgctacaaatttcgtattttttctgttcatgatac

SEQ ID NO: 33449 - DNA, 71 bp, chicken (Gallus Gallus)
  misc_feature (36): n=c or t
aacaaagctagtggttaaaagctccttattttctcngtccttttcttttctggcgctgatttatcaaggct

SEQ ID NO: 33450 - DNA, 71 bp, chicken (Gallus Gallus)
  misc_feature (36): n=a or g
catcagagacagacttgcttctttctaaaagatccntacagttgagtagtgcttctgcttctaacaatttt

SEQ ID NO: 33451 - DNA, 71 bp, chicken (Gallus Gallus)
  misc_feature (36): n=a or c
gattattctgtatgttcctttcatttagctcataanagaaaccacatagtttgctagctgtaggaacaaga

SEQ ID NO: 33452 - DNA, 71 bp, chicken (Gallus Gallus)
  misc_feature (36): n=g or t
catgagagtcccaaacacctgttaggggccacaggnatttggaggtgttatttcagccagcagaggagttg

SEQ ID NO: 33453 - DNA, 71 bp, chicken (Gallus Gallus)
  misc_feature (36): n=a or g
ctgacagatgattttctggctctctattacatgggnagaaaatgttcacacaatgcacaataaatacatat

SEQ ID NO: 33454 - DNA, 71 bp, chicken (Gallus Gallus)
  misc_feature (36): n=a or g
agctatggataaataactcgttaagaatcgcttacntttacatgaccttgtctcttcttgacctgtattaa

SEQ ID NO: 33455 - DNA, 71 bp, chicken (Gallus Gallus)
  misc_feature (36): n=a or g
catatacttaatttagagcacggcttttcttgcagnggctgtctgacacccactgaaaaatgctaagagcc

SEQ ID NO: 33456 - DNA, 71 bp, chicken (Gallus Gallus)
  misc_feature (36): n=g or t
ttttcctaacaaactctgtacttcaaacaaaacttnaatatgcttactggggagccgcgtgcaggaaataa

SEQ ID NO: 33457 - DNA, 71 bp, chicken (Gallus Gallus)
  misc_feature (36): n=g or t
gaatagctggtttatgagaagctagatatactgtgntataaaacttagttaccgtagtgcacatttttctt

SEQ ID NO: 33458 - DNA, 71 bp, chicken (Gallus Gallus)
  misc_feature (36): n=c or t
tcttttgttaatagaattggaacataacaggaatgnggagtgttagcatttcatacttctgtgttctgaaa

SEQ ID NO: 33459 - DNA, 71 bp, chicken (Gallus Gallus)
  misc_feature (36): n=a or g
attgcaacaatacttaatagcattataactgtaatnataaatacatgctagctacctcttcagttaatctc

SEQ ID NO: 33460 - DNA, 71 bp, chicken (Gallus Gallus)
  misc_feature (36): n=g or t
cacagcaggcactacatgacacacactaatgcagcntatgctagctgctagacatgtttttaactactgtt

SEQ ID NO: 33461 - DNA, 71 bp, chicken (Gallus Gallus)
  misc_feature (36): n=c or t
tgttcatatttattgtatgaaaccagatccctatgngaatagtaatgaaaacagtgacctcgtgctctact

SEQ ID NO: 33462 - DNA, 71 bp, chicken (Gallus Gallus)
  misc_feature (36): n=a or g
ctaagttgggttaggcttaatatgcagggctccatntgtgtttcctctgggtctctccttcagcattcggt

SEQ ID NO: 33463 - DNA, 71 bp, chicken (Gallus Gallus)
  misc_feature (36): n=a or g
taaggcactgaaaaaatatgttgaattcgtgtacangtacgttgaaggcctaattccatgttcagatgtat

SEQ ID NO: 33464 - DNA, 71 bp, chicken (Gallus Gallus)
  misc_feature (36): n=c or t
tgcaacagctgtaggacataaagacagagaaaaacntcaccactgttaatattctctaattttgcatcttc

SEQ ID NO: 33465 - DNA, 71 bp, chicken (Gallus Gallus)
  misc_feature (36): n=a or g
aaagaccatagagaacacattccaagtttggaaacncaaaaacactcagcagaaaatggcattattcttga

SEQ ID NO: 33466 - DNA, 71 bp, chicken (Gallus Gallus)
  misc_feature (36): n=c or t
agtctctgctccagatgtagctctaaacccaaattncaagcaacacagtagctatttaggtctgaaggcct

SEQ ID NO: 33467 - DNA, 71 bp, chicken (Gallus Gallus)
  misc_feature (36): n=g or t
cagcaatcacaaacagctacccaccaggatcacagnaacctctggaaaatgcctgctttaatggatgactg

SEQ ID NO: 33468 - DNA, 71 bp, chicken (Gallus Gallus)
  misc_feature (36): n=c or t
aaagctcacatggaccattaactgcaacgacagagnggggcagcgctaatactcacacacacatcatgttt

SEQ ID NO: 33469 - DNA, 71 bp, chicken (Gallus Gallus)
  misc_feature (36): n=a or g
ggtttttgcacagcaagctaattgtattttaagccnacttccaaatgaattccctatagctgttcaacttt

SEQ ID NO: 33470 - DNA, 71 bp, chicken (Gallus Gallus)
  misc_feature (36): n=a or g
tgtccttgcttctagatcagtgtaactgataaaagnaatctgggatggtgaggacgggggcaaagggactc

SEQ ID NO: 33471 - DNA, 71 bp, chicken (Gallus Gallus)
  misc_feature (36): n=g or t
aggtaattgtgctgtgaatgctgacagatctgacanaaagtgtcttcattgagaaattgcattttgaagtt

SEQ ID NO: 33472 - DNA, 71 bp, chicken (Gallus Gallus)
  misc_feature (36): n=a or g
catcaaccttacccatgtctttgccatcaactcttntgggctttggagagatgaaacctccttatacttct

SEQ ID NO: 33473 - DNA, 71 bp, chicken (Gallus Gallus)
  misc_feature (36): n=c or t
gcccttgacagctgtaaaaaggtaataggaatgcantggaaggaagtaagctggctctctctttagagcgc

SEQ ID NO: 33474 - DNA, 71 bp, chicken (Gallus Gallus)
  misc_feature (36): n=a or g
caaaagccttccaagtgagacatagaagaagcattnaactgggataacttattggaaaaaaatgtcttcat

SEQ ID NO: 33475 - DNA, 71 bp, chicken (Gallus Gallus)
  misc_feature (36): n=c or t
catttaatcaaccactttacatactcaatactttgntgatcattaaaaagctttcttcacctagttttgta

SEQ ID NO: 33476 - DNA, 71 bp, chicken (Gallus Gallus)
  misc_feature (36): n=g or t
tatacacatgtcatttcacaggcatgtttcataccncatttacatggtgctagtatcataagctgtacatc

SEQ ID NO: 33477 - DNA, 71 bp, chicken (Gallus Gallus)
  misc_feature (36): n=c or t
acaatatcattactgcgcacatcacttcagcaaaanccacgcattccaggggttaattacaatcccctcct

SEQ ID NO: 33478 - DNA, 71 bp, chicken (Gallus Gallus)
  misc_feature (36): n=c or t
aattaatacaggaaggaaaagcattaagtttgagangtgcaaacaggactaaaattttttaagtcttttgg

SEQ ID NO: 33479 - DNA, 71 bp, chicken (Gallus Gallus)
  misc_feature (36): n=c or t
agtactccaacaaaatacatgaataatccataagcnggcataacacttcaaaaccatttatttttattttt

SEQ ID NO: 33480 - DNA, 71 bp, chicken (Gallus Gallus)
  misc_feature (36): n=c or t
tcaaatgttttcagagcaattttcaccatgtgctangtgagttggaagagtgccttttgagcagttccact

SEQ ID NO: 33481 - DNA, 71 bp, chicken (Gallus Gallus)
  misc_feature (36): n=a or g
cagaaccattgatgtttaaagcacagtgcgctactnctttatgccaaagtccattcctagtaagcagtttg

SEQ ID NO: 33482 - DNA, 71 bp, chicken (Gallus Gallus)
  misc_feature (36): n=a or c
tagtcttgaaacatttctttgctattcggtaccaanatcttcaaggggtctttggcagtctgaaacctaga

SEQ ID NO: 33483 - DNA, 71 bp, chicken (Gallus Gallus)
  misc_feature (36): n=a or c
atgcaatactcagcagacgccattccagcagacaanaaaactctggtttgatgctggaagtgacctcagaa

SEQ ID NO: 33484 - DNA, 71 bp, chicken (Gallus Gallus)
  misc_feature (36): n=a or g
ttctgagggtgagaaagacaggtgagcagacaaagnaccattccagatttcctcacagctctcctttgtcc

SEQ ID NO: 33485 - DNA, 71 bp, chicken (Gallus Gallus)
  misc_feature (36): n=a or c
ccctgaactaaaaggtagctcagattgcacagattnatctgctatgagtattttaagaaattcaactttga

SEQ ID NO: 33486 - DNA, 71 bp, chicken (Gallus Gallus)
  misc_feature (36): n=a or g
agatatttcacagctattgcattaaagccagaaganagacagatttgtatcctgaaagaatgcactacaaa

SEQ ID NO: 33487 - DNA, 71 bp, chicken (Gallus Gallus)
  misc_feature (36): n=a or g
agttaaaattgagagactttcctatatctccaaatnccttataaaagaattatatgaaaatgtttagcatt

SEQ ID NO: 33488 - DNA, 71 bp, chicken (Gallus Gallus)
  misc_feature (36): n=a or g
tatcttgtcttgctaagatttattctttccttatcnaagccagtcacactttgaagagtggtgagtctaag

SEQ ID NO: 33489 - DNA, 71 bp, chicken (Gallus Gallus)
  misc_feature (36): n=c or t
agaagccataaagcatctgattttgcttcatctagnttgagctgtagggacaagcaactgtgttctcattt

SEQ ID NO: 33490 - DNA, 71 bp, chicken (Gallus Gallus)
  misc_feature (36): n=g or t
acctattgcaacttttcctctagtcctgtggcaggntgcaaactatgtgaattaatatgcatcatattctt

SEQ ID NO: 33491 - DNA, 71 bp, chicken (Gallus Gallus)
  misc_feature (36): n=a or c
aaaacttgtacaccaaccccctgagactgctttganataaaatctttctttggattaatcacaagtgtcac

SEQ ID NO: 33492 - DNA, 71 bp, chicken (Gallus Gallus)
  misc_feature (36): n=g or t
agagtaatctctagaagctttatgtcgtttaatganggctaaaatatgctttgcttggtgacgaaaccggt

SEQ ID NO: 33493 - DNA, 71 bp, chicken (Gallus Gallus)
  misc_feature (36): n=a or g
ttcaaatgtggaacacttgaatgcttcctgatgatncagcttattaagtggatattaggaagacaattctt

SEQ ID NO: 33494 - DNA, 71 bp, chicken (Gallus Gallus)
  misc_feature (36): n=c or t
tctggaacgacctgtcttcctttgtaacctaagaanagagagtattacttcttctgtggtggctttttgtt

SEQ ID NO: 33495 - DNA, 71 bp, chicken (Gallus Gallus)
  misc_feature (36): n=a or g
gccaggtattgctgctgtcccagtgcaccttcctcnctttcaaatggccttttctgagacagtccctgctt

SEQ ID NO: 33496 - DNA, 71 bp, chicken (Gallus Gallus)
  misc_feature (36): n=a or g
catattaaatgaagtcttcattgtaatcaagacagncttcagaacagtatcatcacaaatagattctgctt

SEQ ID NO: 33497 - DNA, 71 bp, chicken (Gallus Gallus)
  misc_feature (36): n=a or g
cttcaatgaaattgccacagaataaaaacttgcacnttttcagaatgaaatcttacgttttaatgaaatct

SEQ ID NO: 33498 - DNA, 71 bp, chicken (Gallus Gallus)
  misc_feature (36): n=g or t
aacctgcgaacacagcatttttataggtcttcaatntcgctaattgcagcataacaaatatcagcatatag

SEQ ID NO: 33499 - DNA, 71 bp, chicken (Gallus Gallus)
  misc_feature (36): n=a or g
atcaaccttcatgtcaaagccatgcagccaagtgcnagaattctgctctcttcacctacttttttaatcct

SEQ ID NO: 33500 - DNA, 71 bp, chicken (Gallus Gallus)
  misc_feature (36): n=g or t
cattcaggagttaatcttatggctgtagggcctacntggtcccacagtgctaatcttgcagctctggtccc

SEQ ID NO: 33501 - DNA, 71 bp, chicken (Gallus Gallus)
  misc_feature (36): n=a or g
catggtcaattccagtatcagtagtagctgtttgcntggttattagatgattatcctgtttccacttctca

SEQ ID NO: 33502 - DNA, 71 bp, chicken (Gallus Gallus)
  misc_feature (36): n=a or g
gcaaatagttcttaatgtacaggcacccataccaangtctgtgtatacttatttatagttcagaactttca

SEQ ID NO: 33503 - DNA, 71 bp, chicken (Gallus Gallus)
  misc_feature (36): n=a or g
agataatatttatgttttgcctttactccaaaagangggttgggctcattctctgaattcccttttctcat

SEQ ID NO: 33504 - DNA, 71 bp, chicken (Gallus Gallus)
  misc_feature (36): n=c or t
caaatactccatgtaaatacagatgtatatccatgntatgtttaattttgctcttagagcaaaacatcact

SEQ ID NO: 33505 - DNA, 71 bp, chicken (Gallus Gallus)
  misc_feature (36): n=a or g
ctttgctggatcagggccatatttgataagttttcngtgctggtgtgagagtccataacttgaccccacat

SEQ ID NO: 33506 - DNA, 71 bp, chicken (Gallus Gallus)
  misc_feature (36): n=a or g
tgagaactagtacaaaggtgacatctccccatttgnctttctaaagaaaacttgccaagagaaacttttca

SEQ ID NO: 33507 - DNA, 71 bp, chicken (Gallus Gallus)
  misc_feature (36): n=c or t
tctgtatggtaaggaattaagcatcgactacttagngcaacctgtgaaaaggaagtggaagtggttctgat

SEQ ID NO: 33508 - DNA, 71 bp, chicken (Gallus Gallus)
  misc_feature (36): n=a or g
gatcagtagaataataataccgtgtatattcatatnaagttacttcttgcatataaaaacatttataggct

SEQ ID NO: 33509 - DNA, 71 bp, chicken (Gallus Gallus)
  misc_feature (36): n=g or t
agcagtgtagcctgatggtatactgaataatagagnttttaatagtgtgttagattcttatgtcctcaatg

SEQ ID NO: 33510 - DNA, 71 bp, chicken (Gallus Gallus)
  misc_feature (36): n=a or g
agatccattgtccacatgacagatgctgctcactcnggaatcatgactccctctcagctcaccaccattaa

SEQ ID NO: 33511 - DNA, 71 bp, chicken (Gallus Gallus)
  misc_feature (36): n=c or t
tcctcccttattctgaatacttctctctctcaacangccacagtatcggcatctcctcaaactcttcaaca

SEQ ID NO: 33512 - DNA, 71 bp, chicken (Gallus Gallus)
  misc_feature (36): n=a or g
atgtgtggctttgaatgagctgttctgacacttcantaggctacgctggagatttataatgtactgtttac

SEQ ID NO: 33513 - DNA, 71 bp, chicken (Gallus Gallus)
  misc_feature (36): n=a or g
agtacaatagataaaataccctgcttttcagttatnctccatttttactctggttacttaaaacataaata

SEQ ID NO: 33514 - DNA, 71 bp, chicken (Gallus Gallus)
  misc_feature (36): n=a or g
gaaagaagtacaatcactggagactctttctttagnagagcatgctaaaaataatttggcctttagatagc

SEQ ID NO: 33515 - DNA, 71 bp, chicken (Gallus Gallus)
  misc_feature (36): n=a or g
atcagcattgcaggtggatctgctgtagttctgagnctaactggaatcttttcagtgaccttattgccaga

SEQ ID NO: 33516 - DNA, 71 bp, chicken (Gallus Gallus)
  misc_feature (36): n=c or t
aaacaaacccatttcaagatgatgttacttatttanactaagaaataatcaaatgagtgtacatttgctag

SEQ ID NO: 33517 - DNA, 71 bp, chicken (Gallus Gallus)
  misc_feature (36): n=a or g
agagtatcttctgtgcaaattattgtagtactgaanaccttcatcaagtctatattttctgttcttctaga

SEQ ID NO: 33518 - DNA, 71 bp, chicken (Gallus Gallus)
  misc_feature (36): n=a or g
agaaacacaagctatctctcttctttactgaatatngaaccaaagccttaaatgaaaaacagctttaaaac

SEQ ID NO: 33519 - DNA, 71 bp, chicken (Gallus Gallus)
  misc_feature (36): n=c or t
atggtgccaaggaaactctccaaaaatttcagtaangttttatcttagtaaattgggaataaccaggtgtc

SEQ ID NO: 33520 - DNA, 71 bp, chicken (Gallus Gallus)
  misc_feature (36): n=g or t
gggtcatcagggtcagatacagtcccaggtggtgcntgtcagggtcaggtaaaccagaaaataatctcaca

SEQ ID NO: 33521 - DNA, 71 bp, chicken (Gallus Gallus)
  misc_feature (36): n=a or g
tatctctcacaatgcttgaatgatgtttttaaaagngtaactgaatacttataattcacaggattgatata

SEQ ID NO: 33522 - DNA, 71 bp, chicken (Gallus Gallus)
  misc_feature (36): n=a or g
aaattaaatccctcactgcagagtgatataaaaagnatacgtatttgaagggatgatgctttttcctgttt

SEQ ID NO: 33523 - DNA, 71 bp, chicken (Gallus Gallus)
  misc_feature (36): n=c or t
tctgagactcattatgtttctttatgctcttagtgngtcaaaagagatcttggttagctgtctaagcaagt

SEQ ID NO: 33524 - DNA, 71 bp, chicken (Gallus Gallus)
  misc_feature (36): n=a or c
aactgtattatcactctaacaatgaaaactgctttnttttttctctttgccgcagggaagtgatagtgatt

SEQ ID NO: 33525 - DNA, 71 bp, chicken (Gallus Gallus)
  misc_feature (36): n=c or t
atcctgcactttaacaattaagcatttcttcacttngagaacgctattcccagttatatttagtatcatac

SEQ ID NO: 33526 - DNA, 71 bp, chicken (Gallus Gallus)
  misc_feature (36): n=a or g
aatgtcacagtgtctatctatgcaattaccacacancaccagggcatcttaacacttaaaatacttacata

SEQ ID NO: 33527 - DNA, 71 bp, chicken (Gallus Gallus)
  misc_feature (36): n=g or t
ggaagaacaaagtaaatctattggctctaaaaatgntgcaggagtggactaggcacagactttggtctcct

SEQ ID NO: 33528 - DNA, 71 bp, chicken (Gallus Gallus)
  misc_feature (36): n=c or t
gaatctgatagacaaagcacctattttaaaatcaanttaagatgaattgtgagatgttttataaattatgg

SEQ ID NO: 33529 - DNA, 71 bp, chicken (Gallus Gallus)
  misc_feature (36): n=g or t
aaattgtccctgaaggatggctgatataaaatcccngcaatatttaggtattactgcaaaaacactactga

SEQ ID NO: 33530 - DNA, 71 bp, chicken (Gallus Gallus)
  misc_feature (36): n=c or t
ttaactgcaggttttgcagacttggcaaacaagtantgtaaatcacatcttagcaaactatgagaggacag

SEQ ID NO: 33531 - DNA, 71 bp, chicken (Gallus Gallus)
  misc_feature (36): n=a or g
ttctagaagaaggtatagccataatttgaaaccacnctgctcttgactgacctacgaatcatacaaggctg

SEQ ID NO: 33532 - DNA, 71 bp, chicken (Gallus Gallus)
  misc_feature (36): n=a or c
tctaatattgtatcattggatggattgtggaaatgngtattgatgcatggatcttaattattttaattcct

SEQ ID NO: 33533 - DNA, 71 bp, chicken (Gallus Gallus)
  misc_feature (36): n=c or t
ggtttgaattttcttagagagtaacaataaaacttncatataagagctaaaatggtttagaaaagagagaa

SEQ ID NO: 33534 - DNA, 71 bp, chicken (Gallus Gallus)
  misc_feature (36): n=c or t
ttaacaaatttgagtgggttgttttttgcacagacnaagattttctaaaatctgtctcctacaccatgaac

SEQ ID NO: 33535 - DNA, 71 bp, chicken (Gallus Gallus)
  misc_feature (36): n=c or t
agaatgttgaggcacatattttatttgctgattggnggctagctgttcccttctccaccctgcttcctcta

SEQ ID NO: 33536 - DNA, 71 bp, chicken (Gallus Gallus)
  misc_feature (36): n=a or c
atatgctggttgtataaatcaggacagctcttttantacagtgtagtaatacttgacaattgacttgtacg

SEQ ID NO: 33537 - DNA, 71 bp, chicken (Gallus Gallus)
  misc_feature (36): n=c or t
attagatttataaatactcccactgtctttgattgnagctagattgttgtgttgattagatgaatttggca

SEQ ID NO: 33538 - DNA, 71 bp, chicken (Gallus Gallus)
  misc_feature (36): n=c or t
ccggattgtgcctactgtgccctgctctgctgagcngatcactgcggggccctggggcaggcacaagctca

SEQ ID NO: 33539 - DNA, 71 bp, chicken (Gallus Gallus)
  misc_feature (36): n=a or g
aactgcattaataatcaaatagttaaacagaatctntctcacaaataactattttagatgctagattaatt

SEQ ID NO: 33540 - DNA, 71 bp, chicken (Gallus Gallus)
  misc_feature (36): n=c or t
tgctgccgggtgtgaggcagggaaaggctcaggganatctcatttaccgtgcaacagtgttttgtctttgc

SEQ ID NO: 33541 - DNA, 71 bp, chicken (Gallus Gallus)
  misc_feature (36): n=a or g
gtgagtttactagctccaatttcagctctcttgtancaaacaaatattgacactttttcaagttctttgtg

SEQ ID NO: 33542 - DNA, 71 bp, chicken (Gallus Gallus)
  misc_feature (36): n=a or g
gttttcctaaaccagattgtatacatcccttatccntacacatggataaaagtgtccttgaaattatgtat

SEQ ID NO: 33543 - DNA, 71 bp, chicken (Gallus Gallus)
  misc_feature (36): n=c or t
gtctaaccaaagaatatctaagtactactttgttantatgatgtcagaacgttttattttaaagtctgggt

SEQ ID NO: 33544 - DNA, 71 bp, chicken (Gallus Gallus)
  misc_feature (36): n=c or t
ctgttaacattagagctattaaaaagtggagcaaantgtgtacagcacagaatctgctcacctcaggtgaa

SEQ ID NO: 33545 - DNA, 71 bp, chicken (Gallus Gallus)
  misc_feature (36): n=a or g
tgcagtaggaatgtctgctcttctacagtgtgaggntaacactgggaaaataagtgctggcaagttagatg

SEQ ID NO: 33546 - DNA, 71 bp, chicken (Gallus Gallus)
  misc_feature (36): n=c or t
cttctagtacatgattttatagcttggtattatttncatttttgttcacacattggctaagccagaaatca

SEQ ID NO: 33547 - DNA, 71 bp, chicken (Gallus Gallus)
  misc_feature (36): n=a or g
aggcaggaggaacaaccttacaacattgtgaaagcnctttttttacagccagacctccaactctgaccaat

SEQ ID NO: 33548 - DNA, 71 bp, chicken (Gallus Gallus)
  misc_feature (36): n=a or g
aagtaagaaggatcatatctgtagtctttgctcagnctaaattcccacccctcagaaatgggtttcctcga

SEQ ID NO: 33549 - DNA, 71 bp, chicken (Gallus Gallus)
  misc_feature (36): n=a or g
ttttatcagctagaaaattggatttcacgtaatacntggatggtgagaacaagacactgtcttttccaagg

SEQ ID NO: 33550 - DNA, 71 bp, chicken (Gallus Gallus)
  misc_feature (36): n=a or g
ttacaagtgtgacaatatgaaactaatcctgccagntgcatgctagtctggctctcaaccattaatgcaat

SEQ ID NO: 33551 - DNA, 71 bp, chicken (Gallus Gallus)
  misc_feature (36): n=c or t
agtttatccaggcttactggcagtccctctgctttnagccatatccaacatactacaaggaatgctagtta

SEQ ID NO: 33552 - DNA, 71 bp, chicken (Gallus Gallus)
  misc_feature (36): n=g or t
tggtgagagaaattgtggataacatttccatgtgcngtgcccatacagcagattttgattctaatgctgtt

SEQ ID NO: 33553 - DNA, 71 bp, chicken (Gallus Gallus)
  misc_feature (36): n=c or t
tcttcataaaacaatctagttttataaacacaggtnatctgtaatggatgacttttagttgttagatggca

SEQ ID NO: 33554 - DNA, 71 bp, chicken (Gallus Gallus)
  misc_feature (36): n=a or g
tctatcttgaattcatctgtgtttaggtttgggagnatctgattcagaaatactcattctgttagtatttt

SEQ ID NO: 33555 - DNA, 71 bp, chicken (Gallus Gallus)
  misc_feature (36): n=c or t
catcagttatttgtgcatctgaagtgaaacaggatnatgtatggaggttctgtaggacaccagtctgtatt

SEQ ID NO: 33556 - DNA, 71 bp, chicken (Gallus Gallus)
  misc_feature (36): n=c or t
gtctgttccaaagctgagatgcttcttcccagtgcnatgccttctggaatacccctaatctatctatctat

SEQ ID NO: 33557 - DNA, 71 bp, chicken (Gallus Gallus)
  misc_feature (36): n=g or t
gtttggggaaataatttactgaaaggaaccaactgnttgtcaaaacatgattttgaaacccactagagcta

SEQ ID NO: 33558 - DNA, 71 bp, chicken (Gallus Gallus)
  misc_feature (36): n=c or t
agagccacgtggtgtgcaggtgggcaaaatagcttncctagctgcgtaggagggaggagagcatattaata

SEQ ID NO: 33559 - DNA, 71 bp, chicken (Gallus Gallus)
  misc_feature (36): n=a or g
gctagtggtacacagagctagatctaaaatgccagncgatgtggctgaccgtccctaaaattccacctcaa

SEQ ID NO: 33560 - DNA, 71 bp, chicken (Gallus Gallus)
  misc_feature (36): n=a or g
cgtgtgcaaccggccagatgaaaaaacaacagtgcntcagatgtgtcagctgggtataggatcttaacaga

SEQ ID NO: 33561 - DNA, 71 bp, chicken (Gallus Gallus)
  misc_feature (36): n=a or g
tgtgtaggagctcttcagggggtgggggaagctaantgcctcctgggaaatcttttcaagtccttcctaac

SEQ ID NO: 33562 - DNA, 71 bp, chicken (Gallus Gallus)
  misc_feature (36): n=c or t
aatgcttcaagtgagatgacactaatatcaccaaangttaggaaataaataggcactgaaacttagaactg

SEQ ID NO: 33563 - DNA, 71 bp, chicken (Gallus Gallus)
  misc_feature (36): n=a or g
aggcctggggcagccatgaaagtcagagcccatctnagacttcatctacattacaaggagatcacatagca

SEQ ID NO: 33564 - DNA, 71 bp, chicken (Gallus Gallus)
  misc_feature (36): n=c or t
gctagaacagtgctgcagggagcctgacactgcagngacactgtaactacagctgagcagacacacaagtg

SEQ ID NO: 33565 - DNA, 71 bp, chicken (Gallus Gallus)
  misc_feature (36): n=a or g
cagaagttatcagagctacaaaccaggtaggaagcntgctcactgacccaacaagagtcagctgggttccc

SEQ ID NO: 33566 - DNA, 71 bp, chicken (Gallus Gallus)
  misc_feature (36): n=a or g
aaatctttccatccttcctttgtcagtctttcttcncagctctaaacctcacagtaatccatacgtatagt

SEQ ID NO: 33567 - DNA, 71 bp, chicken (Gallus Gallus)
  misc_feature (36): n=a or g
agaaaatcctaaacgaaactgatactatacactganatgacctatttggagcaacagatctacattaaaat

SEQ ID NO: 33568 - DNA, 71 bp, chicken (Gallus Gallus)
  misc_feature (36): n=a or g
tttggcacaggttctagcaacctccagacctcagcntagtataatttccaatccctgcatagattttgttt

SEQ ID NO: 33569 - DNA, 71 bp, chicken (Gallus Gallus)
  misc_feature (36): n=c or t
aaataaaaaagaacatttggttatctatcctaagtnagcaatgttgcttcattctaaaaacagcaggaaat

SEQ ID NO: 33570 - DNA, 71 bp, chicken (Gallus Gallus)
  misc_feature (36): n=g or t
aaaaggagagcactttccaagtaaggcttgacatantttgctgctccagatgagttaggcaaattgtttcc

SEQ ID NO: 33571 - DNA, 71 bp, chicken (Gallus Gallus)
  misc_feature (36): n=c or t
gataaatatttatggtgatgaagaaggatatggccntgaaaagttcaagcgctgcattcacagctatttca

SEQ ID NO: 33572 - DNA, 71 bp, chicken (Gallus Gallus)
  misc_feature (36): n=a or g
actgtgcaaaacacctccctccctcaaaaaagtcanaacagaagtctgaacatctgagtcactctattctg

SEQ ID NO: 33573 - DNA, 71 bp, chicken (Gallus Gallus)
  misc_feature (36): n=c or t
ctgcaaatcttgcaggcacagtgttgatcctggtcntccctgtaggagcacggaccacaagcaccgctgga

SEQ ID NO: 33574 - DNA, 71 bp, chicken (Gallus Gallus)
  misc_feature (36): n=c or t
tagattcaatttatgaaaaagtgagaatgtgagcangtgagaatgaccgtacacctatttctgtaatattc

SEQ ID NO: 33575 - DNA, 71 bp, chicken (Gallus Gallus)
  misc_feature (36): n=c or t
ggcctatatgggctaacataactgaaatttcactancatattcaagctctactcaaaatgatccaaatcat

SEQ ID NO: 33576 - DNA, 71 bp, chicken (Gallus Gallus)
  misc_feature (36): n=a or g
gggacgtgtgtttgtaccacagtcactgttgttccntattgctttcatacatgcaaccttggctagatctt

SEQ ID NO: 33577 - DNA, 71 bp, chicken (Gallus Gallus)
  misc_feature (36): n=a or g
tggaatggtcttttgtgttcaaactggcaggagagnctgatttaaaagaaccacaaaacagcccagccatc

SEQ ID NO: 33578 - DNA, 71 bp, chicken (Gallus Gallus)
  misc_feature (36): n=a or c
actgagtctttgagatgcagcagattaagaaactgnaaaaaaatctttgcagaagacatattgcgacctca

SEQ ID NO: 33579 - DNA, 71 bp, chicken (Gallus Gallus)
  misc_feature (36): n=g or t
gaaattggaaaatgttgacaatgtctaaaaaaatcnaagatatctaaaattatttcagttgtgagctcatg

SEQ ID NO: 33580 - DNA, 71 bp, chicken (Gallus Gallus)
  misc_feature (36): n=a or g
agagcttattgctaacaaaaggtgacacaaaacacngggcaaatggataaatactgtctctctaacaaaac

SEQ ID NO: 33581 - DNA, 71 bp, chicken (Gallus Gallus)
  misc_feature (36): n=c or t
ataacttctagcacttacttttccaccagtactgcnagcagtaaattttcatccagagaaactctataaaa

SEQ ID NO: 33582 - DNA, 71 bp, chicken (Gallus Gallus)
  misc_feature (36): n=a or g
aattagacccttaaagctgacttgattttccttcantaagctctgaacagtcaatcatacaattgaacata

SEQ ID NO: 33583 - DNA, 71 bp, chicken (Gallus Gallus)
  misc_feature (36): n=c or t
tcacacgttacttgatgtctagtgataacaaagaangtgaaagagaagttctttataaatgttatcataac

SEQ ID NO: 33584 - DNA, 71 bp, chicken (Gallus Gallus)
  misc_feature (36): n=a or g
agagcaaagaatgaaatggtcaagctgcaagataancacatactaagttgaaaacctaacttagctagaat

SEQ ID NO: 33585 - DNA, 71 bp, chicken (Gallus Gallus)
  misc_feature (36): n=c or t
tgtatactaatccaataaagttattgctgtaagtcntcgtagagtataaatggtgcccccaaaaaggtagt

SEQ ID NO: 33586 - DNA, 71 bp, chicken (Gallus Gallus)
  misc_feature (36): n=a or g
aactttgactatccaatagttgcttggactattcantaactcatgtgacgagtgaagatgtggcctctggg

SEQ ID NO: 33587 - DNA, 71 bp, chicken (Gallus Gallus)
  misc_feature (36): n=a or g
tccacaaccccccccacacactcatgcatagggatntatcaggtgttctattacatcatgctttatcagtg

SEQ ID NO: 33588 - DNA, 71 bp, chicken (Gallus Gallus)
  misc_feature (36): n=a or g
tcttcctttttgaagagctttgttgccattcttaantctaacagcagtaatcccaggagaggaacccaaaa

SEQ ID NO: 33589 - DNA, 71 bp, chicken (Gallus Gallus)
  misc_feature (36): n=a or g
ctccattcacttccagtaactctacagaaataaaantagtttctccataactgcaacaacttttcattttt

SEQ ID NO: 33590 - DNA, 71 bp, chicken (Gallus Gallus)
  misc_feature (36): n=c or t
aggaaaacttgaattgccctttgcactcgcagcagngaagtgaagcgtgggctccgtgccgctgcacggct

SEQ ID NO: 33591 - DNA, 71 bp, chicken (Gallus Gallus)
  misc_feature (36): n=c or t
ggcctactcaactggaagaggacagtttgaccaganaaagcctatgtttgaagacctgtggcaacagccaa

SEQ ID NO: 33592 - DNA, 71 bp, chicken (Gallus Gallus)
  misc_feature (36): n=a or c
tgggtgcacaaaaagctcagagctgtttccttaagngctgtagatttaacaaaatagccaaagtctctttt

SEQ ID NO: 33593 - DNA, 71 bp, chicken (Gallus Gallus)
  misc_feature (36): n=a or g
gaataccgacatgctgttctgaagggtggcagctcngctgctccttggctctgagcactcatcggctgtgg

SEQ ID NO: 33594 - DNA, 71 bp, chicken (Gallus Gallus)
  misc_feature (36): n=c or t
cctgtgcatatgtttggctgaagaatattcaggaanagttccagtttgggagctacatttagaaatatctc

SEQ ID NO: 33595 - DNA, 71 bp, chicken (Gallus Gallus)
  misc_feature (36): n=c or t
aactctacagaaaaaaggagcactgagcaccttttnaccagctaatcccatttttctattccttgttcagt

SEQ ID NO: 33596 - DNA, 71 bp, chicken (Gallus Gallus)
  misc_feature (36): n=a or g
aataactactacttaagcagtaagttctacggagtntgtttttaaacctcttacttctatgcactatttat

SEQ ID NO: 33597 - DNA, 71 bp, chicken (Gallus Gallus)
  misc_feature (36): n=a or g
gtgaatcttcaggagcatcaaggaactcactgaccncatggtaaatctatgcaaatgaatccccagaaaga

SEQ ID NO: 33598 - DNA, 71 bp, chicken (Gallus Gallus)
  misc_feature (36): n=a or c
ctgtgccccaaccaaggctgtgggtgagaagcctantaagggcaccacacttctggtagaaatttttggag

SEQ ID NO: 33599 - DNA, 71 bp, chicken (Gallus Gallus)
  misc_feature (36): n=c or t
aaaagcatacacaagtcccattatttcttgtgcttnacagttaagaacgaactgacaaaatctttgcaaaa

SEQ ID NO: 33600 - DNA, 71 bp, chicken (Gallus Gallus)
  misc_feature (36): n=c or t
ctatatacagataaaagaaccaaagattaacaagtngaagtccatacatctagctcgtgagcaactgagaa

SEQ ID NO: 33601 - DNA, 71 bp, chicken (Gallus Gallus)
  misc_feature (36): n=a or c
ccttgaagacagcagcgtattttacacattaaaacnaacacatacacatagctcatactgaattccagtag

SEQ ID NO: 33602 - DNA, 71 bp, chicken (Gallus Gallus)
  misc_feature (36): n=a or g
aggacacaaacacagacacatcatgcctgcactgancattgctacataatgtagatgcagcaagagtgaaa

SEQ ID NO: 33603 - DNA, 71 bp, chicken (Gallus Gallus)
  misc_feature (36): n=c or t
aattcaggggggacttctccttcccaacaaattagntgctctcctccagagacatctgaaggattactttt

SEQ ID NO: 33604 - DNA, 71 bp, chicken (Gallus Gallus)
  misc_feature (36): n=c or t
cttctcacagactctgttacagaattttcagatagntgcaaatctaaaagaccttaacatgaagcttacac

SEQ ID NO: 33605 - DNA, 71 bp, chicken (Gallus Gallus)
  misc_feature (36): n=a or g
caagacagaaaacaatgaagaagttaagtccctgancactgagcctaattgcacttcaatttcacaggcta

SEQ ID NO: 33606 - DNA, 71 bp, chicken (Gallus Gallus)
  misc_feature (36): n=a or g
ttgcatccttcttgtatcatgagcacaataataaanaggcattttctgctgattggaaagtagctgccttg

SEQ ID NO: 33607 - DNA, 71 bp, chicken (Gallus Gallus)
  misc_feature (36): n=a or g
ccttcttctggcaaaacttccaagcagcaaagctcngaggtagtaaataactaaggctttgcttctatctg

SEQ ID NO: 33608 - DNA, 71 bp, chicken (Gallus Gallus)
  misc_feature (36): n=a or g
tgacatttgagctctccaaggaactggaaacctgcntggaacacagggatgtggcaggtgcttcagatcac

SEQ ID NO: 33609 - DNA, 71 bp, chicken (Gallus Gallus)
  misc_feature (36): n=a or g
tttttaataacgaggtggacaataactctatttacnaggaaatcttccttctgcaggattgtggtgtatac

SEQ ID NO: 33610 - DNA, 71 bp, chicken (Gallus Gallus)
  misc_feature (36): n=a or g
gtgcagctgtgggctgtgttcatcagtagcaccaancagagcactgctcctttcggcataagtacagagtg

SEQ ID NO: 33611 - DNA, 71 bp, chicken (Gallus Gallus)
  misc_feature (36): n=a or g
ggagttgctttacgcagaagttatttccagttcatnttagagaaagcaaacaatatgcacgtgttttagag

SEQ ID NO: 33612 - DNA, 71 bp, chicken (Gallus Gallus)
  misc_feature (36): n=c or t
ggagtagaactaatacaaagatgtttttgttgcacngcttcagcaaaaaatccatttgcacaagtatcaat

SEQ ID NO: 33613 - DNA, 71 bp, chicken (Gallus Gallus)
  misc_feature (36): n=g or t
tgtagaaatctggctgaaggttttcttccagctctnacgagcatccccagtgctgaacgtggtgctgggga

SEQ ID NO: 33614 - DNA, 71 bp, chicken (Gallus Gallus)
  misc_feature (36): n=a or g
aaggaacttgagaaatggaaagcaccaatgcaaagncagaaaaatcactgttttggagagacttgtcttag

SEQ ID NO: 33615 - DNA, 71 bp, chicken (Gallus Gallus)
  misc_feature (36): n=g or t
gaggaaaaacagctttcgagttcaaacccactgatnggttcaataaccacaagaatttttgttcaaagcat

SEQ ID NO: 33616 - DNA, 71 bp, chicken (Gallus Gallus)
  misc_feature (36): n=c or t
gtgcacagagcagctgctgggtgtcccttgctgtanagggataagttgtcatctttaggaggctgtgcctg

SEQ ID NO: 33617 - DNA, 71 bp, chicken (Gallus Gallus)
  misc_feature (36): n=a or g
taaagacaaatgtactgtaagaactctctggttgcntactgttttgtgcgtggctatgtattgggttcagg

SEQ ID NO: 33618 - DNA, 71 bp, chicken (Gallus Gallus)
  misc_feature (36): n=a or g
ggccttgatgaacggtgctattttgatacaatgagnattgaccaggtgattgacttccacagtaaaaatca

SEQ ID NO: 33619 - DNA, 71 bp, chicken (Gallus Gallus)
  misc_feature (36): n=c or t
ttttgttggtttgtattcccatagaaacagcccttngattaagcttttgtcagtgcattttgagtggtgaa

SEQ ID NO: 33620 - DNA, 71 bp, chicken (Gallus Gallus)
  misc_feature (36): n=c or t
aaagctatcactggaactgcctattatttgtattancaattaatctcatatctgtgtacaaaattcaaagt

SEQ ID NO: 33621 - DNA, 71 bp, chicken (Gallus Gallus)
  misc_feature (36): n=a or g
aggcagccctgtgttacatagatcttgaggaagttntctaggaaatttgcttctttattggaaggtagaga

SEQ ID NO: 33622 - DNA, 71 bp, chicken (Gallus Gallus)
  misc_feature (36): n=c or t
ccatattacagtcagtcaatcctcttcaggaacttngttattgtcacagtctctaaagtactttgtcattt

SEQ ID NO: 33623 - DNA, 71 bp, chicken (Gallus Gallus)
  misc_feature (36): n=a or g
catggggccatttgggaccaaacctgcagaggatgnagaatgttctgctttcagagctcttgctgctaaga

SEQ ID NO: 33624 - DNA, 71 bp, chicken (Gallus Gallus)
  misc_feature (36): n=a or g
tgctatgtactgacactatgcactggaatccagccnctggcactgtaacaaattatttcacttaataccat

SEQ ID NO: 33625 - DNA, 71 bp, chicken (Gallus Gallus)
  misc_feature (36): n=c or t
cttgctgtggttcagtgtggaaacaattagaaactngtatttttatgtcgttatgaaatacctcttctcaa

SEQ ID NO: 33626 - DNA, 71 bp, chicken (Gallus Gallus)
  misc_feature (36): n=a or g
ttgcctctgcctcctcccagaaaccatgacagaggnaagagctttgattttctctgatttagaaaactgtt

SEQ ID NO: 33627 - DNA, 71 bp, chicken (Gallus Gallus)
  misc_feature (36): n=c or t
ttttagggtgactgaagcaaagaatcataattttangcagaggcagtaccaagtgttgactgcactgtatg

SEQ ID NO: 33628 - DNA, 71 bp, chicken (Gallus Gallus)
  misc_feature (36): n=a or g
acctacaagctatgtttatctgcaggctcaaaaagnaattgttagctttgaaagtactatgtataattata

SEQ ID NO: 33629 - DNA, 71 bp, chicken (Gallus Gallus)
  misc_feature (36): n=g or t
tcactctttgtgtaaaccagctctgctttttattcnttctctcctcttatcttgtagtgcaaatgcagctt

SEQ ID NO: 33630 - DNA, 71 bp, chicken (Gallus Gallus)
  misc_feature (36): n=c or t
gacgctatttgtccttctgccgcttcagatctgtgntgggatgacgagtgaagcgccttttgagttacagg

SEQ ID NO: 33631 - DNA, 71 bp, chicken (Gallus Gallus)
  misc_feature (36): n=c or t
ggacaaatatctagaagtttctgatccttcccaaanatatttagatttctatgatgaaaaagatttttgtt

SEQ ID NO: 33632 - DNA, 71 bp, chicken (Gallus Gallus)
  misc_feature (36): n=a or g
ttacaaggtccttaaaggaggaccaactggtgactnaaagaaaatatacggcccttcttcttccttttcta

SEQ ID NO: 33633 - DNA, 71 bp, chicken (Gallus Gallus)
  misc_feature (36): n=a or g
tttaatatgttcctcttaagaaaaagagagtagcantggccttatcctttttatcaccgcagtgtcttggg

SEQ ID NO: 33634 - DNA, 71 bp, chicken (Gallus Gallus)
  misc_feature (36): n=c or t
ctattcggtacctcctgtgctgcctgatgagaattnagaaacaaatgacatgtatatgttttctttttgtt

SEQ ID NO: 33635 - DNA, 71 bp, chicken (Gallus Gallus)
  misc_feature (36): n=c or t
tctaacaacttcctttttcatgtccagacagctttngatatgaggcatgtgaaggaagcagtgtatagtat

SEQ ID NO: 33636 - DNA, 71 bp, chicken (Gallus Gallus)
  misc_feature (36): n=a or g
atcaccagtgaaacaaaatcttcgaaaaagctttanctagtctgtatcacaagcatgcttcattatccagt

SEQ ID NO: 33637 - DNA, 71 bp, chicken (Gallus Gallus)
  misc_feature (36): n=c or t
tatgttactgctaaccacctcactacataaaatatnaaaccatttagataatacatcaacaaactgaacct

SEQ ID NO: 33638 - DNA, 71 bp, chicken (Gallus Gallus)
  misc_feature (36): n=c or t
agcttattttacttttttgctaaggaatcaaatagncaagatataccgatgccaggatatgcagtatcaag

SEQ ID NO: 33639 - DNA, 71 bp, chicken (Gallus Gallus)
  misc_feature (36): n=a or g
atatattcaaatatcagattagtttatcagtaatanaaatcactatttatattttcctagtgtgaaattgc

SEQ ID NO: 33640 - DNA, 71 bp, chicken (Gallus Gallus)
  misc_feature (36): n=a or g
gcacttgctgtgtgtcttcacctttattttggtacntttccatttgtatgaacgactggagaactaaatgc

SEQ ID NO: 33641 - DNA, 71 bp, chicken (Gallus Gallus)
  misc_feature (36): n=c or t
agagatggaaaaatgcaacccagatctccctgctcnagcaggaccccgtccatgccagcgcagctgccctg

SEQ ID NO: 33642 - DNA, 71 bp, chicken (Gallus Gallus)
  misc_feature (36): n=a or g
ggtagataacaagagaggacagaccctaactcctanccagagaagaacctctgtgttactcatggttggat

SEQ ID NO: 33643 - DNA, 71 bp, chicken (Gallus Gallus)
  misc_feature (36): n=a or c
aactcatgctctgccacagcctagctaaatttagcntgaataagcttctctggacaaacaacagccaaata

SEQ ID NO: 33644 - DNA, 71 bp, chicken (Gallus Gallus)
  misc_feature (36): n=a or g
cagaaatggttatacaaaagctaaattatgtctatnatgctatagcacaaagagacaaaggaaacaagcat

SEQ ID NO: 33645 - DNA, 71 bp, chicken (Gallus Gallus)
  misc_feature (36): n=a or g
tcaaaaagaacaagagtggtcatctaaaacacctanaactacaaatcttcgtttaggaagtaatgcaaata

SEQ ID NO: 33646 - DNA, 71 bp, chicken (Gallus Gallus)
  misc_feature (36): n=c or t
ccagccattaacacaggcattgtgtgtacactgatnggtttgctgtggcagcaggtaactcactgagtata

SEQ ID NO: 33647 - DNA, 71 bp, chicken (Gallus Gallus)
  misc_feature (36): n=a or g
ggattaaatttccaaaatggtgtggtgagctgggtnagatcagagatccaccttaactgtgttgtgtcaag

SEQ ID NO: 33648 - DNA, 71 bp, chicken (Gallus Gallus)
  misc_feature (36): n=a or g
gcatatttctgcaacttagcatcacactgaggaacncaggaaggtctgaagcagactgtggtgcccttgtt

SEQ ID NO: 33649 - DNA, 71 bp, chicken (Gallus Gallus)
  misc_feature (36): n=a or g
aatagtaaacttaaattagtagagaaaaagccaatntttatgttcagtgtcagcatacttattaggatggt

SEQ ID NO: 33650 - DNA, 71 bp, chicken (Gallus Gallus)
  misc_feature (36): n=c or t
atatttggcttctgttttgatatttctcattagttngcacttgcagtattgctttaaaattgaaatagatt

SEQ ID NO: 33651 - DNA, 71 bp, chicken (Gallus Gallus)
  misc_feature (36): n=a or g
taacacgacaacaggctgctataaaagaaggtaatngagaaccagaaatactcatggcaatcacttcaggc

SEQ ID NO: 33652 - DNA, 71 bp, chicken (Gallus Gallus)
  misc_feature (36): n=a or c
tagaggaaacagaacactcacaaccatgaagaactnagtgatcattccaaagcaaaaatgtgttgttacag

SEQ ID NO: 33653 - DNA, 71 bp, chicken (Gallus Gallus)
  misc_feature (36): n=c or t
atgaacatacctatgtacacacacatttgtaatcanatgtgcatatagtcacatattcactcacagagcta

SEQ ID NO: 33654 - DNA, 71 bp, chicken (Gallus Gallus)
  misc_feature (36): n=a or c
ctcttcttacattatctaagaccaaattcctgctanccacctaaccctaatccaggataacctccaaattc

SEQ ID NO: 33655 - DNA, 71 bp, chicken (Gallus Gallus)
  misc_feature (36): n=c or t
caagtaagagagaatgactgtattgaatttaacaangaatataacctgaagaaaaatactccgttcctctc

SEQ ID NO: 33656 - DNA, 71 bp, chicken (Gallus Gallus)
  misc_feature (36): n=a or g
ccttctagcaataagctgatcacagccttactcaantagctgcatgttcccttttttccaactggatgagt

SEQ ID NO: 33657 - DNA, 71 bp, chicken (Gallus Gallus)
  misc_feature (36): n=a or c
cagaggaccagttgtaacagagatcaagtattaaanagacacccaataatcatatggatttccataggact

SEQ ID NO: 33658 - DNA, 71 bp, chicken (Gallus Gallus)
  misc_feature (36): n=a or g
tgatcttcactgcaagctctaattgaccagtgttgntatatactgcaaatgaactagattaacacaaaaat

SEQ ID NO: 33659 - DNA, 71 bp, chicken (Gallus Gallus)
  misc_feature (36): n=a or g
aactgcaaaaaaataggggttccttccttgaaatcnattatatttcacatatggtcatcattctacgtaat

SEQ ID NO: 33660 - DNA, 71 bp, chicken (Gallus Gallus)
  misc_feature (36): n=a or c
ggttacttttaggaatgcgatgttcaagttacttanaatttactatgggaaatagctatcaaacaggattt

SEQ ID NO: 33661 - DNA, 71 bp, chicken (Gallus Gallus)
  misc_feature (36): n=c or t
tgacaacagcggtataggaaactcagaattaacacngttaaagaccaaagtgtttcaccaatcacagaagt

SEQ ID NO: 33662 - DNA, 71 bp, chicken (Gallus Gallus)
  misc_feature (36): n=a or g
tagcaaatcctttaggacggccactgtgcaaaacantggtaaagaaacatcttgggccacctcagcatgtt

SEQ ID NO: 33663 - DNA, 71 bp, chicken (Gallus Gallus)
  misc_feature (36): n=c or t
aatgaagattttagatgcctgtgtgctgacatgtgngacaagagtgaaaataagaccaagcttagttgagg

SEQ ID NO: 33664 - DNA, 71 bp, chicken (Gallus Gallus)
  misc_feature (36): n=c or t
atgtaggtttacaagtggaggtaccattgcttgccngctttcttatctttctaccacactgtactatggag

SEQ ID NO: 33665 - DNA, 71 bp, chicken (Gallus Gallus)
  misc_feature (36): n=g or t
acctgtcttaatttgggaagttacctcctgcttctnttccccactctcctgcttcaacgtgatttggtttt

SEQ ID NO: 33666 - DNA, 71 bp, chicken (Gallus Gallus)
  misc_feature (36): n=g or t
tctatgattctgtaaaaacaatctttagaactcttntgtgtgtattgctcttttctgtatctacaaggctg

SEQ ID NO: 33667 - DNA, 71 bp, chicken (Gallus Gallus)
  misc_feature (36): n=c or t
cttcactgaacctccccataggagtcaacttctcantgcatagtaccagatattagaacttgtcttttaaa

SEQ ID NO: 33668 - DNA, 71 bp, chicken (Gallus Gallus)
  misc_feature (36): n=a or g
ataaccatctatttcaaaagcatcaagtgaaacttngatcgcttgttttgttaaacttaactgctttatag

SEQ ID NO: 33669 - DNA, 71 bp, chicken (Gallus Gallus)
  misc_feature (36): n=c or t
aaaagtaggaaattgttttctgcattggaatgttgngtttaaagagcaatagtttagcttctcaagtaaag

SEQ ID NO: 33670 - DNA, 71 bp, chicken (Gallus Gallus)
  misc_feature (36): n=g or t
ggagccaatataaagatctccaatttgaagttggtncaacatgatgctgtggaggggattttaagtaagta

SEQ ID NO: 33671 - DNA, 71 bp, chicken (Gallus Gallus)
  misc_feature (36): n=a or g
ttttagctttaatcctgtctgccggagatggttcantgccatatctgtgcgccccagatgtttcaggaatc

SEQ ID NO: 33672 - DNA, 71 bp, chicken (Gallus Gallus)
  misc_feature (36): n=a or g
agcattttctctgtgttcctgtttcctggcagagtngagacaaagatggaaatagagttcaagtctcctgg

SEQ ID NO: 33673 - DNA, 71 bp, chicken (Gallus Gallus)
  misc_feature (36): n=c or t
aaagctgctgctcagcaaggtatagcagatgagctncacataaagaacacgcagcattgctattcctcatt

SEQ ID NO: 33674 - DNA, 71 bp, chicken (Gallus Gallus)
  misc_feature (36): n=a or g
gaataaaagaggtgttttctcaagcaagtaaaaatncatactttgttgtaatccaagggttatcattaatt

SEQ ID NO: 33675 - DNA, 71 bp, chicken (Gallus Gallus)
  misc_feature (36): n=c or t
gttttcgcctgtattgcgcttagcctataagctcanttttatacaaatcatttgagttctaaaaactctgt

SEQ ID NO: 33676 - DNA, 71 bp, chicken (Gallus Gallus)
  misc_feature (36): n=c or t
aggaaatgatatttaaacctttcaagctccagtctnctatttgcagacatgtttcataaaaggatttagga

SEQ ID NO: 33677 - DNA, 71 bp, chicken (Gallus Gallus)
  misc_feature (36): n=a or g
tcaaatattatacctcctcatatttcttggcagacnaagtaaacacattaaagtgaagttctgagtagtta

SEQ ID NO: 33678 - DNA, 71 bp, chicken (Gallus Gallus)
  misc_feature (36): n=a or g
gtagttggcaggctcagggttatagaaacctatccncatattgctgaattgccaaaataagctgactgctc

SEQ ID NO: 33679 - DNA, 71 bp, chicken (Gallus Gallus)
  misc_feature (36): n=g or t
gatcgtctccggtactgactgtagccctggataggngcagccttctggaagccccacggcagtatgcaagg

SEQ ID NO: 33680 - DNA, 71 bp, chicken (Gallus Gallus)
  misc_feature (36): n=c or t
attgaaggtgaaaaagtattaaatctgcagctaagngtagcattgttcttctctgagatcagaactgtgtg

SEQ ID NO: 33681 - DNA, 71 bp, chicken (Gallus Gallus)
  misc_feature (36): n=a or g
taaacacatcttcccctccgggtcttgataggaacntattcagcttttctataaaaaaccaaacccgttgc

SEQ ID NO: 33682 - DNA, 71 bp, chicken (Gallus Gallus)
  misc_feature (36): n=g or t
agtaccactgctgttcctgtagtacagcagttaganctatggcagaataacactatcagtaaatgtacagc

SEQ ID NO: 33683 - DNA, 71 bp, chicken (Gallus Gallus)
  misc_feature (36): n=a or g
cccgacgaagaaattgccaaaattgaaatgagtagnaaaaagcaatacgaaaaccaggtaacgaatgtggc

SEQ ID NO: 33684 - DNA, 71 bp, chicken (Gallus Gallus)
  misc_feature (36): n=g or t
tttctaaagtggtgaatgcttttccatccaactctngcttctctaggtaattcacccctgaggtgaatact

SEQ ID NO: 33685 - DNA, 71 bp, chicken (Gallus Gallus)
  misc_feature (36): n=c or t
cctgaatccttagattgcttttggaagttaaccatntgataatgccagtttcctgcaaaatcaaataagta

SEQ ID NO: 33686 - DNA, 71 bp, chicken (Gallus Gallus)
  misc_feature (36): n=a or g
tgggccttttgaaaatctgggctttttgagccagtntgtcaatagatgttttctgtggggtggagaatatt

SEQ ID NO: 33687 - DNA, 71 bp, chicken (Gallus Gallus)
  misc_feature (36): n=c or t
gatttgatgcctctgacaacaacctggctagtgcgnattcttcaactgcatggcatttgttcatgtacctt

SEQ ID NO: 33688 - DNA, 71 bp, chicken (Gallus Gallus)
  misc_feature (36): n=a or g
tctttagcaaatgcataagattcatcttcacttgantgtctatgtgtggaattaaattgaatggttcccta

SEQ ID NO: 33689 - DNA, 71 bp, chicken (Gallus Gallus)
  misc_feature (36): n=a or g
ttacagtgcctttgctgtggtgctctccgttcagcntttccttaatttggtgccaacagaagcatgcagaa

SEQ ID NO: 33690 - DNA, 71 bp, chicken (Gallus Gallus)
  misc_feature (36): n=a or g
ggaggctgttatgaactactcttcactggtggcagnctgtttttctacctctgtgacttgatcaatcctca

SEQ ID NO: 33691 - DNA, 71 bp, chicken (Gallus Gallus)
  misc_feature (36): n=a or c
ctccttaactaatatagatgtctgtatttattcacnattctgcatttcggcaacttggttgcagtgaaata

SEQ ID NO: 33692 - DNA, 71 bp, chicken (Gallus Gallus)
  misc_feature (36): n=a or g
tctgagaggttggtatttctcatccctgatgtggcncacaatagctatgtaggaaaacagtggtacaaaag

SEQ ID NO: 33693 - DNA, 71 bp, chicken (Gallus Gallus)
  misc_feature (36): n=a or g
catttcaaaactaactcagctgagtcaagagtttgngtaggaaaatgagtgagatttacatgtgaaccaca

SEQ ID NO: 33694 - DNA, 71 bp, chicken (Gallus Gallus)
  misc_feature (36): n=a or g
tgctttcgtgtgtgacagtaaaactggtttcatttnattgatatatggagcttggaagatcaaagtttaga

SEQ ID NO: 33695 - DNA, 71 bp, chicken (Gallus Gallus)
  misc_feature (36): n=a or g
ccattaacttccataggagttctgggcgtggggctnaagatccaggctcctaatctgattgctctcaccca

SEQ ID NO: 33696 - DNA, 71 bp, chicken (Gallus Gallus)
  misc_feature (36): n=c or t
aaagaaatgtataaggatgtccccctgctgcgccangtgaggtgaaggcatccatgttccccactgccctt

SEQ ID NO: 33697 - DNA, 71 bp, chicken (Gallus Gallus)
  misc_feature (36): n=c or t
atttagtatcatcgaacagaaaaacacaaacagtangttatcaagcactgcttctcacaccatttacaaaa

SEQ ID NO: 33698 - DNA, 71 bp, chicken (Gallus Gallus)
  misc_feature (36): n=c or t
atgaccgttttcttactttgaattctgtgcgagtgngaaagagaaggagtgtgtttgtgtttcggtaggga

SEQ ID NO: 33699 - DNA, 71 bp, chicken (Gallus Gallus)
  misc_feature (36): n=c or t
actgaagaacaatgcttggcaacaggctgacgagtnctcggttttcataagatttctaaaagtaaccagtc

SEQ ID NO: 33700 - DNA, 71 bp, chicken (Gallus Gallus)
  misc_feature (36): n=a or g
tagcgcttcagcaagggaatttttttaatttgcccntagactaaatacatataaagtagcgttcaattatt

SEQ ID NO: 33701 - DNA, 71 bp, chicken (Gallus Gallus)
  misc_feature (36): n=c or t
acacactactatgctttcagagcgactttgctattncgcacacaaatattggtgatcacgaagttcggggg

SEQ ID NO: 33702 - DNA, 71 bp, chicken (Gallus Gallus)
  misc_feature (36): n=a or g
aacagagggctcgatttaatgatggaaatatcaaangtaaatgaatttgaatcgttccaaacgaataataa

SEQ ID NO: 33703 - DNA, 71 bp, chicken (Gallus Gallus)
  misc_feature (36): n=g or t
gttagtgctttgcattgcccttccttctctgtatanagtagcacagaaattaaagctaatagaattgaata

SEQ ID NO: 33704 - DNA, 71 bp, chicken (Gallus Gallus)
  misc_feature (36): n=c or t
aaattggttagcttatcagaggggtaacatttattnccaaagacaggctgctcggaaggataggctgaaat

SEQ ID NO: 33705 - DNA, 71 bp, chicken (Gallus Gallus)
  misc_feature (36): n=a or g
ggaaggaagtgcagggagggtgggctgtcccaatgnacctcagcaacctccacagcacaacgccatgaccc

SEQ ID NO: 33706 - DNA, 71 bp, chicken (Gallus Gallus)
  misc_feature (36): n=a or c
aagtacttccattcatctattcttaatatacagaangtgtctgatgaaaaagttacacattcaaattttaa

SEQ ID NO: 33707 - DNA, 71 bp, chicken (Gallus Gallus)
  misc_feature (36): n=a or c
aagatgccgatgtttcctgctgctagaaagcagctntcccccaagctgtgcccactgctggagctaaaagc

SEQ ID NO: 33708 - DNA, 71 bp, chicken (Gallus Gallus)
  misc_feature (36): n=a or g
gataattcagcatcaagtcctgacagttcttatcangtatatgtccacatgagccagccctacctgtaccc

SEQ ID NO: 33709 - DNA, 71 bp, chicken (Gallus Gallus)
  misc_feature (36): n=c or t
acatatgaacatttaacagcccaaagaggatgacanggtccacgaagacctgccctcataacctcaggaaa

SEQ ID NO: 33710 - DNA, 71 bp, chicken (Gallus Gallus)
  misc_feature (36): n=c or t
ctgtatttgcaacttaactcgctcaaagaaaaaagngttcctggtggtagctgaaacattaatgacagaca

SEQ ID NO: 33711 - DNA, 71 bp, chicken (Gallus Gallus)
  misc_feature (36): n=a or g
tacacacaccaatctccctaactaaattcttgttcntgcaacgtaactctattttcaattcacatactgtt

SEQ ID NO: 33712 - DNA, 71 bp, chicken (Gallus Gallus)
  misc_feature (36): n=c or t
ctctcacctggtgcaacatttaaagctctcagtctntcagttttccttatgcaaattgagatgctaccaga

SEQ ID NO: 33713 - DNA, 71 bp, chicken (Gallus Gallus)
  misc_feature (36): n=a or g
aatatcagtatttgcaactaatttccacattccacngtgcacaatactagaaaaacaagcacaggaaatgc

SEQ ID NO: 33714 - DNA, 71 bp, chicken (Gallus Gallus)
  misc_feature (36): n=c or t
ggcttatcctgcagtcagttgcaatagcacaagcantgccatttcagaccacacctcccaagtcctactgt

SEQ ID NO: 33715 - DNA, 71 bp, chicken (Gallus Gallus)
  misc_feature (36): n=a or g
gagaggtaaaaataaccaaagggacaagaatgtcangtacccagtagttgagagaaggaactcccttggat

SEQ ID NO: 33716 - DNA, 71 bp, chicken (Gallus Gallus)
  misc_feature (36): n=a or g
aaaactaagagaactcggcctccatcagtctgagcnacattctggcatgtagcgcacagtttcacagttag

SEQ ID NO: 33717 - DNA, 71 bp, chicken (Gallus Gallus)
  misc_feature (36): n=g or t
tgaaagagaaacgtcttatattgtgattaaaatganatgtacatacatatacgtatacactaagatataca

SEQ ID NO: 33718 - DNA, 71 bp, chicken (Gallus Gallus)
  misc_feature (36): n=c or t
ctatgttcaagatactggtcttcacactgtgtgagntttgtgcaccgtaacttatttcaccaccacactag

SEQ ID NO: 33719 - DNA, 71 bp, chicken (Gallus Gallus)
  misc_feature (36): n=c or t
acagaaaaaaaatttatctcggaggaatccaatgcnacctctgaagaacccaatggagtgtatcattcagg

SEQ ID NO: 33720 - DNA, 71 bp, chicken (Gallus Gallus)
  misc_feature (36): n=a or c
gccaatgtgatttcacagttacgtccagtatagccntcagggcagtggcattggaacttggttggtgactg

SEQ ID NO: 33721 - DNA, 71 bp, chicken (Gallus Gallus)
  misc_feature (36): n=a or g
ttaccttgaaagctcttgttgagatcaaatgggtangtatttccaaggaccaggctgctggggtcaatcac

SEQ ID NO: 33722 - DNA, 71 bp, chicken (Gallus Gallus)
  misc_feature (36): n=a or g
tttctacttaaaatgccttcatgctattattatctnacataatggaccttaaatcttctagatcagcaatc

SEQ ID NO: 33723 - DNA, 71 bp, chicken (Gallus Gallus)
  misc_feature (36): n=a or g
gttggagcaggcttttagtcctgatcccagactgcnttttagcttccaaattttgtgtgcctgcatttaaa

SEQ ID NO: 33724 - DNA, 71 bp, chicken (Gallus Gallus)
  misc_feature (36): n=c or t
gcaaaattatgttccttttccctcgtgtaaacctgnaacccagatcataatttaacacagcacgaaaaggg

SEQ ID NO: 33725 - DNA, 71 bp, chicken (Gallus Gallus)
  misc_feature (36): n=a or g
gcattactgtttacaggagacttaaactattaccantaagtacagatgtgagctggagataaagggtcttg

SEQ ID NO: 33726 - DNA, 71 bp, chicken (Gallus Gallus)
  misc_feature (36): n=a or g
ggctctgagccaaagcagaaacttaaaactgctcanctaattgccagaatgcatgcaggcagtttctttac

SEQ ID NO: 33727 - DNA, 71 bp, chicken (Gallus Gallus)
  misc_feature (36): n=c or t
cacatggcatttttggtaacttgcttttaaagaaangtggttgttctgtagctgcaaagcaatgtcattgt

SEQ ID NO: 33728 - DNA, 71 bp, chicken (Gallus Gallus)
  misc_feature (36): n=c or t
gcttctgtcaagcttctatgaaaaaagaacaaccanagtagttaatttttaggcatcagaaatacaaagta

SEQ ID NO: 33729 - DNA, 71 bp, chicken (Gallus Gallus)
  misc_feature (36): n=g or t
acacacacttcccagttcctcttgctctgctgcttnctctgtgtcctcccttgctgctgtggtgtgtttgt

SEQ ID NO: 33730 - DNA, 71 bp, chicken (Gallus Gallus)
  misc_feature (36): n=a or g
aatcacctgctagagagtaagggcaaagatggtatnctctgctttaactgaggaaaagaatatttgaggaa

SEQ ID NO: 33731 - DNA, 71 bp, chicken (Gallus Gallus)
  misc_feature (36): n=c or t
acaggttttatatcaccagctctgtagcacatgcanaagataactgttgaattaaatatgacatagatgtg

SEQ ID NO: 33732 - DNA, 71 bp, chicken (Gallus Gallus)
  misc_feature (36): n=a or g
ccatactgtagcagaactatttcttagtttatctcngttcttttttagaatgtgaatctcattgcaaaact

SEQ ID NO: 33733 - DNA, 71 bp, chicken (Gallus Gallus)
  misc_feature (36): n=c or t
ggcccctccatccagagtccccttaggtggaggtcnttctccagtgaaggcttgcagacagtttaatgagt

SEQ ID NO: 33734 - DNA, 71 bp, chicken (Gallus Gallus)
  misc_feature (36): n=a or g
actgatggagagtgaaaatgcaaaaggataactgcngcgtctaaagggaaattgtccaagcacaggagaag

SEQ ID NO: 33735 - DNA, 71 bp, chicken (Gallus Gallus)
  misc_feature (36): n=c or t
tttttttatctcttccttcccctcgcctttctcctnacaaaacccaccacgtttttcagcttattcgtgtg

SEQ ID NO: 33736 - DNA, 71 bp, chicken (Gallus Gallus)
  misc_feature (36): n=a or g
gtaaaatccagctgtcctaaagagctctgatagcanggtcaccaagtgttgagcacatggatgctctgtcc

SEQ ID NO: 33737 - DNA, 71 bp, chicken (Gallus Gallus)
  misc_feature (36): n=a or g
ttctgaccatggagataacagattcttgtgcagganaagtgtttgttttaaaccatgccatccatactcat

SEQ ID NO: 33738 - DNA, 71 bp, chicken (Gallus Gallus)
  misc_feature (36): n=c or t
atagaagtgaatggtctcaccttggtaatcaaaaantcatgttggtgtttctaaatgtgctactttccctg

SEQ ID NO: 33739 - DNA, 71 bp, chicken (Gallus Gallus)
  misc_feature (36): n=a or g
gccttttgctccacgcccaacctgtccccacatacnctaactggggcctaccttgagcccgtgtgtctgaa

SEQ ID NO: 33740 - DNA, 71 bp, chicken (Gallus Gallus)
  misc_feature (36): n=a or g
tatttcagctgggtttgattaaagcaacagtgcacntttcccctctctttgccttacaaacttcatcaact

SEQ ID NO: 33741 - DNA, 71 bp, chicken (Gallus Gallus)
  misc_feature (36): n=g or t
ttttcgatcaaatatgtgaaaagctttcactgttgnaactcatgcacctaagtatgctcttttcttacaaa

SEQ ID NO: 33742 - DNA, 71 bp, chicken (Gallus Gallus)
  misc_feature (36): n=a or g
cagagaggagggtcggtattcctttcccttgggggntgcgtttagggctcatccttgcagagtggaggacg

SEQ ID NO: 33743 - DNA, 71 bp, chicken (Gallus Gallus)
  misc_feature (36): n=c or t
cctgaacaaacaaaaaaaaggtgccgaatgctgccnggagttggagcaggtgaccaaaactttccaaaaac

SEQ ID NO: 33744 - DNA, 71 bp, chicken (Gallus Gallus)
  misc_feature (36): n=c or t
atatttgctttgcatctgcctcagcatctgcaccantccttttctggagatcactcactttggccggaggg

SEQ ID NO: 33745 - DNA, 71 bp, chicken (Gallus Gallus)
  misc_feature (36): n=a or g
aaaagcttgtttaggtgccttaactacagatgcaancattcatccaagcacaggttgaaaaactgagaccc

SEQ ID NO: 33746 - DNA, 71 bp, chicken (Gallus Gallus)
  misc_feature (36): n=a or g
agacgtgttttggaacggtgctaagggtcagagaantgatgctggaaatgacaccttgttattgcactagt

SEQ ID NO: 33747 - DNA, 71 bp, chicken (Gallus Gallus)
  misc_feature (36): n=a or g
catctcgctggggagttggtttccatcatggactgntgtccctagctgagaaaagcttgaggaatgagaca

SEQ ID NO: 33748 - DNA, 71 bp, chicken (Gallus Gallus)
  misc_feature (36): n=a or g
tacctgggatttttaaattgcgtccaaacagatacntgagcacatacaaggtgctcgtctcaggtagatgc

SEQ ID NO: 33749 - DNA, 71 bp, chicken (Gallus Gallus)
  misc_feature (36): n=a or g
gctttttatttttggagtatgttgggatagtcttcngtgtttgctctgctgacacatgttggctgcccagg

SEQ ID NO: 33750 - DNA, 71 bp, chicken (Gallus Gallus)
  misc_feature (36): n=a or g
agaattcattttatcaggtttttccatctgtagctntaacgataattgactgttaacaagtctgttggctc

SEQ ID NO: 33751 - DNA, 71 bp, chicken (Gallus Gallus)
  misc_feature (36): n=g or t
accggttttggcttctctttgagagcacacagcacntgcgtcattcaaagcagctttggttgattgtgtgc

SEQ ID NO: 33752 - DNA, 71 bp, chicken (Gallus Gallus)
  misc_feature (36): n=c or t
ttcaggatagcacagtggttttcagatgagaagacnaaagtcaggtcaagtgaaacagtttgcagatgctg

SEQ ID NO: 33753 - DNA, 71 bp, chicken (Gallus Gallus)
  misc_feature (36): n=a or g
cttcacatacatggttcatgacctgatcctcaccantacccaaactgtcctagatactactgagcatggga

SEQ ID NO: 33754 - DNA, 71 bp, chicken (Gallus Gallus)
  misc_feature (36): n=c or t
tcgctctcatgttcttatcatatttaagaattctgngtaaatgagcattaatgaaccaatttaaaattatt

SEQ ID NO: 33755 - DNA, 71 bp, chicken (Gallus Gallus)
  misc_feature (36): n=g or t
cttgacctaccttcaacagccatgaaggggacgagntttttcccttagatcagcagatggaataaaagcag

SEQ ID NO: 33756 - DNA, 71 bp, chicken (Gallus Gallus)
  misc_feature (36): n=c or t
ttggtacccacagcatcccgatgctgcattgcctgnagtacctggagctgacaagcaggcactgcacaggg

SEQ ID NO: 33757 - DNA, 71 bp, chicken (Gallus Gallus)
  misc_feature (36): n=c or t
aaattatactgtttcatatgcagtactaatgcttcnatagacttgtgtattctgtgatctcttaaatggaa

SEQ ID NO: 33758 - DNA, 71 bp, chicken (Gallus Gallus)
  misc_feature (36): n=a or c
cggaccgcagtcaacaggaaatgcacatctttaaantgttgatgtcttctacttaggtttgggtttgggag

SEQ ID NO: 33759 - DNA, 71 bp, chicken (Gallus Gallus)
  misc_feature (36): n=a or g
aaaacacttcactgaatcagtggttatgggaagggntaaagtttccaaatcactcttttctgtcttgattt

SEQ ID NO: 33760 - DNA, 71 bp, chicken (Gallus Gallus)
  misc_feature (36): n=a or g
gagggcttttgtgttcaaactgggattttgagctgngtgaggagcacgagcccacactgctctgagccgtg

SEQ ID NO: 33761 - DNA, 71 bp, chicken (Gallus Gallus)
  misc_feature (36): n=c or t
gacacagggacagccacaaccctctgctgtccaccntgagcatggtctggagcagtctgctagcaaactga

SEQ ID NO: 33762 - DNA, 71 bp, chicken (Gallus Gallus)
  misc_feature (36): n=g or t
cagcatgttctcactcatcttcaacattttacattngtctaaagtcacacaggtccctacgaggccattag

SEQ ID NO: 33763 - DNA, 71 bp, chicken (Gallus Gallus)
  misc_feature (36): n=a or c
aaatacacatagaattgcaacatgatgttaaaattnatctcataactaagcattcagctcccctgctaaat

SEQ ID NO: 33764 - DNA, 71 bp, chicken (Gallus Gallus)
  misc_feature (36): n=a or g
ctcctaagtaattgcacttaagtgtgcattaatgcnttgcagcatcaggactttaagcagcacagttgaaa

SEQ ID NO: 33765 - DNA, 71 bp, chicken (Gallus Gallus)
  misc_feature (36): n=c or t
tttcacacagtccaaagctgaactgggccttttctncagtcctgctaagtgataatgctacaggtgagctc

SEQ ID NO: 33766 - DNA, 71 bp, chicken (Gallus Gallus)
  misc_feature (36): n=a or c
ttctgtccttctaccttctttttaccaatgaagtangtgaaatactatcagtgtttatacacagctttaaa

SEQ ID NO: 33767 - DNA, 71 bp, chicken (Gallus Gallus)
  misc_feature (36): n=a or c
tagggtcaggacagaaaaagctagtgaattcctatngtgtgaatagaaagttagtctggatgatgaaatgg

SEQ ID NO: 33768 - DNA, 71 bp, chicken (Gallus Gallus)
  misc_feature (36): n=a or g
agatgccctcagggaactctgctggttatatagganttacgtgtgagtctcaccctcttgaaatccaaact

SEQ ID NO: 33769 - DNA, 71 bp, chicken (Gallus Gallus)
  misc_feature (36): n=a or g
gtctccctctctctaaagaggtgcaaacagcactcngccttctgacatgagtgaagatatatgctctttgt

SEQ ID NO: 33770 - DNA, 71 bp, chicken (Gallus Gallus)
  misc_feature (36): n=a or g
aagctgtcctgtggtgaactgacatggtcctatgtnctgaagaggtgtacccaaaacagttagtctaaatt

SEQ ID NO: 33771 - DNA, 71 bp, chicken (Gallus Gallus)
  misc_feature (36): n=a or g
cttttcttattatacctaagagtatgaggccaagangggatgtaattgttctggcaacgcagaactggggt

SEQ ID NO: 33772 - DNA, 71 bp, chicken (Gallus Gallus)
  misc_feature (36): n=a or g
gtctgagagaatttcttaaggtaggctgatacttangggatggagatgcaagtaaacaccagtgataaggg

SEQ ID NO: 33773 - DNA, 71 bp, chicken (Gallus Gallus)
  misc_feature (36): n=c or t
gcctttgcacgtggaaatctcttacattctcaatgngtgtttctagactttccaggtttgctgcaaggctg

SEQ ID NO: 33774 - DNA, 71 bp, chicken (Gallus Gallus)
  misc_feature (36): n=c or t
agtgctgagctttgccacaaataacccagtgccctnacctgatgtctcactccagtcaagtgcaaggcagg

SEQ ID NO: 33775 - DNA, 71 bp, chicken (Gallus Gallus)
  misc_feature (36): n=a or c
tagctgtagcacatccaagctgcaaacattcagaangttttgtatttgtggtagtgctcttaagatccttg

SEQ ID NO: 33776 - DNA, 71 bp, chicken (Gallus Gallus)
  misc_feature (36): n=a or g
tttgttgttgttaaagaattgctggagacagccctnttctctttcagtaataactataattaatcttggtt

SEQ ID NO: 33777 - DNA, 71 bp, chicken (Gallus Gallus)
  misc_feature (36): n=c or t
gacattcagtcaacacgctcactgtttacagattcntcctttccttattcttgatggtgtctcagatctgc

SEQ ID NO: 33778 - DNA, 71 bp, chicken (Gallus Gallus)
  misc_feature (36): n=g or t
tttggctcaatccctgctgctcgcagcgtgcgaggntagcacagagggatctctttatctgctactctgtc

SEQ ID NO: 33779 - DNA, 71 bp, chicken (Gallus Gallus)
  misc_feature (36): n=a or g
agctcccaaccagagaacccaaacagacaaaccctncagaagtggctgtatggaaaactgcagaatggctg

SEQ ID NO: 33780 - DNA, 71 bp, chicken (Gallus Gallus)
  misc_feature (36): n=c or t
gttctccttgttttctgatgtgcaggttctcaatgngcccagtgctctgtttcaggatatttccagtatca

SEQ ID NO: 33781 - DNA, 71 bp, chicken (Gallus Gallus)
  misc_feature (36): n=c or t
taaccataacagctacaaatatcgtgcttcctttgnacaagtgaaattggggcagaaacagcacctttcac

SEQ ID NO: 33782 - DNA, 71 bp, chicken (Gallus Gallus)
  misc_feature (36): n=g or t
tgtggatcacgccatccacaggaactctagctgtcncagtcctgcacttgtcctctgtagctccaggatga

SEQ ID NO: 33783 - DNA, 71 bp, chicken (Gallus Gallus)
  misc_feature (36): n=g or t
tctggtccaaacagatccatgcatttagaaaagtcntctttgaagtgtgaatagtaggtccaccatggatt

SEQ ID NO: 33784 - DNA, 71 bp, chicken (Gallus Gallus)
  misc_feature (36): n=c or t
aatgaaagttaaactggaattgcatttccctaagcngtgcttggaggggggaaaggaagcacaggtcattt

SEQ ID NO: 33785 - DNA, 71 bp, chicken (Gallus Gallus)
  misc_feature (36): n=c or t
tagccagactcacagctaagcagaaaggttaagagntgtcatctccagcgagcatgagatcatggaaaact

SEQ ID NO: 33786 - DNA, 71 bp, chicken (Gallus Gallus)
  misc_feature (36): n=c or t
gatgaggttatgccttatgcattacatcagcttttnaaccactctttgaaggacagactgcttctgtgtct

SEQ ID NO: 33787 - DNA, 71 bp, chicken (Gallus Gallus)
  misc_feature (36): n=a or g
caggtccccatcagtcatgctgtgagatacagactncatttacattcaccagcccacatctcgcatccaaa

SEQ ID NO: 33788 - DNA, 71 bp, chicken (Gallus Gallus)
  misc_feature (36): n=c or t
ggcctaattatcccagggtagctaattataaaggangtaaattgacagaaataaaaccacatggtcaataa

SEQ ID NO: 33789 - DNA, 71 bp, chicken (Gallus Gallus)
  misc_feature (36): n=g or t
ttagtcaagctcatacatttcaattagctttttttnttgttgttccttaatgactaatacacagtaattaa

SEQ ID NO: 33790 - DNA, 71 bp, chicken (Gallus Gallus)
  misc_feature (36): n=c or t
tactagtagtaagcctgtcgttattttccagccccntgcacaggtaaattgactctgccttcagtacaagc

SEQ ID NO: 33791 - DNA, 71 bp, chicken (Gallus Gallus)
  misc_feature (36): n=c or t
tgtggcatctcatctcctccagcccaaatttgtgcnatttttccaggtctctgagagcagacagctctggt

SEQ ID NO: 33792 - DNA, 71 bp, chicken (Gallus Gallus)
  misc_feature (36): n=c or t
ataccaaggccctcagctggagatcaaaggcagtcnttggggtgtaggatctgcctgttgtggcaaagatt

SEQ ID NO: 33793 - DNA, 71 bp, chicken (Gallus Gallus)
  misc_feature (36): n=c or t
ttgccatgtacagcaatggcatttctcagcatcccngttactgcaaacacctccttcctcaaaatagcaag

SEQ ID NO: 33794 - DNA, 71 bp, chicken (Gallus Gallus)
  misc_feature (36): n=a or g
tcagaatccaaatctccttgcaattaatatctaacntttcccttattagtgtccaactttgccacatgtga

SEQ ID NO: 33795 - DNA, 71 bp, chicken (Gallus Gallus)
  misc_feature (36): n=c or t
cacctaaaaagggaaaagatggacagtttggagtangagctcctcttggagaaacagggacttcagggggg

SEQ ID NO: 33796 - DNA, 71 bp, chicken (Gallus Gallus)
  misc_feature (36): n=a or g
ttcctgttttctgggtgcttttgcccaggggtcacnctggcaagataacactctcttgaaatgccgacagt

SEQ ID NO: 33797 - DNA, 71 bp, chicken (Gallus Gallus)
  misc_feature (36): n=c or t
gttggatcctagctacagcttgtttaaacaatggtnctgcaggttgtgtttgtcttggatggtggtttgtt

SEQ ID NO: 33798 - DNA, 71 bp, chicken (Gallus Gallus)
  misc_feature (36): n=a or g
tcacaacagcttccgagaaagggcacccagcaaccnaagaaagtcgaaagcaggagttagcaaaatcctgt

SEQ ID NO: 33799 - DNA, 71 bp, chicken (Gallus Gallus)
  misc_feature (36): n=a or g
acttgcagaattgttatttacctgaaatgacagctnaaaggagaaaagcagataattcaaacactctcata

SEQ ID NO: 33800 - DNA, 71 bp, chicken (Gallus Gallus)
  misc_feature (36): n=c or t
attctgggagctgaggttttttcacttctgaactcnttagtgaagtttttgggggcttcttggtggttttt

SEQ ID NO: 33801 - DNA, 71 bp, chicken (Gallus Gallus)
  misc_feature (36): n=a or g
ttgtctgcttacatctctgaatcattcacgtgcttnctattatattctcaagcaacaaaatgtagaacaaa

SEQ ID NO: 33802 - DNA, 71 bp, chicken (Gallus Gallus)
  misc_feature (36): n=c or t
tgctattactggcacagttgtaaatctgtcctgttntctttgagtctgtttccatgtattcctgctgggct

SEQ ID NO: 33803 - DNA, 71 bp, chicken (Gallus Gallus)
  misc_feature (36): n=c or t
ttggggaagttgaactccaatcccaaagctctcttnataggtcaggttctcagtgcgttctggggagggct

SEQ ID NO: 33804 - DNA, 71 bp, chicken (Gallus Gallus)
  misc_feature (36): n=c or t
gagtctgactcctacccatggagacaaggcttttcntgtggcccttttggctagaagcagttcagggaaga

SEQ ID NO: 33805 - DNA, 71 bp, chicken (Gallus Gallus)
  misc_feature (36): n=c or t
atcagcgctctgtggtgctggtaatggttgatcacntgggggcttgggttgccagcaacaaggtgactaca

SEQ ID NO: 33806 - DNA, 71 bp, chicken (Gallus Gallus)
  misc_feature (36): n=c or t
ctgtctccggagcaccgggtgcccacttgctggctngtgcaagctcctgtcttgcgttgatgagtctccaa

SEQ ID NO: 33807 - DNA, 71 bp, chicken (Gallus Gallus)
  misc_feature (36): n=g or t
ccatatttcactgtattacaccacatttgcaggagnattcaacatgggcaatataacctgctgctcaccac

SEQ ID NO: 33808 - DNA, 71 bp, chicken (Gallus Gallus)
  misc_feature (36): n=a or g
ggcgtggagcgcgtcagcatccagctggacctgganggcgagttccacttcacccacctcatcatgaagtt

SEQ ID NO: 33809 - DNA, 71 bp, chicken (Gallus Gallus)
  misc_feature (36): n=a or g
ttttgcaggaaccttattgaaccagaccagtgcacntacaacttcacagcatctcgcattgatgtctgctt

SEQ ID NO: 33810 - DNA, 71 bp, chicken (Gallus Gallus)
  misc_feature (36): n=a or g
atcccgcaggttggtgtgacagtggcccaggcgacnatggaaccccacttgctggaggcgtgtgtgaggga

SEQ ID NO: 33811 - DNA, 71 bp, chicken (Gallus Gallus)
  misc_feature (36): n=a or g
ctcttcttctaggaaggatgataaagctgctgtagntgagcatctcacttctgggtggtgtctgtctcaca

SEQ ID NO: 33812 - DNA, 71 bp, chicken (Gallus Gallus)
  misc_feature (36): n=a or g
taaagtatgtgttcctctaatggattgctctgcagntagcctgcatgtgaaagatatcctaattctgcttc

SEQ ID NO: 33813 - DNA, 71 bp, chicken (Gallus Gallus)
  misc_feature (36): n=a or g
gaaacgcactcgggatccatgcagacgactcacccncttttaagacaacaaaccacattccccctatggtg

SEQ ID NO: 33814 - DNA, 71 bp, chicken (Gallus Gallus)
  misc_feature (36): n=g or t
cttggtgcaggccctgcacaagcagtgcatctgtantctagtgcctgtccaacatgtgccagggagtgtgt

SEQ ID NO: 33815 - DNA, 71 bp, chicken (Gallus Gallus)
  misc_feature (36): n=c or t
taaaagagttactcacgtgagaacctaaaaccagcntactacagaggtaacagtagctaaacgtgtgacag

SEQ ID NO: 33816 - DNA, 71 bp, chicken (Gallus Gallus)
  misc_feature (36): n=a or g
gacttctaggaactcaattactctgacacaaggggnaaatatgaaggtgacactggctctgccatctcatc

SEQ ID NO: 33817 - DNA, 71 bp, chicken (Gallus Gallus)
  misc_feature (36): n=a or g
tggagaacttgtagactcctagctattaaaagctantttttgcttatttgaagggtgcctatttattttag

SEQ ID NO: 33818 - DNA, 71 bp, chicken (Gallus Gallus)
  misc_feature (36): n=c or t
ttcaactttaacgtgtattggaagtcaattggaagntcaagttcaggttaattcatagacttggctcaact

SEQ ID NO: 33819 - DNA, 71 bp, chicken (Gallus Gallus)
  misc_feature (36): n=a or g
tcagacatctcaaagggaacaccgtacagcaattcnttttccagcatcacaactagaacaaaatgtacttg

SEQ ID NO: 33820 - DNA, 71 bp, chicken (Gallus Gallus)
  misc_feature (36): n=a or c
gcgcttcacagcggtgtctccatctgagctgcttantaaggactcacaactggtttttagacagtctgtgc

SEQ ID NO: 33821 - DNA, 71 bp, chicken (Gallus Gallus)
  misc_feature (36): n=c or t
cccaactgaaagaatgagctgatatgttcagtgatnaagaataatttgttgtgacagtttcattactctta

SEQ ID NO: 33822 - DNA, 71 bp, chicken (Gallus Gallus)
  misc_feature (36): n=a or g
ggttttcacagaacccagtccaccaacagcacagcntgcacagtttggaaagatgcaaagagctttgcgta

SEQ ID NO: 33823 - DNA, 71 bp, chicken (Gallus Gallus)
  misc_feature (36): n=a or g
aagaaggaggtaaatgtcttagaactgcaggaaatnctagaaagtttacattacaaatttaagagccagtc

SEQ ID NO: 33824 - DNA, 71 bp, chicken (Gallus Gallus)
  misc_feature (36): n=a or c
agtatctgttattttgacaccgtctaaagcagtatnattccttggaagcatcagccaccagggtatctaat

SEQ ID NO: 33825 - DNA, 71 bp, chicken (Gallus Gallus)
  misc_feature (36): n=c or t
aggaaggactgtttgaagaagctccaggtcagccgngcttccttccagttaaggaaagtctgcaaaatcaa

SEQ ID NO: 33826 - DNA, 71 bp, chicken (Gallus Gallus)
  misc_feature (36): n=c or t
aggccccactgcggataaaggacgactaaaacaacngtcaaaatgcatttggacactattgaaaggctttc

SEQ ID NO: 33827 - DNA, 71 bp, chicken (Gallus Gallus)
  misc_feature (36): n=a or g
gaacagtgcctggcagattccctgatgcttggatangaaatgcttcctctgcccttccactcagctgtttg

SEQ ID NO: 33828 - DNA, 71 bp, chicken (Gallus Gallus)
  misc_feature (36): n=c or t
cagcgatgaaagcagtattgtagtagtccatgtggntttaaatatgttgctgggggttgatgtctttatgt

SEQ ID NO: 33829 - DNA, 71 bp, chicken (Gallus Gallus)
  misc_feature (36): n=c or t
tggtcctaaggactgataatgcgcagcacaagctanattcagtcctttcagtctctgtcacctaagtcatg

SEQ ID NO: 33830 - DNA, 71 bp, chicken (Gallus Gallus)
  misc_feature (36): n=c or t
ttattaaagcatcttgtttcagaggcatttggaacngcagggattctttgcacttttcatgaagcgattga

SEQ ID NO: 33831 - DNA, 71 bp, chicken (Gallus Gallus)
  misc_feature (36): n=a or g
aagtgtgcactttaactttcatcataacatctggtntggaaatattgatgacctaattttaagttggagtt

SEQ ID NO: 33832 - DNA, 71 bp, chicken (Gallus Gallus)
  misc_feature (36): n=a or g
aggaaatagtgcagtgatgccttctattgatctggnaggggctgggtgagagccctgcctgggtgtgggag

SEQ ID NO: 33833 - DNA, 71 bp, chicken (Gallus Gallus)
  misc_feature (36): n=c or t
tacaactgattggttcctgcattcaaactacttcangcaacactccatccaccggcgtataaaacaaagct

SEQ ID NO: 33834 - DNA, 71 bp, chicken (Gallus Gallus)
  misc_feature (36): n=c or t
ctctgagcaagaggcatgtcttagcataatgaattnaagcacaaacagttattatttctaaataagtacat

SEQ ID NO: 33835 - DNA, 71 bp, chicken (Gallus Gallus)
  misc_feature (36): n=g or t
atacacctgcaaaaatatcccatatgtagtaagaantaagtgacattatagcagatctgaacatttcaaac

SEQ ID NO: 33836 - DNA, 71 bp, chicken (Gallus Gallus)
  misc_feature (36): n=c or t
cagccatgcagcatcccaaacaagggaaaagacttngatcctgtatcctacagtaatacctagagtaggct

SEQ ID NO: 33837 - DNA, 71 bp, chicken (Gallus Gallus)
  misc_feature (36): n=c or t
tggttgtggcaaaaggagcagcattctctaacagantagaaatctgacattattttccttttcactgcatg

SEQ ID NO: 33838 - DNA, 71 bp, chicken (Gallus Gallus)
  misc_feature (36): n=a or g
gagccaaacaagcacagaacaaaacccttcactgcngataaggagagctttgcctgaggacaagcttttcg

SEQ ID NO: 33839 - DNA, 71 bp, chicken (Gallus Gallus)
  misc_feature (36): n=a or g
tactttcagagcaatctacgtgtgtattaagggcangtctaaagatacatctggaaccagtgccttttggg

SEQ ID NO: 33840 - DNA, 71 bp, chicken (Gallus Gallus)
  misc_feature (36): n=a or g
gagccgttcaaatgacatgggactactgagaaaacnctctctgagctgaatcctaattataacagtgcaaa

SEQ ID NO: 33841 - DNA, 71 bp, chicken (Gallus Gallus)
  misc_feature (36): n=a or g
catctaaggatttgagcaacgtatattcctctcagntaacactgttctcgcagtcagtgagagggccaaga

SEQ ID NO: 33842 - DNA, 71 bp, chicken (Gallus Gallus)
  misc_feature (36): n=c or t
aaacaaaccggcccaacaaaaacatgagcaaatccnactttcaaaactttgtcctgctcctaccatcacaa

SEQ ID NO: 33843 - DNA, 71 bp, chicken (Gallus Gallus)
  misc_feature (36): n=c or t
tcataaacatgcctcatttttgaccaattccataanaaacattacatgtttcagcctctgagctcacaagt

SEQ ID NO: 33844 - DNA, 71 bp, chicken (Gallus Gallus)
  misc_feature (36): n=c or t
gaacctcagcccattgctggaggtattggaatagcngtagtattttgtgacagacagggcctgtgtgtaac

SEQ ID NO: 33845 - DNA, 71 bp, chicken (Gallus Gallus)
  misc_feature (36): n=c or t
caaaactgaatcgtgtgacaactattaaattggccnctcccctgatacgaaggcaaaggaaattaagagat

SEQ ID NO: 33846 - DNA, 71 bp, chicken (Gallus Gallus)
  misc_feature (36): n=c or t
aaagcatctcaccagagattttacagaaaacttctntttcgaaaataaaacatgcattcagagacttccaa

SEQ ID NO: 33847 - DNA, 71 bp, chicken (Gallus Gallus)
  misc_feature (36): n=c or t
gaaacttgggaaattatgtacagtttaatataccanatatgaaagtaaaatgtatcataatgcacatccac

SEQ ID NO: 33848 - DNA, 71 bp, chicken (Gallus Gallus)
  misc_feature (36): n=c or t
aataagccatgttttacagtaagtgccaatttgtangtcttggcatttgctacacactattaatcttctca

SEQ ID NO: 33849 - DNA, 71 bp, chicken (Gallus Gallus)
  misc_feature (36): n=g or t
atcactcaaatatttgtcttattctgattttaatgnttctaggtaagttatatattacttttagtctttag

SEQ ID NO: 33850 - DNA, 71 bp, chicken (Gallus Gallus)
  misc_feature (36): n=c or t
ggttttgagtatgttctttatttctgttggctgatnttagtcatattttgcattacgtgtactgttggcct

SEQ ID NO: 33851 - DNA, 71 bp, chicken (Gallus Gallus)
  misc_feature (36): n=c or t
aaggaagggagacagttaaaagcagtttgtggtttngttttcctgcttttggcaaccttagcctgagcttt

SEQ ID NO: 33852 - DNA, 71 bp, chicken (Gallus Gallus)
  misc_feature (36): n=c or t
gctcctaccgcccaccagctacgcctggaggcacanggaaaggagcagttagctgaagagctaaaagcaat

SEQ ID NO: 33853 - DNA, 71 bp, chicken (Gallus Gallus)
  misc_feature (36): n=g or t
gcaatactattcatagctagaggcatagcagcaggngacttggaattctagctcccaaattttctctcaaa

SEQ ID NO: 33854 - DNA, 71 bp, chicken (Gallus Gallus)
  misc_feature (36): n=a or g
ctatgtaggaaagttttgcagcaatttgggcttgtntttgcactgctctaaagtactaaaagatgtttgtt

SEQ ID NO: 33855 - DNA, 71 bp, chicken (Gallus Gallus)
  misc_feature (36): n=c or t
aagaaaacatggaataactgagcacttcagttccantgcaagctgagaaatatatagcatgtgaagatgag

SEQ ID NO: 33856 - DNA, 71 bp, chicken (Gallus Gallus)
  misc_feature (36): n=a or g
accccacacagccaagactaggagggaaggtgaccnacaccgagtagctgaacccactgtcctcataaaat

SEQ ID NO: 33857 - DNA, 71 bp, chicken (Gallus Gallus)
  misc_feature (36): n=a or g
ccaacattaatattgctagggagatgaagaacagcnttgtgtaccaagcgataaacatcaatgccaaaaca

SEQ ID NO: 33858 - DNA, 71 bp, chicken (Gallus Gallus)
  misc_feature (36): n=a or c
caacgttgctgccatcccacctcattcctcccctcngctgctaatgagctttattctccatgctcttcacg

SEQ ID NO: 33859 - DNA, 71 bp, chicken (Gallus Gallus)
  misc_feature (36): n=a or g
gttctgtggctttgactccaaatcttctccccaganctccgattaaactcacagaacttcattccctgtcc

SEQ ID NO: 33860 - DNA, 71 bp, chicken (Gallus Gallus)
  misc_feature (36): n=a or g
gcagatttccactgccagggcattgcttctaagacntgctcatgctgctgaggaaccagggcttcattcct

SEQ ID NO: 33861 - DNA, 71 bp, chicken (Gallus Gallus)
  misc_feature (36): n=a or c
cttgcatgagctataagaaaggtgaaacgccacctnaccttcctgtactgtttcctgatgtatgtgttaga

SEQ ID NO: 33862 - DNA, 71 bp, chicken (Gallus Gallus)
  misc_feature (36): n=c or t
ccatagaggttgactcagcagctttggtgggaaaantggagcttcccctctgggatgccattcctgatcaa

SEQ ID NO: 33863 - DNA, 71 bp, chicken (Gallus Gallus)
  misc_feature (36): n=g or t
atcctagcagaaagatgaaagcatgctcagccaggnagattgctttctgctaattactgctgagtgcagcc

SEQ ID NO: 33864 - DNA, 71 bp, chicken (Gallus Gallus)
  misc_feature (36): n=c or t
gaaatgtagattggcattccaaaaacgacaggcatnggtttccttatagctatatgattgaaacagtctta

SEQ ID NO: 33865 - DNA, 71 bp, chicken (Gallus Gallus)
  misc_feature (36): n=a or g
ctgatttatttcttacaccagaaagtgaattgcaanttgagactgcactgtatgtctgatttaagtgaaaa

SEQ ID NO: 33866 - DNA, 71 bp, chicken (Gallus Gallus)
  misc_feature (36): n=a or g
acactgagagagacaaaggcgtaccaaaatgggtcntggaaaatgacgatgtggtgggaagcaaaagctac

SEQ ID NO: 33867 - DNA, 71 bp, chicken (Gallus Gallus)
  misc_feature (36): n=c or t
tccaagttaaacctgctttagcctagttgttttttncctcccctcataatgagtgaaatgcttttatatag

SEQ ID NO: 33868 - DNA, 71 bp, chicken (Gallus Gallus)
  misc_feature (36): n=a or g
aacccccagcctcacaccctgttaaaatgcaaatcngtgcacggaccagaaagtgttaatgcccagcttgc

SEQ ID NO: 33869 - DNA, 71 bp, chicken (Gallus Gallus)
  misc_feature (36): n=a or g
tctagagttctcttccttgtctatttattatgtctntgtcttcttcggtatataaaaattaagcttaaagc

SEQ ID NO: 33870 - DNA, 71 bp, chicken (Gallus Gallus)
  misc_feature (36): n=c or t
tagttctgttttagctgggagagtcccaacttatgnctctccaatgtatacagcctccttacgcaacccgt

SEQ ID NO: 33871 - DNA, 71 bp, chicken (Gallus Gallus)
  misc_feature (36): n=c or t
aatcccaccacacatgcagtagggtctctgatctangcctttcagaaccaggcaggatggatccagtcact

SEQ ID NO: 33872 - DNA, 71 bp, chicken (Gallus Gallus)
  misc_feature (36): n=c or t
cttaggataaaacatttgttaaaatgatgtgcaacnacctggagtgcaacatgcagaactaatgccatgag

SEQ ID NO: 33873 - DNA, 71 bp, chicken (Gallus Gallus)
  misc_feature (36): n=c or t
tggagggctaaagcagcccgtaactgaaggaaaatnactgattgaaagtaaacaactgaatacagtgacaa

SEQ ID NO: 33874 - DNA, 71 bp, chicken (Gallus Gallus)
  misc_feature (36): n=a or g
aaaggaagtgcactacaaggcacaaaccaccaggtnttacagacctttccaggctcacactctgtcccgtc

SEQ ID NO: 33875 - DNA, 71 bp, chicken (Gallus Gallus)
  misc_feature (36): n=c or t
gctgtgctcagtgggaagggttgttaaagttactangaaagagtaatctattacaaattactcattaatca

SEQ ID NO: 33876 - DNA, 71 bp, chicken (Gallus Gallus)
  misc_feature (36): n=c or t
tccctcatgaagaaagatcaggaaagtgaggagtcngtgccacaagggcccaggtgtccgctctgatggtg

SEQ ID NO: 33877 - DNA, 71 bp, chicken (Gallus Gallus)
  misc_feature (36): n=a or c
gtgagcctttctgtgggctaacattgccacccagangcacatgagtagtatgttaggtggcctttcactac

SEQ ID NO: 33878 - DNA, 71 bp, chicken (Gallus Gallus)
  misc_feature (36): n=c or t
atctcatcctctgaccaatcacactcagtgattacnaagacacttacaagagcccctggagatccagggca

SEQ ID NO: 33879 - DNA, 71 bp, chicken (Gallus Gallus)
  misc_feature (36): n=c or t
gataggagatacatgaatgagaagctctacacatancaaatttaacaggcatcctcctcatactgtgtaat

SEQ ID NO: 33880 - DNA, 71 bp, chicken (Gallus Gallus)
  misc_feature (36): n=c or t
ttggtatgtagttagaagaacatgcttacaccacangctgaaggaaacatgaaagctgaactatttttttt

SEQ ID NO: 33881 - DNA, 71 bp, chicken (Gallus Gallus)
  misc_feature (36): n=c or t
acccaagcagcgctgagaggcggtgcttccactgangctttttccattacaaaatagcgttctacccaaac

SEQ ID NO: 33882 - DNA, 71 bp, chicken (Gallus Gallus)
  misc_feature (36): n=c or t
ccacaacgtgcagggattcttcattgcctgatgtanaaccaggctccaagtgccccccagacagcaggaag

SEQ ID NO: 33883 - DNA, 71 bp, chicken (Gallus Gallus)
  misc_feature (36): n=c or t
cttttccccatcatcttctaggttcagagcacttcnagactatattccctttcctctccaatgtaagcttc

SEQ ID NO: 33884 - DNA, 71 bp, chicken (Gallus Gallus)
  misc_feature (36): n=g or t
agaggggcggcaaggtagcaagtggtttggggaggntcagacatccccaaatggcaaaactcaacatggat

SEQ ID NO: 33885 - DNA, 71 bp, chicken (Gallus Gallus)
  misc_feature (36): n=a or g
gtgtagcacactttacagacctaaaaaaagccccancgcccccaggtcaatgcttctatgttgcccgagca

SEQ ID NO: 33886 - DNA, 71 bp, chicken (Gallus Gallus)
  misc_feature (36): n=g or t
taaagatgcacatgtttcctttttgcatggacagancctgtttaaatttatatcagcacacaccagcaact

SEQ ID NO: 33887 - DNA, 71 bp, chicken (Gallus Gallus)
  misc_feature (36): n=c or t
cttccaagaagaaaggtccttccaaccatgtggctnttttcctttaataagaatagttttcaagcagtaac

SEQ ID NO: 33888 - DNA, 71 bp, chicken (Gallus Gallus)
  misc_feature (36): n=a or g
caaaacatggcccaaagaggcagacaaaaagcttcntattaatcctctcctgtccaatcttgcagacattt

SEQ ID NO: 33889 - DNA, 71 bp, chicken (Gallus Gallus)
  misc_feature (36): n=c or t
ccactgttgcatatttttttttcacattttaggcanttgcagctataaaccaagcttgagacctctgcacg

SEQ ID NO: 33890 - DNA, 71 bp, chicken (Gallus Gallus)
  misc_feature (36): n=a or g
agaagcaatggtcccattgtttaggtgcactgagcntacaagggctaaaacaaaaggcagccgtggtgaat

SEQ ID NO: 33891 - DNA, 71 bp, chicken (Gallus Gallus)
  misc_feature (36): n=a or g
gttctctcatgaaaaagacccaattggatgtaggcntacctcactgagttagatatagagtatatggaggt

SEQ ID NO: 33892 - DNA, 71 bp, chicken (Gallus Gallus)
  misc_feature (36): n=a or c
tcccaacagtacatgaagagaaaattaaatgttacntgctttataactcagcaagtatggagacacacagt

SEQ ID NO: 33893 - DNA, 71 bp, chicken (Gallus Gallus)
  misc_feature (36): n=c or t
tggggagcccgtctgccccgagcccacagctccacngcccctgtacctccatcggcatcctcccgggtgcc

SEQ ID NO: 33894 - DNA, 71 bp, chicken (Gallus Gallus)
  misc_feature (36): n=c or t
tttacacacttgctgctacactgctgttaacctatntgagtgcataattctacattgtcttgacataaact

SEQ ID NO: 33895 - DNA, 71 bp, chicken (Gallus Gallus)
  misc_feature (36): n=c or t
gcctccccacctcagcaccttcttcacaggagccantggttggttcaaccttattcaaaaatgagagctaa

SEQ ID NO: 33896 - DNA, 71 bp, chicken (Gallus Gallus)
  misc_feature (36): n=a or c
ctaagcaggctaagttatgagtgttactgcaaaganatacatatacaaaaaggatcatagttaaactaatc

SEQ ID NO: 33897 - DNA, 71 bp, chicken (Gallus Gallus)
  misc_feature (36): n=g or t
agactgggatcggcacatcagggagcacaagtcatntaactgagggagacttcataatgaaaggagcaata

SEQ ID NO: 33898 - DNA, 71 bp, chicken (Gallus Gallus)
  misc_feature (36): n=a or c
aaggatcacacagaggaatctggtacaggatataanataactgggcaaccactactgcacgcttgaatttc

SEQ ID NO: 33899 - DNA, 71 bp, chicken (Gallus Gallus)
  misc_feature (36): n=a or c
taaaccaacaggtacatctctcccaaggctgtcacncagaacaactcaatttacttgtctttttaacaagc

SEQ ID NO: 33900 - DNA, 71 bp, chicken (Gallus Gallus)
  misc_feature (36): n=a or g
caggcagtgcagtgtggaaaatacttgtattcgcantcaggggcaagatcccatcccagcagggcagctgc

SEQ ID NO: 33901 - DNA, 71 bp, chicken (Gallus Gallus)
  misc_feature (36): n=c or t
gaaaaagacttgactattttagtctttcttgtctangatctattcacagaaggagtgagttcctgccccca

SEQ ID NO: 33902 - DNA, 71 bp, chicken (Gallus Gallus)
  misc_feature (36): n=c or t
tgctgtgcccaagagagctgtgcaagggtggatagnaccttctgagcacactcttgcagagcgacatcctc

SEQ ID NO: 33903 - DNA, 71 bp, chicken (Gallus Gallus)
  misc_feature (36): n=a or g
tgagccacgtttgccctgcacacttttgtcattacnctctttcatggcatgggaaatgtatcagaattcag

SEQ ID NO: 33904 - DNA, 71 bp, chicken (Gallus Gallus)
  misc_feature (36): n=a or g
atgactcaacagtccatagagccacagagctgaaangcttagctctgcaagagctagtgtgtgacatttag

SEQ ID NO: 33905 - DNA, 71 bp, chicken (Gallus Gallus)
  misc_feature (36): n=a or g
aaatgagccttaaagatgcacctgccacattttccnatgttccaagttttgatgaacaaaggatgctgagg

SEQ ID NO: 33906 - DNA, 71 bp, chicken (Gallus Gallus)
  misc_feature (36): n=a or c
gcaaatcccttatgaaggggaacacatggaaagaanccctttccctgacatgaatgggtgactgtaacagg

SEQ ID NO: 33907 - DNA, 71 bp, chicken (Gallus Gallus)
  misc_feature (36): n=c or t
gccggccctgcctcgggtgtgtgcgctcacctcctngcgcctctcgggctcgctttttagttttctttcct

SEQ ID NO: 33908 - DNA, 71 bp, chicken (Gallus Gallus)
  misc_feature (36): n=a or g
tctgcctggacttggcctctttggaggctgtgagcngggagctctgaccccagtcttatgttgtggcagta

SEQ ID NO: 33909 - DNA, 71 bp, chicken (Gallus Gallus)
  misc_feature (36): n=a or c
aggcaaatggatccacgtgcctctttggtcccaccnatggaggaatgagccgttcgcatgaatgcaaactt

SEQ ID NO: 33910 - DNA, 71 bp, chicken (Gallus Gallus)
  misc_feature (36): n=c or t
caaatgcagatttaccagctggaatttgtcagcacngaggtacacaaaaacactcaggagggggaagctcg

SEQ ID NO: 33911 - DNA, 71 bp, chicken (Gallus Gallus)
  misc_feature (36): n=c or t
aacaatttagggcaagcagttctccccctgccctanttcctctgccttcgcagccctgcatctgctcacac

SEQ ID NO: 33912 - DNA, 71 bp, chicken (Gallus Gallus)
  misc_feature (36): n=g or t
ctctaaggtcaaaataccagagaataaacaatacanggaacagaaccagcagtaccaggttgttttattgg

SEQ ID NO: 33913 - DNA, 71 bp, chicken (Gallus Gallus)
  misc_feature (36): n=a or c
atggatctctgcttacctttatatgtcagcttattntctttttatcaaacaagtctaggaaagttccgtag

SEQ ID NO: 33914 - DNA, 71 bp, chicken (Gallus Gallus)
  misc_feature (36): n=c or t
ctagggacaatttcacaggccatgccatcgctgaanggggaaattggaaaactgcagaatcgattcgcaga

SEQ ID NO: 33915 - DNA, 71 bp, chicken (Gallus Gallus)
  misc_feature (36): n=c or t
gattccatctgcgatgtagtacccccatgcaactcngcttgccctatgatttccgcaagtgctcagccaaa

SEQ ID NO: 33916 - DNA, 71 bp, chicken (Gallus Gallus)
  misc_feature (36): n=a or g
gttcacgtccctatagtattgctcaggtataatganaaaggaagtcaaaaatgagcataccagtcctaaca

SEQ ID NO: 33917 - DNA, 71 bp, chicken (Gallus Gallus)
  misc_feature (36): n=a or c
ccgctctcacttttggcaagggccagtgggaacccntggtatatctagcaaatggaagcttggagcaactc

SEQ ID NO: 33918 - DNA, 71 bp, chicken (Gallus Gallus)
  misc_feature (36): n=c or t
caaaggcaggagagcagacgaacgtgagctgccttnctttttgtcctgaaactcagccagtgctcagagcc

SEQ ID NO: 33919 - DNA, 71 bp, chicken (Gallus Gallus)
  misc_feature (36): n=a or g
cagaattaactgcaataagatccacattccaaaccnaagggatcctcacatccttctgagtagaaggggag

SEQ ID NO: 33920 - DNA, 71 bp, chicken (Gallus Gallus)
  misc_feature (36): n=a or g
aaaaccacatattcatatagcaaacaaacaggttantatccttaaacatcaatcatagcccttcctaaaac

SEQ ID NO: 33921 - DNA, 71 bp, chicken (Gallus Gallus)
  misc_feature (36): n=a or c
taaattggcaaaatgacttagatagtataaattagngactctatgctatatgttgcctacccttaagaaat

SEQ ID NO: 33922 - DNA, 71 bp, chicken (Gallus Gallus)
  misc_feature (36): n=c or t
acatcaggagtgcatccatcagtttcaaaatgcctngttgctatcaaggctttttgctctacttatctcct

SEQ ID NO: 33923 - DNA, 71 bp, chicken (Gallus Gallus)
  misc_feature (36): n=a or g
atagtagtctgtgctgaggcatatgttaagaatatntgcacagaattgctttatgtctgtataaagaataa

SEQ ID NO: 33924 - DNA, 71 bp, chicken (Gallus Gallus)
  misc_feature (36): n=a or g
gcttagtcattccaagacgggtgaaagaggaaacgntgttctaggtgcataggtgtaaatcatagaatcac

SEQ ID NO: 33925 - DNA, 71 bp, chicken (Gallus Gallus)
  misc_feature (36): n=c or t
caattcttttaaactgttattggaagatgaaagcantgctttaactgctgaacagtaataagtggggtttt

SEQ ID NO: 33926 - DNA, 71 bp, chicken (Gallus Gallus)
  misc_feature (36): n=a or g
ttcagatggtgtccctggcagcagactgccacttantttgctgatatttgtttaccaactaaactctaccc

SEQ ID NO: 33927 - DNA, 71 bp, chicken (Gallus Gallus)
  misc_feature (36): n=c or t
ggagggcttctcctctgttactgttcagtaccattnggtggtattaaatactgaggaaccccaggtacaaa

SEQ ID NO: 33928 - DNA, 71 bp, chicken (Gallus Gallus)
  misc_feature (36): n=a or g
cctactgtgtcaaagcttggtggttatatagcaccntttctaatgaaaatgagaagatatggtctaacatg

SEQ ID NO: 33929 - DNA, 71 bp, chicken (Gallus Gallus)
  misc_feature (36): n=a or g
ctaactttccttattcccagtctagggatgatctanaacctgactctcacacaacaaactagcccacggcc

SEQ ID NO: 33930 - DNA, 71 bp, chicken (Gallus Gallus)
  misc_feature (36): n=c or t
gctgtttttgctcaacacatttgggtcgtaagtacncaagtgcagccagaagtactgcttttagaaggtca

SEQ ID NO: 33931 - DNA, 71 bp, chicken (Gallus Gallus)
  misc_feature (36): n=a or g
attcgcagccgcaagctgtattaaaggctgtctccntttgcttcgccaaagcagttgtctgtagaaagtgt

SEQ ID NO: 33932 - DNA, 71 bp, chicken (Gallus Gallus)
  misc_feature (36): n=c or t
ctttgagcacagggctgtatatgttcatggcatganggtgcactgccagagcaagccagctgctaagggaa

SEQ ID NO: 33933 - DNA, 71 bp, chicken (Gallus Gallus)
  misc_feature (36): n=c or t
tctgctattcgctgtgcaaattcctccttaagagangaaatgctgctggtctcttctttcactctaaacat

SEQ ID NO: 33934 - DNA, 71 bp, chicken (Gallus Gallus)
  misc_feature (36): n=g or t
ggactgatagcaacagatgctgaaccacaagccttncctgataattcatcatctgaatttatttcacttac

SEQ ID NO: 33935 - DNA, 71 bp, chicken (Gallus Gallus)
  misc_feature (36): n=c or t
atcataaatatgagccttttcaaaaccagtatactntaacaaaaacactcctgagaacataatgcattcaa

SEQ ID NO: 33936 - DNA, 71 bp, chicken (Gallus Gallus)
  misc_feature (36): n=a or g
tcagcacagctcagctggcaaacagtgctgggaagnggaaccatgcaggtcctaaagaccctttgatccac

SEQ ID NO: 33937 - DNA, 71 bp, chicken (Gallus Gallus)
  misc_feature (36): n=a or g
actcccaggcagaggctctcttgtgagccacagccntggggaaatcacagtgggactgcaccagtggggta

SEQ ID NO: 33938 - DNA, 71 bp, chicken (Gallus Gallus)
  misc_feature (36): n=g or t
ggtattaaagcattaaatgtaattactgcctattancagttattccagagtctttggaatctgaatgtggt

SEQ ID NO: 33939 - DNA, 71 bp, chicken (Gallus Gallus)
  misc_feature (36): n=a or g
tggaattgggcaaataattaaacctaagacttagcnatggaaatgcttatgaaagaacctcattattttcc

SEQ ID NO: 33940 - DNA, 71 bp, chicken (Gallus Gallus)
  misc_feature (36): n=a or g
ttatcatttgaagggatcctgcataacaagacaacncagatgaaaaggcaagcttgtcctgctggagtccg

SEQ ID NO: 33941 - DNA, 71 bp, chicken (Gallus Gallus)
  misc_feature (36): n=g or t
cagaagctgtggtatcacagtaagattagcacaagngcaattttaagaaataaagtttccaagcaaatttt

SEQ ID NO: 33942 - DNA, 71 bp, chicken (Gallus Gallus)
  misc_feature (36): n=c or t
atgtaagacatggcaaccatgatcggcacttgctgnagagctcagtacaggagatattcaacctcgatcta

SEQ ID NO: 33943 - DNA, 71 bp, chicken (Gallus Gallus)
  misc_feature (36): n=c or t
gccagatgtgcagctgcaatgtgtgatgtgatacangcatggggctggcagcttacctgggtggtcctcac

SEQ ID NO: 33944 - DNA, 71 bp, chicken (Gallus Gallus)
  misc_feature (36): n=c or t
cttctaccaggatctgacttcactttatgcacacanagtggtggcaattttgttatattttgagtaccacc

SEQ ID NO: 33945 - DNA, 71 bp, chicken (Gallus Gallus)
  misc_feature (36): n=c or t
tgtctagctttcaaaaactttcaatctttaatctgnaacttaatggttagtacatcctgtagcagaccatg

SEQ ID NO: 33946 - DNA, 71 bp, chicken (Gallus Gallus)
  misc_feature (36): n=g or t
agcaaagcaaactgtaagaacctgtggaaagggggngttgaagaagagatatgggtgggattgagagcaaa

SEQ ID NO: 33947 - DNA, 71 bp, chicken (Gallus Gallus)
  misc_feature (36): n=a or g
gctcagagcaccttgtgcccatcacatgttcatagngagatggataatgtattttagaaaaccacacttct

SEQ ID NO: 33948 - DNA, 71 bp, chicken (Gallus Gallus)
  misc_feature (36): n=c or t
tttaaatagaactgtgattcagctgaagaaagatanggttttcacctgtctcttaaacaatttggccagaa

SEQ ID NO: 33949 - DNA, 71 bp, chicken (Gallus Gallus)
  misc_feature (36): n=c or t
cacatctccttcctaacacttcctaaggtttcgtgnaagtggcaccaatgtaaagcaacccacagaccacc

SEQ ID NO: 33950 - DNA, 71 bp, chicken (Gallus Gallus)
  misc_feature (36): n=c or t
tcacactacggtatttttgtccaaatcttctggaanggattataaaattgaaatgtaagtaggaacacagc

SEQ ID NO: 33951 - DNA, 71 bp, chicken (Gallus Gallus)
  misc_feature (36): n=c or t
tggttaaaatcagaggacatgattcaggaatgcaanccttttcaaagaagaactgaagcacatgattaact

SEQ ID NO: 33952 - DNA, 71 bp, chicken (Gallus Gallus)
  misc_feature (36): n=c or t
taaaactattgtgcaccttattgccagagacccatngccttctatactgcaataaaaagctccaaagtcaa

SEQ ID NO: 33953 - DNA, 71 bp, chicken (Gallus Gallus)
  misc_feature (36): n=g or t
cattgacacgttctcacggcgtccttcagtctgganatggggaaagtgggtcacagggattaactgctttg

SEQ ID NO: 33954 - DNA, 71 bp, chicken (Gallus Gallus)
  misc_feature (36): n=c or t
aaaagatcttacacatctacacggcctgtcggtgantgcagaattggtatgaaaaatacatcgggccgatg

SEQ ID NO: 33955 - DNA, 71 bp, chicken (Gallus Gallus)
  misc_feature (36): n=c or t
caaacacaaacctgagccttcttttgggtatgcagngcagtctttaaactcatctgttacacagcagctct

SEQ ID NO: 33956 - DNA, 71 bp, chicken (Gallus Gallus)
  misc_feature (36): n=c or t
ggagtacctgatagcaggagtgcatggttatcttcnttgtaggtcggcttacagaggaggaggcaaatgct

SEQ ID NO: 33957 - DNA, 71 bp, chicken (Gallus Gallus)
  misc_feature (36): n=a or g
cctggcccatgcggagttgacgtctcctacacagcnggtcactgcaaagcatctgtccactgaaagatcct

SEQ ID NO: 33958 - DNA, 71 bp, chicken (Gallus Gallus)
  misc_feature (36): n=c or t
gctgggttgggttaagggggtccctgagacaagganttagttcagagagccctcacatgcttgattaagaa

SEQ ID NO: 33959 - DNA, 71 bp, chicken (Gallus Gallus)
  misc_feature (36): n=a or c
ccttgggatgacttgcttctacacccaggttacgcnccctgttcatcgctccctggagggtttgcaatttg

SEQ ID NO: 33960 - DNA, 71 bp, chicken (Gallus Gallus)
  misc_feature (36): n=a or c
tagattactgccgcagatagctttggagtgtaactnatgccaaatagccagagggcaacatgtcaacaatt

SEQ ID NO: 33961 - DNA, 71 bp, chicken (Gallus Gallus)
  misc_feature (36): n=a or g
acgctgcttcccctctggaagtgccccataggatgnaggaggataaaaatagcagcagtcagtgcaagaga

SEQ ID NO: 33962 - DNA, 71 bp, chicken (Gallus Gallus)
  misc_feature (36): n=c or t
aaatcagcctcagaggtctaatgctgctcttgcagntgccagcgaagtgctgccctgacttctgcagctcc

SEQ ID NO: 33963 - DNA, 71 bp, chicken (Gallus Gallus)
  misc_feature (36): n=c or t
cactgcccatttctccctggcatcacacagttccangggcacttggcaggtccatgctagggatgctgaca

SEQ ID NO: 33964 - DNA, 71 bp, chicken (Gallus Gallus)
  misc_feature (36): n=a or g
aggggtggaagggaggtactccctgcttttaccgantgctacattctgatgtttctttcacggtcttgttc

SEQ ID NO: 33965 - DNA, 71 bp, chicken (Gallus Gallus)
  misc_feature (36): n=c or t
tcaaagcacaacaaatcaggatgctttggattctgntttattactggcaaagattatgctgatctttacaa

SEQ ID NO: 33966 - DNA, 71 bp, chicken (Gallus Gallus)
  misc_feature (36): n=c or t
aatagtttatatgttttgagtggaaaagatgttcantgttttaaagacatctgagaaacatcactgagatt

SEQ ID NO: 33967 - DNA, 71 bp, chicken (Gallus Gallus)
  misc_feature (36): n=g or t
tcacgcttctgtccaagcaaaaagagatcaaagggngtttgtttagagaacagttacatttcttcccatca

SEQ ID NO: 33968 - DNA, 71 bp, chicken (Gallus Gallus)
  misc_feature (36): n=a or g
aggactaaattttagcatcagttaaaaagacaaacncttgtattttaatgagtaacagagcctggaaagcc

SEQ ID NO: 33969 - DNA, 71 bp, chicken (Gallus Gallus)
  misc_feature (36): n=g or t
aaggaatcttatagcattcccttgctgaaagcagtnaagggctccattagcaaacatgcttggattatttc

SEQ ID NO: 33970 - DNA, 71 bp, chicken (Gallus Gallus)
  misc_feature (36): n=c or t
gcaggagagtagctccagtatttctttcacaggganacagaatgttctgaagagattggtgcttccactct

SEQ ID NO: 33971 - DNA, 71 bp, chicken (Gallus Gallus)
  misc_feature (36): n=g or t
ataaagctgcatatagggagaggtcagtcgcttgcntaaattttggtgtggatgaagtgctgagtgggagc

SEQ ID NO: 33972 - DNA, 71 bp, chicken (Gallus Gallus)
  misc_feature (36): n=c or t
tctttccataatgtattggcatttttgtttgagcangtgctggattttataccgaaatattctcttgactc

SEQ ID NO: 33973 - DNA, 71 bp, chicken (Gallus Gallus)
  misc_feature (36): n=a or g
ctgcctgtaggactgtctgtttaactggcatacagnatgcttaattaagctgctttgggtttacatctgaa

SEQ ID NO: 33974 - DNA, 71 bp, chicken (Gallus Gallus)
  misc_feature (36): n=c or t
taaaggacatgtaaagagagaagctgaaaatgagcngaagagctgtgaagtggaatagcaaaatggtgggg

SEQ ID NO: 33975 - DNA, 71 bp, chicken (Gallus Gallus)
  misc_feature (36): n=c or t
tacatggtgttttacagaaataggattgatttcggnaacagcattacatttttagaagttactttctgttc

SEQ ID NO: 33976 - DNA, 71 bp, chicken (Gallus Gallus)
  misc_feature (36): n=a or g
tttaaactccttccattaccataattttgctggaanagtgcatgtgaacaactgacattctcagttatatt

SEQ ID NO: 33977 - DNA, 71 bp, chicken (Gallus Gallus)
  misc_feature (36): n=a or g
tttctgggcagaaaatgactgatttggttgaagagngaaaagaggtccagcctgctcagcatagcaggcag

SEQ ID NO: 33978 - DNA, 71 bp, chicken (Gallus Gallus)
  misc_feature (36): n=a or g
tggctattgtagtaaatactggtgttttttaaatcncaaactttggacataaagacacatttttctgcaga

SEQ ID NO: 33979 - DNA, 71 bp, chicken (Gallus Gallus)
  misc_feature (36): n=a or g
ctgggggacaagcccttgcagaagcattacaggagntagccacaacgtatttagatgctgctcacacctac

SEQ ID NO: 33980 - DNA, 71 bp, chicken (Gallus Gallus)
  misc_feature (36): n=a or g
aagtcctgggaagaacgtggttaagagtgaacttgnaagtttatattctgctactgctgtcagagttactg

SEQ ID NO: 33981 - DNA, 71 bp, chicken (Gallus Gallus)
  misc_feature (36): n=c or t
tatctctggagccacttgggaaaaaaagcagagtgnctattatgagcattacaaggaacagacatagaaga

SEQ ID NO: 33982 - DNA, 71 bp, chicken (Gallus Gallus)
  misc_feature (36): n=a or g
gacaaatagtgaagagtctgacatctgcgtggcacntataaaactgtacggatctcgcagctattctgtta

SEQ ID NO: 33983 - DNA, 71 bp, chicken (Gallus Gallus)
  misc_feature (36): n=a or g
tcaaaagagtttcagtattcgagtaaggtcctttgnaaactcaggctttaatttcctctcttgcgggtaaa

SEQ ID NO: 33984 - DNA, 71 bp, chicken (Gallus Gallus)
  misc_feature (36): n=c or t
tgtacattaactgggctgtgttccacacaggagaanatgaacttctgctgcaccaccttttttttcccacg

SEQ ID NO: 33985 - DNA, 71 bp, chicken (Gallus Gallus)
  misc_feature (36): n=g or t
attcaagggaaaagtctcaaactgcctacattaggnatggaagagactgctccactgaaagctgatggaaa

SEQ ID NO: 33986 - DNA, 71 bp, chicken (Gallus Gallus)
  misc_feature (36): n=a or g
accttgggactctttgtgtcttcatttggtaaacgngaatgagaaaatttctgcagcattattatacatta

SEQ ID NO: 33987 - DNA, 71 bp, chicken (Gallus Gallus)
  misc_feature (36): n=a or g
agcacaaactggcagcatctccaagtgtcttcaaanggtactgaaccagtgatacatgtttaaaacaccaa

SEQ ID NO: 33988 - DNA, 71 bp, chicken (Gallus Gallus)
  misc_feature (36): n=a or g
aacagctgtagaagaggagcagaagagcttctaaangcaagtcagactggacttgcaacctccagctgagg

SEQ ID NO: 33989 - DNA, 71 bp, chicken (Gallus Gallus)
  misc_feature (36): n=a or g
aaaccctaaacagggtgtaatactaacaaagtcccnttggtagggaaggaaaagcaaatattaagcactga

SEQ ID NO: 33990 - DNA, 71 bp, chicken (Gallus Gallus)
  misc_feature (36): n=c or t
ctccccatctgcagcagcaacctttcctgttttacngtaaactttctccttgacgctttggcaagtagctc

SEQ ID NO: 33991 - DNA, 71 bp, chicken (Gallus Gallus)
  misc_feature (36): n=a or g
acttaactgatggcttctataggttctctggatgtntacacaaatattgccataatggggtttttaacaaa

SEQ ID NO: 33992 - DNA, 71 bp, chicken (Gallus Gallus)
  misc_feature (36): n=a or c
gggcatgagctcaggctgctaggaataattaatacnaaatgtaattgacaattacttagcaagagtgatat

SEQ ID NO: 33993 - DNA, 71 bp, chicken (Gallus Gallus)
  misc_feature (36): n=c or t
ttgtgggcttatttgcagctggacctgcatatcccngagtccctcctgaccagcatctgagcgcactgtgc

SEQ ID NO: 33994 - DNA, 71 bp, chicken (Gallus Gallus)
  misc_feature (36): n=a or g
attataataatctctgtttggaagactattccactntgttaatgaaagattataagcgacgatgcctgaga

SEQ ID NO: 33995 - DNA, 71 bp, chicken (Gallus Gallus)
  misc_feature (36): n=c or t
agttctgccccacgctgggagcagagccttgtgagncctggaaacacatgcttgtcttcaaatgcatgttc

SEQ ID NO: 33996 - DNA, 71 bp, chicken (Gallus Gallus)
  misc_feature (36): n=c or t
agctactctcaaacagcatttccaatgtcctttatntcagtagaggtgctagtttgagacttttcctttga

SEQ ID NO: 33997 - DNA, 71 bp, chicken (Gallus Gallus)
  misc_feature (36): n=a or g
atgcaggcaaaaaaccaccccagcatactctttggnttgcagtaatagtaggtactgggaaatgaatgtgt

SEQ ID NO: 33998 - DNA, 71 bp, chicken (Gallus Gallus)
  misc_feature (36): n=a or g
aacagaacatttgtactgttgtgctctctgctcttngaaagccatagtttttttggtacctgggcctttga

SEQ ID NO: 33999 - DNA, 71 bp, chicken (Gallus Gallus)
  misc_feature (36): n=a or g
catgtccaatcaaactgatcagcattttggggcacngcttttcagtcacagcatgatctgcagtcatttag

SEQ ID NO: 34000 - DNA, 71 bp, chicken (Gallus Gallus)
  misc_feature (36): n=a or c
aattctgatgtgagacatgaaaaatatgcacaattnaaaccttatctactacagtaaacctatgcagatat

SEQ ID NO: 34001 - DNA, 71 bp, chicken (Gallus Gallus)
  misc_feature (36): n=a or c
cagcataagtgatatcttgagtcacaggtgaatttngcacattatccatcattgagggatgattccactgc

SEQ ID NO: 34002 - DNA, 71 bp, chicken (Gallus Gallus)
  misc_feature (36): n=a or c
atattctgttcaccgtaagggagcagaatggcaaancccgttatttataggtgtgtttctgtagtgctgcc

SEQ ID NO: 34003 - DNA, 71 bp, chicken (Gallus Gallus)
  misc_feature (36): n=c or t
agcaatatcatctccaatttatacgtgggctctagntctcatgagaggtgcaaggcgaatgggcttcgtac

SEQ ID NO: 34004 - DNA, 71 bp, chicken (Gallus Gallus)
  misc_feature (36): n=c or t
ttgaatgtatacagaatactgtttactgaaacttantgtaaccttcactcagtgttgtgttcaatattcat

SEQ ID NO: 34005 - DNA, 71 bp, chicken (Gallus Gallus)
  misc_feature (36): n=a or c
gctggctggaaatcaaaccaaatgggtttgatttcnaacaacatgcttcatgccagtgtcaacagacacat

SEQ ID NO: 34006 - DNA, 71 bp, chicken (Gallus Gallus)
  misc_feature (36): n=c or t
ttgagggtgatagtttcaggcagtgaaatgaatccncctaatggttagttgcactgcataccaccattatc

SEQ ID NO: 34007 - DNA, 71 bp, chicken (Gallus Gallus)
  misc_feature (36): n=a or g
tctctttttcccttccatgcttggtgactcttgagngggtctactcacacaagacctcacaaacatgatgg

SEQ ID NO: 34008 - DNA, 71 bp, chicken (Gallus Gallus)
  misc_feature (36): n=a or g
ggcatcaccccttatgcagtggtcgttgtctcaccngtgcaaagacagtgtgaagcagctctctctcacag

SEQ ID NO: 34009 - DNA, 71 bp, chicken (Gallus Gallus)
  misc_feature (36): n=c or t
gctgtgaggaaatacgttgtatgttccttctcttantagtgacaaacagatgaaataggtgaataaaacca

SEQ ID NO: 34010 - DNA, 71 bp, chicken (Gallus Gallus)
  misc_feature (36): n=c or t
tcagctgcacacagaatggggaaatgtagtaaacangtccataattgtaggtgtgttcatttatcgtatac

SEQ ID NO: 34011 - DNA, 71 bp, chicken (Gallus Gallus)
  misc_feature (36): n=c or t
tttccctctcattttttgatcaggggaagcttgtangttgtgccaggattcagtgctgaatgtcctgggag

SEQ ID NO: 34012 - DNA, 71 bp, chicken (Gallus Gallus)
  misc_feature (36): n=c or t
aagtaaggatcagcttggctttcatcatgcacgttngcctaacttgacctaaaaggcttctgatgatgatt

SEQ ID NO: 34013 - DNA, 71 bp, chicken (Gallus Gallus)
  misc_feature (36): n=g or t
atatacttatctaaacaaaatcagagcaatggttgnttaataactgatctcatattcatcccatctctgtt

SEQ ID NO: 34014 - DNA, 71 bp, chicken (Gallus Gallus)
  misc_feature (36): n=a or g
gaggaggagcatgggcacatgggcctgcatgtgtcngtgccaagcaatctgaaaaggagtccagcactagt

SEQ ID NO: 34015 - DNA, 71 bp, chicken (Gallus Gallus)
  misc_feature (36): n=g or t
aattaaaagggagttcttttgacttatgagacaacnaagtcctccaaaagcaaatccccggcccctgagaa

SEQ ID NO: 34016 - DNA, 71 bp, chicken (Gallus Gallus)
  misc_feature (36): n=c or t
gcctgaaagctgatcttgtggtttgctgcagactgngtgttgcattctgtgctattccttgtgcttgtttt

SEQ ID NO: 34017 - DNA, 71 bp, chicken (Gallus Gallus)
  misc_feature (36): n=c or t
ggaaaaggtttggtgctgactgttctctgcactcangtgcctgctcaagaggaagacaaagtacatcttcc

SEQ ID NO: 34018 - DNA, 71 bp, chicken (Gallus Gallus)
  misc_feature (36): n=c or t
atgggtgcagttagccaaagagtagtctacgggtcnttctgctgtgatagttttggctttccctactcaag

SEQ ID NO: 34019 - DNA, 71 bp, chicken (Gallus Gallus)
  misc_feature (36): n=g or t
tccctggcaccaggtaatgtcggacagcttactccnctccatgccttacactgcatccaaatgctcaggta

SEQ ID NO: 34020 - DNA, 71 bp, chicken (Gallus Gallus)
  misc_feature (36): n=a or g
acgtggccattgtgcccagcacatgaggagctggtngcagagctcgttcccactgtgttaggctcagcctc

SEQ ID NO: 34021 - DNA, 71 bp, chicken (Gallus Gallus)
  misc_feature (36): n=a or g
tctccccttccgcctccccctaagctgctggagccnattttctccattaaaagcaaatccttatctccgct

SEQ ID NO: 34022 - DNA, 71 bp, chicken (Gallus Gallus)
  misc_feature (36): n=c or t
gaatttggtttctttattggtgatacttaccagtgngactagaatttaaagctttatacttcctctttctg

SEQ ID NO: 34023 - DNA, 71 bp, chicken (Gallus Gallus)
  misc_feature (36): n=c or t
atggaaacagctcttagagcaatcttcagcctgtcncactgatgcttcctgggagacaaagacggatggtg

SEQ ID NO: 34024 - DNA, 71 bp, chicken (Gallus Gallus)
  misc_feature (36): n=a or g
attgatattaatgggttctctctatgctaatcctcnagatgttctcacttcaagcaaaacttcccaaatat

SEQ ID NO: 34025 - DNA, 71 bp, chicken (Gallus Gallus)
  misc_feature (36): n=c or t
ctgcaggaactctacccccatgttcctgtttaagantctcaccatcaaaaagctgctttccaggtgaccat

SEQ ID NO: 34026 - DNA, 71 bp, chicken (Gallus Gallus)
  misc_feature (36): n=a or g
gacctgctggatctcagcaaagagaaacctcacggnctgctcaggagctcctgttaagtcacatataacat

SEQ ID NO: 34027 - DNA, 71 bp, chicken (Gallus Gallus)
  misc_feature (36): n=c or t
gccatctctcaccacttcccaccggtgcttcgatcngtcccctgcttttagacaggcgtttctttttcaag

SEQ ID NO: 34028 - DNA, 71 bp, chicken (Gallus Gallus)
  misc_feature (36): n=g or t
cttattgtaaattaaaaaggagacttggaaaagtgntttttcagaggcaacctctgtgtgtgtggttgtgt

SEQ ID NO: 34029 - DNA, 71 bp, chicken (Gallus Gallus)
  misc_feature (36): n=c or t
caatgtcactgtgccagaaagaaggtaaatatcagnataatgagagcagttgcaacccatacgagaactag

SEQ ID NO: 34030 - DNA, 71 bp, chicken (Gallus Gallus)
  misc_feature (36): n=g or t
tgaggcaatgggggccactcacttattagcaagcantaggggctgttttagagttttggaaatgtaagggc

SEQ ID NO: 34031 - DNA, 71 bp, chicken (Gallus Gallus)
  misc_feature (36): n=a or g
agtgcttggagcatctctgtagctataggccttacncaactgacaggggtggttggcatgtgtctgttttc

SEQ ID NO: 34032 - DNA, 71 bp, chicken (Gallus Gallus)
  misc_feature (36): n=c or t
taatatagctccgtgtaacaattcaacttgtctccnggaatgggaaatgctcctacacacggacttaatag

SEQ ID NO: 34033 - DNA, 71 bp, chicken (Gallus Gallus)
  misc_feature (36): n=a or g
ttagtcatgcctggtgtgcatgcatgtgagacagcncaggggagggaggctctgggactttgcaaagatta

SEQ ID NO: 34034 - DNA, 71 bp, chicken (Gallus Gallus)
  misc_feature (36): n=c or t
atgatccttggtgctacagacaggattttttgctgngttaaatagcattgtagaataccctacatgtttct

SEQ ID NO: 34035 - DNA, 71 bp, chicken (Gallus Gallus)
  misc_feature (36): n=a or g
gtctcccccaaccttcactcaagcccagcttacacngattgaatttgcctccttctgcattcttccctgaa

SEQ ID NO: 34036 - DNA, 71 bp, chicken (Gallus Gallus)
  misc_feature (36): n=a or g
tccagcacgtgatgatttgattttcctggcactgcncttacttctcacttttctttatcagttgatttact

SEQ ID NO: 34037 - DNA, 71 bp, chicken (Gallus Gallus)
  misc_feature (36): n=c or t
agtgaataatttacagattaatggttgaagacagtncatgcaagtagcagtaaaggagtgcaatgccttgt

SEQ ID NO: 34038 - DNA, 71 bp, chicken (Gallus Gallus)
  misc_feature (36): n=c or t
ccaaaactgtatatatactgcttctgtgatggagantgttacaaactgcttcccattatgccatgggagca

SEQ ID NO: 34039 - DNA, 71 bp, chicken (Gallus Gallus)
  misc_feature (36): n=a or g
tatcgcaattcaccctctattaggaaagagcaaacnctggctttgattgtgatatgtttctgctttatcca

SEQ ID NO: 34040 - DNA, 71 bp, chicken (Gallus Gallus)
  misc_feature (36): n=c or t
gccaattaaaaggccaaggaattttaaaaacagtcntaacagagaaaatatgcctttaagctcaactgatg

SEQ ID NO: 34041 - DNA, 71 bp, chicken (Gallus Gallus)
  misc_feature (36): n=a or g
cccagtgtttgctctgaggcctgccccaactgccancaccgcagcgctttatcttcattggccttgaacct

SEQ ID NO: 34042 - DNA, 71 bp, chicken (Gallus Gallus)
  misc_feature (36): n=a or g
tcataaatcatcgtaagatgctgttcagattagctntgctcctgctgggtcttcctgtccggcaatacaac

SEQ ID NO: 34043 - DNA, 71 bp, chicken (Gallus Gallus)
  misc_feature (36): n=g or t
catccaaccaaaagtaacttctaagacaaatgttantctgtgatttaaaaaaagcaacaaatagatgtgtt

SEQ ID NO: 34044 - DNA, 71 bp, chicken (Gallus Gallus)
  misc_feature (36): n=c or t
ggttgggtcattctagatgtgttttgcctccatgcnacccttgtttttgtaggtgtcatttgcttcaggag

SEQ ID NO: 34045 - DNA, 71 bp, chicken (Gallus Gallus)
  misc_feature (36): n=g or t
acatgatgatgagtggataatgggtggatatgtganttttatcaaggaattagatacatgtgccactgcag

SEQ ID NO: 34046 - DNA, 71 bp, chicken (Gallus Gallus)
  misc_feature (36): n=g or t
cagctcccaaggctcccagtacacagctgaacagtntgttgcttttgtttacacttctgaaagcagttatg

SEQ ID NO: 34047 - DNA, 71 bp, chicken (Gallus Gallus)
  misc_feature (36): n=c or t
agagacctcgagcggtgccagagtcctggggaatcngtgttgtttgccctttgcacttaaagattttgtgc

SEQ ID NO: 34048 - DNA, 71 bp, chicken (Gallus Gallus)
  misc_feature (36): n=a or g
agggagcaggaggtgtgcagcatctccatggcaagnctgagggcactcgtggcaaagagcagctgggaggg

SEQ ID NO: 34049 - DNA, 71 bp, chicken (Gallus Gallus)
  misc_feature (36): n=a or g
ctacatggacttcaattttccagggttcctgagatntctatataaatgtcaggagattaatgtgctatctc

SEQ ID NO: 34050 - DNA, 71 bp, chicken (Gallus Gallus)
  misc_feature (36): n=a or g
aatccaagttatggtttgtaagtaaatgatagaaantactgtccttttctacctgatgaaaacactaacat

SEQ ID NO: 34051 - DNA, 71 bp, chicken (Gallus Gallus)
  misc_feature (36): n=a or g
aagcagaagcagtcccactcatttccattgggcacncttccagttgaagcagagcagttccacggggctca

SEQ ID NO: 34052 - DNA, 71 bp, chicken (Gallus Gallus)
  misc_feature (36): n=c or t
gggcaggctcttaccaagtgcttaatgaggcagttnaagagtgggaaatgcctccttgtcagtcccagccg

SEQ ID NO: 34053 - DNA, 71 bp, chicken (Gallus Gallus)
  misc_feature (36): n=c or t
cacagcacatttcaaccaaaaaatgcagaccttgantccgccagttcatcccaaggtaaatgtagataaac

SEQ ID NO: 34054 - DNA, 71 bp, chicken (Gallus Gallus)
  misc_feature (36): n=c or t
aataatggtactcttatgttgcctattcaatatagnatgttttaatctcaacctgacaaatttacacttca

SEQ ID NO: 34055 - DNA, 71 bp, chicken (Gallus Gallus)
  misc_feature (36): n=c or t
tagagttatttcaccatagctatatccaacctacanaaaaaatacacggtagtgttcttgtgtcagttaca

SEQ ID NO: 34056 - DNA, 71 bp, chicken (Gallus Gallus)
  misc_feature (36): n=a or g
tggtagaatgctactatgctaatggagcttagtacngaatacttcataaacaggagttaattaagctcttc

SEQ ID NO: 34057 - DNA, 71 bp, chicken (Gallus Gallus)
  misc_feature (36): n=a or g
tgtctgtgggacttcttgtgctccactgattcatcngttgggagaacctggtccaacgcaaaacacgtgtt

SEQ ID NO: 34058 - DNA, 71 bp, chicken (Gallus Gallus)
  misc_feature (36): n=a or g
agtactcctacccccgcctttttaaaagcaaaaatnaatattctgctgctcaggtcagttaattaccatct

SEQ ID NO: 34059 - DNA, 71 bp, chicken (Gallus Gallus)
  misc_feature (36): n=c or t
acactacaatctttcacttctggaaatgagtttcanttccctacaggaatgggaagtgagagaaacttgaa

SEQ ID NO: 34060 - DNA, 71 bp, chicken (Gallus Gallus)
  misc_feature (36): n=c or t
aagtgtgcggctacaacaacagagaggattattccngctccccaaagccctccagttcttttcctcagcaa

SEQ ID NO: 34061 - DNA, 71 bp, chicken (Gallus Gallus)
  misc_feature (36): n=a or g
tgacctaatgcagaaactttaaccagataaatctcnatacagtaagcatgggaatgaacttttacatctcg

SEQ ID NO: 34062 - DNA, 71 bp, chicken (Gallus Gallus)
  misc_feature (36): n=c or t
gcagcatgctttcagggtttcaggaaccaacaacancagaatgcaaatgggcctgtagaagttgctgcggt

SEQ ID NO: 34063 - DNA, 71 bp, chicken (Gallus Gallus)
  misc_feature (36): n=c or t
ttaattctgaatgctcttctgccacgacagcagacngaagtacaagggaaaatatgaaggtgcggagatat

SEQ ID NO: 34064 - DNA, 71 bp, chicken (Gallus Gallus)
  misc_feature (36): n=g or t
tctgcttctgatgagaaaattcatttggaggggtgngctatttatacatacttccaaatggtgtgtttttt

SEQ ID NO: 34065 - DNA, 71 bp, chicken (Gallus Gallus)
  misc_feature (36): n=a or g
gtttgcatgatttgaagtgaattatcagtttttaanaggaagccctagaggagtggcattgcttggaaata

SEQ ID NO: 34066 - DNA, 71 bp, chicken (Gallus Gallus)
  misc_feature (36): n=a or g
cagacttgtgtagggacctaatgtgacttgctttgncaaaattgtgttttacagtctcatttcttgtttat

SEQ ID NO: 34067 - DNA, 71 bp, chicken (Gallus Gallus)
  misc_feature (36): n=a or c
ttctcagcaggagatttgctggtctagttgtgatcntgctggaagtctccctagtgtaactaactccttgt

SEQ ID NO: 34068 - DNA, 71 bp, chicken (Gallus Gallus)
  misc_feature (36): n=a or c
aatgtatgcaactctttctgctgtatctttatgctnttgtttttattttggttgtggagacaaggaaacgg

SEQ ID NO: 34069 - DNA, 71 bp, chicken (Gallus Gallus)
  misc_feature (36): n=a or g
ggagtgctgtggtaacgtgtgttagttccatttaanctattatcacattcctctgttagttgctatattcg

SEQ ID NO: 34070 - DNA, 71 bp, chicken (Gallus Gallus)
  misc_feature (36): n=c or t
atttcccagcctcttctatgctgcgcttctgtgctngatgattctcattacctgccctggttgatggattg

SEQ ID NO: 34071 - DNA, 71 bp, chicken (Gallus Gallus)
  misc_feature (36): n=c or t
tgaccatgtatgttctgtatgcagatggagaaatcntgaaggtaagtgcttgtttcgtctttgcgttttga

SEQ ID NO: 34072 - DNA, 71 bp, chicken (Gallus Gallus)
  misc_feature (36): n=a or g
attgtcattgcattatcatctcttcccacattaaangaatgaaaaaattcaaatgcacatggctgggtatg

SEQ ID NO: 34073 - DNA, 71 bp, chicken (Gallus Gallus)
  misc_feature (36): n=g or t
agcaatgagagtatgtatgcattagaaatatttctntatctgtgtcatttgtgactccagaagggctgagg

SEQ ID NO: 34074 - DNA, 71 bp, chicken (Gallus Gallus)
  misc_feature (36): n=a or g
atttggagatgattcaaagctgaagttgtggtaggnaattacagctgcagatgtttggttctaatgctcag

SEQ ID NO: 34075 - DNA, 71 bp, chicken (Gallus Gallus)
  misc_feature (36): n=a or g
cagagccatcatgccagaaagtcacccttaagtggntgtgcctcagctggcacaggaggtctgaatcttcc

SEQ ID NO: 34076 - DNA, 71 bp, chicken (Gallus Gallus)
  misc_feature (36): n=a or g
caaggagcctgggctgttatctataagtattttggnatcagattcattgatcagctctggagcaaatcaga

SEQ ID NO: 34077 - DNA, 71 bp, chicken (Gallus Gallus)
  misc_feature (36): n=g or t
aagcacactggccttctgcacccaaacccgaggtgngcaacatacagctgaggaagacttcacattgtact

SEQ ID NO: 34078 - DNA, 71 bp, chicken (Gallus Gallus)
  misc_feature (36): n=c or t
gctttttctgttcagataatatatatccacacaaantgctaagcctaataagaaccatgcccccctttcac

SEQ ID NO: 34079 - DNA, 71 bp, chicken (Gallus Gallus)
  misc_feature (36): n=c or t
tgtccgtaccagatgttgtgctacaggaggcagtcnggtcaccagatggcactccaggatcaccacaccag

SEQ ID NO: 34080 - DNA, 71 bp, chicken (Gallus Gallus)
  misc_feature (36): n=a or g
aaacaacgtgagcttttgcaaaagaatattcaaggnaaaactgctaataaatgtaaatacagaattaaatt

SEQ ID NO: 34081 - DNA, 71 bp, chicken (Gallus Gallus)
  misc_feature (36): n=c or t
cgcatctctgctctttgatttgcaaaatgggattcntaatagttccaccctaaggcttcagctacatcata

SEQ ID NO: 34082 - DNA, 71 bp, chicken (Gallus Gallus)
  misc_feature (36): n=c or t
agctggccagccatggaacagaagaactggcacttncaattaggactgacatctttggggcacctccagcc

SEQ ID NO: 34083 - DNA, 71 bp, chicken (Gallus Gallus)
  misc_feature (36): n=c or t
ctgtgtacgattaagatgccccacagtaggcctgtntaggttaaaggtgatgacacctaacaaacgatgca

SEQ ID NO: 34084 - DNA, 71 bp, chicken (Gallus Gallus)
  misc_feature (36): n=a or g
gagcggataaatcacaaagcagcttccagcattcgnggctttgccagccagcacctgcacccggcccctgc

SEQ ID NO: 34085 - DNA, 71 bp, chicken (Gallus Gallus)
  misc_feature (36): n=a or g
aaggggtaggcagacccacgttagcacccagcaacnactagcatagggctgcaccaggcagcatcacccca

SEQ ID NO: 34086 - DNA, 71 bp, chicken (Gallus Gallus)
  misc_feature (36): n=c or t
ctacccgacacgggcttcttggagaaaactgagttnctgatgaatgctggcaggaatcctttaagagtctc

SEQ ID NO: 34087 - DNA, 71 bp, chicken (Gallus Gallus)
  misc_feature (36): n=a or c
gtccaatggcattgtttccccatctaataatttgantattacatctaaacagtttgcagttgacaagggat

SEQ ID NO: 34088 - DNA, 71 bp, chicken (Gallus Gallus)
  misc_feature (36): n=a or g
ggaaagatgggtgagtgcagcaagtgacctttggantaacttcagagggccatggggctgtgttctggcag

SEQ ID NO: 34089 - DNA, 71 bp, chicken (Gallus Gallus)
  misc_feature (36): n=a or c
gtcctctgcgtgctcaacatggtcactgctgaacanggcctcctggggttggtctgcagagacaaggaggt

SEQ ID NO: 34090 - DNA, 71 bp, chicken (Gallus Gallus)
  misc_feature (36): n=c or t
aactaagatttcttcaagtttcatggtataaacatnagagcacttccttcctgcttgggaatacacttaac

SEQ ID NO: 34091 - DNA, 71 bp, chicken (Gallus Gallus)
  misc_feature (36): n=a or g
cagttttttgaccagattacaacctttcagatctcnacccaggcagaaagcacgtggttcggttctcctca

SEQ ID NO: 34092 - DNA, 71 bp, chicken (Gallus Gallus)
  misc_feature (36): n=c or t
aggtcaccaaaggtgacttttagcgtgccttctatngctgcagtagcacacaaaggagcagcacacatcac

SEQ ID NO: 34093 - DNA, 71 bp, chicken (Gallus Gallus)
  misc_feature (36): n=c or t
catacatttgcactgcgcctaccaaccccttacccncaagattacactctatataaatcaaaggttctaat

SEQ ID NO: 34094 - DNA, 71 bp, chicken (Gallus Gallus)
  misc_feature (36): n=a or g
agcaaatattgataactgtgattgaagtgcttgacntggaaagaaaacagtacatgaccatctaaaaactt

SEQ ID NO: 34095 - DNA, 71 bp, chicken (Gallus Gallus)
  misc_feature (36): n=a or c
aaattccatcacctgcacacagaaagaaggtgcaanataacacaaatgataataaggcattctgcaagatt

SEQ ID NO: 34096 - DNA, 71 bp, chicken (Gallus Gallus)
  misc_feature (36): n=c or t
aaccgtttccattcggaatttgcttatctgaagggncatctccagccctacatcctggtggcagctgagac

SEQ ID NO: 34097 - DNA, 71 bp, chicken (Gallus Gallus)
  misc_feature (36): n=c or t
gcggccatccctccgtggggacggtgctttattcantctggtctccacagtcacccggaacgcccaggacg

SEQ ID NO: 34098 - DNA, 71 bp, chicken (Gallus Gallus)
  misc_feature (36): n=a or g
cagccctctgcagcgccgtacacgcgaggggcgcgnggcggacctgattgaagccctcgattgactcggcc

SEQ ID NO: 34099 - DNA, 71 bp, chicken (Gallus Gallus)
  misc_feature (36): n=c or t
attagaaattgcagatgtacagtaaggggctggcanggggagggttacacaactttatggtcagctgtcct

SEQ ID NO: 34100 - DNA, 71 bp, chicken (Gallus Gallus)
  misc_feature (36): n=c or t
tctgaggtctttccccaaatcagaagctgagtgttngatgtgatctggaaccgtccttgctgtgtaggagc

SEQ ID NO: 34101 - DNA, 71 bp, chicken (Gallus Gallus)
  misc_feature (36): n=a or g
aaaaatacagagatctgtgacaagctgatgagccancacagcatctatgtccaagcaatcaactaccccac

SEQ ID NO: 34102 - DNA, 71 bp, chicken (Gallus Gallus)
  misc_feature (36): n=a or g
aggaagggaaaggaggagaaccgggctgccaaagcntaaatcaaagcacttcaaaacggggcttaccttcc

SEQ ID NO: 34103 - DNA, 71 bp, chicken (Gallus Gallus)
  misc_feature (36): n=a or g
gaccctcaaagttcccaatgatgctcactcatcctngctccttggggccattatgctataggggctatgtt

SEQ ID NO: 34104 - DNA, 71 bp, chicken (Gallus Gallus)
  misc_feature (36): n=a or c
taaaacgtgctacagatcccaaagagctgtatgttncaaaccactgcagaatatggctgcttacagaaaca

SEQ ID NO: 34105 - DNA, 71 bp, chicken (Gallus Gallus)
  misc_feature (36): n=c or t
gtacttggtgtgctgcctcatgtatctaccttacangtgaggtgcagtaaaagtttgatagaggcctacct

SEQ ID NO: 34106 - DNA, 71 bp, chicken (Gallus Gallus)
  misc_feature (36): n=c or t
agcctctttgccagcagtctgtgtgttaggagcttncatggtgttgttttccaactggccggaaaacagtc

SEQ ID NO: 34107 - DNA, 71 bp, chicken (Gallus Gallus)
  misc_feature (36): n=g or t
ggagacaagagctgcccctcaccgtgggtcaagacnttgctaagcttcactcacgctctcaccaccccagt

SEQ ID NO: 34108 - DNA, 71 bp, chicken (Gallus Gallus)
  misc_feature (36): n=c or t
tcttaagcacttttcttctgtctccgtttttaggcngttttgaacgcggtttggaaggaacgaggctttgg

SEQ ID NO: 34109 - DNA, 71 bp, chicken (Gallus Gallus)
  misc_feature (36): n=c or t
aaccctggatatgcaggacgtactgaattacctganaacctgaaggtaatgagagcagagagcacagacag

SEQ ID NO: 34110 - DNA, 71 bp, chicken (Gallus Gallus)
  misc_feature (36): n=a or g
ggcaatcagaacctgacagctacctgatgcttttanattagttcccattcttatggatctgcatttctctg

SEQ ID NO: 34111 - DNA, 71 bp, chicken (Gallus Gallus)
  misc_feature (36): n=c or t
ggagaagtgttccgtgcacgcttgaggcagtttccntctcttgtgaactgctgtaccattgactggtttaa

SEQ ID NO: 34112 - DNA, 71 bp, chicken (Gallus Gallus)
  misc_feature (36): n=c or t
gggcctggaagagcttgtcctggagggacacagagncgagggatggccagggaggggcacacggggttggc

SEQ ID NO: 34113 - DNA, 71 bp, chicken (Gallus Gallus)
  misc_feature (36): n=a or c
ggatgtcccagtcccacaggctcagcagtgaggcantgccactcaccctgagggccacctcctgcccggct

SEQ ID NO: 34114 - DNA, 71 bp, chicken (Gallus Gallus)
  misc_feature (36): n=a or g
gactaattttaggcggctccggaggggctattttgnaccctttgcctctgtgtgagtcacctgctatttgc

SEQ ID NO: 34115 - DNA, 71 bp, chicken (Gallus Gallus)
  misc_feature (36): n=a or g
gcacttgcagttgccaggcaaaactgtactcttctnctgcaccttatttggtttttcagtgccaaagctgc

SEQ ID NO: 34116 - DNA, 71 bp, chicken (Gallus Gallus)
  misc_feature (36): n=a or g
gcaccgaatgcacatttttcaggtcttttgaaaacnctcggttttctcgttccttatgcaactgtaaggac

SEQ ID NO: 34117 - DNA, 71 bp, chicken (Gallus Gallus)
  misc_feature (36): n=c or t
ctttatcctacttttgaaaatgctcccagaaatgcngagcagttctctccagaaaagcaatctgtaacatt

SEQ ID NO: 34118 - DNA, 71 bp, chicken (Gallus Gallus)
  misc_feature (36): n=a or g
tatttgagtacaataaatttatataaacagtgcccnccagaattagaagttaacaaagacttagaaagtgg

SEQ ID NO: 34119 - DNA, 71 bp, chicken (Gallus Gallus)
  misc_feature (36): n=c or t
tcattcaactttctaagtatgcagttctcatattgngtgcatctgatttgctcccctcattaccaagcatc

SEQ ID NO: 34120 - DNA, 71 bp, chicken (Gallus Gallus)
  misc_feature (36): n=g or t
ctcttgaaaagcagaaaaacgtagatgcttattttntcactgattatgaagatctgacacctaacagctga

SEQ ID NO: 34121 - DNA, 71 bp, chicken (Gallus Gallus)
  misc_feature (36): n=g or t
catttttaacaatttacatactttaaatctgttttnaaaactggtcattttgatgagtgaccaattttatg

SEQ ID NO: 34122 - DNA, 71 bp, chicken (Gallus Gallus)
  misc_feature (36): n=c or t
tcctaatgcagttattttatcatagccttacagtangtgttaaaatcaggctctgagtccatagcaggcat

SEQ ID NO: 34123 - DNA, 71 bp, chicken (Gallus Gallus)
  misc_feature (36): n=a or g
gcaatccagagatttacaatggttaactgccaggcntagtgcatcttaaagacataatgatatcttactta

SEQ ID NO: 34124 - DNA, 71 bp, chicken (Gallus Gallus)
  misc_feature (36): n=c or t
catttctttctgatgctgttgtgactacccatagcnttcctgcattcttaagagttctgttttgctgtata

SEQ ID NO: 34125 - DNA, 71 bp, chicken (Gallus Gallus)
  misc_feature (36): n=a or g
acactaaaatccagctggtcaggcatttcatcatgnatagatgtgtctgcatcaagttttagtagtgtttt

SEQ ID NO: 34126 - DNA, 71 bp, chicken (Gallus Gallus)
  misc_feature (36): n=c or t
ttaacgtttgtctttattcactgtttcaaatgctangtgccaaatcttgcttgatacatataacatactac

SEQ ID NO: 34127 - DNA, 71 bp, chicken (Gallus Gallus)
  misc_feature (36): n=a or g
gtgattcctcagaaagtgccgaactcattgtcatgnggcagagtgctatagtttatatggtttaaaaaatt

SEQ ID NO: 34128 - DNA, 71 bp, chicken (Gallus Gallus)
  misc_feature (36): n=c or t
agctgaactgtctcaaaggagattacgtatttgaantgaacaaatacaacttcataaataaactaaattaa

SEQ ID NO: 34129 - DNA, 71 bp, chicken (Gallus Gallus)
  misc_feature (36): n=a or c
cttttccaaaacgtctttttgattctccgaacagantgtgtggagagcatttagcaaaaacgttgtattat

SEQ ID NO: 34130 - DNA, 71 bp, chicken (Gallus Gallus)
  misc_feature (36): n=c or t
attggctgtgcaaaggtgagttctgtttccttccangagttgttcccacaggatagcttgggctattgctc

SEQ ID NO: 34131 - DNA, 71 bp, chicken (Gallus Gallus)
  misc_feature (36): n=c or t
gttgtgaaggagttggtacgaggtgtaaaaggcacnatgaagaagaataggtattaaaaaataaagctgga

SEQ ID NO: 34132 - DNA, 71 bp, chicken (Gallus Gallus)
  misc_feature (36): n=a or c
gctggtagcaacttgcataaatttgtggacatcccnccttaccatgaattcggacaaaacattttgtgtga

SEQ ID NO: 34133 - DNA, 71 bp, chicken (Gallus Gallus)
  misc_feature (36): n=c or t
cagcaatcccaaactcaggcggtgttcccgtgtgantttttagaagccccagtgacatctctgtcaggttt

SEQ ID NO: 34134 - DNA, 71 bp, chicken (Gallus Gallus)
  misc_feature (36): n=c or t
ccaaatgaattattgctactgagatcattgttaagntaaagaaaatatctctctccttcctcaaagctaaa

SEQ ID NO: 34135 - DNA, 71 bp, chicken (Gallus Gallus)
  misc_feature (36): n=c or t
ccaaagcttcgagtacttgctcggtcatctcccacngacaaacatactttggtcaaaggtgagtgagacca

SEQ ID NO: 34136 - DNA, 71 bp, chicken (Gallus Gallus)
  misc_feature (36): n=a or g
taaaaaaaagtgctaatagcaacatggtaagagtancagaattgatctgaggggactgattccttttgagc

SEQ ID NO: 34137 - DNA, 71 bp, chicken (Gallus Gallus)
  misc_feature (36): n=a or g
gaggtccatcaggtattttttcaaatcttatctcanttttactattacgcataatggattgcaccctgcct

SEQ ID NO: 34138 - DNA, 71 bp, chicken (Gallus Gallus)
  misc_feature (36): n=c or t
atagcacatttgttagccctttgctctaacactttntcctcaccctgctgttcttgtaacccactgaaacc

SEQ ID NO: 34139 - DNA, 71 bp, chicken (Gallus Gallus)
  misc_feature (36): n=c or t
ttctggatttaaaatagtaagggcttaagcatccantggatactgaaatgtatgcattggctactctggat

SEQ ID NO: 34140 - DNA, 71 bp, chicken (Gallus Gallus)
  misc_feature (36): n=c or t
caattctatgaattcaagaaattctatgaatacttnttctcttcttgtaagagagtcagaccacaggctaa

SEQ ID NO: 34141 - DNA, 71 bp, chicken (Gallus Gallus)
  misc_feature (36): n=c or t
tttctctgcatttagaaatatgatactggatttttntactgcataaaaataatgccttaatggaaaactaa

SEQ ID NO: 34142 - DNA, 71 bp, chicken (Gallus Gallus)
  misc_feature (36): n=c or t
acgcttccctggtttgcataacaacataaagcctcntcagttcctgagattttaaacttactcataggaaa

SEQ ID NO: 34143 - DNA, 71 bp, chicken (Gallus Gallus)
  misc_feature (36): n=a or g
acctgtctgtactgcagtaagaagtttccaagggantgggagtggtatgacctattctaatggctattaac

SEQ ID NO: 34144 - DNA, 71 bp, chicken (Gallus Gallus)
  misc_feature (36): n=a or c
ttgaaggtgttaaaaggcagttccagaaaggttttngtctgccattgtatggatgaggtgccattcactat

SEQ ID NO: 34145 - DNA, 71 bp, chicken (Gallus Gallus)
  misc_feature (36): n=g or t
ctagatagtcaggtatgaaataaacatacttcaaanattttgtcagagttccttgtatgtgtgtgtcatca

SEQ ID NO: 34146 - DNA, 71 bp, chicken (Gallus Gallus)
  misc_feature (36): n=g or t
aggaaattccatctgctttgcaccagccaaccggangtactgacgatggtttcagctgacttagtctgggc

SEQ ID NO: 34147 - DNA, 71 bp, chicken (Gallus Gallus)
  misc_feature (36): n=a or g
atatggtctctgttatgaaggaatttgaagaaaganaaacacatagtataatatgaaaacaaattgtttgt

SEQ ID NO: 34148 - DNA, 71 bp, chicken (Gallus Gallus)
  misc_feature (36): n=a or g
agcaaccttcctcacctgtgcatcagcttatgcctngagtattattctaatgcctgttgctaagacttgtt

SEQ ID NO: 34149 - DNA, 71 bp, chicken (Gallus Gallus)
  misc_feature (36): n=c or t
cctgcagaaaaaaatcttatgtgtattaaatatcantattggtgtgtagcactacctcctgtgagcctccc

SEQ ID NO: 34150 - DNA, 71 bp, chicken (Gallus Gallus)
  misc_feature (36): n=c or t
aagctcagtcaaaccatgcaaattcacaaacgtaanggtcctctcttcatgagaccacagagggcgagtga

SEQ ID NO: 34151 - DNA, 71 bp, chicken (Gallus Gallus)
  misc_feature (36): n=c or t
gtgtgcaacaccttcaaagagataagttcccagtcnggattcccatttgtagcatacaagtgaccttggaa

SEQ ID NO: 34152 - DNA, 71 bp, chicken (Gallus Gallus)
  misc_feature (36): n=a or g
agatctggaatctgctcacttggacacatgactcanatttcattcttgatgatcatcagcacagagcacca

SEQ ID NO: 34153 - DNA, 71 bp, chicken (Gallus Gallus)
  misc_feature (36): n=a or c
gtatttaactcttgagtttagccttccacccacagnataaaattatggctcacacttactgtatcaagttc

SEQ ID NO: 34154 - DNA, 71 bp, chicken (Gallus Gallus)
  misc_feature (36): n=c or t
ggggaaataaagtgatgaagaacacctcttatacanacttatggaagaagtcagcaccttgtgtggcacag

SEQ ID NO: 34155 - DNA, 71 bp, chicken (Gallus Gallus)
  misc_feature (36): n=a or g
aaccatagtctgagtctgcaataacctacctaaatncaactaccaaaataggtagctcagggtggacaacc

SEQ ID NO: 34156 - DNA, 71 bp, chicken (Gallus Gallus)
  misc_feature (36): n=g or t
tcttacaactgcttctttctcacttcagagaacttnctcaggcttcccacctcacagaattggtgttcctg

SEQ ID NO: 34157 - DNA, 71 bp, chicken (Gallus Gallus)
  misc_feature (36): n=a or g
gtaggttggtacttgcattttgtactgctgtgaacntcataaaggtttgttttagaaagcactcagacatc

SEQ ID NO: 34158 - DNA, 71 bp, chicken (Gallus Gallus)
  misc_feature (36): n=c or t
tgtatcaagaacagtttgttgttattgtgctggtantgtctctcttttccctctaaaaagctaatcaggtt

SEQ ID NO: 34159 - DNA, 71 bp, chicken (Gallus Gallus)
  misc_feature (36): n=c or t
tggaagtacttgctttattttgggcacttctatgcntaagtgcctaaattgtggagatttaggcgtgattg

SEQ ID NO: 34160 - DNA, 71 bp, chicken (Gallus Gallus)
  misc_feature (36): n=a or g
atacattaggactgcaagtgcttggttttgttcccngtaattctctttccatatgatgtgatgggcaagtt

SEQ ID NO: 34161 - DNA, 71 bp, chicken (Gallus Gallus)
  misc_feature (36): n=a or g
taatgatttcatcacaaagtcagcttaaaatatgtngaatatgaggtgtctgaaagtcagtattccagttt

SEQ ID NO: 34162 - DNA, 71 bp, chicken (Gallus Gallus)
  misc_feature (36): n=c or t
tccctttggactattaactcatagatgctactcttntattgtatatgacactgaggaaaagagctattgct

SEQ ID NO: 34163 - DNA, 71 bp, chicken (Gallus Gallus)
  misc_feature (36): n=a or g
aaaagaacaggtatgtaagtgagagcttgagcaccnagtccaaatataaagtagtataattttacaatctt

SEQ ID NO: 34164 - DNA, 71 bp, chicken (Gallus Gallus)
  misc_feature (36): n=c or t
tctttttttttttcctagtggttttgtgtgctgctntctcatgccttgttgaagagtaggagtggctggat

SEQ ID NO: 34165 - DNA, 71 bp, chicken (Gallus Gallus)
  misc_feature (36): n=c or t
ctatttctacctttttttcttcacactatcaggaanagttaaaactctcagatcctatcttagaacaggag

SEQ ID NO: 34166 - DNA, 71 bp, chicken (Gallus Gallus)
  misc_feature (36): n=c or t
tcatgctgtgctttctctgttgtaaattatttgaangctgccatccactccctcacatccttgctgttttc

SEQ ID NO: 34167 - DNA, 71 bp, chicken (Gallus Gallus)
  misc_feature (36): n=a or g
agcaagaagacagaagtctatttcagtccatacgcntgttcatgtactaagagaagtagatccttcattta

SEQ ID NO: 34168 - DNA, 71 bp, chicken (Gallus Gallus)
  misc_feature (36): n=a or g
gcacaaaaggctcaagtaggacacattctgctttanagaaagcataaggtaaaaccatgatcatttttgaa

SEQ ID NO: 34169 - DNA, 71 bp, chicken (Gallus Gallus)
  misc_feature (36): n=c or t
cacatgtatgtcccaccacccatcactggagatccnactcatctcttgtttcagccatctgagcaggggac

SEQ ID NO: 34170 - DNA, 71 bp, chicken (Gallus Gallus)
  misc_feature (36): n=c or t
ccctgcccagctctctcttgctgctctgcactgtcnctactgtagctctgtcccacatagttctttgcacc

SEQ ID NO: 34171 - DNA, 71 bp, chicken (Gallus Gallus)
  misc_feature (36): n=c or t
aaaggagtgcaagtcaggacttgttattataagcanttttacctggaaaccttcaccttcaacaattccaa

SEQ ID NO: 34172 - DNA, 71 bp, chicken (Gallus Gallus)
  misc_feature (36): n=c or t
ccaggaagtcctctggtgcacatacattgatttccnatgtttctaaaactccctccatctgctatgagcac

SEQ ID NO: 34173 - DNA, 71 bp, chicken (Gallus Gallus)
  misc_feature (36): n=a or g
tgaggaagcattctcatctcacacagattaggcaangctttgctgaaaattgaggagaattctgaatcatt

SEQ ID NO: 34174 - DNA, 71 bp, chicken (Gallus Gallus)
  misc_feature (36): n=a or g
gtgaatttttatgcactgtagtgattaggccagcantaacagctaagggtggaatttaactgctttgcctg

SEQ ID NO: 34175 - DNA, 71 bp, chicken (Gallus Gallus)
  misc_feature (36): n=c or t
ccagctaatgccaagtggcagatatggagcagaatnccatgggtactgtgatagtattaaatccatcctga

SEQ ID NO: 34176 - DNA, 71 bp, chicken (Gallus Gallus)
  misc_feature (36): n=c or t
taaacttctcctcatgtactgtgaatgagagataangaaactttaccaaaggagcttgattttgggaagtg

SEQ ID NO: 34177 - DNA, 71 bp, chicken (Gallus Gallus)
  misc_feature (36): n=a or c
caaaattcttatttattcttagttatgctagagccncaagatgtgcctggaaaggtgtaattagcagagtg

SEQ ID NO: 34178 - DNA, 71 bp, chicken (Gallus Gallus)
  misc_feature (36): n=a or g
ttcaaattaatgcagacagatttgcaaaatgatacnaggcattgcatcttaagtaaggcttagacaatctt

SEQ ID NO: 34179 - DNA, 71 bp, chicken (Gallus Gallus)
  misc_feature (36): n=a or g
cagctcgatacagcccaaagctggcacaatgggtgnggattgtactcggggtgccaacagcagcactttga

SEQ ID NO: 34180 - DNA, 71 bp, chicken (Gallus Gallus)
  misc_feature (36): n=c or t
ctgagttcactgaggttattttggtctttggattantgagatgcttgacttgtttttcgctttgcagagtc

SEQ ID NO: 34181 - DNA, 71 bp, chicken (Gallus Gallus)
  misc_feature (36): n=c or t
catcactagtaatctttactacattaggaattaaanggataacaatcagaagtaacctgctttcttccatt

SEQ ID NO: 34182 - DNA, 71 bp, chicken (Gallus Gallus)
  misc_feature (36): n=g or t
aataaacagttcataaatttttaaaaccacacattngtctgtttctcagagttgtgaagaaataagtgata

SEQ ID NO: 34183 - DNA, 71 bp, chicken (Gallus Gallus)
  misc_feature (36): n=c or t
ttgtaatgaattatgagagtagcatgcacaatccancataaaagtaatagtaacacattaaccaaagttgt

SEQ ID NO: 34184 - DNA, 71 bp, chicken (Gallus Gallus)
  misc_feature (36): n=a or g
ctcatctgaaactaagaacttttccataggaaaatnagactatacctcgcagacacagcactaacaccaca

SEQ ID NO: 34185 - DNA, 71 bp, chicken (Gallus Gallus)
  misc_feature (36): n=c or t
caaaggactgtaaatgcaagtaatggcatttcaatnacacttactgtatcagctcaaaactaattcagaaa

SEQ ID NO: 34186 - DNA, 71 bp, chicken (Gallus Gallus)
  misc_feature (36): n=c or t
ccgttctatgattctatatgacctttatatccctgnactgcgtagcatgtgaaggcttgatagccttgagg

SEQ ID NO: 34187 - DNA, 71 bp, chicken (Gallus Gallus)
  misc_feature (36): n=c or t
caagtgaaaaacctatctaagctttgaagaaatgcnaggtattatgtgaaaagttttaaaacagagacatg

SEQ ID NO: 34188 - DNA, 71 bp, chicken (Gallus Gallus)
  misc_feature (36): n=c or t
accactgaggattagtgcagagaaaggactgcctcntgctttgagcttttttgggggctagaagttgatga

SEQ ID NO: 34189 - DNA, 71 bp, chicken (Gallus Gallus)
  misc_feature (36): n=c or t
actgtgaagaagaaaacattccaaggaaaggcagcntcattttcatttgtcaactttcgtgcttgactctg

SEQ ID NO: 34190 - DNA, 71 bp, chicken (Gallus Gallus)
  misc_feature (36): n=c or t
tctcagtgcctggctaaataacctcaggtattttgngtctgaagttatctttatgggaaaaatgagcccct

SEQ ID NO: 34191 - DNA, 71 bp, chicken (Gallus Gallus)
  misc_feature (36): n=a or g
ataacaagaatgcttatcaggatgtttcgcaacgcntatctgaagtagactgtttaccatttggtgttgtc

SEQ ID NO: 34192 - DNA, 71 bp, chicken (Gallus Gallus)
  misc_feature (36): n=a or g
acacttatgatcttgtgccatgctacagtgcttagnaatagtggacgtgaaggctatcatgctattttttg

SEQ ID NO: 34193 - DNA, 71 bp, chicken (Gallus Gallus)
  misc_feature (36): n=a or g
taaagtgatgataaagcagcattctagggatctggncatcactgttctcacttgcaagtggataacaatgt

SEQ ID NO: 34194 - DNA, 71 bp, chicken (Gallus Gallus)
  misc_feature (36): n=c or t
cttaatatttttggatgaagcaaatattgtgacccngtgatttaaggatctatgaataccagagcttcctc

SEQ ID NO: 34195 - DNA, 71 bp, chicken (Gallus Gallus)
  misc_feature (36): n=c or t
tttcttgatgcctcagttttaaacaagagcaaccancaaataggctccccagcattaaagcataatgaagg

SEQ ID NO: 34196 - DNA, 71 bp, chicken (Gallus Gallus)
  misc_feature (36): n=a or g
atgagcaatagagatgctgggactgccatttgggangcttgttattcaaagttggatatatcagtgagctt

SEQ ID NO: 34197 - DNA, 71 bp, chicken (Gallus Gallus)
  misc_feature (36): n=a or c
attgtaggtggggtgacaaattctaccttggtaccngccccgccagacagctaaatggtaattatgaggat

SEQ ID NO: 34198 - DNA, 71 bp, chicken (Gallus Gallus)
  misc_feature (36): n=a or g
tgctgttgatgtagtcatggttcttcagtgctcatnacatgaccttacacgttatagagaacaccaataat

SEQ ID NO: 34199 - DNA, 71 bp, chicken (Gallus Gallus)
  misc_feature (36): n=a or g
atgaagatgttatccatacctctcagtaaggcaatntacattttcaggaaataaagctcccagtatataat

SEQ ID NO: 34200 - DNA, 71 bp, chicken (Gallus Gallus)
  misc_feature (36): n=c or t
taaagatgccaacttctgtacttaaacatccagtanggtagaacacatcctgcaagtccaactattagaaa

SEQ ID NO: 34201 - DNA, 71 bp, chicken (Gallus Gallus)
  misc_feature (36): n=c or t
caatcatacaccaatcaaaccaccattacattttcntagagatatctgtctaaagaaaatcatgtaagctc

SEQ ID NO: 34202 - DNA, 71 bp, chicken (Gallus Gallus)
  misc_feature (36): n=c or t
ttaagtaccaggaggcttggggtcatttcaataacnggtcctaatgcaaatgaatactagtgccttttggc

SEQ ID NO: 34203 - DNA, 71 bp, chicken (Gallus Gallus)
  misc_feature (36): n=g or t
ctagaaaaattccttgtgttaaccttgattgcaacnttataatttcctgttgtaactggaccaagtctgga

SEQ ID NO: 34204 - DNA, 71 bp, chicken (Gallus Gallus)
  misc_feature (36): n=a or g
aaataccaagcctgcagagaagaggaatagcaatancatgcatggatggaagagagttctgttgtaaaagc

SEQ ID NO: 34205 - DNA, 71 bp, chicken (Gallus Gallus)
  misc_feature (36): n=a or c
gcagcaaactgcatcactcccttagcagcgaacggnatttacataaacgatgatgcaaagccttatctcat

SEQ ID NO: 34206 - DNA, 71 bp, chicken (Gallus Gallus)
  misc_feature (36): n=c or t
actgatgtgacttacagtccccttcttagcaaggangtcttgagaacagagctgaagaggaaaactcatca

SEQ ID NO: 34207 - DNA, 71 bp, chicken (Gallus Gallus)
  misc_feature (36): n=a or g
cattgaccccacgctgtcaggtaccattcagcaggnccactgtgtgtgtttgaagtgaggcagtttctcca

SEQ ID NO: 34208 - DNA, 71 bp, chicken (Gallus Gallus)
  misc_feature (36): n=a or g
acggtggcatttttgccattctaagaattaaccacngtgaaatattcagaatacataatactgagtgaaat

SEQ ID NO: 34209 - DNA, 71 bp, chicken (Gallus Gallus)
  misc_feature (36): n=a or g
ctgcagctcaagaaatcactattttatccccagaanttccttctagggttaatacagttgaactgacaaaa

SEQ ID NO: 34210 - DNA, 71 bp, chicken (Gallus Gallus)
  misc_feature (36): n=g or t
acctgcagggtaactccatgaggctgaatccacctntcccagatttaagtcctgctgtttggatcttagaa

SEQ ID NO: 34211 - DNA, 71 bp, chicken (Gallus Gallus)
  misc_feature (36): n=a or g
gttcttaactccgtgatgtggtgtgaaagttccccnttcatgggtgtgaaaatgcattcagacttgatgct

SEQ ID NO: 34212 - DNA, 71 bp, chicken (Gallus Gallus)
  misc_feature (36): n=c or t
ctgggcactgggatctggcagcgaaggaacaagagncaatgctcctgtaacattttctgtatggcagctag

SEQ ID NO: 34213 - DNA, 71 bp, chicken (Gallus Gallus)
  misc_feature (36): n=a or g
ctttatatgcaaaaaaaatggtgaagtagatctccntgtggagtaccaactttgtttccacgtgtaaaatc

SEQ ID NO: 34214 - DNA, 71 bp, chicken (Gallus Gallus)
  misc_feature (36): n=c or t
gcaatgcaatataaataggaagaaaggcgtcatcantgggaatgcttctaagacgtaacatgcactatttg

SEQ ID NO: 34215 - DNA, 71 bp, chicken (Gallus Gallus)
  misc_feature (36): n=a or g
tggaacaacttcatgagcacagccaagcagcatagngattcttattctaataaagagaagaaaaagtattc

SEQ ID NO: 34216 - DNA, 71 bp, chicken (Gallus Gallus)
  misc_feature (36): n=c or t
atgactatgtgcattcacaaaacctggctttcttangccactaattttatatgaaggctcatgccaatggt

SEQ ID NO: 34217 - DNA, 71 bp, chicken (Gallus Gallus)
  misc_feature (36): n=g or t
aaagattccagtgataaaacaattgaggaatacagngtgatcagacacataccacaggtcaggaatgttgt

SEQ ID NO: 34218 - DNA, 71 bp, chicken (Gallus Gallus)
  misc_feature (36): n=a or g
aaatcgtgacaacggccagcagagtccttcaggtgncccagtgtactttgttttgggtgatattttttctt

SEQ ID NO: 34219 - DNA, 71 bp, chicken (Gallus Gallus)
  misc_feature (36): n=c or t
ttgacgactctgaggaaccagaccagtttatgttangaaaatgtttgtgtgcctgggttttgttagctggt

SEQ ID NO: 34220 - DNA, 71 bp, chicken (Gallus Gallus)
  misc_feature (36): n=c or t
agtgaaagactgcttctcttcccattctgaagccangggcacaacaattttactatttcattcatgctgat

SEQ ID NO: 34221 - DNA, 71 bp, chicken (Gallus Gallus)
  misc_feature (36): n=a or g
tatatctaacttagtacttcagctagaaactagacnactccataaggtttaagaaaatcccaagtaaataa

SEQ ID NO: 34222 - DNA, 71 bp, chicken (Gallus Gallus)
  misc_feature (36): n=a or c
gactatgtgcctagttggcctgtatcacacatgtgntggttagatggccttgagagtggaaaaacaacaag

SEQ ID NO: 34223 - DNA, 71 bp, chicken (Gallus Gallus)
  misc_feature (36): n=a or g
tcccctctctcccacttgtcccataaaaagatgttnaatgttttaaatgggtagcattgcttgctttggtg

SEQ ID NO: 34224 - DNA, 71 bp, chicken (Gallus Gallus)
  misc_feature (36): n=c or t
gtactaaaagaagcaaatgcaagtttacagctatanccttccatactaattttggtgccttctgatcttat

SEQ ID NO: 34225 - DNA, 71 bp, chicken (Gallus Gallus)
  misc_feature (36): n=c or t
tttgctcctgcagttccagaggctgaaaacttttcncattagcagcaaaagagaacaatgctgatactttc

SEQ ID NO: 34226 - DNA, 71 bp, chicken (Gallus Gallus)
  misc_feature (36): n=g or t
ggacgtgtgtggtgtgcgctgccacactgctgtccntggcccttcctgccaccacagcagagcagtgacag

SEQ ID NO: 34227 - DNA, 71 bp, chicken (Gallus Gallus)
  misc_feature (36): n=a or g
tcttttggccaaatctagtcattcctggaactggcnatgtggggtatgtaaactgctgaggactccatacc

SEQ ID NO: 34228 - DNA, 71 bp, chicken (Gallus Gallus)
  misc_feature (36): n=a or g
ggcagacttggagagggggagggtgagtgtccatanttatcctactgcagcaatgggctcatttgcttgta

SEQ ID NO: 34229 - DNA, 71 bp, chicken (Gallus Gallus)
  misc_feature (36): n=c or t
gtgtttatgcaaataagtcttcccaattccaagaanactcagtaattggaaataaataaggagtatttatt

SEQ ID NO: 34230 - DNA, 71 bp, chicken (Gallus Gallus)
  misc_feature (36): n=g or t
gctgtagcctggggaaggtctgctgtttgtgctggntctccccaccccttagagaaccagttccatcagaa

SEQ ID NO: 34231 - DNA, 71 bp, chicken (Gallus Gallus)
  misc_feature (36): n=c or t
tttaaaacgtttcttgcattcttcctccgttaccangtaggcatcttgttgcaaaacatggacatcctaaa

SEQ ID NO: 34232 - DNA, 71 bp, chicken (Gallus Gallus)
  misc_feature (36): n=c or t
cattaccaatgatacccagcctggaactgcctgtgntccatgcaagagagacaccctgatgtccacgtggt

SEQ ID NO: 34233 - DNA, 71 bp, chicken (Gallus Gallus)
  misc_feature (36): n=a or g
caatccttctgtttggtgacatccgtgacatcaacncttctctctggtcctaaaaattaatgtaatgataa

SEQ ID NO: 34234 - DNA, 71 bp, chicken (Gallus Gallus)
  misc_feature (36): n=c or t
gaaactacaaaagatatgaacagcctagtgtttggncaaccaggcttccaagaaagcaggggcaactcaaa

SEQ ID NO: 34235 - DNA, 71 bp, chicken (Gallus Gallus)
  misc_feature (36): n=c or t
atgagcagcaagaaaggccatccttaaatacaaagntcaacatcttgtcacaagtgtctccacactcattt

SEQ ID NO: 34236 - DNA, 71 bp, chicken (Gallus Gallus)
  misc_feature (36): n=c or t
ttccagctgtcctttgtttttaaggcacacagaaanaattacagttactgcttattacagccctttgagta

SEQ ID NO: 34237 - DNA, 71 bp, chicken (Gallus Gallus)
  misc_feature (36): n=g or t
cctcataaacagcggctgggggccctgatgatgggnaacatatggagctgtaacaaagggcctctgaaagc

SEQ ID NO: 34238 - DNA, 71 bp, chicken (Gallus Gallus)
  misc_feature (36): n=a or c
ctgttattcacaagcttccttctgttagcagatganaaatcaagcagcattttacttaatcagaaaagtca

SEQ ID NO: 34239 - DNA, 71 bp, chicken (Gallus Gallus)
  misc_feature (36): n=g or t
cgggaaggttttatgacatttaccaaaatctcaccncttccttctttcaataaaacataagaccagaagtg

SEQ ID NO: 34240 - DNA, 71 bp, chicken (Gallus Gallus)
  misc_feature (36): n=c or t
tcctatcacagttagaacagtggtttcctactgcangctatttactgtaatactgcagtaacgtttatatt

SEQ ID NO: 34241 - DNA, 71 bp, chicken (Gallus Gallus)
  misc_feature (36): n=a or g
tttggcaaaggaactgggaagagatgcccacacatntcctaggtacaaatgcaggcaccatcaagatttca

SEQ ID NO: 34242 - DNA, 71 bp, chicken (Gallus Gallus)
  misc_feature (36): n=a or g
tcagctgaggcttaacgcttcagcacagtcagcacnatgcaattcagatttaactctgaactgtaacagta

SEQ ID NO: 34243 - DNA, 71 bp, chicken (Gallus Gallus)
  misc_feature (36): n=c or t
gaatttgaaaaggtactcaacttctacagcagcccncgtacagctttaaaaggctccttcttcatatctgt

SEQ ID NO: 34244 - DNA, 71 bp, chicken (Gallus Gallus)
  misc_feature (36): n=a or c
gcttagtacatgcagagatgctgcctaggtatcttnatgcattctaccccagcactgtttgcaaacccaac

SEQ ID NO: 34245 - DNA, 71 bp, chicken (Gallus Gallus)
  misc_feature (36): n=a or g
tcttcaatgcattaaaataacttgtgtgcgtaagcnctttgtgggaactggacctatgtgactagatgcca

SEQ ID NO: 34246 - DNA, 71 bp, chicken (Gallus Gallus)
  misc_feature (36): n=c or t
tgtaaaaaatgagtgctatgtttactgttcagtctnggtttaacagaaagaataatatttacgtttctggt

SEQ ID NO: 34247 - DNA, 71 bp, chicken (Gallus Gallus)
  misc_feature (36): n=c or t
ttttagctgacctcagtactttataagactttattngtactagcatgatgcactaaactaaatggagaagg

SEQ ID NO: 34248 - DNA, 71 bp, chicken (Gallus Gallus)
  misc_feature (36): n=c or t
gaagctgaacatacaatggaaaagctccagctacgntagggcacgtcacatagagatattattaataaaag

SEQ ID NO: 34249 - DNA, 71 bp, chicken (Gallus Gallus)
  misc_feature (36): n=a or g
tgtttgtagtattacttatctcaaccattatccatnttttacctgtttatgagttggcggccaccacacgc

SEQ ID NO: 34250 - DNA, 71 bp, chicken (Gallus Gallus)
  misc_feature (36): n=c or t
taatctcatcaggtcacagatataaaacaatgcagnatttctaagcaaacaatatgatttttgcctgcatc

SEQ ID NO: 34251 - DNA, 71 bp, chicken (Gallus Gallus)
  misc_feature (36): n=a or g
ttgtgcatgcctttgtgcatccacagagattagatnctaattactggaggctattaggcgccttgtgatta

SEQ ID NO: 34252 - DNA, 71 bp, chicken (Gallus Gallus)
  misc_feature (36): n=a or g
tcacagcaatttgcaacctgttatttaagggcgaantgctggataaccccagcagaaggaacctgcctagc

SEQ ID NO: 34253 - DNA, 71 bp, chicken (Gallus Gallus)
  misc_feature (36): n=a or g
aaagcaaagcattaaacggctcttgagagttgaacntggtgctgttgtatacgctttcctctaagctccat

SEQ ID NO: 34254 - DNA, 71 bp, chicken (Gallus Gallus)
  misc_feature (36): n=a or c
aacggcacacgatgttacagaggacaaaaagctcantaattagtaacaatagcaaaaattagagcagcaga

SEQ ID NO: 34255 - DNA, 71 bp, chicken (Gallus Gallus)
  misc_feature (36): n=c or t
cagctggggcttgagaggaggcagaaagtatctcangctgaaagatcaaactaaggtacgtggtcagatcc

SEQ ID NO: 34256 - DNA, 71 bp, chicken (Gallus Gallus)
  misc_feature (36): n=c or t
gtcataccgcatagattccccaggcaggggctgtgntgtttcccctgtaaatggagagatgggctggaaat

SEQ ID NO: 34257 - DNA, 71 bp, chicken (Gallus Gallus)
  misc_feature (36): n=a or c
ccacattttgtaccaagtcttccctttttcaagganctggaggtagctgctgaagaggctgttttcaggtg

SEQ ID NO: 34258 - DNA, 71 bp, chicken (Gallus Gallus)
  misc_feature (36): n=c or t
cagatatccaactgatgtttgaggccctatcacacnatatttgaaaatcctctccagtcttgctttacaga

SEQ ID NO: 34259 - DNA, 71 bp, chicken (Gallus Gallus)
  misc_feature (36): n=a or g
tgcttgggtaaggctgcagggagggacctggcaatnaaatacatcagacacacctagaatggtgaaattgg

SEQ ID NO: 34260 - DNA, 71 bp, chicken (Gallus Gallus)
  misc_feature (36): n=c or t
aaacacatcgacagcgctttacttttctgccataangtgattgccaacagttgcattcttggactcttatt

SEQ ID NO: 34261 - DNA, 71 bp, chicken (Gallus Gallus)
  misc_feature (36): n=a or c
acatgaccaagcttctactttttcatcagctatacnggatcatttggagctactttacatgtcgccatgga

SEQ ID NO: 34262 - DNA, 71 bp, chicken (Gallus Gallus)
  misc_feature (36): n=a or g
gccacactgagactgccctgtgtttctccagcaacntcactgactttcttcagctccttttccagtctggc

SEQ ID NO: 34263 - DNA, 71 bp, chicken (Gallus Gallus)
  misc_feature (36): n=a or g
acaatttaaaaaacaggatccagttgtactaattcnctctggcaacttaagcctgggaaaacttgatggat

SEQ ID NO: 34264 - DNA, 71 bp, chicken (Gallus Gallus)
  misc_feature (36): n=a or g
acagcaggtaagtctttacaggaccaatgtgttaancacaattaattcaaaaacaaattaccatctaaacg

SEQ ID NO: 34265 - DNA, 71 bp, chicken (Gallus Gallus)
  misc_feature (36): n=c or t
accataaacagatcgcaaagccgtctgcctgtgccngattctcgagcttctagaactgcattgtacaagat

SEQ ID NO: 34266 - DNA, 71 bp, chicken (Gallus Gallus)
  misc_feature (36): n=a or g
catcataatttgcacagctgatattgtatctgatanttttgcttcattgatttttccatctaaataaagat

SEQ ID NO: 34267 - DNA, 71 bp, chicken (Gallus Gallus)
  misc_feature (36): n=a or g
agatgtttataccatgaaacaaatttaaaaagcttnttttagatatatgtgtacttcatccttcaagatga

SEQ ID NO: 34268 - DNA, 71 bp, chicken (Gallus Gallus)
  misc_feature (36): n=a or g
tgcctgcatctgtgcttagaagaccttgaatatgtnaatactccacagacgttccattacatttgctttcc

SEQ ID NO: 34269 - DNA, 71 bp, chicken (Gallus Gallus)
  misc_feature (36): n=c or t
ctctctagaaggcatgacttgttactctaactacanggagttttgccacaggcttctctgaagaaggatct

SEQ ID NO: 34270 - DNA, 71 bp, chicken (Gallus Gallus)
  misc_feature (36): n=g or t
aatatgtcctgcttatttatatcagactggcatttngcctctgagaactcacttggacaatgtctgcctgg

SEQ ID NO: 34271 - DNA, 71 bp, chicken (Gallus Gallus)
  misc_feature (36): n=c or t
tgcgctgaaatgccaattgtacctgccattgtgaangcaatttgaggaataacttagcaaagagctgctaa

SEQ ID NO: 34272 - DNA, 71 bp, chicken (Gallus Gallus)
  misc_feature (36): n=a or c
ccctttttacgcaaacagcttaagtttgaagaaaantaagtaagaccccaaattaaatacaacttgtgata

SEQ ID NO: 34273 - DNA, 71 bp, chicken (Gallus Gallus)
  misc_feature (36): n=c or t
tagttcctgtaatatacagttgtgctgtatacattnaaatctgctgttctgatctgttcacagttttgaaa

SEQ ID NO: 34274 - DNA, 71 bp, chicken (Gallus Gallus)
  misc_feature (36): n=c or t
tggttttgagagagctttttaatctaaattgttaangtaggcattctggggtaatttaagagctgaaagag

SEQ ID NO: 34275 - DNA, 71 bp, chicken (Gallus Gallus)
  misc_feature (36): n=c or t
cactccatcttatattgtcttgcgttcagaagtganctgctgcacatcatgttgcatggcaaggtgtgatg

SEQ ID NO: 34276 - DNA, 71 bp, chicken (Gallus Gallus)
  misc_feature (36): n=a or c
gtcttgctgcttggtgggttggtctcattcagaagnagtcataacataaatgcatttattgtgtatattct

SEQ ID NO: 34277 - DNA, 71 bp, chicken (Gallus Gallus)
  misc_feature (36): n=a or c
gtaggaaaagaagctcttttgaagccattgatatgnattggaaggaagggcgtggaagatacactgccttt

SEQ ID NO: 34278 - DNA, 71 bp, chicken (Gallus Gallus)
  misc_feature (36): n=a or g
tccactaaaaatgtacttataggtaaaaacaaaatnttgtatcagtccatacttcccttgtggtctttgca

SEQ ID NO: 34279 - DNA, 71 bp, chicken (Gallus Gallus)
  misc_feature (36): n=a or g
ttcttgttgaactctttctaaagcttgtgagcttcntctctccaatttaacaggggaaatgaattcatatt

SEQ ID NO: 34280 - DNA, 71 bp, chicken (Gallus Gallus)
  misc_feature (36): n=c or t
atcagataattagtctaaaagttatcaagtttgtgncgtgtgaattttcacaccttttgactgcataagtt

SEQ ID NO: 34281 - DNA, 71 bp, chicken (Gallus Gallus)
  misc_feature (36): n=g or t
ttcagagtgctgagtcttgtactactgacctagagncaggccagatactatcctacccaggcagattttct

SEQ ID NO: 34282 - DNA, 71 bp, chicken (Gallus Gallus)
  misc_feature (36): n=c or t
gtgatgaatttcagtctgtgtgagttcatgttctcnttaagagttttaggaaaaaggaacactgcctacag

SEQ ID NO: 34283 - DNA, 71 bp, chicken (Gallus Gallus)
  misc_feature (36): n=c or t
gtatttttgaagaagtgagatttccatatactactnagttttaggtatcagactatcatagtgaccatcca

SEQ ID NO: 34284 - DNA, 71 bp, chicken (Gallus Gallus)
  misc_feature (36): n=g or t
tatttatctgttttagatctccaaaaaggattgctnactgcattgcttagctgtaaaagtacagcaaaatc

SEQ ID NO: 34285 - DNA, 71 bp, chicken (Gallus Gallus)
  misc_feature (36): n=a or c
tcagtgagtctggctgtaaaaaagtgttcagaagantgtacaagaatatgcacttttaaactttctctaca

SEQ ID NO: 34286 - DNA, 71 bp, chicken (Gallus Gallus)
  misc_feature (36): n=a or g
gtgggggttttaaagtcttcttacaaatgtatagancagattcttatttccaataagaattgtgcttctta

SEQ ID NO: 34287 - DNA, 71 bp, chicken (Gallus Gallus)
  misc_feature (36): n=a or c
tataaagatacttgacatccaaggaatgaagaggangtggtgatagctcaaatagctgtggcctcggctgt

SEQ ID NO: 34288 - DNA, 71 bp, chicken (Gallus Gallus)
  misc_feature (36): n=a or g
gaccactactcagtaaatggctttcctccctctcantagttaaatcctatgaaaattacagagggcagatc

SEQ ID NO: 34289 - DNA, 71 bp, chicken (Gallus Gallus)
  misc_feature (36): n=g or t
cctcaccaaaaacgagagttgaccaactgctgtttnagaacaagcaacaatatgctggagcatactaggat

SEQ ID NO: 34290 - DNA, 71 bp, chicken (Gallus Gallus)
  misc_feature (36): n=c or t
tcaaacacatgagctacttgaacacaataggcatanagtggcctacaacttgaaaacagcagggaagttat

SEQ ID NO: 34291 - DNA, 71 bp, chicken (Gallus Gallus)
  misc_feature (36): n=c or t
tctcccattatgtgccacacaaaaatattgcttaanatccaagttttcttccagcaagccagaatgtggca

SEQ ID NO: 34292 - DNA, 71 bp, chicken (Gallus Gallus)
  misc_feature (36): n=a or c
gcaatggcaatgcagcctatgcgccttgctaggtanacctcatgattttggtgcatagtcctaatgaacag

SEQ ID NO: 34293 - DNA, 71 bp, chicken (Gallus Gallus)
  misc_feature (36): n=a or c
aatggaaatatttctaatgtgttacttcagacttanagcaattctaagtaatttgataatcacagtataat

SEQ ID NO: 34294 - DNA, 71 bp, chicken (Gallus Gallus)
  misc_feature (36): n=g or t
ggactaattattaactgcttgctcagtaaatcgttntactttcatgcaattcagcgtctttgtttaacctg

SEQ ID NO: 34295 - DNA, 71 bp, chicken (Gallus Gallus)
  misc_feature (36): n=a or g
ttttgtttgttttaatttggaacacagccttaaagnaagggaatagaaagaagacctgtatttgtcaccta

SEQ ID NO: 34296 - DNA, 71 bp, chicken (Gallus Gallus)
  misc_feature (36): n=a or c
tacaaatggatacctatgatttctgatgctgagtanatcttgtacaactttgtgaagtcaattatatacat

SEQ ID NO: 34297 - DNA, 71 bp, chicken (Gallus Gallus)
  misc_feature (36): n=a or c
cgctgatcttcatccagattttaagtacatgtctcntaatacacattttccttgaaagctaactatagaag

SEQ ID NO: 34298 - DNA, 71 bp, chicken (Gallus Gallus)
  misc_feature (36): n=g or t
ctctgttcgtatatattaaaggctttattgtcaaanaggcctctgtttctggacaaaaagcaaagccatgg

SEQ ID NO: 34299 - DNA, 71 bp, chicken (Gallus Gallus)
  misc_feature (36): n=a or g
aatctgctttaaatttgtgggtggatcatggattantaaactcctactctctgctgctcagttttttggta

SEQ ID NO: 34300 - DNA, 71 bp, chicken (Gallus Gallus)
  misc_feature (36): n=a or g
gagcaatggtgtgcgactgcaaatacgtacatatcnatacctgtagagagttacgcagatacataaatgca

SEQ ID NO: 34301 - DNA, 71 bp, chicken (Gallus Gallus)
  misc_feature (36): n=c or t
gcattttgggaatatattgcttttaaaaggcccccngctgcatgtctaatgacagggttcaggtctgctga

SEQ ID NO: 34302 - DNA, 71 bp, chicken (Gallus Gallus)
  misc_feature (36): n=c or t
ggatgagaaaacctacgttaatccctgcagcaaaangctgatgagagataaagcctttcagatctgcctga

SEQ ID NO: 34303 - DNA, 71 bp, chicken (Gallus Gallus)
  misc_feature (36): n=a or g
ccttacagtcaggtgaaactgcttcctaaaggtccnggactgctgggtatggcacaagttgtgacagccag

SEQ ID NO: 34304 - DNA, 71 bp, chicken (Gallus Gallus)
  misc_feature (36): n=a or g
atatacatataaacatttaagctgcagaaaaattcnaacctcaattttaatttcatagaagttcttgtggg

SEQ ID NO: 34305 - DNA, 71 bp, chicken (Gallus Gallus)
  misc_feature (36): n=a or g
taggtaggctatgggtaaatgtgttaagttgctcancaagtcacaagcaaagggctagggggaaaagatac

SEQ ID NO: 34306 - DNA, 71 bp, chicken (Gallus Gallus)
  misc_feature (36): n=a or g
actatccactgtgaagtttgctgagttaaattactnttatttgagctcatgggcagaagtgctgcttctac

SEQ ID NO: 34307 - DNA, 71 bp, chicken (Gallus Gallus)
  misc_feature (36): n=c or t
ggatttgatcaaacattatgttacacaggacaatanattagtttttcaggaatatactcaacacaagctcg

SEQ ID NO: 34308 - DNA, 71 bp, chicken (Gallus Gallus)
  misc_feature (36): n=a or g
aaaccagaagatttaaatccagaaacccatctgatngtttaagcacttcttccacaacccttcttaaaata

SEQ ID NO: 34309 - DNA, 71 bp, chicken (Gallus Gallus)
  misc_feature (36): n=c or t
acaggtccacagcaagtggctgatctggtttaatgnctaaaattaaaatcagcagttcatcctactgcggg

SEQ ID NO: 34310 - DNA, 71 bp, chicken (Gallus Gallus)
  misc_feature (36): n=a or g
agaggagtttccccttggtaagagttaagcatctgngccctcttatctttctttgaggtttacattggtgt

SEQ ID NO: 34311 - DNA, 71 bp, chicken (Gallus Gallus)
  misc_feature (36): n=c or t
accaattacatttttagctgtcatgttttctacatnaaaaatggagcaacaacagaggagaaaagaaaaac

SEQ ID NO: 34312 - DNA, 71 bp, chicken (Gallus Gallus)
  misc_feature (36): n=a or g
ccacggactacacactgggcaaaaaacatttcttgnatcactaagatagctcaagttgaaatggacaagga

SEQ ID NO: 34313 - DNA, 71 bp, chicken (Gallus Gallus)
  misc_feature (36): n=a or g
aactatcatcctgtcagcctcgtatcttagtaatcntgattgtctaattcaagattgctgcacagttccac

SEQ ID NO: 34314 - DNA, 71 bp, chicken (Gallus Gallus)
  misc_feature (36): n=c or t
tgactgaaaacagcgcgccaggcggatttaatcaangtttcagaaagttaacgccacgccgggccgaaggc

SEQ ID NO: 34315 - DNA, 71 bp, chicken (Gallus Gallus)
  misc_feature (36): n=c or t
tggcacagtaactcaccaagctgctatttacttggngtgcatagagatttccctgacaatacctaactact

SEQ ID NO: 34316 - DNA, 71 bp, chicken (Gallus Gallus)
  misc_feature (36): n=a or g
agaaacaaacagaaaggaacaatagaaagatggaangtaggttccaaaaactgctataaaacatcagacag

SEQ ID NO: 34317 - DNA, 71 bp, chicken (Gallus Gallus)
  misc_feature (36): n=g or t
tacattcacgtggacttgaaaatgtgcctaacagtngctctgagaggtgtctctaggaacttgcttaggtc

SEQ ID NO: 34318 - DNA, 71 bp, chicken (Gallus Gallus)
  misc_feature (36): n=c or t
ataaattttttgccattcacctatattttcagtganattactcctacaggagaaagcatttacaattactg

SEQ ID NO: 34319 - DNA, 71 bp, chicken (Gallus Gallus)
  misc_feature (36): n=c or t
cgtgaagcacccaggccaacaagctggagatttacngctggcttcaaacagtgtagtcctggcaaatgtat

SEQ ID NO: 34320 - DNA, 71 bp, chicken (Gallus Gallus)
  misc_feature (36): n=a or g
tatatttccatataatgtaaatattcacagtgtgcnaacttcacaaaagaaatcttttctggctcattaac

SEQ ID NO: 34321 - DNA, 71 bp, chicken (Gallus Gallus)
  misc_feature (36): n=a or g
tcaagataagcattaagccctttcatgattttgtcnagaaactcattacagttctgaagcttctccaacat

SEQ ID NO: 34322 - DNA, 71 bp, chicken (Gallus Gallus)
  misc_feature (36): n=c or t
gattaggactgaggaagggtttcggtcagttccagngttcattcagacacctccaagcacaagtgtgcgat

SEQ ID NO: 34323 - DNA, 71 bp, chicken (Gallus Gallus)
  misc_feature (36): n=c or t
tttgataagctgttgatggtttagcagtaaaatacnccagtataacatgtactgaccaagtcacacattat

SEQ ID NO: 34324 - DNA, 71 bp, chicken (Gallus Gallus)
  misc_feature (36): n=a or g
tgaaaagtaattatcttcaaaatacacgttttcctnggaaaatcaaaattaccttctggaaatagcccctt

SEQ ID NO: 34325 - DNA, 71 bp, chicken (Gallus Gallus)
  misc_feature (36): n=a or g
aggatttgatggatattacatttaaattggcataanaacagtctctttttatgtgttcaagtaaataaaat

SEQ ID NO: 34326 - DNA, 71 bp, chicken (Gallus Gallus)
  misc_feature (36): n=c or t
gtattgaatacctgatggattgtgtctaaacccaanagcagttttactggttgtgaatatagcaataccat

SEQ ID NO: 34327 - DNA, 71 bp, chicken (Gallus Gallus)
  misc_feature (36): n=g or t
ccataagcgagacaattttctactgctttgtgcctnaaaggagctcacattaagaggagcactagcttgag

SEQ ID NO: 34328 - DNA, 71 bp, chicken (Gallus Gallus)
  misc_feature (36): n=a or g
agctggactgtgcctgaggccgaggtcacgggctcngaggagcagtggatatggaaagcccttctggggga

SEQ ID NO: 34329 - DNA, 71 bp, chicken (Gallus Gallus)
  misc_feature (36): n=c or t
cagtgatgtctcgccgaaggtttttgcttaaacatncactgtatcatttgcactgtaaaaggcagtaactg

SEQ ID NO: 34330 - DNA, 71 bp, chicken (Gallus Gallus)
  misc_feature (36): n=a or g
ttcctattcctctgcaaggcttcctgacaggctccngagatcaaggttctccgtcaggcccggctcttcgt

SEQ ID NO: 34331 - DNA, 71 bp, chicken (Gallus Gallus)
  misc_feature (36): n=c or t
gcataaatcttactcctgattgagcttgtctttagngctcctgataggtgtgaaatgaggaggtgctacag

SEQ ID NO: 34332 - DNA, 71 bp, chicken (Gallus Gallus)
  misc_feature (36): n=a or g
gttcagaggtctccactggagtaggtgaatttgcangcttcagatcaaggccaggtttcaactttgactct

SEQ ID NO: 34333 - DNA, 71 bp, chicken (Gallus Gallus)
  misc_feature (36): n=a or g
ggggggggggagaaagcagcagacgtagggatgtanattttagtgtattaggctttgctccctagattctt

SEQ ID NO: 34334 - DNA, 71 bp, chicken (Gallus Gallus)
  misc_feature (36): n=c or t
accagagtgaaaaagtacagtgtttgagtgacttcngagcagagaagtgaaggaattgggcagggaggctg

SEQ ID NO: 34335 - DNA, 71 bp, chicken (Gallus Gallus)
  misc_feature (36): n=g or t
atccagcgataggttaactctgtatgtgtgtaaatntttgtaggcatttattagaccagcaggagctaatg

SEQ ID NO: 34336 - DNA, 71 bp, chicken (Gallus Gallus)
  misc_feature (36): n=c or t
cttatttacccattttcctccccaaagcctgtaagntacacacttacaacaccagcgatggccctctgcgt

SEQ ID NO: 34337 - DNA, 71 bp, chicken (Gallus Gallus)
  misc_feature (36): n=c or t
tatgaatacagaaatgaagcacgggatgacgcggangagaagcccgcgctaagctccgtgtctgtcccacc

SEQ ID NO: 34338 - DNA, 71 bp, chicken (Gallus Gallus)
  misc_feature (36): n=c or t
tgagttcggaaggggagctggtgccttaaatacccngaactggctgcttcccttgctgcaggtcaggagga

SEQ ID NO: 34339 - DNA, 71 bp, chicken (Gallus Gallus)
  misc_feature (36): n=c or t
agttgcagaggtccaacaaagggaaagcagcagaanctggtggcatcatgctcccctgagagcatggattt

SEQ ID NO: 34340 - DNA, 71 bp, chicken (Gallus Gallus)
  misc_feature (36): n=c or t
taggggaaaaaacatttaggaaccacacagtcctcnccaggatactcacagacagatgtggctgatgcccc

SEQ ID NO: 34341 - DNA, 71 bp, chicken (Gallus Gallus)
  misc_feature (36): n=a or g
ctagcattttttttttcccttaccagtatttataantaatgaagtagtgtgggcagtcacagacccatggt

SEQ ID NO: 34342 - DNA, 71 bp, chicken (Gallus Gallus)
  misc_feature (36): n=a or g
aagggtgaccgttttgcactgttggtgaaactggcngaagacttcagagatgtttcccagtagtgctgcct

SEQ ID NO: 34343 - DNA, 71 bp, chicken (Gallus Gallus)
  misc_feature (36): n=a or g
tcttcagatgagtcggcaggagcgtatgcctacaanccgactgctagtactgttgatgttcgtatgataga

SEQ ID NO: 34344 - DNA, 71 bp, chicken (Gallus Gallus)
  misc_feature (36): n=c or t
tgctctgatggatatgtggttgatgacacatggccngtgtcaaactcacctgcgttcccttgtgagaagta

SEQ ID NO: 34345 - DNA, 71 bp, chicken (Gallus Gallus)
  misc_feature (36): n=a or g
acattgcaaagtcctgcgctgagctgcctggaagcnagagggcccctgcaattagtgtgtcgtcatcttct

SEQ ID NO: 34346 - DNA, 71 bp, chicken (Gallus Gallus)
  misc_feature (36): n=a or g
gagaacagtgaaggagatctgcttccaaccacactntgcctgttctccttatgtgtgagactgagcctcgc

SEQ ID NO: 34347 - DNA, 71 bp, chicken (Gallus Gallus)
  misc_feature (36): n=a or g
ttcctagaagtcatcttttaaactagaaaggaaganaaacaactctatgagacttcatcagcatgttatat

SEQ ID NO: 34348 - DNA, 71 bp, chicken (Gallus Gallus)
  misc_feature (36): n=c or t
agtcactgcaacagttatttaagcttttaccttggnacctttccatttcaaggtgtaagtctcagtgtgcc

SEQ ID NO: 34349 - DNA, 71 bp, chicken (Gallus Gallus)
  misc_feature (36): n=c or t
actcttgtgaagatgtccagaagcttgtgagctatnttccttcagtgtacagcaaaaagaagaactgaaaa

SEQ ID NO: 34350 - DNA, 71 bp, chicken (Gallus Gallus)
  misc_feature (36): n=c or t
gccctgaaaatgagatttgtggaccatgtctttgangagcaagttacagattctctgactgtcaagattgt

SEQ ID NO: 34351 - DNA, 71 bp, chicken (Gallus Gallus)
  misc_feature (36): n=c or t
taataaaatacctttttttgtgaaatgagctgtgcncagctttctgtcccgcgggctgctttcagcaagga

SEQ ID NO: 34352 - DNA, 71 bp, chicken (Gallus Gallus)
  misc_feature (36): n=a or g
tacttgcctttcaggcagagcttctgattgatactngttgtttataactgcagtgtcaggcgaagaaacag

SEQ ID NO: 34353 - DNA, 71 bp, chicken (Gallus Gallus)
  misc_feature (36): n=g or t
atggctgcactgctcactggctctctggaatggggntgtatactgaatttatgagctcttaagtcatcaca

SEQ ID NO: 34354 - DNA, 71 bp, chicken (Gallus Gallus)
  misc_feature (36): n=a or g
tctgcaactaatttttgttactggcatcattcatcncagcatttgtcatcggaaaaacagaaattacatct

SEQ ID NO: 34355 - DNA, 71 bp, chicken (Gallus Gallus)
  misc_feature (36): n=a or g
ggtttacccctggctcctgcactgctttttgccacntcgcttcacctaacacctctccatgcctcagtttc

SEQ ID NO: 34356 - DNA, 71 bp, chicken (Gallus Gallus)
  misc_feature (36): n=a or g
aagtttataaactgcgggcttgtagttcattagagngattctgttactctcctctctggcaggttattgca

SEQ ID NO: 34357 - DNA, 71 bp, chicken (Gallus Gallus)
  misc_feature (36): n=a or g
ctctcggtggattttaggcaaaatctgctggaggtnaggaaagaaggcactaaatctaattttctttgtat

SEQ ID NO: 34358 - DNA, 71 bp, chicken (Gallus Gallus)
  misc_feature (36): n=c or t
ttcctcagcccaaggggaaactatcatagctcaggnctactgagcagagctctgagaaaaggacattttgt

SEQ ID NO: 34359 - DNA, 71 bp, chicken (Gallus Gallus)
  misc_feature (36): n=c or t
ccctcgtctttcacaagtcctttgcctttctgttcntggctggggatgcaaggaatttcagcctttgttaa

SEQ ID NO: 34360 - DNA, 71 bp, chicken (Gallus Gallus)
  misc_feature (36): n=a or g
ttggtactttgtaatagtgcgatgctggaaatgttngatgctttagaatctacccctatcttcccacgaat

SEQ ID NO: 34361 - DNA, 71 bp, chicken (Gallus Gallus)
  misc_feature (36): n=a or g
cctggaaagctctaggactaatacaaacctctcccnagaaaagtgactctgcaggtcaagcagcatgaccc

SEQ ID NO: 34362 - DNA, 71 bp, chicken (Gallus Gallus)
  misc_feature (36): n=a or g
gaacagtctagaaaagttaaccttattaatcacagnattaattactagcaggataatactgaaaacctcca

SEQ ID NO: 34363 - DNA, 71 bp, chicken (Gallus Gallus)
  misc_feature (36): n=a or g
cgtgtcagcctctcacacaaaatcccactaaacttnctagatacggtgaaagttttatgtcattcgtacct

SEQ ID NO: 34364 - DNA, 71 bp, chicken (Gallus Gallus)
  misc_feature (36): n=c or t
gccctccgacaagacttcaatagcacagctctgtangatcttgcaaaaaaagtccttaaatatactgacat

SEQ ID NO: 34365 - DNA, 71 bp, chicken (Gallus Gallus)
  misc_feature (36): n=c or t
gtctgtaagattggcagacagtggaaaggtctaatncctctgaaacgaaaatttataaaaccatctcaaac

SEQ ID NO: 34366 - DNA, 71 bp, chicken (Gallus Gallus)
  misc_feature (36): n=c or t
atgatttctcagaagagttgggttaaatgctatgcnttccaaccactcccagggctgagggagatgtagtg

SEQ ID NO: 34367 - DNA, 71 bp, chicken (Gallus Gallus)
  misc_feature (36): n=a or g
ggaaaatcagactatgtggggaaacgttcacaagcntacagaggagcgttcacatccaggaagagtcagtg

SEQ ID NO: 34368 - DNA, 71 bp, chicken (Gallus Gallus)
  misc_feature (36): n=a or g
cgtccagctaggctgattggagaaacaaacaaaganaaaacaagaagcacagagacaattgagtccaatga

SEQ ID NO: 34369 - DNA, 71 bp, chicken (Gallus Gallus)
  misc_feature (36): n=a or g
gacatctagccttcctgagcttcttgagggatgagnaagggacaacaacaagcaatttgggaatggcatta

SEQ ID NO: 34370 - DNA, 71 bp, chicken (Gallus Gallus)
  misc_feature (36): n=c or t
tctagtgccaaactcaatttgaaattaggaccatgngtcttgtcagaaattacatgacctctgatttcagc

SEQ ID NO: 34371 - DNA, 71 bp, chicken (Gallus Gallus)
  misc_feature (36): n=c or t
gagtcaggctgtaaatcgcaaagcctcgttttgtangtgtacttttaagctggctgcttgtctggatcctt

SEQ ID NO: 34372 - DNA, 71 bp, chicken (Gallus Gallus)
  misc_feature (36): n=c or t
caggatgagaagagagtgaaataggcaattattttnacttccttttctcttatgcctgtgaggctccagat

SEQ ID NO: 34373 - DNA, 71 bp, chicken (Gallus Gallus)
  misc_feature (36): n=a or g
ccatgaggctgtacaccctattttttcccattcagnctaagactgttgccacactaataaccatacatctc

SEQ ID NO: 34374 - DNA, 71 bp, chicken (Gallus Gallus)
  misc_feature (36): n=a or g
ttaaaatcctcatccgtcactctcattcaccaatcnctgtgctttgctccacaggtaaccgtggcaaagtc

SEQ ID NO: 34375 - DNA, 71 bp, chicken (Gallus Gallus)
  misc_feature (36): n=a or g
agctgataagggtctgccagaggataacttttcagngttacctcaggttgacacaatcttgtcaaaagatg

SEQ ID NO: 34376 - DNA, 71 bp, chicken (Gallus Gallus)
  misc_feature (36): n=c or t
gtcatgactcaaaactttgcagccgtgaacctcaancctcaacctaacatgatgcctgttcgaccccagac

SEQ ID NO: 34377 - DNA, 71 bp, chicken (Gallus Gallus)
  misc_feature (36): n=a or g
gcattagcaaggcagtcttataattgctatagtacnagcttccaatttttaagccaatgccaagaggtgaa

SEQ ID NO: 34378 - DNA, 71 bp, chicken (Gallus Gallus)
  misc_feature (36): n=c or t
tgattatgatataaagaaaaggcaggcactggaagnaaaaatggctacagtaaaaagcctaataaaagatt

SEQ ID NO: 34379 - DNA, 71 bp, chicken (Gallus Gallus)
  misc_feature (36): n=a or g
ttacgcatccaggctgggtgtgttcagctctagaanggatgctaacgcttcccagggcaatgctttcattt

SEQ ID NO: 34380 - DNA, 71 bp, chicken (Gallus Gallus)
  misc_feature (36): n=a or c
tgaaaaggaatgcagcatgaacatacaagtgtcccntgtttaggtgtacttataatgccctgctgcttttc

SEQ ID NO: 34381 - DNA, 71 bp, chicken (Gallus Gallus)
  misc_feature (36): n=g or t
caggcagaatttcatttgttaaggggttgctcaatnaagctacttttgctttgtgcaagactgggatgaaa

SEQ ID NO: 34382 - DNA, 71 bp, chicken (Gallus Gallus)
  misc_feature (36): n=a or g
ctctgctacatcttgtcatgcttacggaagttaagnctctcttgcaagagacaagtttcttctgtcttgct

SEQ ID NO: 34383 - DNA, 71 bp, chicken (Gallus Gallus)
  misc_feature (36): n=a or c
gaataccaggagatcaccccctcatatctcagctgnaaagctgacagttcaatctgtgttgttggggtagg

SEQ ID NO: 34384 - DNA, 71 bp, chicken (Gallus Gallus)
  misc_feature (36): n=g or t
agaagttcccattaacctcacctatgatagcaaatntgaagggatctactaaaccaaatgcaatcacggaa

SEQ ID NO: 34385 - DNA, 71 bp, chicken (Gallus Gallus)
  misc_feature (36): n=c or t
tcatgcagaaacagcatgtttatggattactggctntgccacgcagcagtacttctcccagtccctagatg

SEQ ID NO: 34386 - DNA, 71 bp, chicken (Gallus Gallus)
  misc_feature (36): n=c or t
cactgcttaaatctggcaagctccaaagcagggagngttctttatcatacatgtttcttaagttattcgga

SEQ ID NO: 34387 - DNA, 71 bp, chicken (Gallus Gallus)
  misc_feature (36): n=c or t
gcactctaaagaacagagaaccacacaacattgttntcagagtctcaggtgtgctcatatgacgaaaatga

SEQ ID NO: 34388 - DNA, 71 bp, chicken (Gallus Gallus)
  misc_feature (36): n=c or t
catgctgacgagcttccaatggagagtgcctgcaangtgtgctctcctttttttatctcggatttctgcat

SEQ ID NO: 34389 - DNA, 71 bp, chicken (Gallus Gallus)
  misc_feature (36): n=a or g
ccctcaaacaaatctcccagaataccagggtagaantaaagtactgtcgctattaccgaaagcgctctgca

SEQ ID NO: 34390 - DNA, 71 bp, chicken (Gallus Gallus)
  misc_feature (36): n=a or g
cattgactgttccctgatgggaaacacttcttgacntttttcataactgtagctgttcttttgcatctaaa

SEQ ID NO: 34391 - DNA, 71 bp, chicken (Gallus Gallus)
  misc_feature (36): n=a or g
gacatgtcttctgacatctctgctggtaaacgaaanagtgacataacaacatgacaggggatttaaaaaat

SEQ ID NO: 34392 - DNA, 71 bp, chicken (Gallus Gallus)
  misc_feature (36): n=g or t
gttgcagtgttgtcaggtcaccattttctttttaangtgttatattgcttgagcttctgttgggaattctc

SEQ ID NO: 34393 - DNA, 71 bp, chicken (Gallus Gallus)
  misc_feature (36): n=a or g
agctcagtggatagaatgcatctttgtagagacagnacagattaaggagttgaatttacttctattttacc

SEQ ID NO: 34394 - DNA, 71 bp, chicken (Gallus Gallus)
  misc_feature (36): n=a or g
tcctgcacatacattccctaccattgtgcctttgcnagtcagactgctggctgcatttatttacatgataa

SEQ ID NO: 34395 - DNA, 71 bp, chicken (Gallus Gallus)
  misc_feature (36): n=a or g
agctcagggtgttccgtgattcgaactgaacagagnaaagggacacccgtggttccatagcagcttctctt

SEQ ID NO: 34396 - DNA, 71 bp, chicken (Gallus Gallus)
  misc_feature (36): n=c or t
cgttgcagcctctcagtcacggctccttgggctgcncggggcaaaaccgggatgggaacgccatcaattca

SEQ ID NO: 34397 - DNA, 71 bp, chicken (Gallus Gallus)
  misc_feature (36): n=g or t
gcaattgtttttgcattagctattaatttcccagtngcaagtggaggactagactaggctcctttcagaac

SEQ ID NO: 34398 - DNA, 71 bp, chicken (Gallus Gallus)
  misc_feature (36): n=a or g
ttttcaagtcttttctgaatacgtctttgaaagcanccagaaattttgtccactcaattacaggtttgtca

SEQ ID NO: 34399 - DNA, 71 bp, chicken (Gallus Gallus)
  misc_feature (36): n=g or t
acgctgtccttatgcacgcaaagttctgtaacccgnagtcttaagaatctacttaactatctgataactta

SEQ ID NO: 34400 - DNA, 71 bp, chicken (Gallus Gallus)
  misc_feature (36): n=a or g
agcagaagtctttcaagggtaagagagtcaaacctncttggtcagatagaatcatattatgaaatcatggc

SEQ ID NO: 34401 - DNA, 71 bp, chicken (Gallus Gallus)
  misc_feature (36): n=a or g
ctgaaattagagctggagagagactaagcccccacngcccaccagctgcagaacttatagagatcacactc

SEQ ID NO: 34402 - DNA, 71 bp, chicken (Gallus Gallus)
  misc_feature (36): n=a or g
atttgatagtctctaatacataggaggtctcttttnggctcaaactatatgaagaaacgcatttggagata

SEQ ID NO: 34403 - DNA, 71 bp, chicken (Gallus Gallus)
  misc_feature (36): n=a or c
tcccttctgagcagaaccatagctattcacctgctngaaaccaaaactgtgaacttggaatcaaagatttt

SEQ ID NO: 34404 - DNA, 71 bp, chicken (Gallus Gallus)
  misc_feature (36): n=c or t
agctataaagctaatccacgaagctaatttaggtanatctggatgagccggtcaccaattgttctatctgc

SEQ ID NO: 34405 - DNA, 71 bp, chicken (Gallus Gallus)
  misc_feature (36): n=a or g
catttatgttttcaagaagtaatgctggggcctctntgtgacccttcaaagacaggaagttctcttgtaat

SEQ ID NO: 34406 - DNA, 71 bp, chicken (Gallus Gallus)
  misc_feature (36): n=a or g
tgacgtcgcataaagatacctccaaaattccagccnaagactccatagcattactgaaaccaatctaaaaa

SEQ ID NO: 34407 - DNA, 71 bp, chicken (Gallus Gallus)
  misc_feature (36): n=c or t
aagctgccgtagcaaagtatttgaactgatgaaagngcggctgatagcgcaactgcagagctatagataga

SEQ ID NO: 34408 - DNA, 71 bp, chicken (Gallus Gallus)
  misc_feature (36): n=a or g
ttccatttaggatacaaccagaggacacactgcagntgttgtctatggtctcatgactgctgtagtggcaa

SEQ ID NO: 34409 - DNA, 71 bp, chicken (Gallus Gallus)
  misc_feature (36): n=a or c
catttctttggtcaactgaaagctaaagaaaagcanaagctctatcaaacagtagcatttttgtgttgctg

SEQ ID NO: 34410 - DNA, 71 bp, chicken (Gallus Gallus)
  misc_feature (36): n=c or t
tcacctgcacaaacccaccaacacttccatcccagngctgttgacttactccagcaccgcactgaaggcat

SEQ ID NO: 34411 - DNA, 71 bp, chicken (Gallus Gallus)
  misc_feature (36): n=g or t
gcatcgctcctggctgggtttggtggtgccccgtgnacccacgctttgatcccttggatgcagcatcactg

SEQ ID NO: 34412 - DNA, 71 bp, chicken (Gallus Gallus)
  misc_feature (36): n=c or t
ccgcgcagcctcctgggaaatgtagtgccggaagtngctgctgaggctgggtcgctgtggggttcgagttc

SEQ ID NO: 34413 - DNA, 71 bp, chicken (Gallus Gallus)
  misc_feature (36): n=a or g
agcactgcatggaaaggaaggagcatccagaagtantttgggattgcaagtggagatgcagcaatgggatc

SEQ ID NO: 34414 - DNA, 71 bp, chicken (Gallus Gallus)
  misc_feature (36): n=c or t
tgaattgtgccaccaccctttttaaccccttattcncctgcaggagtaggggcagggccaagcattgctcc

SEQ ID NO: 34415 - DNA, 71 bp, chicken (Gallus Gallus)
  misc_feature (36): n=c or t
catagcagctttcctgtcacaaaacgcagtgtcacnctgggggcagccacccctccaactgcctgtgggat

SEQ ID NO: 34416 - DNA, 71 bp, chicken (Gallus Gallus)
  misc_feature (36): n=a or g
gtgagcactttacagaagcttgtccttactaaatcnggacttttcacattgcttaggtctttaaatgcatc

SEQ ID NO: 34417 - DNA, 71 bp, chicken (Gallus Gallus)
  misc_feature (36): n=c or t
ctgtgggctggctccagggctctgtcctctgcctgngacttgttttccctcgttctgacatacggccgtct

SEQ ID NO: 34418 - DNA, 71 bp, chicken (Gallus Gallus)
  misc_feature (36): n=c or t
tggtcccctaaagctgtccgatccctctgctctttntgtgccacgttagtcacgtcctgcgggggcagaga

SEQ ID NO: 34419 - DNA, 71 bp, chicken (Gallus Gallus)
  misc_feature (36): n=c or t
catgtcctaccctggtctgatgtgctctcacggganaagtctgtgcccaagggtctggatcaacattgtgt

SEQ ID NO: 34420 - DNA, 71 bp, chicken (Gallus Gallus)
  misc_feature (36): n=a or g
gtaagtgttgggtttgtcattaaatccctgtgttcnaaattcacccagcagaaccaggaattgctgccatc

SEQ ID NO: 34421 - DNA, 71 bp, chicken (Gallus Gallus)
  misc_feature (36): n=a or g
gcacagagcactcaccagtcatcgcccacgttgaangcattgaggcttttggtgaagccctgcatgttgtt

SEQ ID NO: 34422 - DNA, 71 bp, chicken (Gallus Gallus)
  misc_feature (36): n=c or t
atctcatctggagcatggacctgtgttctcagcttntctctttgggacggccattctctcagcttgtaggt

SEQ ID NO: 34423 - DNA, 71 bp, chicken (Gallus Gallus)
  misc_feature (36): n=g or t
actacggaaagccctggcagatttagcaacaagagnattttcaaaacacacgtaaaattataactcctcct

SEQ ID NO: 34424 - DNA, 71 bp, chicken (Gallus Gallus)
  misc_feature (36): n=c or t
ggatcgtttctttgctctagctgaagccaaacaaangagatccctacataaataatcctgaaaatgcccaa

SEQ ID NO: 34425 - DNA, 71 bp, chicken (Gallus Gallus)
  misc_feature (36): n=g or t
atgaacttcttgcttctcagctcagtgtttgaccantgtacttattaggagctgagggtgttttaacagag

SEQ ID NO: 34426 - DNA, 71 bp, chicken (Gallus Gallus)
  misc_feature (36): n=c or t
gggccaggtggaatccatgctgcttgaaaaggtccnggtatctctccaggtggatggtggccagccagtct

SEQ ID NO: 34427 - DNA, 71 bp, chicken (Gallus Gallus)
  misc_feature (36): n=c or t
cctcttccagggatttccccattgctgggcaacaantgcatttttgtggtgttctgtagtacctataaacc

SEQ ID NO: 34428 - DNA, 71 bp, chicken (Gallus Gallus)
  misc_feature (36): n=c or t
tgagacttgcatgaagacaagttacagttagttatnccatggctttccaccactgttttttggtgaatttg

SEQ ID NO: 34429 - DNA, 71 bp, chicken (Gallus Gallus)
  misc_feature (36): n=a or g
ctcaaagcaattagcaacatttatcaactgcgcagncagaaaacagtaaggttacttgaaagtggctgtta

SEQ ID NO: 34430 - DNA, 71 bp, chicken (Gallus Gallus)
  misc_feature (36): n=a or g
ctttcttaagtactcagtgttgaaggtagagcactnaggaacaatgctgcttatcctagaatctccaggtt

SEQ ID NO: 34431 - DNA, 71 bp, chicken (Gallus Gallus)
  misc_feature (36): n=c or t
ttgtgttccccaacttcagcttaagatgctgtgtgngctgcttggagagggagtcaacacaaatacatatg

SEQ ID NO: 34432 - DNA, 71 bp, chicken (Gallus Gallus)
  misc_feature (36): n=c or t
tcttttgcatttgtttctaagctcattgcctgtagnggtgtctgcgcatagatgtaactggaaacagcaaa

SEQ ID NO: 34433 - DNA, 71 bp, chicken (Gallus Gallus)
  misc_feature (36): n=c or t
ttgttcagttctgcttggtttgctgtttgggagagntcaaatacctggagtcccaggagagaaaactgact

SEQ ID NO: 34434 - DNA, 71 bp, chicken (Gallus Gallus)
  misc_feature (36): n=c or t
tagctggtacctggtggtacaggcaaacctcagagnaactccagacttatcatagggcagaacagaagatt

SEQ ID NO: 34435 - DNA, 71 bp, chicken (Gallus Gallus)
  misc_feature (36): n=c or t
aaagccaagctccctttgttgctacctgctgtcgtngtgatggaaatagcaaatctttgggaaatggaacc

SEQ ID NO: 34436 - DNA, 71 bp, chicken (Gallus Gallus)
  misc_feature (36): n=c or t
tcaccgagcaccgaataaatgccctgaatgctcagntcttgtttttcagtcttcccgacatcaggtttccc

SEQ ID NO: 34437 - DNA, 71 bp, chicken (Gallus Gallus)
  misc_feature (36): n=g or t
accctgcattgctggggaaagttgcccattttgtgnctctgctctttttgtttaattacagatcctgtgat

SEQ ID NO: 34438 - DNA, 71 bp, chicken (Gallus Gallus)
  misc_feature (36): n=c or t
ccccttctttgccttccatatcacatttgacgctgnggtaccttaaaggtacatttccatttctatctcag

SEQ ID NO: 34439 - DNA, 71 bp, chicken (Gallus Gallus)
  misc_feature (36): n=a or g
tagcagttgtgtaaaagaaatgtaagctgcccggtntgggattctgcactgattaagtccttggggtccag

SEQ ID NO: 34440 - DNA, 71 bp, chicken (Gallus Gallus)
  misc_feature (36): n=c or t
taagaatgcagtcctggcatattaatttttgagtangtaagtatggataagtaaaatttcggaggcagttt

SEQ ID NO: 34441 - DNA, 71 bp, chicken (Gallus Gallus)
  misc_feature (36): n=c or t
gctgctcttcgtgttttttgggaagatctgattggncttcttcaaaaagaacaaggtttttgcttttaaaa

SEQ ID NO: 34442 - DNA, 71 bp, chicken (Gallus Gallus)
  misc_feature (36): n=g or t
agtcaacccctcgcacatgagaaaggcattcagggncatgaatgaattgcggaggtacgtttctgacttaa

SEQ ID NO: 34443 - DNA, 71 bp, chicken (Gallus Gallus)
  misc_feature (36): n=c or t
actccttgctgtcctgcctgcccggcgtgcccttgnttccctgtgcctgccttatctgggtatttttagac

SEQ ID NO: 34444 - DNA, 71 bp, chicken (Gallus Gallus)
  misc_feature (36): n=a or g
ctttcctggtgtctttctccatagatctgtcaaaancgctccaggcaaacttctgcagtagaaaagaaaaa

SEQ ID NO: 34445 - DNA, 71 bp, chicken (Gallus Gallus)
  misc_feature (36): n=c or t
tattatttttatggctagcaagatctaaatgccacngtgtcctggtctggtcaatgcctattgtggaggta

SEQ ID NO: 34446 - DNA, 71 bp, chicken (Gallus Gallus)
  misc_feature (36): n=c or t
attttaatggccacaaaacatcagtggaacctcccnggactgagtgacaaaggaaggagttctgagagcag

SEQ ID NO: 34447 - DNA, 71 bp, chicken (Gallus Gallus)
  misc_feature (36): n=c or t
atttgggctcagcatgtccaaactgtgttcctgcanggaggagagcttcccgtggatcccagtgtatgctt

SEQ ID NO: 34448 - DNA, 71 bp, chicken (Gallus Gallus)
  misc_feature (36): n=c or t
cttagggcgaagctctgctcctgtcttggagtcacnggtgagccatgcaagtgacagctaaccctaatcac

SEQ ID NO: 34449 - DNA, 71 bp, chicken (Gallus Gallus)
  misc_feature (36): n=c or t
gtcactaagcttttgaattagacgtaatctccttanttaatacaaacactgtaaaatgagaatggacatat

SEQ ID NO: 34450 - DNA, 71 bp, chicken (Gallus Gallus)
  misc_feature (36): n=g or t
acaggtattccattgcccttcatctcctggttgtangtttctattttgacaacagctttgtttcaattctc

SEQ ID NO: 34451 - DNA, 71 bp, chicken (Gallus Gallus)
  misc_feature (36): n=c or t
acttaaaatgtttactgaacagttttcacttacaanaacacaagaagtttgaatggattaattttgtggtg

SEQ ID NO: 34452 - DNA, 71 bp, chicken (Gallus Gallus)
  misc_feature (36): n=a or g
tgtaaattgcacagcatctggcgatgattgatagcnagtaggttttgtgatgtgaaaaagttacatttacg

SEQ ID NO: 34453 - DNA, 71 bp, chicken (Gallus Gallus)
  misc_feature (36): n=a or g
atttggcagttacaaaattaagcgacaggagaaaanacagaaaacaccaaccaacatccttttgaatgttt

SEQ ID NO: 34454 - DNA, 71 bp, chicken (Gallus Gallus)
  misc_feature (36): n=a or g
gctttgctattaaaattgaacacattccaaggcganccttgttttgaagcctggatgagcacaaaaccaaa

SEQ ID NO: 34455 - DNA, 71 bp, chicken (Gallus Gallus)
  misc_feature (36): n=c or t
cacggtaggcagacgagcagaggggagagcacagtnaggatgaggcagacgtgaatcctgcgagagagaaa

SEQ ID NO: 34456 - DNA, 71 bp, chicken (Gallus Gallus)
  misc_feature (36): n=c or t
cccgttgcaaaagcagcagagcaagtggtggagctncgggtgggcacaatctgagctcaacctttctgcta

SEQ ID NO: 34457 - DNA, 71 bp, chicken (Gallus Gallus)
  misc_feature (36): n=c or t
tgtgagattatgtctgtttctatttcagaacttaantgaaataaataatagttccacgtgacataatcagg

SEQ ID NO: 34458 - DNA, 71 bp, chicken (Gallus Gallus)
  misc_feature (36): n=a or c
aatgtttgtaaggtattctccagctgcatccctcancctttggcaatggggaagcctcagggctgttggtc

SEQ ID NO: 34459 - DNA, 71 bp, chicken (Gallus Gallus)
  misc_feature (36): n=g or t
acaaaatatggaccaaaactcatgccagcatatgtnccagcatcagcgctaggtgtttgtgatcaatcttg

SEQ ID NO: 34460 - DNA, 71 bp, chicken (Gallus Gallus)
  misc_feature (36): n=c or t
taaatccaagtatgcacatgttcataataaagccangtaatgttaatgttacaccagcggtgctgcaagca

SEQ ID NO: 34461 - DNA, 71 bp, chicken (Gallus Gallus)
  misc_feature (36): n=a or g
ccttgctatcagttgttttgttccactgacattcantcacttatttacctctgttgccaaagggacacacc

SEQ ID NO: 34462 - DNA, 71 bp, chicken (Gallus Gallus)
  misc_feature (36): n=a or g
tcccgtaagccacaaggcagtaatttgggatacaancattcaacatatgacctaaatctaaccaaggtttg

SEQ ID NO: 34463 - DNA, 71 bp, chicken (Gallus Gallus)
  misc_feature (36): n=c or t
aacctgcaagtgcaacttcattcagagcaccagagnaactctgcatcctttccctgagtgtgcaacaacct

SEQ ID NO: 34464 - DNA, 71 bp, chicken (Gallus Gallus)
  misc_feature (36): n=g or t
cacaaatagattattacactttatatgatgtaaaangactttctgaccaagaaggaagtcaagatattgat

SEQ ID NO: 34465 - DNA, 71 bp, chicken (Gallus Gallus)
  misc_feature (36): n=a or g
aaagagaaatacataaccagcaggaatcagactaanatgtccctcagagctgtaaaacttgtggaaaaaag

SEQ ID NO: 34466 - DNA, 71 bp, chicken (Gallus Gallus)
  misc_feature (36): n=c or t
aaatgctattgaggagtaaaatggcttaaatagttncccggtgtcagaggggcttcgtgtttgcaactgca

SEQ ID NO: 34467 - DNA, 71 bp, chicken (Gallus Gallus)
  misc_feature (36): n=c or t
ccgagggggaatgtgctcatctggcagcttggtgcngcatagctccctgtcatcaggcagtgctgatgtcc

SEQ ID NO: 34468 - DNA, 71 bp, chicken (Gallus Gallus)
  misc_feature (36): n=c or t
ttagccttactatcaacatgacgtggagacagaaangatgtgagacacagccaaaacccatacctcccttg

SEQ ID NO: 34469 - DNA, 71 bp, chicken (Gallus Gallus)
  misc_feature (36): n=a or c
ttggctttctaagtgtcctgaggacaagcttggttnatcttcaagttttccagacccttgtgtttaattct

SEQ ID NO: 34470 - DNA, 71 bp, chicken (Gallus Gallus)
  misc_feature (36): n=a or g
cacttagaaatgccctaacgtttcgctgcaaactcncaacaaaagtctctgggaccgggataataaagcgc

SEQ ID NO: 34471 - DNA, 71 bp, chicken (Gallus Gallus)
  misc_feature (36): n=c or t
cccacctgctggtctgtgtctttgctcccatccttnctctgctctctctggatattttgctttctggccca

SEQ ID NO: 34472 - DNA, 71 bp, chicken (Gallus Gallus)
  misc_feature (36): n=a or g
agattgtccaacagggtcttgcagactgtattcaantatcctgtctctattgcattatgagagacatcaaa

SEQ ID NO: 34473 - DNA, 71 bp, chicken (Gallus Gallus)
  misc_feature (36): n=a or g
gaatctcagggtgatctgcacctatggaaaggaatnagggctccagaaaagctgtcctgggtcatcaggtg

SEQ ID NO: 34474 - DNA, 71 bp, chicken (Gallus Gallus)
  misc_feature (36): n=c or t
cctaaacgataaatggactctgatagtaataacttncatggagaaaaagtcactttatgagcatactgttg

SEQ ID NO: 34475 - DNA, 71 bp, chicken (Gallus Gallus)
  misc_feature (36): n=a or g
aaaccccagtgcggcgttgctgctgtgcacagctcngggtgctgcaccagaacagattacatcactttcct

SEQ ID NO: 34476 - DNA, 71 bp, chicken (Gallus Gallus)
  misc_feature (36): n=a or g
tggatggaaaaacctttcagagctaatgagcagaancaggagcacttggctcctacctggggaggtgactc

SEQ ID NO: 34477 - DNA, 71 bp, chicken (Gallus Gallus)
  misc_feature (36): n=c or t
tcatgctgatggcactgtcagggtgtgagaaataangttagcagaaagcaatccggctttataccacttca

SEQ ID NO: 34478 - DNA, 71 bp, chicken (Gallus Gallus)
  misc_feature (36): n=a or c
cgtgacatccacgtggctttttatctagctctccancaccacttctcactccatacaggcgcctgtcctca

SEQ ID NO: 34479 - DNA, 71 bp, chicken (Gallus Gallus)
  misc_feature (36): n=a or g
aatgtcaagattatcaagccagtccttccgagatcncaaaaccacaaagaaaggtccgatcgctatccaga

SEQ ID NO: 34480 - DNA, 71 bp, chicken (Gallus Gallus)
  misc_feature (36): n=a or g
tcatttccatacattgtaccaagaagcttcattacnttcaagataatgtttcagtattcgaatgctgaaaa

SEQ ID NO: 34481 - DNA, 71 bp, chicken (Gallus Gallus)
  misc_feature (36): n=c or t
atcagcactgcaaacaaatgcagcattctgtaaganggtataaattgaatggagcgtttgttacttcgtcc

SEQ ID NO: 34482 - DNA, 71 bp, chicken (Gallus Gallus)
  misc_feature (36): n=a or g
gacttgcagatgtcttctgtaggctgctttcagtcnccatctgatcctctaaatcaaggggtattaactat

SEQ ID NO: 34483 - DNA, 71 bp, chicken (Gallus Gallus)
  misc_feature (36): n=c or t
taaaatgtggctttttcattagacaaatggtgattngttgtaatcagaagttttccggaaagcacctcatg

SEQ ID NO: 34484 - DNA, 71 bp, chicken (Gallus Gallus)
  misc_feature (36): n=a or g
agacccaatgcatggagaggaccccgtgaacaatgngggacaacacacacacaggggccgcatatacacaa

SEQ ID NO: 34485 - DNA, 71 bp, chicken (Gallus Gallus)
  misc_feature (36): n=c or t
aaaagcccatgctgggttccatggttctcagcttgngatttcatgatgcaattctaagattgaaattaaat

SEQ ID NO: 34486 - DNA, 71 bp, chicken (Gallus Gallus)
  misc_feature (36): n=g or t
tggatgattctctgtacctctgtcaggccacaagcntcctaaattatcgcagtctgactctggctgaggta

SEQ ID NO: 34487 - DNA, 71 bp, chicken (Gallus Gallus)
  misc_feature (36): n=g or t
catgttgaacattggtcttgcccttcaacattctgncagggaattctacagtcctatcatctgcaaaacta

SEQ ID NO: 34488 - DNA, 71 bp, chicken (Gallus Gallus)
  misc_feature (36): n=a or c
acagagcaaaccttcagttaatgtctctgtacaacncatcaggctttgatgtctccatgcagtaatccttc

SEQ ID NO: 34489 - DNA, 71 bp, chicken (Gallus Gallus)
  misc_feature (36): n=g or t
aaatgactgcacagctgcaatcccagaagcgtgctnaagagctacttcataccaaggaataatttttcttt

SEQ ID NO: 34490 - DNA, 71 bp, chicken (Gallus Gallus)
  misc_feature (36): n=c or t
caggtggatgttgatgcttctgaggatactaaaatngaggaggaagatcttctcacagatttgaaagacac

SEQ ID NO: 34491 - DNA, 71 bp, chicken (Gallus Gallus)
  misc_feature (36): n=c or t
tgttgtgggaaggactcgcctggatgtttcattatngccagtgggaaccaaatgtaaattatacacttaaa

SEQ ID NO: 34492 - DNA, 71 bp, chicken (Gallus Gallus)
  misc_feature (36): n=c or t
atgtgggtactcaagtctcctatggaaaattgattngaagatgacaaaatgagtagaaccttttcctttga

SEQ ID NO: 34493 - DNA, 71 bp, chicken (Gallus Gallus)
  misc_feature (36): n=c or t
gggatattaccaccaatcattacatatttttgttgnatctcttctgccttttgccacttttcttgacaatc

SEQ ID NO: 34494 - DNA, 71 bp, chicken (Gallus Gallus)
  misc_feature (36): n=c or t
gagcaagtcagaatagaagtatgaaataatctggangattcgctgtcatcttttgtagaagaggctgtatt

SEQ ID NO: 34495 - DNA, 71 bp, chicken (Gallus Gallus)
  misc_feature (36): n=a or g
caaaatagtgctcatcatgtgagcccagctggttcntgccccctttttcatagagattggtctggttttca

SEQ ID NO: 34496 - DNA, 71 bp, chicken (Gallus Gallus)
  misc_feature (36): n=g or t
tgatagtgccaacgtcaagaaaatcttgttttagtnggataaggctgaacactattgaagtggatagaaag

SEQ ID NO: 34497 - DNA, 71 bp, chicken (Gallus Gallus)
  misc_feature (36): n=a or g
gaccaacagccacatcaaaggaagaacagagaccanttctgctaccacaggttaaatatgaaagcctgcca

SEQ ID NO: 34498 - DNA, 71 bp, chicken (Gallus Gallus)
  misc_feature (36): n=a or g
tgtttctgaagttttgcatttccataaccttgagcnggcagcatcacaaatcaaccctgggatggtgtggc

SEQ ID NO: 34499 - DNA, 71 bp, chicken (Gallus Gallus)
  misc_feature (36): n=g or t
atttgtcttcccagatgagcttagttcccagttccncttggtgacattgcaggttattggatgaacttttc

SEQ ID NO: 34500 - DNA, 71 bp, chicken (Gallus Gallus)
  misc_feature (36): n=a or g
ataaggaggtttcctctttcgcttgtactcatttcntacaacatctccagtaatgacttgtgagcctttct

SEQ ID NO: 34501 - DNA, 71 bp, chicken (Gallus Gallus)
  misc_feature (36): n=c or t
gcaatctttcactctcctgtcttcctgtataataantatgtatttgctgctggttgtgttaaatgcatctg

SEQ ID NO: 34502 - DNA, 71 bp, chicken (Gallus Gallus)
  misc_feature (36): n=a or g
ctcagtgggcacttgaggccctgaggagtttgactntgtgcacagctatccatcagaagcactcatttact

SEQ ID NO: 34503 - DNA, 71 bp, chicken (Gallus Gallus)
  misc_feature (36): n=a or g
accccacaaagcctgaataaagcatacaaagggatngactcttgtgggagaaaaaaggcattctcaaatcc

SEQ ID NO: 34504 - DNA, 71 bp, chicken (Gallus Gallus)
  misc_feature (36): n=c or t
tgctccctgagatctgtccatcagccagttcctgcnccatttagcacgtgcttcattggtgctgcatagca

SEQ ID NO: 34505 - DNA, 71 bp, chicken (Gallus Gallus)
  misc_feature (36): n=a or g
ccgatgcaaatgatcgtctgacttttttttcacctngtgatgccctttctatagtaccagagcttatcctc

SEQ ID NO: 34506 - DNA, 71 bp, chicken (Gallus Gallus)
  misc_feature (36): n=a or c
ttagcatgcttcatgcatggagttaattaagggaanatcattctttaagctcattaactgttctttaagta

SEQ ID NO: 34507 - DNA, 71 bp, chicken (Gallus Gallus)
  misc_feature (36): n=c or t
tcccgcatgactgctccttcttgcaatataaacatnttatgaaagcagagttgtgtacttaccttacaaat

SEQ ID NO: 34508 - DNA, 71 bp, chicken (Gallus Gallus)
  misc_feature (36): n=c or t
cgtgcatgcccccagtcccaaccactttggaccttnaacatgcacagctttagatgctccacacattagct

SEQ ID NO: 34509 - DNA, 71 bp, chicken (Gallus Gallus)
  misc_feature (36): n=a or g
tgtcgagcaaattgttcactccatagaagctgatgngagctctccttggtccccaggccgtttctctgctc

SEQ ID NO: 34510 - DNA, 71 bp, chicken (Gallus Gallus)
  misc_feature (36): n=g or t
cctcttcactatctgcgccaggcatatctgctagcngggggccggacggctgccgactatgccactgaggc

SEQ ID NO: 34511 - DNA, 71 bp, chicken (Gallus Gallus)
  misc_feature (36): n=a or g
ctgggattggacttctgtggtcacactggtgcctcngccagaaggatccctccatcccttgcagcagagtg

SEQ ID NO: 34512 - DNA, 71 bp, chicken (Gallus Gallus)
  misc_feature (36): n=a or g
tctatacagccaaattcttctcaaacaacaacacantgctttcatggaatgcaaggacaggacttgctcaa

SEQ ID NO: 34513 - DNA, 71 bp, chicken (Gallus Gallus)
  misc_feature (36): n=g or t
catgtaattcaccagaaatgtgtactgtaaagcaancaatgaagctgactgaaacaagaatgcttttcagc

SEQ ID NO: 34514 - DNA, 71 bp, chicken (Gallus Gallus)
  misc_feature (36): n=c or t
tctgttgaaagtagtaagatgtgagcttgcattaangtcaacttattgtacactggagtataagaaaattc

SEQ ID NO: 34515 - DNA, 71 bp, chicken (Gallus Gallus)
  misc_feature (36): n=c or t
tttttttcttttctgtgcacgaagaccagccaaagntcctgcatttcagtgttagcattgtttgtcggtgc

SEQ ID NO: 34516 - DNA, 71 bp, chicken (Gallus Gallus)
  misc_feature (36): n=c or t
tcagccagcacaactgtgctctgtaagcagcacgtncacgtgccatagggtggtagtaaggtttccaaacc

SEQ ID NO: 34517 - DNA, 71 bp, chicken (Gallus Gallus)
  misc_feature (36): n=a or g
gctcattgcggctgtgctccgcagcgcccatccgcncggcggttctgtgctcagttcggaacgtccccaca

SEQ ID NO: 34518 - DNA, 71 bp, chicken (Gallus Gallus)
  misc_feature (36): n=a or c
agctgttggcatcataagtaagatgacacgctggcnagggggacatctgatctcacatattagggagtatt

SEQ ID NO: 34519 - DNA, 71 bp, chicken (Gallus Gallus)
  misc_feature (36): n=a or g
tgtgtttgctgcaatttcaatttgtttctccttttnaaaactgtaaatagaaacaacctcttgacaaacaa

SEQ ID NO: 34520 - DNA, 71 bp, chicken (Gallus Gallus)
  misc_feature (36): n=a or g
accacaaagcctggatttggtttatttccacccaancacttatttctccatccgtttgccaaccagagaaa

SEQ ID NO: 34521 - DNA, 71 bp, chicken (Gallus Gallus)
  misc_feature (36): n=a or g
tggggaagctgacacagtgtttgttgctcagaatantcttggggatgatttttaacgctttagaaaattct

SEQ ID NO: 34522 - DNA, 71 bp, chicken (Gallus Gallus)
  misc_feature (36): n=a or g
ctctagagttacaaatcacggatttacctaaaaccnaactgcacgggacgtactggctgaaacacattcag

SEQ ID NO: 34523 - DNA, 71 bp, chicken (Gallus Gallus)
  misc_feature (36): n=a or g
caacaaaaaaatggctgagaaacaataagtcttccnttaccacttggaatcaaaatcatatctcgcaatgg

SEQ ID NO: 34524 - DNA, 71 bp, chicken (Gallus Gallus)
  misc_feature (36): n=a or g
agagagttttctataaagaaagcagatgagcatctntggggatgggtgttccccactgaatggatgcaaat

SEQ ID NO: 34525 - DNA, 71 bp, chicken (Gallus Gallus)
  misc_feature (36): n=c or t
atacatagaaagcaatagtgagaaatgccaccatantcaagcgatgaaatccagcatctctgttatggagc

SEQ ID NO: 34526 - DNA, 71 bp, chicken (Gallus Gallus)
  misc_feature (36): n=c or t
aacttgtactgtacatagtttgggtatgaacaaagnaactggcacaaaagtcagaaagctgatttaatgct

SEQ ID NO: 34527 - DNA, 71 bp, chicken (Gallus Gallus)
  misc_feature (36): n=c or t
agtttcccaagttgcttgaatccagtggatcattcngtttggagcttcacccttctcctccaacatgcagg

SEQ ID NO: 34528 - DNA, 71 bp, chicken (Gallus Gallus)
  misc_feature (36): n=c or t
tacgactaccgcagtttcacatcgcagagcagcctngtgttgcatccgcaccgagagcaacaaacctcacg

SEQ ID NO: 34529 - DNA, 71 bp, chicken (Gallus Gallus)
  misc_feature (36): n=c or t
agaggatcagtggggacgtcccgaagccccactgtncccctgctgtgccaatggtgggagtgcaggagaaa

SEQ ID NO: 34530 - DNA, 71 bp, chicken (Gallus Gallus)
  misc_feature (36): n=c or t
tctttctatttagcatcacctgtaattcttgggcantgggaatgatcatcctgattttaaaacttacaagc

SEQ ID NO: 34531 - DNA, 71 bp, chicken (Gallus Gallus)
  misc_feature (36): n=a or g
aactttacaaaacagaggtgtgtttgactagggttnctcgagctctacttgaacctaagaaaatggaatac

SEQ ID NO: 34532 - DNA, 71 bp, chicken (Gallus Gallus)
  misc_feature (36): n=a or g
aaatcagcaagtacccatgtaaatatgagattacantggatgattatccaatgcatatagctgaaatccat

SEQ ID NO: 34533 - DNA, 71 bp, chicken (Gallus Gallus)
  misc_feature (36): n=c or t
ttacacaccttgaaggcttaaggaatgctcctaganatatcatgacactgattaagactgaagtaattcat

SEQ ID NO: 34534 - DNA, 71 bp, chicken (Gallus Gallus)
  misc_feature (36): n=c or t
aattctctgggctcacattgctttatttcacgtttncagactctctgactcctacttcctggaaatacttc

SEQ ID NO: 34535 - DNA, 71 bp, chicken (Gallus Gallus)
  misc_feature (36): n=a or g
atggatgaactgtaacagcagctacaggaagataantagacagaaaggtgtcttttatgtatgatttgtac

SEQ ID NO: 34536 - DNA, 71 bp, chicken (Gallus Gallus)
  misc_feature (36): n=c or t
gagttggccaccaaaagctttagctagtcttcacanttcaagacatccagcattaacacacaggtttccat

SEQ ID NO: 34537 - DNA, 71 bp, chicken (Gallus Gallus)
  misc_feature (36): n=c or t
gattttatgctggggagtcaaacacaggtgtctcangaatgccagaaactgtaaaagttgtgaagtctata

SEQ ID NO: 34538 - DNA, 71 bp, chicken (Gallus Gallus)
  misc_feature (36): n=c or t
ccgtaaggtctggttaaatatagactttttgctgangtaaaactagtcacaaaatgagagaaaagggtcta

SEQ ID NO: 34539 - DNA, 71 bp, chicken (Gallus Gallus)
  misc_feature (36): n=c or t
tggtgagaaaattgctttgtcttggtttgctcaccntcatacctccctagaaagatgaggagcttaggatg

SEQ ID NO: 34540 - DNA, 71 bp, chicken (Gallus Gallus)
  misc_feature (36): n=c or t
tactcctttgcttctttcaggagggaaacacgttangaagtaccaggactggagggagtgtatgctggggt

SEQ ID NO: 34541 - DNA, 71 bp, chicken (Gallus Gallus)
  misc_feature (36): n=a or g
tgtactctgtgcaagatgacttaccacggggtctcnccgtgtaaaataactgcaggtgagtcgtcgcgtgt

SEQ ID NO: 34542 - DNA, 71 bp, chicken (Gallus Gallus)
  misc_feature (36): n=a or g
aagattccactgccgtggcacggcacagatcaggangtccctaaactgctgactgccaaattcggagaggc

SEQ ID NO: 34543 - DNA, 71 bp, chicken (Gallus Gallus)
  misc_feature (36): n=c or t
ccatttacctttatgaaatgattctatacacacgtntttattgcttatttagcctttaaaatatagaatcc

SEQ ID NO: 34544 - DNA, 71 bp, chicken (Gallus Gallus)
  misc_feature (36): n=c or t
cctgtgcaacccaggaggggacagttggagcagacnttatattgctgtgggtgaggggcagtaccagaccc

SEQ ID NO: 34545 - DNA, 71 bp, chicken (Gallus Gallus)
  misc_feature (36): n=c or t
tgctttgtgggctctatctcacatttactccggtcngtatggaagtttgtccctgagccaggagttctgtg

SEQ ID NO: 34546 - DNA, 71 bp, chicken (Gallus Gallus)
  misc_feature (36): n=c or t
ccgtgtgctttttagtagcaatttcctcatattagngtgcacaggagataccatttctttgaaagattcgt

SEQ ID NO: 34547 - DNA, 71 bp, chicken (Gallus Gallus)
  misc_feature (36): n=c or t
tgctgtgtcctgggctgctgactgatggagttcccnctgccgctgctctttgggaagaactgctttgaagg

SEQ ID NO: 34548 - DNA, 71 bp, chicken (Gallus Gallus)
  misc_feature (36): n=c or t
aagcacaggagatttccatttgattgtttgtatganctccatcctaaagcaaaagccattaggaacatcca

SEQ ID NO: 34549 - DNA, 71 bp, chicken (Gallus Gallus)
  misc_feature (36): n=c or t
atttgactcttaaagatgcattttagtttaacacangatacaaagtcgcctgcagcccattggtctctgag

SEQ ID NO: 34550 - DNA, 71 bp, chicken (Gallus Gallus)
  misc_feature (36): n=c or t
gcagcagcaccatcacacactgaaggttgcagtgcnctatcacagacctccatctggcacggccatatacc

SEQ ID NO: 34551 - DNA, 71 bp, chicken (Gallus Gallus)
  misc_feature (36): n=g or t
cactccccagtcagttacttagataacggtaggggncttttgttccatctgcttttccttcggtgctgctt

SEQ ID NO: 34552 - DNA, 71 bp, chicken (Gallus Gallus)
  misc_feature (36): n=g or t
agcaactgagttctggcaaccaccactgctgctgcncccatttacaacatatcgctccatctccaacctca

SEQ ID NO: 34553 - DNA, 71 bp, chicken (Gallus Gallus)
  misc_feature (36): n=a or g
aggcagagcggtttgagggggataaatagcagtgangggagaagttatgagcaataaagcagtgagtttct

SEQ ID NO: 34554 - DNA, 71 bp, chicken (Gallus Gallus)
  misc_feature (36): n=a or g
gttcaaagcgatctccataagttggagaaatgatcngaaccgttctgagagagttcagtaaagcacacaat

SEQ ID NO: 34555 - DNA, 71 bp, chicken (Gallus Gallus)
  misc_feature (36): n=a or g
tcagaatgtatttattaaaacaccaattagacctcngtctctcatcaatcacaacacctttaattcatgca

SEQ ID NO: 34556 - DNA, 71 bp, chicken (Gallus Gallus)
  misc_feature (36): n=a or g
cagagataattgtgtcaagctgaatgcacagcacangggttacatttctattcagttaccatggttgctaa

SEQ ID NO: 34557 - DNA, 71 bp, chicken (Gallus Gallus)
  misc_feature (36): n=c or t
caaaacagaacagttttgtctgctctcgtgctcccnctgctttcattgcatgcgggctgtttggctgagca

SEQ ID NO: 34558 - DNA, 71 bp, chicken (Gallus Gallus)
  misc_feature (36): n=a or g
aaggtgggtgattcctgatggcaagagctgtactgnaagaacagacccaagtgagttctctgggtgagctg

SEQ ID NO: 34559 - DNA, 71 bp, chicken (Gallus Gallus)
  misc_feature (36): n=g or t
atagaatgcacgcatcttgcagcaaaatttcacttnaacttggccaagaagtttggaagctcccagacatc

SEQ ID NO: 34560 - DNA, 71 bp, chicken (Gallus Gallus)
  misc_feature (36): n=c or t
cccgggtcagcccaacctggggatctcagccagccntcagtgtcaccttatcctcaagcagccctcctgcc

SEQ ID NO: 34561 - DNA, 71 bp, chicken (Gallus Gallus)
  misc_feature (36): n=g or t
gctcggtattttctgctcctccagaaacatcttcanctcctttctgaatttgacagacaggatttggattg

SEQ ID NO: 34562 - DNA, 71 bp, chicken (Gallus Gallus)
  misc_feature (36): n=a or g
ttatctccttgcctaatctcaatttttgtagagaantggccatttgacggttgagggttcaccaaaaacac

SEQ ID NO: 34563 - DNA, 71 bp, chicken (Gallus Gallus)
  misc_feature (36): n=a or g
tgtgacttgcatttgttctaatccactttgtgtccntgggtgttgttcctttggaagaaaatacatgcatc

SEQ ID NO: 34564 - DNA, 71 bp, chicken (Gallus Gallus)
  misc_feature (36): n=g or t
tctccatgttcaagtcccacaccttgacagtgaggnagtctcgggtcatgatgtacctcccactgtggctg

SEQ ID NO: 34565 - DNA, 71 bp, chicken (Gallus Gallus)
  misc_feature (36): n=c or t
aacagagcctttccttagggctgggggtgtcacatntacagtgtgtgaacaagaggaaatcattgctgata

SEQ ID NO: 34566 - DNA, 71 bp, chicken (Gallus Gallus)
  misc_feature (36): n=a or g
cgtcgggcaggagatcatttgcagtaacgaatactncagtcgggatttcccagctttcagccttcccttac

SEQ ID NO: 34567 - DNA, 71 bp, chicken (Gallus Gallus)
  misc_feature (36): n=a or g
gttagcagctgatctttccagccttcctagacaacnggctaggccaaaatccttaagcctttcacccagtt

SEQ ID NO: 34568 - DNA, 71 bp, chicken (Gallus Gallus)
  misc_feature (36): n=a or g
tctttagccaggtccagcttccgcagcacaacaccntacctgtaaagcaaatacatcagtcataaaactct

SEQ ID NO: 34569 - DNA, 71 bp, chicken (Gallus Gallus)
  misc_feature (36): n=a or c
tgtgctgcaagccgcgctcacggctgcgctccgccncgctcagcaactgcttcttgatctcccgtaagtcc

SEQ ID NO: 34570 - DNA, 71 bp, chicken (Gallus Gallus)
  misc_feature (36): n=c or t
tataaatttgaataaggaggcaattttatcctttcngtgacactggtgagagtgtcctcacttcaataaca

SEQ ID NO: 34571 - DNA, 71 bp, chicken (Gallus Gallus)
  misc_feature (36): n=c or t
ttagtgttgtaatggatctttctgtgtataatgaanactgctttgacaatgttaatcaataaaagggttgg

SEQ ID NO: 34572 - DNA, 71 bp, chicken (Gallus Gallus)
  misc_feature (36): n=g or t
gccagagcctctcttcagccttgtcagtgggctggngagcatggctaatgcacctcccacctctacaccct

SEQ ID NO: 34573 - DNA, 71 bp, chicken (Gallus Gallus)
  misc_feature (36): n=a or g
ccttactccacttcccagatgggcccactcagcacnatccaaccacaacaagaagcaatttcccatttgtc

SEQ ID NO: 34574 - DNA, 71 bp, chicken (Gallus Gallus)
  misc_feature (36): n=a or g
gtcattcagtgggatgctgagcacctctgctggaanaaaacacctaacaaagaagggctgttgattattta

SEQ ID NO: 34575 - DNA, 71 bp, chicken (Gallus Gallus)
  misc_feature (36): n=a or g
tgcatgcaaaatgaattcactccgttttcattcccnagaccgcaggagtggaaatgtgtagcctttaaaat

SEQ ID NO: 34576 - DNA, 71 bp, chicken (Gallus Gallus)
  misc_feature (36): n=a or c
gggtccttgccctagaaaaagcaagctgtctgaccntggtgctgcaaacccttatccttgtgaattgccat

SEQ ID NO: 34577 - DNA, 71 bp, chicken (Gallus Gallus)
  misc_feature (36): n=c or t
cacgcagactctgacagctgttggtcagtcactgcntccctcctcaatagctgatcaataacaacgtttca

SEQ ID NO: 34578 - DNA, 71 bp, chicken (Gallus Gallus)
  misc_feature (36): n=a or c
ggatcagagtctgtgctggaagttgaggcaagaggnttttcgcttttctcatcctaagccctgttttatca

SEQ ID NO: 34579 - DNA, 71 bp, chicken (Gallus Gallus)
  misc_feature (36): n=a or g
ccctgcagatgccacaaacacttgtttaagaattangttgtgaacaccgtaggcatgcagtaattataaaa

SEQ ID NO: 34580 - DNA, 71 bp, chicken (Gallus Gallus)
  misc_feature (36): n=a or g
tacttattgtttgtattaagtcgcatttgggaaccnaagctcaattaaaaatagtaacgacaattttatat

SEQ ID NO: 34581 - DNA, 71 bp, chicken (Gallus Gallus)
  misc_feature (36): n=a or g
cctgcctggagcgggcgccaaggagacagctgagcncagtgctggcaccccagggcatggcctcatttcca

SEQ ID NO: 34582 - DNA, 71 bp, chicken (Gallus Gallus)
  misc_feature (36): n=g or t
gaggctcttcctcgcatgaaaacatcacccttttgnggtaatatccttctaatgctgtacaaatgtctgtg

SEQ ID NO: 34583 - DNA, 71 bp, chicken (Gallus Gallus)
  misc_feature (36): n=c or t
ttccaaaacatcacccttgcctggctctgcctgctnggggctcctctgtgaggccagcacttgggcgcatg

SEQ ID NO: 34584 - DNA, 71 bp, chicken (Gallus Gallus)
  misc_feature (36): n=c or t
atgggagcaactgtggggagttcgctctctcccatnatctccagtttagggtaggaacgctgctgtgacac

SEQ ID NO: 34585 - DNA, 71 bp, chicken (Gallus Gallus)
  misc_feature (36): n=a or g
gtgtcaaaaataaggaggctcttcacgcagagcacngctaaggctgtgaattctgcacgagatgctggaga

SEQ ID NO: 34586 - DNA, 71 bp, chicken (Gallus Gallus)
  misc_feature (36): n=c or t
agcactctgcagccctcaaagttcattccagttccntgatattttaaatgccaacaactggagtatcaaaa

SEQ ID NO: 34587 - DNA, 71 bp, chicken (Gallus Gallus)
  misc_feature (36): n=a or g
atcagggccttctgcaccagtctttgaatttcctanaatgggccaagaccactcctaccccaaagaacatc

SEQ ID NO: 34588 - DNA, 71 bp, chicken (Gallus Gallus)
  misc_feature (36): n=c or t
acaaaagaacatttaaagaatgagtaaatccagccngctcccatctccaaagcttctactttcttgaagtt

SEQ ID NO: 34589 - DNA, 71 bp, chicken (Gallus Gallus)
  misc_feature (36): n=a or g
agagaaattcctcacagtgtcaacataccttgaacnaatcagtaattacagtatgctaattgtgttgtact

SEQ ID NO: 34590 - DNA, 71 bp, chicken (Gallus Gallus)
  misc_feature (36): n=a or g
ggtgtaaaagaatctcagggtccacacagctggggntataggcttggtgcagggcgatgttacagcccaac

SEQ ID NO: 34591 - DNA, 71 bp, chicken (Gallus Gallus)
  misc_feature (36): n=a or g
gcccacatacaggatgagaactgcccaatgcaatcnttggcatgaacgtggtccagctccatctgcaggga

SEQ ID NO: 34592 - DNA, 71 bp, chicken (Gallus Gallus)
  misc_feature (36): n=a or g
atcacagagccacctgcagtgagtgctattagctgnggttgtctgtgggcaaggaggagacctctgcacat

SEQ ID NO: 34593 - DNA, 71 bp, chicken (Gallus Gallus)
  misc_feature (36): n=c or t
tttttctccatctgttcttgtagcattgcagtttangacttgggtggtggcactttcgatatttccatttt

SEQ ID NO: 34594 - DNA, 71 bp, chicken (Gallus Gallus)
  misc_feature (36): n=c or t
cagcagaaactacatgaggcaataaacagtatttgnggagtattcaatgaggaaatgaagttataagcttt

SEQ ID NO: 34595 - DNA, 71 bp, chicken (Gallus Gallus)
  misc_feature (36): n=a or g
gatgcctgatgtaaatagctgtgctgtagtttggancaagtttgtcaaagaccccagacctaccagcactg

SEQ ID NO: 34596 - DNA, 71 bp, chicken (Gallus Gallus)
  misc_feature (36): n=a or g
attttataagactttccaaaaatatccctctttacncttagggcagagttaaacagcagaagaacttagta

SEQ ID NO: 34597 - DNA, 71 bp, chicken (Gallus Gallus)
  misc_feature (36): n=a or c
gctctgaggctgagtagtgctacaaaatactgcagntgagcaacacagaggctcggctagaagaaagctga

SEQ ID NO: 34598 - DNA, 71 bp, chicken (Gallus Gallus)
  misc_feature (36): n=g or t
tccctgcatgccccgggaactgcggactgttcaggngctgtggggctacaaggacaatctgatctgcttca

SEQ ID NO: 34599 - DNA, 71 bp, chicken (Gallus Gallus)
  misc_feature (36): n=c or t
atctataaatcccttagtcccaacctccttcatggnttttcaaacaaggaacaaggaaaggctatgtcaag

SEQ ID NO: 34600 - DNA, 71 bp, chicken (Gallus Gallus)
  misc_feature (36): n=a or g
tttttgtataggtgtatataggccttctgctgctgntgatggctttttggagtgacctaaaccaacatgag

SEQ ID NO: 34601 - DNA, 71 bp, chicken (Gallus Gallus)
  misc_feature (36): n=a or g
gcctaccaggaaaataagaattagtgagctgaaaantgaccaaaaatggaattgcaagacaatatcacagc

SEQ ID NO: 34602 - DNA, 71 bp, chicken (Gallus Gallus)
  misc_feature (36): n=a or g
gtgaagttgtggcatcttgtattagtgctaaagaanacaacacaagcatgctcagccttgagcaaaggcct

SEQ ID NO: 34603 - DNA, 71 bp, chicken (Gallus Gallus)
  misc_feature (36): n=a or g
gctgggaggctggccattcccacaccctgtgacccnaagtgctgtctgctgtccctgttccgctccccccc

SEQ ID NO: 34604 - DNA, 71 bp, chicken (Gallus Gallus)
  misc_feature (36): n=c or t
ggtacagcagaatcacacagctgctcagaaagggangatgccaatactgcacaagaacactgtgctgagct

SEQ ID NO: 34605 - DNA, 71 bp, chicken (Gallus Gallus)
  misc_feature (36): n=a or g
attttaagatattcagaaagacatttcaaataaacnaaaactctcttggtatgattattgttacagggagt

SEQ ID NO: 34606 - DNA, 71 bp, chicken (Gallus Gallus)
  misc_feature (36): n=a or c
ctcaggatcgagccctaagcatccgaaattcagtgntctcacgtatctgagaaaggttttgcaccggagct

SEQ ID NO: 34607 - DNA, 71 bp, chicken (Gallus Gallus)
  misc_feature (36): n=c or t
tagaaagagacctcaagaacactgaagggaccttanggatgctgagtggaggttcttaccaacacaggcaa

SEQ ID NO: 34608 - DNA, 71 bp, chicken (Gallus Gallus)
  misc_feature (36): n=c or t
cttactgacaggataattctccatccactgcattgngttcatcagtgctactgcacgttaatcctcccccc

SEQ ID NO: 34609 - DNA, 71 bp, chicken (Gallus Gallus)
  misc_feature (36): n=a or g
ttttccaaccgaaaagcattcagcggggaaagttcncccagttccacggagagcagcactgctgggatgtc

SEQ ID NO: 34610 - DNA, 71 bp, chicken (Gallus Gallus)
  misc_feature (36): n=c or t
tgtgtttgttagttcagggcaacattttcaagacanatgcataagatgctgttaagaaagagtaaatgaga

SEQ ID NO: 34611 - DNA, 71 bp, chicken (Gallus Gallus)
  misc_feature (36): n=c or t
cagggaagccaaaggttggtttaccttaaggcatanaagatagtgccattagagaacaatctgatgaggcg

SEQ ID NO: 34612 - DNA, 71 bp, chicken (Gallus Gallus)
  misc_feature (36): n=c or t
ctcagttttctttcagcagagctccaaccaatggangtgacttctcaagttacagcgttctgctatgacag

SEQ ID NO: 34613 - DNA, 71 bp, chicken (Gallus Gallus)
  misc_feature (36): n=c or t
cagccggccagcattagaagtgacagaacagactantcacattctcttgcataagtttctgcagaagccaa

SEQ ID NO: 34614 - DNA, 71 bp, chicken (Gallus Gallus)
  misc_feature (36): n=c or t
tgcaaacatttttagatgcagacaaatgctcagctnggaaaactctgaagtcttctctttgctcagttcaa

SEQ ID NO: 34615 - DNA, 71 bp, chicken (Gallus Gallus)
  misc_feature (36): n=a or g
cccaagatactgatcttcatggcatcttggcctcantctgccttgtgatgcctgagcattgcagtgtgcgc

SEQ ID NO: 34616 - DNA, 71 bp, chicken (Gallus Gallus)
  misc_feature (36): n=a or g
tcttcacaaaatcacacagataaataactgaaagcntaatgattcacccgctttctgaaaaataaaggaaa

SEQ ID NO: 34617 - DNA, 71 bp, chicken (Gallus Gallus)
  misc_feature (36): n=g or t
tttcccgtgcagcggttacagacacaactgttatgntttaaaagcatcacgcagacaagacggaacactta

SEQ ID NO: 34618 - DNA, 71 bp, chicken (Gallus Gallus)
  misc_feature (36): n=a or g
tccaataaaacattaaaagaggcattaagtacagcnccgtgccaaaagctattgcaactacaaacacaagt

SEQ ID NO: 34619 - DNA, 71 bp, chicken (Gallus Gallus)
  misc_feature (36): n=a or g
ctcagttccctgcctgaagacagggataccacaggntgcttcaacttgatgggttaatgctgaaccccagt

SEQ ID NO: 34620 - DNA, 71 bp, chicken (Gallus Gallus)
  misc_feature (36): n=c or t
gcacagcagaagcagacaaggatcaggtaggtacangtgctaagctctgaagcagatggagtgatgacaaa

SEQ ID NO: 34621 - DNA, 71 bp, chicken (Gallus Gallus)
  misc_feature (36): n=c or t
tcttttaactgatggagttggggccttcatattccnagctgagtcttcactgccatttgtgaagaaagtgt

SEQ ID NO: 34622 - DNA, 71 bp, chicken (Gallus Gallus)
  misc_feature (36): n=a or g
aaagcaagcggctgtaagaattgtcaaggatgactnaatgaccaaagactcatctggaagaaccataaatt

SEQ ID NO: 34623 - DNA, 71 bp, chicken (Gallus Gallus)
  misc_feature (36): n=a or g
taaagcactttgccggacagcacctggctccacaancacatcacttcagcaaacagcacaccacaatgcta

SEQ ID NO: 34624 - DNA, 71 bp, chicken (Gallus Gallus)
  misc_feature (36): n=g or t
atgacaaaattgctagctggtcattaaaaatttagngctggtagctaaaatttcagtcactctcataacaa

SEQ ID NO: 34625 - DNA, 71 bp, chicken (Gallus Gallus)
  misc_feature (36): n=g or t
acaccacaaattcttgcaaacattgtgaaactcctncatgtgaattttgccaactacaaaatgttcagcaa

SEQ ID NO: 34626 - DNA, 71 bp, chicken (Gallus Gallus)
  misc_feature (36): n=g or t
atggattgttactgcatttctggaaggattcttttnttattaagatgctggtgtagcaagtttcaggctat

SEQ ID NO: 34627 - DNA, 71 bp, chicken (Gallus Gallus)
  misc_feature (36): n=c or t
ctactaagttaaacaaagtaattacaggagcaattnctgcacattcttgctagtattgcattagtagcctg

SEQ ID NO: 34628 - DNA, 71 bp, chicken (Gallus Gallus)
  misc_feature (36): n=a or g
aactatggagtgattactattatttctgataaacantacccaaagcaaggccccttttgtggcacttcaga

SEQ ID NO: 34629 - DNA, 71 bp, chicken (Gallus Gallus)
  misc_feature (36): n=a or c
tctgtgctggtgcagaattgtggttctttggctgantcaccaatagggatgattgtcattagggaacacta

SEQ ID NO: 34630 - DNA, 71 bp, chicken (Gallus Gallus)
  misc_feature (36): n=a or c
aatgttattttttccaagtgtcattacaatcttggnacgtttgctagcatctcttttcacatcgtaagggc

SEQ ID NO: 34631 - DNA, 71 bp, chicken (Gallus Gallus)
  misc_feature (36): n=a or g
aatgatttgacagtgaaatccgcctctgtcagaganaaagcatgagatttatagtgctgttgtcatgtgaa

SEQ ID NO: 34632 - DNA, 71 bp, chicken (Gallus Gallus)
  misc_feature (36): n=a or g
caggaatcctgcaaacaaccctcatttggcagcacnctctctggcatatctgtgggctttgtgctaagcga

SEQ ID NO: 34633 - DNA, 71 bp, chicken (Gallus Gallus)
  misc_feature (36): n=a or g
aatctaaatacatttaatgacgtatctggtgaggtngtaactgcagcttcttgtctggcttctgagcagag

SEQ ID NO: 34634 - DNA, 71 bp, chicken (Gallus Gallus)
  misc_feature (36): n=c or t
cactgagatgtttatttcttgttagtgttgatctanaggcactttgtaaagcaacagaactgcaggatttt

SEQ ID NO: 34635 - DNA, 71 bp, chicken (Gallus Gallus)
  misc_feature (36): n=g or t
tggaattggtgaaattcccgtaagcaggcaaagatnaaaagaaaactttctttataatgtaagagtaaact

SEQ ID NO: 34636 - DNA, 71 bp, chicken (Gallus Gallus)
  misc_feature (36): n=a or g
aatgtgccagtaaagcatttgatagtatctgtaacnctggagcaaaaaacttcagtttgtattttgattca

SEQ ID NO: 34637 - DNA, 71 bp, chicken (Gallus Gallus)
  misc_feature (36): n=c or t
agcaattgtgaaggctgcagcactgctctgtgctcntcagtcacagaacaaagaggttcagtctgatagca

SEQ ID NO: 34638 - DNA, 71 bp, chicken (Gallus Gallus)
  misc_feature (36): n=c or t
aagttttgcatgaacactgatagattttttggacgnggtgtttggtaccaagcctggaattctcttgaatt

SEQ ID NO: 34639 - DNA, 71 bp, chicken (Gallus Gallus)
  misc_feature (36): n=c or t
taagctgtgtttgactacataacttccagcttggcnttgtgttttcacaggaaaaccccaagaattggaaa

SEQ ID NO: 34640 - DNA, 71 bp, chicken (Gallus Gallus)
  misc_feature (36): n=a or g
tctgcgttgagatttactttacatatattattcatnttatgcttggatggaaaggttacagttgacattgg

SEQ ID NO: 34641 - DNA, 71 bp, chicken (Gallus Gallus)
  misc_feature (36): n=c or t
gcatttttcgtgctttcttctcaacatgtggttttnatttggcttccagaggtgatagtgcttgaagggat

SEQ ID NO: 34642 - DNA, 71 bp, chicken (Gallus Gallus)
  misc_feature (36): n=c or t
acgtcccacggaagtggcccaatgtcatggttttangagcattgtcctattgcagaagttctcctttccta

SEQ ID NO: 34643 - DNA, 71 bp, chicken (Gallus Gallus)
  misc_feature (36): n=c or t
tgtacggacagatgtgtgtacccatatctgtctagnctttggtaaaacagggcaatagggtgtttcttggt

SEQ ID NO: 34644 - DNA, 71 bp, chicken (Gallus Gallus)
  misc_feature (36): n=c or t
atcttcaaattctttcacgatatctttcatcatatnttggtagaatgactcccctctctctgtcagtgtga

SEQ ID NO: 34645 - DNA, 71 bp, chicken (Gallus Gallus)
  misc_feature (36): n=a or g
aatgcagaggacaaattgatctcattcagaaccacngagcagaaaggctgaaaatcagcaggcattacacc

SEQ ID NO: 34646 - DNA, 71 bp, chicken (Gallus Gallus)
  misc_feature (36): n=c or t
tgcctgtagttgataacaatatcagtttcacgttanatgaaattttgctaccagaatgtgcagcataactt

SEQ ID NO: 34647 - DNA, 71 bp, chicken (Gallus Gallus)
  misc_feature (36): n=a or g
tatttcttactttttcatataggatcaatttggagnaaggtgcccaagcaaggcctccccactgggggact

SEQ ID NO: 34648 - DNA, 71 bp, chicken (Gallus Gallus)
  misc_feature (36): n=c or t
ttcacatattacacagactcttgagctccctgaganagtcactaacctacctgggatgttaaactccaaag

SEQ ID NO: 34649 - DNA, 71 bp, chicken (Gallus Gallus)
  misc_feature (36): n=a or g
gcagcatcaaaaggaagaaacagatgtgcacagacncagcagaacaaaagagaaatggcttttgagatgat

SEQ ID NO: 34650 - DNA, 71 bp, chicken (Gallus Gallus)
  misc_feature (36): n=c or t
aattgggcacagtcagacttttcctcttttgagagnactttgctgctggagagcgtgcagcgggcacatac

SEQ ID NO: 34651 - DNA, 71 bp, chicken (Gallus Gallus)
  misc_feature (36): n=g or t
ttaaacatcagcaatgttaatttacacctgtgttanaggagaaccaagcccaaataaatccattcagagtt

SEQ ID NO: 34652 - DNA, 71 bp, chicken (Gallus Gallus)
  misc_feature (36): n=c or t
ttgaagtgaaggcctacctcagtaactccctaatgnatactgggattttagaagttcctatctgagcagct

SEQ ID NO: 34653 - DNA, 71 bp, chicken (Gallus Gallus)
  misc_feature (36): n=a or g
aaaacgcccagattaacctagcagagaaatgacacnatggaagtcagaaagcagttgtgaataaacactct

SEQ ID NO: 34654 - DNA, 71 bp, chicken (Gallus Gallus)
  misc_feature (36): n=g or t
gtaagcatttaatatgctgcactatgtttcatttcnatctccttttaatgcacttattattcaatcctcat

SEQ ID NO: 34655 - DNA, 71 bp, chicken (Gallus Gallus)
  misc_feature (36): n=a or g
gcaggacacagaagataaattttggatttggaactntcagtaccatacagagtacttttctgtccagctaa

SEQ ID NO: 34656 - DNA, 71 bp, chicken (Gallus Gallus)
  misc_feature (36): n=a or g
cagctgagatttttccctattagtttcaatttgagnaagatgcatttgattttatggtctaatagagaaaa

SEQ ID NO: 34657 - DNA, 71 bp, chicken (Gallus Gallus)
  misc_feature (36): n=c or t
ctgctcccactaacagcgccgtggtttctcctttcntagcttatatacttacatctggtctaacctatcac

SEQ ID NO: 34658 - DNA, 71 bp, chicken (Gallus Gallus)
  misc_feature (36): n=c or t
ggaagaaacaaattacacattactaaggtaccagtngcaatcaagaaacacatatgtaaacacagacatga

SEQ ID NO: 34659 - DNA, 71 bp, chicken (Gallus Gallus)
  misc_feature (36): n=a or c
aagaaaacaggacaagagcccttagagcagctaccnttgtcatgtcccttacattgccgagtactgtgagg

SEQ ID NO: 34660 - DNA, 71 bp, chicken (Gallus Gallus)
  misc_feature (36): n=a or g
gaaacgaagacccagcattccagcttctgttctgcntgtgcttttatgtgccttacctttggcaggtttga

SEQ ID NO: 34661 - DNA, 71 bp, chicken (Gallus Gallus)
  misc_feature (36): n=c or t
caaaggaaaagagaaagtatcaaatagaaaactcangtgagcagaaattatatcatccgaacaccatttgt

SEQ ID NO: 34662 - DNA, 71 bp, chicken (Gallus Gallus)
  misc_feature (36): n=a or g
taactgttaaggaattaatctttcatttaggaaatncaagtctgttctgttactcttcaaaacactccttg

SEQ ID NO: 34663 - DNA, 71 bp, chicken (Gallus Gallus)
  misc_feature (36): n=c or t
tgattgaccccaacgccttagaaggtgcactgaccnagggacactgtcaatgaaatgatgcatttcaaaac

SEQ ID NO: 34664 - DNA, 71 bp, chicken (Gallus Gallus)
  misc_feature (36): n=g or t
accagtggtgtatgtataatacacttggagccaatnaatcttttaaggaacaggtctaacctattttttaa

SEQ ID NO: 34665 - DNA, 71 bp, chicken (Gallus Gallus)
  misc_feature (36): n=a or c
ggcttcttcagaattcaaatctaagcttcacatctnacagagaaaaaaggccaacacaccaatacgtttca

SEQ ID NO: 34666 - DNA, 71 bp, chicken (Gallus Gallus)
  misc_feature (36): n=a or c
aaaaatacaaacgcctggcaataaaactagcacctnatttatttttgaaagttttaactctcttttctaca

SEQ ID NO: 34667 - DNA, 71 bp, chicken (Gallus Gallus)
  misc_feature (36): n=a or g
cattaaaaaccactgtggcattcaagaaataacccncaacaactgtttctgtagatctaagagtttattac

SEQ ID NO: 34668 - DNA, 71 bp, chicken (Gallus Gallus)
  misc_feature (36): n=c or t
cattctatggacttctcactaagattgttgacttantcaatttgctcttatgagattttaacctatctgtt

SEQ ID NO: 34669 - DNA, 71 bp, chicken (Gallus Gallus)
  misc_feature (36): n=a or g
tgtctgacacatccctgtcccttccctccaggtgangccccaggagcccaatggaaaaccagagcccagct

SEQ ID NO: 34670 - DNA, 71 bp, chicken (Gallus Gallus)
  misc_feature (36): n=c or t
ttgtgaacttgaccgtgaagatttgacactggtcangtacttcatgaggagccaaaagtgttcggcaagct

SEQ ID NO: 34671 - DNA, 71 bp, chicken (Gallus Gallus)
  misc_feature (36): n=a or c
aggctatctgttggaactgtgcattcagaagagtgncaccaaacagtgccaagtctaaggggtcaatgggt

SEQ ID NO: 34672 - DNA, 71 bp, chicken (Gallus Gallus)
  misc_feature (36): n=c or t
tcagctgaatggattaatacaagattaccctgagcncaactgtctccctatatcctcattctccaattttg

SEQ ID NO: 34673 - DNA, 71 bp, chicken (Gallus Gallus)
  misc_feature (36): n=a or g
tgctcaattccacactataagtccagtcaagtttantatatgagctatcacgattacagtttcacatataa

SEQ ID NO: 34674 - DNA, 71 bp, chicken (Gallus Gallus)
  misc_feature (36): n=a or c
ctcattcagtctcagaggtcactctgcatgtgtctntgcatatctaggaggttcttcagtagaaaagggat

SEQ ID NO: 34675 - DNA, 71 bp, chicken (Gallus Gallus)
  misc_feature (36): n=c or t
ctctgtgaagccttctgtctttcttgtgagtgtaanacaactccataaaactaaatacagctctaatacca

SEQ ID NO: 34676 - DNA, 71 bp, chicken (Gallus Gallus)
  misc_feature (36): n=c or t
gagccaagttcagtcaatattggagagacttcaaancaatacctgagtaatgcagaggagtatcagtcatc

SEQ ID NO: 34677 - DNA, 71 bp, chicken (Gallus Gallus)
  misc_feature (36): n=c or t
atagtgaggaaaatgtgtgactctccaaatatcttnatctgaatcttctgttagctcactgtcagcattta

SEQ ID NO: 34678 - DNA, 71 bp, chicken (Gallus Gallus)
  misc_feature (36): n=c or t
gaccagactgaagaggagtaagagacagaagttccnccaggtgcacagttcttctttagaagggcattttc

SEQ ID NO: 34679 - DNA, 71 bp, chicken (Gallus Gallus)
  misc_feature (36): n=a or g
tttctaagtgatcttttcaaaagtagcacagaaaangagctggatgttgcgtggcattagagatgaatgca

SEQ ID NO: 34680 - DNA, 71 bp, chicken (Gallus Gallus)
  misc_feature (36): n=c or t
atatgatttcggctgaagaggtcaacagtcactctngatgctcattagcatcctatgatactgctatgata

SEQ ID NO: 34681 - DNA, 71 bp, chicken (Gallus Gallus)
  misc_feature (36): n=c or t
ttaaatctggtggtgtaatattaatactatcacatnacattgttaaactattgtattattatactgctaat

SEQ ID NO: 34682 - DNA, 71 bp, chicken (Gallus Gallus)
  misc_feature (36): n=c or t
ggatggctgtggcagaggatccccatgaagacagangcttgccatttaatgcttagcatgggtaattgcaa

SEQ ID NO: 34683 - DNA, 71 bp, chicken (Gallus Gallus)
  misc_feature (36): n=c or t
atgaactacagggggccatgacaaatatgcagattnataaagatttggtacaagcaacattcccttggatg

SEQ ID NO: 34684 - DNA, 71 bp, chicken (Gallus Gallus)
  misc_feature (36): n=a or g
agaaacaccccagtcttcatgcaatctgattaacantttatatgtagattcattattctcttgccagcaac

SEQ ID NO: 34685 - DNA, 71 bp, chicken (Gallus Gallus)
  misc_feature (36): n=c or t
tgagtctcagggttttgggattgtggcctacacaanatccttaatgatgaactctagaaaggaaaagagtt

SEQ ID NO: 34686 - DNA, 71 bp, chicken (Gallus Gallus)
  misc_feature (36): n=c or t
aaaatgcccccgcttcagacatggaattcagtcttngggccttggtttgacctttaagtcagaaagaagag

SEQ ID NO: 34687 - DNA, 71 bp, chicken (Gallus Gallus)
  misc_feature (36): n=g or t
ctcctcctcccgttagcccacaggtaggcactaagngtctgaagtagagatatgtgactagtgtttatact

SEQ ID NO: 34688 - DNA, 71 bp, chicken (Gallus Gallus)
  misc_feature (36): n=c or t
actccagtcagcactagtttgggctataacagaaangtgttggtcctgcaacaggttcacctgcaaaacaa

SEQ ID NO: 34689 - DNA, 71 bp, chicken (Gallus Gallus)
  misc_feature (36): n=a or g
ggttgccattctgctgggaaatggcatcagaatttnctttcaaatagaagaccagagaagtcacaggtaac

SEQ ID NO: 34690 - DNA, 71 bp, chicken (Gallus Gallus)
  misc_feature (36): n=a or g
tctcaaacagtttatccacttggtccacactaaagngttatgcttccatcttcacacagtatcaagcatta

SEQ ID NO: 34691 - DNA, 71 bp, chicken (Gallus Gallus)
  misc_feature (36): n=c or t
atctccaaataaatcttatgccgtgtgatgaactcngagcattatctacatatcttttgctaatgtgtcca

SEQ ID NO: 34692 - DNA, 71 bp, chicken (Gallus Gallus)
  misc_feature (36): n=c or t
ccactggtggggaagactgccacatactaaacactnttctctacaactgtcaattgggagtcactttgcaa

SEQ ID NO: 34693 - DNA, 71 bp, chicken (Gallus Gallus)
  misc_feature (36): n=c or t
accttctactctgccaaagctcctctgtgggacttntgtatttacaacagagacagcgctatattcagaag

SEQ ID NO: 34694 - DNA, 71 bp, chicken (Gallus Gallus)
  misc_feature (36): n=c or t
agatgctggagatttattcatgaaaactaactgagnactcagtcaccagaagggaattctgagtagcattt

SEQ ID NO: 34695 - DNA, 71 bp, chicken (Gallus Gallus)
  misc_feature (36): n=a or c
tatattttcctccacactgactgatagccctgatantctgaaattcacttcagtgaggaacttcttgagaa

SEQ ID NO: 34696 - DNA, 71 bp, chicken (Gallus Gallus)
  misc_feature (36): n=a or g
ctatgtttaagctgccgtgctgtacgtccagacacnatccattttaatttctggacatttggtttggaaca

SEQ ID NO: 34697 - DNA, 71 bp, chicken (Gallus Gallus)
  misc_feature (36): n=a or g
acgtataaaacgcagaggatctgttttgtgcaccantgagttttattgtcctgtttactcaatgtatgtgt

SEQ ID NO: 34698 - DNA, 71 bp, chicken (Gallus Gallus)
  misc_feature (36): n=c or t
tatgctattaattttctggcacagtttaaattgccntaagttaaatctacatgagtggttgaccctctgta

SEQ ID NO: 34699 - DNA, 71 bp, chicken (Gallus Gallus)
  misc_feature (36): n=a or g
agaaaataagggatttattgagaagttgttctcaanttctcttttagtatctttgccatctttgtaatgtt

SEQ ID NO: 34700 - DNA, 71 bp, chicken (Gallus Gallus)
  misc_feature (36): n=g or t
gaagcagtctgatagtgttggtcggaaacctgatgngagtgtactccggggagatccaaatgaaaagacag

SEQ ID NO: 34701 - DNA, 71 bp, chicken (Gallus Gallus)
  misc_feature (36): n=c or t
ttctcccttccatttctgtggtacaaactagactgngttctgctgaaattggactcagatcgcaagtgtgt

SEQ ID NO: 34702 - DNA, 71 bp, chicken (Gallus Gallus)
  misc_feature (36): n=a or g
attcagtagcactgcagcagacaaactccatttccntatgaaagcctgtattcaagcgtactacacatctt

SEQ ID NO: 34703 - DNA, 71 bp, chicken (Gallus Gallus)
  misc_feature (36): n=a or g
ccatagatcatagaatatttccagaggtgagagtcncaacaaattaaattagcacagaaatcattaaaaga

SEQ ID NO: 34704 - DNA, 71 bp, chicken (Gallus Gallus)
  misc_feature (36): n=a or c
atgcttaaaaaactgtgatcagttggatcacagcangtaaggctgagaagagattgtgcttcctgttcggg

SEQ ID NO: 34705 - DNA, 71 bp, chicken (Gallus Gallus)
  misc_feature (36): n=a or g
tagaagtgccgctgcaaagaacaaaggcaacacagnaccaatggacagacaatagagtttcaggcagagca

SEQ ID NO: 34706 - DNA, 71 bp, chicken (Gallus Gallus)
  misc_feature (36): n=a or g
gcacgtactgctgtcacacagcgctttcactgaacnacataactgacttccacaatagcagattgttggct

SEQ ID NO: 34707 - DNA, 71 bp, chicken (Gallus Gallus)
  misc_feature (36): n=c or t
taggaaaaaaaatgcaaaacaagatggtgctaaatnaaattgcactaacatgaggccagagagtcattttg

SEQ ID NO: 34708 - DNA, 71 bp, chicken (Gallus Gallus)
  misc_feature (36): n=a or g
cagtaacctttcaagaaaaaggaagcccagagctcntgaatatgccttacttagtggggaaaaacaattcc

SEQ ID NO: 34709 - DNA, 71 bp, chicken (Gallus Gallus)
  misc_feature (36): n=a or g
ccatctcttttcttgccttgacagggtctgtatttngaattcttgctagcatttattgtttcgttaggggt

SEQ ID NO: 34710 - DNA, 71 bp, chicken (Gallus Gallus)
  misc_feature (36): n=a or g
caccacctcggttgtatttcttaatcccgtaaaggngaactggtagagcctccaggacctggtatctccca

SEQ ID NO: 34711 - DNA, 71 bp, chicken (Gallus Gallus)
  misc_feature (36): n=g or t
acatcacatgaaaaagcattatgcagctgaagcagncatttgtatgggaaggtgtttgcaagatttctcct

SEQ ID NO: 34712 - DNA, 71 bp, chicken (Gallus Gallus)
  misc_feature (36): n=a or g
acagatgtgatatcttcacaacaaatgacttaaggnttttgtatagaaaaagatgtcttacgaaaaatacc

SEQ ID NO: 34713 - DNA, 71 bp, chicken (Gallus Gallus)
  misc_feature (36): n=c or t
gtgggatgagttccaagcaatcatttccagtataantgggatcaatcatcactcaacctatttacatactt

SEQ ID NO: 34714 - DNA, 71 bp, chicken (Gallus Gallus)
  misc_feature (36): n=g or t
acctaactgtatcttctcttaaacacccttaaatanccaattcttaactaatagctcagactcagaaatgc

SEQ ID NO: 34715 - DNA, 71 bp, chicken (Gallus Gallus)
  misc_feature (36): n=a or g
agttcaggttttaggatcgtgtaatttgaggttaantgtatactttgtatatgatagcacttggaaagata

SEQ ID NO: 34716 - DNA, 71 bp, chicken (Gallus Gallus)
  misc_feature (36): n=a or g
gctcccagggactttcccaggaaaatcagagggccnaatacactggaatgactttccctctgtttgtgttc

SEQ ID NO: 34717 - DNA, 71 bp, chicken (Gallus Gallus)
  misc_feature (36): n=a or g
agttgccttcattttatactgacaatcagatttttntgggaagaattgaggacaatcagatttttgtggga

SEQ ID NO: 34718 - DNA, 71 bp, chicken (Gallus Gallus)
  misc_feature (36): n=a or g
aggagaggttctctgagtatagatgctctgcaaatncttccaagctatttcacagttcagatttgaatatg

SEQ ID NO: 34719 - DNA, 71 bp, chicken (Gallus Gallus)
  misc_feature (36): n=c or t
actttctggcacaagaatggcacagatacaaagaantgtatcaccagcacaactgaaaccaagaggaacag

SEQ ID NO: 34720 - DNA, 71 bp, chicken (Gallus Gallus)
  misc_feature (36): n=c or t
tttacctcattttaagaaagacttgagcaaagttangccaggtggaggaaaagactcaggattagaggtga

SEQ ID NO: 34721 - DNA, 71 bp, chicken (Gallus Gallus)
  misc_feature (36): n=c or t
atacctgagtaataccttatcagtactaatcttttnggcttgagactgtgacttgggttcgagtggccttt

SEQ ID NO: 34722 - DNA, 71 bp, chicken (Gallus Gallus)
  misc_feature (36): n=a or g
ttgcaaagcattacttcaaatggtgcactccaaccngtatcaccaactacccttcccctgcaacttctaga

SEQ ID NO: 34723 - DNA, 71 bp, chicken (Gallus Gallus)
  misc_feature (36): n=a or g
ggtcataaaaccttcatcatcaaaccttcctcatcnttcaggtctgcaaagattttcacaggaggtcaatc

SEQ ID NO: 34724 - DNA, 71 bp, chicken (Gallus Gallus)
  misc_feature (36): n=a or g
gagaaatttcaggagaacatctgactgggtaaaaantttctattgtatgtgtatttaaaaggcattttttt

SEQ ID NO: 34725 - DNA, 71 bp, chicken (Gallus Gallus)
  misc_feature (36): n=g or t
tgaagctagaaatttcctcagatcgccatttctttngtttatggagtattctacatggtttagatgtaagc

SEQ ID NO: 34726 - DNA, 71 bp, chicken (Gallus Gallus)
  misc_feature (36): n=g or t
tcaaggaattgtcaatatttacctagtactaatgcngagagaatacagagagcaccctaaccacatttctc

SEQ ID NO: 34727 - DNA, 71 bp, chicken (Gallus Gallus)
  misc_feature (36): n=a or c
gtttgcataaggaatgttatgtttctatcctattgnaatttaatgacggggaagaaagactcaagcaatgc

SEQ ID NO: 34728 - DNA, 71 bp, chicken (Gallus Gallus)
  misc_feature (36): n=c or t
ccataggtttttcatactgtgaatttagaaggatanttacggatttctaaacacatttgtcagctagacaa

SEQ ID NO: 34729 - DNA, 71 bp, chicken (Gallus Gallus)
  misc_feature (36): n=c or t
tttagctcatgtttggagaaagagaaggttaaatancagtgtgtagaggcttccatggtgcagtctcaatt

SEQ ID NO: 34730 - DNA, 71 bp, chicken (Gallus Gallus)
  misc_feature (36): n=a or g
caggaaatgcagtctctggcattatttccttcagantacttaactttttctggtacactgtgagcagcatt

SEQ ID NO: 34731 - DNA, 71 bp, chicken (Gallus Gallus)
  misc_feature (36): n=g or t
ttatgggctctaccttttaattgacaaatgcactgnttagatcctgtagatgcaacagaaaaagaccgtaa

SEQ ID NO: 34732 - DNA, 71 bp, chicken (Gallus Gallus)
  misc_feature (36): n=a or g
aaggatgtgtgtacataacaaattatctgatctccngttggttactggtgctcaggtgttctggggggggg

SEQ ID NO: 34733 - DNA, 71 bp, chicken (Gallus Gallus)
  misc_feature (36): n=c or t
gctcttgaacctcacatatgtcattgtgaagaggtnattatttctgatttgacattacgtctaccttgaaa

SEQ ID NO: 34734 - DNA, 71 bp, chicken (Gallus Gallus)
  misc_feature (36): n=a or g
tagtgcatcagtaagccaaatttaagaatgtttccntatcaaatatttttctacatccaatccagagtctt

SEQ ID NO: 34735 - DNA, 71 bp, chicken (Gallus Gallus)
  misc_feature (36): n=c or t
aaaaaggtagtgaattatatggctagttgcttgctngtgttccaaaaacagagtttgcaggaaggatttat

SEQ ID NO: 34736 - DNA, 71 bp, chicken (Gallus Gallus)
  misc_feature (36): n=c or t
aaagaaccattcactgatagcttccatgagcaaagncttgtgctgcatgagccactgctcaggtagaatgc

SEQ ID NO: 34737 - DNA, 71 bp, chicken (Gallus Gallus)
  misc_feature (36): n=a or g
tacatggacttctctgatgtagtttcatggaagtcnactttggggatgcagcttttttcttgatgacctga

SEQ ID NO: 34738 - DNA, 71 bp, chicken (Gallus Gallus)
  misc_feature (36): n=g or t
tcagagttacatcttcaatagtgctaatgaaaaggngaaatttctgctagtttgtaatctctgtggagttc

SEQ ID NO: 34739 - DNA, 71 bp, chicken (Gallus Gallus)
  misc_feature (36): n=c or t
attggatagtatctggggtgtgaaattaaaatcccntttgagcaaccacaagttcctacatttctgaataa

SEQ ID NO: 34740 - DNA, 71 bp, chicken (Gallus Gallus)
  misc_feature (36): n=c or t
gctattatctctgggctgcaggaacattcgtgtcantagaaagcatgcaggctgaagctgtgcctcttgat

SEQ ID NO: 34741 - DNA, 71 bp, chicken (Gallus Gallus)
  misc_feature (36): n=a or g
cctctgacagtggtagtatacctgagcagtagcagncaaatttgagaactgcagctgcacagaagtgtagg

SEQ ID NO: 34742 - DNA, 71 bp, chicken (Gallus Gallus)
  misc_feature (36): n=a or g
ggcgtaaccgaagcgggatgtttcctcataccagcntcaaggaagctgcatgttctgtcaagctgcagttt

SEQ ID NO: 34743 - DNA, 71 bp, chicken (Gallus Gallus)
  misc_feature (36): n=a or g
tagccctgtagctacgcaaatacaatgaaggagacntagcaagtctgcagaattcaaggcagaagcatata

SEQ ID NO: 34744 - DNA, 71 bp, chicken (Gallus Gallus)
  misc_feature (36): n=c or t
tggtggtgttaattgaggcactccaacttttaaatncaaagattaattgtctgttggcagtgttaggcaaa

SEQ ID NO: 34745 - DNA, 71 bp, chicken (Gallus Gallus)
  misc_feature (36): n=c or t
aatagagccaccttcttctgctctgttttggcaagngctacacattcaagtatggtaaatctagtagtgaa

SEQ ID NO: 34746 - DNA, 71 bp, chicken (Gallus Gallus)
  misc_feature (36): n=a or g
tccttaatcaagacagttatatgccctgttttcaangcctctatgatctcagtttctcctttctcaactcc

SEQ ID NO: 34747 - DNA, 71 bp, chicken (Gallus Gallus)
  misc_feature (36): n=c or t
catgcaccgggtgtgtaagggcagcaagtttgcccngcagtgacagccaagcttggcttcataatggtaag

SEQ ID NO: 34748 - DNA, 71 bp, chicken (Gallus Gallus)
  misc_feature (36): n=c or t
ctcactgcgtttatccaagtatgcagcatgtttctncctgtaaaaatgacaaaatgccaccgaaattgggg

SEQ ID NO: 34749 - DNA, 71 bp, chicken (Gallus Gallus)
  misc_feature (36): n=a or c
ttgcccctagccttggttttctgactggcatgtggnaggatggagtcccatcagtgcaacggagggaatgc

SEQ ID NO: 34750 - DNA, 71 bp, chicken (Gallus Gallus)
  misc_feature (36): n=c or t
ccacggggctcttgggatcacttccttcatagcttnagctgctgccagtatcctcctgcttctccctactg

SEQ ID NO: 34751 - DNA, 71 bp, chicken (Gallus Gallus)
  misc_feature (36): n=c or t
tgccttaatccatgtgtccacttcacatcctgctcnatgttttgaatgtgatatggctcaagagtctggag

SEQ ID NO: 34752 - DNA, 71 bp, chicken (Gallus Gallus)
  misc_feature (36): n=a or g
gcagggaggaagcctgcagggggacagaggacaggngaactcctgtgggagcatcaggaaggacaccaagc

SEQ ID NO: 34753 - DNA, 71 bp, chicken (Gallus Gallus)
  misc_feature (36): n=a or g
caggccaccatccggtcctgagaaaaggtgatgtcnggtccatgggtagggtggaatcgcaggtctgtgtc

SEQ ID NO: 34754 - DNA, 71 bp, chicken (Gallus Gallus)
  misc_feature (36): n=c or t
ttctcagactttctcaaagcaaaagagacgtctttntctctttgttccctgaagacagacatgctgtcatt

SEQ ID NO: 34755 - DNA, 71 bp, chicken (Gallus Gallus)
  misc_feature (36): n=a or g
ttgaaatgtcatactttggtgcttttctagcattcnagaactgacttaagctgttgtgaatatcaggagac

SEQ ID NO: 34756 - DNA, 71 bp, chicken (Gallus Gallus)
  misc_feature (36): n=a or g
aatggaggaggtcggtgtttctgcccattaagcgcngcagctgatttatgcccagctagctgctctgcagg

SEQ ID NO: 34757 - DNA, 71 bp, chicken (Gallus Gallus)
  misc_feature (36): n=a or g
catgcccactttctgcagaaattaggccaaaactcnggtgcattatgttatgaaagtgatatctaagaaac

SEQ ID NO: 34758 - DNA, 71 bp, chicken (Gallus Gallus)
  misc_feature (36): n=a or g
agaaaggtctggagtggttctcagcagaatggaganaagcccaaagtggagcttgctaagcatatggaaaa

SEQ ID NO: 34759 - DNA, 71 bp, chicken (Gallus Gallus)
  misc_feature (36): n=c or t
atccacttccctctgaagtcggtggacatccagcanagggtttctctctctttcaaggcacatgatagacg

SEQ ID NO: 34760 - DNA, 71 bp, chicken (Gallus Gallus)
  misc_feature (36): n=a or g
ggtgttactgagctccctaagacagagagaaggtcnttctgaaacttggtactttcatcagtgctatcagg

SEQ ID NO: 34761 - DNA, 71 bp, chicken (Gallus Gallus)
  misc_feature (36): n=c or t
aattattctttcatgtgctggtggaatgcattaacnacttgtgaagggtacttcagcggttatgaagcaaa

SEQ ID NO: 34762 - DNA, 71 bp, chicken (Gallus Gallus)
  misc_feature (36): n=a or g
ttctgccacagatacttagcgttaaaaagcttttcnttgtggaaagggggagtgggaccgagctgaatcca

SEQ ID NO: 34763 - DNA, 71 bp, chicken (Gallus Gallus)
  misc_feature (36): n=c or t
cctcctgtgaatagcgtatctgcagtcctgaaatanagcatattattatattttgtcttggcagtagaagt

SEQ ID NO: 34764 - DNA, 71 bp, chicken (Gallus Gallus)
  misc_feature (36): n=a or g
aaacaggtggctgtcctccaatagtaaagtgaaacngtaggacacaagaaatatacacagcaattggcctc

SEQ ID NO: 34765 - DNA, 71 bp, chicken (Gallus Gallus)
  misc_feature (36): n=c or t
actatcagatgctgttaaagtatttatgtttttcgncctcaagaaatgttcatcttcccttactgtgtccc

SEQ ID NO: 34766 - DNA, 71 bp, chicken (Gallus Gallus)
  misc_feature (36): n=g or t
ctgctttagtttagcaattcaaagcagctcatgccntactgatgggatcaatgggccgctggtctccatgg

SEQ ID NO: 34767 - DNA, 71 bp, chicken (Gallus Gallus)
  misc_feature (36): n=a or g
gctaaattttagttagaagatgctgtctctatatgntattttctacactaggatcacacagaacttcagga

SEQ ID NO: 34768 - DNA, 71 bp, chicken (Gallus Gallus)
  misc_feature (36): n=c or t
ccaatcctaagtgataaacagcaaatagctcatgtnccaaaaatcaaagtcatgggagttccaaaactgca

SEQ ID NO: 34769 - DNA, 71 bp, chicken (Gallus Gallus)
  misc_feature (36): n=a or g
gtgctgtaagccagccgtgacaaatatcctgaggancagctatgcaaacaagatggttgataaaaacagag

SEQ ID NO: 34770 - DNA, 71 bp, chicken (Gallus Gallus)
  misc_feature (36): n=g or t
cccccagctcattaacataacaccagtagttagctntgtgcctcccatacctgtgcctttttagataaagg

SEQ ID NO: 34771 - DNA, 71 bp, chicken (Gallus Gallus)
  misc_feature (36): n=c or t
taaaatcctcgaatgagttttaaaggaagagacatntagggatttgtttcgtgggctgaccgttctctctt

SEQ ID NO: 34772 - DNA, 71 bp, chicken (Gallus Gallus)
  misc_feature (36): n=c or t
ttcatgcccagcctcatccagaaataaaatgataanaactacgacaacaacaaaaatcatgaagaaacctg

SEQ ID NO: 34773 - DNA, 71 bp, chicken (Gallus Gallus)
  misc_feature (36): n=a or c
cttggcattatcagctctttaaacttacgttgttgnggaggtcaaatgtgaatagctcattccaagactga

SEQ ID NO: 34774 - DNA, 71 bp, chicken (Gallus Gallus)
  misc_feature (36): n=c or t
tggtaattatactctgtcagtgggtttaatggcttnaaaaattgtctttgctgtttgatctcttgatcaag

SEQ ID NO: 34775 - DNA, 71 bp, chicken (Gallus Gallus)
  misc_feature (36): n=a or c
tctctgtcaagactgatgctttcctgatgaaaggcngtacaggttttttagtgtctgttgagtctggattt

SEQ ID NO: 34776 - DNA, 71 bp, chicken (Gallus Gallus)
  misc_feature (36): n=a or c
tgtgcttcccaggccgccttttgctacgttacatcncctcaagcaagaaagaaatagggctgaaagttttt

SEQ ID NO: 34777 - DNA, 71 bp, chicken (Gallus Gallus)
  misc_feature (36): n=a or g
cagctccctgtgaaactgcagacctcatttaccttncctctgcttcatctcaggggtgcacagagaattag

SEQ ID NO: 34778 - DNA, 71 bp, chicken (Gallus Gallus)
  misc_feature (36): n=a or g
tttaagtttccataagccataaagctttgtgaagtngctagctattctataaaggatctgaaatgattcgg

SEQ ID NO: 34779 - DNA, 71 bp, chicken (Gallus Gallus)
  misc_feature (36): n=a or g
atccaccttgttttcatccagggaattgatgctgcngaaagggaagggttaaggggtggtggtagcatggg

SEQ ID NO: 34780 - DNA, 71 bp, chicken (Gallus Gallus)
  misc_feature (36): n=g or t
ctccctgggcaggtggattaaatttgaagagaaggnggaagatggaggggagcgctggagcaaaccccaca

SEQ ID NO: 34781 - DNA, 71 bp, chicken (Gallus Gallus)
  misc_feature (36): n=c or t
tggcttggttttggtggccactgaagcgagtcaccnggtgcagtacttcacccgcttcactgaggaaggct

SEQ ID NO: 34782 - DNA, 71 bp, chicken (Gallus Gallus)
  misc_feature (36): n=g or t
cagggattctgggggaaggggaagacagggcactcngtatgtcttcatatgagttgcctttaagcagcgtg

SEQ ID NO: 34783 - DNA, 71 bp, chicken (Gallus Gallus)
  misc_feature (36): n=a or g
agaacaaaccctaaactcattcacaatcacacaacngtcaaacttttgtgtgcaaacgaacactgggaatc

SEQ ID NO: 34784 - DNA, 71 bp, chicken (Gallus Gallus)
  misc_feature (36): n=a or g
gtccttagataactacgattctgctttgagcgttangagaacagctggtgttggtgcacacccggcagcct

SEQ ID NO: 34785 - DNA, 71 bp, chicken (Gallus Gallus)
  misc_feature (36): n=c or t
caaatacaactccctttcccctcagtatttgtaagnaaacagaaaatcttgctagctctatgaatctactg

SEQ ID NO: 34786 - DNA, 71 bp, chicken (Gallus Gallus)
  misc_feature (36): n=g or t
gtggctggttgtgcatttgctggaagaactgcaagncagtccaagctcagagcacttacacccttggaaat

SEQ ID NO: 34787 - DNA, 71 bp, chicken (Gallus Gallus)
  misc_feature (36): n=c or t
taagcttagctcccataaaggggaacaatggattanggatgcatttctttcaggtcttggcagaaagagaa

SEQ ID NO: 34788 - DNA, 71 bp, chicken (Gallus Gallus)
  misc_feature (36): n=c or t
gtaaggaagcagatacaatgaggtcaagagttcagnctccctgagttttaaatctagagaaggattattgt

SEQ ID NO: 34789 - DNA, 71 bp, chicken (Gallus Gallus)
  misc_feature (36): n=a or g
gcaaaatccttttgcgttatctgtacaacatcaatnatacaacaattcttactatctttcatcattaaagc

SEQ ID NO: 34790 - DNA, 71 bp, chicken (Gallus Gallus)
  misc_feature (36): n=a or c
ctgaactagtaaccttcaaactttgggagggattancagcctattccatattcattttaacctgcagccaa

SEQ ID NO: 34791 - DNA, 71 bp, chicken (Gallus Gallus)
  misc_feature (36): n=c or t
ttaaatcatgatggtttccatgggataaaacaccantacttgctctgatgcagacgcacttatatattctc

SEQ ID NO: 34792 - DNA, 71 bp, chicken (Gallus Gallus)
  misc_feature (36): n=g or t
tgaagagcaggtgaaaagtccagtgacagcaaagcncttctttaggtcacttgacttttctagttctaatc

SEQ ID NO: 34793 - DNA, 71 bp, chicken (Gallus Gallus)
  misc_feature (36): n=a or g
tggtaaaaaatggcttgaatttgcagttgtgccatncaggtgataaaagagcccttgcaactgcatttcag

SEQ ID NO: 34794 - DNA, 71 bp, chicken (Gallus Gallus)
  misc_feature (36): n=c or t
gtaaagatctgccttatattgtaaaactccaatcantgccttgttaaaaggcagccagaatccttggaaga

SEQ ID NO: 34795 - DNA, 71 bp, chicken (Gallus Gallus)
  misc_feature (36): n=a or c
aacacttctgatcagaaagcacttcaatacaagatnaatgcttaggcctaccacaaccaactaaatcgctc

SEQ ID NO: 34796 - DNA, 71 bp, chicken (Gallus Gallus)
  misc_feature (36): n=c or t
ttttacatccaattaacacagaggtagtagcagaanattaataaaattttagtcacttgtaatggtaaaag

SEQ ID NO: 34797 - DNA, 71 bp, chicken (Gallus Gallus)
  misc_feature (36): n=a or g
aattcatctggatgatgagaagatacctgaaacaanacccaggacaccacttaacaataacttcaggctat

SEQ ID NO: 34798 - DNA, 71 bp, chicken (Gallus Gallus)
  misc_feature (36): n=c or t
atgacatcttcatagcacaacatgctaagctactcntgaaacattttctaagtgtgcacacacacaaaagc

SEQ ID NO: 34799 - DNA, 71 bp, chicken (Gallus Gallus)
  misc_feature (36): n=g or t
aggagatcccaaatcttttagcaaccttctgagttntgggactcaatggcagaaaaaagaaatggaacaag

SEQ ID NO: 34800 - DNA, 71 bp, chicken (Gallus Gallus)
  misc_feature (36): n=c or t
cttgtgaaactttgcagtctcagaaatccatggagnaaaacaggcgcattcctccatccgttttttttgtt

SEQ ID NO: 34801 - DNA, 71 bp, chicken (Gallus Gallus)
  misc_feature (36): n=a or g
cacagggaaagtgtctgggcagcctcaggaagtcancggcatagatgtctgtataaaaaccgaccccacat

SEQ ID NO: 34802 - DNA, 71 bp, chicken (Gallus Gallus)
  misc_feature (36): n=c or t
atggtaatgaaactactggaaaaattaatccatgcnacagagagtcttgtttattaaatcaatattagttt

SEQ ID NO: 34803 - DNA, 71 bp, chicken (Gallus Gallus)
  misc_feature (36): n=a or g
agctctgtgactgctgcagttttcatccaactgtangaagagaaactaaatctgtgacagacaaggtgaga

SEQ ID NO: 34804 - DNA, 71 bp, chicken (Gallus Gallus)
  misc_feature (36): n=a or g
gggccggtgggcacagcgccaggggaggctttttantggctctgatgttgctgcgatgctcctggaaggtg

SEQ ID NO: 34805 - DNA, 71 bp, chicken (Gallus Gallus)
  misc_feature (36): n=c or t
cctagacatgtacagattgcttaaatcacaaattanaattcacacaaaattaacataattcacaaaaacta

SEQ ID NO: 34806 - DNA, 71 bp, chicken (Gallus Gallus)
  misc_feature (36): n=a or c
actccagacttttccagccctaactgcagctgatcnttccacaaaggaactataaattaaccacataatta

SEQ ID NO: 34807 - DNA, 71 bp, chicken (Gallus Gallus)
  misc_feature (36): n=a or g
tgccttcagttttcttcctggcatccaaagccaacncaaataggtcgggcgcttgcatggggagaactatt

SEQ ID NO: 34808 - DNA, 71 bp, chicken (Gallus Gallus)
  misc_feature (36): n=a or g
taaatgggcttccagaaaaattggtgtgcttaaatngcagagtaaaagagactattagacataaaaggaca

SEQ ID NO: 34809 - DNA, 71 bp, chicken (Gallus Gallus)
  misc_feature (36): n=c or t
ccccatatgtgtaacagggtgaaggagaagttaacngttactggggttcagtacatcgtcaatgagagaaa

SEQ ID NO: 34810 - DNA, 71 bp, chicken (Gallus Gallus)
  misc_feature (36): n=a or c
agcttaaaatcctaatgctttaggcaagtacgtagntaataaacagcctacatgcacttaaagacaatcca

SEQ ID NO: 34811 - DNA, 71 bp, chicken (Gallus Gallus)
  misc_feature (36): n=c or t
gaagaactagcagctttgcaatgtttccctccaaantggaatataaacactataatctgagaatccattta

SEQ ID NO: 34812 - DNA, 71 bp, chicken (Gallus Gallus)
  misc_feature (36): n=a or c
tatcattacagtactcttaagtgtacctgtttaganacactgcatcatcactaaacaaattaacacaagaa

SEQ ID NO: 34813 - DNA, 71 bp, chicken (Gallus Gallus)
  misc_feature (36): n=c or t
ttctgcaataagtgttattcctatactctcaatganatctattatatccatacttttaatttctcttccat

SEQ ID NO: 34814 - DNA, 71 bp, chicken (Gallus Gallus)
  misc_feature (36): n=a or g
ctacagccagattccttgatatgatttcacttcagnaatgtgagtgcgcttcactgtaagacagataatag

SEQ ID NO: 34815 - DNA, 71 bp, chicken (Gallus Gallus)
  misc_feature (36): n=a or g
tttcttcctggtcacaaagaaaatctactagattanaataacaaaggtttaccaagccttgatcatttttt

SEQ ID NO: 34816 - DNA, 71 bp, chicken (Gallus Gallus)
  misc_feature (36): n=a or c
gtatcatcagcataaagccagcataaaagagactcnatatgaatatgaaatgtttaaaccaaatgtgatgg

SEQ ID NO: 34817 - DNA, 71 bp, chicken (Gallus Gallus)
  misc_feature (36): n=c or t
tgtccgagtatcagccatggttagtcagtgtcgtancattttttgattcattaagtctactgtccctcccc

SEQ ID NO: 34818 - DNA, 71 bp, chicken (Gallus Gallus)
  misc_feature (36): n=c or t
agggtgacaattctcagccacgttaatcagggttangctcatggccgacaaaagatgagacctgtttgttt

SEQ ID NO: 34819 - DNA, 71 bp, chicken (Gallus Gallus)
  misc_feature (36): n=a or g
agaatgtaaaagtactgaatacattttaggtaatanaaaaccaattatttcataattctaccctgacatag

SEQ ID NO: 34820 - DNA, 71 bp, chicken (Gallus Gallus)
  misc_feature (36): n=c or t
caacgcaaccttagttgcgttgagatgcaagtccanaaaacttaaaactgaccagaattttatgcaaattt

SEQ ID NO: 34821 - DNA, 71 bp, chicken (Gallus Gallus)
  misc_feature (36): n=g or t
gtgaaggtgctgacggagaggactgcatgcctgtgngcctcctttaagtcaatgttcgtccactgcagttc

SEQ ID NO: 34822 - DNA, 71 bp, chicken (Gallus Gallus)
  misc_feature (36): n=a or g
tgttggctgcctacagctctcaggcaaacactgaancaacatcacattttctggatatgaaatagtaagat

SEQ ID NO: 34823 - DNA, 71 bp, chicken (Gallus Gallus)
  misc_feature (36): n=c or t
ctacccgacagaagtgcaagtaaagagaaaaaccanttaactactgtgcctgtactaaataaaatttgaag

SEQ ID NO: 34824 - DNA, 71 bp, chicken (Gallus Gallus)
  misc_feature (36): n=c or t
aattttctccgtgtgtaacaaaatgtccattaattnggtaacaagagtcagcttgtaaataacatttcaca

SEQ ID NO: 34825 - DNA, 71 bp, chicken (Gallus Gallus)
  misc_feature (36): n=c or t
aagagtccctgggtttgagctctttcctttccctcnttacttaaagaatgttgctaaggcaattcagatac

SEQ ID NO: 34826 - DNA, 71 bp, chicken (Gallus Gallus)
  misc_feature (36): n=c or t
tgcctgagaatttatacacattgactcattcacttnactggtattcttttcctcctttttaatgaaatttt

SEQ ID NO: 34827 - DNA, 71 bp, chicken (Gallus Gallus)
  misc_feature (36): n=a or g
cccacagttatagtctgaagaagtctttccctagtnatcccaaagatgactgaatttccatactcagtatt

SEQ ID NO: 34828 - DNA, 71 bp, chicken (Gallus Gallus)
  misc_feature (36): n=c or t
tcaggcaggtttcatattttagaacagaatgtgcangtgcatcatacaggctgctacagaactgccagttt

SEQ ID NO: 34829 - DNA, 71 bp, chicken (Gallus Gallus)
  misc_feature (36): n=a or g
gcagcaacacagtcttggcatgtaacaccgagtaanagaggatagatgtagcaagtagaacacaagctcaa

SEQ ID NO: 34830 - DNA, 71 bp, chicken (Gallus Gallus)
  misc_feature (36): n=c or t
atattagacttgaaataggtttacgctaacattttntaacttgtatctgccattaagcgaagcattacata

SEQ ID NO: 34831 - DNA, 71 bp, chicken (Gallus Gallus)
  misc_feature (36): n=a or g
ctattgtacagtaattacacttaaataatttttagnacaagtttagatagcaattatcattactgcagatg

SEQ ID NO: 34832 - DNA, 71 bp, chicken (Gallus Gallus)
  misc_feature (36): n=a or g
gtcttcagcgctcacagaaaagcctaatttaagacngaaaaacaaatactgataactcatttgtgataact

SEQ ID NO: 34833 - DNA, 71 bp, chicken (Gallus Gallus)
  misc_feature (36): n=c or t
ttcattccccaaactgctggagcaatcagcatctcntaagattagaactgtggctttgggcagttctcagt

SEQ ID NO: 34834 - DNA, 71 bp, chicken (Gallus Gallus)
  misc_feature (36): n=a or g
aataaggaaggaaaaagttctgaatgacaaatgctngcaagatactgcttttgaaagatggtatttcctta

SEQ ID NO: 34835 - DNA, 71 bp, chicken (Gallus Gallus)
  misc_feature (36): n=c or t
ataaatcttgttcaaacaaatttgccctttttaaanctcatcgacaaatcatattctactgttagtccata

SEQ ID NO: 34836 - DNA, 71 bp, chicken (Gallus Gallus)
  misc_feature (36): n=a or g
gactaagataacgctttttgccacaataaaagagcnagaaaaagatgagttatgctgacatctaggtaaag

SEQ ID NO: 34837 - DNA, 71 bp, chicken (Gallus Gallus)
  misc_feature (36): n=c or t
ctaactctttagaaacaggtgaatctgctgatatanccccaatctttgccagactgtcgtagtatgatctt

SEQ ID NO: 34838 - DNA, 71 bp, chicken (Gallus Gallus)
  misc_feature (36): n=a or g
ctgcaacatatccccatacaacactcacagaacagnagcaaagagccaaagtgacccacaatacacagatt

SEQ ID NO: 34839 - DNA, 71 bp, chicken (Gallus Gallus)
  misc_feature (36): n=c or t
actgccaggagaaaccttcatagccaggaaagcttnctgttttcccctactcttatgcccaccacttatgc

SEQ ID NO: 34840 - DNA, 71 bp, chicken (Gallus Gallus)
  misc_feature (36): n=a or g
gagaggtgatggagaaagagccatgaaagaaatggnttctccactaattgttttctaaagtcagagaataa

SEQ ID NO: 34841 - DNA, 71 bp, chicken (Gallus Gallus)
  misc_feature (36): n=a or g
aatgtagcccagaaagaatcaagttggacaatgtcnaatgaagcaccgatagtcatgatgcactgtaaaac

SEQ ID NO: 34842 - DNA, 71 bp, chicken (Gallus Gallus)
  misc_feature (36): n=a or c
caggtggaaaatagcagggctgctctttctcttgangtaggaggtctaacagtgcttacttaaggtgtttg

SEQ ID NO: 34843 - DNA, 71 bp, chicken (Gallus Gallus)
  misc_feature (36): n=a or g
aagtgttttgggagcagtgagtcagatgggtggagngaggagaaaattttcttctctccagtggccaagag

SEQ ID NO: 34844 - DNA, 71 bp, chicken (Gallus Gallus)
  misc_feature (36): n=a or g
agaatactaaattataatgttctatcttatactgangtgaaaactgtgtcctttgttcatttgtatagagt

SEQ ID NO: 34845 - DNA, 71 bp, chicken (Gallus Gallus)
  misc_feature (36): n=a or g
tcattggtcctgagttagcagtttaagagggctcangcaaggagaactgggttgcccagcgtttgggcttg

SEQ ID NO: 34846 - DNA, 71 bp, chicken (Gallus Gallus)
  misc_feature (36): n=c or t
ctgcagaacagaacccaagatagggctaaccaaacntgcacttgaagtttcaggggttctgacatcagaaa

SEQ ID NO: 34847 - DNA, 71 bp, chicken (Gallus Gallus)
  misc_feature (36): n=a or g
tcgcatttgtatgttatcaatatgtaaaggagaacntttctctattctttaaatagaaaaagaacatgcca

SEQ ID NO: 34848 - DNA, 71 bp, chicken (Gallus Gallus)
  misc_feature (36): n=a or g
ccaccaagtgaagtcctgggaacaaaggctgtgttnagtttgggttttcttgaacagctcttgtggtgtgc

SEQ ID NO: 34849 - DNA, 71 bp, chicken (Gallus Gallus)
  misc_feature (36): n=c or t
agtgcccaaggcagtttcccactggtcagtgcgtgnggatttaagtcagctcaaatagccctctgtgtgtg

SEQ ID NO: 34850 - DNA, 71 bp, chicken (Gallus Gallus)
  misc_feature (36): n=a or g
cttaatctgtccttccctccagttgccatggatctnctgaacagattacacctgggtgtctttcccttaag

SEQ ID NO: 34851 - DNA, 71 bp, chicken (Gallus Gallus)
  misc_feature (36): n=c or t
ggagagggtgatggacaccctctgcaatgggctttngttgaggccaaacctctgcatagaggaaacttgtg

SEQ ID NO: 34852 - DNA, 71 bp, chicken (Gallus Gallus)
  misc_feature (36): n=c or t
gggatgggcaagttgggccaaaaggtctcaatccanggcacttctccagagatactacagacacaaaaatg

SEQ ID NO: 34853 - DNA, 71 bp, chicken (Gallus Gallus)
  misc_feature (36): n=c or t
aggtgatcagtgaggacacatctgagccttaaaatngtacaagaagctattttacactaaagagcctggat

SEQ ID NO: 34854 - DNA, 71 bp, chicken (Gallus Gallus)
  misc_feature (36): n=a or g
caaaatgggctaggcacacctccatcattcaatctnaaaattgtcaagggaattcatatttaccaagttca

SEQ ID NO: 34855 - DNA, 71 bp, chicken (Gallus Gallus)
  misc_feature (36): n=a or g
tttgctgcaggcagcgtggctgggagaaagacaganggacacaggggctgcagtggagtgaagactcagcc

SEQ ID NO: 34856 - DNA, 71 bp, chicken (Gallus Gallus)
  misc_feature (36): n=a or g
cctgacacagtacaaagtctggctctgtgcagctgnagggattagggacagagatcatgaaactgccagaa

SEQ ID NO: 34857 - DNA, 71 bp, chicken (Gallus Gallus)
  misc_feature (36): n=a or g
agaaagccatgattcacccatcacacatctgtagtnccttgctggtgagtacctacgttccctcatgatgg

SEQ ID NO: 34858 - DNA, 71 bp, chicken (Gallus Gallus)
  misc_feature (36): n=c or t
aacactgctgctcaaaagctcgtaagaagattcccnctgggtgaaatattcccctcttggtgaaattcgga

SEQ ID NO: 34859 - DNA, 71 bp, chicken (Gallus Gallus)
  misc_feature (36): n=g or t
gggggctgaggtcccggcgtctgtaaggctggctgngttcccaagatcccttgtttatgcagacgagacct

SEQ ID NO: 34860 - DNA, 71 bp, chicken (Gallus Gallus)
  misc_feature (36): n=a or g
atgcacaatgagcaactgcaacaaggaaaagcagtnagattaaggtcacttcccagctaactggtttgaat

SEQ ID NO: 34861 - DNA, 71 bp, chicken (Gallus Gallus)
  misc_feature (36): n=c or t
tgatgcatcctaatacgatcaatgtgcttggagtcnaatacttatttctctatttcaacagctttagcagt

SEQ ID NO: 34862 - DNA, 71 bp, chicken (Gallus Gallus)
  misc_feature (36): n=a or c
tgaataattgcttacagaaaatacacctattccccntacaaggaggaatgttttctccaacagaaaaaatg

SEQ ID NO: 34863 - DNA, 71 bp, chicken (Gallus Gallus)
  misc_feature (36): n=g or t
gtcacacacatcaacaatgcctggacaactgcagtnggctacagcacatttttccccaacagaattccttt

SEQ ID NO: 34864 - DNA, 71 bp, chicken (Gallus Gallus)
  misc_feature (36): n=c or t
tctttttttgtcataaggagcagacatgaaagcttncttccaatgtgcaagtctctgcatgaaatgtttct

SEQ ID NO: 34865 - DNA, 71 bp, chicken (Gallus Gallus)
  misc_feature (36): n=c or t
agctttagagcccattggaggtctgattgacattgncctaattaaaacttcctacaacagctgctaactca

SEQ ID NO: 34866 - DNA, 71 bp, chicken (Gallus Gallus)
  misc_feature (36): n=c or t
gaaaaaaaaaaaccttgaggttgcacttcattacantcagggctgtttttgccacataaccaccagtgaaa

SEQ ID NO: 34867 - DNA, 71 bp, chicken (Gallus Gallus)
  misc_feature (36): n=a or g
gggagcttcttgcactcggcgcagaacttgaaggtntcctccatcttctggaacatgtcgaagtaagtccg

SEQ ID NO: 34868 - DNA, 71 bp, chicken (Gallus Gallus)
  misc_feature (36): n=c or t
aatctttccactgctgtcaggaggctttagttcagnctaatgatttgtcctcagtgctggaagtcacagag

SEQ ID NO: 34869 - DNA, 71 bp, chicken (Gallus Gallus)
  misc_feature (36): n=a or g
atccgactgcatcgtagtggatctgtccagagcacngtgtgttcagtgatcttcaccctcctggagaaaca

SEQ ID NO: 34870 - DNA, 71 bp, chicken (Gallus Gallus)
  misc_feature (36): n=a or g
atcctcacaggcttaagtgagaaaagagcccagganttggtaaaacgagagctctccccagggaaacactc

SEQ ID NO: 34871 - DNA, 71 bp, chicken (Gallus Gallus)
  misc_feature (36): n=c or t
acccttctgcatgctcatttctaggtggcttattcnaagatattccaagaataatagcactctgagaatac

SEQ ID NO: 34872 - DNA, 71 bp, chicken (Gallus Gallus)
  misc_feature (36): n=c or t
tctaaaaagagaagttagaattacccagggaacaantgtgccaatttctgttattgaataatttctgcaaa

SEQ ID NO: 34873 - DNA, 71 bp, chicken (Gallus Gallus)
  misc_feature (36): n=c or t
ggacgagaagctgcggctgcagcagctccgcgcccngcggcgccgctggctgcgagaccaggagctgagcg

SEQ ID NO: 34874 - DNA, 71 bp, chicken (Gallus Gallus)
  misc_feature (36): n=a or g
ctctaggagacagcccagcaagccctcttctgctgncttctggtatttacagtgaaaatgaagcttccccc

SEQ ID NO: 34875 - DNA, 71 bp, chicken (Gallus Gallus)
  misc_feature (36): n=a or c
ccagcagcaaaaaaccctcctaaagtaatttgtagnagggggttgcatagtgctagcagcccagcaccgca

SEQ ID NO: 34876 - DNA, 71 bp, chicken (Gallus Gallus)
  misc_feature (36): n=g or t
ctcagctgctcataaatgttgctggtcacttttatnttatgtgggaagcttgctggaatgctcttcagacc

SEQ ID NO: 34877 - DNA, 71 bp, chicken (Gallus Gallus)
  misc_feature (36): n=a or g
aaccccacaaactggggtgtgtcagcagcttggaanacctgtagtgtctacctgagcctcttggccctttg

SEQ ID NO: 34878 - DNA, 71 bp, chicken (Gallus Gallus)
  misc_feature (36): n=a or g
ctgtcctggcattttcctgctgccaggagcttttcntggccagaggtggagatccagttccccctgatagc

SEQ ID NO: 34879 - DNA, 71 bp, chicken (Gallus Gallus)
  misc_feature (36): n=c or t
ggagtgattttcagggtgaacgccgtcctgttgtantgggggttctcctttttgcaacctggctttgggta

SEQ ID NO: 34880 - DNA, 71 bp, chicken (Gallus Gallus)
  misc_feature (36): n=a or c
tgtttgtagataatgtctgatgaacactcagggccnatctttactttgtggagcactgcacctcatggctg

SEQ ID NO: 34881 - DNA, 71 bp, chicken (Gallus Gallus)
  misc_feature (36): n=a or g
gccaacctgagctgtgttagaagtatggaacagctntatgttatcttactgctggcaccaaactgtccctg

SEQ ID NO: 34882 - DNA, 71 bp, chicken (Gallus Gallus)
  misc_feature (36): n=c or t
ggggccctatgggaagcagtcatccttgctgttttntcagctgttgttgagcagggagtgccttctgcctg

SEQ ID NO: 34883 - DNA, 71 bp, chicken (Gallus Gallus)
  misc_feature (36): n=a or g
ttccaggcttcctcagcaaccaacagctttgttccntcagtgcagagtgaggctttcctggctgccctgtc

SEQ ID NO: 34884 - DNA, 71 bp, chicken (Gallus Gallus)
  misc_feature (36): n=a or c
ccacacacagagccttggctgccagcggcatctccnaggtgaggtctctgatgtctcataataaggctgtg

SEQ ID NO: 34885 - DNA, 71 bp, chicken (Gallus Gallus)
  misc_feature (36): n=c or t
ggagtgtgcctcaaaggtgatgtgcagagcttgttntctataccttgtctgtggtgcattgtattttaacc

SEQ ID NO: 34886 - DNA, 71 bp, chicken (Gallus Gallus)
  misc_feature (36): n=a or g
tgggcaggactgtggcagaaacgctgtaaattcccngagacagcaacagctatcgcctatgaacagcatgg

SEQ ID NO: 34887 - DNA, 71 bp, chicken (Gallus Gallus)
  misc_feature (36): n=c or t
gccaataaataagcccacagctaattccaatgccangttcaacactttgtcctgtcctgagagagagcaga

SEQ ID NO: 34888 - DNA, 71 bp, chicken (Gallus Gallus)
  misc_feature (36): n=a or g
tctcacaggactatccttgtgctttccgatttgctnaaatgtgtatgaaaaaggaatcagaaaggggtaag

SEQ ID NO: 34889 - DNA, 71 bp, chicken (Gallus Gallus)
  misc_feature (36): n=a or g
tgctaccactgcgttgcatttgacacattcagactnctgatgcaggtgcctctgaccattgttttacttcc

SEQ ID NO: 34890 - DNA, 71 bp, chicken (Gallus Gallus)
  misc_feature (36): n=a or g
aaaaaaaaacatatacaaaagaaactaagtgtctantgtgacactctggctctgaaaaagtagtctggatg

SEQ ID NO: 34891 - DNA, 71 bp, chicken (Gallus Gallus)
  misc_feature (36): n=a or c
gaccttcttcagcacaggaaccacacacaatcttcntgttgatatgactgtgaatggagtcttcactacta

SEQ ID NO: 34892 - DNA, 71 bp, chicken (Gallus Gallus)
  misc_feature (36): n=g or t
tttaactgggaagaaatgtatttcaatcaatttcangtcacttattgtgtattgtctgaaagtctgcacag

SEQ ID NO: 34893 - DNA, 71 bp, chicken (Gallus Gallus)
  misc_feature (36): n=g or t
tcacagcatctccctgagcccatagctctgttactnactgcagccttcatgtgttcaccctaacttctggg

SEQ ID NO: 34894 - DNA, 71 bp, chicken (Gallus Gallus)
  misc_feature (36): n=c or t
caataaacagaatcacagtccctggttgttgacaancagcatcattttatgccttcgtgttatcgtctttg

SEQ ID NO: 34895 - DNA, 71 bp, chicken (Gallus Gallus)
  misc_feature (36): n=c or t
tcatcccactctatcttctggcaactcattttttgnctgatctgaacacaggtaagttagtacagaggcgc

SEQ ID NO: 34896 - DNA, 71 bp, chicken (Gallus Gallus)
  misc_feature (36): n=a or g
acatacaggagtgacatcccataaagcatgctccangcacgagcaattccccttgtgcaggaaaccagcac

SEQ ID NO: 34897 - DNA, 71 bp, chicken (Gallus Gallus)
  misc_feature (36): n=c or t
tgtatgagcaagtcacacgattaaagatgccccatngcaaaatgtgatggtgataccaaatgataacattt

SEQ ID NO: 34898 - DNA, 71 bp, chicken (Gallus Gallus)
  misc_feature (36): n=c or t
tctctgggtgcactacttgcagtgtgagccaactcnggcttctccaaggctgaaatctgcaccatatttac

SEQ ID NO: 34899 - DNA, 71 bp, chicken (Gallus Gallus)
  misc_feature (36): n=a or g
agcagaaccccaagggggcagaaatcctgagtcacntgaggagcaagttgaagggctgctagcatcgctga

SEQ ID NO: 34900 - DNA, 71 bp, chicken (Gallus Gallus)
  misc_feature (36): n=c or t
ggtgcctgaagagcagtccttagggtctgaccaccnggtaacttcaaaggaacatttccatctgctatttc

SEQ ID NO: 34901 - DNA, 71 bp, chicken (Gallus Gallus)
  misc_feature (36): n=c or t
gcccctatgtctattacaagagaaaagtactctganagtctccgtttactcaattttggggctgtggaatt

SEQ ID NO: 34902 - DNA, 71 bp, chicken (Gallus Gallus)
  misc_feature (36): n=c or t
accacctgaagcatcaaaagggtagaaagtctcatngacagctgggttatgtacaacattcatttctttgt

SEQ ID NO: 34903 - DNA, 71 bp, chicken (Gallus Gallus)
  misc_feature (36): n=a or c
aggaacagccgagtacatggtaccagacaccacaanattgatcttttatatgaataatctcatatttaaga

SEQ ID NO: 34904 - DNA, 71 bp, chicken (Gallus Gallus)
  misc_feature (36): n=g or t
ctggcacctttggggctctcctgatggcctctgcancatctggagaaggaaagctcattgcagagagacct

SEQ ID NO: 34905 - DNA, 71 bp, chicken (Gallus Gallus)
  misc_feature (36): n=a or g
gcagagacatgttttgaatggcattactttccccangcagtagctgtctcaaagtttgccatctggtgtaa

SEQ ID NO: 34906 - DNA, 71 bp, chicken (Gallus Gallus)
  misc_feature (36): n=a or c
gtaaatgattcacctcggccgtcacaggtccctctntgccccagtttaattggtgatggagtaactagccc

SEQ ID NO: 34907 - DNA, 71 bp, chicken (Gallus Gallus)
  misc_feature (36): n=c or t
ttgcatctcgctcttttagttcttcatggggtttcnacttcaaagtgcctgtgctgtggcatctgcttaga

SEQ ID NO: 34908 - DNA, 71 bp, chicken (Gallus Gallus)
  misc_feature (36): n=a or g
cattgcagggaataatgctcagtctctgaagtccanctgtgttcctcccatgctgtttattgcagttatat

SEQ ID NO: 34909 - DNA, 71 bp, chicken (Gallus Gallus)
  misc_feature (36): n=g or t
gggctcgtcgtgcgcccacagccaggacttgcgggngaccatgcggcccacaccgaacagcggctggcggc

SEQ ID NO: 34910 - DNA, 71 bp, chicken (Gallus Gallus)
  misc_feature (36): n=g or t
gaaatacagactagtccaattgcaagtttaagacangtggttgaagaggtctgtgcatgtcttggacaaaa

SEQ ID NO: 34911 - DNA, 71 bp, chicken (Gallus Gallus)
  misc_feature (36): n=c or t
attctcctaaccaaatttttctgtctcttgggtaangtgccaatgagaccatgtcaagggtagggttgatg

SEQ ID NO: 34912 - DNA, 71 bp, chicken (Gallus Gallus)
  misc_feature (36): n=c or t
ctcagttcgcacttctgggctttggagttttttgtntagatggattttcagattacacttagactctattt

SEQ ID NO: 34913 - DNA, 71 bp, chicken (Gallus Gallus)
  misc_feature (36): n=a or g
aagaccgtgatcttttatcgcacattcagctccagnaattcttcctttcaggctgactgactgcttgagaa

SEQ ID NO: 34914 - DNA, 71 bp, chicken (Gallus Gallus)
  misc_feature (36): n=a or c
ggcacagaaggggcgtgaaagtccagtctttccctnaccatgctgtcctttattccagcacagtcaaatac

SEQ ID NO: 34915 - DNA, 71 bp, chicken (Gallus Gallus)
  misc_feature (36): n=a or g
tgttttccacacgcagtgttcattcactgtaacttncaaagctaaggctatggtggcctctaagaataggt

SEQ ID NO: 34916 - DNA, 71 bp, chicken (Gallus Gallus)
  misc_feature (36): n=c or t
gggcctggttttgctaataaatgcccttataatctnaaagttttccttcagaaagctagtggagagcattt

SEQ ID NO: 34917 - DNA, 71 bp, chicken (Gallus Gallus)
  misc_feature (36): n=g or t
aaaagaaactcactgtaatgggttttagtggatggnagtcaccaaaatccaagggcacagattcgagtttg

SEQ ID NO: 34918 - DNA, 71 bp, chicken (Gallus Gallus)
  misc_feature (36): n=c or t
agaccacagtcagatgcagagcagagatgaaggaangacatggtgacaacatggcctgcatggccatggca

SEQ ID NO: 34919 - DNA, 71 bp, chicken (Gallus Gallus)
  misc_feature (36): n=a or c
gtaactgataatacttcatattttcaatctacctcntgcaaatctggcaagttcagtgggcagactcagtt

SEQ ID NO: 34920 - DNA, 71 bp, chicken (Gallus Gallus)
  misc_feature (36): n=a or g
aaatgagccataaaaaagtgagcaaaagctggcacncggatcactgcatgtcagaaatgccatgcagaacc

SEQ ID NO: 34921 - DNA, 71 bp, chicken (Gallus Gallus)
  misc_feature (36): n=c or t
ccagatattaaccactagaaacttccaaagtcaacngcctgctgtactcatcttcatttcaagcagcaaag

SEQ ID NO: 34922 - DNA, 71 bp, chicken (Gallus Gallus)
  misc_feature (36): n=a or g
ttcaatatttgccaacacaaatcagaattgcaagcnggtcattatctaattattgctacagagagagcaaa

SEQ ID NO: 34923 - DNA, 71 bp, chicken (Gallus Gallus)
  misc_feature (36): n=a or g
gaaaacttgtttgtaatgagagaagctcctgctggntggaaatgccacagattttacagcttcacctactg

SEQ ID NO: 34924 - DNA, 71 bp, chicken (Gallus Gallus)
  misc_feature (36): n=a or c
atcaaaagcattgcagagttatgcacaatgatatgnctgtaccaggatctaccgtttggggctgttggggt

SEQ ID NO: 34925 - DNA, 71 bp, chicken (Gallus Gallus)
  misc_feature (36): n=c or t
attgcaagatccaccctcatgctgatgtaacagagntgtgaccaggcagttttactgctctgtgacttagt

SEQ ID NO: 34926 - DNA, 71 bp, chicken (Gallus Gallus)
  misc_feature (36): n=c or t
ccacctctccgctttgaatttaaattgagattggcnaccattcctgactatggttacttctaaaataaaga

SEQ ID NO: 34927 - DNA, 71 bp, chicken (Gallus Gallus)
  misc_feature (36): n=a or c
tttaaatcttgttaggaatcaggactgcagtcgttnaatgtgcaggctgtgaagtgaggatatcagcactg

SEQ ID NO: 34928 - DNA, 71 bp, chicken (Gallus Gallus)
  misc_feature (36): n=a or g
tctttaaattcagtattagctgcaaccaatacagcncctttcattccactaattgagcttaatagacttaa

SEQ ID NO: 34929 - DNA, 71 bp, chicken (Gallus Gallus)
  misc_feature (36): n=a or g
taggacagtgctgttatttactcattttcttgcacngataaattgagttatccattgctgctgctgctaag

SEQ ID NO: 34930 - DNA, 71 bp, chicken (Gallus Gallus)
  misc_feature (36): n=a or g
gggagcagagagaaggagaatctagtgtttattttngttagtattattggaaaggggcggctggcagttgc

SEQ ID NO: 34931 - DNA, 71 bp, chicken (Gallus Gallus)
  misc_feature (36): n=a or g
atgagcacacagacgctctctgcttcttaactgtcntaattagttcaagttttgatcaccgagtgtggtga

SEQ ID NO: 34932 - DNA, 71 bp, chicken (Gallus Gallus)
  misc_feature (36): n=a or g
caacctcacttggaggcgatggacaggcggctgcgnattgtcctcaaggctgttagtgactgtatagaaaa

SEQ ID NO: 34933 - DNA, 71 bp, chicken (Gallus Gallus)
  misc_feature (36): n=c or t
cctaatctgaagttaatggacacctgcctagtggtntcaagttgtttgcatccagcccagagcagttgctg

SEQ ID NO: 34934 - DNA, 71 bp, chicken (Gallus Gallus)
  misc_feature (36): n=g or t
cacatatatcttgtgaatctctgcatctacctaagncaggaataatatatctgagctagtttatatagctg

SEQ ID NO: 34935 - DNA, 71 bp, chicken (Gallus Gallus)
  misc_feature (36): n=a or c
caagcctagagcaggcagtaagcatgtggcatatantttcagacaggtttgctgtggtggcagaagagctg

SEQ ID NO: 34936 - DNA, 71 bp, chicken (Gallus Gallus)
  misc_feature (36): n=a or g
tcagacaggggcatgtgtccttcctaagagtgcacntggttccaaaggggatgcagaggaattagcgttaa

SEQ ID NO: 34937 - DNA, 71 bp, chicken (Gallus Gallus)
  misc_feature (36): n=a or g
caaccactaacaatgttacattggaagtggctttcntgcaccaatgtctgtatgttcacttggggcaaaat

SEQ ID NO: 34938 - DNA, 71 bp, chicken (Gallus Gallus)
  misc_feature (36): n=c or t
cagcactgtaatcaatcagcaaactcagaactattncattctgcagcagcatcagttcctacaggtgcatg

SEQ ID NO: 34939 - DNA, 71 bp, chicken (Gallus Gallus)
  misc_feature (36): n=c or t
tgatataaaataaacagtctgatggtttctctgctntttctgtctttctcatttcccgttgctatgctgtt

SEQ ID NO: 34940 - DNA, 71 bp, chicken (Gallus Gallus)
  misc_feature (36): n=a or g
ttcctttggaggaaaacactgatgtacatttttctnctcactattactgttcatacatttgtatgaattgt

SEQ ID NO: 34941 - DNA, 71 bp, chicken (Gallus Gallus)
  misc_feature (36): n=c or t
atctaaccttgagcaaatcacttaccctttctcttngcttggaggtggggtaagcagggtaacctccctca

SEQ ID NO: 34942 - DNA, 71 bp, chicken (Gallus Gallus)
  misc_feature (36): n=a or c
gcacaccttgataccaacgatcactcaacaggcagnacatgtcaaaataagttcattcgattgagagttgt

SEQ ID NO: 34943 - DNA, 71 bp, chicken (Gallus Gallus)
  misc_feature (36): n=g or t
aagttggccgaggtgggatcaatctgactccgaggnatctcatatatcaccgtccgtgttttgcagacagc

SEQ ID NO: 34944 - DNA, 71 bp, chicken (Gallus Gallus)
  misc_feature (36): n=a or g
caccccatactccacaaaactcatctgtggggtaancagaatggcttgcctgagatcccacaggaagtttg

SEQ ID NO: 34945 - DNA, 71 bp, chicken (Gallus Gallus)
  misc_feature (36): n=c or t
agatcccaggcgcagcaagttaacatacaaggctgntttctgatgtgaacgcagcgttttcatgttgcctt

SEQ ID NO: 34946 - DNA, 71 bp, chicken (Gallus Gallus)
  misc_feature (36): n=a or g
accaaggagcagggaacatgaataaaattcacacgngatctgcaggcggatttctgtttgggctgtctgtc

SEQ ID NO: 34947 - DNA, 71 bp, chicken (Gallus Gallus)
  misc_feature (36): n=g or t
aaagaaaaaagaaacgagcctgcaaacaaaattagnatctctgagtcttctgcttattacatggcaactga

SEQ ID NO: 34948 - DNA, 71 bp, chicken (Gallus Gallus)
  misc_feature (36): n=c or t
cagtcagcaacacagtcattcccaattcagattttntgtgtgataaattaccaggaaaacttatgcttaca

SEQ ID NO: 34949 - DNA, 71 bp, chicken (Gallus Gallus)
  misc_feature (36): n=c or t
aagcacaatgaggggaaaagatctggggagaacacngctctaatgtaagctaaaaaagaagcagcagcagt

SEQ ID NO: 34950 - DNA, 71 bp, chicken (Gallus Gallus)
  misc_feature (36): n=c or t
agagttggagagctctacagatctccagcagaagantgtgcctacatcagtggatttatcacatagccaaa

SEQ ID NO: 34951 - DNA, 71 bp, chicken (Gallus Gallus)
  misc_feature (36): n=c or t
gtctgctggcagcaacagcagttatacatgaatatnttgctgcctctggcatcacaaatacaacatcattc

SEQ ID NO: 34952 - DNA, 71 bp, chicken (Gallus Gallus)
  misc_feature (36): n=a or c
tggcacaatgacgtacagcccaggtaattaagaacnatctacaatgaagtgaagatcagatttcaagtgct

SEQ ID NO: 34953 - DNA, 71 bp, chicken (Gallus Gallus)
  misc_feature (36): n=c or t
aatttgcacacttgagaacatgctttgattgaaagngtatgagtacagtcccattgaaggaccgcattgcc

SEQ ID NO: 34954 - DNA, 71 bp, chicken (Gallus Gallus)
  misc_feature (36): n=c or t
catacatacatacagtacatgaaggaaggtattccnaccccctcctttctgcttccttgcacccgcagagc

SEQ ID NO: 34955 - DNA, 71 bp, chicken (Gallus Gallus)
  misc_feature (36): n=a or g
tgcccagacactcttggtaagaatagccaagattgngaggcatggcttcttaattcacctaagcactcccc

SEQ ID NO: 34956 - DNA, 71 bp, chicken (Gallus Gallus)
  misc_feature (36): n=g or t
cagcaacttgcatgcacatgggtttcttgggttatnatattgaaaaggagtttgtaaccatcttttaatag

SEQ ID NO: 34957 - DNA, 71 bp, chicken (Gallus Gallus)
  misc_feature (36): n=c or t
tggctctgaaagcaaatacgaagctgctgctgtaangctagctttcagctgtctccagtccctagaaattc

SEQ ID NO: 34958 - DNA, 71 bp, chicken (Gallus Gallus)
  misc_feature (36): n=g or t
accagttttgttttacctaggaaagctgaatgtgtntttgtggtggcccacagagagacagactttaaggg

SEQ ID NO: 34959 - DNA, 71 bp, chicken (Gallus Gallus)
  misc_feature (36): n=c or t
gcaaaggaggagaaatcctagcacagaagctctgcngtgtgcaatgcacattgctggtggagcagcagtgc

SEQ ID NO: 34960 - DNA, 71 bp, chicken (Gallus Gallus)
  misc_feature (36): n=a or c
acttcacatccaatttaaattaccttcttccaagtntaaggttgcttgctctcctgggaaagagcacggtg

SEQ ID NO: 34961 - DNA, 71 bp, chicken (Gallus Gallus)
  misc_feature (36): n=c or t
atgggatgagagaagatctgcagattccttgagggntttttggctatggcaatctccagtttgagggagga

SEQ ID NO: 34962 - DNA, 71 bp, chicken (Gallus Gallus)
  misc_feature (36): n=a or g
ttttactctgtttctgcagttgaagaggtgttctgngtccacatctcagcagtctatcattgcctgtctcc

SEQ ID NO: 34963 - DNA, 71 bp, chicken (Gallus Gallus)
  misc_feature (36): n=a or g
agtcgtgagcccagcacgaattccccatgccctggnaaatgcagttagacatcccagggaaataaggattc

SEQ ID NO: 34964 - DNA, 71 bp, chicken (Gallus Gallus)
  misc_feature (36): n=a or g
gcagctactgcctggagaagttgtgctgtgatcccngtcacttgtgtgtttccctggcggatttgagccag

SEQ ID NO: 34965 - DNA, 71 bp, chicken (Gallus Gallus)
  misc_feature (36): n=c or t
ctcctctgtcatggaagggtgcgggctacttcctangagagatgagcacaaagcacaccccatgagacaac

SEQ ID NO: 34966 - DNA, 71 bp, chicken (Gallus Gallus)
  misc_feature (36): n=a or g
gatggatgaggtgaggggcagagcttagaggactcnggctctggaatggaggccagaggtggtgcggagct

SEQ ID NO: 34967 - DNA, 71 bp, chicken (Gallus Gallus)
  misc_feature (36): n=a or g
atgaaaaagcattaaaagaggccctgtgagtacagnatggccatctctggggcaggacagcgcatggggag

SEQ ID NO: 34968 - DNA, 71 bp, chicken (Gallus Gallus)
  misc_feature (36): n=c or t
agataataaaattttacactttatatggtatctctnagggagaagtcttccaatgtgctttacaaacagca

SEQ ID NO: 34969 - DNA, 71 bp, chicken (Gallus Gallus)
  misc_feature (36): n=c or t
ccagtggtgaacatagaggtggttttggggcactgnggtaagcatggacttttgggacaaacttccagtgc

SEQ ID NO: 34970 - DNA, 71 bp, chicken (Gallus Gallus)
  misc_feature (36): n=a or g
gtcccatccaacccaggatattcggtgagcagcacntgttcaaatcctagcacacaagggtcttcaactgg

SEQ ID NO: 34971 - DNA, 71 bp, chicken (Gallus Gallus)
  misc_feature (36): n=a or g
gcaacctcagatagaaatcccaaggtttgaagatgnaagctcacatttaatggttactttgggtcaaactg

SEQ ID NO: 34972 - DNA, 71 bp, chicken (Gallus Gallus)
  misc_feature (36): n=a or c
cagccaaaatcagcccccctacgagtccatcccccngcaaatcaacagcaccatcgtggacttgcggctga

SEQ ID NO: 34973 - DNA, 71 bp, chicken (Gallus Gallus)
  misc_feature (36): n=a or c
tggtctccgtccaccaatactccaagtacaaccacncctgtgtcaccatcacgcccaccagacccaaccga

SEQ ID NO: 34974 - DNA, 71 bp, chicken (Gallus Gallus)
  misc_feature (36): n=c or t
aggaggaaccaacagatttaaagaataaatgtggcnaagtctcacctagaaaacaaatcaatcaagttgct

SEQ ID NO: 34975 - DNA, 71 bp, chicken (Gallus Gallus)
  misc_feature (36): n=c or t
cagataaaaggtgaattttatttacagctgagtgtnaccactgggctgtgaacacgaaaatcaaaccggag

SEQ ID NO: 34976 - DNA, 71 bp, chicken (Gallus Gallus)
  misc_feature (36): n=c or t
gaggtgggacagcaagacaaggaatgacacaagagntgggataatcaagaagaaaagaaatacattcaagc

SEQ ID NO: 34977 - DNA, 71 bp, chicken (Gallus Gallus)
  misc_feature (36): n=a or c
gctgcagcctctcactgtgagatgctattgcctccnagcctccttctgctttggccaagtagaagataaaa

SEQ ID NO: 34978 - DNA, 71 bp, chicken (Gallus Gallus)
  misc_feature (36): n=c or t
acattttaattagcttctcctatctctgacaagcancccaggtcacacagagaaaccaccatttacttcct

SEQ ID NO: 34979 - DNA, 71 bp, chicken (Gallus Gallus)
  misc_feature (36): n=c or t
caactagcatatagcatcatttcggaatgaccacgnacgcaaatagcccaaaaggtcaaatgcaaatattt

SEQ ID NO: 34980 - DNA, 71 bp, chicken (Gallus Gallus)
  misc_feature (36): n=a or g
gtactgcttcacaaaggactccgagcattccctggntggaatataaattttcagagaacagcaaagtcttt

SEQ ID NO: 34981 - DNA, 71 bp, chicken (Gallus Gallus)
  misc_feature (36): n=a or g
gactcttcatattttgcttttcccttctgtaatccnctttaatgtaatcttaatgataaaacttcattttc

SEQ ID NO: 34982 - DNA, 71 bp, chicken (Gallus Gallus)
  misc_feature (36): n=a or g
aggaagctctgttctacgtaaagagctgagatagcnttacaagaaggctttcagatatcccaggctctgat

SEQ ID NO: 34983 - DNA, 71 bp, chicken (Gallus Gallus)
  misc_feature (36): n=c or t
catttcatacactgcttgagttttgatattttcctnttctccctattccttatcccaattagccttttcag

SEQ ID NO: 34984 - DNA, 71 bp, chicken (Gallus Gallus)
  misc_feature (36): n=c or t
tatcagacagaatagaagagattaaagcatttctantactgattggatgaccacagcatcacattacctct

SEQ ID NO: 34985 - DNA, 71 bp, chicken (Gallus Gallus)
  misc_feature (36): n=c or t
atgacagaaagaagatattaagattttgtaactgcngcagtgcaaagagctctttatgaccccaagaaaga

SEQ ID NO: 34986 - DNA, 71 bp, chicken (Gallus Gallus)
  misc_feature (36): n=a or c
accttgctgtgcaattaaatgccaggaagcaccatntcaggtagagcaaagtgtgaaggactcccattttt

SEQ ID NO: 34987 - DNA, 71 bp, chicken (Gallus Gallus)
  misc_feature (36): n=a or g
acaaaaaaacccatcccctccctaaaatgccacagnctttatgcaattcccttacattttctgtaccaaag

SEQ ID NO: 34988 - DNA, 71 bp, chicken (Gallus Gallus)
  misc_feature (36): n=c or t
gctaaccataagctgagatcaggcaccccattaaangtaactgtggaacaagataatgttgttttttttct

SEQ ID NO: 34989 - DNA, 71 bp, chicken (Gallus Gallus)
  misc_feature (36): n=a or g
gtggacaagacctccctggttaccccttgaacaaangggaacaaagaggatctcactgctagagagctctg

SEQ ID NO: 34990 - DNA, 71 bp, chicken (Gallus Gallus)
  misc_feature (36): n=a or g
cctggaggtgccttacgagcagcactgtagaaaccnatgatttcactgcacgcgggcactgaattcaggaa

SEQ ID NO: 34991 - DNA, 71 bp, chicken (Gallus Gallus)
  misc_feature (36): n=c or t
ccacagtaagacagaacgatgatttgaacacaagangacaccagtctaggtactagctcttaaatcaactg

SEQ ID NO: 34992 - DNA, 71 bp, chicken (Gallus Gallus)
  misc_feature (36): n=a or g
ttcaactgtttcagacaaatcttccaagactaaccntgtcaattcttgaatagcaaatccacttgtctgct

SEQ ID NO: 34993 - DNA, 71 bp, chicken (Gallus Gallus)
  misc_feature (36): n=a or g
tgcagcatgaacggtgccttagcatttgttgatacntctgactgcaccatgatgaatattgctgaacacta

SEQ ID NO: 34994 - DNA, 71 bp, chicken (Gallus Gallus)
  misc_feature (36): n=a or g
cctgactctcgagggttgatgaagtccggagcttgngtcatcataggctctgatgctgtatttggacacag

SEQ ID NO: 34995 - DNA, 71 bp, chicken (Gallus Gallus)
  misc_feature (36): n=c or t
tctgcgttgttgcacaccagcctgcatgcagacccntctgcagactcctcatccatcacatgcgctcccag

SEQ ID NO: 34996 - DNA, 71 bp, chicken (Gallus Gallus)
  misc_feature (36): n=g or t
agttgcagacaattctggagctggcaaagcgggggntaaagtggaaggcgatctgatctccgggatgactg

SEQ ID NO: 34997 - DNA, 71 bp, chicken (Gallus Gallus)
  misc_feature (36): n=a or g
ccgtgttgttgggtgaggggactcgcagtatccccnggaacagcaggtttgctgtgggttccctccatttc

SEQ ID NO: 34998 - DNA, 71 bp, chicken (Gallus Gallus)
  misc_feature (36): n=a or g
tcgtgactggaagaccatccatggcccatccccaantgaccaggggaaagaagaggtctctactggagctg

SEQ ID NO: 34999 - DNA, 71 bp, chicken (Gallus Gallus)
  misc_feature (36): n=c or t
ctaatagattgcatcagcatttgagagaatctttantgccttggaaaattacttctgtcttctaaaatctt

SEQ ID NO: 35000 - DNA, 71 bp, chicken (Gallus Gallus)
  misc_feature (36): n=a or c
cagtccatctccccagtgagacactcagacaagttnaaacaggcacgttgcaacagggcccagaaagagga

SEQ ID NO: 35001 - DNA, 71 bp, chicken (Gallus Gallus)
  misc_feature (36): n=a or g
gctatgcatgggaaaaggacaggaggtgtctctggnaggttattccccactgttggggcattttgtagctg

SEQ ID NO: 35002 - DNA, 71 bp, chicken (Gallus Gallus)
  misc_feature (36): n=a or g
ccagcactgtctttatagggactgaatgcagtcagnagctgcagtacgtcggatattttaatgtgactgcg

SEQ ID NO: 35003 - DNA, 71 bp, chicken (Gallus Gallus)
  misc_feature (36): n=c or t
cagcccctggtgcagtgttctgggtgcacagagccnacattgtcagccaccccatggcactgaccgggacc

SEQ ID NO: 35004 - DNA, 71 bp, chicken (Gallus Gallus)
  misc_feature (36): n=c or t
ccctggggagcagtgcgggcagaacagagcagcctntccctcttcactcgtgggctggaaagtaaataaat

SEQ ID NO: 35005 - DNA, 71 bp, chicken (Gallus Gallus)
  misc_feature (36): n=a or g
ttgaataattctgtaacattcacatcttacttcccnagagtgctcttcagcatactgacttattatcacct

SEQ ID NO: 35006 - DNA, 71 bp, chicken (Gallus Gallus)
  misc_feature (36): n=a or g
agttcaaacgtttctgcctcatccattcatactgcngcaaatgagagcgtgtgacgagtctggaactggga

SEQ ID NO: 35007 - DNA, 71 bp, chicken (Gallus Gallus)
  misc_feature (36): n=a or c
agtcagctgagtgggcgaagagcacctacagtaatntacagcctttggctcagccccacaggacacacaca

SEQ ID NO: 35008 - DNA, 71 bp, chicken (Gallus Gallus)
  misc_feature (36): n=c or t
gaccaaatcatccaagaacctttgcagtttctgganaacatgcaagtggtctgtctgctttgcaaacatct

SEQ ID NO: 35009 - DNA, 71 bp, chicken (Gallus Gallus)
  misc_feature (36): n=a or c
cgtgtcacaaaataccgcttcttcccagtgagcttncacagataacaaaacagcaaatgctccctcatgcc

SEQ ID NO: 35010 - DNA, 71 bp, chicken (Gallus Gallus)
  misc_feature (36): n=g or t
gaactagttcgattagaagacatttgcataagttantacatctcctctccttccaccttcacttgaaagtt

SEQ ID NO: 35011 - DNA, 71 bp, chicken (Gallus Gallus)
  misc_feature (36): n=c or t
ggcatttcagagagcaactcaaggtgaaggaggtangtggtcaaagcccccagttgccccaaccccaaccc

SEQ ID NO: 35012 - DNA, 71 bp, chicken (Gallus Gallus)
  misc_feature (36): n=c or t
gtgaggtgacaattaagtaactctcactgtaaccanagcagtcagcactaatggcttctggtgcagaaacc

SEQ ID NO: 35013 - DNA, 71 bp, chicken (Gallus Gallus)
  misc_feature (36): n=c or t
atagcatccctcttaagctcacagacatttttattnatattcttgtactacctgtatttcagggtacttta

SEQ ID NO: 35014 - DNA, 71 bp, chicken (Gallus Gallus)
  misc_feature (36): n=c or t
gcctgaacggcttaatttgcgttaaaaaccgtttanccgacgttagcagcaggcacggagcgtgcccggct

SEQ ID NO: 35015 - DNA, 71 bp, chicken (Gallus Gallus)
  misc_feature (36): n=c or t
cagggctcatccagatggataacgcaggcttggctnttgcctttggtcaccgttcccatgttatcatactg

SEQ ID NO: 35016 - DNA, 71 bp, chicken (Gallus Gallus)
  misc_feature (36): n=c or t
cttaaaggatttcttcaagtgcaaccagaagtcaanggccttttaaacaaggagttacttctcctcaggat

SEQ ID NO: 35017 - DNA, 71 bp, chicken (Gallus Gallus)
  misc_feature (36): n=a or g
gcggggctctgcgggcgccggggccggctgagggantcgtgcgagcggccgcgccgggttcaaccggggag

SEQ ID NO: 35018 - DNA, 71 bp, chicken (Gallus Gallus)
  misc_feature (36): n=g or t
agaaaggggatgctctggtgctctggcagaagacanctctgtagggcttggcattttgtgcccactcctga

SEQ ID NO: 35019 - DNA, 71 bp, chicken (Gallus Gallus)
  misc_feature (36): n=c or t
gtactgtttgcttctaagcttctaaaaactacctcntctttctgctgcgtggtcatacagtgtaagtatca

SEQ ID NO: 35020 - DNA, 71 bp, chicken (Gallus Gallus)
  misc_feature (36): n=a or g
gaggtggaaactaaatggcaaaatcgacagctcaantcaactcaccaggttggatctgtctctgcccagaa

SEQ ID NO: 35021 - DNA, 71 bp, chicken (Gallus Gallus)
  misc_feature (36): n=c or t
aataaaacgaggtgatgttcagttgactctaaagcnatggtgaagagaacacgagtgctgagcaaggtcat

SEQ ID NO: 35022 - DNA, 71 bp, chicken (Gallus Gallus)
  misc_feature (36): n=a or c
tttccaagtgaattacaaaaatatacgtatactganacaactgaatataacacaagctcccaaatttagtc

SEQ ID NO: 35023 - DNA, 71 bp, chicken (Gallus Gallus)
  misc_feature (36): n=c or t
agtttctgcggttgttttgttatgagcctaagcagnaggtgtaagcacccatgtgagagcttatgagggag

SEQ ID NO: 35024 - DNA, 71 bp, chicken (Gallus Gallus)
  misc_feature (36): n=a or g
ttttagtttctctgtttggatgactgtaggactgcntacgatgcactgggtattcaatattagtgtaaaaa

SEQ ID NO: 35025 - DNA, 71 bp, chicken (Gallus Gallus)
  misc_feature (36): n=c or t
ttctgtctgcttttgcaactgcatacaaaacactangatgtacccatcagtttctggaggaaaaaactgca

SEQ ID NO: 35026 - DNA, 71 bp, chicken (Gallus Gallus)
  misc_feature (36): n=c or t
aaatagttgcatgtggtttttgaacagatttttccngcttatgctttctggtcacctcttctgtgtcccct

SEQ ID NO: 35027 - DNA, 71 bp, chicken (Gallus Gallus)
  misc_feature (36): n=a or c
gcctccgggaccagaacaaaaatatccgttaatacnacaaggtgctgctttatacaggcaaattcactgag

SEQ ID NO: 35028 - DNA, 71 bp, chicken (Gallus Gallus)
  misc_feature (36): n=c or t
gtgtccaaaccatactggcataggtctggagggacnaatagattggtgttagattgccatgaaggctgaga

SEQ ID NO: 35029 - DNA, 71 bp, chicken (Gallus Gallus)
  misc_feature (36): n=c or t
tggaggactcatttcctcaggtttaccctcagtttnagctctgaatgcctgttttatttggtatccctctc

SEQ ID NO: 35030 - DNA, 71 bp, chicken (Gallus Gallus)
  misc_feature (36): n=a or g
tattgctgacataaaactttccatgctgaaagaaanaaacaacacacaaacatttcacatgctcaaatgca

SEQ ID NO: 35031 - DNA, 71 bp, chicken (Gallus Gallus)
  misc_feature (36): n=c or t
tagcaatgctgggaatggggtggagtgctggattcngctgttcccaggcctcttaggtgaactgagatagc

SEQ ID NO: 35032 - DNA, 71 bp, chicken (Gallus Gallus)
  misc_feature (36): n=g or t
ataaacacttgcagcatgagaataagaactaaggtngtacagtattggcaaggttttcttctggaagcagt

SEQ ID NO: 35033 - DNA, 71 bp, chicken (Gallus Gallus)
  misc_feature (36): n=c or t
caaaggctaatattgactaatattttgaagactatntggctgattaaacaaacaatagaagttttaataag

SEQ ID NO: 35034 - DNA, 71 bp, chicken (Gallus Gallus)
  misc_feature (36): n=c or t
ttgtttattttattactatgctttttattattcctnctttgctgcttgattgtattcccaaggtaattttg

SEQ ID NO: 35035 - DNA, 71 bp, chicken (Gallus Gallus)
  misc_feature (36): n=a or g
tacaatgtgtttatgtgcaggtaggaggagtttgcnttggtggaggaaaatatatccaagaggggtttaaa

SEQ ID NO: 35036 - DNA, 71 bp, chicken (Gallus Gallus)
  misc_feature (36): n=a or c
tgtctgaaaattctgcagctgtttctcccgcctctnagtcctttccattagtttagtacaacaggtataaa

SEQ ID NO: 35037 - DNA, 71 bp, chicken (Gallus Gallus)
  misc_feature (36): n=g or t
actgaaagaacaaaccatctctgcaatgaatatttnatgtaagttgaaatccaaagggatgataaatctag

SEQ ID NO: 35038 - DNA, 71 bp, chicken (Gallus Gallus)
  misc_feature (36): n=c or t
tgggaatacttgaattgagttctgtgaactttgggntctgctttgattgtgttttttgccctaattcagca

SEQ ID NO: 35039 - DNA, 71 bp, chicken (Gallus Gallus)
  misc_feature (36): n=a or c
tgattaacaacagctgggtccattgcagtttgcagntgatgactactcctacctacataagatactgagaa

SEQ ID NO: 35040 - DNA, 71 bp, chicken (Gallus Gallus)
  misc_feature (36): n=c or t
tatccattatgagtctacttcctgcactcctaccangttacacattttcttttgtcaatgctgagaatgca

SEQ ID NO: 35041 - DNA, 71 bp, chicken (Gallus Gallus)
  misc_feature (36): n=c or t
ttccagggcatataaaattactaagtggacgatgantggtttttctgtgtaactggtagaggagggagata

SEQ ID NO: 35042 - DNA, 71 bp, chicken (Gallus Gallus)
  misc_feature (36): n=a or g
acatattttatcagaagtgaagatgtgatttaatantagaacttttccattcacagtaaaggaaaaggaaa

SEQ ID NO: 35043 - DNA, 71 bp, chicken (Gallus Gallus)
  misc_feature (36): n=a or g
taagaagataagttctcagaagggtctgagcagacnttttcctctctggaagaaagcatttcacaaacata

SEQ ID NO: 35044 - DNA, 71 bp, chicken (Gallus Gallus)
  misc_feature (36): n=c or t
ccaggaaggtgcacagtgtcctggtccctaaggctntgcttgtgcaaaaataatgttagatttgtccaact

SEQ ID NO: 35045 - DNA, 71 bp, chicken (Gallus Gallus)
  misc_feature (36): n=c or t
tggactgaactgaaaaccccctaacactttttttcntaatatagttgatatgttttctcatgagagcagcc

SEQ ID NO: 35046 - DNA, 71 bp, chicken (Gallus Gallus)
  misc_feature (36): n=a or g
tggttccagccacagttacaagccccaaagggatcngggcttcgctgtctccttcctccaggacagcacac

SEQ ID NO: 35047 - DNA, 71 bp, chicken (Gallus Gallus)
  misc_feature (36): n=c or t
ctttagctagaatagcttgaggctctatattttttnatgttaaaagctctaatgatgtggtggatgataag

SEQ ID NO: 35048 - DNA, 71 bp, chicken (Gallus Gallus)
  misc_feature (36): n=a or g
tgctaaccgtgcgccatgtgtccattagtttagctntagggtactgtgacccttaactcaaagtgtttttc

SEQ ID NO: 35049 - DNA, 71 bp, chicken (Gallus Gallus)
  misc_feature (36): n=a or g
tccacatttagcaacgtttccattagctgttctaancatcagccttgggactttcagcacaagttgtgggg

SEQ ID NO: 35050 - DNA, 71 bp, chicken (Gallus Gallus)
  misc_feature (36): n=a or g
tattgttttcaaatggaaaactactacctctgcacngggtggacattccatctaacaaaggatttcatggt

SEQ ID NO: 35051 - DNA, 71 bp, chicken (Gallus Gallus)
  misc_feature (36): n=c or t
cagagtgctgggattaattaatacaaagcactgcangtggaagagcctggtctaagtgcagcccagcagct

SEQ ID NO: 35052 - DNA, 71 bp, chicken (Gallus Gallus)
  misc_feature (36): n=a or g
ctgctgcaatggtgtgtgatggtgccctgcttctcntgtcccaaataattggtaacagggaaattgtttca

SEQ ID NO: 35053 - DNA, 71 bp, chicken (Gallus Gallus)
  misc_feature (36): n=c or t
gcagtaaccaacttgaggcttaactctgtcttcttngaggcgctccattcagctgcatccagcatagctcc

SEQ ID NO: 35054 - DNA, 71 bp, chicken (Gallus Gallus)
  misc_feature (36): n=c or t
gtttgatatctgttgctagaagggtataggttcagngatgaccttttacacagggaaataagaatcagttt

SEQ ID NO: 35055 - DNA, 71 bp, chicken (Gallus Gallus)
  misc_feature (36): n=c or t
catacttccaggagtctccaaatggaattaaactcngtttgattggcttccaaactctgcactaaccatta

SEQ ID NO: 35056 - DNA, 71 bp, chicken (Gallus Gallus)
  misc_feature (36): n=a or g
tgagggagaaagatatgcatgcagtactttgaatgngactacagcttccctgctgcaggttatcctctgga

SEQ ID NO: 35057 - DNA, 71 bp, chicken (Gallus Gallus)
  misc_feature (36): n=c or t
ttccactttgctgcatcgttacgaatctcaactggntttgagcacatcttgataacagtcactcctcaaat

SEQ ID NO: 35058 - DNA, 71 bp, chicken (Gallus Gallus)
  misc_feature (36): n=a or g
tctgatgcgtgcagtgaaggtctcaaagccctgagntgcttggagagaccctcagcagcactgtgctgtgc

SEQ ID NO: 35059 - DNA, 71 bp, chicken (Gallus Gallus)
  misc_feature (36): n=a or c
cttttaagcattagctgtcattttacaataacttcncccatcaaatccacttctgtttccttcttcttgtt

SEQ ID NO: 35060 - DNA, 71 bp, chicken (Gallus Gallus)
  misc_feature (36): n=a or g
aacgactgctagacaggcaagttgtattgcaaaccntgtcattcaactggagttcctgatagttcagtcac

SEQ ID NO: 35061 - DNA, 71 bp, chicken (Gallus Gallus)
  misc_feature (36): n=g or t
tcccatgatgttggatgcccaaagggatctgatgangagcctaacgcaacttcttggggagaaaggctggc

SEQ ID NO: 35062 - DNA, 71 bp, chicken (Gallus Gallus)
  misc_feature (36): n=a or g
tcagtacccctgctagatccgtgcgctgcagggggnagaaggagaggtgttaaccccaggaaagtttgcag

SEQ ID NO: 35063 - DNA, 71 bp, chicken (Gallus Gallus)
  misc_feature (36): n=a or g
atttgcttttggttaggagctgcagctccccaagcnagcagttcattgcagaagggatgtaaagctgcaaa

SEQ ID NO: 35064 - DNA, 71 bp, chicken (Gallus Gallus)
  misc_feature (36): n=a or c
tgtgaggtgagtatgagatggggggaaagcctcagngcctctgagccattgggctccttcacccataactt

SEQ ID NO: 35065 - DNA, 71 bp, chicken (Gallus Gallus)
  misc_feature (36): n=g or t
gctctaattggccttcctataaacgtccttgctccngcacatcctgctgctggtttgcagaggacgttcaa

SEQ ID NO: 35066 - DNA, 71 bp, chicken (Gallus Gallus)
  misc_feature (36): n=a or g
aggaaattatctgtgtatgatggcttttcttggtcnaactttgtcacttttcttattgagttaacccaagg

SEQ ID NO: 35067 - DNA, 71 bp, chicken (Gallus Gallus)
  misc_feature (36): n=a or g
agaattgcatggttctaaagactgtgtcattttggntgagcacttgtaaggacctcgctctttgggtgatc

SEQ ID NO: 35068 - DNA, 71 bp, chicken (Gallus Gallus)
  misc_feature (36): n=a or g
agtcatggaaacttcatggcattccctatcctgatngcctctgaaggtcctacgtagcttcagcctctact

SEQ ID NO: 35069 - DNA, 71 bp, chicken (Gallus Gallus)
  misc_feature (36): n=a or g
ttatggcaggatccaagacctgctttcagctcaggnacagaaagctgagacagacaattccaccatcaaga

SEQ ID NO: 35070 - DNA, 71 bp, chicken (Gallus Gallus)
  misc_feature (36): n=c or t
aatgcttacttgctgggtacaaaataatttgtcagngtctcccatggggaagagtcaggaaagaagaagaa

SEQ ID NO: 35071 - DNA, 71 bp, chicken (Gallus Gallus)
  misc_feature (36): n=a or g
aatctttttatgcatttctgtctttgcgtaagaacnggaagaagtggtgttcagtacccagtgaccagagc

SEQ ID NO: 35072 - DNA, 71 bp, chicken (Gallus Gallus)
  misc_feature (36): n=c or t
aacacaggagataagtgcaggggcaaaagccacggngctgtgatttaattcccaatgaacgacgcaaatcc

SEQ ID NO: 35073 - DNA, 71 bp, chicken (Gallus Gallus)
  misc_feature (36): n=a or g
tttaccaagtgaacgagggatctgctgtgaattacntatgttatataaattacgtacgttatataaattac

SEQ ID NO: 35074 - DNA, 71 bp, chicken (Gallus Gallus)
  misc_feature (36): n=c or t
agggaggctgtttccaatgcaaacctgcacacacanggagttctgctctgcactcctgatactatcgcttt

SEQ ID NO: 35075 - DNA, 71 bp, chicken (Gallus Gallus)
  misc_feature (36): n=c or t
agctatgcaaaacctttgctgctgactcacggcccnccaaagataactctgccctggaagcactacggtac

SEQ ID NO: 35076 - DNA, 71 bp, chicken (Gallus Gallus)
  misc_feature (36): n=a or g
ggaatgcttaccgtctctctgatgagcagagcagtnaagtcctggtcctcctgcccggcagccccttgttc

SEQ ID NO: 35077 - DNA, 71 bp, chicken (Gallus Gallus)
  misc_feature (36): n=c or t
tccctgcggtttattcggtctgtagcaaggtaagtngtgttagctgcttgcaaattactgatacatctgca

SEQ ID NO: 35078 - DNA, 71 bp, chicken (Gallus Gallus)
  misc_feature (36): n=c or t
ctttccatccccaattctaaggatatgttattaagntggatacgtatgccatctgtaacaatctgcatatt

SEQ ID NO: 35079 - DNA, 71 bp, chicken (Gallus Gallus)
  misc_feature (36): n=a or g
attgacattaattgccaacaaaatgaacagcaaganaaaagtctttagaggcactgaaaataagcaacaac

SEQ ID NO: 35080 - DNA, 71 bp, chicken (Gallus Gallus)
  misc_feature (36): n=a or c
ttatgctttccaatatattcagttattaatgttttntctgcctcacttgtttgtagaagaatcaagactct

SEQ ID NO: 35081 - DNA, 71 bp, chicken (Gallus Gallus)
  misc_feature (36): n=a or g
gggctactaacattaatctcttgggggatacaactnagtttaatgagctggtgagtttccttactagcaga

SEQ ID NO: 35082 - DNA, 71 bp, chicken (Gallus Gallus)
  misc_feature (36): n=c or t
cccaggtatggcacagtaagtgcaggagaaccaagntgatgtgctccaaatctttcatgagaagaaggtga

SEQ ID NO: 35083 - DNA, 71 bp, chicken (Gallus Gallus)
  misc_feature (36): n=a or g
gccattagctctcgtggcaaaaatggggtccatcangtggtggctgcatgctgtgtggagacctccctcac

SEQ ID NO: 35084 - DNA, 71 bp, chicken (Gallus Gallus)
  misc_feature (36): n=c or t
gaagaggaggaaagaaactgcacaaaatgtacatcnacactacttcaataggcataatacttgccactgtt

SEQ ID NO: 35085 - DNA, 71 bp, chicken (Gallus Gallus)
  misc_feature (36): n=c or t
gccgggtttctcggcgctgcaggtgccgcgctaatngctgcgccactaacaaccattaccacaacaaatag

SEQ ID NO: 35086 - DNA, 71 bp, chicken (Gallus Gallus)
  misc_feature (36): n=a or g
gccttttacaatgagaagtatgtggttaagtgcacnagagcacagaagtgacacacggtggggcaacaggt

SEQ ID NO: 35087 - DNA, 71 bp, chicken (Gallus Gallus)
  misc_feature (36): n=g or t
cagggaagcaaaatgtaaacactcaagttggaaacnggctaggattctgaacttaatatctcagccatgcc

SEQ ID NO: 35088 - DNA, 71 bp, chicken (Gallus Gallus)
  misc_feature (36): n=a or g
atctccttttctttcccactaagccttaggtttacntacaaatgatgagaaaaggcttacatccacagata

SEQ ID NO: 35089 - DNA, 71 bp, chicken (Gallus Gallus)
  misc_feature (36): n=c or t
tgaaggggatgagatgttctcagtaaggtatggtangtcagcctgaggttagggcacactggccatgagga

SEQ ID NO: 35090 - DNA, 71 bp, chicken (Gallus Gallus)
  misc_feature (36): n=c or t
aattaaaatcctcaagtttgagctatttgcatgaangtaactgcattgttacagtgctgccagtgggaagg

SEQ ID NO: 35091 - DNA, 71 bp, chicken (Gallus Gallus)
  misc_feature (36): n=a or g
acttaactgaaaaagtaatattttggtgaggaaaanggggctaagctgttaattcctcttttccctaccat

SEQ ID NO: 35092 - DNA, 71 bp, chicken (Gallus Gallus)
  misc_feature (36): n=g or t
caggttaaaacttgtgtggagacgagctgaggtctnggtgaggtttaggaagcagctttgctcagcgttac

SEQ ID NO: 35093 - DNA, 71 bp, chicken (Gallus Gallus)
  misc_feature (36): n=c or t
ctcagagcgtacaggactcctgattttgacagagtngtgcatcagatttctgaagctcttgaaattcagaa

SEQ ID NO: 35094 - DNA, 71 bp, chicken (Gallus Gallus)
  misc_feature (36): n=a or c
tcaccaggcaattcactgctctgcagtacgttaggnaccagccctcaaaaaataaggtgacagataagctt

SEQ ID NO: 35095 - DNA, 71 bp, chicken (Gallus Gallus)
  misc_feature (36): n=c or t
ctgtccatccagatttaaaactcccaagataagcanggaaagaaacagggcctgtaaaatcatatttggta

SEQ ID NO: 35096 - DNA, 71 bp, chicken (Gallus Gallus)
  misc_feature (36): n=a or c
tcctgtcaaaccaggccgtgcgaagagctggaaggngcaaagtgtttccaaaggaatgcctggcacttagc

SEQ ID NO: 35097 - DNA, 71 bp, chicken (Gallus Gallus)
  misc_feature (36): n=c or t
tttttgttttaaggagtagggagttattacaattantggtcgtaatgccataatgggcagcaccagcagtc

SEQ ID NO: 35098 - DNA, 71 bp, chicken (Gallus Gallus)
  misc_feature (36): n=c or t
cacacatgaactgaaggtttgcttttttcccagtgnaaaatcctcagtgggattttacagattaagcatct

SEQ ID NO: 35099 - DNA, 71 bp, chicken (Gallus Gallus)
  misc_feature (36): n=c or t
ggtgcgttggatgggggcaccggagagggtgcatangtgggatgaactggagagggggtgcgctgaaaggg

SEQ ID NO: 35100 - DNA, 71 bp, chicken (Gallus Gallus)
  misc_feature (36): n=c or t
cagcccccacaccccttcgccattaggggctctagnagcaggcttaccagatcctaatggaactgtctgtt

SEQ ID NO: 35101 - DNA, 71 bp, chicken (Gallus Gallus)
  misc_feature (36): n=g or t
ctgctgtgtagtctaataatgtttctttgcttttcncagcgagaagttgccatttcaaattaccactacct

SEQ ID NO: 35102 - DNA, 71 bp, chicken (Gallus Gallus)
  misc_feature (36): n=c or t
gaacggcccagagggttctgctggcaccaacagagnaactgtgacccaaccagataacctcattctgtttg

SEQ ID NO: 35103 - DNA, 71 bp, chicken (Gallus Gallus)
  misc_feature (36): n=c or t
aggtctgtggaggggcagggtgtgagaagggctgcnagaagtcctggggacacggggatctcccgctcccc

SEQ ID NO: 35104 - DNA, 71 bp, chicken (Gallus Gallus)
  misc_feature (36): n=c or t
agctgattggggatggtctcaattctgcggggacanggggaccttcagagtggccctggatgtgcgctgga

SEQ ID NO: 35105 - DNA, 71 bp, chicken (Gallus Gallus)
  misc_feature (36): n=c or t
tggtaagaatgccaactaactaaagacaactaatanctgttactaggtctgagcagtgatacctgttaaat

SEQ ID NO: 35106 - DNA, 71 bp, chicken (Gallus Gallus)
  misc_feature (36): n=c or t
ccttctgggaatgccacagcccacgaccattactcnggcctccagaagagcctgcatgtcctctccatggt

SEQ ID NO: 35107 - DNA, 71 bp, chicken (Gallus Gallus)
  misc_feature (36): n=g or t
agttcagaactcagatgtttgctgtgtcagtctcanactgtgtggttccattttgtcatgtgtcaaatgga

SEQ ID NO: 35108 - DNA, 71 bp, chicken (Gallus Gallus)
  misc_feature (36): n=a or g
cttctgaatgacttcataaagcctcagtgcggacanatagaggtatgggtgtcagtcaggttgatactgga

SEQ ID NO: 35109 - DNA, 71 bp, chicken (Gallus Gallus)
  misc_feature (36): n=c or t
tttgttgcataattttgcatactgtgctatctttgntgtgttctgctgtgtgcaccctctgctcctctcat

SEQ ID NO: 35110 - DNA, 71 bp, chicken (Gallus Gallus)
  misc_feature (36): n=g or t
cgctggcctgggagacgtcgcagactttgatgcggntcatttgtgagagcttcacattctttatcttgggg

SEQ ID NO: 35111 - DNA, 71 bp, chicken (Gallus Gallus)
  misc_feature (36): n=c or t
agtacagattaaccatgagtttgcattcctgaagangggttctgataaggctgagctgactgtgagttaca

SEQ ID NO: 35112 - DNA, 71 bp, chicken (Gallus Gallus)
  misc_feature (36): n=a or g
tgtgttttctctgaagaccagctgatttggggagcngtttgctttttgtgtatttagaacttagcactgtt

SEQ ID NO: 35113 - DNA, 71 bp, chicken (Gallus Gallus)
  misc_feature (36): n=c or t
tttatttttgtgtttgagaatagggactttgcaaangttttaaggccatccttttctgtgctgtcagatat

SEQ ID NO: 35114 - DNA, 71 bp, chicken (Gallus Gallus)
  misc_feature (36): n=a or g
tcaaccaggtagcacttcaggtggtagcatactgtnaagctgtatgcaggtgaattcactgcagccccctg

SEQ ID NO: 35115 - DNA, 71 bp, chicken (Gallus Gallus)
  misc_feature (36): n=a or g
aacacttccagagccgcccatacgggcagagagccntagagcaacccagagcttcacccttctgctgattt

SEQ ID NO: 35116 - DNA, 71 bp, chicken (Gallus Gallus)
  misc_feature (36): n=a or g
gtgttaggtcacactgtgccggagcaggattgttcntaataaaaagggcatttttgcaaatatttcagcaa

SEQ ID NO: 35117 - DNA, 71 bp, chicken (Gallus Gallus)
  misc_feature (36): n=c or t
atttaggttggcattacaattgctagctaaagctcntccattattctcctctgcatgaaacattagaaagc

SEQ ID NO: 35118 - DNA, 71 bp, chicken (Gallus Gallus)
  misc_feature (36): n=c or t
tttcaacaccaactggagcctagaaaacatcctgcngtgagtatttttatggcttatgaaatagtttgttg

SEQ ID NO: 35119 - DNA, 71 bp, chicken (Gallus Gallus)
  misc_feature (36): n=c or t
acaattcaaaaggaatttaagcaatttgcttcaaangctgctgaaaggttccattctgccttctgaataag

SEQ ID NO: 35120 - DNA, 71 bp, chicken (Gallus Gallus)
  misc_feature (36): n=a or c
agtcagggttgtataaacttggggtgtaggagtccntgctcaaggtgcactccaccttgtactccttcctg

SEQ ID NO: 35121 - DNA, 71 bp, chicken (Gallus Gallus)
  misc_feature (36): n=a or g
aaagtgctcagcaaattcctttcaccacctgtgtgnggtctgctcctcagccgccccatgagggaatggga

SEQ ID NO: 35122 - DNA, 71 bp, chicken (Gallus Gallus)
  misc_feature (36): n=a or c
ttgcagtgaaatcacctcaagtcttcgtggaagagncaaaggatcctttgccaaggagaagcttggagtgc

SEQ ID NO: 35123 - DNA, 71 bp, chicken (Gallus Gallus)
  misc_feature (36): n=c or t
ccacagtaacgtggcagccccggacagcaccggcanactgctcaatctaagtgtcagacagcaatgaaatt

SEQ ID NO: 35124 - DNA, 71 bp, chicken (Gallus Gallus)
  misc_feature (36): n=a or g
ccatgttttcataacagttccctcgtacaatcaaanagctgaagtagcaatattggttttaatcttcatta

SEQ ID NO: 35125 - DNA, 71 bp, chicken (Gallus Gallus)
  misc_feature (36): n=c or t
ctatgggccataaacctcactacacatatagcccangtatgtacctcatactggaggacacacttcttcct

SEQ ID NO: 35126 - DNA, 71 bp, chicken (Gallus Gallus)
  misc_feature (36): n=a or g
tatggggctggggtaagtcttagtgagttttatcantaaataaataggttttgggaagtgtccctgtgcgc

SEQ ID NO: 35127 - DNA, 71 bp, chicken (Gallus Gallus)
  misc_feature (36): n=a or g
cgccatcagtgctctagagaggggcagagggggccnctgctttccaaatgacagactgctagggctgattt

SEQ ID NO: 35128 - DNA, 71 bp, chicken (Gallus Gallus)
  misc_feature (36): n=c or t
aaaagccacagctcacaagcaagcacaaagtgccancaggaagtttaaagagcacttcttccccagtttta

SEQ ID NO: 35129 - DNA, 71 bp, chicken (Gallus Gallus)
  misc_feature (36): n=c or t
ctcacagtaaagatggcagaatcgagtatgcaaaantgctgagagcttgttaaagctcacgtgcatgcaca

SEQ ID NO: 35130 - DNA, 71 bp, chicken (Gallus Gallus)
  misc_feature (36): n=a or g
gatagggccaaacacattcctttcgacgcaccgtgntctttgaaggaggataggtctccctgttttacagt

SEQ ID NO: 35131 - DNA, 71 bp, chicken (Gallus Gallus)
  misc_feature (36): n=a or g
gagcatcacaaggagacataggaatcctaagaacancttagaagtataaaacctgtgagaaggacagcctg

SEQ ID NO: 35132 - DNA, 71 bp, chicken (Gallus Gallus)
  misc_feature (36): n=a or g
gatttatttggaaggatgagaacctgaccaagattnactgttagaaagcattgttaagaattccctcctgt

SEQ ID NO: 35133 - DNA, 71 bp, chicken (Gallus Gallus)
  misc_feature (36): n=c or t
ctgccttctgtttcttatatagtgacacccttatgngtctctgcacttatccacagagaatgtacttcatt

SEQ ID NO: 35134 - DNA, 71 bp, chicken (Gallus Gallus)
  misc_feature (36): n=c or t
gcatcagtgtgctcagatcccatatcatacttcaangcttaaacagtttcaagtgtacaacaaaaaagacc

SEQ ID NO: 35135 - DNA, 71 bp, chicken (Gallus Gallus)
  misc_feature (36): n=a or g
agcaccttcccatcagtaaagtagagagcattattnaaacaagcattaataaggatctgctaaaagatggt

SEQ ID NO: 35136 - DNA, 71 bp, chicken (Gallus Gallus)
  misc_feature (36): n=a or g
aagcgcagtatctcttactgccatttcaagacaagnaagcctgcagcagacactctggaccaacggtaact

SEQ ID NO: 35137 - DNA, 71 bp, chicken (Gallus Gallus)
  misc_feature (36): n=a or g
ctcgctcaacgttttattctgaatagcctctttcanaagtattctgagttccacagcaatgggctcaagga

SEQ ID NO: 35138 - DNA, 71 bp, chicken (Gallus Gallus)
  misc_feature (36): n=a or g
tggggagggcaacccaatgagcgctgcatccctacngggtcaccctcacagtagaaggacccctctacaca

SEQ ID NO: 35139 - DNA, 71 bp, chicken (Gallus Gallus)
  misc_feature (36): n=a or g
atgaggacttgcgaacaaattccttcccaagacacnaatgtacttgtgtagatctgatttctaataccgct

SEQ ID NO: 35140 - DNA, 71 bp, chicken (Gallus Gallus)
  misc_feature (36): n=a or g
tctttatccttctaacaaggctggctgcagaaaatntctgtgtctttattttaaatctgggcatctcagtg

SEQ ID NO: 35141 - DNA, 71 bp, chicken (Gallus Gallus)
  misc_feature (36): n=c or t
tgtcaaaataaataaccgtgctctgtgttgctttgnctttttgttttcttacggtgctgaaagttgcttat

SEQ ID NO: 35142 - DNA, 71 bp, chicken (Gallus Gallus)
  misc_feature (36): n=g or t
tcctccttgcaggcaccggggtgcaggtttgaagcnctttggagagtgggtgaacctcacagctgtgcttt

SEQ ID NO: 35143 - DNA, 71 bp, chicken (Gallus Gallus)
  misc_feature (36): n=a or g
gctggtggtgccctttttcatcttcatgggacgaangatgtgcatggtgcatggcgttctgcagatccttt

SEQ ID NO: 35144 - DNA, 71 bp, chicken (Gallus Gallus)
  misc_feature (36): n=a or g
cagaattgcagaagccttatacccaacgtggtgcantggaactgtggagaaagtctattaggaatgcacac

SEQ ID NO: 35145 - DNA, 71 bp, chicken (Gallus Gallus)
  misc_feature (36): n=c or t
tctgcaaagcagagattaaatcctcctgcaaataangagttaagaagttaacaagagattaaattaataat

SEQ ID NO: 35146 - DNA, 71 bp, chicken (Gallus Gallus)
  misc_feature (36): n=g or t
gcccctttgctcactgctcagatcgagtctggcaangtggtgggaaggatgaggaaccagaagccgaaagc

SEQ ID NO: 35147 - DNA, 71 bp, chicken (Gallus Gallus)
  misc_feature (36): n=a or c
aaagccatttgccagcgatgagacctgtcctgggangtgatgcagttctcaggggtgaaggactcccaacg

SEQ ID NO: 35148 - DNA, 71 bp, chicken (Gallus Gallus)
  misc_feature (36): n=a or g
tgacaaagctccccactggggctggaagcgttctcntgtgttgatggaatagagcagccccatcgaggact

SEQ ID NO: 35149 - DNA, 71 bp, chicken (Gallus Gallus)
  misc_feature (36): n=c or t
catggttcccaatcatccagtttgggataacacccngactgctgcactccacgctgtgctgtccccatcac

SEQ ID NO: 35150 - DNA, 71 bp, chicken (Gallus Gallus)
  misc_feature (36): n=c or t
ctctctccagcctttgttgtatgtatttcagaaaanaaaaattcctgatctcactcagttctatgtgagtt

SEQ ID NO: 35151 - DNA, 71 bp, chicken (Gallus Gallus)
  misc_feature (36): n=g or t
gacacggaggtgggagaaagatgagagacacagcanggagcaaagcccggagcaggctgggatgcagcagg

SEQ ID NO: 35152 - DNA, 71 bp, chicken (Gallus Gallus)
  misc_feature (36): n=g or t
tctctgattcctgaaaatttcagaaggaaactgcantgaagtcgagtaaagcttggggtagatctgttcaa

SEQ ID NO: 35153 - DNA, 71 bp, chicken (Gallus Gallus)
  misc_feature (36): n=a or g
aagtgacacaggcagagtgctcagtccttcgggacncggaagttgtccttctctttcctgatggctcccat

SEQ ID NO: 35154 - DNA, 71 bp, chicken (Gallus Gallus)
  misc_feature (36): n=a or c
ccctaaggcaaccccacgatgccacttctcagctcnctggggaatgatggggatagacacctccagcacag

SEQ ID NO: 35155 - DNA, 71 bp, chicken (Gallus Gallus)
  misc_feature (36): n=c or t
acacatccagtatgccaagcactgccccacaggtanacgtcatagaatcacagaatcattaaggttggaaa

SEQ ID NO: 35156 - DNA, 71 bp, chicken (Gallus Gallus)
  misc_feature (36): n=a or g
tttgagatttccttccaacccatcatttcaatgtcnttttaaatggagtagaggagctttttaaggacaaa

SEQ ID NO: 35157 - DNA, 71 bp, chicken (Gallus Gallus)
  misc_feature (36): n=a or g
tggggtgcccactgtgctcttgcttccccacaccanggtgcttcgtcccaggctctgggagacccaaacag

SEQ ID NO: 35158 - DNA, 71 bp, chicken (Gallus Gallus)
  misc_feature (36): n=c or t
cctacatcagcccaggaataaaggctgtgattcttnctgggatagattaagccagcaggcacagtgagcac

SEQ ID NO: 35159 - DNA, 71 bp, chicken (Gallus Gallus)
  misc_feature (36): n=g or t
gtgtgtggcccaaggattgggtcatgctcatggggnaggcgctgtctcttgctcaaggtaatgaatttcaa

SEQ ID NO: 35160 - DNA, 71 bp, chicken (Gallus Gallus)
  misc_feature (36): n=a or g
ccttaagtgctctcctgttttataccctgcaattcntagctctttgacagcaaaagcaaagacttgaactg

SEQ ID NO: 35161 - DNA, 71 bp, chicken (Gallus Gallus)
  misc_feature (36): n=c or t
aggaagattttttctttctaggtgataaagtttcanagtcctccctagggtagtgtacttcacatcagaga

SEQ ID NO: 35162 - DNA, 71 bp, chicken (Gallus Gallus)
  misc_feature (36): n=a or g
tcaagatctttgcctattgctgctgtctcactatanctgtgagcttatttgcagcaagaggaagtgaaata

SEQ ID NO: 35163 - DNA, 71 bp, chicken (Gallus Gallus)
  misc_feature (36): n=c or t
tatttcctggtgtttgcactctgttgtctgcaaatnctaaaactataattatctgctggctcttacagcta

SEQ ID NO: 35164 - DNA, 71 bp, chicken (Gallus Gallus)
  misc_feature (36): n=a or c
gaaatcttctttaagcttaactgctgctagctgagnagagctgcaagaaagggaaagtacacctagttaca

SEQ ID NO: 35165 - DNA, 71 bp, chicken (Gallus Gallus)
  misc_feature (36): n=a or g
aataacaacaaatttgcctgcttagagtgtatcatntaaaaactaatttggatagatcttcaaaagaaagt

SEQ ID NO: 35166 - DNA, 71 bp, chicken (Gallus Gallus)
  misc_feature (36): n=c or t
tcatggcccttttagtgccctgttttccctgattgnagcgtgctggaatgatacggacaataagtggggag

SEQ ID NO: 35167 - DNA, 71 bp, chicken (Gallus Gallus)
  misc_feature (36): n=c or t
cccacgagcacacaggtcccataagtttccccaacnttcaggggagcacaattaggatccgggtattgggg

SEQ ID NO: 35168 - DNA, 71 bp, chicken (Gallus Gallus)
  misc_feature (36): n=a or g
cctcacctcaagcagcctattgttctctcagttctnatgcaagggaactagcgtccaggtgttaaatggga

SEQ ID NO: 35169 - DNA, 71 bp, chicken (Gallus Gallus)
  misc_feature (36): n=a or g
taagccaggtgaggcagccctgcagttacctgtatngtgtcctcccccttatcctgtagtacaacgattcg

SEQ ID NO: 35170 - DNA, 71 bp, chicken (Gallus Gallus)
  misc_feature (36): n=a or c
tgtgctgtgctgtgtcctcccggctgcctttcttcnttcagaatctgcacagaagatgtcctgggcacaga

SEQ ID NO: 35171 - DNA, 71 bp, chicken (Gallus Gallus)
  misc_feature (36): n=c or t
acctaaagagggtgagacactcaaactcccttcagngggaatggtggatgatccttttcctgcggatttct

SEQ ID NO: 35172 - DNA, 71 bp, chicken (Gallus Gallus)
  misc_feature (36): n=a or c
aacttagctcacttcagcttttgtaatagtatttcnccagtgatgtaccaatcccctaaaggatgtgtaac

SEQ ID NO: 35173 - DNA, 71 bp, chicken (Gallus Gallus)
  misc_feature (36): n=c or t
actttgctcattggccctgaacattcccagctgganagatcagtctgtaacacggagcagggctgtgtggc

SEQ ID NO: 35174 - DNA, 71 bp, chicken (Gallus Gallus)
  misc_feature (36): n=g or t
ggcctcctatcagccagctgcgggcatctctgggangcagtggggagctccctgtgcacacagcagcaccc

SEQ ID NO: 35175 - DNA, 71 bp, chicken (Gallus Gallus)
  misc_feature (36): n=a or g
agtcaaaaacaagttttcaccccaagcaaatctctncaagctcagatttgtgcatctatgcttttggagat

SEQ ID NO: 35176 - DNA, 71 bp, chicken (Gallus Gallus)
  misc_feature (36): n=c or t
atcatagcatgtgctcactcagcacttggccattanttctgctcatccttgggtagaaatgagtttggcaa

SEQ ID NO: 35177 - DNA, 71 bp, chicken (Gallus Gallus)
  misc_feature (36): n=a or g
agaggtgttgtgaggagagaggctttggggagaacntcgttgttttagcacagtctttcccctcacagtgg

SEQ ID NO: 35178 - DNA, 71 bp, chicken (Gallus Gallus)
  misc_feature (36): n=a or g
gtggctgggagcttggattggggaaaggctgctggngtatcgccgaggcgcagaaacctgggaactggagg

SEQ ID NO: 35179 - DNA, 71 bp, chicken (Gallus Gallus)
  misc_feature (36): n=c or t
acctgcagaagaaaggctgcagtcatttggtgaaanctagcattaatcaagaatccgcattgagggctcac

SEQ ID NO: 35180 - DNA, 71 bp, chicken (Gallus Gallus)
  misc_feature (36): n=c or t
tgtcctgatgcagaaagtcacaattcagtgagcagncttagacagcctgatagcttttaaacatccagttg

SEQ ID NO: 35181 - DNA, 71 bp, chicken (Gallus Gallus)
  misc_feature (36): n=a or g
acttgtcattgagcacctctatcttttacaaggaantggtagatctccagggagaagcagtgaatttgtgc

SEQ ID NO: 35182 - DNA, 71 bp, chicken (Gallus Gallus)
  misc_feature (36): n=a or g
aagccatggtgagatactgggaatgagtgcttagantatgagactttctgtggattcagccaccaaacatc

SEQ ID NO: 35183 - DNA, 71 bp, chicken (Gallus Gallus)
  misc_feature (36): n=a or g
aaagcaagttgtggacctgtgtgattaagcaggganaagagaacaaaatgcttttgggggtgattctagac

SEQ ID NO: 35184 - DNA, 71 bp, chicken (Gallus Gallus)
  misc_feature (36): n=c or t
taatttgtttttaggttttattcgttctttgcattngttacgctgaatgcttttgcttagttcaagaatac

SEQ ID NO: 35185 - DNA, 71 bp, chicken (Gallus Gallus)
  misc_feature (36): n=a or g
acgctggcgctgaggttctggggctgctttatgtcncattgctctgaagtcacggctgggcacttgtgctt

SEQ ID NO: 35186 - DNA, 71 bp, chicken (Gallus Gallus)
  misc_feature (36): n=a or g
ctgaaactgccaaatttggccaccacaaatgagacnctgtgctcgggaagcagtttgtcctctgcctttga

SEQ ID NO: 35187 - DNA, 71 bp, chicken (Gallus Gallus)
  misc_feature (36): n=c or t
tcacttccaactcagacactgaaccttctcctgttnaccatacgatgtgcagccccccagggtcagtgggg

SEQ ID NO: 35188 - DNA, 71 bp, chicken (Gallus Gallus)
  misc_feature (36): n=c or t
ttttactgttctgcagatgttggtgggctgtcactntgtatccatttgctttaagttgtaatgtgccaatt

SEQ ID NO: 35189 - DNA, 71 bp, chicken (Gallus Gallus)
  misc_feature (36): n=a or g
tcacaagcactgctcatggtgtgagcccagccttgntggtttgggtgctttgtgcagctccttatttgatg

SEQ ID NO: 35190 - DNA, 71 bp, chicken (Gallus Gallus)
  misc_feature (36): n=c or t
ggaaaagcccaagcagcaaaccctcatctcagcgangtctctttgctgacaaactgctgtcactccatcac

SEQ ID NO: 35191 - DNA, 71 bp, chicken (Gallus Gallus)
  misc_feature (36): n=a or g
ctcaaaggacaagtgtgtcatctttgaatggcttcngctgtcctaatctagtatgaaaattcaactttttt

SEQ ID NO: 35192 - DNA, 71 bp, chicken (Gallus Gallus)
  misc_feature (36): n=a or c
tccttattttcctcagtaataggcttttaatatgcncacagatctttctctgtgtatctttgtttatattt

SEQ ID NO: 35193 - DNA, 71 bp, chicken (Gallus Gallus)
  misc_feature (36): n=a or g
atttgcagaaatagcagcttggctgcccatactgcntggagcacataatcgctccttaattgcttgcttgc

SEQ ID NO: 35194 - DNA, 71 bp, chicken (Gallus Gallus)
  misc_feature (36): n=a or g
ttgtcagactggatttctgcagcaatgtgaaggggngtaatccaaagtgttccctgggtctgagggtgaat

SEQ ID NO: 35195 - DNA, 71 bp, chicken (Gallus Gallus)
  misc_feature (36): n=a or g
cagcactgcagtatgtgttttggtggctctcagcangacatgtgctgttctctggttgatgtgggatgcaa

SEQ ID NO: 35196 - DNA, 71 bp, chicken (Gallus Gallus)
  misc_feature (36): n=a or g
ggataaacctacccagatgcagggaagagctcagcnagggaatttattcatcttccatttttgtcctatta

SEQ ID NO: 35197 - DNA, 71 bp, chicken (Gallus Gallus)
  misc_feature (36): n=a or c
tgaaagtagcaacaatagaatgaatgcttggggcancataaactcttcatcaaatggagggttaaatccaa

SEQ ID NO: 35198 - DNA, 71 bp, chicken (Gallus Gallus)
  misc_feature (36): n=c or t
tttgctactttcacatcttcttatctattgtattgnggatttcatggctgaaagctcatctttggatcaga

SEQ ID NO: 35199 - DNA, 71 bp, chicken (Gallus Gallus)
  misc_feature (36): n=a or g
gcagtggatctgctcagaaatataagccggaacacngaggctcttctctgtctggtccacgcggacacacg

SEQ ID NO: 35200 - DNA, 71 bp, chicken (Gallus Gallus)
  misc_feature (36): n=a or g
gttaggtaggtggtatatgtttatgtataatgatantatgtctgggatgccaatgtgtgtgccagctgtga

SEQ ID NO: 35201 - DNA, 71 bp, chicken (Gallus Gallus)
  misc_feature (36): n=a or c
gagatggacccctcacagcccacagcggcttctccnttctgtgatgcatttgcctggctaaagctgcagcc

SEQ ID NO: 35202 - DNA, 71 bp, chicken (Gallus Gallus)
  misc_feature (36): n=g or t
tttcagacagaactggatgcaagaacttactgtaanaacttactgtaaacttgagccaaagaaaagctgga

SEQ ID NO: 35203 - DNA, 71 bp, chicken (Gallus Gallus)
  misc_feature (36): n=a or g
aggaattccttgaggggagtaaagcgcctctgtaanggcaggcagagaccccatctgtcagcagaggtttt

SEQ ID NO: 35204 - DNA, 71 bp, chicken (Gallus Gallus)
  misc_feature (36): n=a or g
agtaagctggttctccttttctggtggcaggatgtntctgcaattgcagccaagctaacaagtatgcagag

SEQ ID NO: 35205 - DNA, 71 bp, chicken (Gallus Gallus)
  misc_feature (36): n=c or t
gctcaaaaaaaggggagttgaacaacctttgaaaanatgtattgtttgtgcatttgcatcattaagatgtt

SEQ ID NO: 35206 - DNA, 71 bp, chicken (Gallus Gallus)
  misc_feature (36): n=a or g
gggttttccttggagcaacaggaagacagcagtacnaatgttgcagaatgttgctggtgactgtttgctct

SEQ ID NO: 35207 - DNA, 71 bp, chicken (Gallus Gallus)
  misc_feature (36): n=c or t
tgtagttcctgtatctaaattatctggatactgttncgagtagtggtagcagttgcaatttttagctacaa

SEQ ID NO: 35208 - DNA, 71 bp, chicken (Gallus Gallus)
  misc_feature (36): n=a or g
tggcagttagcaggaaagtggagtggcaccatgtcnctgcccatgaagcccctgagcccagggtgcagcac

SEQ ID NO: 35209 - DNA, 71 bp, chicken (Gallus Gallus)
  misc_feature (36): n=c or t
cataacgtatttgctacctcaggaggagcggccccnctgccatccaacagtggaaaggtaggtggtgctgc

SEQ ID NO: 35210 - DNA, 71 bp, chicken (Gallus Gallus)
  misc_feature (36): n=a or g
aatatcgccgagggctttgcaggattagagttaatntatttttgtttattatatttgctgatatttctcca

SEQ ID NO: 35211 - DNA, 71 bp, chicken (Gallus Gallus)
  misc_feature (36): n=a or g
tgcccttcccctgcttcccattttcctggcagggcnacagcagctcactgcgctgagcgttagacctgctc

SEQ ID NO: 35212 - DNA, 71 bp, chicken (Gallus Gallus)
  misc_feature (36): n=c or t
ggattagaagagacagtgtgacaggcgttctggtgntattgtttatgagaggtttgcatgaaattttagga

SEQ ID NO: 35213 - DNA, 71 bp, chicken (Gallus Gallus)
  misc_feature (36): n=c or t
aattcctagtaaattagtaattggctaaacaatgcngctcagattactgcgctggtgttcattgtgaagga

SEQ ID NO: 35214 - DNA, 71 bp, chicken (Gallus Gallus)
  misc_feature (36): n=c or t
cagaacctgctgaacaattgctcattttctgctcangctcattctcgctcgcagctttttagccgtgcctg

SEQ ID NO: 35215 - DNA, 71 bp, chicken (Gallus Gallus)
  misc_feature (36): n=a or c
cctgcaaagatgggtaactgccaaaacccctccaanttattaagagtaaattactgtccctactaaaaatg

SEQ ID NO: 35216 - DNA, 71 bp, chicken (Gallus Gallus)
  misc_feature (36): n=c or t
gtccttcccccagggatcacgagcattgattccacngctgcttgcctgcactgtcagcactcgcacctccc

SEQ ID NO: 35217 - DNA, 71 bp, chicken (Gallus Gallus)
  misc_feature (36): n=a or c
tcctgaatcatcccctgctgtcacccttctgttccnttaaggcctgatgtcatcgtgacctgtggcttggt

SEQ ID NO: 35218 - DNA, 71 bp, chicken (Gallus Gallus)
  misc_feature (36): n=g or t
aggcagctgagcacagccctcgctgctccatccttntgcataaattacctctgggctctgagctaaacaaa

SEQ ID NO: 35219 - DNA, 71 bp, chicken (Gallus Gallus)
  misc_feature (36): n=c or t
aaataggttctgcttttaatgcgcactgcagccctnggttgcaatgccgttctccccttgaaagtcccacg

SEQ ID NO: 35220 - DNA, 71 bp, chicken (Gallus Gallus)
  misc_feature (36): n=c or t
ttacagtcaacttatattagaaaagccctgaagaanagaatcattaaattattactctctgaagcagtgca

SEQ ID NO: 35221 - DNA, 71 bp, chicken (Gallus Gallus)
  misc_feature (36): n=a or g
atccacaactgctgtttgttctgtcatgaaagctcnaaaattaatttatcaggtgagttttctctgtattc

SEQ ID NO: 35222 - DNA, 71 bp, chicken (Gallus Gallus)
  misc_feature (36): n=a or g
tgctgccagcagggccaagggtatggaaagtcttcngggagcagatgcagaaactcctaccagttagttaa

SEQ ID NO: 35223 - DNA, 71 bp, chicken (Gallus Gallus)
  misc_feature (36): n=a or g
cagtgcagacacggccttttcagctaagctctgatnctatcagtatctgaactgctttgaaacagaataag

SEQ ID NO: 35224 - DNA, 71 bp, chicken (Gallus Gallus)
  misc_feature (36): n=c or t
ttccagaactctctgctacaccttcagacatcgctngctgtcaggatatctgaactgcctgacggtcggtt

SEQ ID NO: 35225 - DNA, 71 bp, chicken (Gallus Gallus)
  misc_feature (36): n=a or g
tctagcccttgtctcagcactccaacaccacaggtnatgttacaaaactgaaaatgtacaaccatgtgggc

SEQ ID NO: 35226 - DNA, 71 bp, chicken (Gallus Gallus)
  misc_feature (36): n=g or t
cacatgcagtacacttgggtatgctgacactcatgnggtaaccttgcttttttctgaggtaaagcacaggt

SEQ ID NO: 35227 - DNA, 71 bp, chicken (Gallus Gallus)
  misc_feature (36): n=c or t
gaataaaaattccttgtttcagctcggtagaagaangtgcgtaaatgctaccacttcatttttgtggctgt

SEQ ID NO: 35228 - DNA, 71 bp, chicken (Gallus Gallus)
  misc_feature (36): n=a or g
aacaaaggctgtagctggttgttgatagtactgacnaaatcatccagtttatcttgtgcatagtaggctga

SEQ ID NO: 35229 - DNA, 71 bp, chicken (Gallus Gallus)
  misc_feature (36): n=a or c
tggtctcattttctatctctggagcttcaaggtctnaacatcttgaagggctttgaatctgtttcatgaac

SEQ ID NO: 35230 - DNA, 71 bp, chicken (Gallus Gallus)
  misc_feature (36): n=c or t
actaaccagtatgtgtacctggcaggctctgggctngaaggttacacacagcagtgcgctgctggggctct

SEQ ID NO: 35231 - DNA, 71 bp, chicken (Gallus Gallus)
  misc_feature (36): n=a or g
gcagaacacctcatgcctgtggctgagctgagagtngcccaactgtgcaagtgactatgactaaaggagat

SEQ ID NO: 35232 - DNA, 71 bp, chicken (Gallus Gallus)
  misc_feature (36): n=a or g
tatttattggcactggttcttttcataggttcatcngaactgtctgaaaagctctttgacaccagaacgtt

SEQ ID NO: 35233 - DNA, 71 bp, chicken (Gallus Gallus)
  misc_feature (36): n=c or t
agtgcacaatctgttgttctgggttgccttcattcntggcagtcattctggtgtagccacataaagaggat

SEQ ID NO: 35234 - DNA, 71 bp, chicken (Gallus Gallus)
  misc_feature (36): n=g or t
aagattctctgcttcactctgtacagctagagttanggagttctaacagaacttgaagatgctttcttaaa

SEQ ID NO: 35235 - DNA, 71 bp, chicken (Gallus Gallus)
  misc_feature (36): n=a or g
ttagagatagtttaacttccagatgaacactgttanatatttgtgctcagtacatttgaagatttatgtag

SEQ ID NO: 35236 - DNA, 71 bp, chicken (Gallus Gallus)
  misc_feature (36): n=a or c
cggcggaagtggtaatggcggccgcccggctgctgntggcggtgtttgtgggcgctgcgttgggtgagagt

SEQ ID NO: 35237 - DNA, 71 bp, chicken (Gallus Gallus)
  misc_feature (36): n=a or g
gatggcctttattctctcccatcctttccctgcccnatgtcttgagtcccctctgcctggtagacatgctg

SEQ ID NO: 35238 - DNA, 71 bp, chicken (Gallus Gallus)
  misc_feature (36): n=c or t
gatcttatgtgcaacttacatcatgattactgcccngaactgtcagtgttacttcagttctcacatgcctc

SEQ ID NO: 35239 - DNA, 71 bp, chicken (Gallus Gallus)
  misc_feature (36): n=a or c
gcatctcattcatgtgtatggtgttgttatacaaanatgctgagaaaggttgacatgcacaaaaagtgatt

SEQ ID NO: 35240 - DNA, 71 bp, chicken (Gallus Gallus)
  misc_feature (36): n=a or g
gagctgttctcagtacagaaggtatcagttacggcntgtttaaaactctgagcacttgttactactttgct

SEQ ID NO: 35241 - DNA, 71 bp, chicken (Gallus Gallus)
  misc_feature (36): n=a or g
tgcactgcaagctccatcagtaggggagaaattganttccacttgcaaatgcagtagtgaaaatgctccga

SEQ ID NO: 35242 - DNA, 71 bp, chicken (Gallus Gallus)
  misc_feature (36): n=a or g
cctggtcaggtgctgggtgcgctccttggttagcanggagaagccgccgcgttgctcgagaggtccgtgtg

SEQ ID NO: 35243 - DNA, 71 bp, chicken (Gallus Gallus)
  misc_feature (36): n=c or t
ccagaagtgcaataggcaattgtgcacagtcctttntatgatctcttcttatctagttttaaaattgagtc

SEQ ID NO: 35244 - DNA, 71 bp, chicken (Gallus Gallus)
  misc_feature (36): n=a or g
atttgaacaaatttcacatacattactgtgatcacntattgatttaaaataccaaaacttgttcttttagt

SEQ ID NO: 35245 - DNA, 71 bp, chicken (Gallus Gallus)
  misc_feature (36): n=c or t
tgaacttggggagcaaatgtcttcagagacaagatngcaaaaggtattctgtaagaatctggatcaaactc

SEQ ID NO: 35246 - DNA, 71 bp, chicken (Gallus Gallus)
  misc_feature (36): n=c or t
ggaacgttcattacctaaggagagagagtgatttantagcagctcctgttgctaatgagacctggatcctt

SEQ ID NO: 35247 - DNA, 71 bp, chicken (Gallus Gallus)
  misc_feature (36): n=a or g
tgttcttgaattagtttttccacaaaggaagtgtcngtagctttgggaaaccagcactcttcatccagcag

SEQ ID NO: 35248 - DNA, 71 bp, chicken (Gallus Gallus)
  misc_feature (36): n=a or g
aatgttgagcaccagaagaggttgtacagaaaggtntggtgtctccacccttgcacatatttgcaagtaga

SEQ ID NO: 35249 - DNA, 71 bp, chicken (Gallus Gallus)
  misc_feature (36): n=a or g
aaaataccattgcaatcagtagagctggtgaagganaagtaatttagagttattctctttctgtatctcag

SEQ ID NO: 35250 - DNA, 71 bp, chicken (Gallus Gallus)
  misc_feature (36): n=c or t
ccttttgattctgaacttgtcagtggtaaacaatantttattgtcacatggtcaaatactgtttcatggta

SEQ ID NO: 35251 - DNA, 71 bp, chicken (Gallus Gallus)
  misc_feature (36): n=c or t
ataatgaggcaaatttcaccattgcaaaataaaagntaagaactttgtggttctgccaagtactgtgctct

SEQ ID NO: 35252 - DNA, 71 bp, chicken (Gallus Gallus)
  misc_feature (36): n=a or g
ctgccatctctgagtacagagcacacccatgttttntggctgtgcctctttctaacagtatgaagctgagc

SEQ ID NO: 35253 - DNA, 71 bp, chicken (Gallus Gallus)
  misc_feature (36): n=a or g
aactgattagatgtgagcactgttaaggtaccaagntgcttggaagagtaaagtatctcacggttccttac

SEQ ID NO: 35254 - DNA, 71 bp, chicken (Gallus Gallus)
  misc_feature (36): n=c or t
cccatattattttctggttctctgcgtatgaatctngatccttttgaccaacactccgatgaagacatttg

SEQ ID NO: 35255 - DNA, 71 bp, chicken (Gallus Gallus)
  misc_feature (36): n=a or g
ctatagcctttgttaacattcaggagtgagttttcntcaagtacgtgatgccttagcttatgcctcactgt

SEQ ID NO: 35256 - DNA, 71 bp, chicken (Gallus Gallus)
  misc_feature (36): n=c or t
atgaagcagactcagaaacctctacgtattctacantgctttcactttgggccctgaagaattcattcatt

SEQ ID NO: 35257 - DNA, 71 bp, chicken (Gallus Gallus)
  misc_feature (36): n=c or t
gccgaagcttgggcagcccggcagaaagctcggccngcagcaattctggcaaagaaggcggggtagttgga

SEQ ID NO: 35258 - DNA, 71 bp, chicken (Gallus Gallus)
  misc_feature (36): n=c or t
tattctgtttggaaaggttacttccatttatattgnagatgaaaatactttatggcatgtaatcgcaatct

SEQ ID NO: 35259 - DNA, 71 bp, chicken (Gallus Gallus)
  misc_feature (36): n=a or g
ttatattgactgctgtagtaagacacttgcttttcntattggtagacttatgcaagagatgcagtaagaca

SEQ ID NO: 35260 - DNA, 71 bp, chicken (Gallus Gallus)
  misc_feature (36): n=c or t
gtttctagaagtgaaattctttatagataaagtacntgagaaatttgtaagagacattgaagtaatgagat

SEQ ID NO: 35261 - DNA, 71 bp, chicken (Gallus Gallus)
  misc_feature (36): n=a or g
caggcttgagtcaaaccacaaaacttctaatgtttntacttaagcttcctagcatgctaatacagtggttt

SEQ ID NO: 35262 - DNA, 71 bp, chicken (Gallus Gallus)
  misc_feature (36): n=a or c
aattaggcttctgaattagctacctcagttaattgncaaaggtaatctgaaagatggatcagggcctaatg

SEQ ID NO: 35263 - DNA, 71 bp, chicken (Gallus Gallus)
  misc_feature (36): n=c or t
atattttcttgcaagttggtagaattttctgaagcnactgttggggttctgggagatgctgaagatgatgc

SEQ ID NO: 35264 - DNA, 71 bp, chicken (Gallus Gallus)
  misc_feature (36): n=a or g
ctttatgtctctctgatacagctgggacatcatgtnaggcttcagaagaataagggttgatccgtaggacc

SEQ ID NO: 35265 - DNA, 71 bp, chicken (Gallus Gallus)
  misc_feature (36): n=a or g
gctcacaagagaggcctagagataaatgagcatgtnatctaaattacctctaagcacttgaaagaccagcc

SEQ ID NO: 35266 - DNA, 71 bp, chicken (Gallus Gallus)
  misc_feature (36): n=c or t
gatctctagatcttttgcctggcttattgtcacttnggtctgcttcagttgttaaactaagtcaccccttc

SEQ ID NO: 35267 - DNA, 71 bp, chicken (Gallus Gallus)
  misc_feature (36): n=a or g
ctgtaggaaactgacagtctgtaacatcatttagcngagagaaacttttatgttgtttcatagcttctact

SEQ ID NO: 35268 - DNA, 71 bp, chicken (Gallus Gallus)
  misc_feature (36): n=a or g
ggttgtgtgtgataaaaagtgaagtttatagtggcnaatgtgttgtgaagtctggtaacttcaatttctct

SEQ ID NO: 35269 - DNA, 71 bp, chicken (Gallus Gallus)
  misc_feature (36): n=c or t
cagcagtaaaagcaagtgaggattcagcagcagctngctgcttcgttgggctctgttcatgctgtctgctc

SEQ ID NO: 35270 - DNA, 71 bp, chicken (Gallus Gallus)
  misc_feature (36): n=a or g
tgatcccaggctttcctggaagctctcatcatacgnaagctgctttctctttatggaaacttttttttgtt

SEQ ID NO: 35271 - DNA, 71 bp, chicken (Gallus Gallus)
  misc_feature (36): n=c or t
gcaggctgaaatgaaaccactttctttccccagtgncctgaaacagggtttgcagaaagatttctccatcg

SEQ ID NO: 35272 - DNA, 71 bp, chicken (Gallus Gallus)
  misc_feature (36): n=a or c
agctgtgtgtggagacccccttctgtaaatggattntaagcctagctgagattcagtttggattttctaag

SEQ ID NO: 35273 - DNA, 71 bp, chicken (Gallus Gallus)
  misc_feature (36): n=a or g
actatttgctacccttctgatggtgaccatcctttngtatgcatctggcagacaagttgggatgactccaa

SEQ ID NO: 35274 - DNA, 71 bp, chicken (Gallus Gallus)
  misc_feature (36): n=g or t
gtgtgtacagccagtcatgtggatgaattgcagcangagccaggtgtgctttgctaaaggcaaaacccagg

SEQ ID NO: 35275 - DNA, 71 bp, chicken (Gallus Gallus)
  misc_feature (36): n=a or g
acggtgaatgtcatgtcagtgcttacctggtcacanagcttgtacaaaggatagacgcaatgaaacatttg

SEQ ID NO: 35276 - DNA, 71 bp, chicken (Gallus Gallus)
  misc_feature (36): n=a or c
taccgggtgagttatgggtgccatgaatgtcagtancaattacacaggatgaaccttccggtatcaccgca

SEQ ID NO: 35277 - DNA, 71 bp, chicken (Gallus Gallus)
  misc_feature (36): n=a or g
tggccaaccatactttgatgcagctctgcattgttntcctggcaagtgcaactgcagttttacctgaagtt

SEQ ID NO: 35278 - DNA, 71 bp, chicken (Gallus Gallus)
  misc_feature (36): n=c or t
aagcaggttcggcttcacttggtccaccagtatctncttctcctgtgtcctgcacggccagattctgttgt

SEQ ID NO: 35279 - DNA, 71 bp, chicken (Gallus Gallus)
  misc_feature (36): n=g or t
atagggatttctttgcagtgcccggatatttgactnttcttcacccattactaaggaatctgtagcctcat

SEQ ID NO: 35280 - DNA, 71 bp, chicken (Gallus Gallus)
  misc_feature (36): n=a or g
tctacttttgaattcctgtttatatgagcacagaanagctggctgatttgggaatcacagctcgtccacaa

SEQ ID NO: 35281 - DNA, 71 bp, chicken (Gallus Gallus)
  misc_feature (36): n=c or t
caggaggcttcaacagatgtgggctctgaaagccantaacacacttatcagcaaattgcaggacacagcat

SEQ ID NO: 35282 - DNA, 71 bp, chicken (Gallus Gallus)
  misc_feature (36): n=c or t
atggtaaggaagcttgaactagtcaacatattttgnggatttaactaaggttgctatctctcattcattag

SEQ ID NO: 35283 - DNA, 71 bp, chicken (Gallus Gallus)
  misc_feature (36): n=c or t
ccctttctgggcaaacaccaagtagatacacacagnactgaagaaaggaaatcctaatcaggaggacaagg

SEQ ID NO: 35284 - DNA, 71 bp, chicken (Gallus Gallus)
  misc_feature (36): n=g or t
gtgatagagggagctaagccagtgagatacacaggnagtaagacacaggatcaagaagttctgtatacatg

SEQ ID NO: 35285 - DNA, 71 bp, chicken (Gallus Gallus)
  misc_feature (36): n=c or t
agagatgattatctctaagaaatagatttcagctgnattatattgatgctaagtgctgtttctcctgccct

SEQ ID NO: 35286 - DNA, 71 bp, chicken (Gallus Gallus)
  misc_feature (36): n=a or g
caaacattttcttcctgttccctctactcagactcnagactcctaatcctcctccaaattaaatgccaaat

SEQ ID NO: 35287 - DNA, 71 bp, chicken (Gallus Gallus)
  misc_feature (36): n=c or t
agataagcaagtcactgactagtaatgaaacaccantccatagcttagccactaaaatacagtgctcatag

SEQ ID NO: 35288 - DNA, 71 bp, chicken (Gallus Gallus)
  misc_feature (36): n=a or g
tttgtctgagaatcctgttacagacaatctgccatnctatgtgttatctgtgactcctccaggagactgta

SEQ ID NO: 35289 - DNA, 71 bp, chicken (Gallus Gallus)
  misc_feature (36): n=a or g
gagctgcatcaaaccaccaaacaagagaggaactcngagcaccactgctacacgtgcccagagtgaaaaga

SEQ ID NO: 35290 - DNA, 71 bp, chicken (Gallus Gallus)
  misc_feature (36): n=a or g
agcatacaggttagggaaacagaacatacacacatnctataaaactcagtggtcccactccatttcccatt

SEQ ID NO: 35291 - DNA, 71 bp, chicken (Gallus Gallus)
  misc_feature (36): n=a or g
tttacgcacagattggattcctcttccgacccgcantatctgtatattcctgatatatgaaacatacagat

SEQ ID NO: 35292 - DNA, 71 bp, chicken (Gallus Gallus)
  misc_feature (36): n=a or c
aaagtccttcacaaaaagtgggaaaataatcctttnatgactaatcagacactgatcagtagctacacata

SEQ ID NO: 35293 - DNA, 71 bp, chicken (Gallus Gallus)
  misc_feature (36): n=c or t
gcttcgcccaccgctgtacagcactgtaacatgaangaaaccggttgctgtgcacacatagctgcatatcc

SEQ ID NO: 35294 - DNA, 71 bp, chicken (Gallus Gallus)
  misc_feature (36): n=a or g
tgaaggtgatgacctttgttccttgagcagtgaaangtgtaatgcctatcccttttaactgaaactcctga

SEQ ID NO: 35295 - DNA, 71 bp, chicken (Gallus Gallus)
  misc_feature (36): n=a or g
tcccacaaaagagccttactgaatcgtgttcagganattctagaaaacattcaggtaggatttgaactaac

SEQ ID NO: 35296 - DNA, 71 bp, chicken (Gallus Gallus)
  misc_feature (36): n=a or c
tctggtcacagaggacattatttcagcgacagaaanctgccagtgagtgaggcagcaaatccctggcacca

SEQ ID NO: 35297 - DNA, 71 bp, chicken (Gallus Gallus)
  misc_feature (36): n=a or g
atagcctttactggaaccaccgtggcatggataacntgcagctgtgcctggctccagcaagtgtaatcatt

SEQ ID NO: 35298 - DNA, 71 bp, chicken (Gallus Gallus)
  misc_feature (36): n=c or t
accgagttttagttttgcgacagaactgaaatacgngtcacgctttgccggacgtgcagtctcagctcccg

SEQ ID NO: 35299 - DNA, 71 bp, chicken (Gallus Gallus)
  misc_feature (36): n=c or t
tcagctggatatgttaaacacttcctcatttaaggnggcttctgtggtatagtggtgtaagcagctcctga

SEQ ID NO: 35300 - DNA, 71 bp, chicken (Gallus Gallus)
  misc_feature (36): n=c or t
taatattctgcttaaccttttacctccttagaagancgatgtgtttatattttaggcaatttaagaacaga

SEQ ID NO: 35301 - DNA, 71 bp, chicken (Gallus Gallus)
  misc_feature (36): n=c or t
agaagggacaagcaggcaggccagtagaaaatcatnttacaagaaggtgataagtgaacacaggagtccta

SEQ ID NO: 35302 - DNA, 71 bp, chicken (Gallus Gallus)
  misc_feature (36): n=c or t
ggctttaattgaggtggtagtcttactacaagcaanagtgataggaagttgacagtattttatgattgata

SEQ ID NO: 35303 - DNA, 71 bp, chicken (Gallus Gallus)
  misc_feature (36): n=a or g
ggcgagtatatatggacattttaaagttagtgatanttcacgtacagccaagctgagaaattatcaccatg

SEQ ID NO: 35304 - DNA, 71 bp, chicken (Gallus Gallus)
  misc_feature (36): n=c or t
ttcattattcctactatacctgttattccatactanccctatgaaatgcttctctttggagctgtgcatgg

SEQ ID NO: 35305 - DNA, 71 bp, chicken (Gallus Gallus)
  misc_feature (36): n=c or t
gtgtacctgatctacatgaaatttaaggccacctangatggaaaccatgatacgttcagggtggagtttct

SEQ ID NO: 35306 - DNA, 71 bp, chicken (Gallus Gallus)
  misc_feature (36): n=a or c
cttttcttactgacttgtttgcagtggtgatagtcntgtagcagtggtgtcttgccagttctgtaactgga

SEQ ID NO: 35307 - DNA, 71 bp, chicken (Gallus Gallus)
  misc_feature (36): n=c or t
acctgcacccaaacctggctgccaggcttcccatanacctgtgttggtctgcattgtcaaatgtgacttgg

SEQ ID NO: 35308 - DNA, 71 bp, chicken (Gallus Gallus)
  misc_feature (36): n=a or g
tgcagttgggtgactggtatttctgcatattgctgncagcaagttaatttgatttaatgttagtcttgcat

SEQ ID NO: 35309 - DNA, 71 bp, chicken (Gallus Gallus)
  misc_feature (36): n=a or c
ccttacagttgggctacagctcccaaagcaggattnattaggactttccaaaccccaggcctgtgtgagat

SEQ ID NO: 35310 - DNA, 71 bp, chicken (Gallus Gallus)
  misc_feature (36): n=g or t
ttaccaaggtgatggtgctttatgtaatcacctccntctcagatggtgattaaaccttcaggaaagtgcag

SEQ ID NO: 35311 - DNA, 71 bp, chicken (Gallus Gallus)
  misc_feature (36): n=c or t
ggcatcacgttgtgcatgctggaatttgtcttgtcntggaggaaagtaaatgctacttaaggagaagtgag

SEQ ID NO: 35312 - DNA, 71 bp, chicken (Gallus Gallus)
  misc_feature (36): n=a or g
gtacacagaattttatagagaaagctgtttacttcnggtttgcataagtatctttaagttcctctcttaat

SEQ ID NO: 35313 - DNA, 71 bp, chicken (Gallus Gallus)
  misc_feature (36): n=a or g
tcttgatggcttagctttttaatgctagcagaaacnggcaaaacactagcaattaaaatggaacatgataa

SEQ ID NO: 35314 - DNA, 71 bp, chicken (Gallus Gallus)
  misc_feature (36): n=c or t
taggtggaagttcttatatcctgcacaagtaattanttacagtaacaggtatcttaggatatcatagcagg

SEQ ID NO: 35315 - DNA, 71 bp, chicken (Gallus Gallus)
  misc_feature (36): n=c or t
tcaggatgccttattttcaaaacccgaggagcccanaaaaccacacttgaagtagtgaattctgctgcaaa

SEQ ID NO: 35316 - DNA, 71 bp, chicken (Gallus Gallus)
  misc_feature (36): n=a or c
tggagctaatctattctgaacacagcttgttgagtncacaagtaaaactggccaaggtttgcagtaagtca

SEQ ID NO: 35317 - DNA, 71 bp, chicken (Gallus Gallus)
  misc_feature (36): n=c or t
tgttcaatccttttgtcaataagaaagttaacaganaaatcctttccccagttcttagctctctcccagag

SEQ ID NO: 35318 - DNA, 71 bp, chicken (Gallus Gallus)
  misc_feature (36): n=c or t
aatcccaagagctgagcttgctgtctgtagaactcnacctctgtcacctccagcagggactgtactgtgaa

SEQ ID NO: 35319 - DNA, 71 bp, chicken (Gallus Gallus)
  misc_feature (36): n=a or g
atcgtaaggaaacatccattccctgttgatactgcnggggcatccacttcaaaataaaatgaaaaatgaga

SEQ ID NO: 35320 - DNA, 71 bp, chicken (Gallus Gallus)
  misc_feature (36): n=a or c
taaacccacccagttttcttattactgaaacctctnaaaatgactcaggtaatgccttccgcttcagtcag

SEQ ID NO: 35321 - DNA, 71 bp, chicken (Gallus Gallus)
  misc_feature (36): n=c or t
aagtgttttctgctgggctatcccacattggtgtcncattgttcatatactgtactctgcatgctttccat

SEQ ID NO: 35322 - DNA, 71 bp, chicken (Gallus Gallus)
  misc_feature (36): n=g or t
tttctactcttggagctttggttttggttgccaaanaacatagtgtagaagttttcaggtactaagaatat

SEQ ID NO: 35323 - DNA, 71 bp, chicken (Gallus Gallus)
  misc_feature (36): n=a or g
caaaataaaacgtacaaaatggcacccagattttcnaacaactatttaggttggtccttaagtacctgtgc

SEQ ID NO: 35324 - DNA, 71 bp, chicken (Gallus Gallus)
  misc_feature (36): n=c or t
caggacgttacagaaaatatccttccagaaggcagnctcattcacatgatgcggttacctctgtagctact

SEQ ID NO: 35325 - DNA, 71 bp, chicken (Gallus Gallus)
  misc_feature (36): n=g or t
aattttaagtcgtttccccatggaaaaccaggtctntctggactgttcaggagagtatcagtttagtgctg

SEQ ID NO: 35326 - DNA, 71 bp, chicken (Gallus Gallus)
  misc_feature (36): n=g or t
taaaaatgctagagctttcaaaatacttaaatcatnttttaatcatatgcccactgctggtgttctggcag

SEQ ID NO: 35327 - DNA, 71 bp, chicken (Gallus Gallus)
  misc_feature (36): n=c or t
attcctacaaaggatggggcaagtctctctgaacgngcctctcacctgtaagagcagctcacgctcagtct

SEQ ID NO: 35328 - DNA, 71 bp, chicken (Gallus Gallus)
  misc_feature (36): n=a or g
ataataatgaaaatccccagcagaaatgctacttcngcagtactgaagccatgaggagaaaggcaagaagc

SEQ ID NO: 35329 - DNA, 71 bp, chicken (Gallus Gallus)
  misc_feature (36): n=a or c
caggtagatagtgatgttaatacctaaatttctccntggggcagattcatttttgaagtatctttagcctg

SEQ ID NO: 35330 - DNA, 71 bp, chicken (Gallus Gallus)
  misc_feature (36): n=g or t
atacacacatggagaatacatgctacacatacaatnaaatgcacttcagtatatgctaataagacatttgt

SEQ ID NO: 35331 - DNA, 71 bp, chicken (Gallus Gallus)
  misc_feature (36): n=a or g
gatgttgcaacgctttcctatcctactggtagaatnaggtgtggctttggttttcaagcccttcactggtt

SEQ ID NO: 35332 - DNA, 71 bp, chicken (Gallus Gallus)
  misc_feature (36): n=c or t
caataatatatgagttggatgagcagtatactgtantttgtagcgcatgatcaataatacattttcatgct

SEQ ID NO: 35333 - DNA, 71 bp, chicken (Gallus Gallus)
  misc_feature (36): n=c or t
attgaacattcactcactgtggccgctacattagcntctatttgttgtccttatttaggcagtagtactta

SEQ ID NO: 35334 - DNA, 71 bp, chicken (Gallus Gallus)
  misc_feature (36): n=c or t
acttttacagtcagattaacttaatagtagagaaangatagggtatgtgatagtgatagaaatgttactgt

SEQ ID NO: 35335 - DNA, 71 bp, chicken (Gallus Gallus)
  misc_feature (36): n=c or t
tccttgacattcatgccatgcatgagcaactacacntacatggatacacagaaacttacaggctgcattaa

SEQ ID NO: 35336 - DNA, 71 bp, chicken (Gallus Gallus)
  misc_feature (36): n=a or c
gttacatagctcctaacattttgacaaaaagacttnaaagcagctgaagaaaatccaagttaatgattaaa

SEQ ID NO: 35337 - DNA, 71 bp, chicken (Gallus Gallus)
  misc_feature (36): n=c or t
catcaatatgagatcacctagcaaggttcaaagttngttctcttcagaaatcctttacatctaaaggatct

SEQ ID NO: 35338 - DNA, 71 bp, chicken (Gallus Gallus)
  misc_feature (36): n=c or t
attcatggccatttttaggcaagagaccacaatcantgcttttaagagaagactgaagtttcctggaccag

SEQ ID NO: 35339 - DNA, 71 bp, chicken (Gallus Gallus)
  misc_feature (36): n=c or t
gacagtgcgtgcccttacgttgcctaatcagtctcnagagtgcctgcgaaaaggcaaatccgtagcagaat

SEQ ID NO: 35340 - DNA, 71 bp, chicken (Gallus Gallus)
  misc_feature (36): n=g or t
tacaactattgcttagctcagaagttcagtgagacnggttcacagaaagctcagattcagtaaactgcctc

SEQ ID NO: 35341 - DNA, 71 bp, chicken (Gallus Gallus)
  misc_feature (36): n=a or g
ggaaaagcccagcagtagaagtaattcccactgtgncattttgttacccacaattctttttcttttagttc

SEQ ID NO: 35342 - DNA, 71 bp, chicken (Gallus Gallus)
  misc_feature (36): n=a or g
taagactacatgtaaattcatttgaccaggaattcnagcttggggtaaaataccagctggatttactgagg

SEQ ID NO: 35343 - DNA, 71 bp, chicken (Gallus Gallus)
  misc_feature (36): n=g or t
tactgaattcaagagagcttttctgtccgtagttcnttcttctaatgttcttaaagttcatcaactaaagt

SEQ ID NO: 35344 - DNA, 71 bp, chicken (Gallus Gallus)
  misc_feature (36): n=g or t
ggcagacggacgtaaggcaggattcctttgtgcccnctcaaaacacttcatcagagcaccttatgatctct

SEQ ID NO: 35345 - DNA, 71 bp, chicken (Gallus Gallus)
  misc_feature (36): n=a or g
acagctgatagaaattcctgatagaaattgattttnagagggctgttttcctttcaacttgtgtaacacca

SEQ ID NO: 35346 - DNA, 71 bp, chicken (Gallus Gallus)
  misc_feature (36): n=c or t
tttttaagctttgtattttaacatctttaccacagnatttgataacaactgcttgttgcttctaatatgat

SEQ ID NO: 35347 - DNA, 71 bp, chicken (Gallus Gallus)
  misc_feature (36): n=a or g
ctaagctgttacatcgtttaaggtaggtcttctatnatgaatggagtgacactgcgaaactgaatgctcag

SEQ ID NO: 35348 - DNA, 71 bp, chicken (Gallus Gallus)
  misc_feature (36): n=a or c
tggattaacggagctctcattagcagtaacctcagntacttctctctgtggtctttcctgcatgtctttct

SEQ ID NO: 35349 - DNA, 71 bp, chicken (Gallus Gallus)
  misc_feature (36): n=a or g
taccaacaggtttcacctgaaacacaagcttacacnagccttaacagctgagagccacacaaggcagtgct

SEQ ID NO: 35350 - DNA, 71 bp, chicken (Gallus Gallus)
  misc_feature (36): n=c or t
agccatttacactgggaattaccagttcaaagccanggagacaaattaaaaaaagtttggggataggtcaa

SEQ ID NO: 35351 - DNA, 71 bp, chicken (Gallus Gallus)
  misc_feature (36): n=a or g
gtccaggacagtgagagaaaacccttctgaatgacntgccagcagattaggtgccagaaagaaattccatg

SEQ ID NO: 35352 - DNA, 71 bp, chicken (Gallus Gallus)
  misc_feature (36): n=g or t
gaagaggggggaagaaggtctgcaggtgggatctgnccaggattgggtcccaacaccacagcagtaccagg

SEQ ID NO: 35353 - DNA, 71 bp, chicken (Gallus Gallus)
  misc_feature (36): n=c or t
agtgtcgtccaaagataccggcacagaaataatttntcccaacaaagacttcacaaggatggagaatgtgg

SEQ ID NO: 35354 - DNA, 71 bp, chicken (Gallus Gallus)
  misc_feature (36): n=c or t
accaaaaggccacacacaaactctgccagcacctgngcagtttccttatttgagttggtgacagccccagt

SEQ ID NO: 35355 - DNA, 71 bp, chicken (Gallus Gallus)
  misc_feature (36): n=a or g
aaatctatgggttccatgggttgaaatggattcacnatgggttgaaatgtgccatgctggagtcgtccaac

SEQ ID NO: 35356 - DNA, 71 bp, chicken (Gallus Gallus)
  misc_feature (36): n=c or t
tgctgcctgctcctcccagcgccctggagtgaatgngagtgtctgttggagaaccacgattttaaagatga

SEQ ID NO: 35357 - DNA, 71 bp, chicken (Gallus Gallus)
  misc_feature (36): n=a or g
tatttcttttgtcttaaatatatcaagccaacagtntattttcctcagttgtttcttaactatatccagta

SEQ ID NO: 35358 - DNA, 71 bp, chicken (Gallus Gallus)
  misc_feature (36): n=a or g
aaagacatcacctgcgctccgagtgtggtccctctnactgtgtgttgtgttgcaatgagctaggcaacttt

SEQ ID NO: 35359 - DNA, 71 bp, chicken (Gallus Gallus)
  misc_feature (36): n=c or t
tgtctttaactacagtgtatcttggaggcaaagggnctcaagggaggaatggacttgatgctaaacagatg

SEQ ID NO: 35360 - DNA, 71 bp, chicken (Gallus Gallus)
  misc_feature (36): n=c or t
atgtgcacgtgtgcttggaggggccagcacatcccnatgtgtctgtgtacttttgtgctcatttccatgtg

SEQ ID NO: 35361 - DNA, 71 bp, chicken (Gallus Gallus)
  misc_feature (36): n=g or t
ttcccaacttacctctgtcaatcatacaaccagacnttcacttaccttttgccaacaaagcaaagacattg

SEQ ID NO: 35362 - DNA, 71 bp, chicken (Gallus Gallus)
  misc_feature (36): n=a or g
ctctgatcatcaagatcctctcctgtgcactcctcnctggggaaactggttaaatttcccttttttttccc

SEQ ID NO: 35363 - DNA, 71 bp, chicken (Gallus Gallus)
  misc_feature (36): n=a or g
ctctgctgctcctccacctggagagatggtgctggnatcccacacccaaaccatgggctgtcgcctttttc

SEQ ID NO: 35364 - DNA, 71 bp, chicken (Gallus Gallus)
  misc_feature (36): n=g or t
atggggaggatggagcgttgccatgcatccgtcagntctgggactctttgccccaggattctgtgagttga

SEQ ID NO: 35365 - DNA, 71 bp, chicken (Gallus Gallus)
  misc_feature (36): n=a or c
tttctgtgctggcatgcagcctgatctgtttgaacnctgtacctctaacacagcatcagtgatgctccctc

SEQ ID NO: 35366 - DNA, 71 bp, chicken (Gallus Gallus)
  misc_feature (36): n=a or g
aaaggaggcaggcaacagctagcctggcctggtgcntggatgaagggccagatgaccaagggacaccaaga

SEQ ID NO: 35367 - DNA, 71 bp, chicken (Gallus Gallus)
  misc_feature (36): n=a or g
aggaggtggcatgcagtgctaaatgggaggacctcntgctcaggcactgcccaaagagaaagagcattgtt

SEQ ID NO: 35368 - DNA, 71 bp, chicken (Gallus Gallus)
  misc_feature (36): n=a or g
tggactctcttggattcagactttctgagtctaccnctgccttgcatgggtttgtggtgactgctttcctc

SEQ ID NO: 35369 - DNA, 71 bp, chicken (Gallus Gallus)
  misc_feature (36): n=c or t
aacatttctgtcgggatctcaaggaaacagtgaagncttggtgcttctcaatgtttctatcaattatctaa

SEQ ID NO: 35370 - DNA, 71 bp, chicken (Gallus Gallus)
  misc_feature (36): n=a or c
atgagatgggaaggacagggccttattctgccaaanctacctaatatgctgagctcttaatcataggaata

SEQ ID NO: 35371 - DNA, 71 bp, chicken (Gallus Gallus)
  misc_feature (36): n=a or g
caactttcgctgggacacatttctttaaaaattttntgccataagattccatgtgctcagttactaaagac

SEQ ID NO: 35372 - DNA, 71 bp, chicken (Gallus Gallus)
  misc_feature (36): n=g or t
ttactgctgggagagcagcaagtgtgcttggattcnggtttgttggttggggaaacctggcagagaaggaa

SEQ ID NO: 35373 - DNA, 71 bp, chicken (Gallus Gallus)
  misc_feature (36): n=g or t
aaatgtgacctgggaaaaccccaatgagcagaagtnctgcgtttcagtccatttggtctaaactcaatgca

SEQ ID NO: 35374 - DNA, 71 bp, chicken (Gallus Gallus)
  misc_feature (36): n=a or g
aaggccaagggctaagtctgaaattcacagccaacnacttgcaaagcatcttcttcataaagggttcgttc

SEQ ID NO: 35375 - DNA, 71 bp, chicken (Gallus Gallus)
  misc_feature (36): n=c or t
tagaaaaactgaagcattaatggagatgaatatttnaggcataaagctcttctgggactgtacaaaaccag

SEQ ID NO: 35376 - DNA, 71 bp, chicken (Gallus Gallus)
  misc_feature (36): n=a or g
acgtgggtcctgatgcactcggtatctgaagccccngtccatgtcttgctgttttctgattcactgcagtt

SEQ ID NO: 35377 - DNA, 71 bp, chicken (Gallus Gallus)
  misc_feature (36): n=c or t
tacaggtagcatttaaaacctcttcattgggtctcnctcattctccaggctgctctcctaccagctcaggc

SEQ ID NO: 35378 - DNA, 71 bp, chicken (Gallus Gallus)
  misc_feature (36): n=a or g
aaacctctccaggaataaatctcctcaaggaacacnaaggaagaatgctttccttgcaaggtccccacaag

SEQ ID NO: 35379 - DNA, 71 bp, chicken (Gallus Gallus)
  misc_feature (36): n=a or g
tgtgagttactgggggtggatttcagcacacagagnggaggcacagtcagctttgaccaaatatctctaat

SEQ ID NO: 35380 - DNA, 71 bp, chicken (Gallus Gallus)
  misc_feature (36): n=a or g
ggggggggacagggatggggtgccccgggttgcagngctctgctccagaaggctcaaggtcctcattacgc

SEQ ID NO: 35381 - DNA, 71 bp, chicken (Gallus Gallus)
  misc_feature (36): n=a or g
ccaagattatgcatcaggttccaagcaagcactgcncaacggggctgcaaatgccaccagaacacggtgac

SEQ ID NO: 35382 - DNA, 71 bp, chicken (Gallus Gallus)
  misc_feature (36): n=c or t
tagggctgcacagaacggacccagagctcccagtcnattccagcagatctgcctgaaatccactgggatca

SEQ ID NO: 35383 - DNA, 71 bp, chicken (Gallus Gallus)
  misc_feature (36): n=c or t
tacccatcttatctggaatatatgaaagtgcaggangctatggaaaaggctgtgtttttgggataaagaca

SEQ ID NO: 35384 - DNA, 71 bp, chicken (Gallus Gallus)
  misc_feature (36): n=a or g
agggagaggcttggtgcaaagagccgacgggagccnggagcaggcagtcaaacagtgagctgggagcacac

SEQ ID NO: 35385 - DNA, 71 bp, chicken (Gallus Gallus)
  misc_feature (36): n=a or g
gtggatatttgttcttcctaattaggatggttccanttggccaaagcaagcagagcactaccacacacagg

SEQ ID NO: 35386 - DNA, 71 bp, chicken (Gallus Gallus)
  misc_feature (36): n=a or g
acatcccggggcttaatgccgtttggaggggaggcnctgctccatgcggatacgccgtcgctttcgtgcgc

SEQ ID NO: 35387 - DNA, 71 bp, chicken (Gallus Gallus)
  misc_feature (36): n=a or g
gaattttacaactcaacccactgaaaatcaacccantctaagtttggagactaccaggctgtgctttcaca

SEQ ID NO: 35388 - DNA, 71 bp, chicken (Gallus Gallus)
  misc_feature (36): n=a or g
acagatgagccttcgactcagctggatcaagacacncaagtgcaggatatggatgaggtaggtagccaaca

SEQ ID NO: 35389 - DNA, 71 bp, chicken (Gallus Gallus)
  misc_feature (36): n=c or t
gcaatgcgctctaaatgggattaagtcagatcctangtgtgtttatttgactttaaccagaaagtaaacct

SEQ ID NO: 35390 - DNA, 71 bp, chicken (Gallus Gallus)
  misc_feature (36): n=a or c
gagtctgcactttctgcccatgcagtgcatctacantcaagccaggtggtttcacattgtgagtagtgcaa

SEQ ID NO: 35391 - DNA, 71 bp, chicken (Gallus Gallus)
  misc_feature (36): n=c or t
agagtgatatgaattggcactctggctctgggcctngagaggaatttcacgtgtgggcctttgctcatggc

SEQ ID NO: 35392 - DNA, 71 bp, chicken (Gallus Gallus)
  misc_feature (36): n=a or g
attcgggggtgatatgaaggagtgagctggggaganagcaagtaagccatgtccctaggcaagtcctgcct

SEQ ID NO: 35393 - DNA, 71 bp, chicken (Gallus Gallus)
  misc_feature (36): n=c or t
ttattcccaccgcaaagtccagcatcgctccacatnactgtgtgtgattctctagacaagctcctctaaga

SEQ ID NO: 35394 - DNA, 71 bp, chicken (Gallus Gallus)
  misc_feature (36): n=a or g
tccgcagggaaaaaaaggctgcaggggttggcatgngttgttctccttcccgcttgcagagatgaggaagg

SEQ ID NO: 35395 - DNA, 71 bp, chicken (Gallus Gallus)
  misc_feature (36): n=c or t
atacggaccctttcccaccctaagaactgagggtgnccagaaataaggccagaaaacaccgctgtcagctt

SEQ ID NO: 35396 - DNA, 71 bp, chicken (Gallus Gallus)
  misc_feature (36): n=a or g
tgtgctgctctgttagggtggtgctgggagaactgnatcaagaattcctaaagcagcgaacccgagttctg

SEQ ID NO: 35397 - DNA, 71 bp, chicken (Gallus Gallus)
  misc_feature (36): n=a or g
ggaactttctatgggcctaaattctctcacactgcntgcgcaatttaggtaaatggcagtgatgtttgtgt

SEQ ID NO: 35398 - DNA, 71 bp, chicken (Gallus Gallus)
  misc_feature (36): n=g or t
tccaggtacagacagcaggaggggcactcagcactnctggtttcattgggacttcccgtctttctttcctt

SEQ ID NO: 35399 - DNA, 71 bp, chicken (Gallus Gallus)
  misc_feature (36): n=a or g
cgtgtgggagaacagccgcactctgcatcttgcacngtgcacagacaaaataccagggagaaccagggaac

SEQ ID NO: 35400 - DNA, 71 bp, chicken (Gallus Gallus)
  misc_feature (36): n=c or t
tttcagttacatccagcatgtaaaacttggtatgangcatgctgggcttaacaccgctctgactccttcat

SEQ ID NO: 35401 - DNA, 71 bp, chicken (Gallus Gallus)
  misc_feature (36): n=a or c
ctcattctaaggtttcctatttactaagatatttcngttaaagtatttctaagttgcaattcatacttctt

SEQ ID NO: 35402 - DNA, 71 bp, chicken (Gallus Gallus)
  misc_feature (36): n=g or t
aatgcagcagatcgctcacaaggaagcacaggtccnggaggagacacggaagcaggtcaaaacttatcaca

SEQ ID NO: 35403 - DNA, 71 bp, chicken (Gallus Gallus)
  misc_feature (36): n=c or t
cagacaaatagtgacaatcccatatcttggtcattncaatcttattctacctctaatacaacttaagaatt

SEQ ID NO: 35404 - DNA, 71 bp, chicken (Gallus Gallus)
  misc_feature (36): n=c or t
tatcttaaccagtacagctggcagtgggtgaggatncacatactattggcacatttattgtatgatctcct

SEQ ID NO: 35405 - DNA, 71 bp, chicken (Gallus Gallus)
  misc_feature (36): n=a or g
ctttctactttccactcttcaggcctgggaatgacntacttccaaagtaagataccaaaggaaacaagagt

SEQ ID NO: 35406 - DNA, 71 bp, chicken (Gallus Gallus)
  misc_feature (36): n=g or t
gaccttgtatggcgctgttgggttctgcgctgtcangtccaaaacttgctaggcactttgacagaggactt

SEQ ID NO: 35407 - DNA, 71 bp, chicken (Gallus Gallus)
  misc_feature (36): n=c or t
tacatagaagtttgcatatctttctctgaatattgncacttactcatatctatttgaatttattataggta

SEQ ID NO: 35408 - DNA, 71 bp, chicken (Gallus Gallus)
  misc_feature (36): n=c or t
tctttctgtgcgtttggttgtttgttccagttacangtacacatgattaaaacttgctgtaaatcctactt

SEQ ID NO: 35409 - DNA, 71 bp, chicken (Gallus Gallus)
  misc_feature (36): n=c or t
tctgtttttagttctgacatgaactcttgttcctgnctccgtttccctatgaatgaattggggattgtact

SEQ ID NO: 35410 - DNA, 71 bp, chicken (Gallus Gallus)
  misc_feature (36): n=c or t
gaaaaatgcttcttttccagtgtttcatccttgctncttttattgatcacatttcacagccagatgatatt

SEQ ID NO: 35411 - DNA, 71 bp, chicken (Gallus Gallus)
  misc_feature (36): n=c or t
gtgaaaaaggtacactgaaaggaccttatagcctgnagggcagctgggaattcctgcttacaagtccttgc

SEQ ID NO: 35412 - DNA, 71 bp, chicken (Gallus Gallus)
  misc_feature (36): n=c or t
gtccttccactgagcccatcctactggatcccaaanactagcactgccattgcttcttttgatcacatcac

SEQ ID NO: 35413 - DNA, 71 bp, chicken (Gallus Gallus)
  misc_feature (36): n=c or t
tgaggtgctgcaggtagctgagaacttatctggacnggaatgaaatcattccatgacgtccatgggggatg

SEQ ID NO: 35414 - DNA, 71 bp, chicken (Gallus Gallus)
  misc_feature (36): n=g or t
tttagggcctaaaaagtccttcttagtttaaacatntaattcaaagatataaaacctttagtgttgttgtt

SEQ ID NO: 35415 - DNA, 71 bp, chicken (Gallus Gallus)
  misc_feature (36): n=a or g
ctgcagtgggcagcgtttggccgaatgaaaggatcncagagatattgttaggctggagccttctgtgagca

SEQ ID NO: 35416 - DNA, 71 bp, chicken (Gallus Gallus)
  misc_feature (36): n=c or t
cttgttgttcagccatgcaactgcttttgagaaagntccccttcaagtgggagctccaccaacaggtgaat

SEQ ID NO: 35417 - DNA, 71 bp, chicken (Gallus Gallus)
  misc_feature (36): n=c or t
accctagtgtgtgcagaataaaggaggcttagaaangctgatgaagttagttagtatactggaacattcct

SEQ ID NO: 35418 - DNA, 71 bp, chicken (Gallus Gallus)
  misc_feature (36): n=a or c
caaaagacaaatggtccttcgttctccccaaagagncatagttaggggggagagacaaaggcactgatatc

SEQ ID NO: 35419 - DNA, 71 bp, chicken (Gallus Gallus)
  misc_feature (36): n=a or g
ggctgctttatttctggcgctatctcagaaagcatnaattaatgtatacgtgtatatatttttggtccttc

SEQ ID NO: 35420 - DNA, 71 bp, chicken (Gallus Gallus)
  misc_feature (36): n=c or t
ttacatagcaagtgcttgggaaatttggggagttgntgaaaatttccctgcctgaagccctgagagcttca

SEQ ID NO: 35421 - DNA, 71 bp, chicken (Gallus Gallus)
  misc_feature (36): n=a or g
tccgctgaaccagactgcactggagatgagggaacnttgtcactaactaggcactgcaaaagttgaggcca

SEQ ID NO: 35422 - DNA, 71 bp, chicken (Gallus Gallus)
  misc_feature (36): n=a or g
acaaggaaacacctgagattgagtgcattcgtgccnatactcctcacaaatgggcctctctctcaccaaaa

SEQ ID NO: 35423 - DNA, 71 bp, chicken (Gallus Gallus)
  misc_feature (36): n=c or t
attatcttatacacaggtaataacatggcagaacangtcagcttcatcatagttctgcaagaagatcttga

SEQ ID NO: 35424 - DNA, 71 bp, chicken (Gallus Gallus)
  misc_feature (36): n=c or t
aggaagggcagatttctattaattagtgtaagccanggattcaagtgatgaaaactcttctctctgtctcc

SEQ ID NO: 35425 - DNA, 71 bp, chicken (Gallus Gallus)
  misc_feature (36): n=c or t
caacgagttttcacttggtcagaggaaaagctcttnttcaggaggaaacccatggtttaacaggggaacag

SEQ ID NO: 35426 - DNA, 71 bp, chicken (Gallus Gallus)
  misc_feature (36): n=a or g
ggaaagggctccattttgtgggaaggaacacatggnctgaaaatatgctgtgcaccttttacagcagtgca

SEQ ID NO: 35427 - DNA, 71 bp, chicken (Gallus Gallus)
  misc_feature (36): n=c or t
cagaagaactgatatgcacataaacccatccttcgncattgggctcctcatcatggctggggtcctgcggg

SEQ ID NO: 35428 - DNA, 71 bp, chicken (Gallus Gallus)
  misc_feature (36): n=c or t
gaaatgagttattctagtaaaaaccctggagaacgnagtgttttggaaccagggaaaagttaaacttggca

SEQ ID NO: 35429 - DNA, 71 bp, chicken (Gallus Gallus)
  misc_feature (36): n=a or g
gtgaaaacatatgtgcgcccacatgtctgtctgatnggaaaggaccgcaccaccagtgaggatcttccact

SEQ ID NO: 35430 - DNA, 71 bp, chicken (Gallus Gallus)
  misc_feature (36): n=c or t
gtatattgcctctggcaagaaataagtgtacttgtnttatttcccaggtctattattcctgtggtgcggtg

SEQ ID NO: 35431 - DNA, 71 bp, chicken (Gallus Gallus)
  misc_feature (36): n=c or t
cacgatctcccgggtattcctgttccaatggccggnccgtacctggcagctgaagggagatgtgcacatca

SEQ ID NO: 35432 - DNA, 71 bp, chicken (Gallus Gallus)
  misc_feature (36): n=a or g
gtagcgctctgagtgtgaatttctgactgtgacganagtatgagttgtaaccatgttaacaaataaccaga

SEQ ID NO: 35433 - DNA, 71 bp, chicken (Gallus Gallus)
  misc_feature (36): n=c or t
tgttccttagcggtcattaatgccctagctaacatngctgctaacattcaaggagagcaccttgtggatga

SEQ ID NO: 35434 - DNA, 71 bp, chicken (Gallus Gallus)
  misc_feature (36): n=c or t
cttgctcttccatcgccaatctccaaaggcaaactngcagcggttcgatgctcctgcaatgctccagccct

SEQ ID NO: 35435 - DNA, 71 bp, chicken (Gallus Gallus)
  misc_feature (36): n=g or t
gggatatcaagtcagcacaaggatatcttgtcaagngtggtaaagtcaatactgtaataggctgtgtcgtt

SEQ ID NO: 35436 - DNA, 71 bp, chicken (Gallus Gallus)
  misc_feature (36): n=c or t
ttcaggaaaactccaattaatatagcattgcatcantaatatgaatgacagcgtgaaacctgtgactctaa

SEQ ID NO: 35437 - DNA, 71 bp, chicken (Gallus Gallus)
  misc_feature (36): n=c or t
cagtgttcccaggaggctcctaaaacttgtgctgcngtgctgaggctgtacttcaggtattcactgttgtt

SEQ ID NO: 35438 - DNA, 71 bp, chicken (Gallus Gallus)
  misc_feature (36): n=g or t
ccctgcccctccatccctgcctccccagaaagcagnccattaagtgataaagttgtttacttgtagcaaca

SEQ ID NO: 35439 - DNA, 71 bp, chicken (Gallus Gallus)
  misc_feature (36): n=c or t
atatatcagggatatctaggaaaaaacactgtatangatggactcgctgcagctagactatataagctgaa

SEQ ID NO: 35440 - DNA, 71 bp, chicken (Gallus Gallus)
  misc_feature (36): n=c or t
atatagtgatgccttaaagttggtagagaaaaagantgtatttcatcttcacaggcatctcctgcagtgtt

SEQ ID NO: 35441 - DNA, 71 bp, chicken (Gallus Gallus)
  misc_feature (36): n=c or t
tattttagaactgatcgagtgtcacccttattttgnattactggcaaacaacttcataaaagtgtaagcac

SEQ ID NO: 35442 - DNA, 71 bp, chicken (Gallus Gallus)
  misc_feature (36): n=g or t
tggagaaagtttgtcttgacgaagtctgtatgcacngagatttctcttatggaaagaagcatacaagggct

SEQ ID NO: 35443 - DNA, 71 bp, chicken (Gallus Gallus)
  misc_feature (36): n=c or t
aaatgatatcatgcagagagggtgaatctcagcttncataaaaatcagactctgatcttatttttttcttc

SEQ ID NO: 35444 - DNA, 71 bp, chicken (Gallus Gallus)
  misc_feature (36): n=c or t
tattgtgagcagagcgcgctctaaacgcagcaccantcacaacaaatagtcctaaggacctgggaaaaatt

SEQ ID NO: 35445 - DNA, 71 bp, chicken (Gallus Gallus)
  misc_feature (36): n=c or t
cacacagaacataaagcaggttcactcaacactaancagaaacacgtcaggcagacacacactgtgtgacc

SEQ ID NO: 35446 - DNA, 71 bp, chicken (Gallus Gallus)
  misc_feature (36): n=c or t
atattaacaccaacttctttcacaaaggcttttcangtaacaggcaataacactttgaaatatttcttgtg

SEQ ID NO: 35447 - DNA, 71 bp, chicken (Gallus Gallus)
  misc_feature (36): n=a or g
gcctccacagttcttcacaagccctcctgggccacngctagcccattacttggtagcttcacaaacaagca

SEQ ID NO: 35448 - DNA, 71 bp, chicken (Gallus Gallus)
  misc_feature (36): n=c or t
ttgcttgcaatgagattaggagaaaactattatagngacaagatgtttgttggcattacgttacccactcc

SEQ ID NO: 35449 - DNA, 71 bp, chicken (Gallus Gallus)
  misc_feature (36): n=a or c
tgtgctgaggcaacgcacccatcctgcaccccctgnatggtcactccccctgggacaacaaacacaggccc

SEQ ID NO: 35450 - DNA, 71 bp, chicken (Gallus Gallus)
  misc_feature (36): n=c or t
ttaaattcaacacagggtatcaatccttgtccattntgcatccttatctatgatgcctgaaaatagaaata

SEQ ID NO: 35451 - DNA, 71 bp, chicken (Gallus Gallus)
  misc_feature (36): n=a or g
acagaaagggagaggttaccctgtcactgttactcntgtctccaaaaagggcagacttcactttctgcgat

SEQ ID NO: 35452 - DNA, 71 bp, chicken (Gallus Gallus)
  misc_feature (36): n=a or g
tttctccgtggtaatctgctctaaccactcctgaanacttgtaaggttcatctgagacttggtcttctcac

SEQ ID NO: 35453 - DNA, 71 bp, chicken (Gallus Gallus)
  misc_feature (36): n=c or t
attaaaggagaggggtaggcgactcgtcgcaatacngtggagcaatgataggtgatcatgtttgttgatgg

SEQ ID NO: 35454 - DNA, 71 bp, chicken (Gallus Gallus)
  misc_feature (36): n=c or t
agagttttgcttttaaacctggactgaaaggttcantgaaatataaaaacaaggatcaacagaaaattgat

SEQ ID NO: 35455 - DNA, 71 bp, chicken (Gallus Gallus)
  misc_feature (36): n=a or g
aaaaggctgtgtgcagcataggcatgtgcatccacnaaaccttttttgtctcccttgtgctcttagcaaat

SEQ ID NO: 35456 - DNA, 71 bp, chicken (Gallus Gallus)
  misc_feature (36): n=c or t
ttgtatcaaattagcattgttgatttgaggcttttnccccatcatgtttgctgagactgaaaatttgggca

SEQ ID NO: 35457 - DNA, 71 bp, chicken (Gallus Gallus)
  misc_feature (36): n=a or g
taatggagtgggtggtattttggcaaaatattttcncatagttatgcaaatgactgctattgcattgtgta

SEQ ID NO: 35458 - DNA, 71 bp, chicken (Gallus Gallus)
  misc_feature (36): n=c or t
ctgttcaaccgttcatactgcaacatatgatgcagntaaaccacccagatctgtgtaaattcagatctgtc

SEQ ID NO: 35459 - DNA, 71 bp, chicken (Gallus Gallus)
  misc_feature (36): n=a or g
cagggattaacatgctaaattccagtagtgctttgnggtaatggggcacctagcttgtgtacacatgacaa

SEQ ID NO: 35460 - DNA, 71 bp, chicken (Gallus Gallus)
  misc_feature (36): n=a or c
tatgttaagaatcccccctcttgaaaatcaaaaggncttgtacgatttcagcactattctacgtgtcctgg

SEQ ID NO: 35461 - DNA, 71 bp, chicken (Gallus Gallus)
  misc_feature (36): n=a or g
ttatggagacaactgtctatagtggataagatagtnaaaggcaagtttaactatgggagcctagatttaat

SEQ ID NO: 35462 - DNA, 71 bp, chicken (Gallus Gallus)
  misc_feature (36): n=a or g
tttctttcctttctgtgctaagtatcttgcatatgntggcattgtgtcagccacagaccaataactgaaat

SEQ ID NO: 35463 - DNA, 71 bp, chicken (Gallus Gallus)
  misc_feature (36): n=c or t
ccagtttgcttccacagtggtcttgaagatgttaancagttggtcccttggttgtgtcagtttagcttctc

SEQ ID NO: 35464 - DNA, 71 bp, chicken (Gallus Gallus)
  misc_feature (36): n=a or g
actttgagcaagaatgacttttttgacgtgaaaagnagccaagcatacatagcagaaaatggagaatacat

SEQ ID NO: 35465 - DNA, 71 bp, chicken (Gallus Gallus)
  misc_feature (36): n=g or t
tgttgctgatataacagagaaatagccaactgattnaagttgtggcccagctctgcactgatgtctgctac

SEQ ID NO: 35466 - DNA, 71 bp, chicken (Gallus Gallus)
  misc_feature (36): n=a or g
cagcttcacatttccatgctactgttcattcctgtncattttaatgctgacaaagagaaatctgctacaga

SEQ ID NO: 35467 - DNA, 71 bp, chicken (Gallus Gallus)
  misc_feature (36): n=c or t
tcactagataatcagcaggataattacctttaaaanactcctacatgatattccctatatcttgatttggg

SEQ ID NO: 35468 - DNA, 71 bp, chicken (Gallus Gallus)
  misc_feature (36): n=c or t
cattagactttgtatcgaaatagtcaatatcgctcnccgcttcaaagttcatcagggatgtgtgacctttt

SEQ ID NO: 35469 - DNA, 71 bp, chicken (Gallus Gallus)
  misc_feature (36): n=a or g
tattcccttcctaggcagctgtttagaaatgcatgntgtcccacaatactgtataagatagtacgtatagc

SEQ ID NO: 35470 - DNA, 71 bp, chicken (Gallus Gallus)
  misc_feature (36): n=g or t
cttttcccccacatttgtctattttttgttcagagnaagtagcagttatgcaccctggaggtataaaaatt

SEQ ID NO: 35471 - DNA, 71 bp, chicken (Gallus Gallus)
  misc_feature (36): n=a or g
ctttttgttcatctcactcactgaatttttgggatntgctctttatcatgaatcatctgtggacaatcaag

SEQ ID NO: 35472 - DNA, 71 bp, chicken (Gallus Gallus)
  misc_feature (36): n=a or c
ctgctgaacacagtggggtcagcttcacactctcangttcaacattaaaaaaccagacttccataatatca

SEQ ID NO: 35473 - DNA, 71 bp, chicken (Gallus Gallus)
  misc_feature (36): n=a or c
aatgctgtcacctcagttactttgctaatgggatanatttttttggtttccaatacctcactgtattcttc

SEQ ID NO: 35474 - DNA, 71 bp, chicken (Gallus Gallus)
  misc_feature (36): n=a or g
tacagaagtgtgcagtttcagaatctctgaagaagnttcaggagaatgatcctcaattaaactcatcacag

SEQ ID NO: 35475 - DNA, 71 bp, chicken (Gallus Gallus)
  misc_feature (36): n=c or t
agaggatcaaataaatctgtcatattacaccactangtattataagaaagacatgaaatctcacccaaagt

SEQ ID NO: 35476 - DNA, 71 bp, chicken (Gallus Gallus)
  misc_feature (36): n=a or g
aaacattaaagttcctgtgaaatttcaatcagaaantcaaatgcaggtattcaaagagaagtgatttaggc

SEQ ID NO: 35477 - DNA, 71 bp, chicken (Gallus Gallus)
  misc_feature (36): n=a or g
gatgtggtgaactacagcaaaaattcatgaagctcntaatgaaaaaatcaacacatcatagaagagaattt

SEQ ID NO: 35478 - DNA, 71 bp, chicken (Gallus Gallus)
  misc_feature (36): n=a or c
ggatttggagttcagtgaaggttcaactttaatgtnttcgaaaagggaagagggggaattattagattgaa

SEQ ID NO: 35479 - DNA, 71 bp, chicken (Gallus Gallus)
  misc_feature (36): n=c or t
agtgtactttcataaagtacactatagtactttcantgtaactccttctaaaaatcccagtttctgcttat

SEQ ID NO: 35480 - DNA, 71 bp, chicken (Gallus Gallus)
  misc_feature (36): n=c or t
tagtggcacagactggttttgtgtcaccttctgacnttctctgatcatcccagtttgcagtgggatgcagc

SEQ ID NO: 35481 - DNA, 71 bp, chicken (Gallus Gallus)
  misc_feature (36): n=g or t
tgtccttacctaccctttgagtcgtcagcttttagncttcttgtatcagtccccttggtaacctcttctga

SEQ ID NO: 35482 - DNA, 71 bp, chicken (Gallus Gallus)
  misc_feature (36): n=a or g
gtaaagatttcaatatccttgagagaacgagtctcnataaattatgcacagctatcttgtaagtgtgggtt

SEQ ID NO: 35483 - DNA, 71 bp, chicken (Gallus Gallus)
  misc_feature (36): n=a or g
ttggaaagatccgcatttggctaaatgcatttgaanacaatactaagagagtaagcaggtgtaaatagggc

SEQ ID NO: 35484 - DNA, 71 bp, chicken (Gallus Gallus)
  misc_feature (36): n=c or t
atgattaaatctgtctccccagaaatcttccaatantgaggcatattaatggatgggagtccttgcatgca

SEQ ID NO: 35485 - DNA, 71 bp, chicken (Gallus Gallus)
  misc_feature (36): n=c or t
atgcatggaaataaaataagagatgaagagaactcnaattagtgttagactgtctgtttttaacatgtata

SEQ ID NO: 35486 - DNA, 71 bp, chicken (Gallus Gallus)
  misc_feature (36): n=g or t
acaactctcccattgttagaacagtgctggtggcanctttatagcaacttatcatttctatttaaagcctg

SEQ ID NO: 35487 - DNA, 71 bp, chicken (Gallus Gallus)
  misc_feature (36): n=a or g
cagctgtgacacgctgtcctggatttgggcttgtangagaaattcctaacattcttccaatggcctttacc

SEQ ID NO: 35488 - DNA, 71 bp, chicken (Gallus Gallus)
  misc_feature (36): n=c or t
tcttttcatcttgcaacttctatttctcaggttctnctactgctcacataagaaatcccaccaaatataaa

SEQ ID NO: 35489 - DNA, 71 bp, chicken (Gallus Gallus)
  misc_feature (36): n=c or t
ttctgatgtttcagtgttgcttctaccaactcctgngctgtaataattgtaaaatgaagaggatgggcatc

SEQ ID NO: 35490 - DNA, 71 bp, chicken (Gallus Gallus)
  misc_feature (36): n=c or t
attctgaatcgagaaaaagggaattacaggaatacngagcttcaaatatacaaaaatgaagaccaaatctt

SEQ ID NO: 35491 - DNA, 71 bp, chicken (Gallus Gallus)
  misc_feature (36): n=c or t
agctacacagcaactgtgagacctttcactgaagcngttctcagcatagatgtggtacatcataaaccaat

SEQ ID NO: 35492 - DNA, 71 bp, chicken (Gallus Gallus)
  misc_feature (36): n=g or t
gcattatgcaatgagcaaagaaaaagcttatatttntatcatgctaattaaattgacatggttattgcaaa

SEQ ID NO: 35493 - DNA, 71 bp, chicken (Gallus Gallus)
  misc_feature (36): n=c or t
taggaggggtagttcggaacctccacatagctttangttagtgggaatcagcttctatgttctttttcttt

SEQ ID NO: 35494 - DNA, 71 bp, chicken (Gallus Gallus)
  misc_feature (36): n=c or t
ttaagaaaagggagttcacaaaggatatttccctantagaaaggtaggctggaacttaaaacagtaattat

SEQ ID NO: 35495 - DNA, 71 bp, chicken (Gallus Gallus)
  misc_feature (36): n=c or t
aagtgtagctcaacaagatggtgcacaaaatccccnatgaaattctgagaccgtggtcagaccatcacaac

SEQ ID NO: 35496 - DNA, 71 bp, chicken (Gallus Gallus)
  misc_feature (36): n=c or t
aagcaggaaatctcccagaggtaaagctgataaaangtatgtatactatggtagtttagcttttggtctgt

SEQ ID NO: 35497 - DNA, 71 bp, chicken (Gallus Gallus)
  misc_feature (36): n=a or c
gttgtgcaggaagtttgagatgttaaaataatgtgnatggagtgagagagattgttgccagatttctttta

SEQ ID NO: 35498 - DNA, 71 bp, chicken (Gallus Gallus)
  misc_feature (36): n=a or g
caatggcatgggattttggatgttttgcacaggggntcacccataatctcaaatggttacatatgcaggaa

SEQ ID NO: 35499 - DNA, 71 bp, chicken (Gallus Gallus)
  misc_feature (36): n=a or g
atgggaaataagcgggcagcagctgcaaggactttngagtagcacgcgggtaacttttaagtggtgacact

SEQ ID NO: 35500 - DNA, 71 bp, chicken (Gallus Gallus)
  misc_feature (36): n=c or t
tgagtttaccactgacaccagttgagatactgaganactgtttgtctttggtgggaaacatattcattctt

SEQ ID NO: 35501 - DNA, 71 bp, chicken (Gallus Gallus)
  misc_feature (36): n=c or t
cttcctgaagttgcacagtaccttcagctggttccngttgacttaaatcagtggctgaaatccaccctgct

SEQ ID NO: 35502 - DNA, 71 bp, chicken (Gallus Gallus)
  misc_feature (36): n=c or t
cgacctcctgtgcaaagtgaaatcaaagctgaacangggtcttttatcatatctgtatttctggcatttat

SEQ ID NO: 35503 - DNA, 71 bp, chicken (Gallus Gallus)
  misc_feature (36): n=c or t
cctgagtctgttcaaagtgaattgatgaattttacnagtgtctgtaatgcaatactagtgactttaatgtg

SEQ ID NO: 35504 - DNA, 71 bp, chicken (Gallus Gallus)
  misc_feature (36): n=c or t
tggtaacagtagtgaagcttgttttcctggaaagcnttcattcctctggatctttattttctatctgtcct

SEQ ID NO: 35505 - DNA, 71 bp, chicken (Gallus Gallus)
  misc_feature (36): n=a or g
cagccagggtactttctagcattagaacagggtcantgaagcaccaaatgtgggctgcttccgtaggagga

SEQ ID NO: 35506 - DNA, 71 bp, chicken (Gallus Gallus)
  misc_feature (36): n=a or g
gtaaaaaacagtgagactacttggctgcattgcacntaggcaataagattagattcattcatatctctttt

SEQ ID NO: 35507 - DNA, 71 bp, chicken (Gallus Gallus)
  misc_feature (36): n=c or t
gcctgtaaagtgttctgaaaatatataatgctacanaaatactaaataataacagtgcacttaaagtaaaa

SEQ ID NO: 35508 - DNA, 71 bp, chicken (Gallus Gallus)
  misc_feature (36): n=c or t
aaatggtttcatatatacctaattaaagagttgagnaggtgatgtattctcttccagatagggacgtaagt

SEQ ID NO: 35509 - DNA, 71 bp, chicken (Gallus Gallus)
  misc_feature (36): n=c or t
agaacccagagctacgcagggaatacagcagagatngctcctccaccttcggaatcccctgaagtcaatga

SEQ ID NO: 35510 - DNA, 71 bp, chicken (Gallus Gallus)
  misc_feature (36): n=a or g
ctaagcagcttttccaagtggttatgttctttgccnttatatacaacagcttcaacagagaagatgagctt

SEQ ID NO: 35511 - DNA, 71 bp, chicken (Gallus Gallus)
  misc_feature (36): n=c or t
gatgtgagtcagtcgtgatttgcgtttagtcccctngcaggggctgactgctgcagttgcagcccattgct

SEQ ID NO: 35512 - DNA, 71 bp, chicken (Gallus Gallus)
  misc_feature (36): n=c or t
gcaatgaccacagaggtattgccaatccatctgctnttgctgatctgagagcttctttacctggaatctgc

SEQ ID NO: 35513 - DNA, 71 bp, chicken (Gallus Gallus)
  misc_feature (36): n=a or c
ttagtggttttgtgagggctgaagtggttaaatgcnagaggtgagatgtaattgatttattgctggggagg

SEQ ID NO: 35514 - DNA, 71 bp, chicken (Gallus Gallus)
  misc_feature (36): n=a or c
caataggaatgtgaatttcccacaccaagatccatnatttcctatgaagtgttcccctgtcttcacagagg

SEQ ID NO: 35515 - DNA, 71 bp, chicken (Gallus Gallus)
  misc_feature (36): n=c or t
ccttctgtacaggaatggttgaaagaacagaaacantggacttctgacctccatagagaaaatgatgagct

SEQ ID NO: 35516 - DNA, 71 bp, chicken (Gallus Gallus)
  misc_feature (36): n=a or g
catttctcagataggatgaaatgcgaagagaatcanaggatgttgctgctttgctgggaacaggacagggt

SEQ ID NO: 35517 - DNA, 71 bp, chicken (Gallus Gallus)
  misc_feature (36): n=a or c
agcccaagactacctttattccctgctttgctttantgaattggcattaaaaaggtctgattctcctccca

SEQ ID NO: 35518 - DNA, 71 bp, chicken (Gallus Gallus)
  misc_feature (36): n=a or c
gaacatcaagtttccacaccacgggcttattcttgnagaattcttgagctttctggctgtggtccaataaa

SEQ ID NO: 35519 - DNA, 71 bp, chicken (Gallus Gallus)
  misc_feature (36): n=g or t
ctgactccatcctctgttactcgctgtggtgacaanagtttaccagaccacggcctttcagtgacgtctgc

SEQ ID NO: 35520 - DNA, 71 bp, chicken (Gallus Gallus)
  misc_feature (36): n=a or g
cagtactggaatgaagaaagcaacagcttgggacgngaggagcggagcacagaactgtgaaccaatgctat

SEQ ID NO: 35521 - DNA, 71 bp, chicken (Gallus Gallus)
  misc_feature (36): n=c or t
ttatctttaaaggcatgttgatgtgactctgtaagngtattggtgagtaatttcacctgcattcataatga

SEQ ID NO: 35522 - DNA, 71 bp, chicken (Gallus Gallus)
  misc_feature (36): n=c or t
gaaactctggccaggggctaagttacatcaggctgngcttccagaggttaagctgattgcagatctctcag

SEQ ID NO: 35523 - DNA, 71 bp, chicken (Gallus Gallus)
  misc_feature (36): n=c or t
attaaggaaactgcatgtagctcttgtctatgctangctagtttgtcaggcaatttggttaataacatttt

SEQ ID NO: 35524 - DNA, 71 bp, chicken (Gallus Gallus)
  misc_feature (36): n=c or t
tcagtagtatacagcagtttggagctttgacctgangtgagcttgaagcagaaaaattggttgaaaatcca

SEQ ID NO: 35525 - DNA, 71 bp, chicken (Gallus Gallus)
  misc_feature (36): n=c or t
ggagagaccttcctgccctactacacagggttggcnattgacggcatcgtggtgcagaagagtatggaccg

SEQ ID NO: 35526 - DNA, 71 bp, chicken (Gallus Gallus)
  misc_feature (36): n=c or t
gcagcaatttgagctcctctgctttgcttcacatcnccaacagaagccatcttcttccatgctgccctgca

SEQ ID NO: 35527 - DNA, 71 bp, chicken (Gallus Gallus)
  misc_feature (36): n=a or g
ctgtaaaaccattcctaatctctcatacatctgtcntgtaaaatgcatgatggaagattactgggttaaaa

SEQ ID NO: 35528 - DNA, 71 bp, chicken (Gallus Gallus)
  misc_feature (36): n=a or g
atctaagtaattttttaaggagatgtgaagctaagntaacaatgaaagagtccttaataaatgtgtgtttt

SEQ ID NO: 35529 - DNA, 71 bp, chicken (Gallus Gallus)
  misc_feature (36): n=c or t
ataagttgttttatcaccttgtaaaaagagcagcanagcaatacatttagataatacatattacaaaagtc

SEQ ID NO: 35530 - DNA, 71 bp, chicken (Gallus Gallus)
  misc_feature (36): n=a or g
attctgcgtatttactgctacacaccaactggcagncatgaaagtacatttgccctttgtcgtttcttaaa

SEQ ID NO: 35531 - DNA, 71 bp, chicken (Gallus Gallus)
  misc_feature (36): n=c or t
tactccatgcccatattaattttatcctttattatnagacaggttagtctgtgtgcccaaatgttacttga

SEQ ID NO: 35532 - DNA, 71 bp, chicken (Gallus Gallus)
  misc_feature (36): n=g or t
cagttcaagactggtattacggacttcaatctattngaacagcacatgcaagcggtgggggcagcaaacag

SEQ ID NO: 35533 - DNA, 71 bp, chicken (Gallus Gallus)
  misc_feature (36): n=c or t
ggaaaagcagaaccagcctgttgcaatgctgaggcngtgtactttgcaccatgctataataatggataaga

SEQ ID NO: 35534 - DNA, 71 bp, chicken (Gallus Gallus)
  misc_feature (36): n=c or t
aagaagatagttcagatactcttttagttttcattngtggctcaatggctgatgaacgttgtaaaaaaata

SEQ ID NO: 35535 - DNA, 71 bp, chicken (Gallus Gallus)
  misc_feature (36): n=c or t
cccagacatccaaagcctgcagagagaaaagagcanccttagtcctgcacgtacaatgaaggtcattacaa

SEQ ID NO: 35536 - DNA, 71 bp, chicken (Gallus Gallus)
  misc_feature (36): n=c or t
cacgcggacacagattaagcgtggatgggctgactnctggccgctccactctcacaaaacacattttccag

SEQ ID NO: 35537 - DNA, 71 bp, chicken (Gallus Gallus)
  misc_feature (36): n=c or t
tgtttcaatttctgcaagacttttaaaaagtgtcantgaactatggggaaaactacagcatgtaactgaaa

SEQ ID NO: 35538 - DNA, 71 bp, chicken (Gallus Gallus)
  misc_feature (36): n=a or c
cttctaagtgctcagacacagagatgtgcccaaaantacacttctgttaccaaccaaaagaatagctgctc

SEQ ID NO: 35539 - DNA, 71 bp, chicken (Gallus Gallus)
  misc_feature (36): n=g or t
agatttaaaaagctaagataccaaatattgttattnccttgttacttacagacacccaaatgtgaagtgat

SEQ ID NO: 35540 - DNA, 71 bp, chicken (Gallus Gallus)
  misc_feature (36): n=c or t
tatttttgctccattgttttataaacatcctcctgntttgctggccatgtacacaggaatctccaccctca

SEQ ID NO: 35541 - DNA, 71 bp, chicken (Gallus Gallus)
  misc_feature (36): n=c or t
ggaggattgaaatgtcctgcaagagtggggaattantgagtctgcaatagacccagcagcccagctttcac

SEQ ID NO: 35542 - DNA, 71 bp, chicken (Gallus Gallus)
  misc_feature (36): n=a or c
ttgtttttggcatgactgccgctaatatttagctanaagcaggttctactggtatacaaacttggggatgc

SEQ ID NO: 35543 - DNA, 71 bp, chicken (Gallus Gallus)
  misc_feature (36): n=a or g
tgtcttacagcactgttgtcttcagcagaagagcantgttcagctccttgtagcatccaggctgaaggctt

SEQ ID NO: 35544 - DNA, 71 bp, chicken (Gallus Gallus)
  misc_feature (36): n=g or t
atggctcttagaaatttgaaaagtgatgattgttcntatatttctgcaactgaatgctttagcattgtcta

SEQ ID NO: 35545 - DNA, 71 bp, chicken (Gallus Gallus)
  misc_feature (36): n=c or t
ttttttttttgataatttgacttcagtgaaatgttnattttgaagtacaggtttttaattgtttccacaga

SEQ ID NO: 35546 - DNA, 71 bp, chicken (Gallus Gallus)
  misc_feature (36): n=c or t
ccgaacactgaaggtgagcaagcagtgccttgtgangatgggatggggaaaagggtcccatctgggaatgc

SEQ ID NO: 35547 - DNA, 71 bp, chicken (Gallus Gallus)
  misc_feature (36): n=c or t
agatagaagaccataaagaactataaacaaaattanattgatactatagaccatctgaattatccttctga

SEQ ID NO: 35548 - DNA, 71 bp, chicken (Gallus Gallus)
  misc_feature (36): n=c or t
cattagagattagcaacagcacagtcaggtggtagngtgtctcaaagccaggacacttggaggagaagtcc

SEQ ID NO: 35549 - DNA, 71 bp, chicken (Gallus Gallus)
  misc_feature (36): n=c or t
acagctgtcacagagattatactacaacagtgtaanggtcacacttacacagtaacaagataaaattaaaa

SEQ ID NO: 35550 - DNA, 71 bp, chicken (Gallus Gallus)
  misc_feature (36): n=c or t
agttttatcattttttaagtctctgactggactgangttctgaacaaaaaagtcaccaattctggacacat

SEQ ID NO: 35551 - DNA, 71 bp, chicken (Gallus Gallus)
  misc_feature (36): n=a or g
tttggaacctgcttcagaagtctaacacaatgatgngttttggggggtttttaattttggtggtaggattt

SEQ ID NO: 35552 - DNA, 71 bp, chicken (Gallus Gallus)
  misc_feature (36): n=a or g
agtaaaatgtaacattatatgcacagagtagcatcnatagttatttccttgctatttacagtttatctgaa

SEQ ID NO: 35553 - DNA, 71 bp, chicken (Gallus Gallus)
  misc_feature (36): n=c or t
attaaacaactctttcagttttgccatattttacantaagatgcttgaaatcttaagagacatttccaaaa

SEQ ID NO: 35554 - DNA, 71 bp, chicken (Gallus Gallus)
  misc_feature (36): n=a or g
ttgggtgggcacagggtgggcactgatctgactgtnttggcttcacaccatgagtgtgtcctccacagaag

SEQ ID NO: 35555 - DNA, 71 bp, chicken (Gallus Gallus)
  misc_feature (36): n=a or c
gaggcacaccgcccactgagcgttccacattggccnccgtcagccagaacatcgtcccagcctatgtcaag

SEQ ID NO: 35556 - DNA, 71 bp, chicken (Gallus Gallus)
  misc_feature (36): n=a or c
aatgcaggtgtgttggcttctctgcaagcttacttnatggagaccagagagcctatgctgggggtgcatgt

SEQ ID NO: 35557 - DNA, 71 bp, chicken (Gallus Gallus)
  misc_feature (36): n=g or t
ggggggaaagaaagagtgctaattgtcctcaaggtncaggccatttccatttgtggactaaattctccctt

SEQ ID NO: 35558 - DNA, 71 bp, chicken (Gallus Gallus)
  misc_feature (36): n=a or g
ttctgctgcaatcaatttacagttgccgctggcgangaacccatctattaaaagccaggctgggatctgca

SEQ ID NO: 35559 - DNA, 71 bp, chicken (Gallus Gallus)
  misc_feature (36): n=a or c
ctgcattttacagattttaggtgtctgtgtgcaaanaagccatatgtatttatgagacacccaggaatgca

SEQ ID NO: 35560 - DNA, 71 bp, chicken (Gallus Gallus)
  misc_feature (36): n=c or t
actgcttgccatcatttcttctgaatgatttagctngtgctgaagttttattaacttcatagacacaaaaa

SEQ ID NO: 35561 - DNA, 71 bp, chicken (Gallus Gallus)
  misc_feature (36): n=c or t
atagcgtgactatgaaatgcactgaagattagaggnaccagaaagtccccagggcaactaaaatctgtact

SEQ ID NO: 35562 - DNA, 71 bp, chicken (Gallus Gallus)
  misc_feature (36): n=c or t
caaggttctcattcaagataactttctttaattcanaccattttgtgggcgtgaattgaataaagcaggta

SEQ ID NO: 35563 - DNA, 71 bp, chicken (Gallus Gallus)
  misc_feature (36): n=a or g
aggggcatagcaaggaggagagtgaataagaagcanaaaagcaaatgcctcaaaaatcaccttattatgtt

SEQ ID NO: 35564 - DNA, 71 bp, chicken (Gallus Gallus)
  misc_feature (36): n=c or t
atcatcatccccaattaaatgtgaaaatggctatanttagaacagcagcaaataaagcccactgatgccgg

SEQ ID NO: 35565 - DNA, 71 bp, chicken (Gallus Gallus)
  misc_feature (36): n=g or t
gtgatggcaacagtaagccactctctgatggcttgngaattgccctggtagaagaggtctgtggcagcaca

SEQ ID NO: 35566 - DNA, 71 bp, chicken (Gallus Gallus)
  misc_feature (36): n=a or g
caaataaaaccaaaattaattggtttaattaaaccngatatttctgtacaagcattcaaaagcaagtctga

SEQ ID NO: 35567 - DNA, 71 bp, chicken (Gallus Gallus)
  misc_feature (36): n=a or g
atgtaagacaggaatgcaagtccagtagtgcccccntagctcacgcagctcacgcaggttgaactcctcag

SEQ ID NO: 35568 - DNA, 71 bp, chicken (Gallus Gallus)
  misc_feature (36): n=a or g
gaaacaccttgggagtaaaatgtcagtttacttccnaggtactcccaaacttgtcagttttctttcctttt

SEQ ID NO: 35569 - DNA, 71 bp, chicken (Gallus Gallus)
  misc_feature (36): n=g or t
ctgcagaatacagtgaatgatttttggaggatggtnttccaggagaattctcgagttattgttatgacaac

SEQ ID NO: 35570 - DNA, 71 bp, chicken (Gallus Gallus)
  misc_feature (36): n=c or t
ttctgtgctggtatttatgggtcttagttcagctgntctgctgctgcattgtgatttttattgctgcgaag

SEQ ID NO: 35571 - DNA, 71 bp, chicken (Gallus Gallus)
  misc_feature (36): n=c or t
gggtcactgggtagactcagactgtgatgctttcangagggctgtaagaaaaattcaaagcttctttccca

SEQ ID NO: 35572 - DNA, 71 bp, chicken (Gallus Gallus)
  misc_feature (36): n=c or t
ctcctgtgcccacctgctatatcagtctcagtttcnggatcccacatacagcttcattttggtcactataa

SEQ ID NO: 35573 - DNA, 71 bp, chicken (Gallus Gallus)
  misc_feature (36): n=c or t
tagcagagcagaacttcacactttgtcttgcggcangcaaatcccctcaccagttcatagcatcactaagg

SEQ ID NO: 35574 - DNA, 71 bp, chicken (Gallus Gallus)
  misc_feature (36): n=c or t
gctttttgtgctacacagcaatcaaaaataggtaangagcactgattctgaaagcacttgtaaagcgctgt

SEQ ID NO: 35575 - DNA, 71 bp, chicken (Gallus Gallus)
  misc_feature (36): n=c or t
agcagtgggctctgacacacgcggacggcgttgtcngctcgtcaggagagtatggacaacttgtaattgaa

SEQ ID NO: 35576 - DNA, 71 bp, chicken (Gallus Gallus)
  misc_feature (36): n=c or t
ttctgtagctttagtgcctgcctgctctcccttagngtatcaagaacctgatgatccattgcaaacaagct

SEQ ID NO: 35577 - DNA, 71 bp, chicken (Gallus Gallus)
  misc_feature (36): n=c or t
gatgggtgtatctgtggggatttcttatctgtgtgntcattgatgtgaaactgctgactttggggaaggtg

SEQ ID NO: 35578 - DNA, 71 bp, chicken (Gallus Gallus)
  misc_feature (36): n=c or t
tttcctcacttttcttctgtaagtgacatatttgangaagactccattattatctttgtatctgtttctat

SEQ ID NO: 35579 - DNA, 71 bp, chicken (Gallus Gallus)
  misc_feature (36): n=c or t
  misc_feature (67, 68): n=a
  misc_feature (69): n=g
  misc_feature (70): n=t
  misc_feature (71): n=c
tctgaagcactgaaagcaatcctgaagactgttcantgacagtaaggcacttggcctcgagaaggcnnnnn

SEQ ID NO: 35580 - DNA, 71 bp, chicken (Gallus Gallus)
  misc_feature (36): n=a or c
taaattcgatttgcaaaatagaaattgacaatttanttcttgcaacagtgtttctgaggtcaaaggcacac

SEQ ID NO: 35581 - DNA, 71 bp, chicken (Gallus Gallus)
  misc_feature (36): n=c or t
tagattttagcttctcctttttgcacgtcaagctgnagggtgtcattttggctgtctgatgtctcagtctc

SEQ ID NO: 35582 - DNA, 71 bp, chicken (Gallus Gallus)
  misc_feature (36): n=a or g
tgcttaccagaatacttaggcaggcttaattctagnactcggcaggctgacggtgttgcgttgccactcgt

SEQ ID NO: 35583 - DNA, 71 bp, chicken (Gallus Gallus)
  misc_feature (36): n=c or t
ctgcatgtgctattctacatctgtataattgcatangtttctgccctgatgggtgcatgttcccctggcca

SEQ ID NO: 35584 - DNA, 71 bp, chicken (Gallus Gallus)
  misc_feature (36): n=a or g
tgagttctgcagctcgtacagagcagtgtgtttagntagtgctgtggcaatagctttgctgccgttagacg

SEQ ID NO: 35585 - DNA, 71 bp, chicken (Gallus Gallus)
  misc_feature (36): n=a or c
gggctctggaagccattcccaagctcatactcccanactggtgttccttgcccagcagtggtgctggtgga

SEQ ID NO: 35586 - DNA, 71 bp, chicken (Gallus Gallus)
  misc_feature (36): n=a or g
gggtagcaggtcacttctcataagcataaagaaaanagatgggtgttattcatgctacattaaaaagtaat

SEQ ID NO: 35587 - DNA, 71 bp, chicken (Gallus Gallus)
  misc_feature (36): n=c or t
cggggagcgagcaacaaattcaataacgcagccagnggtttctaaatgatatctcctcctgctttaagtaa

SEQ ID NO: 35588 - DNA, 71 bp, chicken (Gallus Gallus)
  misc_feature (36): n=c or t
cccagctcctcacatccaagtgtccccatacgacgntcatgtacctcattatggcttacttcgaaacagac

SEQ ID NO: 35589 - DNA, 71 bp, chicken (Gallus Gallus)
  misc_feature (36): n=c or t
ctttctgtgtgtgagccatccatgcgggcacagcantagaagcgcaatcctgaatgacgctctcattcaga

SEQ ID NO: 35590 - DNA, 71 bp, chicken (Gallus Gallus)
  misc_feature (36): n=c or t
ctgctgttgcaaaaccgtattgagcgcagggaacgngtttgtccaaaaactgatccggcttttgctgaaga

SEQ ID NO: 35591 - DNA, 71 bp, chicken (Gallus Gallus)
  misc_feature (36): n=c or t
cctaacgacaaatctcctttttttactttcacaaangtcagctacaacaacaaccactttacagcaagagc

SEQ ID NO: 35592 - DNA, 71 bp, chicken (Gallus Gallus)
  misc_feature (36): n=a or c
aagctgggggtgactggtagcagtgagctagggggnttattggaagaggaacagaatgggtcagaactaag

SEQ ID NO: 35593 - DNA, 71 bp, chicken (Gallus Gallus)
  misc_feature (36): n=a or g
ttaatgttattactcttatctaatgtcgtaccaatngatttacattgcatgggaattagtatggcagactg

SEQ ID NO: 35594 - DNA, 71 bp, chicken (Gallus Gallus)
  misc_feature (36): n=a or c
aggtgctaattttaggctgcagctgtgtctgcactncacagccccacggctcggagcaaagcgagggcaga

SEQ ID NO: 35595 - DNA, 71 bp, chicken (Gallus Gallus)
  misc_feature (36): n=a or c
ttggtctgtgctcagtgccgcttcacgtgtaaagtntctggacagaacaggcagttttctttccaaaggct

SEQ ID NO: 35596 - DNA, 71 bp, chicken (Gallus Gallus)
  misc_feature (36): n=c or t
acatttattaccattattaaaccatgccagagcctnggcctgcagggaggccttgtcccttctttccacgg

SEQ ID NO: 35597 - DNA, 71 bp, chicken (Gallus Gallus)
  misc_feature (36): n=c or t
tgggcaatatttagtctgtaaggggagtactcagcntctgtctgcatgacaggtttcagcatctgaagtct

SEQ ID NO: 35598 - DNA, 71 bp, chicken (Gallus Gallus)
  misc_feature (36): n=a or g
agacctgcaaagaaaagaagtttatgggggtggccnggtcccttgtccactgaactcaatccaacaatgct

SEQ ID NO: 35599 - DNA, 71 bp, chicken (Gallus Gallus)
  misc_feature (36): n=a or g
cacccacactgcttgcacagtcaaaactactttctngccttaatttatcatgtttagacttgagtaatagc

SEQ ID NO: 35600 - DNA, 71 bp, chicken (Gallus Gallus)
  misc_feature (36): n=c or t
atatgtgacatcttttgtaatcatggagcatgtgtngagtgctagagaccacaattctcacttcttcctag

SEQ ID NO: 35601 - DNA, 71 bp, chicken (Gallus Gallus)
  misc_feature (36): n=c or t
ccttcctacagagtacttgggcagagcatccagaanccacattccagtacatacttgggcacagcagggct

SEQ ID NO: 35602 - DNA, 71 bp, chicken (Gallus Gallus)
  misc_feature (36): n=a or g
ccttgcgctctctgcagcctctacagcattggcaanattggagggcagcagaacaagacctacaccaagct

SEQ ID NO: 35603 - DNA, 71 bp, chicken (Gallus Gallus)
  misc_feature (36): n=a or g
taccaaggcaacgtatataacgtgtctctttgttangctatccctctaccttaagcagaaactgaaaattt

SEQ ID NO: 35604 - DNA, 71 bp, chicken (Gallus Gallus)
  misc_feature (36): n=g or t
tgtctgttggccgtgtgatgtggtagagaaaactgnatgtgtatcactgaagggaagaatgagatctgtta

SEQ ID NO: 35605 - DNA, 71 bp, chicken (Gallus Gallus)
  misc_feature (36): n=a or g
tctctgactctcacatccctatcttgtaaatcaccnatccatcacagccctcttcttcgtattgttccata

SEQ ID NO: 35606 - DNA, 71 bp, chicken (Gallus Gallus)
  misc_feature (36): n=a or g
actagtccgttccattttgtgcttgatggagagtgnaacatcacagaacagaggctgctgtgatctgtgct

SEQ ID NO: 35607 - DNA, 71 bp, chicken (Gallus Gallus)
  misc_feature (36): n=a or g
cttgtgtctgcagaggttagtggtcagttgcatgcntttgtttcttgcagggaatgctgtagaacagattt

SEQ ID NO: 35608 - DNA, 71 bp, chicken (Gallus Gallus)
  misc_feature (36): n=c or t
ctacagactcataacagagagatgaataaagccatncgtagcattctgaagcccattcagctctaccttat

SEQ ID NO: 35609 - DNA, 71 bp, chicken (Gallus Gallus)
  misc_feature (36): n=c or t
tccactgtgaagcaatctctttacttcaattacttngctgctcaacgtgcttttcctattatagggaaggt

SEQ ID NO: 35610 - DNA, 71 bp, chicken (Gallus Gallus)
  misc_feature (36): n=c or t
aaacatcaagtgcacacaaaagcaagcaagaggccngatgtagtgttacatgctcatgcaaatggcagctt

SEQ ID NO: 35611 - DNA, 71 bp, chicken (Gallus Gallus)
  misc_feature (36): n=a or g
ttaaatgaaagctggatttattccgttattctgtgnatccagaagcttgtggaataagtaacccgggcttt

SEQ ID NO: 35612 - DNA, 71 bp, chicken (Gallus Gallus)
  misc_feature (36): n=a or g
acgcttggagaatggtgtgtgcttagagttcttttngtttattttaccaaagataagagtgataaatcgag

SEQ ID NO: 35613 - DNA, 71 bp, chicken (Gallus Gallus)
  misc_feature (36): n=a or g
agcttttaaatgaacttaatgagagcaactgaaccnaacctcttgtgctaagtgcaacagtgtcttttaat

SEQ ID NO: 35614 - DNA, 71 bp, chicken (Gallus Gallus)
  misc_feature (36): n=g or t
aatgacagctatctctttggttttctgttgaagggnctgttatcacaatggaggaccttaaggcatacaaa

SEQ ID NO: 35615 - DNA, 71 bp, chicken (Gallus Gallus)
  misc_feature (36): n=c or t
cccttctgttggaaaggacattctgtcaccctttgnggggaaggaagcagttcatactgtgaacacacaac

SEQ ID NO: 35616 - DNA, 71 bp, chicken (Gallus Gallus)
  misc_feature (36): n=c or t
cccttggactctaattactcagcaatgaaagcttanctccctgctgctatacacatcttgatagacacctc

SEQ ID NO: 35617 - DNA, 71 bp, chicken (Gallus Gallus)
  misc_feature (36): n=a or g
ccaacctcacactgcagcctcatctaatcatggcanaacccatctaagcaatatgggtgcagagcgcttcc

SEQ ID NO: 35618 - DNA, 71 bp, chicken (Gallus Gallus)
  misc_feature (36): n=a or g
taaggccactggtgccagatggcagaaggagaaagnatagaccaaaacttttcagtgtctcaatcagaaat

SEQ ID NO: 35619 - DNA, 71 bp, chicken (Gallus Gallus)
  misc_feature (36): n=a or c
acattgtttcctcttacgaaagcaagcaaaagagcnttcagcatttgcctttagagacagatcatcctgtc

SEQ ID NO: 35620 - DNA, 71 bp, chicken (Gallus Gallus)
  misc_feature (36): n=a or c
aacatggtggagttaaaacaacgccaagagtattantgctgaagaaaccccaaattatccaaacaataaca

SEQ ID NO: 35621 - DNA, 71 bp, chicken (Gallus Gallus)
  misc_feature (36): n=a or c
actaccagaccactgcttagaatgccccttttagtntcttttgggaggaattagttttgtgagggatcact

SEQ ID NO: 35622 - DNA, 71 bp, chicken (Gallus Gallus)
  misc_feature (36): n=a or g
tcctagttctggctcagcacatcctcagcgtgcacntatctgtcctgagtgcacaggatgactcactgctc

SEQ ID NO: 35623 - DNA, 71 bp, chicken (Gallus Gallus)
  misc_feature (36): n=a or c
gagactgttggtacctattggtcatagctcttccangagggctggtgctggtccttgtttagctgcagtat

SEQ ID NO: 35624 - DNA, 71 bp, chicken (Gallus Gallus)
  misc_feature (36): n=a or g
cgaagagaaggatacagtgctacagcagcctagcancaatacactactgccatcactggaaacaaaaagca

SEQ ID NO: 35625 - DNA, 71 bp, chicken (Gallus Gallus)
  misc_feature (36): n=a or g
ttcacgttcctaaatctatcactcacaaccacaacnttctacaagaggagggctcagtataaacagaactc

SEQ ID NO: 35626 - DNA, 71 bp, chicken (Gallus Gallus)
  misc_feature (36): n=c or t
gcatccataatatttcacccttacctcaattcctgnagggacagtttttctcctaatgaaggatagttcat

SEQ ID NO: 35627 - DNA, 71 bp, chicken (Gallus Gallus)
  misc_feature (36): n=g or t
attgcagcataaattagtagctcttctaactgccantagagcagcttcaggcaggagttttccattgctgt

SEQ ID NO: 35628 - DNA, 71 bp, chicken (Gallus Gallus)
  misc_feature (36): n=a or g
accacacagtcaagcaagcttcatacacaagcctcntggaagttctgctgtggtgacactgagctacaaca

SEQ ID NO: 35629 - DNA, 71 bp, chicken (Gallus Gallus)
  misc_feature (36): n=a or g
aattggtgttgggttttaatgtttgttaatgtaganctaaggatgttagtgctggcttgttcggaggctgc

SEQ ID NO: 35630 - DNA, 71 bp, chicken (Gallus Gallus)
  misc_feature (36): n=a or c
gttggttggattgtttctaagtctagggacacgttncaggatgggatgagaaggctctcttttaaaagctt

SEQ ID NO: 35631 - DNA, 71 bp, chicken (Gallus Gallus)
  misc_feature (36): n=a or g
caatagtgaaaaataaaatacagagtaacgagagtntttatgtcatttcctgatgggcagttatatagcat

SEQ ID NO: 35632 - DNA, 71 bp, chicken (Gallus Gallus)
  misc_feature (36): n=c or t
atacatttgaacttacatacaagtatactttttcantgtttatatgcagatacccacgaagacagtcacaa

SEQ ID NO: 35633 - DNA, 71 bp, chicken (Gallus Gallus)
  misc_feature (36): n=a or g
gagggacaaagggggtggggaagctctggtctgganatctccacatcagagcacacccatgcaaagcaagc

SEQ ID NO: 35634 - DNA, 71 bp, chicken (Gallus Gallus)
  misc_feature (36): n=c or t
ggagctagaaacctggttgtccctgagccccccatntgggcttcagctgggaaagagccccagccattcag

SEQ ID NO: 35635 - DNA, 71 bp, chicken (Gallus Gallus)
  misc_feature (36): n=c or t
taacagctgctttagtagctacactaggaagacttngtgttttgttcacactgatgatactcgcagttgtc

SEQ ID NO: 35636 - DNA, 71 bp, chicken (Gallus Gallus)
  misc_feature (36): n=c or t
tagttgtcctaagactccaaggagtcaatcacacangttaaacatggaaatcaacaatactgaaaccagtg

SEQ ID NO: 35637 - DNA, 71 bp, chicken (Gallus Gallus)
  misc_feature (36): n=c or t
aaaccactgctaactggagatcttctaaactccctntaagataactgctttgagctagcagatgccctaat

SEQ ID NO: 35638 - DNA, 71 bp, chicken (Gallus Gallus)
  misc_feature (36): n=c or t
ttcttattagacctaacctgtaatatttacccactnatgctccaagaaaagacctacaaaatactgactat

SEQ ID NO: 35639 - DNA, 71 bp, chicken (Gallus Gallus)
  misc_feature (36): n=c or t
tgtggaaggacatcctcgtgcacaaaatgaatcctnccccaggaacgctccttgtggatgttgctggtgga

SEQ ID NO: 35640 - DNA, 71 bp, chicken (Gallus Gallus)
  misc_feature (36): n=a or g
cccagcaaagctctttctgctgcactatctaatccngagtactgtgtatgagatttatgttctgacagttc

SEQ ID NO: 35641 - DNA, 71 bp, chicken (Gallus Gallus)
  misc_feature (36): n=c or t
ggaaaaaggtaccagtgcttttgctttaattagacnccagccgctgaggagcggtccggggttgagtaacc

SEQ ID NO: 35642 - DNA, 71 bp, chicken (Gallus Gallus)
  misc_feature (36): n=a or g
cattggagtttgtctgctcgctgttcccttgtcagnctgcagtttctgtggtctgcattggaggcacggga

SEQ ID NO: 35643 - DNA, 71 bp, chicken (Gallus Gallus)
  misc_feature (36): n=c or t
tgaaaggccatttaacaggataaatatacccaagcnccccattcctttgcagttactcacaatgtaaatct

SEQ ID NO: 35644 - DNA, 71 bp, chicken (Gallus Gallus)
  misc_feature (36): n=c or t
gctgcatgtctctgcatgggcagaatgtttgtactngatcctggctctcccaggcttctgcagagagcata

SEQ ID NO: 35645 - DNA, 71 bp, chicken (Gallus Gallus)
  misc_feature (36): n=c or t
accaggattctggagatctggcttctcctctgggcncttctgctgctgtgttcagtgaatggaatccagat

SEQ ID NO: 35646 - DNA, 71 bp, chicken (Gallus Gallus)
  misc_feature (36): n=c or t
tacataagtttaatcaaacttgttgacgttttgctntgtgaattgaaggctacttgtttttcttgttgaag

SEQ ID NO: 35647 - DNA, 71 bp, chicken (Gallus Gallus)
  misc_feature (36): n=c or t
ctcatgtctggaatcataaaaccagatgaaggcttngggtatattcgaagatggagatgagtacaccttgt

SEQ ID NO: 35648 - DNA, 71 bp, chicken (Gallus Gallus)
  misc_feature (36): n=a or g
cactgctcaaaagaaaagaggggggggcaaaaagcntcttttctccctgtatggtgctaagcatcactaag

SEQ ID NO: 35649 - DNA, 71 bp, chicken (Gallus Gallus)
  misc_feature (36): n=a or g
tttcttattgtccagcactacgtctgaataaaggantagttatgaaaacaggatttcaagaaaaacttgtg

SEQ ID NO: 35650 - DNA, 71 bp, chicken (Gallus Gallus)
  misc_feature (36): n=c or t
tttttgtatggttggatatggtcattcctttttccngtagtgtagtaaatttatatcaaagtctatttgga

SEQ ID NO: 35651 - DNA, 71 bp, chicken (Gallus Gallus)
  misc_feature (36): n=g or t
ctggtggtcttctctcccatcgtggtttcagtagtntacttgatggagagaagataatatgcgagaggctc

SEQ ID NO: 35652 - DNA, 71 bp, chicken (Gallus Gallus)
  misc_feature (36): n=a or g
catggtaggctgccttccagaggttgtaacctgttntctcattgtagtagaattttggctttgtaagtgtg

SEQ ID NO: 35653 - DNA, 71 bp, chicken (Gallus Gallus)
  misc_feature (36): n=a or g
cccaaagttctctctgtgtggtggtgtccccacagntctgggtgcagaggggggagaactgggggcaaact

SEQ ID NO: 35654 - DNA, 71 bp, chicken (Gallus Gallus)
  misc_feature (36): n=a or g
cccaaatgaaaagcaattcctccctctgtggcaatnatcgcccaacagaaaacagcaaggagaagtcctag

SEQ ID NO: 35655 - DNA, 71 bp, chicken (Gallus Gallus)
  misc_feature (36): n=a or g
ggggctccccggggaggagcgcagctggaaaagggnaactcatcggggggtgcacctgtctgcaagctccc

SEQ ID NO: 35656 - DNA, 71 bp, chicken (Gallus Gallus)
  misc_feature (36): n=c or t
gtggatgggggagatgtgaaagctcggaagctgttnctacagcatcccatagcccaaatcccataatcggg

SEQ ID NO: 35657 - DNA, 71 bp, chicken (Gallus Gallus)
  misc_feature (36): n=a or g
ataattttccggaatcccagaaaccaccaacaatcntcacgataggcaaaaagacaaacagcacaaacaac

SEQ ID NO: 35658 - DNA, 71 bp, chicken (Gallus Gallus)
  misc_feature (36): n=a or g
ccaaaataggctttggtttgttgctggattgacagntgcaaggaaggaaatgcacttaccgagcagctcag

SEQ ID NO: 35659 - DNA, 71 bp, chicken (Gallus Gallus)
  misc_feature (36): n=c or t
tttggtggcttcagcacattgaagcatcaaaaatantgaaaggtttaactcttaatgggagaagttaaagg

SEQ ID NO: 35660 - DNA, 71 bp, chicken (Gallus Gallus)
  misc_feature (36): n=a or c
tccccggttcgaaaccgggcagaaacacggcctttncttttacgcttcctgcatttttttcactgttaatt

SEQ ID NO: 35661 - DNA, 71 bp, chicken (Gallus Gallus)
  misc_feature (36): n=c or t
agaaaaggatggaaggaagaggaacctctccagctncccccaagcctaaatcctacctccattccctctca

SEQ ID NO: 35662 - DNA, 71 bp, chicken (Gallus Gallus)
  misc_feature (36): n=a or g
caccgctcaccctgacctcatcctctctgaagaccnaaagagtgtgaaacgtggggaaggacaacaggacc

SEQ ID NO: 35663 - DNA, 71 bp, chicken (Gallus Gallus)
  misc_feature (36): n=c or t
tgcacaggaagcattgcgtgagcccggtgcagcctngactcgcggcagatcacgcagatgaaagcttcgtc

SEQ ID NO: 35664 - DNA, 71 bp, chicken (Gallus Gallus)
  misc_feature (36): n=a or g
gaaaaagtagtgaagaaacaaggggaggttttggtnctgagaagggggcctggtcaagctctattcctgat

SEQ ID NO: 35665 - DNA, 71 bp, chicken (Gallus Gallus)
  misc_feature (36): n=c or t
ttgggatcaagccatgcttccaacgctcatctctcntaccctcagaaagtctgacgttggaccccgacacg

SEQ ID NO: 35666 - DNA, 71 bp, chicken (Gallus Gallus)
  misc_feature (36): n=a or g
agggcaaaaaaaataccccaaaccgttttaatgtgnggagaaatcataaggataaaatccagtgggtaaaa

SEQ ID NO: 35667 - DNA, 71 bp, chicken (Gallus Gallus)
  misc_feature (36): n=a or c
gctctttgctaacagctctgcattgttgctgccccnttccatggcagtgtgagtgttcctctccttatttc

SEQ ID NO: 35668 - DNA, 71 bp, chicken (Gallus Gallus)
  misc_feature (36): n=c or t
cttccagctgctcttttcctcctatatctcagcagntcagacagtgggaaagggaggtttggggcagagga

SEQ ID NO: 35669 - DNA, 71 bp, chicken (Gallus Gallus)
  misc_feature (36): n=a or c
ttgcatagataaagggaaactgataatgatcagcantgggattttgcatttcaaaggtgtgagttggctgt

SEQ ID NO: 35670 - DNA, 71 bp, chicken (Gallus Gallus)
  misc_feature (36): n=c or t
gcctcttcccagcatcgaacccaaatccacaccatnaaatctggagacgatttcttgggtgatctgggaat

SEQ ID NO: 35671 - DNA, 71 bp, chicken (Gallus Gallus)
  misc_feature (36): n=c or t
cacaaagctgagtgccccacatatcaacactaccangctaccccttgcccccagacccttttgtcttccag

SEQ ID NO: 35672 - DNA, 71 bp, chicken (Gallus Gallus)
  misc_feature (36): n=g or t
ccatggggatcacagtaaccctctggaactataaangggggagaacccagggagcaatggggggctgtggt

SEQ ID NO: 35673 - DNA, 71 bp, chicken (Gallus Gallus)
  misc_feature (36): n=a or g
gggtcaataaagctgcgagtagccagtgctgacccntgtatcccacacactgggctcaggagctatggggg

SEQ ID NO: 35674 - DNA, 71 bp, chicken (Gallus Gallus)
  misc_feature (36): n=a or g
ctgagtgcttcaggttcacagatcttcccgacgctnagctgaacgcatccatacctgctgagcacaaatcg

SEQ ID NO: 35675 - DNA, 71 bp, chicken (Gallus Gallus)
  misc_feature (36): n=a or g
ttttacagagcacctacacacgtttaatgccaaaantcactgatgtgccacaataccccgtttctgctgtg

SEQ ID NO: 35676 - DNA, 71 bp, chicken (Gallus Gallus)
  misc_feature (36): n=c or t
cagtggtctgttgcagttgtgtagcagctgaatgancttgtttgtctttgcacagcgcttctttgtctcct

SEQ ID NO: 35677 - DNA, 71 bp, chicken (Gallus Gallus)
  misc_feature (36): n=c or t
cgcagcaccagcgccgtcagcctgcaccaggacacngtgtcaccacgtccccaaatccacatggccccacc

SEQ ID NO: 35678 - DNA, 71 bp, chicken (Gallus Gallus)
  misc_feature (36): n=a or g
ctttgtttcttggacacatcagtatgtaggaatggntgcaagaagtaaaacagatcctcacaaggagtcaa

SEQ ID NO: 35679 - DNA, 71 bp, chicken (Gallus Gallus)
  misc_feature (36): n=c or t
ccccatagggctctgcacctccacctggagcactgnacatcccattgcaaacaccatagagagatgcaatc

SEQ ID NO: 35680 - DNA, 71 bp, chicken (Gallus Gallus)
  misc_feature (36): n=a or c
ccctcccaccccctgcagtcctgtgcccaccccacnctccttgcttgtcactccatcacacactgctgctc

SEQ ID NO: 35681 - DNA, 71 bp, chicken (Gallus Gallus)
  misc_feature (36): n=a or g
tgtccaccatccatgccatgtgctcattattccctntgtgtgaccattatcccttccacatgggttctgtt

SEQ ID NO: 35682 - DNA, 71 bp, chicken (Gallus Gallus)
  misc_feature (36): n=c or t
gggagctcttcgctcacgggaggaggctctgtgggntgtgctgggcctcccattcatcaacctttctgtat

SEQ ID NO: 35683 - DNA, 71 bp, chicken (Gallus Gallus)
  misc_feature (36): n=a or g
gcatggcccttctacaagccggtcgatgcctcggcnctggggctgcacgattaccacgagatcatcaaaca

SEQ ID NO: 35684 - DNA, 71 bp, chicken (Gallus Gallus)
  misc_feature (36): n=a or g
aggagtgagcagctttttgggaaaagcacctgaaangaggagagaaaggacacggatttctgcaggctgac

SEQ ID NO: 35685 - DNA, 71 bp, chicken (Gallus Gallus)
  misc_feature (36): n=a or g
gtcgctcgcagtaatacaactcgagaagtagctccngtttccagcccaaaagtttattcaagttaagaaaa

SEQ ID NO: 35686 - DNA, 71 bp, chicken (Gallus Gallus)
  misc_feature (36): n=a or g
agctgtcttcttatgacatcaaactgttttgttatnaagaaaaatgtattatcagacacaatatggtacat

SEQ ID NO: 35687 - DNA, 71 bp, chicken (Gallus Gallus)
  misc_feature (36): n=c or t
tcttaggcactgtcatggttcccgttagtaagtcangggttatcggtggaaagttttcctacagagtttcc

SEQ ID NO: 35688 - DNA, 71 bp, chicken (Gallus Gallus)
  misc_feature (36): n=a or c
gcagaggctgcctacgttgctcagatagatggaaanaaattttcagtagaaaaaggagtgctttttcataa

SEQ ID NO: 35689 - DNA, 71 bp, chicken (Gallus Gallus)
  misc_feature (36): n=g or t
gggcatgcagacacacacagagcctgcacagcccancgccccaccgcaaagaagcgcacagactgctgctg

SEQ ID NO: 35690 - DNA, 71 bp, chicken (Gallus Gallus)
  misc_feature (36): n=c or t
agtaatattgctgggtttatccagtgtttgagatangagatcctggcagctggctctgggtcatcatcatg

SEQ ID NO: 35691 - DNA, 71 bp, chicken (Gallus Gallus)
  misc_feature (36): n=g or t
ctggtgcccaagaatttacaatcagttatatgggangtatcctgactttcctccctttcccagggctttca

SEQ ID NO: 35692 - DNA, 71 bp, chicken (Gallus Gallus)
  misc_feature (36): n=c or t
aaaactcctttggaggcatgttctgtgttccaaaancaatgcaggaattaagacaaagccattttaaatga

SEQ ID NO: 35693 - DNA, 71 bp, chicken (Gallus Gallus)
  misc_feature (36): n=a or g
tgggaggtttggatgtgtggaactggagtcaaatcnaatgcctgcaggtttcacactggtgggactcctgt

SEQ ID NO: 35694 - DNA, 71 bp, chicken (Gallus Gallus)
  misc_feature (36): n=a or g
ggatcagctgtgaataccagatgaaaaacattagcnctgaggttactagacaaattaccttgtgagggtga

SEQ ID NO: 35695 - DNA, 71 bp, chicken (Gallus Gallus)
  misc_feature (36): n=a or g
ttgagatctgtttgtccaattggaagagcagatacngtagctgtattgtgtgtttacacttctgtgttaga

SEQ ID NO: 35696 - DNA, 71 bp, chicken (Gallus Gallus)
  misc_feature (36): n=g or t
tctttctgtcaaaatgatactgcaaaattaacaccnatgatgttagtttggaatgttggaaaatgtgagca

SEQ ID NO: 35697 - DNA, 71 bp, chicken (Gallus Gallus)
  misc_feature (36): n=c or t
cataactgatgtatcttacaggttattaagtacttntgtttgtacatttttaagttcaagaggatatttca

SEQ ID NO: 35698 - DNA, 71 bp, chicken (Gallus Gallus)
  misc_feature (36): n=a or g
agcaaaataattttagaatatgcgtgtacaatggtngatattagctggtggggcttgggaatgcttttctc

SEQ ID NO: 35699 - DNA, 71 bp, chicken (Gallus Gallus)
  misc_feature (36): n=a or g
tgtagggtaaggagctttgcagtgagtgtgagcctnttgcaggcagcttagatgcttggggacatggttca

SEQ ID NO: 35700 - DNA, 71 bp, chicken (Gallus Gallus)
  misc_feature (36): n=g or t
tgtgtagctgaactgcaattccacctactcacaatntaagaatgttacttgaagtcattcatagtgtaaat

SEQ ID NO: 35701 - DNA, 71 bp, chicken (Gallus Gallus)
  misc_feature (36): n=c or t
gctcagcatcaagcactgagaggtccctgaaagcanggcagtgcttgcctccagaaacgttcttctaagca

SEQ ID NO: 35702 - DNA, 71 bp, chicken (Gallus Gallus)
  misc_feature (36): n=a or g
ctgtgtgcacaccacggttactggacatgagcaagnggccaaatgttttgttgtgcagaatgaggacggtg

SEQ ID NO: 35703 - DNA, 71 bp, chicken (Gallus Gallus)
  misc_feature (36): n=g or t
catgacagtcaaaccattcagcatggcctgaagcanagacctggagctgcagaaggacctgaatgtgttcg

SEQ ID NO: 35704 - DNA, 71 bp, chicken (Gallus Gallus)
  misc_feature (36): n=a or c
tccagcaccaaagcagtctagcatttggggaacagnatgtgatccacaggctttggagactggaggagctt

SEQ ID NO: 35705 - DNA, 71 bp, chicken (Gallus Gallus)
  misc_feature (36): n=c or t
cttcttacagacagggcaggggcaaacccaggctcntaacatgctcgtggtggctgtgacacttgtgacac

SEQ ID NO: 35706 - DNA, 71 bp, chicken (Gallus Gallus)
  misc_feature (36): n=g or t
cattgctaccgttgtaaatcccaacctggaccagtntgcggttctgcaggttcatgatgctgtaattggca

SEQ ID NO: 35707 - DNA, 71 bp, chicken (Gallus Gallus)
  misc_feature (36): n=a or g
ccattcttccaggagtacctcatggggcaactaggncaggctttcgccattcagttctgtccattacttct

SEQ ID NO: 35708 - DNA, 71 bp, chicken (Gallus Gallus)
  misc_feature (36): n=a or g
ctggctttgcctcctgcccatctataactgaagccnttgcttgtagctcaatggaactggaaggaggttca

SEQ ID NO: 35709 - DNA, 71 bp, chicken (Gallus Gallus)
  misc_feature (36): n=a or g
agttccctgagatgcagccagcggccgcaacagaanaggcagttattcgccacatatgtcctcctatagct

SEQ ID NO: 35710 - DNA, 71 bp, chicken (Gallus Gallus)
  misc_feature (36): n=a or g
caggtttcttcagaaccaaaccaccacctctactcnagatcagtcatttctgcattaattttcaacttctc

SEQ ID NO: 35711 - DNA, 71 bp, chicken (Gallus Gallus)
  misc_feature (36): n=c or t
cgtgagtgcatatgttacccatgtaaaacaagaaanctttgggtttaaaaacattaagattgtataaacac

SEQ ID NO: 35712 - DNA, 71 bp, chicken (Gallus Gallus)
  misc_feature (36): n=g or t
taaatcagatcactgtgctgactttttaagacatgntgaagtggcagtgggtttgtagtcaagcagtggca

SEQ ID NO: 35713 - DNA, 71 bp, chicken (Gallus Gallus)
  misc_feature (36): n=g or t
tctgaagagtttggtgtcttcaaggaccggagcagnggaaatgtaatgaaattcccaagtgaggctttagc

SEQ ID NO: 35714 - DNA, 71 bp, chicken (Gallus Gallus)
  misc_feature (36): n=c or t
gtcagacaaaagctttgtgtattaccaataacacancagccactcttcggagaaaataattcaagacctgg

SEQ ID NO: 35715 - DNA, 71 bp, chicken (Gallus Gallus)
  misc_feature (36): n=a or g
acctggacagcagcatgatggtgctgggacctgctnagccagtagagcacaatgacaggatctctttgtct

SEQ ID NO: 35716 - DNA, 71 bp, chicken (Gallus Gallus)
  misc_feature (36): n=a or c
catgggatctacccatgtcattccaaattgcctccngggagtgatggttactgagccatggagggggattt

SEQ ID NO: 35717 - DNA, 71 bp, chicken (Gallus Gallus)
  misc_feature (36): n=a or g
ttcaacctgcactgctctttgcataaattcaactcntggccatcctcacttactagtaataaaatgaactg

SEQ ID NO: 35718 - DNA, 71 bp, chicken (Gallus Gallus)
  misc_feature (36): n=a or g
tacataactccctccagagacctgactggggaagancttttcctgtttctcatcaggaggtgtacagaact

SEQ ID NO: 35719 - DNA, 71 bp, chicken (Gallus Gallus)
  misc_feature (36): n=c or t
aggagtctgtatcctgaacagtaatgagatggttanggaagcatcaaaagaaaacagatctggttttagtc

SEQ ID NO: 35720 - DNA, 71 bp, chicken (Gallus Gallus)
  misc_feature (36): n=a or c
aacacagagttcacttctttgtctttctaaaatatntgctggtgtttgtcactgcttttggactccaagat

SEQ ID NO: 35721 - DNA, 71 bp, chicken (Gallus Gallus)
  misc_feature (36): n=a or g
caactgaaagaaacccctctccaaaactcttccctncttttaccaactttgcaccttctgctgtgcttacc

SEQ ID NO: 35722 - DNA, 71 bp, chicken (Gallus Gallus)
  misc_feature (36): n=a or g
gccgagcactctttagttttgctgaaggaaggcacnaaaagagcagttggggagtggaatactactgtttt

SEQ ID NO: 35723 - DNA, 71 bp, chicken (Gallus Gallus)
  misc_feature (36): n=a or g
tgcttggttgatcagctgtatatttgcaagtctgtntgttggatatcaaatatttggtttaatttctgata

SEQ ID NO: 35724 - DNA, 71 bp, chicken (Gallus Gallus)
  misc_feature (36): n=a or g
atgtccatctcgagaatggcacgtgttggagctggntaaaataagatgagccggttgctaaatcttaactt

SEQ ID NO: 35725 - DNA, 71 bp, chicken (Gallus Gallus)
  misc_feature (36): n=a or g
gtccagaatttctctgcaggatctccagataagccnataaaatctttggtacatttaatgatgtatgtgta

SEQ ID NO: 35726 - DNA, 71 bp, chicken (Gallus Gallus)
  misc_feature (36): n=a or g
aaatcctaaacatgctgtagcttcaactcaaaaggnagataaccaataatttctttctattattaaaataa

SEQ ID NO: 35727 - DNA, 71 bp, chicken (Gallus Gallus)
  misc_feature (36): n=g or t
tgcaccttcttgtgaaggctttgagtcagagcatcnacactgggatattgggatcgccctgatgaaattga

SEQ ID NO: 35728 - DNA, 71 bp, chicken (Gallus Gallus)
  misc_feature (36): n=c or t
gttggatacacaacgtgggctaagaggcaaatactnatcgatgactttgacggtgtctgatggtgtatgct

SEQ ID NO: 35729 - DNA, 71 bp, chicken (Gallus Gallus)
  misc_feature (36): n=a or g
gcaggatcagctcagtcacctgctccagaagctggngatgcccatctctgtggttgtggcacttgtcctgt

SEQ ID NO: 35730 - DNA, 71 bp, chicken (Gallus Gallus)
  misc_feature (36): n=c or t
caccaatcggagcatctgcggccttctgtgtctttnctgggactgtgttttatttctcaggcatggaaatg

SEQ ID NO: 35731 - DNA, 71 bp, chicken (Gallus Gallus)
  misc_feature (36): n=c or t
gaaatgtggttttccacccagatttctcttctgggncgatgcagctgtgctttggattgggagcgagggct

SEQ ID NO: 35732 - DNA, 71 bp, chicken (Gallus Gallus)
  misc_feature (36): n=a or g
aatgcagcgtttggtagtgctagcattgctgcggcnctctgatgtaaactgggttgccagctgaactagta

SEQ ID NO: 35733 - DNA, 71 bp, chicken (Gallus Gallus)
  misc_feature (36): n=c or t
ctttccttggggacaggagttgtatgtagggctaangtgcactctgcttggaaatggagccctctgagcag

SEQ ID NO: 35734 - DNA, 71 bp, chicken (Gallus Gallus)
  misc_feature (36): n=a or g
agttaagggcaaggcagttagagcaagttctgtgtncagactgaagaggaggtggccgtgtctgcaggacc

SEQ ID NO: 35735 - DNA, 71 bp, chicken (Gallus Gallus)
  misc_feature (36): n=c or t
aagaggaacagctggttgggatcaagcagcaagtcnatccaggccagtatcttgtctctaatgatccagca

SEQ ID NO: 35736 - DNA, 71 bp, chicken (Gallus Gallus)
  misc_feature (36): n=a or g
gaaaatttatgaacacaccaatattaataagtgggngtgggaggggtgggttgtcctatatgtgaattagg

SEQ ID NO: 35737 - DNA, 71 bp, chicken (Gallus Gallus)
  misc_feature (36): n=a or c
tttcagtatcctaatttggttggacaccttcaaaancagtgtcctgctcagattgtctgcatacttcttag

SEQ ID NO: 35738 - DNA, 71 bp, chicken (Gallus Gallus)
  misc_feature (36): n=c or t
aatgaaatatatctacacaaagtatgtttcttgctntgaccatttttacatcagggtgaatatgaaagtac

SEQ ID NO: 35739 - DNA, 71 bp, chicken (Gallus Gallus)
  misc_feature (36): n=a or g
ttatgcctaaagtcatgaactgggagaacaccactnagggctgcccatgaatgctttgtgctgcttctttc

SEQ ID NO: 35740 - DNA, 71 bp, chicken (Gallus Gallus)
  misc_feature (36): n=a or g
ttgaatgacatccttgatattgaggtaggaacaagnatgagtttagctgggaatcatcaaggcactgctgc

SEQ ID NO: 35741 - DNA, 71 bp, chicken (Gallus Gallus)
  misc_feature (36): n=c or t
cagtgttgtacaatgaaacatcgtaatgaaaacganacacttcaattgaaggcgagaggtggaaaaacgtt

SEQ ID NO: 35742 - DNA, 71 bp, chicken (Gallus Gallus)
  misc_feature (36): n=a or g
gacttaatcttccttctccaggcaaagcttttaccnatgactgcagcatatccaattcaatctgcagatta

SEQ ID NO: 35743 - DNA, 71 bp, chicken (Gallus Gallus)
  misc_feature (36): n=c or t
ttagcctaaatgtggaagaatggtacccttatcagntactgcagtgactggtggtgtgagagcttcaggaa

SEQ ID NO: 35744 - DNA, 71 bp, chicken (Gallus Gallus)
  misc_feature (36): n=a or g
tggcagtgacctatttctgcactgtgaaggaataancagttttggctggtgtgtttggtagacagttaaca

SEQ ID NO: 35745 - DNA, 71 bp, chicken (Gallus Gallus)
  misc_feature (36): n=a or g
ttcctctatttcccggtctgtaaaattggaagtccnttatgtcacaagcacaagctaaggttgaagttggt

SEQ ID NO: 35746 - DNA, 71 bp, chicken (Gallus Gallus)
  misc_feature (36): n=a or g
acagagctggtaggattataatgctgtaacgtcatntgaaatatgataagaatcagatttgctgggtaata

SEQ ID NO: 35747 - DNA, 71 bp, chicken (Gallus Gallus)
  misc_feature (36): n=c or t
atgcacagaaacaaaattacaatggttgcagcccantgaaggacagctttttatttcaacttgttggtctc

SEQ ID NO: 35748 - DNA, 71 bp, chicken (Gallus Gallus)
  misc_feature (36): n=c or t
tcatcattgtgctgctgacttgctctgtggccatgnagaaggtgctcatatatgtaaaatgcttgttccta

SEQ ID NO: 35749 - DNA, 71 bp, chicken (Gallus Gallus)
  misc_feature (36): n=c or t
gtaaagtgaataaaattttattacgtcttgctgcangtgttgcataaaacaggtgattctgataagctttg

SEQ ID NO: 35750 - DNA, 71 bp, chicken (Gallus Gallus)
  misc_feature (36): n=a or g
gcctggatgggaaacccttccatttgtaagcagtgncaccacattcagttctcagaagctgttattatctt

SEQ ID NO: 35751 - DNA, 71 bp, chicken (Gallus Gallus)
  misc_feature (36): n=a or g
gaatgctcaagcattgggctctttaatgagtagagnatgttctttctccatctggctaaagaagcacaaat

SEQ ID NO: 35752 - DNA, 71 bp, chicken (Gallus Gallus)
  misc_feature (36): n=c or t
gcttgctgctcgggagggatggactttgcctcctgngtgtctgtaggtcgtgctgctgggaggaaaggagg

SEQ ID NO: 35753 - DNA, 71 bp, chicken (Gallus Gallus)
  misc_feature (36): n=a or g
gcacagggcatgggcacagggacatggagctgggcnccagcatggcatggggtgtaggaatgggcatcggt

SEQ ID NO: 35754 - DNA, 71 bp, chicken (Gallus Gallus)
  misc_feature (36): n=a or g
agcagccccatccccccccatgagctgtcagtgccnatgaacgcgagagcagcgatggcgccgtgccccca

SEQ ID NO: 35755 - DNA, 71 bp, chicken (Gallus Gallus)
  misc_feature (36): n=a or g
aatgctttatttttgaaacgaagtcgtcacagcacngcaatgtgagtgtcttgtggcggatggacgggagg

SEQ ID NO: 35756 - DNA, 71 bp, chicken (Gallus Gallus)
  misc_feature (36): n=a or g
aggactcagcaattctgaggtgcctgggacagaganccctgctacagctctaactcagtgtgacagcttgt

SEQ ID NO: 35757 - DNA, 71 bp, chicken (Gallus Gallus)
  misc_feature (36): n=a or g
cagcctgtcccacaggactgaggaagttggttcacntgtgtcagggtgacttaatctcgtttctatttgca

SEQ ID NO: 35758 - DNA, 71 bp, chicken (Gallus Gallus)
  misc_feature (36): n=c or t
aaaaagtggcacctaaatgactggaggatttagaanggaaacataaaagccattgatacgttcatattttc

SEQ ID NO: 35759 - DNA, 71 bp, chicken (Gallus Gallus)
  misc_feature (36): n=c or t
ttctctaaacaatctgacaaaccacattgtgttggnctaggaagtaactcagccaatcttccatcactcaa

SEQ ID NO: 35760 - DNA, 71 bp, chicken (Gallus Gallus)
  misc_feature (36): n=a or g
aatactaagaggaatatgtaaagatttggatccacngagttgaaggttgtggatttgatagtcattatacc

SEQ ID NO: 35761 - DNA, 71 bp, chicken (Gallus Gallus)
  misc_feature (36): n=c or t
cattcctccagagagaaaacccacagctttcagagntgaaaagatgggctacgaaagcttgagctaaaacc

SEQ ID NO: 35762 - DNA, 71 bp, chicken (Gallus Gallus)
  misc_feature (36): n=c or t
attttaacacagtgaaagacttacaaagaatgcctnccattcattggaaaatgaaatcttccctaagagct

SEQ ID NO: 35763 - DNA, 71 bp, chicken (Gallus Gallus)
  misc_feature (36): n=a or g
agtcagagagtccttacacaccaggcagaataggcnagatgcctagcaaagatgattaaaagtaggaacaa

SEQ ID NO: 35764 - DNA, 71 bp, chicken (Gallus Gallus)
  misc_feature (36): n=a or g
gctgtgcacagagccattagggccactgacaccagnaagggacctccccttccttgggtgaaaggattttt

SEQ ID NO: 35765 - DNA, 71 bp, chicken (Gallus Gallus)
  misc_feature (36): n=a or c
ttggctacaggtcatgttacaagacaaatcttgtcngagtgttcacatttcacctgaacggctgaagtttg

SEQ ID NO: 35766 - DNA, 71 bp, chicken (Gallus Gallus)
  misc_feature (36): n=c or t
tcgtttagcccaacataatcttgaaaggaataagcncccaaaacactctacagacccctaacttctgtcta

SEQ ID NO: 35767 - DNA, 71 bp, chicken (Gallus Gallus)
  misc_feature (36): n=a or g
atttataatgtgctaacacctagatcccatcagaantggcagctctgttgttttaggcactgtacaaccag

SEQ ID NO: 35768 - DNA, 71 bp, chicken (Gallus Gallus)
  misc_feature (36): n=a or g
gcctgctgaactggaatcagactgtaggagctgggnctctcactttcctggggctctgctctctcattcca

SEQ ID NO: 35769 - DNA, 71 bp, chicken (Gallus Gallus)
  misc_feature (36): n=c or t
tggctctgtgcaagcagagaaatacgaaggggtcantgtaccaagtcagctattttctgtccctgtgggaa

SEQ ID NO: 35770 - DNA, 71 bp, chicken (Gallus Gallus)
  misc_feature (36): n=a or g
taacccagtggacagcacagaaatgttggggtgacntctgagctgaagattaaaagcaagtactcctgtgc

SEQ ID NO: 35771 - DNA, 71 bp, chicken (Gallus Gallus)
  misc_feature (36): n=c or t
tgcaacctctgtgcttccatgctagaacctgatctngtcattcacttcaaagatgcaattcactgccaaat

SEQ ID NO: 35772 - DNA, 71 bp, chicken (Gallus Gallus)
  misc_feature (36): n=g or t
gcgcccatttacactgtgccatgttgctgtgcaatntaagcagattaaaaacacgtttaacaaagtgcaag

SEQ ID NO: 35773 - DNA, 71 bp, chicken (Gallus Gallus)
  misc_feature (36): n=a or g
accgccccaatgaccctcttctctggtagcagaggntgcaaacttctctgttactcctcacaattggctaa

SEQ ID NO: 35774 - DNA, 71 bp, chicken (Gallus Gallus)
  misc_feature (36): n=a or g
gtgggggtcctaagaacaaactgaggtagaaatcantaggatggtagggccatccacggccttgggcacat

SEQ ID NO: 35775 - DNA, 71 bp, chicken (Gallus Gallus)
  misc_feature (36): n=c or t
agatgggtaggttattctatgttcttaatgctatangagtgcagattactgtaagaactgctgtaaggggc

SEQ ID NO: 35776 - DNA, 71 bp, chicken (Gallus Gallus)
  misc_feature (36): n=c or t
cccccctctgcacccagttggattcagataagaganagaagttcctggctctctcctcatctgctcggaat

SEQ ID NO: 35777 - DNA, 71 bp, chicken (Gallus Gallus)
  misc_feature (36): n=a or g
cgggcctttaagatccagtgcacccaggatggcacntggctgccaggtgcttgtgtgcctgttacgtgtga

SEQ ID NO: 35778 - DNA, 71 bp, chicken (Gallus Gallus)
  misc_feature (36): n=g or t
tctccgctacacagacctgtcctggggaatcacagntcttgttccttttgcagaacatggttttgaggcag

SEQ ID NO: 35779 - DNA, 71 bp, chicken (Gallus Gallus)
  misc_feature (36): n=c or t
cctggattttgttaaaaatgaccaggttgctttctngtcctgatagacagacaggtctcttggccaggcaa

SEQ ID NO: 35780 - DNA, 71 bp, chicken (Gallus Gallus)
  misc_feature (36): n=a or c
aaaaaaaagcacgaaaaacaaaattctaaaggcccnaaaccgcaatgctgagaatgaaaccccaggacgtg

SEQ ID NO: 35781 - DNA, 71 bp, chicken (Gallus Gallus)
  misc_feature (36): n=g or t
tacaggcaatggagaaacagtgctcagcgctgggcnaatcgtacaccaaatccacgccagaatctcttcct

SEQ ID NO: 35782 - DNA, 71 bp, chicken (Gallus Gallus)
  misc_feature (36): n=c or t
ggaaggggctccccaaattttaatgctaaatttacngtgtttctactcaaacaaaatctctgctacaacaa

SEQ ID NO: 35783 - DNA, 71 bp, chicken (Gallus Gallus)
  misc_feature (36): n=c or t
aggagagagccctgggctcctcgtgatgctctgccnatggaacagcatccctggtacatctgcaagagccc

SEQ ID NO: 35784 - DNA, 71 bp, chicken (Gallus Gallus)
  misc_feature (36): n=a or g
ctgcagtcgctcagcaattagcaccaacgctcttcncttttgtttattccaatgcatttcaccacgtttca

SEQ ID NO: 35785 - DNA, 71 bp, chicken (Gallus Gallus)
  misc_feature (36): n=c or t
atttgggaactaatttagagctcatatttcctaagncctttcagacactgaggctattggcaggcagcatc

SEQ ID NO: 35786 - DNA, 71 bp, chicken (Gallus Gallus)
  misc_feature (36): n=a or g
agggatgtgggaccccagcagggctccttccgatcnatttggtaatgccattttccctccaccgtttctac

SEQ ID NO: 35787 - DNA, 71 bp, chicken (Gallus Gallus)
  misc_feature (36): n=a or g
ccaataacaattacttgcaatggattagccaacatntttaaatatgcttttatacacacgcacacacacat

SEQ ID NO: 35788 - DNA, 71 bp, chicken (Gallus Gallus)
  misc_feature (36): n=a or g
cctcctgtcctgcctcacaccacgcacagcccccancaatgcacttcccctaccaacactgaagagacaaa

SEQ ID NO: 35789 - DNA, 71 bp, chicken (Gallus Gallus)
  misc_feature (36): n=a or g
attctcaaaactttcctcaatagagagcaaccacancgatgtgtgtgattgacttgtggttattttattgc

SEQ ID NO: 35790 - DNA, 71 bp, chicken (Gallus Gallus)
  misc_feature (36): n=a or g
tctgctgtcccctcgcagtgcagtagcagatgctgngggccatgcagggcactttccattgatgcagagct

SEQ ID NO: 35791 - DNA, 71 bp, chicken (Gallus Gallus)
  misc_feature (36): n=c or t
cctgtgagggaggagcagacagctcacctcctcaantccatgccctgatgtccttctggagctgcagtgat

SEQ ID NO: 35792 - DNA, 71 bp, chicken (Gallus Gallus)
  misc_feature (36): n=a or g
gggattatcaaggtctgacatgccagggagacctanagcctggatttgggaacagcagggggtggttgctg

SEQ ID NO: 35793 - DNA, 71 bp, chicken (Gallus Gallus)
  misc_feature (36): n=a or g
gatatggggctgcctgaaacctttttgggtatgcanatgttaatttccccactggaaaactgtcctaaagg

SEQ ID NO: 35794 - DNA, 71 bp, chicken (Gallus Gallus)
  misc_feature (36): n=a or g
gctgcaccgagggccgagcgcctccgtcacactgcnccgagtaacagcaggcctcacttccctcccccaca

SEQ ID NO: 35795 - DNA, 71 bp, chicken (Gallus Gallus)
  misc_feature (36): n=a or g
gacttggacctcagtttcaacagtctgaaattgctnagctcaaattatttttcatcagtacccaaactgca

SEQ ID NO: 35796 - DNA, 71 bp, chicken (Gallus Gallus)
  misc_feature (36): n=c or t
agcaacatctctgtgaaagccagcgacatgtgagantgacttatttgcaaaagagggaaagctaatttcag

SEQ ID NO: 35797 - DNA, 71 bp, chicken (Gallus Gallus)
  misc_feature (36): n=c or t
ttggtggtacagaaattgagccaattttagctcttncatgtgtattactgcaacttgcaaagcaaaaagga

SEQ ID NO: 35798 - DNA, 71 bp, chicken (Gallus Gallus)
  misc_feature (36): n=g or t
caagaaacccccttcgtgtccctttcttcccttctngtcttaaatccttccttctggggttgggattttgc

SEQ ID NO: 35799 - DNA, 71 bp, chicken (Gallus Gallus)
  misc_feature (36): n=c or t
accaaaggagacggggatgaagcacggagagggggngcccaccactggtgcaggaggacctgctcagcatt

SEQ ID NO: 35800 - DNA, 71 bp, chicken (Gallus Gallus)
  misc_feature (36): n=a or g
ttacaactcctgcttggacaggggctgagcagcagngcacagggatgcactgggatgtgtgcttgatttcc

SEQ ID NO: 35801 - DNA, 71 bp, chicken (Gallus Gallus)
  misc_feature (36): n=a or g
tcaattgaaaaagtcattaagcagctgtggtgtaanaaagcctttcctacgctgaactctggagctggccc

SEQ ID NO: 35802 - DNA, 71 bp, chicken (Gallus Gallus)
  misc_feature (36): n=c or t
ttgtatgcactaatgtttttctgatccctattgaanttaagggaagactgccttcctcttgcttcctgtcc

SEQ ID NO: 35803 - DNA, 71 bp, chicken (Gallus Gallus)
  misc_feature (36): n=a or g
gaaacgggcacccaacgtttgcaaagagatgcagcnttccagaccatgccagacacaggatatcagagtgc

SEQ ID NO: 35804 - DNA, 71 bp, chicken (Gallus Gallus)
  misc_feature (36): n=a or g
gatattagagatggttccagcctctttgtttccatntaaaatcctgggttacttcaacatgtgggcaggaa

SEQ ID NO: 35805 - DNA, 71 bp, chicken (Gallus Gallus)
  misc_feature (36): n=a or g
ccatcctctgagcacagcatgctttcatagcaagcngagcccgtttgtccgtgtcaccttaacatttagtt

SEQ ID NO: 35806 - DNA, 71 bp, chicken (Gallus Gallus)
  misc_feature (36): n=c or t
ttgtccactgcttatgaaagagtggatgaaatatgngcaacagctcttaacaggcaacatgtgcaggattt

SEQ ID NO: 35807 - DNA, 71 bp, chicken (Gallus Gallus)
  misc_feature (36): n=a or g
ctaggaaaacaggataaccactgttcttccaagttncttcctacatatattgtggctggatatttaaatgg

SEQ ID NO: 35808 - DNA, 71 bp, chicken (Gallus Gallus)
  misc_feature (36): n=a or g
ctttaattaataatttaagtgatttgcattcccccnaagtgcatccaaacagatttattacaagcatttgt

SEQ ID NO: 35809 - DNA, 71 bp, chicken (Gallus Gallus)
  misc_feature (36): n=a or g
tctactacttcccagccttcttgctgtggctttttnaatgtgcatgatgatgtcgtgatggtattacctgc

SEQ ID NO: 35810 - DNA, 71 bp, chicken (Gallus Gallus)
  misc_feature (36): n=a or g
ggtctacacacataggaaatgtctttgttttattcntagatcaaaagatgagtcgcaggaggcaccaggct

SEQ ID NO: 35811 - DNA, 71 bp, chicken (Gallus Gallus)
  misc_feature (36): n=c or t
agagggcattccactcaacctttgtttcccaagtanattgtgattacccaaagctccccagacatccagag

SEQ ID NO: 35812 - DNA, 71 bp, chicken (Gallus Gallus)
  misc_feature (36): n=c or t
ataaacagaaagaaggctcaggtcctgagcttcccnagtgctctcacaaataggtcccagtgctcagtgtg

SEQ ID NO: 35813 - DNA, 71 bp, chicken (Gallus Gallus)
  misc_feature (36): n=c or t
tgcctgatttgacctataaggctgatgggacccttnaaacatagagaggttttattagaaagaattagtca

SEQ ID NO: 35814 - DNA, 71 bp, chicken (Gallus Gallus)
  misc_feature (36): n=c or t
gtgtacttgaactttaatttctcatgttacaggcangggtacctgactactgcactactggcagccgaagc

SEQ ID NO: 35815 - DNA, 71 bp, chicken (Gallus Gallus)
  misc_feature (36): n=c or t
tcatgacctgcagagctgcaatagggtggggagagnggttgtgtctgcccctaaaggcacacccagaccca

SEQ ID NO: 35816 - DNA, 71 bp, chicken (Gallus Gallus)
  misc_feature (36): n=c or t
ctcctctccctcccagctccagccacatatctctcntggagctttattccatctgcagtatgtgctccctt

SEQ ID NO: 35817 - DNA, 71 bp, chicken (Gallus Gallus)
  misc_feature (36): n=a or g
tgttctgagcagtgagcctctggggctgcagaatgnggttttcaatctcctgagatttagccttctgatga

SEQ ID NO: 35818 - DNA, 71 bp, chicken (Gallus Gallus)
  misc_feature (36): n=a or g
gtgctaaaccaattacagatttctataagctttccntgctaagcactccattggctgcatttgtattgtac

SEQ ID NO: 35819 - DNA, 71 bp, chicken (Gallus Gallus)
  misc_feature (36): n=g or t
gattctccagcaaacaccatcactgccagcagcttnagtctggtagtccctatggacagcacattgcactt

SEQ ID NO: 35820 - DNA, 71 bp, chicken (Gallus Gallus)
  misc_feature (36): n=a or g
gtggttttggatcgtttgaaaggtttatggcaaaangcacagcactctggtttgttgagagatgaccactg

SEQ ID NO: 35821 - DNA, 71 bp, chicken (Gallus Gallus)
  misc_feature (36): n=c or t
tttctggtgtgtgagcagcagagacccagcaggcanggccaattaaagaaacctgtgtgttttcattctaa

SEQ ID NO: 35822 - DNA, 71 bp, chicken (Gallus Gallus)
  misc_feature (36): n=c or t
ctgggtaaaactcctggtggagctttgaaacattcnccaaatcttggaacatctgaagcaggaagccaagc

SEQ ID NO: 35823 - DNA, 71 bp, chicken (Gallus Gallus)
  misc_feature (36): n=c or t
ttgcctcaggtgaactccattcccttcttagcatgngtcatttagctttttaatgcttctgtctctccatt

SEQ ID NO: 35824 - DNA, 71 bp, chicken (Gallus Gallus)
  misc_feature (36): n=c or t
cagactcacctgctgtcaattggacaaatgacaatnctagaacagctccatgattctggttgtgtcttctg

SEQ ID NO: 35825 - DNA, 71 bp, chicken (Gallus Gallus)
  misc_feature (36): n=c or t
tatatagcatttggattctgcctcatttgcttcctnttgtaaatgagatttcacatattgtcctttaagtt

SEQ ID NO: 35826 - DNA, 71 bp, chicken (Gallus Gallus)
  misc_feature (36): n=a or g
ctcctgtgtaaaactgacaggagaacagaagtcccngtagacttgagagatgcaggaatggaggagcagag

SEQ ID NO: 35827 - DNA, 71 bp, chicken (Gallus Gallus)
  misc_feature (36): n=a or c
ggaaatatttaggtaaacaaataatgcatacaggtnaaggggaaacatctttcctataaagaatgttactc

SEQ ID NO: 35828 - DNA, 71 bp, chicken (Gallus Gallus)
  misc_feature (36): n=a or g
tcataataaaccctgaaattggtattttcaccctcntttggatgatcaggtgtaaatataaattttaatta

SEQ ID NO: 35829 - DNA, 71 bp, chicken (Gallus Gallus)
  misc_feature (36): n=c or t
ttttgtttttctttcccttaatataaatgtcattcnttcttaaagcttatggctccctctataaatgaagg

SEQ ID NO: 35830 - DNA, 71 bp, chicken (Gallus Gallus)
  misc_feature (36): n=a or c
agtgtcacatcctctgatctctcaagttctctcaanaaaacatactcctccatttattcagatgtaaacgc

SEQ ID NO: 35831 - DNA, 71 bp, chicken (Gallus Gallus)
  misc_feature (36): n=a or g
gctgtaatgcagcaagtttcagcctttacaccttcntatgctgcacaccatgacaactaacatctcacggc

SEQ ID NO: 35832 - DNA, 71 bp, chicken (Gallus Gallus)
  misc_feature (36): n=a or c
cacacttacagcaaaactcccttcttgctggtctgntggaactagttagcttgacttatttggtgaaaact

SEQ ID NO: 35833 - DNA, 71 bp, chicken (Gallus Gallus)
  misc_feature (36): n=g or t
gaggcggtcacctgaagctcagctacagcgcgatgngtgggccaagtctggggggttctgaatgttcagag

SEQ ID NO: 35834 - DNA, 71 bp, chicken (Gallus Gallus)
  misc_feature (36): n=c or t
tggattcagcatgggttcagtacacagctctgcagnagtcctaccctccagaacatgctcagcgtggcatt

SEQ ID NO: 35835 - DNA, 71 bp, chicken (Gallus Gallus)
  misc_feature (36): n=a or c
aagtagattggtaactgcaataattaggcaggagtnaaacagtgaatgtgttactgtatggagaggtgact

SEQ ID NO: 35836 - DNA, 71 bp, chicken (Gallus Gallus)
  misc_feature (36): n=a or g
ttggaatgcacggtttcccttagaatatggtgcacnacagaaaatagatgttctccccctttatttccagc

SEQ ID NO: 35837 - DNA, 71 bp, chicken (Gallus Gallus)
  misc_feature (36): n=a or g
tgattggcaaggctgtaacaagcttgatcacatcanaaggttaaaacgtgaagcaaacttcctgatgttat

SEQ ID NO: 35838 - DNA, 71 bp, chicken (Gallus Gallus)
  misc_feature (36): n=c or t
actttggcattttctagctatgctaccaacctccangtgaaataatggaatttattgacagagaagcaggc

SEQ ID NO: 35839 - DNA, 71 bp, chicken (Gallus Gallus)
  misc_feature (36): n=a or g
aaacattattaggcaagttgaaaaatgttgaaatanttttctggatcttatgctccttttcttgatgggga

SEQ ID NO: 35840 - DNA, 71 bp, chicken (Gallus Gallus)
  misc_feature (36): n=c or t
ggaggctgttgaagatgtgacttcaactgccaaggntgaggtatcccaactgagttacgaagttaatagtg

SEQ ID NO: 35841 - DNA, 71 bp, chicken (Gallus Gallus)
  misc_feature (36): n=a or g
aagggagtggatctgaaaaaatgcaggaagtcaaanaatagagggcataaacaagatctacaatggtgtgg

SEQ ID NO: 35842 - DNA, 71 bp, chicken (Gallus Gallus)
  misc_feature (36): n=c or t
cttcaatccccaaaataagctttatgttcgttcagntgaaccaattttgtccttacctttctttgtgcctc

SEQ ID NO: 35843 - DNA, 71 bp, chicken (Gallus Gallus)
  misc_feature (36): n=a or g
acgtgcaggaatcccagccttataagaataagcatnaagtattccaattgcaattcagtttggaaaagggt

SEQ ID NO: 35844 - DNA, 71 bp, chicken (Gallus Gallus)
  misc_feature (36): n=a or g
gttcacaatcactaagtgaaccagcaatacagaatnggttgtgattagcaggtgggtactgggtcattacc

SEQ ID NO: 35845 - DNA, 71 bp, chicken (Gallus Gallus)
  misc_feature (36): n=a or g
accccactatcctcccaccatcataagaaacagacngaaattaaagagattgaaggaggttttattcaatc

SEQ ID NO: 35846 - DNA, 71 bp, chicken (Gallus Gallus)
  misc_feature (36): n=g or t
agtggcagatttgggtcagccccacgtttgaggagntcaaccactgcctgcaaatgtacatatgcaaacgt

SEQ ID NO: 35847 - DNA, 71 bp, chicken (Gallus Gallus)
  misc_feature (36): n=c or t
tagtaccctggcacaggtattttggctctgaactcnatccaggagcgatgccaacccaagctgactggagg

SEQ ID NO: 35848 - DNA, 71 bp, chicken (Gallus Gallus)
  misc_feature (36): n=c or t
agtgcagagccccgtgttattgccccctgccccatnagcatgcctatatttactgacaccctcctgcacct

SEQ ID NO: 35849 - DNA, 71 bp, chicken (Gallus Gallus)
  misc_feature (36): n=c or t
agacaacaagagcaatgccagcgcagcagaactccnggcagaggaacgtatttgttatgcagcaactcagg

SEQ ID NO: 35850 - DNA, 71 bp, chicken (Gallus Gallus)
  misc_feature (36): n=a or c
ttggacagaaacaaacctggtaactgtgcaagctcntctcagcaatattacccttaaaagattcttctgga

SEQ ID NO: 35851 - DNA, 71 bp, chicken (Gallus Gallus)
  misc_feature (36): n=a or g
gataattatgggatggtgccgtctctcttagcgttnccatcaattcaaatgaaactctttcactttgtcct

SEQ ID NO: 35852 - DNA, 71 bp, chicken (Gallus Gallus)
  misc_feature (36): n=c or t
cctttcccatttcatgggctcttgaaatgatccagnttgaaggcatggctgctattcctcccttcggtgca

SEQ ID NO: 35853 - DNA, 71 bp, chicken (Gallus Gallus)
  misc_feature (36): n=a or g
tggcatgggatgggtactgggaactgtgtccttgantgggatcatgtcagaggaagatattacttttcttt

SEQ ID NO: 35854 - DNA, 71 bp, chicken (Gallus Gallus)
  misc_feature (36): n=g or t
tcagataagactttggttaagtctcctctccatttntcaatcttggaaattagagactgagactataatta

SEQ ID NO: 35855 - DNA, 71 bp, chicken (Gallus Gallus)
  misc_feature (36): n=c or t
tacaggggaagtggaaaatgggattctgaggctgangtctgagcaaaaactacctcgcaagccaccggtgc

SEQ ID NO: 35856 - DNA, 71 bp, chicken (Gallus Gallus)
  misc_feature (36): n=a or c
ttaggttggctgcaagaaaaatgacataaaagggcntgcagaatcaggaaaggtgcattagcaaagccctt

SEQ ID NO: 35857 - DNA, 71 bp, chicken (Gallus Gallus)
  misc_feature (36): n=c or t
gagaggggtggaaggtgccagctccatgctgcctcnggttaccttcttggtgcactgtctaacggtattga

SEQ ID NO: 35858 - DNA, 71 bp, chicken (Gallus Gallus)
  misc_feature (36): n=a or g
tagctgattatttggcaagaggagacaagagcctcnatgaagtggaaaactgctcagcctgttgcttgttt

SEQ ID NO: 35859 - DNA, 71 bp, chicken (Gallus Gallus)
  misc_feature (36): n=c or t
ccatgaagataaagacttgtggttttggctgagagntctgaatgaagtgggttgttaaccacaaacttaga

SEQ ID NO: 35860 - DNA, 71 bp, chicken (Gallus Gallus)
  misc_feature (36): n=g or t
cccacagttctcatccaaggcagcttgttctaacanagcctagcacttccaaggctttgggctgtttggtg

SEQ ID NO: 35861 - DNA, 71 bp, chicken (Gallus Gallus)
  misc_feature (36): n=a or g
cttgaaattaagccaccccatttgattgctgtgtcncgagaagcgtcatttgccaagtccagataacttcc

SEQ ID NO: 35862 - DNA, 71 bp, chicken (Gallus Gallus)
  misc_feature (36): n=a or c
ctaaaagaaatgttactctcatctgtgacagttgcnttgttgctgtgggatttgttttcatccataattgt

SEQ ID NO: 35863 - DNA, 71 bp, chicken (Gallus Gallus)
  misc_feature (36): n=a or g
acatttcctgactccagctgaactttctgtataacntcagggtttgaaggcacatctcaggagtccttggt

SEQ ID NO: 35864 - DNA, 71 bp, chicken (Gallus Gallus)
  misc_feature (36): n=a or g
gacacttagtgtctgttctgtagtatggccatcacnagggtaacctttgaattgtttcttttgaaatagtg

SEQ ID NO: 35865 - DNA, 71 bp, chicken (Gallus Gallus)
  misc_feature (36): n=a or g
gaaaagagaaggtgtggtgggtaacagagatcctantgtggcctccattttaattctgtttttgcctccac

SEQ ID NO: 35866 - DNA, 71 bp, chicken (Gallus Gallus)
  misc_feature (36): n=c or t
caaacacaacacctggaagagattaaattcaagcantgaagcaatcgtttctgaacgcaaagacctgagat

SEQ ID NO: 35867 - DNA, 71 bp, chicken (Gallus Gallus)
  misc_feature (36): n=c or t
gctggaaggccaaatattacagctgtgagtttatgnaggtctgtgtcccattgaaggcatggagcagcccg

SEQ ID NO: 35868 - DNA, 71 bp, chicken (Gallus Gallus)
  misc_feature (36): n=c or t
gtagaaagctacagaatgctgaaacagaagaatgcngatttccaaattcatggtttaaaacctatcgtgca

SEQ ID NO: 35869 - DNA, 71 bp, chicken (Gallus Gallus)
  misc_feature (36): n=c or t
aaatacacagcaccatactgcttcgggtcactccanctttgcctgcagaaaggtaccttttcagtaggcat

SEQ ID NO: 35870 - DNA, 71 bp, chicken (Gallus Gallus)
  misc_feature (36): n=a or g
ttttccattcacatcaacatccacttccatgctgtnaaacctggggaaatgggttaaaaaagcagtagtag

SEQ ID NO: 35871 - DNA, 71 bp, chicken (Gallus Gallus)
  misc_feature (36): n=c or t
tagtgcagctcttctggtgtagactcccattggtgngctggggcaggcattgcaaattgggcagccagtgg

SEQ ID NO: 35872 - DNA, 71 bp, chicken (Gallus Gallus)
  misc_feature (36): n=c or t
gtatttttatccccccaccttcccgtaggtccgtangcttccctgcagactgggagccccagggaggccag

SEQ ID NO: 35873 - DNA, 71 bp, chicken (Gallus Gallus)
  misc_feature (36): n=a or g
cctgggctctgcagcacctgggctgtgctgggagcncatatggcttctggctagggctgaggattgtcccc

SEQ ID NO: 35874 - DNA, 71 bp, chicken (Gallus Gallus)
  misc_feature (36): n=a or g
cagggaatgtaaattatctcatttgaacaaggctancgtagaatcaagccattggtcccaaatatccctta

SEQ ID NO: 35875 - DNA, 71 bp, chicken (Gallus Gallus)
  misc_feature (36): n=a or g
aggattactgtgacaacttagcaacagtaaagatcnagggaaaccaatgcatttgtagtacagacatctag

SEQ ID NO: 35876 - DNA, 71 bp, chicken (Gallus Gallus)
  misc_feature (36): n=c or t
gaatatcatcccagttttgcggggagacagacaaanacttgcatcattctgctccatcatgggctgaaatc

SEQ ID NO: 35877 - DNA, 71 bp, chicken (Gallus Gallus)
  misc_feature (36): n=a or g
gaattgtatgaggatcactgcctcacattccaaggnctggttacatacagggtgtagttctgctgtgttta

SEQ ID NO: 35878 - DNA, 71 bp, chicken (Gallus Gallus)
  misc_feature (36): n=c or t
tatctactttctttgagagaccctttgaaagcgttncaagaaaagcaagatgtacttggaagtatcttaca

SEQ ID NO: 35879 - DNA, 71 bp, chicken (Gallus Gallus)
  misc_feature (36): n=c or t
acacagctttgcaacgttcccgtgttaagaacatangtcagaaagcatccgctgtgagaaatggatgtttc

SEQ ID NO: 35880 - DNA, 71 bp, chicken (Gallus Gallus)
  misc_feature (36): n=a or g
gccattttccaaagacctgcacgtttgcctaatgtnggcagattttctcagcaccagaaggcacacctcgg

SEQ ID NO: 35881 - DNA, 71 bp, chicken (Gallus Gallus)
  misc_feature (36): n=a or g
ctcagcccttcctctgctgctttggccccagatccnatttccaaagccttacatcggccccttaactattt

SEQ ID NO: 35882 - DNA, 71 bp, chicken (Gallus Gallus)
  misc_feature (36): n=c or t
tcctggcatccattaagactttgctctgtgcgctcnttttcggtgctccatggggagcaccaccccagggc

SEQ ID NO: 35883 - DNA, 71 bp, chicken (Gallus Gallus)
  misc_feature (36): n=a or g
ggagcgttttgctcagctttccagtttcgctgagcntcagactcacacttgttattatgcttgcttcgtgc

SEQ ID NO: 35884 - DNA, 71 bp, chicken (Gallus Gallus)
  misc_feature (36): n=a or g
gtcatctccaagaggagcagactgaggtaagggctngaaatcatcatccatctgtaagaggaagatgtgcc

SEQ ID NO: 35885 - DNA, 71 bp, chicken (Gallus Gallus)
  misc_feature (36): n=g or t
gggctgagagtggaggttatgtaggtcactgggganggaattaggtgattacaacccaggaggtgctgcag

SEQ ID NO: 35886 - DNA, 71 bp, chicken (Gallus Gallus)
  misc_feature (36): n=c or t
ccttgcaaagcaatgtctgcagtgggcagcaaatcnacctcttcagcattgtgccacctgcaagcaactca

SEQ ID NO: 35887 - DNA, 71 bp, chicken (Gallus Gallus)
  misc_feature (36): n=c or t
actaacctcaagtgcctctcaatcctgttttatgtnggagcttcacaaaagacccgaacatctgggcgaga

SEQ ID NO: 35888 - DNA, 71 bp, chicken (Gallus Gallus)
  misc_feature (36): n=a or g
tgggtttgtccacgtgctctgcctgcgcaggttttncttctaatgggctcctaacgtgtggcggtaggagt

SEQ ID NO: 35889 - DNA, 71 bp, chicken (Gallus Gallus)
  misc_feature (36): n=a or g
ttgcttccctgcctggaaaaagaaagtctcttgcantggattgggttttagcacccaatggccatccccat

SEQ ID NO: 35890 - DNA, 71 bp, chicken (Gallus Gallus)
  misc_feature (36): n=a or g
cttatttttctctccagccataatgactttcagatntaagtttgcctcttgctctgtattagggattgcct

SEQ ID NO: 35891 - DNA, 71 bp, chicken (Gallus Gallus)
  misc_feature (36): n=a or g
ccataaccaacacagccaggtttgtttagaaaaaantcaatcataaaatatcaaaaagtccctcttagtaa

SEQ ID NO: 35892 - DNA, 71 bp, chicken (Gallus Gallus)
  misc_feature (36): n=a or g
ggtgcagtagcttagaaaggtatcactttgtaggancaagaaccacactacttcttgggcctgtcccctca

SEQ ID NO: 35893 - DNA, 71 bp, chicken (Gallus Gallus)
  misc_feature (36): n=a or g
aggtcggtctgagcacagatcacagcaaaacatacngttaactcaaggaggattcgctatatattactaat

SEQ ID NO: 35894 - DNA, 71 bp, chicken (Gallus Gallus)
  misc_feature (36): n=a or c
cctctcctttctgtggcagggtgcttgtgccaaaanaaggagatctgaggtgctgggagtgagacaggttt

SEQ ID NO: 35895 - DNA, 71 bp, chicken (Gallus Gallus)
  misc_feature (36): n=a or g
cagcccaccagagcccacacatttaaataggacacnagtcattcctactagtttcaaagaggcagtttgtg

SEQ ID NO: 35896 - DNA, 71 bp, chicken (Gallus Gallus)
  misc_feature (36): n=c or t
gggatctcagcaaaacccacctgctgtacctccctnggaatcagtctgtttatcaagagcccatcggactc

SEQ ID NO: 35897 - DNA, 71 bp, chicken (Gallus Gallus)
  misc_feature (36): n=a or c
tcattgatgaaaacagacctgcttacagcacataanccctggaaggcaatattgctaccgagctaacttct

SEQ ID NO: 35898 - DNA, 71 bp, chicken (Gallus Gallus)
  misc_feature (36): n=a or g
tggactctctgaactctcagttaatcctgtgtggtnaatgtacacagactttcaggtttactagtttgtcc

SEQ ID NO: 35899 - DNA, 71 bp, chicken (Gallus Gallus)
  misc_feature (36): n=a or g
aaattaaatatttcttctgagtgccatgggagaaanggtttcattgctgcagtttacactgtaaatgtgaa

SEQ ID NO: 35900 - DNA, 71 bp, chicken (Gallus Gallus)
  misc_feature (36): n=a or g
cagatttttttcctcagacagattcttgtgacctcncaggttacttttaaagtcacacaaatatttgggct

SEQ ID NO: 35901 - DNA, 71 bp, chicken (Gallus Gallus)
  misc_feature (36): n=a or g
tgcttgagagagctgtcatctagtcattatgatcanatcacatcttccccccctttacaaccaaaaagggg

SEQ ID NO: 35902 - DNA, 71 bp, chicken (Gallus Gallus)
  misc_feature (36): n=a or g
tgttgtcctgccacatgacatgggttggagactagnaatagctaagagtagaggttttcttattcactatt

SEQ ID NO: 35903 - DNA, 71 bp, chicken (Gallus Gallus)
  misc_feature (36): n=c or t
actgcccacttcccttcccattgccctgtaggcacngaccccatccctctgtgggtccggagagcatgtga

SEQ ID NO: 35904 - DNA, 71 bp, chicken (Gallus Gallus)
  misc_feature (36): n=a or c
ccccagagacataggtgcatgaatatgaatatctgnacaggactttggataatctagcatggcagaatgac

SEQ ID NO: 35905 - DNA, 71 bp, chicken (Gallus Gallus)
  misc_feature (36): n=a or g
atatgtagattcagagtcacaaacaaaaatgtaggncactaagctgaattcctgttaccttttccaacaac

SEQ ID NO: 35906 - DNA, 71 bp, chicken (Gallus Gallus)
  misc_feature (36): n=a or g
ctgatatagatcaaatccagaggtgtttctgtctcntttctgacatttactgacacttctgcagtccctga

SEQ ID NO: 35907 - DNA, 71 bp, chicken (Gallus Gallus)
  misc_feature (36): n=a or g
caccatcagcacatgtgttatcagaccatgaagcantgtcctcccccagggcacctatgtactcttcctac

SEQ ID NO: 35908 - DNA, 71 bp, chicken (Gallus Gallus)
  misc_feature (36): n=c or t
agtggaacgtgtgctggaatcccttctgatgcagcnttttatccaaaaaggcatgatttggattgcagtct

SEQ ID NO: 35909 - DNA, 71 bp, chicken (Gallus Gallus)
  misc_feature (36): n=c or t
agcacaagccctgtagtgcttgctctgagcatcccnatcccaaaagcttgaaattcccaccctcctgtgca

SEQ ID NO: 35910 - DNA, 71 bp, chicken (Gallus Gallus)
  misc_feature (36): n=c or t
gagcctgagaccaccatgatgtcagctcggttatgntccagttctcagatccagctcaaatctctcccacc

SEQ ID NO: 35911 - DNA, 71 bp, chicken (Gallus Gallus)
  misc_feature (36): n=a or g
agagggaggggaggtttgggggaagggaaactgggngggaagagacaaaccttttggaaggaggaatgact

SEQ ID NO: 35912 - DNA, 71 bp, chicken (Gallus Gallus)
  misc_feature (36): n=c or t
tcgcggtggggtgttgctgcctggtgggacagagcngtttcatcagtgcatgctaattacaaacatgacct

SEQ ID NO: 35913 - DNA, 71 bp, chicken (Gallus Gallus)
  misc_feature (36): n=c or t
gacgtccccagcaaggagctggcatgaatgcagttnggcactcacctgttccacgctccagtgctgtgctg

SEQ ID NO: 35914 - DNA, 71 bp, chicken (Gallus Gallus)
  misc_feature (36): n=g or t
ggagcactgtcattggtttacgttaaaggaaacagnttttatccaggaaacataagaagagacctcggctc

SEQ ID NO: 35915 - DNA, 71 bp, chicken (Gallus Gallus)
  misc_feature (36): n=a or g
aggacctcctggatgggcagcccagtgttggtgatnggataatatgcatggaaaatgtgccctgccccaaa

SEQ ID NO: 35916 - DNA, 71 bp, chicken (Gallus Gallus)
  misc_feature (36): n=g or t
aagaagtcccacatcctactgacctggagataaatntctgtgatcaaatcctggcgctttttggaagagac

SEQ ID NO: 35917 - DNA, 71 bp, chicken (Gallus Gallus)
  misc_feature (36): n=a or g
atgatcttcaccaagtcattaagtcacaaatgcccnatgacacaataaaggaaaaacatcttgcgggggtc

SEQ ID NO: 35918 - DNA, 71 bp, chicken (Gallus Gallus)
  misc_feature (36): n=c or t
acagacctgcatcattatccacaacccttagagacnaaacacaaagaggcttctttcagcctcacccacac

SEQ ID NO: 35919 - DNA, 71 bp, chicken (Gallus Gallus)
  misc_feature (36): n=a or g
ctttgaccacagttgctgttcatgctgcaagaaacntgctttgctatcaggtgatgagaatgtttaaccac

SEQ ID NO: 35920 - DNA, 71 bp, chicken (Gallus Gallus)
  misc_feature (36): n=a or g
ggcaggactcagggtcatgacatggggagcactggngcagctgtgactgcatgacatcttctgctcagggc

SEQ ID NO: 35921 - DNA, 71 bp, chicken (Gallus Gallus)
  misc_feature (36): n=a or c
cagtgaagaagaaccttctccccctctcccacgtgngctgattgccagagcacaaaggcaccgagcagcac

SEQ ID NO: 35922 - DNA, 71 bp, chicken (Gallus Gallus)
  misc_feature (36): n=a or g
cctctgcaaccagagggctgagatatcctgcaaaanaggtggtaagtgtagacgtactttaacagtactga

SEQ ID NO: 35923 - DNA, 71 bp, chicken (Gallus Gallus)
  misc_feature (36): n=a or c
tgtgagtttgtcgtaaactcccttttatggcccttncagtttatggctaatggagatttacagtgggaaga

SEQ ID NO: 35924 - DNA, 71 bp, chicken (Gallus Gallus)
  misc_feature (36): n=a or g
cgctcagcaattaaaagcaaggagctggggtgagancagtcctgctaatgatttgcagtccactcccttga

SEQ ID NO: 35925 - DNA, 71 bp, chicken (Gallus Gallus)
  misc_feature (36): n=a or g
gcattttgctcccgttggaggcaaaaaacaaaccgnggggggcaatccgagcattgcactggaaaataacg

SEQ ID NO: 35926 - DNA, 71 bp, chicken (Gallus Gallus)
  misc_feature (36): n=c or t
gctcagctgagcagggagaaatccattctctgcctntttgcaatggggaaaaactttccaggctggaaagt

SEQ ID NO: 35927 - DNA, 71 bp, chicken (Gallus Gallus)
  misc_feature (36): n=c or t
taaaagaaggcaaatctggagaggttcccatcgtgngtgtgcttggggacagtgactttgtccctgctgaa

SEQ ID NO: 35928 - DNA, 71 bp, chicken (Gallus Gallus)
  misc_feature (36): n=a or c
gccaatcacctccccacgctcacacgcctggctatntcccacataagacttcacaatgggagctcctttat

SEQ ID NO: 35929 - DNA, 71 bp, chicken (Gallus Gallus)
  misc_feature (36): n=c or t
gctgtagccacacaagtgtaagacatcacctacatncttcacatggtgttaattaacagctatgtatgggg

SEQ ID NO: 35930 - DNA, 71 bp, chicken (Gallus Gallus)
  misc_feature (36): n=a or g
aagaacttttggtccacgtgcgtgtcttgcagtggnggatcccaaatgaagccccgtgtcctgcagctcct

SEQ ID NO: 35931 - DNA, 71 bp, chicken (Gallus Gallus)
  misc_feature (36): n=a or g
ctttccaagcccttgtttgggtttgggtcttgtatncagctgatgcatcttaggatgtctgtcttaaagcc

SEQ ID NO: 35932 - DNA, 71 bp, chicken (Gallus Gallus)
  misc_feature (36): n=g or t
tgtttcctccctgcattttggccccaaaagagcctnttcttgtaagggatcttaatcccttgcacctctgg

SEQ ID NO: 35933 - DNA, 71 bp, chicken (Gallus Gallus)
  misc_feature (36): n=a or g
cccatatttggcttctgtaatgagggatccagaaancacctcttgcttctctgtccgaggttatgtgagct

SEQ ID NO: 35934 - DNA, 71 bp, chicken (Gallus Gallus)
  misc_feature (36): n=a or g
ctgaagcaaaagcaggctctctccgagctattttgnagggctgaaaagtaaatggcatctgtcaacacagt

SEQ ID NO: 35935 - DNA, 71 bp, chicken (Gallus Gallus)
  misc_feature (36): n=c or t
tagcaccacgggtccagttcccagttaccatgcagncacttggcaaagccccacttggctgcccacatcaa

SEQ ID NO: 35936 - DNA, 71 bp, chicken (Gallus Gallus)
  misc_feature (36): n=c or t
ctttccttctttacagttccactctgacccattccnggggttgttttgctttctaaggaatggttataaac

SEQ ID NO: 35937 - DNA, 71 bp, chicken (Gallus Gallus)
  misc_feature (36): n=g or t
gtttttgttctttctctgcagcgttagcctcacctntgggtagcaactgggttttgaggggactgacatcc

SEQ ID NO: 35938 - DNA, 71 bp, chicken (Gallus Gallus)
  misc_feature (36): n=c or t
tgaccgtggcaagctgggtcccatcaacacctcccnttcattctgtggctgcaagtagtggtaaatcacag

SEQ ID NO: 35939 - DNA, 71 bp, chicken (Gallus Gallus)
  misc_feature (36): n=a or g
tccttgtgcagaacgctcctgttctgtaacaggtgnactttgtggcaaagtcaatgaaaagaaccataaaa

SEQ ID NO: 35940 - DNA, 71 bp, chicken (Gallus Gallus)
  misc_feature (36): n=c or t
tccttgctcactcctgctgggcttgggttatttagnacatgggctctggccatgtggtccaactggagcat

SEQ ID NO: 35941 - DNA, 71 bp, chicken (Gallus Gallus)
  misc_feature (36): n=a or g
caaacccacaccaaactgattttcctatgcgataangggcaataaactcagccagggaacacttagccctg

SEQ ID NO: 35942 - DNA, 71 bp, chicken (Gallus Gallus)
  misc_feature (36): n=a or g
gggctgtgggccgtctacgccaccaaccagaacgcnggcaacatcgtcatcagcaagctggaccccaacac

SEQ ID NO: 35943 - DNA, 71 bp, chicken (Gallus Gallus)
  misc_feature (36): n=a or g
agatcaaaagcaccgggatcttgggatgtgcctccnagcagcaaagaaagtcgaacaaagccaaaaatagc

SEQ ID NO: 35944 - DNA, 71 bp, chicken (Gallus Gallus)
  misc_feature (36): n=c or t
tcgcttttgcactgcttcatgagcttgtcgcaagtngccatgcagtccttcccataggtgcagtccacgtt

SEQ ID NO: 35945 - DNA, 71 bp, chicken (Gallus Gallus)
  misc_feature (36): n=a or g
tccttctcgtgcaaggagagcatgagaagaaactcnttgagctgaagtagcgcccagatggatttggcctc

SEQ ID NO: 35946 - DNA, 71 bp, chicken (Gallus Gallus)
  misc_feature (36): n=a or g
cttcactttgatgcccgggaggcggctctgcaaggnaaggaaaacgcagtgggtgaacgcagtggtgctca

SEQ ID NO: 35947 - DNA, 71 bp, chicken (Gallus Gallus)
  misc_feature (36): n=a or g
atgaggctgctgccactcacgagtctgctatttaanacacctctgtggtgcactgcgtgacaaagtactgc

SEQ ID NO: 35948 - DNA, 71 bp, chicken (Gallus Gallus)
  misc_feature (36): n=c or t
gggacaattcaagacccagcctctatcagccacagnactgcttggccctatgccactgctcctgtggtccc

SEQ ID NO: 35949 - DNA, 71 bp, chicken (Gallus Gallus)
  misc_feature (36): n=a or g
tttctctttctttgttttgtaatgcagcgtggcgangtgcgcagcgctccactggattaggattagctatt

SEQ ID NO: 35950 - DNA, 71 bp, chicken (Gallus Gallus)
  misc_feature (36): n=a or g
ggccgctctgcctgaagcgatgagcgaaatacagcncggggtgccctgcacacactcacaattatccctta

SEQ ID NO: 35951 - DNA, 71 bp, chicken (Gallus Gallus)
  misc_feature (36): n=a or g
gtctctattttgcagagtccctactttgcatccctntgcgtgccctatccctgcaccgccccacgctccgt

SEQ ID NO: 35952 - DNA, 71 bp, chicken (Gallus Gallus)
  misc_feature (36): n=a or g
cacgaggcttcaccggtgggaaagctgtgaaccgantgcatgggagggggaaaatatttcctccccagagc

SEQ ID NO: 35953 - DNA, 71 bp, chicken (Gallus Gallus)
  misc_feature (36): n=c or t
aacctggacgactgcgccagcaacccctgcgactanggcaagtgcatcgacaagatcaacggctatgagtg

SEQ ID NO: 35954 - DNA, 71 bp, chicken (Gallus Gallus)
  misc_feature (36): n=a or g
gctggaaaaagcagtccgaggccgcggggccgggcnattctgctgagctgattcctgtttgccgtcctctc

SEQ ID NO: 35955 - DNA, 71 bp, chicken (Gallus Gallus)
  misc_feature (36): n=c or t
ggtacatttattcagcaagaaagtgggaagcccgangaggaatcttctgctcgcttctttaaacagataga

SEQ ID NO: 35956 - DNA, 71 bp, chicken (Gallus Gallus)
  misc_feature (36): n=c or t
ctgccatttgctggcatgcatctttggtgtttcacntgcaggcagcgttctagagtaaaatttaggtgaaa

SEQ ID NO: 35957 - DNA, 71 bp, chicken (Gallus Gallus)
  misc_feature (36): n=g or t
actagcagatgttgcatcatgtttcttgtaagtttnaggttgttctcctgtctgaattccagttgttttag

SEQ ID NO: 35958 - DNA, 71 bp, chicken (Gallus Gallus)
  misc_feature (36): n=g or t
gactggtcggtagatcactgaaggtctctgttgttntacttcctgaggagactggaaacagtttgtaggtg

SEQ ID NO: 35959 - DNA, 71 bp, chicken (Gallus Gallus)
  misc_feature (36): n=g or t
gatgccttgtgagtgtattgaggcctcatgcagctnaagttgtgagggtaatggcaaggctccacaggagg

SEQ ID NO: 35960 - DNA, 71 bp, chicken (Gallus Gallus)
  misc_feature (36): n=a or g
gctgaagaagttttggcaaaactgggagcatccaancatcaacaagaatgaatggacagaggaggaaacag

SEQ ID NO: 35961 - DNA, 71 bp, chicken (Gallus Gallus)
  misc_feature (36): n=a or g
ccggtttcttccaaacccaaaccaaagaggtctgantcatttttcagtttgaaggagtggactgttgattt

SEQ ID NO: 35962 - DNA, 71 bp, chicken (Gallus Gallus)
  misc_feature (36): n=a or g
tacagcacgtaagcaccttcggggtgaaagccagcntgtgataaagagatttctagtctgctggaaagagg

SEQ ID NO: 35963 - DNA, 71 bp, chicken (Gallus Gallus)
  misc_feature (36): n=g or t
tgccacgctgcaagtagaaccaaacaggggtatctngatcctaaaggtagcactgcactgttggacaaagt

SEQ ID NO: 35964 - DNA, 71 bp, chicken (Gallus Gallus)
  misc_feature (36): n=a or g
caggcttctgttacacagcaactttgctgggagatnagcttcctgttttgcaagggttcacatccagaaat

SEQ ID NO: 35965 - DNA, 71 bp, chicken (Gallus Gallus)
  misc_feature (36): n=a or g
taaggagcaaagcaaggcatcttgccaaatttcacnaagctttttcacaggaatgacgagaacagaggaag

SEQ ID NO: 35966 - DNA, 71 bp, chicken (Gallus Gallus)
  misc_feature (36): n=a or c
gttgtacctgttacttctggtatttgtgagagctcntgcattttgatttattgcttttaaagctgataaaa

SEQ ID NO: 35967 - DNA, 71 bp, chicken (Gallus Gallus)
  misc_feature (36): n=c or t
gatagcttgtaattgttttcacagctctgagccacngaggaagtgaaagtctttgatctttcttccccccc

SEQ ID NO: 35968 - DNA, 71 bp, chicken (Gallus Gallus)
  misc_feature (36): n=a or c
agatattttttcataactaaatttgcttatttacanaatggattttttcagacaggtttttctgcagcttc

SEQ ID NO: 35969 - DNA, 71 bp, chicken (Gallus Gallus)
  misc_feature (36): n=a or g
cccggcccttggctgtgctcaggctgctttggaggncgcgttgttagctttcagcattcattgcacaggtg

SEQ ID NO: 35970 - DNA, 71 bp, chicken (Gallus Gallus)
  misc_feature (36): n=c or t
gaaagaggaaagaaggacaaatcgcactgatgcctnccacgcatcccaaagcgaaggaggactttgacata

SEQ ID NO: 35971 - DNA, 71 bp, chicken (Gallus Gallus)
  misc_feature (36): n=c or t
gagtcagtgtgctcagttagccccagagcaaactgntgcttatgcaagtgaggtttgttctctgttactca

SEQ ID NO: 35972 - DNA, 71 bp, chicken (Gallus Gallus)
  misc_feature (36): n=c or t
ctgggggtcctcctcctgtaacagccacagatagcnctgtgcttgtgtattacagaaaagaaggatctgtt

SEQ ID NO: 35973 - DNA, 71 bp, chicken (Gallus Gallus)
  misc_feature (36): n=a or g
aggaggaagcaaaacaacagccctgggctcccctcncagtcatttgggctctcaaaagctcactgggattt

SEQ ID NO: 35974 - DNA, 71 bp, chicken (Gallus Gallus)
  misc_feature (36): n=a or g
atttctgaacaaatggtctccttatttccaaagacngtttcacactgcagctcagagtataaatagaaaac

SEQ ID NO: 35975 - DNA, 71 bp, chicken (Gallus Gallus)
  misc_feature (36): n=a or g
ctttcctgttgttgaagcatcccaaacactgaagcntgtgctgctaaaagaccaataatgtacaacgattt

SEQ ID NO: 35976 - DNA, 71 bp, chicken (Gallus Gallus)
  misc_feature (36): n=c or t
ctttgtgttggcgttttaacacgtgctgagttttgntgtctgtctttagggactttcaaatcagctggtct

SEQ ID NO: 35977 - DNA, 71 bp, chicken (Gallus Gallus)
  misc_feature (36): n=c or t
ttctgttgtaaataaatcattcctcagaaaggggancatcaagcatcactgcaaacatggtgcttatatac

SEQ ID NO: 35978 - DNA, 71 bp, chicken (Gallus Gallus)
  misc_feature (36): n=c or t
tgatgcacatgtggggcttattattgttttaaaagngcacagttgggaaagccaatatttgtaatggaagt

SEQ ID NO: 35979 - DNA, 71 bp, chicken (Gallus Gallus)
  misc_feature (36): n=c or t
ggttatgacagcatatgacagacatttactgaaagntgatggagacaaagtccagctttgagcagtttctt

SEQ ID NO: 35980 - DNA, 71 bp, chicken (Gallus Gallus)
  misc_feature (36): n=c or t
gcaacagatgatgttatgatccttgacacatgggancaggtatgtcatgttcacacaaagtggctctagat

SEQ ID NO: 35981 - DNA, 71 bp, chicken (Gallus Gallus)
  misc_feature (36): n=a or c
ttaaaggattctcctatttgtgggcaaataccatgnagtaaaagggctttgtccaattgtacgaatcaagc

SEQ ID NO: 35982 - DNA, 71 bp, chicken (Gallus Gallus)
  misc_feature (36): n=c or t
atagaatatgtgctgaactcagtgtggtccaaatcngggcattccactaccagtgggcaagctgtagaggc

SEQ ID NO: 35983 - DNA, 71 bp, chicken (Gallus Gallus)
  misc_feature (36): n=c or t
ttatttaatgctatggaggatctctactagtatgcngtcacccaaatacttgcttacagtgcatcaccttt

SEQ ID NO: 35984 - DNA, 71 bp, chicken (Gallus Gallus)
  misc_feature (36): n=c or t
tgctggaaagcagcaggttgattgccaggatgtgcnacaatgccttttgttcactatttgtttggaggagc

SEQ ID NO: 35985 - DNA, 71 bp, chicken (Gallus Gallus)
  misc_feature (36): n=c or t
tgccaagcttttgcctgctctcttttcccatctctntaatctctgaggcctttctaaccagatgcacttca

SEQ ID NO: 35986 - DNA, 71 bp, chicken (Gallus Gallus)
  misc_feature (36): n=c or t
ttactcacaaataaatattaccagtctatttcaaanctgactccatctaagatatctgcaactaagaaaaa

SEQ ID NO: 35987 - DNA, 71 bp, chicken (Gallus Gallus)
  misc_feature (36): n=c or t
ttaccctacatacaataaatactgatctagtattantcctgcttgttcagttcttacaacagtttggcaag

SEQ ID NO: 35988 - DNA, 71 bp, chicken (Gallus Gallus)
  misc_feature (36): n=a or c
gtctagataaaagaccaagacgaaagagaggcatancaagtccaaaagtaagtacataaatttaagaactg

SEQ ID NO: 35989 - DNA, 71 bp, chicken (Gallus Gallus)
  misc_feature (36): n=c or t
aatccgctaagaccattcttcagagcccttcctccnctgttctttccaggagcattaaattactctgcatg

SEQ ID NO: 35990 - DNA, 71 bp, chicken (Gallus Gallus)
  misc_feature (36): n=a or g
tgaattcaccaaaatctcctgttgccttgtaatgtnggcctttgagaaggggcaagaaagtaacagctaga

SEQ ID NO: 35991 - DNA, 71 bp, chicken (Gallus Gallus)
  misc_feature (36): n=a or g
cctgaaaccaaagacagataatcaaaatgcttgctncagagcaatgggccaaaacaaaatggatttacgtt

SEQ ID NO: 35992 - DNA, 71 bp, chicken (Gallus Gallus)
  misc_feature (36): n=a or g
ttctgggcaaaaagcagtcatgtgaattgtggcatngcaatggtcctgcagccataaaagaaatacttggt

SEQ ID NO: 35993 - DNA, 71 bp, chicken (Gallus Gallus)
  misc_feature (36): n=c or t
tcctgtatgaataagtcaccgaaacagacccagtanagtctccattctcagaggcatctgacatagttaat

SEQ ID NO: 35994 - DNA, 71 bp, chicken (Gallus Gallus)
  misc_feature (36): n=g or t
atcgaggtttaaatgaattgcctacagcaaaagtgngcactgttatagtaaagaaagcaaattcccgcatc

SEQ ID NO: 35995 - DNA, 71 bp, chicken (Gallus Gallus)
  misc_feature (36): n=a or c
tctttcatttgtttcattattaatatcaatctctgnaatactaattctccctagtttgcatacataatgga

SEQ ID NO: 35996 - DNA, 71 bp, chicken (Gallus Gallus)
  misc_feature (36): n=c or t
gctgagattttttaaggttgccaaaagaaacttcangtgactctggctaaagacaaggttttttttcagtg

SEQ ID NO: 35997 - DNA, 71 bp, chicken (Gallus Gallus)
  misc_feature (36): n=c or t
tttaagagctgctctatgatttgcactgaatgaagnccttccctttacaacaggttgaagatccatttttt

SEQ ID NO: 35998 - DNA, 71 bp, chicken (Gallus Gallus)
  misc_feature (36): n=a or c
tcattttcaccagaacaaacgttccagagacaaagnttttaaccacagctctgagaactttaccaaaaata

SEQ ID NO: 35999 - DNA, 71 bp, chicken (Gallus Gallus)
  misc_feature (36): n=g or t
acaactgttgaaatcagtaacaattccaaaatattntttccaaacagacattgaattgtttcaagtaagca

SEQ ID NO: 36000 - DNA, 71 bp, chicken (Gallus Gallus)
  misc_feature (36): n=a or c
gtactttattcagaatttgaagagcatcaaaaattncctgcgtacaagcaggagcagggggaagtcctgaa

SEQ ID NO: 36001 - DNA, 71 bp, chicken (Gallus Gallus)
  misc_feature (36): n=a or g
gctcatatttgcattgcttattagaacatatcaganaggatgccaaaactgctagttgcaaatatggcata

SEQ ID NO: 36002 - DNA, 71 bp, chicken (Gallus Gallus)
  misc_feature (36): n=a or g
tgtaaagatgcaagtggataggacagaggacttgtnaactcaacattttatcgtggggtaaccagattttt

SEQ ID NO: 36003 - DNA, 71 bp, chicken (Gallus Gallus)
  misc_feature (36): n=a or g
ttaaattggtattttgtactgcctttttcaatgcantgcattagaaaactttaagatgtgattttttaatg

SEQ ID NO: 36004 - DNA, 71 bp, chicken (Gallus Gallus)
  misc_feature (36): n=a or g
ttagcaatttctacagcttgtgccaaagccattaanaaaaagacgaaacatcatttccacagctgattttt

SEQ ID NO: 36005 - DNA, 71 bp, chicken (Gallus Gallus)
  misc_feature (36): n=c or t
tgtgataactgttagaactttgaaactttgtgaacntgatgtgttcatgtagtgttttgccatgggtttgg

SEQ ID NO: 36006 - DNA, 71 bp, chicken (Gallus Gallus)
  misc_feature (36): n=a or g
ctcaaattgggaactgcctttgaacagaacagttcngacagtgctacttacttgatgatctggttacttca

SEQ ID NO: 36007 - DNA, 71 bp, chicken (Gallus Gallus)
  misc_feature (36): n=a or g
ataagagctattgcattttcccatgtgtaggaaaancagtgctgacagagttcaaattgtggctttatgaa

SEQ ID NO: 36008 - DNA, 71 bp, chicken (Gallus Gallus)
  misc_feature (36): n=a or g
atggcgcggtcgcaccggccattcagcgccattcanttggcttaattgaggggaaaagccctccgcggacg

SEQ ID NO: 36009 - DNA, 71 bp, chicken (Gallus Gallus)
  misc_feature (36): n=g or t
cagaggccccttgcagactttggtttatgcaaatanatcagtcattcccattcagtgacttaagagattct

SEQ ID NO: 36010 - DNA, 71 bp, chicken (Gallus Gallus)
  misc_feature (36): n=a or g
ttccaggactagacgtaaatgagaaaaagtaaagtncatctttgccagtgcttcttttgtctttatagcag

SEQ ID NO: 36011 - DNA, 71 bp, chicken (Gallus Gallus)
  misc_feature (36): n=c or t
tcacagagatatgtgcacgtgtacacggtaaatttngttctctttttgagttgagaggaaaacaactggaa

SEQ ID NO: 36012 - DNA, 71 bp, chicken (Gallus Gallus)
  misc_feature (36): n=c or t
tagagcggagctgaggagcacgggcagcactgatgntacccaggagcccaaagaacagctgagctggaaat

SEQ ID NO: 36013 - DNA, 71 bp, chicken (Gallus Gallus)
  misc_feature (36): n=c or t
ccccacaaaatatttctatcaaccccgacctggctngccctatttcctaaactatcccactgagctcatct

SEQ ID NO: 36014 - DNA, 71 bp, chicken (Gallus Gallus)
  misc_feature (36): n=a or g
gctgcagtgttgtggccaaaatccaaccgagatganccagcagtccctgtcctgcccagctaacgaggcaa

SEQ ID NO: 36015 - DNA, 71 bp, chicken (Gallus Gallus)
  misc_feature (36): n=c or t
agagtgcaagaattaaagtgcctcaccctgggacanggagttgacaacatgacctgtggttcagcagtgac

SEQ ID NO: 36016 - DNA, 71 bp, chicken (Gallus Gallus)
  misc_feature (36): n=c or t
tcacacagccagtattagcatcattgtaaagctatncctcctaagagctcagtatatgggaagttcacttt

SEQ ID NO: 36017 - DNA, 71 bp, chicken (Gallus Gallus)
  misc_feature (36): n=a or c
cttgtgaccagcttgattccatgtccaaatcctatnagtaggtacatacgtgcaggattgcacagagtatt

SEQ ID NO: 36018 - DNA, 71 bp, chicken (Gallus Gallus)
  misc_feature (36): n=c or t
ttgtaagatgtgtagtcctggtgggccagccgtccngaggcattcgctagtttgtggtttggcttctatta

SEQ ID NO: 36019 - DNA, 71 bp, chicken (Gallus Gallus)
  misc_feature (36): n=g or t
aaaaacaaatctaaacagaggaatctgactcaccanagacttgtttgttgtctgcttaaactaccatcttt

SEQ ID NO: 36020 - DNA, 71 bp, chicken (Gallus Gallus)
  misc_feature (36): n=c or t
cagattaaatcctgcacagaactgggaacaaaatcntgagtactagatttaaggttcaggggttctcagtt

SEQ ID NO: 36021 - DNA, 71 bp, chicken (Gallus Gallus)
  misc_feature (36): n=c or t
caagtttgctttcagaactagcatcattaatggaancttgacacatctatgaatttgcctggtgttttctc

SEQ ID NO: 36022 - DNA, 71 bp, chicken (Gallus Gallus)
  misc_feature (36): n=c or t
cgcaccactgcgccctgctcagcccttatctttgcngagctcccacgagctcctgagttctcacaaaagcc

SEQ ID NO: 36023 - DNA, 71 bp, chicken (Gallus Gallus)
  misc_feature (36): n=a or g
aactgccagagaataaaacagggatgtgtaattttntaacacaaatgcaagaacagtttactgaagctgga

SEQ ID NO: 36024 - DNA, 71 bp, chicken (Gallus Gallus)
  misc_feature (36): n=c or t
aatggggttacggagggaagcagccaccgcgtgcangcaggagagctcggctgagatgcccggtgcgcggc

SEQ ID NO: 36025 - DNA, 71 bp, chicken (Gallus Gallus)
  misc_feature (36): n=a or g
tactgtcaataaatgctctattttcagtcactgagntttttatcccttcagttgggggggctgaggtcaac

SEQ ID NO: 36026 - DNA, 71 bp, chicken (Gallus Gallus)
  misc_feature (36): n=a or c
aaaaccaggtatggtaaactgcagaatgctggtgtncagcaggactgctctgggacagggccaaccaatcc

SEQ ID NO: 36027 - DNA, 71 bp, chicken (Gallus Gallus)
  misc_feature (36): n=c or t
ctgtgcaagggtgggctccttgtagagccgtctgcntccttgtccacagcgcttttaagtaactgacacac

SEQ ID NO: 36028 - DNA, 71 bp, chicken (Gallus Gallus)
  misc_feature (36): n=a or g
ggctttgtgcccctgccttcctttcatctgttctcntgatgaattgtgaggaaaaactgcccaagcctgtc

SEQ ID NO: 36029 - DNA, 71 bp, chicken (Gallus Gallus)
  misc_feature (36): n=c or t
attctaacagagttgggaactgcgttatttcacagntgagctgattccagcacttctgttttgctctacct

SEQ ID NO: 36030 - DNA, 71 bp, chicken (Gallus Gallus)
  misc_feature (36): n=c or t
taaaaggatcaaagcactcagcgccagttttcagcnggggatgaacgagcgctgtctgaaccacaggaaag

SEQ ID NO: 36031 - DNA, 71 bp, chicken (Gallus Gallus)
  misc_feature (36): n=a or g
aaggaatgttttaagatgaacacatttacatctgtntttctccagctttgcctgtatttcctctgtctttg

SEQ ID NO: 36032 - DNA, 71 bp, chicken (Gallus Gallus)
  misc_feature (36): n=a or g
ccaccctcccccatacaaggactgaagctgtaaacnaaaagccatttccttctgaatcagtctttgaaatc

SEQ ID NO: 36033 - DNA, 71 bp, chicken (Gallus Gallus)
  misc_feature (36): n=a or g
acctgacaggttgatgccctgcagggaaacagaganaaaacgcatcacacgactcagttcaaacaacagct

SEQ ID NO: 36034 - DNA, 71 bp, chicken (Gallus Gallus)
  misc_feature (36): n=c or t
gctctggtctctcagagctagatgtgcaaaatatgnaaacacacgctgaaatttaggactgagtttgagcc

SEQ ID NO: 36035 - DNA, 71 bp, chicken (Gallus Gallus)
  misc_feature (36): n=c or t
ggaaacacaggcagcatcctgattaaaggcagacangctcagaagcagatgcctggaatttttctctggga

SEQ ID NO: 36036 - DNA, 71 bp, chicken (Gallus Gallus)
  misc_feature (36): n=a or g
tctccccagagctccgtgggctgcccatgggcaacncatgagagatgctctgcagttcctcctgacttccc

SEQ ID NO: 36037 - DNA, 71 bp, chicken (Gallus Gallus)
  misc_feature (36): n=g or t
tctcctgcacatgggaaaaccaactgcaacttgganggatcatctttttatagaaatagttacggccctca

SEQ ID NO: 36038 - DNA, 71 bp, chicken (Gallus Gallus)
  misc_feature (36): n=c or t
agccggggtgctgcccagcggtgtctgaaggagctnggaggaaactcagcccctggggaaacggctgttgc

SEQ ID NO: 36039 - DNA, 71 bp, chicken (Gallus Gallus)
  misc_feature (36): n=c or t
agcccccacctggttgggtggttccctccctccagntttgatggtcagagcctcatttcagcctcagagcg

SEQ ID NO: 36040 - DNA, 71 bp, chicken (Gallus Gallus)
  misc_feature (36): n=a or g
ggctcagcagagaaaacccaaatcttgtcaaaaacngaagaatttaagattttgatcagagaggacacaga

SEQ ID NO: 36041 - DNA, 71 bp, chicken (Gallus Gallus)
  misc_feature (36): n=a or g
gcacgctgagggacctgggatgtaaatgagaagaantttcagtacagcctaagaaattattgaggtcacat

SEQ ID NO: 36042 - DNA, 71 bp, chicken (Gallus Gallus)
  misc_feature (36): n=c or t
ataaatattgatgggctgtcagccatgaaaaagganccttatcccattgcaatgctgtgtcggaggggagc

SEQ ID NO: 36043 - DNA, 71 bp, chicken (Gallus Gallus)
  misc_feature (36): n=a or g
tcctgtggtgtcattctccaagactgcagtttcagnacagcaggacagttctcacagccaacagaaagcac

SEQ ID NO: 36044 - DNA, 71 bp, chicken (Gallus Gallus)
  misc_feature (36): n=a or g
ggagttttgcataacctgacctcacttttctcaaangagggctctgccatttcagcttaccattgggaggc

SEQ ID NO: 36045 - DNA, 71 bp, chicken (Gallus Gallus)
  misc_feature (36): n=a or g
cacacctactataaaccagaccaagaagtgaaggantgggatttccatgccacgatggtgtttgcaaggct

SEQ ID NO: 36046 - DNA, 71 bp, chicken (Gallus Gallus)
  misc_feature (36): n=c or t
ctcgtgtgcccaggaggttctcaagcctgttctccngggcagtgttttcttgagaccccgtatgacttttt

SEQ ID NO: 36047 - DNA, 71 bp, chicken (Gallus Gallus)
  misc_feature (36): n=a or g
ggtcctcagctggctagagtctgtcctacaaactgnaggatgaacttaggatcttagtgaacttacgatct

SEQ ID NO: 36048 - DNA, 71 bp, chicken (Gallus Gallus)
  misc_feature (36): n=a or c
gggaaggcaagagccactccgaaatgctcaagaagnagccaagcccagaggcacgagctgtgagcgtcctc

SEQ ID NO: 36049 - DNA, 71 bp, chicken (Gallus Gallus)
  misc_feature (36): n=a or g
ggttgggggggggcggagcacagaggaatatctacngaggaaaggatgtgcccatgcaaaaactgtccctc

SEQ ID NO: 36050 - DNA, 71 bp, chicken (Gallus Gallus)
  misc_feature (36): n=c or t
ccagtaactggacgacattccagatctgaaggcacnccaaagtattttggcaacccagagagacttggaag

SEQ ID NO: 36051 - DNA, 71 bp, chicken (Gallus Gallus)
  misc_feature (36): n=g or t
tgaggatgaggttcgtggaattgtggacaaagcagngagagaaatgagcatggagaaggtgctgaaggaac

SEQ ID NO: 36052 - DNA, 71 bp, chicken (Gallus Gallus)
  misc_feature (36): n=g or t
acttactttccccccctgctaggccaggaaacgggnaggcgtggtttacacacaggcagaccgcgttccct

SEQ ID NO: 36053 - DNA, 71 bp, chicken (Gallus Gallus)
  misc_feature (36): n=a or g
ttcaattgtgcatgtcactgataaaaaaagccatcnagagtgatgtagtccattaccacactcttcacagg

SEQ ID NO: 36054 - DNA, 71 bp, chicken (Gallus Gallus)
  misc_feature (36): n=a or g
gtccccaggagtcactgtcgcagctgggctgtgccntgcagtcagatacagctaccaaacatggatgggtt

SEQ ID NO: 36055 - DNA, 71 bp, chicken (Gallus Gallus)
  misc_feature (36): n=a or g
gttcacatccagaactgtttacccatcacttctganctgtcttgttccctctcttgttcagaaactgttgg

SEQ ID NO: 36056 - DNA, 71 bp, chicken (Gallus Gallus)
  misc_feature (36): n=g or t
tggctgtgcaagctgatagtccaccacagatgaagngcacaaaggaattgcgggcattgtatgaggtgacg

SEQ ID NO: 36057 - DNA, 71 bp, chicken (Gallus Gallus)
  misc_feature (36): n=a or g
atcaagtgttattatacaataactaaatcaggtgcntagatcgcaatataatggaattatttgtcagtgga

SEQ ID NO: 36058 - DNA, 71 bp, chicken (Gallus Gallus)
  misc_feature (36): n=c or t
gtttccttttaaggaactataaaggcttacaatgtnactcaagtgtactggagctccatttttctttcctg

SEQ ID NO: 36059 - DNA, 71 bp, chicken (Gallus Gallus)
  misc_feature (36): n=a or g
ttctaatatatttagatatgggccttcttactctgnaattactctagtttttgcttgaaaactaataaagc

SEQ ID NO: 36060 - DNA, 71 bp, chicken (Gallus Gallus)
  misc_feature (36): n=a or c
taggaagcacaatccattcccttgctgtgtaatatncctgctacttcagttgcagccatatgtgctggggg

SEQ ID NO: 36061 - DNA, 71 bp, chicken (Gallus Gallus)
  misc_feature (36): n=a or g
gaagggttgtgaagtggattcattgaagagcagacntttctagggctatatacagaatcgtagagtggttt

SEQ ID NO: 36062 - DNA, 71 bp, chicken (Gallus Gallus)
  misc_feature (36): n=a or g
cctggaaagcgtgttagctctgctgagaacttgccntgtctgtttatgatcttagattactggggcaagta

SEQ ID NO: 36063 - DNA, 71 bp, chicken (Gallus Gallus)
  misc_feature (36): n=g or t
tactgtcttggataacacacccactgagtgcaggantctgcaccctgcaaagcgaggagctatgagtgtgt

SEQ ID NO: 36064 - DNA, 71 bp, chicken (Gallus Gallus)
  misc_feature (36): n=c or t
ggagccagagagcagctttaagtcacacttttgctncttctaggtgcaaaaggaaggactacactgaaaca

SEQ ID NO: 36065 - DNA, 71 bp, chicken (Gallus Gallus)
  misc_feature (36): n=c or t
gcccctagtaacaccactgggtgaatgcctgctcanagtcctgtaaccatgaggctgtgtaactcctacgc

SEQ ID NO: 36066 - DNA, 71 bp, chicken (Gallus Gallus)
  misc_feature (36): n=a or g
tttatttctgtgcagaaattctatggaaaaaagcanttcatcatcagaaagtttcttcttgcgagatcttc

SEQ ID NO: 36067 - DNA, 71 bp, chicken (Gallus Gallus)
  misc_feature (36): n=a or g
gtgcttccccactagacttagctgcaagcacgaganatattgtcctgtatgagatgtgttgtccattctag

SEQ ID NO: 36068 - DNA, 71 bp, chicken (Gallus Gallus)
  misc_feature (36): n=c or t
ggaacagagcacatatctgtaagcattcacacttcngccgttgcgcagcttgcaggatgagttactctttt

SEQ ID NO: 36069 - DNA, 71 bp, chicken (Gallus Gallus)
  misc_feature (36): n=c or t
atctgccctcttcccctgctttgtggccttcaagtnctcctgatcagctcatggctgaaaaatttcagtct

SEQ ID NO: 36070 - DNA, 71 bp, chicken (Gallus Gallus)
  misc_feature (36): n=a or g
atgcttagcacataacaccttctcagggaagcagancccgaggactgctttatcaacccactgcactcccc

SEQ ID NO: 36071 - DNA, 71 bp, chicken (Gallus Gallus)
  misc_feature (36): n=a or g
ataattagaggactatgcaaaggcaagcagccaggngaagtgtcccacaccaaaccaggagccttcccatc

SEQ ID NO: 36072 - DNA, 71 bp, chicken (Gallus Gallus)
  misc_feature (36): n=c or t
ccaaatcatttcccttacaggctgccatccttgtangtaatgaattgcaacactaaggtgcactaccaaag

SEQ ID NO: 36073 - DNA, 71 bp, chicken (Gallus Gallus)
  misc_feature (36): n=a or g
catacagacaaagcgtatgcctctgggctgagcccngacatgaaagataagatgaaggcttcagaaagtca

SEQ ID NO: 36074 - DNA, 71 bp, chicken (Gallus Gallus)
  misc_feature (36): n=c or t
tcatttgcaatgataagctgcatgcattttaactgnggtgcttggaggtgcagagttggtggatatgctaa

SEQ ID NO: 36075 - DNA, 71 bp, chicken (Gallus Gallus)
  misc_feature (36): n=c or t
ccaaagtcaatgaaattccactctatgccctctcgntggtactcctcttgctccaggataaacatcgtgtg

SEQ ID NO: 36076 - DNA, 71 bp, chicken (Gallus Gallus)
  misc_feature (36): n=c or t
tcttatcaaaggttgcttacaaacctctgcttcagnttagacaggcatcagcataaagccatgcatgtttg

SEQ ID NO: 36077 - DNA, 71 bp, chicken (Gallus Gallus)
  misc_feature (36): n=c or t
atctaccaaataattttagcagggggaagcatctgngagacagcttcagtaacactttcttctatcagtat

SEQ ID NO: 36078 - DNA, 71 bp, chicken (Gallus Gallus)
  misc_feature (36): n=a or c
aatatgcagattacatgtggctgtgtttctaacacntaccagtgagaaaacacgtgtgcaggtgagaggag

SEQ ID NO: 36079 - DNA, 71 bp, chicken (Gallus Gallus)
  misc_feature (36): n=c or t
caaataacagcaagtaagttttgtcttcactacaangtaacagacactactgtatcctcagtatgcctcga

SEQ ID NO: 36080 - DNA, 71 bp, chicken (Gallus Gallus)
  misc_feature (36): n=c or t
cagcactctgctcagggtctcagcaggctgacctgngatgtgccggccgtgtgcccttggcttggtgtcag

SEQ ID NO: 36081 - DNA, 71 bp, chicken (Gallus Gallus)
  misc_feature (36): n=a or g
tcctccctgctttatcttgggtggtggaagcagcantgttaaaagcagatgaacacaatgctatggtattt

SEQ ID NO: 36082 - DNA, 71 bp, chicken (Gallus Gallus)
  misc_feature (36): n=a or c
ctgattgtccgagtttggcttgaaaaggagaaatantgtttgtcctggtggagatttgtttggttccttgc

SEQ ID NO: 36083 - DNA, 71 bp, chicken (Gallus Gallus)
  misc_feature (36): n=a or g
caggagaaatgcaactttcagtcaagttccattganggaaagatgtgaactaaaccaagcagtgatcaaat

SEQ ID NO: 36084 - DNA, 71 bp, chicken (Gallus Gallus)
  misc_feature (36): n=c or t
aacagcaagatctggtcaatccaaagagaagacagnaagtcctaaatcataaaaccttcaagaggaaaggc

SEQ ID NO: 36085 - DNA, 71 bp, chicken (Gallus Gallus)
  misc_feature (36): n=c or t
ctacagcctgttacagcaggaccagccatccagtgnaggaggatgggaaatctgaattcccagtccctgga

SEQ ID NO: 36086 - DNA, 71 bp, chicken (Gallus Gallus)
  misc_feature (36): n=a or g
agagagtcccacgaccacttgggatatgggatcccnctgcccaacagagacaggtgcccttacctatctct

SEQ ID NO: 36087 - DNA, 71 bp, chicken (Gallus Gallus)
  misc_feature (36): n=a or c
ttcacaagaatgccttgtgagacagaaccaaaaccnttcttacatcaagatggcactgagttgcttttccc

SEQ ID NO: 36088 - DNA, 71 bp, chicken (Gallus Gallus)
  misc_feature (36): n=a or g
ataccaaagtaatgtagtgtcctgccctgtgttccngcccaagttgtcagttaggataaataccaagagca

SEQ ID NO: 36089 - DNA, 71 bp, chicken (Gallus Gallus)
  misc_feature (36): n=g or t
cagaggattaaggtgcgtgctaattggctgtatccngctggctattagctgcctggcacaactcactccaa

SEQ ID NO: 36090 - DNA, 71 bp, chicken (Gallus Gallus)
  misc_feature (36): n=a or g
ctggaagatgctgcgtggtagcctggggttacagcntggcaaggatggaagttcaagcaagaaaaggaggt

SEQ ID NO: 36091 - DNA, 71 bp, chicken (Gallus Gallus)
  misc_feature (36): n=a or g
tgctccgtgcaccagagcataaaatctgccaaagcnatggcttacgtccaggtgctggggagcagggaggg

SEQ ID NO: 36092 - DNA, 71 bp, chicken (Gallus Gallus)
  misc_feature (36): n=a or g
tctgctggattatttctctcccctcctttcagtctntgatttttggagaaacaaactcaggtcttcctcct

SEQ ID NO: 36093 - DNA, 71 bp, chicken (Gallus Gallus)
  misc_feature (36): n=g or t
gcagaaaggatggtaatgcaaggatagtgtgtgtgngggggggagaatccaactgctgcttcttacacaag

SEQ ID NO: 36094 - DNA, 71 bp, chicken (Gallus Gallus)
  misc_feature (36): n=a or g
atggtttcacagcacagagcttcccacactgggcanctgactgctgaatccccacttggccaagcacttag

SEQ ID NO: 36095 - DNA, 71 bp, chicken (Gallus Gallus)
  misc_feature (36): n=c or t
catgcccactaacacaggtattccttcccatcttcncttgcattgcactacttctcccatcaccccttttt

SEQ ID NO: 36096 - DNA, 71 bp, chicken (Gallus Gallus)
  misc_feature (36): n=a or g
aggtgggtagtgtcatcccctatggatgtcccctanggtcaatccatcaccctatgcaaacacaacagaaa

SEQ ID NO: 36097 - DNA, 71 bp, chicken (Gallus Gallus)
  misc_feature (36): n=c or t
gcagagaatgggaaggctcaccaagcagatacctantgcctgcagacactgcaaacaccctccacacaccc

SEQ ID NO: 36098 - DNA, 71 bp, chicken (Gallus Gallus)
  misc_feature (36): n=a or g
ggcatacacagtgactttgtcatttaatggtctccngggctgttttaatcaacgtgcacattttgcgtgtc

SEQ ID NO: 36099 - DNA, 71 bp, chicken (Gallus Gallus)
  misc_feature (36): n=g or t
agtgaggagcagtccctgtgcttgcagttactgatntttaggaacaaagccagagcttggagtaaatctca

SEQ ID NO: 36100 - DNA, 71 bp, chicken (Gallus Gallus)
  misc_feature (36): n=a or g
gctctaattgaattataagccatcactttatggccncatgtaaaaatcccacatgttccttgcacagcata

SEQ ID NO: 36101 - DNA, 71 bp, chicken (Gallus Gallus)
  misc_feature (36): n=c or t
gtgagctctgcacatctttcatcaagtgctggacangatgaagtagtgcttcaagggtgggtgtagctgca

SEQ ID NO: 36102 - DNA, 71 bp, chicken (Gallus Gallus)
  misc_feature (36): n=a or g
ctaggaaacccttaacaaatatacagaaatgctggntactggcagtcagatgtaaaatgctgtgtttaacg

SEQ ID NO: 36103 - DNA, 71 bp, chicken (Gallus Gallus)
  misc_feature (36): n=a or g
acgttctattgccttcaatgggggtttgaatacacnctttgagttaacaaggcaaataatgattagcttaa

SEQ ID NO: 36104 - DNA, 71 bp, chicken (Gallus Gallus)
  misc_feature (36): n=g or t
gcttccctgcagtgatgggatcaatgcccatagggntaaaccccatggatgtgagaatgtgggtgaataca

SEQ ID NO: 36105 - DNA, 71 bp, chicken (Gallus Gallus)
  misc_feature (36): n=a or g
agttccaactgctgatgcccagagcccacctggagncacagcctgaacaggcagcacaaggcacatcagca

SEQ ID NO: 36106 - DNA, 71 bp, chicken (Gallus Gallus)
  misc_feature (36): n=g or t
ggctgcagaagaagagcttcctggagctgctgcggnctgcatccctgtagaaccgaaagccgaggtaggag

SEQ ID NO: 36107 - DNA, 71 bp, chicken (Gallus Gallus)
  misc_feature (36): n=g or t
ctcagcaaaacctcttgcttcagccctaagccaacntttttaccacagtgcaaataacgatgctctgctct

SEQ ID NO: 36108 - DNA, 71 bp, chicken (Gallus Gallus)
  misc_feature (36): n=a or g
aacgcggcgagctgctgacagagaagagacagagcnaaattaccccgttagctaattgaattcccagagct

SEQ ID NO: 36109 - DNA, 71 bp, chicken (Gallus Gallus)
  misc_feature (36): n=a or g
aaatgtaatcagtctgccatcaggcgctcggcacangtgcacaaactggcatgggacttgccggattcctg

SEQ ID NO: 36110 - DNA, 71 bp, chicken (Gallus Gallus)
  misc_feature (36): n=g or t
agggaataaaggcaaagaaccaacacagcaaacggngtcttttaaaagcgacgagctgtctgtgaagcgag

SEQ ID NO: 36111 - DNA, 71 bp, chicken (Gallus Gallus)
  misc_feature (36): n=a or c
tgcacacaacaatctatacttagacccggagctacncaaaagattgtgaaaacggccatagggactatctg

SEQ ID NO: 36112 - DNA, 71 bp, chicken (Gallus Gallus)
  misc_feature (36): n=g or t
ttataaagaaaaatctgaagctccaactagcacatngtctcctggacatcttcactgttgttcttttttcc

SEQ ID NO: 36113 - DNA, 71 bp, chicken (Gallus Gallus)
  misc_feature (36): n=a or c
gcagcaaccagctggaagggctgaagcaagagcccnaaatgggtcttctccaaagcaatctgtgctctgct

SEQ ID NO: 36114 - DNA, 71 bp, chicken (Gallus Gallus)
  misc_feature (36): n=a or c
cacatgaatcatggtgcgtgaaagaagtaactgagncttaagagggccgtggtgaaaacaattacaatctt

SEQ ID NO: 36115 - DNA, 71 bp, chicken (Gallus Gallus)
  misc_feature (36): n=a or g
taaaagttctttcttaaagggctctattgctggttntggggaatgatgggactgaatggggggggggacag

SEQ ID NO: 36116 - DNA, 71 bp, chicken (Gallus Gallus)
  misc_feature (36): n=a or g
cagacattgtactaaatacaattctgggcccggttnaatggcgaactacactgcacagaggcccctttaga

SEQ ID NO: 36117 - DNA, 71 bp, chicken (Gallus Gallus)
  misc_feature (36): n=c or t
agcgaaaagccacaacgaatcatctgctccgtgctntgtagttctgagatgtactgtgtcaccagctcacc

SEQ ID NO: 36118 - DNA, 71 bp, chicken (Gallus Gallus)
  misc_feature (36): n=c or t
attgggtggcttaataaacacaggaatcatagttgnagtaatatatgaagcaagacaaaatcatacaccag

SEQ ID NO: 36119 - DNA, 71 bp, chicken (Gallus Gallus)
  misc_feature (36): n=g or t
cctttgtgttttataccaaccatgaaactaaaaacnttaaattacggcttccaagctcaagatggatgcat

SEQ ID NO: 36120 - DNA, 71 bp, chicken (Gallus Gallus)
  misc_feature (36): n=a or g
tcaattcgttctttctcagacttccttaaatagggngcagcttctccaaagattgccatctctgcatctga

SEQ ID NO: 36121 - DNA, 71 bp, chicken (Gallus Gallus)
  misc_feature (36): n=c or t
caacctacctgtggaagatagccacagcaggtaacngtatgaaagccaaattgatccacaaactggacttc

SEQ ID NO: 36122 - DNA, 71 bp, chicken (Gallus Gallus)
  misc_feature (36): n=a or g
aaagcagtaattctgaagatgggcaggtaggcagtngggttagttgtctgggtaacctgccgttagaggtt

SEQ ID NO: 36123 - DNA, 71 bp, chicken (Gallus Gallus)
  misc_feature (36): n=a or g
tccttactgccactgtgttttaatactttgttgtcntgatgccatggcttttcaacaggcacggcacaata

SEQ ID NO: 36124 - DNA, 71 bp, chicken (Gallus Gallus)
  misc_feature (36): n=c or t
ttaatgtgtgagtgttctgtattttcagggaatttnaggaggtttgagttcctcattctaattctctcctc

SEQ ID NO: 36125 - DNA, 71 bp, chicken (Gallus Gallus)
  misc_feature (36): n=a or g
ctggtgcagcagtcagctgtggtactccatctcctntgctgctgcataattgatgttagcttcctaaacca

SEQ ID NO: 36126 - DNA, 71 bp, chicken (Gallus Gallus)
  misc_feature (36): n=c or t
gaacacttgggaatggcagtgtttcagcttctttcncagttagctgttaaagaaattgctctgtgttcgta

SEQ ID NO: 36127 - DNA, 71 bp, chicken (Gallus Gallus)
  misc_feature (36): n=a or c
gacggtggaatggaagcatttcttctcaaatagctnatttttgttttcccagtggacaaaaagcactaatg

SEQ ID NO: 36128 - DNA, 71 bp, chicken (Gallus Gallus)
  misc_feature (36): n=a or g
gaaaagacatatctactccccataaagctgagcatngctcagtatccttgttcaggatctctctcgttcac

SEQ ID NO: 36129 - DNA, 71 bp, chicken (Gallus Gallus)
  misc_feature (36): n=c or t
tgttggtaaatagcacacagtgctgaatctatgtgngtatctggtacagtttgtcttaacatgaattcctc

SEQ ID NO: 36130 - DNA, 71 bp, chicken (Gallus Gallus)
  misc_feature (36): n=g or t
ctacatttgcagagaggtgctgtatgaagtttcaanataagtaaagtggtatttaacaccaggtttgtgta

SEQ ID NO: 36131 - DNA, 71 bp, chicken (Gallus Gallus)
  misc_feature (36): n=c or t
gcatttctaaatgcagccaagggatttcaaagattnttaggggggatatttctgtaggtcagctcgtgaag

SEQ ID NO: 36132 - DNA, 71 bp, chicken (Gallus Gallus)
  misc_feature (36): n=a or g
attgcaaacacctattttctgtatttcttccagttnatagctcgcaactctcagaactgctgactattgac

SEQ ID NO: 36133 - DNA, 71 bp, chicken (Gallus Gallus)
  misc_feature (36): n=a or g
aaatatggtgctggttaaaagttttaattctgattntagctcatgagcccttgtctgtgtgtcagtaatgg

SEQ ID NO: 36134 - DNA, 71 bp, chicken (Gallus Gallus)
  misc_feature (36): n=a or g
taggcactggtagcaggaacatgcaaagcattaatngggaaagagcaggaatttgggaaggaatctaagcc

SEQ ID NO: 36135 - DNA, 71 bp, chicken (Gallus Gallus)
  misc_feature (36): n=c or t
ttatcctacgtgcaatctctgtgtcagaccatgaantctattaaagaacttcttactgatggtgctgtgaa

SEQ ID NO: 36136 - DNA, 71 bp, chicken (Gallus Gallus)
  misc_feature (36): n=a or g
ttccaaagtcatgcttccatcaaaggcgcattaccngctgcccagggactccaaaagtttactgaagctta

SEQ ID NO: 36137 - DNA, 71 bp, chicken (Gallus Gallus)
  misc_feature (36): n=a or g
gatgtcctatgagctccaggagacagcgaggcaagntttggagcatcgtgttggagtctgtgaatgcctct

SEQ ID NO: 36138 - DNA, 71 bp, chicken (Gallus Gallus)
  misc_feature (36): n=a or g
gagtggtgactcccaagatttcccccaaatcttggnaaaacagcagttcttagttggaatgcagcatgtga

SEQ ID NO: 36139 - DNA, 71 bp, chicken (Gallus Gallus)
  misc_feature (36): n=c or t
actttcccctcctttctgtgttgtcaattagagcgngggcttgttagctgttttattatctgtttcctttt

SEQ ID NO: 36140 - DNA, 71 bp, chicken (Gallus Gallus)
  misc_feature (36): n=a or g
tagcatttttttttgtgctggaaagcaaggttacantattgtagagcagagcatggcaggcacagagggtg

SEQ ID NO: 36141 - DNA, 71 bp, chicken (Gallus Gallus)
  misc_feature (36): n=c or t
ccactgtctgaaggggggcaaggggaaagcaagagntcgccctttgagtcagacttcacaagtagatgggt

SEQ ID NO: 36142 - DNA, 71 bp, chicken (Gallus Gallus)
  misc_feature (36): n=c or t
actcagccttctgcttcactatggccattgcaaccngcttggagatccagaatggccaaacgttccctttt

SEQ ID NO: 36143 - DNA, 71 bp, chicken (Gallus Gallus)
  misc_feature (36): n=a or g
acacgaggagatgagctcctggtaaatgagctttcntgcttgaagggtttcctggtgccattccccacccc

SEQ ID NO: 36144 - DNA, 71 bp, chicken (Gallus Gallus)
  misc_feature (36): n=c or t
caagggctgtggtggtggtttgttcatgtacagggntcttggtggggtttctgtggcttcagaagccaggg

SEQ ID NO: 36145 - DNA, 71 bp, chicken (Gallus Gallus)
  misc_feature (36): n=a or g
ggatgcagccagctttgtgctgtgacactctgcacnttcctcaggtagttactctcctgattcaggagagt

SEQ ID NO: 36146 - DNA, 71 bp, chicken (Gallus Gallus)
  misc_feature (36): n=a or g
gaaacaaagccaaagacacgtgctgtaggtcagccngagaacacactcaaggtgacagtggtctggagcag

SEQ ID NO: 36147 - DNA, 71 bp, chicken (Gallus Gallus)
  misc_feature (36): n=c or t
ctttcctagcacagccacacagacagcattatcagngttggcttgaagtatttctgtgctccgtgggtgcg

SEQ ID NO: 36148 - DNA, 71 bp, chicken (Gallus Gallus)
  misc_feature (36): n=c or t
cctaggtgtgtcctgggaaacactaccatcctggcngagttcgccggcgaggaggaggtgaaccgcttcct

SEQ ID NO: 36149 - DNA, 71 bp, chicken (Gallus Gallus)
  misc_feature (36): n=c or t
ggatgagttttgtatgcagttctgagagtggaggcngagagctccttcagctctgcccatccgtccccacg

SEQ ID NO: 36150 - DNA, 71 bp, chicken (Gallus Gallus)
  misc_feature (36): n=a or g
taaatggcaacaagatgataccagaaatggccacanacttcagctgctaagcattataacatatcagaact

SEQ ID NO: 36151 - DNA, 71 bp, chicken (Gallus Gallus)
  misc_feature (36): n=a or c
cacaaaagaagaaagtctgacagcttgcaagcaacnttttgctatcccattattcttacagtacctgaatc

SEQ ID NO: 36152 - DNA, 71 bp, chicken (Gallus Gallus)
  misc_feature (36): n=c or t
tctttatttgcctgtgaaatgctctgattgttatgnatttcttaataacaccagcggagtaataagaaaca

SEQ ID NO: 36153 - DNA, 71 bp, chicken (Gallus Gallus)
  misc_feature (36): n=c or t
ctttacttctggtcacaaccagcctgtgtctgaatngaacaaaaggatccatatgtcacagtgcagctccc

SEQ ID NO: 36154 - DNA, 71 bp, chicken (Gallus Gallus)
  misc_feature (36): n=c or t
cgccgacctgcccgcaaacttgcttgggctcccgangtctccatctggggccaacccgcatgcaaggcaaa

SEQ ID NO: 36155 - DNA, 71 bp, chicken (Gallus Gallus)
  misc_feature (36): n=c or t
tgcaacaccccaacaaggacaccccaaagccattcntgtgggcatcccgtgggaacagatattgcagctct

SEQ ID NO: 36156 - DNA, 71 bp, chicken (Gallus Gallus)
  misc_feature (36): n=a or g
aagagtgcccaaaatactccgctgttccttccaatngtgttttcatcagaatttatagtcaagcaatttcc

SEQ ID NO: 36157 - DNA, 71 bp, chicken (Gallus Gallus)
  misc_feature (36): n=c or t
gtagccacaacaccttaataaactgattaagcatcntgttaacccacttaatctagttaacactaaaccaa

SEQ ID NO: 36158 - DNA, 71 bp, chicken (Gallus Gallus)
  misc_feature (36): n=g or t
ctacaaactgaggagtttctgtgttccaggactgantgtctagcagcagtctacatagattcaattacagg

SEQ ID NO: 36159 - DNA, 71 bp, chicken (Gallus Gallus)
  misc_feature (36): n=a or c
tttatggatattctgtgggatttttattccgaggtnttttgtgacctaggaaactgtgaactgcctacact

SEQ ID NO: 36160 - DNA, 71 bp, chicken (Gallus Gallus)
  misc_feature (36): n=c or t
gtgggattttggctccagcagtgcaatggtttagtngacagaaacacttggaaacgtaaagtcttacctgt

SEQ ID NO: 36161 - DNA, 71 bp, chicken (Gallus Gallus)
  misc_feature (36): n=c or t
aaagcagaagtggtgtgcgtgtactgatcctgcatngatgcccagaactggtagctgagttaaaaagcaga

SEQ ID NO: 36162 - DNA, 71 bp, chicken (Gallus Gallus)
  misc_feature (36): n=a or g
ctcgctcattgcctatgaggcgtatggcttcacccngacaccgcagggcaaggtgagaccccgagggcatg

SEQ ID NO: 36163 - DNA, 71 bp, chicken (Gallus Gallus)
  misc_feature (36): n=c or t
cccggagttagacaccccccagtttattaccttagnagaccaggaacctgatggttatactgctgcctgtc

SEQ ID NO: 36164 - DNA, 71 bp, chicken (Gallus Gallus)
  misc_feature (36): n=a or g
tatggcaccaggaggacccatgtacggtacagggancacccatgtatagcactgggcgcacacatatacgg

SEQ ID NO: 36165 - DNA, 71 bp, chicken (Gallus Gallus)
  misc_feature (36): n=c or t
ggacagtttcgactgtttaggaagaactgtttttcntaatgccatccacagatggaaggtttcagctgaga

SEQ ID NO: 36166 - DNA, 71 bp, chicken (Gallus Gallus)
  misc_feature (36): n=a or g
tggaggttatagcagaacaagaacaaagttgagacnaggcttaagggttgcttaggatttgagtaacctct

SEQ ID NO: 36167 - DNA, 71 bp, chicken (Gallus Gallus)
  misc_feature (36): n=c or t
acaggatctgaaagccgtcgctctctttatagctcntcacggagttgctggctgttcgggtttaaattccc

SEQ ID NO: 36168 - DNA, 71 bp, chicken (Gallus Gallus)
  misc_feature (36): n=c or t
gagggctttcgctggagaggtgcttccctgtctgangtgcctgcagtcgctggctctgtgctgctggtgtc

SEQ ID NO: 36169 - DNA, 71 bp, chicken (Gallus Gallus)
  misc_feature (36): n=a or g
ctttggaataagatgtgcaactcctatttctgtgtntctttctggttataggactagaacctctacctgca

SEQ ID NO: 36170 - DNA, 71 bp, chicken (Gallus Gallus)
  misc_feature (36): n=c or t
caaacagccttaaaagctgcttaagaataattccangatcaaaggaagcaactgaagtgtatatggctcat

SEQ ID NO: 36171 - DNA, 71 bp, chicken (Gallus Gallus)
  misc_feature (36): n=c or t
tggagttttactgtgttctctgtagctgatgaggcngatcactcctgtgtactgctccagctggagtgtgg

SEQ ID NO: 36172 - DNA, 71 bp, chicken (Gallus Gallus)
  misc_feature (36): n=a or g
aaggaagatgagctgtgccaaaaggtctcagtgtanagtccttttcaagatgaccccagatggggtgttgg

SEQ ID NO: 36173 - DNA, 71 bp, chicken (Gallus Gallus)
  misc_feature (36): n=a or g
gaccgcctccgtcaagaagtgcgcagcatgtctcanaagaggagagctgcagaggatgctatctatgacct

SEQ ID NO: 36174 - DNA, 71 bp, chicken (Gallus Gallus)
  misc_feature (36): n=a or g
gtacgataccaccactgacaccaagtacaacatcangactgctgttactaagaagctgcttgatcccatga

SEQ ID NO: 36175 - DNA, 71 bp, chicken (Gallus Gallus)
  misc_feature (36): n=g or t
tacccttctggacttctcaggagaaataaggccttnggacagggctagccccttgctaagtgcactgaaac

SEQ ID NO: 36176 - DNA, 71 bp, chicken (Gallus Gallus)
  misc_feature (36): n=c or t
tgcagtcagccacactcggagcaaaggtaattgacngttggtttcataagctgtgctgctcgggcactttt

SEQ ID NO: 36177 - DNA, 71 bp, chicken (Gallus Gallus)
  misc_feature (36): n=a or g
ccaaaagagtaagagttgtttgtcaccttgggactnaccttggatcagagaacatgtggatgacttggttc

SEQ ID NO: 36178 - DNA, 71 bp, chicken (Gallus Gallus)
  misc_feature (36): n=c or t
tacttgtgactgagctgccactaacttccatgtcangttttcaatgtgagggttattctggaatttgattc

SEQ ID NO: 36179 - DNA, 71 bp, chicken (Gallus Gallus)
  misc_feature (36): n=c or t
ttgccagcaatttttctgctggctttgttccaaaantggctatgaatttcagtcagatcagaagtgtcaca

SEQ ID NO: 36180 - DNA, 71 bp, chicken (Gallus Gallus)
  misc_feature (36): n=a or g
tggtttctaattgaggcttaaggagtcagtgcaggnactcggggttacagaagtcaagtgacaagagaagg

SEQ ID NO: 36181 - DNA, 71 bp, chicken (Gallus Gallus)
  misc_feature (36): n=a or g
ccagttttggtagatcagtaaactctgcacactgcncttctgctccaagctgtaacactgtgccttttctc

SEQ ID NO: 36182 - DNA, 71 bp, chicken (Gallus Gallus)
  misc_feature (36): n=a or g
tgccctgccatggctcaggcagcaaacgctgccccnttcacagatgaatacacaaagctgacctcctcttt

SEQ ID NO: 36183 - DNA, 71 bp, chicken (Gallus Gallus)
  misc_feature (36): n=c or t
agagctgcttggaaaggaaaaccagcagaagggaangcttcaaaatcatctctgaggttcaaagatgagaa

SEQ ID NO: 36184 - DNA, 71 bp, chicken (Gallus Gallus)
  misc_feature (36): n=g or t
ggtggacttctgttcagggaacttcagagacctcancagcagcagtctgtgctcgcccgataggtgcacca

SEQ ID NO: 36185 - DNA, 71 bp, chicken (Gallus Gallus)
  misc_feature (36): n=a or g
ccggcctggagaggaggatggaagaagaacgcaggnggaaagcacaaagggaggaccgtggggaggatgaa

SEQ ID NO: 36186 - DNA, 71 bp, chicken (Gallus Gallus)
  misc_feature (36): n=c or t
gtaacatgacaaaacttcatggcacccatctgccanggatgtactgcttatctgcctgttttctgtaacca

SEQ ID NO: 36187 - DNA, 71 bp, chicken (Gallus Gallus)
  misc_feature (36): n=c or t
atgcacacaggtacagatgtcagtattacaacaaanaatccatctacattcatagatgtagaatgagcttc

SEQ ID NO: 36188 - DNA, 71 bp, chicken (Gallus Gallus)
  misc_feature (36): n=c or t
aatagaatgtctattcaatgctgaagaagaaattgnaacagcaaatgtaactccttagatattatttacac

SEQ ID NO: 36189 - DNA, 71 bp, chicken (Gallus Gallus)
  misc_feature (36): n=a or g
tgactgttcagattctcactctgacaagcactaacntgctaactcagaacaggctatttcagtacagcaaa

SEQ ID NO: 36190 - DNA, 71 bp, chicken (Gallus Gallus)
  misc_feature (36): n=c or t
caaataggaagagagacaaatttctgctctgcttantgaggaagcagatggccagaacagagagggtcaca

SEQ ID NO: 36191 - DNA, 71 bp, chicken (Gallus Gallus)
  misc_feature (36): n=a or g
ctgaaaaacagttcactgtcttgatcctctgctgcnaacactacacagagcggagttccccacacccagca

SEQ ID NO: 36192 - DNA, 71 bp, chicken (Gallus Gallus)
  misc_feature (36): n=c or t
ttcagaccttattagtcacattttggagtggaaccngtcaagaagattttcccccctctgctctgattcct

SEQ ID NO: 36193 - DNA, 71 bp, chicken (Gallus Gallus)
  misc_feature (36): n=a or c
cactgtaactataaatcttttacttggtttaagaangttttttgtatcattttgctaaaattatgggctta

SEQ ID NO: 36194 - DNA, 71 bp, chicken (Gallus Gallus)
  misc_feature (36): n=a or g
ggcatagcaggaaagctgccggagtctgagaacttncaagagttttgggagaacctgctcaatggggttga

SEQ ID NO: 36195 - DNA, 71 bp, chicken (Gallus Gallus)
  misc_feature (36): n=c or t
tgatacccttctgttacaccagcatccttgcacttnttaaagagccctgggaactcagtagtgttcgtgaa

SEQ ID NO: 36196 - DNA, 71 bp, chicken (Gallus Gallus)
  misc_feature (36): n=a or g
gagatggctgaggagtatctggagatagtgcagaantacccctgtccattgtcttatgtcagggctcatct

SEQ ID NO: 36197 - DNA, 71 bp, chicken (Gallus Gallus)
  misc_feature (36): n=c or t
gacccatttgtagctacagggaatgatctactccantttccagtgtgttcacttcctttctgtttctcttt

SEQ ID NO: 36198 - DNA, 71 bp, chicken (Gallus Gallus)
  misc_feature (36): n=a or g
ggattccctacaggaaatctagagagccaaccctgntaagaatctaaccatgttccgaggtaactattttt

SEQ ID NO: 36199 - DNA, 71 bp, chicken (Gallus Gallus)
  misc_feature (36): n=a or c
cagactcttgccaaaagccagaaggcctcacactgnccaagtcagtcagcttcagtgagcagaatgccaga

SEQ ID NO: 36200 - DNA, 71 bp, chicken (Gallus Gallus)
  misc_feature (36): n=a or c
caaagcttctgcaatttgatttcagaattacgtggnagtctgaatccgatcaaagagctgcatgaggtatc

SEQ ID NO: 36201 - DNA, 71 bp, chicken (Gallus Gallus)
  misc_feature (36): n=g or t
aaatggtgatgatcatcatttaggaggagagaagcnaggatgcagtggaacacacatcttcaccaaacagt

SEQ ID NO: 36202 - DNA, 71 bp, chicken (Gallus Gallus)
  misc_feature (36): n=a or g
ttcatttgatatggatattttcactgtttcttggcntaagcatttccatcagtaacgcatccctaaggata

SEQ ID NO: 36203 - DNA, 71 bp, chicken (Gallus Gallus)
  misc_feature (36): n=a or g
acacagcccccaacttaaaggatgtgccacagtacngagcagcactcagcaatgaaccatggaatcacggg

SEQ ID NO: 36204 - DNA, 71 bp, chicken (Gallus Gallus)
  misc_feature (36): n=c or t
aagaaaacctcaagttcacaggcaaaagtgtctctncattttgctcccttctggttttagcactgaagaag

SEQ ID NO: 36205 - DNA, 71 bp, chicken (Gallus Gallus)
  misc_feature (36): n=a or g
gggtttgctttaaaaggaagtgtagtgagttgttgnaggtagtgatgtctattgctttactatatgtttag

SEQ ID NO: 36206 - DNA, 71 bp, chicken (Gallus Gallus)
  misc_feature (36): n=c or t
gtgatgtaagctgtaaatattaatctctgtaatcangtggggaaggggaatgctgaagaacaagaagtttt

SEQ ID NO: 36207 - DNA, 71 bp, chicken (Gallus Gallus)
  misc_feature (36): n=c or t
cagcagaccccgtctgtatcctaggtcactactcanctaaacattgcataaaagtagtgttttcttctaga

SEQ ID NO: 36208 - DNA, 71 bp, chicken (Gallus Gallus)
  misc_feature (36): n=c or t
cctcagcaaccaaaaaaacaacctgtcaggtatggnaaaggtgtaggtgaatagaccattgattgctatgc

SEQ ID NO: 36209 - DNA, 71 bp, chicken (Gallus Gallus)
  misc_feature (36): n=a or g
cactctagaaattcacccatagtattttcctttatngtgatatctgtggtaaatagtaaactaacagtgct

SEQ ID NO: 36210 - DNA, 71 bp, chicken (Gallus Gallus)
  misc_feature (36): n=g or t
tgtgactcagcactgcttttccttgatcaaatacanacatgatgtgtgtatgatgtctgaacatatgccct

SEQ ID NO: 36211 - DNA, 71 bp, chicken (Gallus Gallus)
  misc_feature (36): n=a or g
tcctgcaaggaatcagagcatttacagtacagcacncagacactgcaggctcattagtcattgctttgtgg

SEQ ID NO: 36212 - DNA, 71 bp, chicken (Gallus Gallus)
  misc_feature (36): n=a or g
gaactaacatgtagtacttctgtttagcaaatggtntccagtgagctttatccagatttcccacacaagta

SEQ ID NO: 36213 - DNA, 71 bp, chicken (Gallus Gallus)
  misc_feature (36): n=c or t
aacatgccttcctgcaagccctgctgtctggttacntcagcagtgcttttcccctggtggactacactttt

SEQ ID NO: 36214 - DNA, 71 bp, chicken (Gallus Gallus)
  misc_feature (36): n=c or t
ctaacatttacctttggaagaagtgatggccttatngaataaaaggagatgtggctggcttgcagcttgca

SEQ ID NO: 36215 - DNA, 71 bp, chicken (Gallus Gallus)
  misc_feature (36): n=c or t
ccactgatgataagttttattttttggcatgacagntataagcattatgtgaaagtggagggaaaaattat

SEQ ID NO: 36216 - DNA, 71 bp, chicken (Gallus Gallus)
  misc_feature (36): n=c or t
ttattttctgtatttacatcataagttagaaggcantgtaccatgaactggtatgaaatagcccattgatt

SEQ ID NO: 36217 - DNA, 71 bp, chicken (Gallus Gallus)
  misc_feature (36): n=c or t
aatgagatacacattttaaaaactccagatgatgtntataggactgggctgttaagacagatacagttttt

SEQ ID NO: 36218 - DNA, 71 bp, chicken (Gallus Gallus)
  misc_feature (36): n=a or g
atgattcctgccaactctctttccaaaagatgtgcntaattttgcttctgtgtgcacctacccgaatcttg

SEQ ID NO: 36219 - DNA, 71 bp, chicken (Gallus Gallus)
  misc_feature (36): n=a or g
tgcttatcttccccagggtgtctgctcctggtcacngtccatagcagaagatgaagtctaggtgagacagt

SEQ ID NO: 36220 - DNA, 71 bp, chicken (Gallus Gallus)
  misc_feature (36): n=a or g
gcttttgagcagcatactatgagatcctagttatcntcagtgtctctgatttgggcataaactagcaagac

SEQ ID NO: 36221 - DNA, 71 bp, chicken (Gallus Gallus)
  misc_feature (36): n=a or g
gacagaaatacaaccattttcaggctgattgtaccntactgaatgatacagtaggtgcctactggatcttc

SEQ ID NO: 36222 - DNA, 71 bp, chicken (Gallus Gallus)
  misc_feature (36): n=a or g
gtaggattatcagtaccaccatgttaagcaacttcngactttgtgtaactcagtaaggtcatggaattagt

SEQ ID NO: 36223 - DNA, 71 bp, chicken (Gallus Gallus)
  misc_feature (36): n=c or t
actgagatgtcattattttctttctttcaatccttnttctggctgtcctacaaagaatagaaaaagaaaaa

SEQ ID NO: 36224 - DNA, 71 bp, chicken (Gallus Gallus)
  misc_feature (36): n=c or t
aatcctgctcttttaggtgacatcttgaacttcctntcctttcagagaggaaagagggagagagaaaaaag

SEQ ID NO: 36225 - DNA, 71 bp, chicken (Gallus Gallus)
  misc_feature (36): n=a or g
catgcataatagattgaatataggttggtttataancagcaagcccagggcttcttggtaaatgcatcttt

SEQ ID NO: 36226 - DNA, 71 bp, chicken (Gallus Gallus)
  misc_feature (36): n=a or g
gagaagtgaagctgaggaggaatggtcaggctgtanatgcgtctatttctcttaataagagagctgtacgt

SEQ ID NO: 36227 - DNA, 71 bp, chicken (Gallus Gallus)
  misc_feature (36): n=c or t
tttatcctgctatgatgagatggtagctttgcagcnttctcctgcaggccagatgttgttcccagctgggc

SEQ ID NO: 36228 - DNA, 71 bp, chicken (Gallus Gallus)
  misc_feature (36): n=c or t
tggtgccctccttgtcccaccccaatgtcctctgancagtccctgctgcagaaatcgtcttattcaatggg

SEQ ID NO: 36229 - DNA, 71 bp, chicken (Gallus Gallus)
  misc_feature (36): n=c or t
tttgttgagattaacaaggaacttattctttgttcnacttctgtgataaacatccatttctttcatattga

SEQ ID NO: 36230 - DNA, 71 bp, chicken (Gallus Gallus)
  misc_feature (36): n=a or g
tccagctctgcaatgaaatgcagtttacctgcaaantacagcccatgatgtctgagaactgaatcaataca

SEQ ID NO: 36231 - DNA, 71 bp, chicken (Gallus Gallus)
  misc_feature (36): n=c or t
aactgctttcctttttgactgtgtgtggttagtaanagctggacagaaacagccatgcagtccttttcagg

SEQ ID NO: 36232 - DNA, 71 bp, chicken (Gallus Gallus)
  misc_feature (36): n=c or t
tctctgagcaatctcatatgcaatccttcataaaanagtctatattttccacaatagctacagattactgt

SEQ ID NO: 36233 - DNA, 71 bp, chicken (Gallus Gallus)
  misc_feature (36): n=g or t
gcatggacacagcagcctccatcacattgttaatangaatcagaatcacaagcatttctctagcctggcac

SEQ ID NO: 36234 - DNA, 71 bp, chicken (Gallus Gallus)
  misc_feature (36): n=c or t
gaatgtgggagagctttccctgcctttcaggaacangaggatctgaggggtctgactgcagaatcagatga

SEQ ID NO: 36235 - DNA, 71 bp, chicken (Gallus Gallus)
  misc_feature (36): n=a or g
atttgatttaggtggggatgggagaaattcctgacntgttcagtcaggaggagcagctcctgggtgcctac

SEQ ID NO: 36236 - DNA, 71 bp, chicken (Gallus Gallus)
  misc_feature (36): n=a or g
gcaagatcaccaacctttaatctaagaatggagccngttataattaagtggagatctgatgggagatgttg

SEQ ID NO: 36237 - DNA, 71 bp, chicken (Gallus Gallus)
  misc_feature (36): n=a or g
cgcttttagctcttctgagaggtcatattgacatcntattatgcagggtggacttagtgtagacagtgatt

SEQ ID NO: 36238 - DNA, 71 bp, chicken (Gallus Gallus)
  misc_feature (36): n=a or g
ggctgaagtatgtactaccattaccgtaaaataacncagtgctctgtcttgctttaagaagggtagtgatg

SEQ ID NO: 36239 - DNA, 71 bp, chicken (Gallus Gallus)
  misc_feature (36): n=g or t
ttgaggaagcactgtgaatgcttttataagtcgtcntcttttaaactaatggagtgaataccactggtact

SEQ ID NO: 36240 - DNA, 71 bp, chicken (Gallus Gallus)
  misc_feature (36): n=a or g
agcaagttactgctgaacttctcagaatggtcatcntggagatgaggttcccactgtaattgtaagaaaca

SEQ ID NO: 36241 - DNA, 71 bp, chicken (Gallus Gallus)
  misc_feature (36): n=a or g
cctctgtaggtaccggagcacatcagcattctcagntgctggtgcccggataggactgcacttatctgtgg

SEQ ID NO: 36242 - DNA, 71 bp, chicken (Gallus Gallus)
  misc_feature (36): n=c or t
agtactttctgtttaccagaataggatcagctgttntggcactaatggggaagaaccagcatcaaagctcc

SEQ ID NO: 36243 - DNA, 71 bp, chicken (Gallus Gallus)
  misc_feature (36): n=a or g
tgactttttcaagagtaatatacttttgactttgcntaaagatcaatggagtgttaaattgagggtgatta

SEQ ID NO: 36244 - DNA, 71 bp, chicken (Gallus Gallus)
  misc_feature (36): n=g or t
catggtgctgaattgtgtctggcttggtttttaatnctcttctcctccacctcctatgctaagaacataaa

SEQ ID NO: 36245 - DNA, 71 bp, chicken (Gallus Gallus)
  misc_feature (36): n=a or c
ttgccaagagctgtccaggtagagagaagttcattntttcatacgtcactgaaagtgatgcaattgtttaa

SEQ ID NO: 36246 - DNA, 71 bp, chicken (Gallus Gallus)
  misc_feature (36): n=a or g
ttcctaataattcgagcttttttgtggcccgtttcnatgttgatattgtagaattttgttctctctctgat

SEQ ID NO: 36247 - DNA, 71 bp, chicken (Gallus Gallus)
  misc_feature (36): n=a or g
gccatcagattaagcacctaccctttctctcagacngttttaaggttaaaatcacacggagtatttcagag

SEQ ID NO: 36248 - DNA, 71 bp, chicken (Gallus Gallus)
  misc_feature (36): n=a or g
gcagcagcaattcattctgacctttctccttactcngagatggacttcttcaccagtagccttccatgtga

SEQ ID NO: 36249 - DNA, 71 bp, chicken (Gallus Gallus)
  misc_feature (36): n=a or g
tgaaagataaataagaagacctcaccacaaatacanagaactgttatcttgagggctttgggaattaaagc

SEQ ID NO: 36250 - DNA, 71 bp, chicken (Gallus Gallus)
  misc_feature (36): n=c or t
acctgaaggcaaggaggtagctcggtgcatgccatntgtgcagggctggcaagttctgtgttcccttaata

SEQ ID NO: 36251 - DNA, 71 bp, chicken (Gallus Gallus)
  misc_feature (36): n=c or t
gccttgatagtatacttacttggaacttcaatttcnagtgatatttccttacctggtggcaaagatgttat

SEQ ID NO: 36252 - DNA, 71 bp, chicken (Gallus Gallus)
  misc_feature (36): n=c or t
acatttaggcactgttagggtattccttgtcatganatcacatgttcttacttcctagtctattatcaagt

SEQ ID NO: 36253 - DNA, 71 bp, chicken (Gallus Gallus)
  misc_feature (36): n=a or g
atttaggtcgatgaactctgagggggatttttttcngtgagtttgtgcatgtggcacaagatcgtgcattt

SEQ ID NO: 36254 - DNA, 71 bp, chicken (Gallus Gallus)
  misc_feature (36): n=a or g
atgagtcagaggagtggcacagcagtgacccaggtntgtacactggctgatcacaaaatgatttggtcccg

SEQ ID NO: 36255 - DNA, 71 bp, chicken (Gallus Gallus)
  misc_feature (36): n=a or g
gttcaaagaatttccaccaagtgccttcccttttanaggtcttggctttgctggaggtggtgtccagcttc

SEQ ID NO: 36256 - DNA, 71 bp, chicken (Gallus Gallus)
  misc_feature (36): n=c or t
tgtaatgtgactaagtttctcctatttcccaaatgnactgtgtctgtacctgccttatccctcagccgcat

SEQ ID NO: 36257 - DNA, 71 bp, chicken (Gallus Gallus)
  misc_feature (36): n=a or c
acattcccatacagcatccgagctctcattcactantgatggttgtcaggctcattctgtagaagtcacct

SEQ ID NO: 36258 - DNA, 71 bp, chicken (Gallus Gallus)
  misc_feature (36): n=c or t
ttatccgtgtcagtccaatacttgcttctcactgcntcccaaacctgcctgatttgaaagcaatctttgac

SEQ ID NO: 36259 - DNA, 71 bp, chicken (Gallus Gallus)
  misc_feature (36): n=c or t
ggtttacaaagacaattgtctgcctgtaaaatggantcataagaaatacacatttctgaggtggggataag

SEQ ID NO: 36260 - DNA, 71 bp, chicken (Gallus Gallus)
  misc_feature (36): n=c or t
ccagcttgagtcaaagggtggcttttattttcaganagatataagttactaaatgggatttataaaaaata

SEQ ID NO: 36261 - DNA, 71 bp, chicken (Gallus Gallus)
  misc_feature (36): n=a or g
aatagatctctgcatctatctagcttctctggtaancattacctcttcagataatccactagttcaagtgc

SEQ ID NO: 36262 - DNA, 71 bp, chicken (Gallus Gallus)
  misc_feature (36): n=a or g
cttccttgagaacgtaaagaggttcattgtatttcnatgttcttaataaataccacaagattaaaaactgg

SEQ ID NO: 36263 - DNA, 71 bp, chicken (Gallus Gallus)
  misc_feature (36): n=a or g
gggctttccatccatagcaagatccattactttggntggcaatgattggaccttagttttgtttttgaaat

SEQ ID NO: 36264 - DNA, 71 bp, chicken (Gallus Gallus)
  misc_feature (36): n=a or g
aagcctgctttaaacaaggctgcagaatataaagcngactcagcatgagagggactgcactgaaattaagg

SEQ ID NO: 36265 - DNA, 71 bp, chicken (Gallus Gallus)
  misc_feature (36): n=a or g
gtcagggctgtgtgaaggagaccacgaaaacgttcncaagcatgacaagaaacgacaacttgtcctgagct

SEQ ID NO: 36266 - DNA, 71 bp, chicken (Gallus Gallus)
  misc_feature (36): n=a or g
cagccattgagctttctagggaaaaagagacttggnaaacatcaacattacaactacttcagcaggcatca

SEQ ID NO: 36267 - DNA, 71 bp, chicken (Gallus Gallus)
  misc_feature (36): n=c or t
acctgattgcctgtggggactgaactttctgcaagnatctgaagctgggagtaagctctgcctctgacttc

SEQ ID NO: 36268 - DNA, 71 bp, chicken (Gallus Gallus)
  misc_feature (36): n=a or c
tatatatatatatatgttatcttaatggtatcatcntgggtgtgatgtcattgttatggttggagaactaa

SEQ ID NO: 36269 - DNA, 71 bp, chicken (Gallus Gallus)
  misc_feature (36): n=a or g
gaccaagcaagaaactccaatggttaaaaggaaagngatgaatacgttcacttgaagcaactgttggaatg

SEQ ID NO: 36270 - DNA, 71 bp, chicken (Gallus Gallus)
  misc_feature (36): n=a or g
taggaaaatatttacctgcgatagcacaaatgtcanactcaagtggaccaatagctatttcaagtcagcag

SEQ ID NO: 36271 - DNA, 71 bp, chicken (Gallus Gallus)
  misc_feature (36): n=c or t
tttcctcaagtctagaaatccctcacctcgctgcanacatcatacattgcctttctcttgcattctctgtc

SEQ ID NO: 36272 - DNA, 71 bp, chicken (Gallus Gallus)
  misc_feature (36): n=c or t
gccacaaatgtcccttacaagaatccatgttatctnttctaaagcatctaagtggtaagataagatataaa

SEQ ID NO: 36273 - DNA, 71 bp, chicken (Gallus Gallus)
  misc_feature (36): n=a or g
ctccttcccctgtaacttttgataaagatggagtgnagctcagaaaggttttaactcataaactatatagg

SEQ ID NO: 36274 - DNA, 71 bp, chicken (Gallus Gallus)
  misc_feature (36): n=a or g
gcactgagaaagtctcagaagtgctgtgtagttgcnccgttacgaatgctgttgttgtttatgatctgcag

SEQ ID NO: 36275 - DNA, 71 bp, chicken (Gallus Gallus)
  misc_feature (36): n=a or g
ctgtttgtgtattttgagtcaaatgggagaagatgnaactgccaaacctcaagcccttaattgaaaccaac

SEQ ID NO: 36276 - DNA, 71 bp, chicken (Gallus Gallus)
  misc_feature (36): n=c or t
tctgttctgcacagagggaggcttcgctggggcttntgtggttattctctgttttaggagacagtgttggt

SEQ ID NO: 36277 - DNA, 71 bp, chicken (Gallus Gallus)
  misc_feature (36): n=a or c
catggttatacattttagtatttgtgccttttactnctctgttgtgagaatgcattgtattgtcacatttc

SEQ ID NO: 36278 - DNA, 71 bp, chicken (Gallus Gallus)
  misc_feature (36): n=a or g
cttggccatgcctgctagtgctgccattcattaacnttaccttaactgtatgacatcccatctcaccaagg

SEQ ID NO: 36279 - DNA, 71 bp, chicken (Gallus Gallus)
  misc_feature (36): n=a or g
gcaagaagcagcgaggaaggagcttaatcacgaccnagcttgcccagttcactttaatttgcctttgacca

SEQ ID NO: 36280 - DNA, 71 bp, chicken (Gallus Gallus)
  misc_feature (36): n=c or t
cattatttatcagaaacaatgatttcttgaactaantggtggaagctataaatcaagtccttttagtattt

SEQ ID NO: 36281 - DNA, 71 bp, chicken (Gallus Gallus)
  misc_feature (36): n=c or t
tctctctcaccaagttttggccgagcttttaattcnaggtagggaggtcttcgaaagccataccttgaaac

SEQ ID NO: 36282 - DNA, 71 bp, chicken (Gallus Gallus)
  misc_feature (36): n=c or t
gtagggctgctatctgcactgaggactggactaccngaagggctcttcttttcctgtggaacacattttgc

SEQ ID NO: 36283 - DNA, 71 bp, chicken (Gallus Gallus)
  misc_feature (36): n=a or g
tcagtaaagagtacttttaagcgttttcacatttanaaaatgattactgttagaagtgggaactgaagagc

SEQ ID NO: 36284 - DNA, 71 bp, chicken (Gallus Gallus)
  misc_feature (36): n=g or t
ctcctcctccggttgcggcgctttgccggcgggggnaccgagcgcggtgccgttaccgccaccgctgggga

SEQ ID NO: 36285 - DNA, 71 bp, chicken (Gallus Gallus)
  misc_feature (36): n=c or t
acaatagaaaaatccaaagtacagtggcctattcgntttcagaaatgtctacgttagggaaatactcttca

SEQ ID NO: 36286 - DNA, 71 bp, chicken (Gallus Gallus)
  misc_feature (36): n=a or c
gcacctgtgtgtagaagaacctttgtgtagcttgcncagaccaacagcttctgtgttaaaaaagaccaaag

SEQ ID NO: 36287 - DNA, 71 bp, chicken (Gallus Gallus)
  misc_feature (36): n=g or t
cactgtcccagcagctagtggtaagctgaatcaatntgccaaaaagactgcaaagatggtacaactgactt

SEQ ID NO: 36288 - DNA, 71 bp, chicken (Gallus Gallus)
  misc_feature (36): n=g or t
tacacagtaactatgagcttagatgcactggtgttnggagaggaaaatgtgatggagcactctgggctcat

SEQ ID NO: 36289 - DNA, 71 bp, chicken (Gallus Gallus)
  misc_feature (36): n=a or g
cctaacaggtaaagcaacgcaaaagaacaacagccntgaaacagaagaggtagaaaaaggaaatggctcaa

SEQ ID NO: 36290 - DNA, 71 bp, chicken (Gallus Gallus)
  misc_feature (36): n=g or t
gctcaagaggctcaaagtcccataacctgatttttnttcttagacaaatcttctaacacagagtggtaatt

SEQ ID NO: 36291 - DNA, 71 bp, chicken (Gallus Gallus)
  misc_feature (36): n=a or g
tgtcagagcaatttgtgaatgcttgtccttcaaatnctcatccctcctgctaagattaaatatcaatagct

SEQ ID NO: 36292 - DNA, 71 bp, chicken (Gallus Gallus)
  misc_feature (36): n=c or t
acatttaatatatttgggtaatattactctatcttnggttggcgtttattataagcacccctctcctccac

SEQ ID NO: 36293 - DNA, 71 bp, chicken (Gallus Gallus)
  misc_feature (36): n=c or t
catttcttctccatttaagcttcattttcagattgnttggcagaaaacgtgtctgagggcaattacagatg

SEQ ID NO: 36294 - DNA, 71 bp, chicken (Gallus Gallus)
  misc_feature (36): n=c or t
ttcaaaactgacatgctgataccaaaaacttaaaanaccattctgaaacgacagcagtttctccctaagaa

SEQ ID NO: 36295 - DNA, 71 bp, chicken (Gallus Gallus)
  misc_feature (36): n=c or t
tttctaagaaggatgttacccactgagctattcatngtagttaaatgaggaaaggggttaataaaatacat

SEQ ID NO: 36296 - DNA, 71 bp, chicken (Gallus Gallus)
  misc_feature (36): n=c or t
tgggattatccaaaggattatgggagaattaggcanccaaagccaattgatttttttcaccgggatttagc

SEQ ID NO: 36297 - DNA, 71 bp, chicken (Gallus Gallus)
  misc_feature (36): n=a or c
attgattcctttggggacatgaacagagatttagcnagcaggccttgacatcagagcaaaagactcacgca

SEQ ID NO: 36298 - DNA, 71 bp, chicken (Gallus Gallus)
  misc_feature (36): n=c or t
ctgcatgctagctgttcagcagaaaggtattgaagnatctgaagagcagtggccttgtattgccagctggc

SEQ ID NO: 36299 - DNA, 71 bp, chicken (Gallus Gallus)
  misc_feature (36): n=a or g
gactatacgtattcaaaaaagctcatagagacattngtttccatggtgtgattggctcttattcatacctt

SEQ ID NO: 36300 - DNA, 71 bp, chicken (Gallus Gallus)
  misc_feature (36): n=g or t
gtgacgtttgtggcatgacaccagccctgagtaatnaatggccagcaactcacatcaggctgttaaatcag

SEQ ID NO: 36301 - DNA, 71 bp, chicken (Gallus Gallus)
  misc_feature (36): n=c or t
ttggctggatattgagagaagaggaggaggtcctgnctgaccttccaaggaagacgggtttctcaccagac

SEQ ID NO: 36302 - DNA, 71 bp, chicken (Gallus Gallus)
  misc_feature (36): n=a or g
gggctgaggctatcttctgaggtcccagctagctgnggatgcgcaaggacataggtggtgctatttttagt

SEQ ID NO: 36303 - DNA, 71 bp, chicken (Gallus Gallus)
  misc_feature (36): n=g or t
tattttcatattcatattcaaacacagcccgaagtntgggcctgccccaggtttccttggaagctgaagtt

SEQ ID NO: 36304 - DNA, 71 bp, chicken (Gallus Gallus)
  misc_feature (36): n=a or g
tcacagcctttcatctgggagcatcttcatggctgnacgtgcaccagcatccaggctagcagtgaagggaa

SEQ ID NO: 36305 - DNA, 71 bp, chicken (Gallus Gallus)
  misc_feature (36): n=a or g
tcgtaaagtgcgatctctccgctggttgcactgccnggataagccaagtaggagttggcgtggttgattga

SEQ ID NO: 36306 - DNA, 71 bp, chicken (Gallus Gallus)
  misc_feature (36): n=c or t
acgccattagttttgcagcttgactgatgcaaccangttggtcaatcttcctttcagctagttgccttcaa

SEQ ID NO: 36307 - DNA, 71 bp, chicken (Gallus Gallus)
  misc_feature (36): n=a or g
ttccttggtgaatgctgcaatgctttatgctcacangataatattgagtcaatatctccgtggggtttata

SEQ ID NO: 36308 - DNA, 71 bp, chicken (Gallus Gallus)
  misc_feature (36): n=c or t
gcctttccatcgttcttggaaatgtggctgatctantgcataccagtagatgttctctttcacaggactaa

SEQ ID NO: 36309 - DNA, 71 bp, chicken (Gallus Gallus)
  misc_feature (36): n=a or g
aattgatcagcaacatagtacatactagaaaaactnctgcttgctaaggaaggttacatagttaactgaga

SEQ ID NO: 36310 - DNA, 71 bp, chicken (Gallus Gallus)
  misc_feature (36): n=a or g
ccaaggcttacgcagagcaggtacagcaaggaaatnggttagggatctcctaaagagaaaccacggggagg

SEQ ID NO: 36311 - DNA, 71 bp, chicken (Gallus Gallus)
  misc_feature (36): n=c or t
gattccctttgactttaatggtctttgcataagtanctaattccttcctgttcacagactctcttggatct

SEQ ID NO: 36312 - DNA, 71 bp, chicken (Gallus Gallus)
  misc_feature (36): n=g or t
gatctaaagcgtttaaagctttacgtgcttacttcnggcttcacaagagacagagatgagaggggcaatag

SEQ ID NO: 36313 - DNA, 71 bp, chicken (Gallus Gallus)
  misc_feature (36): n=a or g
ggcttcataaagaaaaacgatgagcggcgcagtccnaactcccctgagtaataaagggaaaaagaaaactt

SEQ ID NO: 36314 - DNA, 71 bp, chicken (Gallus Gallus)
  misc_feature (36): n=a or g
cctcttgcaaccaaaatatacaggcagatagggcgnaatggcagccctctgctttatgtattgacacaaat

SEQ ID NO: 36315 - DNA, 71 bp, chicken (Gallus Gallus)
  misc_feature (36): n=a or g
ggaaaacactcctttagacttgctttctgtggagtngatgcacagagtgagcacagtcctgaggaactgag

SEQ ID NO: 36316 - DNA, 71 bp, chicken (Gallus Gallus)
  misc_feature (36): n=g or t
caaaaaacaactgacctgatcttgattactggtatnattgagaaagttcactgggaaatgaaagcaatcac

SEQ ID NO: 36317 - DNA, 71 bp, chicken (Gallus Gallus)
  misc_feature (36): n=c or t
aagattgcacgaggctaatgccatcccgcaggtccncagtgagagaccaccctgggccatccttgtgctct

SEQ ID NO: 36318 - DNA, 71 bp, chicken (Gallus Gallus)
  misc_feature (36): n=a or g
aggagctggtgtcattcatctcatgaacaaaaggtnctcaactctggtttggttgaatggcacagtaacct

SEQ ID NO: 36319 - DNA, 71 bp, chicken (Gallus Gallus)
  misc_feature (36): n=a or c
agtttgctcgctgctgcatccttccagcctccagcncaggctctgcaagcatctctacaaaaccacatgct

SEQ ID NO: 36320 - DNA, 71 bp, chicken (Gallus Gallus)
  misc_feature (36): n=a or g
aaaaaaaatcccttccagactctgaaatccactganttttaaaggagaaagagtgtgaagaccatgcctcc

SEQ ID NO: 36321 - DNA, 71 bp, chicken (Gallus Gallus)
  misc_feature (36): n=c or t
aatgtgctagctgatatttaggcccaagaaagcccngagaaggcagctaatcacagctatccagcagtggt

SEQ ID NO: 36322 - DNA, 71 bp, chicken (Gallus Gallus)
  misc_feature (36): n=a or g
tcaatccttttgatcgattacaggaaagtagaaacntggaggatgtttcaacaccagccatcaacttcatg

SEQ ID NO: 36323 - DNA, 71 bp, chicken (Gallus Gallus)
  misc_feature (36): n=a or c
catttctcctggtatttcagtgtttccactgcttgntcttggctacgaccaagcagtgcatacagtgtgaa

SEQ ID NO: 36324 - DNA, 71 bp, chicken (Gallus Gallus)
  misc_feature (36): n=c or t
gcataagcattacattggtacggttacactcagttngggagataagaggtacaactcagcgtatcagaagt

SEQ ID NO: 36325 - DNA, 71 bp, chicken (Gallus Gallus)
  misc_feature (36): n=a or g
ataatatccaggatttgcttgcagctgtctcagccngttgatacatgggagggcttcattatgttgttatt

SEQ ID NO: 36326 - DNA, 71 bp, chicken (Gallus Gallus)
  misc_feature (36): n=a or g
ggctggaggaagaggcctgggccatggagcacagtntgttccactgcacaactcaggcacgggcacacaga

SEQ ID NO: 36327 - DNA, 71 bp, chicken (Gallus Gallus)
  misc_feature (36): n=a or g
ggaaaaatatttgacacgggatttgtaaagtgcacntgttcatcccagttttaccctacaagagaccaata

SEQ ID NO: 36328 - DNA, 71 bp, chicken (Gallus Gallus)
  misc_feature (36): n=c or t
gctttattttggtagtccctctcctgaaagagatgntactgaagttctctactttttttaactttcctgaa

SEQ ID NO: 36329 - DNA, 71 bp, chicken (Gallus Gallus)
  misc_feature (36): n=c or t
tttccatccaacacaaatgctaggttcaaaatgctntgtgccatgtacaaagcagcttgagaaacgtagta

SEQ ID NO: 36330 - DNA, 71 bp, chicken (Gallus Gallus)
  misc_feature (36): n=a or g
ctattctaactccactcaatcattccacagtagganaataaattacaacaatgacaatatgaatagacagc

SEQ ID NO: 36331 - DNA, 71 bp, chicken (Gallus Gallus)
  misc_feature (36): n=a or g
ctgccatcatcagtacatgtgctgctgacagcctcntctgaagaatatgcaagaggacaaacccagtgcct

SEQ ID NO: 36332 - DNA, 71 bp, chicken (Gallus Gallus)
  misc_feature (36): n=c or t
atgcatctggtatcatagttcccctcaccgtatagntgagggtcattgatttgcagatgaagacagaccaa

SEQ ID NO: 36333 - DNA, 71 bp, chicken (Gallus Gallus)
  misc_feature (36): n=c or t
ctccatccgtcagcgtgcagcacagctgttgctgtncagatgggacatggggttggtttcacacttgggaa

SEQ ID NO: 36334 - DNA, 71 bp, chicken (Gallus Gallus)
  misc_feature (36): n=c or t
attcagcactgaaaaggattgtctgtacacacacanactgcaagagaacacttaggctgttatgagttgtc

SEQ ID NO: 36335 - DNA, 71 bp, chicken (Gallus Gallus)
  misc_feature (36): n=a or g
ttgcttcatttaaagcccaacagccattaaaatgcngccgtacattctgagggcacttacacccggcagca

SEQ ID NO: 36336 - DNA, 71 bp, chicken (Gallus Gallus)
  misc_feature (36): n=a or c
gtatggaaaccatggcattcccatagctcgctgtgntaaggaaacatccccagctagagattacagtggta

SEQ ID NO: 36337 - DNA, 71 bp, chicken (Gallus Gallus)
  misc_feature (36): n=a or g
tccattatggtcaggtctgaatgatgtcacctcgtncacaaaaacagtgattttctttttgccttttatct

SEQ ID NO: 36338 - DNA, 71 bp, chicken (Gallus Gallus)
  misc_feature (36): n=a or g
ccaactccatagaacacaggcagagtagtgatatcncagtcagtgagcattgccggagaacttcaacttcc

SEQ ID NO: 36339 - DNA, 71 bp, chicken (Gallus Gallus)
  misc_feature (36): n=a or g
tagatcataaaatcctctctcaattccaccattaantgtgatgatcgttgggtgagatattgggcctcatc

SEQ ID NO: 36340 - DNA, 71 bp, chicken (Gallus Gallus)
  misc_feature (36): n=c or t
gccattatgtcacatctacattttctgataggaacntgaggtcgggaggcccgtatgtattttgttttttc

SEQ ID NO: 36341 - DNA, 71 bp, chicken (Gallus Gallus)
  misc_feature (36): n=c or t
tcaaatttgcagcctcagcagcttggacagcaaaanatagctaagaaagaggggatttttctctcctggaa

SEQ ID NO: 36342 - DNA, 71 bp, chicken (Gallus Gallus)
  misc_feature (36): n=a or g
tgaaaagaacaccaactaaaatgtgatatatgaacnaattacagatgattaaatgtgatggcttcggttgt

SEQ ID NO: 36343 - DNA, 71 bp, chicken (Gallus Gallus)
  misc_feature (36): n=a or g
ggcaaaaagcaggcaaagaattctggcatgcaattnttatcagctccagaaatcttaagttgaacagtata

SEQ ID NO: 36344 - DNA, 71 bp, chicken (Gallus Gallus)
  misc_feature (36): n=c or t
gtctgccagggatcagggagcagccagatctttagntgtctattttgggatgttttctctaaaaagctttt

SEQ ID NO: 36345 - DNA, 71 bp, chicken (Gallus Gallus)
  misc_feature (36): n=a or g
gcattgattgctctggggcagagagaggacaaggancataagcgctgccaaattggcaccgcgttcaaaag

SEQ ID NO: 36346 - DNA, 71 bp, chicken (Gallus Gallus)
  misc_feature (36): n=c or t
atttggacaccattagaagctgtgggggagacaccnaaagcagtttggcttccaaagacaagtaaaagtaa

SEQ ID NO: 36347 - DNA, 71 bp, chicken (Gallus Gallus)
  misc_feature (36): n=c or t
ctgtgtaggagaaggatagagtttaatatgtttgcntctcagttttccctctcactttgggtcctttctgc

SEQ ID NO: 36348 - DNA, 71 bp, chicken (Gallus Gallus)
  misc_feature (36): n=a or g
gagaagagaggtaccagctgctacctgccagagganaccagaggctttaaacaaagatgttcctggccctc

SEQ ID NO: 36349 - DNA, 71 bp, chicken (Gallus Gallus)
  misc_feature (36): n=a or g
gacacaataactctgcagggattgatcttggataanctccttcctacaaacccctccaagtggccatgttt

SEQ ID NO: 36350 - DNA, 71 bp, chicken (Gallus Gallus)
  misc_feature (36): n=c or t
caggagcatccctccttgttaccagctgcgattcangctttcagctaaaaacccaccaacttttcagcagg

SEQ ID NO: 36351 - DNA, 71 bp, chicken (Gallus Gallus)
  misc_feature (36): n=a or g
atgccagcttttgacattagagtatagaaccattcnattagatttacagttctgaagtctatattccctgg

SEQ ID NO: 36352 - DNA, 71 bp, chicken (Gallus Gallus)
  misc_feature (36): n=g or t
cacagaggcttcagaacaggtgcctgaagtgacttnaatggaaactacaccttggtttcacttcttcattg

SEQ ID NO: 36353 - DNA, 71 bp, chicken (Gallus Gallus)
  misc_feature (36): n=g or t
tctcatacttcattctcagtctcttctcaccgcttncccttctgtgcacaattaatttctctaactcatct

SEQ ID NO: 36354 - DNA, 71 bp, chicken (Gallus Gallus)
  misc_feature (36): n=a or g
acgggatgcatgagcagagtgcattgcaaaaggagncagctcaggactaggtgcgttggtgaggtcttgtt

SEQ ID NO: 36355 - DNA, 71 bp, chicken (Gallus Gallus)
  misc_feature (36): n=a or g
gatcttcatttgatttttgatccttcctctgtgacnggtgtcaaagtactgtaattactaagccttaagaa

SEQ ID NO: 36356 - DNA, 71 bp, chicken (Gallus Gallus)
  misc_feature (36): n=a or g
tccacgctgcaggaacagatatcccaaagaaacacngtgctgagaggcattatcacaggctagatgccaag

SEQ ID NO: 36357 - DNA, 71 bp, chicken (Gallus Gallus)
  misc_feature (36): n=c or t
tgagagcagaacaagtctatcagtatgcgaccaacntcacaccacacttacaccccaacaaattccattat

SEQ ID NO: 36358 - DNA, 71 bp, chicken (Gallus Gallus)
  misc_feature (36): n=g or t
taaatctagtttctcctgagagctacccttgttggnctggaaggagtaccatgagcacatcctgcctagtc

SEQ ID NO: 36359 - DNA, 71 bp, chicken (Gallus Gallus)
  misc_feature (36): n=a or c
caagtggagacggcccaggacagccaaaatgatcancatggccgtttggggtgtctccctgttggtgatca

SEQ ID NO: 36360 - DNA, 71 bp, chicken (Gallus Gallus)
  misc_feature (36): n=c or t
gtcgtggtcctcagttatgccaacagctgtgccaancccatcctttatgccttcttgtctgataacttcaa

SEQ ID NO: 36361 - DNA, 71 bp, chicken (Gallus Gallus)
  misc_feature (36): n=a or g
cctgtttcctgctaattaccattaatcagggtaagncacagctgggtgcacctgaactcatccctgctcat

SEQ ID NO: 36362 - DNA, 71 bp, chicken (Gallus Gallus)
  misc_feature (36): n=g or t
ctgacacgtttattatctcccctataattaccttantgtgagcatttgttctaaagcaccctgggaacccc

SEQ ID NO: 36363 - DNA, 71 bp, chicken (Gallus Gallus)
  misc_feature (36): n=c or t
ctatgggagcacagcaggagatgagagcactacagnctccttccatgtcctcccaatttctgcccctatcc

SEQ ID NO: 36364 - DNA, 71 bp, chicken (Gallus Gallus)
  misc_feature (36): n=c or t
gaatacagggtgggtatcggctctcgtcccatgtcngtgctgactgcgtttcgtctttcagcctcgcaaga

SEQ ID NO: 36365 - DNA, 71 bp, chicken (Gallus Gallus)
  misc_feature (36): n=a or c
ctgtctacgccctggccaggaaccctttcttccccnaaatcttcctgacggttggtgactggactgctcgg

SEQ ID NO: 36366 - DNA, 71 bp, chicken (Gallus Gallus)
  misc_feature (36): n=c or t
gcacatccaggagccaccatatccatcccaccccanggcacaacggctgctggagtgccgcgctcagcccc

SEQ ID NO: 36367 - DNA, 71 bp, chicken (Gallus Gallus)
  misc_feature (36): n=a or g
tgacagattggcttcctcaaatgtgatccagttaanattcagctgcatgatctgggatttgaatgtcgttt

SEQ ID NO: 36368 - DNA, 71 bp, chicken (Gallus Gallus)
  misc_feature (36): n=c or t
gtctatctggttctagaaaacatccagattggtttncatttcagtaggagtgtaacttcgaaccagctacc

SEQ ID NO: 36369 - DNA, 71 bp, chicken (Gallus Gallus)
  misc_feature (36): n=c or t
cgggcatcagaaggtactgccgaccatggggagcgngctgggcctcggggtgggacggggcaggagagctg

SEQ ID NO: 36370 - DNA, 71 bp, chicken (Gallus Gallus)
  misc_feature (36): n=c or t
agcagcagggccttgcagttcttgttcttgggggangtcaccccttcgtggtccagcttcaccaggaactc

SEQ ID NO: 36371 - DNA, 71 bp, chicken (Gallus Gallus)
  misc_feature (36): n=c or t
ctcatcccaatatacaccccctgctcagggcaaccnggcacagcgtggagctccccagccgggccgagccg

SEQ ID NO: 36372 - DNA, 71 bp, chicken (Gallus Gallus)
  misc_feature (36): n=c or t
gcgcgtaacagatgggcagcaatcgtgtgccagcantgtgctgctctcccagagcctgcagacccttctgc

SEQ ID NO: 36373 - DNA, 71 bp, chicken (Gallus Gallus)
  misc_feature (36): n=a or g
ctgggtgccacagcccagaatagtgtgcatggggcncacagcccataggagcgtgcagacagcatccttcc

SEQ ID NO: 36374 - DNA, 71 bp, chicken (Gallus Gallus)
  misc_feature (36): n=c or t
gcacgtgggctattcacatcaggcaggggcagctcngtgcccagctcctcatccccaacaacagcacaagt

SEQ ID NO: 36375 - DNA, 71 bp, chicken (Gallus Gallus)
  misc_feature (36): n=g or t
ctactgcagctgcccacactgtgactaaggttccancaccttacagaacacgcctttcacacacagcctgc

SEQ ID NO: 36376 - DNA, 71 bp, chicken (Gallus Gallus)
  misc_feature (36): n=a or g
ggatgcaaaatttagcaatgagatgtgaccaaaganaccacagcctgctggcggatccccagcaaaggcag

SEQ ID NO: 36377 - DNA, 71 bp, chicken (Gallus Gallus)
  misc_feature (36): n=a or g
aagaattactttgaaccaatctgttatccttccttntggtttccaaaagcaacaagatctctttgtgagct

SEQ ID NO: 36378 - DNA, 71 bp, chicken (Gallus Gallus)
  misc_feature (36): n=c or t
gatggagaccttcaacaggtcctctctctgcagaanaggcacaaacccacacagtattaaccaggcaggac

SEQ ID NO: 36379 - DNA, 71 bp, chicken (Gallus Gallus)
  misc_feature (36): n=a or g
tctctgagagatcagggtgcagactgcacctgcccngcactgctgctcctctccacctgtaattgggttgc

SEQ ID NO: 36380 - DNA, 71 bp, chicken (Gallus Gallus)
  misc_feature (36): n=a or g
agaaaactcaagagccctgtagagtgcaataaaacngtacgtgtttagctttgcaatgtttcaaagggctg

SEQ ID NO: 36381 - DNA, 71 bp, chicken (Gallus Gallus)
  misc_feature (36): n=a or g
acaggaggtttctgtagtaaataacgaccaaaactnaaacagcttacataaaaatcacaaatggtgtgtaa

SEQ ID NO: 36382 - DNA, 71 bp, chicken (Gallus Gallus)
  misc_feature (36): n=a or g
tggtccatgttgtaggaagatatcatatcaaggagnctgctctgggtctgcacaaagcacacacgacagaa

SEQ ID NO: 36383 - DNA, 71 bp, chicken (Gallus Gallus)
  misc_feature (36): n=a or g
acaccactgagtgctatcattcaaacgaggagaacntcactgcgctgaaaagagcccatgctcctcagtct

SEQ ID NO: 36384 - DNA, 71 bp, chicken (Gallus Gallus)
  misc_feature (36): n=c or t
agccagagctcagcctccacctgctgtaacccagcncatgttctccttgcagacagactacttccacctct

SEQ ID NO: 36385 - DNA, 71 bp, chicken (Gallus Gallus)
  misc_feature (36): n=a or g
gttgctgatgagaaacacgaacactaatgagagccnagtgcccccagcagtgtgtgtggctgggggaaggg

SEQ ID NO: 36386 - DNA, 71 bp, chicken (Gallus Gallus)
  misc_feature (36): n=c or t
catgcatagaatttgtctttatttcctaatgtaccncaaaacactctgaaacaaataaaaatggtttggag

SEQ ID NO: 36387 - DNA, 71 bp, chicken (Gallus Gallus)
  misc_feature (36): n=g or t
gagttgtttgtgaaatcagatgtgctgagcgggganaatgcctacatgtgtgccaggtgagtggggtccca

SEQ ID NO: 36388 - DNA, 71 bp, chicken (Gallus Gallus)
  misc_feature (36): n=c or t
gcagcagcgtgtacgtgggacagcccggccagaganggatgcaaacaccgtgcagctgccccgagcagtgg

SEQ ID NO: 36389 - DNA, 71 bp, chicken (Gallus Gallus)
  misc_feature (36): n=c or t
caacatccatttctcaacaacttcccctccaactcncagaaggcaccaggatgcacctaatcagtactctg

SEQ ID NO: 36390 - DNA, 71 bp, chicken (Gallus Gallus)
  misc_feature (36): n=a or g
gtcactgtgctcatcacctactttcagaagagtccncaggaaaataaatgtcaagcttctccccctcccca

SEQ ID NO: 36391 - DNA, 71 bp, chicken (Gallus Gallus)
  misc_feature (36): n=a or g
aaatactcaaggtaaatgtatgttattttacttcanttttcaaataaagttgcaagagaggcaatgaaaag

SEQ ID NO: 36392 - DNA, 71 bp, chicken (Gallus Gallus)
  misc_feature (36): n=a or g
ctccgagtgtgcctgtctgtggggaacggctgtccntggggagggggagcggtgacactaccaccccaatg

SEQ ID NO: 36393 - DNA, 71 bp, chicken (Gallus Gallus)
  misc_feature (36): n=a or c
tgcacctcccactcctgaagacacacttgtgccccncacacaaccacaagctatacgcggtcacatctgca

SEQ ID NO: 36394 - DNA, 71 bp, chicken (Gallus Gallus)
  misc_feature (36): n=a or g
cagagataagcatggccatgggatccccacagagantcaaatcttgctccatttcactggggcttcaagaa

SEQ ID NO: 36395 - DNA, 71 bp, chicken (Gallus Gallus)
  misc_feature (36): n=c or t
tcatcagaaaacccccacaacaacagaaagcttacngtaagagtatgctgaaatcacagaggttagctgca

SEQ ID NO: 36396 - DNA, 71 bp, chicken (Gallus Gallus)
  misc_feature (36): n=g or t
ttggaagctgtgctgttcctggctcaccttttcgcngtaattcctaactcttaggaattagaggagtttaa

SEQ ID NO: 36397 - DNA, 71 bp, chicken (Gallus Gallus)
  misc_feature (36): n=a or c
tgaagtgtttattgaggagaagtgacaaaaggtggnaaagagctgggatggagttctttgctgtccttact

SEQ ID NO: 36398 - DNA, 71 bp, chicken (Gallus Gallus)
  misc_feature (36): n=a or g
agtttgcacaacgttattgggttctgcatgtccatnaattacagtcctgttactctgagatgttactagcc

SEQ ID NO: 36399 - DNA, 71 bp, chicken (Gallus Gallus)
  misc_feature (36): n=a or c
caaggagtgtctctagcttgtgcttggcatctctgncttcctttgctctatttctaaatgcaatattcacc

SEQ ID NO: 36400 - DNA, 71 bp, chicken (Gallus Gallus)
  misc_feature (36): n=c or t
aaaaatatatgcttgtttagtgtttttgtttacaangttcaatgtgaaaacaaagctatgtttatttagca

SEQ ID NO: 36401 - DNA, 71 bp, chicken (Gallus Gallus)
  misc_feature (36): n=g or t
tatcctttaaatattaccattccacattatttactntattcttcctaagtaattgccaggcaacagacatc

SEQ ID NO: 36402 - DNA, 71 bp, chicken (Gallus Gallus)
  misc_feature (36): n=a or g
atgcgcagtgctttctcttaaacggtacatgcgcantacggactcagatgtgacgcatgcgcagtgtggag

SEQ ID NO: 36403 - DNA, 71 bp, chicken (Gallus Gallus)
  misc_feature (36): n=a or g
ggcaggagcgctgtcagccccatctcctgctaatangacacagagttctaatggaatgggcagctgacatg

SEQ ID NO: 36404 - DNA, 71 bp, chicken (Gallus Gallus)
  misc_feature (36): n=a or c
aaatatggatttattcagatgggcgtttgaatgtanagtctggagtctattgctagaaattcatctgtatc

SEQ ID NO: 36405 - DNA, 71 bp, chicken (Gallus Gallus)
  misc_feature (36): n=a or c
cagcactatcaagagtgatatggtctgatatttctnagcaagccttgctggtgcatggtctggaagtagca

SEQ ID NO: 36406 - DNA, 71 bp, chicken (Gallus Gallus)
  misc_feature (36): n=a or g
ctaacacaatattgcactttgagagtcccttctctncccggagcactgaatcttgtttctgtgtcagcaga

SEQ ID NO: 36407 - DNA, 71 bp, chicken (Gallus Gallus)
  misc_feature (36): n=g or t
ggagcagagagccaggtgagcatctgcaggtgaggncaggctcttctggatactttgcagtggctcctgga

SEQ ID NO: 36408 - DNA, 71 bp, chicken (Gallus Gallus)
  misc_feature (36): n=a or g
ccataacgatggatgcagcataaatattttgcatcntatgaagttgttgcaaggtgtgatttgctccgaga

SEQ ID NO: 36409 - DNA, 71 bp, chicken (Gallus Gallus)
  misc_feature (36): n=c or t
gcattgtaagtccgtgttaagttgggtttaatgtgntgctgggcagccatgtagaagttaattaaaggcag

SEQ ID NO: 36410 - DNA, 71 bp, chicken (Gallus Gallus)
  misc_feature (36): n=a or g
tttcaattggaatattttgggaggggagaaagggtntatttcaattaggctaaaaatgtagatattatgac

SEQ ID NO: 36411 - DNA, 71 bp, chicken (Gallus Gallus)
  misc_feature (36): n=c or t
ctctcctttcttcagtcttcagctctggcaaagtanttcctccaaaacccctcaataaagctatcatgaca

SEQ ID NO: 36412 - DNA, 71 bp, chicken (Gallus Gallus)
  misc_feature (36): n=a or c
cttccagttgccaggatgaagtgctcatccaggtcnaaactggaggcactggaaatggacaagttttgaaa

SEQ ID NO: 36413 - DNA, 71 bp, chicken (Gallus Gallus)
  misc_feature (36): n=a or g
tcatgtgaccaactgtgtgcacatcatgagtgtagntccaacagagagcagcaagcccatcagagagggaa

SEQ ID NO: 36414 - DNA, 71 bp, chicken (Gallus Gallus)
  misc_feature (36): n=g or t
gtttattttgacaagtatttgataggagcccattcncagggagggcagctctcaggtttaacttacccttc

SEQ ID NO: 36415 - DNA, 71 bp, chicken (Gallus Gallus)
  misc_feature (36): n=a or g
agagaaggcatagcctagcactgactttcttctagngattcattcctgtgcactcttcaagcaccatttcc

SEQ ID NO: 36416 - DNA, 71 bp, chicken (Gallus Gallus)
  misc_feature (36): n=c or t
ttctcagagaacaacccaaagcctcctctagaaccntccatcctttccactatagcccaaagagtttcagc

SEQ ID NO: 36417 - DNA, 71 bp, chicken (Gallus Gallus)
  misc_feature (36): n=a or g
ccatgtgcacatagatgcttaatgatgtacacagcnggaagggagtgaagaagatgctgacaaatactgat

SEQ ID NO: 36418 - DNA, 71 bp, chicken (Gallus Gallus)
  misc_feature (36): n=a or g
ctgcacctccagctcttcactcggggccaggatgangcaggagatgtcagtgtggtatgtgctttcatcag

SEQ ID NO: 36419 - DNA, 71 bp, chicken (Gallus Gallus)
  misc_feature (36): n=a or c
atctacctaaattgttcccagttacagtacacaacnagctgccatgaaggaagctcaaataacccactagg

SEQ ID NO: 36420 - DNA, 71 bp, chicken (Gallus Gallus)
  misc_feature (36): n=c or t
ttccattatctggttatgtaggggtctgtagttaancacatgaataatgattcctgcacagatttagaaac

SEQ ID NO: 36421 - DNA, 71 bp, chicken (Gallus Gallus)
  misc_feature (36): n=a or g
ttcgagcaatcgctttgaacaacggcaatgttttcngttccagactctaagattttactcagcctgcaatt

SEQ ID NO: 36422 - DNA, 71 bp, chicken (Gallus Gallus)
  misc_feature (36): n=a or g
tgcactccttctgacatcccactgaagaccaaatgnaattaaatatatgaggtagttgtgccacgacgcct

SEQ ID NO: 36423 - DNA, 71 bp, chicken (Gallus Gallus)
  misc_feature (36): n=a or c
catctgactcctacaaaggcaaaggcaatttcactnagagcatgaataaaataaactctccctgacagggc

SEQ ID NO: 36424 - DNA, 71 bp, chicken (Gallus Gallus)
  misc_feature (36): n=c or t
aaacctctgggcttctccttcaagctccttttgacnaccacagacctgcaggtctgagatgctacagtcac

SEQ ID NO: 36425 - DNA, 71 bp, chicken (Gallus Gallus)
  misc_feature (36): n=a or g
ataatactttgcatttctaaaagcccttccagctcngaaactcaaagcttgataattaatgtctctttgat

SEQ ID NO: 36426 - DNA, 71 bp, chicken (Gallus Gallus)
  misc_feature (36): n=a or g
tcaaagggaagagggagcagcgctgctaaaacagcnttgcttccaacccctgcgggatgcaaaaataatct

SEQ ID NO: 36427 - DNA, 71 bp, chicken (Gallus Gallus)
  misc_feature (36): n=a or c
actgctaaaagcttccaaccttaccaaaaccacagntcctccatgtccacatggcaatgcaaactcttcct

SEQ ID NO: 36428 - DNA, 71 bp, chicken (Gallus Gallus)
  misc_feature (36): n=c or t
cattagggcaggtttctaaagttaatgagaaaatcncacacagaaggtctgcaaaagtaactaagagcgcc

SEQ ID NO: 36429 - DNA, 71 bp, chicken (Gallus Gallus)
  misc_feature (36): n=c or t
tgggggagaaatcctcatctccctgagtgaacaatngtcccttcctgccctcattacacacaattacacat

SEQ ID NO: 36430 - DNA, 71 bp, chicken (Gallus Gallus)
  misc_feature (36): n=c or t
cccactacgaggtctgagatatctgctgggtcttcngaagcccgcagagaggggctgagctgacaggcaga

SEQ ID NO: 36431 - DNA, 71 bp, chicken (Gallus Gallus)
  misc_feature (36): n=a or g
tccatctatgcactaaaaaacgtcagtttctcctcngtgaacaataatttgtgaaataaagcaggcatgca

SEQ ID NO: 36432 - DNA, 71 bp, chicken (Gallus Gallus)
  misc_feature (36): n=a or g
cacagacaccaagatatctaattcatgcattccctnatcagatatgcagcttagaactactgatggatttt

SEQ ID NO: 36433 - DNA, 71 bp, chicken (Gallus Gallus)
  misc_feature (36): n=g or t
aggctgtatttatttcacacgcaacaatccagtctngagcttaacctatggcctccaataccacacaacaa

SEQ ID NO: 36434 - DNA, 71 bp, chicken (Gallus Gallus)
  misc_feature (36): n=c or t
gggttacaaatacagaaagcactcaggtaaaagtgnaagaaaatcaacaaaggcaagaagatccacaactt

SEQ ID NO: 36435 - DNA, 71 bp, chicken (Gallus Gallus)
  misc_feature (36): n=a or g
ccattttcaaaatttatgaagagcttcactccttcngagaagcacgtgaatggcagctaatggaaaccaca

SEQ ID NO: 36436 - DNA, 71 bp, chicken (Gallus Gallus)
  misc_feature (36): n=a or g
ctggagatacagtttgctcttcacagtgggaaaaanagaaatatcattaattactagcagtgcccaagtaa

SEQ ID NO: 36437 - DNA, 71 bp, chicken (Gallus Gallus)
  misc_feature (36): n=a or c
gcaatttagaaaataacaataattggcatcaggacnaaatggcttaggaaattaaagaccaaatgaagctt

SEQ ID NO: 36438 - DNA, 71 bp, chicken (Gallus Gallus)
  misc_feature (36): n=a or g
ttgcatcctgttgtaagcgtatttaagctgacaaantacagagcaagccggtcacgactgcactacagaac

SEQ ID NO: 36439 - DNA, 71 bp, chicken (Gallus Gallus)
  misc_feature (36): n=c or t
taagaaggaaggaagattgtctacatatgaatttangttaaagagctgtttataaataattccatatgtgg

SEQ ID NO: 36440 - DNA, 71 bp, chicken (Gallus Gallus)
  misc_feature (36): n=a or g
gacacatctgccagcaagaccccagtgaagcttccnatcagccttttgctccagggagttggacggcatct

SEQ ID NO: 36441 - DNA, 71 bp, chicken (Gallus Gallus)
  misc_feature (36): n=a or c
ccagcatggaaccacagaggccttcactttgatacnaacactacttaacaaaaattacttcaaagacatat

SEQ ID NO: 36442 - DNA, 71 bp, chicken (Gallus Gallus)
  misc_feature (36): n=a or g
caagctcacccctcactgccccacgtcatctccgtnctttatacatatccgtgtcccatttcaggcttgtc

SEQ ID NO: 36443 - DNA, 71 bp, chicken (Gallus Gallus)
  misc_feature (36): n=a or g
aagacactgaaaaggcatcagagagcacaagcaccnggaacatataaatcactgggagcaatttgctgcag

SEQ ID NO: 36444 - DNA, 71 bp, chicken (Gallus Gallus)
  misc_feature (36): n=a or g
acagcacaggttacctgcacaaattgtatgtgacantcacttaaagccaaagaaatcctattaggaactcc

SEQ ID NO: 36445 - DNA, 71 bp, chicken (Gallus Gallus)
  misc_feature (36): n=a or g
gtttgcctaaacaattcctcctgaaccgcagcgaangcacaattcatagcctgctttttcatttccatgaa

SEQ ID NO: 36446 - DNA, 71 bp, chicken (Gallus Gallus)
  misc_feature (36): n=a or g
atcaattagaaaaaaaataaataagaactgcttccnaaaagacagaaacattaaagtgcaaggtccttaga

SEQ ID NO: 36447 - DNA, 71 bp, chicken (Gallus Gallus)
  misc_feature (36): n=c or t
cccaggcaaagaggatgagaggggctcatgcaagcnaagaagatgagaaagactacttcttcatttcagcc

SEQ ID NO: 36448 - DNA, 71 bp, chicken (Gallus Gallus)
  misc_feature (36): n=a or g
gacacatccagcatttcattttggctgcctcaacantgagagatagtagaggtagaaaaggagaggacact

SEQ ID NO: 36449 - DNA, 71 bp, chicken (Gallus Gallus)
  misc_feature (36): n=g or t
ttagcttatagtgcagagagttttcagtaatgagtntgagtgcttttccttatggccggttttgttacctc

SEQ ID NO: 36450 - DNA, 71 bp, chicken (Gallus Gallus)
  misc_feature (36): n=a or g
ccactgcctggaagtttcattgtaaatatccactcntatagatttgtgcaggtccttatatttatgagctt

SEQ ID NO: 36451 - DNA, 71 bp, chicken (Gallus Gallus)
  misc_feature (36): n=c or t
gttggcaggagcatcccccagagtttgcacatctanagattcccaccgccagttgttctggagatccaagt

SEQ ID NO: 36452 - DNA, 71 bp, chicken (Gallus Gallus)
  misc_feature (36): n=a or g
gtgatgtaaggggggaaggtttgataataataatangcagcaccttcagcttcaatcagttgcatgttcca

SEQ ID NO: 36453 - DNA, 71 bp, chicken (Gallus Gallus)
  misc_feature (36): n=a or g
aagtctgatggagttggcaatgggaagcggggaganaccccaacttttgtccctgtgtcagacaggactga

SEQ ID NO: 36454 - DNA, 71 bp, chicken (Gallus Gallus)
  misc_feature (36): n=a or c
aaatgccaatgtgtgcttatagaaccaaagaaatgnctgctgtggttatgttgtgagataacccgaatatt

SEQ ID NO: 36455 - DNA, 71 bp, chicken (Gallus Gallus)
  misc_feature (36): n=c or t
ggaatacacagagcctgttgctgcactgactgagcntcatccatgaccttggactctccatgtccctgtga

SEQ ID NO: 36456 - DNA, 71 bp, chicken (Gallus Gallus)
  misc_feature (36): n=a or g
caatcagaaggagtctgtcctgaaggaggaagacancaggagggaaagtatgagtaagttgtaaaacagca

SEQ ID NO: 36457 - DNA, 71 bp, chicken (Gallus Gallus)
  misc_feature (36): n=a or g
tttgctcagcggtgtgcagtgctacaaccagctgcnttcagctgcagtcctatggaagctggcagcattac

SEQ ID NO: 36458 - DNA, 71 bp, chicken (Gallus Gallus)
  misc_feature (36): n=g or t
tcttgctgttcctcctgtaggtttcctggctgatcngcttccgtcccttgttgtggatgctctttgcattg

SEQ ID NO: 36459 - DNA, 71 bp, chicken (Gallus Gallus)
  misc_feature (36): n=a or g
cagaatttattgggctaaagggaaaaccctgtttcnttgcatagagatgctaaatacatggacagtcctgg

SEQ ID NO: 36460 - DNA, 71 bp, chicken (Gallus Gallus)
  misc_feature (36): n=c or t
aagcagatttccaagtagctgcatcatctatttgcnctgggatgtctccccttttagacaaaggatatcca

SEQ ID NO: 36461 - DNA, 71 bp, chicken (Gallus Gallus)
  misc_feature (36): n=a or g
taatctaccacagtaggcaatgcaggtttccatttntcctgaatgtcttgggctccaggttgtacgctagc

SEQ ID NO: 36462 - DNA, 71 bp, chicken (Gallus Gallus)
  misc_feature (36): n=c or t
cttttctcctctgtatctgaggccatatgacatctngaaaaggtttacaagaacatttagctttacactct

SEQ ID NO: 36463 - DNA, 71 bp, chicken (Gallus Gallus)
  misc_feature (36): n=c or t
gccatgcagccccatcttcatttatgcatgattgcnggtgctttacatcctattcagcatttctcactgca

SEQ ID NO: 36464 - DNA, 71 bp, chicken (Gallus Gallus)
  misc_feature (36): n=a or g
caaaggatgaaggctcatcaaagctttgtaaagtancttttaggtacagtaataaaggtcctctaagtttt

SEQ ID NO: 36465 - DNA, 71 bp, chicken (Gallus Gallus)
  misc_feature (36): n=a or c
aattcccacaagccaaggaaagacatcacttagagntaaatgacatgatttggctaaaaggctaaaatgag

SEQ ID NO: 36466 - DNA, 71 bp, chicken (Gallus Gallus)
  misc_feature (36): n=c or t
aagcttattaccatagcctgctaaaaacttggtatngctcatctagtaaaaatattactgtattggaacca

SEQ ID NO: 36467 - DNA, 71 bp, chicken (Gallus Gallus)
  misc_feature (36): n=a or g
cagttaggaaggggcttgctgctgccactagctgtnagaccagggctgggagttatagcaaaggagcagag

SEQ ID NO: 36468 - DNA, 71 bp, chicken (Gallus Gallus)
  misc_feature (36): n=a or g
aaacattggtcttatgctaatgttatttcttagcanttccacccagctatttcgggctacgcggtcccagt

SEQ ID NO: 36469 - DNA, 71 bp, chicken (Gallus Gallus)
  misc_feature (36): n=c or t
gtaagcaagatcaggtaaatcagcctcagatatatnccattatggggaacaagacaccttcctgacagaag

SEQ ID NO: 36470 - DNA, 71 bp, chicken (Gallus Gallus)
  misc_feature (36): n=a or c
ctgccttcacacaccaaacaacagattgctcaaacnccttaacgctccatctcctttatatatttagttct

SEQ ID NO: 36471 - DNA, 71 bp, chicken (Gallus Gallus)
  misc_feature (36): n=c or t
gccagaggtttatagaaaatcccctttgaaatcagngaggagttgtgaaatcttcagatgaaataaaagtg

SEQ ID NO: 36472 - DNA, 71 bp, chicken (Gallus Gallus)
  misc_feature (36): n=c or t
ccctaaagcaggcattttgccctagtcctgactaangagtgagcaaagtctcagtttcctagctgagagtg

SEQ ID NO: 36473 - DNA, 71 bp, chicken (Gallus Gallus)
  misc_feature (36): n=c or t
taaatgggcatacttgcttctcttctccttcctacngtcaggtccaaggcatatcagctggaacagagatc

SEQ ID NO: 36474 - DNA, 71 bp, chicken (Gallus Gallus)
  misc_feature (36): n=c or t
aaagagttttggagagattgctgtggaattgggaangtcacttgctgttcagttctgaacacttgcttcat

SEQ ID NO: 36475 - DNA, 71 bp, chicken (Gallus Gallus)
  misc_feature (36): n=a or c
ttccacagctcccccacgtccgactggagccgaccnaaggagggacgccctggactgctacgggccctgca

SEQ ID NO: 36476 - DNA, 71 bp, chicken (Gallus Gallus)
  misc_feature (36): n=c or t
gtggttagtgattgaatggaagtgctttgccaccangtagacagttggaacaaatggtgatttccagtaga

SEQ ID NO: 36477 - DNA, 71 bp, chicken (Gallus Gallus)
  misc_feature (36): n=c or t
aaactccttttcttgtctcaatctgtttggtctgangggcttctcctgcatttacttttgtaaaaatgggc

SEQ ID NO: 36478 - DNA, 71 bp, chicken (Gallus Gallus)
  misc_feature (36): n=c or t
actgagcgaagtgttcggggcaaatgccaggaaatncagcagtgaggctcagggcagccctcggcactccc

SEQ ID NO: 36479 - DNA, 71 bp, chicken (Gallus Gallus)
  misc_feature (36): n=a or g
aaagcctgcaaatagccttgtgatgtctgctggtcntgcaagctaggagcaggcaggaaatctgacgtaac

SEQ ID NO: 36480 - DNA, 71 bp, chicken (Gallus Gallus)
  misc_feature (36): n=a or g
ggtgatgctgatggtgctgggggctgtgccaagagnagccgaggggaggtggaaagaggaggatttttatt

SEQ ID NO: 36481 - DNA, 71 bp, chicken (Gallus Gallus)
  misc_feature (36): n=c or t
ccaagagctttatcctttgttgtgaacaactgcagngctatgaaaggctgtgaaatcttgcttatttacat

SEQ ID NO: 36482 - DNA, 71 bp, chicken (Gallus Gallus)
  misc_feature (36): n=c or t
tatctgggatttatacttcagcacaaaacgtgaagngtgagcagctgagctccaggagcattccaacactg

SEQ ID NO: 36483 - DNA, 71 bp, chicken (Gallus Gallus)
  misc_feature (36): n=a or g
gcatttgcttcctgttactcattggaggcaatgtgncaggtattggcatgctgcactaagcaggagtacca

SEQ ID NO: 36484 - DNA, 71 bp, chicken (Gallus Gallus)
  misc_feature (36): n=c or t
gaatcacttaaaacaatattcccattctctgctgtngtatgaattgtttttcttattgactgtcaccaaac

SEQ ID NO: 36485 - DNA, 71 bp, chicken (Gallus Gallus)
  misc_feature (36): n=a or g
cggagggcagaggacatggcaagaacagaaacctcngtggctttaagcaggggcactggcgagttcagcct

SEQ ID NO: 36486 - DNA, 71 bp, chicken (Gallus Gallus)
  misc_feature (36): n=c or t
tcaggctagctttcaaacagggcctttaagtgctcncataaagtaaatgtttactatgggttctgctaata

SEQ ID NO: 36487 - DNA, 71 bp, chicken (Gallus Gallus)
  misc_feature (36): n=a or g
ggcttaagtgacagctccatccccacttcttttcanaggaatagtgatgaaatgtgtgggcttcgtgttgc

SEQ ID NO: 36488 - DNA, 71 bp, chicken (Gallus Gallus)
  misc_feature (36): n=c or t
aatgggacaaggagaattcaatgggccagctgcagngttcgggcaagagtgtgcttgctcccttgggatcc

SEQ ID NO: 36489 - DNA, 71 bp, chicken (Gallus Gallus)
  misc_feature (36): n=g or t
cctgttcataacctttttgagaggggctgtttcttngtgagacccttgaccagtcagttcaattacaaaga

SEQ ID NO: 36490 - DNA, 71 bp, chicken (Gallus Gallus)
  misc_feature (36): n=a or g
atggaccaagtcactcgggtcagcattgcagaagcngtttaatgcagggatgtctgctttgggagcagctg

SEQ ID NO: 36491 - DNA, 71 bp, chicken (Gallus Gallus)
  misc_feature (36): n=c or t
caacatatgtgcactcggccttttaagggaatctgntgttctgtctggtaatgcaggctcacacttcatcc

SEQ ID NO: 36492 - DNA, 71 bp, chicken (Gallus Gallus)
  misc_feature (36): n=c or t
ggtgaaccagtgagcattgggtttggatctagccanacaggtgggtttggttgcctcacgttctttccctt

SEQ ID NO: 36493 - DNA, 71 bp, chicken (Gallus Gallus)
  misc_feature (36): n=a or g
ttcctctaagaaagcataaatgagcctgggaaactngaaaagggatctgagggtaatgactgaggtcagcc

SEQ ID NO: 36494 - DNA, 71 bp, chicken (Gallus Gallus)
  misc_feature (36): n=a or g
taaggtacagaacaggctgtctgttttctctaacantgtgatgttcctcgtaggctcataagctctacagc

SEQ ID NO: 36495 - DNA, 71 bp, chicken (Gallus Gallus)
  misc_feature (36): n=c or t
ttgtcctgtctgcttccttgtttcacgttacgccgngccacatcttgactgcatttttcccccatcacttc

SEQ ID NO: 36496 - DNA, 71 bp, chicken (Gallus Gallus)
  misc_feature (36): n=g or t
attcaaaattcataaataggttctttaagagtctgnctttttcacatgtggcacacattataaatttttta

SEQ ID NO: 36497 - DNA, 71 bp, chicken (Gallus Gallus)
  misc_feature (36): n=c or t
agcttggagagggtcttatggacgtttttcttgatnttgttattttgcctttggaataccagatgtcatgt

SEQ ID NO: 36498 - DNA, 71 bp, chicken (Gallus Gallus)
  misc_feature (36): n=c or t
tatccacacagctgctattgtggactgcagaaacangttgcccttttgggaaatgaaagctgtcaatgttg

SEQ ID NO: 36499 - DNA, 71 bp, chicken (Gallus Gallus)
  misc_feature (36): n=c or t
acacacatcaggacaggtgaatgcatgcacttgaangatatttctccctggttctgccctcccagggcatg

SEQ ID NO: 36500 - DNA, 71 bp, chicken (Gallus Gallus)
  misc_feature (36): n=a or g
tttctccctggttctgccctcccagggcatgacacnttacagatgtgctctaagaatgctgtgaaagcatt

SEQ ID NO: 36501 - DNA, 71 bp, chicken (Gallus Gallus)
  misc_feature (36): n=a or g
actgggagggttcagctgatagctcagccccaaacntctctgcacactcttgggtacttctttaatctgac

SEQ ID NO: 36502 - DNA, 71 bp, chicken (Gallus Gallus)
  misc_feature (36): n=c or t
tgaatgttcagccttttgccttgcacagaaaagcanaatgaaataacttggtgcatcatcacaggagaagc

SEQ ID NO: 36503 - DNA, 71 bp, chicken (Gallus Gallus)
  misc_feature (36): n=a or g
aggggctgcccattgggtatgcatctttctctatcncagctggtgtttttgaaccaaagtgtggagtagaa

SEQ ID NO: 36504 - DNA, 71 bp, chicken (Gallus Gallus)
  misc_feature (36): n=c or t
ccatccatggttgatcagcaaagagctaattcatantgagttgattgattcattgaaatgaatcttgaatt

SEQ ID NO: 36505 - DNA, 71 bp, chicken (Gallus Gallus)
  misc_feature (36): n=a or g
ctctttctcttctaatgttgtcctttacgaacaatnacatattctcactgtttctcgtatgcccttccatt

SEQ ID NO: 36506 - DNA, 71 bp, chicken (Gallus Gallus)
  misc_feature (36): n=a or g
ggaacagaaaaatatgtctttcaaacactatgaccnttaaaacagaaaccctctctgccccagagagtggt

SEQ ID NO: 36507 - DNA, 71 bp, chicken (Gallus Gallus)
  misc_feature (36): n=a or g
cacagatatttttcaggcttgttgctggaagtggcntctatagaagtaaatgtgaacggagaactgagtgg

SEQ ID NO: 36508 - DNA, 71 bp, chicken (Gallus Gallus)
  misc_feature (36): n=c or t
aaataaaacgtaccctttgtctgtgatctgaaatangatcgcgttaatttggtcagcaaagtgtgcatcta

SEQ ID NO: 36509 - DNA, 71 bp, chicken (Gallus Gallus)
  misc_feature (36): n=a or g
tcctttgttcccaaacccaagagctactgaagagcntacagctctgatggattcctacaacttggatcatc

SEQ ID NO: 36510 - DNA, 71 bp, chicken (Gallus Gallus)
  misc_feature (36): n=c or t
cttcatgcttcacttgagtccctttcagcccaagcnactcttgtgattcagaatacattgaagaggggaag

SEQ ID NO: 36511 - DNA, 71 bp, chicken (Gallus Gallus)
  misc_feature (36): n=c or t
tagggggtgccttggtatgcgggaggtcttcagctnaatggttggagaatgaagagaggcaaaagcaagcc

SEQ ID NO: 36512 - DNA, 71 bp, chicken (Gallus Gallus)
  misc_feature (36): n=c or t
gcatttttgcattaatttttgtactccctttccttntacgataaggtgttctgaatggatgaggtgcaact

SEQ ID NO: 36513 - DNA, 71 bp, chicken (Gallus Gallus)
  misc_feature (36): n=c or t
acaaaaaagtcctcgtgtgcatttccttggctttcngaggacaaactgtgctccctgctaatgagctcttt

SEQ ID NO: 36514 - DNA, 71 bp, chicken (Gallus Gallus)
  misc_feature (36): n=c or t
acagtaagaaagtattcctcagtaacatacagcagnacttttaataacttcacagtcccgggttgtttcac

SEQ ID NO: 36515 - DNA, 71 bp, chicken (Gallus Gallus)
  misc_feature (36): n=g or t
ccacagatgtttcatttttcctgcaagaagatgatngaaccttgaatgacagtttcaggcagtctttgatt

SEQ ID NO: 36516 - DNA, 71 bp, chicken (Gallus Gallus)
  misc_feature (36): n=c or t
tcttctgaaatcctttttagtgcctgtgtgaggctnataatgctgctggaaacaaacctcccactttgatt

SEQ ID NO: 36517 - DNA, 71 bp, chicken (Gallus Gallus)
  misc_feature (36): n=a or c
ggagcgaacgctattttctaggcagatattccttgnggctgaattgcaatgacaaagcaccaacacacttt

SEQ ID NO: 36518 - DNA, 71 bp, chicken (Gallus Gallus)
  misc_feature (36): n=c or t
aggattacacccctatcatctgagcatgatatctgngtcattaaaaactcctttgttttaatacataaaga

SEQ ID NO: 36519 - DNA, 71 bp, chicken (Gallus Gallus)
  misc_feature (36): n=a or g
gtagggaaatgctggtgagaagtctcagctaaagantgaactaggttgctgatggacgtcttgtttggaca

SEQ ID NO: 36520 - DNA, 71 bp, chicken (Gallus Gallus)
  misc_feature (36): n=g or t
ccattggtttgggtcagggatggacctacccattgncagagccgtgatgccaaggttgcaatgctgattcc

SEQ ID NO: 36521 - DNA, 71 bp, chicken (Gallus Gallus)
  misc_feature (36): n=c or t
caaatgcatcataacaaatctgagacaatgattaanggagtaagcaccgtaaagtgctgttttctaaaaca

SEQ ID NO: 36522 - DNA, 71 bp, chicken (Gallus Gallus)
  misc_feature (36): n=c or t
agctctgtttataccacatttttttcatctacaagnccactctaacttagcatccctagaaatggtccaag

SEQ ID NO: 36523 - DNA, 71 bp, chicken (Gallus Gallus)
  misc_feature (36): n=c or t
tcgtggtgatcctgcccccaggcacactttgaccancctttcagccccactcagactgccatcagcctgat

SEQ ID NO: 36524 - DNA, 71 bp, chicken (Gallus Gallus)
  misc_feature (36): n=g or t
ctgcagcctaatcaagcttggaagctgctgatttgntaagagggtaactatgcatgcagtgaccctgtagg

SEQ ID NO: 36525 - DNA, 71 bp, chicken (Gallus Gallus)
  misc_feature (36): n=a or g
acccaaaaactagaaattcaggattctgcacaccantgttcccagaggcagcatggaaaatcaaaacgtcc

SEQ ID NO: 36526 - DNA, 71 bp, chicken (Gallus Gallus)
  misc_feature (36): n=a or g
ttctctctctctgggccaaacaggagccattcatcntctccaaatggctcaaaagtcgcaaccatttactt

SEQ ID NO: 36527 - DNA, 71 bp, chicken (Gallus Gallus)
  misc_feature (36): n=c or t
agagccaaactggaggaacaaactggccaccagccncagtgttacaggaagagatttagaaaatcccaagc

SEQ ID NO: 36528 - DNA, 71 bp, chicken (Gallus Gallus)
  misc_feature (36): n=g or t
tgcaatctggacccagcaccccattgccccagtggngcgtttctccctgcagcgtggtcaccaacaaggag

SEQ ID NO: 36529 - DNA, 71 bp, chicken (Gallus Gallus)
  misc_feature (36): n=c or t
tagcactcaccttatttttatgtagctatctttccncttgcatagcagattcttgtatttcagctttctct

SEQ ID NO: 36530 - DNA, 71 bp, chicken (Gallus Gallus)
  misc_feature (36): n=a or g
actcagtgtattttgtacaaactgtgaagtaggcanttcagtacaaggagtgacataggagttgaagttgt

SEQ ID NO: 36531 - DNA, 71 bp, chicken (Gallus Gallus)
  misc_feature (36): n=c or t
agtagtccaaggaacacaaataagctgtgttgaggngctgttacttgtcccaggtggccagtgtgtagcag

SEQ ID NO: 36532 - DNA, 71 bp, chicken (Gallus Gallus)
  misc_feature (36): n=g or t
cagcacagcccaggagttaatcattaaaatgtgccnatgtgtaactgctctctgcaggacaacgaactgag

SEQ ID NO: 36533 - DNA, 71 bp, chicken (Gallus Gallus)
  misc_feature (36): n=a or g
tcttgttatcctttgtgttgctgccatggtagacangaggactttccattattggctctttgtttttcaga

SEQ ID NO: 36534 - DNA, 71 bp, chicken (Gallus Gallus)
  misc_feature (36): n=c or t
ggggagcctgcgccttatttgtgtaacaaagacccntttgctctaaaatccttaacttatcttgctagaat

SEQ ID NO: 36535 - DNA, 71 bp, chicken (Gallus Gallus)
  misc_feature (36): n=c or t
atggtgttttgtgtaatctttaaacattctgcattntctttttaggagccctctctgaaaaacccttatag

SEQ ID NO: 36536 - DNA, 71 bp, chicken (Gallus Gallus)
  misc_feature (36): n=a or g
tcacacaagccttttgctgtgtgagtgcctcagaangctcacagagagaacacaggtcctgccctgctgtg

SEQ ID NO: 36537 - DNA, 71 bp, chicken (Gallus Gallus)
  misc_feature (36): n=c or t
caaattctaaagggtttcgataccttcaactgttcngagcgatagctttgttaaaccgtaatctacttgga

SEQ ID NO: 36538 - DNA, 71 bp, chicken (Gallus Gallus)
  misc_feature (36): n=c or t
tttaagacgtggtgctttcctctttggtttgtaganacgtactgatgtctgcttaaggcatttctgggaga

SEQ ID NO: 36539 - DNA, 71 bp, chicken (Gallus Gallus)
  misc_feature (36): n=c or t
tcatcatgttcaggcttaggtttggcctcagttttntctgcctttgttggcatgaagttatggtattgtgc

SEQ ID NO: 36540 - DNA, 71 bp, chicken (Gallus Gallus)
  misc_feature (36): n=a or g
agctgcccgtacaaaaggtgttaggcaacaccgtgncaggaggcatgaagaagttatgtcatatgtttact

SEQ ID NO: 36541 - DNA, 71 bp, chicken (Gallus Gallus)
  misc_feature (36): n=g or t
ggggggtgggttgaaccgtcagttcaggttgaggcngatcacctcttattgctgctcagctgcctggggga

SEQ ID NO: 36542 - DNA, 71 bp, chicken (Gallus Gallus)
  misc_feature (36): n=c or t
gtttccctgcacacccagatgtgattaatcaaaatncagattgctccttggttaatttaacatttataatg

SEQ ID NO: 36543 - DNA, 71 bp, chicken (Gallus Gallus)
  misc_feature (36): n=c or t
accaataaaatccagggcatcaagaaaactgacttnaagaacatacaatacaaagtcaaaagctactaacc

SEQ ID NO: 36544 - DNA, 71 bp, chicken (Gallus Gallus)
  misc_feature (36): n=a or g
accccaagtagctcagagtctctggcagctgagganttgtagcaaagcatttgttaatgcagcagttggaa

SEQ ID NO: 36545 - DNA, 71 bp, chicken (Gallus Gallus)
  misc_feature (36): n=c or t
ccacaattcatcaactttcactatttgttcaagatnacagccttctctacaaatttcattgaaggaagaaa

SEQ ID NO: 36546 - DNA, 71 bp, chicken (Gallus Gallus)
  misc_feature (36): n=a or g
aattaatgaaagcacacgctgaaatggattattacngtgatcagacattgcagtcatttactctcgacagc

SEQ ID NO: 36547 - DNA, 71 bp, chicken (Gallus Gallus)
  misc_feature (36): n=c or t
agtgatcctcctgccctgacactctgatcaccggcngctcttctatctaccactgtatttattttagtctc

SEQ ID NO: 36548 - DNA, 71 bp, chicken (Gallus Gallus)
  misc_feature (36): n=a or c
atacaaaattgatgtacttaacttaacccctaaagngttgcttttacactgtagagaaggctgtattgcag

SEQ ID NO: 36549 - DNA, 71 bp, chicken (Gallus Gallus)
  misc_feature (36): n=c or t
ttaaaagcaatcagtggaagcactgatagtcacttngaaattactcacactgagacaataatgatcctgcg

SEQ ID NO: 36550 - DNA, 71 bp, chicken (Gallus Gallus)
  misc_feature (36): n=c or t
atgtcacagatatctttcactgactttataaattantgtacaagtgctaattaacgtatcctttaagatgc

SEQ ID NO: 36551 - DNA, 71 bp, chicken (Gallus Gallus)
  misc_feature (36): n=g or t
gtgagaactcaaacttccagttatccctgaaaactntagatggggaaaagtagttcttgggcaggtgctgc

SEQ ID NO: 36552 - DNA, 71 bp, chicken (Gallus Gallus)
  misc_feature (36): n=c or t
agctgttttattttctgaaatctagagaatgatatnattcttaagtgtgtcaacacgtattgatttagaga

SEQ ID NO: 36553 - DNA, 71 bp, chicken (Gallus Gallus)
  misc_feature (36): n=a or g
aattcccatttgtatggaaaaataccagtgaaaacnggtcatttgtactccaaatacgtttgggtgtttgt

SEQ ID NO: 36554 - DNA, 71 bp, chicken (Gallus Gallus)
  misc_feature (36): n=c or t
gcacatcaggttcagaccaccaaaccattgagaggnatgaagcaccataagcataagtaaccagcgaaatt

SEQ ID NO: 36555 - DNA, 71 bp, chicken (Gallus Gallus)
  misc_feature (36): n=a or g
aaaatctaaagaatattccagaacatttttcttacncttttcacccaagtatttctttagaacattccttt

SEQ ID NO: 36556 - DNA, 71 bp, chicken (Gallus Gallus)
  misc_feature (36): n=c or t
tttaactgttttttgctccttgtagtgcaagaatgnatgaaataacacaggagagcagcttgcagcctgtg

SEQ ID NO: 36557 - DNA, 71 bp, chicken (Gallus Gallus)
  misc_feature (36): n=c or t
attgcttactaaggaagagagtatttagatccagcnatcgataactttgataagttggaagcaggatggag

SEQ ID NO: 36558 - DNA, 71 bp, chicken (Gallus Gallus)
  misc_feature (36): n=c or t
ctgacctcttagaaggatcgaatatgggtcagcacncagctccaaggaagcagattaaagtctccaggtcc

SEQ ID NO: 36559 - DNA, 71 bp, chicken (Gallus Gallus)
  misc_feature (36): n=g or t
agtgacacacatggtgataaggctgagcaacaaganggggctgaagacactcttcatgaaggatggagaag

SEQ ID NO: 36560 - DNA, 71 bp, chicken (Gallus Gallus)
  misc_feature (36): n=a or g
tgtttacagcacagagggatgggcaaggagccctcnttgctaatcagcacagcgggacgcatcctgcccca

SEQ ID NO: 36561 - DNA, 71 bp, chicken (Gallus Gallus)
  misc_feature (36): n=a or g
ggggtgaagcactcacgggagctgcaatctgcaccnaagaagccgggtttgcagcggcacagcccaggtct

SEQ ID NO: 36562 - DNA, 71 bp, chicken (Gallus Gallus)
  misc_feature (36): n=a or c
tcagcaagttcagcatattgtagccctggcgacacncctgcaggcctacttccacccagtccagctttgtt

SEQ ID NO: 36563 - DNA, 71 bp, chicken (Gallus Gallus)
  misc_feature (36): n=c or t
ccccattgcagcaatgcttcatcccgaagtattccnggtgcttgccccagtatcccatccctcactgtggg

SEQ ID NO: 36564 - DNA, 71 bp, chicken (Gallus Gallus)
  misc_feature (36): n=a or g
agggggtaaggtacagaagggagctgtgcagccagnagctgctctttgtatttcctaatatctgggtccat

SEQ ID NO: 36565 - DNA, 71 bp, chicken (Gallus Gallus)
  misc_feature (36): n=a or g
gagggagaggaactgccagatcactctgatgacaangagcagacaatactcctgggtaaggccctgcgagt

SEQ ID NO: 36566 - DNA, 71 bp, chicken (Gallus Gallus)
  misc_feature (36): n=c or t
tgctattttatttcactctctccagctattctctcnacaaaccaagtactttttaacaaggatagcacacg

SEQ ID NO: 36567 - DNA, 71 bp, chicken (Gallus Gallus)
  misc_feature (36): n=c or t
cagccttcagcatagaccggccatttatcttcattntatttgaagaagaaatgggcatcccactctttatt

SEQ ID NO: 36568 - DNA, 71 bp, chicken (Gallus Gallus)
  misc_feature (36): n=a or c
cttgctttaggctacaacattctatgcaattgctantccaatttaaacggttttacaccaagattttattt

SEQ ID NO: 36569 - DNA, 71 bp, chicken (Gallus Gallus)
  misc_feature (36): n=g or t
ctctgcggaccacagtgtactgataaaatctcctcngctctttgaattgtgctcagagcttcagaaactgc

SEQ ID NO: 36570 - DNA, 71 bp, chicken (Gallus Gallus)
  misc_feature (36): n=c or t
tttttttttccccaaaattttagcactaagccattngggatagagcaaaactctgatttagataaagaact

SEQ ID NO: 36571 - DNA, 71 bp, chicken (Gallus Gallus)
  misc_feature (36): n=g or t
tttaacacatttttacaagaacaaactttccagtcntcaacttgtctgattcttttctactgttttgacaa

SEQ ID NO: 36572 - DNA, 71 bp, chicken (Gallus Gallus)
  misc_feature (36): n=a or g
attcagaatctctgaagtaactttgctttcttgctntacataaacctgaattacataaccattgtgtcgtc

SEQ ID NO: 36573 - DNA, 71 bp, chicken (Gallus Gallus)
  misc_feature (36): n=g or t
tcctcacagagctcggaggagcatccctggggaggntcctcatggcagcagcattcgggatttggccctga

SEQ ID NO: 36574 - DNA, 71 bp, chicken (Gallus Gallus)
  misc_feature (36): n=c or t
tgggatgggttcttcgggatggacaccttgggatgnatgctttgggacatgcatgctgggatgggcacttt

SEQ ID NO: 36575 - DNA, 71 bp, chicken (Gallus Gallus)
  misc_feature (36): n=c or t
ctgttgctaggtttttgtcttacattttccagaagnacacagaaatctgtgatactggtgttgttgctctg

SEQ ID NO: 36576 - DNA, 71 bp, chicken (Gallus Gallus)
  misc_feature (36): n=a or g
tggtcccatcaccccaccaagcaccatcccaaaggnatgcagtaccatcaccattgtcccaaagggatgga

SEQ ID NO: 36577 - DNA, 71 bp, chicken (Gallus Gallus)
  misc_feature (36): n=g or t
tgggaaccggaggtggccctgggggtcagtcccgcnctctgctgatgggagtgaggtgtgacagagctcca

SEQ ID NO: 36578 - DNA, 71 bp, chicken (Gallus Gallus)
  misc_feature (36): n=a or g
cctcttccctccctgctctctggccaccacatccangctcagcagtcagatagtcacatatttttttaatt

SEQ ID NO: 36579 - DNA, 71 bp, chicken (Gallus Gallus)
  misc_feature (36): n=c or t
tattcaggataacaatgaggagttattaattggggnttttttcaggtttcctgaggtccctccagtagttg

SEQ ID NO: 36580 - DNA, 71 bp, chicken (Gallus Gallus)
  misc_feature (36): n=c or t
cctgtactaaagctgtcaccttttccattgctttcncttaactatttagtcaataaacattggtacgcttt

SEQ ID NO: 36581 - DNA, 71 bp, chicken (Gallus Gallus)
  misc_feature (36): n=c or t
gatgggaaggtcccagcctgcatcaggatgcacaangcatgtgctccttgctcttcccccctctctggtgc

SEQ ID NO: 36582 - DNA, 71 bp, chicken (Gallus Gallus)
  misc_feature (36): n=a or g
ttcctccctgctcctaatggtcccatttcttactanggttttacagcaagatcctttacatcactgaaccc

SEQ ID NO: 36583 - DNA, 71 bp, chicken (Gallus Gallus)
  misc_feature (36): n=a or c
ctccttacctcttctgactgttcatagacagcaccncgctggtgctctccagtttcacctccaccctcttg

SEQ ID NO: 36584 - DNA, 71 bp, chicken (Gallus Gallus)
  misc_feature (36): n=a or g
ctgtagaaaaagcagcttggtctgcagtgatgtttntgttaatacaccctggtgggtacagaagaatgggt

SEQ ID NO: 36585 - DNA, 71 bp, chicken (Gallus Gallus)
  misc_feature (36): n=a or g
ttggtaccaagtgatgcactgcgggctggagaggantagtcagcctgaagtcaacataggccttgtcactc

SEQ ID NO: 36586 - DNA, 71 bp, chicken (Gallus Gallus)
  misc_feature (36): n=a or g
gagggcttttgaagctgcggtaagacagacgtgtancgcagagaaccatggtctctttcagaggtgaaaat

SEQ ID NO: 36587 - DNA, 71 bp, chicken (Gallus Gallus)
  misc_feature (36): n=c or t
gccagctcatttccagtgcttcagatagggcactangacagctggtgcaccttcaaacaccgttcggacca

SEQ ID NO: 36588 - DNA, 71 bp, chicken (Gallus Gallus)
  misc_feature (36): n=a or g
ggacagatccatcccaaagggacccagggatgtgcngacattggcccccaccagacctactgccccacagc

SEQ ID NO: 36589 - DNA, 71 bp, chicken (Gallus Gallus)
  misc_feature (36): n=a or g
gattaacttcagaactgatactctttcttgaaaacnttttcactgtcaacaccatcatgttgacatctcca

SEQ ID NO: 36590 - DNA, 71 bp, chicken (Gallus Gallus)
  misc_feature (36): n=a or g
taggactttagtcgggcactctgagtttgtggaacncattctctcagaactggtatttacaagaacttata

SEQ ID NO: 36591 - DNA, 71 bp, chicken (Gallus Gallus)
  misc_feature (36): n=a or g
attgagatagtgtttgccatgggtagaaaatgaagngatgagaaaagtttatgataactttcaaaggataa

SEQ ID NO: 36592 - DNA, 71 bp, chicken (Gallus Gallus)
  misc_feature (36): n=c or t
ttcttaatttaaaattgataaaaccaaaccactatngacagcacttttaatatatttcactgtgaggtttt

SEQ ID NO: 36593 - DNA, 71 bp, chicken (Gallus Gallus)
  misc_feature (36): n=a or g
ggtgtaacccaagccttagaaacctgagaggaaatnatttagaatgtgaaagagacttttggctatgttac

SEQ ID NO: 36594 - DNA, 71 bp, chicken (Gallus Gallus)
  misc_feature (36): n=a or g
atgtgtggtgcagtgggtagcaaagatctgcacaanggacggatggttccccaaaggctgcaggtttatgg

SEQ ID NO: 36595 - DNA, 71 bp, chicken (Gallus Gallus)
  misc_feature (36): n=c or t
cttgtccaggcacacaaaccctggtgtgtttgcatngatggcaggaagggctttgatattgcagaaccaca

SEQ ID NO: 36596 - DNA, 71 bp, chicken (Gallus Gallus)
  misc_feature (36): n=c or t
tggtccaggcttacaaatctgaatgggcaccaatangtgcaccaatgggcttagcattaaaagtacaacca

SEQ ID NO: 36597 - DNA, 71 bp, chicken (Gallus Gallus)
  misc_feature (36): n=a or c
aaggatggtttcttggtggagctgtcagagggctcncggaagctgcggcacgtcttcctcttcaccgacgt

SEQ ID NO: 36598 - DNA, 71 bp, chicken (Gallus Gallus)
  misc_feature (36): n=c or t
tcggtgatcttatgaagttgtatattaacacactgngttaagtcatcattcattttgtggctggaaattac

SEQ ID NO: 36599 - DNA, 71 bp, chicken (Gallus Gallus)
  misc_feature (36): n=c or t
catgcgtaatagagcaaagtaaaactatttggggangtttaataactctttttagttgctgtgcaaacatg

SEQ ID NO: 36600 - DNA, 71 bp, chicken (Gallus Gallus)
  misc_feature (36): n=c or t
aagaaaagacagtagcttttcctttaataaaccaanctataaaagttcaagttgtttcttagcactggcat

SEQ ID NO: 36601 - DNA, 71 bp, chicken (Gallus Gallus)
  misc_feature (36): n=a or g
cctgttgcttcttccatcaatattttgtgctgctgngacctcttcctaccttgtttccatccttttccctg

SEQ ID NO: 36602 - DNA, 71 bp, chicken (Gallus Gallus)
  misc_feature (36): n=a or g
tacatcaggaacgttccgttgtgtgataacggtccncagacgaagtgctgtcatgatttatgaaatagttc

SEQ ID NO: 36603 - DNA, 71 bp, chicken (Gallus Gallus)
  misc_feature (36): n=c or t
ttttcttaggtatccatattttaatgaaattgatangctttttaatgtaggagacattttgatgatcttaa

SEQ ID NO: 36604 - DNA, 71 bp, chicken (Gallus Gallus)
  misc_feature (36): n=c or t
ccttccttctatttttattttcgagatctgattttngcagttatttctacacttcagaaagtgcctttctc

SEQ ID NO: 36605 - DNA, 71 bp, chicken (Gallus Gallus)
  misc_feature (36): n=a or g
atgaaatgggatagatgagactataatgaacggtcntaacatgtttctcagaatctgattttgatagacca

SEQ ID NO: 36606 - DNA, 71 bp, chicken (Gallus Gallus)
  misc_feature (36): n=a or c
agtggaacggagcaaagatgatcatcactttggacnccaacataacgatctccctgttggaaagatgtacg

SEQ ID NO: 36607 - DNA, 71 bp, chicken (Gallus Gallus)
  misc_feature (36): n=a or g
aggagatggcaatcccttcatcagacctacagcccnggtgctggtgacagtgccaaatccccagggccacg

SEQ ID NO: 36608 - DNA, 71 bp, chicken (Gallus Gallus)
  misc_feature (36): n=g or t
ctggatgcctcccaccaaggtcgctgctgttgaggnctttgattttggtggagacacacaggaatgaatta

SEQ ID NO: 36609 - DNA, 71 bp, chicken (Gallus Gallus)
  misc_feature (36): n=a or g
gagaggtgagctgacacctccacccttgcacccacngccctgcagcagcatgaatccaggctgtaccagta

SEQ ID NO: 36610 - DNA, 71 bp, chicken (Gallus Gallus)
  misc_feature (36): n=c or t
tgttatgctgtcacacacatcagagcatcaaataangtattaccatagataaaacatgccgaagctcttaa

SEQ ID NO: 36611 - DNA, 71 bp, chicken (Gallus Gallus)
  misc_feature (36): n=a or g
agtgttttgtatttggtgcacagctggaactgtctncccattaatctctgcagttatgatacagaggaaag

SEQ ID NO: 36612 - DNA, 71 bp, chicken (Gallus Gallus)
  misc_feature (36): n=c or t
tgcaagtctgcagtcagtgattagaaaatgtctgcnagtgtttagaaatgtttgtcataacacagggagtt

SEQ ID NO: 36613 - DNA, 71 bp, chicken (Gallus Gallus)
  misc_feature (36): n=a or g
tcatacagagcattccattgaaatctccaattgctntactgctgtaactgagatgatgaatgagggaatgg

SEQ ID NO: 36614 - DNA, 71 bp, chicken (Gallus Gallus)
  misc_feature (36): n=g or t
gcacataaattagtggcatccgctcgggatgctggntccagcgacaacattactgtcattgtggtatttct

SEQ ID NO: 36615 - DNA, 71 bp, chicken (Gallus Gallus)
  misc_feature (36): n=c or t
agttatgagtctggaagcacagtaagagctggtaanaagcaaagttacgttttatagctgcaagtgggaaa

SEQ ID NO: 36616 - DNA, 71 bp, chicken (Gallus Gallus)
  misc_feature (36): n=a or g
gtgtgcacaagttccatttgcttcccaaagcaggtnaggaaactcagttgtgattggttccctctgcttaa

SEQ ID NO: 36617 - DNA, 71 bp, chicken (Gallus Gallus)
  misc_feature (36): n=c or t
tcgctttgagctgtctgaaaaggtttgcggtgcccncgttgtataactgaagaaggtgaggtgctcgaggg

SEQ ID NO: 36618 - DNA, 71 bp, chicken (Gallus Gallus)
  misc_feature (36): n=c or t
aacactcatttagctgctgttaaggccttcgagtancttattgcaaggtcgctgttagtatttctctagtg

SEQ ID NO: 36619 - DNA, 71 bp, chicken (Gallus Gallus)
  misc_feature (36): n=a or g
gagaagttattttgaagctttgtcactgtgaaatanattttaacttaattctaactttagtgaaaattgct

SEQ ID NO: 36620 - DNA, 71 bp, chicken (Gallus Gallus)
  misc_feature (36): n=c or t
taaagcagtattaccatgctgaaagacattagtganaaaaacatcagccacgtactgtgtctttgacctat

SEQ ID NO: 36621 - DNA, 71 bp, chicken (Gallus Gallus)
  misc_feature (36): n=a or g
gcacatttgaattcacgtaaattgtacgtgactccnaacgtctttgagttctctgtcctatggtttcctga

SEQ ID NO: 36622 - DNA, 71 bp, chicken (Gallus Gallus)
  misc_feature (36): n=c or t
aacaaacggagctcgctttgaattgcagagcttcangtccaggccgggcaccgcggccaaggggatttttt

SEQ ID NO: 36623 - DNA, 71 bp, chicken (Gallus Gallus)
  misc_feature (36): n=c or t
tttcaacctaaactcactcccaccatcacgtggtgncgaaattgggaacaggagcggaataaaaagtaaac

SEQ ID NO: 36624 - DNA, 71 bp, chicken (Gallus Gallus)
  misc_feature (36): n=a or g
tcatctttggttataaacgttgttcactggaactcngctatctgtccagaaatgcatgtgtcattgaataa

SEQ ID NO: 36625 - DNA, 71 bp, chicken (Gallus Gallus)
  misc_feature (36): n=a or c
ttttacttgagaaaggattacaggcctggatcttancatcatatacctaaaccgtttcttgttcctctgcc

SEQ ID NO: 36626 - DNA, 71 bp, chicken (Gallus Gallus)
  misc_feature (36): n=a or c
agagccaaaagacagagctcgatggaaatgaagcanagaatcagaccatcatctgttcagcagtccttttc

SEQ ID NO: 36627 - DNA, 71 bp, chicken (Gallus Gallus)
  misc_feature (36): n=c or t
ctttggatctgaatatatgcagtgcatttggtacanggagacatgaacggagcataaatcttcacatggtt

SEQ ID NO: 36628 - DNA, 71 bp, chicken (Gallus Gallus)
  misc_feature (36): n=a or g
cgactctgcagaagagagggaggactccatttgacnaaggaaaaagacatatgagcagaaagtgcaaggtc

SEQ ID NO: 36629 - DNA, 71 bp, chicken (Gallus Gallus)
  misc_feature (36): n=c or t
ctgctaggctgtgacctaattgagacttttgatctnagctttttagaaacatgtgattcttcatagcctgt

SEQ ID NO: 36630 - DNA, 71 bp, chicken (Gallus Gallus)
  misc_feature (36): n=g or t
tttcaggtgagtaacacacaaattactcagctacangttagagtataaaacttctgaaaagtacccattca

SEQ ID NO: 36631 - DNA, 71 bp, chicken (Gallus Gallus)
  misc_feature (36): n=a or g
ttctgcaaagatctggatttttaaaggacatctcancaactcctttgaaactactggtgtacagatccagg

SEQ ID NO: 36632 - DNA, 71 bp, chicken (Gallus Gallus)
  misc_feature (36): n=c or t
tgcagaattggttagactgcttgaaagacccaatantgaacatttgcattcaacagaaacaaatcccaaag

SEQ ID NO: 36633 - DNA, 71 bp, chicken (Gallus Gallus)
  misc_feature (36): n=c or t
aagcaaataccacaagtaactgcatcaagtaaagcngtacccagcatcacctaaaaatcaagtattgaaat

SEQ ID NO: 36634 - DNA, 71 bp, chicken (Gallus Gallus)
  misc_feature (36): n=a or g
acgaagggcaactgagaaacctgtgggtatttcaantcacactgggagtttgagtgaccaacgtgcagcag

SEQ ID NO: 36635 - DNA, 71 bp, chicken (Gallus Gallus)
  misc_feature (36): n=a or g
gagaacatttcttcctctcttcacctgcttctttgnaatctttcttagcattaagaatctcgcctttaact

SEQ ID NO: 36636 - DNA, 71 bp, chicken (Gallus Gallus)
  misc_feature (36): n=c or t
ctcgaaggaagcagctcattcactttcccaaagcanagagaagacaaatcccacaggaatcccaaggctgc

SEQ ID NO: 36637 - DNA, 71 bp, chicken (Gallus Gallus)
  misc_feature (36): n=c or t
gttttacatttggttcttatttaaaaccaagcacanggattttctcccatcactagcatggttcagttgta

SEQ ID NO: 36638 - DNA, 71 bp, chicken (Gallus Gallus)
  misc_feature (36): n=a or g
attttctttttccacacagtagtttacacagtaaangaaacatcttcaaaggccaactgatcccattttta

SEQ ID NO: 36639 - DNA, 71 bp, chicken (Gallus Gallus)
  misc_feature (36): n=a or c
cgttggcaccacaaaggcaactctgttcccctgaanacccctatgaaggtttgctcagatgaacagatttc

SEQ ID NO: 36640 - DNA, 71 bp, chicken (Gallus Gallus)
  misc_feature (36): n=c or t
cagcttgtggctgagaagcagccatgttccctggcncgggagctgtaagcagcaccaccgtgtggcattgc

SEQ ID NO: 36641 - DNA, 71 bp, chicken (Gallus Gallus)
  misc_feature (36): n=c or t
atgaagttgagaaaacattaatgctttaactgcacngtttctagtcttactcgtgtaaagttgtcttcttc

SEQ ID NO: 36642 - DNA, 71 bp, chicken (Gallus Gallus)
  misc_feature (36): n=a or g
atagttttctaatgtaacaaatatcattgtcaaatnctaaatatatgccatttagagagagaaaaagagca

SEQ ID NO: 36643 - DNA, 71 bp, chicken (Gallus Gallus)
  misc_feature (36): n=a or g
ccaagggctgagctttccttctggggcctgtaaacnttatgacctcaggtacgctatgtacaatgacaagg

SEQ ID NO: 36644 - DNA, 71 bp, chicken (Gallus Gallus)
  misc_feature (36): n=c or t
ttccaggaaaatcatacctgtttcttggtcatgtcnagaaccagatcaacacacacctgcacaaaagttac

SEQ ID NO: 36645 - DNA, 71 bp, chicken (Gallus Gallus)
  misc_feature (36): n=c or t
taccccaaatgggggggaagaatgtttttaatttanacaggtttttctaataagaaatttaatacagtgaa

SEQ ID NO: 36646 - DNA, 71 bp, chicken (Gallus Gallus)
  misc_feature (36): n=c or t
aagggcctcaagtactccttgcactgcaaaggaagngttggaatagctgttttctattagtaagctactta

SEQ ID NO: 36647 - DNA, 71 bp, chicken (Gallus Gallus)
  misc_feature (36): n=a or g
aaaggctgatccagagaaaggaggaagatgacattntaagctgctcaagaatcctgtttctttttttttgc

SEQ ID NO: 36648 - DNA, 71 bp, chicken (Gallus Gallus)
  misc_feature (36): n=c or t
acgaccaactcccttctgattcttcctcacataagntatatttggtattcacattgcactggtcttatttt

SEQ ID NO: 36649 - DNA, 71 bp, chicken (Gallus Gallus)
  misc_feature (36): n=c or t
tgatccaaatctctggataatgattcaaaggagagnaagaaggcaatttgatctgcatgtatttgtaggag

SEQ ID NO: 36650 - DNA, 71 bp, chicken (Gallus Gallus)
  misc_feature (36): n=c or t
cccattcctcctttaaataagcttggacacctcacnctggaggactaccagatatggagtgtgaagagtgc

SEQ ID NO: 36651 - DNA, 71 bp, chicken (Gallus Gallus)
  misc_feature (36): n=c or t
cttagtaggaatgttggctgaaaagctgcaagtcangttccagggaaattacagctttttctatcagtgta

SEQ ID NO: 36652 - DNA, 71 bp, chicken (Gallus Gallus)
  misc_feature (36): n=a or g
gccttcacgagtgaagaagaactgggtgaagatganatgtactactgttccaaatgcaagacccattgttt

SEQ ID NO: 36653 - DNA, 71 bp, chicken (Gallus Gallus)
  misc_feature (36): n=a or g
tcagtgtagccttcactgcctcagaataagtaatcntgttggtgattatttcaaagtgatgtttgattcat

SEQ ID NO: 36654 - DNA, 71 bp, chicken (Gallus Gallus)
  misc_feature (36): n=c or t
tggtttggggcactgaaattccctgaggttaacagngagtccctcccctttgcttatccatgtttgcaatg

SEQ ID NO: 36655 - DNA, 71 bp, chicken (Gallus Gallus)
  misc_feature (36): n=a or g
cagtgtgagagtaatcagactatacagacttggagntagttctcctcccaaaaagctgcgtaactcctgat

SEQ ID NO: 36656 - DNA, 71 bp, chicken (Gallus Gallus)
  misc_feature (36): n=c or t
tgtgatcagtgctgtgcttggttatcacaagagcangacctcgtagactttgccccaaagtgggatttgct

SEQ ID NO: 36657 - DNA, 71 bp, chicken (Gallus Gallus)
  misc_feature (36): n=a or g
agggccattagttggagctaacctatcgataagagngagcacatacaaaaaagcctgacaaaggcagatgc

SEQ ID NO: 36658 - DNA, 71 bp, chicken (Gallus Gallus)
  misc_feature (36): n=g or t
gacccagactacgttccggcgataacggtgttccgngtctatgtcaatgtgttgacttccatcagcatctt

SEQ ID NO: 36659 - DNA, 71 bp, chicken (Gallus Gallus)
  misc_feature (36): n=a or c
tcacggccctcacagaggggctgaggcaagaactcngagaagcaaagactcatatacgagctacagtgagt

SEQ ID NO: 36660 - DNA, 71 bp, chicken (Gallus Gallus)
  misc_feature (36): n=a or g
taagtagtgagtagctgacttggctgccttgctggntttgaggcaggtgttttggataccttgtaaatagg

SEQ ID NO: 36661 - DNA, 71 bp, chicken (Gallus Gallus)
  misc_feature (36): n=g or t
tgagtgctgtgcggtttgcccccgatttaataaatncaatccattaattggatcattgcctgcttctgcag

SEQ ID NO: 36662 - DNA, 71 bp, chicken (Gallus Gallus)
  misc_feature (36): n=c or t
gaagcttccagtcctaattagagaatgtgcataccnaagcctcctagatggagacttccttggaaatgtgg

SEQ ID NO: 36663 - DNA, 71 bp, chicken (Gallus Gallus)
  misc_feature (36): n=a or g
gatagggatgcagatggatatatagatatgcacaancaactgtaaatgtaagatgaaaatagatctgcttg

SEQ ID NO: 36664 - DNA, 71 bp, chicken (Gallus Gallus)
  misc_feature (36): n=a or g
tgagattggagagcgtttcctgagctctggtgggantaaccagccttcctgtccacctcagccccatcctg

SEQ ID NO: 36665 - DNA, 71 bp, chicken (Gallus Gallus)
  misc_feature (36): n=a or g
tgaataagcagcacagcattcctcacccatcctccntctgctccaagaaaatccagtgttcagcatgacct

SEQ ID NO: 36666 - DNA, 71 bp, chicken (Gallus Gallus)
  misc_feature (36): n=c or t
actgtgtgcagttggaaagggataaggaaattgtcnactgaggcatgctgcttctcgtagcaggttctcag

SEQ ID NO: 36667 - DNA, 71 bp, chicken (Gallus Gallus)
  misc_feature (36): n=c or t
gggaaaccaacacgtgtgccgatatgaaatgtgagnctcacttttttggctgttccccctcccacctttct

SEQ ID NO: 36668 - DNA, 71 bp, chicken (Gallus Gallus)
  misc_feature (36): n=c or t
ctggttttgtttgcagatcacaaataacagcataangtagctcaccggtcccctcctgtctgtttcttctg

SEQ ID NO: 36669 - DNA, 71 bp, chicken (Gallus Gallus)
  misc_feature (36): n=c or t
tttaaagaaaggaaaaagatcttgcttatacttcangctcacatttattactccggaaaataaggttggtg

SEQ ID NO: 36670 - DNA, 71 bp, chicken (Gallus Gallus)
  misc_feature (36): n=a or g
aaaaaaaaaagcccacatcaccactcaccaaataantgaacttctttaggattagcctctctaatttcagc

SEQ ID NO: 36671 - DNA, 71 bp, chicken (Gallus Gallus)
  misc_feature (36): n=c or t
gagggaggtctccaaccttcactgctcgggttcagngtgtccttcaagctcagggaaatcagatgcttgct

SEQ ID NO: 36672 - DNA, 71 bp, chicken (Gallus Gallus)
  misc_feature (36): n=a or g
caactgtttacgtctaacgttaaattcaggagctcnatgttttactaacaaatcctgttttagaacctctt

SEQ ID NO: 36673 - DNA, 71 bp, chicken (Gallus Gallus)
  misc_feature (36): n=g or t
gttcccagccaccatttccgggtgagacattgagtntgggggccgggaggggtttcccagcctcttatggg

SEQ ID NO: 36674 - DNA, 71 bp, chicken (Gallus Gallus)
  misc_feature (36): n=c or t
tgtgaggcaccaggagcgtatttggggattgtcctnactgcgtgtgggtcgtgcagcaattctgcacaagg

SEQ ID NO: 36675 - DNA, 71 bp, chicken (Gallus Gallus)
  misc_feature (36): n=c or t
atgatgacttttatcaccaggtaagtgtctgccaanctgtgttggcattgtgactttgcttatttttgaat

SEQ ID NO: 36676 - DNA, 71 bp, chicken (Gallus Gallus)
  misc_feature (36): n=c or t
tgacagatgagcagtgtgaaggccaggaggttcccngcgaagcagcctggccgtcctcctgtcacatccca

SEQ ID NO: 36677 - DNA, 71 bp, chicken (Gallus Gallus)
  misc_feature (36): n=a or g
gtgctgattttgagtaacactttggaccagaaatgnagaaagaaagagctccagcttattttaccttcccg

SEQ ID NO: 36678 - DNA, 71 bp, chicken (Gallus Gallus)
  misc_feature (36): n=a or g
agaacttcactgaacttacacccagggaagagcacngccttcctacatgtgtgttcccacttacctttact

SEQ ID NO: 36679 - DNA, 71 bp, chicken (Gallus Gallus)
  misc_feature (36): n=a or g
aggtgctctcactgatccacacggtcagaaacaacnccaaggaaagaattccagaaaagtgtaaaagattt

SEQ ID NO: 36680 - DNA, 71 bp, chicken (Gallus Gallus)
  misc_feature (36): n=c or t
ttctgcgctccactaacgaaggtatttgaataaaancctgcaagaaatttgggccatattcttataaacat

SEQ ID NO: 36681 - DNA, 71 bp, chicken (Gallus Gallus)
  misc_feature (36): n=a or g
agaggaaaagggagggaaaagagttatgtttgagancttccgaagcaaagagaagggtactacaacaaaac

SEQ ID NO: 36682 - DNA, 71 bp, chicken (Gallus Gallus)
  misc_feature (36): n=c or t
tgatgatggcagattccagcataaggatttctgtgnatttctatgctagaatctgtgttcagattgtgtct

SEQ ID NO: 36683 - DNA, 71 bp, chicken (Gallus Gallus)
  misc_feature (36): n=a or g
gagaacttgcagagccactctcacctgttccatgtnctcaaataccaccgaagttgcaatagaagcaggtg

SEQ ID NO: 36684 - DNA, 71 bp, chicken (Gallus Gallus)
  misc_feature (36): n=a or c
agaggtaacggatcactcaggtgcactcacacaacncttctgcatctgactcagttctctaatttagagat

SEQ ID NO: 36685 - DNA, 71 bp, chicken (Gallus Gallus)
  misc_feature (36): n=a or g
tcattccaggtgagggggttggtgatgccatgcacnctggcacagcttgtgtcctggcaggcaaggagcag

SEQ ID NO: 36686 - DNA, 71 bp, chicken (Gallus Gallus)
  misc_feature (36): n=a or g
attagaagagaccccctgccctacacaatgactganagcctttattttcccagctgctgatgatccccccc

SEQ ID NO: 36687 - DNA, 71 bp, chicken (Gallus Gallus)
  misc_feature (36): n=c or t
gaaatcctgctgacttcaggttggggcctgggttangcaagctgaattgtataagcattaaaagctgcaag

SEQ ID NO: 36688 - DNA, 71 bp, chicken (Gallus Gallus)
  misc_feature (36): n=a or c
gactgtgttatgctcattaagttaccatactgcaancccatgccaaaaatctgctggcagcactacgagct

SEQ ID NO: 36689 - DNA, 71 bp, chicken (Gallus Gallus)
  misc_feature (36): n=c or t
acaatttttcccagatatttctgaaaccccagccanttccaggaaaattcttcctggtgaacttctgtatg

SEQ ID NO: 36690 - DNA, 71 bp, chicken (Gallus Gallus)
  misc_feature (36): n=c or t
atctgtgtttattgtccggagttctgtactactgcntgctcaaaaagggcagctgttattctttcttaagg

SEQ ID NO: 36691 - DNA, 71 bp, chicken (Gallus Gallus)
  misc_feature (36): n=g or t
tgagcaaccctgggaagggccgaacacttctccggncactgtcctggcttttggatccgtatcattcccac

SEQ ID NO: 36692 - DNA, 71 bp, chicken (Gallus Gallus)
  misc_feature (36): n=c or t
gcctgcaccgccagcgagcactaatgcagcactccngagaactgcctaatgacagtcaatcacctcccggg

SEQ ID NO: 36693 - DNA, 71 bp, chicken (Gallus Gallus)
  misc_feature (36): n=c or t
gtatttaaaccacaacagacctcagccaggagcccngtgcagagcgaccgctgctgtggtcgaggcctgat

SEQ ID NO: 36694 - DNA, 71 bp, chicken (Gallus Gallus)
  misc_feature (36): n=c or t
aaggtctgcatttaagagacctcactgtcccagccngcatcatggttctccaatatgaaatttgattcaaa

SEQ ID NO: 36695 - DNA, 71 bp, chicken (Gallus Gallus)
  misc_feature (36): n=a or g
ctcctgccatcagacatgagctcagaaagggccacntcccacatgtggggctgcacagacacctacacagc

SEQ ID NO: 36696 - DNA, 71 bp, chicken (Gallus Gallus)
  misc_feature (36): n=a or c
gctgataatagaaagacatgcattttacacagtaanaggacagcctctggaggttaaggacaatgtgagtg

SEQ ID NO: 36697 - DNA, 71 bp, chicken (Gallus Gallus)
  misc_feature (36): n=c or t
ctgcacacggctgaccaaaggctgctccgccggacngcagtgctgggatgtacacctcctccacccccctg

SEQ ID NO: 36698 - DNA, 71 bp, chicken (Gallus Gallus)
  misc_feature (36): n=a or g
acatgaaacaccaacaccgggctgccttttatctcngagataaagactgcttttggtgtaatcagctccac

SEQ ID NO: 36699 - DNA, 71 bp, chicken (Gallus Gallus)
  misc_feature (36): n=c or t
aaggcccgttatacaatttatactacacacctgctngaaaccagtcatattttaactccctcttcatagtt

SEQ ID NO: 36700 - DNA, 71 bp, chicken (Gallus Gallus)
  misc_feature (36): n=g or t
ttcatttattgtcattgttataagcttatcaagaanggcagtgactcgctggcgcttcgcatcgtcgttgt

SEQ ID NO: 36701 - DNA, 71 bp, chicken (Gallus Gallus)
  misc_feature (36): n=a or g
gcactgtggcaaatggaggaaagggagttctgaccncaccacatagccagggttgtacatgctgtaataac

SEQ ID NO: 36702 - DNA, 71 bp, chicken (Gallus Gallus)
  misc_feature (36): n=c or t
gcagatgacacagaccgagccctgcacagtggctgngtcacctcacatgattgacatggggacccaactgc

SEQ ID NO: 36703 - DNA, 71 bp, chicken (Gallus Gallus)
  misc_feature (36): n=a or g
ggttgctggtaaattatttacagccgtatcacttgntgaaacacttggtctgctaaagctatcacgtaagt

SEQ ID NO: 36704 - DNA, 71 bp, chicken (Gallus Gallus)
  misc_feature (36): n=a or c
atctatgcctttgggtaaggggaagagacctgaagngtatcactggaactttctaaatgagatatgataca

SEQ ID NO: 36705 - DNA, 71 bp, chicken (Gallus Gallus)
  misc_feature (36): n=c or t
aacaacaggataagaaattaacctcttagacctccnagttctcacattagggcaataaagagtaggcccag

SEQ ID NO: 36706 - DNA, 71 bp, chicken (Gallus Gallus)
  misc_feature (36): n=a or g
ctgcatcagcttatatggaaaatggctggcaggagnctgtaacagtgctacagcacatgcacaaagattgg

SEQ ID NO: 36707 - DNA, 71 bp, chicken (Gallus Gallus)
  misc_feature (36): n=a or g
tggcaaattattatatactgactttaagcacctgantagttccagttaaagacaagatcatgtttaagctc

SEQ ID NO: 36708 - DNA, 71 bp, chicken (Gallus Gallus)
  misc_feature (36): n=a or c
aagaaaggtgcagtctgaccgtctttgtgaaagggntttgttttgtctgactggggtaggtcctgatcttg

SEQ ID NO: 36709 - DNA, 71 bp, chicken (Gallus Gallus)
  misc_feature (36): n=c or t
gtaatgtgttttgaaaattacactctactgggattngtgctgaggctgcttatgagttcacgtttcaaaca

SEQ ID NO: 36710 - DNA, 71 bp, chicken (Gallus Gallus)
  misc_feature (36): n=a or g
agtcagtaatctgtaatgaattccctttggagctcnacacttcaagcttgaaactgtagaggaacttcatt

SEQ ID NO: 36711 - DNA, 71 bp, chicken (Gallus Gallus)
  misc_feature (36): n=c or t
tttgattctcattaagattgtccttaaaatttgttnataccattattgcaatattgaacactgaactggaa

SEQ ID NO: 36712 - DNA, 71 bp, chicken (Gallus Gallus)
  misc_feature (36): n=a or c
tagccttcactggatatggtcacaaaaaatgcaagnaatgtcgtgcagtgttgttagcagttctttattat

SEQ ID NO: 36713 - DNA, 71 bp, chicken (Gallus Gallus)
  misc_feature (36): n=a or c
gatgacgtgttgcttgtgcctggactttcaccctcnggctctaggcaaagatgatgatctaacgtgtgagt

SEQ ID NO: 36714 - DNA, 71 bp, chicken (Gallus Gallus)
  misc_feature (36): n=a or c
ggcttggactttgcctccttaatgtttacagaacgnagaagacttctatttttggcagtgatactccctgg

SEQ ID NO: 36715 - DNA, 71 bp, chicken (Gallus Gallus)
  misc_feature (36): n=a or g
gctcccagagcagcctgcacccaccacgccaggctnggactgctgcattgttgcccctgcacgtgcaggga

SEQ ID NO: 36716 - DNA, 71 bp, chicken (Gallus Gallus)
  misc_feature (36): n=a or c
gtgcaagaaagggaagtgcaaatcccaagggaagcngagtaaggagagctcaaatcctgaacgtggagcac

SEQ ID NO: 36717 - DNA, 71 bp, chicken (Gallus Gallus)
  misc_feature (36): n=c or t
ctacagcttctcacacgcattgatctggtgaaatcngtgttgtatagttttgtaaataggtgaagatttca

SEQ ID NO: 36718 - DNA, 71 bp, chicken (Gallus Gallus)
  misc_feature (36): n=c or t
gcccatatacagtctcatagcatttccattcatttnttggatgttggccctgggtcaaggctatggatggc

SEQ ID NO: 36719 - DNA, 71 bp, chicken (Gallus Gallus)
  misc_feature (36): n=g or t
gaagttatgtcgacctcagcaggaattgcacatatnaaatactattgcctagaaaagttagaaacatcttg

SEQ ID NO: 36720 - DNA, 71 bp, chicken (Gallus Gallus)
  misc_feature (36): n=a or g
actggcttcttccagagatggattattcccccacanacaatacattgatcctaacagacttccatctgttt

SEQ ID NO: 36721 - DNA, 71 bp, chicken (Gallus Gallus)
  misc_feature (36): n=c or t
ggtgtgacacgtggctctgctgcacctgaggcaatntcctgtaatgagggctgttagtccccagatcacaa

SEQ ID NO: 36722 - DNA, 71 bp, chicken (Gallus Gallus)
  misc_feature (36): n=c or t
tgaaagaacccctggatcaaactctcagtgttcggngagtttgctggaaatttgccaccagccaacagact

SEQ ID NO: 36723 - DNA, 71 bp, chicken (Gallus Gallus)
  misc_feature (36): n=a or g
cttggttgatgttgaaggagacagtttaccccgcanacatatttgtctactacatctgttcctacttgtca

SEQ ID NO: 36724 - DNA, 71 bp, chicken (Gallus Gallus)
  misc_feature (36): n=g or t
atgcttgaaacgaaatgaaaaccagcttctttaatnggcttcagtaacctactttgtacagtaaaatctgt

SEQ ID NO: 36725 - DNA, 71 bp, chicken (Gallus Gallus)
  misc_feature (36): n=c or t
gttctgattacctaaagatatgttaaaggtagattnacataattaattatcaaatgtaaggttccttacac

SEQ ID NO: 36726 - DNA, 71 bp, chicken (Gallus Gallus)
  misc_feature (36): n=a or g
tttcaaagggaatgaaaatgttttcttttctccacntgaagattcaggttgtggatcatgagctgcctgcc

SEQ ID NO: 36727 - DNA, 71 bp, chicken (Gallus Gallus)
  misc_feature (36): n=a or c
gaatactcatactcatagcatcgttatcttcagaancattaaaaatgcattctaggaaccttgtgagcgat

SEQ ID NO: 36728 - DNA, 71 bp, chicken (Gallus Gallus)
  misc_feature (36): n=a or g
caaaaacaggatgaacaaattcagtggtagtatagntgtatggatgactgttaaataccagttgctgtagt

SEQ ID NO: 36729 - DNA, 71 bp, chicken (Gallus Gallus)
  misc_feature (36): n=a or g
agataacaaatggggggttgtctttcttatgactgngtctcccacagttcttatttctgcaactattgaca

SEQ ID NO: 36730 - DNA, 71 bp, chicken (Gallus Gallus)
  misc_feature (36): n=g or t
cagtgggagtggaaggtattaagttttgtgctaagngagctaatttcacagtctcagactacctcccaaaa

SEQ ID NO: 36731 - DNA, 71 bp, chicken (Gallus Gallus)
  misc_feature (36): n=c or t
tgactatttttggttaaaatatgtgctattaacagnttaggtttgcaagatagaaatctttctcatattgt

SEQ ID NO: 36732 - DNA, 71 bp, chicken (Gallus Gallus)
  misc_feature (36): n=a or g
cttggagaacatttctgcaggccatgagccacttgngttatttctgggatcccatcacctcagcagcagcc

SEQ ID NO: 36733 - DNA, 71 bp, chicken (Gallus Gallus)
  misc_feature (36): n=c or t
gtaggcagccattcaaagttctctaaagacttctantaaaggttccctgaaggttttcaccactacctgga

SEQ ID NO: 36734 - DNA, 71 bp, chicken (Gallus Gallus)
  misc_feature (36): n=a or g
ggcctacctgcattcccaaatgttattttgaaaacntttctaatatgaaacaaacggcaaaaaaaaaaaaa

SEQ ID NO: 36735 - DNA, 71 bp, chicken (Gallus Gallus)
  misc_feature (36): n=c or t
acagccaagtcttcctgtgcagcccagaatgcacanatgggcttgcactgagcaagtctgtcaccaacacc

SEQ ID NO: 36736 - DNA, 71 bp, chicken (Gallus Gallus)
  misc_feature (36): n=c or t
ataaaaagcacagaagcagcacgtgtttcttcttcntccacccctacttgagaaaagatagaaggaagaaa

SEQ ID NO: 36737 - DNA, 71 bp, chicken (Gallus Gallus)
  misc_feature (36): n=a or g
gatcttcttcccagtaagagggctaaactccccatngtactgacagcattgtgacagctgtctattttgta

SEQ ID NO: 36738 - DNA, 71 bp, chicken (Gallus Gallus)
  misc_feature (36): n=a or g
gaacaaaagatatcatacagaatctttctgctcagnaagttgaaggatgaataagagcttccatgcagaca

SEQ ID NO: 36739 - DNA, 71 bp, chicken (Gallus Gallus)
  misc_feature (36): n=a or g
ttttctgtgaaatatggccctgtggtactgcctacnatttaagcactccaagttaagaccaaacacgcgca

SEQ ID NO: 36740 - DNA, 71 bp, chicken (Gallus Gallus)
  misc_feature (36): n=c or t
gtgagcaaataacttaccagctgcccagttttgaangttttcccatcccactctattgcagaatatattgc

SEQ ID NO: 36741 - DNA, 71 bp, chicken (Gallus Gallus)
  misc_feature (36): n=c or t
atgttttagaattaacagacaaacccttcaaattgnattttttcacttcagcctaaatattgtgcttattg

SEQ ID NO: 36742 - DNA, 71 bp, chicken (Gallus Gallus)
  misc_feature (36): n=a or c
ttcatgctccaaaagctcaagaacatagaaacaagntaagataatcccactgtcttcaatcagtagtctta

SEQ ID NO: 36743 - DNA, 71 bp, chicken (Gallus Gallus)
  misc_feature (36): n=a or g
agagagcatgaactcagtcaactgcctgaaatgatngagatgtaataaatcatatccttgaaataccaaag

SEQ ID NO: 36744 - DNA, 71 bp, chicken (Gallus Gallus)
  misc_feature (36): n=a or g
gtttgccttagtgaaggtgtcagtatagagaaagcntatagagagactgagtgcatgacctcaggcttctg

SEQ ID NO: 36745 - DNA, 71 bp, chicken (Gallus Gallus)
  misc_feature (36): n=a or g
acaaccctgaaaataaccaaatctagaccatgaganagcttctgtgtagataatcaattttatgctcagta

SEQ ID NO: 36746 - DNA, 71 bp, chicken (Gallus Gallus)
  misc_feature (36): n=a or g
aactactgtagaaggattccaggattgtccctttgntacctgcataacaccgcagcataaaatgtgctcta

SEQ ID NO: 36747 - DNA, 71 bp, chicken (Gallus Gallus)
  misc_feature (36): n=c or t
cattatgtgtgggatagtgaagtatttgcagtgctncaaagtattttcattagtacataacagtgaaatgc

SEQ ID NO: 36748 - DNA, 71 bp, chicken (Gallus Gallus)
  misc_feature (36): n=g or t
tctcaggcttctgcaatgcagtcatcattatacttngtctctatttgctgaatgcaaccctaaaaagctgt

SEQ ID NO: 36749 - DNA, 71 bp, chicken (Gallus Gallus)
  misc_feature (36): n=c or t
taaaggaccatttatctactgtcccatgtgcacttnctcattccatcagactgcttctctaccagagcagt

SEQ ID NO: 36750 - DNA, 71 bp, chicken (Gallus Gallus)
  misc_feature (36): n=a or g
tctttgcatgaaaaccattctgcttcacctttagcnataggttcttagaaataattattccatgcactccg

SEQ ID NO: 36751 - DNA, 71 bp, chicken (Gallus Gallus)
  misc_feature (36): n=a or c
aaggtggttctctttagagaagataacctgtagttnatgattacaagtatatacaataaatctcagtcagt

SEQ ID NO: 36752 - DNA, 71 bp, chicken (Gallus Gallus)
  misc_feature (36): n=c or t
agtatggaagcataatccagtgcagaaaagcgatangaggtcacaaaggttgaacatggtgaagttaggac

SEQ ID NO: 36753 - DNA, 71 bp, chicken (Gallus Gallus)
  misc_feature (36): n=a or g
acagaaatttctggaacttctaagaagaggaactcntcaacgtgacaaacaataccaagataaaggtatca

SEQ ID NO: 36754 - DNA, 71 bp, chicken (Gallus Gallus)
  misc_feature (36): n=a or g
aagttctgttcacaaatcttgaaatgatctgggcangaactctctgtttgcatatgttcagatgatttcca

SEQ ID NO: 36755 - DNA, 71 bp, chicken (Gallus Gallus)
  misc_feature (36): n=a or g
aaatattttactgaaagatcttttgcataacttctnttactaagtgattaagtacatatagtattaattca

SEQ ID NO: 36756 - DNA, 71 bp, chicken (Gallus Gallus)
  misc_feature (36): n=a or g
aatttctgcccaagtgccacttttaacagcaatgangaaatgctgcgcaaggcaaacaagtttggtatttg

SEQ ID NO: 36757 - DNA, 71 bp, chicken (Gallus Gallus)
  misc_feature (36): n=a or g
ggttttgcagaaagaagggcccactggtttggaacngtaccaaccaccagcttattttgtatttaaggagc

SEQ ID NO: 36758 - DNA, 71 bp, chicken (Gallus Gallus)
  misc_feature (36): n=c or t
tgccttgttagagctgatacaggaggaaacaaacantaaactaaacaaaatgttcttcaacatttctaaca

SEQ ID NO: 36759 - DNA, 71 bp, chicken (Gallus Gallus)
  misc_feature (36): n=g or t
gccgtgttgtacataacgttttttttctctgtgcantgtcctccattgctctattagttctgctggctgtg

SEQ ID NO: 36760 - DNA, 71 bp, chicken (Gallus Gallus)
  misc_feature (36): n=c or t
caaaatgagatggaacctgaaaccttcagttgcttntgaattcaaattgatgagttgttttcaaagggcag

SEQ ID NO: 36761 - DNA, 71 bp, chicken (Gallus Gallus)
  misc_feature (36): n=a or g
atttaaaagattatttaagatcgcagcaacaaatgntatgtttaattaatgttaggtttaaagaagctgaa

SEQ ID NO: 36762 - DNA, 71 bp, chicken (Gallus Gallus)
  misc_feature (36): n=c or t
tagtaaaacatttctactttatatatttttcatctngggagcagcataaactatctcggacttaaaaggta

SEQ ID NO: 36763 - DNA, 71 bp, chicken (Gallus Gallus)
  misc_feature (36): n=c or t
aacaatatagtgcagcctacataaccaaacggatcnctacggcctacctggatttttgaggctgtgaaaga

SEQ ID NO: 36764 - DNA, 71 bp, chicken (Gallus Gallus)
  misc_feature (36): n=a or g
atattttaacactttacatttccaaacaatattccnagttgttcccaagcatggcagaaaccttttaattc

SEQ ID NO: 36765 - DNA, 71 bp, chicken (Gallus Gallus)
  misc_feature (36): n=a or c
agtgcgtagtttgtgaggtactgaaaaacgcttgangatgctgctaactgccccagtatgctggtttcctg

SEQ ID NO: 36766 - DNA, 71 bp, chicken (Gallus Gallus)
  misc_feature (36): n=a or g
tttacaaatatagtgcacaggggccaaagaaaacantaaagatactaataattcactaaggtttgctaccg

SEQ ID NO: 36767 - DNA, 71 bp, chicken (Gallus Gallus)
  misc_feature (36): n=a or g
agcatagcagctatgctaaatcaagcatggaaatanccattgaactaggacagttgaaagatgtaacattt

SEQ ID NO: 36768 - DNA, 71 bp, chicken (Gallus Gallus)
  misc_feature (36): n=c or t
ttttaccataccttttctgaatgattaagcctatcntgtgcttgtttcctttctgcttccactctttcaag

SEQ ID NO: 36769 - DNA, 71 bp, chicken (Gallus Gallus)
  misc_feature (36): n=c or t
tcacaaccagtaaactacaacttatggcaagacagnaatacattaaacagttaaagcaacagtggtatttt

SEQ ID NO: 36770 - DNA, 71 bp, chicken (Gallus Gallus)
  misc_feature (36): n=a or g
agcatacactcttcttgatgatttatgccttacctntgacgacaagagttagatacaaaatacattagttt

SEQ ID NO: 36771 - DNA, 71 bp, chicken (Gallus Gallus)
  misc_feature (36): n=c or t
tgagagaggtctgctcccaacagcacctatgcctgntaggacattgtgaacgctgcactagctccgctcag

SEQ ID NO: 36772 - DNA, 71 bp, chicken (Gallus Gallus)
  misc_feature (36): n=c or t
tgattgtatgctatagcaggtattttacaagcaccntgatatgctttcaaatctttcatgtgctttttaaa

SEQ ID NO: 36773 - DNA, 71 bp, chicken (Gallus Gallus)
  misc_feature (36): n=c or t
aaaagctagaagaaactgggaagttgaaaggagaangcaaaatgcaactggtcactgaccaaacattagtt

SEQ ID NO: 36774 - DNA, 71 bp, chicken (Gallus Gallus)
  misc_feature (36): n=c or t
gcagtaggatgccagcagctggacaagttctgcacngtgtttcaccaatcattctgtagcataaccatcca

SEQ ID NO: 36775 - DNA, 71 bp, chicken (Gallus Gallus)
  misc_feature (36): n=a or g
atttggggtctttcttcctctagtgctgtttacatntaagttttgaagcgatagtgattttaaaagcagcc

SEQ ID NO: 36776 - DNA, 71 bp, chicken (Gallus Gallus)
  misc_feature (36): n=a or g
tgtggtggaaggctgggaagagcgtatgcctgtgcnttacatctaatctgctttccttcagaaagcaaaat

SEQ ID NO: 36777 - DNA, 71 bp, chicken (Gallus Gallus)
  misc_feature (36): n=a or g
taccatctaactgctcttagaaggctgctttatgantagaattgctgtactggtgagctgagagtattcct

SEQ ID NO: 36778 - DNA, 71 bp, chicken (Gallus Gallus)
  misc_feature (36): n=a or c
tttgttcaaaattatctgtgtatctgtctttttggntgaagtaaatagccctccccttttggtacttattg

SEQ ID NO: 36779 - DNA, 71 bp, chicken (Gallus Gallus)
  misc_feature (36): n=a or g
ggcagctcaggagaacccatactctgcaacactcgncatatgctgcgcaaaagttaaaagcaactggaagc

SEQ ID NO: 36780 - DNA, 71 bp, chicken (Gallus Gallus)
  misc_feature (36): n=a or g
taattgcactcctaaacaactgcttggggggcatcnggatggagggaaagattctgtgccatggtttgaag

SEQ ID NO: 36781 - DNA, 71 bp, chicken (Gallus Gallus)
  misc_feature (36): n=c or t
gttgatttcatgataaccatcagactatatgagcanaaccatttcttgtcttatagcactgctgagagcag

SEQ ID NO: 36782 - DNA, 71 bp, chicken (Gallus Gallus)
  misc_feature (36): n=a or g
aggcaaggcagctgctcagtcattcttgcctagacnggacaaggctgaaatgacagccccatgactgaaag

SEQ ID NO: 36783 - DNA, 71 bp, chicken (Gallus Gallus)
  misc_feature (36): n=c or t
gcctgatttacccgtgaaccaatttgacttttttangtctggacaaactcgttgagctccaactctgctcc

SEQ ID NO: 36784 - DNA, 71 bp, chicken (Gallus Gallus)
  misc_feature (36): n=c or t
tacaagaggctctttggaacaactgagtgtgatctngcaggcattttcccactgttgttcccaccgtccca

SEQ ID NO: 36785 - DNA, 71 bp, chicken (Gallus Gallus)
  misc_feature (36): n=a or g
ttgttcttcagcagctccgctggttatttgtcattngtggctccccagtgctctgtgcccatccgttttcc

SEQ ID NO: 36786 - DNA, 71 bp, chicken (Gallus Gallus)
  misc_feature (36): n=g or t
aactttgggtcacacacttgatggacctcttgctgnatggtccataggtagttttgggaacatctgttatc

SEQ ID NO: 36787 - DNA, 71 bp, chicken (Gallus Gallus)
  misc_feature (36): n=c or t
agttgtccttctgaacacagactgcaaaatattagnctctcttctcaacaagagacaagaggaaataccaa

SEQ ID NO: 36788 - DNA, 71 bp, chicken (Gallus Gallus)
  misc_feature (36): n=c or t
cctgttcacatcctggacatttaggggctcagtcangccaacagcagacattctcatagctctactgtaac

SEQ ID NO: 36789 - DNA, 71 bp, chicken (Gallus Gallus)
  misc_feature (36): n=c or t
tggtcattttcctgagcctcagacctgatgtgggtntgaccattttggtccagttaaatcatctcttgtga

SEQ ID NO: 36790 - DNA, 71 bp, chicken (Gallus Gallus)
  misc_feature (36): n=a or g
tcctgccccgatccagtgaccacatccagatgtgcngatatgccaggtttgctccccacaaagaggctgcc

SEQ ID NO: 36791 - DNA, 71 bp, chicken (Gallus Gallus)
  misc_feature (36): n=a or g
taccaatgcatgtagtcgagccagcagatacaaggnaagctgaggaccaagttaattagctgagttcatgt

SEQ ID NO: 36792 - DNA, 71 bp, chicken (Gallus Gallus)
  misc_feature (36): n=a or g
cagttctctctgaaatcactctgctctttgcatgcntggtgcttgctgggtatcaattgaattaatacttt

SEQ ID NO: 36793 - DNA, 71 bp, chicken (Gallus Gallus)
  misc_feature (36): n=c or t
ggacatgtgcccgtcccagagagcggtcagtgcagngacccagatgcagtagctgttccacatccatgcat

SEQ ID NO: 36794 - DNA, 71 bp, chicken (Gallus Gallus)
  misc_feature (36): n=c or t
tcctcctagctcaggtcccagcataaagtgtccctngcaagactcaaacctaacctttgtccaagcttctg

SEQ ID NO: 36795 - DNA, 71 bp, chicken (Gallus Gallus)
  misc_feature (36): n=a or g
ttgtaagctcccttccccaaactgccaaaacccccntccttacaaaaactcatatttcatccaaagacagg

SEQ ID NO: 36796 - DNA, 71 bp, chicken (Gallus Gallus)
  misc_feature (36): n=c or t
gaataatcatgctgtaaataatggcttaagaagagnaccacacttttgtccttggcaagcatttcttcaga

SEQ ID NO: 36797 - DNA, 71 bp, chicken (Gallus Gallus)
  misc_feature (36): n=a or g
gaaggcagatttgacatcccccgattaaacatttcntaggtcattgtagttcaaacagataataaacctga

SEQ ID NO: 36798 - DNA, 71 bp, chicken (Gallus Gallus)
  misc_feature (36): n=g or t
ttcttcaaactgtctgagagagctcaaggaacgctnaaggcactttgtgctttttgctactgctctacact

SEQ ID NO: 36799 - DNA, 71 bp, chicken (Gallus Gallus)
  misc_feature (36): n=c or t
acactgagcagcacggagggagatctgcttctcttncacttgctgagcacaccctgcactgtgcaccgatt

SEQ ID NO: 36800 - DNA, 71 bp, chicken (Gallus Gallus)
  misc_feature (36): n=c or t
tgtgatatcccctgtgccacaattcctcatactttnctccatgtctagagagcacaagctcttatgggatt

SEQ ID NO: 36801 - DNA, 71 bp, chicken (Gallus Gallus)
  misc_feature (36): n=c or t
gaaagtagactgtaactagtaagaattactgactcnttccccttcccggtagcatttgtttaagttctgga

SEQ ID NO: 36802 - DNA, 71 bp, chicken (Gallus Gallus)
  misc_feature (36): n=a or g
agcagcattactacacccatagcctgtgcagcaagngcttctggcacccactcaaatagagttaagtatta

SEQ ID NO: 36803 - DNA, 71 bp, chicken (Gallus Gallus)
  misc_feature (36): n=c or t
taagctaattaagtccataacatcatacttgtctancacctacagtacagagaggtggtaatactttaacc

SEQ ID NO: 36804 - DNA, 71 bp, chicken (Gallus Gallus)
  misc_feature (36): n=g or t
atagatgtacctctataattagtttgaggaataaanagactgcttgttgaatcaaaattgcagtacttgga

SEQ ID NO: 36805 - DNA, 71 bp, chicken (Gallus Gallus)
  misc_feature (36): n=g or t
atttcacaaaaaaatgtactaccagagctgttgttntttctgcagaaccaggtaaccatgactggcagagt

SEQ ID NO: 36806 - DNA, 71 bp, chicken (Gallus Gallus)
  misc_feature (36): n=c or t
gactgattaatcccttaaacaagcaagctggaacanatatgaatagaggctataaatgtcttagtatctaa

SEQ ID NO: 36807 - DNA, 71 bp, chicken (Gallus Gallus)
  misc_feature (36): n=c or t
gcaagtttcccatttcccagagatttccaagttggntttggctttcgaacgatggcgtcgactggaacgct

SEQ ID NO: 36808 - DNA, 71 bp, chicken (Gallus Gallus)
  misc_feature (36): n=a or g
cattcagttaagtaggccacatacagtaattttacntgttttccattgaagctgctgaacttttatcacag

SEQ ID NO: 36809 - DNA, 71 bp, chicken (Gallus Gallus)
  misc_feature (36): n=g or t
gtttcgttcacatcaatgtgtttaatgtactggggngaaaaaataactttccttctaaccagtgtgattca

SEQ ID NO: 36810 - DNA, 71 bp, chicken (Gallus Gallus)
  misc_feature (36): n=c or t
gttcagaactgctttgctgcatcttcagctgttgtncaaagtaattaccatgaatgcaggagccctcttgg

SEQ ID NO: 36811 - DNA, 71 bp, chicken (Gallus Gallus)
  misc_feature (36): n=c or t
ctcttgccccagaatttgagtttaggataaattganccatgaaacacaaaatcattatttaaaccttcagc

SEQ ID NO: 36812 - DNA, 71 bp, chicken (Gallus Gallus)
  misc_feature (36): n=c or t
agatagatagcttgtaaggggttttcctcacagtcngcttcaccaaagcactttctgtcttgcagaccaca

SEQ ID NO: 36813 - DNA, 71 bp, chicken (Gallus Gallus)
  misc_feature (36): n=c or t
ggcacggccgtgtcaatcacaggactcatcagagangcctctgtgaggcacagtccctgcctccctcccct

SEQ ID NO: 36814 - DNA, 71 bp, chicken (Gallus Gallus)
  misc_feature (36): n=a or g
tttttaaaaagctataaaaaccacgtcagaggaagntttaaactttcgatgcaacagattgttgctgggta

SEQ ID NO: 36815 - DNA, 71 bp, chicken (Gallus Gallus)
  misc_feature (36): n=a or g
atctactctttcagagagaatatttggtctttcaantatttgatttgcattagcagcctggaaggtagtgg

SEQ ID NO: 36816 - DNA, 71 bp, chicken (Gallus Gallus)
  misc_feature (36): n=a or g
ttcctgtgaaaccaatagcagacaggacagcagagntaaagcctccagaggaaaaatcatttaactcaggt

SEQ ID NO: 36817 - DNA, 71 bp, chicken (Gallus Gallus)
  misc_feature (36): n=c or t
gggacagtcatcttagagctgaagctgcatttcttntgcagttacgaatggccagctaaccatgaagcatc

SEQ ID NO: 36818 - DNA, 71 bp, chicken (Gallus Gallus)
  misc_feature (36): n=g or t
ccattgtgctggaccaaaggatggggagccatgtgnacaagaaagaaattacacagaattgtatcagaaga

SEQ ID NO: 36819 - DNA, 71 bp, chicken (Gallus Gallus)
  misc_feature (36): n=c or t
ttacaggtagagtgttctcacaataagtacttctancatgagtcaagtcttcattgaaatttaagctgttg

SEQ ID NO: 36820 - DNA, 71 bp, chicken (Gallus Gallus)
  misc_feature (36): n=c or t
gcactcacataggtgtgccatgaaaagcaatgaagntagaggcacagtgggttcattgtgaaggttgcctg

SEQ ID NO: 36821 - DNA, 71 bp, chicken (Gallus Gallus)
  misc_feature (36): n=a or c
tgaaagctggcagctagatcatcaaatgttcaaaanaaactaacaaaccaacagccaagatgacggaagat

SEQ ID NO: 36822 - DNA, 71 bp, chicken (Gallus Gallus)
  misc_feature (36): n=a or g
cctttgatttcttccccagaagacattttacacacntgcaaaatttcttagattggagagccatttgcaag

SEQ ID NO: 36823 - DNA, 71 bp, chicken (Gallus Gallus)
  misc_feature (36): n=c or t
tattccgcaatcaccttcactgaatctattttcccngaagcagtagtgtcatcagtttagagtatacaggc

SEQ ID NO: 36824 - DNA, 71 bp, chicken (Gallus Gallus)
  misc_feature (36): n=c or t
aaagttttaaatgctgaacagtttaagctgcactanttccacctcactgtgacacctaaaggtgtatgctt

SEQ ID NO: 36825 - DNA, 71 bp, chicken (Gallus Gallus)
  misc_feature (36): n=a or g
ataagatgactcagtacaagagagggcaagttcaanctacaggcaatggacattaaaaccacatcagcctg

SEQ ID NO: 36826 - DNA, 71 bp, chicken (Gallus Gallus)
  misc_feature (36): n=a or g
atattcagatatgcagcagtaaacacccagcagcantaaataccctgattggcaccactgagcaatataag

SEQ ID NO: 36827 - DNA, 71 bp, chicken (Gallus Gallus)
  misc_feature (36): n=a or g
agctgaagagcccctgacgtgctgtactcagctctnataggcctgtttgatgctgtgtgaaattgaaaaat

SEQ ID NO: 36828 - DNA, 71 bp, chicken (Gallus Gallus)
  misc_feature (36): n=c or t
cagggcaagtcaactggcgaggcactgtgagatganattcctcaggacaagcagggatgccatccagtgac

SEQ ID NO: 36829 - DNA, 71 bp, chicken (Gallus Gallus)
  misc_feature (36): n=a or g
tggcaggccagcagtacggagcccttgggacattangattctcctagcattaggcttgctattcaatctct

SEQ ID NO: 36830 - DNA, 71 bp, chicken (Gallus Gallus)
  misc_feature (36): n=a or g
tgattttccttcgtctctccaagacttcatcagacntagctgtcacaaataatttactacaagaaattgca

SEQ ID NO: 36831 - DNA, 71 bp, chicken (Gallus Gallus)
  misc_feature (36): n=a or g
gttacccagtctttgggttgtcctaagagctgaacnttaaacgtgccaactgtcccaggtgtgtgttttca

SEQ ID NO: 36832 - DNA, 71 bp, chicken (Gallus Gallus)
  misc_feature (36): n=c or t
ttcttgctaggaccaacaaagcctggctttgtctgnaggtttgacttccgtaaggcagagacaactttaat

SEQ ID NO: 36833 - DNA, 71 bp, chicken (Gallus Gallus)
  misc_feature (36): n=a or c
ggattcaagctctgtgagcttattgactatacatgntgggcacaaacctaatccctaccaggggtaacaca

SEQ ID NO: 36834 - DNA, 71 bp, chicken (Gallus Gallus)
  misc_feature (36): n=g or t
ggctttgctctgtactgctgctcatgaaggtggaanctgaaggttcattaagtgtgcttaatgcagaatta

SEQ ID NO: 36835 - DNA, 71 bp, chicken (Gallus Gallus)
  misc_feature (36): n=a or c
agaacaatgcacgtttttgatactgcctaacagaanagtaggtttcacgagttaagtttcaaattcaaatt

SEQ ID NO: 36836 - DNA, 71 bp, chicken (Gallus Gallus)
  misc_feature (36): n=a or g
agttaagtattaagatctaataatacactgccttgnaagtagctgtaaaattctttgtttccctttacaag

SEQ ID NO: 36837 - DNA, 71 bp, chicken (Gallus Gallus)
  misc_feature (36): n=a or g
ggctgcatgtcagatgtatccaagtagtctaaagcncaaaaaattaatggagcaagacagatacagccaag

SEQ ID NO: 36838 - DNA, 71 bp, chicken (Gallus Gallus)
  misc_feature (36): n=a or g
caagaaccacatcattgatttttcatggatctaacntatatccaagatcttgctgagagtccatcatttta

SEQ ID NO: 36839 - DNA, 71 bp, chicken (Gallus Gallus)
  misc_feature (36): n=a or g
atctctggtgtcataaataaagaagatagatgaaanggcatgatgcaaataatgtttcctggtgcacatat

SEQ ID NO: 36840 - DNA, 71 bp, chicken (Gallus Gallus)
  misc_feature (36): n=c or t
aatgctttagaagggaagtagtgaatttagttttgnttggtgttcatgtatcctctggttctggaccataa

SEQ ID NO: 36841 - DNA, 71 bp, chicken (Gallus Gallus)
  misc_feature (36): n=c or t
gatgaaaatttgtatctttacagtgagaatgatggntaaggttaactccatcaagtgctaaaaagagacca

SEQ ID NO: 36842 - DNA, 71 bp, chicken (Gallus Gallus)
  misc_feature (36): n=a or g
ctctatcttgcaatgagtgagcagaaattgcttttnctgtctcaaagtccaaggatttcaaatatctcttc

SEQ ID NO: 36843 - DNA, 71 bp, chicken (Gallus Gallus)
  misc_feature (36): n=c or t
agcatgcctgaatgcaaattacctcacacaggaaancgtgcaatgcattcggtacctgaaaataaagatcc

SEQ ID NO: 36844 - DNA, 71 bp, chicken (Gallus Gallus)
  misc_feature (36): n=a or g
gggacataataaggggaggatttgtaggcattcccnggaaggtaatctcgccaagtgttgattcaaaatgg

SEQ ID NO: 36845 - DNA, 71 bp, chicken (Gallus Gallus)
  misc_feature (36): n=g or t
cagactttgactttggaaggagcctagttcttatantgagggtgtgccttcctcggcctttattaaagttc

SEQ ID NO: 36846 - DNA, 71 bp, chicken (Gallus Gallus)
  misc_feature (36): n=a or g
atcattcctaggtaggacgaggaccttgtgttcaancaggtagatgtgatctgtcacatatgattcaattc

SEQ ID NO: 36847 - DNA, 71 bp, chicken (Gallus Gallus)
  misc_feature (36): n=c or t
cctttagttgccaatacaagcactttaacttttagnataaatgttagtattttatttttcattaaagacag

SEQ ID NO: 36848 - DNA, 71 bp, chicken (Gallus Gallus)
  misc_feature (36): n=a or g
aatgtgtgataataacctttaaagatgctcagcaantcagttcaagtagcagatgtaattcttggttaata

SEQ ID NO: 36849 - DNA, 71 bp, chicken (Gallus Gallus)
  misc_feature (36): n=a or g
tcctgctctttaatggagtccaatgtcatcctggtngtgatgcaaacaagttgatattttcttcctagaaa

SEQ ID NO: 36850 - DNA, 71 bp, chicken (Gallus Gallus)
  misc_feature (36): n=c or t
tggcttgcagtccaactcaaaggatttttggaattnttttgacttagagctgtctcactctcttggcgata

SEQ ID NO: 36851 - DNA, 71 bp, chicken (Gallus Gallus)
  misc_feature (36): n=a or g
aattaatctgctagtctgttacaagctgctataaantgaaacaacagtaatctgatattacaagtgggtaa

SEQ ID NO: 36852 - DNA, 71 bp, chicken (Gallus Gallus)
  misc_feature (36): n=a or c
aaggaagaagcccatctgtaaatccaaagggtgtangtttctcactcagctttcctctttttttccacatc

SEQ ID NO: 36853 - DNA, 71 bp, chicken (Gallus Gallus)
  misc_feature (36): n=c or t
aaggctctgtgtaactcatgctcacattttccctanatccttcttgtagctcttcttgctttagtacagtg

SEQ ID NO: 36854 - DNA, 71 bp, chicken (Gallus Gallus)
  misc_feature (36): n=c or t
gaaatggaaatgaaagagtttttctgacatatttanagatctctaaactagaaacagatgcataatggatg

SEQ ID NO: 36855 - DNA, 71 bp, chicken (Gallus Gallus)
  misc_feature (36): n=c or t
taaaataacaggcataattatttcaagaatcatgcntaaggtgcaataaatatgcacaagtaccaaaatgc

SEQ ID NO: 36856 - DNA, 71 bp, chicken (Gallus Gallus)
  misc_feature (36): n=a or g
gcacttttcataactggtaaataacttattttaatngtgaaagaatgaatcaatataataggagcatattt

SEQ ID NO: 36857 - DNA, 71 bp, chicken (Gallus Gallus)
  misc_feature (36): n=c or t
aaagaatagtctcttacaacacctgaaagcaagcangggtatacctacagaatctgccctcatgcttgcat

SEQ ID NO: 36858 - DNA, 71 bp, chicken (Gallus Gallus)
  misc_feature (36): n=c or t
tcctaagagacatctcaataaagcagccaccgtganatagcatgccccaattaacagtgtatattctgata

SEQ ID NO: 36859 - DNA, 71 bp, chicken (Gallus Gallus)
  misc_feature (36): n=c or t
tgctagagttcaatcaaatgaatacaggcagaaagngaacagaaaggaatgcacacatctacaaagcaaac

SEQ ID NO: 36860 - DNA, 71 bp, chicken (Gallus Gallus)
  misc_feature (36): n=g or t
tcatgtattggtgcactacctgaggatacagcactngatcaaagtacagttctccagcttgaattgcttat

SEQ ID NO: 36861 - DNA, 71 bp, chicken (Gallus Gallus)
  misc_feature (36): n=a or c
attcattaagaaattaagataacttctgagattagnaaaatgcagtgcaactctctgtgcagcaaaaatac

SEQ ID NO: 36862 - DNA, 71 bp, chicken (Gallus Gallus)
  misc_feature (36): n=a or c
atcagtatcatctcattttaatgaaacatatcatgnggtccatctccaaattaacatcaatctagtagata

SEQ ID NO: 36863 - DNA, 71 bp, chicken (Gallus Gallus)
  misc_feature (36): n=c or t
atatgttgttatttccatgactccttgtgtagctanactttggcactggactgctcttggatcagtcacac

SEQ ID NO: 36864 - DNA, 71 bp, chicken (Gallus Gallus)
  misc_feature (36): n=a or c
attaacaaccagatctttagagaaatgaatgttgtnagatcctctccaggacaggggcctcagttatgctg

SEQ ID NO: 36865 - DNA, 71 bp, chicken (Gallus Gallus)
  misc_feature (36): n=c or t
gtattaaaattttccagggaaagccctcaagtggcngagactgcttcaggagtgcactggtggtgtttttc

SEQ ID NO: 36866 - DNA, 71 bp, chicken (Gallus Gallus)
  misc_feature (36): n=c or t
gccaacagatatgaaaagcaatgccataaggtatcnagtaacagattttctcttgccatacaggctgattt

SEQ ID NO: 36867 - DNA, 71 bp, chicken (Gallus Gallus)
  misc_feature (36): n=a or g
acactaacagagcagctagctgggtaatgagagaangcagagcattcctgaacttaaaatcaccagggtag

SEQ ID NO: 36868 - DNA, 71 bp, chicken (Gallus Gallus)
  misc_feature (36): n=c or t
atcacctttcagtatattttaaacagtccagatgtngcagagtaggaacagaaaagagtaaaacgtgatga

SEQ ID NO: 36869 - DNA, 71 bp, chicken (Gallus Gallus)
  misc_feature (36): n=c or t
tgaaacagattttgagaattcattatattggtttcncttcataataatttctaactaaaaatatactttca

SEQ ID NO: 36870 - DNA, 71 bp, chicken (Gallus Gallus)
  misc_feature (36): n=g or t
gccagtgaactaaattctttatgtggtgatgtcatnattccaaataataaaaactcatgtgaaatcattgt

SEQ ID NO: 36871 - DNA, 71 bp, chicken (Gallus Gallus)
  misc_feature (36): n=c or t
tctcttccagtggggaagtatttacacaaatccccnttttaaaagactttgtgcttggagctctgttatga

SEQ ID NO: 36872 - DNA, 71 bp, chicken (Gallus Gallus)
  misc_feature (36): n=g or t
aagcccgatgctctctagccataacaagggagtgcnacactaggcttcatagtggctggaccccctctata

SEQ ID NO: 36873 - DNA, 71 bp, chicken (Gallus Gallus)
  misc_feature (36): n=c or t
ggagcacatttgtaagaacagagttttcaagcatgnaggggcaagaattgcaaatggaaccaataacccaa

SEQ ID NO: 36874 - DNA, 71 bp, chicken (Gallus Gallus)
  misc_feature (36): n=a or g
catacagctagcaatatactgcagggaccctgtaangtctgagcactggcaagagaacctgcggcaatggc

SEQ ID NO: 36875 - DNA, 71 bp, chicken (Gallus Gallus)
  misc_feature (36): n=c or t
cataaatataaatgtattccagagattacagtttantggacctcattctgaacttctgcaaattttcaaag

SEQ ID NO: 36876 - DNA, 71 bp, chicken (Gallus Gallus)
  misc_feature (36): n=a or g
cagaatgtgctctttccacacagaagttaccacacntttgctgcttgaaactgagaatccaatgagaaatt

SEQ ID NO: 36877 - DNA, 71 bp, chicken (Gallus Gallus)
  misc_feature (36): n=c or t
ttggtacaattgacttctgttctcagatggcattcnacccccctcggggctgtggcaaaagggggcaggga

SEQ ID NO: 36878 - DNA, 71 bp, chicken (Gallus Gallus)
  misc_feature (36): n=c or t
gtagttaattaacccttgaggagtcaacaatttggngcaaggagctgcgtgtaggatttttgtaaagcaca

SEQ ID NO: 36879 - DNA, 71 bp, chicken (Gallus Gallus)
  misc_feature (36): n=c or t
tatcccaataagggatacgttccaagtgtattaaangggattgtgaacattaccagtgttaacgttcactg

SEQ ID NO: 36880 - DNA, 71 bp, chicken (Gallus Gallus)
  misc_feature (36): n=a or g
ccatactgacaccaacctcattgctgaagacgaacnatggctttggtgtcagatgtgataagtctgggatc

SEQ ID NO: 36881 - DNA, 71 bp, chicken (Gallus Gallus)
  misc_feature (36): n=c or t
agggtgaaaatatgtttgaagcaccgagagctggtnttccttccgtgtttcagccaacagagtagtttctt

SEQ ID NO: 36882 - DNA, 71 bp, chicken (Gallus Gallus)
  misc_feature (36): n=c or t
gacaggttcaagatagagtgagctgcttgccgtaangagtgtaccttgtgtacgtattagagttactgaat

SEQ ID NO: 36883 - DNA, 71 bp, chicken (Gallus Gallus)
  misc_feature (36): n=a or c
tgcaactagatattttaccttcttttaggccccccngacctgtaaccagcatgaacgacacactcttctcc

SEQ ID NO: 36884 - DNA, 71 bp, chicken (Gallus Gallus)
  misc_feature (36): n=a or g
ggtgtctggaagctggaaaaattacagcttcacaanagcttcaaggccaagcaattagggaggagctttag

SEQ ID NO: 36885 - DNA, 71 bp, chicken (Gallus Gallus)
  misc_feature (36): n=a or g
ttttatgagattgcccacagcaataaatagcagcanaaaatcttgacacttttagtgtttttccacagatg

SEQ ID NO: 36886 - DNA, 71 bp, chicken (Gallus Gallus)
  misc_feature (36): n=a or g
tgaaaaggtttaattgttgaaagtggaacggggacntgtctagtttacactgtgtggaatttacagctggg

SEQ ID NO: 36887 - DNA, 71 bp, chicken (Gallus Gallus)
  misc_feature (36): n=g or t
tgtattcctgctgtgtgccatgaaaccagaagcttnctttctttcatgttacaaagtgcttctgccataga

SEQ ID NO: 36888 - DNA, 71 bp, chicken (Gallus Gallus)
  misc_feature (36): n=c or t
cactaatgcatgtgagcattgtaggcaaactgccangtatctcatatgtctggattgatggaacattaacc

SEQ ID NO: 36889 - DNA, 71 bp, chicken (Gallus Gallus)
  misc_feature (36): n=c or t
ctacttctagaagagagcaacatggcacaatactcngtatgagcacaaggcctccgtatgaggcctcccct

SEQ ID NO: 36890 - DNA, 71 bp, chicken (Gallus Gallus)
  misc_feature (36): n=c or t
tgagtattggcattttgcatatcagtacattcagtntggctattgtagaatatctgttagcaaaattttgt

SEQ ID NO: 36891 - DNA, 71 bp, chicken (Gallus Gallus)
  misc_feature (36): n=c or t
aaactgaaggaggacttcaggttttggccacagttngtctatctttttgctacatataaggctttatggca

SEQ ID NO: 36892 - DNA, 71 bp, chicken (Gallus Gallus)
  misc_feature (36): n=c or t
aacaccgcccactgtaagctttcctttctgttgctnccagacctgcagatacaaaggaaacattcaggtca

SEQ ID NO: 36893 - DNA, 71 bp, chicken (Gallus Gallus)
  misc_feature (36): n=g or t
tccagagatgtcagttattaacatgcaggtgcattnagtttacttgttctccttcagtggactgctcctgt

SEQ ID NO: 36894 - DNA, 71 bp, chicken (Gallus Gallus)
  misc_feature (36): n=c or t
gaaattaaattaaaacccacagcaggactattttcntcctacttctgtgacaccagttcaagtcctcctga

SEQ ID NO: 36895 - DNA, 71 bp, chicken (Gallus Gallus)
  misc_feature (36): n=g or t
agactttgcagtgtatttcctatttgtatgagctangagggccctgagggcactacctgaccattcctttc

SEQ ID NO: 36896 - DNA, 71 bp, chicken (Gallus Gallus)
  misc_feature (36): n=g or t
tggtactgtaattccaagaaactggactggttaatncactatgaatatggcatgattggctgctgtcgggt

SEQ ID NO: 36897 - DNA, 71 bp, chicken (Gallus Gallus)
  misc_feature (36): n=c or t
ggcttgccatgctacatgtctcactgtccaaatatntcattcccacagcaaacaaacttttgaggattgtg

SEQ ID NO: 36898 - DNA, 71 bp, chicken (Gallus Gallus)
  misc_feature (36): n=a or g
gaaatggactgtagatttttcactaaaatatttcanttggacttgttcagacaaaataatcctttttaatt

SEQ ID NO: 36899 - DNA, 71 bp, chicken (Gallus Gallus)
  misc_feature (36): n=g or t
aagcttgaacttggattttaaagtggaaatcaaaangtgacaaagctacatctgtcctatacattcttata

SEQ ID NO: 36900 - DNA, 71 bp, chicken (Gallus Gallus)
  misc_feature (36): n=a or g
aaactgattatatactctaaatcaaaacgctgtaantggtttggcctttccgttttcagtttataaggatc

SEQ ID NO: 36901 - DNA, 71 bp, chicken (Gallus Gallus)
  misc_feature (36): n=c or t
tactggtggcttagtaatggaatacttaactcttangtaattctggtttatgtatttgaaggttgttaatt

SEQ ID NO: 36902 - DNA, 71 bp, chicken (Gallus Gallus)
  misc_feature (36): n=c or t
tgaagactgactcattaagccttcagtaatgttaantgacatgtatttgtcccatccactggcctgggatt

SEQ ID NO: 36903 - DNA, 71 bp, chicken (Gallus Gallus)
  misc_feature (36): n=g or t
agtaatgtcaagagagttttagatactgacttatcngacagtaatgctggttgacttttttgctgcttgaa

SEQ ID NO: 36904 - DNA, 71 bp, chicken (Gallus Gallus)
  misc_feature (36): n=c or t
aacaaaattacaaaaggaatttccatcttcaggagnctacaggatgattattcataaagaccacagcataa

SEQ ID NO: 36905 - DNA, 71 bp, chicken (Gallus Gallus)
  misc_feature (36): n=c or t
gcattttattgtatttgagtactctcaaatttctantgacctattttggtttatgaagtacttgcaaatcc

SEQ ID NO: 36906 - DNA, 71 bp, chicken (Gallus Gallus)
  misc_feature (36): n=g or t
tttttcatctctgtcccttttttggagaaatgctanctgtgagaaacctaacccaggttttgaaaagccag

SEQ ID NO: 36907 - DNA, 71 bp, chicken (Gallus Gallus)
  misc_feature (36): n=c or t
agagtctgaatccttcacttgttaagggtgcctganggaatttctcaaatcctgttaaacaacagatctgt

SEQ ID NO: 36908 - DNA, 71 bp, chicken (Gallus Gallus)
  misc_feature (36): n=c or t
gcacaggtattataacttaaattacttctcccatangagatataacttaaattacttctcccatatgagat

SEQ ID NO: 36909 - DNA, 71 bp, chicken (Gallus Gallus)
  misc_feature (36): n=c or t
gggacattccacaaacagtctggattatttcaaccnagatatgatattgttgctcacacaaaaaatacaca

SEQ ID NO: 36910 - DNA, 71 bp, chicken (Gallus Gallus)
  misc_feature (36): n=a or g
agcatacaaataagcatgtagctaaaaatataatgncaagcaaaattatttgggatctttgttcatgtagt

SEQ ID NO: 36911 - DNA, 71 bp, chicken (Gallus Gallus)
  misc_feature (36): n=a or c
tctttttcatccttggtaggagtcactttgataccncctttcctggcacggggacaaccagataagctgca

SEQ ID NO: 36912 - DNA, 71 bp, chicken (Gallus Gallus)
  misc_feature (36): n=a or g
aaactttgcccttcttggccctggagtcaatacatncagcccacaagggaccacatccatctccagagttt

SEQ ID NO: 36913 - DNA, 71 bp, chicken (Gallus Gallus)
  misc_feature (36): n=a or g
actgtgctggaaactgcaggttaattgttcaagggnattccttctgtttacttcaataggatttgaaagta

SEQ ID NO: 36914 - DNA, 71 bp, chicken (Gallus Gallus)
  misc_feature (36): n=c or t
tagttttaccctaggccccttttaggggacacaccngagagagaaagtgaattatcaatgacatttttttt

SEQ ID NO: 36915 - DNA, 71 bp, chicken (Gallus Gallus)
  misc_feature (36): n=g or t
ggaaacatgcatttcaggtgagttttctttctttcntctttccagtgcaggtgcttacacagttctcttag

SEQ ID NO: 36916 - DNA, 71 bp, chicken (Gallus Gallus)
  misc_feature (36): n=a or g
aaagtaagtgtacacaaaacaatttataaaaaaacnagttgtcgatataagaagtgatcttgttttcctcc

SEQ ID NO: 36917 - DNA, 71 bp, chicken (Gallus Gallus)
  misc_feature (36): n=c or t
acaacttatatactatataaatacagtgtgatgtcnctcctcatacacagctgcaaggagaaaagtcaata

SEQ ID NO: 36918 - DNA, 71 bp, chicken (Gallus Gallus)
  misc_feature (36): n=a or c
tggaaataatgatttgataagaatctgagacatttngattcctatgtggaggtgccctatttctgaaaact

SEQ ID NO: 36919 - DNA, 71 bp, chicken (Gallus Gallus)
  misc_feature (36): n=a or g
ttttcccccatgaatttcctgtgctactgagatttntttctatatgccttgcaatggcacatagtgattac

SEQ ID NO: 36920 - DNA, 71 bp, chicken (Gallus Gallus)
  misc_feature (36): n=a or g
ctaaaacattataaatgtatgtaataagagaaaagnactgcatggattcatgtcactggaagaattcttaa

SEQ ID NO: 36921 - DNA, 71 bp, chicken (Gallus Gallus)
  misc_feature (36): n=c or t
atatttgtgcacactgcctgaaatggaaattgtgcnggttttcaatacacatgttgactttgctttagtct

SEQ ID NO: 36922 - DNA, 71 bp, chicken (Gallus Gallus)
  misc_feature (36): n=a or g
cttgtaagtctagaagctcatttctccattggcatngggaatatgtaaggaaagaatagttaaagcagatt

SEQ ID NO: 36923 - DNA, 71 bp, chicken (Gallus Gallus)
  misc_feature (36): n=c or t
aactaaatttgaaattactccaaacgtgccatttcntaacaacaagtgatgatagaacctcatgcaaaatc

SEQ ID NO: 36924 - DNA, 71 bp, chicken (Gallus Gallus)
  misc_feature (36): n=g or t
tgacataacattaaaatttgagttgttaagtagttngaaaaggtttagtagtgtggaaaaattttatcact

SEQ ID NO: 36925 - DNA, 71 bp, chicken (Gallus Gallus)
  misc_feature (36): n=a or g
cttgaagatggagtagaaagtcaactcagattccanatgaaacaccagcctcttctagcctggaaaaacaa

SEQ ID NO: 36926 - DNA, 71 bp, chicken (Gallus Gallus)
  misc_feature (36): n=a or g
ggtcagtggcagactgacatgaaaatgagctttggnggcaaaacagaaaaattaattagttggggatgtca

SEQ ID NO: 36927 - DNA, 71 bp, chicken (Gallus Gallus)
  misc_feature (36): n=a or g
cttttaacatatcagcactagtagtaggcataaacnaacccaaaacagaatgtgagataaaacactgacag

SEQ ID NO: 36928 - DNA, 71 bp, chicken (Gallus Gallus)
  misc_feature (36): n=c or t
atagacagaagacaagcaagaattctcctgccagcnggtagttctcctggtcagtcaacagcgatgagccc

SEQ ID NO: 36929 - DNA, 71 bp, chicken (Gallus Gallus)
  misc_feature (36): n=c or t
acagatgttgcactgagtaagggagactgtttcccntttcatattcagtatctgctttaatctgaccagct

SEQ ID NO: 36930 - DNA, 71 bp, chicken (Gallus Gallus)
  misc_feature (36): n=a or g
acctcctaaggggactggaaatctgagaagataaangaggctcatggcacagggagtttacagcagcagca

SEQ ID NO: 36931 - DNA, 71 bp, chicken (Gallus Gallus)
  misc_feature (36): n=a or g
catttattgtgttctatttatgaaaagtaaagaaantcagacttgcataaacatctgtttttttccaccaa

SEQ ID NO: 36932 - DNA, 71 bp, chicken (Gallus Gallus)
  misc_feature (36): n=c or t
tcccttctccttccttacctctcactcaacgtgtcntattttgcctaccatacttgcttttccatacttaa

SEQ ID NO: 36933 - DNA, 71 bp, chicken (Gallus Gallus)
  misc_feature (36): n=c or t
attctgtggcttcagattattatctgctaagtctcnttgaaagcttcttaaaattccaaactggattttag

SEQ ID NO: 36934 - DNA, 71 bp, chicken (Gallus Gallus)
  misc_feature (36): n=a or g
tttagctggacctacctattttttgcatcagttccnttttaataaaagtctccaggctgtgccagaaattc

SEQ ID NO: 36935 - DNA, 71 bp, chicken (Gallus Gallus)
  misc_feature (36): n=a or g
ctattagtaatatgtgcatgtagaagatttgtgccnttctggttactgagaatatgaaatagctccttcag

SEQ ID NO: 36936 - DNA, 71 bp, chicken (Gallus Gallus)
  misc_feature (36): n=c or t
tgcagaatcactccaccttatcaggatacaaggagngtggcactaagtactggatacctcctggaggtggc

SEQ ID NO: 36937 - DNA, 71 bp, chicken (Gallus Gallus)
  misc_feature (36): n=c or t
atccaggtggaaaactttatgcttctgaaagatatnttttcagagttgctaccaacttcactgcttgcaca

SEQ ID NO: 36938 - DNA, 71 bp, chicken (Gallus Gallus)
  misc_feature (36): n=a or g
tgctctcttctcataaagattttactaatatattanatctgaaatgttgtcattagcttcattctcaagaa

SEQ ID NO: 36939 - DNA, 71 bp, chicken (Gallus Gallus)
  misc_feature (36): n=c or t
gagagtgagcagagtttatctacacgccatttcaangttactgaacctgtagtggccaaaaggatctgttt

SEQ ID NO: 36940 - DNA, 71 bp, chicken (Gallus Gallus)
  misc_feature (36): n=c or t
acacattgccaaatttgtcttaaatgacactgtaanaagctattgagagagctggatttttccgaagaaat

SEQ ID NO: 36941 - DNA, 71 bp, chicken (Gallus Gallus)
  misc_feature (36): n=a or g
attccaattttggaaagcttcacatccagtaaagcntacctgggctaacctggaaaagtgtcatcctctca

SEQ ID NO: 36942 - DNA, 71 bp, chicken (Gallus Gallus)
  misc_feature (36): n=c or t
atcatacactcagttatcacctctttaacgtgctgntttaatataggaagacctgctactttatccataag

SEQ ID NO: 36943 - DNA, 71 bp, chicken (Gallus Gallus)
  misc_feature (36): n=a or g
tttaagttttcaagtgcaattctttaccatgtttcntaagttgtaattcataaactgttcaaaaactgtaa

SEQ ID NO: 36944 - DNA, 71 bp, chicken (Gallus Gallus)
  misc_feature (36): n=a or g
ctcacctaaaaggcagcaaagcatatattttcccantatttcccagtctgtcattacagatagataagact

SEQ ID NO: 36945 - DNA, 71 bp, chicken (Gallus Gallus)
  misc_feature (36): n=g or t
gtttactacctaataaatatcaaagttcatgaaagnttctttgattgattgcaggaaatggtcttctacaa

SEQ ID NO: 36946 - DNA, 71 bp, chicken (Gallus Gallus)
  misc_feature (36): n=a or g
gaagcatttacagctggacagcaaattatagcaagnggaaggtgctgtggtctgtattcagtccactgaat

SEQ ID NO: 36947 - DNA, 71 bp, chicken (Gallus Gallus)
  misc_feature (36): n=c or t
tatccacactttgggaaagaagggagcacagctgtngtgcctgtgcacttttccctaggtgactgttctgg

SEQ ID NO: 36948 - DNA, 71 bp, chicken (Gallus Gallus)
  misc_feature (36): n=a or c
gttttttcagaaacagttaaaacattcctgcaggancacgagaagctacatttgagctgttaagtgtcatc

SEQ ID NO: 36949 - DNA, 71 bp, chicken (Gallus Gallus)
  misc_feature (36): n=a or g
tctaaaaaggcacatcctggttgtgctgtttccacngagaaacctggaaagtcttcagcctacccaaaggc

SEQ ID NO: 36950 - DNA, 71 bp, chicken (Gallus Gallus)
  misc_feature (36): n=c or t
tatttctgctagggatacaaaataacctctcctagnttttcttaactatttaaactcaagagagccagata

SEQ ID NO: 36951 - DNA, 71 bp, chicken (Gallus Gallus)
  misc_feature (36): n=a or g
tgctttgagtcagccctatcaaaactcacaatctcntgaatgtcatgggattcaatgttttcttcatgctc

SEQ ID NO: 36952 - DNA, 71 bp, chicken (Gallus Gallus)
  misc_feature (36): n=a or g
atgcctcctaatagggcagctctgttgttctatagntggccaggaagagtcctctatctagaagtggtatt

SEQ ID NO: 36953 - DNA, 71 bp, chicken (Gallus Gallus)
  misc_feature (36): n=c or t
gtcctgtcataattactccattgggttgcacaagcngtacagaggaagggacagctgaaaggcaggaagca

SEQ ID NO: 36954 - DNA, 71 bp, chicken (Gallus Gallus)
  misc_feature (36): n=a or c
caaagaaccctggtatgccattatctgtttataacntaaccctcaatttagtagtactgcttttcatctca

SEQ ID NO: 36955 - DNA, 71 bp, chicken (Gallus Gallus)
  misc_feature (36): n=a or g
acacttgcagtgtggttctgcatcagctgccaggangacatgctatatctaaaataacagtagtgacagtc

SEQ ID NO: 36956 - DNA, 71 bp, chicken (Gallus Gallus)
  misc_feature (36): n=c or t
ggacatcttcttaaactctaaagaactaataacttnggcagctttagtacaaatgctagtacaattactat

SEQ ID NO: 36957 - DNA, 71 bp, chicken (Gallus Gallus)
  misc_feature (36): n=a or c
tcgttttcatttactcctcggtaatgcgccgcttcngggttatcccctgctcctaaaagctccttcagcag

SEQ ID NO: 36958 - DNA, 71 bp, chicken (Gallus Gallus)
  misc_feature (36): n=c or t
atgacagcacagaccaaaaagtaccaaataacatanggtaagacttggtttcctacagattgttttttctt

SEQ ID NO: 36959 - DNA, 71 bp, chicken (Gallus Gallus)
  misc_feature (36): n=c or t
ctgctatgcccaagagaaaattcatgttcgtgtgcnagatgcttataactctcttatggtaacagttgtcc

SEQ ID NO: 36960 - DNA, 71 bp, chicken (Gallus Gallus)
  misc_feature (36): n=c or t
ttacccttgcaaattcaaggtgctgtatcatctccnccttgactcttccatttcaacagtaccttcaatta

SEQ ID NO: 36961 - DNA, 71 bp, chicken (Gallus Gallus)
  misc_feature (36): n=a or g
gcctgtttgaaagaaacaaaaatattgtacttggcntgtgactgtccatggccatcatggaacagtccaat

SEQ ID NO: 36962 - DNA, 71 bp, chicken (Gallus Gallus)
  misc_feature (36): n=g or t
ctgaaatatgaattatgtgaaaactgtgcctagctngtgataaattaatgctcagaaatacaccatatgtg

SEQ ID NO: 36963 - DNA, 71 bp, chicken (Gallus Gallus)
  misc_feature (36): n=g or t
cagcacttttcaaactttgcatggaatgtacagtgncaaaagcctcattgtgccatgaaaaagtgattaat

SEQ ID NO: 36964 - DNA, 71 bp, chicken (Gallus Gallus)
  misc_feature (36): n=c or t
gctttggctataagaagagtttggggcagccagcgnggatcctcactcctgctttatcctgcctttgcaag

SEQ ID NO: 36965 - DNA, 71 bp, chicken (Gallus Gallus)
  misc_feature (36): n=a or g
gccaagtcagtcaaaattaccccactgattttgcangcaaaaaaggtcattgaattaaggttcattctttt

SEQ ID NO: 36966 - DNA, 71 bp, chicken (Gallus Gallus)
  misc_feature (36): n=c or t
ctttaatttaaaaatatctagtttattagcagtaanagcaatgtctgatgtttcttgagagtactgtacac

SEQ ID NO: 36967 - DNA, 71 bp, chicken (Gallus Gallus)
  misc_feature (36): n=a or g
tctgagttatgatgcttagtctgcatttgtagccanttttattcctgaagctggctaagttccattgcagt

SEQ ID NO: 36968 - DNA, 71 bp, chicken (Gallus Gallus)
  misc_feature (36): n=a or g
tttcccatccattttcttgtccctgtccagagcagntacttccagaactttctttttttttttttttttgt

SEQ ID NO: 36969 - DNA, 71 bp, chicken (Gallus Gallus)
  misc_feature (36): n=c or t
tggagtttacttgtgagttcatccaaacaaaatgangtgcagaattcttgcctactcgtttgatacttgtg

SEQ ID NO: 36970 - DNA, 71 bp, chicken (Gallus Gallus)
  misc_feature (36): n=a or g
ttccacttttactatttcactgtaaaaacatgcacntccatttaacagtgcctgaacacaataactatttc

SEQ ID NO: 36971 - DNA, 71 bp, chicken (Gallus Gallus)
  misc_feature (36): n=a or c
gttttgtaataaatccacaaagcagctcatttaccncctttcagcctgttctcttgatgactacaagctct

SEQ ID NO: 36972 - DNA, 71 bp, chicken (Gallus Gallus)
  misc_feature (36): n=c or t
cctcaatgtatccatgagccaactgattcccattgnttttcaaggacttatcttgcattctaagcaccaca

SEQ ID NO: 36973 - DNA, 71 bp, chicken (Gallus Gallus)
  misc_feature (36): n=c or t
aaatgacctcatctcacacaagcactccaattcttngctctgctgaggacttatcatcaagccatgctaac

SEQ ID NO: 36974 - DNA, 71 bp, chicken (Gallus Gallus)
  misc_feature (36): n=g or t
tgggatgtcagtggtattatgtaatatagaggcagncatcctagacagattttaactattaactaaattaa

SEQ ID NO: 36975 - DNA, 71 bp, chicken (Gallus Gallus)
  misc_feature (36): n=a or g
agtgaattgcattacatgtgatgttagcctcatacntgcaggtgtttaagtatttttgtgtattattctat

SEQ ID NO: 36976 - DNA, 71 bp, chicken (Gallus Gallus)
  misc_feature (36): n=g or t
tgtgcagtcatggaactacagaactgctggggctgngtgggtcctgtggagatggagcacactcagcatct

SEQ ID NO: 36977 - DNA, 71 bp, chicken (Gallus Gallus)
  misc_feature (36): n=c or t
acaaatctgggatgagtctatcaccaagaaagggtnagcctttgtgatcaatgacagtgagagtcttacac

SEQ ID NO: 36978 - DNA, 71 bp, chicken (Gallus Gallus)
  misc_feature (36): n=a or c
tgctcttctcttaacctaacggacttatttccaggntttttaagcttgtttctttcaataagaaatagata

SEQ ID NO: 36979 - DNA, 71 bp, chicken (Gallus Gallus)
  misc_feature (36): n=c or t
attttgttacttctttcaactactgtgggagagatncttctcctgggcctgatccaaggcacaaggaggtg

SEQ ID NO: 36980 - DNA, 71 bp, chicken (Gallus Gallus)
  misc_feature (36): n=a or g
gcttatatgtttagtctaagatagaaatttctagcntgcttcctaaaagcagtctactcctaaaagctgtc

SEQ ID NO: 36981 - DNA, 71 bp, chicken (Gallus Gallus)
  misc_feature (36): n=c or t
gaacattagagataatgtcctcacactgtcactgcncttcagatcacaatcttgtctactccacttagaca

SEQ ID NO: 36982 - DNA, 71 bp, chicken (Gallus Gallus)
  misc_feature (36): n=c or t
ccttttcaatttactcccattcatccttcaaaatanacattcccagatcatgtaactttactaagtttagc

SEQ ID NO: 36983 - DNA, 71 bp, chicken (Gallus Gallus)
  misc_feature (36): n=a or g
agtatgtgcaatattatgctggatgtaataataaanagtctggaatattgtagtgatacatgttcacagaa

SEQ ID NO: 36984 - DNA, 71 bp, chicken (Gallus Gallus)
  misc_feature (36): n=c or t
tgtaagggactggagtatagaacactactgaatgtngtgtagctcctttattcagtctccaactatgttgg

SEQ ID NO: 36985 - DNA, 71 bp, chicken (Gallus Gallus)
  misc_feature (36): n=a or c
gcatttgtaggaagtgttaaaatgtgtattgtctcngagagcaaaggtgagtagcttgcagaatcactcca

SEQ ID NO: 36986 - DNA, 71 bp, chicken (Gallus Gallus)
  misc_feature (36): n=a or g
atttaaactgtcattctgagaaactgttaactggcngacagagtttaggatgaggttataaagtttagtga

SEQ ID NO: 36987 - DNA, 71 bp, chicken (Gallus Gallus)
  misc_feature (36): n=a or g
agagaatatcagtagtgactcttgaaagtaagctcngaaattggaaaggtatatgcaagaatgacttttag

SEQ ID NO: 36988 - DNA, 71 bp, chicken (Gallus Gallus)
  misc_feature (36): n=c or t
ttctggtttccttttgtctaaatactttacaatatncaaatccttacagaagcctaaatactttacaatat

SEQ ID NO: 36989 - DNA, 71 bp, chicken (Gallus Gallus)
  misc_feature (36): n=c or t
aaagaattaaaatatagtaagtacacatagaattcnttattccagttgaactcctaattcagtctggttgt

SEQ ID NO: 36990 - DNA, 71 bp, chicken (Gallus Gallus)
  misc_feature (36): n=a or g
tttgtgagttacataaattgttcagcgcaacttcantagactcagaaaatctgcaaaaggaggaaaattct

SEQ ID NO: 36991 - DNA, 71 bp, chicken (Gallus Gallus)
  misc_feature (36): n=c or t
ttactgacataaatccagcattacccaccagccaanctttgcaatcaggttataatgattatcagctgaat

SEQ ID NO: 36992 - DNA, 71 bp, chicken (Gallus Gallus)
  misc_feature (36): n=g or t
ccagtttatgctaaagctacgttcaatactccaganaaatgaaactgtccagatgttgtttatatatgtac

SEQ ID NO: 36993 - DNA, 71 bp, chicken (Gallus Gallus)
  misc_feature (36): n=a or c
tgaatatgcacagaacccagagaagccagtccctancttccgtgttacatgaagaacctaaggctgagcag

SEQ ID NO: 36994 - DNA, 71 bp, chicken (Gallus Gallus)
  misc_feature (36): n=a or g
agcagtttataccacatatagaagtaatgaaacaanttaagagaaagacttcatatctcacgtatcataaa

SEQ ID NO: 36995 - DNA, 71 bp, chicken (Gallus Gallus)
  misc_feature (36): n=c or t
caggattacaggcatagatgctgtgagactccctcngcccatacattgagtacagaaattgacatgtctag

SEQ ID NO: 36996 - DNA, 71 bp, chicken (Gallus Gallus)
  misc_feature (36): n=a or g
aaaagcaatgaatgtttaactcctgagattggcacntgtacaaggtatttgctaatactttcactcttgct

SEQ ID NO: 36997 - DNA, 71 bp, chicken (Gallus Gallus)
  misc_feature (36): n=c or t
ttcactgggaagggaagtacaaagtgtgtcttcatngggcatggtttgaatgtaggatcctaagagaaaag

SEQ ID NO: 36998 - DNA, 71 bp, chicken (Gallus Gallus)
  misc_feature (36): n=c or t
tgatttctggcttagctctggggttcactgggacangggcagttgtcacctttgtgcagtgatatcccaga

SEQ ID NO: 36999 - DNA, 71 bp, chicken (Gallus Gallus)
  misc_feature (36): n=a or g
aacagccatccctcctcacagaatatttagtcttcngtgctcaaaaagaaaaactcgaggtttagtttgaa

SEQ ID NO: 37000 - DNA, 71 bp, chicken (Gallus Gallus)
  misc_feature (36): n=a or g
aacccggtagtttctcaaacctcatttttggacacnggatataccacggtgcagatgtatttgtgttcctt

SEQ ID NO: 37001 - DNA, 71 bp, chicken (Gallus Gallus)
  misc_feature (36): n=g or t
aacaaggcactggtaaattcaccagtgtactgacanaggtatacagtacagctgaaacattgagcttgact

SEQ ID NO: 37002 - DNA, 71 bp, chicken (Gallus Gallus)
  misc_feature (36): n=c or t
acggtgactttgtgcttgaattgtaactatgcaaancatcttttgtatatcccggtttaaaaaaggtaaat

SEQ ID NO: 37003 - DNA, 71 bp, chicken (Gallus Gallus)
  misc_feature (36): n=a or g
ctgggcctcaaactatttgagcttggacagcttganggatttcagtacttatttgcagtgtaagagtgcca

SEQ ID NO: 37004 - DNA, 71 bp, chicken (Gallus Gallus)
  misc_feature (36): n=a or g
cattttatggggttaagagttaaaggaaatgaaatncaaaaatgtttcaattaacataagtaaaagcattt

SEQ ID NO: 37005 - DNA, 71 bp, chicken (Gallus Gallus)
  misc_feature (36): n=a or g
atttaattttacagctgtagagtttaacgttactgngaacataagaattttttgggggtgccttatttgaa

SEQ ID NO: 37006 - DNA, 71 bp, chicken (Gallus Gallus)
  misc_feature (36): n=c or t
caaagcaaaaggagtagggggaagggaaagcatacnagaattagccatacattactgcaaatacatccagt

SEQ ID NO: 37007 - DNA, 71 bp, chicken (Gallus Gallus)
  misc_feature (36): n=c or t
aaagaggtatctttgctaaagcaattacaaggatgngtaagactaaatggtacttgtgataaaatttagca

SEQ ID NO: 37008 - DNA, 71 bp, chicken (Gallus Gallus)
  misc_feature (36): n=a or c
cagagctttatcagctggtacttgatggtaagtatnagttaatttcataaatgcaattgaggttctttctt

SEQ ID NO: 37009 - DNA, 71 bp, chicken (Gallus Gallus)
  misc_feature (36): n=c or t
ttactcggagctgtttcatggcactgtctctcctgngaattggaaggacagttctggctgtaggtctcctc

SEQ ID NO: 37010 - DNA, 71 bp, chicken (Gallus Gallus)
  misc_feature (36): n=g or t
cttagtggtatttacaggacaaattagtggtaaacnccagattcagttcttaatttactgtttcctggtca

SEQ ID NO: 37011 - DNA, 71 bp, chicken (Gallus Gallus)
  misc_feature (36): n=a or g
ttaacttgcctgtgcatcgacatagaaggcctgaanaaaatgttatttgtgcctaccattctgtgtgattt

SEQ ID NO: 37012 - DNA, 71 bp, chicken (Gallus Gallus)
  misc_feature (36): n=c or t
ctggaatatcataaatcaaaaagagaaatctacttngtgataaggaagtgtggaaactgttagtaccaatg

SEQ ID NO: 37013 - DNA, 71 bp, chicken (Gallus Gallus)
  misc_feature (36): n=g or t
ttcacaatacatacaaatagatgtcttggtaaggtngtctttaagggaagacaagtggaaaagcccccaat

SEQ ID NO: 37014 - DNA, 71 bp, chicken (Gallus Gallus)
  misc_feature (36): n=a or g
gatcttggcaatactgtttgggtatagatctgccanggagctaaaggtatccttagcactttgactaacac

SEQ ID NO: 37015 - DNA, 71 bp, chicken (Gallus Gallus)
  misc_feature (36): n=a or g
ggtcaccttcagtcactggaattaattttacccccnagaaactctgagaactatgagtataaataatgtat

SEQ ID NO: 37016 - DNA, 71 bp, chicken (Gallus Gallus)
  misc_feature (36): n=c or t
gctgaaatacatgaagaagaatttcatatgctattnagatgtttggatgggtttgatgaagaactaatgaa

SEQ ID NO: 37017 - DNA, 71 bp, chicken (Gallus Gallus)
  misc_feature (36): n=g or t
ggcagcgcacggggtaatgctgcagcagggcagatngatgtaattcatttgcagatctgtctgtggaagtt

SEQ ID NO: 37018 - DNA, 71 bp, chicken (Gallus Gallus)
  misc_feature (36): n=c or t
cagattggtcttagcctgtatattcagatacactcntcagtaagagtagacacagaaggcacccacagaag

SEQ ID NO: 37019 - DNA, 71 bp, chicken (Gallus Gallus)
  misc_feature (36): n=c or t
tgttaaagaaaggcacttacaaaatccacagcttcnctggggaatttctttcagcgctctaccatccttac

SEQ ID NO: 37020 - DNA, 71 bp, chicken (Gallus Gallus)
  misc_feature (36): n=a or g
ctcgcaacttaaactgaacaactgggtacacgttanagtataccctcataatccaagacaaaagtaaactt

SEQ ID NO: 37021 - DNA, 71 bp, chicken (Gallus Gallus)
  misc_feature (36): n=c or t
ttgcaaacagacttccaaaatcaccccagaactgcncagaactacatgaaagtgggcacatgctaaaggaa

SEQ ID NO: 37022 - DNA, 71 bp, chicken (Gallus Gallus)
  misc_feature (36): n=a or g
gggttaataagacaataagataactcctgcttgtgnagtactcacagaagtctgggaaggttgtaaagatg

SEQ ID NO: 37023 - DNA, 71 bp, chicken (Gallus Gallus)
  misc_feature (36): n=c or t
catgcctcaaacacaaagggctcttagctggtcccnagttgcattgcctactgatatcaatgagctggagc

SEQ ID NO: 37024 - DNA, 71 bp, chicken (Gallus Gallus)
  misc_feature (36): n=a or g
taatgttggtagttggagtagcagtgtgagaacgtnttttatagcactgaatacatgagaagagctgtcaa

SEQ ID NO: 37025 - DNA, 71 bp, chicken (Gallus Gallus)
  misc_feature (36): n=a or g
aatcacgctccttccttggctttccgaaatatgcantgaacacagctttttattgacaaggattttaggat

SEQ ID NO: 37026 - DNA, 71 bp, chicken (Gallus Gallus)
  misc_feature (36): n=c or t
aatgatatccataactaccaggcaattctttatttncagaactgtatgacccactttgatcgtttgggtta

SEQ ID NO: 37027 - DNA, 71 bp, chicken (Gallus Gallus)
  misc_feature (36): n=a or g
aagagcaaaagaaaagagatctctaacaatgccccnctcctaagcaatgactgacatctgtttcaaaaact

SEQ ID NO: 37028 - DNA, 71 bp, chicken (Gallus Gallus)
  misc_feature (36): n=c or t
caagttctgaaggccttccccacactcctcagtttnagctgtgcactgactagtctgaattgcagcacttg

SEQ ID NO: 37029 - DNA, 71 bp, chicken (Gallus Gallus)
  misc_feature (36): n=c or t
tgacctctctgaaaagctttctctaactatctccanggtatacatttgcttttaaatccttgtttttaaat

SEQ ID NO: 37030 - DNA, 71 bp, chicken (Gallus Gallus)
  misc_feature (36): n=a or g
gaattaaagatgtacaagaaatggagcctaaaagantagggacagagttagaagtagagctaaagaagtca

SEQ ID NO: 37031 - DNA, 71 bp, chicken (Gallus Gallus)
  misc_feature (36): n=a or g
taaaacaacatacacaagaaacaattgtgctcaacncagtaaattttacagtttccctcataatgacagat

SEQ ID NO: 37032 - DNA, 71 bp, chicken (Gallus Gallus)
  misc_feature (36): n=a or g
ctttaaaatagctaatctttaatttctacacctgancagggaaataaagatgaaggaccaaattttgccct

SEQ ID NO: 37033 - DNA, 71 bp, chicken (Gallus Gallus)
  misc_feature (36): n=c or t
gctttatcttagaaacgatccttcccttgggaagantgcttcccttgggatctaaaccatcacaatggaaa

SEQ ID NO: 37034 - DNA, 71 bp, chicken (Gallus Gallus)
  misc_feature (36): n=c or t
tgcatgttcagtagatgaattcagacaaatgctatntgtagaagttgctcataaccaagtatctcagcatt

SEQ ID NO: 37035 - DNA, 71 bp, chicken (Gallus Gallus)
  misc_feature (36): n=g or t
acatatagctgcgccatattcaatccagtctgatgntgaattactttgctagtaaatttgctctataatag

SEQ ID NO: 37036 - DNA, 71 bp, chicken (Gallus Gallus)
  misc_feature (36): n=c or t
gctgttggctttttgggcactctcctaacaggacancattgataatctccagggccaaggtcccccaagtg

SEQ ID NO: 37037 - DNA, 71 bp, chicken (Gallus Gallus)
  misc_feature (36): n=c or t
gagggtacagaacagcgccttgatcaacaactgtgnttgtgcacaggtttgaggataccttcttcttcccg

SEQ ID NO: 37038 - DNA, 71 bp, chicken (Gallus Gallus)
  misc_feature (36): n=a or g
ccttaagatatacaagacaaaactaattctcttacngactgaagttgaacaaagcacctcaaattaaaaat

SEQ ID NO: 37039 - DNA, 71 bp, chicken (Gallus Gallus)
  misc_feature (36): n=a or c
acaacagcccttccagcttaacatttctgagatacncacacagctctcctgacacacagaaaagagtgcaa

SEQ ID NO: 37040 - DNA, 71 bp, chicken (Gallus Gallus)
  misc_feature (36): n=g or t
attatgagaacccattccatcactaattaattccantgcctggccaacacgttatgtaggttgtttgtttg

SEQ ID NO: 37041 - DNA, 71 bp, chicken (Gallus Gallus)
  misc_feature (36): n=a or g
ccaaacatacacaggatgaaagacaatgagaaaacncatttgaagtactcctccattactaaaagttgtaa

SEQ ID NO: 37042 - DNA, 71 bp, chicken (Gallus Gallus)
  misc_feature (36): n=a or g
aacagaacttggtcagagatgtagactgtcactgtntagacaacaaataccaggccagtttgtatgcctaa

SEQ ID NO: 37043 - DNA, 71 bp, chicken (Gallus Gallus)
  misc_feature (36): n=a or g
aagactgagtcaaggttttatcaagttagtctggtntagggttaaggaaaaataatatgtggaaacagaaa

SEQ ID NO: 37044 - DNA, 71 bp, chicken (Gallus Gallus)
  misc_feature (36): n=c or t
ccttaacaatgtctgtattccttctctacatagaantggtatgctttcttaggataagaactttttaaaag

SEQ ID NO: 37045 - DNA, 71 bp, chicken (Gallus Gallus)
  misc_feature (36): n=g or t
tcagaaactgaaataacatgacctcccatatgtganccattcccatgtgcctgtcttttgagttttcagac

SEQ ID NO: 37046 - DNA, 71 bp, chicken (Gallus Gallus)
  misc_feature (36): n=c or t
gatctgatatattcaggtggagagcactttgaaacnaagtactagacaactctaactctgagttaacacaa

SEQ ID NO: 37047 - DNA, 71 bp, chicken (Gallus Gallus)
  misc_feature (36): n=c or t
atacacatcttttctgtggtttgtgctgaatttaanacatgctgtatacttatgtgctatataagttgaaa

SEQ ID NO: 37048 - DNA, 71 bp, chicken (Gallus Gallus)
  misc_feature (36): n=c or t
tttcattaggacagcaaagaaatgatcaccaacgcnttttatctatttaagcgaagtgctcatgcccacgg

SEQ ID NO: 37049 - DNA, 71 bp, chicken (Gallus Gallus)
  misc_feature (36): n=a or g
agctgtacaaaatgaacgggacaggataagtacaanaagaaatacttttgatggctgcaacattccctcta

SEQ ID NO: 37050 - DNA, 71 bp, chicken (Gallus Gallus)
  misc_feature (36): n=g or t
ggaagacctttaacctttcctgtctgccagaaaaancccagtattaatgagagaaaggagattaggagacc

SEQ ID NO: 37051 - DNA, 71 bp, chicken (Gallus Gallus)
  misc_feature (36): n=c or t
acaacactcttgcttgatatacatgattaggaaacnacatgtttctaacaggaaccataaatgattaaaaa

SEQ ID NO: 37052 - DNA, 71 bp, chicken (Gallus Gallus)
  misc_feature (36): n=a or g
ttctcaagtaaaaggaataagcctttgaaaaattcnagtttgtgggtcctcaggatgttgtagccagcaag

SEQ ID NO: 37053 - DNA, 71 bp, chicken (Gallus Gallus)
  misc_feature (36): n=a or g
accatttcaagtgattcttcagttgccaaaatgccntgttatgcaaattcctgtagatatttacttcaaaa

SEQ ID NO: 37054 - DNA, 71 bp, chicken (Gallus Gallus)
  misc_feature (36): n=c or t
ggaggaatccccatttattgatcaactttaaagccnatgcacagcacttaaaaagataaagtaagcaaggt

SEQ ID NO: 37055 - DNA, 71 bp, chicken (Gallus Gallus)
  misc_feature (36): n=a or g
ataacagtggtaaggatgacatggaagtagacaaanaaagtatcttctgattaagaagactgctaatgcca

SEQ ID NO: 37056 - DNA, 71 bp, chicken (Gallus Gallus)
  misc_feature (36): n=c or t
aaacaaacaaaaaactctgttgctcttaataccttngtaggatacttgtatgcccaaatgatattattttg

SEQ ID NO: 37057 - DNA, 71 bp, chicken (Gallus Gallus)
  misc_feature (36): n=g or t
ttgtcattgacattatatgtagttagatttgtaganaaatgtatcatagagatatacatacacatatcgaa

SEQ ID NO: 37058 - DNA, 71 bp, chicken (Gallus Gallus)
  misc_feature (36): n=c or t
cagaagttaaaccaaaattattcatatcaattaatnatcttatttggaaaattgttgcttttggttgtttt

SEQ ID NO: 37059 - DNA, 71 bp, chicken (Gallus Gallus)
  misc_feature (36): n=a or g
cagcaacagtctttcatcctgatcagacagtaaagnaacaggataattcctgctggtgctgtttgtttttg

SEQ ID NO: 37060 - DNA, 71 bp, chicken (Gallus Gallus)
  misc_feature (36): n=c or t
gagacaagagtgtcatagaatatttattaacattanccaggtttgtttgagactgtatagctcaccaagtt

SEQ ID NO: 37061 - DNA, 71 bp, chicken (Gallus Gallus)
  misc_feature (36): n=c or t
ttaatatacacagattgcccttgaaaaagaccttcntcattcttctgtcttccctgagaagggctatgcaa

SEQ ID NO: 37062 - DNA, 71 bp, chicken (Gallus Gallus)
  misc_feature (36): n=c or t
tgttttattccaatggacttttaatcatacacaatngaataagaaagccattttggtagctgaattaaaac

SEQ ID NO: 37063 - DNA, 71 bp, chicken (Gallus Gallus)
  misc_feature (36): n=a or c
atgcatgtggtaatatttctggatcttcctgattcnagtagtctgttatgaacaacattttctttttattc

SEQ ID NO: 37064 - DNA, 71 bp, chicken (Gallus Gallus)
  misc_feature (36): n=c or t
tgtcattagatagaaaatagtacagactcgatatantgtccccaggcttggcctatgtatggagtcaaaac

SEQ ID NO: 37065 - DNA, 71 bp, chicken (Gallus Gallus)
  misc_feature (36): n=a or c
ctgtgccaaccaatcatctttttgtgcccaaatccnttctataaccttcagaaatttaaagataaaatgct

SEQ ID NO: 37066 - DNA, 71 bp, chicken (Gallus Gallus)
  misc_feature (36): n=a or g
aaagctaccttgggtaccacttgtcctaggaggagngtagctctccacatgcatgtttttgcctatggcta

SEQ ID NO: 37067 - DNA, 71 bp, chicken (Gallus Gallus)
  misc_feature (36): n=c or t
aactcagttctaaacctctaccaagcattactgggngctttcatttattgtgacaaatagcagttttactc

SEQ ID NO: 37068 - DNA, 71 bp, chicken (Gallus Gallus)
  misc_feature (36): n=c or t
tataccgcttttgaaagaaggcttaaatgtaaagcngtggaattagtgtggctctgaatataaacaatcta

SEQ ID NO: 37069 - DNA, 71 bp, chicken (Gallus Gallus)
  misc_feature (36): n=c or t
tttcaaggatgtgtccatacaacttcagttgttgcnccaagtctcacccagtcagttgatgtctcctaaat

SEQ ID NO: 37070 - DNA, 71 bp, chicken (Gallus Gallus)
  misc_feature (36): n=a or c
gtaccatgaaagctttctaacaaaaagataaaaagngataggatcctcaaagtctctttaggctcaaagaa

SEQ ID NO: 37071 - DNA, 71 bp, chicken (Gallus Gallus)
  misc_feature (36): n=c or t
agatacatatcagcagattccagctcctgcatacangcctttctggtaacagctatcatgcagttacatta

SEQ ID NO: 37072 - DNA, 71 bp, chicken (Gallus Gallus)
  misc_feature (36): n=c or t
caagacacttaagcaggtgtctgggtttgagcatgngaacagccccaatggcgttgaacagaactcttcgc

SEQ ID NO: 37073 - DNA, 71 bp, chicken (Gallus Gallus)
  misc_feature (36): n=c or t
ttcagaacagtcacataattaaaatcgacataagtngttgtagttcatgcatttatgcatcgattttacat

SEQ ID NO: 37074 - DNA, 71 bp, chicken (Gallus Gallus)
  misc_feature (36): n=a or g
agacagctggacagaagggcatagcactgacttctngtatctgctccccagcttcatcatagcagaaagac

SEQ ID NO: 37075 - DNA, 71 bp, chicken (Gallus Gallus)
  misc_feature (36): n=c or t
ctgcacactggctttgcagtggggcattacgcaacngcactgaaggagagggctgcatacacctgtagtct

SEQ ID NO: 37076 - DNA, 71 bp, chicken (Gallus Gallus)
  misc_feature (36): n=c or t
tttaaaggaagcaggtcctagtcacttcccaactgntaagccttgtgttgctgcgtcatgctgagaaatgt

SEQ ID NO: 37077 - DNA, 71 bp, chicken (Gallus Gallus)
  misc_feature (36): n=c or t
gactgtaagtcagtcaagcagagagtgcttcttcanacatataggaggtgggaggagtaaggaaaccattg

SEQ ID NO: 37078 - DNA, 71 bp, chicken (Gallus Gallus)
  misc_feature (36): n=a or g
tgttctttcaaactgatgtttggttgcaggtccatntcagctagtagaagctaaaattccctcatatctat

SEQ ID NO: 37079 - DNA, 71 bp, chicken (Gallus Gallus)
  misc_feature (36): n=g or t
gcagtggtatctgtgcttgtgtctttatgtaagaanaaatacaagcagagacgtgtatgattttttttgtt

SEQ ID NO: 37080 - DNA, 71 bp, chicken (Gallus Gallus)
  misc_feature (36): n=a or g
aaggtgtttaagctacttctggcacataagacaacntaccacaattctatatagcctacagcttcccctct

SEQ ID NO: 37081 - DNA, 71 bp, chicken (Gallus Gallus)
  misc_feature (36): n=a or c
cgtgtaactactggtaaagcacacaaacttgatggnattttaaccatggtgttagttatctactttgtgta

SEQ ID NO: 37082 - DNA, 71 bp, chicken (Gallus Gallus)
  misc_feature (36): n=a or c
ttcacgttaaatgtggttttgaaatccatttgttgnactgaacaactaaaacagaaatgttgctattttcc

SEQ ID NO: 37083 - DNA, 71 bp, chicken (Gallus Gallus)
  misc_feature (36): n=c or t
tctttgcattcaaagcaagatatgtcatctaagaantgttcaatttaactatttttgtgacatccatttat

SEQ ID NO: 37084 - DNA, 71 bp, chicken (Gallus Gallus)
  misc_feature (36): n=c or t
tcccctgaactataaatgcacaacagaaaacctaanatgaattcttaatatcatctatataaaagcttgcc

SEQ ID NO: 37085 - DNA, 71 bp, chicken (Gallus Gallus)
  misc_feature (36): n=g or t
tttactacagaaatgatgtttaactgaaaggaaagngggagccaccacagcaagcaattcccatccgattt

SEQ ID NO: 37086 - DNA, 71 bp, chicken (Gallus Gallus)
  misc_feature (36): n=a or g
gataatgcaaataatggtaatgagcagttaatagcnggctaaattttaaccagccttttcatccttaatgg

SEQ ID NO: 37087 - DNA, 71 bp, chicken (Gallus Gallus)
  misc_feature (36): n=c or t
gaagtaaagatgatggtaaaaaagaattggctgtancatgctcttgcttcttgaacaggtctgtagtgctt

SEQ ID NO: 37088 - DNA, 71 bp, chicken (Gallus Gallus)
  misc_feature (36): n=a or g
atgctaaaaattgctattgcaagccctacaaaaaantattgtctggagagaacttaagaaagagatgctta

SEQ ID NO: 37089 - DNA, 71 bp, chicken (Gallus Gallus)
  misc_feature (36): n=a or g
cttatcgaatgtctctatgcggatgtccagcctcantgtccaactcagagagaggtcctgggagagtgggc

SEQ ID NO: 37090 - DNA, 71 bp, chicken (Gallus Gallus)
  misc_feature (36): n=a or c
tgaacagcttagttactctactgggtttagcagaanattctatccattgaaatctcttttgtgtgcttaac

SEQ ID NO: 37091 - DNA, 71 bp, chicken (Gallus Gallus)
  misc_feature (36): n=c or t
ctgatctgattttttagttttccacatatacattcnctggtgatgagaaataatgctaagtcaggtaaagc

SEQ ID NO: 37092 - DNA, 71 bp, chicken (Gallus Gallus)
  misc_feature (36): n=c or t
ttctttatgattgtgggttaggatccaatacagctnaccacagaaaagctttctcacctgaaacttcccac

SEQ ID NO: 37093 - DNA, 71 bp, chicken (Gallus Gallus)
  misc_feature (36): n=c or t
aagcagtacctatctgtaaaatgaagggaatggctnatttaagaatcagcaagatgttattacagtgttag

SEQ ID NO: 37094 - DNA, 71 bp, chicken (Gallus Gallus)
  misc_feature (36): n=c or t
atcactaaatggtaaaatgaatgaatagataaaacncaaattatacactgtgcctgagcaaaatatttatt

SEQ ID NO: 37095 - DNA, 71 bp, chicken (Gallus Gallus)
  misc_feature (36): n=c or t
gtattgtacattcaaaatatgtccattatagtacanagcaaaaacttgttacttattattggaacaagaca

SEQ ID NO: 37096 - DNA, 71 bp, chicken (Gallus Gallus)
  misc_feature (36): n=c or t
agctgagcataatcccaaacactgatgagaatgctnggacaatgaaggtgagctgtttaattatatgtaaa

SEQ ID NO: 37097 - DNA, 71 bp, chicken (Gallus Gallus)
  misc_feature (36): n=a or g
cacaagtttcctacatgtttctactgcagaggaagngagctatttgacagctttcctaatttttgtttgag

SEQ ID NO: 37098 - DNA, 71 bp, chicken (Gallus Gallus)
  misc_feature (36): n=a or g
tgaaatcagtgagagtccctcttgtgacttaacttngcaatgaactggacaaaaaatgtttacttgaggtc

SEQ ID NO: 37099 - DNA, 71 bp, chicken (Gallus Gallus)
  misc_feature (36): n=c or t
atggagtatctctccactgaatatttttcataatgntgctagtgttaagtgtgaccttattacaggctgtg

SEQ ID NO: 37100 - DNA, 71 bp, chicken (Gallus Gallus)
  misc_feature (36): n=a or g
tgtttctcttaacatgctgtgcctttgtatgtccantgttgctatccttgacgctgagtaaaagatgactt

SEQ ID NO: 37101 - DNA, 71 bp, chicken (Gallus Gallus)
  misc_feature (36): n=c or t
aatgctttttcatataaggctcactacgaatagtantcgcataatcttttggcagtaggattagagtcatt

SEQ ID NO: 37102 - DNA, 71 bp, chicken (Gallus Gallus)
  misc_feature (36): n=c or t
ctagttaataatttaactggaattcagacttctttnacagaatataaatgatcaaacaacaataacaaaaa

SEQ ID NO: 37103 - DNA, 71 bp, chicken (Gallus Gallus)
  misc_feature (36): n=c or t
aatttatctgctcacccctgctttaccacagcccangtgtaacatgaagttatgccattgtgtgtcttgct

SEQ ID NO: 37104 - DNA, 71 bp, chicken (Gallus Gallus)
  misc_feature (36): n=a or g
gattggtgttctaatgcattacaggatagacttgcncagtttgtagcccacaggaacataaatagcctgca

SEQ ID NO: 37105 - DNA, 71 bp, chicken (Gallus Gallus)
  misc_feature (36): n=g or t
attcccatcattacttttcactaaattcttatttgnctacttaaggcatagagtttatctaatgtattggc

SEQ ID NO: 37106 - DNA, 71 bp, chicken (Gallus Gallus)
  misc_feature (36): n=a or g
ttttgttagaaattcacgagaactgttgtatctgcngacttacactgcataattaatacgctgtatatgat

SEQ ID NO: 37107 - DNA, 71 bp, chicken (Gallus Gallus)
  misc_feature (36): n=a or g
acgctggcaaggccaataatgaatgaggctattgcnaagttaatgctgcagaaatgatccatgatttaaat

SEQ ID NO: 37108 - DNA, 71 bp, chicken (Gallus Gallus)
  misc_feature (36): n=c or t
caaaacagtaattaatttcttgctaatggggctgantgtgggctgtagttttgaaccacagattcacagaa

SEQ ID NO: 37109 - DNA, 71 bp, chicken (Gallus Gallus)
  misc_feature (36): n=c or t
agatttgttgattgtaactgctgatcttatcactcnccttctttatcctgttccctatttataacctgttt

SEQ ID NO: 37110 - DNA, 71 bp, chicken (Gallus Gallus)
  misc_feature (36): n=a or g
gtaaaatgtgctattggaaagtcatattttcctcantatgaaaaagctgaggtctcaacaccttcttttca

SEQ ID NO: 37111 - DNA, 71 bp, chicken (Gallus Gallus)
  misc_feature (36): n=a or g
atggctatgcttggaatgagttacactataaatccnttcttgctctaggatacactgtctcttctgaagca

SEQ ID NO: 37112 - DNA, 71 bp, chicken (Gallus Gallus)
  misc_feature (36): n=a or g
gtgatctatgagcacagacatataaaagcgtgaganattattgcatttctttgcactggagtaaaggggaa

SEQ ID NO: 37113 - DNA, 71 bp, chicken (Gallus Gallus)
  misc_feature (36): n=c or t
tgtacctgtatttggagagtatgcttccatgcagtncacaactccagtttgttctaccttcccagccaagc

SEQ ID NO: 37114 - DNA, 71 bp, chicken (Gallus Gallus)
  misc_feature (36): n=c or t
tgaaaaatccaggtatatgatatcaaggcaccaaantggctaatatgaacacatagaacataagctgagga

SEQ ID NO: 37115 - DNA, 71 bp, chicken (Gallus Gallus)
  misc_feature (36): n=c or t
gtcttaagggcattaataatgctggatgactgctantgcaggagttaagagggctgttgctggataacaca

SEQ ID NO: 37116 - DNA, 71 bp, chicken (Gallus Gallus)
  misc_feature (36): n=g or t
tccactctgaagaaacaatgaatgggaacacaaatntacactgttccactgtaagatgtcttctaagtaat

SEQ ID NO: 37117 - DNA, 71 bp, chicken (Gallus Gallus)
  misc_feature (36): n=a or g
aacaatgttggctttaggaaaacatgaacatatctntacagtgaaagatcatatgttgacattcccagtaa

SEQ ID NO: 37118 - DNA, 71 bp, chicken (Gallus Gallus)
  misc_feature (36): n=a or c
gtctagacaggattatgtcacagagagtggtcaaanatagtggcctagggaagagtcccacattaggatga

SEQ ID NO: 37119 - DNA, 71 bp, chicken (Gallus Gallus)
  misc_feature (36): n=a or g
gacccaacccagtacactacacacttcataaacatntaagaagacacaagtcctgccctgaagagcttaca

SEQ ID NO: 37120 - DNA, 71 bp, chicken (Gallus Gallus)
  misc_feature (36): n=a or c
aacatatctgaagtgtaattacaaacatagtggaanagaaattttctcagcatgtgataaaacaagaagta

SEQ ID NO: 37121 - DNA, 71 bp, chicken (Gallus Gallus)
  misc_feature (36): n=a or g
attcactttcacatacatatgcattacaatgaagtnaatagtcctctggagatactggcttatttccacag

SEQ ID NO: 37122 - DNA, 71 bp, chicken (Gallus Gallus)
  misc_feature (36): n=a or c
cttttcattgacatggagatcagtctattactctgnatggaagagaatacagagcaatcggaaagaaatgt

SEQ ID NO: 37123 - DNA, 71 bp, chicken (Gallus Gallus)
  misc_feature (36): n=a or g
ctctgtcatcagttttcggctgcattaactgagacntaacctcagtacaaagctccaggaatttgaattct

SEQ ID NO: 37124 - DNA, 71 bp, chicken (Gallus Gallus)
  misc_feature (36): n=a or c
atttctttgcagctgatctaagatacttgacaatcntttttgaaatatataacacattctaccagaacaga

SEQ ID NO: 37125 - DNA, 71 bp, chicken (Gallus Gallus)
  misc_feature (36): n=g or t
tagtttaaactttctagaataccacacatgactctntaactctaaagcagttagaagtgacagtctcaaat

SEQ ID NO: 37126 - DNA, 71 bp, chicken (Gallus Gallus)
  misc_feature (36): n=c or t
gagaggctaaggtgcaggtagttgaaagttatatcngtagaaaatctcttctgcatgagggagatgagtta

SEQ ID NO: 37127 - DNA, 71 bp, chicken (Gallus Gallus)
  misc_feature (36): n=g or t
attgatgcatggcatcatggttaaacatccctaacngatgtacttctatgaaggcatgaataattcacata

SEQ ID NO: 37128 - DNA, 71 bp, chicken (Gallus Gallus)
  misc_feature (36): n=c or t
gtgattcagtgtctgcgctccacacactttgcctgngtgaaggatttacttaccctatatttattaactac

SEQ ID NO: 37129 - DNA, 71 bp, chicken (Gallus Gallus)
  misc_feature (36): n=a or g
atacagttttttgttactggccttgcaagcaaatangaacagaagagctgtaagaagatgacatttttgtg

SEQ ID NO: 37130 - DNA, 71 bp, chicken (Gallus Gallus)
  misc_feature (36): n=a or g
tgatcaatgaccaggtcttaggccactaatgttagntgggcaactttggctacagcacactcacttgtcca

SEQ ID NO: 37131 - DNA, 71 bp, chicken (Gallus Gallus)
  misc_feature (36): n=g or t
ttcaactacgttccttgtactatcaacttgtgcagnatgattacttctctaaaagagagctggagtagtca

SEQ ID NO: 37132 - DNA, 71 bp, chicken (Gallus Gallus)
  misc_feature (36): n=c or t
tttttcttcagttttactcaacttgaaaacatgtanacttctgaactgtgctgtaatctaatcatttggat

SEQ ID NO: 37133 - DNA, 71 bp, chicken (Gallus Gallus)
  misc_feature (36): n=a or c
ttttcaatgtcaagaaataatttggtatgtgtgccnagacatatttctaaaacttcaccataactttgaat

SEQ ID NO: 37134 - DNA, 71 bp, chicken (Gallus Gallus)
  misc_feature (36): n=a or g
atatacagagagcttgaagaactaaaaggctgtttncagtgaagtggcaaatgctgatggaaaattgtttt

SEQ ID NO: 37135 - DNA, 71 bp, chicken (Gallus Gallus)
  misc_feature (36): n=c or t
tcagagattgcaggggaaataccaaagggaaatacnagtgagacacagatgcactcaagcttcttctagat

SEQ ID NO: 37136 - DNA, 71 bp, chicken (Gallus Gallus)
  misc_feature (36): n=g or t
tttcagttcttcagctgtggatcaaatgtgttgctncaagagagcaaagttccgcaagctgcattcttttc

SEQ ID NO: 37137 - DNA, 71 bp, chicken (Gallus Gallus)
  misc_feature (36): n=a or g
gataaggtgggtcgtgatttttcatatggccctacnaatgatgttctctaggtacatccactgtgctgaat

SEQ ID NO: 37138 - DNA, 71 bp, chicken (Gallus Gallus)
  misc_feature (36): n=c or t
acctgcttatttctaacccatctacttctctgcctngtgaggctagtgcatgaactgtgtgaaggcaacta

SEQ ID NO: 37139 - DNA, 71 bp, chicken (Gallus Gallus)
  misc_feature (36): n=a or g
tacagaagagatagaaatatcttatatgtctcccangatctcttcaactttctgaaattcaagactcaagt

SEQ ID NO: 37140 - DNA, 71 bp, chicken (Gallus Gallus)
  misc_feature (36): n=a or g
aaattacctttacaaaatatgcatgcattaaatcanacacattatacatttgaatgaatctgctataaagt

SEQ ID NO: 37141 - DNA, 71 bp, chicken (Gallus Gallus)
  misc_feature (36): n=c or t
agctttagttcctttatcaagacagattttggccantgtgagcagagagaattatgaatgagaccttgata

SEQ ID NO: 37142 - DNA, 71 bp, chicken (Gallus Gallus)
  misc_feature (36): n=c or t
gagtcaggcttcagaatattgggagattgagttaanagactaaaaatgaaatttaaacacttttatttgcc

SEQ ID NO: 37143 - DNA, 71 bp, chicken (Gallus Gallus)
  misc_feature (36): n=c or t
tgctgacacagtaggagacatataattgcacaggcnacaaagtataaaaagccatagtgaatgtgagggct

SEQ ID NO: 37144 - DNA, 71 bp, chicken (Gallus Gallus)
  misc_feature (36): n=a or g
ttctggtctggaccctggacaatgaagggttaatgnattcacactataccttgctgaacatgtttaacctg

SEQ ID NO: 37145 - DNA, 71 bp, chicken (Gallus Gallus)
  misc_feature (36): n=c or t
acaacgctgtgcacttaaccctgcttcagaaagccngtaaagatgaattcatgggaatggaatggccttag

SEQ ID NO: 37146 - DNA, 71 bp, chicken (Gallus Gallus)
  misc_feature (36): n=c or t
gaccaacaatttcaactttctgttactgtgttaggnctgggaagacgtaatctcaatgttttatctcagca

SEQ ID NO: 37147 - DNA, 71 bp, chicken (Gallus Gallus)
  misc_feature (36): n=c or t
agcctttactaaaaagctgcaagcccacttatttcnctgggatgtcagaagtgaacagaagttgaaggata

SEQ ID NO: 37148 - DNA, 71 bp, chicken (Gallus Gallus)
  misc_feature (36): n=g or t
aacccttctcttttcatggtatcaagatcatctttnctaacattgctttcctcctccctatcacctcgcct

SEQ ID NO: 37149 - DNA, 71 bp, chicken (Gallus Gallus)
  misc_feature (36): n=a or g
gtgaaatctacaggacattaattaatttcatcagtntttgaggattttttgtacaagtattctttcttggt

SEQ ID NO: 37150 - DNA, 71 bp, chicken (Gallus Gallus)
  misc_feature (36): n=c or t
agaagacaatccatttctaattcatatgccctaatntgtgacttgtgtatgcgacattacctccagggtat

SEQ ID NO: 37151 - DNA, 71 bp, chicken (Gallus Gallus)
  misc_feature (36): n=a or g
acatatttggaaaagctgtgagatcttgaacttcanttggattcctttcagaatgcacatttaagtcaggg

SEQ ID NO: 37152 - DNA, 71 bp, chicken (Gallus Gallus)
  misc_feature (36): n=a or c
attttggaaaggtgtgaataccaaataaaaggatcncaacacggaattcgtatcatattcgtattatttat

SEQ ID NO: 37153 - DNA, 71 bp, chicken (Gallus Gallus)
  misc_feature (36): n=a or g
ccactcctgaccaagtaggaagattttccgggtccntctattcataacactattttgtggacttgttggtc

SEQ ID NO: 37154 - DNA, 71 bp, chicken (Gallus Gallus)
  misc_feature (36): n=c or t
tctggataactttgaagcacttcaaggtgattctgngttccacttacaagtcctctcttgtccttatacat

SEQ ID NO: 37155 - DNA, 71 bp, chicken (Gallus Gallus)
  misc_feature (36): n=c or t
tttctttcttctaaaaagagccagtgagcctgtctntgctcctgatgcagctacaccagggaaagggagag

SEQ ID NO: 37156 - DNA, 71 bp, chicken (Gallus Gallus)
  misc_feature (36): n=g or t
tgtgaaaaaaacctgatggcaatatgctctgcatcnaagaagaagctctctctcagctgtcaagcacaacc

SEQ ID NO: 37157 - DNA, 71 bp, chicken (Gallus Gallus)
  misc_feature (36): n=c or t
tacgcagttatttcagtccccatcaaagagaaacangttggggtccaacatcccaaggctgtttcagcatg

SEQ ID NO: 37158 - DNA, 71 bp, chicken (Gallus Gallus)
  misc_feature (36): n=a or g
ttattctgacctgtgctgaaatctcccaaatcttgncttggtgacatgagagtttttggcaaaatagtcct

SEQ ID NO: 37159 - DNA, 71 bp, chicken (Gallus Gallus)
  misc_feature (36): n=a or g
cagtctgcttaatagccagttaaaatactttatgcntttgaatagattgcgtgttaaatattgatcttttt

SEQ ID NO: 37160 - DNA, 71 bp, chicken (Gallus Gallus)
  misc_feature (36): n=a or g
ttatgcccggggaccttggctctttgataaaagttngcaacttgctcggggaacccggcagctcagcccta

SEQ ID NO: 37161 - DNA, 71 bp, chicken (Gallus Gallus)
  misc_feature (36): n=a or g
acaaggaatacaatactgttgcaagaattctccctntaagaattcaaaataagtgtggttgcctgtgagta

SEQ ID NO: 37162 - DNA, 71 bp, chicken (Gallus Gallus)
  misc_feature (36): n=g or t
agaggacaggttggggagataaaggaaagttgaacngctgcacattttccccatcttcagataaagccatg

SEQ ID NO: 37163 - DNA, 71 bp, chicken (Gallus Gallus)
  misc_feature (36): n=a or g
caggtgaaagaaatcataattataatctaaggatancagttgatgaaaatctacagacagtaaataacatg

SEQ ID NO: 37164 - DNA, 71 bp, chicken (Gallus Gallus)
  misc_feature (36): n=c or t
agattaaaaagtccaacagaaagtaaactgaaaacncagataaaaagcataaatttgattcattacatata

SEQ ID NO: 37165 - DNA, 71 bp, chicken (Gallus Gallus)
  misc_feature (36): n=c or t
gcacagcccagagacacatttctggttaaatgatanaggactgccatacagcaacctcatcaagaccacaa

SEQ ID NO: 37166 - DNA, 71 bp, chicken (Gallus Gallus)
  misc_feature (36): n=a or g
ttagattagaaaaactgttggtggtaaccattaatntatttcaacaaaatgatacagctctgctgattctc

SEQ ID NO: 37167 - DNA, 71 bp, chicken (Gallus Gallus)
  misc_feature (36): n=a or g
tttatttatcctgtcactgctgtgggaataaattanatgttttaagtgggaaagggaatagaactgcatca

SEQ ID NO: 37168 - DNA, 71 bp, chicken (Gallus Gallus)
  misc_feature (36): n=a or g
acatcaataaaccataccctgactgtagctgcctgngagagggctgaaatgttgaaatattgcatccaaag

SEQ ID NO: 37169 - DNA, 71 bp, chicken (Gallus Gallus)
  misc_feature (36): n=c or t
tgagttacagaagttatcccaaacaagtgcccaaanccctgcgcccgccgtcccacaccgcattgcactgc

SEQ ID NO: 37170 - DNA, 71 bp, chicken (Gallus Gallus)
  misc_feature (36): n=c or t
ttgtgttcatgcagattcttactgacatcaggcatngcattgcctggcacagcaatttgtggaacactgga

SEQ ID NO: 37171 - DNA, 71 bp, chicken (Gallus Gallus)
  misc_feature (36): n=a or g
tctgtatttccttgtactcagctacaacttagatangcatcagaagtgattaaatgtaaccatgtaaagga

SEQ ID NO: 37172 - DNA, 71 bp, chicken (Gallus Gallus)
  misc_feature (36): n=c or t
acacttcatcgctccttccacagagctggacccgtngctcagatgagtccctacagcattaccctgagttc

SEQ ID NO: 37173 - DNA, 71 bp, chicken (Gallus Gallus)
  misc_feature (36): n=a or g
ccccagaagtctggccttctgatttctccctctctnccatacaagacccagtgcatggagttttttattgc

SEQ ID NO: 37174 - DNA, 71 bp, chicken (Gallus Gallus)
  misc_feature (36): n=a or g
ccatgtgtagtattacaaaaccagtctatctaaaantgtatggttttctatgagaagagattgcaggtgaa

SEQ ID NO: 37175 - DNA, 71 bp, chicken (Gallus Gallus)
  misc_feature (36): n=g or t
tctttaaatgacccaatagctattttataaatgtgntttttgttataacttggatcacctaccaattgggt

SEQ ID NO: 37176 - DNA, 71 bp, chicken (Gallus Gallus)
  misc_feature (36): n=g or t
tttcctcattaactgagaaagaggagtgatcaagtngggtcagctacagaattagaatttcagcattgtgg

SEQ ID NO: 37177 - DNA, 71 bp, chicken (Gallus Gallus)
  misc_feature (36): n=a or g
aaacaaaactgtttaaattttccagtatgaggtatntaccaattcagtttggtaacaatgacttactgtaa

SEQ ID NO: 37178 - DNA, 71 bp, chicken (Gallus Gallus)
  misc_feature (36): n=a or c
caccagtcttcactcagaatgaataccacggcagcntcctggaggagctcacagatctgcctgtatttgtt

SEQ ID NO: 37179 - DNA, 71 bp, chicken (Gallus Gallus)
  misc_feature (36): n=c or t
gcgtagtctatgataggcagaatgtctgcttgttcntctcctgcctaaacgtttttattcttggtttgttc

SEQ ID NO: 37180 - DNA, 71 bp, chicken (Gallus Gallus)
  misc_feature (36): n=a or g
ctgcagttttcttggggtaatttttatctgggaatnaagcactttttcacacccttcaaaacaagaatgcc

SEQ ID NO: 37181 - DNA, 71 bp, chicken (Gallus Gallus)
  misc_feature (36): n=c or t
cttctaaaacttgaaatcaaagctgataaggctacngtactgagcagtgatattgcaggagatgtgggctt

SEQ ID NO: 37182 - DNA, 71 bp, chicken (Gallus Gallus)
  misc_feature (36): n=a or g
gagaactgttttctgtgaacagtaaacattttaccntagatcctcaatgtattattttcattttcctctct

SEQ ID NO: 37183 - DNA, 71 bp, chicken (Gallus Gallus)
  misc_feature (36): n=a or g
cactaggtatgttccccaacaactccagctgcactntgtgcagtaactacatcatgcactacatgatgctc

SEQ ID NO: 37184 - DNA, 71 bp, chicken (Gallus Gallus)
  misc_feature (36): n=a or g
catcctgtattttggtttacgatgctgcacagtacntttctgagaacaagattggtggctttttttaacca

SEQ ID NO: 37185 - DNA, 71 bp, chicken (Gallus Gallus)
  misc_feature (36): n=a or g
aagatcatctggaggcttactgaatcatcagtgatncaacatttaatatactggtcactgttggcttaatc

SEQ ID NO: 37186 - DNA, 71 bp, chicken (Gallus Gallus)
  misc_feature (36): n=a or g
ttgtctgacaccatctaaggatgactgcaagatctntcagcttggaaatcccatgctgtatgactgtatgt

SEQ ID NO: 37187 - DNA, 71 bp, chicken (Gallus Gallus)
  misc_feature (36): n=c or t
gagctgatagagaggtacagatatgttttgtgaaangtagccaggcaaggaacatcctcagaccttgacaa

SEQ ID NO: 37188 - DNA, 71 bp, chicken (Gallus Gallus)
  misc_feature (36): n=c or t
tggaattggtgaagaagtgctttctattcaactaangaagatctgatcttgttacttacaaaaatattgac

SEQ ID NO: 37189 - DNA, 71 bp, chicken (Gallus Gallus)
  misc_feature (36): n=g or t
ctaaacaggtgaggcaagtgaataggaataaaagcntcaattcagaaggcagagttcaaactgcattaagt

SEQ ID NO: 37190 - DNA, 71 bp, chicken (Gallus Gallus)
  misc_feature (36): n=a or g
ttgtagaagcagagcagtgaatagaaggctgtgagnatagctttttagctgctttaaatcctgcctttccc

SEQ ID NO: 37191 - DNA, 71 bp, chicken (Gallus Gallus)
  misc_feature (36): n=a or g
gtgaaagagcaggaaaacttcaaaaggaatgtttangaattgagttctggtcacagtgacctcaacaggct

SEQ ID NO: 37192 - DNA, 71 bp, chicken (Gallus Gallus)
  misc_feature (36): n=c or t
ctttttcccatattgctatggagaggtataaattcnatctgcatgtgggatgctgcacactggtaggtgtt

SEQ ID NO: 37193 - DNA, 71 bp, chicken (Gallus Gallus)
  misc_feature (36): n=c or t
gtgtaaactttgagaaaagagtttctttgtgctgcntgccattgtacatttgtatttagaagagtagtgtt

SEQ ID NO: 37194 - DNA, 71 bp, chicken (Gallus Gallus)
  misc_feature (36): n=a or g
aaatgccaatttcttctcatccaagttgattctttngataaagattacagggattcagtttagtagcagtc

SEQ ID NO: 37195 - DNA, 71 bp, chicken (Gallus Gallus)
  misc_feature (36): n=a or g
aggttggtagcaagtgcagtcatcatctggtctgantgaacatatcaggccaggagcgcagcagagaaaat

SEQ ID NO: 37196 - DNA, 71 bp, chicken (Gallus Gallus)
  misc_feature (36): n=a or c
tggttttgttaaataccttctttgtgacttcatacnaatgtagagtttactaatgtatagaatttagaagc

SEQ ID NO: 37197 - DNA, 71 bp, chicken (Gallus Gallus)
  misc_feature (36): n=c or t
atatggaagagaatcaaaactccaggaaacagagtnaaaaaatttctgaaggagacatggaacaggattaa

SEQ ID NO: 37198 - DNA, 71 bp, chicken (Gallus Gallus)
  misc_feature (36): n=a or g
tctatcagatgtctgcgcttattgaaagggtttaanggtgatgggaataaccagcaatggctgaatatctt

SEQ ID NO: 37199 - DNA, 71 bp, chicken (Gallus Gallus)
  misc_feature (36): n=a or c
aggcaatgataaattcgacctctgaaatgtgggatncaggattgtttctcctgctgggacaagactcagat

SEQ ID NO: 37200 - DNA, 71 bp, chicken (Gallus Gallus)
  misc_feature (36): n=c or t
cccaagtcaatggaccaaattctgcaccgcccttcnctgaggcaaggggaagtagagcaagttggaaaatc

SEQ ID NO: 37201 - DNA, 71 bp, chicken (Gallus Gallus)
  misc_feature (36): n=c or t
cctgcttttgctgttccagggtctgtgaaacacagncttttctcactctgtataaatagactttgacccct

SEQ ID NO: 37202 - DNA, 71 bp, chicken (Gallus Gallus)
  misc_feature (36): n=c or t
gtttctttaggctattacatcaaataaaaagacttnggacttatccatcactatgcacactactgatttca

SEQ ID NO: 37203 - DNA, 71 bp, chicken (Gallus Gallus)
  misc_feature (36): n=a or g
aagtaattctatgattctagaaatggcaatcatagnaaaggtgatcatcagggatcctttcaagaaacgtg

SEQ ID NO: 37204 - DNA, 71 bp, chicken (Gallus Gallus)
  misc_feature (36): n=a or g
tcactggttcaggaaagcagagatgtaacccatgcnttccttcttgcacagataccctccctgcaagaaga

SEQ ID NO: 37205 - DNA, 71 bp, chicken (Gallus Gallus)
  misc_feature (36): n=g or t
ccgcttccgggcacttgagatgagggtttggggtgngtttttgctgtactttgtggagtttctttttacaa

SEQ ID NO: 37206 - DNA, 71 bp, chicken (Gallus Gallus)
  misc_feature (36): n=a or c
cagaaagaaaggctgcctgggaaagaaagtatttcnagtaatcgtgtatgttatggggaggtggaataaaa

SEQ ID NO: 37207 - DNA, 71 bp, chicken (Gallus Gallus)
  misc_feature (36): n=a or g
taaaagagcaaataacatgactagctcttaagatgngaacaggtaattgtgccacttctctgctgctgcac

SEQ ID NO: 37208 - DNA, 71 bp, chicken (Gallus Gallus)
  misc_feature (36): n=c or t
cgagtagtgggttatctgttgttaaagcacatcctnctagtgcttctgacaatggctccagctgccttgct

SEQ ID NO: 37209 - DNA, 71 bp, chicken (Gallus Gallus)
  misc_feature (36): n=a or g
catgcgttatgattgataaagagagattgtaacatncataatccccaaaagcacttcttgtggtaatcgtt

SEQ ID NO: 37210 - DNA, 71 bp, chicken (Gallus Gallus)
  misc_feature (36): n=c or t
gaagagttttaagatgcaggcatgaaatgaaccagngctagcccggagtactcgattcaagtgctaaagtt

SEQ ID NO: 37211 - DNA, 71 bp, chicken (Gallus Gallus)
  misc_feature (36): n=g or t
ctagaaaatcctcaagttcaggaataagaagaaatnttttgcagtagtgtgagtaaggattgactaaatgc

SEQ ID NO: 37212 - DNA, 71 bp, chicken (Gallus Gallus)
  misc_feature (36): n=g or t
aaacccattgctgctgcttccaagcctttctaactnttgatatatcatctaacttctggtcctgtcaaaac

SEQ ID NO: 37213 - DNA, 71 bp, chicken (Gallus Gallus)
  misc_feature (36): n=a or g
tcaagtgtcaggaaggaaatgccctccagaacacanaaagtgttaaacaaacagagcaaaattgccctcaa

SEQ ID NO: 37214 - DNA, 71 bp, chicken (Gallus Gallus)
  misc_feature (36): n=c or t
cacttaagcactatgaagtattcttctatttccatnaactggctctcatttttctaagtttaatctttcca

SEQ ID NO: 37215 - DNA, 71 bp, chicken (Gallus Gallus)
  misc_feature (36): n=a or g
ttaacccatctcaatggaagaagtggagcctgaagnacagaatgtaccactagacctcactcacccacagc

SEQ ID NO: 37216 - DNA, 71 bp, chicken (Gallus Gallus)
  misc_feature (36): n=a or g
cttgttggacatatctttctgtaaggagacagaggnctagaatgtcagctttttagcaaatctagcagtgt

SEQ ID NO: 37217 - DNA, 71 bp, chicken (Gallus Gallus)
  misc_feature (36): n=c or t
agagctcttgggttcttcagttttcttgattaaacngacaagcatcttaccagtatgtggagtccataaat

SEQ ID NO: 37218 - DNA, 71 bp, chicken (Gallus Gallus)
  misc_feature (36): n=c or t
ctgtgatgccagacgtggagtcacctcaggtagcanagaaggagctctgaaaggggagtatgtgctgtaca

SEQ ID NO: 37219 - DNA, 71 bp, chicken (Gallus Gallus)
  misc_feature (36): n=a or g
ttatgtgtcagttagtatatgtatttgctgtgtttnaagatgtgttcaatatatgtatttgagaggaaaca

SEQ ID NO: 37220 - DNA, 71 bp, chicken (Gallus Gallus)
  misc_feature (36): n=c or t
tttttatgggaactgtctttgctcataatcagcaantaattttcgagtcactgcacaaatgagaaatgttt

SEQ ID NO: 37221 - DNA, 71 bp, chicken (Gallus Gallus)
  misc_feature (36): n=a or g
tcttcctctccacagatcatcaactcagtggtactnctgattctgctgagcgccctgaccgaccctgacca

SEQ ID NO: 37222 - DNA, 71 bp, chicken (Gallus Gallus)
  misc_feature (36): n=c or t
catagcctctgaaatgtagttgcaaaattcagttgnacactcacagttactgtaagggcaggttcagaaat

SEQ ID NO: 37223 - DNA, 71 bp, chicken (Gallus Gallus)
  misc_feature (36): n=g or t
tcctacagagatgtccattttcacacctgcatcacncatctagtaaaatcagagttaaactcactatttaa

SEQ ID NO: 37224 - DNA, 71 bp, chicken (Gallus Gallus)
  misc_feature (36): n=a or g
agtggttaacgtggatctggaaggcagaatgctgtntgcaataagaatgtacaggatgcaaaaactaaatg

SEQ ID NO: 37225 - DNA, 71 bp, chicken (Gallus Gallus)
  misc_feature (36): n=a or c
atgcaaagtttaaaaccctgttagctaaggatagancagttcgtgggcttttttatgaactgatctgaacc

SEQ ID NO: 37226 - DNA, 71 bp, chicken (Gallus Gallus)
  misc_feature (36): n=c or t
aagtggagaataagggcagcacatttgctctgcatngtgtatttcagctcactgtcttaacactcgttacc

SEQ ID NO: 37227 - DNA, 71 bp, chicken (Gallus Gallus)
  misc_feature (36): n=c or t
aaaggaggaaactgatgtatttcactgcagatccanacaaaagaaggatgtaaatgacagtatgtcggtga

SEQ ID NO: 37228 - DNA, 71 bp, chicken (Gallus Gallus)
  misc_feature (36): n=c or t
ttaaatggaaaatctggaagtcctctatgaatgtgngtagttaatactcatacaacactaaacagaataac

SEQ ID NO: 37229 - DNA, 71 bp, chicken (Gallus Gallus)
  misc_feature (36): n=c or t
ggcacttttcagctgtggtcttctggaaggaactgntgtcagttaccaagaaggaccctctgcccatgagg

SEQ ID NO: 37230 - DNA, 71 bp, chicken (Gallus Gallus)
  misc_feature (36): n=a or g
ttgtacgctgctattgtcataggtctctgaagcccntgagttcagtaatacttgtctagttgtgtttgtcc

SEQ ID NO: 37231 - DNA, 71 bp, chicken (Gallus Gallus)
  misc_feature (36): n=a or g
cacctgtgaatgtatggacgtctgtatagtttctcntgatcagatgaagcctatttaaagttgataagttt

SEQ ID NO: 37232 - DNA, 71 bp, chicken (Gallus Gallus)
  misc_feature (36): n=a or g
atacggaagcattgcttttgaaaggctgaatttgantgatttgactaaagtatggcacatgcaatcaatct

SEQ ID NO: 37233 - DNA, 71 bp, chicken (Gallus Gallus)
  misc_feature (36): n=c or t
tatatcgtttctttgcagaattggagcagaacgtanttgaactcttcctgataatcaaaggttattgaata

SEQ ID NO: 37234 - DNA, 71 bp, chicken (Gallus Gallus)
  misc_feature (36): n=c or t
gcactgaatctcggaatacttcgagaccctggatcngaagttgaagacagacaatatcaaatagaccttca

SEQ ID NO: 37235 - DNA, 71 bp, chicken (Gallus Gallus)
  misc_feature (36): n=a or g
gcagaaagcagggaatccatttgcatttctatggcnttctggtatcagtttttttactacttctttggagg

SEQ ID NO: 37236 - DNA, 71 bp, chicken (Gallus Gallus)
  misc_feature (36): n=a or g
tgagatcataaaatatttccacctttgaacggtgangattcaaaaaaagtgtctcttgctctgcgctacat

SEQ ID NO: 37237 - DNA, 71 bp, chicken (Gallus Gallus)
  misc_feature (36): n=a or c
ttaacactttaaacatgaatagtatggaatgcattncctagtccagagctactggcatcagagctttgtag

SEQ ID NO: 37238 - DNA, 71 bp, chicken (Gallus Gallus)
  misc_feature (36): n=c or t
ggagcaaattgtgagggtgtttgaattttgaaaatngccataaggtgaacagttttttttagaaatagtca

SEQ ID NO: 37239 - DNA, 71 bp, chicken (Gallus Gallus)
  misc_feature (36): n=c or t
taaacaaaggagaaaaaagttcaaatcagaataaanggagcagacagggacttcataagcctttgttgatt

SEQ ID NO: 37240 - DNA, 71 bp, chicken (Gallus Gallus)
  misc_feature (36): n=a or g
ttttctctctgcaggtaggctcactgacacctgtangaccctcagttgatggaacagggaggccaaagcca

SEQ ID NO: 37241 - DNA, 71 bp, chicken (Gallus Gallus)
  misc_feature (36): n=a or g
gcatgcaatgaattacaaatactggcaccaaggcangctgcaaaaagtgactaattgcatttttttttaag

SEQ ID NO: 37242 - DNA, 71 bp, chicken (Gallus Gallus)
  misc_feature (36): n=a or c
taggccatgggagacaataactgtataaaataagcncctgatgatgagtgtcacagtggcatagctggtgg

SEQ ID NO: 37243 - DNA, 71 bp, chicken (Gallus Gallus)
  misc_feature (36): n=g or t
tacagctctggtccacttagattcaggttttagttngtatctctacactgctcttccaagcagcttctcct

SEQ ID NO: 37244 - DNA, 71 bp, chicken (Gallus Gallus)
  misc_feature (36): n=c or t
ttaaagaaaaactttgtcgtagtaaccatggaatgnttcccgcataatttgaattcttttttttaatgtct

SEQ ID NO: 37245 - DNA, 71 bp, chicken (Gallus Gallus)
  misc_feature (36): n=a or g
gacatctgtaaaggctatccaggtagatatctaacngttgttttattgttaaaaacgcatattgatactgt

SEQ ID NO: 37246 - DNA, 71 bp, chicken (Gallus Gallus)
  misc_feature (36): n=c or t
agggagtccttccccgcctgtaacaccctgctctgnactaacagccagctgtatcttagcctgatacaagt

SEQ ID NO: 37247 - DNA, 71 bp, chicken (Gallus Gallus)
  misc_feature (36): n=a or g
taaaaattaggctaaaccaggagaaggcagcaagcntggaattaaaaggaaaccggtatgatgacaggagt

SEQ ID NO: 37248 - DNA, 71 bp, chicken (Gallus Gallus)
  misc_feature (36): n=c or t
catttattttgctcctagagccttaaaatagaaatngtacctccatgtttgctagaaatctttcttttctg

SEQ ID NO: 37249 - DNA, 71 bp, chicken (Gallus Gallus)
  misc_feature (36): n=c or t
ggtgctcgttctgtaactcacccattcattcgatgngtgcctttttctgaatcgagtgcacgtcctcctcc

SEQ ID NO: 37250 - DNA, 71 bp, chicken (Gallus Gallus)
  misc_feature (36): n=c or t
tcttggaactgcggattaaaatcccacatctcagcntttatgaaaagatttgccgaggtctgggtgttgct

SEQ ID NO: 37251 - DNA, 71 bp, chicken (Gallus Gallus)
  misc_feature (36): n=c or t
agattgcctcttatcttgctgctcagcctgaaaaantgctaataatctcggggacatgggtatagtacata

SEQ ID NO: 37252 - DNA, 71 bp, chicken (Gallus Gallus)
  misc_feature (36): n=a or g
tgtcctttgggccttgaaaatatctaattctcatcnttgttgtgccaatacatgggaactgtgagtctcca

SEQ ID NO: 37253 - DNA, 71 bp, chicken (Gallus Gallus)
  misc_feature (36): n=a or g
ctttaggaaaactgatttctcctgaaagtctgcttntctttgagatggggtctgtttttacaggtttgtgt

SEQ ID NO: 37254 - DNA, 71 bp, chicken (Gallus Gallus)
  misc_feature (36): n=a or g
agctcagcttgaaaagtaaatcctcaaaaagagttngtatccaaggtgtatgctggatacctgagtactga

SEQ ID NO: 37255 - DNA, 71 bp, chicken (Gallus Gallus)
  misc_feature (36): n=a or g
ggcatagttacaaggtttgtggtggtaagcagacgntagaggagatcaaggcgagcagacttctgtcctgc

SEQ ID NO: 37256 - DNA, 71 bp, chicken (Gallus Gallus)
  misc_feature (36): n=a or g
acacttcaatgtcttcaaacctggatgctatcagtncattgacagacttaaataaaacctactgacagttt

SEQ ID NO: 37257 - DNA, 71 bp, chicken (Gallus Gallus)
  misc_feature (36): n=a or g
tccaggcttcgggaaggttcctaacccacagagatnattaaacaacattaagtcttaaagctgtccatttt

SEQ ID NO: 37258 - DNA, 71 bp, chicken (Gallus Gallus)
  misc_feature (36): n=g or t
ctgtgatttttcttgtgcagaggcaggcgtgttggngttcctgcaatattcaggaatttccttctggggct

SEQ ID NO: 37259 - DNA, 71 bp, chicken (Gallus Gallus)
  misc_feature (36): n=c or t
tatttcatataaacattccattttagcttaagagcngaagagtgatcacttttgctagcagtagcagcgtg

SEQ ID NO: 37260 - DNA, 71 bp, chicken (Gallus Gallus)
  misc_feature (36): n=c or t
aaaattcttttttctgttctgaggggatgaatttangttttctggtcagctcaaatggtgtattttccagt

SEQ ID NO: 37261 - DNA, 71 bp, chicken (Gallus Gallus)
  misc_feature (36): n=g or t
tgcactttgctttattgtaatgagctggaccaggantgttcacctggtgtcaaaaagcagagcagggtagc

SEQ ID NO: 37262 - DNA, 71 bp, chicken (Gallus Gallus)
  misc_feature (36): n=c or t
tacctaacagacagcactgatccctacaggaaagantggtacagctttaccaggctaggtaccattactag

SEQ ID NO: 37263 - DNA, 71 bp, chicken (Gallus Gallus)
  misc_feature (36): n=c or t
tttaaattttgatggtctttcttcttcctcctctancttatatttctttgaggtatgtagatgaaaccccc

SEQ ID NO: 37264 - DNA, 71 bp, chicken (Gallus Gallus)
  misc_feature (36): n=a or g
aacaaaaaaccaaattatcctgtaaacaaaattacntttttatccagtttccatatttctttttaaagatt

SEQ ID NO: 37265 - DNA, 71 bp, chicken (Gallus Gallus)
  misc_feature (36): n=g or t
agcagtcattggcattcaaactaggatagatttttnggggtaaatttatcatggatgtgatgagttaggat

SEQ ID NO: 37266 - DNA, 71 bp, chicken (Gallus Gallus)
  misc_feature (36): n=a or g
ttttcattctttctcagcaaccataggaactaaaanttgatgtcacaggaaaattttcattgtaagaaatt

SEQ ID NO: 37267 - DNA, 71 bp, chicken (Gallus Gallus)
  misc_feature (36): n=a or g
gaggtcgtaccttgctaaaacccaccactaaggacntggcacttcttccagcattcctcaaaaaactgctg

SEQ ID NO: 37268 - DNA, 71 bp, chicken (Gallus Gallus)
  misc_feature (36): n=a or g
atcaaacaagataagctagacaagacatttccttcnttgcaaaggaactgtttaaaccaagtgttttaaag

SEQ ID NO: 37269 - DNA, 71 bp, chicken (Gallus Gallus)
  misc_feature (36): n=c or t
ttcactttgtcagcacaaaaatgcactcttatttgncctgaagatgaaacaactgtgaggggagcatgaga

SEQ ID NO: 37270 - DNA, 71 bp, chicken (Gallus Gallus)
  misc_feature (36): n=a or g
atatgaatttgtcagccttgtgggaaaaggattggnagttcttccctgggttatttctattcttttaactt

SEQ ID NO: 37271 - DNA, 71 bp, chicken (Gallus Gallus)
  misc_feature (36): n=c or t
cagtgtatttacagattgaatttactattttctcantgtgtgccaagagtccatcttctgcccagctcttt

SEQ ID NO: 37272 - DNA, 71 bp, chicken (Gallus Gallus)
  misc_feature (36): n=a or g
catacagtatggaaacaaacttaaatttggtaagcntacgattaggcaggattcttctgcaggatccctgg

SEQ ID NO: 37273 - DNA, 71 bp, chicken (Gallus Gallus)
  misc_feature (36): n=a or c
aatctaattaaaggcctactaaaattcatcaaattnagcaacttggggaagaatattttgaccaagtttcc

SEQ ID NO: 37274 - DNA, 71 bp, chicken (Gallus Gallus)
  misc_feature (36): n=a or g
tactgtggcagcggagctgtgtggtatcgtgcaggngagaacctgacaaatgctgtgctgtgaactttaac

SEQ ID NO: 37275 - DNA, 71 bp, chicken (Gallus Gallus)
  misc_feature (36): n=a or g
tccttggtctgttgcagtaaatgctttttgtcctcnagaaactttgtataactggtttccatcctattacc

SEQ ID NO: 37276 - DNA, 71 bp, chicken (Gallus Gallus)
  misc_feature (36): n=a or c
agaagtgaaataccaaaatatttgtgtccataaatncttggggttttttggtgttgttctgaaatttgccc

SEQ ID NO: 37277 - DNA, 71 bp, chicken (Gallus Gallus)
  misc_feature (36): n=c or t
tattttaaagcagaacatcactctgctagaagcaanactgtgtgcttacactcttatgatatctgtgttaa

SEQ ID NO: 37278 - DNA, 71 bp, chicken (Gallus Gallus)
  misc_feature (36): n=a or c
ctgtacaagaaaacagacagagatttgttggtgggnataacatataatttgctggaccatatatgcatatt

SEQ ID NO: 37279 - DNA, 71 bp, chicken (Gallus Gallus)
  misc_feature (36): n=a or g
gtatgtatgagagaatgaagctctttgatgcaactnttaaaaatgcaaccatgttcagtaaagggacggca

SEQ ID NO: 37280 - DNA, 71 bp, chicken (Gallus Gallus)
  misc_feature (36): n=g or t
aaaaaaaaaagaggcaattaagtcaatagtgctctnatgttgaagcagtaatctccagtctcttctaccaa

SEQ ID NO: 37281 - DNA, 71 bp, chicken (Gallus Gallus)
  misc_feature (36): n=c or t
cctgtttttccattcatacagctaagactaaaatgntttatccatcctcagaataattgtcaaagtagtgt

SEQ ID NO: 37282 - DNA, 71 bp, chicken (Gallus Gallus)
  misc_feature (36): n=c or t
ccatccctggtattgaaacaacatcagcctaacaanatcaacataactgtacgccatgcctgtgggtctaa

SEQ ID NO: 37283 - DNA, 71 bp, chicken (Gallus Gallus)
  misc_feature (36): n=c or t
gttttacctgtcatcacatttaaccccagtggggantggtgctgttgctaataaattacataggtcattgt

SEQ ID NO: 37284 - DNA, 71 bp, chicken (Gallus Gallus)
  misc_feature (36): n=c or t
cctcacaagggatcttctcatttattattacaaagngatgacattggagattcactctgaggaaaacaagc

SEQ ID NO: 37285 - DNA, 71 bp, chicken (Gallus Gallus)
  misc_feature (36): n=c or t
caagccagttattaaaaacttctctttatcttgttntcactgaaggcacatggaacagctaatgacaattt

SEQ ID NO: 37286 - DNA, 71 bp, chicken (Gallus Gallus)
  misc_feature (36): n=c or t
agtatctcagaacctgccaacatcagcgtctgattnctgaagactaaccttttggtttggaaaatttttac

SEQ ID NO: 37287 - DNA, 71 bp, chicken (Gallus Gallus)
  misc_feature (36): n=g or t
cagcaccgagatgatagatggtttctagaacctctntggttgaatttggatctttcatttttttaaatact

SEQ ID NO: 37288 - DNA, 71 bp, chicken (Gallus Gallus)
  misc_feature (36): n=c or t
ctttgatgcttttgtactctagtagtaatgcaaccnagctcaatatgtagtagtgttccagtgacttacca

SEQ ID NO: 37289 - DNA, 71 bp, chicken (Gallus Gallus)
  misc_feature (36): n=g or t
tggcgtaagtaccagggagaggagttttttgtaatnggccagaggatgaagaaagctgtctttccttttag

SEQ ID NO: 37290 - DNA, 71 bp, chicken (Gallus Gallus)
  misc_feature (36): n=c or t
atataaaggctgggtgagagtgtttcagaaaagaanattaaagacaatattgttgacttcttcctataaaa

SEQ ID NO: 37291 - DNA, 71 bp, chicken (Gallus Gallus)
  misc_feature (36): n=c or t
gccagaggtcttggacagagcaggtgactgtccctngctgctcctaaagctggtggacctgtaaatcttac

SEQ ID NO: 37292 - DNA, 71 bp, chicken (Gallus Gallus)
  misc_feature (36): n=a or g
aaagttacagcagtgaacttcaatatatgcccacanttaatctgcttgatgctcttctaaaatgcacacta

SEQ ID NO: 37293 - DNA, 71 bp, chicken (Gallus Gallus)
  misc_feature (36): n=a or c
gctgccttaagtcctgaaaagataagttttttccangtggcagaatcagcgttaatggatactgacttaat

SEQ ID NO: 37294 - DNA, 71 bp, chicken (Gallus Gallus)
  misc_feature (36): n=a or g
ttgtatctggaagtaagggtaatttcagttttgttntcattttagcaaagttaagataagtaattttagaa

SEQ ID NO: 37295 - DNA, 71 bp, chicken (Gallus Gallus)
  misc_feature (36): n=a or c
ctcagactaataggatttatgcatacctaccttagnctcagtcctctcagattttctactactgaaatttc

SEQ ID NO: 37296 - DNA, 71 bp, chicken (Gallus Gallus)
  misc_feature (36): n=a or g
tctctttcaaccatgcattgagcactaagctgtcantgaataccacagctgtgcatggtgtgatgtgctgt

SEQ ID NO: 37297 - DNA, 71 bp, chicken (Gallus Gallus)
  misc_feature (36): n=a or g
tgtaatctacactggcattttaataccttgtaaganattaatggaaggggtcatgctgagcaatgattcct

SEQ ID NO: 37298 - DNA, 71 bp, chicken (Gallus Gallus)
  misc_feature (36): n=a or g
agattttaagactaaaatgcccaaaagcttgggganagatggcaactataagaaaaagaatattaaatatt

SEQ ID NO: 37299 - DNA, 71 bp, chicken (Gallus Gallus)
  misc_feature (36): n=c or t
attagctgaggtcttatgagcttggagtagggtatncattttcagttatgtatcatatgtctcactgatga

SEQ ID NO: 37300 - DNA, 71 bp, chicken (Gallus Gallus)
  misc_feature (36): n=c or t
ggagaatttagtaaaattcctctttggactgagccntaacacctatggctatgcggtgccgtcagctggag

SEQ ID NO: 37301 - DNA, 71 bp, chicken (Gallus Gallus)
  misc_feature (36): n=g or t
tcgttcctactgattaacctgaaagttttttactancaagagcagaaagtctttactatcaggactggcct

SEQ ID NO: 37302 - DNA, 71 bp, chicken (Gallus Gallus)
  misc_feature (36): n=a or g
ctacaaaataatcagacagttctgtgaaactgtctnaactatggctcagctgtctgagtttccagaggtga

SEQ ID NO: 37303 - DNA, 71 bp, chicken (Gallus Gallus)
  misc_feature (36): n=a or c
aacttgaacatcttttttttacacaaatcttgctcngaatgtaaatttcacatgccactaggctaaaaata

SEQ ID NO: 37304 - DNA, 71 bp, chicken (Gallus Gallus)
  misc_feature (36): n=a or c
aagaaaaaaagttgttaattttaatgttaaatctcngtattagttcagagtctgtaacatttgtgggaacc

SEQ ID NO: 37305 - DNA, 71 bp, chicken (Gallus Gallus)
  misc_feature (36): n=a or g
agcactaaagttattacagtgccatatctgctgacnttactggttataaacccatgcttagttctcaaata

SEQ ID NO: 37306 - DNA, 71 bp, chicken (Gallus Gallus)
  misc_feature (36): n=c or t
gtacatatatgtgtataataccagctaatttttatngacatactatctatgaacttgaaaagtaatttagt

SEQ ID NO: 37307 - DNA, 71 bp, chicken (Gallus Gallus)
  misc_feature (36): n=a or g
aggaatcatgtttaagtgaatagaacttaagactcnggttgccaccatccatggttgaatatgcacagcac

SEQ ID NO: 37308 - DNA, 71 bp, chicken (Gallus Gallus)
  misc_feature (36): n=c or t
caatgatcagcttgattgagcatattacaagtttcntcattttcaattcagtaagagccaattatttttaa

SEQ ID NO: 37309 - DNA, 71 bp, chicken (Gallus Gallus)
  misc_feature (36): n=c or t
atatttgccaaacattttgctgacaccttaaacatnggtatgaattccattataatcaactttaaaggaaa

SEQ ID NO: 37310 - DNA, 71 bp, chicken (Gallus Gallus)
  misc_feature (36): n=a or g
gaggaaaataaaatatatctcacaaaactcaacatntttatatctgagaattcagtgctagcaacaacaat

SEQ ID NO: 37311 - DNA, 71 bp, chicken (Gallus Gallus)
  misc_feature (36): n=c or t
tagaatttttccacatacgattgattgtaacatttnacacaatgataatgagaagtagctttcaaagcata

SEQ ID NO: 37312 - DNA, 71 bp, chicken (Gallus Gallus)
  misc_feature (36): n=c or t
tgaggcactgcaatgagcaagcactctacaacttantatgcctgtacagtactgtttttactgtacttttt

SEQ ID NO: 37313 - DNA, 71 bp, chicken (Gallus Gallus)
  misc_feature (36): n=a or g
acttgacatcagagacataaagatcaaacacagacnacttaatcatgcaacagcaaagcaatgattttcag

SEQ ID NO: 37314 - DNA, 71 bp, chicken (Gallus Gallus)
  misc_feature (36): n=a or g
tggttacctcaaaggaagattttgcggacagtgaanatcacagcttacctgggcctgtcaaaaataccctg

SEQ ID NO: 37315 - DNA, 71 bp, chicken (Gallus Gallus)
  misc_feature (36): n=c or t
gctgaggtgccagggccaagttctgcagcaccgcantactgtgcagaatctgccttcgtaaacctctcctc

SEQ ID NO: 37316 - DNA, 71 bp, chicken (Gallus Gallus)
  misc_feature (36): n=c or t
tcttaatgatttgcaataaatacaattgcattccantgatatgtctgttttaaaggatttaaattacatgt

SEQ ID NO: 37317 - DNA, 71 bp, chicken (Gallus Gallus)
  misc_feature (36): n=a or g
agcaaagggaaagtcacaaaatattaggaaaccatngtatctcttgttccaggagaaatctgtgggataag

SEQ ID NO: 37318 - DNA, 71 bp, chicken (Gallus Gallus)
  misc_feature (36): n=a or c
ccaggcttgattttgactcagcaagtgggtactaanatgcagccagctgtgctgattcgtgttttgtcttt

SEQ ID NO: 37319 - DNA, 71 bp, chicken (Gallus Gallus)
  misc_feature (36): n=a or g
acagttaatctcagctacctggctaactgtcctttncagcagagggtgtgcacttgatgcatttgttagag

SEQ ID NO: 37320 - DNA, 71 bp, chicken (Gallus Gallus)
  misc_feature (36): n=c or t
ttcagacacacttcttgagtcaaaagtacttcctgntccataattcctacagggacacaggtggcccaaat

SEQ ID NO: 37321 - DNA, 71 bp, chicken (Gallus Gallus)
  misc_feature (36): n=c or t
cagacttccgttccttctccatgactgtatcagcanacatctatcatcgcacagaacacagccagtttccc

SEQ ID NO: 37322 - DNA, 71 bp, chicken (Gallus Gallus)
  misc_feature (36): n=c or t
ggttttattttgcatttataggaaacatctgggaangctggaacgtattcagactttatgattcttaactc

SEQ ID NO: 37323 - DNA, 71 bp, chicken (Gallus Gallus)
  misc_feature (36): n=c or t
tgtctctgtgtccatgagaaagaaataagtcaagantgtaacgttcaacttttgaggtcctttatcttgta

SEQ ID NO: 37324 - DNA, 71 bp, chicken (Gallus Gallus)
  misc_feature (36): n=c or t
cactgcactatgtcttcagagtagccagaagacttngcagacttcagctgtcagccaacacatacccagtg

SEQ ID NO: 37325 - DNA, 71 bp, chicken (Gallus Gallus)
  misc_feature (36): n=a or c
gctttcctgcacaaaggggaaaaatgctgcctcttncacagtaggagataaattaatcgaagtgggagaac

SEQ ID NO: 37326 - DNA, 71 bp, chicken (Gallus Gallus)
  misc_feature (36): n=c or t
tcctgtgcaagcaccttacctcaaagcccttttccnttagggtcaggcaaggaatgacacgctttcagatt

SEQ ID NO: 37327 - DNA, 71 bp, chicken (Gallus Gallus)
  misc_feature (36): n=a or g
ccactgtcgggattcaaagaaattgccccagcatanaacagttccaagcctaagggttactaaaataaaca

SEQ ID NO: 37328 - DNA, 71 bp, chicken (Gallus Gallus)
  misc_feature (36): n=a or g
cccacctgggctaattgtgccattaggctgtcttcnggccttgggtttcccactgagaggggctgatggtg

SEQ ID NO: 37329 - DNA, 71 bp, chicken (Gallus Gallus)
  misc_feature (36): n=a or c
tttcggttctgagattacagaggaatatgatctcanctcgttagggcgtaactacaacatgctgctacagc

SEQ ID NO: 37330 - DNA, 71 bp, chicken (Gallus Gallus)
  misc_feature (36): n=c or t
atgacctattaataataaacgtttttcaattaattnaatcttttctcttgtgcatcagtttgtcaggaaga

SEQ ID NO: 37331 - DNA, 71 bp, chicken (Gallus Gallus)
  misc_feature (36): n=a or c
ggatatgggtctgacctcagctctttttaaatgtcncctcttctgaagtcttgcatccttacattattcct

SEQ ID NO: 37332 - DNA, 71 bp, chicken (Gallus Gallus)
  misc_feature (36): n=c or t
tgtcgccacaattaacaagtggacaagtgaccatgnaagccttttctggtttcctacatttgccagcgatt

SEQ ID NO: 37333 - DNA, 71 bp, chicken (Gallus Gallus)
  misc_feature (36): n=c or t
ctcctgcagaatgtctaagcacttacaaggagtttnctgttaccagagatgctgatttcctagctgacaaa

SEQ ID NO: 37334 - DNA, 71 bp, chicken (Gallus Gallus)
  misc_feature (36): n=a or g
aggagaggacaagcccaggagctcatttttgaagtnggtagtagcattccttggaaaagaatgcacatgca

SEQ ID NO: 37335 - DNA, 71 bp, chicken (Gallus Gallus)
  misc_feature (36): n=a or c
gtcatttaaaactgaagtacataagctaaaatctcngtaacagaagagtacacaaaaccataaaaagtagt

SEQ ID NO: 37336 - DNA, 71 bp, chicken (Gallus Gallus)
  misc_feature (36): n=c or t
cctagtcttttccactggacagaaatacaatgctcncaattacggggtttgacatggtagcaaatgttttg

SEQ ID NO: 37337 - DNA, 71 bp, chicken (Gallus Gallus)
  misc_feature (36): n=a or g
actgtcctgtagtccacatggagaacgttgagaccnttgacggagacgacaaattggcaaacctgaaggga

SEQ ID NO: 37338 - DNA, 71 bp, chicken (Gallus Gallus)
  misc_feature (36): n=c or t
tgaaatccaatactatgtagaagaatcacacagggntcaggaaatattactgactacataaatcaaaggtt

SEQ ID NO: 37339 - DNA, 71 bp, chicken (Gallus Gallus)
  misc_feature (36): n=g or t
tgagatcaacagattttagggggaaaaggaaagtancattaaagctttccttctgaaagtctcttcagaca

SEQ ID NO: 37340 - DNA, 71 bp, chicken (Gallus Gallus)
  misc_feature (36): n=a or g
attcgctatgaaactcagaccacttgcaccaaggantgctgccctctgccggtcgtcttgagccctctgcc

SEQ ID NO: 37341 - DNA, 71 bp, chicken (Gallus Gallus)
  misc_feature (36): n=c or t
tgcctggttttgttcttttctctctctgacctcagngacagctcaaaggtgtctctctctgttatcagata

SEQ ID NO: 37342 - DNA, 71 bp, chicken (Gallus Gallus)
  misc_feature (36): n=a or g
cctgtgtggtagcaaagtgagctgagctaccagagnagaaccctgaaagcaagagccaccccaagttcctg

SEQ ID NO: 37343 - DNA, 71 bp, chicken (Gallus Gallus)
  misc_feature (36): n=c or t
agcttggtttgaggtttggggagatgtgaacttttntgaacaccttttagaccctgagggcttgattaaat

SEQ ID NO: 37344 - DNA, 71 bp, chicken (Gallus Gallus)
  misc_feature (36): n=g or t
caataatgactgcattttagtctagagtgaaaagantgtagttaacacattaagtacaaagtctcttaaaa

SEQ ID NO: 37345 - DNA, 71 bp, chicken (Gallus Gallus)
  misc_feature (36): n=c or t
cactattcctcaaataccatctgcagagctaggggngaatactgttgtataagacagtgctgcaatatcag

SEQ ID NO: 37346 - DNA, 71 bp, chicken (Gallus Gallus)
  misc_feature (36): n=c or t
ttaagcacctgtaacagagttaagtctcagtaatgngtatttgtaatgaattatcagttctgctgaaatca

SEQ ID NO: 37347 - DNA, 71 bp, chicken (Gallus Gallus)
  misc_feature (36): n=a or g
cggtgtcagatcacgttgttcattttttagaaggcncctacaaatgagtttcctgcaaggcactttcatca

SEQ ID NO: 37348 - DNA, 71 bp, chicken (Gallus Gallus)
  misc_feature (36): n=c or t
cgtgatccagcagtgcaatgggagttgcgattccantgatgtgtcatatggacttttcctaaaaaatactg

SEQ ID NO: 37349 - DNA, 71 bp, chicken (Gallus Gallus)
  misc_feature (36): n=c or t
tttatctttttgttctcagccctttcttacttcttntttgggtaagaagggggtgatagtgaaatataaat

SEQ ID NO: 37350 - DNA, 71 bp, chicken (Gallus Gallus)
  misc_feature (36): n=a or g
cgttccttattacagcttcctgaaaaccacttagcnttcagtagcctgatagataagggaacccacagcgc

SEQ ID NO: 37351 - DNA, 71 bp, chicken (Gallus Gallus)
  misc_feature (36): n=a or g
tcttttccacttagaaagttcccacacatatcaccnaacttactgccttcatcacaactttcctcttaaaa

SEQ ID NO: 37352 - DNA, 71 bp, chicken (Gallus Gallus)
  misc_feature (36): n=a or g
gatgatcttaatgatcactgacattgttcttgtagnggagccagggaaacatcacccagtgcaatccttgc

SEQ ID NO: 37353 - DNA, 71 bp, chicken (Gallus Gallus)
  misc_feature (36): n=a or g
cagttgttggtttctggtgccattagagatgcctcngggcaagctcaatgccagctggaaatgtgtaggct

SEQ ID NO: 37354 - DNA, 71 bp, chicken (Gallus Gallus)
  misc_feature (36): n=c or t
attgtgaaacaggaaggctttgatgattcaaggaanaggaaacagctaggaacaacagagctttgtgactt

SEQ ID NO: 37355 - DNA, 71 bp, chicken (Gallus Gallus)
  misc_feature (36): n=c or t
atgtcttttaatcagcgctgtgatgacctttttgtnagaaacttcacctagagaaccatgctaatagctac

SEQ ID NO: 37356 - DNA, 71 bp, chicken (Gallus Gallus)
  misc_feature (36): n=g or t
tgggggctgcctacgagcactattgcctgcctggancattactccaatggtatgttaacgtggctcatctg

SEQ ID NO: 37357 - DNA, 71 bp, chicken (Gallus Gallus)
  misc_feature (36): n=a or g
atcattgtaattgcctcagcactgccaagaaatccntggctctgaatatatgccacaccaaaagatttggg

SEQ ID NO: 37358 - DNA, 71 bp, chicken (Gallus Gallus)
  misc_feature (36): n=c or t
aaataaacagccgtcagatactaacaagttgcaatnggcgtaggatattaattgctaacctcagtgggtaa

SEQ ID NO: 37359 - DNA, 71 bp, chicken (Gallus Gallus)
  misc_feature (36): n=a or g
acgtccatccaaaagagcttctcagcagcaagaacnagagaaaagagcatgcatgtgcaaggagtattgct

SEQ ID NO: 37360 - DNA, 71 bp, chicken (Gallus Gallus)
  misc_feature (36): n=c or t
atgacctctgctggtgctgtgaaaacacactgacgntctggggagcatagaagaaatggtggtttagtgag

SEQ ID NO: 37361 - DNA, 71 bp, chicken (Gallus Gallus)
  misc_feature (36): n=a or g
ccctgctctgggtgtttggattaaatttcctcagtncactcatgaaggtgagcagtaagtttaaaaaaaag

SEQ ID NO: 37362 - DNA, 71 bp, chicken (Gallus Gallus)
  misc_feature (36): n=c or t
ctacatgatgtgcttctacagatgtcaggtgagaanttcacttacgataaaaatcagtacaaagtctgtag

SEQ ID NO: 37363 - DNA, 71 bp, chicken (Gallus Gallus)
  misc_feature (36): n=c or t
acctggtttcaaattccttctttgcttgagaagacntgaactggtatttgtagctttgaactcactttcat

SEQ ID NO: 37364 - DNA, 71 bp, chicken (Gallus Gallus)
  misc_feature (36): n=a or g
tttggaaataccttacaagctttcacttgtgcttcnttatcctggatttgtaatctgtgtttttcctgatg

SEQ ID NO: 37365 - DNA, 71 bp, chicken (Gallus Gallus)
  misc_feature (36): n=c or t
ctggttccttgactgagaagtttggttatcatcttnattaagttgccctcggtatatcagggaaagtctgc

SEQ ID NO: 37366 - DNA, 71 bp, chicken (Gallus Gallus)
  misc_feature (36): n=a or c
tgtatgcatttatgctctttgtaggaatagattcanttcatctcaattaaaaggggtatgccatcaaaatg

SEQ ID NO: 37367 - DNA, 71 bp, chicken (Gallus Gallus)
  misc_feature (36): n=c or t
atctttacgtgctattgaatttcctcacctttgtcnagtattttttactatctatctatgcagaaaatagt

SEQ ID NO: 37368 - DNA, 71 bp, chicken (Gallus Gallus)
  misc_feature (36): n=c or t
agttttttagcaagatgttctggaagaatattgcanaattcctgcctttcaaggtggaagtatttaaccgc

SEQ ID NO: 37369 - DNA, 71 bp, chicken (Gallus Gallus)
  misc_feature (36): n=c or t
cttccgataactgaaacaatgacttattaatttctncccatagcgagcagccagtttatttataactggcc

SEQ ID NO: 37370 - DNA, 71 bp, chicken (Gallus Gallus)
  misc_feature (36): n=c or t
agttgtagaggtgcagggtcagcccctgggatctcngtgcctctgcaccaggactgggaactgaatggctg

SEQ ID NO: 37371 - DNA, 71 bp, chicken (Gallus Gallus)
  misc_feature (36): n=a or g
gttagattcagagagtggtggtctgccttgtcactnctctacttactggtcacaaaactctagggtctaca

SEQ ID NO: 37372 - DNA, 71 bp, chicken (Gallus Gallus)
  misc_feature (36): n=c or t
ctgcatgaaagtcaggaggacaagtctcagagctangttattagaagacttatgtggaatttaacatcaac

SEQ ID NO: 37373 - DNA, 71 bp, chicken (Gallus Gallus)
  misc_feature (36): n=a or c
ggtctgacttaattgctgggaaccaaacataatagnagttatttcatgatgctagggcacaaatgcctaca

SEQ ID NO: 37374 - DNA, 71 bp, chicken (Gallus Gallus)
  misc_feature (36): n=c or t
attgttccatgcctgaggtaataagatctgtctcantgctgtgtgatcagctgaagttcagcaccactctg

SEQ ID NO: 37375 - DNA, 71 bp, chicken (Gallus Gallus)
  misc_feature (36): n=c or t
gctagcatccatgactgagtccagaaagtgaatggntgagtgatcacaaaactctgaactcactgtattcc

SEQ ID NO: 37376 - DNA, 71 bp, chicken (Gallus Gallus)
  misc_feature (36): n=c or t
ccttcaatggttgaaaatgctttcagtatttcttantcatcagttttccaacatagattcaaaaaaactgt

SEQ ID NO: 37377 - DNA, 71 bp, chicken (Gallus Gallus)
  misc_feature (36): n=g or t
ggctggccccatgcctccggatcaagactagtgatntgcctttcacagtggctctgtgctcatgtatagaa

SEQ ID NO: 37378 - DNA, 71 bp, chicken (Gallus Gallus)
  misc_feature (36): n=c or t
caagtatggaaagatggatgtgattcctcatgcacnggaccttagctccaacagtgactttttggagataa

SEQ ID NO: 37379 - DNA, 71 bp, chicken (Gallus Gallus)
  misc_feature (36): n=a or g
cagccagttacctccttttttaaccatattgctctnaaatacttgttttggaggttgccaaaccagctctg

SEQ ID NO: 37380 - DNA, 71 bp, chicken (Gallus Gallus)
  misc_feature (36): n=a or c
aaaggctgaagacagacctaagctacaccatccatnttcgggtgcttgacttacactctgtgatgtctaag

SEQ ID NO: 37381 - DNA, 71 bp, chicken (Gallus Gallus)
  misc_feature (36): n=g or t
atatggctttttgagaaagtactgattgctcatggntgatgttgtctgacacatgtaccatgcttagagga

SEQ ID NO: 37382 - DNA, 71 bp, chicken (Gallus Gallus)
  misc_feature (36): n=g or t
gtgccccaccccagagatggctgcacagagaagagngctgattgtagttacctgtaaagtacttgatcttt

SEQ ID NO: 37383 - DNA, 71 bp, chicken (Gallus Gallus)
  misc_feature (36): n=c or t
tacattttcccagaaacaaaggttgcaagctatggngtggaacaaatccacacttgagtttgctaaatagc

SEQ ID NO: 37384 - DNA, 71 bp, chicken (Gallus Gallus)
  misc_feature (36): n=a or c
taattcagccatgtgattgcctacccaagccatagnagaacaaccccacacattgtgtaacctgtaattgt

SEQ ID NO: 37385 - DNA, 71 bp, chicken (Gallus Gallus)
  misc_feature (36): n=a or c
gtgacctacaaacaggttctccaattttccaagtanagaaaagctaagggcagtcaggaatccccatcatg

SEQ ID NO: 37386 - DNA, 71 bp, chicken (Gallus Gallus)
  misc_feature (36): n=g or t
cacacttggccctacaccttggggtctgggcacggntaagtgcctttgcaacacaaatgataacagtaata

SEQ ID NO: 37387 - DNA, 71 bp, chicken (Gallus Gallus)
  misc_feature (36): n=a or c
cagatcctgcccctttctggcagaatccttcagccncgctatttccagtcacaccagcaaagtccactaca

SEQ ID NO: 37388 - DNA, 71 bp, chicken (Gallus Gallus)
  misc_feature (36): n=g or t
agtcaacacgactcggctgcctgcctcacttctctnctggatgctcagcagagagcccagcaaaccttaaa

SEQ ID NO: 37389 - DNA, 71 bp, chicken (Gallus Gallus)
  misc_feature (36): n=a or g
agacccaacacctatgtgttaggtaggattatggtngagaagatgcagtgtttggatacagagggcagtgt

SEQ ID NO: 37390 - DNA, 71 bp, chicken (Gallus Gallus)
  misc_feature (36): n=c or t
caatttgtacaatatttaatgtttgaagtgctcacncagaatgtaaggaatccaggttcaagttccagtgt

SEQ ID NO: 37391 - DNA, 71 bp, chicken (Gallus Gallus)
  misc_feature (36): n=c or t
aaggaagctgggcatcctcatccaaaccaaaagctntcacacactcatacaggcctgttgcaactcaactc

SEQ ID NO: 37392 - DNA, 71 bp, chicken (Gallus Gallus)
  misc_feature (36): n=g or t
tttattatatcctgctgcgaaaataaaaagggaagngaggtgggaaagaagggacaactggtgaactttca

SEQ ID NO: 37393 - DNA, 71 bp, chicken (Gallus Gallus)
  misc_feature (36): n=g or t
ttgttttctttgcttcactcttactgagacaattanagtctaaattacctctcatctttcaggttagccat

SEQ ID NO: 37394 - DNA, 71 bp, chicken (Gallus Gallus)
  misc_feature (36): n=g or t
attagtctgccacttccctgagaaattatgaccttngatctatcagtttaactaagctgattttatatata

SEQ ID NO: 37395 - DNA, 71 bp, chicken (Gallus Gallus)
  misc_feature (36): n=a or g
ttatcacagaaataacattttgcctaaagaattttngaatgaatgtaagccatcactcttcaggacgcaac

SEQ ID NO: 37396 - DNA, 71 bp, chicken (Gallus Gallus)
  misc_feature (36): n=a or g
aacacttgtgaaaagaactgatgttcaacacttgtngagagaaaattcagttctccatcttagataatgaa

SEQ ID NO: 37397 - DNA, 71 bp, chicken (Gallus Gallus)
  misc_feature (36): n=a or g
tgtgttatcctgcttctctgtcccagtttgattctnttctgcccattaggtgacattttcacagcagtaga

SEQ ID NO: 37398 - DNA, 71 bp, chicken (Gallus Gallus)
  misc_feature (36): n=a or g
ctcttttgttcatgtttttcaagttcccattaaganaaccaatattactagccacacacaagctgatcact

SEQ ID NO: 37399 - DNA, 71 bp, chicken (Gallus Gallus)
  misc_feature (36): n=c or t
tttttgaggaaaaaattgttacatactggttctttntacagcatctgactcagaagtctgttttcttcttt

SEQ ID NO: 37400 - DNA, 71 bp, chicken (Gallus Gallus)
  misc_feature (36): n=a or g
acagactgtaagtctgccaaaaaagtcaagtcagantagtcagggatcaaagaggccagggcacttctggg

SEQ ID NO: 37401 - DNA, 71 bp, chicken (Gallus Gallus)
  misc_feature (36): n=c or t
acatgaacttgaaatatatgggtttataatcaagangaaatggagagcattactgcacttccatgctcatc

SEQ ID NO: 37402 - DNA, 71 bp, chicken (Gallus Gallus)
  misc_feature (36): n=c or t
gcaattggcaggttaagaagtttggggactgcctgntctgcctgttttctatagctgtactgcaatagata

SEQ ID NO: 37403 - DNA, 71 bp, chicken (Gallus Gallus)
  misc_feature (36): n=g or t
gcattgtctcctccacaccctgtgatcacagcagtnttcctggaaccagcctggccttttgtgagaatgac

SEQ ID NO: 37404 - DNA, 71 bp, chicken (Gallus Gallus)
  misc_feature (36): n=a or g
tatggcacgcacacaaaactgtccagctctggttgnagctcataccttatagcttcctcatacctcaaagc

SEQ ID NO: 37405 - DNA, 71 bp, chicken (Gallus Gallus)
  misc_feature (36): n=c or t
tagctctgctttctcaagcacagcctaaagaggtantaaaagcagctatttacactattagtgtggagtag

SEQ ID NO: 37406 - DNA, 71 bp, chicken (Gallus Gallus)
  misc_feature (36): n=c or t
agtgctacaggagatttctttagctgtagagcaggntgtaagtctgcggaggatcaatcctgtactcaggt

SEQ ID NO: 37407 - DNA, 71 bp, chicken (Gallus Gallus)
  misc_feature (36): n=c or t
atacgtaacagatgatactgtacagacatccacatnagcatccagtcttgcacactttgccatactcagcc

SEQ ID NO: 37408 - DNA, 71 bp, chicken (Gallus Gallus)
  misc_feature (36): n=a or g
gcttaactcacatgtgctagtcggtcaaatcttgcnaagagttcattcagcattcggaccagttcctgggc

SEQ ID NO: 37409 - DNA, 71 bp, chicken (Gallus Gallus)
  misc_feature (36): n=c or t
aatatccaggagaattcctaatctgtgtaattaaanggcatatgcccctcaaatgtttgcaatgaactgaa

SEQ ID NO: 37410 - DNA, 71 bp, chicken (Gallus Gallus)
  misc_feature (36): n=a or g
ttgccagaagaaggggtgaaatccttctttgctcgngttaacaaatactagatgatagactggggaaggga

SEQ ID NO: 37411 - DNA, 71 bp, chicken (Gallus Gallus)
  misc_feature (36): n=a or c
gattctaacctacaccaaatcaatctgtatgatgantaactgaatactgatggtacttattacctgtttct

SEQ ID NO: 37412 - DNA, 71 bp, chicken (Gallus Gallus)
  misc_feature (36): n=g or t
attcatattgacttctattggctgtgtccctttttnatggctcaataaaacaacatgtttgcaatacagat

SEQ ID NO: 37413 - DNA, 71 bp, chicken (Gallus Gallus)
  misc_feature (36): n=a or g
ctgagcatcaggatgttaatgaacatgtggggagcntgctagatcactgacccaatgtactaaaccaagga

SEQ ID NO: 37414 - DNA, 71 bp, chicken (Gallus Gallus)
  misc_feature (36): n=c or t
taaagagtttaccctttcaaacagagatggtagcangacagtctttgtaagaaactgtcagaaaagaaaaa

SEQ ID NO: 37415 - DNA, 71 bp, chicken (Gallus Gallus)
  misc_feature (36): n=a or g
ctgcatctttgtagatgcacaataaatgtctcagcntttgtttagcaattggtaagaatgcattgcagagg

SEQ ID NO: 37416 - DNA, 71 bp, chicken (Gallus Gallus)
  misc_feature (36): n=c or t
tctttaaaatggaattttattagatgtctgtcatangatactgtgtgaaactgaaatgcctttgtgaattt

SEQ ID NO: 37417 - DNA, 71 bp, chicken (Gallus Gallus)
  misc_feature (36): n=a or g
ataattcttagcacagtgctgtcattttagaggacnatctgtgaggaaatgtgatgtcttaatcagtttag

SEQ ID NO: 37418 - DNA, 71 bp, chicken (Gallus Gallus)
  misc_feature (36): n=a or g
atccagggtaagggtgagtccatgatctttggggcnggcttttcttcctcaggtaggtgtgctttctgcca

SEQ ID NO: 37419 - DNA, 71 bp, chicken (Gallus Gallus)
  misc_feature (36): n=g or t
ttatgatttctggaggtatgacaatacaactggtcntgcaggctttggaggtctcagcaacacagcttgag

SEQ ID NO: 37420 - DNA, 71 bp, chicken (Gallus Gallus)
  misc_feature (36): n=c or t
tatggggttgagtgtcaggacttgtagattctgttncaatttctgacagtaaatcaaaagttgttctctga

SEQ ID NO: 37421 - DNA, 71 bp, chicken (Gallus Gallus)
  misc_feature (36): n=c or t
ggcagtccaacggattgctcctccactctccctaangacaatttttggcttattcattaatgaagagggtt

SEQ ID NO: 37422 - DNA, 71 bp, chicken (Gallus Gallus)
  misc_feature (36): n=c or t
tgttatttttttctaagtgctcaacttccattttcncccttgtagtctcagggtcagtcctcataatatgt

SEQ ID NO: 37423 - DNA, 71 bp, chicken (Gallus Gallus)
  misc_feature (36): n=c or t
agactggattgtgtttgcacctattctgcttggaangactcaagattcacatgttgcagtcagataacttt

SEQ ID NO: 37424 - DNA, 71 bp, chicken (Gallus Gallus)
  misc_feature (36): n=c or t
aggtggggagatgcaagtgtaggtgtgaggtaaggnaaagagaccaagaagagcctcactggtgtgtgatg

SEQ ID NO: 37425 - DNA, 71 bp, chicken (Gallus Gallus)
  misc_feature (36): n=c or t
atctggggcaagtaataatagacaaatagaagctcnttgcttccatagtgacccagggcaggactccaatg

SEQ ID NO: 37426 - DNA, 71 bp, chicken (Gallus Gallus)
  misc_feature (36): n=a or g
ctccacaggaatgcgctactggttgcctgatgcctnatgaacatttcagtgaaactgcagtatttaaagtg

SEQ ID NO: 37427 - DNA, 71 bp, chicken (Gallus Gallus)
  misc_feature (36): n=a or g
ccctaaaggagaatggatccaagacaacatccgccnaaaggctctgcccttgctctacaagcccagggcaa

SEQ ID NO: 37428 - DNA, 71 bp, chicken (Gallus Gallus)
  misc_feature (36): n=c or t
cataatgaaaataatcatctccccacataaacagcntttcatggttgagtttgaccacttcctaatgcctg

SEQ ID NO: 37429 - DNA, 71 bp, chicken (Gallus Gallus)
  misc_feature (36): n=c or t
caaggccacagccctatttcatttgcttatagagantgtcatatctctgacatgagccaacattgatgttt

SEQ ID NO: 37430 - DNA, 71 bp, chicken (Gallus Gallus)
  misc_feature (36): n=a or g
cggatgagaggtcatcttgcacctgtactgtccctngtgtttcctgaatgggatcttaagagggaaataga

SEQ ID NO: 37431 - DNA, 71 bp, chicken (Gallus Gallus)
  misc_feature (36): n=a or g
ttccatataatgaaatatactacttctccctacaantcttgcttcactattaaatgaaatacatttcaaca

SEQ ID NO: 37432 - DNA, 71 bp, chicken (Gallus Gallus)
  misc_feature (36): n=a or g
agatgatgtattttcctctctgagtgtttacaggtnaggttaaatatcttgtagatggaacaagaggtaat

SEQ ID NO: 37433 - DNA, 71 bp, chicken (Gallus Gallus)
  misc_feature (36): n=c or t
acctctagtggtatgagtgttcaccttccagtaagngacctgtaatgatgacaaggaaccagttgccagga

SEQ ID NO: 37434 - DNA, 71 bp, chicken (Gallus Gallus)
  misc_feature (36): n=a or g
gtgtttgaaatattattgttttagtaaaaactgacntgcgatttcattcccagtgacatggagacttcttg

SEQ ID NO: 37435 - DNA, 71 bp, chicken (Gallus Gallus)
  misc_feature (36): n=a or g
atgggatgcatattcctactttaataaggaattttnagatacatatgagttagtaatatcaagtcagacat

SEQ ID NO: 37436 - DNA, 71 bp, chicken (Gallus Gallus)
  misc_feature (36): n=c or t
cacaagctgtagtgtgttgagttgtttatagcatgnaaatagcaaaagcatggcatgacatgctacatgga

SEQ ID NO: 37437 - DNA, 71 bp, chicken (Gallus Gallus)
  misc_feature (36): n=a or c
aagccactccaggagggaaaaggcacaaggcctttntctccctcctccatctgaagggcatccttccactc

SEQ ID NO: 37438 - DNA, 71 bp, chicken (Gallus Gallus)
  misc_feature (36): n=a or g
agcttatgtattccttagattctatacgtctccaanaaatagatattttctactccttggtacaagtcagt

SEQ ID NO: 37439 - DNA, 71 bp, chicken (Gallus Gallus)
  misc_feature (36): n=g or t
catgctacttttcattttacagttgtagaatgttcntgtcttaccataccactgactgcatgttatttatg

SEQ ID NO: 37440 - DNA, 71 bp, chicken (Gallus Gallus)
  misc_feature (36): n=c or t
aaaagccacttccagagatgtgttagttacaccatnggtacttagagtctgtggggctgatgaatagcact

SEQ ID NO: 37441 - DNA, 71 bp, chicken (Gallus Gallus)
  misc_feature (36): n=a or g
tgaaatgtagtagaaaaggatgttgttttgatgatnctcttacggcatattcctagcactgctcatccgag

SEQ ID NO: 37442 - DNA, 71 bp, chicken (Gallus Gallus)
  misc_feature (36): n=c or t
gaagttatggatactatagatgaaggaaaatcaaancgacatgtagcagttacaagtaagtactatcccta

SEQ ID NO: 37443 - DNA, 71 bp, chicken (Gallus Gallus)
  misc_feature (36): n=c or t
gatgttgaaaagagtcatgttgtaatgagatttctntgctttacaatggtgttggcagtgtttttgtggta

SEQ ID NO: 37444 - DNA, 71 bp, chicken (Gallus Gallus)
  misc_feature (36): n=c or t
atagattcacttgactgtgacaacatatcagaagcnttagtttctaattattgataacataacttggattg

SEQ ID NO: 37445 - DNA, 71 bp, chicken (Gallus Gallus)
  misc_feature (36): n=c or t
tgcaggaattttatgacagatggagaactggacctntctttctcaagtctcaacttagtgattctcagcat

SEQ ID NO: 37446 - DNA, 71 bp, chicken (Gallus Gallus)
  misc_feature (36): n=c or t
ttttggagtaaagcagttgcaaaagtttactttgcngccttactactttacaaataacctgtggacatagt

SEQ ID NO: 37447 - DNA, 71 bp, chicken (Gallus Gallus)
  misc_feature (36): n=a or g
gtggaatggagtcttgatactgacagaggggaattntgatgcccattttctccatctctagtggtcgttaa

SEQ ID NO: 37448 - DNA, 71 bp, chicken (Gallus Gallus)
  misc_feature (36): n=c or t
ttggtattaccaagaaaaaatataggtcaacaatgnacatttttaacaataaaaaccctggaacatttttt

SEQ ID NO: 37449 - DNA, 71 bp, chicken (Gallus Gallus)
  misc_feature (36): n=a or g
ctgtgcaactcatgggaatccatgagcaatttaccntgcttcctctcagtgcaacacagtaaatcactttc

SEQ ID NO: 37450 - DNA, 71 bp, chicken (Gallus Gallus)
  misc_feature (36): n=a or g
gctgtcctacttgtagttaaaaatgttgcttatacngattattggtgtgctttatggtagtaatgcataga

SEQ ID NO: 37451 - DNA, 71 bp, chicken (Gallus Gallus)
  misc_feature (36): n=a or g
tctaaccttatttacttaaagatagaacaggaaaancacatggaaatatggatagaagacaacagtggaac

SEQ ID NO: 37452 - DNA, 71 bp, chicken (Gallus Gallus)
  misc_feature (36): n=g or t
aatatccattagatgtagagaggaactgagccaatnctcgaatgcatttgatatttcaatgtgctacctgt

SEQ ID NO: 37453 - DNA, 71 bp, chicken (Gallus Gallus)
  misc_feature (36): n=c or t
gttgttgaatagattctctgccaacaaaatacccanataatctattcatactcataaattcttcagactcc

SEQ ID NO: 37454 - DNA, 71 bp, chicken (Gallus Gallus)
  misc_feature (36): n=c or t
aatgtttatcatatctgtggatctaactttgaaaanggactggctttgagatgctggatgaaccaaatgat

SEQ ID NO: 37455 - DNA, 71 bp, chicken (Gallus Gallus)
  misc_feature (36): n=c or t
ctgtactggtgctgtggacctgaaagatatgcttantctgccagacaatttggttctcagttctcattctt

SEQ ID NO: 37456 - DNA, 71 bp, chicken (Gallus Gallus)
  misc_feature (36): n=a or g
aacctgttccagtgcttcccttctcttatcctcttntcataaaaataatggctacaactctgtttcaatac

SEQ ID NO: 37457 - DNA, 71 bp, chicken (Gallus Gallus)
  misc_feature (36): n=c or t
aaatcagtgactcttttggatgcactggaatcatanaaataacaacccactgggaaccttgcaaaagctca

SEQ ID NO: 37458 - DNA, 71 bp, chicken (Gallus Gallus)
  misc_feature (36): n=c or t
cactaggtctattctagctccatatagtaaatccantgaaagcaatgtcaaaagtaagatgacacctcagt

SEQ ID NO: 37459 - DNA, 71 bp, chicken (Gallus Gallus)
  misc_feature (36): n=g or t
tgcacaaaggcataagttaggatgctcccactaacntatggctatggagaagcaagaacaatttgcacatt

SEQ ID NO: 37460 - DNA, 71 bp, chicken (Gallus Gallus)
  misc_feature (36): n=c or t
accttagcagcattaggtcctttacaagggaaaaantgaaatgtccttcccatggttcatacagaagaaac

SEQ ID NO: 37461 - DNA, 71 bp, chicken (Gallus Gallus)
  misc_feature (36): n=c or t
agatttttccgagcagtccctgccagtgctatcaangggaaattaaaccaaccagcactccttggctggaa

SEQ ID NO: 37462 - DNA, 71 bp, chicken (Gallus Gallus)
  misc_feature (36): n=a or g
gaggaatgctcattcagatcccctattatgctaaantaagctgaatttgaaagtgccaagacaacattttt

SEQ ID NO: 37463 - DNA, 71 bp, chicken (Gallus Gallus)
  misc_feature (36): n=g or t
ttgatctgggttcttttattgaacaggaaattaganctctaaaacagaccacatattattctcttgcaatt

SEQ ID NO: 37464 - DNA, 71 bp, chicken (Gallus Gallus)
  misc_feature (36): n=c or t
tttcctggagctctgtgggaggactggagagagcanacctctctgcaagggattctctgctgatttgtatt

SEQ ID NO: 37465 - DNA, 71 bp, chicken (Gallus Gallus)
  misc_feature (36): n=g or t
caggactgagagacaataaattaacacagacaactntaagtctttgggtctcagatctcattgggaatata

SEQ ID NO: 37466 - DNA, 71 bp, chicken (Gallus Gallus)
  misc_feature (36): n=a or c
agtcacctctccctggcataactgctagctggatanatttccctctgtggtacttacagggttacctgctg

SEQ ID NO: 37467 - DNA, 71 bp, chicken (Gallus Gallus)
  misc_feature (36): n=a or g
tacataattcagcgcttgttttatttaccactgtgnattcgtaggtgttcctttagatgatgtttatattt

SEQ ID NO: 37468 - DNA, 71 bp, chicken (Gallus Gallus)
  misc_feature (36): n=c or t
ttagagaggatgatataggtagaccaaagatgatanagaaaaataaagcagtagattcagatgttcactgc

SEQ ID NO: 37469 - DNA, 71 bp, chicken (Gallus Gallus)
  misc_feature (36): n=c or t
acaggaggcctatctgcagctaccagttcacactgncaatagctcaggcactgtcctaaataccacaaaac

SEQ ID NO: 37470 - DNA, 71 bp, chicken (Gallus Gallus)
  misc_feature (36): n=a or g
caggcactatttatgactgttccttccactttctcnacatccatcacttctttccttgtcaaagcccattt

SEQ ID NO: 37471 - DNA, 71 bp, chicken (Gallus Gallus)
  misc_feature (36): n=a or g
tttacctaatctgaactatcttagcaccctctacanttgtcttgaaaatcacatttaagatgagatgcacc

SEQ ID NO: 37472 - DNA, 71 bp, chicken (Gallus Gallus)
  misc_feature (36): n=a or g
ctgctcagggctgtttttaagcatttccttaccagnaagggtgaagggattaaagaggatacgaaaaggct

SEQ ID NO: 37473 - DNA, 71 bp, chicken (Gallus Gallus)
  misc_feature (36): n=a or g
atgctttacatatagaaagagttctaagaaatgtantaagaagggatgtaaaaaggttttactgctatcgg

SEQ ID NO: 37474 - DNA, 71 bp, chicken (Gallus Gallus)
  misc_feature (36): n=a or c
caagcatacagtcaagtttaccttactgctgagacntggcaggagtactttctgacaagattttgagctac

SEQ ID NO: 37475 - DNA, 71 bp, chicken (Gallus Gallus)
  misc_feature (36): n=a or g
taaccagagcattcccaagggagatccaaaagcagnaagaggggcaaatcattcaatgcctacaagactgg

SEQ ID NO: 37476 - DNA, 71 bp, chicken (Gallus Gallus)
  misc_feature (36): n=g or t
caccatgtggccaggagatcctacaggaaaaacatnaataaaagtgccaggaacggctgaatataattctg

SEQ ID NO: 37477 - DNA, 71 bp, chicken (Gallus Gallus)
  misc_feature (36): n=g or t
gtgaacctcttattttgtactggaatatattacacngttagctgtgtactgcaaatagcccaggaatggtt

SEQ ID NO: 37478 - DNA, 71 bp, chicken (Gallus Gallus)
  misc_feature (36): n=a or g
tacggaggccccaagaacatccttacctagcggcancctttgtcttccaactcctttttcctttgtgtgtt

SEQ ID NO: 37479 - DNA, 71 bp, chicken (Gallus Gallus)
  misc_feature (36): n=c or t
cactgatatgatgcccaccatgcaggaacattatanagatgaataagtttcaaaagacaagtgttttcatt

SEQ ID NO: 37480 - DNA, 71 bp, chicken (Gallus Gallus)
  misc_feature (36): n=a or g
ctccgcaacgcagtgtgtggtattgtatccatagcnacatttctgcatttaaatactagcgttgatcttgc

SEQ ID NO: 37481 - DNA, 71 bp, chicken (Gallus Gallus)
  misc_feature (36): n=c or t
gagctctctgcacctcttttctccccctatttgtcnttgcttgtagcaaaaggaaactggaaattctatat

SEQ ID NO: 37482 - DNA, 71 bp, chicken (Gallus Gallus)
  misc_feature (36): n=g or t
ttgtaactcctgaagtagcaagtgtacatccttatnactgatcagaatcactttgtgtcagagagaacaca

SEQ ID NO: 37483 - DNA, 71 bp, chicken (Gallus Gallus)
  misc_feature (36): n=a or g
taaattcactaatggagctatcaatgtaagcccatnctatgacacaaacatgacagctattttgtcttaaa

SEQ ID NO: 37484 - DNA, 71 bp, chicken (Gallus Gallus)
  misc_feature (36): n=c or t
agatttcaaaatgatggtgatgaatggagggagagnaaattacaaaagaaaccacaagtaaccaaagtaag

SEQ ID NO: 37485 - DNA, 71 bp, chicken (Gallus Gallus)
  misc_feature (36): n=a or g
gttttgagcaagtttcaaatcaaaaaagttttatcntttctaatacacagcatttaaaacactactcaatg

SEQ ID NO: 37486 - DNA, 71 bp, chicken (Gallus Gallus)
  misc_feature (36): n=a or g
actgtgtcatgcttcctacaaattattttccatacnaggtagattatggtctttaaactggaaatctttga

SEQ ID NO: 37487 - DNA, 71 bp, chicken (Gallus Gallus)
  misc_feature (36): n=a or g
gcatctctatttcttgatgccaccacagctgagctntatctccccagcagaatacacaggaccccaaagta

SEQ ID NO: 37488 - DNA, 71 bp, chicken (Gallus Gallus)
  misc_feature (36): n=c or t
ctatttcactctgtaatagcactcacatctgtgcangtaatagggagaacgtgaccaagttgtgaatggtg

SEQ ID NO: 37489 - DNA, 71 bp, chicken (Gallus Gallus)
  misc_feature (36): n=a or g
caggtttcactacctgcaccagaatatgttacaccnttttagagcagatctgagcatatcttaagatgacc

SEQ ID NO: 37490 - DNA, 71 bp, chicken (Gallus Gallus)
  misc_feature (36): n=a or g
ctctttaaatgtgtgtgtcaatactggacaagcacntgtttatcaacatctcagcagcagatggatgtgga

SEQ ID NO: 37491 - DNA, 71 bp, chicken (Gallus Gallus)
  misc_feature (36): n=c or t
acaatgatacagtaagaatttctttgttgcagtttntcagtactgagctataactacaaccttctcaagaa

SEQ ID NO: 37492 - DNA, 71 bp, chicken (Gallus Gallus)
  misc_feature (36): n=g or t
aaatggttgcttcttacctgctctttcatgggcatntatttcagctaatgcttgtacagagtgtgaaaaca

SEQ ID NO: 37493 - DNA, 71 bp, chicken (Gallus Gallus)
  misc_feature (36): n=g or t
attaaccaatcaaaagcatatattaagtaaaaaatnatttcaagactcaccttgatctgtgagtacctgat

SEQ ID NO: 37494 - DNA, 71 bp, chicken (Gallus Gallus)
  misc_feature (36): n=c or t
cattgatgcttgggaggagatgaatgaaccaaatgntgcatgggcattgatttctctgagctgatgctaca

SEQ ID NO: 37495 - DNA, 71 bp, chicken (Gallus Gallus)
  misc_feature (36): n=a or g
acttgctcttgagatttaaaaataccacccaagaangtctgtgtccagtccagtcctcctaacatataacc

SEQ ID NO: 37496 - DNA, 71 bp, chicken (Gallus Gallus)
  misc_feature (36): n=c or t
ttgataggaaattaaagcctatgctcctgcctctangtttcaaaaccttgaagaattgcatagcaccttct

SEQ ID NO: 37497 - DNA, 71 bp, chicken (Gallus Gallus)
  misc_feature (36): n=a or c
atacgaccaagagaaggagcttaaatgatgggcccngatttaatgtctaaccgttgggtgcctgcacctaa

SEQ ID NO: 37498 - DNA, 71 bp, chicken (Gallus Gallus)
  misc_feature (36): n=a or g
acatgtaggtctaagcctgaacactttggtgcatcnactatacttagtttggatcacgaacccacctataa

SEQ ID NO: 37499 - DNA, 71 bp, chicken (Gallus Gallus)
  misc_feature (36): n=c or t
ttgtagcagacctccaccggcgcagggcggttcatncgggccatggtgggacaagagaaggatgatgctga

SEQ ID NO: 37500 - DNA, 71 bp, chicken (Gallus Gallus)
  misc_feature (36): n=c or t
acttctatcacctgaaaattaaatcaaggctgagangcaaagcttccccaccctgctcagcaggaaacctt

SEQ ID NO: 37501 - DNA, 71 bp, chicken (Gallus Gallus)
  misc_feature (36): n=a or g
ctgaatttgcatggatttgcagcagaaatattgacnatctcctgtgaatgttagcatccttgagcgcagtt

SEQ ID NO: 37502 - DNA, 71 bp, chicken (Gallus Gallus)
  misc_feature (36): n=c or t
caccctggagtcactttggaatggtgtcagaataancttagaatgatcaaggaatgagcttagaacaaatt

SEQ ID NO: 37503 - DNA, 71 bp, chicken (Gallus Gallus)
  misc_feature (36): n=c or t
agcagcactcccagctgagatgcccactaaagacanttcagatgtgcagcaagttgtcccctccacgcatc

SEQ ID NO: 37504 - DNA, 71 bp, chicken (Gallus Gallus)
  misc_feature (36): n=c or t
catgtccatctacttagctaagttagattgcatcanttcatagttgacatctcacttaatccctgctttct

SEQ ID NO: 37505 - DNA, 71 bp, chicken (Gallus Gallus)
  misc_feature (36): n=a or c
aattaccatttggaactttatttgactccttcttcncaacaggaggctttgggtctcacccatgtgctgta

SEQ ID NO: 37506 - DNA, 71 bp, chicken (Gallus Gallus)
  misc_feature (36): n=a or g
acctcaaagaaaatcacattcttactacggtaatanacagacagggggagaaagaagagttaatatatagc

SEQ ID NO: 37507 - DNA, 71 bp, chicken (Gallus Gallus)
  misc_feature (36): n=a or g
gcaatctccttcatgaactgcttcttaaattactangagcagacttcaggtcatggtaagaaacctgaaca

SEQ ID NO: 37508 - DNA, 71 bp, chicken (Gallus Gallus)
  misc_feature (36): n=a or g
agctctacaacttcaaaagaagacatgtgatctctnggtgagttgttagtcatccattgagaagaagaagc

SEQ ID NO: 37509 - DNA, 71 bp, chicken (Gallus Gallus)
  misc_feature (36): n=c or t
tccgtagcagattgatcataagaattaagtacactnttcattctgattatctgcactgtgaatacaccaac

SEQ ID NO: 37510 - DNA, 71 bp, chicken (Gallus Gallus)
  misc_feature (36): n=g or t
ccaatgatgatttttgccatggtgatcgcaaaagangtgctccatgtctgaaggaccctgcagtgtgaagt

SEQ ID NO: 37511 - DNA, 71 bp, chicken (Gallus Gallus)
  misc_feature (36): n=a or c
atttgactgtagatgtccatagttataatacacttnaggcagttgtttactcaagaacccttcccttcccc

SEQ ID NO: 37512 - DNA, 71 bp, chicken (Gallus Gallus)
  misc_feature (36): n=c or t
gtctgtgcagaaggctataatgatcttgaggaattnagttgaagaattaagtaggaactgttgctggcttt

SEQ ID NO: 37513 - DNA, 71 bp, chicken (Gallus Gallus)
  misc_feature (36): n=c or t
cctgatcttacattcatatacatcttcttttaatanacatacaagaagtcaagggcaatactaacttcctg

SEQ ID NO: 37514 - DNA, 71 bp, chicken (Gallus Gallus)
  misc_feature (36): n=c or t
atatatatattatggcaaataaagagtgacaccagntgagtcctgtagaatatttgagatagtgtttttgc

SEQ ID NO: 37515 - DNA, 71 bp, chicken (Gallus Gallus)
  misc_feature (36): n=c or t
ttcattaactcagacaactcatttctttatgatggnaagttttatggtggttaggctactaccaaatagag

SEQ ID NO: 37516 - DNA, 71 bp, chicken (Gallus Gallus)
  misc_feature (36): n=c or t
atgttgaaaaggaaacctggtaaatattgatttcangtggagtcagaaaagagaggtttatttcaaaataa

SEQ ID NO: 37517 - DNA, 71 bp, chicken (Gallus Gallus)
  misc_feature (36): n=c or t
caggcatgaaaatcttatttggagaaagtgataaanggtgtgctacaaattcagggaatgcacacctccac

SEQ ID NO: 37518 - DNA, 71 bp, chicken (Gallus Gallus)
  misc_feature (36): n=a or g
cacatcccaagcaatcacactctacctgtagtcctntagagatcccagcagtttcctatcagtccttagga

SEQ ID NO: 37519 - DNA, 71 bp, chicken (Gallus Gallus)
  misc_feature (36): n=c or t
ttcttaatctatgtatacatttgtcaataatctcanaaaatactacttgcacacaaacacatttttatata

SEQ ID NO: 37520 - DNA, 71 bp, chicken (Gallus Gallus)
  misc_feature (36): n=a or g
ttctaaactgctagcatcagtgagggattttattgnaagtacccctcagcaagaaattatacataggaacg

SEQ ID NO: 37521 - DNA, 71 bp, chicken (Gallus Gallus)
  misc_feature (36): n=c or t
gttgcagtgcaaaagattaaacaatgtcaaatcaangaggcaagaatgagaaaatcaagcacacatgaggg

SEQ ID NO: 37522 - DNA, 71 bp, chicken (Gallus Gallus)
  misc_feature (36): n=c or t
tctaatagttacgtaaaaatggtgagcactgtttcngccccaaataagaatccattttcagtcttaattaa

SEQ ID NO: 37523 - DNA, 71 bp, chicken (Gallus Gallus)
  misc_feature (36): n=c or t
atcctctttataaatctatgcttcctaactttatanagaagtgaaaaacaactatgattaaaaaagaggtg

SEQ ID NO: 37524 - DNA, 71 bp, chicken (Gallus Gallus)
  misc_feature (36): n=c or t
aaaaattaaaaataaatatccatcttgttgggtttntactgtgcaaatccaagtagcaaagcttgtgtact

SEQ ID NO: 37525 - DNA, 71 bp, chicken (Gallus Gallus)
  misc_feature (36): n=c or t
ggaaagacttttctctcccttcagctatgaggatanatcctattttctaaggttcgttactgatatgctgt

SEQ ID NO: 37526 - DNA, 71 bp, chicken (Gallus Gallus)
  misc_feature (36): n=a or c
aagaatgtaatttttctccatctctagatatccaantagatttacaacctgtatgagactgtacctaagag

SEQ ID NO: 37527 - DNA, 71 bp, chicken (Gallus Gallus)
  misc_feature (36): n=a or g
acagacacataccagcaaactataatgcaccttatngatgatgaagcaaaataattcagggctcattatga

SEQ ID NO: 37528 - DNA, 71 bp, chicken (Gallus Gallus)
  misc_feature (36): n=c or t
gacaacagtgtctgaaacagattggagaacatctcntatctctacagaatatgtagagccttgaccatatg

SEQ ID NO: 37529 - DNA, 71 bp, chicken (Gallus Gallus)
  misc_feature (36): n=a or c
gggatgctgcagctgttcggtgtcctcgcaatgccnctggtaaggatgactgcatatattggctggatacc

SEQ ID NO: 37530 - DNA, 71 bp, chicken (Gallus Gallus)
  misc_feature (36): n=a or g
ggtttgtgcatccatctcattgcttagggatagatnggattgatggatgcactgggaaattgctgaaaatt

SEQ ID NO: 37531 - DNA, 71 bp, chicken (Gallus Gallus)
  misc_feature (36): n=a or g
gctgaaagttagaacagtctaaacagaaagtcagcntgatgttgtgtgtgataatgatcctttgaaagtaa

SEQ ID NO: 37532 - DNA, 71 bp, chicken (Gallus Gallus)
  misc_feature (36): n=a or g
cacaaagaactcccaaatccaggcatgaatggcatnactcattaatgatattttataggagtacagtgtta

SEQ ID NO: 37533 - DNA, 71 bp, chicken (Gallus Gallus)
  misc_feature (36): n=c or t
gatttactccatagctcagttttggaagctcactgntccatatttggagattgccaggcttcttcaaacct

SEQ ID NO: 37534 - DNA, 71 bp, chicken (Gallus Gallus)
  misc_feature (36): n=c or t
attttcttggataagaaccaactaaacctgtaggtntccagtgctgaacaatctaagcatttggttttttg

SEQ ID NO: 37535 - DNA, 71 bp, chicken (Gallus Gallus)
  misc_feature (36): n=a or g
ctgtcaatatcttgctctttttgtttggccaccacnaggtccttaaactcaaatatactgtgatccaacca

SEQ ID NO: 37536 - DNA, 71 bp, chicken (Gallus Gallus)
  misc_feature (36): n=g or t
catgcttctctcttttattctctatctcaggtgcangagatagtggctgtgtggctgcactccttgcaaaa

SEQ ID NO: 37537 - DNA, 71 bp, chicken (Gallus Gallus)
  misc_feature (36): n=a or g
catatccattaatttttcccccttccaaaggaaganttaagtgccatataagtcatttctttgtgcctcag

SEQ ID NO: 37538 - DNA, 71 bp, chicken (Gallus Gallus)
  misc_feature (36): n=c or t
ttagttatccatggtctagacagggatcaatggcantcagataagattaagacactcacccttcacattcc

SEQ ID NO: 37539 - DNA, 71 bp, chicken (Gallus Gallus)
  misc_feature (36): n=c or t
ttaggcattatcactccaccaaagatttggtctttntgataccttctgctctggtattgcaaaacttgcaa

SEQ ID NO: 37540 - DNA, 71 bp, chicken (Gallus Gallus)
  misc_feature (36): n=g or t
gcacttctgagatgatatcatggaaagctcagaatngagtttttatcatgggcctcttccagaaggatagg

SEQ ID NO: 37541 - DNA, 71 bp, chicken (Gallus Gallus)
  misc_feature (36): n=a or g
tgcccatgccatcccactgctgtgtagtaatccacngcagaatgacagcagctccttcataacttgtagca

SEQ ID NO: 37542 - DNA, 71 bp, chicken (Gallus Gallus)
  misc_feature (36): n=c or t
tgtctatcattctctctgcccacatccagatagaancatttactctaacatctttagaagcatagaaaggt

SEQ ID NO: 37543 - DNA, 71 bp, chicken (Gallus Gallus)
  misc_feature (36): n=a or g
gcaaatatacagacagccatgttcatttctccactncaaaggcagtctggaagggagcacacccatcactc

SEQ ID NO: 37544 - DNA, 71 bp, chicken (Gallus Gallus)
  misc_feature (36): n=c or t
tcttggtctcttgcaggttcttctttgcaatgttanagctgcaagacaaaactcagcaacagcaactgtca

SEQ ID NO: 37545 - DNA, 71 bp, chicken (Gallus Gallus)
  misc_feature (36): n=a or g
ggcatttttcgaaaccttgctttcattccctccctntactcaaaattgcctatggagacagcaaaaatact

SEQ ID NO: 37546 - DNA, 71 bp, chicken (Gallus Gallus)
  misc_feature (36): n=c or t
cttcactcaagcatgtcttcacccatcttcagcgcngtgaattcaacgggattcaagccaggagtttgggc

SEQ ID NO: 37547 - DNA, 71 bp, chicken (Gallus Gallus)
  misc_feature (36): n=a or g
gcctgtctgatgttcctggcaaatgggcaaagaaangtctgagatcacctgtcatctccttccaagctagt

SEQ ID NO: 37548 - DNA, 71 bp, chicken (Gallus Gallus)
  misc_feature (36): n=c or t
ctgtagacatctccaggcctcatacagagcttttcngcctcctttcagctgcatctcttgctgggagagga

SEQ ID NO: 37549 - DNA, 71 bp, chicken (Gallus Gallus)
  misc_feature (36): n=c or t
gtattaagcacatcccttcagggtctgaggagcatnttctatagctccacaaatctcagctgcaatcagac

SEQ ID NO: 37550 - DNA, 71 bp, chicken (Gallus Gallus)
  misc_feature (36): n=a or g
tgggtggtttccagcagagcccttgcatcccttgcntagctgctggtatctgttcccttgaaaattgctct

SEQ ID NO: 37551 - DNA, 71 bp, chicken (Gallus Gallus)
  misc_feature (36): n=a or g
tgggaacagattgggtagaaggtgatgagataaggntgggttatggaaccagattccatttgagctcctga

SEQ ID NO: 37552 - DNA, 71 bp, chicken (Gallus Gallus)
  misc_feature (36): n=a or g
ccgattgaggagacatacggtgtttaggcagaaaangtcttgcagctgcttagcttagtgtctcttttggg

SEQ ID NO: 37553 - DNA, 71 bp, chicken (Gallus Gallus)
  misc_feature (36): n=c or t
tgacgtgggcctttccagatctgcttaagagcttanggagcccagctgtctcattagaggcaccttctcag

SEQ ID NO: 37554 - DNA, 71 bp, chicken (Gallus Gallus)
  misc_feature (36): n=a or g
atgtcagctctcatgggtcacaccatggagaggcanaatgttaagctcccattggaactttctacttatgc

SEQ ID NO: 37555 - DNA, 71 bp, chicken (Gallus Gallus)
  misc_feature (36): n=a or g
aaataaggataaattcatattcccccttggaatgcncaggtaagagacatctctaggcaccagggaaactg

SEQ ID NO: 37556 - DNA, 71 bp, chicken (Gallus Gallus)
  misc_feature (36): n=c or t
cgtctctgagctcaggaaggtaattgcctctctcgntccaatccctgagaaacctttaatatgtgtctccg

SEQ ID NO: 37557 - DNA, 71 bp, chicken (Gallus Gallus)
  misc_feature (36): n=a or g
caaactgtgctctaactactggagatgtttcctccntatgaacagcacgagggctccagggactgtccaga

SEQ ID NO: 37558 - DNA, 71 bp, chicken (Gallus Gallus)
  misc_feature (36): n=a or g
ccagtattccccagcagcaccgctccccctgccatngacactgggatgcaggtgtgtgaatggaggctgga

SEQ ID NO: 37559 - DNA, 71 bp, chicken (Gallus Gallus)
  misc_feature (36): n=g or t
cgttattggtagaaacctttttcccagagaggaggnatttctactggtacaccattattggctggggtagg

SEQ ID NO: 37560 - DNA, 71 bp, chicken (Gallus Gallus)
  misc_feature (36): n=a or g
ttttttactgccgaatagaagggttcttggacaaancagatcactgcaaagccttcctaatgaagaaaaat

SEQ ID NO: 37561 - DNA, 71 bp, chicken (Gallus Gallus)
  misc_feature (36): n=a or c
gcagcctgctccaatgcattttaccactctttcttnatttgcagtggaaaaagaccaggagctgatgcaaa

SEQ ID NO: 37562 - DNA, 71 bp, chicken (Gallus Gallus)
  misc_feature (36): n=a or g
acaaacacagctgatgttgacatgagttgcagctcnttaagtcccataatggataaccttgtcatttgttg

SEQ ID NO: 37563 - DNA, 71 bp, chicken (Gallus Gallus)
  misc_feature (36): n=a or c
tactctcaggcctatggaactatatgcaaatctgcnctgcagagccttcccatatcaaattcctcccagca

SEQ ID NO: 37564 - DNA, 71 bp, chicken (Gallus Gallus)
  misc_feature (36): n=a or g
agatgaaagcagataaaatgggctgatgagaggcangatctcatctcagtagagaaggtctcccccaccca

SEQ ID NO: 37565 - DNA, 71 bp, chicken (Gallus Gallus)
  misc_feature (36): n=c or t
ctatgctcccggaaaagcaaaagcgagactataagngtgcagtcattcttgggcatagcttccaagcctgg

SEQ ID NO: 37566 - DNA, 71 bp, chicken (Gallus Gallus)
  misc_feature (36): n=c or t
acttccaggtcattgccacccagatccaactgctcnaacttgacaaggaatgagagcgaactgcaaaatac

SEQ ID NO: 37567 - DNA, 71 bp, chicken (Gallus Gallus)
  misc_feature (36): n=c or t
ttgtagaaagaagtgaagtttcgacagtatacaccnagaaatgaagataaactatggttaacttaatatta

SEQ ID NO: 37568 - DNA, 71 bp, chicken (Gallus Gallus)
  misc_feature (36): n=c or t
tgcttctactggcaatactattgcaagcagaaaggnggttttatttagcaagtgaagatgaggacatgctg

SEQ ID NO: 37569 - DNA, 71 bp, chicken (Gallus Gallus)
  misc_feature (36): n=a or g
gaaaccagtatcctgactaactactaattactgagncactcatttagttctatttttaaagtagtgataat

SEQ ID NO: 37570 - DNA, 71 bp, chicken (Gallus Gallus)
  misc_feature (36): n=c or t
ctggaatacaaagagtaatcatgctctaactgtaanagtcactgccaggaaacatggcaatttttactttt

SEQ ID NO: 37571 - DNA, 71 bp, chicken (Gallus Gallus)
  misc_feature (36): n=g or t
aaataagagatttggataggaaggaccaagttttantttcccaacccggattctgatgacactttttgatc

SEQ ID NO: 37572 - DNA, 71 bp, chicken (Gallus Gallus)
  misc_feature (36): n=c or t
tctgcaagaggactgccttaaagtgctacaagcacnctttgttcagtgaaaggacaaagtatgagcacaat

SEQ ID NO: 37573 - DNA, 71 bp, chicken (Gallus Gallus)
  misc_feature (36): n=a or g
tcaacatcaaaaccagcatcaggatttggctcttcngacctgcggcaaattaccattacctgcagcaaatt

SEQ ID NO: 37574 - DNA, 71 bp, chicken (Gallus Gallus)
  misc_feature (36): n=c or t
atgtggcatggaatattttaccatctctgtcccctnggattatggaaaaagcgttttcaaactgcagtttt

SEQ ID NO: 37575 - DNA, 71 bp, chicken (Gallus Gallus)
  misc_feature (36): n=c or t
tgtgaggagttgtaccttggagttctgcaagatagnttgagatcttgcattttagtggctcattgaaagga

SEQ ID NO: 37576 - DNA, 71 bp, chicken (Gallus Gallus)
  misc_feature (36): n=g or t
atggaggaatgttccttttgcctggctttgtgccantgccattggagctgcagtgcatctcgtttcagcct

SEQ ID NO: 37577 - DNA, 71 bp, chicken (Gallus Gallus)
  misc_feature (36): n=a or g
agtaccaaagagagctgaatagaaggagtaaggtgnggggatttaaaacttctaccgttttttgtttattt

SEQ ID NO: 37578 - DNA, 71 bp, chicken (Gallus Gallus)
  misc_feature (36): n=a or g
gagatccctgctgcctcacactcccctgcctcaacntgtgtgagaaacccagccaaacccacagcagagca

SEQ ID NO: 37579 - DNA, 71 bp, chicken (Gallus Gallus)
  misc_feature (36): n=a or g
cctcactctaagacttttgatacattgccatccttngaagtatctttcagctttgtgtgcacatatacctg

SEQ ID NO: 37580 - DNA, 71 bp, chicken (Gallus Gallus)
  misc_feature (36): n=a or g
tgcttggaataggagtgggttcagactcatcaaaancctcatccctgtcatcatgcctactgtactttagt

SEQ ID NO: 37581 - DNA, 71 bp, chicken (Gallus Gallus)
  misc_feature (36): n=c or t
catttgacagatgtggcactaggcatcaggggtggntgttgcgaagaggtgagatcattagagttttccac

SEQ ID NO: 37582 - DNA, 71 bp, chicken (Gallus Gallus)
  misc_feature (36): n=c or t
atttggtgttctacttctacagcagttgcaaagaantttcattgcaggaaaactttccatttaagctagag

SEQ ID NO: 37583 - DNA, 71 bp, chicken (Gallus Gallus)
  misc_feature (36): n=a or c
ctgcatgatattgatgtctaaacttaagaaaagatnttttctgtacctgcagtaaattataattaataatg

SEQ ID NO: 37584 - DNA, 71 bp, chicken (Gallus Gallus)
  misc_feature (36): n=c or t
tagtagcatgctgtgcacagcaaaacctgttcaacntcctaccaaagctgctgtgtttgaatttagccaac

SEQ ID NO: 37585 - DNA, 71 bp, chicken (Gallus Gallus)
  misc_feature (36): n=c or t
tctattgtttccttttgacatacagttattttcagnaagtggcactattttcagggcctgctctgatagaa

SEQ ID NO: 37586 - DNA, 71 bp, chicken (Gallus Gallus)
  misc_feature (36): n=c or t
tcctgaacatggagaggtcttttaatgactaattangtacatatgtaaattacatgtgacacacagaatga

SEQ ID NO: 37587 - DNA, 71 bp, chicken (Gallus Gallus)
  misc_feature (36): n=c or t
actgatcagccagttcagtgcttattgttatttccnttcccctacttttcaatctctaggcttttactgca

SEQ ID NO: 37588 - DNA, 71 bp, chicken (Gallus Gallus)
  misc_feature (36): n=g or t
aaatgcttaccaaaggtatgggtaaaacacctgctncaggtacaggggtatggggctgtccccttctcagc

SEQ ID NO: 37589 - DNA, 71 bp, chicken (Gallus Gallus)
  misc_feature (36): n=c or t
caaaaatctcttaagtgcagcaatggatctcatggnatttggtatcctgctagtgtctgtctgggcaatat

SEQ ID NO: 37590 - DNA, 71 bp, chicken (Gallus Gallus)
  misc_feature (36): n=c or t
ggttccagagaagttacaaaaagagcagctaaaaanctagtttagacttttttaatactctcgctgacatc

SEQ ID NO: 37591 - DNA, 71 bp, chicken (Gallus Gallus)
  misc_feature (36): n=a or g
tacagaaagctgaaagaagtgcataagggaaggatngagggaaccatcaccgaattaacatccttgctgtc

SEQ ID NO: 37592 - DNA, 71 bp, chicken (Gallus Gallus)
  misc_feature (36): n=c or t
gataacaagacaaggcatagatcttcaccaccaatngcattccattactgggtttcagcaattttttctag

SEQ ID NO: 37593 - DNA, 71 bp, chicken (Gallus Gallus)
  misc_feature (36): n=c or t
accatctccccaccttataagattctataccacatntgctgcactgtttttaactctgtcctctcccatac

SEQ ID NO: 37594 - DNA, 71 bp, chicken (Gallus Gallus)
  misc_feature (36): n=c or t
agttcctccaagcctcagttgacaaagctacttaanaacatttctgatttcagtgtattagggcaattcca

SEQ ID NO: 37595 - DNA, 71 bp, chicken (Gallus Gallus)
  misc_feature (36): n=c or t
tagctggggagcagttgaattcagtactttgctaanaacacatgcattgatctcttacacccttatcaata

SEQ ID NO: 37596 - DNA, 71 bp, chicken (Gallus Gallus)
  misc_feature (36): n=a or g
tttctttgcctttcttgaatgaaaataacacttttntttttgacaattttagccctttgctttggaggtgg

SEQ ID NO: 37597 - DNA, 71 bp, chicken (Gallus Gallus)
  misc_feature (36): n=c or t
ggggcaaatgggcaagagagatggtgtagatgtgcntggattgactgctgtcattctgggtaccaaaatgg

SEQ ID NO: 37598 - DNA, 71 bp, chicken (Gallus Gallus)
  misc_feature (36): n=c or t
ccacctgagaggaagcgaacaaatcacaagaccctngtgtttaatggtgattattgcaggtttagaaagca

SEQ ID NO: 37599 - DNA, 71 bp, chicken (Gallus Gallus)
  misc_feature (36): n=c or t
atttttgttacagatcatactcaactggcaaaacantgctcaaaaggaaagatttactttcttcagctgtt

SEQ ID NO: 37600 - DNA, 71 bp, chicken (Gallus Gallus)
  misc_feature (36): n=c or t
gaaataccatattatcctactctgttattcagatanacaacctgaaatcaggcctaggtgctccaggtaca

SEQ ID NO: 37601 - DNA, 71 bp, chicken (Gallus Gallus)
  misc_feature (36): n=a or g
catcaccttttagccgctcaaactcccagagcagcngagtttccacataccccgctccttgactctgactg

SEQ ID NO: 37602 - DNA, 71 bp, chicken (Gallus Gallus)
  misc_feature (36): n=a or g
gtattctacgttgtttcaaaacctaccttctgttanttttatggcttagaaatttgcacagaattctgctg

SEQ ID NO: 37603 - DNA, 71 bp, chicken (Gallus Gallus)
  misc_feature (36): n=a or g
tcttgcatgcatcccaagatcaaaaatgggtctccntattacatggctgaacaagtgagacgatctctgag

SEQ ID NO: 37604 - DNA, 71 bp, chicken (Gallus Gallus)
  misc_feature (36): n=c or t
gctatagggagaatatagagcatcctatatatgtgngtgtatatgaaaattccacactggctaggagttag

SEQ ID NO: 37605 - DNA, 71 bp, chicken (Gallus Gallus)
  misc_feature (36): n=a or g
gcacacggtgctcatccgcagagctccgagcaactnttctgaaactatcaggacacagaaagtccaagcaa

SEQ ID NO: 37606 - DNA, 71 bp, chicken (Gallus Gallus)
  misc_feature (36): n=a or g
agcatagactgatactatacataggttttcagctcngctatcatgaaaatcctcaattacagagtgggaaa

SEQ ID NO: 37607 - DNA, 71 bp, chicken (Gallus Gallus)
  misc_feature (36): n=c or t
agagtctgtagaagaaaggtaagtgcagctggctcngagaaggtttgaagatctttgtatgagatatgtta

SEQ ID NO: 37608 - DNA, 71 bp, chicken (Gallus Gallus)
  misc_feature (36): n=a or c
ggtacgcgtacatggatacataaagctacgatatangtcatcagttaaaacgtggtgcgagtacatgtatg

SEQ ID NO: 37609 - DNA, 71 bp, chicken (Gallus Gallus)
  misc_feature (36): n=c or t
agcctgtctttcagatctcaaatgaagaacagtatncacactgtgttgaaatgtattcttcttcctggaag

SEQ ID NO: 37610 - DNA, 71 bp, chicken (Gallus Gallus)
  misc_feature (36): n=a or g
cctcacactgccaggagaatctgtgcagaagcacancatgggtataaatgatggcacgagtccatttactc

SEQ ID NO: 37611 - DNA, 71 bp, chicken (Gallus Gallus)
  misc_feature (36): n=g or t
taatgctaccatgaaatcagacccagcagaattacngtggatttgagttcacttacatatttatttatatt

SEQ ID NO: 37612 - DNA, 71 bp, chicken (Gallus Gallus)
  misc_feature (36): n=a or g
gtgactttcaagcctttgggctacattgtgaagtanaagactgattttataggggttctgctgaaaaactg

SEQ ID NO: 37613 - DNA, 71 bp, chicken (Gallus Gallus)
  misc_feature (36): n=a or g
tggttcttattctgataccataactagtttgggagngggggaagcagattaccatagtgtctgcaggagtg

SEQ ID NO: 37614 - DNA, 71 bp, chicken (Gallus Gallus)
  misc_feature (36): n=c or t
tggaggctggggagaaatgtgatgtgttcactcctnataggtgttccctgagatacttatttacagtcact

SEQ ID NO: 37615 - DNA, 71 bp, chicken (Gallus Gallus)
  misc_feature (36): n=a or g
cttgtaaatgagtatgcacgtgtatacagggagtgnttacacaaacatcagaacagactttaaatgggaga

SEQ ID NO: 37616 - DNA, 71 bp, chicken (Gallus Gallus)
  misc_feature (36): n=g or t
taactttatgttttacttcataaaaggagattcacntgttctttcaccagttccattcagctccttcagca

SEQ ID NO: 37617 - DNA, 71 bp, chicken (Gallus Gallus)
  misc_feature (36): n=c or t
actgaattgctttgaaccccattgtcgtcccgttanaatctgataggcttttgttcatcccagattctttt

SEQ ID NO: 37618 - DNA, 71 bp, chicken (Gallus Gallus)
  misc_feature (36): n=a or g
ctgtgacgccaatattttcagttcatataaccacanttacagtctggagggtcgctgtaaataaatggggc

SEQ ID NO: 37619 - DNA, 71 bp, chicken (Gallus Gallus)
  misc_feature (36): n=a or g
ggagtcctaatccagggaagcaggaccatgcaacanagcatctagatgtgactacaggatgttagtcacct

SEQ ID NO: 37620 - DNA, 71 bp, chicken (Gallus Gallus)
  misc_feature (36): n=a or g
cgcacacagagcccagaagcaaatggccccagagcnctactaggataatttcactgatttaggtaatcaaa

SEQ ID NO: 37621 - DNA, 71 bp, chicken (Gallus Gallus)
  misc_feature (36): n=a or g
cctacccaacacaaatatctaaagacattttgcaangctgccttgagttgtctgtcagtaattttccttcg

SEQ ID NO: 37622 - DNA, 71 bp, chicken (Gallus Gallus)
  misc_feature (36): n=c or t
ctggagttatgaccccagatttgcaatttctgatgngttattacgttttctaatgtactgtattagcctgt

SEQ ID NO: 37623 - DNA, 71 bp, chicken (Gallus Gallus)
  misc_feature (36): n=a or g
cactgtatttctaattccatgttacatttatacatntttttggattgcattcttcactttgattgtgaact

SEQ ID NO: 37624 - DNA, 71 bp, chicken (Gallus Gallus)
  misc_feature (36): n=a or g
agtattgaaacaacaccggaaacgtcatcaaaaggncacccatagaagtgaatatatctggaagactttgc

SEQ ID NO: 37625 - DNA, 71 bp, chicken (Gallus Gallus)
  misc_feature (36): n=a or g
aatcaaaaagtcaaaaagtggaaaatatgaatgaanatagtccccatcaccttcccttgtcttcacttatt

SEQ ID NO: 37626 - DNA, 71 bp, chicken (Gallus Gallus)
  misc_feature (36): n=a or g
tatgctagaaattacaaattcaaaacattgttagantggattttttttcatactgttggcctagaagtaga

SEQ ID NO: 37627 - DNA, 71 bp, chicken (Gallus Gallus)
  misc_feature (36): n=c or t
agtccccctggggacggtaaacatcatttttatcangttggaactacaggctctgtcagcccagtgaagtt

SEQ ID NO: 37628 - DNA, 71 bp, chicken (Gallus Gallus)
  misc_feature (36): n=a or c
gcatatcagcaaagccagtcccaaggatatggatanatgcaccagaccagtatgtcgtctatgaggtcagt

SEQ ID NO: 37629 - DNA, 71 bp, chicken (Gallus Gallus)
  misc_feature (36): n=a or g
tgcttcttttgtgaatccatcccctcctacctctcngggagccttgtggaaaggtcatcgccgtggtccct

SEQ ID NO: 37630 - DNA, 71 bp, chicken (Gallus Gallus)
  misc_feature (36): n=a or g
gtgatttaaaaccaggaatgtgagcctgtaaatgtncagtctgtatggcttacactactgtcatttaaagt

SEQ ID NO: 37631 - DNA, 71 bp, chicken (Gallus Gallus)
  misc_feature (36): n=a or g
cctcgtttcctcctctctcagaaggttaagcccaangatcatatacaatgcagctgaccttctgcatgaca

SEQ ID NO: 37632 - DNA, 71 bp, chicken (Gallus Gallus)
  misc_feature (36): n=c or t
actgtcacattaagtgtcaaaggagattcttcactnggggtactttaattttaatataaaagagatatgca

SEQ ID NO: 37633 - DNA, 71 bp, chicken (Gallus Gallus)
  misc_feature (36): n=c or t
tgtgactatcacccatcatttactttgtaagcctcnacatcttttcaaatttaccccaattcatgatgctg

SEQ ID NO: 37634 - DNA, 71 bp, chicken (Gallus Gallus)
  misc_feature (36): n=c or t
ctatactccttcaaggagtatgagcaggaggggaantgtgttaagaagatgctaaggctatcccaacaaca

SEQ ID NO: 37635 - DNA, 71 bp, chicken (Gallus Gallus)
  misc_feature (36): n=a or g
tgaaatattcagtaaatcaatacagcgtaatttcantgtccagaaatgcttatctgtgtgtctatttgtca

SEQ ID NO: 37636 - DNA, 71 bp, chicken (Gallus Gallus)
  misc_feature (36): n=c or t
ctgtgaccaaagatcccacactacaatatttcacanacatgaagggctgttgagcacagtacagatttaga

SEQ ID NO: 37637 - DNA, 71 bp, chicken (Gallus Gallus)
  misc_feature (36): n=c or t
ttcagggagctaaaacaattctaaaaagcacgtacngaccacattgcaggaggcgttaggttttgttaaaa

SEQ ID NO: 37638 - DNA, 71 bp, chicken (Gallus Gallus)
  misc_feature (36): n=c or t
aaactagtattgtagttgagatgcttgaacttcaangatgaaaacatttccctcactcagcttcttaacta

SEQ ID NO: 37639 - DNA, 71 bp, chicken (Gallus Gallus)
  misc_feature (36): n=c or t
tgttttaattactggtatgttaagtgctttgagggnagaaaatgagtggtgatctttctgatcagaattct

SEQ ID NO: 37640 - DNA, 71 bp, chicken (Gallus Gallus)
  misc_feature (36): n=c or t
ttccttccaagagaaaccaggtcaatcgtgtcttangtcatgctgcagagattgtctaccaacagaaaaaa

SEQ ID NO: 37641 - DNA, 71 bp, chicken (Gallus Gallus)
  misc_feature (36): n=c or t
ttgagcttctgggcctcttttctccccaggtaatcntcccttatgtatttcttccagccacgttccatacg

SEQ ID NO: 37642 - DNA, 71 bp, chicken (Gallus Gallus)
  misc_feature (36): n=a or g
ttctgtcctaatctgtcactgtatgccaacagtacnaagttataagcagaggtcttaacaagtcctaaagc

SEQ ID NO: 37643 - DNA, 71 bp, chicken (Gallus Gallus)
  misc_feature (36): n=a or c
attgttcatcctggtaagagaataacaaaactaacnactttcattttaggaaattccagacttgttcattg

SEQ ID NO: 37644 - DNA, 71 bp, chicken (Gallus Gallus)
  misc_feature (36): n=c or t
ttctgttgcttgtactttgacaataggagatcacantgagaagtgcaccaatgaaaaaaaacaattgtaat

SEQ ID NO: 37645 - DNA, 71 bp, chicken (Gallus Gallus)
  misc_feature (36): n=c or t
gttgaaacaattataatctactatgtgctcctcatnaaagacaaaagagtacagattttatgaacaactgt

SEQ ID NO: 37646 - DNA, 71 bp, chicken (Gallus Gallus)
  misc_feature (36): n=c or t
gaaagccaacttcagacataaagaagaataccagantaaataccgacttttgaagatgtgttaaactgctt

SEQ ID NO: 37647 - DNA, 71 bp, chicken (Gallus Gallus)
  misc_feature (36): n=c or t
atataaaactacaggaggaagaaagatataaaaggnagattagatatatttctccgttcacttcacctgtc

SEQ ID NO: 37648 - DNA, 71 bp, chicken (Gallus Gallus)
  misc_feature (36): n=c or t
atccacctatttatctcgggaggaattgctatcctnacatttcatagtttcaaccaacaataagtctattt

SEQ ID NO: 37649 - DNA, 71 bp, chicken (Gallus Gallus)
  misc_feature (36): n=a or g
ctctttaactggaacttcatgttatcactgctttgnttgtttaatctcatggtttataacctttttctttt

SEQ ID NO: 37650 - DNA, 71 bp, chicken (Gallus Gallus)
  misc_feature (36): n=c or t
caaattcaagaaaagcatacggtctggaagctaaantgatgctcgttgtgtcataggaagcagcaaatgcc

SEQ ID NO: 37651 - DNA, 71 bp, chicken (Gallus Gallus)
  misc_feature (36): n=a or g
tttctacataactattagagatctgagttaatcccntcatggggaggatgtctaaaacatcccaaatcttg

SEQ ID NO: 37652 - DNA, 71 bp, chicken (Gallus Gallus)
  misc_feature (36): n=c or t
gcagatttagagtgttgcaagattgcttgttcctgntaatacaagcaagaagtatcctgtgcaaaatgaac

SEQ ID NO: 37653 - DNA, 71 bp, chicken (Gallus Gallus)
  misc_feature (36): n=a or g
tacacttgaagatatgtaaaagttaggacaggtcanaatcacagtttcttgcacacaattaatttttcctc

SEQ ID NO: 37654 - DNA, 71 bp, chicken (Gallus Gallus)
  misc_feature (36): n=c or t
ttaaccagcaccaccaaaacagttgttttgcttgangtttgttttcccaagtttctaggcctctgttaagc

SEQ ID NO: 37655 - DNA, 71 bp, chicken (Gallus Gallus)
  misc_feature (36): n=c or t
ggcggccttcaaatgaaatcactatgagtaaatcanacttccaaatgcatcttctatcattctctggaacc

SEQ ID NO: 37656 - DNA, 71 bp, chicken (Gallus Gallus)
  misc_feature (36): n=a or c
agttcctaaataaaagcatcaaatgtatcaaatganaacatcattttgttacagaagaagtaggtatttcc

SEQ ID NO: 37657 - DNA, 71 bp, chicken (Gallus Gallus)
  misc_feature (36): n=c or t
atccctcagtctcttgacgttttgtccagggagtanttccctgatctcagaaacagctatcattttaatcc

SEQ ID NO: 37658 - DNA, 71 bp, chicken (Gallus Gallus)
  misc_feature (36): n=c or t
gtaagggtgagactaatgaaaagttttgccagaagnttttgcagaattctaaggaataacaggagaagatc

SEQ ID NO: 37659 - DNA, 71 bp, chicken (Gallus Gallus)
  misc_feature (36): n=c or t
gaggaagaaaggaaagtcaagggggatttaagtgtntgcttttatgtggaaatcaagcagagaaaagtgaa

SEQ ID NO: 37660 - DNA, 71 bp, chicken (Gallus Gallus)
  misc_feature (36): n=a or c
cgtgtggtgaaatgctctgtttcttcctgccaaatntgtgcacaaactattctctctagagatgtttctca

SEQ ID NO: 37661 - DNA, 71 bp, chicken (Gallus Gallus)
  misc_feature (36): n=g or t
acctgacacaaattgcttaaagaagtgattcagagnatctgactgcttgctgctttatgtctctgacctta

SEQ ID NO: 37662 - DNA, 71 bp, chicken (Gallus Gallus)
  misc_feature (36): n=c or t
aatcactttcaatattacaagagatttttcttctcngaagtatttctctcctttctatgtggcacatggac

SEQ ID NO: 37663 - DNA, 71 bp, chicken (Gallus Gallus)
  misc_feature (36): n=c or t
tatggactatataaagctgtgggcttaccaacaccnttcatttgtaaatcaaagcagttaaaggcctccat

SEQ ID NO: 37664 - DNA, 71 bp, chicken (Gallus Gallus)
  misc_feature (36): n=a or g
aatgaggagtttggtttcagcttccctttggaagtngtttaagttgcctaactccttctcttgcatctaga

SEQ ID NO: 37665 - DNA, 71 bp, chicken (Gallus Gallus)
  misc_feature (36): n=a or g
ttctgttccactttgtttgtactgaagtaatgcctntgtatactaatcataccttactgtacttctaatat

SEQ ID NO: 37666 - DNA, 71 bp, chicken (Gallus Gallus)
  misc_feature (36): n=a or g
ctaaggaagtcaacatagctgaaaagcatcaggatnggcatgtgagagagagttcagatttctctgcctct

SEQ ID NO: 37667 - DNA, 71 bp, chicken (Gallus Gallus)
  misc_feature (36): n=c or t
ttttggttcagatagtttaaccacacgttctgctgnatgactgggggtagggggaggtctagaaaactcat

SEQ ID NO: 37668 - DNA, 71 bp, chicken (Gallus Gallus)
  misc_feature (36): n=c or t
tttcaataactaaatgaaccacagtgagccactatnggtgtctgcaaatatgtatttctcattaatttcta

SEQ ID NO: 37669 - DNA, 71 bp, chicken (Gallus Gallus)
  misc_feature (36): n=a or g
aaatgtaagtgttgcacaaaaagaggatcaggcccntaaactgtccatgccctctcctctgaggacattag

SEQ ID NO: 37670 - DNA, 71 bp, chicken (Gallus Gallus)
  misc_feature (36): n=a or g
ggtcagtgttgagccccgaggcacgctcattggtgncatggtgctaccacacgtcttcttgggatgatgtc

SEQ ID NO: 37671 - DNA, 71 bp, chicken (Gallus Gallus)
  misc_feature (36): n=a or g
ttcagtcattgctgcaagaattaaacatcctctccntgttttagctttcagagcactgaacagcatgaata

SEQ ID NO: 37672 - DNA, 71 bp, chicken (Gallus Gallus)
  misc_feature (36): n=a or g
gttctactgtcacagtgttctgaaaaatcaccatgnactaaatgcattactacatcaaaatatgtgttccg

SEQ ID NO: 37673 - DNA, 71 bp, chicken (Gallus Gallus)
  misc_feature (36): n=c or t
cttcccggtggcatgcagcaaagcaggtgtccccantgaaagccatcatctggccttgttagctgccctct

SEQ ID NO: 37674 - DNA, 71 bp, chicken (Gallus Gallus)
  misc_feature (36): n=a or g
gactcaatcaagtggtggttgacagtgaaacgatcngggctttgaatccttgggtaccctctgaaaaaatc

SEQ ID NO: 37675 - DNA, 71 bp, chicken (Gallus Gallus)
  misc_feature (36): n=a or g
aaccagcagctcctgcgctccgagctggggcacacngctggcaggcacctctaacaggtctgccttcatct

SEQ ID NO: 37676 - DNA, 71 bp, chicken (Gallus Gallus)
  misc_feature (36): n=c or t
cagggcagcactgtagtgtcacacaggcaaattggntgttaacggataaaggcattaagtgtatttttagt

SEQ ID NO: 37677 - DNA, 71 bp, chicken (Gallus Gallus)
  misc_feature (36): n=a or g
catatctataagtcttgttaagaaacttttctgaangcaacgtgctggtaatttcccttcttttacaacaa

SEQ ID NO: 37678 - DNA, 71 bp, chicken (Gallus Gallus)
  misc_feature (36): n=g or t
taagatgaatcatcctgtactggagcatggtgtgtncagctttgttagctgttaagcaaagcagaattgtt

SEQ ID NO: 37679 - DNA, 71 bp, chicken (Gallus Gallus)
  misc_feature (36): n=a or c
gcaattgctgctctgttatcaaatcccatatctagntgtcataagcaaacttaccaaattccagtgtaaaa

SEQ ID NO: 37680 - DNA, 71 bp, chicken (Gallus Gallus)
  misc_feature (36): n=a or g
cagaagcactcaagctggcaggaaattgtcattcancccaggctctgtcttactggagggcctttacacat

SEQ ID NO: 37681 - DNA, 71 bp, chicken (Gallus Gallus)
  misc_feature (36): n=a or g
gtgtgacagcacaggcagagttcatgcatgcatggntaccagacaaaaaactataggaaatgggcccacag

SEQ ID NO: 37682 - DNA, 71 bp, chicken (Gallus Gallus)
  misc_feature (36): n=c or t
gcagtgcagtctaatttcttagtccagaacatcagntttatatcttctgcaacatcaaaaacacatccaac

SEQ ID NO: 37683 - DNA, 71 bp, chicken (Gallus Gallus)
  misc_feature (36): n=a or g
aatttgcattctctcttcacttcttgttgagtttancatggatacagaaaccaagcataagagagcagggg

SEQ ID NO: 37684 - DNA, 71 bp, chicken (Gallus Gallus)
  misc_feature (36): n=a or c
aagaagtagcacttcatctggaacaaaaattgtaantgcatacagtttaagcatatacaaacttctgtaac

SEQ ID NO: 37685 - DNA, 71 bp, chicken (Gallus Gallus)
  misc_feature (36): n=c or t
caacttctggatattaaggccactagcacatacagngctcagcccaggagatcggcctgatgaccatcaat

SEQ ID NO: 37686 - DNA, 71 bp, chicken (Gallus Gallus)
  misc_feature (36): n=c or t
aatgaaggatcaataatgtcagaaatgaggcaaaanttgcagggattatacggtccaccaggggaatactg

SEQ ID NO: 37687 - DNA, 71 bp, chicken (Gallus Gallus)
  misc_feature (36): n=a or g
actgaaagcacaaagggaagctctgcctgtatgacnactgccacgattcccttcagatcatttaaatcaga

SEQ ID NO: 37688 - DNA, 71 bp, chicken (Gallus Gallus)
  misc_feature (36): n=a or g
ttattcccgaatgtgcatattgtgaataaaagcctnggaattgcagtttttgaacttttgagtgacaggta

SEQ ID NO: 37689 - DNA, 71 bp, chicken (Gallus Gallus)
  misc_feature (36): n=a or c
ttgacttcatggtaagactgagcttgtattcttcangagtctccacttcactgcctctgcactacctaata

SEQ ID NO: 37690 - DNA, 71 bp, chicken (Gallus Gallus)
  misc_feature (36): n=a or g
caaaaaagtgtccgcacttgcaaaaatgtttgaagnaaggagagaaaaagctgttgagtttttctggtgtt

SEQ ID NO: 37691 - DNA, 71 bp, chicken (Gallus Gallus)
  misc_feature (36): n=a or g
aaatacctcaaaagaagaggttgttagtcaactcantagcttggaatgtatacagtaagtacagtgaagca

SEQ ID NO: 37692 - DNA, 71 bp, chicken (Gallus Gallus)
  misc_feature (36): n=c or t
acttgatgtaaatccatgcttagggcagcaatttgngaggatctggccaaaactctgccatataacagttt

SEQ ID NO: 37693 - DNA, 71 bp, chicken (Gallus Gallus)
  misc_feature (36): n=a or g
ttttatattgacaaatgggcataggttaaaacccangggtagtggtttttaaaaagacactctttatgaga

SEQ ID NO: 37694 - DNA, 71 bp, chicken (Gallus Gallus)
  misc_feature (36): n=c or t
cacagttactgttggtcttcttggtatgcacccttncatgaaactgaacacctttgcctgtattattattt

SEQ ID NO: 37695 - DNA, 71 bp, chicken (Gallus Gallus)
  misc_feature (36): n=c or t
aaagtctaagtgagtaatattctgtgtttgaatgangtagtcctcaaaaatatgaattttttgtccttcat

SEQ ID NO: 37696 - DNA, 71 bp, chicken (Gallus Gallus)
  misc_feature (36): n=c or t
gcacagcaaaaccattgctgttagaggttgtatcancagtttgtgtgtgtggtattctgtaatttttatat

SEQ ID NO: 37697 - DNA, 71 bp, chicken (Gallus Gallus)
  misc_feature (36): n=a or g
atggttgcagttttgtgacaagaacagctatacctncagacttgatcagggtacagtactgcaaattgaat

SEQ ID NO: 37698 - DNA, 71 bp, chicken (Gallus Gallus)
  misc_feature (36): n=g or t
tggacagaaggccaagaagaagacatttatgaggtngaatctcgtgtgcctttgccatatccttttccttt

SEQ ID NO: 37699 - DNA, 71 bp, chicken (Gallus Gallus)
  misc_feature (36): n=c or t
aagctataaaacatgaagattgaaggattttgttanagagcttgacattccacttgatgaagcgaataaga

SEQ ID NO: 37700 - DNA, 71 bp, chicken (Gallus Gallus)
  misc_feature (36): n=a or g
ccataaatgaatgttaaaagaggtctctgagtgtcncaggctggaaacaaaatcctttacagtgcacagca

SEQ ID NO: 37701 - DNA, 71 bp, chicken (Gallus Gallus)
  misc_feature (36): n=c or t
tagtagcaaccacagtgtttgttcttctttggatgngctttaaacgagtttcaaatatattgttatgtttt

SEQ ID NO: 37702 - DNA, 71 bp, chicken (Gallus Gallus)
  misc_feature (36): n=a or g
tgggtgaggcaaatagcaagctgcacttacctgccngaatcgggaaatattcagcttagctgctgaagcac

SEQ ID NO: 37703 - DNA, 71 bp, chicken (Gallus Gallus)
  misc_feature (36): n=c or t
cactcagggctatgggtctaaaatgacttgtgcaantttcttcagactctgtagcatatttctcctcagct

SEQ ID NO: 37704 - DNA, 71 bp, chicken (Gallus Gallus)
  misc_feature (36): n=a or g
tcataaaaagctgcagtctgactccaaatacacacntaatttcacctgatatcactgggagctctgggtgg

SEQ ID NO: 37705 - DNA, 71 bp, chicken (Gallus Gallus)
  misc_feature (36): n=a or c
cataaactctagagaggatgaattccaaggacagcntttgggatgagatttgtttttttggaacgcatatc

SEQ ID NO: 37706 - DNA, 71 bp, chicken (Gallus Gallus)
  misc_feature (36): n=g or t
ctgccgctgggagaaacttgctgcgactcaactgtnctttgtgtgagggcaagtccttccactgctcactg

SEQ ID NO: 37707 - DNA, 71 bp, chicken (Gallus Gallus)
  misc_feature (36): n=c or t
aattatctcattctgtgcatctggatcccatgcgcnttccttcctttccttaggacattgctcaaccagga

SEQ ID NO: 37708 - DNA, 71 bp, chicken (Gallus Gallus)
  misc_feature (36): n=c or t
aagtgttggtcatgcttttgcaacatagaacttatnacctgcctgaaactggagctctaatttagagcatg

SEQ ID NO: 37709 - DNA, 71 bp, chicken (Gallus Gallus)
  misc_feature (36): n=a or g
aactcttgagttcctaaacagcttcatgcaggcagnctgaaaaccagagatcttaagaggatgatatatgt

SEQ ID NO: 37710 - DNA, 71 bp, chicken (Gallus Gallus)
  misc_feature (36): n=a or g
atacttgcactgaaactttcttaaatgaagctacanttagcatcactagctaaaatatacactgaagccaa

SEQ ID NO: 37711 - DNA, 71 bp, chicken (Gallus Gallus)
  misc_feature (36): n=a or g
tgagaaaccaagtgctagctcatcactctgttcagngaggcattctgacagaggagctgtgttggtacaat

SEQ ID NO: 37712 - DNA, 71 bp, chicken (Gallus Gallus)
  misc_feature (36): n=c or t
gttgaaatgcatgaatgatactccccatttggtggngtttgaggtagactccctcagttgaactgtgatta

SEQ ID NO: 37713 - DNA, 71 bp, chicken (Gallus Gallus)
  misc_feature (36): n=c or t
ttcagtccagcagcagaatgcagtcactactgacanctgtcagtataatggtccttccaaattagcactgt

SEQ ID NO: 37714 - DNA, 71 bp, chicken (Gallus Gallus)
  misc_feature (36): n=c or t
cttcttctccccagttgtaagcaacttttcacatantggctaaatatagattatatacccattcaatttcc

SEQ ID NO: 37715 - DNA, 71 bp, chicken (Gallus Gallus)
  misc_feature (36): n=c or t
ttggtttcctcttcatcagaaaaagttagcgaatcntcttcctttatccatgctacagcagcattacgagc

SEQ ID NO: 37716 - DNA, 71 bp, chicken (Gallus Gallus)
  misc_feature (36): n=c or t
tttggtgcaaaggttaaactgttaaagaagaatagncttgccaaggatgcaagtttgtggctacctgaaaa

SEQ ID NO: 37717 - DNA, 71 bp, chicken (Gallus Gallus)
  misc_feature (36): n=c or t
gagagtgttttagtctgggcagcactgaatgcacanggcaacaaacaggaagcttctttttgaattacctg

SEQ ID NO: 37718 - DNA, 71 bp, chicken (Gallus Gallus)
  misc_feature (36): n=a or c
cataattatataatacagagtaatacatcttttttntttattgattctatattagtaaagcattaaattga

SEQ ID NO: 37719 - DNA, 71 bp, chicken (Gallus Gallus)
  misc_feature (36): n=c or t
aacatcatgcacgagcaggtgaaaagtagaagcatngtagggactactctgtccaaaattcacatatacct

SEQ ID NO: 37720 - DNA, 71 bp, chicken (Gallus Gallus)
  misc_feature (36): n=a or g
gcttgagagaactttgtgtgcactaaactctagctngtaaaattacagtaagttaaaccaaagccctgatc

SEQ ID NO: 37721 - DNA, 71 bp, chicken (Gallus Gallus)
  misc_feature (36): n=a or g
cgatccaagaagtattgaatgttttgattggtgacnggatctactttaaacatatctttgtattcaattac

SEQ ID NO: 37722 - DNA, 71 bp, chicken (Gallus Gallus)
  misc_feature (36): n=a or g
actcaagtgtgaactcacagctattcaaatactganttcccataatatactctgcagaagatattcacaca

SEQ ID NO: 37723 - DNA, 71 bp, chicken (Gallus Gallus)
  misc_feature (36): n=a or g
actcagatcttacatggaatggtagtttgaatagancaatcatcagctccatgatgtattgtccatggaaa

SEQ ID NO: 37724 - DNA, 71 bp, chicken (Gallus Gallus)
  misc_feature (36): n=g or t
tggaaggtttactctgggagaagtaagggtaacttntcttgggactgagcttggggccattcctgagtggg

SEQ ID NO: 37725 - DNA, 71 bp, chicken (Gallus Gallus)
  misc_feature (36): n=a or g
ggatgaaatattagtttttaagaaaggtcgctctcnttttaattattgaggacaggatgctaagcaaaagg

SEQ ID NO: 37726 - DNA, 71 bp, chicken (Gallus Gallus)
  misc_feature (36): n=a or c
acctttgagtggttatgtctgaaaggcaggaaaaanagtgctatttcatggatgagcttctgcaggtaaca

SEQ ID NO: 37727 - DNA, 71 bp, chicken (Gallus Gallus)
  misc_feature (36): n=c or t
gtccacgtaaaaccatctctgcagtagttcataagncacaagagttacaccaaactggggggatgatcgaa

SEQ ID NO: 37728 - DNA, 71 bp, chicken (Gallus Gallus)
  misc_feature (36): n=g or t
cgtctaaggtccaaggtctagacagcagaacaaggngactgactgactcatgtacgcgcagaatgtctgaa

SEQ ID NO: 37729 - DNA, 71 bp, chicken (Gallus Gallus)
  misc_feature (36): n=a or g
aaagcagtggttggaaaggactgaaatgctcatacntgtttatcctgtttagcacagccgtgctcccatac

SEQ ID NO: 37730 - DNA, 71 bp, chicken (Gallus Gallus)
  misc_feature (36): n=a or g
tgctgacagatcagtaagccctagaaaagtccagancagggaaatgttacggatactccatgaaggaaaag

SEQ ID NO: 37731 - DNA, 71 bp, chicken (Gallus Gallus)
  misc_feature (36): n=a or g
taagtgttgaaaagacccccagatagtattgcctcngtatgtggatgattctggaagaattcctgtgctgc

SEQ ID NO: 37732 - DNA, 71 bp, chicken (Gallus Gallus)
  misc_feature (36): n=a or g
gaatatttgtaaccgtctttgggaagaatctttcantatggatttgtttaacataatgctcatctgctcaa

SEQ ID NO: 37733 - DNA, 71 bp, chicken (Gallus Gallus)
  misc_feature (36): n=c or t
atcacttctgctttagactcttagtgtgttgctatngggttccgatgggaataataaaagatctggaatag

SEQ ID NO: 37734 - DNA, 71 bp, chicken (Gallus Gallus)
  misc_feature (36): n=c or t
atagggagtggccctttcctggcagcaaacccacangtcatgctgcattgcattttggttaatgctctctt

SEQ ID NO: 37735 - DNA, 71 bp, chicken (Gallus Gallus)
  misc_feature (36): n=a or g
agtctcaaaaagacctatcaagaaataatcaaattncagtttatttgcagaatgaattcccttctaccatc

SEQ ID NO: 37736 - DNA, 71 bp, chicken (Gallus Gallus)
  misc_feature (36): n=c or t
tatgtgttaagtgttgtctgctatctttcttctccngcaccctcctttggttccagtggaacttttgaatc

SEQ ID NO: 37737 - DNA, 71 bp, chicken (Gallus Gallus)
  misc_feature (36): n=a or c
tggttttgatatttccattaaatcatttcaacaaanctggaaaattctgcttcacctttttggtgggtatg

SEQ ID NO: 37738 - DNA, 71 bp, chicken (Gallus Gallus)
  misc_feature (36): n=c or t
tgagcaaggccttgctgggacacgctgcatcacctngccttttaggagttattttcactcatacacagact

SEQ ID NO: 37739 - DNA, 71 bp, chicken (Gallus Gallus)
  misc_feature (36): n=c or t
gcagagagctgaggggtctggagagcctgaaagcanttcgtacagtggaaggaggagacgtgccagaggtg

SEQ ID NO: 37740 - DNA, 71 bp, chicken (Gallus Gallus)
  misc_feature (36): n=a or g
tgatctctctgtttcaccttttccctaaggttactnagcttgagaataggaattactttcaaatcaaatta

SEQ ID NO: 37741 - DNA, 71 bp, chicken (Gallus Gallus)
  misc_feature (36): n=a or g
ttcattccctaaatacatacggagatattatatacnacgtagatgcctgtaaggagcaaggtctttacatt

SEQ ID NO: 37742 - DNA, 71 bp, chicken (Gallus Gallus)
  misc_feature (36): n=a or g
ctcaccttgcctatttcctgcaactacaagaacacnactgtttatttggatgctttccctccaatgtgcat

SEQ ID NO: 37743 - DNA, 71 bp, chicken (Gallus Gallus)
  misc_feature (36): n=g or t
gttgcctgtagggaatgccagcctatgtaattattntgccttaatgactgagtcagattataatcttctca

SEQ ID NO: 37744 - DNA, 71 bp, chicken (Gallus Gallus)
  misc_feature (36): n=a or c
agcaataagtgtgcatgcagttagaataaactaagntatctcaaccaggtgcacagagaggcacattgttt

SEQ ID NO: 37745 - DNA, 71 bp, chicken (Gallus Gallus)
  misc_feature (36): n=g or t
cctaccaaacacttgaatgaattcaccaaaaagacnaaagaatgtgtaaaaaccttagattaaatacatgc

SEQ ID NO: 37746 - DNA, 71 bp, chicken (Gallus Gallus)
  misc_feature (36): n=g or t
aagattggattaggatggaatatgaaactttttttntgtgtgtaacacttctcagtccattaaaaaaaaat

SEQ ID NO: 37747 - DNA, 71 bp, chicken (Gallus Gallus)
  misc_feature (36): n=c or t
aggtggaaagaaagaagacaattaggaattataagnatacatgaattggcagtaaattaagtgagcttccc

SEQ ID NO: 37748 - DNA, 71 bp, chicken (Gallus Gallus)
  misc_feature (36): n=a or g
ttttggctcaagtaaggagaacaggtggcgcaaggngctatgtgttgtgaagttggtttcccaatgatctt

SEQ ID NO: 37749 - DNA, 71 bp, chicken (Gallus Gallus)
  misc_feature (36): n=c or t
accttttctcagccatcaatcaaaatgacagaatgntttagattaagtttagattctctgtcacaaattaa

SEQ ID NO: 37750 - DNA, 71 bp, chicken (Gallus Gallus)
  misc_feature (36): n=a or g
tattcttggtccttccatatgctagtcagccataanaaaacttcatccaatcttttctcagaacaattgat

SEQ ID NO: 37751 - DNA, 71 bp, chicken (Gallus Gallus)
  misc_feature (36): n=c or t
aaatcatcaaaatattcccctcccctatttccttanctgataatcattacaagtcattaacaatgctttga

SEQ ID NO: 37752 - DNA, 71 bp, chicken (Gallus Gallus)
  misc_feature (36): n=c or t
cttctgtggcatcacagaaagttaagagcaacatanaagtcattacataacagttaccttaaatctatgct

SEQ ID NO: 37753 - DNA, 71 bp, chicken (Gallus Gallus)
  misc_feature (36): n=c or t
aataaaaaaaattagattccaagagtcatttcccanaggtgtacacttgttcccattcatactgagctgta

SEQ ID NO: 37754 - DNA, 71 bp, chicken (Gallus Gallus)
  misc_feature (36): n=a or c
actttaaaaatagatggtctgcactgtcttgaagcntgacaaagcctggagctccctaggatacaagggac

SEQ ID NO: 37755 - DNA, 71 bp, chicken (Gallus Gallus)
  misc_feature (36): n=a or g
ccattctgtgctgtttcttctacatatgcttgtgangaaatagtccttacaagtcctctgctctgatgttc

SEQ ID NO: 37756 - DNA, 71 bp, chicken (Gallus Gallus)
  misc_feature (36): n=a or c
cccaggaggcttaatagctgccattcatccttcacngttgcttttctatgccatctgtctgcgtattgctt

SEQ ID NO: 37757 - DNA, 71 bp, chicken (Gallus Gallus)
  misc_feature (36): n=a or g
acacataccatcccatcctggccacatctggccccntgtataagggcagtccaggaaaagcagatgctatg

SEQ ID NO: 37758 - DNA, 71 bp, chicken (Gallus Gallus)
  misc_feature (36): n=a or g
agatgttctgctagtcaagatgatggctgagtgctnggttctatttctctttggctgccctttctcagtgg

SEQ ID NO: 37759 - DNA, 71 bp, chicken (Gallus Gallus)
  misc_feature (36): n=c or t
ttctggatggctgcattgctggagcagtacagatanagatgaaatgctgtgccactctctctgtttattac

SEQ ID NO: 37760 - DNA, 71 bp, chicken (Gallus Gallus)
  misc_feature (36): n=a or g
agaacagggtagtggtgaaaaaccatgttcagcacngcagttcattagcaataaaatgctaacagtcagac

SEQ ID NO: 37761 - DNA, 71 bp, chicken (Gallus Gallus)
  misc_feature (36): n=a or g
tgtgaactgtgctgtgctttgtactattccttcagnaaactgctctgcattctgtttccttccatcttaag

SEQ ID NO: 37762 - DNA, 71 bp, chicken (Gallus Gallus)
  misc_feature (36): n=c or t
tgacatgggactacctcatatacctggaatccacantgagtgtcagttttgttgcatacaatcaagataaa

SEQ ID NO: 37763 - DNA, 71 bp, chicken (Gallus Gallus)
  misc_feature (36): n=g or t
aattaaaactaattacattccctaaagtagaaaatnagatcaacaagccatttcactctgtgctagcaaaa

SEQ ID NO: 37764 - DNA, 71 bp, chicken (Gallus Gallus)
  misc_feature (36): n=a or g
cttcactctacctcatggtcataagagagctaaagnacattcaaggatcatataagaatatttgtcatatc

SEQ ID NO: 37765 - DNA, 71 bp, chicken (Gallus Gallus)
  misc_feature (36): n=a or c
tgcatgcctgtatttgcagacccctcacgcaggacngaaaatgcctagaatgcaagagacaggtgtcaaga

SEQ ID NO: 37766 - DNA, 71 bp, chicken (Gallus Gallus)
  misc_feature (36): n=c or t
gacttttgtgaagattactgtaactgtcagaaattnttttaatgtctgatgttccttctttttctattcca

SEQ ID NO: 37767 - DNA, 71 bp, chicken (Gallus Gallus)
  misc_feature (36): n=a or g
tagggctttatcctgttcactgagtgcatgaagtcngagtattatgccaataaaaattgacttagttgctc

SEQ ID NO: 37768 - DNA, 71 bp, chicken (Gallus Gallus)
  misc_feature (36): n=a or g
ttttggtatctctagtttagttctttaggctgaacnttctgtagacaaggagtgtattaggtgcccacccg

SEQ ID NO: 37769 - DNA, 71 bp, chicken (Gallus Gallus)
  misc_feature (36): n=a or g
tgcagtgtgcttgtattcctagaaaggagagaaggngtgaagtaaagtaggagagaaaattcttcttcaaa

SEQ ID NO: 37770 - DNA, 71 bp, chicken (Gallus Gallus)
  misc_feature (36): n=g or t
aagagaaaggctaataacccaacataggtaagtacntttgtagacaagaagaatatataggaaaataaaac

SEQ ID NO: 37771 - DNA, 71 bp, chicken (Gallus Gallus)
  misc_feature (36): n=a or g
ccacaacactggtgcatcctccacaggcaaccaagnggaaactcatttcctgaagttcagctcaaatgtgg

SEQ ID NO: 37772 - DNA, 71 bp, chicken (Gallus Gallus)
  misc_feature (36): n=c or t
gaaaacaaggcagctccacaggggcatttctgctcntactctcaccagtgagcattcactagtggaaagga

SEQ ID NO: 37773 - DNA, 71 bp, chicken (Gallus Gallus)
  misc_feature (36): n=c or t
atggctgaaaaatatgccagcaaaagtactaattcnacctttgatatgtattttggattatataaatataa

SEQ ID NO: 37774 - DNA, 71 bp, chicken (Gallus Gallus)
  misc_feature (36): n=a or g
gaggaagcaaggaggtaggagaaatcagacatcacnaattcttgggctgtgattaaacaagatattgtctg

SEQ ID NO: 37775 - DNA, 71 bp, chicken (Gallus Gallus)
  misc_feature (36): n=c or t
ttagtagttcttatttccgttatgaatcctaatctnaaacttttcctgtcgtctctcttaagattatggaa

SEQ ID NO: 37776 - DNA, 71 bp, chicken (Gallus Gallus)
  misc_feature (36): n=a or g
tatttttgaacttccctcatggactagtcatacaancatttctccctgtccattcaaggccacatctactg

SEQ ID NO: 37777 - DNA, 71 bp, chicken (Gallus Gallus)
  misc_feature (36): n=a or g
gtctgtacatacagatgtataaggtcagcattaatntcctgcaaatgagtcccttaaaaattctcctgtgc

SEQ ID NO: 37778 - DNA, 71 bp, chicken (Gallus Gallus)
  misc_feature (36): n=c or t
ttctgtgcaaatttcttccactcacgtattaaaatnactgtaaattctaaacaaatgtatacaagtgacac

SEQ ID NO: 37779 - DNA, 71 bp, chicken (Gallus Gallus)
  misc_feature (36): n=a or g
atgccaaaataattatccctggccattatttctacntttacaataatggattttgattatttgctcctatt

SEQ ID NO: 37780 - DNA, 71 bp, chicken (Gallus Gallus)
  misc_feature (36): n=a or c
cagcggtggccagactgcacacaggcaacatgtttnccagtagtcagtagaaactgctgccacagaaaggc

SEQ ID NO: 37781 - DNA, 71 bp, chicken (Gallus Gallus)
  misc_feature (36): n=a or g
atagatgttctgtgtagtctaatatagtcattatcnatgtgtcaggcatgtgctggaggggtcgtgtagaa

SEQ ID NO: 37782 - DNA, 71 bp, chicken (Gallus Gallus)
  misc_feature (36): n=a or g
tatcttgagcaagacattcaaaaaaattgctttagnaacaatggcataaagcgtatcctaaagaaacgact

SEQ ID NO: 37783 - DNA, 71 bp, chicken (Gallus Gallus)
  misc_feature (36): n=g or t
attatgtagccatatgatctggaattgttcttgagnattcaatttcagatggaaagtgactgatggaagat

SEQ ID NO: 37784 - DNA, 71 bp, chicken (Gallus Gallus)
  misc_feature (36): n=a or c
tgttagaaaaaggttacaagtattctgaaatcaaanagacaagaactttctgattattgataactccaaac

SEQ ID NO: 37785 - DNA, 71 bp, chicken (Gallus Gallus)
  misc_feature (36): n=c or t
caatcttaattattccataattctagttcaaaagantgcatgctatctactgggcactagcagcatccaca

SEQ ID NO: 37786 - DNA, 71 bp, chicken (Gallus Gallus)
  misc_feature (36): n=c or t
ggtaccattaacaaacaacaaatacaggactgtaangcttccatacaacacaagctgtacttttaaagtgg

SEQ ID NO: 37787 - DNA, 71 bp, chicken (Gallus Gallus)
  misc_feature (36): n=a or g
gatgcttattctaccccattaagtgggaatgatggnaaaccacgtattgccccaggatgcagaaattcctt

SEQ ID NO: 37788 - DNA, 71 bp, chicken (Gallus Gallus)
  misc_feature (36): n=a or c
cacccagcagctcagtcccaaacagtggtttcatgnctgcctgtcactgtttcccttgcaaaaagactcca

SEQ ID NO: 37789 - DNA, 71 bp, chicken (Gallus Gallus)
  misc_feature (36): n=a or g
tgaaaactctttcagttttaaatggctcccttcatnttcctcacatgatctctcctgagcgaatactcaga

SEQ ID NO: 37790 - DNA, 71 bp, chicken (Gallus Gallus)
  misc_feature (36): n=c or t
tgtggcaacaggatttacaaaaggaaattgcagacngagtccagtgccccaggtcaaaggttctccagcag

SEQ ID NO: 37791 - DNA, 71 bp, chicken (Gallus Gallus)
  misc_feature (36): n=a or g
tcatcttgaaacttctcatttattctatctgtttantcttttaatattaattcatattgtctcatgctgcc

SEQ ID NO: 37792 - DNA, 71 bp, chicken (Gallus Gallus)
  misc_feature (36): n=c or t
cttaactctgaggaatggagagtgactatttgaaanaattcagggttgcaaagggaagggatctgttactg

SEQ ID NO: 37793 - DNA, 71 bp, chicken (Gallus Gallus)
  misc_feature (36): n=g or t
cttttaggcaggaaacaccctatagaaaaacctacnctaaaccctgcaattcccacattaaatccgtcttc

SEQ ID NO: 37794 - DNA, 71 bp, chicken (Gallus Gallus)
  misc_feature (36): n=c or t
taaataggaacaacttgcatgaataacagagttctnggtaactacaggcacattaatgtaagcaagacaat

SEQ ID NO: 37795 - DNA, 71 bp, chicken (Gallus Gallus)
  misc_feature (36): n=a or g
gaaatacatgaagaaagactaaccatttcaggaaanagctggcatacaacagcaaagaatgcatcagactt

SEQ ID NO: 37796 - DNA, 71 bp, chicken (Gallus Gallus)
  misc_feature (36): n=a or g
ataaatgcctgttcagcagttaaaatacgagactgngagaattgcactcactgcccttctggggaagcatt

SEQ ID NO: 37797 - DNA, 71 bp, chicken (Gallus Gallus)
  misc_feature (36): n=c or t
aagagcggggaggcagctaatgaagaaatctttgcngtgcactaagccacaaccaaactacaaaaaagttc

SEQ ID NO: 37798 - DNA, 71 bp, chicken (Gallus Gallus)
  misc_feature (36): n=c or t
ttgaggtgttgacaaatggtatgtgctactgcatancagctatctctctcttccatttcagtagtaagtaa

SEQ ID NO: 37799 - DNA, 71 bp, chicken (Gallus Gallus)
  misc_feature (36): n=a or g
ccaagtgtgcaagaatttcattctccaccagatgtntattttatgctgattatgataaagatcattcttgt

SEQ ID NO: 37800 - DNA, 71 bp, chicken (Gallus Gallus)
  misc_feature (36): n=a or g
ttaagcagaacaggtctcaaggggccctaatctgtnacgtgtgatgagaaaacttactgagtacatggata

SEQ ID NO: 37801 - DNA, 71 bp, chicken (Gallus Gallus)
  misc_feature (36): n=c or t
cgtctttcttttgacagatgggaatgtaatctctangtagtctttcagctttgtttgactgttagctttga

SEQ ID NO: 37802 - DNA, 71 bp, chicken (Gallus Gallus)
  misc_feature (36): n=c or t
tactcataaattgagttgagatattaacttgaaatntagtatgtaataactaaaaaaataggttactctta

SEQ ID NO: 37803 - DNA, 71 bp, chicken (Gallus Gallus)
  misc_feature (36): n=a or g
ttctttgaagggaaataaatgttctggaaataagcncccaacccagtgtagatctaagcttgccctggtat

SEQ ID NO: 37804 - DNA, 71 bp, chicken (Gallus Gallus)
  misc_feature (36): n=c or t
actgaggctgcagctgtagacagcctctagaccacngttgctgcctgccccagcactagcatgtgtggcta

SEQ ID NO: 37805 - DNA, 71 bp, chicken (Gallus Gallus)
  misc_feature (36): n=c or t
ttatcagtgtctgttgtacttttcaattgcagtcantggggtctcttcaaaagcctcgtaggagagagcta

SEQ ID NO: 37806 - DNA, 71 bp, chicken (Gallus Gallus)
  misc_feature (36): n=c or t
ctagtaaaattgtttctccttttgggttgcagagtncttgaagctctgtgttaagtgtagctccagggaac

SEQ ID NO: 37807 - DNA, 71 bp, chicken (Gallus Gallus)
  misc_feature (36): n=a or g
tggtattagatatctctgattccagcatctttctcngattctttctgtatatcattcactttttgatgccc

SEQ ID NO: 37808 - DNA, 71 bp, chicken (Gallus Gallus)
  misc_feature (36): n=a or c
atgtatctagtagatgcagttattgccttgcgatgncttctgtgcctgtagaaacacgataaattatatga

SEQ ID NO: 37809 - DNA, 71 bp, chicken (Gallus Gallus)
  misc_feature (36): n=a or g
gctgacacatctatggggttaggaaagcagtacagnatgttatcatggtcctcctgtatgtttctactagg

SEQ ID NO: 37810 - DNA, 71 bp, chicken (Gallus Gallus)
  misc_feature (36): n=g or t
attttaatttgatttgccttaccaagtgacaaattncatctcatcttgctgaaagatttcctagcatttga

SEQ ID NO: 37811 - DNA, 71 bp, chicken (Gallus Gallus)
  misc_feature (36): n=g or t
cccctcatcctgatttcccttgctggctatatctgncactagagcctgtgctccaccttggccctttctcc

SEQ ID NO: 37812 - DNA, 71 bp, chicken (Gallus Gallus)
  misc_feature (36): n=a or g
acttatttttaggcatctcctataggtctcttcccntatgagatgatggcctcaacaggtctttgttctga

SEQ ID NO: 37813 - DNA, 71 bp, chicken (Gallus Gallus)
  misc_feature (36): n=a or g
cagcaaaatggctctgtatggagctgtggtgttccnttatctccatctgcagacaattttaaaggctgtga

SEQ ID NO: 37814 - DNA, 71 bp, chicken (Gallus Gallus)
  misc_feature (36): n=a or c
aagaggatccatccctggtagaagtcaagtactgangggcttcagcatttctaaaaggccaactaacacaa

SEQ ID NO: 37815 - DNA, 71 bp, chicken (Gallus Gallus)
  misc_feature (36): n=c or t
cctttcttccttcctgttctcacttagattccctcnagcacttctcagttcttaaatatcaagcccatttc

SEQ ID NO: 37816 - DNA, 71 bp, chicken (Gallus Gallus)
  misc_feature (36): n=a or c
ctcatggtgtaggggtctgtatgaacctgattaagnatcatctcactaatctcatcaatagatctagaagg

SEQ ID NO: 37817 - DNA, 71 bp, chicken (Gallus Gallus)
  misc_feature (36): n=g or t
attgctgcatctgtcacaaagattgctttgcttttncattgtgttcatcatcatgtttaagatcccacgct

SEQ ID NO: 37818 - DNA, 71 bp, chicken (Gallus Gallus)
  misc_feature (36): n=g or t
atcttagaaagatcctgtggcttttagctccagaancactttctgtgaaatacgcttcacttcagcaggca

SEQ ID NO: 37819 - DNA, 71 bp, chicken (Gallus Gallus)
  misc_feature (36): n=a or g
tttctttaacacacctagcaggatctagctgaaacntactgggaagcatggggtatgctgtgcccacacct

SEQ ID NO: 37820 - DNA, 71 bp, chicken (Gallus Gallus)
  misc_feature (36): n=c or t
ggcctcgccttctgcccccacattccctggtttaanatcagaatttagccttggagagcatctgcaaaatc

SEQ ID NO: 37821 - DNA, 71 bp, chicken (Gallus Gallus)
  misc_feature (36): n=a or g
tagggtgactgggagaaagctgatgatctgagacanagtgatttactgtcacctttagaacttgaaattaa

SEQ ID NO: 37822 - DNA, 71 bp, chicken (Gallus Gallus)
  misc_feature (36): n=a or g
cttcctccaccactgtgtgctggaaacaccggagcnatgggatgtgcccaggtgtggttcacagaggggtg

SEQ ID NO: 37823 - DNA, 71 bp, chicken (Gallus Gallus)
  misc_feature (36): n=c or t
gaagatcacggagtctgctacctgccagcacgctcngcttccagcagcggaagctcttactcatcaccaat

SEQ ID NO: 37824 - DNA, 71 bp, chicken (Gallus Gallus)
  misc_feature (36): n=a or g
aaactagcaccaaggggctgagcaacacagccagcnttaagcctatgtatgaatggaaatctgtgaaaatc

SEQ ID NO: 37825 - DNA, 71 bp, chicken (Gallus Gallus)
  misc_feature (36): n=a or g
ctatagcagtgtctctgaagcaactgctggaaggangatgttactttctaaggaaaatgccacttacgctt

SEQ ID NO: 37826 - DNA, 71 bp, chicken (Gallus Gallus)
  misc_feature (36): n=c or t
ggacattcctgccctagatataaagcaacaagtacngctgtgtcatcagtcatccagagccaggctttgtt

SEQ ID NO: 37827 - DNA, 71 bp, chicken (Gallus Gallus)
  misc_feature (36): n=c or t
tactcttacagtgaactaaaagcttctgtctgccanagaatctgacaaatacttgtgaccattccatggcc

SEQ ID NO: 37828 - DNA, 71 bp, chicken (Gallus Gallus)
  misc_feature (36): n=c or t
cacacataagaatccatactcttttcataacgatangtattaaaggcaacaaacttcataagttgatttgt

SEQ ID NO: 37829 - DNA, 71 bp, chicken (Gallus Gallus)
  misc_feature (36): n=c or t
taggcctctctcattattgtgcaataacgagtaccntaagtgaaatgatgttagtagcctcttagtactac

SEQ ID NO: 37830 - DNA, 71 bp, chicken (Gallus Gallus)
  misc_feature (36): n=c or t
tactgtccagtgatactgtttgcattacgacaaccncagaactgtacaaagagctattaggactagttgga

SEQ ID NO: 37831 - DNA, 71 bp, chicken (Gallus Gallus)
  misc_feature (36): n=c or t
cgagtccaagcaaataggaatttgctgtagcaacangatctaaaaccttaaactccagtgctgtttggata

SEQ ID NO: 37832 - DNA, 71 bp, chicken (Gallus Gallus)
  misc_feature (36): n=a or g
atgaaacagtagtggaaactaaagaagagcggttancccagggaaggccagtggggcaggacgttccctat

SEQ ID NO: 37833 - DNA, 71 bp, chicken (Gallus Gallus)
  misc_feature (36): n=a or g
aaatatcatagtccaaatcacctgttttagcacctnaatgtgtattttcactttggtccagtcatgtgctc

SEQ ID NO: 37834 - DNA, 71 bp, chicken (Gallus Gallus)
  misc_feature (36): n=c or t
cggatccacgtgtaggaagaatgttgacttatggtntgatgactaaccacagctgttgggaaatggtttta

SEQ ID NO: 37835 - DNA, 71 bp, chicken (Gallus Gallus)
  misc_feature (36): n=a or c
tgccccttggggaccctgaagaatccatgcaatgcnatgcagctgcatttggacttttcttttcatgcata

SEQ ID NO: 37836 - DNA, 71 bp, chicken (Gallus Gallus)
  misc_feature (36): n=a or g
tgtgaatctgctgagacagttttgctatttatgtcngatttggtaaatgagagcaaactgggatgagcagt

SEQ ID NO: 37837 - DNA, 71 bp, chicken (Gallus Gallus)
  misc_feature (36): n=a or g
attttggtaacagtaacagagctggaggtaagtttncaacagattaatgattacccatatatgtaacttag

SEQ ID NO: 37838 - DNA, 71 bp, chicken (Gallus Gallus)
  misc_feature (36): n=a or g
aagcagcagcagtgtctgcgtgaaggatggtttcanttgaagttccttgtctaagaggttgcacagaaact

SEQ ID NO: 37839 - DNA, 71 bp, chicken (Gallus Gallus)
  misc_feature (36): n=c or t
gtgcccttgccatgtctgctttctatttggctaaangcacatgaagctgtcaccggtgctcctgctttggt

SEQ ID NO: 37840 - DNA, 71 bp, chicken (Gallus Gallus)
  misc_feature (36): n=a or g
actgaatacttcaaaggaaaggtccaaatgaccacntgaggagccaaacgaagactaagctgactgcagag

SEQ ID NO: 37841 - DNA, 71 bp, chicken (Gallus Gallus)
  misc_feature (36): n=c or t
acagtcctgtgtgagatgatgggattccttaagaanggctattcctggaaaccttcataggtatcccgagg

SEQ ID NO: 37842 - DNA, 71 bp, chicken (Gallus Gallus)
  misc_feature (36): n=c or t
ctgctggttctctcatgtcttcctgcacgtgggtcnggcttaattctttagggaaatcccagaaaacgaaa

SEQ ID NO: 37843 - DNA, 71 bp, chicken (Gallus Gallus)
  misc_feature (36): n=a or g
ggtagatgtgtttggtgttccccatgcctcagtggnaccgggcaggaggctgtgggagcactgagatttgc

SEQ ID NO: 37844 - DNA, 71 bp, chicken (Gallus Gallus)
  misc_feature (36): n=a or g
tgcactccagacaacatcgcaagcagctcccacacnaagtgtctatacagaaacagtctttaaaaatacaa

SEQ ID NO: 37845 - DNA, 71 bp, chicken (Gallus Gallus)
  misc_feature (36): n=a or g
ggggggcatgccgcaattatggtcgacacgatgccntaatcctgaaagcagaacttcatatttttgagaaa

SEQ ID NO: 37846 - DNA, 71 bp, chicken (Gallus Gallus)
  misc_feature (36): n=a or g
agtttctttgttttagcttactggttttgggaaccngtcatacagctgtgatccacaacaggtactgctag

SEQ ID NO: 37847 - DNA, 71 bp, chicken (Gallus Gallus)
  misc_feature (36): n=c or t
ggagagctgggctgcaccactcctcccaggagtccngtggctgaaagagaaattcccatggtcaaagactg

SEQ ID NO: 37848 - DNA, 71 bp, chicken (Gallus Gallus)
  misc_feature (36): n=c or t
cacctcaccacttgctgtaggactgatcagactggngtgtatctgttggattggactctagcagaaaacac

SEQ ID NO: 37849 - DNA, 71 bp, chicken (Gallus Gallus)
  misc_feature (36): n=a or g
atcatcagggacaccaaaatacagcatggcttatcngtacgaggagtgggttgtgattctgtctgctccct

SEQ ID NO: 37850 - DNA, 71 bp, chicken (Gallus Gallus)
  misc_feature (36): n=a or g
acaaataagatcgggtaagcagaaatgcaaatattngttcagtcttcctttctaatctttctgaaagttat

SEQ ID NO: 37851 - DNA, 71 bp, chicken (Gallus Gallus)
  misc_feature (36): n=a or g
aaacgatactcccgtctgctggcataaattgcttantaaccgtagtaggctgggtctggtgagtattttcg

SEQ ID NO: 37852 - DNA, 71 bp, chicken (Gallus Gallus)
  misc_feature (36): n=a or g
aatcctccttgattggtggggtccatcaagtctctnatcagatggatttcagctcccaggtgctgtattct

SEQ ID NO: 37853 - DNA, 71 bp, chicken (Gallus Gallus)
  misc_feature (36): n=c or t
gcaagctccttgcttgtgagataatgcaaagcatgnggtagttctggggctgctgtcttgcatacagctgt

SEQ ID NO: 37854 - DNA, 71 bp, chicken (Gallus Gallus)
  misc_feature (36): n=c or t
ccacctgactacgaccagcagggcttcgagaggcangttcagacgcactttgatcagaacgttttaaactt

SEQ ID NO: 37855 - DNA, 71 bp, chicken (Gallus Gallus)
  misc_feature (36): n=c or t
cagctttgtatggcagtgccctccaaacagtttaangctgctctacatttcctgaagtcaaagaaagagca

SEQ ID NO: 37856 - DNA, 71 bp, chicken (Gallus Gallus)
  misc_feature (36): n=a or g
aatgcacagtgcacaaggtgagatctgcaccatccnagtatcacttgtgtatgctttatggagctgaaagt

SEQ ID NO: 37857 - DNA, 71 bp, chicken (Gallus Gallus)
  misc_feature (36): n=c or t
atgagagctggaagcaaaatctcatggctgtaaatntcttcttcatgggcaggtttaaacggcatttttga

SEQ ID NO: 37858 - DNA, 71 bp, chicken (Gallus Gallus)
  misc_feature (36): n=c or t
acactatataaaaagcgcactatactacctctaagngagaaatgtgtctaagaaaaattaaatgcctttta

SEQ ID NO: 37859 - DNA, 71 bp, chicken (Gallus Gallus)
  misc_feature (36): n=c or t
ttggatacgtgggagaaagctttccttcctatttcncagaaggtgtatccacctttttctcttttctgatg

SEQ ID NO: 37860 - DNA, 71 bp, chicken (Gallus Gallus)
  misc_feature (36): n=c or t
cagtttatacagttaaatgtaaatcaaggaaagtangctgttgctaatattagtacttcataacaatgaag

SEQ ID NO: 37861 - DNA, 71 bp, chicken (Gallus Gallus)
  misc_feature (36): n=c or t
catctattatgtttgtgctgtaaaacaaatgagaangtgaagtaggtcattcattaagactttccggggac

SEQ ID NO: 37862 - DNA, 71 bp, chicken (Gallus Gallus)
  misc_feature (36): n=g or t
tagagcatgagataaggcctctttaagatgcaaatnatgctttttaagaagaatttcagttggtttgagga

SEQ ID NO: 37863 - DNA, 71 bp, chicken (Gallus Gallus)
  misc_feature (36): n=c or t
tacttctgtagttctgtgggatgtgttaatcttgantacctcagtggttcatgtaaattcttacacaggaa

SEQ ID NO: 37864 - DNA, 71 bp, chicken (Gallus Gallus)
  misc_feature (36): n=a or g
tgactttacactaagtgtttcagtggtatgaattanagggtttgttcagatttgtggtacctgagcaaatc

SEQ ID NO: 37865 - DNA, 71 bp, chicken (Gallus Gallus)
  misc_feature (36): n=c or t
ctgaaccttttcttgccctatccaaaaagcacaggngctgctagtgagcattctggtcttcagacacagta

SEQ ID NO: 37866 - DNA, 71 bp, chicken (Gallus Gallus)
  misc_feature (36): n=a or g
ttcctccttgttctgaattacaaataggttgcatcngaagcagaaatgattttctctgcctttaaagcatc

SEQ ID NO: 37867 - DNA, 71 bp, chicken (Gallus Gallus)
  misc_feature (36): n=a or g
tactgaaggtggcatccattcagcagcgccttgggnatgcacatggtttggtgtgtacattaagaattggc

SEQ ID NO: 37868 - DNA, 71 bp, chicken (Gallus Gallus)
  misc_feature (36): n=c or t
cttccacatccttctggtagaactcgcgccctcagngtccttcttaacggatattcctcctcagctccagg

SEQ ID NO: 37869 - DNA, 71 bp, chicken (Gallus Gallus)
  misc_feature (36): n=a or c
atcttcatgcttggggttgcaaccagcaattttttntgagtcatctttaaatagcttttccagaccaattt

SEQ ID NO: 37870 - DNA, 71 bp, chicken (Gallus Gallus)
  misc_feature (36): n=a or g
aaggaagaccttgaactaaaaacagtatggtagtcntaacaaatagaagagtatttgcacatcttaggaca

SEQ ID NO: 37871 - DNA, 71 bp, chicken (Gallus Gallus)
  misc_feature (36): n=c or t
tttctttcatccagccaacaacagcttcctgcactntgagtgactcaactcttccctgtcccaatctgtca

SEQ ID NO: 37872 - DNA, 71 bp, chicken (Gallus Gallus)
  misc_feature (36): n=g or t
aacaagcttccacaacgagaataacttacagaggcnagaagacgtgtgaacaatggaaagaagcccttgaa

SEQ ID NO: 37873 - DNA, 71 bp, chicken (Gallus Gallus)
  misc_feature (36): n=a or g
gcagcttcaacctaaagaaatgcatataaccatcantgtgattcaatcttttccaacttgcttcaacatga

SEQ ID NO: 37874 - DNA, 71 bp, chicken (Gallus Gallus)
  misc_feature (36): n=a or g
ttaagaaatttaaagaaatatgactgtataaataancttagtttgagcgagtgaccaaaaactgctttggt

SEQ ID NO: 37875 - DNA, 71 bp, chicken (Gallus Gallus)
  misc_feature (36): n=a or g
ggtaattagaagcatgctgctgaaagaaaccaggancagactgtgtgttcaggagagcattttgtagatgc

SEQ ID NO: 37876 - DNA, 71 bp, chicken (Gallus Gallus)
  misc_feature (36): n=c or t
ccgtgacgtttctggcaacgttctgagcataaatcngcaggagttagaactttctgcatcaccttttagat

SEQ ID NO: 37877 - DNA, 71 bp, chicken (Gallus Gallus)
  misc_feature (36): n=a or g
ttctttctcatcctcctgctcaacagctcagccaangggcagtatccatattatttataagctccttcagt

SEQ ID NO: 37878 - DNA, 71 bp, chicken (Gallus Gallus)
  misc_feature (36): n=c or t
tagatcttctccattttcagtgttatcttgtacctngctctacttctcactggaagtggggatgggtgaaa

SEQ ID NO: 37879 - DNA, 71 bp, chicken (Gallus Gallus)
  misc_feature (36): n=a or g
ccatacatacttcaataacccataatctcagctggngcaatgctgaagtcatcatatcagtttgttctgtg

SEQ ID NO: 37880 - DNA, 71 bp, chicken (Gallus Gallus)
  misc_feature (36): n=a or g
cagtgttgccagggtaattgcaaaggcatttgtagncgttttaatagggaccactgtgtaaaactttcccc

SEQ ID NO: 37881 - DNA, 71 bp, chicken (Gallus Gallus)
  misc_feature (36): n=a or g
ttagcatatagcttaatgccactcaataataacgtnaatcgcatcaggcttccataggctgccaaaacatg

SEQ ID NO: 37882 - DNA, 71 bp, chicken (Gallus Gallus)
  misc_feature (36): n=a or c
attaaaaagaaaaaagaaccaaacaactgtaaggcnttagaggacaaaatgtgccaattttaaagtggttc

SEQ ID NO: 37883 - DNA, 71 bp, chicken (Gallus Gallus)
  misc_feature (36): n=a or g
agatgtattgctaactactttggttggatatgtgantactctattaaaaaaggtttttctgattatagtta

SEQ ID NO: 37884 - DNA, 71 bp, chicken (Gallus Gallus)
  misc_feature (36): n=a or g
ttgttcatcaagactttgtcttagtctcagtcatcnctggatactaaaacattcgtttatcttaatagcga

SEQ ID NO: 37885 - DNA, 71 bp, chicken (Gallus Gallus)
  misc_feature (36): n=a or c
cctttaggcaaagtttaaaaagtgctatttgtaaanatcaaatgaaaagaattttgcctgaaattagtcga

SEQ ID NO: 37886 - DNA, 71 bp, chicken (Gallus Gallus)
  misc_feature (36): n=a or g
agcattccttaaacttgtggccaaaaaatgttttantagtaacactcatatgtatacatctgtactttgct

SEQ ID NO: 37887 - DNA, 71 bp, chicken (Gallus Gallus)
  misc_feature (36): n=c or t
tcacctcttcccattcaaaaattcaaactgacaccnagtgaaggggagaattccttggaaaagccttatga

SEQ ID NO: 37888 - DNA, 71 bp, chicken (Gallus Gallus)
  misc_feature (36): n=a or g
ggtcatatgtagttggctgcatgttgtttgactgcntgtctggagggtgcaagttcagatgtgttcattgc

SEQ ID NO: 37889 - DNA, 71 bp, chicken (Gallus Gallus)
  misc_feature (36): n=a or g
tcccttaatgcagcaaagaagaattcccaccatcantgggagacactccactgctgggaatgactacatac

SEQ ID NO: 37890 - DNA, 71 bp, chicken (Gallus Gallus)
  misc_feature (36): n=a or g
ctttcctggtaggaatttttgcagggaatatagganaaccaaagatgattcctgtgctggaagaagatttg

SEQ ID NO: 37891 - DNA, 71 bp, chicken (Gallus Gallus)
  misc_feature (36): n=a or g
cacaggagcaactctaccagtaaacagcatgttacngttcttcctgaaaagctgcatcaaaactcataaac

SEQ ID NO: 37892 - DNA, 71 bp, chicken (Gallus Gallus)
  misc_feature (36): n=c or t
agaactgcagttgcacgccaacatcttttgcgggtnaatacatgtattaataaatttatagaacagggact

SEQ ID NO: 37893 - DNA, 71 bp, chicken (Gallus Gallus)
  misc_feature (36): n=g or t
tctgtcattactgacacaatgtatatgtacactgcnctggactgcacagaatatcaggcaggaatacaatg

SEQ ID NO: 37894 - DNA, 71 bp, chicken (Gallus Gallus)
  misc_feature (36): n=a or g
ctctagaaattagtgcctttacaagtcagtcatgtnctgcagttttaaggtgattttaacaactggaccac

SEQ ID NO: 37895 - DNA, 71 bp, chicken (Gallus Gallus)
  misc_feature (36): n=c or t
aaagggcgagagatgatatcaatttgattctcctcngtagaataactatttaagacatgtgggagctggct

SEQ ID NO: 37896 - DNA, 71 bp, chicken (Gallus Gallus)
  misc_feature (36): n=c or t
tattttgtggagagttttctctacttggctctcttntgtcatttgtacatttgatgacttaaacttgcagc

SEQ ID NO: 37897 - DNA, 71 bp, chicken (Gallus Gallus)
  misc_feature (36): n=c or t
gagacttctttgcccctagaaatatttctctttacnatcgacaagctccaacgcagatcttttcgcatgac

SEQ ID NO: 37898 - DNA, 71 bp, chicken (Gallus Gallus)
  misc_feature (36): n=c or t
caaaaagttcaaaaaggagaattcagaagattcacngaatcttaaagtgcaaagaaatatttcataagtca

SEQ ID NO: 37899 - DNA, 71 bp, chicken (Gallus Gallus)
  misc_feature (36): n=a or c
aattcagaagattcaccgaatcttaaagtgcaaagnaatatttcataagtcagggatgtgagctggtaaat

SEQ ID NO: 37900 - DNA, 71 bp, chicken (Gallus Gallus)
  misc_feature (36): n=c or t
ctgcacccatcttgattgcatatgctaatcttgtcntcttaattgactcataacagatttatctggatttc

SEQ ID NO: 37901 - DNA, 71 bp, chicken (Gallus Gallus)
  misc_feature (36): n=g or t
tggcactcactctggcattctgtgtaccttgctganctgaagatgtgcacacagaaacagggaatcccact

SEQ ID NO: 37902 - DNA, 71 bp, chicken (Gallus Gallus)
  misc_feature (36): n=a or c
ggtcatacagaaagttaagattagaactgataattnaggattctatcattagttttgaagtctattgacca

SEQ ID NO: 37903 - DNA, 71 bp, chicken (Gallus Gallus)
  misc_feature (36): n=c or t
aaataaaatgcacttaaggaatacattggtggagangcaagaaatgtaaatttgtaaggtacaaattacag

SEQ ID NO: 37904 - DNA, 71 bp, chicken (Gallus Gallus)
  misc_feature (36): n=a or c
ctgtgccactactctttagataaatgtatgcttgtncctgtgctacagggtaccatggaaacaggatctgt

SEQ ID NO: 37905 - DNA, 71 bp, chicken (Gallus Gallus)
  misc_feature (36): n=c or t
ttctaaggtagactcatagctaaaaaaataatctgnctgtgggagactggctggttaaagccaatgctgtt

SEQ ID NO: 37906 - DNA, 71 bp, chicken (Gallus Gallus)
  misc_feature (36): n=g or t
atgcctttagcattgctgaatagtgttttccttttncctacatacctattagagtaagaattcgagaagta

SEQ ID NO: 37907 - DNA, 71 bp, chicken (Gallus Gallus)
  misc_feature (36): n=g or t
cataaataatgtaatatgtaaaattagaatggtagntggctgtgcttggttgcacaagtagtcagatagat

SEQ ID NO: 37908 - DNA, 71 bp, chicken (Gallus Gallus)
  misc_feature (36): n=a or g
gcttgtacctatagcaactctagcattccacatgcngtttcatatgagttccagactgtggtgaacaaaac

SEQ ID NO: 37909 - DNA, 71 bp, chicken (Gallus Gallus)
  misc_feature (36): n=a or g
agaagacagtttcacatcagtattacttgttctacntaattcatattcgtatgtgtctgaccatcaataat

SEQ ID NO: 37910 - DNA, 71 bp, chicken (Gallus Gallus)
  misc_feature (36): n=a or c
tggagatatacacaaattctgaaagagactagagcntgcagctcacgtactcataaatgtggagggctctg

SEQ ID NO: 37911 - DNA, 71 bp, chicken (Gallus Gallus)
  misc_feature (36): n=a or g
tttttgaggacttatattaaagttctgtttacagtnagaaaataacagcttattcaaaatgttatgttcat

SEQ ID NO: 37912 - DNA, 71 bp, chicken (Gallus Gallus)
  misc_feature (36): n=a or g
ttttttacgtcatcacctgtttctgagtgttaggtntatgttttttgtatctctgccagcatacacaaaac

SEQ ID NO: 37913 - DNA, 71 bp, chicken (Gallus Gallus)
  misc_feature (36): n=a or g
aaagggggagtttttctgggggtaacactcacttcnaagaaatgcagtttctgaactgatgttggcatttc

SEQ ID NO: 37914 - DNA, 71 bp, chicken (Gallus Gallus)
  misc_feature (36): n=c or t
tattaatatacctgccttttaaattatggttacacnaatccactacaaaatgaagactttagtctttagaa

SEQ ID NO: 37915 - DNA, 71 bp, chicken (Gallus Gallus)
  misc_feature (36): n=c or t
atttttcttgttataatatcattaaaaagtacctangttttctgactgagaacacttacatcattaagaca

SEQ ID NO: 37916 - DNA, 71 bp, chicken (Gallus Gallus)
  misc_feature (36): n=c or t
ttcatctttcaaaatacttgcatctattttggggantataagaagggaaacccaagttttcattgaatagt

SEQ ID NO: 37917 - DNA, 71 bp, chicken (Gallus Gallus)
  misc_feature (36): n=a or g
cattatagtatgtgcttagtggtccagctgatgagntaatgaatgggagtcacaatgaaaacctatgtgtt

SEQ ID NO: 37918 - DNA, 71 bp, chicken (Gallus Gallus)
  misc_feature (36): n=a or c
ttcacagtacactcagaagtaaccaatggaaactcnaggctctgtgagctgcagattgaaaatcactgttg

SEQ ID NO: 37919 - DNA, 71 bp, chicken (Gallus Gallus)
  misc_feature (36): n=a or c
ctacactgaaattaggaggaaaaactaatacaaatnagaaaaatttattgtctggatctcagtaggaagtg

SEQ ID NO: 37920 - DNA, 71 bp, chicken (Gallus Gallus)
  misc_feature (36): n=c or t
atctaagtcagtttcaactccacttacctgctttancctcaacatgtctttccatagagcagcacaacaac

SEQ ID NO: 37921 - DNA, 71 bp, chicken (Gallus Gallus)
  misc_feature (36): n=c or t
ccaacattcttcactcatggaggaaaagtttctcanccttggattgaaacagattttcagataattaactt

SEQ ID NO: 37922 - DNA, 71 bp, chicken (Gallus Gallus)
  misc_feature (36): n=a or g
tagtatcagccaaaactattattaaatgaactaagntaattattagtacacagtatacatttatccatgcc

SEQ ID NO: 37923 - DNA, 71 bp, chicken (Gallus Gallus)
  misc_feature (36): n=c or t
ccaaaacaaaagcagctgggtccacagaaaacacanggtgttcatatgacaaagctctcagtacatagatg

SEQ ID NO: 37924 - DNA, 71 bp, chicken (Gallus Gallus)
  misc_feature (36): n=c or t
ttccccctccttcctctggacataatacttacatanctcttggaatagagtaaaattacataagttatgat

SEQ ID NO: 37925 - DNA, 71 bp, chicken (Gallus Gallus)
  misc_feature (36): n=c or t
aattcaatcacatttacagaattggaatcaagtaanagagataaacctatctaaagatgcaaatctaaaac

SEQ ID NO: 37926 - DNA, 71 bp, chicken (Gallus Gallus)
  misc_feature (36): n=c or t
ctattcttctctgcctgaaggctctggaataaatangctccccaaacaattgattttaatcaaatatattt

SEQ ID NO: 37927 - DNA, 71 bp, chicken (Gallus Gallus)
  misc_feature (36): n=c or t
tgtaaaaacagtacttatttagatttttgcccccangtcatcacctcttatctctgatacctatatgaagc

SEQ ID NO: 37928 - DNA, 71 bp, chicken (Gallus Gallus)
  misc_feature (36): n=a or g
tgatgtgtttgcctaaagtcaagcaattttcagagnaaatttacaggaattcaccaggtacttttgaactg

SEQ ID NO: 37929 - DNA, 71 bp, chicken (Gallus Gallus)
  misc_feature (36): n=c or t
tgcagagttgtgctatatgtgttttcttatcaggtnttaaactgatgactccatgcttttgctttctgtga

SEQ ID NO: 37930 - DNA, 71 bp, chicken (Gallus Gallus)
  misc_feature (36): n=a or c
tcctgcttcttgaggtcaaaaaacatctgaaatagntcactgcttgcattttcacacactcctaagttgaa

SEQ ID NO: 37931 - DNA, 71 bp, chicken (Gallus Gallus)
  misc_feature (36): n=c or t
ctgcagcaagaatttttctgccagtcatctatgacnaaatgaaggacagtcgtggcaatctgtatggtcat

SEQ ID NO: 37932 - DNA, 71 bp, chicken (Gallus Gallus)
  misc_feature (36): n=a or g
tcataaaatatgtaaatgcttagattcctgtcccanaattttcttgaaagttagaatatctctaatgtagg

SEQ ID NO: 37933 - DNA, 71 bp, chicken (Gallus Gallus)
  misc_feature (36): n=a or g
tatgagaagaaacatatcctagtatccaacatgagncatgatgggaagccctacacgtttatctctgcaaa

SEQ ID NO: 37934 - DNA, 71 bp, chicken (Gallus Gallus)
  misc_feature (36): n=a or c
ttttacctgtaagtggttagagcagaagacagcacncaagagaaagcatgtgagaaatggggatgaaggct

SEQ ID NO: 37935 - DNA, 71 bp, chicken (Gallus Gallus)
  misc_feature (36): n=c or t
agatagttgcattattctccatcttcaccttgtctnctcttccctacagtttccactgttgcacaaaagac

SEQ ID NO: 37936 - DNA, 71 bp, chicken (Gallus Gallus)
  misc_feature (36): n=a or g
tcttgtgatattctgttttatctggaagaactttcncatagcaaaaacatagaaaaccacaaaaatctatg

SEQ ID NO: 37937 - DNA, 71 bp, chicken (Gallus Gallus)
  misc_feature (36): n=c or t
gagatgccttcagaagcaggaaaaccttgcttagtnttctttatggcctgagtagacttgaatcaacactt

SEQ ID NO: 37938 - DNA, 71 bp, chicken (Gallus Gallus)
  misc_feature (36): n=a or c
cctgatattctgctgtcatttttgctacacttcgtngggatgtctattagcacggctgagtgtgttgaggt

SEQ ID NO: 37939 - DNA, 71 bp, chicken (Gallus Gallus)
  misc_feature (36): n=a or g
cctggcaagctgcaaggttggaggtcatgttaaaangtccctggaatgtcttttcatttatttgtagtggt

SEQ ID NO: 37940 - DNA, 71 bp, chicken (Gallus Gallus)
  misc_feature (36): n=c or t
tactgatatcactgaagcatctaggtaggcggctgngactcctttcccttccctgccccactgttactgca

SEQ ID NO: 37941 - DNA, 71 bp, chicken (Gallus Gallus)
  misc_feature (36): n=c or t
gatgcagcccttgttgcactcactgaaaaatctatncatcaatccacacagaaagttcatacattcgtttt

SEQ ID NO: 37942 - DNA, 71 bp, chicken (Gallus Gallus)
  misc_feature (36): n=c or t
gggctctcagctgctatctcagcttgctgttacaanatgcaccaggctcatggctgctttatctccgtcat

SEQ ID NO: 37943 - DNA, 71 bp, chicken (Gallus Gallus)
  misc_feature (36): n=a or g
ataggttttgcttatggcacatggtgttttgggggncagtttttgaggatgaaatcatttttgttccaaaa

SEQ ID NO: 37944 - DNA, 71 bp, chicken (Gallus Gallus)
  misc_feature (36): n=a or g
aaatgatacttgacaggtgagtaggattcctgcagnaactgccagatttctgaagtcagtttgttccctgt

SEQ ID NO: 37945 - DNA, 71 bp, chicken (Gallus Gallus)
  misc_feature (36): n=c or t
ctttgaacaacaaccggtgttttgatccagtcctcnccaagtaattgcttgaaatctatacacgtgtaaaa

SEQ ID NO: 37946 - DNA, 71 bp, chicken (Gallus Gallus)
  misc_feature (36): n=c or t
tagactgtaggtgtatgggtaggtaatgggtttagntcaatgttagttagataaaatatggaaaatctgtg

SEQ ID NO: 37947 - DNA, 71 bp, chicken (Gallus Gallus)
  misc_feature (36): n=c or t
ccagcttttatgctggtgcatgactgtaatcttcanggcatatagcaagagtcgtctccttcatgcttcaa

SEQ ID NO: 37948 - DNA, 71 bp, chicken (Gallus Gallus)
  misc_feature (36): n=c or t
acttcccctcattgtaaacctcgacaatttactccnctttgcttcctaatgtataacctgctgtaaattca

SEQ ID NO: 37949 - DNA, 71 bp, chicken (Gallus Gallus)
  misc_feature (36): n=c or t
ttccctcccactaataaagcattctcccacaaatcntatgggactgtagcatctttcacttcatcttacaa

SEQ ID NO: 37950 - DNA, 71 bp, chicken (Gallus Gallus)
  misc_feature (36): n=c or t
tcaaggcaaaggagcccagaaacagagcagacaagnctactgttgccagatgtcttccaaatgtgagttgt

SEQ ID NO: 37951 - DNA, 71 bp, chicken (Gallus Gallus)
  misc_feature (36): n=a or g
atcaccatactcagcagttgcctggagaagtttctntgtcttctaaagctacaaggaaggactgttcttgc

SEQ ID NO: 37952 - DNA, 71 bp, chicken (Gallus Gallus)
  misc_feature (36): n=c or t
gcaggaatatttgcacagtctgcaccttctcaggcngttgcctggcttccgcagtgctgccctctcctttc

SEQ ID NO: 37953 - DNA, 71 bp, chicken (Gallus Gallus)
  misc_feature (36): n=c or t
atgtaaaattgcatcttcctgcaatattgcacaagnttggccatagagaatctccaggctaatgaactttg

SEQ ID NO: 37954 - DNA, 71 bp, chicken (Gallus Gallus)
  misc_feature (36): n=a or g
ctagtaatatttaagagcatcttagacaaatgtctntcaggcttgatgctgctatatcactctcctggcat

SEQ ID NO: 37955 - DNA, 71 bp, chicken (Gallus Gallus)
  misc_feature (36): n=g or t
gtgtgcaagaaataagcaaaatccaataaaaccaanggctgttcattaagaaaacaggaggtagaaggcac

SEQ ID NO: 37956 - DNA, 71 bp, chicken (Gallus Gallus)
  misc_feature (36): n=a or g
ctttgcagtcccaagcagtctcaggtcaccatgctntgctgacatgccccagcatcctccatgtagttgcc

SEQ ID NO: 37957 - DNA, 71 bp, chicken (Gallus Gallus)
  misc_feature (36): n=c or t
gttgatgctcaggtattcctgctactttgatcatcntttctctcttgcataaactttaagcatgctgaagt

SEQ ID NO: 37958 - DNA, 71 bp, chicken (Gallus Gallus)
  misc_feature (36): n=a or g
ttcagaagagaggaatgtgtctgtatttttcagtgngaaatcggactaggaaagccataccttaaatcctt

SEQ ID NO: 37959 - DNA, 71 bp, chicken (Gallus Gallus)
  misc_feature (36): n=a or g
acagcttctctctgttgaacttaacaatagcagacntcagggacttctcacagttttagttagcatcatca

SEQ ID NO: 37960 - DNA, 71 bp, chicken (Gallus Gallus)
  misc_feature (36): n=a or g
atttttttttccccagcagtaagtactagatgtaanaattgctttgctgtgggctagatttttaactagat

SEQ ID NO: 37961 - DNA, 71 bp, chicken (Gallus Gallus)
  misc_feature (36): n=a or c
cctccgcagatcctcagaatttgcacaagatacacnccagaacaagacaccatgacattttcagatggcct

SEQ ID NO: 37962 - DNA, 71 bp, chicken (Gallus Gallus)
  misc_feature (36): n=a or g
ggaaatactgcagaacacagtccgagtatctcaccnagctcagtggataacagcagtgtcagtcaatcccc

SEQ ID NO: 37963 - DNA, 71 bp, chicken (Gallus Gallus)
  misc_feature (36): n=a or g
agaagacggtaaaaataagtggtcttacctgcatcnttagcatcatccagttttggaatgcctttgatttt

SEQ ID NO: 37964 - DNA, 71 bp, chicken (Gallus Gallus)
  misc_feature (36): n=c or t
atatcataagatgaatttcaaaaacattccacactngaatggtgaatttaaatacaatgattctacttatc

SEQ ID NO: 37965 - DNA, 71 bp, chicken (Gallus Gallus)
  misc_feature (36): n=c or t
aaaaagtaagtattcttcactgaaacaattcattanccttggcactgaacattagttcacctacactgaaa

SEQ ID NO: 37966 - DNA, 71 bp, chicken (Gallus Gallus)
  misc_feature (36): n=c or t
agccttctctttcaattgctgaaggggaatcaaagncagtgctttctgctgaagagaagtactctcatacg

SEQ ID NO: 37967 - DNA, 71 bp, chicken (Gallus Gallus)
  misc_feature (36): n=a or g
tatcagcttttctgaatagaagctcattgcctggangttgaaagtggtttataaggctatacattacattt

SEQ ID NO: 37968 - DNA, 71 bp, chicken (Gallus Gallus)
  misc_feature (36): n=a or g
ctttccagacacagtgccattctgcttgcacatgcngtcttcattcaaaagtacttcagctgaagactaat

SEQ ID NO: 37969 - DNA, 71 bp, chicken (Gallus Gallus)
  misc_feature (36): n=c or t
tatgtcttatctacacagacaacaagaagttgttcntttcccctttgcaattgccttgtatatattctaag

SEQ ID NO: 37970 - DNA, 71 bp, chicken (Gallus Gallus)
  misc_feature (36): n=a or g
ctgatatctcccacagataaggagaaatggcaaacntgttgactgttgagttggaggtagatcagctcaca

SEQ ID NO: 37971 - DNA, 71 bp, chicken (Gallus Gallus)
  misc_feature (36): n=a or c
tagaccaaaagtgatttgtgattacaagctctaaanctccttgaaggtgtctgattatcaggaatttaaga

SEQ ID NO: 37972 - DNA, 71 bp, chicken (Gallus Gallus)
  misc_feature (36): n=c or t
tatccttcctttggggtccatctccagccccatgcncagtcccactggtggctctgctgaatgagggtctt

SEQ ID NO: 37973 - DNA, 71 bp, chicken (Gallus Gallus)
  misc_feature (36): n=c or t
cttactccatccttcctcatcctaattaaagaaaanactccttagcccaagtctgtgctaaatattggcac

SEQ ID NO: 37974 - DNA, 71 bp, chicken (Gallus Gallus)
  misc_feature (36): n=c or t
caacatattaatgcatgcacttaattatggaaacanttttcttctattcttacttgttttgctgctgtttt

SEQ ID NO: 37975 - DNA, 71 bp, chicken (Gallus Gallus)
  misc_feature (36): n=c or t
cccatgatcaaagaagtcagtgtttctaacagttanacaatagttggacagacaagggcagtagtgtaaac

SEQ ID NO: 37976 - DNA, 71 bp, chicken (Gallus Gallus)
  misc_feature (36): n=a or c
gcaacagcaaggctaaattcttctaaatcaagacanagaaatatatccacagaataattctctaaattctc

SEQ ID NO: 37977 - DNA, 71 bp, chicken (Gallus Gallus)
  misc_feature (36): n=c or t
cttcatcctctgcgtaatcagcagcacgcagtgctngtgctgagaggggagacctcgggagacccacagct

SEQ ID NO: 37978 - DNA, 71 bp, chicken (Gallus Gallus)
  misc_feature (36): n=a or c
attaatggaatatatagtaacattaatagaacaccncctttcaggtcacagaaacagtgagtgcattgctt

SEQ ID NO: 37979 - DNA, 71 bp, chicken (Gallus Gallus)
  misc_feature (36): n=a or c
atgataaacttttcaagggaatctaccaccaaaagnctttttttctgcgttcgtacgtgacaaaacgagcg

SEQ ID NO: 37980 - DNA, 71 bp, chicken (Gallus Gallus)
  misc_feature (36): n=g or t
ctgtgtagctacgtcagccatgttgacagatgcatnccagaaccctacagtatcagagacaaaattaaaac

SEQ ID NO: 37981 - DNA, 71 bp, chicken (Gallus Gallus)
  misc_feature (36): n=a or c
tgcagccacatgctgtcctcatgctttgctgaaaancatggggctaatcatgctgcagccctgtgtctcgg

SEQ ID NO: 37982 - DNA, 71 bp, chicken (Gallus Gallus)
  misc_feature (36): n=c or t
tttgaagggaatctgtggaaaatggcactgtccacntcattgaactctgaacctgataaggaactagtttc

SEQ ID NO: 37983 - DNA, 71 bp, chicken (Gallus Gallus)
  misc_feature (36): n=c or t
acattttaaatctattttactcctgtctctaatttnagcttcagtggtgtctatatgaatttgaaatacat

SEQ ID NO: 37984 - DNA, 71 bp, chicken (Gallus Gallus)
  misc_feature (36): n=a or g
atcaagatcatggcagaatatagattaattgaaccngacagcgtgagagccaacactgcagatcaaaattc

SEQ ID NO: 37985 - DNA, 71 bp, chicken (Gallus Gallus)
  misc_feature (36): n=a or g
gttaagtagcataggtactcatttaacttgctcttngtttagttttttctactctgtgttaattttgtccg

SEQ ID NO: 37986 - DNA, 71 bp, chicken (Gallus Gallus)
  misc_feature (36): n=a or g
ctaatttgggggaaaatacttgccttctgtgtatcnccaattgtgctgtctgccttcgtggcagttttctt

SEQ ID NO: 37987 - DNA, 71 bp, chicken (Gallus Gallus)
  misc_feature (36): n=c or t
ttaactctgaatgccttttgataaatgactgtacanaccatcatatgttatgacggtcacgtgaattgatc

SEQ ID NO: 37988 - DNA, 71 bp, chicken (Gallus Gallus)
  misc_feature (36): n=a or g
aaaataacatttgtaaatacatcagtgaccacttgnaagggcaaaatgttttactacttttatgtgtgaga

SEQ ID NO: 37989 - DNA, 71 bp, chicken (Gallus Gallus)
  misc_feature (36): n=c or t
caacaagacattagagaagacagtaatactcaccantatttgttgcactttaataataatatggaagaatc

SEQ ID NO: 37990 - DNA, 71 bp, chicken (Gallus Gallus)
  misc_feature (36): n=a or g
ttctttacatggagaaatattttaccttacagaccnacaaactgggccagttctgctttaatacatgtctg

SEQ ID NO: 37991 - DNA, 71 bp, chicken (Gallus Gallus)
  misc_feature (36): n=a or g
accagactttcaacacgttactgatccaaaatggantgttgctggttaaacactatgggacagtgtcatct

SEQ ID NO: 37992 - DNA, 71 bp, chicken (Gallus Gallus)
  misc_feature (36): n=c or t
ttgcagggttattggcaactgaaactggatttttanatggagaagtatcaggtaactttgataactagcaa

SEQ ID NO: 37993 - DNA, 71 bp, chicken (Gallus Gallus)
  misc_feature (36): n=a or g
tcacaaggtaaaaacagaagtacttttcctatagcntttaccagcagagaaattaaagagagagacaattg

SEQ ID NO: 37994 - DNA, 71 bp, chicken (Gallus Gallus)
  misc_feature (36): n=a or g
acaaatgccagtaccaactgggaagatgtgaagctntgctgtggttcagtttgggaggcctcaatattgtg

SEQ ID NO: 37995 - DNA, 71 bp, chicken (Gallus Gallus)
  misc_feature (36): n=a or c
tgttcattattactatttaagatgtgtttatgaatntttctcttttgaccaacaactgtaatgttgttacc

SEQ ID NO: 37996 - DNA, 71 bp, chicken (Gallus Gallus)
  misc_feature (36): n=a or g
gccatccatgctgcacagagttgaactattaaaatncatgagagttcctcttctgagccaaactgggagct

SEQ ID NO: 37997 - DNA, 71 bp, chicken (Gallus Gallus)
  misc_feature (36): n=a or g
aatcccccattgtccacggaatggatcccagggagncatcgcatggaggggacagagggacgctggactcc

SEQ ID NO: 37998 - DNA, 71 bp, chicken (Gallus Gallus)
  misc_feature (36): n=c or t
ttggatctagaagacgtgagaccctgaactgcaggntgagaggcaatcttacatatcctctgtaagaaaca

SEQ ID NO: 37999 - DNA, 71 bp, chicken (Gallus Gallus)
  misc_feature (36): n=a or g
actaagtgaacagaggtaaaaccttaagattgctcnaagctgtgaaggtgagtctgcttggatatctctgg

SEQ ID NO: 38000 - DNA, 71 bp, chicken (Gallus Gallus)
  misc_feature (36): n=a or g
acaagcctgtccagtttgaatctggatgtgttgtgnatatccattaacatgtgatctctcaaatatttgtt

SEQ ID NO: 38001 - DNA, 71 bp, chicken (Gallus Gallus)
  misc_feature (36): n=a or g
atctagatcctttttctcctgttctgagaagtcctnaagagcagaaataggtgacttttatgactaaatga

SEQ ID NO: 38002 - DNA, 71 bp, chicken (Gallus Gallus)
  misc_feature (36): n=a or c
agagctctgtctttcaggcctttgctggatgtggangttagatatcagtcatgcgtggactttgtaggacc

SEQ ID NO: 38003 - DNA, 71 bp, chicken (Gallus Gallus)
  misc_feature (36): n=g or t
agaaaaaaatcatggaacatattaaatatgctttgnattttggagatagatacatatttatcaggatgggt

SEQ ID NO: 38004 - DNA, 71 bp, chicken (Gallus Gallus)
  misc_feature (36): n=a or c
ctctaggggggaatactgtggccaggttaataaganatttggaaactgattgaaggaaagaggaaaagggc

SEQ ID NO: 38005 - DNA, 71 bp, chicken (Gallus Gallus)
  misc_feature (36): n=a or g
ctgactttgcccagttctctcttcacagcagaaacnctttttcccccagcagcccgtgtcattagctcatc

SEQ ID NO: 38006 - DNA, 71 bp, chicken (Gallus Gallus)
  misc_feature (36): n=a or c
aacatgtgtccagcctgggatccgggccccagaganggattccagatgactttcaaaaatgagtttattac

SEQ ID NO: 38007 - DNA, 71 bp, chicken (Gallus Gallus)
  misc_feature (36): n=g or t
cacatccctatgcaaaagaagccttttttcctatcntaagagtttcccattgctacttttcatccagatgt

SEQ ID NO: 38008 - DNA, 71 bp, chicken (Gallus Gallus)
  misc_feature (36): n=c or t
ctgtgcagctccagtatatttaactaaaatgagganttagaattctagggcatcagcttgtaatgattcat

SEQ ID NO: 38009 - DNA, 71 bp, chicken (Gallus Gallus)
  misc_feature (36): n=c or t
aaaaaagattggagggcatttactctgggttcttgntgctagtttgagcatcactgctttaggttttttag

SEQ ID NO: 38010 - DNA, 71 bp, chicken (Gallus Gallus)
  misc_feature (36): n=a or g
tgcttccttctgtgctctagaagtgcaaagttggcntcacaggtgtgcttccactccgtgaataccctgcg

SEQ ID NO: 38011 - DNA, 71 bp, chicken (Gallus Gallus)
  misc_feature (36): n=a or g
ctgttctatttaaccatttccttgcctgtttgttcnggcaggttttgctcagaacagtgcccagaaagagg

SEQ ID NO: 38012 - DNA, 71 bp, chicken (Gallus Gallus)
  misc_feature (36): n=c or t
taaataatcacattaaaaggccaaaaataaacctantgaagattgtgggacttcctccatgtgcaagcaaa

SEQ ID NO: 38013 - DNA, 71 bp, chicken (Gallus Gallus)
  misc_feature (36): n=c or t
atctcttttacacctaatccagtattttcaaactgncccatcacaaatgattttctgtgcctctagcactg

SEQ ID NO: 38014 - DNA, 71 bp, chicken (Gallus Gallus)
  misc_feature (36): n=a or g
aattacaatgattcagagcttcacatgtgaaagaantaaattcagagctgatgcgcagatcagcttcatgt

SEQ ID NO: 38015 - DNA, 71 bp, chicken (Gallus Gallus)
  misc_feature (36): n=a or g
attaaggcactgcacaagccaaacctgtaagaaggnagtacatccacacaaaacatacacaactacagtag

SEQ ID NO: 38016 - DNA, 71 bp, chicken (Gallus Gallus)
  misc_feature (36): n=c or t
atttttttcttcccacgaggacctctgtgacagggnctactggaaaaacagacaagtatctcatgctttag

SEQ ID NO: 38017 - DNA, 71 bp, chicken (Gallus Gallus)
  misc_feature (36): n=c or t
agcagctggaattaatacagagacaacactgttctnatcagttagcacaagtggtgggccagtttccagaa

SEQ ID NO: 38018 - DNA, 71 bp, chicken (Gallus Gallus)
  misc_feature (36): n=c or t
gagaagagtatataagaccgttcagaaacaagagantcacttgctcctcagctttgattaaaccccacagc

SEQ ID NO: 38019 - DNA, 71 bp, chicken (Gallus Gallus)
  misc_feature (36): n=a or g
caggaatgtggttttatctaggttacattagatgtntctgtggctcagtgaaacctgaagaatcaattttg

SEQ ID NO: 38020 - DNA, 71 bp, chicken (Gallus Gallus)
  misc_feature (36): n=c or t
tttatttggctttctgtaaccaaaaggcatagtccncccactatttctactggaatcagcatggcttcctg

SEQ ID NO: 38021 - DNA, 71 bp, chicken (Gallus Gallus)
  misc_feature (36): n=a or g
tctattggaaaatatgatttagagacagaaatgganttgaatatgcataaaacccaaaagctattagcttt

SEQ ID NO: 38022 - DNA, 71 bp, chicken (Gallus Gallus)
  misc_feature (36): n=a or g
gattgttagagccaagatcaacttctaaacgtgtgngatggtatcagccaaacttaatggggagctgcatt

SEQ ID NO: 38023 - DNA, 71 bp, chicken (Gallus Gallus)
  misc_feature (36): n=c or t
tatcttactgctttgggaagctgttcaaaaaactgntcgattctgtccagaaatatgtaattaataatata

SEQ ID NO: 38024 - DNA, 71 bp, chicken (Gallus Gallus)
  misc_feature (36): n=c or t
taaaaccgtttccagtaagaaaagattcctaagtgngttgagtgggtttttaaaataaccattctgttaca

SEQ ID NO: 38025 - DNA, 71 bp, chicken (Gallus Gallus)
  misc_feature (36): n=a or c
tccgattcagaaggcagctccaacaggctgccaggncccactgtttttactccagctgaactgtgataaaa

SEQ ID NO: 38026 - DNA, 71 bp, chicken (Gallus Gallus)
  misc_feature (36): n=c or t
ctttgtgtgaggtttcttatcttacttaagagagangagaaaagaaatggaatcaaaatatccagaagttc

SEQ ID NO: 38027 - DNA, 71 bp, chicken (Gallus Gallus)
  misc_feature (36): n=a or c
caataaaagagctcttcattagaaagaaattcactntttcattggatcacacagtcatcagtctgtaacat

SEQ ID NO: 38028 - DNA, 71 bp, chicken (Gallus Gallus)
  misc_feature (36): n=g or t
ctccagcaaggcttactcaccacacactgcaagtcnctctcattgccacgaacctcctagcacagcgtggc

SEQ ID NO: 38029 - DNA, 71 bp, chicken (Gallus Gallus)
  misc_feature (36): n=a or g
aaaaataaactttaaaattagctttgtctagtcagntaacttactattcataattaaaggtaaaagcttgg

SEQ ID NO: 38030 - DNA, 71 bp, chicken (Gallus Gallus)
  misc_feature (36): n=c or t
ttatgttcatgtttttgaaggaagctaattatagangccagaaaggaaccagctgaagtggagggctgtgt

SEQ ID NO: 38031 - DNA, 71 bp, chicken (Gallus Gallus)
  misc_feature (36): n=a or g
acttatcagccttattcaccaaacccgaattggggnctgaaggtttgttaatgatatatagtgattttaaa

SEQ ID NO: 38032 - DNA, 71 bp, chicken (Gallus Gallus)
  misc_feature (36): n=a or g
tgagccgctctttatgtgtgaggatactacagtgtnctaatctgctttcccgagaaggcttttgttcactg

SEQ ID NO: 38033 - DNA, 71 bp, chicken (Gallus Gallus)
  misc_feature (36): n=c or t
cacagagaggccttcgagaggtgttttaaaacgtangttgttagagatcctgcactagtagaaccatcatt

SEQ ID NO: 38034 - DNA, 71 bp, chicken (Gallus Gallus)
  misc_feature (36): n=c or t
tgaatgaacttcaaaccacatccatttaagtggacngaaggtactgtgattaacttgagagatttctagtc

SEQ ID NO: 38035 - DNA, 71 bp, chicken (Gallus Gallus)
  misc_feature (36): n=c or t
agaccattggggttgatcgcatgcagaaagccaganctggcaccagccttgccaagataaaccacctctgc

SEQ ID NO: 38036 - DNA, 71 bp, chicken (Gallus Gallus)
  misc_feature (36): n=c or t
taaaattcctagataaaatcttttccattgcaattncacagtcagattatctccttgagtgtaaaatctgt

SEQ ID NO: 38037 - DNA, 71 bp, chicken (Gallus Gallus)
  misc_feature (36): n=c or t
tcgagggatggcctcccactcaagtcaagcccttcngtaacactgcatggactgctgtcaggttgatctgt

SEQ ID NO: 38038 - DNA, 71 bp, chicken (Gallus Gallus)
  misc_feature (36): n=a or g
tcaaaatcacagctgcagctctgctgtcagtcccanaagtcagtttgctttcactgacagctgaccttatg

SEQ ID NO: 38039 - DNA, 71 bp, chicken (Gallus Gallus)
  misc_feature (36): n=a or g
aaaggggagatgggaagagcttgatttcttcatgcncagctgcacatgcacttcgctgggcagtctgtctg

SEQ ID NO: 38040 - DNA, 71 bp, chicken (Gallus Gallus)
  misc_feature (36): n=a or g
acttggaaacaccttctgtactacaacgcaaaaaancaaataagacagctacagaaaatgtgatattacct

SEQ ID NO: 38041 - DNA, 71 bp, chicken (Gallus Gallus)
  misc_feature (36): n=c or t
tcaaagtggaaataatgggaggggatgtcctgttgncctgctgcacaggagcttgtttttgtgctgtgcac

SEQ ID NO: 38042 - DNA, 71 bp, chicken (Gallus Gallus)
  misc_feature (36): n=a or g
atacaagaaaccatcagagtttaggctctcattgcnctagcagttctacacccacaaggtaagaactcagt

SEQ ID NO: 38043 - DNA, 71 bp, chicken (Gallus Gallus)
  misc_feature (36): n=c or t
attgttttaaggcctggttagctttagctgatcatnacagactgctgtttcaatctatactctgtcaatgg

SEQ ID NO: 38044 - DNA, 71 bp, chicken (Gallus Gallus)
  misc_feature (36): n=a or g
ggaactctcaatttccagtaatgtaaaccttccagncaaacttgcattaattttgataaacatgctttagt

SEQ ID NO: 38045 - DNA, 71 bp, chicken (Gallus Gallus)
  misc_feature (36): n=c or t
caaggaaagcatatccttgatatgttcacaattggngtgaggtaagatttttgtcatgtaggttgtgcatt

SEQ ID NO: 38046 - DNA, 71 bp, chicken (Gallus Gallus)
  misc_feature (36): n=a or g
ctgcattctagagaaatttgggcagtttctgttacncggagcaatgctgaaatttcaagaaactgctaagc

SEQ ID NO: 38047 - DNA, 71 bp, chicken (Gallus Gallus)
  misc_feature (36): n=a or g
ctatgaacaaaagagaacactgctctccattgctcngcttgacatctgttattataactgaattctctcaa

SEQ ID NO: 38048 - DNA, 71 bp, chicken (Gallus Gallus)
  misc_feature (36): n=a or g
ggcatttactttccagactaaggtctattgagtccnttatagtacctgtgactttttaattattccatttg

SEQ ID NO: 38049 - DNA, 71 bp, chicken (Gallus Gallus)
  misc_feature (36): n=c or t
aacactttgcattgaagctttctctttagaaaaacngggatcctgctgtttattttgatagtcaccacagt

SEQ ID NO: 38050 - DNA, 71 bp, chicken (Gallus Gallus)
  misc_feature (36): n=c or t
agtatcagtgcaaaataaagatatgcctcagccctnaccagaaccaaaaaggaacagattaagtgatattg

SEQ ID NO: 38051 - DNA, 71 bp, chicken (Gallus Gallus)
  misc_feature (36): n=a or g
caagacctataggcaaatttatttgaagtaaaactngcttttgaaacgtgaggcagcaccatgatagtgct

SEQ ID NO: 38052 - DNA, 71 bp, chicken (Gallus Gallus)
  misc_feature (36): n=a or c
cagaatgacttctgcacagcactttgccctaccccncagagtcaaacagaccagaaaaatcagcaacacat

SEQ ID NO: 38053 - DNA, 71 bp, chicken (Gallus Gallus)
  misc_feature (36): n=c or t
ctgtatgggttggcaaagaccccatcacactgagangagtcagtgcaaaaccacactagtgctggtgtcta

SEQ ID NO: 38054 - DNA, 71 bp, chicken (Gallus Gallus)
  misc_feature (36): n=a or c
ttttttgtgtgtgggatttgcagttaagtgtgtacnttttgaggattttttacattctggagaggacaaat

SEQ ID NO: 38055 - DNA, 71 bp, chicken (Gallus Gallus)
  misc_feature (36): n=c or t
aaaacttttcaaataagactgagtgagcattgttanagcaagatatagcatatctgcagcattttcacttt

SEQ ID NO: 38056 - DNA, 71 bp, chicken (Gallus Gallus)
  misc_feature (36): n=a or g
accatatgctgcttgccagttttttgaactctaccnagataacagtgggcaagtatcctcttatctatgta

SEQ ID NO: 38057 - DNA, 71 bp, chicken (Gallus Gallus)
  misc_feature (36): n=a or g
cgaaggctttgagaccacatcaaaggctttgaaatncattctattgtgacttcattgtccacaaaaagata

SEQ ID NO: 38058 - DNA, 71 bp, chicken (Gallus Gallus)
  misc_feature (36): n=g or t
tcgccttaactcttaacaaattgcagcatttaaacngacaaggtcagactgacatttgtattacttctaga

SEQ ID NO: 38059 - DNA, 71 bp, chicken (Gallus Gallus)
  misc_feature (36): n=c or t
aataaagagaaattaaaatatagactgtgctgtacnaaataactaacgtgtttttcctggtatttggaaag

SEQ ID NO: 38060 - DNA, 71 bp, chicken (Gallus Gallus)
  misc_feature (36): n=a or g
tgttattccctccagcaacttttgtgcagcttccanatagcccagcatatgccacagctcacacagctgct

SEQ ID NO: 38061 - DNA, 71 bp, chicken (Gallus Gallus)
  misc_feature (36): n=a or g
acaaatggttccttagttcttccactaaaccacttnggagtaaaagtaaatccattgccataagggacttt

SEQ ID NO: 38062 - DNA, 71 bp, chicken (Gallus Gallus)
  misc_feature (36): n=a or g
aaaataacctcaaaccgcattctgttttgagcagtntgacttagctaaatacattactttcttttggcagc

SEQ ID NO: 38063 - DNA, 71 bp, chicken (Gallus Gallus)
  misc_feature (36): n=c or t
acaactgacatatgttgagctgacatttactacaanaaactcagtgcacagctttagtagagctggttagc

SEQ ID NO: 38064 - DNA, 71 bp, chicken (Gallus Gallus)
  misc_feature (36): n=g or t
gacagcagttaagtcaaagcagactattaataacangaaaaaaagcaatgactttggtttgttcagcttta

SEQ ID NO: 38065 - DNA, 71 bp, chicken (Gallus Gallus)
  misc_feature (36): n=c or t
atggatcagaacttaagatcagttctcatttctcanccttactttggcaaactactcttgaaatcaatgtg

SEQ ID NO: 38066 - DNA, 71 bp, chicken (Gallus Gallus)
  misc_feature (36): n=c or t
atttatactaccagttctgattgtggtggatcatgntaacgagctctgtgaccaccaactatttgttttaa

SEQ ID NO: 38067 - DNA, 71 bp, chicken (Gallus Gallus)
  misc_feature (36): n=g or t
aggggaggaggtaacaggtggcatgaaaggagagcngagaagccatgaagatgcaagggagcagcactttt

SEQ ID NO: 38068 - DNA, 71 bp, chicken (Gallus Gallus)
  misc_feature (36): n=a or g
gggtaatttgattattccaatgcttgaagagctggnttgccattattgattctgaatgatcagtttgttca

SEQ ID NO: 38069 - DNA, 71 bp, chicken (Gallus Gallus)
  misc_feature (36): n=a or g
actttgtgaggagaccctgtttcctgtctcccatancctctgcctcactgggaaggctaactagttagagg

SEQ ID NO: 38070 - DNA, 71 bp, chicken (Gallus Gallus)
  misc_feature (36): n=c or t
aagtggtgatgaatgtccagcacacacgtgcagcanggctgatagcgttgcctggtgacagaggagggatg

SEQ ID NO: 38071 - DNA, 71 bp, chicken (Gallus Gallus)
  misc_feature (36): n=a or g
ttggagtagatcctaaaaagagaaccccaaatgcanctataatccaacctggaaactacagataaataagt

SEQ ID NO: 38072 - DNA, 71 bp, chicken (Gallus Gallus)
  misc_feature (36): n=a or g
taatttggtacagataagtcaggagaagacaaaacncaaaacgtctgggagtggaagtctgttcctaactc

SEQ ID NO: 38073 - DNA, 71 bp, chicken (Gallus Gallus)
  misc_feature (36): n=a or g
ggccattattagcttctctgctacaaaagctgaggnatacaaattatctgcttagttgcattatgttatca

SEQ ID NO: 38074 - DNA, 71 bp, chicken (Gallus Gallus)
  misc_feature (36): n=a or g
ggaccttgaaggcaaggaaaagagcttcattgaacntggaaaaagataaactgcaagtgaaggggcctgtc

SEQ ID NO: 38075 - DNA, 71 bp, chicken (Gallus Gallus)
  misc_feature (36): n=a or g
tccacccctgatcttgcagccagtgataccttcagnccctccattaaccctgaaagggaagacagttatgc

SEQ ID NO: 38076 - DNA, 71 bp, chicken (Gallus Gallus)
  misc_feature (36): n=c or t
ttgcccatgcatctaaaatcttggtctgcgtggtangtttcttttctggcagatagaagacttcaggttag

SEQ ID NO: 38077 - DNA, 71 bp, chicken (Gallus Gallus)
  misc_feature (36): n=g or t
ctgtagaaggccagaatagaaatgaaagagggcagncgcagggacattatttcaggccaaagaaagatcaa

SEQ ID NO: 38078 - DNA, 71 bp, chicken (Gallus Gallus)
  misc_feature (36): n=c or t
acgcagggaacacactaacatttccagatcgatttntccaatgaacttgcctacagattcagctgggtaac

SEQ ID NO: 38079 - DNA, 71 bp, chicken (Gallus Gallus)
  misc_feature (36): n=a or g
tatccatgcaacacaaaattagcaagaactttttancacttgcctactttactgtaatttttattatttct

SEQ ID NO: 38080 - DNA, 71 bp, chicken (Gallus Gallus)
  misc_feature (36): n=c or t
tagcactgatcacagatcttccctggctggactcanaaagcagcaaggactaagggaaagagtgagtggca

SEQ ID NO: 38081 - DNA, 71 bp, chicken (Gallus Gallus)
  misc_feature (36): n=g or t
ggtaatcttgcagatttctaagcaagctgcttcccngtgcagagagaaatatgctcctttttcctctggcg

SEQ ID NO: 38082 - DNA, 71 bp, chicken (Gallus Gallus)
  misc_feature (36): n=a or g
gcattagttggatgcagcagctcaccctgctctttntcttagcaaattaggataagtagggtcagcgaccc

SEQ ID NO: 38083 - DNA, 71 bp, chicken (Gallus Gallus)
  misc_feature (36): n=a or g
gtgtagcaactctgtgttttatatttatgctcccancaactgtgtgcctcagtcttgttagctgaacctca

SEQ ID NO: 38084 - DNA, 71 bp, chicken (Gallus Gallus)
  misc_feature (36): n=a or g
gaaatcactgctattcttactcttctcacagtaagnctctccagtaaactacaaccacactatttccaata

SEQ ID NO: 38085 - DNA, 71 bp, chicken (Gallus Gallus)
  misc_feature (36): n=a or g
cgctgttttttgatgaagccaatccttacatgtcanggggggaggcagctgagcccttctgttgggtacat

SEQ ID NO: 38086 - DNA, 71 bp, chicken (Gallus Gallus)
  misc_feature (36): n=a or g
agaatggagcagaacacacatagttttggaaagccntgctgccatctctcatactagtgttttaatgaagc

SEQ ID NO: 38087 - DNA, 71 bp, chicken (Gallus Gallus)
  misc_feature (36): n=c or t
ctttgccaaccagctccaaaatgcactgagaacatntggatttgactatgatggctaggaccgtgagggaa

SEQ ID NO: 38088 - DNA, 71 bp, chicken (Gallus Gallus)
  misc_feature (36): n=a or c
ctattgttgatattgaggacacagagagaaaataangcaggtcattgttaattatctttttgaagcatgcc

SEQ ID NO: 38089 - DNA, 71 bp, chicken (Gallus Gallus)
  misc_feature (36): n=c or t
gactgccagaacacaagaaaatccatctgtgagaangagaattgaatcctataagcacttacatgtgtgct

SEQ ID NO: 38090 - DNA, 71 bp, chicken (Gallus Gallus)
  misc_feature (36): n=a or g
atagttttcatccgaaaactttgaaagctgaaattntcatgtatgagttctcccactggcagctgagacta

SEQ ID NO: 38091 - DNA, 71 bp, chicken (Gallus Gallus)
  misc_feature (36): n=g or t
gaattagagtaagaatgtggattttcttagaaattnaagcacaatatctgaatcttttcttacttgttatc

SEQ ID NO: 38092 - DNA, 71 bp, chicken (Gallus Gallus)
  misc_feature (36): n=c or t
agtctgaaagctcaggcatccttagtaatctataangagggagtctctgttggtcgcatcatggatattgc

SEQ ID NO: 38093 - DNA, 71 bp, chicken (Gallus Gallus)
  misc_feature (36): n=a or g
tgttccatgtagtactttccattagagcctgggacnttacagtctgcttcacacaggtgatggaataatta

SEQ ID NO: 38094 - DNA, 71 bp, chicken (Gallus Gallus)
  misc_feature (36): n=g or t
tggggaaaaaaaaaaaagctgtctgtagcatacttntcctcattgcatgtcttttgctagaggcatctttg

SEQ ID NO: 38095 - DNA, 71 bp, chicken (Gallus Gallus)
  misc_feature (36): n=c or t
gagtgaggagaaaagtgtatgtaataatttgaattngagacttttgatttgattgagttcagctgtccttc

SEQ ID NO: 38096 - DNA, 71 bp, chicken (Gallus Gallus)
  misc_feature (36): n=a or g
ccactggtgcaacttcactgaaagtgtttaagcttnagctagggatgaattaggctcacagtcattaattg

SEQ ID NO: 38097 - DNA, 71 bp, chicken (Gallus Gallus)
  misc_feature (36): n=a or g
ttcctattccacaaaccttagctcttgtgtctctcngtgaccccagagctcatgtgggaagagaggctcca

SEQ ID NO: 38098 - DNA, 71 bp, chicken (Gallus Gallus)
  misc_feature (36): n=a or g
tgaatggagaaactcaataattctgagctactgcanctctgaaaaattgggttcgtaaatctcttttcaac

SEQ ID NO: 38099 - DNA, 71 bp, chicken (Gallus Gallus)
  misc_feature (36): n=c or t
ggaaaatctgttggatctaaaaccatattaaagctncctcctccgcatgctaattaattgtgaccctctgc

SEQ ID NO: 38100 - DNA, 71 bp, chicken (Gallus Gallus)
  misc_feature (36): n=a or g
aaacacaacattaaggttgtacttaggagccgaacnagcaagcaaatttccagcttgtgatagccctataa

SEQ ID NO: 38101 - DNA, 71 bp, chicken (Gallus Gallus)
  misc_feature (36): n=a or g
tgagttgctcacagccaagttaccttgagtgtttgntcatccccatctacagtgcctctattcctgtgcag

SEQ ID NO: 38102 - DNA, 71 bp, chicken (Gallus Gallus)
  misc_feature (36): n=g or t
acaaggtgctatcccacggctagttcagctgctggntagagcacatcaagatacccagcgacgtacttcca

SEQ ID NO: 38103 - DNA, 71 bp, chicken (Gallus Gallus)
  misc_feature (36): n=c or t
ccacagggtgcaactgcacttctgggttatggtacnttctcatttctgtacactgaaggacagcagaaatc

SEQ ID NO: 38104 - DNA, 71 bp, chicken (Gallus Gallus)
  misc_feature (36): n=g or t
atttaagtgatgtcaccaatacccaccaagaggagnataaacagatataactgtatgtctgcccaacataa

SEQ ID NO: 38105 - DNA, 71 bp, chicken (Gallus Gallus)
  misc_feature (36): n=c or t
taaactaagattggatcattgtaggtttaatctttntaaatacttttgacaatagatctactttagcataa

SEQ ID NO: 38106 - DNA, 71 bp, chicken (Gallus Gallus)
  misc_feature (36): n=c or t
ggaagtcttcctgacaaaataacctctcaggtccantggaaacttaagttagagcagcattcagatagatt

SEQ ID NO: 38107 - DNA, 71 bp, chicken (Gallus Gallus)
  misc_feature (36): n=g or t
ttatttgccccacccaaaacaaaaatctgttccttncttatcctaacagggaccaccagttacttttaaag

SEQ ID NO: 38108 - DNA, 71 bp, chicken (Gallus Gallus)
  misc_feature (36): n=a or g
ttcagaggaaaagctggtagtacaacaaatatacanttgatcttgcataacactgaggcttccttgaacat

SEQ ID NO: 38109 - DNA, 71 bp, chicken (Gallus Gallus)
  misc_feature (36): n=a or g
tatactaagggaaaataaagagtttttccccctcantcttatcaggcaaaagcaatcactaagggtccctg

SEQ ID NO: 38110 - DNA, 71 bp, chicken (Gallus Gallus)
  misc_feature (36): n=c or t
acagagggacatttgttattcagtacaaaatattangttgccgtgtgatttaatcatgtcaaaattcatag

SEQ ID NO: 38111 - DNA, 71 bp, chicken (Gallus Gallus)
  misc_feature (36): n=c or t
aagcaaaagcaggacaattgcttttcagggttttcngtactcagtgacttatcaatgggctcttttgccct

SEQ ID NO: 38112 - DNA, 71 bp, chicken (Gallus Gallus)
  misc_feature (36): n=a or c
ataggatggcttaaatcacagtctgtgtcatctcanggactgctcagttactcagggtaacacacgaggaa

SEQ ID NO: 38113 - DNA, 71 bp, chicken (Gallus Gallus)
  misc_feature (36): n=a or g
ccaaccttaaattaccttttagacaaaaataatacnagtggaacaaattgcttatgtgcagagcaattgag

SEQ ID NO: 38114 - DNA, 71 bp, chicken (Gallus Gallus)
  misc_feature (36): n=a or g
gggaatgataccaggtctgtctgggtatgtgggaanagcagcaagagattcctccatgaacctgctttctt

SEQ ID NO: 38115 - DNA, 71 bp, chicken (Gallus Gallus)
  misc_feature (36): n=a or g
agatctggaaggaatagttttaagctacacgttacncagttgtgactgataggcacacatgggaaaatgtt

SEQ ID NO: 38116 - DNA, 71 bp, chicken (Gallus Gallus)
  misc_feature (36): n=c or t
tgctgtgctaacatttgagtgtattaacctgacacnccagtgggttttattgaaatatccttctttaatgt

SEQ ID NO: 38117 - DNA, 71 bp, chicken (Gallus Gallus)
  misc_feature (36): n=g or t
tgctttatgcttgcaatataacctggttctgggagnagggcagtaaatgtggtctagcatgacctggtcag

SEQ ID NO: 38118 - DNA, 71 bp, chicken (Gallus Gallus)
  misc_feature (36): n=a or g
tacttataaagtatttataattaggacattaatacnaaaccagtttcccctagcatacttggctgtgggag

SEQ ID NO: 38119 - DNA, 71 bp, chicken (Gallus Gallus)
  misc_feature (36): n=a or c
attttttctccctcctgtagaaatattttaatttgnctgcatagatatgttcaacaagttaaggaaacaac

SEQ ID NO: 38120 - DNA, 71 bp, chicken (Gallus Gallus)
  misc_feature (36): n=c or t
catatttctcattgtgtcgttgggctaagggattgnttttatgtcatttgcaaatgtgcctatctctgtgt

SEQ ID NO: 38121 - DNA, 71 bp, chicken (Gallus Gallus)
  misc_feature (36): n=c or t
aaagaaaatgtgaggaactgcattattcaggcagcngaggaaggaaaagcaatcttaaggagctgtttgga

SEQ ID NO: 38122 - DNA, 71 bp, chicken (Gallus Gallus)
  misc_feature (36): n=c or t
tcctgaagttggttgctttccctccttttcttattncccattcacagttgccatttttggcatcttgtccc

SEQ ID NO: 38123 - DNA, 71 bp, chicken (Gallus Gallus)
  misc_feature (36): n=g or t
ttgataatttttcataagatatttgtaattaatttnttatttcatgactctgaagagaaagtatattttac

SEQ ID NO: 38124 - DNA, 71 bp, chicken (Gallus Gallus)
  misc_feature (36): n=c or t
ctcactgttaaacaggaataaaattggccaatggangcagaaagtcaataggagagggctggggaggaagg

SEQ ID NO: 38125 - DNA, 71 bp, chicken (Gallus Gallus)
  misc_feature (36): n=c or t
tgcaaaacacacattaactcaattattgttcaaaangtactgcctctgttatatttacacccagatgaatt

SEQ ID NO: 38126 - DNA, 71 bp, chicken (Gallus Gallus)
  misc_feature (36): n=a or c
gaaagagagccgtcctaaagtaagacatagcgaatnaaagaccaacaaacaaatcttgtgggatgcaaaag

SEQ ID NO: 38127 - DNA, 71 bp, chicken (Gallus Gallus)
  misc_feature (36): n=c or t
catgaaattggaagacctccactcaacttttgcagnaatggtcaagttcatagagtttggcattaagggga

SEQ ID NO: 38128 - DNA, 71 bp, chicken (Gallus Gallus)
  misc_feature (36): n=c or t
tctatgtgtcttttcatttaagcacaagttgccatngtggtatcacacaattccacaacacagtactggtt

SEQ ID NO: 38129 - DNA, 71 bp, chicken (Gallus Gallus)
  misc_feature (36): n=a or g
cggactctaacagcaaaacaaatgtaagctttcaanacggtgttgagtgctttaaatatacgtgggcaaca

SEQ ID NO: 38130 - DNA, 71 bp, chicken (Gallus Gallus)
  misc_feature (36): n=c or t
aataacaataataactagtagccttagcagatcacngaatgaggattttgcaattatcctctgaacaagtc

SEQ ID NO: 38131 - DNA, 71 bp, chicken (Gallus Gallus)
  misc_feature (36): n=c or t
ccaaaatctccttctgttggcagtagcagactaacnacacaaaggagctaacagctgcatactacatttct

SEQ ID NO: 38132 - DNA, 71 bp, chicken (Gallus Gallus)
  misc_feature (36): n=a or g
ctaacacagaacttactgtgtaacacagccaagtcngggctgctgaaaccttcagcaatggatgccctgag

SEQ ID NO: 38133 - DNA, 71 bp, chicken (Gallus Gallus)
  misc_feature (36): n=a or g
attcacaggtgctgggggagaagaaggtcaattacntaatccagccaaattctcagcttttacagttttgt

SEQ ID NO: 38134 - DNA, 71 bp, chicken (Gallus Gallus)
  misc_feature (36): n=a or g
tttttaaatcaagacatcactcatctgctcttaaanttgctacagggctgcagttattacaaaactccagt

SEQ ID NO: 38135 - DNA, 71 bp, chicken (Gallus Gallus)
  misc_feature (36): n=c or t
cgatatgagtttcagctgggaggctgtgagtgctgngctgccaacaggatatagccttgcgatgaggcaca

SEQ ID NO: 38136 - DNA, 71 bp, chicken (Gallus Gallus)
  misc_feature (36): n=c or t
aaattcagataatactttaaagtattacagaagcangaatgtagtatactgaatcttactgtgtcaggtgt

SEQ ID NO: 38137 - DNA, 71 bp, chicken (Gallus Gallus)
  misc_feature (36): n=a or g
gttcagtaactgaaaacaaggacaattacagttggntgaccagatgtccctgcaagtagcatgcagaggga

SEQ ID NO: 38138 - DNA, 71 bp, chicken (Gallus Gallus)
  misc_feature (36): n=a or g
taaaatataacctttttctgtcatgagagacatgangaacagtctaccactacacaaacatataccacatg

SEQ ID NO: 38139 - DNA, 71 bp, chicken (Gallus Gallus)
  misc_feature (36): n=a or g
aaccaaaacaagtttttttggcttaagagtgaaacnggggattcagttggtgccctgcttcctttttcaga

SEQ ID NO: 38140 - DNA, 71 bp, chicken (Gallus Gallus)
  misc_feature (36): n=g or t
attattatatttggcctttttatatctattactagnaatatctactttctactatgaaagacttatataat

SEQ ID NO: 38141 - DNA, 71 bp, chicken (Gallus Gallus)
  misc_feature (36): n=c or t
aatgctactggagctcttatgttttcaaaacttaanacattttggcagggaaatccagtacaaccatagtg

SEQ ID NO: 38142 - DNA, 71 bp, chicken (Gallus Gallus)
  misc_feature (36): n=a or g
ctttgtagaaaccactgtacttgtggaagaggaggnccagaactgggaacatgcccctttctgtgcttgcc

SEQ ID NO: 38143 - DNA, 71 bp, chicken (Gallus Gallus)
  misc_feature (36): n=c or t
tcattgattctaagggtaaggaacagtaattctacnctggcctaaactagtgaaaacattctcctgtttca

SEQ ID NO: 38144 - DNA, 71 bp, chicken (Gallus Gallus)
  misc_feature (36): n=c or t
accactttggaagccacttcatgaaaactaaacaanagaggaaggattatcacaacgcattaatggcacta

SEQ ID NO: 38145 - DNA, 71 bp, chicken (Gallus Gallus)
  misc_feature (36): n=a or c
ggttgtttttcagaggcatttatgaaaaggacagantttcagacttacagatcacagtggagtggctttga

SEQ ID NO: 38146 - DNA, 71 bp, chicken (Gallus Gallus)
  misc_feature (36): n=c or t
tagcattgcaggatgactgttgcaattttgaagctntggccaaagcttgaaaaatgttagaataccttttt

SEQ ID NO: 38147 - DNA, 71 bp, chicken (Gallus Gallus)
  misc_feature (36): n=g or t
tgctcctactccagctccaggagccagtgcatcaancactgcgccttcacaggcacagggacctccttacc

SEQ ID NO: 38148 - DNA, 71 bp, chicken (Gallus Gallus)
  misc_feature (36): n=a or g
tgtgaagccgatttaggaagtcagaagtgcttcaantccagattttacctcttcagtctgtgacctgccgt

SEQ ID NO: 38149 - DNA, 71 bp, chicken (Gallus Gallus)
  misc_feature (36): n=a or g
ggtttcctgacagaatacctgttgagacttgatctnccaagtaccttcaactgttgggcatacatttcctc

SEQ ID NO: 38150 - DNA, 71 bp, chicken (Gallus Gallus)
  misc_feature (36): n=a or g
ggtgctgtggctttgattcagcctagctcaattaanttttgaggaggacagagacttcggtctcacaagga

SEQ ID NO: 38151 - DNA, 71 bp, chicken (Gallus Gallus)
  misc_feature (36): n=c or t
taaagtccattgcttgccttttatttgtatgcattnttaaggttactttcctttgtgtgcatatgaggata

SEQ ID NO: 38152 - DNA, 71 bp, chicken (Gallus Gallus)
  misc_feature (36): n=c or t
gttttaaatcctgtcattataacagtttagtgttgnggtggaagattttccttaattactcccaaagggaa

SEQ ID NO: 38153 - DNA, 71 bp, chicken (Gallus Gallus)
  misc_feature (36): n=c or t
gtattatactaggaaaataccatcctataattgtcnttgtttttatattctctccagctcattcattacca

SEQ ID NO: 38154 - DNA, 71 bp, chicken (Gallus Gallus)
  misc_feature (36): n=a or c
tgctatgcatgtttctctgtgtctcttttgactagnctttcatacagctttagcatatgcgtgaataaaag

SEQ ID NO: 38155 - DNA, 71 bp, chicken (Gallus Gallus)
  misc_feature (36): n=a or g
ggttctgccctctggcattgccgtgagaaccagccnatatttaatggacagcacactgacacatagcaaat

SEQ ID NO: 38156 - DNA, 71 bp, chicken (Gallus Gallus)
  misc_feature (36): n=a or g
gatatataattagttaccatctttcaacttaaaccntaagacagtatgaatagtattttgcttatctttgg

SEQ ID NO: 38157 - DNA, 71 bp, chicken (Gallus Gallus)
  misc_feature (36): n=c or t
actgaggcaaaattggcctgtcagatctgttaggangatctgtgccaacctaatcagcttgaaaataccct

SEQ ID NO: 38158 - DNA, 71 bp, chicken (Gallus Gallus)
  misc_feature (36): n=g or t
attatgtcggcattagaaaactgtaacaacatgggnagttgggtttgtgaagaaatgtctttgaagtatga

SEQ ID NO: 38159 - DNA, 71 bp, chicken (Gallus Gallus)
  misc_feature (36): n=g or t
ttaataatggagctgtcagtttgacacctgcaaacnctagtcctgagagttttatttccaaatttagattt

SEQ ID NO: 38160 - DNA, 71 bp, chicken (Gallus Gallus)
  misc_feature (36): n=c or t
aataacagactgggggattgctctggaatcttgtcnggaatctccaagtagctctctaacccactgaattc

SEQ ID NO: 38161 - DNA, 71 bp, chicken (Gallus Gallus)
  misc_feature (36): n=a or g
tagggaaatgttgacataaggatgtagctaataaangtaggaatttaataatagttttgtgcaagtatcac

SEQ ID NO: 38162 - DNA, 71 bp, chicken (Gallus Gallus)
  misc_feature (36): n=g or t
tgccagtcttgaaacctagctatgaatacaagtcantttacataaattcactccagaactaacatggccta

SEQ ID NO: 38163 - DNA, 71 bp, chicken (Gallus Gallus)
  misc_feature (36): n=c or t
aaactcagttacagcatttctgatgttggtaatttntgtgactgaaaaatatgctgactctgtgtttgtgt

SEQ ID NO: 38164 - DNA, 71 bp, chicken (Gallus Gallus)
  misc_feature (36): n=c or t
cttgcactgcccctgtttcccattacatatggtgangatgcctatctatctcagctgacaactgaacaaga

SEQ ID NO: 38165 - DNA, 71 bp, chicken (Gallus Gallus)
  misc_feature (36): n=a or g
tcaaaccacttggagacaacttggggcagtttcagnctaagtgcatcaactcatattctgacttcacattc

SEQ ID NO: 38166 - DNA, 71 bp, chicken (Gallus Gallus)
  misc_feature (36): n=a or c
gtcaagataccaaaggagtttagaagcctgcttgcnattggatagtaattactgatgtagaagaaagggtc

SEQ ID NO: 38167 - DNA, 71 bp, chicken (Gallus Gallus)
  misc_feature (36): n=a or g
acattggtctccatggctgatcccgaagagcaccanttccacctatgaagtttcaagggtccatcagagca

SEQ ID NO: 38168 - DNA, 71 bp, chicken (Gallus Gallus)
  misc_feature (36): n=a or g
acttcttcatcctcactgtcctggtcttgctcctcnctcacctgctcctcacttgaatcatcattgtcctg

SEQ ID NO: 38169 - DNA, 71 bp, chicken (Gallus Gallus)
  misc_feature (36): n=c or t
gtctttgaaacatgccaagtgatgagaaatttttgnagctgagctccctgttttagaccaggagatgacat

SEQ ID NO: 38170 - DNA, 71 bp, chicken (Gallus Gallus)
  misc_feature (36): n=c or t
ggccttgtgtctggttatcaaactacaagaaagtgnagtgttacatcttggaactgtaaccaaggtgaata

SEQ ID NO: 38171 - DNA, 71 bp, chicken (Gallus Gallus)
  misc_feature (36): n=a or g
ttgcaaaaacgtcctgctttcatcatgccacggagnagccaatgtcagagactcagcgtcatgagctcacc

SEQ ID NO: 38172 - DNA, 71 bp, chicken (Gallus Gallus)
  misc_feature (36): n=a or g
gaataatactgaataactttgtttttaattcatctnttgacttatgtgaagaccataaatagcttcatctt

SEQ ID NO: 38173 - DNA, 71 bp, chicken (Gallus Gallus)
  misc_feature (36): n=a or c
gtaaaaataatcactctagtacatgaccaaccagcnaagttctggagtccaagcaaattactaagctacct

SEQ ID NO: 38174 - DNA, 71 bp, chicken (Gallus Gallus)
  misc_feature (36): n=a or g
tagtagtactattgtagatgttgagaaggtaaggcntaaatagatcaaatgatttcttcaaagtcatacag

SEQ ID NO: 38175 - DNA, 71 bp, chicken (Gallus Gallus)
  misc_feature (36): n=g or t
tgggcatgggaaggccccagggcagccctcaccctnctccatcccttccagctgactgcatcctgtcccca

SEQ ID NO: 38176 - DNA, 71 bp, chicken (Gallus Gallus)
  misc_feature (36): n=g or t
ctgtttgttggattgaggctgtaaagagaggcttgnataggctgtcaccccttctgcaggctttccttcat

SEQ ID NO: 38177 - DNA, 71 bp, chicken (Gallus Gallus)
  misc_feature (36): n=c or t
acctacattcaagtgctgtaacaaaaagaaagtctnctcagagcctttccttcttagctgattatttgtga

SEQ ID NO: 38178 - DNA, 71 bp, chicken (Gallus Gallus)
  misc_feature (36): n=c or t
tgcctgcaaatgtacagtgcatgtcttttcccatgntctgttatgcattatcagatgatattagctcactt

SEQ ID NO: 38179 - DNA, 71 bp, chicken (Gallus Gallus)
  misc_feature (36): n=c or t
aaatactgaaagtaggagagctacgtaagttggccnatttatttgacctctaagaaccacagagtgagttc

SEQ ID NO: 38180 - DNA, 71 bp, chicken (Gallus Gallus)
  misc_feature (36): n=c or t
cagcgttgtacaaatgtgtctataatataagttttnacagctatgtgaaatgtttgtactttatcagcttc

SEQ ID NO: 38181 - DNA, 71 bp, chicken (Gallus Gallus)
  misc_feature (36): n=a or c
gcaaatatgcaaataactgctcttgacagtgctagnagaaatttgtccctgatggtgttgtttcttatggg

SEQ ID NO: 38182 - DNA, 71 bp, chicken (Gallus Gallus)
  misc_feature (36): n=c or t
tatacagcagctgggtatacaagtcagggcacaaanaacactgtaattgaactgttttcagtacaatcttt

SEQ ID NO: 38183 - DNA, 71 bp, chicken (Gallus Gallus)
  misc_feature (36): n=a or g
taattttataatattggccatcacaagatctgtaanaagagagtgacagcctctgcttagccacccaaaca

SEQ ID NO: 38184 - DNA, 71 bp, chicken (Gallus Gallus)
  misc_feature (36): n=c or t
gctattggggaatctctgctctggtgcacaagaacncggtgcaaactagaaaccttgctgtgacactgaac

SEQ ID NO: 38185 - DNA, 71 bp, chicken (Gallus Gallus)
  misc_feature (36): n=c or t
ttctctatctaatgtatcaggctgaggtgtagccancaaaatgacatttcctttgcatcaaaactggcttc

SEQ ID NO: 38186 - DNA, 71 bp, chicken (Gallus Gallus)
  misc_feature (36): n=a or g
atcatgaaaaaaatgtagagctttttttaacctttnatttggaagcttatctagattgccttatatgtgct

SEQ ID NO: 38187 - DNA, 71 bp, chicken (Gallus Gallus)
  misc_feature (36): n=c or t
gcacaaccatgtctgacaaggcagaggtgaacctcnttgcatccccaccaggagaccaaggactgccttgt

SEQ ID NO: 38188 - DNA, 71 bp, chicken (Gallus Gallus)
  misc_feature (36): n=c or t
tcccagcttatttcttcaccaaagtgtgcaaggtgncatttattaaagctcagtaaaggcaccctgaaata

SEQ ID NO: 38189 - DNA, 71 bp, chicken (Gallus Gallus)
  misc_feature (36): n=a or g
ggatataattcatcaacagtgcctggttttgcctgngttctggatgttttttagtttatatatcaaaggta

SEQ ID NO: 38190 - DNA, 71 bp, chicken (Gallus Gallus)
  misc_feature (36): n=c or t
gaccatcctggggcctcctcagtaacatgggctttnagattctatatacagataataattaaataaaaaat

SEQ ID NO: 38191 - DNA, 71 bp, chicken (Gallus Gallus)
  misc_feature (36): n=a or g
gaataacccctccgtcctctccgggaagcgaccagnggccccacgagcaccggggcggctgcaacgcgggg

SEQ ID NO: 38192 - DNA, 71 bp, chicken (Gallus Gallus)
  misc_feature (36): n=a or g
attagttcggagttctgtaactgtcctcggctttantattttcccatttttaaaccattagatgttaattc

SEQ ID NO: 38193 - DNA, 71 bp, chicken (Gallus Gallus)
  misc_feature (36): n=c or t
ggctcacctctgccttcttagtccagctcctaccangtgccaggtagtactacaatctgctttgaaactca

SEQ ID NO: 38194 - DNA, 71 bp, chicken (Gallus Gallus)
  misc_feature (36): n=a or g
gctaagtgaaaattactggatgttactcaggtgatnttaaagcttcagtctggcacctctggttttctgtc

SEQ ID NO: 38195 - DNA, 71 bp, chicken (Gallus Gallus)
  misc_feature (36): n=g or t
tgagcattgtatatttctattcttccttcagtcggnttgtcatggtaatgggagccatgctactggtttac

SEQ ID NO: 38196 - DNA, 71 bp, chicken (Gallus Gallus)
  misc_feature (36): n=a or g
acagggctgctgctccgggcttgtaaatcagtagcngtcagggacaaaaggtgaatgctcttgtcatcatt

SEQ ID NO: 38197 - DNA, 71 bp, chicken (Gallus Gallus)
  misc_feature (36): n=a or g
tgggacctgaatcttttatttcttaagtgcatctcnggaatggtgcatagcagctggccctgctcacactg

SEQ ID NO: 38198 - DNA, 71 bp, chicken (Gallus Gallus)
  misc_feature (36): n=a or g
caaaatgatacatctacagattttaaaatcccaccnataccttgcttattccacttgtgctgcataagcat

SEQ ID NO: 38199 - DNA, 71 bp, chicken (Gallus Gallus)
  misc_feature (36): n=c or t
tgggtagaattgcacataaaaagagaacagcaaacnggaaataatttgttatgcagtttgtcccaaaagta

SEQ ID NO: 38200 - DNA, 71 bp, chicken (Gallus Gallus)
  misc_feature (36): n=a or g
agcctgtgcatgtaagtacagctgtttctaacacanaaagctgcctgagtatgtagaaatgttcccttccc

SEQ ID NO: 38201 - DNA, 71 bp, chicken (Gallus Gallus)
  misc_feature (36): n=a or g
cgtttatttagatattgttatgctgtaggaatatcnttaacacagaaactttcctgtggctgttacattgc

SEQ ID NO: 38202 - DNA, 71 bp, chicken (Gallus Gallus)
  misc_feature (36): n=c or t
aaattgtcagttgttagagtgggttcatcatgcagnagtttggcaattttaatgcttcctcttagagcatg

SEQ ID NO: 38203 - DNA, 71 bp, chicken (Gallus Gallus)
  misc_feature (36): n=a or c
tgctccagcgaatctgtgacaagtgaatacagaaangatgcatgcaggctttattgaaagctttgctaatc

SEQ ID NO: 38204 - DNA, 71 bp, chicken (Gallus Gallus)
  misc_feature (36): n=c or t
ggctctgactagacactgtttacattgctttttgcnatttggagtacagatatgttacagcttgcttgaaa

SEQ ID NO: 38205 - DNA, 71 bp, chicken (Gallus Gallus)
  misc_feature (36): n=a or g
caccttggaattccaaactctggaatctctaaatcngcccttcagagtcaccagatttctggtctcttaag

SEQ ID NO: 38206 - DNA, 71 bp, chicken (Gallus Gallus)
  misc_feature (36): n=c or t
aaactgaggcatgaggtaatgaagatgcttgttcangcagcagagataagctgtgtgcgtagaaattctga

SEQ ID NO: 38207 - DNA, 71 bp, chicken (Gallus Gallus)
  misc_feature (36): n=c or t
tccatacatctacaacctccttcactcttgtttttngctaacttcacctgtagtaattacctaaagatcag

SEQ ID NO: 38208 - DNA, 71 bp, chicken (Gallus Gallus)
  misc_feature (36): n=a or g
cgcatgttgtttggattagtcctgtgcttaacctcncttttagcaacaggacgctcgttacaagccagaca

SEQ ID NO: 38209 - DNA, 71 bp, chicken (Gallus Gallus)
  misc_feature (36): n=a or c
atatcacagagatgccgaagaaaaagttagctaaanaatgtctaagttatggcaaccttctttctgaaagt

SEQ ID NO: 38210 - DNA, 71 bp, chicken (Gallus Gallus)
  misc_feature (36): n=c or t
aacacataacttcctccacatttattagttctctanagggtctgcctactcaagcacagtaattctaatac

SEQ ID NO: 38211 - DNA, 71 bp, chicken (Gallus Gallus)
  misc_feature (36): n=c or t
caacaaaagaaaaaacaacttctccagtgattgcanagtgtactctgagtatgatttttgcttcatttcaa

SEQ ID NO: 38212 - DNA, 71 bp, chicken (Gallus Gallus)
  misc_feature (36): n=a or c
gcaagagaaaaatcagtaagctctttttttgacaantatgcacctccatttctaaatgcactatcaacaat

SEQ ID NO: 38213 - DNA, 71 bp, chicken (Gallus Gallus)
  misc_feature (36): n=a or g
taacaggtcaaaaccttgcctctcttacaagctctnataattggaacagaataaaagacttgaattttgaa

SEQ ID NO: 38214 - DNA, 71 bp, chicken (Gallus Gallus)
  misc_feature (36): n=a or g
gctgaactgctctaagtccagaccgccttggctgancttcccaggttctttctgcagctgaatattgcaga

SEQ ID NO: 38215 - DNA, 71 bp, chicken (Gallus Gallus)
  misc_feature (36): n=c or t
actcactcttgccaccacaataaaggtctaaccctntttcctatactagatatctaagggcagaagttccc

SEQ ID NO: 38216 - DNA, 71 bp, chicken (Gallus Gallus)
  misc_feature (36): n=c or t
ccatttaccttgagtttgagtagaagaaattatgcnggaattaattttgcatatagatagattttagagaa

SEQ ID NO: 38217 - DNA, 71 bp, chicken (Gallus Gallus)
  misc_feature (36): n=c or t
ctgttactgcatatagttggatgaggatcatgattnacaatgttacagtctgcaggtcatctggagaaggt

SEQ ID NO: 38218 - DNA, 71 bp, chicken (Gallus Gallus)
  misc_feature (36): n=c or t
gcttttccttgagtgtgtgtatgttctgctcagttnatcgtcattactaaatggcttttatttctcacagt

SEQ ID NO: 38219 - DNA, 71 bp, chicken (Gallus Gallus)
  misc_feature (36): n=g or t
atctgtctcttttttgttaggggtttaaaggaagantttcctgttacaagattggttttgttcccaatgaa

SEQ ID NO: 38220 - DNA, 71 bp, chicken (Gallus Gallus)
  misc_feature (36): n=a or g
tcgtctgacttggaagagatggaaataagcagacanaactctggttctcaaaaaattactgctgatttcag

SEQ ID NO: 38221 - DNA, 71 bp, chicken (Gallus Gallus)
  misc_feature (36): n=c or t
aaactgcctagagaaagtttgcatggttgagaggantgggtagaggtctgggattttcagctttgtaattc

SEQ ID NO: 38222 - DNA, 71 bp, chicken (Gallus Gallus)
  misc_feature (36): n=a or c
gggctaaagaatactattttatggccgaaatatccnccagagaaattttattcatgttgatgtctgctact

SEQ ID NO: 38223 - DNA, 71 bp, chicken (Gallus Gallus)
  misc_feature (36): n=c or t
aatttggccaactgcacttttggcccatcaggttgntgagtatgtgttttgtagaattctgaagcttttcc

SEQ ID NO: 38224 - DNA, 71 bp, chicken (Gallus Gallus)
  misc_feature (36): n=a or g
atttgtatctctgcaatctctgaagtagtgatcttnagaggagggctgagggacagaggcccagttccata

SEQ ID NO: 38225 - DNA, 71 bp, chicken (Gallus Gallus)
  misc_feature (36): n=g or t
ggacctttgcccaacttcagtccactcttatggagngagataacaaagagatgtactgcttacctgttagg

SEQ ID NO: 38226 - DNA, 71 bp, chicken (Gallus Gallus)
  misc_feature (36): n=a or g
gagccaacctcttagcagagcagtttccaagagaangattggttactgatggggtagataggaaatactgt

SEQ ID NO: 38227 - DNA, 71 bp, chicken (Gallus Gallus)
  misc_feature (36): n=a or g
atttaagaagttaaggcagagaaaaataatgccagnttctcacatgtcacttagcctgcatcatttttgcc

SEQ ID NO: 38228 - DNA, 71 bp, chicken (Gallus Gallus)
  misc_feature (36): n=a or c
ttcacattccaattttcagttttgtttttgtatganttttcaggtcagttcatatgttaccagtgaggtta

SEQ ID NO: 38229 - DNA, 71 bp, chicken (Gallus Gallus)
  misc_feature (36): n=g or t
cacacgggacccaggtttacaactggcccactgcangaggaacttcctcagcactgacaggcaccagagca

SEQ ID NO: 38230 - DNA, 71 bp, chicken (Gallus Gallus)
  misc_feature (36): n=c or t
ttgaatccagtatctcctagaagagtgctttaatgngtgatgtctgtctcttccagaagtgctttgaactc

SEQ ID NO: 38231 - DNA, 71 bp, chicken (Gallus Gallus)
  misc_feature (36): n=a or c
actgcaagagaagcagagttgtcccttttgaaagcncctagtgtcacagactgacatgaagcaagcaacca

SEQ ID NO: 38232 - DNA, 71 bp, chicken (Gallus Gallus)
  misc_feature (36): n=c or t
catccacattcaaaactcagctccttgatcatgtgnttccatcgctctccctgcacttacctggcactcac

SEQ ID NO: 38233 - DNA, 71 bp, chicken (Gallus Gallus)
  misc_feature (36): n=a or g
gaagctgaaggcatattcatggagtatcctgaatgnaaaaaaaatggtccttcagaactgtgatactatgt

SEQ ID NO: 38234 - DNA, 71 bp, chicken (Gallus Gallus)
  misc_feature (36): n=c or t
attgcagcacttaactacttgcagcttgggtctccnctgaaaggacataagtgccaggaaaatctggctgc

SEQ ID NO: 38235 - DNA, 71 bp, chicken (Gallus Gallus)
  misc_feature (36): n=c or t
gctaggctaatcatttgcttctccttgcatttacangtggtgtcccagtggtattattgtgttcaggtttt

SEQ ID NO: 38236 - DNA, 71 bp, chicken (Gallus Gallus)
  misc_feature (36): n=a or g
gcacaccatttagccatagaaggtagctaaaatacngaaaagaaacaactagaacagatgactaaaacttc

SEQ ID NO: 38237 - DNA, 71 bp, chicken (Gallus Gallus)
  misc_feature (36): n=c or t
tcttgccgggcattattatcctggtggactatctgnccagaaatcagtgagataagtcaagttcttcttcc

SEQ ID NO: 38238 - DNA, 71 bp, chicken (Gallus Gallus)
  misc_feature (36): n=a or g
taatgctcattttcagtttcagctacacagttatcntgattttcatgagaagtctgctgtctaacaactct

SEQ ID NO: 38239 - DNA, 71 bp, chicken (Gallus Gallus)
  misc_feature (36): n=a or g
aatagtttgatatattgaaaatggtaggaagtgatntatttgagtaaaggttctagctttcgagccctgtt

SEQ ID NO: 38240 - DNA, 71 bp, chicken (Gallus Gallus)
  misc_feature (36): n=a or g
gtgttcacccggggagaagagctggtggcgggatcnctgcatgactacgtgacctacactgacaacacagc

SEQ ID NO: 38241 - DNA, 71 bp, chicken (Gallus Gallus)
  misc_feature (36): n=a or g
agtgcctgagaggccagagcctggaaaaggggaaangagaggaggtcaggatgcatatcaaatgatgctgt

SEQ ID NO: 38242 - DNA, 71 bp, chicken (Gallus Gallus)
  misc_feature (36): n=c or t
gccgtattccaatttactctgtaagtatttgtttgngagttgctcaaatactttgtttctttccctttcct

SEQ ID NO: 38243 - DNA, 71 bp, chicken (Gallus Gallus)
  misc_feature (36): n=c or t
tgaaacaactttatttgtaattatatcatctgaganagttttcacaaacctggcaaagagatcctcaacaa

SEQ ID NO: 38244 - DNA, 71 bp, chicken (Gallus Gallus)
  misc_feature (36): n=c or t
aaagcactagttttatgattccactgacacttcttntgaaaaaagtccttgtaatggaagtaagtattgga

SEQ ID NO: 38245 - DNA, 71 bp, chicken (Gallus Gallus)
  misc_feature (36): n=a or g
ctattagatattttaatggaagaatagcctggcacncttccatctacgtaatataggggaaattttaaaaa

SEQ ID NO: 38246 - DNA, 71 bp, chicken (Gallus Gallus)
  misc_feature (36): n=a or c
ggggttctccatggcagcagttcagtaggacctcanctctgattctccacagttgttccatgttccccttc

SEQ ID NO: 38247 - DNA, 71 bp, chicken (Gallus Gallus)
  misc_feature (36): n=c or t
cttagattctgaatggaatttcatttccaatagatntatttcccaagtttttaccaactcaggcatgtttt

SEQ ID NO: 38248 - DNA, 71 bp, chicken (Gallus Gallus)
  misc_feature (36): n=a or g
ttgtattcctcaggcagcacaaattgcacctccttntaactaagaggtgaagaagttgtgttgcttcagta

SEQ ID NO: 38249 - DNA, 71 bp, chicken (Gallus Gallus)
  misc_feature (36): n=c or t
gtaccatcatagcgtacctcatctgggggaatgccngggagtcaaattgggagggtgagtgtcagggaatt

SEQ ID NO: 38250 - DNA, 71 bp, chicken (Gallus Gallus)
  misc_feature (36): n=c or t
gcttctcagacatatttagatcttggttaattgtanttttaagtttgctctagttcataggcctaaagcag

SEQ ID NO: 38251 - DNA, 71 bp, chicken (Gallus Gallus)
  misc_feature (36): n=a or g
aggcatgatacatcatctgactgttttaatgtaccntgtgtagtgatctgagtaaacagaggcaatttttc

SEQ ID NO: 38252 - DNA, 71 bp, chicken (Gallus Gallus)
  misc_feature (36): n=a or g
ttgactgcatacagctgaaaggcttatttgtttctngtaatgctgagaaattttcagatgagacattattt

SEQ ID NO: 38253 - DNA, 71 bp, chicken (Gallus Gallus)
  misc_feature (36): n=a or c
tatcaaaattacagatcttattaaaaaaaagcctanaaatatggatgcagtaacatcagcatctatgctag

SEQ ID NO: 38254 - DNA, 71 bp, chicken (Gallus Gallus)
  misc_feature (36): n=c or t
aagataaaagagaaaggtaagttattttgtagacangatgatacaggcttcacaagcagggcaaaaataat

SEQ ID NO: 38255 - DNA, 71 bp, chicken (Gallus Gallus)
  misc_feature (36): n=a or g
cacattctgactatgacacctacaggccagaggagngctgtgtgaaagtgaagacacttcagcaaaaaaaa

SEQ ID NO: 38256 - DNA, 71 bp, chicken (Gallus Gallus)
  misc_feature (36): n=c or t
attgtctaagaaaaaatcccatccaacccacccatngatgtcagtatgcgtactcatacatatttgtgtgt

SEQ ID NO: 38257 - DNA, 71 bp, chicken (Gallus Gallus)
  misc_feature (36): n=a or g
agagaaaagtgctggtgaaataggtctttgcttaanctgtccttgaatcacctataggtaatgaggtctcc

SEQ ID NO: 38258 - DNA, 71 bp, chicken (Gallus Gallus)
  misc_feature (36): n=c or t
tctggctttagtttgacattttattcagaaaacacngaggtttagaatctaatagtttttgtgtttctgga

SEQ ID NO: 38259 - DNA, 71 bp, chicken (Gallus Gallus)
  misc_feature (36): n=g or t
ctgtaagttgcgtctgtctctgacagatatgtactnttacttctgttggaattaatttgtacacttacata

SEQ ID NO: 38260 - DNA, 71 bp, chicken (Gallus Gallus)
  misc_feature (36): n=c or t
gaaaaagactgatgttcagcatgaaggacttctttnatgtttggacaataaatgattgaaaaaaaaaagaa

SEQ ID NO: 38261 - DNA, 71 bp, chicken (Gallus Gallus)
  misc_feature (36): n=a or g
acaagaaggtctccattcaccaccatagccacagtntgtatttgctgaactggatatctttaggatagatt

SEQ ID NO: 38262 - DNA, 71 bp, chicken (Gallus Gallus)
  misc_feature (36): n=g or t
aaaattgcatgtaaaatagactgcagcttgatttanctatatttgaaattatgatagagaatgaaaggtaa

SEQ ID NO: 38263 - DNA, 71 bp, chicken (Gallus Gallus)
  misc_feature (36): n=a or g
ttctctaagattctcctctatatgtggaaggactcngtgatgaatcaagaaaccaattcatttatattttg

SEQ ID NO: 38264 - DNA, 71 bp, chicken (Gallus Gallus)
  misc_feature (36): n=a or g
ttattgcagattcatccacttaataatatgagaccntaggagtataaaagtaattgtacatagaatcatag

SEQ ID NO: 38265 - DNA, 71 bp, chicken (Gallus Gallus)
  misc_feature (36): n=a or g
cctccccatcagccacagtattttgtttggaagagnatacatcctgccctattttccacatgaaagtgggc

SEQ ID NO: 38266 - DNA, 71 bp, chicken (Gallus Gallus)
  misc_feature (36): n=a or g
agttagagtcatgcactcttgaacaacatacagaantagttgtttatgtataggcacatgcatataaagta

SEQ ID NO: 38267 - DNA, 71 bp, chicken (Gallus Gallus)
  misc_feature (36): n=c or t
caggatgactacattttgaataaattgaaatggcangaaaaggttattgctgaaagacagactgcttttga

SEQ ID NO: 38268 - DNA, 71 bp, chicken (Gallus Gallus)
  misc_feature (36): n=c or t
acattcaagggtgtgcggacagaaaccaacatgtgntttcttctacattacgggaaacagtttccacccag

SEQ ID NO: 38269 - DNA, 71 bp, chicken (Gallus Gallus)
  misc_feature (36): n=a or c
gagctgactgcaaacaaaagttatctaagtcttggnaaatgcactcaaacgaactaggtagtcatgcacga

SEQ ID NO: 38270 - DNA, 71 bp, chicken (Gallus Gallus)
  misc_feature (36): n=a or c
gctcttccatatgttcttgtaaggggacaattcagnaaactggtaatgtttgtgaatacctcttttaccca

SEQ ID NO: 38271 - DNA, 71 bp, chicken (Gallus Gallus)
  misc_feature (36): n=c or t
aataaagaatacaacacttgttaaagggaagaaaanctaaaacttcatcattaagagagtataagttgaaa

SEQ ID NO: 38272 - DNA, 71 bp, chicken (Gallus Gallus)
  misc_feature (36): n=c or t
ttagaaccgagtattactctttatttgttgaggtgncagctcatctaaggcttagactgtagttgatagat

SEQ ID NO: 38273 - DNA, 71 bp, chicken (Gallus Gallus)
  misc_feature (36): n=c or t
taactcccctggttagcaggattcttgtttgcatangtaacacttgtcatctatattctcattacaatcag

SEQ ID NO: 38274 - DNA, 71 bp, chicken (Gallus Gallus)
  misc_feature (36): n=a or g
aaaggcctcctcctgaaccctttgtgaccttcaggnaggtttgcataattagcttgattaaatacagcaca

SEQ ID NO: 38275 - DNA, 71 bp, chicken (Gallus Gallus)
  misc_feature (36): n=a or g
ttgcccatttctcttctttgcttgaaaaaggagctncaacaaagaggccacatgtgggtctgtgaagctgg

SEQ ID NO: 38276 - DNA, 71 bp, chicken (Gallus Gallus)
  misc_feature (36): n=c or t
tctgtcactgttaaaagcaagggagttgcaaactangcgttgtgaatggatcttttctaggaattgtttgg

SEQ ID NO: 38277 - DNA, 71 bp, chicken (Gallus Gallus)
  misc_feature (36): n=c or t
ttcaaagtttactttcagacttaatgtaacccttgnttatctggcaaccaatgttcaggtcctccagcttc

SEQ ID NO: 38278 - DNA, 71 bp, chicken (Gallus Gallus)
  misc_feature (36): n=c or t
tccttctggtctttacccgattccaactcttctganttgcggtcactaccttatcatgaattatgtaacaa

SEQ ID NO: 38279 - DNA, 71 bp, chicken (Gallus Gallus)
  misc_feature (36): n=a or c
attcagatttgtctgggcttgaatttaaaggcattnccttacaacagcctagctaacgtgctccagctaac

SEQ ID NO: 38280 - DNA, 71 bp, chicken (Gallus Gallus)
  misc_feature (36): n=a or g
gcaaacccatctcactcacagaatgcctggccaaangcaaacacaaatgaagcagcctaaatcacagtcag

SEQ ID NO: 38281 - DNA, 71 bp, chicken (Gallus Gallus)
  misc_feature (36): n=a or c
ccaaatctgtgaacatgagtaataaatgggtacacncccttccaaagtggcagatattatccctaccataa

SEQ ID NO: 38282 - DNA, 71 bp, chicken (Gallus Gallus)
  misc_feature (36): n=c or t
ttgtaatgacactatggtgcttagtggctctcctangcatcaacctgtgcaacactgctgctcaggactat

SEQ ID NO: 38283 - DNA, 71 bp, chicken (Gallus Gallus)
  misc_feature (36): n=a or g
ctacccctttcataaactcggttcataaaccttcanctgaatcataaatttatgtatttcatgcatgtgaa

SEQ ID NO: 38284 - DNA, 71 bp, chicken (Gallus Gallus)
  misc_feature (36): n=a or g
agtgctttcctgggggcaattgggaatctgaagtantgtgaagtggacttggttggaaagggaagatgtga

SEQ ID NO: 38285 - DNA, 71 bp, chicken (Gallus Gallus)
  misc_feature (36): n=a or g
aagccttgggcttcaagtaacagtgggcaaaggatncataattaatataacaagagaccagaaaatgaata

SEQ ID NO: 38286 - DNA, 71 bp, chicken (Gallus Gallus)
  misc_feature (36): n=a or g
tttttgacactttaaaggctgtactttcttggagcntgccaaaattcaaccatgtaagtcaagagtttggc

SEQ ID NO: 38287 - DNA, 71 bp, chicken (Gallus Gallus)
  misc_feature (36): n=c or t
acagcttggtgcaaattgtttttagcattcagtctncaggatagtcagtagaagtgaaggactctctgtac

SEQ ID NO: 38288 - DNA, 71 bp, chicken (Gallus Gallus)
  misc_feature (36): n=c or t
tctcccttttgtgaaaagtaggaagagaggtgatangggagggagatagaagtgagaagttatgacaaatg

SEQ ID NO: 38289 - DNA, 71 bp, chicken (Gallus Gallus)
  misc_feature (36): n=c or t
ctgctggaatggagtgcatgtaaatgtgaaggatcngattccctatttcactgcatcactgtcaggctaat

SEQ ID NO: 38290 - DNA, 71 bp, chicken (Gallus Gallus)
  misc_feature (36): n=c or t
gagacctgcttacctgttcaaaagccaaattttaanccctctgacattccatttaaatagcaacttttatg

SEQ ID NO: 38291 - DNA, 71 bp, chicken (Gallus Gallus)
  misc_feature (36): n=a or g
tgtaacagttctcgctgaaatggtatcaggagctgngaatgccctaaattttccatgcccttgtgttaaaa

SEQ ID NO: 38292 - DNA, 71 bp, chicken (Gallus Gallus)
  misc_feature (36): n=a or g
aggaagatcaaagtctctaaccaaagagctctgtgnaagcttctgatttgttgcctcagtccttgatttgg

SEQ ID NO: 38293 - DNA, 71 bp, chicken (Gallus Gallus)
  misc_feature (36): n=c or t
tacactgtgccaacaaatacagttcggtttggctcnttttctgcacctggatcagcactaactcactcaga

SEQ ID NO: 38294 - DNA, 71 bp, chicken (Gallus Gallus)
  misc_feature (36): n=a or g
tctccctctgcaaccctactaattaaacattatgcngtggcttcccagttttcaagtaaaaatacagtctg

SEQ ID NO: 38295 - DNA, 71 bp, chicken (Gallus Gallus)
  misc_feature (36): n=a or g
ctaaatcaatttgcagaccatcttacttaacagtgnaatacagtactaggagctgctcaaacataattctt

SEQ ID NO: 38296 - DNA, 71 bp, chicken (Gallus Gallus)
  misc_feature (36): n=c or t
gccatgtgaaacttctttgtaaagtgaaatactttngtctggtggctgggaatggtcatgtttcttaagtc

SEQ ID NO: 38297 - DNA, 71 bp, chicken (Gallus Gallus)
  misc_feature (36): n=a or g
gggtattcagttagtatatcagcatactgttgatgntttataagaaatgctaaaagaataggaaattatta

SEQ ID NO: 38298 - DNA, 71 bp, chicken (Gallus Gallus)
  misc_feature (36): n=a or c
tacttaacaatgcatggcaagagagcacagcacacnagctgctcctgctaggctgcttcatgttctgcaac

SEQ ID NO: 38299 - DNA, 71 bp, chicken (Gallus Gallus)
  misc_feature (36): n=a or g
agtgacccattctgtacatgctgcagctatgcttcngcgcatacaaagactgaagtgtttaagtagttccc

SEQ ID NO: 38300 - DNA, 71 bp, chicken (Gallus Gallus)
  misc_feature (36): n=c or t
atttaaatctcagctggacatttccagttttctatncaaaaactgatgattttgagcaccccttttgaatc

SEQ ID NO: 38301 - DNA, 71 bp, chicken (Gallus Gallus)
  misc_feature (36): n=g or t
ctaaggggatgttagcaacagctccacagcagcacnggaaatctttctacctatcctagcacatgctaaag

SEQ ID NO: 38302 - DNA, 71 bp, chicken (Gallus Gallus)
  misc_feature (36): n=a or c
actttggtcattaatgagtttggagcagattgctanagcttaaacaagtctctcagtcagacttcctttaa

SEQ ID NO: 38303 - DNA, 71 bp, chicken (Gallus Gallus)
  misc_feature (36): n=c or t
atgaggccctaaaatcaagctatgaaagcttatgangacgatggttaaacaggatttctcaaatatccttg

SEQ ID NO: 38304 - DNA, 71 bp, chicken (Gallus Gallus)
  misc_feature (36): n=c or t
cactgtagactgccctgtcctttgtctgggctccantgaacagctgccaagtgatgcaaccagtaaacctg

SEQ ID NO: 38305 - DNA, 71 bp, chicken (Gallus Gallus)
  misc_feature (36): n=a or g
tcaaactctttatgccacaagatactgagtcctgtnaaagcaaggagtataaaggggaggctctgccatag

SEQ ID NO: 38306 - DNA, 71 bp, chicken (Gallus Gallus)
  misc_feature (36): n=a or g
atgacaccgttcagcagcagtgcataacagtatatntgagacccaggatagctggactttaagttctcttc

SEQ ID NO: 38307 - DNA, 71 bp, chicken (Gallus Gallus)
  misc_feature (36): n=c or t
ctttgctaacacaaaagactggaatcaacagacaanaccaataaacatgcagagcatgtcaaagacctgaa

SEQ ID NO: 38308 - DNA, 71 bp, chicken (Gallus Gallus)
  misc_feature (36): n=a or c
ggtatataattgtaaaaatattcctatcatccagantgagcttccaggtctaacaatgaaagagaaccaag

SEQ ID NO: 38309 - DNA, 71 bp, chicken (Gallus Gallus)
  misc_feature (36): n=g or t
gttagctttgggaaaaacaacgtgacaggagaactnctagaactctgggctatagtgggaaattatgtatt

SEQ ID NO: 38310 - DNA, 71 bp, chicken (Gallus Gallus)
  misc_feature (36): n=g or t
acccagcacctccttgccccctgttctttttttctnggaagcatctttagcagaacaaccaaatcacattt

SEQ ID NO: 38311 - DNA, 71 bp, chicken (Gallus Gallus)
  misc_feature (36): n=c or t
attatctgcctatacagcatctttactaaagaccangctgcaaaattcaatctaatagaaatttgcctcct

SEQ ID NO: 38312 - DNA, 71 bp, chicken (Gallus Gallus)
  misc_feature (36): n=a or g
gtgttgtggcagacaacattgttgtatgtcatggtncaaactcaactcacaacggtaggttggacactgtt

SEQ ID NO: 38313 - DNA, 71 bp, chicken (Gallus Gallus)
  misc_feature (36): n=g or t
aaaccatgatctccattattaatcctcagtgaaaanggaagagccataacaaacatttctctctctgtttt

SEQ ID NO: 38314 - DNA, 71 bp, chicken (Gallus Gallus)
  misc_feature (36): n=c or t
atttgggcttgacaggtcataacgagtttgcaaagntgaataactcaggcccccccaaaatgaagtgttta

SEQ ID NO: 38315 - DNA, 71 bp, chicken (Gallus Gallus)
  misc_feature (36): n=c or t
gctgactcgggagaaaacttttgagtatggcatgcngtatgctaccttatcaggaactgtaccgaagttaa

SEQ ID NO: 38316 - DNA, 71 bp, chicken (Gallus Gallus)
  misc_feature (36): n=a or g
gtggcaagagagctctaagatcccttacgggtgtgncaagagaggcacggactccctcactggtgcagaac

SEQ ID NO: 38317 - DNA, 71 bp, chicken (Gallus Gallus)
  misc_feature (36): n=a or c
gagctgctacctgtggcagcactaactgcttaattnatttactagatcctgctattaaaatttggagtgtt

SEQ ID NO: 38318 - DNA, 71 bp, chicken (Gallus Gallus)
  misc_feature (36): n=c or t
ttcttcaaggcccatgtgagaaatttgaaactgctnttccagctctgtctgcaaaacaatcacctgttgct

SEQ ID NO: 38319 - DNA, 71 bp, chicken (Gallus Gallus)
  misc_feature (36): n=c or t
tcacatgcccaagctcctctgcaatctctaatgctngagtcattgcatacttagagtatatttctgtctat

SEQ ID NO: 38320 - DNA, 71 bp, chicken (Gallus Gallus)
  misc_feature (36): n=g or t
aattatactctgtgcaagtgtatacggtttcctttngcaaaatagggaaaaatagtttagtattggaataa

SEQ ID NO: 38321 - DNA, 71 bp, chicken (Gallus Gallus)
  misc_feature (36): n=c or t
tttctactgtgtcaggcaccatgatgtgaagtttanaaggtcaaaaaagtgagaagatctactacttcata

SEQ ID NO: 38322 - DNA, 71 bp, chicken (Gallus Gallus)
  misc_feature (36): n=a or g
agaagcataaagaaagactctgcacatggcaattcngatgcttctttcttctcccctagggtataatttag

SEQ ID NO: 38323 - DNA, 71 bp, chicken (Gallus Gallus)
  misc_feature (36): n=c or t
actaatatgtgacttgtggaactgcaaagatgaacnagccaaaggaacttacaaataacactcctcctctt

SEQ ID NO: 38324 - DNA, 71 bp, chicken (Gallus Gallus)
  misc_feature (36): n=a or g
aaaatagtgtaagaataaagtacaagaaaaccaganttttctttggccgtactaaatctactgtgagaaaa

SEQ ID NO: 38325 - DNA, 71 bp, chicken (Gallus Gallus)
  misc_feature (36): n=c or t
gtccatgattctctgctttgtgcaggcaagtccgtnatttcatcctgagcacaattattttcagaattgtc

SEQ ID NO: 38326 - DNA, 71 bp, chicken (Gallus Gallus)
  misc_feature (36): n=a or g
gacaggctggctggaaataccattgtctgaaaatgnttgttacagtgtgaaaagggttgaagatcatctat

SEQ ID NO: 38327 - DNA, 71 bp, chicken (Gallus Gallus)
  misc_feature (36): n=c or t
tactgaagttgaaaccatccctttatcactattttngatggaaagtgtcagtgacatctgacaaattcctg

SEQ ID NO: 38328 - DNA, 71 bp, chicken (Gallus Gallus)
  misc_feature (36): n=a or g
aacatgaattgattaactgaatgaaaaccaaaaatntttagaaacaaattagaagagaacaaatacaaaca

SEQ ID NO: 38329 - DNA, 71 bp, chicken (Gallus Gallus)
  misc_feature (36): n=c or t
catctgctgtaacatgatcaccatgctttcatcagnggttcccaagacaggataagacatactttgcttgt

SEQ ID NO: 38330 - DNA, 71 bp, chicken (Gallus Gallus)
  misc_feature (36): n=a or g
ttggagcagagggcaggagcgcggggtggggttgtnatatctcttctccccgtccaggattggagtcggaa

SEQ ID NO: 38331 - DNA, 71 bp, chicken (Gallus Gallus)
  misc_feature (36): n=a or g
ccatatttttcaaaactcaactttgtctgtatatcntttctgtcaatttcttaaataacatctgtatgcta

SEQ ID NO: 38332 - DNA, 71 bp, chicken (Gallus Gallus)
  misc_feature (36): n=a or g
attattctacagaaacactaaaatatgtatgaaacntatatacatgaaacaattgtactaagcatgctaaa

SEQ ID NO: 38333 - DNA, 71 bp, chicken (Gallus Gallus)
  misc_feature (36): n=c or t
aaaataaatattgtttttaggtgttaggaaatcctnacggttgattgtagtattcatgtgccctcctccct

SEQ ID NO: 38334 - DNA, 71 bp, chicken (Gallus Gallus)
  misc_feature (36): n=a or g
ccaatatacacactctcacacacatgcaggcatccnttttagatgatcccgtgagtgggaagcagaaactc

SEQ ID NO: 38335 - DNA, 71 bp, chicken (Gallus Gallus)
  misc_feature (36): n=a or g
ctgccctggcagcatatgtagtttaaagtacttggngggcaaagaaccatttccctggaaatgtttcagtg

SEQ ID NO: 38336 - DNA, 71 bp, chicken (Gallus Gallus)
  misc_feature (36): n=a or g
tctgaacacatgcaaatttgaaaacaggataaaagncatggaacgcattcctattgttgatgaaatgcctg

SEQ ID NO: 38337 - DNA, 71 bp, chicken (Gallus Gallus)
  misc_feature (36): n=c or t
aagttaaatatattgttgcaagcagaagtatggagngaaagaactctctatcatatgaccaaactcagaaa

SEQ ID NO: 38338 - DNA, 71 bp, chicken (Gallus Gallus)
  misc_feature (36): n=a or g
tctaccaggaaggctgtttcaacagtgttggtaganctgtgggcttctaagagaacttcaactgtgaagat

SEQ ID NO: 38339 - DNA, 71 bp, chicken (Gallus Gallus)
  misc_feature (36): n=a or g
ctgctgttatgatcactgacacaacttcagtcaccntcacctctcctgtcgcgatgaccaggatattgtcc

SEQ ID NO: 38340 - DNA, 71 bp, chicken (Gallus Gallus)
  misc_feature (36): n=a or g
attaaattctgtatcacctgtgaaggccattgttcnacactattttgtcccttagaaagcaatttcctgct

SEQ ID NO: 38341 - DNA, 71 bp, chicken (Gallus Gallus)
  misc_feature (36): n=c or t
tatattgtgtctggcaggatttttgtctggtatctnacaaactccgtagcaaaacctgcaaagtgaccagc

SEQ ID NO: 38342 - DNA, 71 bp, chicken (Gallus Gallus)
  misc_feature (36): n=c or t
tatttttctgaagtacgttctctcctaacatttcantgtaggaggcagtgataaaagacagttcatgcatg

SEQ ID NO: 38343 - DNA, 71 bp, chicken (Gallus Gallus)
  misc_feature (36): n=a or g
gagaatttttgtcattccagtaccttgaaacacaanttgtaagtatttagattcacaccttccaaaaatga

SEQ ID NO: 38344 - DNA, 71 bp, chicken (Gallus Gallus)
  misc_feature (36): n=a or g
tgaatgggatttgacttgaatgtgtgaaaactgttntatagcctttgattttccttgcaactaatggacaa

SEQ ID NO: 38345 - DNA, 71 bp, chicken (Gallus Gallus)
  misc_feature (36): n=c or t
aaaacctgtaaaaaactgccatctctctatggtgangttcccgcggagcttattggggaacctctggaaga

SEQ ID NO: 38346 - DNA, 71 bp, chicken (Gallus Gallus)
  misc_feature (36): n=c or t
cactatttccaaagtattttgttagttaatagatantgtaatgtttgttactcctctgcttcctcccttct

SEQ ID NO: 38347 - DNA, 71 bp, chicken (Gallus Gallus)
  misc_feature (36): n=a or g
tagcatgttaggtagctttcattagtatacctaatnaataggtatgctatctactcaaaggtgatgcaaaa

SEQ ID NO: 38348 - DNA, 71 bp, chicken (Gallus Gallus)
  misc_feature (36): n=c or t
atactgaatatttaggcttgaattgttgttgcttcngtttggaattttgagaaatatagtgcaagataaat

SEQ ID NO: 38349 - DNA, 71 bp, chicken (Gallus Gallus)
  misc_feature (36): n=c or t
attccgttttctagaaatccttcccacaaattcaanatttttgatctctcttccttgaagagcaacagtat

SEQ ID NO: 38350 - DNA, 71 bp, chicken (Gallus Gallus)
  misc_feature (36): n=c or t
ttccttggtgttttgcactgtttagacatttgcacnatgtgttcaagaacatttaccatctccaaaaagag

SEQ ID NO: 38351 - DNA, 71 bp, chicken (Gallus Gallus)
  misc_feature (36): n=c or t
agatctgatgttttgccagcttattcattattaccnttttgattggagataataaattcattccttgaaga

SEQ ID NO: 38352 - DNA, 71 bp, chicken (Gallus Gallus)
  misc_feature (36): n=a or g
tttgcctttgtattttacaggaacatttatatatgncatttcatccaggaacttgatatttactgcctaaa

SEQ ID NO: 38353 - DNA, 71 bp, chicken (Gallus Gallus)
  misc_feature (36): n=g or t
gacctaagagtttccatacacaccatccctttactncatgaagctatgactgaacacatcaaggtcaagct

SEQ ID NO: 38354 - DNA, 71 bp, chicken (Gallus Gallus)
  misc_feature (36): n=c or t
tgccagtcgtcattctgtccaggggatcaggctacnactaagtgaaacttctgaaatgtgcttagcctgag

SEQ ID NO: 38355 - DNA, 71 bp, chicken (Gallus Gallus)
  misc_feature (36): n=c or t
tttaatgttttactcagacagttactgaggtgaatngtggctttttattctagagcagtacaaatactttt

SEQ ID NO: 38356 - DNA, 71 bp, chicken (Gallus Gallus)
  misc_feature (36): n=a or g
acccttggacttattagctgacgtagggactacatnagcacggaagctttggggctccatctgaatttcga

SEQ ID NO: 38357 - DNA, 71 bp, chicken (Gallus Gallus)
  misc_feature (36): n=a or g
actaacaggaaacctgacagagatcttggcagtgcnaatctgtatggcaactcagagaagacggcacccca

SEQ ID NO: 38358 - DNA, 71 bp, chicken (Gallus Gallus)
  misc_feature (36): n=c or t
taaaacaatgttcataacaaatacagtgatgtgcangtgtggtcaggttttagaatataatagacaatcag

SEQ ID NO: 38359 - DNA, 71 bp, chicken (Gallus Gallus)
  misc_feature (36): n=a or g
tagtaacagaataagagatgtttacagttaatgtanagtatgtgaaaacttctccaactactcagacagtc

SEQ ID NO: 38360 - DNA, 71 bp, chicken (Gallus Gallus)
  misc_feature (36): n=c or t
taggttgttgctctttcttgctgagagtggacaagngtgagtggctggctgggtatatattaaatgctcac

SEQ ID NO: 38361 - DNA, 71 bp, chicken (Gallus Gallus)
  misc_feature (36): n=c or t
cacaatttcagtagtttcagacaaatttgaccaatntctcaaaatccttccactaaatctcatgctgcagc

SEQ ID NO: 38362 - DNA, 71 bp, chicken (Gallus Gallus)
  misc_feature (36): n=c or t
cagtgatatctaacaatggactttttgaacatcttncaagcttaaaagacataactcaaaactctggactc

SEQ ID NO: 38363 - DNA, 71 bp, chicken (Gallus Gallus)
  misc_feature (36): n=a or g
gagcagaacagtaccaaaccttagagaccagcactntaatacatggtcagaacaagacaatgtgccataga

SEQ ID NO: 38364 - DNA, 71 bp, chicken (Gallus Gallus)
  misc_feature (36): n=c or t
ttcacttccactgttttagtgttttgactctacttntaattactgacacattgcaaaacttaacaaactga

SEQ ID NO: 38365 - DNA, 71 bp, chicken (Gallus Gallus)
  misc_feature (36): n=g or t
ttgaactacagaagacaaaagtaggacataaataanctagaatgattctataaagttatggggtatgttga

SEQ ID NO: 38366 - DNA, 71 bp, chicken (Gallus Gallus)
  misc_feature (36): n=a or g
tattctagtctcaaggacttccaccaccaaggtgcncacaaagataagcaggcatcagcattttcaatact

SEQ ID NO: 38367 - DNA, 71 bp, chicken (Gallus Gallus)
  misc_feature (36): n=c or t
gtaagaagtttattccacctatgttccatttttgtnctgtccaattgtgaggacagctcttcctcacaaag

SEQ ID NO: 38368 - DNA, 71 bp, chicken (Gallus Gallus)
  misc_feature (36): n=c or t
caagacatagcaatgcctgaagttcctcattacgtnccagataacgatctttccctttcaaaagggagagg

SEQ ID NO: 38369 - DNA, 71 bp, chicken (Gallus Gallus)
  misc_feature (36): n=a or g
gtaaatttttgttaacattaactattatagctctgnatatccttatctacatatgtaacaagtctctcttt

SEQ ID NO: 38370 - DNA, 71 bp, chicken (Gallus Gallus)
  misc_feature (36): n=c or t
acagtgaaatgcatatgtaacaacccacctaacttngactcttctagcaaaatcgtatccctttaaagaaa

SEQ ID NO: 38371 - DNA, 71 bp, chicken (Gallus Gallus)
  misc_feature (36): n=a or g
ttggacttaatgatgtttgcagatcccatccaactnaactgtttcattctattattactcaggcagttgtc

SEQ ID NO: 38372 - DNA, 71 bp, chicken (Gallus Gallus)
  misc_feature (36): n=a or g
agggaggcccaagaagagagagaatttggaatcctntgaacctttaatttcttctgtcacacaggaattgg

SEQ ID NO: 38373 - DNA, 71 bp, chicken (Gallus Gallus)
  misc_feature (36): n=c or t
tatggggagggagtagaagcaaaggaagcatcacgntaccaggcaaatgccgccttgacccttcctatttc

SEQ ID NO: 38374 - DNA, 71 bp, chicken (Gallus Gallus)
  misc_feature (36): n=c or t
ttcttttttcctcctagttgttgcttcttaactaanggtgagatattcattattatgtatagatctgtgaa

SEQ ID NO: 38375 - DNA, 71 bp, chicken (Gallus Gallus)
  misc_feature (36): n=a or g
tgtgttttcagccattctggaggactaagcttctgnctgcttgccagacttcatgactgtgaagtttgaag

SEQ ID NO: 38376 - DNA, 71 bp, chicken (Gallus Gallus)
  misc_feature (36): n=a or g
ttattttaatggagctgaggagaatttggtcttctntgttgcttttcttgagtttttttccaagtagtatc

SEQ ID NO: 38377 - DNA, 71 bp, chicken (Gallus Gallus)
  misc_feature (36): n=a or g
tactgctctttacttatctatgaacacttgagaggnatgataggctaaaaaggaaattgttagtactaatt

SEQ ID NO: 38378 - DNA, 71 bp, chicken (Gallus Gallus)
  misc_feature (36): n=c or t
gcaggtgtttgtgcaaaatctctacatgtaggacangaaccaatagtttgaaaatgtgctagaaggcagct

SEQ ID NO: 38379 - DNA, 71 bp, chicken (Gallus Gallus)
  misc_feature (36): n=a or g
ataaaaggtactaacaccagaataagtactgggttnccaagtctcatttttatgttgctctaattttagat

SEQ ID NO: 38380 - DNA, 71 bp, chicken (Gallus Gallus)
  misc_feature (36): n=a or c
tacactgatttctttcttagcatataagcatacccngaccctctttggaagacaagacaagagcaaagaag

SEQ ID NO: 38381 - DNA, 71 bp, chicken (Gallus Gallus)
  misc_feature (36): n=c or t
tgcattgctatttcatgacagcactcttagatatangttaaagactaaaaaatactaaacagaaggagata

SEQ ID NO: 38382 - DNA, 71 bp, chicken (Gallus Gallus)
  misc_feature (36): n=a or c
atcaaaatcattactgccagtagaggttggaaaaancacatttagggtaccacaagatgttggtgttgcta

SEQ ID NO: 38383 - DNA, 71 bp, chicken (Gallus Gallus)
  misc_feature (36): n=a or g
cctacaggcatgtattttacttcctgagagaatatngatttctacagtacctttgtacgaataagctatgt

SEQ ID NO: 38384 - DNA, 71 bp, chicken (Gallus Gallus)
  misc_feature (36): n=a or c
ggtcccaagtggttgggaaaatactggcaatattcncaattgtagtgtgtttatttcttggagtatcatac

SEQ ID NO: 38385 - DNA, 71 bp, chicken (Gallus Gallus)
  misc_feature (36): n=a or c
tgtcaacagtaattgtgtgctgcctcctaccagtcntgcaaacgtgtaggtcatctgctgcttttagctct

SEQ ID NO: 38386 - DNA, 71 bp, chicken (Gallus Gallus)
  misc_feature (36): n=a or g
atagaaattgaggatatttcatgcttgaagtagtanttgtttccagataaacagatttggagaccgaaagc

SEQ ID NO: 38387 - DNA, 71 bp, chicken (Gallus Gallus)
  misc_feature (36): n=c or t
caaatttaactttagacattcttaaatagacaatcntaaaagactataatccaacatttagaattttagta

SEQ ID NO: 38388 - DNA, 71 bp, chicken (Gallus Gallus)
  misc_feature (36): n=a or g
gttagcagaatcctaacctataaagagcttagctcngaataatatttggaaagctctgaactacagagact

SEQ ID NO: 38389 - DNA, 71 bp, chicken (Gallus Gallus)
  misc_feature (36): n=g or t
ataacaactcagttttactgaggcagtgttgacatntaagcagcagataaggaaggattaagaacacgtta

SEQ ID NO: 38390 - DNA, 71 bp, chicken (Gallus Gallus)
  misc_feature (36): n=a or g
ctgaaagcagcaatacattaatttgctcattttgcngctatcttctctatggaacagatggaacagctcaa

SEQ ID NO: 38391 - DNA, 71 bp, chicken (Gallus Gallus)
  misc_feature (36): n=a or g
atatagctttactgtcttctgcctctcaatcaaganggacttgctttcagccagtgaaacacaaagtgctg

SEQ ID NO: 38392 - DNA, 71 bp, chicken (Gallus Gallus)
  misc_feature (36): n=a or g
cattgcagaaatgttaagtagtgggctggaaatacngaactgcaagaaaggaatctccactgtgcacagat

SEQ ID NO: 38393 - DNA, 71 bp, chicken (Gallus Gallus)
  misc_feature (36): n=c or t
atttacaggtactggggagacaccatttcctccctntaggcttcaacctagtgtctgccacataatttcat

SEQ ID NO: 38394 - DNA, 71 bp, chicken (Gallus Gallus)
  misc_feature (36): n=c or t
gcactggtgggcaggacaggcacccttgatttatangtgtgggtgagatgctgtgagggacatggctttag

SEQ ID NO: 38395 - DNA, 71 bp, chicken (Gallus Gallus)
  misc_feature (36): n=a or g
cattaaagcagtgggatgttgaaaatttggatttcnagtaaaatgcatggaagtaaaatgcatgttttact

SEQ ID NO: 38396 - DNA, 71 bp, chicken (Gallus Gallus)
  misc_feature (36): n=c or t
ttgtggactgatagcaggtcaaaacatggaacaacntattctgtgttccaatcatacaacactgaagtaga

SEQ ID NO: 38397 - DNA, 71 bp, chicken (Gallus Gallus)
  misc_feature (36): n=a or g
caaacataagaaaatcagagaaggtcacaagctatngagacacaacttccacaattctgaacataagtcat

SEQ ID NO: 38398 - DNA, 71 bp, chicken (Gallus Gallus)
  misc_feature (36): n=a or g
ctgcagacctatgaaaacaacactaggctagcaacngtccttttcagaaactattctccctttcaattttg

SEQ ID NO: 38399 - DNA, 71 bp, chicken (Gallus Gallus)
  misc_feature (36): n=a or g
acagtacttttaaacttaccacgttctctgttcagnaacagcaggctaaaaggagcctcctctttgatgac

SEQ ID NO: 38400 - DNA, 71 bp, chicken (Gallus Gallus)
  misc_feature (36): n=a or c
tttacctcagagctctcactgttttccggctggacnccttcttcagcagcttcactctctgcctggtcact

SEQ ID NO: 38401 - DNA, 71 bp, chicken (Gallus Gallus)
  misc_feature (36): n=a or g
aagagaggcgtcgtaggcatctcaatctgcaaagcnctaccatgaaatgcttgaagaacctaaagcagaga

SEQ ID NO: 38402 - DNA, 71 bp, chicken (Gallus Gallus)
  misc_feature (36): n=a or c
agcggagacacatccagctgtgtcaaggtagtgcancctgcctcagcaaagccttcagtaagtgtaaaatg

SEQ ID NO: 38403 - DNA, 71 bp, chicken (Gallus Gallus)
  misc_feature (36): n=g or t
ctcatctgcaaatcctccaaaactctttctgtctanagaagtaacaagagcagagtctcttttgtacacag

SEQ ID NO: 38404 - DNA, 71 bp, chicken (Gallus Gallus)
  misc_feature (36): n=g or t
ttaagaccaattttcatggcagcacaatatagaggnctgggtacttacaacactcttcatctctttctgta

SEQ ID NO: 38405 - DNA, 71 bp, chicken (Gallus Gallus)
  misc_feature (36): n=a or g
aaatttaggtcaattttcagggtcattttacataantaccttttagccacacaataaagctatctcaactt

SEQ ID NO: 38406 - DNA, 71 bp, chicken (Gallus Gallus)
  misc_feature (36): n=a or g
atgttttcgtatcatatcaaccagatataagtacancctatcagttgattctgcttaccttacaaaatctt

SEQ ID NO: 38407 - DNA, 71 bp, chicken (Gallus Gallus)
  misc_feature (36): n=a or g
atatgattttgaaaagctgataaacactgatttgcnttttgcttttatctcacaatgaaaacactgcatga

SEQ ID NO: 38408 - DNA, 71 bp, chicken (Gallus Gallus)
  misc_feature (36): n=a or g
caaagttttggcttttagcactgtgagagcaaaggnctgactgtacctcctgggtggtaggaagaacaaac

SEQ ID NO: 38409 - DNA, 71 bp, chicken (Gallus Gallus)
  misc_feature (36): n=a or g
gcattactttaccaataactccagtccactccccanagatgctgaactccagttctgctgaagtaattgaa

SEQ ID NO: 38410 - DNA, 71 bp, chicken (Gallus Gallus)
  misc_feature (36): n=c or t
cttccaagccatggcaaaagcagataagccattaantgcacaggcagatagctgttaggatgtgtgagaga

SEQ ID NO: 38411 - DNA, 71 bp, chicken (Gallus Gallus)
  misc_feature (36): n=a or g
gaaacagtttcaatgtttctttcagagtaatgcagncagtgtgttgtacatctttatcacagctgcatctt

SEQ ID NO: 38412 - DNA, 71 bp, chicken (Gallus Gallus)
  misc_feature (36): n=a or g
gtttttctaatgggtcaccttcctttttctcctgcncatttgcacttactgcagataatttagaatctaag

SEQ ID NO: 38413 - DNA, 71 bp, chicken (Gallus Gallus)
  misc_feature (36): n=a or c
gtcccctggaggttttccaggttcaaaccgtacagnaagaccaaaatcggctagcaccgccgttaagtcgt

SEQ ID NO: 38414 - DNA, 71 bp, chicken (Gallus Gallus)
  misc_feature (36): n=c or t
gattgggttcactgaagggtagaagccactcaaagnttatgctcattgtcacagctctgacacagcctcca

SEQ ID NO: 38415 - DNA, 71 bp, chicken (Gallus Gallus)
  misc_feature (36): n=g or t
cctaattaaggtacacaagttcagagtgtggctggnctacttgccttctactatcaattgacccagatggg

SEQ ID NO: 38416 - DNA, 71 bp, chicken (Gallus Gallus)
  misc_feature (36): n=c or t
tgtagtaaatgcattccctcgtctctgcctccccgngacctggtcctgaagcaaaattcaaagcctaagta

SEQ ID NO: 38417 - DNA, 71 bp, chicken (Gallus Gallus)
  misc_feature (36): n=a or g
caaatctctccatgtgtaatctgtggccatgcaatnttttttcaagcagttggaggataatgaatacaatt

SEQ ID NO: 38418 - DNA, 71 bp, chicken (Gallus Gallus)
  misc_feature (36): n=c or t
gtgatttttagatatgcaggatttatttctttactngctaaataagaacttcaaataatggtgtttttatg

SEQ ID NO: 38419 - DNA, 71 bp, chicken (Gallus Gallus)
  misc_feature (36): n=a or g
tgctgctgagaaaatgtttgccaaggtccttatttnccaaagctaatagtaaaaagaaaacatctccattc

SEQ ID NO: 38420 - DNA, 71 bp, chicken (Gallus Gallus)
  misc_feature (36): n=g or t
ctacctccctacagatttcagtgttaaatgtatcanaagttaataaagcttattgcagtttttacagtatt

SEQ ID NO: 38421 - DNA, 71 bp, chicken (Gallus Gallus)
  misc_feature (36): n=c or t
tagaatagagaagcataaatgtctatcttctggtanctaagtccattaacattagaattagacgtcatcta

SEQ ID NO: 38422 - DNA, 71 bp, chicken (Gallus Gallus)
  misc_feature (36): n=a or g
tctgagctggaggctccaggtgctctgagatggctnaaggcttcagcaagtgacttcactcagccatctct

SEQ ID NO: 38423 - DNA, 71 bp, chicken (Gallus Gallus)
  misc_feature (36): n=a or c
agcatacaaaggagagacaccttcacccagtttctncaaaatagacgcatctcctcatccagcccacacct

SEQ ID NO: 38424 - DNA, 71 bp, chicken (Gallus Gallus)
  misc_feature (36): n=a or c
ttcccgtatgagttctgctgtctgtttgagaaagangggtattcatttacatcctcagtagagatttattc

SEQ ID NO: 38425 - DNA, 71 bp, chicken (Gallus Gallus)
  misc_feature (36): n=a or g
atatagcatttccaggtttgatagcctatcaccgtnaacttcattggcaaaacacattttctagaacacaa

SEQ ID NO: 38426 - DNA, 71 bp, chicken (Gallus Gallus)
  misc_feature (36): n=c or t
cttagaagtgctcagctccatccattcagcctgacnttttattatctcatacctttgccagttacttgctc

SEQ ID NO: 38427 - DNA, 71 bp, chicken (Gallus Gallus)
  misc_feature (36): n=g or t
cgtttgcatttgatccacttctttttctgtggattnagagactttaaactggtttgtttcatctctgagtt

SEQ ID NO: 38428 - DNA, 71 bp, chicken (Gallus Gallus)
  misc_feature (36): n=a or g
ataacatacaaggagcgctaagtttctgcatgaacngggcaggagaagtgggatggagaaatacaaagtgc

SEQ ID NO: 38429 - DNA, 71 bp, chicken (Gallus Gallus)
  misc_feature (36): n=c or t
acccacatcatagataagagttgaactaacttcatncagctatgggtattttacccttcccataagatgaa

SEQ ID NO: 38430 - DNA, 71 bp, chicken (Gallus Gallus)
  misc_feature (36): n=a or g
tggcataatttgctgtgagctatatttttggcatcnacttctaccccaatgccctaaaatgtatggtaaca

SEQ ID NO: 38431 - DNA, 71 bp, chicken (Gallus Gallus)
  misc_feature (36): n=a or c
tggtagaatgctgcagtagatatgcataaagaaatnattcctgcaatgtttacagaaacttttctcactat

SEQ ID NO: 38432 - DNA, 71 bp, chicken (Gallus Gallus)
  misc_feature (36): n=c or t
ccactggagtggaaaaaacccacatttttctactcngttcaaacaatcgaaatctttgttacctgaacctt

SEQ ID NO: 38433 - DNA, 71 bp, chicken (Gallus Gallus)
  misc_feature (36): n=c or t
gcactgcactaatgacaacagttatctacctgaaangttatcactaataacaattaattactaatctgcaa

SEQ ID NO: 38434 - DNA, 71 bp, chicken (Gallus Gallus)
  misc_feature (36): n=a or g
ttattccaaaagcaaaggccccaaaactagcattcnttaacagaaactatcgaccaaagaaatatgaaagt

SEQ ID NO: 38435 - DNA, 71 bp, chicken (Gallus Gallus)
  misc_feature (36): n=c or t
attcccagctctgccattacaccgaatttctcctgngttggacagttcacaataaggttctaaatgtcgct

SEQ ID NO: 38436 - DNA, 71 bp, chicken (Gallus Gallus)
  misc_feature (36): n=c or t
acagtttagttggtgctgacaataaaaggacagtcntctgacagctctggggaacctttaattcatgttac

SEQ ID NO: 38437 - DNA, 71 bp, chicken (Gallus Gallus)
  misc_feature (36): n=c or t
ttaaatatctattttatgttctcctgttttggggantgattaaaaacccactaaatctaattaagtctttc

SEQ ID NO: 38438 - DNA, 71 bp, chicken (Gallus Gallus)
  misc_feature (36): n=a or g
agactgaagctgcaaatgtcaagactaaagcacatnagctccacctgtcctcttcagcagcccaatatgtt

SEQ ID NO: 38439 - DNA, 71 bp, chicken (Gallus Gallus)
  misc_feature (36): n=c or t
caaattctacagacacaccatatcaaatctgttctnctgaaaagacacattcactggtgaaacaaagagaa

SEQ ID NO: 38440 - DNA, 71 bp, chicken (Gallus Gallus)
  misc_feature (36): n=a or c
cctcgggagctggaattcttcctgtgagatgtcccntctgaagtctctaatttgttcaactcttggaggag

SEQ ID NO: 38441 - DNA, 71 bp, chicken (Gallus Gallus)
  misc_feature (36): n=c or t
tgaagtcgaggaaggcaatatcagtttgcaggaaangtaagaaaaggagcacctgctcttgaatacttgtg

SEQ ID NO: 38442 - DNA, 71 bp, chicken (Gallus Gallus)
  misc_feature (36): n=a or g
gagcacaactccagcctgctctctgcaggatcggtnttacagccttgcaaatcatcgatttctttctttcc

SEQ ID NO: 38443 - DNA, 71 bp, chicken (Gallus Gallus)
  misc_feature (36): n=a or g
acagttcctatctctggaaatggtttatagacccancactcggggaaaacaattgacagcattaaaatatt

SEQ ID NO: 38444 - DNA, 71 bp, chicken (Gallus Gallus)
  misc_feature (36): n=c or t
agcgaacatcttttctcccccatttctctcttcccnctttcaagaatcttacaaattaagacaaaagataa

SEQ ID NO: 38445 - DNA, 71 bp, chicken (Gallus Gallus)
  misc_feature (36): n=c or t
ggaatgaatcaaatttcacttgattctgcagagacngttatacataattatttccacctacactgattcta

SEQ ID NO: 38446 - DNA, 71 bp, chicken (Gallus Gallus)
  misc_feature (36): n=c or t
acatctagacacctcactcatgggagacacagacanaggcaggagacacatccaagaactctttttttttt

SEQ ID NO: 38447 - DNA, 71 bp, chicken (Gallus Gallus)
  misc_feature (36): n=a or c
gatagcatcactgtgcgtctgtgcctgtgtgtcccntgctgttgcaaattctcatccttccttgtgtttgt

SEQ ID NO: 38448 - DNA, 71 bp, chicken (Gallus Gallus)
  misc_feature (36): n=g or t
acctgcaaataagataggcttagcaccttaagttantgaaaacagtttgctttattatttaagatgaaatt

SEQ ID NO: 38449 - DNA, 71 bp, chicken (Gallus Gallus)
  misc_feature (36): n=c or t
aactggagggactaaagtgtgtttgaatgacctttnctctgtatttctctccatctatccacttttctctt

SEQ ID NO: 38450 - DNA, 71 bp, chicken (Gallus Gallus)
  misc_feature (36): n=a or g
caatatcgagagacattacttttggagcagccctcnaacttctatgaaagaagaaaaggtagtgaagtaac

SEQ ID NO: 38451 - DNA, 71 bp, chicken (Gallus Gallus)
  misc_feature (36): n=c or t
gacttgaggatatgttgtactaagctctgcctgacngttagctagttgaagataaccaaataaataaactt

SEQ ID NO: 38452 - DNA, 71 bp, chicken (Gallus Gallus)
  misc_feature (36): n=c or t
aaccaagactgcacgagttagggtttaaatgagaantgccaatctaatcacagtctgcacagaagcaccaa

SEQ ID NO: 38453 - DNA, 71 bp, chicken (Gallus Gallus)
  misc_feature (36): n=c or t
tgcagggatagctgctcattcccctaccttaatganactataattactaaccactgcagaatcttgctagc

SEQ ID NO: 38454 - DNA, 71 bp, chicken (Gallus Gallus)
  misc_feature (36): n=a or g
taagtttttgaggttttacttggaagattcagaacngtccaggagggccgttcagcccttatctttccttg

SEQ ID NO: 38455 - DNA, 71 bp, chicken (Gallus Gallus)
  misc_feature (36): n=a or g
tttcttttcttctgtaactaatatccgtggcaatgncatttgaggggcctgtttagcaagggaaaggaaaa

SEQ ID NO: 38456 - DNA, 71 bp, chicken (Gallus Gallus)
  misc_feature (36): n=c or t
ttgtatgtgcccttcaagaaacacaatgagcaatgngtaacgaggctggtggcacacttcaataccttaaa

SEQ ID NO: 38457 - DNA, 71 bp, chicken (Gallus Gallus)
  misc_feature (36): n=g or t
tgaagtttctctaataatgacatatatgaaagccancagggagctcactaggaggtaactggccaacagga

SEQ ID NO: 38458 - DNA, 71 bp, chicken (Gallus Gallus)
  misc_feature (36): n=c or t
agcactggcctgctctgggtgacaaacaggcagaanggttctcacatcatgggtttgttttatacctttgc

SEQ ID NO: 38459 - DNA, 71 bp, chicken (Gallus Gallus)
  misc_feature (36): n=c or t
ttcctagcagcaagcagtgccaattgctggtgttgntgcatcacacagaggctcttccacccttatgggta

SEQ ID NO: 38460 - DNA, 71 bp, chicken (Gallus Gallus)
  misc_feature (36): n=g or t
ctcttagccctattcttgtgtctgtaaatagtaaangagatctctaagctcataaactgcaagggaatgca

SEQ ID NO: 38461 - DNA, 71 bp, chicken (Gallus Gallus)
  misc_feature (36): n=c or t
cctgtgaaatgcacagtccaactcctcagtctgcanaaacactcatcctcttgccacagaggcactaagga

SEQ ID NO: 38462 - DNA, 71 bp, chicken (Gallus Gallus)
  misc_feature (36): n=a or g
cagtgctcatctttcagcctcctgtacaattctgcnttcaagtgaaggagatcaaggagcatcttatggag

SEQ ID NO: 38463 - DNA, 71 bp, chicken (Gallus Gallus)
  misc_feature (36): n=c or t
aaacttgtagacttctggaagtcgatttgcttttanggataaaacacagaaaatccctctttcataaatac

SEQ ID NO: 38464 - DNA, 71 bp, chicken (Gallus Gallus)
  misc_feature (36): n=g or t
gacacataaaagtctatcttcatcatacaagatagncttattggtggacacaaggcttaaaaactcatgaa

SEQ ID NO: 38465 - DNA, 71 bp, chicken (Gallus Gallus)
  misc_feature (36): n=a or g
tttgggcattgtaggtttacagcactgcagttgaantgctaacttcaggattccataaggacttccagctc

SEQ ID NO: 38466 - DNA, 71 bp, chicken (Gallus Gallus)
  misc_feature (36): n=a or c
cacatgacagctcaccctggcgtactcacctggganttcaccgcctggcacaaagtccttgtaagaaagtt

SEQ ID NO: 38467 - DNA, 71 bp, chicken (Gallus Gallus)
  misc_feature (36): n=a or g
ggtgttaaaaatgacacacgtttcctttgagtaacnaagcacaaacatgatatcctggggagctctgaagg

SEQ ID NO: 38468 - DNA, 71 bp, chicken (Gallus Gallus)
  misc_feature (36): n=a or g
ccccgatactcaaaatatggtgcctgtctcccatcnttgtgccatgtaacctcttcaggaggcaagaaaac

SEQ ID NO: 38469 - DNA, 71 bp, chicken (Gallus Gallus)
  misc_feature (36): n=a or g
agtgtgttcaaagagagatgttttgcaaccttgttnggctcttgagatgaaactggtgacactctttcaaa

SEQ ID NO: 38470 - DNA, 71 bp, chicken (Gallus Gallus)
  misc_feature (36): n=a or g
actggatttccttggaaaaggccaatggccttgtcngtgtccaaaaacatattcctctttttttccttcac

SEQ ID NO: 38471 - DNA, 71 bp, chicken (Gallus Gallus)
  misc_feature (36): n=a or g
gtaaattcaagaatggttgaaacaaagcatggcatngtgataatttaagcgttcagagtttgaaaatcagt

SEQ ID NO: 38472 - DNA, 71 bp, chicken (Gallus Gallus)
  misc_feature (36): n=a or c
ctctttttgctttttagtgcagaagcagacaaatanagcttctgtaacacaaatgacagtaatgtaagtac

SEQ ID NO: 38473 - DNA, 71 bp, chicken (Gallus Gallus)
  misc_feature (36): n=g or t
ttaagtcgtgtctttattttgcttatagcaaatacntaagtgttgtacccaattatgaatgcctctcccat

SEQ ID NO: 38474 - DNA, 71 bp, chicken (Gallus Gallus)
  misc_feature (36): n=a or g
cgcatgcaccatacctgccttcagtcttctgcttgnccaaaccttttattctggttctcctttccacggta

SEQ ID NO: 38475 - DNA, 71 bp, chicken (Gallus Gallus)
  misc_feature (36): n=a or g
gtagctgatctgtcactagcaccaagtgtcaaaatnagagattgtaaattgctgtgaggtggcaagctcag

SEQ ID NO: 38476 - DNA, 71 bp, chicken (Gallus Gallus)
  misc_feature (36): n=c or t
aagctttctctatgtctttctccagtcataccaganatagcaggaaaaggcctttatcttcatatttttca

SEQ ID NO: 38477 - DNA, 71 bp, chicken (Gallus Gallus)
  misc_feature (36): n=a or g
agatctacctgtaatttgatgacatccactggttanggctttctttaccttattaaactgctgcagctctt

SEQ ID NO: 38478 - DNA, 71 bp, chicken (Gallus Gallus)
  misc_feature (36): n=g or t
gagcattggaagtggggattaggtgctataacaaanaatgattgaggaaggacagtaaatactgctaaacc

SEQ ID NO: 38479 - DNA, 71 bp, chicken (Gallus Gallus)
  misc_feature (36): n=a or g
cacagtaatgcttctaatagcatactgtccagctcnctttaagacatgtccatgtccacaaggacagatgg

SEQ ID NO: 38480 - DNA, 71 bp, chicken (Gallus Gallus)
  misc_feature (36): n=a or g
gatccctggtaggatgaactcccttgtcaaaatgcncagtaggtgtaatgcataagtgaacaggatttgtt

SEQ ID NO: 38481 - DNA, 71 bp, chicken (Gallus Gallus)
  misc_feature (36): n=a or g
tctattcctgctcagcgtaagcctagactggcatcntctgaaaggtgttgtactcttaaagctacttgata

SEQ ID NO: 38482 - DNA, 71 bp, chicken (Gallus Gallus)
  misc_feature (36): n=a or g
gtcatttcctctgcagggcaacctctgacctccacnaaagatcctgacacccataagggaagtattcccac

SEQ ID NO: 38483 - DNA, 71 bp, chicken (Gallus Gallus)
  misc_feature (36): n=a or g
tcagatggggttttgctttcagactttacaatagtntaacaaaaaggaattttgaagcaagtagttggttc

SEQ ID NO: 38484 - DNA, 71 bp, chicken (Gallus Gallus)
  misc_feature (36): n=a or c
tttgttcacagaaatgtgccaaacagctctgtattnttaaggaatggtcttcctcttttgagtcctcctac

SEQ ID NO: 38485 - DNA, 71 bp, chicken (Gallus Gallus)
  misc_feature (36): n=a or g
taagatagttgacttaacacctatgtggaacatggnatggggagagatgcactgtcttttaaaagtagagt

SEQ ID NO: 38486 - DNA, 71 bp, chicken (Gallus Gallus)
  misc_feature (36): n=a or c
ccctcttaacatcgcagctatgctcctttgccatanaattccccacagtctgtcccaaactgcatgcaagt

SEQ ID NO: 38487 - DNA, 71 bp, chicken (Gallus Gallus)
  misc_feature (36): n=c or t
caaaactcagaaagttgtaaatgatttggatgagantgagccatacctgacttctgtcctgtactgaggtt

SEQ ID NO: 38488 - DNA, 71 bp, chicken (Gallus Gallus)
  misc_feature (36): n=a or c
tgggttgtttatgaactaagtgtttgtagattctcngtgctgaatgaaggagttggggtattttagaggac

SEQ ID NO: 38489 - DNA, 71 bp, chicken (Gallus Gallus)
  misc_feature (36): n=g or t
ggttgagaacagcaaacacacaaggagcagagctgngcttgagcctccaaggctgaatgttgctgactgaa

SEQ ID NO: 38490 - DNA, 71 bp, chicken (Gallus Gallus)
  misc_feature (36): n=c or t
tgttgtctggcctgtgactatgctgagtgcctgatnggtaaacatcatggctccctggccttgttttgaag

SEQ ID NO: 38491 - DNA, 71 bp, chicken (Gallus Gallus)
  misc_feature (36): n=a or g
ttgtacacacattgcttgcaatgtatcctggaacanttttgtgttgaagagaatctaatcgtattttaagc

SEQ ID NO: 38492 - DNA, 71 bp, chicken (Gallus Gallus)
  misc_feature (36): n=a or c
gcttcatctaaggctcaaatgatcttgaaccttgantagcagcacagaacaaacaacaggctcttcatgtt

SEQ ID NO: 38493 - DNA, 71 bp, chicken (Gallus Gallus)
  misc_feature (36): n=c or t
ggaaataggtccctgacagacagcgttgagtcactntgtcattgctctgagctctgaccttgcttccccat

SEQ ID NO: 38494 - DNA, 71 bp, chicken (Gallus Gallus)
  misc_feature (36): n=a or c
ttttcctagaatcagctatgtaaagcttctagtgcntttttagtctatgtcatatgcagcagagacctccc

SEQ ID NO: 38495 - DNA, 71 bp, chicken (Gallus Gallus)
  misc_feature (36): n=c or t
ttgtcctggtcagttgtgggctctgcccaaaggcancttcataatacagaggtccagaaaaactccaggcc

SEQ ID NO: 38496 - DNA, 71 bp, chicken (Gallus Gallus)
  misc_feature (36): n=c or t
tctcaagatttcagaagtttaaggaagcatcagaantaatgagaagcggatgacactggttactgtggttc

SEQ ID NO: 38497 - DNA, 71 bp, chicken (Gallus Gallus)
  misc_feature (36): n=c or t
cattttctttctccaggtgtgtgacagagtattccnaaggtgaccacctgacagaagagctacctcgctag

SEQ ID NO: 38498 - DNA, 71 bp, chicken (Gallus Gallus)
  misc_feature (36): n=a or c
atttgtctgtgacctctctgtacctgcttgaagtanataatgccaccccaaatgcttttgactcctgcaaa

SEQ ID NO: 38499 - DNA, 71 bp, chicken (Gallus Gallus)
  misc_feature (36): n=a or g
ccaaggcatggaaaaaaaaagtacaagaaacagagnacattcaggaattcagcttcaggagtacacctctg

SEQ ID NO: 38500 - DNA, 71 bp, chicken (Gallus Gallus)
  misc_feature (36): n=a or c
aggagtatctatgaagaaacgtatattaaagttttncctaacatgcatcacctttttacatacatatctgc

SEQ ID NO: 38501 - DNA, 71 bp, chicken (Gallus Gallus)
  misc_feature (36): n=a or g
agaatatgctacaaaaatcatgcagcaccattgacngtgatcagcatttgttcttatcagtttcctctttt

SEQ ID NO: 38502 - DNA, 71 bp, chicken (Gallus Gallus)
  misc_feature (36): n=c or t
tattggatgatttgcaggtacagctcccggactttngagtcagataactgggcattcttcagcagaggagc

SEQ ID NO: 38503 - DNA, 71 bp, chicken (Gallus Gallus)
  misc_feature (36): n=c or t
acacaggtgcttgttagcatcccatctacagcagcncaccaaaggggctccaagttacaggccctgcttta

SEQ ID NO: 38504 - DNA, 71 bp, chicken (Gallus Gallus)
  misc_feature (36): n=a or g
ggaaatgtttacttctaatagttacaactgggagcncaggagagaagtgctttttgtacatatgacttaaa

SEQ ID NO: 38505 - DNA, 71 bp, chicken (Gallus Gallus)
  misc_feature (36): n=c or t
taattagtagggcttaactcagcagaagagaaacangagtatcagtaatcacagcttgaactgactctctc

SEQ ID NO: 38506 - DNA, 71 bp, chicken (Gallus Gallus)
  misc_feature (36): n=c or t
gaggaaggggagaaatgctacgaaagatgccagaangaaaagagaaagctctcaatggaccgtaccttaag

SEQ ID NO: 38507 - DNA, 71 bp, chicken (Gallus Gallus)
  misc_feature (36): n=c or t
ttatacttaaataagaaatcctaccaaaagcaatcnaagctgcatttctgcctaagaagaaacttttgctg

SEQ ID NO: 38508 - DNA, 71 bp, chicken (Gallus Gallus)
  misc_feature (36): n=c or t
ctttgagcaccgtttctcctgctttggtctttctantggattcaaatgaggataaacattacctccttcac

SEQ ID NO: 38509 - DNA, 71 bp, chicken (Gallus Gallus)
  misc_feature (36): n=c or t
ataggtacttctgtatgaagatgacttggtgattgnctgggaacctaaaccctgaagtttggaaggtccaa

SEQ ID NO: 38510 - DNA, 71 bp, chicken (Gallus Gallus)
  misc_feature (36): n=a or g
cctttactggcaaagcacctccaggccatggagccncgtccttggccaagacattggtgaagtctgccacg

SEQ ID NO: 38511 - DNA, 71 bp, chicken (Gallus Gallus)
  misc_feature (36): n=a or g
cagcaaacaacctctggccattaccaacctgcctgntcttcaccagctcttctgtctttcaagctttcaat

SEQ ID NO: 38512 - DNA, 71 bp, chicken (Gallus Gallus)
  misc_feature (36): n=c or t
aacgtgtgggtacccactgacctgtccttctgtacncccatcagcgtatggcctgagatgagagcaagtgt

SEQ ID NO: 38513 - DNA, 71 bp, chicken (Gallus Gallus)
  misc_feature (36): n=a or g
ttatgcagattccctggaaaccctatgagcagaagnacataatgttatgaacccgaaatgggcatgtgttt

SEQ ID NO: 38514 - DNA, 71 bp, chicken (Gallus Gallus)
  misc_feature (36): n=g or t
aggaatgttcactgtcctcatccattaatttcaagngccacagagtgcgaaacgtgcacttttgtgagtgg

SEQ ID NO: 38515 - DNA, 71 bp, chicken (Gallus Gallus)
  misc_feature (36): n=c or t
ttgaccaaaaatgcatatcttcacagagacacacangtataggtaggttgaaatatgtaatcactgcattt

SEQ ID NO: 38516 - DNA, 71 bp, chicken (Gallus Gallus)
  misc_feature (36): n=c or t
ttctccatctacatctctacccaaaatacctcttgnctctactgttaaatcatgtatgtcatgctttcggt

SEQ ID NO: 38517 - DNA, 71 bp, chicken (Gallus Gallus)
  misc_feature (36): n=c or t
agatgggataaggcagaactagcaaacaattgccantgagaagatatatataaactgaattgccacctgta

SEQ ID NO: 38518 - DNA, 71 bp, chicken (Gallus Gallus)
  misc_feature (36): n=a or g
tagaattgtcataaaatggaatactacatttgttcnttctacacaaacacacagagattgagagtaagctt

SEQ ID NO: 38519 - DNA, 71 bp, chicken (Gallus Gallus)
  misc_feature (36): n=a or g
cttaatttcaggatccttcagttttcagacctccanttatgtgacatgtttcagtgagactcccagctcca

SEQ ID NO: 38520 - DNA, 71 bp, chicken (Gallus Gallus)
  misc_feature (36): n=c or t
tttaggtttttattaagtagcattctactcttacanagcatatctctgcacaggatcgcaaagtgcctttc

SEQ ID NO: 38521 - DNA, 71 bp, chicken (Gallus Gallus)
  misc_feature (36): n=a or c
gtataaaagcaaaatgacaatagcattatcaatgtnatctctgcataaaaagtacatttctggaagatctg

SEQ ID NO: 38522 - DNA, 71 bp, chicken (Gallus Gallus)
  misc_feature (36): n=c or t
agcccaaaccacctctacaaaaaactgtccatacanaaacagcaggattcacaaagaagacaaagggctcc

SEQ ID NO: 38523 - DNA, 71 bp, chicken (Gallus Gallus)
  misc_feature (36): n=a or g
tcagttttgtagagcattcagatgttgcagttggcnttattaatagatctctttcccagatagttaaattt

SEQ ID NO: 38524 - DNA, 71 bp, chicken (Gallus Gallus)
  misc_feature (36): n=a or g
ggaaataactgtcagtgcttcatttctactattacntttaatttcctgaatcctctctaggtgtaggtacc

SEQ ID NO: 38525 - DNA, 71 bp, chicken (Gallus Gallus)
  misc_feature (36): n=c or t
gaaagccaggctgctttaacttgctctgatgtaagngacatggaggaagtccgaacacgtgcagtttgtca

SEQ ID NO: 38526 - DNA, 71 bp, chicken (Gallus Gallus)
  misc_feature (36): n=a or g
gtcctgcaaactcaagtgagtaaaatacactgtctnctcttattctgtgtgtctgcatttcagttgtgata

SEQ ID NO: 38527 - DNA, 71 bp, chicken (Gallus Gallus)
  misc_feature (36): n=a or g
gcttgtggcaattggagttgagacacatgattggangagtaggtctgagggtcctgttaccctcatggtga

SEQ ID NO: 38528 - DNA, 71 bp, chicken (Gallus Gallus)
  misc_feature (36): n=c or t
gtatgttctcttgcatgtactctgatgaagtgtatncaatacatgtacatctctataactgctcctgtcct

SEQ ID NO: 38529 - DNA, 71 bp, chicken (Gallus Gallus)
  misc_feature (36): n=a or c
tgaagtcaaagcaaagccgaggcaattttcctctanggagagcagtctctaaatttctcacctacttccag

SEQ ID NO: 38530 - DNA, 71 bp, chicken (Gallus Gallus)
  misc_feature (36): n=a or g
ctaacttgttgtcaatttccagtcagttaaaatacntaaagaaaggtattctttctgacctgaatgtatct

SEQ ID NO: 38531 - DNA, 71 bp, chicken (Gallus Gallus)
  misc_feature (36): n=c or t
tgttttactcagctctggttttctgttgggttcacntggctatctttaccttgaaaaagctctcccagaaa

SEQ ID NO: 38532 - DNA, 71 bp, chicken (Gallus Gallus)
  misc_feature (36): n=a or g
gaggagaatcagtaggatcaggtcatagatttaggnaaatgctggataccagcttctcagagagatagtca

SEQ ID NO: 38533 - DNA, 71 bp, chicken (Gallus Gallus)
  misc_feature (36): n=c or t
ggtgtgttttgtggagaagtgaaatggtgccattangttcagaactccaaacattttgtttcttacagaag

SEQ ID NO: 38534 - DNA, 71 bp, chicken (Gallus Gallus)
  misc_feature (36): n=c or t
catagatttcagttactgctaacagctcatgtcaangtaagagacctatatgtattgtgactttcaataaa

SEQ ID NO: 38535 - DNA, 71 bp, chicken (Gallus Gallus)
  misc_feature (36): n=c or t
gcttctgacagggtgagttcattacatagctgattncaaggcagtctttatggctctttctgtagcaaatg

SEQ ID NO: 38536 - DNA, 71 bp, chicken (Gallus Gallus)
  misc_feature (36): n=c or t
tcaaagagtatctctgaggaaatgcctgtggagtcnatgaatagacccatggaatcttcctcctgtcttgt

SEQ ID NO: 38537 - DNA, 71 bp, chicken (Gallus Gallus)
  misc_feature (36): n=a or g
gtatcctatacttctattaaattgctgactttctgncatcaattagaagctaatgaatgcttgctgctttt

SEQ ID NO: 38538 - DNA, 71 bp, chicken (Gallus Gallus)
  misc_feature (36): n=c or t
gacagctctccgactcatttcagtgcgtaaactcanaaacagtcacagcttccgcataaataatttaacag

SEQ ID NO: 38539 - DNA, 71 bp, chicken (Gallus Gallus)
  misc_feature (36): n=a or g
cagtactaattacaccactattatccaagtgatacntgctaagctatggctgtttttgacttcccatttta

SEQ ID NO: 38540 - DNA, 71 bp, chicken (Gallus Gallus)
  misc_feature (36): n=c or t
aactacacagaaaagtttagttgggatgaaagtaantcagacagcatttaagagaatatgctatgtcattg

SEQ ID NO: 38541 - DNA, 71 bp, chicken (Gallus Gallus)
  misc_feature (36): n=g or t
taagcagttcgtgattaccatggttaggcatagctngcacaagtgaggagattgggtgttgctctttgact

SEQ ID NO: 38542 - DNA, 71 bp, chicken (Gallus Gallus)
  misc_feature (36): n=c or t
aggacaaactcactataatactactaatatccaaangcaggaccattaatgctgaatatactttcagtcaa

SEQ ID NO: 38543 - DNA, 71 bp, chicken (Gallus Gallus)
  misc_feature (36): n=c or t
tactctgagaaggtggagttgggtatttcccctaanggactgaagtcatcttggtgacatccctttaaagc

SEQ ID NO: 38544 - DNA, 71 bp, chicken (Gallus Gallus)
  misc_feature (36): n=c or t
agcaaaaaggactatcattagaactcatatcactcngagataaccttgtcaagaacatttgagtagctttg

SEQ ID NO: 38545 - DNA, 71 bp, chicken (Gallus Gallus)
  misc_feature (36): n=c or t
tgctataaaaacagcacctctgataacaggcggatntcatatcacccctatttcatctgcttacaagaatc

SEQ ID NO: 38546 - DNA, 71 bp, chicken (Gallus Gallus)
  misc_feature (36): n=a or g
ctctagctagagcccaaggtacttttctgcacagcngttattcttctcatgccaagattatccaagggaat

SEQ ID NO: 38547 - DNA, 71 bp, chicken (Gallus Gallus)
  misc_feature (36): n=c or t
cggttgaagtcctctttctgagcccttctcgttgtntccttctcttgcagtgggactgccccgctaccagc

SEQ ID NO: 38548 - DNA, 71 bp, chicken (Gallus Gallus)
  misc_feature (36): n=c or t
cattaagttgaaaggctgtgccctgtcagtcagacntggggagaaggcgattcgattgcagatatttaagg

SEQ ID NO: 38549 - DNA, 71 bp, chicken (Gallus Gallus)
  misc_feature (36): n=a or g
ttaatacagcccttgggtttctggcaagctctcagngcagcccacagctctcttacgaagataatactgcc

SEQ ID NO: 38550 - DNA, 71 bp, chicken (Gallus Gallus)
  misc_feature (36): n=c or t
aagtggctgactcacccacaactgattgaattctgnaactgttaaaagggtaggtgtgtactgggtgtacc

SEQ ID NO: 38551 - DNA, 71 bp, chicken (Gallus Gallus)
  misc_feature (36): n=a or c
agaagcaagccatgcgaagtgcctttgctaagtggngtagttcatagttcagcagaaactatgtgagcttc

SEQ ID NO: 38552 - DNA, 71 bp, chicken (Gallus Gallus)
  misc_feature (36): n=c or t
actgacaagacctgaagcaacaaaaatgaatagcangtgccatagcctgtattgtgttaaagtgaacactg

SEQ ID NO: 38553 - DNA, 71 bp, chicken (Gallus Gallus)
  misc_feature (36): n=a or g
aggtaagatttcctggaagactgatccgaggtaaanggggaaattgaaagaaatcacataactttaaagaa

SEQ ID NO: 38554 - DNA, 71 bp, chicken (Gallus Gallus)
  misc_feature (36): n=c or t
acaaaacctgctgtctgaactagcatatttgaaaanagaatgtagtgatttatgctgtatcttgtcatcga

SEQ ID NO: 38555 - DNA, 71 bp, chicken (Gallus Gallus)
  misc_feature (36): n=a or g
atagctgcaaatgagccatagcttcaactaagtagntgtttcaaaggccttctcccatggtgtatatttga

SEQ ID NO: 38556 - DNA, 71 bp, chicken (Gallus Gallus)
  misc_feature (36): n=a or g
acactctatcatgcaatgctttgctctcaaggatcnaagatgaccacatgcacagagccgggactgaccat

SEQ ID NO: 38557 - DNA, 71 bp, chicken (Gallus Gallus)
  misc_feature (36): n=a or g
aaaaagatccagctcgaatgtccagactattgaaanatacctttacaaattgttttctgagagtgacagag

SEQ ID NO: 38558 - DNA, 71 bp, chicken (Gallus Gallus)
  misc_feature (36): n=a or g
cagagagactactttctctctttgagcactgtaatncgtttcaacaatccacggtcaggcactaaattttg

SEQ ID NO: 38559 - DNA, 71 bp, chicken (Gallus Gallus)
  misc_feature (36): n=c or t
tcggtaataatctcctcatgaagacacatactaaangcagaaaactcccttaggataacatcatcctaggt

SEQ ID NO: 38560 - DNA, 71 bp, chicken (Gallus Gallus)
  misc_feature (36): n=c or t
tttgtgtatttatgttatttaatcttttctgagcanagaccttctggaatgacagcttcctagatatttat

SEQ ID NO: 38561 - DNA, 71 bp, chicken (Gallus Gallus)
  misc_feature (36): n=c or t
aggaaaaacaatatgacagcacacaggagccgcagngctctgaatagcagagaatggatgtgtgagggtac

SEQ ID NO: 38562 - DNA, 71 bp, chicken (Gallus Gallus)
  misc_feature (36): n=a or g
tatttccttaggcaaaactagctgcaaagtcacatnacaggaatactgtatagtaaagcttaattaagaag

SEQ ID NO: 38563 - DNA, 71 bp, chicken (Gallus Gallus)
  misc_feature (36): n=g or t
tgccttctcatttcccagagcctgattacatccagnaatttttgctacgttgtaccctttcacatttgcaa

SEQ ID NO: 38564 - DNA, 71 bp, chicken (Gallus Gallus)
  misc_feature (36): n=c or t
aactgaggtttgcctgaatacatcaaactgaatctnctaatccttctagagatgtattggaatcttcaaaa

SEQ ID NO: 38565 - DNA, 71 bp, chicken (Gallus Gallus)
  misc_feature (36): n=c or t
ctaggtagtgtttacccgagtcgtgcagtcatctcnaccatgaaggaacgacggatgggaaggattgtgtt

SEQ ID NO: 38566 - DNA, 71 bp, chicken (Gallus Gallus)
  misc_feature (36): n=g or t
tgttttcactagcagctaagcaaattttatttcagnagtcttgtgcaactctgctgatgcatgttgtgttg

SEQ ID NO: 38567 - DNA, 71 bp, chicken (Gallus Gallus)
  misc_feature (36): n=c or t
gcctcacactgcatgtgactttgcaattacattcanctaagttgcactcagcattgtggcatccagctgca

SEQ ID NO: 38568 - DNA, 71 bp, chicken (Gallus Gallus)
  misc_feature (36): n=c or t
ccttcctactccttctgggctttgattttgcgagangtttgcaactttagatcctggaaagagctaagagt

SEQ ID NO: 38569 - DNA, 71 bp, chicken (Gallus Gallus)
  misc_feature (36): n=g or t
taaaggtcaaacccacgcttcttgtgggttgcattntgggcagacagactttcaatataagagcctcaggg

SEQ ID NO: 38570 - DNA, 71 bp, chicken (Gallus Gallus)
  misc_feature (36): n=a or g
taggtgtgtaaaagtagtggtgaagacaggaagtcngtaactaaaatctgacagagaagcttcacaatgca

SEQ ID NO: 38571 - DNA, 71 bp, chicken (Gallus Gallus)
  misc_feature (36): n=a or g
cctgaggaaaactaggctttcatttataccagcaancctcaagcatgcaattcccttcccacagggctcaa

SEQ ID NO: 38572 - DNA, 71 bp, chicken (Gallus Gallus)
  misc_feature (36): n=a or g
tacaggaacacagaagcaactcaaaacagctcatgngaagtctcatacctttccatgtggttttgcaaagc

SEQ ID NO: 38573 - DNA, 71 bp, chicken (Gallus Gallus)
  misc_feature (36): n=a or g
ccggaggcattcctgttagcagtaccacttgaaatnaaaggcagtttggagaaaacagtctgctacccttg

SEQ ID NO: 38574 - DNA, 71 bp, chicken (Gallus Gallus)
  misc_feature (36): n=a or c
acacgttagattttcccccagtgactagcctgaaanttccttgctgccccacaggcagaggaggacgattc

SEQ ID NO: 38575 - DNA, 71 bp, chicken (Gallus Gallus)
  misc_feature (36): n=c or t
accccaagcagaaataagagccagacaaggcacttngtgagatgctttcaacacatcagcttattaggtgg

SEQ ID NO: 38576 - DNA, 71 bp, chicken (Gallus Gallus)
  misc_feature (36): n=c or t
gtctgtgtgaaaagtgggattaggcatagccagagntgaaggcaatgaaccaaaatgagtgtaactccacc

SEQ ID NO: 38577 - DNA, 71 bp, chicken (Gallus Gallus)
  misc_feature (36): n=c or t
catgaagggtacagaactgtctgatagacctggggnagaaccaatctcctccggagctgatctcacgcgac

SEQ ID NO: 38578 - DNA, 71 bp, chicken (Gallus Gallus)
  misc_feature (36): n=a or g
ggcgcatcttccataccatggtcacttgctagaggnctctgaccagcagagagaaaattcatgccacaggt

SEQ ID NO: 38579 - DNA, 71 bp, chicken (Gallus Gallus)
  misc_feature (36): n=a or g
gaagactaatgaattacctaacatcactgacatggnggcagatacaaggctgattctttaccttgcagaaa

SEQ ID NO: 38580 - DNA, 71 bp, chicken (Gallus Gallus)
  misc_feature (36): n=c or t
cctccagcaaagcgcctcgtactctttgttgctganggtctgcgggcagattctctgtttgaattgaatag

SEQ ID NO: 38581 - DNA, 71 bp, chicken (Gallus Gallus)
  misc_feature (36): n=g or t
aatccagaccagggcatgttgcgctgatagctgggntttatgaagatgtcagtgcagttgctaaaggtatg

SEQ ID NO: 38582 - DNA, 71 bp, chicken (Gallus Gallus)
  misc_feature (36): n=c or t
ggaaccctgcctctggaatacctgaacaatagtgancatttcaaagcagagagcatgtttaccaatgctgt

SEQ ID NO: 38583 - DNA, 71 bp, chicken (Gallus Gallus)
  misc_feature (36): n=a or g
tatctctgtgcaaaacactgattaaccttgctttgnaaggcctgtcatactaccatacttacgacaggtta

SEQ ID NO: 38584 - DNA, 71 bp, chicken (Gallus Gallus)
  misc_feature (36): n=a or g
cagagcatcctttccttacatgtagtcgttatggtntgccttaggattcccttagcaactttgctaacctt

SEQ ID NO: 38585 - DNA, 71 bp, chicken (Gallus Gallus)
  misc_feature (36): n=c or t
agatgtacttgctgtatattatagtttgatttctgntccttaatagaagaaataattatggcttaatgctg

SEQ ID NO: 38586 - DNA, 71 bp, chicken (Gallus Gallus)
  misc_feature (36): n=g or t
tcagcatagaggttgtgaaactgcagctggagctantggtttgcacacagagatgctcattatgctgtgct

SEQ ID NO: 38587 - DNA, 71 bp, chicken (Gallus Gallus)
  misc_feature (36): n=a or g
tttaggctttcttctgctctgctaatgggtcttcantccttcttcgagagtgggactctgggcacagatgc

SEQ ID NO: 38588 - DNA, 71 bp, chicken (Gallus Gallus)
  misc_feature (36): n=a or g
cctgactcaaagacaatgaggtcccttcaatagtcntgccttcaatagcctttggatcataagccaagcag

SEQ ID NO: 38589 - DNA, 71 bp, chicken (Gallus Gallus)
  misc_feature (36): n=a or c
gtgtcctcagacttaatcagaaagaattatcaaggnttcctcatttgatgcacagatacggggatattttt

SEQ ID NO: 38590 - DNA, 71 bp, chicken (Gallus Gallus)
  misc_feature (36): n=a or c
ctccaatttttagggtacgccgctgttagtaagcantatgacaagtaaatggcttgctttccagctcccaa

SEQ ID NO: 38591 - DNA, 71 bp, chicken (Gallus Gallus)
  misc_feature (36): n=a or g
gatttcaggacagaaatttaaaacaacttcatcccnaaaatatgagaaacatgtcaagagagacaaataac

SEQ ID NO: 38592 - DNA, 71 bp, chicken (Gallus Gallus)
  misc_feature (36): n=g or t
gtactgcattttgttgtcgagttgctctgtaaaagngattcactatcttatcagaaactgctgctgagaat

SEQ ID NO: 38593 - DNA, 71 bp, chicken (Gallus Gallus)
  misc_feature (36): n=c or t
aacatgtagccttaaaaatgttcttgcattttgaanaactgctggtctggaaggtgctagaaaagctaata

SEQ ID NO: 38594 - DNA, 71 bp, chicken (Gallus Gallus)
  misc_feature (36): n=g or t
ataaatgtattgagacaaagaaagcacccaatacanggttaaaataattaatctccagtgtaccatataaa

SEQ ID NO: 38595 - DNA, 71 bp, chicken (Gallus Gallus)
  misc_feature (36): n=a or g
gtatttaattttagctttaagatatcagctttcctnttactcctgtggctaagaatgacagtaccttccta

SEQ ID NO: 38596 - DNA, 71 bp, chicken (Gallus Gallus)
  misc_feature (36): n=a or g
tttcaaattactctgccacagtctataattatactnaatgtgccccgatgccaaagattattaggaggatt

SEQ ID NO: 38597 - DNA, 71 bp, chicken (Gallus Gallus)
  misc_feature (36): n=c or t
ttgtctgacatacagatgaatcccttctttcctgtnccaaattacataaatcacagtggctcaaccagaaa

SEQ ID NO: 38598 - DNA, 71 bp, chicken (Gallus Gallus)
  misc_feature (36): n=a or c
attccacacatgccaaagggcctgcagaaaggacantaactgtcccatcccatggcaaagtgaactctgta

SEQ ID NO: 38599 - DNA, 71 bp, chicken (Gallus Gallus)
  misc_feature (36): n=c or t
ttgcaaaatctgtaaaacactaactgaaatggttgngtggaattcatcagttcaaaatctgatgaagacac

SEQ ID NO: 38600 - DNA, 71 bp, chicken (Gallus Gallus)
  misc_feature (36): n=c or t
aaaaaaaaaagtggaaaaatacaacaacttgtctangcaatatcagtgatttgacactacatattcacaag

SEQ ID NO: 38601 - DNA, 71 bp, chicken (Gallus Gallus)
  misc_feature (36): n=c or t
aaagacaatccagtaagttaagtctggaagtctctntgcagcactactactgcaacaggccaggaatgaga

SEQ ID NO: 38602 - DNA, 71 bp, chicken (Gallus Gallus)
  misc_feature (36): n=a or g
tgtatttcatcatagatttttacgatcaaaaatgtnttaaagaatgaaatgctctaaaactattttaagtt

SEQ ID NO: 38603 - DNA, 71 bp, chicken (Gallus Gallus)
  misc_feature (36): n=a or c
catctgaaaaattgcatatagctatatggttattgnagtagttacacagacaaatcttttgcaacaaatca

SEQ ID NO: 38604 - DNA, 71 bp, chicken (Gallus Gallus)
  misc_feature (36): n=c or t
gcctttgttgaaatgtatgctgtcaatctgctgccncagctgtgcttgtgaagcatttctgcttgggttgt

SEQ ID NO: 38605 - DNA, 71 bp, chicken (Gallus Gallus)
  misc_feature (36): n=a or g
agcacacaacacacctgttctgcctttgcattttcncagacaaaggtctcataaaacatggcaaactctgg

SEQ ID NO: 38606 - DNA, 71 bp, chicken (Gallus Gallus)
  misc_feature (36): n=a or g
cttcctgtgtgtccttgtctgtggtaattccaaacntgtcatatccatccccctcagtgatgctgtattca

SEQ ID NO: 38607 - DNA, 71 bp, chicken (Gallus Gallus)
  misc_feature (36): n=g or t
atcaaaaatcatttttttcccctataatttctgttnagtttttaaggtgtaaatcaggcagaatttaacct

SEQ ID NO: 38608 - DNA, 71 bp, chicken (Gallus Gallus)
  misc_feature (36): n=c or t
ataggcaattctccagataacaggcttgctgctctnctgcaagatattttctcccaagtaggaatggagaa

SEQ ID NO: 38609 - DNA, 71 bp, chicken (Gallus Gallus)
  misc_feature (36): n=a or g
agatgagtgaataggtggcagtgaattgcaaacaanacacaagtgaataatgcaagactgataaacctgtt

SEQ ID NO: 38610 - DNA, 71 bp, chicken (Gallus Gallus)
  misc_feature (36): n=a or g
aagatacccttaggacaacatactaatttttcagcnatacactgtcactaaaagtcttcagcgttaatcat

SEQ ID NO: 38611 - DNA, 71 bp, chicken (Gallus Gallus)
  misc_feature (36): n=g or t
ctgtggtgccagctagctaaaggtggctgggaaaanctagaatcaactcagttttcttgtttctccctcct

SEQ ID NO: 38612 - DNA, 71 bp, chicken (Gallus Gallus)
  misc_feature (36): n=g or t
ccctcatgtccacaggactacacttttggcattgtntgcctttgctgcaaagttcatttctgtttcagcat

SEQ ID NO: 38613 - DNA, 71 bp, chicken (Gallus Gallus)
  misc_feature (36): n=a or g
gctgtctgcatcacagcacaaagcaattgtagttgncctggtaacctccattttccagaccatgactgggt

SEQ ID NO: 38614 - DNA, 71 bp, chicken (Gallus Gallus)
  misc_feature (36): n=c or t
tggttgaattgctgttggcatttcaaatgtaactanttcatggcagaagtgaaaagagcctaacacttgta

SEQ ID NO: 38615 - DNA, 71 bp, chicken (Gallus Gallus)
  misc_feature (36): n=a or g
cacagccccacatgaagagaactgtgaaggggcccntgagttattaaggccaattgccttgcataggcatt

SEQ ID NO: 38616 - DNA, 71 bp, chicken (Gallus Gallus)
  misc_feature (36): n=c or t
atataatttaaatttgctcaagtcacagtaggaaanggcaatatttcaactgttatcaacatcttgagcct

SEQ ID NO: 38617 - DNA, 71 bp, chicken (Gallus Gallus)
  misc_feature (36): n=a or g
aacattacactttatcttttcaaagagattcataangtacggttcagtccttcctccctagacagaaataa

SEQ ID NO: 38618 - DNA, 71 bp, chicken (Gallus Gallus)
  misc_feature (36): n=c or t
ctgaagtatggtttccacttcagtgctaacgtgccnggagaaggtaattaaaagcgtaggaattcctgtta

SEQ ID NO: 38619 - DNA, 71 bp, chicken (Gallus Gallus)
  misc_feature (36): n=a or g
aagtctaaaaaaatggtgcagaagaaatatgtgacnaattttctgtatcggtaaactgtgaatcatttaag

SEQ ID NO: 38620 - DNA, 71 bp, chicken (Gallus Gallus)
  misc_feature (36): n=c or t
agatgtagaagacgtcagttagagtccctggtttantttgtatggtaaagtggtgcttaagttctctacag

SEQ ID NO: 38621 - DNA, 71 bp, chicken (Gallus Gallus)
  misc_feature (36): n=c or t
atctactataaaccttggaacaggaattagctgaanaaggcttactggttctttccaacacagcatagtaa

SEQ ID NO: 38622 - DNA, 71 bp, chicken (Gallus Gallus)
  misc_feature (36): n=a or g
tagaggctttactgtgtgtgttctgcattgagcctnatcaaagcacagcgttttcctttcacttcagctac

SEQ ID NO: 38623 - DNA, 71 bp, chicken (Gallus Gallus)
  misc_feature (36): n=g or t
ccagggtactctaggatccagattactcagttacangtgctgaagtccactatgacacattctcagacaaa

SEQ ID NO: 38624 - DNA, 71 bp, chicken (Gallus Gallus)
  misc_feature (36): n=c or t
gtgtctactctaaaagaagatagatctgatcaatcnatactgcagtgctgtagagttaatccaaggactga

SEQ ID NO: 38625 - DNA, 71 bp, chicken (Gallus Gallus)
  misc_feature (36): n=c or t
ttttcactttctcactgctgctttgtcctgtgagangagcagcttatttgttatgacattttcccttcaag

SEQ ID NO: 38626 - DNA, 71 bp, chicken (Gallus Gallus)
  misc_feature (36): n=c or t
aaatatatctactactctatatacacattcaagtantctcagagagagagtcatttcaaatcttttacttg

SEQ ID NO: 38627 - DNA, 71 bp, chicken (Gallus Gallus)
  misc_feature (36): n=a or g
ggagtagtaaaacagttttgtatctgtttgccacantctaggacatcaaagaccaagtcccaggaatttat

SEQ ID NO: 38628 - DNA, 71 bp, chicken (Gallus Gallus)
  misc_feature (36): n=a or g
ctataccttcaaaactacacagatgtggtttgcagncaaacgcacagaagaggcacaaaacagttgattta

SEQ ID NO: 38629 - DNA, 71 bp, chicken (Gallus Gallus)
  misc_feature (36): n=a or g
tctgtggataataactgaaacattcgtgattcactntttgctatttatcccatgtgtttagttactgcatt

SEQ ID NO: 38630 - DNA, 71 bp, chicken (Gallus Gallus)
  misc_feature (36): n=a or g
atttaatgctactcttttccttatctttctaaacantttgcagtaaaggatatgatttttacctatgaaag

SEQ ID NO: 38631 - DNA, 71 bp, chicken (Gallus Gallus)
  misc_feature (36): n=a or g
ggaatagtgctgcaatgtttctcatctttcaccttnacactccctacatgctgattggcaatcagcagaag

SEQ ID NO: 38632 - DNA, 71 bp, chicken (Gallus Gallus)
  misc_feature (36): n=c or t
gaggatgttatgaataaaatctgtacccctctgaangcggcgttcaatttatcattaatttcagtgggact

SEQ ID NO: 38633 - DNA, 71 bp, chicken (Gallus Gallus)
  misc_feature (36): n=a or g
ggaaagcaacttatccagatctgacctgagaattgncaagggcatgataagggcagaaggaaaaatgaaaa

SEQ ID NO: 38634 - DNA, 71 bp, chicken (Gallus Gallus)
  misc_feature (36): n=a or g
agtgtagtgcaagtcacacacaagcagtacttttgnatagacttcaccccatgacaatgtcattaccctag

SEQ ID NO: 38635 - DNA, 71 bp, chicken (Gallus Gallus)
  misc_feature (36): n=a or g
aaatattgcagtaaatacatgaactattagggagantcctacctctcttatctcatgttggaactcatatc

SEQ ID NO: 38636 - DNA, 71 bp, chicken (Gallus Gallus)
  misc_feature (36): n=a or g
catatttctgcatttgtaaaagattataaaatccantttaactttatcaaactagaatgccatgctttctt

SEQ ID NO: 38637 - DNA, 71 bp, chicken (Gallus Gallus)
  misc_feature (36): n=c or t
cgtctaaaaatggtgtgacaaactttttctaatttntgtgtgccctctcagtgtatatatgatataattta

SEQ ID NO: 38638 - DNA, 71 bp, chicken (Gallus Gallus)
  misc_feature (36): n=c or t
tgatggctcttgggaatagtattttgttccatcttngcgtacttccccttggaggttcagaactcatgtga

SEQ ID NO: 38639 - DNA, 71 bp, chicken (Gallus Gallus)
  misc_feature (36): n=a or g
tgtatttattaaatctttcttaaagagatgtttttnttggttttgttgtgtaataatttactaaaagttca

SEQ ID NO: 38640 - DNA, 71 bp, chicken (Gallus Gallus)
  misc_feature (36): n=a or g
attgaaagtagtattaaaaatgtgatacattgtgcntagataggcacatacaaatttgtacaaattccttt

SEQ ID NO: 38641 - DNA, 71 bp, chicken (Gallus Gallus)
  misc_feature (36): n=c or t
tctccagcttgcactttaatattttgctagagcaangtttactagaaatcctttaagtaaagccatagtaa

SEQ ID NO: 38642 - DNA, 71 bp, chicken (Gallus Gallus)
  misc_feature (36): n=c or t
tcagttgtcctcctacaaatctgtggggagagatgngtcacatggaacagggaataaggcaagaagaggct

SEQ ID NO: 38643 - DNA, 71 bp, chicken (Gallus Gallus)
  misc_feature (36): n=a or g
atactacatatatttgcttagctttcttgttctctnacagccagaatcacacgtacaatctgtgtaatgta

SEQ ID NO: 38644 - DNA, 71 bp, chicken (Gallus Gallus)
  misc_feature (36): n=g or t
cctgatctagtaaccaatttagtattttgtttccanattatacaaagatatgtgaacatttagttcttgat

SEQ ID NO: 38645 - DNA, 71 bp, chicken (Gallus Gallus)
  misc_feature (36): n=g or t
aaatggcatatttgagtgtaaataaattgaaaattncaaggagagaggttagatgtgatggtgactgaagt

SEQ ID NO: 38646 - DNA, 71 bp, chicken (Gallus Gallus)
  misc_feature (36): n=c or t
cgtaagtttatcaactttcaaaaaaatcagcatagntcttttctcccagtgaaaactaggaaactgtcact

SEQ ID NO: 38647 - DNA, 71 bp, chicken (Gallus Gallus)
  misc_feature (36): n=c or t
gatagtcttggtaatctgatcgggctgctaagtctnttccttctactgtcgtgacctaacctaaatggcag

SEQ ID NO: 38648 - DNA, 71 bp, chicken (Gallus Gallus)
  misc_feature (36): n=a or g
tattctttactgattgtctgtcaggattcattctcnttgatagcaatggcttagggcttggttttactctg

SEQ ID NO: 38649 - DNA, 71 bp, chicken (Gallus Gallus)
  misc_feature (36): n=a or g
cagctgaaaagctaactaattttaacaaatggtttntggcctttaagtctggttttgtattccaattggaa

SEQ ID NO: 38650 - DNA, 71 bp, chicken (Gallus Gallus)
  misc_feature (36): n=a or g
gagcagaaaagagaatagatcctttgccttcagagntggattgtctgtatgaaacatcatgtgtgtagggc

SEQ ID NO: 38651 - DNA, 71 bp, chicken (Gallus Gallus)
  misc_feature (36): n=a or g
accagatgtagatatacagacagtaatggtaacganggatttagatgttaatctgatttgaacatggcaaa

SEQ ID NO: 38652 - DNA, 71 bp, chicken (Gallus Gallus)
  misc_feature (36): n=a or g
attcaaaaatacagagaacaaacatactatatgttncaacaagtttaatataatgagattatgtaatacat

SEQ ID NO: 38653 - DNA, 71 bp, chicken (Gallus Gallus)
  misc_feature (36): n=a or g
tcctggttactctgatctttaagtatggtctatcantatggtgaagcgaggaagggaaaacctggaaaatg

SEQ ID NO: 38654 - DNA, 71 bp, chicken (Gallus Gallus)
  misc_feature (36): n=c or t
tctttatcatatttctagaatttggagaaacaaaanaccagttgtaataactaacttcaatgctattctag

SEQ ID NO: 38655 - DNA, 71 bp, chicken (Gallus Gallus)
  misc_feature (36): n=a or g
ccagctatagcatgtgtatacctgtaaatgctgtgnatttgctactgtcttaggacattgtactaaggaaa

SEQ ID NO: 38656 - DNA, 71 bp, chicken (Gallus Gallus)
  misc_feature (36): n=a or g
ccatgctgtgattctaactagccaacaaacaaggangagaagcaaacaagccctggcagtgctgatcttct

SEQ ID NO: 38657 - DNA, 71 bp, chicken (Gallus Gallus)
  misc_feature (36): n=a or g
cgtatgacactaaataaatgtgtcatttctcttctntagcatcagtgtctaattttcagtattgtcaattg

SEQ ID NO: 38658 - DNA, 71 bp, chicken (Gallus Gallus)
  misc_feature (36): n=c or t
tacatgcacatatgctctttctgtctctcatgttangatgatctgttcttttgttactcaggtaaaacgta

SEQ ID NO: 38659 - DNA, 71 bp, chicken (Gallus Gallus)
  misc_feature (36): n=a or g
atttaaatcattgtcttactgcagagttcagtctgntttattatgtgaaattgtcctgctttctagaggct

SEQ ID NO: 38660 - DNA, 71 bp, chicken (Gallus Gallus)
  misc_feature (36): n=a or g
ggaagctgaagaacaaaattgtgaaatattaagagnaatgtcttacctaaaaaatataggtttttctttcc

SEQ ID NO: 38661 - DNA, 71 bp, chicken (Gallus Gallus)
  misc_feature (36): n=a or g
attttgttttaaaagaacaagactatgacagtatgncaatacttgatctgtactattaaagcagcacccta

SEQ ID NO: 38662 - DNA, 71 bp, chicken (Gallus Gallus)
  misc_feature (36): n=c or t
aagtagagagtgtttttctgatgcatagtaatttancctctgcatctgaaataggaacacagaacccattt

SEQ ID NO: 38663 - DNA, 71 bp, chicken (Gallus Gallus)
  misc_feature (36): n=c or t
tgtctcctctgttgttccttaaaactgtaagtctcncttcatttgcctgaattttccccaggaaggtgtcc

SEQ ID NO: 38664 - DNA, 71 bp, chicken (Gallus Gallus)
  misc_feature (36): n=a or g
tcccatttttcctcagttgttacctgctagcatggngctgaacaacttactattttattcttaccttatat

SEQ ID NO: 38665 - DNA, 71 bp, chicken (Gallus Gallus)
  misc_feature (36): n=c or t
tcatgttggcaatatcagtgaataaatatgggctangttgataaggtgaaaagctagtagagtaactttgc

SEQ ID NO: 38666 - DNA, 71 bp, chicken (Gallus Gallus)
  misc_feature (36): n=a or g
ccacccgcaattagattcatttggaacatagtcctnggctggaaattatacactgtttgattctctgcaaa

SEQ ID NO: 38667 - DNA, 71 bp, chicken (Gallus Gallus)
  misc_feature (36): n=c or t
ttagacccgtcccagcgcaaatgagctgtccgtggncctgaacctgctggggctagcacctgtgtagtcac

SEQ ID NO: 38668 - DNA, 71 bp, chicken (Gallus Gallus)
  misc_feature (36): n=a or g
acactactctgaattacaaatgagctattatctccnctttacagaagtgctcttcatgcaaaagagaggtt

SEQ ID NO: 38669 - DNA, 71 bp, chicken (Gallus Gallus)
  misc_feature (36): n=a or g
tttcccatatctattttcatatccattgcagtgttntgcatctattctatgcttaggcataggcagatttt

SEQ ID NO: 38670 - DNA, 71 bp, chicken (Gallus Gallus)
  misc_feature (36): n=g or t
gttctaattagcggtagccctttgactgtgagaaantagcaaggcataaaacatatcttctcttagattga

SEQ ID NO: 38671 - DNA, 71 bp, chicken (Gallus Gallus)
  misc_feature (36): n=c or t
agcccaaaggaaaaaggacctgtctgttaataaccncatagaggataataaggtgattaaaaatagaccat

SEQ ID NO: 38672 - DNA, 71 bp, chicken (Gallus Gallus)
  misc_feature (36): n=a or g
tttgccgacagctttgtaatatcctatgattgcagncagttttgtaatatcatataatttccatatattta

SEQ ID NO: 38673 - DNA, 71 bp, chicken (Gallus Gallus)
  misc_feature (36): n=g or t
gaaaccatattctgtattctccttaaaagaattcangcctttttggatgcagagtcagagccttaacattc

SEQ ID NO: 38674 - DNA, 71 bp, chicken (Gallus Gallus)
  misc_feature (36): n=c or t
ctcagatgcaccacaagagatgctgtatcaagtttngtatttctcattttgctcaggcttgggaataaact

SEQ ID NO: 38675 - DNA, 71 bp, chicken (Gallus Gallus)
  misc_feature (36): n=c or t
aatctgcgtgtggtttccttaccctttggctttagntccatagatggatgaggagatggtcagagacagaa

SEQ ID NO: 38676 - DNA, 71 bp, chicken (Gallus Gallus)
  misc_feature (36): n=a or g
taatgggagctctacgtttgttaaacttcttgtcanattttgttaagtggagccacaagctcaaaagggag

SEQ ID NO: 38677 - DNA, 71 bp, chicken (Gallus Gallus)
  misc_feature (36): n=c or t
attgccctagttaagaaacttcccaatgcacatgangtatcctcagcagtaaaatggatattaaaattgaa

SEQ ID NO: 38678 - DNA, 71 bp, chicken (Gallus Gallus)
  misc_feature (36): n=a or c
aatattaagtataccagcaacctgtgcaaaaacagnattaattagtttacccttcttgatgtagactttct

SEQ ID NO: 38679 - DNA, 71 bp, chicken (Gallus Gallus)
  misc_feature (36): n=c or t
tgctgccacatcagtcagctcccagctatgaagaanagggatgaaaaaccaccctcccagaatgtcaagca

SEQ ID NO: 38680 - DNA, 71 bp, chicken (Gallus Gallus)
  misc_feature (36): n=c or t
atcataacccttacctttccccagtttctcagcagngccctgacattttgcttataagtgcattctggacc

SEQ ID NO: 38681 - DNA, 71 bp, chicken (Gallus Gallus)
  misc_feature (36): n=c or t
tttttgatgttattcctcattctgtttttgttatgntttctttaggtttattgcacaggaatgagactatt

SEQ ID NO: 38682 - DNA, 71 bp, chicken (Gallus Gallus)
  misc_feature (36): n=a or g
atgggagcttgctgccaaggacagggagaaccaggnaacagtggtaaggctgtaacgtctcggaggtgaaa

SEQ ID NO: 38683 - DNA, 71 bp, chicken (Gallus Gallus)
  misc_feature (36): n=c or t
gaaggctctcacatcctaaatggaattcaggcatgnggtcctgaaggaatggtgtgtgaccggacctagag

SEQ ID NO: 38684 - DNA, 71 bp, chicken (Gallus Gallus)
  misc_feature (36): n=a or g
aaaaaggcctttcactgcctgattccaactataccntaacttctgtgtaatgatcttgaagtttcatactt

SEQ ID NO: 38685 - DNA, 71 bp, chicken (Gallus Gallus)
  misc_feature (36): n=c or t
cgttaagccccccagaaatctataccactgtgcacngagttatagaaagtcctgcattcttatctgccatg

SEQ ID NO: 38686 - DNA, 71 bp, chicken (Gallus Gallus)
  misc_feature (36): n=c or t
agatactctatgcctgtcatatcaggctttctccantgtgttccacatagataatacatttaaacacacaa

SEQ ID NO: 38687 - DNA, 71 bp, chicken (Gallus Gallus)
  misc_feature (36): n=a or g
aaattccatcttcagaaaggcctctcagttcagtgnaaggaagctgatgtacaatattgatagaacagcca

SEQ ID NO: 38688 - DNA, 71 bp, chicken (Gallus Gallus)
  misc_feature (36): n=a or c
cagcctcagcctctgggaggggtgtgtggataagcntatctctccttgttttcctgcccttcaaactcttg

SEQ ID NO: 38689 - DNA, 71 bp, chicken (Gallus Gallus)
  misc_feature (36): n=c or t
cagctccacaagaggaatgcttaacttgacatcttnttgatacttgtatgctttgattttaggcccaagct

SEQ ID NO: 38690 - DNA, 71 bp, chicken (Gallus Gallus)
  misc_feature (36): n=c or t
tccagaacgtgctcaccatgggcttccaacattatngaaaaagggagcattcttaaagaacatttggccat

SEQ ID NO: 38691 - DNA, 71 bp, chicken (Gallus Gallus)
  misc_feature (36): n=c or t
cactctgtgtgcctagttcctaaaaagcaggtatgnccttctccaaagagaggaacagaatttgggctccc

SEQ ID NO: 38692 - DNA, 71 bp, chicken (Gallus Gallus)
  misc_feature (36): n=c or t
ttaagtcacaggttgtacattttctacaatgatctnggtcatttaacattagaatttcatttataaacact

SEQ ID NO: 38693 - DNA, 71 bp, chicken (Gallus Gallus)
  misc_feature (36): n=c or t
aagcatgggttaaaagacagctcaacaagtaacctntcacaccaaagcaacttctttaaggatttgctgca

SEQ ID NO: 38694 - DNA, 71 bp, chicken (Gallus Gallus)
  misc_feature (36): n=c or t
agttaagtaaaatacagaagttctaacagctcattncaatgccagggcatatggatgtgcatatttagctc

SEQ ID NO: 38695 - DNA, 71 bp, chicken (Gallus Gallus)
  misc_feature (36): n=a or c
acgtctcgtttttggctcacctgtcactgattacanagcaaagggcaaccactgccagtcagtgtacttga

SEQ ID NO: 38696 - DNA, 71 bp, chicken (Gallus Gallus)
  misc_feature (36): n=c or t
taactgattgccattaaaatcacttttcaaatgaangttcttatacccagagatttgttaaactgtcattc

SEQ ID NO: 38697 - DNA, 71 bp, chicken (Gallus Gallus)
  misc_feature (36): n=g or t
taggttcttcaaggacagcgttcaataaatctccangttacttttctacatctttacagccaacgcctctc

SEQ ID NO: 38698 - DNA, 71 bp, chicken (Gallus Gallus)
  misc_feature (36): n=c or t
tttcagatgaagaacagccaacagaaggggctctgngtccttacagctgagtctacaggctcttgccacac

SEQ ID NO: 38699 - DNA, 71 bp, chicken (Gallus Gallus)
  misc_feature (36): n=c or t
gacttactccatttcattgaagaaatagctttattncagcaaagcagattattaaatttacgtaaaatcta

SEQ ID NO: 38700 - DNA, 71 bp, chicken (Gallus Gallus)
  misc_feature (36): n=a or c
tagtttttagaaagagtcttcaaatttggagcatgngttctcaagaataagacattttctgtgttcttccc

SEQ ID NO: 38701 - DNA, 71 bp, chicken (Gallus Gallus)
  misc_feature (36): n=c or t
acatccagtaggatttgtccatttccatgtccatcntctgcttgccaaaccctgcccaaaaggcagggaat

SEQ ID NO: 38702 - DNA, 71 bp, chicken (Gallus Gallus)
  misc_feature (36): n=c or t
atctgaatcacttgggccaggagatttttgggaagngggaactgagtcagagcacggatggcagtgttgtc

SEQ ID NO: 38703 - DNA, 71 bp, chicken (Gallus Gallus)
  misc_feature (36): n=a or g
ctctactacaactcagggtttggcattccttgtagnaatattagatataccttctgtaattttccacttca

SEQ ID NO: 38704 - DNA, 71 bp, chicken (Gallus Gallus)
  misc_feature (36): n=a or g
cacataaatcttctcatataaattttagttaaactntaaaacttatcttggttcttttatttgaaaatgtt

SEQ ID NO: 38705 - DNA, 71 bp, chicken (Gallus Gallus)
  misc_feature (36): n=g or t
gatattgctatggactgatgcgtttggcagcctctnttggcacctacatataaaccactcagtgtcagaaa

SEQ ID NO: 38706 - DNA, 71 bp, chicken (Gallus Gallus)
  misc_feature (36): n=c or t
ggaccaaccacatacccctctactagcatctgacanctgcaacaggtatccgtaccatgcattgattctta

SEQ ID NO: 38707 - DNA, 71 bp, chicken (Gallus Gallus)
  misc_feature (36): n=c or t
aacttctggcatttgaaacactcttctaaccactcnggagttactatgtgcttcactacagaaattgcagt

SEQ ID NO: 38708 - DNA, 71 bp, chicken (Gallus Gallus)
  misc_feature (36): n=a or g
tatagtgatctgcatagtgagtaacaaatcacctcnaagcaaaggaaagccataatcatttgacagatcct

SEQ ID NO: 38709 - DNA, 71 bp, chicken (Gallus Gallus)
  misc_feature (36): n=c or t
ggcgcatagccttgtagatgtctttattcctaaggnatgtgttcattgttattacagactaatggaaatgg

SEQ ID NO: 38710 - DNA, 71 bp, chicken (Gallus Gallus)
  misc_feature (36): n=a or g
attttgtctctggagttctgaaagaacatttccagnctacggatggattcatttatataaatgttcagaga

SEQ ID NO: 38711 - DNA, 71 bp, chicken (Gallus Gallus)
  misc_feature (36): n=c or t
gaggtgatgtttcagcatcctgcattagcttcttcngcttattgtccttgtttctcagactgaaggactaa

SEQ ID NO: 38712 - DNA, 71 bp, chicken (Gallus Gallus)
  misc_feature (36): n=a or g
caatgactccttcgcctcacagcaagaagtaacatngatttttctaaatccagatagcatttctcttacat

SEQ ID NO: 38713 - DNA, 71 bp, chicken (Gallus Gallus)
  misc_feature (36): n=a or c
catggggaaacagagcagtgtgccaccagctgtgcncaatgcttcatggagaggcactggtaaggcaccaa

SEQ ID NO: 38714 - DNA, 71 bp, chicken (Gallus Gallus)
  misc_feature (36): n=c or t
acccccaaactgtaataatgatagcataaagggcangatggggaaaatggctaaaaataaatacttgtcca

SEQ ID NO: 38715 - DNA, 71 bp, chicken (Gallus Gallus)
  misc_feature (36): n=a or g
tccttgtcctgtagatgctcagtctgccccaacctnggacattactgattgttgttggccctaaccattgg

SEQ ID NO: 38716 - DNA, 71 bp, chicken (Gallus Gallus)
  misc_feature (36): n=a or g
gaaactagcctgcaacacatggcccaaagtcttcancttcatccttatggatttcacagtggtaagcgtgt

SEQ ID NO: 38717 - DNA, 71 bp, chicken (Gallus Gallus)
  misc_feature (36): n=c or t
tttttttctgatttgtttcctttcgacctttactgntcaatttattgtaccaatttatacaccaagccctc

SEQ ID NO: 38718 - DNA, 71 bp, chicken (Gallus Gallus)
  misc_feature (36): n=c or t
tcatgtaatatcttggtgatgagatgaatcaaaaancacacgattgaatgtggctaatgaacaaaacaaat

SEQ ID NO: 38719 - DNA, 71 bp, chicken (Gallus Gallus)
  misc_feature (36): n=c or t
aaatgacaacagtttatgctgtcattgtttcccttngcgtagaaagtgaattactgaagtattaagtacag

SEQ ID NO: 38720 - DNA, 71 bp, chicken (Gallus Gallus)
  misc_feature (36): n=a or g
tcaaagaaataagagcctgtaagaaaaacttctccntagtatgtgtaatatagatagagacagaaagctct

SEQ ID NO: 38721 - DNA, 71 bp, chicken (Gallus Gallus)
  misc_feature (36): n=a or g
ccagggctgcagatcactcaagctgtagttcagctnttcagagggaggagactaaagctgtaccgagggat

SEQ ID NO: 38722 - DNA, 71 bp, chicken (Gallus Gallus)
  misc_feature (36): n=a or g
gaaactgaacatttacaatgccacatacagagaacncatatatgacagtccagcagtaaaatccaggaggc

SEQ ID NO: 38723 - DNA, 71 bp, chicken (Gallus Gallus)
  misc_feature (36): n=c or t
cttgagagctagctctggattggatattctttctanaaaaataaaactctctactggtgatgcatgaaaca

SEQ ID NO: 38724 - DNA, 71 bp, chicken (Gallus Gallus)
  misc_feature (36): n=a or g
gttaaataagtatttgctctgttgtagtggtgaggntattaaaacactaggcctttgtctgtacctgctct

SEQ ID NO: 38725 - DNA, 71 bp, chicken (Gallus Gallus)
  misc_feature (36): n=a or g
acttctcacacttctcttccatccagacatgagaantttatcagctcacctatctacacaagtattgttaa

SEQ ID NO: 38726 - DNA, 71 bp, chicken (Gallus Gallus)
  misc_feature (36): n=a or g
ccgcggatgggaacgcagctcgtggctcagtaatcntcagtgagttgaagtgagatcttaattcctccccc

SEQ ID NO: 38727 - DNA, 71 bp, chicken (Gallus Gallus)
  misc_feature (36): n=a or g
ttcctcttatgtgtctgtttaatggctctttaaacnagcaatttcccacttactctttctctaagaactga

SEQ ID NO: 38728 - DNA, 71 bp, chicken (Gallus Gallus)
  misc_feature (36): n=a or c
aggatttgtaagtggatgtgtccagctctattccanactgcttaaagttagtgcctctactggaggcaacc

SEQ ID NO: 38729 - DNA, 71 bp, chicken (Gallus Gallus)
  misc_feature (36): n=c or t
ctcagtaattgaactcagcctttcttgttacttgtncctcttagaagactaagaattagaacactaattct

SEQ ID NO: 38730 - DNA, 71 bp, chicken (Gallus Gallus)
  misc_feature (36): n=a or g
actgctcttattctctcatctctcttcattgtctanagaaagtttggagggatacaggttatgcagggttt

SEQ ID NO: 38731 - DNA, 71 bp, chicken (Gallus Gallus)
  misc_feature (36): n=c or t
gaatggacggtagatatttgaaggctgctatttcangttcatcccacctagatattttaaacatcgactaa

SEQ ID NO: 38732 - DNA, 71 bp, chicken (Gallus Gallus)
  misc_feature (36): n=c or t
cagacattccagccttattgatttctgcaaggttcngaaatagtaaagacctcaggaaacaacttccatcc

SEQ ID NO: 38733 - DNA, 71 bp, chicken (Gallus Gallus)
  misc_feature (36): n=c or t
catgaaaattagcattggttttcatatctttgcatnagacccgaggaagaatgattatgacacagccattg

SEQ ID NO: 38734 - DNA, 71 bp, chicken (Gallus Gallus)
  misc_feature (36): n=c or t
attatagggcgcccgaacgcctgttcattactgtgnctctgttaatctagccctaaatttcttccttgata

SEQ ID NO: 38735 - DNA, 71 bp, chicken (Gallus Gallus)
  misc_feature (36): n=a or g
ggtattcgtttaatttatttcagactatttgtttancaatatgatcataaaagacaagctcttaataactg

SEQ ID NO: 38736 - DNA, 71 bp, chicken (Gallus Gallus)
  misc_feature (36): n=c or t
aaaaaataacataaccaggcagtaggcagcagtcanactatgcagtgagtaaccagtaagcttgcaccatt

SEQ ID NO: 38737 - DNA, 71 bp, chicken (Gallus Gallus)
  misc_feature (36): n=c or t
aggtctgctttggagcagcagagtgctgactactgnacagcacacttacaggcacattatcatttgttatt

SEQ ID NO: 38738 - DNA, 71 bp, chicken (Gallus Gallus)
  misc_feature (36): n=a or c
ctacaaacaggcttctgccagacatgattcagtgcngataccagattttggtactcttttactgctaggag

SEQ ID NO: 38739 - DNA, 71 bp, chicken (Gallus Gallus)
  misc_feature (36): n=c or t
gatgatattgagagtttgatatgaaagtaggttagnaatgtgttctaattgggtaaagttcagtgatgggt

SEQ ID NO: 38740 - DNA, 71 bp, chicken (Gallus Gallus)
  misc_feature (36): n=g or t
actgttctcattataaactgacacattatcattttngggatacaggtctatgaattgattcagccgaatga

SEQ ID NO: 38741 - DNA, 71 bp, chicken (Gallus Gallus)
  misc_feature (36): n=c or t
tttgtaacaagctaaagtctagcaggtgggaagttntgagaacttcatgtgttgggcaagagatggtagag

SEQ ID NO: 38742 - DNA, 71 bp, chicken (Gallus Gallus)
  misc_feature (36): n=a or g
atactcaagttcccatgaatgaactacaagggaaanccccctgaggcctacccctttctgctgtatgtgac

SEQ ID NO: 38743 - DNA, 71 bp, chicken (Gallus Gallus)
  misc_feature (36): n=a or g
gattcacctggagtcttctgggatcatagctttaantgtgggtttatattctaaacaaatttaatatcaca

SEQ ID NO: 38744 - DNA, 71 bp, chicken (Gallus Gallus)
  misc_feature (36): n=a or g
tgcagattccaatgtacttcattttgaaggtaaacntcaaagtaaggattcactgtgtctattatttaaaa

SEQ ID NO: 38745 - DNA, 71 bp, chicken (Gallus Gallus)
  misc_feature (36): n=g or t
ataggtgacattaaagtgaatgtgcattaattgggnatataacagcattgaccaaacaattatcttgtgga

SEQ ID NO: 38746 - DNA, 71 bp, chicken (Gallus Gallus)
  misc_feature (36): n=c or t
actattaattcccttaaaatgaaggcaataaaatanggattgcaaacagattctgcatctgcaaatagata

SEQ ID NO: 38747 - DNA, 71 bp, chicken (Gallus Gallus)
  misc_feature (36): n=c or t
tgcaaataaagagtctccttccatgttggggttctncaatccccaaacactgtatttccatttctatcatt

SEQ ID NO: 38748 - DNA, 71 bp, chicken (Gallus Gallus)
  misc_feature (36): n=c or t
cctgtccgaagaataatttaagataccctcttctcnttcagtattccttgttttctctacgacattcagaa

SEQ ID NO: 38749 - DNA, 71 bp, chicken (Gallus Gallus)
  misc_feature (36): n=a or c
tagttcagtagtggaagtggtcaatcctctttgacnttggctgtgtcaactactgaaataaatgtacatta

SEQ ID NO: 38750 - DNA, 71 bp, chicken (Gallus Gallus)
  misc_feature (36): n=a or g
gacaatagtgtgaactgaattttgatgaacactgcncagttcccatccaatcagcctttctttttgatttg

SEQ ID NO: 38751 - DNA, 71 bp, chicken (Gallus Gallus)
  misc_feature (36): n=a or c
agagctgaagtggtggctacgccgtactgactctcngtacatagtggtttcagttaaggccaatacacatt

SEQ ID NO: 38752 - DNA, 71 bp, chicken (Gallus Gallus)
  misc_feature (36): n=c or t
cttggttgagagaatctttcaaaagctgagaactanggcgataagcagggttgcctgaaattcccaatcag

SEQ ID NO: 38753 - DNA, 71 bp, chicken (Gallus Gallus)
  misc_feature (36): n=c or t
gaattatttaaaatttttacagatagttacagtgangggaaggggaaaaacttacatcaaaattaaataag

SEQ ID NO: 38754 - DNA, 71 bp, chicken (Gallus Gallus)
  misc_feature (36): n=c or t
gagtttttgtacaaagtgtagatgatcaagatggtntagaaaaatgattcagaatgttaagaagcttttgt

SEQ ID NO: 38755 - DNA, 71 bp, chicken (Gallus Gallus)
  misc_feature (36): n=a or g
cttaaatatctgtgttttcaagagtatccaggattnttgacttaattgcgaaactcactactgaaaatgac

SEQ ID NO: 38756 - DNA, 71 bp, chicken (Gallus Gallus)
  misc_feature (36): n=a or g
gtgtacgtgtagatgaacaatgcataattcaattcngaattttaaagctgaagagtattggaaagacccta

SEQ ID NO: 38757 - DNA, 71 bp, chicken (Gallus Gallus)
  misc_feature (36): n=c or t
atccatgtagtatcactgatttttgaattaacaaangatgatgctggcagagccatcataagaacagatgc

SEQ ID NO: 38758 - DNA, 71 bp, chicken (Gallus Gallus)
  misc_feature (36): n=g or t
gtcctaagtgaaagagtagaaagcccatggcagtgnggatgaacctagaagcaggtctgtaatgttctgac

SEQ ID NO: 38759 - DNA, 71 bp, chicken (Gallus Gallus)
  misc_feature (36): n=a or g
gtgttcttttctaggccatacctaaagtcagagtcncttttaaaggtgaatagaggagcctgtttgtgaag

SEQ ID NO: 38760 - DNA, 71 bp, chicken (Gallus Gallus)
  misc_feature (36): n=a or g
gcacacagatcagagatgagacaaggatcttgaagngtacccaaagtagcatagaataagaggttgaacac

SEQ ID NO: 38761 - DNA, 71 bp, chicken (Gallus Gallus)
  misc_feature (36): n=a or g
gattcctggaaacagagggagactaaaaaccagatnaggagaaggggaagtcagtagtgtctttactgaaa

SEQ ID NO: 38762 - DNA, 71 bp, chicken (Gallus Gallus)
  misc_feature (36): n=a or g
cattctggttatacaaatacaacagctttcaactcnacagttacctcatgaagaatgagccttgtgcacaa

SEQ ID NO: 38763 - DNA, 71 bp, chicken (Gallus Gallus)
  misc_feature (36): n=c or t
ttctatcctctgagtgtaaaagtcatgtagctgatnagctcagaaatatgtgtctacattgtgtagacatc

SEQ ID NO: 38764 - DNA, 71 bp, chicken (Gallus Gallus)
  misc_feature (36): n=a or g
cacagggatgtgtcctggaatgaggctcaactttgncacagaactcagtgcaagaggatacaatcctgcca

SEQ ID NO: 38765 - DNA, 71 bp, chicken (Gallus Gallus)
  misc_feature (36): n=c or t
atttgctcatgtgtatctgtgtgtgatatatagccnaagagagtcccatgtcttgttttaaaacattaatg

SEQ ID NO: 38766 - DNA, 71 bp, chicken (Gallus Gallus)
  misc_feature (36): n=c or t
gtagaggaagagtttttcttagagggaaaagcatanaccagctatttcagaactactgtgacttctattct

SEQ ID NO: 38767 - DNA, 71 bp, chicken (Gallus Gallus)
  misc_feature (36): n=c or t
tggtctgggatatttttgcttgatttagatccatgnttggttatgttttacacgttgttggcactgtgatg

SEQ ID NO: 38768 - DNA, 71 bp, chicken (Gallus Gallus)
  misc_feature (36): n=c or t
ggtgtccattcagagacagtggtagaatttctcagntctgacagcatggtgtggggttagcaataatacca

SEQ ID NO: 38769 - DNA, 71 bp, chicken (Gallus Gallus)
  misc_feature (36): n=g or t
ttaagggtacagattttaattacctatttgtttcantctctttgttttgcaagaatgatataagtcttgaa

SEQ ID NO: 38770 - DNA, 71 bp, chicken (Gallus Gallus)
  misc_feature (36): n=c or t
agttcataacaccatatttttataatcattcatcanagctgagttaatttggcacagctctgtgtcagtat

SEQ ID NO: 38771 - DNA, 71 bp, chicken (Gallus Gallus)
  misc_feature (36): n=a or g
gaacagttgtgggatttttcttcaatgctgtatagntggtagacatgaaagaaaatcgtctctttgcctga

SEQ ID NO: 38772 - DNA, 71 bp, chicken (Gallus Gallus)
  misc_feature (36): n=g or t
ttttgatggcaatgacaggcagtggaagcctgaggnttttttggatattgtgcttgtgcatgggtcttaga

SEQ ID NO: 38773 - DNA, 71 bp, chicken (Gallus Gallus)
  misc_feature (36): n=c or t
gaattttggaatgaggatatgtaaatgtggattcanatagctagatatgtttttctacacacacagttgtg

SEQ ID NO: 38774 - DNA, 71 bp, chicken (Gallus Gallus)
  misc_feature (36): n=a or g
aaggtgaaactgagaaaggactgagacttaaaacantggacagctttgttcaatatactttattcatttaa

SEQ ID NO: 38775 - DNA, 71 bp, chicken (Gallus Gallus)
  misc_feature (36): n=a or g
ctacctagcaatagtggtggctttgaaataggattncatatcattagttatgacacagaggttaacttttt

SEQ ID NO: 38776 - DNA, 71 bp, chicken (Gallus Gallus)
  misc_feature (36): n=a or g
ttcttcagctgtacttagatgtgaaagtagtcagangagtgggtagtgttcatatttcactgaaaaattct

SEQ ID NO: 38777 - DNA, 71 bp, chicken (Gallus Gallus)
  misc_feature (36): n=c or t
atgggaaaaacacaataagccttagaaatcaaactnctaaacttgtgttgaggtaagtgaagtgacttatt

SEQ ID NO: 38778 - DNA, 71 bp, chicken (Gallus Gallus)
  misc_feature (36): n=a or g
attaactcccaagattagaatattatccagagtttnaactggccctatttaaaactgaatcttaaactact

SEQ ID NO: 38779 - DNA, 71 bp, chicken (Gallus Gallus)
  misc_feature (36): n=c or t
tctgggaaaactgttgcctaagttgatgataccccngtagccatatagagggcatggaaaaaactttatgt

SEQ ID NO: 38780 - DNA, 71 bp, chicken (Gallus Gallus)
  misc_feature (36): n=c or t
ggcaaacatcctgctctccttatgaccaggggggangggttcctgggtgggttcccctcctttctagcagg

SEQ ID NO: 38781 - DNA, 71 bp, chicken (Gallus Gallus)
  misc_feature (36): n=c or t
ttctgcacagcaaaagcaaacgggatcccactgaangccttcctgccacctctaactgaaacgctctgcat

SEQ ID NO: 38782 - DNA, 71 bp, chicken (Gallus Gallus)
  misc_feature (36): n=g or t
cgcatttgcctttctcttgattttctctgtgctcgnccggattcatttcttacccatatttccctttttaa

SEQ ID NO: 38783 - DNA, 71 bp, chicken (Gallus Gallus)
  misc_feature (36): n=c or t
gatctcatctggtcaccttcagcaaaatttgaatgngaactataatacatactgtttaccaaaaatgcaag

SEQ ID NO: 38784 - DNA, 71 bp, chicken (Gallus Gallus)
  misc_feature (36): n=c or t
taattaatcaatgcagataccacttgatgaattaanggcaaagggaacacaatcctcctaactttgtttcc

SEQ ID NO: 38785 - DNA, 71 bp, chicken (Gallus Gallus)
  misc_feature (36): n=a or g
aataaacttaatttctattgaggatactgaagttantgctagatcactagagaagaaaatacaaactcctg

SEQ ID NO: 38786 - DNA, 71 bp, chicken (Gallus Gallus)
  misc_feature (36): n=a or c
tttatctttccctactcttaaatgcagctttgttantgttacagatcaaagtttataagctctctttgcaa

SEQ ID NO: 38787 - DNA, 71 bp, chicken (Gallus Gallus)
  misc_feature (36): n=c or t
aaattacatactgcacaatgcccgggggggaataanatgagatttttctggctttggttagatatttgtca

SEQ ID NO: 38788 - DNA, 71 bp, chicken (Gallus Gallus)
  misc_feature (36): n=a or g
gagaagaagaattaaaatccaaggggatttcaagcnagaagaaaattccaagtaagaaggaaaaattgaaa

SEQ ID NO: 38789 - DNA, 71 bp, chicken (Gallus Gallus)
  misc_feature (36): n=c or t
agctcttaaggtgagctcagccttggccaaagaccnccacattgtaagcaatctcaagggacatggccttg

SEQ ID NO: 38790 - DNA, 71 bp, chicken (Gallus Gallus)
  misc_feature (36): n=a or g
caagttgaatgcaaattatagcagtcgttcattccntcagagccttctcaatgcactggccctcagcctct

SEQ ID NO: 38791 - DNA, 71 bp, chicken (Gallus Gallus)
  misc_feature (36): n=a or g
aaaatggtggcagtggctttgcttctccagaaggtncctcaatcactagaaaattgcatcagaggaagaga

SEQ ID NO: 38792 - DNA, 71 bp, chicken (Gallus Gallus)
  misc_feature (36): n=c or t
agcagtggagcagtgatactaccagcagggtatttnatcctttgaataaggcagtcaaacctccaccctcc

SEQ ID NO: 38793 - DNA, 71 bp, chicken (Gallus Gallus)
  misc_feature (36): n=a or g
aggcatggatcaaagaaccataaaaattaatgaatnctcagttctaatatgatcaaccacactaagaagtg

SEQ ID NO: 38794 - DNA, 71 bp, chicken (Gallus Gallus)
  misc_feature (36): n=a or c
ttcagggatcaaacttctctctccagatagagagtnctcatgatgccattttaaccaaagatggatcttta

SEQ ID NO: 38795 - DNA, 71 bp, chicken (Gallus Gallus)
  misc_feature (36): n=a or g
tatgctggtcacaaatcgaatctcaaaggacccctngatggtgtagtcttgttggcaagggcttgcaatgt

SEQ ID NO: 38796 - DNA, 71 bp, chicken (Gallus Gallus)
  misc_feature (36): n=a or g
caggggcttcctgcccatcccagtgggagcttgcangtgagccagactgggagctgttgatttcctgtgag

SEQ ID NO: 38797 - DNA, 71 bp, chicken (Gallus Gallus)
  misc_feature (36): n=a or g
tagcacattatcctgttaatcacacacttcatctanctgaagatgaaaaaagaaataccttaacgcttctt

SEQ ID NO: 38798 - DNA, 71 bp, chicken (Gallus Gallus)
  misc_feature (36): n=c or t
agaagcagcattaggagtgccattaaaataagctgnacaaaaacttagacaagcattgaaccatcagatga

SEQ ID NO: 38799 - DNA, 71 bp, chicken (Gallus Gallus)
  misc_feature (36): n=a or g
gggaaaagctctcaaaattggaatgaagcactccanaagaagagtaagcccttcaacacaactggatcttg

SEQ ID NO: 38800 - DNA, 71 bp, chicken (Gallus Gallus)
  misc_feature (36): n=c or t
ctacagacctccattgcacacctactcattttgaangcaaacagaggctgccaggcctccttttagaaatg

SEQ ID NO: 38801 - DNA, 71 bp, chicken (Gallus Gallus)
  misc_feature (36): n=c or t
accacatgtattaatatcacagaatacagtaagatntcaagtcaaatgcagtaagtaagtttttacggtag

SEQ ID NO: 38802 - DNA, 71 bp, chicken (Gallus Gallus)
  misc_feature (36): n=c or t
tttactcaaaaaagactttagcaaaggtatgtgcanttagatttctgttcccctgtggcttctattaggca

SEQ ID NO: 38803 - DNA, 71 bp, chicken (Gallus Gallus)
  misc_feature (36): n=a or g
caacagaagcaagaaacaacaggaagatgtcttacnaataatgccacagctagctgatttgttaaagagaa

SEQ ID NO: 38804 - DNA, 71 bp, chicken (Gallus Gallus)
  misc_feature (36): n=a or g
gtctgccatcaaggtcccgtgttcctaaaggagagnatgaaggaggtatctgggctcaagtatctgaacca

SEQ ID NO: 38805 - DNA, 71 bp, chicken (Gallus Gallus)
  misc_feature (36): n=a or g
tattcttaatgtacagtagttatgcattaggctttnaagcttttcatcagccattgagaagtcaaggttac

SEQ ID NO: 38806 - DNA, 71 bp, chicken (Gallus Gallus)
  misc_feature (36): n=c or t
gaaacaccatggtgcaactctaactttagagacgcnattgatttcatgagcatgatgttcctctaaatctt

SEQ ID NO: 38807 - DNA, 71 bp, chicken (Gallus Gallus)
  misc_feature (36): n=a or g
aaaaaaaaccaacaggaacaatacagaagggggggnaaaaaaaaggcttctacttcagaggaatgctaaac

SEQ ID NO: 38808 - DNA, 71 bp, chicken (Gallus Gallus)
  misc_feature (36): n=a or g
agctccagcttatagtgcaccaaaactctcttcaanaacgtgtgcagctccgatagcgcttctaaaaacac

SEQ ID NO: 38809 - DNA, 71 bp, chicken (Gallus Gallus)
  misc_feature (36): n=a or g
taggcctgtctcatcctttcctataatgtgctgtanaagtgtgtagaagaataagtaattctttgaagaaa

SEQ ID NO: 38810 - DNA, 71 bp, chicken (Gallus Gallus)
  misc_feature (36): n=c or t
tttaatgcattttggtattgatcacaattagtcaancaactgaagagatttcaacaagctgactaggagat

SEQ ID NO: 38811 - DNA, 71 bp, chicken (Gallus Gallus)
  misc_feature (36): n=a or g
atggattattcctgtgtttcctatctgtgatgtgcnttcttggagacaatttatcagtgctgttaaagtaa

SEQ ID NO: 38812 - DNA, 71 bp, chicken (Gallus Gallus)
  misc_feature (36): n=a or g
taatgcttttaatttttctgctaagcacctagtacntggtaagaagtcccatttaaaattacttgcataaa

SEQ ID NO: 38813 - DNA, 71 bp, chicken (Gallus Gallus)
  misc_feature (36): n=c or t
ttacaatactttatgacttctcctagcacccagaanatttgatcagattatatccccatttaaacaatttt

SEQ ID NO: 38814 - DNA, 71 bp, chicken (Gallus Gallus)
  misc_feature (36): n=a or g
tcttttcttccggaaatgtttttcaaggtctacgtnacaatccttaggctcctaaaagttactcttatatc

SEQ ID NO: 38815 - DNA, 71 bp, chicken (Gallus Gallus)
  misc_feature (36): n=a or g
agaattttgtacaaattggaaaacctaggtcttcanatgcctcaggacacttaaatgaacacatacatggt

SEQ ID NO: 38816 - DNA, 71 bp, chicken (Gallus Gallus)
  misc_feature (36): n=a or g
cttgtttattaataagtttataatgactacagaggnattctcacctcctttagaaagttttaggtgctcca

SEQ ID NO: 38817 - DNA, 71 bp, chicken (Gallus Gallus)
  misc_feature (36): n=c or t
tgcttgagaaggactgacctatctctttcttctttncaagcgccttagtaaaataccggtgtcccagaaaa

SEQ ID NO: 38818 - DNA, 71 bp, chicken (Gallus Gallus)
  misc_feature (36): n=a or g
gaagagaactgtgtgaagttggactagatttaagtngatttggctatgcacttcccatggactacttcttc

SEQ ID NO: 38819 - DNA, 71 bp, chicken (Gallus Gallus)
  misc_feature (36): n=c or t
ctgcctttcctcttgccatcacagctgctgttctgnacaaatccctttcataaggctgtcatagtccatct

SEQ ID NO: 38820 - DNA, 71 bp, chicken (Gallus Gallus)
  misc_feature (36): n=c or t
ttcaccagcaactgacccattactgtaaacatccgngaaagtcccactggcgtgcatactacagaggaagg

SEQ ID NO: 38821 - DNA, 71 bp, chicken (Gallus Gallus)
  misc_feature (36): n=c or t
tttctctggttggcagaaaaatttgaaggttgcaangctgcaaattactttgaaactgtttgttttgccag

SEQ ID NO: 38822 - DNA, 71 bp, chicken (Gallus Gallus)
  misc_feature (36): n=c or t
tttggaaacaaatgcagttatgtagacaaatggcantgatcacagtcctctttctctacagcacagcagta

SEQ ID NO: 38823 - DNA, 71 bp, chicken (Gallus Gallus)
  misc_feature (36): n=c or t
aactttgcataaagtgaccctttatattcagaagcncaaatgtgtttgcaaattggagtgcataaaattca

SEQ ID NO: 38824 - DNA, 71 bp, chicken (Gallus Gallus)
  misc_feature (36): n=c or t
attcattccacagcacttaatttacacaagaaagtnagtgtggctaatttcatttcagaaccactgtacca

SEQ ID NO: 38825 - DNA, 71 bp, chicken (Gallus Gallus)
  misc_feature (36): n=g or t
aagcagtctcactgaaattaagaatgcatgctcagntgatgtgaaaagtaggatggctttgtaaatccgca

SEQ ID NO: 38826 - DNA, 71 bp, chicken (Gallus Gallus)
  misc_feature (36): n=a or g
cttcatagacacttcagtgcgtttcctcccttcacnttatcagaacacacactgaaggctacaagtagtgc

SEQ ID NO: 38827 - DNA, 71 bp, chicken (Gallus Gallus)
  misc_feature (36): n=a or c
ggagactatgtcatcacaatgatcagaacagatatnccttcgtctatccaatagccagctggttggggttt

SEQ ID NO: 38828 - DNA, 71 bp, chicken (Gallus Gallus)
  misc_feature (36): n=a or g
cgtgtcagatcacccagcaataaaccattcttttgntgattgttgatggttgtgtaagcccttcttttcca

SEQ ID NO: 38829 - DNA, 71 bp, chicken (Gallus Gallus)
  misc_feature (36): n=a or g
atcagtaccagtaaactggtttgttcatccaaaagnaaaagaaatattactacagtactaaagcaccgcca

SEQ ID NO: 38830 - DNA, 71 bp, chicken (Gallus Gallus)
  misc_feature (36): n=a or g
taacacatctttcaaggctgatctaaatttctgcangcgttagtagcctctaaactctatcggtttgagtc

SEQ ID NO: 38831 - DNA, 71 bp, chicken (Gallus Gallus)
  misc_feature (36): n=a or g
tcaaatacaggaaaggatttagtaaacctaagttanggagcagcatcagttggcacattttatacagtatc

SEQ ID NO: 38832 - DNA, 71 bp, chicken (Gallus Gallus)
  misc_feature (36): n=a or g
tttaagcagcaggaaaataaagctacaaatgccctntgacagcttcagtatgcttctgcccattctgtaca

SEQ ID NO: 38833 - DNA, 71 bp, chicken (Gallus Gallus)
  misc_feature (36): n=a or g
agcgtggggccagcgtcaccccacctaggagcagcncaaggcatcaggaggtgcttccagacctactgtgg

SEQ ID NO: 38834 - DNA, 71 bp, chicken (Gallus Gallus)
  misc_feature (36): n=c or t
agctacatacccatgacaagctcttttgaaaacacnggggcaatttaacatcctcggtaaattaatcatgg

SEQ ID NO: 38835 - DNA, 71 bp, chicken (Gallus Gallus)
  misc_feature (36): n=a or c
gatcacattatccaaatatacgtaattgttcatgtntaatttcaggtttatgtagagctaatgggaattaa

SEQ ID NO: 38836 - DNA, 71 bp, chicken (Gallus Gallus)
  misc_feature (36): n=c or t
tttctgatgaacaaggggattgtaatttcaactccnttaattgaagataaaagctcatggagatcttctta

SEQ ID NO: 38837 - DNA, 71 bp, chicken (Gallus Gallus)
  misc_feature (36): n=a or g
gaagatagctaacagaaggagagctagtgagagctncagactgcctacagtaattggtctggcccagtaag

SEQ ID NO: 38838 - DNA, 71 bp, chicken (Gallus Gallus)
  misc_feature (36): n=a or g
agatccaggaaaatattgcaggcactgttttagaancagctgtatttcttgatgtgaaatatcttttgctt

SEQ ID NO: 38839 - DNA, 71 bp, chicken (Gallus Gallus)
  misc_feature (36): n=a or g
aatgtttggaatagtccctggtctgagaacataacncaacaattaagtggtagagtcatgatggctgtaac

SEQ ID NO: 38840 - DNA, 71 bp, chicken (Gallus Gallus)
  misc_feature (36): n=a or g
ggaattacctgcacatcttattcttaaataagatcngtgttatttcttggtgaaacaaaggccctgtcctg

SEQ ID NO: 38841 - DNA, 71 bp, chicken (Gallus Gallus)
  misc_feature (36): n=c or t
tctatgattctatgtctgggtagaagaaagagagcngaattagggtttcaactggagcaatctcagccttc

SEQ ID NO: 38842 - DNA, 71 bp, chicken (Gallus Gallus)
  misc_feature (36): n=c or t
catctggagggtagcacacagttatactcgggtcanctattgttctgtggattataaatgaagtcctgtca

SEQ ID NO: 38843 - DNA, 71 bp, chicken (Gallus Gallus)
  misc_feature (36): n=c or t
aaaatcaaaagcaaaggaagagaagtaaatcataanattcattcaaaacataaaggcagtaaaagcacgaa

SEQ ID NO: 38844 - DNA, 71 bp, chicken (Gallus Gallus)
  misc_feature (36): n=c or t
gcataggctgtgctaagtgactgaattggagagaangcccagaaaaagtcatagttttgtcaagaaaatta

SEQ ID NO: 38845 - DNA, 71 bp, chicken (Gallus Gallus)
  misc_feature (36): n=a or g
agttaggtgctgtttcgtggtctgaagaaagtgagnagtatgggaaatatggccagatttgaggcatagta

SEQ ID NO: 38846 - DNA, 71 bp, chicken (Gallus Gallus)
  misc_feature (36): n=c or t
tagttacaacaggaacagcaatgctagtgataatcnttcttccagcattttcatacgagccccaggaattc

SEQ ID NO: 38847 - DNA, 71 bp, chicken (Gallus Gallus)
  misc_feature (36): n=c or t
ctgctggaacaaaattttgtactacagtgtgccttnctaagtgatgtcctggtccaaggactgactatttc

SEQ ID NO: 38848 - DNA, 71 bp, chicken (Gallus Gallus)
  misc_feature (36): n=a or c
gcagccagtgtatggaaggaaatgaacagatgaaanccctcagatggcaacaccttgtcagaccaaagatc

SEQ ID NO: 38849 - DNA, 71 bp, chicken (Gallus Gallus)
  misc_feature (36): n=c or t
tcaagcaggaggacacagagaggaaataagccccanagctctccccttgcgttccctctcaccagtcagcc

SEQ ID NO: 38850 - DNA, 71 bp, chicken (Gallus Gallus)
  misc_feature (36): n=a or g
gggaagagtacttaaacaaataccgcgatcccgggngaatcgctgtaattcagttcagagtgcggagatcc

SEQ ID NO: 38851 - DNA, 71 bp, chicken (Gallus Gallus)
  misc_feature (36): n=c or t
agagcaagccaaagaaaatctctgccatactcttgntgaataaactctactatttgtcttctcataaagtt

SEQ ID NO: 38852 - DNA, 71 bp, chicken (Gallus Gallus)
  misc_feature (36): n=c or t
gtagtgtggcaaataagttggacaataggaaaggcngtaagtaggcaacgtatctcagggtttttttgaaa

SEQ ID NO: 38853 - DNA, 71 bp, chicken (Gallus Gallus)
  misc_feature (36): n=c or t
cattcttggactgcttatttttctacattctcctgntctatttactgcaatgcacaaggcatagatactac

SEQ ID NO: 38854 - DNA, 71 bp, chicken (Gallus Gallus)
  misc_feature (36): n=a or g
ggtctcagctttgggtctcattggtgtcagcaggcnggatgctggtgtgggttcggctctactgtgggtct

SEQ ID NO: 38855 - DNA, 71 bp, chicken (Gallus Gallus)
  misc_feature (36): n=a or g
ggaaaagagcttaatttgcactccttatgttgaatntacattatctccagttttcatctaaacaaccactt

SEQ ID NO: 38856 - DNA, 71 bp, chicken (Gallus Gallus)
  misc_feature (36): n=c or t
tactacttctcagtagtgtatctaatgtgtgatctnttgtaaatcatatattttttttgtcttccttattc

SEQ ID NO: 38857 - DNA, 71 bp, chicken (Gallus Gallus)
  misc_feature (36): n=c or t
ctttataatatgctcacagtcaaaactgggaacagngttgttggaaatagaacagagtaaaattgtcatat

SEQ ID NO: 38858 - DNA, 71 bp, chicken (Gallus Gallus)
  misc_feature (36): n=a or g
gttatggtgctgtgaattgattaatattctgagacnaagctcatatggatttctattagacacaattttgg

SEQ ID NO: 38859 - DNA, 71 bp, chicken (Gallus Gallus)
  misc_feature (36): n=g or t
tacaaaatcatttgagctgtacaggaaggacagtgnaactgtgatcgatgattgactttctaccctgaact

SEQ ID NO: 38860 - DNA, 71 bp, chicken (Gallus Gallus)
  misc_feature (36): n=c or t
tgtatttctgtgttacaggggcttcgaacctgacangttccatgtttaatttgagatgaatgctgaacaga

SEQ ID NO: 38861 - DNA, 71 bp, chicken (Gallus Gallus)
  misc_feature (36): n=c or t
tccatccacttttctctatgtactaactgccctaanagagctggaaacaagaaggctgtttgtatttgtca

SEQ ID NO: 38862 - DNA, 71 bp, chicken (Gallus Gallus)
  misc_feature (36): n=a or g
gccacttagatcccatttcccactggcagacaacantacttagtacttcgtgttctgtccctccacatgca

SEQ ID NO: 38863 - DNA, 71 bp, chicken (Gallus Gallus)
  misc_feature (36): n=c or t
taatactgctgcaatttgatctcttggtcatgcagnttcccatattggtggtatacccaagtcccagtgct

SEQ ID NO: 38864 - DNA, 71 bp, chicken (Gallus Gallus)
  misc_feature (36): n=a or c
ttgcagcactattgatctttctgtcatctgcccccngaaatgatctggaattattttgtcattacactgct

SEQ ID NO: 38865 - DNA, 71 bp, chicken (Gallus Gallus)
  misc_feature (36): n=a or g
catctgggcagttatattctgctaatcatagcagcnggaacaatttagagatttaaggtcaggattcacca

SEQ ID NO: 38866 - DNA, 71 bp, chicken (Gallus Gallus)
  misc_feature (36): n=c or t
aagcccagttctgctaagaagttctacttgttcacnaccaggaaagagaagtctgcaaacttgccatcttc

SEQ ID NO: 38867 - DNA, 71 bp, chicken (Gallus Gallus)
  misc_feature (36): n=c or t
aactggtactccgcaacatctaggaaattgatcttnaaaccatttacttttgaaaactttgagagattgac

SEQ ID NO: 38868 - DNA, 71 bp, chicken (Gallus Gallus)
  misc_feature (36): n=c or t
ggcattccagttcttaaagtggaataaaatgttctntttatcataccaaactttacttgttcctagaggtt

SEQ ID NO: 38869 - DNA, 71 bp, chicken (Gallus Gallus)
  misc_feature (36): n=a or c
atgggggattttcggaatggcattacctgtttcatnaagcgtggtcttggggagaaacaagatcacggctc

SEQ ID NO: 38870 - DNA, 71 bp, chicken (Gallus Gallus)
  misc_feature (36): n=c or t
aagtatatcatgctaaataatatacattcttttttnatcatttcccatatttcctgtctagtttttatttc

SEQ ID NO: 38871 - DNA, 71 bp, chicken (Gallus Gallus)
  misc_feature (36): n=c or t
acgtactcctgacatttgtgccaatttagcatttgngtttaggctatatttccaacaaaccacatgctact

SEQ ID NO: 38872 - DNA, 71 bp, chicken (Gallus Gallus)
  misc_feature (36): n=a or g
acaaatccacaacaagaaatgcctgtatttgctctntactgctctgagggaggaaggtgggtggtgaattc

SEQ ID NO: 38873 - DNA, 71 bp, chicken (Gallus Gallus)
  misc_feature (36): n=c or t
tgccattttctgcctgctctttcagaggtagaacangagtatgtatttagatgagtgtggtagtaatgctt

SEQ ID NO: 38874 - DNA, 71 bp, chicken (Gallus Gallus)
  misc_feature (36): n=a or g
ccatctgcatctagcagatatctgtgggagagagtnaagatgagatgatctgggtgtagacaggttatagt

SEQ ID NO: 38875 - DNA, 71 bp, chicken (Gallus Gallus)
  misc_feature (36): n=g or t
gaatacttaatatagtacccatattccttctaaaancattcagaaagtgctccacctgtgttctgcattag

SEQ ID NO: 38876 - DNA, 71 bp, chicken (Gallus Gallus)
  misc_feature (36): n=c or t
agctgtagtaacattttcagccagccttaaattgtnagttaattggcatagattagaaatagtgtaacaca

SEQ ID NO: 38877 - DNA, 71 bp, chicken (Gallus Gallus)
  misc_feature (36): n=c or t
tgttagctatcctttaaaacaagcactcatggattngtacttcaacatgaaggctgagagttttcagtagt

SEQ ID NO: 38878 - DNA, 71 bp, chicken (Gallus Gallus)
  misc_feature (36): n=a or g
tgcctctggtttagtgtgtttatttgttacctcacntggcaattgcagcgagctgaagtttgttttgctcc

SEQ ID NO: 38879 - DNA, 71 bp, chicken (Gallus Gallus)
  misc_feature (36): n=c or t
aaaaaacaaaccccatactcatcagctcagagttantgtgaatttgggttaagaaggaatatcaagtagat

SEQ ID NO: 38880 - DNA, 71 bp, chicken (Gallus Gallus)
  misc_feature (36): n=c or t
tgctttaatttcaaattgtgcatatgtagcctaagntaaggagaggggagtacaaagaagctttgatggta

SEQ ID NO: 38881 - DNA, 71 bp, chicken (Gallus Gallus)
  misc_feature (36): n=a or g
tacgtagtacctagcatcaaaagcatgcatgtagcntggaaattcacctaagagagtaaaattgtcaaaga

SEQ ID NO: 38882 - DNA, 71 bp, chicken (Gallus Gallus)
  misc_feature (36): n=a or g
cttagggaactgcagcccgtacttatgtgaggaggntttgccagcataactctaccatcaaaaccctatct

SEQ ID NO: 38883 - DNA, 71 bp, chicken (Gallus Gallus)
  misc_feature (36): n=c or t
aacttcacttctggaaaataattatagaccttagcnttaatctgctttcttatggacatcactatttcaag

SEQ ID NO: 38884 - DNA, 71 bp, chicken (Gallus Gallus)
  misc_feature (36): n=a or g
ccctggcaaggagagaaaagcccttggttatagatntggataccattcagcattcatttttctgctaagaa

SEQ ID NO: 38885 - DNA, 71 bp, chicken (Gallus Gallus)
  misc_feature (36): n=c or t
gtagcccatctcccaaagagttcttatggtttagangtttctaagtctaaaaacattgcctagattaatgt

SEQ ID NO: 38886 - DNA, 71 bp, chicken (Gallus Gallus)
  misc_feature (36): n=c or t
agtggagaggactcatttgcttcagcataactatgngctctggtaatcgaagcaaaagatgcttcaaaaag

SEQ ID NO: 38887 - DNA, 71 bp, chicken (Gallus Gallus)
  misc_feature (36): n=c or t
acctcgtaacagaaggtattattaagatgaaagccngaaacttttacaacaggaaaatatgcgtatttata

SEQ ID NO: 38888 - DNA, 71 bp, chicken (Gallus Gallus)
  misc_feature (36): n=c or t
tcctctgtttttgcaatgctaattgactgctgtcancattacagaaagctctgcattctcaaagaaaaaaa

SEQ ID NO: 38889 - DNA, 71 bp, chicken (Gallus Gallus)
  misc_feature (36): n=c or t
ttatgagtgaaagacaacatcctcctcccaagtagntccagaggggattgctgaagattggcacctcagta

SEQ ID NO: 38890 - DNA, 71 bp, chicken (Gallus Gallus)
  misc_feature (36): n=a or g
tccagtgaataatttatagaggtagtagcatgaccntggccacaatacaatggcagcttcagatccggcct

SEQ ID NO: 38891 - DNA, 71 bp, chicken (Gallus Gallus)
  misc_feature (36): n=a or g
aatgcatttccaggttcctgcttaaggaagggagcngtttgcttttccgtatctccttactgctgtctggt

SEQ ID NO: 38892 - DNA, 71 bp, chicken (Gallus Gallus)
  misc_feature (36): n=a or g
gctggaagcttccacagagagaaattctgctgcaanaattcatgagtgagaaccagcatgagcagggcaga

SEQ ID NO: 38893 - DNA, 71 bp, chicken (Gallus Gallus)
  misc_feature (36): n=a or g
ctggcttagcttacttgttcctttgctcttgactcnacaggactctgaactatttctcacagacatttact

SEQ ID NO: 38894 - DNA, 71 bp, chicken (Gallus Gallus)
  misc_feature (36): n=a or g
tcttggacatatgtataatgctttcccctgaaactntgaaagcaagttcatagctagatctgatttttatc

SEQ ID NO: 38895 - DNA, 71 bp, chicken (Gallus Gallus)
  misc_feature (36): n=c or t
ttaaccttatgctttaggtagaaaaagtaacgtcangacctccttttattcacatgtattaggaccctcta

SEQ ID NO: 38896 - DNA, 71 bp, chicken (Gallus Gallus)
  misc_feature (36): n=c or t
acaacctatgggatctacaacttcccattcaaacangtgaggttacgggtttggtgtgagcagagcccagt

SEQ ID NO: 38897 - DNA, 71 bp, chicken (Gallus Gallus)
  misc_feature (36): n=c or t
agttcccatctgttatacagtttgtacaaactgtgnaacactggattaagtcttctcatgccgaagttgat

SEQ ID NO: 38898 - DNA, 71 bp, chicken (Gallus Gallus)
  misc_feature (36): n=a or g
gttcctctgcagaattcacttattgtcttctgactngtgcttcaatttcaggctctcgaggatggcggctt

SEQ ID NO: 38899 - DNA, 71 bp, chicken (Gallus Gallus)
  misc_feature (36): n=c or t
ttgaactacagaggcacagaggcttgtctgcctttnctttcttcctcagattctttaggcagacatttggg

SEQ ID NO: 38900 - DNA, 71 bp, chicken (Gallus Gallus)
  misc_feature (36): n=g or t
acttttttttttagcttctaccttttttagggcatnactttgaatgcaggttaaatctttgaaaatatgtc

SEQ ID NO: 38901 - DNA, 71 bp, chicken (Gallus Gallus)
  misc_feature (36): n=c or t
gtttacaatttgatatcaagggggatttatagcatncagttaggtattttgctgtataacagaggtacaat

SEQ ID NO: 38902 - DNA, 71 bp, chicken (Gallus Gallus)
  misc_feature (36): n=a or g
taaatagcccacatctaggaacataagcactcctanggaaaaatgtggagtgtacatgattaagggaaaat

SEQ ID NO: 38903 - DNA, 71 bp, chicken (Gallus Gallus)
  misc_feature (36): n=c or t
accaagatcagacaaaacataaattgtgctggccangttacatatggtcgatgcatctcagcaaattaatc

SEQ ID NO: 38904 - DNA, 71 bp, chicken (Gallus Gallus)
  misc_feature (36): n=a or g
tttcagctgctctggctccacactgttattccccancacatgcactctatgtttaaaatccaggacaaatt

SEQ ID NO: 38905 - DNA, 71 bp, chicken (Gallus Gallus)
  misc_feature (36): n=c or t
atgaacaatggagaggttcaagcacctgtgtccccncaacatcccctgttcaaacatcaggaattaaaaag

SEQ ID NO: 38906 - DNA, 71 bp, chicken (Gallus Gallus)
  misc_feature (36): n=c or t
aggctagaatctgaaagcatttgattattgtattcntattccactgaaatggaatttagttatcaacacta

SEQ ID NO: 38907 - DNA, 71 bp, chicken (Gallus Gallus)
  misc_feature (36): n=a or g
tccttaaaccaataaattaaaatcacaggactgccnttaaaagtaagtacaatatggtcacagattctcca

SEQ ID NO: 38908 - DNA, 71 bp, chicken (Gallus Gallus)
  misc_feature (36): n=c or t
acctagcaaagcccctgccaagccaaagggagctgntcgataatgttacgtcctatactcctaaaaacaca

SEQ ID NO: 38909 - DNA, 71 bp, chicken (Gallus Gallus)
  misc_feature (36): n=c or t
cttctccttttctggtacgttttggctcagtggagnctctctgcccaagctcagtctgcaaatgtccatgc

SEQ ID NO: 38910 - DNA, 71 bp, chicken (Gallus Gallus)
  misc_feature (36): n=a or c
caaggtagatagcagagatacctaggttgttatttnacttcctttaatgatattcaccaagaagtgtccca

SEQ ID NO: 38911 - DNA, 71 bp, chicken (Gallus Gallus)
  misc_feature (36): n=a or c
agggacaatgagtttcttctcggacaatctggaganatgcttctgtagaattcttctcaagcagactgtaa

SEQ ID NO: 38912 - DNA, 71 bp, chicken (Gallus Gallus)
  misc_feature (36): n=a or g
tattgcttattatttcttcggtaatgtaagctggtnatggaaataccaatacataaattcctgagtcttta

SEQ ID NO: 38913 - DNA, 71 bp, chicken (Gallus Gallus)
  misc_feature (36): n=a or c
actgtcagagctgcaagattaaaaaccttgatacanaactaggggccttattcaaagaggggaagagatct

SEQ ID NO: 38914 - DNA, 71 bp, chicken (Gallus Gallus)
  misc_feature (36): n=a or g
aaacagtgagatggacagcatcaatcagtgcttgcnctcagattacaaagctgcctgtgaagtttgttcct

SEQ ID NO: 38915 - DNA, 71 bp, chicken (Gallus Gallus)
  misc_feature (36): n=a or g
atatttgcacacagaaagatggcactttttctaacncttagggctaaggcatactattgtccctgcttgat

SEQ ID NO: 38916 - DNA, 71 bp, chicken (Gallus Gallus)
  misc_feature (36): n=a or g
aacatgactacaggattatttacgctgccatatgantgtccttgtggcataatgctttaaagatacagaca

SEQ ID NO: 38917 - DNA, 71 bp, chicken (Gallus Gallus)
  misc_feature (36): n=a or g
gtagggggatgatgtgggattaataacattaatttncaagtagaaagatgagtaaatctaatgatctcttt

SEQ ID NO: 38918 - DNA, 71 bp, chicken (Gallus Gallus)
  misc_feature (36): n=a or g
aaaactacagtcaattttactgcagttggagaagtnttgctgtggtttgagacaaactcagctaagaacta

SEQ ID NO: 38919 - DNA, 71 bp, chicken (Gallus Gallus)
  misc_feature (36): n=a or c
gatgcaccaccttctttgtctttctgttagcagtgnatcttgcacatttactgtatttaagtgcagcattt

SEQ ID NO: 38920 - DNA, 71 bp, chicken (Gallus Gallus)
  misc_feature (36): n=a or g
tgataaggagtgattattctgctgtaactcagtatnttcatatgcatctctcctctccctgtaaagggtaa

SEQ ID NO: 38921 - DNA, 71 bp, chicken (Gallus Gallus)
  misc_feature (36): n=c or t
ctaatgaacttgcgtggaaaacatagatccttaaantgaaaatttgtgtgtgctgtaactagcctacagtg

SEQ ID NO: 38922 - DNA, 71 bp, chicken (Gallus Gallus)
  misc_feature (36): n=c or t
tctatcgtgtcataatagtcccctgcacccttcttncattattttaagcctcagcgtaggaaccctcatat

SEQ ID NO: 38923 - DNA, 71 bp, chicken (Gallus Gallus)
  misc_feature (36): n=a or g
catgttttactaaaaggtttaaacattatactgaancagaggtaattacactgcttatatgcagttctaat

SEQ ID NO: 38924 - DNA, 71 bp, chicken (Gallus Gallus)
  misc_feature (36): n=a or g
ctgacctccatacctctaaaactttcaccatatcanaaatttatttgtttgtttgtttctttcaaggataa

SEQ ID NO: 38925 - DNA, 71 bp, chicken (Gallus Gallus)
  misc_feature (36): n=c or t
cttccaggaagtcacttcatctcacatgcttttgcnttctaggactgagtttggaagaacaatgatgcttc

SEQ ID NO: 38926 - DNA, 71 bp, chicken (Gallus Gallus)
  misc_feature (36): n=a or g
caaggtagcatggacctagctggccttttcttaagnctgacaacagcaagcagtgtgacagtaaaccaatg

SEQ ID NO: 38927 - DNA, 71 bp, chicken (Gallus Gallus)
  misc_feature (36): n=c or t
agtttaggtaggttttggggggctgtatactataantaataactatataaattcttttagtggctttttcc

SEQ ID NO: 38928 - DNA, 71 bp, chicken (Gallus Gallus)
  misc_feature (36): n=a or g
ggttaatatagtcatttacaactataggtggtatgnccatatcaaatgcagcttctgcagttactttcctt

SEQ ID NO: 38929 - DNA, 71 bp, chicken (Gallus Gallus)
  misc_feature (36): n=a or g
tgcagtcattacagtgtggcctgttcacaaagagcntgaatagttcttcacacaagagttacttcagcagt

SEQ ID NO: 38930 - DNA, 71 bp, chicken (Gallus Gallus)
  misc_feature (36): n=g or t
caagaggtgtcactttgaacctgaaagatgttaggnctccctaaaaaaaacgtagccttcttaatcctatt

SEQ ID NO: 38931 - DNA, 71 bp, chicken (Gallus Gallus)
  misc_feature (36): n=a or g
tttaaaattaaatgcagaatgtacaaaagagaatgnggaaagataatttattacttcaatttcttgttgga

SEQ ID NO: 38932 - DNA, 71 bp, chicken (Gallus Gallus)
  misc_feature (36): n=a or g
cagccagactgtctcagctcttcttgaaaagggaantggaggcaaaactttctgataagctccagagaagg

SEQ ID NO: 38933 - DNA, 71 bp, chicken (Gallus Gallus)
  misc_feature (36): n=c or t
ggtaaaattctaggaactgaagaagacaatgtctcnagcagttaattcctttttacttgccatgagtttat

SEQ ID NO: 38934 - DNA, 71 bp, chicken (Gallus Gallus)
  misc_feature (36): n=a or c
aaaatccacataacaaatgaacatagtatttactcngatctcatagttttccacacacattatagtttgtg

SEQ ID NO: 38935 - DNA, 71 bp, chicken (Gallus Gallus)
  misc_feature (36): n=c or t
ctctgcagagctgccactacaacatcattatctctnaaaacctatctttgttatagtgcacacaaggacac

SEQ ID NO: 38936 - DNA, 71 bp, chicken (Gallus Gallus)
  misc_feature (36): n=c or t
ccctcttcatatctagagcgtgttgatcctttgcantgaagatgcacgtgtaataaagggatttagatatg

SEQ ID NO: 38937 - DNA, 71 bp, chicken (Gallus Gallus)
  misc_feature (36): n=c or t
cctatacactaaacttgccttgtcccaagcacttangagcaagaaaaataaggaagtccactgtaagaagt

SEQ ID NO: 38938 - DNA, 71 bp, chicken (Gallus Gallus)
  misc_feature (36): n=c or t
aaaaataagaaagaaagcagatgaacaacccacccncagagaagatgagtattgttccattattccataac

SEQ ID NO: 38939 - DNA, 71 bp, chicken (Gallus Gallus)
  misc_feature (36): n=g or t
agtacagttacttataccagaccactgtgcaaacanatagaagaacacatagtctgtaccaacttagagcg

SEQ ID NO: 38940 - DNA, 71 bp, chicken (Gallus Gallus)
  misc_feature (36): n=c or t
taacagcaagtgtactagtgttagttaaatatgtgntctagtgatcttgtcaaacctcagctgctcctggt

SEQ ID NO: 38941 - DNA, 71 bp, chicken (Gallus Gallus)
  misc_feature (36): n=c or t
gttcaatcctgtaacaatttccataagaagaatcancaaatactccaatttttcaacaattgtatgttgct

SEQ ID NO: 38942 - DNA, 71 bp, chicken (Gallus Gallus)
  misc_feature (36): n=a or g
cttggaatgcacatcggacatgtactctaccacatntactctatcactgacatgtactctatcacatgaaa

SEQ ID NO: 38943 - DNA, 71 bp, chicken (Gallus Gallus)
  misc_feature (36): n=g or t
ccacacgcccaatggtagatcaaattgcatctgctnttacctctgccttatttgtgcttgtgtagttatca

SEQ ID NO: 38944 - DNA, 71 bp, chicken (Gallus Gallus)
  misc_feature (36): n=c or t
gtactgttcacgtttcacaaacacttcagaaacctngatagagttttctcatgggcacacccttagttcat
